United States Patent 7,250,496 (BIOINFORMATICALLY DETECTABLE GROUP OF NOVEL REGULATORY GENES AND USES THEREOF) - sequence listing, part 17

SEQ ID NO: 697004 - RNA, 21 nt, Human
caacccagccuccagaaccag

SEQ ID NO: 697005 - RNA, 22 nt, Human
caacccagccuccagaaccaga

SEQ ID NO: 697006 - RNA, 25 nt, Human
caaccgccgaggacagucggaccgg

SEQ ID NO: 697007 - RNA, 19 nt, Human
ccagccuccagaaccagaa

SEQ ID NO: 697008 - RNA, 21 nt, Human
cgccgaggacagucggaccgg

SEQ ID NO: 697009 - RNA, 21 nt, Human
cucaacccagccuccagaacc

SEQ ID NO: 697010 - RNA, 21 nt, Human
gaaccagaaccaagagcagca

SEQ ID NO: 697011 - RNA, 25 nt, Human
ggggcggggagcaacugcagcuguc

SEQ ID NO: 697012 - RNA, 23 nt, Human
aaaaaaaaaaaaaaaaaaaagag

SEQ ID NO: 697013 - RNA, 21 nt, Human
aaaaaaaaaaaaaaaagagga

SEQ ID NO: 697014 - RNA, 26 nt, Human
aaaaaaaaaaagaggaaaaaaaaugu

SEQ ID NO: 697015 - RNA, 26 nt, Human
aaaaaaaaggaacucaugauaaaugc

SEQ ID NO: 697016 - RNA, 19 nt, Human
aaaacagcaacacaacuga

SEQ ID NO: 697017 - RNA, 24 nt, Human
aaagcaaaaaaaaaaauuuacaaa

SEQ ID NO: 697018 - RNA, 25 nt, Human
acaaaagaagcuuuaaaaagacagu

SEQ ID NO: 697019 - RNA, 22 nt, Human
acagccgcuccacuccacuccc

SEQ ID NO: 697020 - RNA, 20 nt, Human
accacagccgcuccacucca

SEQ ID NO: 697021 - RNA, 24 nt, Human
accguggggaagaggaaagagucg

SEQ ID NO: 697022 - RNA, 20 nt, Human
acuccacucccacucggcua

SEQ ID NO: 697023 - RNA, 19 nt, Human
acuuucaacuaccugacug

SEQ ID NO: 697024 - RNA, 23 nt, Human
agcaaaaaaaaaaauuuacaaag

SEQ ID NO: 697025 - RNA, 21 nt, Human
agcaacacaacugacaaaagu

SEQ ID NO: 697026 - RNA, 19 nt, Human
aggaacucaugauaaaugc

SEQ ID NO: 697027 - RNA, 27 nt, Human
agguaaaagcaaaaaaaaaaauuuacu

SEQ ID NO: 697028 - RNA, 22 nt, Human
auaagagacaagucucggcucg

SEQ ID NO: 697029 - RNA, 30 nt, Human
aucucagaauuaaaaaaaaaaaaaaaaaaa

SEQ ID NO: 697030 - RNA, 19 nt, Human
cagcaacacaacugacaaa

SEQ ID NO: 697031 - RNA, 19 nt, Human
ccagaacuaaauaagagac

SEQ ID NO: 697032 - RNA, 22 nt, Human
ccauuccaccccagacaaaccu

SEQ ID NO: 697033 - RNA, 26 nt, Human
ccgcuccacuccacucccacucggcc

SEQ ID NO: 697034 - RNA, 21 nt, Human
cgacgaggcgcuccccagaac

SEQ ID NO: 697035 - RNA, 24 nt, Human
cgacgaggcgcuccccagaacuaa

SEQ ID NO: 697036 - RNA, 23 nt, Human
cucagaauuaaaaaaaaaaaaaa

SEQ ID NO: 697037 - RNA, 24 nt, Human
cucagaauuaaaaaaaaaaaaaaa

SEQ ID NO: 697038 - RNA, 21 nt, Human
cuguuccauuccaccccagac

SEQ ID NO: 697039 - RNA, 18 nt, Human
gaagaauccacagcuugg

SEQ ID NO: 697040 - RNA, 18 nt, Human
gcauguuuuacaggaguu

SEQ ID NO: 697041 - RNA, 22 nt, Human
ggaaaucucagaauuaaaaaaa

SEQ ID NO: 697042 - RNA, 18 nt, Human
ggccuaauuaacccgcug

SEQ ID NO: 697043 - RNA, 22 nt, Human
guuaaaaaaaaaaaaaggaacu

SEQ ID NO: 697044 - RNA, 20 nt, Human
uaaaaaaaaacuuucaacua

SEQ ID NO: 697045 - RNA, 19 nt, Human
uaaauaagagacaagucuc

SEQ ID NO: 697046 - RNA, 18 nt, Human
uaacauaacauugggguu

SEQ ID NO: 697047 - RNA, 22 nt, Human
uauaauaaaauggguggaaaac

SEQ ID NO: 697048 - RNA, 23 nt, Human
ucagaauuaaaaaaaaaaaaaaa

SEQ ID NO: 697049 - RNA, 24 nt, Human
uccccagaacuaaauaagagacaa

SEQ ID NO: 697050 - RNA, 21 nt, Human
ucucagaauuaaaaaaaaaaa

SEQ ID NO: 697051 - RNA, 22 nt, Human
uggaaaacagcaacacaacuga

SEQ ID NO: 697052 - RNA, 21 nt, Human
uguagaugcuaaauaaaccaa

SEQ ID NO: 697053 - RNA, 21 nt, Human
uguuccauuccaccccagaca

SEQ ID NO: 697054 - RNA, 20 nt, Human
uuaaaaaaaaaaaaaaaaaa

SEQ ID NO: 697055 - RNA, 24 nt, Human
uuaaaaaaaaaaaaaggaacucau

SEQ ID NO: 697056 - RNA, 22 nt, Human
uuaaggaguaggaagaauccac

SEQ ID NO: 697057 - RNA, 20 nt, Human
uugauuagcuagaaguuuau

SEQ ID NO: 697058 - RNA, 23 nt, Human
uuggggaaaucucagaauuaaaa

SEQ ID NO: 697059 - RNA, 22 nt, Human
auacauccuaagcuccugauuc

SEQ ID NO: 697060 - RNA, 23 nt, Human
ugcuauaaauucuccuuuuaagg

SEQ ID NO: 697061 - RNA, 24 nt, Human
uguauuacagugcuauaaauucuc

SEQ ID NO: 697062 - RNA, 18 nt, Human
ugugccaauccaguccuu

SEQ ID NO: 697063 - RNA, 22 nt, Human
uuuuaagcuguauuacagugcu

SEQ ID NO: 697064 - RNA, 20 nt, Human
aaaagggggcaggugcagaa

SEQ ID NO: 697065 - RNA, 20 nt, Human
aagaguuacugaacaggaag

SEQ ID NO: 697066 - RNA, 18 nt, Human
aaggcagaguagugggga

SEQ ID NO: 697067 - RNA, 23 nt, Human
acaaaaaucucuagauggagaag

SEQ ID NO: 697068 - RNA, 18 nt, Human
acucauuugccuuccuua

SEQ ID NO: 697069 - RNA, 24 nt, Human
acucugucacccaggcuggacucc

SEQ ID NO: 697070 - RNA, 25 nt, Human
acucugucacccaggcuggacucca

SEQ ID NO: 697071 - RNA, 18 nt, Human
agaguaguggggaaaguu

SEQ ID NO: 697072 - RNA, 18 nt, Human
agauggcagcaaaaagaa

SEQ ID NO: 697073 - RNA, 22 nt, Human
aggaagauggcagcaaaaagaa

SEQ ID NO: 697074 - RNA, 22 nt, Human
aggaccagcgcugagaguucac

SEQ ID NO: 697075 - RNA, 24 nt, Human
aggcaaaaguaagaguuacugaac

SEQ ID NO: 697076 - RNA, 20 nt, Human
agguggccgggacccaggag

SEQ ID NO: 697077 - RNA, 20 nt, Human
aucucaaaaaaaaaaaaaag

SEQ ID NO: 697078 - RNA, 23 nt, Human
caaacccaccaggaccagcgcug

SEQ ID NO: 697079 - RNA, 19 nt, Human
caaggagaaaaaggacagc

SEQ ID NO: 697080 - RNA, 22 nt, Human
cacacacacaaaaaucucuaga

SEQ ID NO: 697081 - RNA, 19 nt, Human
cacucugucacccaggcug

SEQ ID NO: 697082 - RNA, 31 nt, Human
cacucugucacccaggcuggacuccaucucu

SEQ ID NO: 697083 - RNA, 18 nt, Human
caggaaggcagaguagug

SEQ ID NO: 697084 - RNA, 23 nt, Human
ccaaaauaaacucuggaauuuau

SEQ ID NO: 697085 - RNA, 19 nt, Human
ccaccaggaccagcgcuga

SEQ ID NO: 697086 - RNA, 23 nt, Human
cccaccaggaccagcgcugagag

SEQ ID NO: 697087 - RNA, 21 nt, Human
ccccaaagauuuaaaaaaggg

SEQ ID NO: 697088 - RNA, 24 nt, Human
ccuauguuccacacuuuaugauga

SEQ ID NO: 697089 - RNA, 22 nt, Human
cucaaaaaaaaaaaaaaggaau

SEQ ID NO: 697090 - RNA, 19 nt, Human
cuccaucucaaaaaaaaaa

SEQ ID NO: 697091 - RNA, 22 nt, Human
cucuagauggagaaguagaaga

SEQ ID NO: 697092 - RNA, 20 nt, Human
cugggccucagggcuaagcu

SEQ ID NO: 697093 - RNA, 26 nt, Human
cuuccuuguaaaaugacaaaguuaug

SEQ ID NO: 697094 - RNA, 23 nt, Human
gagcuucaacauuuauuuaaaua

SEQ ID NO: 697095 - RNA, 23 nt, Human
gaggaagauggcagcaaaaagaa

SEQ ID NO: 697096 - RNA, 26 nt, Human
gaugaggaagauggcagcaaaaagaa

SEQ ID NO: 697097 - RNA, 24 nt, Human
gcuucuuuaaacuugagcuucaac

SEQ ID NO: 697098 - RNA, 21 nt, Human
ggcaacagaggagaaccaaaa

SEQ ID NO: 697099 - RNA, 21 nt, Human
gucauggucagcaaacccacc

SEQ ID NO: 697100 - RNA, 21 nt, Human
uaaccaagcauguaaagaaaa

SEQ ID NO: 697101 - RNA, 19 nt, Human
uaggaagggcaacagagga

SEQ ID NO: 697102 - RNA, 24 nt, Human
uagggucucacucugucacccagg

SEQ ID NO: 697103 - RNA, 22 nt, Human
uccaucucaaaaaaaaaaaaaa

SEQ ID NO: 697104 - RNA, 23 nt, Human
uccaucucaaaaaaaaaaaaaag

SEQ ID NO: 697105 - RNA, 19 nt, Human
uccccaaagauuuaaaaaa

SEQ ID NO: 697106 - RNA, 19 nt, Human
uccgcaguuuuauuuccuc

SEQ ID NO: 697107 - RNA, 19 nt, Human
uccgcaguuuuauuuccuc

SEQ ID NO: 697108 - RNA, 27 nt, Human
uccuuaaaugacaauuacacucaacuu

SEQ ID NO: 697109 - RNA, 23 nt, Human
ucucacucugucacccaggcugg

SEQ ID NO: 697110 - RNA, 24 nt, Human
ucucacucugucacccaggcugga

SEQ ID NO: 697111 - RNA, 26 nt, Human
ucucacucugucacccaggcuggacu

SEQ ID NO: 697112 - RNA, 27 nt, Human
ucucacucugucacccaggcuggacuc

SEQ ID NO: 697113 - RNA, 18 nt, Human
ucucugggccucagggcc

SEQ ID NO: 697114 - RNA, 18 nt, Human
ucugucacccaggcugga

SEQ ID NO: 697115 - RNA, 21 nt, Human
ucugucacccaggcuggacuc

SEQ ID NO: 697116 - RNA, 22 nt, Human
ugaaauagggucucacucuguc

SEQ ID NO: 697117 - RNA, 24 nt, Human
ugauggcacacacacaaaaaucuc

SEQ ID NO: 697118 - RNA, 23 nt, Human
uggacagguggccgggacccagg

SEQ ID NO: 697119 - RNA, 22 nt, Human
ugucaucuucagcucauuuuuu

SEQ ID NO: 697120 - RNA, 21 nt, Human
uguggaauauggacagguggc

SEQ ID NO: 697121 - RNA, 25 nt, Human
uguuacuucaggcaaaaguaagagu

SEQ ID NO: 697122 - RNA, 23 nt, Human
uucuauccaagaaucucaaagca

SEQ ID NO: 697123 - RNA, 23 nt, Human
uuuaagcucuucuuccaauuuuu

SEQ ID NO: 697124 - RNA, 24 nt, Human
uuuauuuuuuugaaauagggucuc

SEQ ID NO: 697125 - RNA, 26 nt, Human
uuuuauuuuuuugaaauagggucuca

SEQ ID NO: 697126 - RNA, 20 nt, Human
uuuuuaggaagggcaacaga

SEQ ID NO: 697127 - RNA, 25 nt, Human
uuuuuuguuggaaaggagauguuua

SEQ ID NO: 697128 - RNA, 20 nt, Human
uuuuuuuuuuuuuuguugga

SEQ ID NO: 697129 - RNA, 18 nt, Human
uuuuuuuuuuuuuuuuug

SEQ ID NO: 697130 - RNA, 20 nt, Human
uuuuuuuuuuuuuuuuuguu

SEQ ID NO: 697131 - RNA, 22 nt, Human
uuuuuuuuuuuuuuuuuguugg

SEQ ID NO: 697132 - RNA, 25 nt, Human
acaaguuccuuuuauuaccuggaaa

SEQ ID NO: 697133 - RNA, 19 nt, Human
acccaggucuguccgugcc

SEQ ID NO: 697134 - RNA, 23 nt, Human
accucuguccucucacccagucc

SEQ ID NO: 697135 - RNA, 25 nt, Human
aggaacacaacucucuccucuccgu

SEQ ID NO: 697136 - RNA, 23 nt, Human
aggcaaggucuggcccuuggggg

SEQ ID NO: 697137 - RNA, 19 nt, Human
caaggucuggcccuugggg

SEQ ID NO: 697138 - RNA, 26 nt, Human
cacugcacagcgcaacuuggcagguu

SEQ ID NO: 697139 - RNA, 24 nt, Human
cacugcguuguaguccagcuacgc

SEQ ID NO: 697140 - RNA, 25 nt, Human
cacugcguuguaguccagcuacgcc

SEQ ID NO: 697141 - RNA, 23 nt, Human
caggaacacaacucucuccucuc

SEQ ID NO: 697142 - RNA, 19 nt, Human
caggcgggcagcauugccc

SEQ ID NO: 697143 - RNA, 27 nt, Human
cccagaggcaaggucuggcccuugggg

SEQ ID NO: 697144 - RNA, 20 nt, Human
ccgugcccucaucuuccucc

SEQ ID NO: 697145 - RNA, 19 nt, Human
ccucaggaacacaacucuc

SEQ ID NO: 697146 - RNA, 23 nt, Human
ccucuguccucucacccagucca

SEQ ID NO: 697147 - RNA, 20 nt, Human
ccuggcacaggucccgugcu

SEQ ID NO: 697148 - RNA, 21 nt, Human
cgaccccucaggaacacaacu

SEQ ID NO: 697149 - RNA, 22 nt, Human
cgagaugcacugcguuguaguc

SEQ ID NO: 697150 - RNA, 27 nt, Human
cgcccaucgagccaccucuguccucuc

SEQ ID NO: 697151 - RNA, 18 nt, Human
cucuccucuccguccaag

SEQ ID NO: 697152 - RNA, 20 nt, Human
cugcacagcgcaacuuggca

SEQ ID NO: 697153 - RNA, 21 nt, Human
cugcacagcgcaacuuggcag

SEQ ID NO: 697154 - RNA, 19 nt, Human
cuggagcagacggaacagg

SEQ ID NO: 697155 - RNA, 18 nt, Human
cuggcccaguccuggggc

SEQ ID NO: 697156 - RNA, 20 nt, Human
cuuccuccucugccaugacc

SEQ ID NO: 697157 - RNA, 22 nt, Human
gagaugcacugcguuguagucc

SEQ ID NO: 697158 - RNA, 22 nt, Human
gcgaagcgggccagggcuuccc

SEQ ID NO: 697159 - RNA, 18 nt, Human
gcucugggaggcucacgc

SEQ ID NO: 697160 - RNA, 20 nt, Human
ggccaagagguugaccauga

SEQ ID NO: 697161 - RNA, 26 nt, Human
uaaaggcacgagcgaagcuggagacc

SEQ ID NO: 697162 - RNA, 18 nt, Human
uaccuggaaaccauggaa

SEQ ID NO: 697163 - RNA, 19 nt, Human
uagcgaccccucaggaaca

SEQ ID NO: 697164 - RNA, 23 nt, Human
ucacgcucccuccucaggcuggg

SEQ ID NO: 697165 - RNA, 22 nt, Human
ucagcuucgcgcgcuccccuua

SEQ ID NO: 697166 - RNA, 21 nt, Human
ucaggaacacaacucucuccu

SEQ ID NO: 697167 - RNA, 21 nt, Human
ucccugaguccauccagggcc

SEQ ID NO: 697168 - RNA, 19 nt, Human
uccuggggcucugggaggc

SEQ ID NO: 697169 - RNA, 18 nt, Human
ucugccaugaccaccucc

SEQ ID NO: 697170 - RNA, 22 nt, Human
ucugccaugaccaccuccucca

SEQ ID NO: 697171 - RNA, 23 nt, Human
ucugggaggcucacgcucccucc

SEQ ID NO: 697172 - RNA, 19 nt, Human
ugcacguacuggcaggcgg

SEQ ID NO: 697173 - RNA, 19 nt, Human
uggaaaaagaaaccuaagu

SEQ ID NO: 697174 - RNA, 22 nt, Human
uggaaaccauggaaaaagaaac

SEQ ID NO: 697175 - RNA, 27 nt, Human
uggcacugcacagcgcaacuuggcaac

SEQ ID NO: 697176 - RNA, 21 nt, Human
uggcaggcgguagcccuuccu

SEQ ID NO: 697177 - RNA, 20 nt, Human
uggcccacauggcacugcac

SEQ ID NO: 697178 - RNA, 23 nt, Human
uucccugaguccauccagggcca

SEQ ID NO: 697179 - RNA, 20 nt, Human
uuccuccacguagcgacccc

SEQ ID NO: 697180 - RNA, 24 nt, Human
uuccuccacguagcgaccccucag

SEQ ID NO: 697181 - RNA, 22 nt, Human
uuuuuuuuuuuuuuuuuaccaa

SEQ ID NO: 697182 - RNA, 19 nt, Human
aaacaagaggugccuucca

SEQ ID NO: 697183 - RNA, 25 nt, Human
aaugauuuaauaaauaacaauacca

SEQ ID NO: 697184 - RNA, 19 nt, Human
aggcggcucggaugcuggc

SEQ ID NO: 697185 - RNA, 18 nt, Human
auacaggacacaacucac

SEQ ID NO: 697186 - RNA, 24 nt, Human
augcuccccaaaacaagaggugcc

SEQ ID NO: 697187 - RNA, 23 nt, Human
caaacgucugcacgcaaaccacg

SEQ ID NO: 697188 - RNA, 19 nt, Human
cacaacucacaaccccuuu

SEQ ID NO: 697189 - RNA, 30 nt, Human
cacgcaaaccacggaccgaagcacguggcu

SEQ ID NO: 697190 - RNA, 23 nt, Human
cacguggcgcaaggaugcggagc

SEQ ID NO: 697191 - RNA, 20 nt, Human
caggacacaacucacaaccc

SEQ ID NO: 697192 - RNA, 25 nt, Human
caggucaaacgucugcacgcaaacc

SEQ ID NO: 697193 - RNA, 18 nt, Human
ccccggaguuacgguggg

SEQ ID NO: 697194 - RNA, 23 nt, Human
cucacaaccccuuacccucaccu

SEQ ID NO: 697195 - RNA, 18 nt, Human
cuggcuucucgccccucc

SEQ ID NO: 697196 - RNA, 24 nt, Human
gaggugccuuccacuucaguauuc

SEQ ID NO: 697197 - RNA, 21 nt, Human
ggagagcggggcgggcagauc

SEQ ID NO: 697198 - RNA, 23 nt, Human
ggcgggcagauccgcgaccccgg

SEQ ID NO: 697199 - RNA, 24 nt, Human
gggcagauccgcgaccccggaguu

SEQ ID NO: 697200 - RNA, 18 nt, Human
ggggaggggcaggagcgc

SEQ ID NO: 697201 - RNA, 23 nt, Human
uacccucaccuuuggcacgaauu

SEQ ID NO: 697202 - RNA, 23 nt, Human
ucacaaccccuuacccucaccuu

SEQ ID NO: 697203 - RNA, 20 nt, Human
uccagauccucagcacauuu

SEQ ID NO: 697204 - RNA, 19 nt, Human
ugcccgaacagcuucggga

SEQ ID NO: 697205 - RNA, 23 nt, Human
uuaauaaauaacaauaccauccu

SEQ ID NO: 697206 - RNA, 20 nt, Human
uuugcaccucucuguggaag

SEQ ID NO: 697207 - RNA, 18 nt, Human
uuuuuuuuuuuuuuuuug

SEQ ID NO: 697208 - RNA, 19 nt, Human
aagcagcagagggugcugg

SEQ ID NO: 697209 - RNA, 20 nt, Human
aagcagcagagggugcuggc

SEQ ID NO: 697210 - RNA, 24 nt, Human
acucagugcugaguggagggggau

SEQ ID NO: 697211 - RNA, 24 nt, Human
agaugugaccagaggagaaaugcu

SEQ ID NO: 697212 - RNA, 20 nt, Human
agcagccagaggcugagggc

SEQ ID NO: 697213 - RNA, 23 nt, Human
aggccuucacagggaaguggagg

SEQ ID NO: 697214 - RNA, 26 nt, Human
aggcggagaugcugaagcagcagagg

SEQ ID NO: 697215 - RNA, 19 nt, Human
aggggaaggaggaaaggag

SEQ ID NO: 697216 - RNA, 20 nt, Human
caaugaccucccucuguccu

SEQ ID NO: 697217 - RNA, 19 nt, Human
cacaccuucuucucagcag

SEQ ID NO: 697218 - RNA, 24 nt, Human
cacaccuucuucucagcaguccca

SEQ ID NO: 697219 - RNA, 21 nt, Human
cacagccugccucaggccuuc

SEQ ID NO: 697220 - RNA, 18 nt, Human
cagaagccauaaggcagc

SEQ ID NO: 697221 - RNA, 20 nt, Human
cagcagagggugcuggcucc

SEQ ID NO: 697222 - RNA, 18 nt, Human
cagccagaggcugagggc

SEQ ID NO: 697223 - RNA, 20 nt, Human
ccacacucccuuucugcaca

SEQ ID NO: 697224 - RNA, 28 nt, Human
ccaugagccccuccucccuuuguggccu

SEQ ID NO: 697225 - RNA, 19 nt, Human
cccacagucagggccugag

SEQ ID NO: 697226 - RNA, 20 nt, Human
cccgguaggacacacacgca

SEQ ID NO: 697227 - RNA, 21 nt, Human
cucccucuguccuguccugcc

SEQ ID NO: 697228 - RNA, 25 nt, Human
cuguccugcccgguaggacacacac

SEQ ID NO: 697229 - RNA, 19 nt, Human
cuugaccuccuuucaggua

SEQ ID NO: 697230 - RNA, 20 nt, Human
gacguagaugugaccagagg

SEQ ID NO: 697231 - RNA, 18 nt, Human
gagacacagaagccauaa

SEQ ID NO: 697232 - RNA, 23 nt, Human
gagagcagccagaggcugagggc

SEQ ID NO: 697233 - RNA, 20 nt, Human
gagcagccagaggcugaggg

SEQ ID NO: 697234 - RNA, 21 nt, Human
gaggggaaggaggaaaggagg

SEQ ID NO: 697235 - RNA, 20 nt, Human
gagggugcuggcuccacuga

SEQ ID NO: 697236 - RNA, 18 nt, Human
gcccccacccagcucuaa

SEQ ID NO: 697237 - RNA, 22 nt, Human
gcugaagcagcagagggugcug

SEQ ID NO: 697238 - RNA, 21 nt, Human
ggagccccugcacacagccuu

SEQ ID NO: 697239 - RNA, 22 nt, Human
ggaggggaaggaggaaaggagg

SEQ ID NO: 697240 - RNA, 23 nt, Human
ggaggggaaggaggaaaggaggg

SEQ ID NO: 697241 - RNA, 22 nt, Human
ggccugagccuggccacagccu

SEQ ID NO: 697242 - RNA, 22 nt, Human
ggcugagggcuguuggagacac

SEQ ID NO: 697243 - RNA, 23 nt, Human
gguaacagaggcuuuuuaaagga

SEQ ID NO: 697244 - RNA, 19 nt, Human
gugaaggcagacaugcccc

SEQ ID NO: 697245 - RNA, 23 nt, Human
guggaggggaaggaggaaaggag

SEQ ID NO: 697246 - RNA, 18 nt, Human
uaacucagugcugagugg

SEQ ID NO: 697247 - RNA, 18 nt, Human
uauugggaaggagagcag

SEQ ID NO: 697248 - RNA, 23 nt, Human
ucagcagucccaugagccccucc

SEQ ID NO: 697249 - RNA, 22 nt, Human
ucccugguguguaccccacagu

SEQ ID NO: 697250 - RNA, 24 nt, Human
ucucagcagucccaugagccccuc

SEQ ID NO: 697251 - RNA, 20 nt, Human
ugaagcagcagagggugcug

SEQ ID NO: 697252 - RNA, 24 nt, Human
uguccuguccugcccgguaggaca

SEQ ID NO: 697253 - RNA, 24 nt, Human
uugcagcugagacacaaaauggga

SEQ ID NO: 697254 - RNA, 21 nt, Human
uuuguggccuucuugcagcug

SEQ ID NO: 697255 - RNA, 24 nt, Human
aaagcgccuccgacuagcaccucc

SEQ ID NO: 697256 - RNA, 20 nt, Human
aagcagcggcgggaguacuc

SEQ ID NO: 697257 - RNA, 18 nt, Human
aagcggaagggggugccg

SEQ ID NO: 697258 - RNA, 22 nt, Human
aaggggccgcggccgguccggg

SEQ ID NO: 697259 - RNA, 23 nt, Human
acccgcgaacaggcggggcggca

SEQ ID NO: 697260 - RNA, 21 nt, Human
accuucuugagcgucucgucg

SEQ ID NO: 697261 - RNA, 23 nt, Human
acucgcugccucucccgggccuu

SEQ ID NO: 697262 - RNA, 25 nt, Human
agcgcccacccacccgcgaacaggc

SEQ ID NO: 697263 - RNA, 21 nt, Human
aggaggggcaggggcgcggcg

SEQ ID NO: 697264 - RNA, 20 nt, Human
agucgggccaggcuagcgcc

SEQ ID NO: 697265 - RNA, 26 nt, Human
caaagcgccuccgacuagcaccuccc

SEQ ID NO: 697266 - RNA, 19 nt, Human
caccgggguccacggggga

SEQ ID NO: 697267 - RNA, 24 nt, Human
caccucggccagcuucucgggggc

SEQ ID NO: 697268 - RNA, 22 nt, Human
cacgcgguggugcucgaaggcc

SEQ ID NO: 697269 - RNA, 21 nt, Human
cagaggaccccgucggcgucc

SEQ ID NO: 697270 - RNA, 19 nt, Human
cagcagccgagggccucag

SEQ ID NO: 697271 - RNA, 19 nt, Human
cagccgagggccucagggg

SEQ ID NO: 697272 - RNA, 20 nt, Human
ccacccgcgaacaggcgggg

SEQ ID NO: 697273 - RNA, 19 nt, Human
ccaggaucuucuuguaccg

SEQ ID NO: 697274 - RNA, 19 nt, Human
cccaaagcgccuccgacua

SEQ ID NO: 697275 - RNA, 22 nt, Human
cccaaagcgccuccgacuagca

SEQ ID NO: 697276 - RNA, 23 nt, Human
cccagucgggccaggcuagcgcc

SEQ ID NO: 697277 - RNA, 20 nt, Human
ccccagcagccgagggccuc

SEQ ID NO: 697278 - RNA, 21 nt, Human
ccccggguccaggugaggccc

SEQ ID NO: 697279 - RNA, 24 nt, Human
cccgccugccugguuuuccaggag

SEQ ID NO: 697280 - RNA, 24 nt, Human
cccgcgaacaggcggggcggcagg

SEQ ID NO: 697281 - RNA, 21 nt, Human
ccuccgcggggccagggcgga

SEQ ID NO: 697282 - RNA, 24 nt, Human
ccuccgcggggccagggcggagac

SEQ ID NO: 697283 - RNA, 22 nt, Human
ccuucacucgcugccucucccg

SEQ ID NO: 697284 - RNA, 19 nt, Human
cgagggccucaggggcacc

SEQ ID NO: 697285 - RNA, 25 nt, Human
cgcggaggcguggugcgaucaccgc

SEQ ID NO: 697286 - RNA, 20 nt, Human
cgcggcggggagaggggcag

SEQ ID NO: 697287 - RNA, 18 nt, Human
cggaagggggugccggcg

SEQ ID NO: 697288 - RNA, 19 nt, Human
cggaccccagcagccgagg

SEQ ID NO: 697289 - RNA, 21 nt, Human
cggcucggggaccgacggcgg

SEQ ID NO: 697290 - RNA, 23 nt, Human
cgggaaucaggugggcagcuccu

SEQ ID NO: 697291 - RNA, 21 nt, Human
cgggcagggacgcggggacuc

SEQ ID NO: 697292 - RNA, 18 nt, Human
cggggcggcaggggagcg

SEQ ID NO: 697293 - RNA, 19 nt, Human
cgggguccacgggggagga

SEQ ID NO: 697294 - RNA, 23 nt, Human
cguccagggccagaaagcagcgg

SEQ ID NO: 697295 - RNA, 20 nt, Human
cgucgcgcuugggggcccgg

SEQ ID NO: 697296 - RNA, 22 nt, Human
gaacaggcggggcggcagggga

SEQ ID NO: 697297 - RNA, 19 nt, Human
gaacucgcccaccucggcc

SEQ ID NO: 697298 - RNA, 20 nt, Human
gagcgugucguggaacugag

SEQ ID NO: 697299 - RNA, 19 nt, Human
gccucucccgggccuuggg

SEQ ID NO: 697300 - RNA, 22 nt, Human
gccuugggcuucccaaagcgcc

SEQ ID NO: 697301 - RNA, 23 nt, Human
gcgacaugcucuugagcuucugg

SEQ ID NO: 697302 - RNA, 18 nt, Human
ggagcgaggaggaggggc

SEQ ID NO: 697303 - RNA, 24 nt, Human
ggcaggggcgcggcggggagaggg

SEQ ID NO: 697304 - RNA, 19 nt, Human
ggcaggucauccaccgggg

SEQ ID NO: 697305 - RNA, 19 nt, Human
gggaagcgcccacccaccc

SEQ ID NO: 697306 - RNA, 19 nt, Human
gggcagcagcagcuugcuc

SEQ ID NO: 697307 - RNA, 19 nt, Human
gggccgcggccgguccggg

SEQ ID NO: 697308 - RNA, 18 nt, Human
uaagggagcccccaaccc

SEQ ID NO: 697309 - RNA, 20 nt, Human
uccacgggggaggaaggccc

SEQ ID NO: 697310 - RNA, 21 nt, Human
uccccggguccaggugaggcc

SEQ ID NO: 697311 - RNA, 18 nt, Human
ucgcugccucucccgggc

SEQ ID NO: 697312 - RNA, 24 nt, Human
ucggcguccuucacucgcugccuc

SEQ ID NO: 697313 - RNA, 20 nt, Human
ugagcgacggaacgggcagg

SEQ ID NO: 697314 - RNA, 24 nt, Human
ugggggcccggcuaagggagcccc

SEQ ID NO: 697315 - RNA, 23 nt, Human
aagaagucuaucuuuccacauaa

SEQ ID NO: 697316 - RNA, 21 nt, Human
acacaauguaguaggaaaacc

SEQ ID NO: 697317 - RNA, 19 nt, Human
acggggcugcgagcaacga

SEQ ID NO: 697318 - RNA, 23 nt, Human
acuacauauaugaagaaguucua

SEQ ID NO: 697319 - RNA, 19 nt, Human
agcuacagagacagaggga

SEQ ID NO: 697320 - RNA, 23 nt, Human
agguucuugggcaucaacaguuu

SEQ ID NO: 697321 - RNA, 18 nt, Human
augaagaaguucuaauuc

SEQ ID NO: 697322 - RNA, 20 nt, Human
cacuuguagccgaacggggc

SEQ ID NO: 697323 - RNA, 23 nt, Human
ccagcuacagagacagagggagg

SEQ ID NO: 697324 - RNA, 19 nt, Human
ccuggaaacuaccuucucc

SEQ ID NO: 697325 - RNA, 21 nt, Human
cggggcugcgagcaacgagca

SEQ ID NO: 697326 - RNA, 23 nt, Human
cucacuuguagccgaacggggcu

SEQ ID NO: 697327 - RNA, 18 nt, Human
cuggccgcgguggccccu

SEQ ID NO: 697328 - RNA, 21 nt, Human
gagacugcucgucgccgcgga

SEQ ID NO: 697329 - RNA, 19 nt, Human
gaggauggccccugcccga

SEQ ID NO: 697330 - RNA, 21 nt, Human
gcgaaaggcagccucacaccc

SEQ ID NO: 697331 - RNA, 20 nt, Human
gcggacccagagaccacugg

SEQ ID NO: 697332 - RNA, 23 nt, Human
ggggaccgaggauggccccugcc

SEQ ID NO: 697333 - RNA, 21 nt, Human
uacagagacagagggaggagc

SEQ ID NO: 697334 - RNA, 26 nt, Human
uaggaaaaccacuacauauaugaaga

SEQ ID NO: 697335 - RNA, 20 nt, Human
uaguaggaaaaccacuacau

SEQ ID NO: 697336 - RNA, 22 nt, Human
ucacacccggcuggccgcggug

SEQ ID NO: 697337 - RNA, 18 nt, Human
ucuggacaaauuuuguuu

SEQ ID NO: 697338 - RNA, 23 nt, Human
ucuugggcaucaacaguuucaug

SEQ ID NO: 697339 - RNA, 18 nt, Human
uggaaaaacuacaacauu

SEQ ID NO: 697340 - RNA, 25 nt, Human
uggaaaaacuacaacauucuuugca

SEQ ID NO: 697341 - RNA, 22 nt, Human
uggccccuggccaugacgcccu

SEQ ID NO: 697342 - RNA, 22 nt, Human
uuuuuuuuuagguguaaaugug

SEQ ID NO: 697343 - RNA, 25 nt, Human
caacgaauaaaacccaucaccuuuc

SEQ ID NO: 697344 - RNA, 20 nt, Human
caccacagcaaguaggcagg

SEQ ID NO: 697345 - RNA, 22 nt, Human
ccaacgaauaaaacccaucacc

SEQ ID NO: 697346 - RNA, 23 nt, Human
cccaacgaauaaaacccaucacc

SEQ ID NO: 697347 - RNA, 18 nt, Human
cugccaaaccuuuucuuu

SEQ ID NO: 697348 - RNA, 21 nt, Human
gcaaguaggcaggaaugccag

SEQ ID NO: 697349 - RNA, 18 nt, Human
gccuuuuacuucuuucuc

SEQ ID NO: 697350 - RNA, 19 nt, Human
uaacaugaagucaaguuga

SEQ ID NO: 697351 - RNA, 26 nt, Human
uagauggcucuuauuauuuugaggua

SEQ ID NO: 697352 - RNA, 19 nt, Human
ucuuauuauuuugagguau

SEQ ID NO: 697353 - RNA, 25 nt, Human
ugagguauguuccuucgacgccugg

SEQ ID NO: 697354 - RNA, 23 nt, Human
ugcuguggcgagacuuccaguac

SEQ ID NO: 697355 - RNA, 23 nt, Human
uggcugugguuuugucauagaug

SEQ ID NO: 697356 - RNA, 24 nt, Human
uuaaagcccaacgaauaaaacccc

SEQ ID NO: 697357 - RNA, 25 nt, Human
uuaaagcccaacgaauaaaaccccc

SEQ ID NO: 697358 - RNA, 22 nt, Human
aaggaagagagaucacuaaagg

SEQ ID NO: 697359 - RNA, 19 nt, Human
aaggcuuuaccacauuguu

SEQ ID NO: 697360 - RNA, 22 nt, Human
agccagugugggucccagcgcg

SEQ ID NO: 697361 - RNA, 24 nt, Human
agcuuccagguguccggguguccu

SEQ ID NO: 697362 - RNA, 18 nt, Human
aggguuucacuccagugu

SEQ ID NO: 697363 - RNA, 18 nt, Human
cacucaccacugucacau

SEQ ID NO: 697364 - RNA, 19 nt, Human
cagcuuccagguguccggg

SEQ ID NO: 697365 - RNA, 19 nt, Human
caugucuuagauagguacu

SEQ ID NO: 697366 - RNA, 26 nt, Human
ccaagacgacuucuccacacucacca

SEQ ID NO: 697367 - RNA, 23 nt, Human
cguuuucccacauugcuuacaug

SEQ ID NO: 697368 - RNA, 21 nt, Human
cuaaaggcuuucccacacuga

SEQ ID NO: 697369 - RNA, 23 nt, Human
cuaaaggcuuucccacacugaca

SEQ ID NO: 697370 - RNA, 24 nt, Human
cuaggacaaucaaagccuuuccca

SEQ ID NO: 697371 - RNA, 21 nt, Human
cucaccacugucacauggauu

SEQ ID NO: 697372 - RNA, 25 nt, Human
cuccacauugacugucaucuuuaau

SEQ ID NO: 697373 - RNA, 21 nt, Human
cuccagugugaguaguuucau

SEQ ID NO: 697374 - RNA, 23 nt, Human
cuccagugugaguaguuucauga

SEQ ID NO: 697375 - RNA, 21 nt, Human
cuccagugugaguugucucau

SEQ ID NO: 697376 - RNA, 23 nt, Human
cuccagugugaguugucucauga

SEQ ID NO: 697377 - RNA, 25 nt, Human
cuuguucacaauacuaucuggaauc

SEQ ID NO: 697378 - RNA, 22 nt, Human
gacaaucaaagccuuucccaca

SEQ ID NO: 697379 - RNA, 20 nt, Human
gagccaagagaaugcuuuuc

SEQ ID NO: 697380 - RNA, 24 nt, Human
gaucacuaaaggcuuucccacacu

SEQ ID NO: 697381 - RNA, 22 nt, Human
gcgacagacgcugauacagacc

SEQ ID NO: 697382 - RNA, 23 nt, Human
ggguguccuccuuaaaagccagu

SEQ ID NO: 697383 - RNA, 20 nt, Human
gucaacucugauguugcaau

SEQ ID NO: 697384 - RNA, 23 nt, Human
gugugaguugcuucaugucuucg

SEQ ID NO: 697385 - RNA, 22 nt, Human
uaagagacgaaugacccaagac

SEQ ID NO: 697386 - RNA, 20 nt, Human
uaaguuacugaaaugacuga

SEQ ID NO: 697387 - RNA, 21 nt, Human
uacuguguggguccuuuuaug

SEQ ID NO: 697388 - RNA, 18 nt, Human
uauaggguuucucuccgg

SEQ ID NO: 697389 - RNA, 21 nt, Human
ucacauggauuuacucgagga

SEQ ID NO: 697390 - RNA, 22 nt, Human
ucacauggauuuacucgaggag

SEQ ID NO: 697391 - RNA, 23 nt, Human
ucacauguaugacuucauuuccc

SEQ ID NO: 697392 - RNA, 21 nt, Human
uccacacucaccacugucaca

SEQ ID NO: 697393 - RNA, 23 nt, Human
uccugaugcucacaugauuugug

SEQ ID NO: 697394 - RNA, 21 nt, Human
ucuccacacucaccacuguca

SEQ ID NO: 697395 - RNA, 20 nt, Human
ucugggguccaucuccugug

SEQ ID NO: 697396 - RNA, 18 nt, Human
ucuugcauuucugggguc

SEQ ID NO: 697397 - RNA, 19 nt, Human
ucuugcauuucuggggucc

SEQ ID NO: 697398 - RNA, 19 nt, Human
ucuuuaauuucacauguau

SEQ ID NO: 697399 - RNA, 19 nt, Human
ugaauccuuucauggacuu

SEQ ID NO: 697400 - RNA, 21 nt, Human
ugacuucauuucccagcuucc

SEQ ID NO: 697401 - RNA, 19 nt, Human
ugauacagaccuuccaggg

SEQ ID NO: 697402 - RNA, 18 nt, Human
uggaaucuggccaaaagu

SEQ ID NO: 697403 - RNA, 19 nt, Human
uggaaucuggccaaaaguu

SEQ ID NO: 697404 - RNA, 18 nt, Human
uguccggguguccuccuu

SEQ ID NO: 697405 - RNA, 24 nt, Human
uguccggguguccuccuuaaaagc

SEQ ID NO: 697406 - RNA, 18 nt, Human
ugugaguucucucauguc

SEQ ID NO: 697407 - RNA, 22 nt, Human
ugugucuucgaaagcuugugug

SEQ ID NO: 697408 - RNA, 21 nt, Human
uucccacauaucuuacauuua

SEQ ID NO: 697409 - RNA, 25 nt, Human
uuguucacaauacuaucuggaaucu

SEQ ID NO: 697410 - RNA, 20 nt, Human
aaccaagauucaaggcaucu

SEQ ID NO: 697411 - RNA, 23 nt, Human
aauacaaaauaacuuggaauuca

SEQ ID NO: 697412 - RNA, 22 nt, Human
agcuaaagccacuaauacccau

SEQ ID NO: 697413 - RNA, 18 nt, Human
aggaccaaagcaucacug

SEQ ID NO: 697414 - RNA, 19 nt, Human
auggaacagcagagaagga

SEQ ID NO: 697415 - RNA, 20 nt, Human
ccuguagcuucaccugggac

SEQ ID NO: 697416 - RNA, 18 nt, Human
cuaaagccacuaauaccc

SEQ ID NO: 697417 - RNA, 20 nt, Human
gaaguuccuuaacauuuucu

SEQ ID NO: 697418 - RNA, 23 nt, Human
gauuauugugauguuuauccccu

SEQ ID NO: 697419 - RNA, 22 nt, Human
ggaagaaugguccgucuuagga

SEQ ID NO: 697420 - RNA, 19 nt, Human
guauucuuccauggaacag

SEQ ID NO: 697421 - RNA, 23 nt, Human
gucaguccuaaagaaaaagcuaa

SEQ ID NO: 697422 - RNA, 23 nt, Human
uaacaggucaguccuaaagaaaa

SEQ ID NO: 697423 - RNA, 25 nt, Human
ucaagggugguaacggaagaauuuu

SEQ ID NO: 697424 - RNA, 18 nt, Human
uccuaaagaaaaagcuaa

SEQ ID NO: 697425 - RNA, 19 nt, Human
uccuguagcuucaccuggg

SEQ ID NO: 697426 - RNA, 22 nt, Human
ugaaaggagauagcuggccuuu

SEQ ID NO: 697427 - RNA, 25 nt, Human
uggaacagcagagaaguuccuuaac

SEQ ID NO: 697428 - RNA, 24 nt, Human
ugugggaagaaugguccgucuuag

SEQ ID NO: 697429 - RNA, 18 nt, Human
ugugugggaagaaugguc

SEQ ID NO: 697430 - RNA, 24 nt, Human
ugugugggaagaaugguccgucuu

SEQ ID NO: 697431 - RNA, 18 nt, Human
aacacggugaaacccugu

SEQ ID NO: 697432 - RNA, 21 nt, Human
aacacggugaaacccuguggc

SEQ ID NO: 697433 - RNA, 23 nt, Human
aacugucaaaggcucugccuucu

SEQ ID NO: 697434 - RNA, 21 nt, Human
aagcagcggccuggauuguca

SEQ ID NO: 697435 - RNA, 24 nt, Human
aagcagggccgugccccccugugg

SEQ ID NO: 697436 - RNA, 21 nt, Human
aagcaggggagguggccaggu

SEQ ID NO: 697437 - RNA, 20 nt, Human
aagccggaucugaaugggac

SEQ ID NO: 697438 - RNA, 21 nt, Human
aaggagcugggaagcagcggc

SEQ ID NO: 697439 - RNA, 20 nt, Human
aagguaaaaaguaugaaacc

SEQ ID NO: 697440 - RNA, 20 nt, Human
acuguguuuccaaacaaggu

SEQ ID NO: 697441 - RNA, 19 nt, Human
acuuuccucagaauccugg

SEQ ID NO: 697442 - RNA, 18 nt, Human
agagaagcccaccccagg

SEQ ID NO: 697443 - RNA, 25 nt, Human
agcagccaggaggcagcugaggggg

SEQ ID NO: 697444 - RNA, 21 nt, Human
agcccagggagaagcagggga

SEQ ID NO: 697445 - RNA, 21 nt, Human
agccccagggaagaagucagu

SEQ ID NO: 697446 - RNA, 20 nt, Human
agccccugaccccgcagccc

SEQ ID NO: 697447 - RNA, 21 nt, Human
agccgggcaugguggcucacg

SEQ ID NO: 697448 - RNA, 23 nt, Human
agcgauuugggaggccgaggugg

SEQ ID NO: 697449 - RNA, 24 nt, Human
agcgauuugggaggccgagguggg

SEQ ID NO: 697450 - RNA, 22 nt, Human
agcggccuggauugucagccuc

SEQ ID NO: 697451 - RNA, 21 nt, Human
agcggcgaagcagccuuuccu

SEQ ID NO: 697452 - RNA, 21 nt, Human
aggccgaggugggcggaucac

SEQ ID NO: 697453 - RNA, 19 nt, Human
aggcuuuagggaaggaucc

SEQ ID NO: 697454 - RNA, 19 nt, Human
aggggccaccccagugacc

SEQ ID NO: 697455 - RNA, 24 nt, Human
aggugggcggaucacgaggucagg

SEQ ID NO: 697456 - RNA, 24 nt, Human
aguugcugcugggucaucaccguc

SEQ ID NO: 697457 - RNA, 21 nt, Human
auccuggccaacacggugaaa

SEQ ID NO: 697458 - RNA, 20 nt, Human
caaguuggcagcagcagcca

SEQ ID NO: 697459 - RNA, 24 nt, Human
caauccgugguagcuucccacccu

SEQ ID NO: 697460 - RNA, 23 nt, Human
cacagaacccagcccugccccag

SEQ ID NO: 697461 - RNA, 20 nt, Human
cacagcccagggagaagcag

SEQ ID NO: 697462 - RNA, 25 nt, Human
cacccccagcucgggagggagacuc

SEQ ID NO: 697463 - RNA, 21 nt, Human
caccuggcgccggcaaucccc

SEQ ID NO: 697464 - RNA, 22 nt, Human
caccuggggccucacagugcuc

SEQ ID NO: 697465 - RNA, 24 nt, Human
cagaaaggaagccccucaccuccc

SEQ ID NO: 697466 - RNA, 21 nt, Human
cagaauccuggcuuuggagac

SEQ ID NO: 697467 - RNA, 21 nt, Human
cagcaagcagggccgugcccc

SEQ ID NO: 697468 - RNA, 23 nt, Human
cagcaagcagggccgugcccccc

SEQ ID NO: 697469 - RNA, 22 nt, Human
cagcagcagccaggaggcagcu

SEQ ID NO: 697470 - RNA, 21 nt, Human
cagcagccaggaggcagcuga

SEQ ID NO: 697471 - RNA, 18 nt, Human
cagcccagggagaagcag

SEQ ID NO: 697472 - RNA, 23 nt, Human
cagcccagggagaagcaggggag

SEQ ID NO: 697473 - RNA, 20 nt, Human
cagccccagggaagaaguca

SEQ ID NO: 697474 - RNA, 23 nt, Human
cagccucuugaaagucagggaga

SEQ ID NO: 697475 - RNA, 21 nt, Human
cagcucggaugcuggagcccc

SEQ ID NO: 697476 - RNA, 21 nt, Human
caggggagguggccaggugca

SEQ ID NO: 697477 - RNA, 24 nt, Human
cagugcucagugcaacuauccugg

SEQ ID NO: 697478 - RNA, 19 nt, Human
caucuccuuagaaggacac

SEQ ID NO: 697479 - RNA, 23 nt, Human
caucugggcagucccgggcugaa

SEQ ID NO: 697480 - RNA, 20 nt, Human
ccaagaccuucaccaaggac

SEQ ID NO: 697481 - RNA, 19 nt, Human
ccaagccggaucugaaugg

SEQ ID NO: 697482 - RNA, 23 nt, Human
ccaauccgugguagcuucccacc

SEQ ID NO: 697483 - RNA, 19 nt, Human
ccacgcacagcccagggag

SEQ ID NO: 697484 - RNA, 25 nt, Human
ccacugccuccggcaucagcuccug

SEQ ID NO: 697485 - RNA, 21 nt, Human
ccagcaccuggcgccggcaau

SEQ ID NO: 697486 - RNA, 23 nt, Human
cccagcccugccccagcaaugaa

SEQ ID NO: 697487 - RNA, 21 nt, Human
ccccacaggacuuuccucaga

SEQ ID NO: 697488 - RNA, 21 nt, Human
ccccacgcucccgcuguccga

SEQ ID NO: 697489 - RNA, 23 nt, Human
ccccugaccccgcagcccaaucc

SEQ ID NO: 697490 - RNA, 18 nt, Human
cccgcaguauccagagcu

SEQ ID NO: 697491 - RNA, 21 nt, Human
cccgggcugaaagugacaggc

SEQ ID NO: 697492 - RNA, 21 nt, Human
ccgugguagcuucccacccuu

SEQ ID NO: 697493 - RNA, 21 nt, Human
ccguguguugugguugcaucc

SEQ ID NO: 697494 - RNA, 24 nt, Human
ccuaaaaucagaauccuaugggac

SEQ ID NO: 697495 - RNA, 22 nt, Human
ccuaaccagggcacccacugcc

SEQ ID NO: 697496 - RNA, 19 nt, Human
ccucacucugaucuccgac

SEQ ID NO: 697497 - RNA, 23 nt, Human
ccucaugggaagggcagggcugu

SEQ ID NO: 697498 - RNA, 19 nt, Human
ccucuugaaagucagggag

SEQ ID NO: 697499 - RNA, 25 nt, Human
ccugcagcagggcaggaccgggguc

SEQ ID NO: 697500 - RNA, 23 nt, Human
ccugcugggcaggcgcccggccu

SEQ ID NO: 697501 - RNA, 22 nt, Human
ccuggccaacacggugaaaccc

SEQ ID NO: 697502 - RNA, 24 nt, Human
ccuggccaacacggugaaacccug

SEQ ID NO: 697503 - RNA, 24 nt, Human
ccuggcgccggcaauccccggcuu

SEQ ID NO: 697504 - RNA, 24 nt, Human
cgagaccauccuggccaacacggu

SEQ ID NO: 697505 - RNA, 24 nt, Human
cgaggugggcggaucacgagguca

SEQ ID NO: 697506 - RNA, 27 nt, Human
cgcccccagcaccuggcgccggcaauc

SEQ ID NO: 697507 - RNA, 26 nt, Human
cgggcgcuccuccgcggaaaagcccc

SEQ ID NO: 697508 - RNA, 19 nt, Human
cguggagccgggcauggug

SEQ ID NO: 697509 - RNA, 21 nt, Human
cucacagugcucagugcaacu

SEQ ID NO: 697510 - RNA, 19 nt, Human
cuccaccccacgcucccgc

SEQ ID NO: 697511 - RNA, 19 nt, Human
cuccuccgcggaaaagccc

SEQ ID NO: 697512 - RNA, 20 nt, Human
cuccuccgcggaaaagcccc

SEQ ID NO: 697513 - RNA, 23 nt, Human
cuccuucacacggcugccuucuc

SEQ ID NO: 697514 - RNA, 21 nt, Human
cugaaaccggggggucagcaa

SEQ ID NO: 697515 - RNA, 21 nt, Human
cugcagcagggcaggaccagg

SEQ ID NO: 697516 - RNA, 18 nt, Human
cugcuccccugcuuagcc

SEQ ID NO: 697517 - RNA, 22 nt, Human
cugcuuccucuuugaucagcca

SEQ ID NO: 697518 - RNA, 21 nt, Human
cuggaaggccuccugggggcc

SEQ ID NO: 697519 - RNA, 25 nt, Human
cuggagccccugaccccgcagccca

SEQ ID NO: 697520 - RNA, 18 nt, Human
cuggccaacacggugaaa

SEQ ID NO: 697521 - RNA, 24 nt, Human
cuggccaacacggugaaacccugu

SEQ ID NO: 697522 - RNA, 19 nt, Human
cuggucuugcuuugucucc

SEQ ID NO: 697523 - RNA, 22 nt, Human
cuuccagccuuguuuccucauc

SEQ ID NO: 697524 - RNA, 20 nt, Human
gaacugucaaaggcucugcc

SEQ ID NO: 697525 - RNA, 21 nt, Human
gacaguggucagaaucucccc

SEQ ID NO: 697526 - RNA, 18 nt, Human
gagaagcaggggaggugg

SEQ ID NO: 697527 - RNA, 21 nt, Human
gagccacuucagauaucgcuu

SEQ ID NO: 697528 - RNA, 23 nt, Human
gagccccugaccccgcagcccaa

SEQ ID NO: 697529 - RNA, 23 nt, Human
gcacagcccagggagaagcaggg

SEQ ID NO: 697530 - RNA, 24 nt, Human
gcacagcccagggagaagcagggg

SEQ ID NO: 697531 - RNA, 21 nt, Human
gcagcagcagccaggaggcag

SEQ ID NO: 697532 - RNA, 18 nt, Human
gcagcugagggggcuggg

SEQ ID NO: 697533 - RNA, 18 nt, Human
gccaacacggugaaaccc

SEQ ID NO: 697534 - RNA, 19 nt, Human
gcccaccccagggaguagc

SEQ ID NO: 697535 - RNA, 21 nt, Human
gcuucaaguuaggacuucagc

SEQ ID NO: 697536 - RNA, 20 nt, Human
gcuuguaggggccucgggaa

SEQ ID NO: 697537 - RNA, 23 nt, Human
ggagaagcaggggagguggccag

SEQ ID NO: 697538 - RNA, 21 nt, Human
ggagaugggucugcgugcauc

SEQ ID NO: 697539 - RNA, 23 nt, Human
ggaguagccaugaacggccuagg

SEQ ID NO: 697540 - RNA, 21 nt, Human
ggcaggcgcccggccuggugc

SEQ ID NO: 697541 - RNA, 21 nt, Human
ggcggaucacgaggucaggag

SEQ ID NO: 697542 - RNA, 18 nt, Human
ggcuuguaggggccucgg

SEQ ID NO: 697543 - RNA, 20 nt, Human
gggaggccgaggugggcgga

SEQ ID NO: 697544 - RNA, 18 nt, Human
gggauguaaggagcuggg

SEQ ID NO: 697545 - RNA, 21 nt, Human
gggcaugguggcucacgccgg

SEQ ID NO: 697546 - RNA, 19 nt, Human
ggugacuaauuaaucugca

SEQ ID NO: 697547 - RNA, 19 nt, Human
ggugcucugcuccccugcu

SEQ ID NO: 697548 - RNA, 22 nt, Human
ggugcuucaaguuaggacuuca

SEQ ID NO: 697549 - RNA, 19 nt, Human
guagucuuaucauuucucu

SEQ ID NO: 697550 - RNA, 18 nt, Human
gugaggacauggacaucc

SEQ ID NO: 697551 - RNA, 24 nt, Human
uagcgauuugggaggccgaggugg

SEQ ID NO: 697552 - RNA, 18 nt, Human
uaggauggaccucucugc

SEQ ID NO: 697553 - RNA, 19 nt, Human
uauccagagcucuccgaac

SEQ ID NO: 697554 - RNA, 22 nt, Human
uaugaaaccacuuuugagaacu

SEQ ID NO: 697555 - RNA, 20 nt, Human
uauuucagauucuacgauua

SEQ ID NO: 697556 - RNA, 18 nt, Human
ucacgaggucaggagauc

SEQ ID NO: 697557 - RNA, 24 nt, Human
ucacgaggucaggagaucgagacc

SEQ ID NO: 697558 - RNA, 21 nt, Human
ucagaacucagacccuguacu

SEQ ID NO: 697559 - RNA, 23 nt, Human
ucagaacucagacccuguacugu

SEQ ID NO: 697560 - RNA, 26 nt, Human
ucagcuccugcugggcaggcgcccgg

SEQ ID NO: 697561 - RNA, 21 nt, Human
ucaguguggucuuagaggugg

SEQ ID NO: 697562 - RNA, 20 nt, Human
uccaaaauaacuguuugaau

SEQ ID NO: 697563 - RNA, 21 nt, Human
uccagaaggaacgcagauguc

SEQ ID NO: 697564 - RNA, 22 nt, Human
uccauccuacuccaccccacgc

SEQ ID NO: 697565 - RNA, 19 nt, Human
ucccuuucaguugcugcca

SEQ ID NO: 697566 - RNA, 18 nt, Human
ucccuuucaguugcugcu

SEQ ID NO: 697567 - RNA, 19 nt, Human
uccgaacacagcggcgaag

SEQ ID NO: 697568 - RNA, 23 nt, Human
uccuaggcccacacccccagcuc

SEQ ID NO: 697569 - RNA, 27 nt, Human
uccucagcccuaaccagggcacccacu

SEQ ID NO: 697570 - RNA, 19 nt, Human
uccugcugggcaggcgccc

SEQ ID NO: 697571 - RNA, 19 nt, Human
uccuuggguuccuuggcuu

SEQ ID NO: 697572 - RNA, 20 nt, Human
uccuuggguuccuuggcuug

SEQ ID NO: 697573 - RNA, 18 nt, Human
ucgccagcucggaugcug

SEQ ID NO: 697574 - RNA, 25 nt, Human
ucuacgauuaggacugaaaaugagc

SEQ ID NO: 697575 - RNA, 21 nt, Human
ucucagcugcagaaaggaagc

SEQ ID NO: 697576 - RNA, 23 nt, Human
ucucaggugccuguccaagccgg

SEQ ID NO: 697577 - RNA, 21 nt, Human
ucuccgggcagcuggugguuu

SEQ ID NO: 697578 - RNA, 24 nt, Human
ucugcaacgacuguguuuccaaac

SEQ ID NO: 697579 - RNA, 20 nt, Human
ucuggaaggccuccuggggg

SEQ ID NO: 697580 - RNA, 20 nt, Human
ucuugcuuugucuccuuugc

SEQ ID NO: 697581 - RNA, 22 nt, Human
ucuugggguccucagcccuaac

SEQ ID NO: 697582 - RNA, 24 nt, Human
ugaaaaugagcaggccugugagga

SEQ ID NO: 697583 - RNA, 20 nt, Human
ugaccucauggugacuaauu

SEQ ID NO: 697584 - RNA, 22 nt, Human
ugaggagacugugguucccaag

SEQ ID NO: 697585 - RNA, 19 nt, Human
ugagggggcuggguccugc

SEQ ID NO: 697586 - RNA, 20 nt, Human
ugccccacaccagugccugu

SEQ ID NO: 697587 - RNA, 24 nt, Human
ugccucuccgggcagcuggugguu

SEQ ID NO: 697588 - RNA, 18 nt, Human
ugcgugguugugguugug

SEQ ID NO: 697589 - RNA, 24 nt, Human
ugcuggagccccugaccccgcagc

SEQ ID NO: 697590 - RNA, 20 nt, Human
ugcugggcaggcgcccggcc

SEQ ID NO: 697591 - RNA, 19 nt, Human
uggacauccuaaaaucaga

SEQ ID NO: 697592 - RNA, 22 nt, Human
uggauugucagccucuugaaag

SEQ ID NO: 697593 - RNA, 19 nt, Human
uggcagcagcagccaggag

SEQ ID NO: 697594 - RNA, 19 nt, Human
uggcagcagcagccaggag

SEQ ID NO: 697595 - RNA, 24 nt, Human
uggcucacgccggccauucuagcg

SEQ ID NO: 697596 - RNA, 20 nt, Human
uggcuugugguugcgucccu

SEQ ID NO: 697597 - RNA, 19 nt, Human
ugggaggccgaggugggcg

SEQ ID NO: 697598 - RNA, 24 nt, Human
ugggaggccgaggugggcggauca

SEQ ID NO: 697599 - RNA, 18 nt, Human
uggguccugcucagagaa

SEQ ID NO: 697600 - RNA, 24 nt, Human
uggucagaaucuccccacaggacu

SEQ ID NO: 697601 - RNA, 19 nt, Human
uggugacuaauuaaucugc

SEQ ID NO: 697602 - RNA, 23 nt, Human
ugguggggaccgugguugucaug

SEQ ID NO: 697603 - RNA, 20 nt, Human
uguagucuuaucauuucucu

SEQ ID NO: 697604 - RNA, 18 nt, Human
ugucccagagaugcgagg

SEQ ID NO: 697605 - RNA, 20 nt, Human
ugucucacagcuguggaggc

SEQ ID NO: 697606 - RNA, 21 nt, Human
ugucuggaaggccuccugggg

SEQ ID NO: 697607 - RNA, 23 nt, Human
ugucuggaaggccuccugggggc

SEQ ID NO: 697608 - RNA, 20 nt, Human
uguggaggccggaaaucuga

SEQ ID NO: 697609 - RNA, 23 nt, Human
uuaaucugcaacgacuguguuuc

SEQ ID NO: 697610 - RNA, 23 nt, Human
uucucugagcacagggccuaagg

SEQ ID NO: 697611 - RNA, 19 nt, Human
uugcuuugucuccuuugcc

SEQ ID NO: 697612 - RNA, 25 nt, Human
uugggaggccgaggugggcggauca

SEQ ID NO: 697613 - RNA, 22 nt, Human
uuucugauucugaggucugguu

SEQ ID NO: 697614 - RNA, 18 nt, Human
agaaacuucauuuugcua

SEQ ID NO: 697615 - RNA, 22 nt, Human
agcucuucagguggggaggugg

SEQ ID NO: 697616 - RNA, 19 nt, Human
aggcaaaaggcacagaagg

SEQ ID NO: 697617 - RNA, 24 nt, Human
aggcaaaauggacacaccaucagg

SEQ ID NO: 697618 - RNA, 22 nt, Human
agguggggagguggaaacagug

SEQ ID NO: 697619 - RNA, 20 nt, Human
auaccaggcaaaauggacac

SEQ ID NO: 697620 - RNA, 18 nt, Human
caaaauggacacaccauc

SEQ ID NO: 697621 - RNA, 19 nt, Human
cacaccaucaggagauaag

SEQ ID NO: 697622 - RNA, 21 nt, Human
cagcaaugccugagucggcgc

SEQ ID NO: 697623 - RNA, 21 nt, Human
ccacaccugaaucccuuggcu

SEQ ID NO: 697624 - RNA, 23 nt, Human
ccagccucauacccgaacaccac

SEQ ID NO: 697625 - RNA, 24 nt, Human
ccaggcaaaauggacacaccauca

SEQ ID NO: 697626 - RNA, 18 nt, Human
ccucauacccgaacacca

SEQ ID NO: 697627 - RNA, 18 nt, Human
uaacucuuucagcaaugc

SEQ ID NO: 697628 - RNA, 24 nt, Human
uaccaggcaaaaggcacagaacaa

SEQ ID NO: 697629 - RNA, 25 nt, Human
uauaccaggcaaaaggcacagaaca

SEQ ID NO: 697630 - RNA, 23 nt, Human
ucagcaaugccugaguccucuuu

SEQ ID NO: 697631 - RNA, 24 nt, Human
ucauuuccuugggcgcuuccucag

SEQ ID NO: 697632 - RNA, 21 nt, Human
ucccagccucauacccgaaca

SEQ ID NO: 697633 - RNA, 19 nt, Human
uccucaguuucucaugaaa

SEQ ID NO: 697634 - RNA, 22 nt, Human
uccuugggcgcuuccucaguuc

SEQ ID NO: 697635 - RNA, 20 nt, Human
ugauugaauuauugaauacu

SEQ ID NO: 697636 - RNA, 18 nt, Human
uggcuuagucccagccuc

SEQ ID NO: 697637 - RNA, 18 nt, Human
ugggcgcuuccucaguuc

SEQ ID NO: 697638 - RNA, 21 nt, Human
uggggagguggaaacaguggc

SEQ ID NO: 697639 - RNA, 26 nt, Human
uguuucauuuccuugggcgcuuccuc

SEQ ID NO: 697640 - RNA, 24 nt, Human
uuaguccgagcucagaaccgaaag

SEQ ID NO: 697641 - RNA, 24 nt, Human
uuuuuuauuguuacauuuauugac

SEQ ID NO: 697642 - RNA, 24 nt, Human
aacauucugacacaaaugcacaaa

SEQ ID NO: 697643 - RNA, 19 nt, Human
aaccccacacauccagcuc

SEQ ID NO: 697644 - RNA, 20 nt, Human
aacuaaacauucugacacag

SEQ ID NO: 697645 - RNA, 24 nt, Human
aacuggcucuggcuuucuaacccc

SEQ ID NO: 697646 - RNA, 24 nt, Human
aagaaccccacacauccagcucga

SEQ ID NO: 697647 - RNA, 19 nt, Human
aaucccacuguccuuaccc

SEQ ID NO: 697648 - RNA, 19 nt, Human
acaccucacaguggaaugg

SEQ ID NO: 697649 - RNA, 20 nt, Human
acaguugucacuagaugcag

SEQ ID NO: 697650 - RNA, 21 nt, Human
accgaaaugaaaaggcucaca

SEQ ID NO: 697651 - RNA, 18 nt, Human
agaauuccucuccccacc

SEQ ID NO: 697652 - RNA, 19 nt, Human
agaauuccucuccccaccc

SEQ ID NO: 697653 - RNA, 18 nt, Human
agagggcagaagcagucc

SEQ ID NO: 697654 - RNA, 21 nt, Human
aguauagaagugaaaaagucc

SEQ ID NO: 697655 - RNA, 19 nt, Human
aucccacuguccuuaccca

SEQ ID NO: 697656 - RNA, 18 nt, Human
auucaagauuagcuagcc

SEQ ID NO: 697657 - RNA, 24 nt, Human
caaacuuuuggucuugacucuuga

SEQ ID NO: 697658 - RNA, 23 nt, Human
cacaaacauggguagacuuuuaa

SEQ ID NO: 697659 - RNA, 21 nt, Human
cacagaauuccucuccccacc

SEQ ID NO: 697660 - RNA, 23 nt, Human
cagaauuccucuccccacccucc

SEQ ID NO: 697661 - RNA, 20 nt, Human
cagagggcagaagcaguccu

SEQ ID NO: 697662 - RNA, 21 nt, Human
cagauggcggccaagaacccc

SEQ ID NO: 697663 - RNA, 18 nt, Human
cagcaggcaauccagaca

SEQ ID NO: 697664 - RNA, 25 nt, Human
caggaaaacauucaagauuagcuag

SEQ ID NO: 697665 - RNA, 26 nt, Human
ccacacauccagcucgaugucacaau

SEQ ID NO: 697666 - RNA, 20 nt, Human
cccaaucagauuaacaaacu

SEQ ID NO: 697667 - RNA, 23 nt, Human
cccacccuccagacacauugcac

SEQ ID NO: 697668 - RNA, 22 nt, Human
cccauauaaaccuggaggacac

SEQ ID NO: 697669 - RNA, 21 nt, Human
cccaucccaucuguaugagag

SEQ ID NO: 697670 - RNA, 22 nt, Human
ccuacacaacgaaaaaucagaa

SEQ ID NO: 697671 - RNA, 21 nt, Human
cucacagaauuccucucccca

SEQ ID NO: 697672 - RNA, 22 nt, Human
cucacagaauuccucuccccac

SEQ ID NO: 697673 - RNA, 18 nt, Human
cuuuuggucuugacucuu

SEQ ID NO: 697674 - RNA, 22 nt, Human
gaaaaaucagaacaguacacca

SEQ ID NO: 697675 - RNA, 20 nt, Human
gaaaugaaaaggcucacaga

SEQ ID NO: 697676 - RNA, 18 nt, Human
gcucuggcuuucuaaccc

SEQ ID NO: 697677 - RNA, 22 nt, Human
ggcacuggcaggcagagggcag

SEQ ID NO: 697678 - RNA, 22 nt, Human
ggucuugacucuugaaauaauu

SEQ ID NO: 697679 - RNA, 18 nt, Human
gugaccaggacacgugga

SEQ ID NO: 697680 - RNA, 21 nt, Human
gugguuguaccucauugguga

SEQ ID NO: 697681 - RNA, 24 nt, Human
guuggcaacauuaauuuugagaug

SEQ ID NO: 697682 - RNA, 18 nt, Human
uaaaaaaccacuauuagc

SEQ ID NO: 697683 - RNA, 18 nt, Human
uaaaccuggaggacacag

SEQ ID NO: 697684 - RNA, 22 nt, Human
uaacuucuggauccaccaugau

SEQ ID NO: 697685 - RNA, 19 nt, Human
uaagaaacaguagcugugg

SEQ ID NO: 697686 - RNA, 19 nt, Human
uaaggguucaaacauguuu

SEQ ID NO: 697687 - RNA, 21 nt, Human
uacaaaguauagaagugaaaa

SEQ ID NO: 697688 - RNA, 23 nt, Human
uacaaaguauagaagugaaaaag

SEQ ID NO: 697689 - RNA, 23 nt, Human
uacacaacgaaaaaucagaacag

SEQ ID NO: 697690 - RNA, 20 nt, Human
ucaggaagggaaaucugccc

SEQ ID NO: 697691 - RNA, 19 nt, Human
uccacugugcaccggcugc

SEQ ID NO: 697692 - RNA, 23 nt, Human
uccacugugcaccggcugccuga

SEQ ID NO: 697693 - RNA, 18 nt, Human
uccagcucgaugucacaa

SEQ ID NO: 697694 - RNA, 20 nt, Human
ucccauauaaaccuggagga

SEQ ID NO: 697695 - RNA, 22 nt, Human
ucucuucugucaccgaaaugaa

SEQ ID NO: 697696 - RNA, 18 nt, Human
ugaaaggcuugggauggu

SEQ ID NO: 697697 - RNA, 25 nt, Human
ugaagaaaagcuuuggaggaguaga

SEQ ID NO: 697698 - RNA, 24 nt, Human
ugaccaggacacguggacucugac

SEQ ID NO: 697699 - RNA, 21 nt, Human
ugagcaaacuuuuggucuuga

SEQ ID NO: 697700 - RNA, 23 nt, Human
ugcaagcgauuuuaaauccccac

SEQ ID NO: 697701 - RNA, 23 nt, Human
ugcucugcccaucucuucuguca

SEQ ID NO: 697702 - RNA, 18 nt, Human
ugcugagcaaacuuuugg

SEQ ID NO: 697703 - RNA, 19 nt, Human
ugcuucccaaaugcacaau

SEQ ID NO: 697704 - RNA, 26 nt, Human
uggaauggucaaacaauuuaagucaa

SEQ ID NO: 697705 - RNA, 21 nt, Human
uggaggaguagaggaggcaag

SEQ ID NO: 697706 - RNA, 23 nt, Human
uggaggaguagaggaggcaaguu

SEQ ID NO: 697707 - RNA, 23 nt, Human
uggguagacuuuuaaaagccaug

SEQ ID NO: 697708 - RNA, 19 nt, Human
ugucaccgaaaugaaaagg

SEQ ID NO: 697709 - RNA, 21 nt, Human
uguggaaaauaaguugcucug

SEQ ID NO: 697710 - RNA, 21 nt, Human
uucccauauaaaccuggagga

SEQ ID NO: 697711 - RNA, 26 nt, Human
uuguucagcuuugcucuuacugugcu

SEQ ID NO: 697712 - RNA, 26 nt, Human
uuugagauguagugugaugcugagca

SEQ ID NO: 697713 - RNA, 18 nt, Human
uuugauguuuucacauac

SEQ ID NO: 697714 - RNA, 21 nt, Human
aaaugacaauaaaauuggagc

SEQ ID NO: 697715 - RNA, 23 nt, Human
caauaaaauuggagcugagacca

SEQ ID NO: 697716 - RNA, 26 nt, Human
cagaucagacauuuuguaaugaugcc

SEQ ID NO: 697717 - RNA, 20 nt, Human
cagggcugcugcaccgagcc

SEQ ID NO: 697718 - RNA, 20 nt, Human
cagggcugcugcaccgagcc

SEQ ID NO: 697719 - RNA, 23 nt, Human
cccugcguggguuggggcuccac

SEQ ID NO: 697720 - RNA, 20 nt, Human
gacaauaaaauuggagcuga

SEQ ID NO: 697721 - RNA, 21 nt, Human
gacaauaaaauuggagcugag

SEQ ID NO: 697722 - RNA, 19 nt, Human
gagcugagaccaagaagaa

SEQ ID NO: 697723 - RNA, 24 nt, Human
gaucagacauuuuguaaugaugcc

SEQ ID NO: 697724 - RNA, 18 nt, Human
gguuggggcuccacuccu

SEQ ID NO: 697725 - RNA, 22 nt, Human
uaaccaccucgacaagcaacag

SEQ ID NO: 697726 - RNA, 24 nt, Human
uaaccaccucgacaagcaacaggu

SEQ ID NO: 697727 - RNA, 23 nt, Human
uacagcagaggucggacacgaaa

SEQ ID NO: 697728 - RNA, 22 nt, Human
uauccuuauugaugaaaaugac

SEQ ID NO: 697729 - RNA, 19 nt, Human
uccuuugcagggcugcugc

SEQ ID NO: 697730 - RNA, 21 nt, Human
ugaaauaaacacuaaccaccu

SEQ ID NO: 697731 - RNA, 23 nt, Human
ugaaauaaacacuaaccaccucg

SEQ ID NO: 697732 - RNA, 22 nt, Human
uggcagagauguguauccuuau

SEQ ID NO: 697733 - RNA, 20 nt, Human
uggguuggggcuccacuccu

SEQ ID NO: 697734 - RNA, 24 nt, Human
uguaaugaugccugaaauaaacac

SEQ ID NO: 697735 - RNA, 18 nt, Human
uuccuggugaguccguuc

SEQ ID NO: 697736 - RNA, 20 nt, Human
uuccuggugaguccguucaa

SEQ ID NO: 697737 - RNA, 19 nt, Human
uuggagcugagaccaagaa

SEQ ID NO: 697738 - RNA, 21 nt, Human
uuggagcugagaccaagaaga

SEQ ID NO: 697739 - RNA, 20 nt, Human
uuuguaaugaugccugaaau

SEQ ID NO: 697740 - RNA, 24 nt, Human
uuuuuuuuuuuuucuuucucuuuu

SEQ ID NO: 697741 - RNA, 19 nt, Human
aaacauacaaauacagagg

SEQ ID NO: 697742 - RNA, 23 nt, Human
aaaccaaaagauggaaaggcaga

SEQ ID NO: 697743 - RNA, 25 nt, Human
aaagauacacaauacugaaucugca

SEQ ID NO: 697744 - RNA, 20 nt, Human
acaguacaacaucaaucauu

SEQ ID NO: 697745 - RNA, 18 nt, Human
accaaaagauggaaaggc

SEQ ID NO: 697746 - RNA, 21 nt, Human
agacagauggcaccggccaga

SEQ ID NO: 697747 - RNA, 19 nt, Human
aucaugaacuacucugaac

SEQ ID NO: 697748 - RNA, 22 nt, Human
caacuuuauuggcaaaaaagaa

SEQ ID NO: 697749 - RNA, 21 nt, Human
ccuccagaaucagcauaggaa

SEQ ID NO: 697750 - RNA, 23 nt, Human
cuaguucauccaaauccucucca

SEQ ID NO: 697751 - RNA, 18 nt, Human
cugcggcaggacgaggag

SEQ ID NO: 697752 - RNA, 24 nt, Human
gauacacaauacugaaucugcaua

SEQ ID NO: 697753 - RNA, 18 nt, Human
gauggcaccggccagacu

SEQ ID NO: 697754 - RNA, 20 nt, Human
gcauaggaaauaaacauccu

SEQ ID NO: 697755 - RNA, 23 nt, Human
gcggagcugcgcgugcgcgccac

SEQ ID NO: 697756 - RNA, 24 nt, Human
ggcauuguagcugauccugucaga

SEQ ID NO: 697757 - RNA, 22 nt, Human
gggaaacuuuuaaacaauuuaa

SEQ ID NO: 697758 - RNA, 23 nt, Human
uacacaauacugaaucugcauac

SEQ ID NO: 697759 - RNA, 18 nt, Human
ucacucauuaaaaacugu

SEQ ID NO: 697760 - RNA, 21 nt, Human
uccaaagauacacaauacuga

SEQ ID NO: 697761 - RNA, 19 nt, Human
uccaucuaauuguccaaag

SEQ ID NO: 697762 - RNA, 23 nt, Human
ucugcauacgcaguuuccuuuau

SEQ ID NO: 697763 - RNA, 21 nt, Human
ugacuuaauuuuuucagcgag

SEQ ID NO: 697764 - RNA, 22 nt, Human
ugagauguagccaaagucagaa

SEQ ID NO: 697765 - RNA, 18 nt, Human
uggcaaaaaagaaaaggg

SEQ ID NO: 697766 - RNA, 21 nt, Human
uguagggacaagaugccuuuu

SEQ ID NO: 697767 - RNA, 20 nt, Human
ugucagauaaaagaaguucc

SEQ ID NO: 697768 - RNA, 24 nt, Human
uuuauuggcaaaaaagaaaaggga

SEQ ID NO: 697769 - RNA, 19 nt, Human
uuuuuuuuuuuuuuuuuaa

SEQ ID NO: 697770 - RNA, 21 nt, Human
aagcaacguuucaggcagcuu

SEQ ID NO: 697771 - RNA, 22 nt, Human
acacagcgagacaaacuggaac

SEQ ID NO: 697772 - RNA, 19 nt, Human
aggcaggaagcuaaucagc

SEQ ID NO: 697773 - RNA, 18 nt, Human
caaagcaacguuucaggc

SEQ ID NO: 697774 - RNA, 19 nt, Human
caucacacgucucuacccc

SEQ ID NO: 697775 - RNA, 22 nt, Human
caugccagaaacacaacaccca

SEQ ID NO: 697776 - RNA, 19 nt, Human
cauuuggggccacagaauc

SEQ ID NO: 697777 - RNA, 19 nt, Human
ccagaaacacaacacccau

SEQ ID NO: 697778 - RNA, 22 nt, Human
ccagaaacacaacacccaucau

SEQ ID NO: 697779 - RNA, 24 nt, Human
ccccaggaccucuagcuguucugu

SEQ ID NO: 697780 - RNA, 21 nt, Human
ccuagaagaauacaaagcaac

SEQ ID NO: 697781 - RNA, 22 nt, Human
ggccacagaauccauuguggag

SEQ ID NO: 697782 - RNA, 20 nt, Human
guaauaaugaaggcuuucac

SEQ ID NO: 697783 - RNA, 18 nt, Human
uaaaccauuagcuuaugc

SEQ ID NO: 697784 - RNA, 25 nt, Human
uaaaccauuagcuuaugccuacaca

SEQ ID NO: 697785 - RNA, 27 nt, Human
uaccccagggucucucaacuuuggcac

SEQ ID NO: 697786 - RNA, 20 nt, Human
uauagcacuucguccagcac

SEQ ID NO: 697787 - RNA, 21 nt, Human
ugaaugaucuucuagacaguu

SEQ ID NO: 697788 - RNA, 24 nt, Human
ugcaaauaaaucauuaaaaagaua

SEQ ID NO: 697789 - RNA, 24 nt, Human
uggcacuauuaacauuuggggcca

SEQ ID NO: 697790 - RNA, 18 nt, Human
uggggccacagaauccau

SEQ ID NO: 697791 - RNA, 22 nt, Human
uguugugaugugcuuuuuuucu

SEQ ID NO: 697792 - RNA, 20 nt, Human
uuccuagaagaauacaaagc

SEQ ID NO: 697793 - RNA, 26 nt, Human
aagaaggaggacacaaagggcgaaga

SEQ ID NO: 697794 - RNA, 27 nt, Human
aagaaggaggacacaaagggcgaagaa

SEQ ID NO: 697795 - RNA, 19 nt, Human
aagaggccgggagucaggc

SEQ ID NO: 697796 - RNA, 22 nt, Human
aagaggccgggagucaggcgag

SEQ ID NO: 697797 - RNA, 22 nt, Human
agagcuggaaaguccagaaguu

SEQ ID NO: 697798 - RNA, 23 nt, Human
agccuuugggcuuugcgcaagaa

SEQ ID NO: 697799 - RNA, 20 nt, Human
agcuggaaaguccagaaguu

SEQ ID NO: 697800 - RNA, 22 nt, Human
cccgcacccuucuccgccccua

SEQ ID NO: 697801 - RNA, 21 nt, Human
cccggugguccgcgauuugcu

SEQ ID NO: 697802 - RNA, 19 nt, Human
ccgcacccuucuccgcccc

SEQ ID NO: 697803 - RNA, 19 nt, Human
ccgcacccuucuccgcccc

SEQ ID NO: 697804 - RNA, 21 nt, Human
ccuuugggcuuugcgcaagaa

SEQ ID NO: 697805 - RNA, 22 nt, Human
gaacgaacuucggaagagcugg

SEQ ID NO: 697806 - RNA, 18 nt, Human
gcgcaagaggccgggagu

SEQ ID NO: 697807 - RNA, 21 nt, Human
ugaaagaaggaggacacaaag

SEQ ID NO: 697808 - RNA, 22 nt, Human
ugaaagaaggaggacacaaagg

SEQ ID NO: 697809 - RNA, 22 nt, Human
uggaaaguccagaaguuaguga

SEQ ID NO: 697810 - RNA, 25 nt, Human
uggaaaguccagaaguuagugaaag

SEQ ID NO: 697811 - RNA, 18 nt, Human
uuuuuuuuuuuuuuucug

SEQ ID NO: 697812 - RNA, 25 nt, Human
uuuuuuuuuuuuuuuuucugguuuu

SEQ ID NO: 697813 - RNA, 25 nt, Human
uuuuuuuuuuuuuuuuuucugguuu

SEQ ID NO: 697814 - RNA, 26 nt, Human
uuuuuuuuuuuuuuuuuuucugguuu

SEQ ID NO: 697815 - RNA, 22 nt, Human
uuuuuuuuuuuuuuuuuuuucu

SEQ ID NO: 697816 - RNA, 22 nt, Human
aaaacaaaaacaaaaacaaaaa

SEQ ID NO: 697817 - RNA, 27 nt, Human
aaaacaaaaacaaaaacaaaaaaacaa

SEQ ID NO: 697818 - RNA, 22 nt, Human
aaacaagucacacaacaaucuu

SEQ ID NO: 697819 - RNA, 20 nt, Human
aacaaugagaggggaaagga

SEQ ID NO: 697820 - RNA, 19 nt, Human
aagucuggcaaggauuuau

SEQ ID NO: 697821 - RNA, 23 nt, Human
acaaagcaacaugacacuuggaa

SEQ ID NO: 697822 - RNA, 22 nt, Human
acauuaaggaauuuccaagggg

SEQ ID NO: 697823 - RNA, 20 nt, Human
acugccagaugccacccagc

SEQ ID NO: 697824 - RNA, 24 nt, Human
agaaaguuuccuauagcccacaaa

SEQ ID NO: 697825 - RNA, 21 nt, Human
agaugccacccagcccaagac

SEQ ID NO: 697826 - RNA, 18 nt, Human
agguuucugcagcaagcc

SEQ ID NO: 697827 - RNA, 23 nt, Human
agugaauaaaagccaugaaaaga

SEQ ID NO: 697828 - RNA, 24 nt, Human
auaaaagccaugaaaagaagaacu

SEQ ID NO: 697829 - RNA, 24 nt, Human
caaaaacaaaaaaacaagucacac

SEQ ID NO: 697830 - RNA, 30 nt, Human
caagccccaaagacaaagcuuggcagaggg

SEQ ID NO: 697831 - RNA, 22 nt, Human
cagaaaguuuccuauagcccac

SEQ ID NO: 697832 - RNA, 21 nt, Human
cagacaacuccaagcugggca

SEQ ID NO: 697833 - RNA, 19 nt, Human
cagcaagccccaaagacaa

SEQ ID NO: 697834 - RNA, 19 nt, Human
cagcaagccccaaagacaa

SEQ ID NO: 697835 - RNA, 24 nt, Human
cagcaagccccaaagacaaagcuu

SEQ ID NO: 697836 - RNA, 22 nt, Human
cagccaacucucucuggagccu

SEQ ID NO: 697837 - RNA, 20 nt, Human
cagcgccucuaugggagccu

SEQ ID NO: 697838 - RNA, 24 nt, Human
ccaaagacaaagcuuggcagaggc

SEQ ID NO: 697839 - RNA, 22 nt, Human
ccacaaauaguuuccuuuaaaa

SEQ ID NO: 697840 - RNA, 24 nt, Human
ccacacacauagaaaugaucccca

SEQ ID NO: 697841 - RNA, 19 nt, Human
ccacagcgcccuagagaac

SEQ ID NO: 697842 - RNA, 18 nt, Human
ccacccagcccaagaccc

SEQ ID NO: 697843 - RNA, 19 nt, Human
ccaguggugucguaucuuc

SEQ ID NO: 697844 - RNA, 18 nt, Human
cccacacacauagaaauu

SEQ ID NO: 697845 - RNA, 18 nt, Human
ccgccgcgcucgcucggc

SEQ ID NO: 697846 - RNA, 19 nt, Human
ccgccgcgcucgcucggcu

SEQ ID NO: 697847 - RNA, 22 nt, Human
ccuuuaaaaaaacaaaaacaaa

SEQ ID NO: 697848 - RNA, 19 nt, Human
cgcgccgcgccugccgccc

SEQ ID NO: 697849 - RNA, 20 nt, Human
cuauaaccacaggacacaug

SEQ ID NO: 697850 - RNA, 20 nt, Human
cuccccagacugcuuagcua

SEQ ID NO: 697851 - RNA, 24 nt, Human
cuuuaaaaaaacaaaaacaaaaac

SEQ ID NO: 697852 - RNA, 26 nt, Human
cuuuaaaaaaacaaaaacaaaaacaa

SEQ ID NO: 697853 - RNA, 24 nt, Human
gaaaugauccccaugcucucccca

SEQ ID NO: 697854 - RNA, 24 nt, Human
gcccaagacccaauuuccacagcg

SEQ ID NO: 697855 - RNA, 23 nt, Human
gccucaucccuuuguccuuccca

SEQ ID NO: 697856 - RNA, 18 nt, Human
gcgccgcgccugccgccc

SEQ ID NO: 697857 - RNA, 22 nt, Human
gcgccucuaugggagccuuggc

SEQ ID NO: 697858 - RNA, 22 nt, Human
ggggaaucuuaacuaagucuca

SEQ ID NO: 697859 - RNA, 21 nt, Human
guggaaaagaccuucucccca

SEQ ID NO: 697860 - RNA, 24 nt, Human
uacccacacacauagaaaugaucc

SEQ ID NO: 697861 - RNA, 24 nt, Human
uagucacagugaauaaaagccaug

SEQ ID NO: 697862 - RNA, 25 nt, Human
uauaaccacaggacacaugugcgug

SEQ ID NO: 697863 - RNA, 20 nt, Human
ucacacaacaaucuugccac

SEQ ID NO: 697864 - RNA, 23 nt, Human
ucacacaacaaucuugccacaaa

SEQ ID NO: 697865 - RNA, 22 nt, Human
uccaugacugccagaugccacc

SEQ ID NO: 697866 - RNA, 19 nt, Human
uccccaagcuuaagcuauc

SEQ ID NO: 697867 - RNA, 23 nt, Human
ucggccccaccgccgcgcucgcu

SEQ ID NO: 697868 - RNA, 18 nt, Human
ucuggagccucaucccuu

SEQ ID NO: 697869 - RNA, 23 nt, Human
ucuggcaaggauuuauuaggaag

SEQ ID NO: 697870 - RNA, 19 nt, Human
ugauccccaugcucucccc

SEQ ID NO: 697871 - RNA, 19 nt, Human
uggaaaagcaaguguuauc

SEQ ID NO: 697872 - RNA, 25 nt, Human
uggagccucaucccuuuguccuucc

SEQ ID NO: 697873 - RNA, 21 nt, Human
uggcaaggauuuauuaggaag

SEQ ID NO: 697874 - RNA, 25 nt, Human
ugguccccuggcaccuacacaaccc

SEQ ID NO: 697875 - RNA, 24 nt, Human
uuagcuaggcaguggaaaagaccu

SEQ ID NO: 697876 - RNA, 21 nt, Human
uuccuuuaaaaaaacaaaaac

SEQ ID NO: 697877 - RNA, 21 nt, Human
uuggcagaggcuguggcagcc

SEQ ID NO: 697878 - RNA, 24 nt, Human
uuucugcagcaagccccaaagaca

SEQ ID NO: 697879 - RNA, 19 nt, Human
aaagcaaauucaugaccuu

SEQ ID NO: 697880 - RNA, 20 nt, Human
aauuccuaaaguuccugcaa

SEQ ID NO: 697881 - RNA, 20 nt, Human
agauaaucgaagaauaugaa

SEQ ID NO: 697882 - RNA, 18 nt, Human
cagcuuuauuaaacaggc

SEQ ID NO: 697883 - RNA, 18 nt, Human
caugugacuugccaguaa

SEQ ID NO: 697884 - RNA, 24 nt, Human
ccaaaacugcaggcaacucaucug

SEQ ID NO: 697885 - RNA, 24 nt, Human
ccuccaaaacugcaggcaacucau

SEQ ID NO: 697886 - RNA, 19 nt, Human
cucugaaggccuccaaaac

SEQ ID NO: 697887 - RNA, 21 nt, Human
cugcaauaaccuacauacacc

SEQ ID NO: 697888 - RNA, 22 nt, Human
gcccgagcccgccucugagccc

SEQ ID NO: 697889 - RNA, 19 nt, Human
ggcuuaaaagguuaaagug

SEQ ID NO: 697890 - RNA, 18 nt, Human
uaaagacacuggaccgac

SEQ ID NO: 697891 - RNA, 27 nt, Human
uaucuucacugucacuuaggagauaau

SEQ ID NO: 697892 - RNA, 18 nt, Human
ucacugucacuuaggaga

SEQ ID NO: 697893 - RNA, 21 nt, Human
ucugaaggccuccaaaacugc

SEQ ID NO: 697894 - RNA, 18 nt, Human
uggguuugguagaaagca

SEQ ID NO: 697895 - RNA, 22 nt, Human
uucguguuuaacacaucuaugg

SEQ ID NO: 697896 - RNA, 28 nt, Human
uuuaacacaucuauggguuugguagaaa

SEQ ID NO: 697897 - RNA, 19 nt, Human
aaaacggaguguuacaagc

SEQ ID NO: 697898 - RNA, 23 nt, Human
acccagcugcgaggggcaagacu

SEQ ID NO: 697899 - RNA, 23 nt, Human
agaagccagaaauuuuugcagcc

SEQ ID NO: 697900 - RNA, 22 nt, Human
agagcucccccauccggauccc

SEQ ID NO: 697901 - RNA, 27 nt, Human
agcacccaccccacccccaacuucuac

SEQ ID NO: 697902 - RNA, 22 nt, Human
agcccggagcucgccuuggugc

SEQ ID NO: 697903 - RNA, 19 nt, Human
aguuggucugagcccggag

SEQ ID NO: 697904 - RNA, 21 nt, Human
caccccacccccaacuucuac

SEQ ID NO: 697905 - RNA, 21 nt, Human
cacuuccggccccucugggag

SEQ ID NO: 697906 - RNA, 24 nt, Human
cagaaauuuuugcagccagcaccc

SEQ ID NO: 697907 - RNA, 19 nt, Human
cagcacccaccccaccccc

SEQ ID NO: 697908 - RNA, 18 nt, Human
cagccagcacccacccca

SEQ ID NO: 697909 - RNA, 25 nt, Human
ccacugccacuuccggccccucugg

SEQ ID NO: 697910 - RNA, 21 nt, Human
ccccaguccugcugccgucuu

SEQ ID NO: 697911 - RNA, 21 nt, Human
cccucccuccacugccacuuc

SEQ ID NO: 697912 - RNA, 19 nt, Human
cccugcuucagaggaggcc

SEQ ID NO: 697913 - RNA, 23 nt, Human
cccugcuucagaggaggccuggg

SEQ ID NO: 697914 - RNA, 21 nt, Human
cccugugggcccgggccucac

SEQ ID NO: 697915 - RNA, 20 nt, Human
cccuucucacuguacacagc

SEQ ID NO: 697916 - RNA, 19 nt, Human
ccggagcucgccuuggugc

SEQ ID NO: 697917 - RNA, 28 nt, Human
ccugugacucgggggaaaaccggggucc

SEQ ID NO: 697918 - RNA, 21 nt, Human
cgagcccuagguggaaacccc

SEQ ID NO: 697919 - RNA, 24 nt, Human
cgcgacccagcugcgaggggcaag

SEQ ID NO: 697920 - RNA, 18 nt, Human
cucacuguacacagcugc

SEQ ID NO: 697921 - RNA, 22 nt, Human
cuccacugccacuuccggcccc

SEQ ID NO: 697922 - RNA, 20 nt, Human
cucccuccacugccacuucc

SEQ ID NO: 697923 - RNA, 22 nt, Human
cucccuccacugccacuuccgg

SEQ ID NO: 697924 - RNA, 18 nt, Human
cucuguacagagcucccc

SEQ ID NO: 697925 - RNA, 19 nt, Human
cugaccuuggaguuggucu

SEQ ID NO: 697926 - RNA, 18 nt, Human
cuuugagagacaccgcga

SEQ ID NO: 697927 - RNA, 19 nt, Human
gcccugugggcccgggccc

SEQ ID NO: 697928 - RNA, 24 nt, Human
gcccugugggcccgggccucacga

SEQ ID NO: 697929 - RNA, 21 nt, Human
ggccgagcccuagguggaaac

SEQ ID NO: 697930 - RNA, 25 nt, Human
uacaaaagaaauuuuuacaaucacc

SEQ ID NO: 697931 - RNA, 20 nt, Human
ucagaggaggccugggcugu

SEQ ID NO: 697932 - RNA, 18 nt, Human
ucccccauccggaucccu

SEQ ID NO: 697933 - RNA, 21 nt, Human
ucccuuagagugcuuuguggg

SEQ ID NO: 697934 - RNA, 24 nt, Human
ucccuuagagugcuuugugggagc

SEQ ID NO: 697935 - RNA, 20 nt, Human
ugagagacaccgcgacccag

SEQ ID NO: 697936 - RNA, 24 nt, Human
uggcauauagaaacaauuuauugc

SEQ ID NO: 697937 - RNA, 23 nt, Human
uggccagcugaccuuggaguugg

SEQ ID NO: 697938 - RNA, 23 nt, Human
ugggggcggggugggcuaucagc

SEQ ID NO: 697939 - RNA, 22 nt, Human
uugugggagcugcagugggggc

SEQ ID NO: 697940 - RNA, 24 nt, Human
agcacuuuuguaacucagagacau

SEQ ID NO: 697941 - RNA, 20 nt, Human
agccaguggcaucggaaccg

SEQ ID NO: 697942 - RNA, 22 nt, Human
cacgacgcagcaggagcagggc

SEQ ID NO: 697943 - RNA, 21 nt, Human
cagcccccggccccggguccu

SEQ ID NO: 697944 - RNA, 23 nt, Human
ccacaccccagaaauuuugauuc

SEQ ID NO: 697945 - RNA, 19 nt, Human
ccaggcucugaaccacuga

SEQ ID NO: 697946 - RNA, 21 nt, Human
cccacaccccagaaauuuuga

SEQ ID NO: 697947 - RNA, 19 nt, Human
cccccggccccggguccuc

SEQ ID NO: 697948 - RNA, 19 nt, Human
cccggccccggguccucac

SEQ ID NO: 697949 - RNA, 20 nt, Human
ccgccgcgcucagcgccgca

SEQ ID NO: 697950 - RNA, 23 nt, Human
cgauuuggugauggguguuaagg

SEQ ID NO: 697951 - RNA, 19 nt, Human
cgccagagcagccgccgcc

SEQ ID NO: 697952 - RNA, 24 nt, Human
cucagcgccgcaggcccggccauc

SEQ ID NO: 697953 - RNA, 21 nt, Human
gcucauuugcacggucauaag

SEQ ID NO: 697954 - RNA, 22 nt, Human
gcucauuugcacggucauaaga

SEQ ID NO: 697955 - RNA, 19 nt, Human
ggugauggguguuaagguu

SEQ ID NO: 697956 - RNA, 21 nt, Human
uaaacaaagaaaauuacagau

SEQ ID NO: 697957 - RNA, 18 nt, Human
uauugugcccacacccca

SEQ ID NO: 697958 - RNA, 24 nt, Human
ucaggggaaguauaaacaaagaaa

SEQ ID NO: 697959 - RNA, 18 nt, Human
uccucacgacgcagcagg

SEQ ID NO: 697960 - RNA, 23 nt, Human
uccucacgacgcagcaggagcug

SEQ ID NO: 697961 - RNA, 22 nt, Human
ucugaaccacugaugcagagca

SEQ ID NO: 697962 - RNA, 20 nt, Human
ucuuuauuccuuuauuuaau

SEQ ID NO: 697963 - RNA, 22 nt, Human
ugaauuagcacuuuuguaacuc

SEQ ID NO: 697964 - RNA, 27 nt, Human
ugacaaaucuuuauuuuuccaaagcuc

SEQ ID NO: 697965 - RNA, 22 nt, Human
ugcagacaagcauuucaaagca

SEQ ID NO: 697966 - RNA, 18 nt, Human
ugcccacaccccagaaau

SEQ ID NO: 697967 - RNA, 19 nt, Human
uggggccagcccccggccc

SEQ ID NO: 697968 - RNA, 22 nt, Human
uguuuacuuacacaauuacaug

SEQ ID NO: 697969 - RNA, 19 nt, Human
uuagacccugaaauuaccg

SEQ ID NO: 697970 - RNA, 24 nt, Human
uugagauagggcugacaaaucuuu

SEQ ID NO: 697971 - RNA, 18 nt, Human
uuuuuuuuuuuuuuuuug

SEQ ID NO: 697972 - RNA, 23 nt, Human
uuuuuuuuuuuuuuuuuggaguu

SEQ ID NO: 697973 - RNA, 26 nt, Human
aagaggccgaaaugacgcugguggga

SEQ ID NO: 697974 - RNA, 19 nt, Human
accgcgcucugcucgcgcc

SEQ ID NO: 697975 - RNA, 22 nt, Human
aggacucucccuaaaaagcaag

SEQ ID NO: 697976 - RNA, 26 nt, Human
aguauccaguuuacuugcauuguaac

SEQ ID NO: 697977 - RNA, 23 nt, Human
ccccccggcccgccuccccgcug

SEQ ID NO: 697978 - RNA, 20 nt, Human
cccccggcccgccuccccgc

SEQ ID NO: 697979 - RNA, 24 nt, Human
cccgccuccccgcugccggggccg

SEQ ID NO: 697980 - RNA, 18 nt, Human
cccgcugcgccccagcag

SEQ ID NO: 697981 - RNA, 23 nt, Human
cccuaaaaagcaaguuuaaggga

SEQ ID NO: 697982 - RNA, 20 nt, Human
ccgccgccccccggcccgcc

SEQ ID NO: 697983 - RNA, 20 nt, Human
cugcucgcgccccgccgccc

SEQ ID NO: 697984 - RNA, 19 nt, Human
gcccgccuccccgcugcgc

SEQ ID NO: 697985 - RNA, 21 nt, Human
gccuccccgcugcgccccagc

SEQ ID NO: 697986 - RNA, 21 nt, Human
gcucgcgccccgccgcccccc

SEQ ID NO: 697987 - RNA, 23 nt, Human
uacccugaagcacaggcaaaugu

SEQ ID NO: 697988 - RNA, 18 nt, Human
uagcucaggagcaggguu

SEQ ID NO: 697989 - RNA, 22 nt, Human
uccuaccacuaugcacauguuc

SEQ ID NO: 697990 - RNA, 20 nt, Human
ucgcgccccgccgccccccc

SEQ ID NO: 697991 - RNA, 20 nt, Human
ugacaaaagaacaaguaucc

SEQ ID NO: 697992 - RNA, 21 nt, Human
ugagcagagaaagggagguca

SEQ ID NO: 697993 - RNA, 20 nt, Human
ugcauuuaacaaaucugaca

SEQ ID NO: 697994 - RNA, 22 nt, Human
aaaaaaaauggggagacucuac

SEQ ID NO: 697995 - RNA, 19 nt, Human
aaaaaagagauugacaaga

SEQ ID NO: 697996 - RNA, 22 nt, Human
aaccacacagaaauacagacaa

SEQ ID NO: 697997 - RNA, 20 nt, Human
aagaaacagccaggccaccu

SEQ ID NO: 697998 - RNA, 25 nt, Human
aagaggcagaucacagaauaccagg

SEQ ID NO: 697999 - RNA, 19 nt, Human
aauacagagaagcagagga

SEQ ID NO: 698000 - RNA, 22 nt, Human
aaucuccaaacaucucaaaaca

SEQ ID NO: 698001 - RNA, 18 nt, Human
aauggcagcaagaggcag

SEQ ID NO: 698002 - RNA, 22 nt, Human
acacgccaugaaccacaccccu

SEQ ID NO: 698003 - RNA, 21 nt, Human
acagauacugguucuguucaa

SEQ ID NO: 698004 - RNA, 19 nt, Human
agaaauacagacaaucaag

SEQ ID NO: 698005 - RNA, 19 nt, Human
agaagaaaaauacagagaa

SEQ ID NO: 698006 - RNA, 23 nt, Human
agacaaucaagugaaccugagca

SEQ ID NO: 698007 - RNA, 18 nt, Human
agagaagcagaggagaga

SEQ ID NO: 698008 - RNA, 19 nt, Human
agagauuagggggaaaagg

SEQ ID NO: 698009 - RNA, 20 nt, Human
agagauugacaagaaauuga

SEQ ID NO: 698010 - RNA, 21 nt, Human
agaggccagagucaggaggcg

SEQ ID NO: 698011 - RNA, 18 nt, Human
agauuagggggaaaaggu

SEQ ID NO: 698012 - RNA, 21 nt, Human
agcugcuuucuuucacuuuuu

SEQ ID NO: 698013 - RNA, 21 nt, Human
aggaaaaaaagagauugacaa

SEQ ID NO: 698014 - RNA, 18 nt, Human
aggagagaaagaauggca

SEQ ID NO: 698015 - RNA, 20 nt, Human
aggcgggacucgaacccgcc

SEQ ID NO: 698016 - RNA, 23 nt, Human
aggugccccuggucgaggagagg

SEQ ID NO: 698017 - RNA, 18 nt, Human
agugggagggagugcucu

SEQ ID NO: 698018 - RNA, 18 nt, Human
augaagcccaaaguacgc

SEQ ID NO: 698019 - RNA, 24 nt, Human
augcagcccgcccgggacucaggg

SEQ ID NO: 698020 - RNA, 26 nt, Human
auggagaccaucgaugaauguucagu

SEQ ID NO: 698021 - RNA, 26 nt, Human
caaaauaaaguacccaaguuacaaaa

SEQ ID NO: 698022 - RNA, 20 nt, Human
caaccacacagaaauacaga

SEQ ID NO: 698023 - RNA, 25 nt, Human
caaucaagugaaccugagcaccccc

SEQ ID NO: 698024 - RNA, 24 nt, Human
cacacagaaauacagacaaucaag

SEQ ID NO: 698025 - RNA, 21 nt, Human
cacugugcugggacugcagau

SEQ ID NO: 698026 - RNA, 20 nt, Human
cagacaucacacccucaaag

SEQ ID NO: 698027 - RNA, 22 nt, Human
cagacccaggccucucauucca

SEQ ID NO: 698028 - RNA, 22 nt, Human
cagcaagaggcagaucacagaa

SEQ ID NO: 698029 - RNA, 22 nt, Human
caggagacagacccaggccucu

SEQ ID NO: 698030 - RNA, 21 nt, Human
cagggaacaccuaguccaaac

SEQ ID NO: 698031 - RNA, 19 nt, Human
cauagcuacagacaucaca

SEQ ID NO: 698032 - RNA, 21 nt, Human
ccaaaaccaucacauacccca

SEQ ID NO: 698033 - RNA, 20 nt, Human
ccaaaauacauaguuuaugg

SEQ ID NO: 698034 - RNA, 20 nt, Human
ccaaaguacgccgucgcccc

SEQ ID NO: 698035 - RNA, 22 nt, Human
ccaaaguacgccgucgccccug

SEQ ID NO: 698036 - RNA, 28 nt, Human
ccacacagaaauacagacaacgucaccg

SEQ ID NO: 698037 - RNA, 22 nt, Human
cccacuguucagugaaacuguu

SEQ ID NO: 698038 - RNA, 18 nt, Human
ccccuggucgaguagagg

SEQ ID NO: 698039 - RNA, 19 nt, Human
ccucacccacuaccuccuc

SEQ ID NO: 698040 - RNA, 19 nt, Human
ccuggucgaguagaggugc

SEQ ID NO: 698041 - RNA, 25 nt, Human
ccuuugguucaugaucacaccacuu

SEQ ID NO: 698042 - RNA, 18 nt, Human
cgaacccgccacacggcg

SEQ ID NO: 698043 - RNA, 20 nt, Human
cgggaggaacugcguaagcg

SEQ ID NO: 698044 - RNA, 20 nt, Human
cucaaagugaagucaaacug

SEQ ID NO: 698045 - RNA, 25 nt, Human
cugcugggucaacacgccaugaacc

SEQ ID NO: 698046 - RNA, 19 nt, Human
gacaauggccucuaaucug

SEQ ID NO: 698047 - RNA, 21 nt, Human
gagaagcagaggagagaaaga

SEQ ID NO: 698048 - RNA, 18 nt, Human
gagcaaggaaaaaaagag

SEQ ID NO: 698049 - RNA, 24 nt, Human
gaguccuugcuacaaccacacaga

SEQ ID NO: 698050 - RNA, 23 nt, Human
gcaaugaagacagaauugcugaa

SEQ ID NO: 698051 - RNA, 21 nt, Human
gcagcccgcccgggacucagg

SEQ ID NO: 698052 - RNA, 24 nt, Human
gccaugaaccacaccccuauucgu

SEQ ID NO: 698053 - RNA, 19 nt, Human
gcuacagacaucacacccu

SEQ ID NO: 698054 - RNA, 22 nt, Human
ggaggcgggacucgaacccgcc

SEQ ID NO: 698055 - RNA, 21 nt, Human
ggcagaaagaaaagucaccga

SEQ ID NO: 698056 - RNA, 20 nt, Human
ggccucuaaucuguucccaa

SEQ ID NO: 698057 - RNA, 18 nt, Human
ggguggcucugggacaga

SEQ ID NO: 698058 - RNA, 21 nt, Human
gguagccucacccacuaccuc

SEQ ID NO: 698059 - RNA, 20 nt, Human
gguaggaaaaaggggaaagg

SEQ ID NO: 698060 - RNA, 25 nt, Human
gguaggaaaaaggggaaaggguugc

SEQ ID NO: 698061 - RNA, 19 nt, Human
gguggcucugggacagagg

SEQ ID NO: 698062 - RNA, 25 nt, Human
gugcugggacugcagauaugucaca

SEQ ID NO: 698063 - RNA, 23 nt, Human
guggcucugggacagagggaucc

SEQ ID NO: 698064 - RNA, 18 nt, Human
uaaauuuccaaagcgcac

SEQ ID NO: 698065 - RNA, 23 nt, Human
uaugggagcauuagaacuccaug

SEQ ID NO: 698066 - RNA, 21 nt, Human
ucaaacugucccccucauacu

SEQ ID NO: 698067 - RNA, 23 nt, Human
ucacaauaagcuaagaauagaaa

SEQ ID NO: 698068 - RNA, 20 nt, Human
ucacacccucaaagugaagu

SEQ ID NO: 698069 - RNA, 21 nt, Human
ucacauaccccacuguucagu

SEQ ID NO: 698070 - RNA, 21 nt, Human
ucagggacuagaggccagagu

SEQ ID NO: 698071 - RNA, 23 nt, Human
ucaugaucacaccacuauuuuua

SEQ ID NO: 698072 - RNA, 23 nt, Human
uccaaagaaacagccaggccacc

SEQ ID NO: 698073 - RNA, 18 nt, Human
uccaaagcgcacucucuu

SEQ ID NO: 698074 - RNA, 20 nt, Human
uccggaguccggcgucgccc

SEQ ID NO: 698075 - RNA, 20 nt, Human
uccuggagcaaugaagacag

SEQ ID NO: 698076 - RNA, 23 nt, Human
uccuugcuacaaccacacagaaa

SEQ ID NO: 698077 - RNA, 22 nt, Human
ucugaaacagucacaauaagcu

SEQ ID NO: 698078 - RNA, 20 nt, Human
ucuggguguuuucuugauuc

SEQ ID NO: 698079 - RNA, 19 nt, Human
ucuuuuuggaagagugccu

SEQ ID NO: 698080 - RNA, 18 nt, Human
ugaagugucuugccaaaa

SEQ ID NO: 698081 - RNA, 25 nt, Human
ugaauaaaugaauacauggagacca

SEQ ID NO: 698082 - RNA, 22 nt, Human
ugacagauacugguucuguuca

SEQ ID NO: 698083 - RNA, 19 nt, Human
ugaucaggacagaagacaa

SEQ ID NO: 698084 - RNA, 18 nt, Human
ugcugaaucuccaaacau

SEQ ID NO: 698085 - RNA, 18 nt, Human
ugcugggacugcagauau

SEQ ID NO: 698086 - RNA, 19 nt, Human
uggaaaaccauucuuaaag

SEQ ID NO: 698087 - RNA, 18 nt, Human
uggagcaaugaagacaga

SEQ ID NO: 698088 - RNA, 20 nt, Human
uggaguagugaagugucuug

SEQ ID NO: 698089 - RNA, 20 nt, Human
uggccucuaaucuguucccu

SEQ ID NO: 698090 - RNA, 21 nt, Human
ugggacagagggauccaaaga

SEQ ID NO: 698091 - RNA, 19 nt, Human
ugggacugcagauauguca

SEQ ID NO: 698092 - RNA, 20 nt, Human
ugggagggagugcucugcug

SEQ ID NO: 698093 - RNA, 20 nt, Human
ugggagggagugcucugcug

SEQ ID NO: 698094 - RNA, 21 nt, Human
ugggagggagugcucugcugg

SEQ ID NO: 698095 - RNA, 23 nt, Human
ugggagggagugcucugcugggu

SEQ ID NO: 698096 - RNA, 22 nt, Human
ugucccacugugcugggacugc

SEQ ID NO: 698097 - RNA, 20 nt, Human
uguugucuuuuuggaagagu

SEQ ID NO: 698098 - RNA, 24 nt, Human
uuaaggccuuucuggguguuuucu

SEQ ID NO: 698099 - RNA, 21 nt, Human
uuacauggaacagagcugugg

SEQ ID NO: 698100 - RNA, 20 nt, Human
uuagggggaaaagguggaaa

SEQ ID NO: 698101 - RNA, 22 nt, Human
uuagugggagggagugcucugc

SEQ ID NO: 698102 - RNA, 19 nt, Human
uuccaguucuguugucuuu

SEQ ID NO: 698103 - RNA, 20 nt, Human
uucccaaacuagaucugaaa

SEQ ID NO: 698104 - RNA, 23 nt, Human
uugaaugaacaagugaauaaaug

SEQ ID NO: 698105 - RNA, 22 nt, Human
uuggaagagugccuaugagguc

SEQ ID NO: 698106 - RNA, 24 nt, Human
uugguucaugaucacaccacuauu

SEQ ID NO: 698107 - RNA, 21 nt, Human
aaacaacuacaagcugccccu

SEQ ID NO: 698108 - RNA, 27 nt, Human
aaacagaaaacugaggaggggggaccc

SEQ ID NO: 698109 - RNA, 21 nt, Human
aaagccaaacucgaccuaagu

SEQ ID NO: 698110 - RNA, 21 nt, Human
aaaggauaugcaacuugaaca

SEQ ID NO: 698111 - RNA, 19 nt, Human
aaagucuuuccagucuacu

SEQ ID NO: 698112 - RNA, 23 nt, Human
aacaaaugcaagucaacuaaaaa

SEQ ID NO: 698113 - RNA, 21 nt, Human
aacaacuacaagcugccccuu

SEQ ID NO: 698114 - RNA, 20 nt, Human
aacauuguaucuauuuuuau

SEQ ID NO: 698115 - RNA, 20 nt, Human
aagccaaacucgaccuaagu

SEQ ID NO: 698116 - RNA, 20 nt, Human
aaggauaugcaacuugaaca

SEQ ID NO: 698117 - RNA, 24 nt, Human
aauuuuuccuguggacucagcgug

SEQ ID NO: 698118 - RNA, 22 nt, Human
accaccuccaaaguccugaacc

SEQ ID NO: 698119 - RNA, 24 nt, Human
accggcucaggacccaggggaguu

SEQ ID NO: 698120 - RNA, 19 nt, Human
acuacagcuuguguccuuc

SEQ ID NO: 698121 - RNA, 22 nt, Human
acugcaauucacaggggauguu

SEQ ID NO: 698122 - RNA, 23 nt, Human
agaucuuuuuuuccaguggagac

SEQ ID NO: 698123 - RNA, 22 nt, Human
agcaauccuaggaucuuuagau

SEQ ID NO: 698124 - RNA, 20 nt, Human
agcacaguuuuauuauauuc

SEQ ID NO: 698125 - RNA, 18 nt, Human
agcaucuuuuuuaaauau

SEQ ID NO: 698126 - RNA, 20 nt, Human
agcauuugaaaaaaaaaagg

SEQ ID NO: 698127 - RNA, 18 nt, Human
aggagaaaacagugaugg

SEQ ID NO: 698128 - RNA, 18 nt, Human
agguguuguccaaguaca

SEQ ID NO: 698129 - RNA, 20 nt, Human
aguagucaagagaaacagcu

SEQ ID NO: 698130 - RNA, 18 nt, Human
aguuuacagauauguuuc

SEQ ID NO: 698131 - RNA, 19 nt, Human
auaaagaacaaauaugaau

SEQ ID NO: 698132 - RNA, 21 nt, Human
auaaagaacaaauaugaauua

SEQ ID NO: 698133 - RNA, 20 nt, Human
auacagcauuucugcccucu

SEQ ID NO: 698134 - RNA, 21 nt, Human
aucauccuucacucuaaaucc

SEQ ID NO: 698135 - RNA, 20 nt, Human
aucuaucuguaucugauaca

SEQ ID NO: 698136 - RNA, 21 nt, Human
auucuaucuaucuguccuuca

SEQ ID NO: 698137 - RNA, 23 nt, Human
caaaugggaauauucacugaacc

SEQ ID NO: 698138 - RNA, 23 nt, Human
caagcaauuucacaguuaaguga

SEQ ID NO: 698139 - RNA, 20 nt, Human
caccuccaaaguccugaacc

SEQ ID NO: 698140 - RNA, 20 nt, Human
cagagaacacagauuucaac

SEQ ID NO: 698141 - RNA, 22 nt, Human
cccagcgaaaagacuacagcuu

SEQ ID NO: 698142 - RNA, 18 nt, Human
ccgggcccucucugacuc

SEQ ID NO: 698143 - RNA, 26 nt, Human
ccucaaaaagccgacucaccccuuuu

SEQ ID NO: 698144 - RNA, 21 nt, Human
ccucagcucaaaaccuggcau

SEQ ID NO: 698145 - RNA, 25 nt, Human
ccugaaccccuucucaaguguacca

SEQ ID NO: 698146 - RNA, 19 nt, Human
ccugucucuucuuucauca

SEQ ID NO: 698147 - RNA, 24 nt, Human
ccugucucuucuuucaucauuucc

SEQ ID NO: 698148 - RNA, 22 nt, Human
ccuuuacugcaauucacagggg

SEQ ID NO: 698149 - RNA, 20 nt, Human
cggugcagccgcaaaaggga

SEQ ID NO: 698150 - RNA, 23 nt, Human
cuacagcuuguguccuucauagg

SEQ ID NO: 698151 - RNA, 19 nt, Human
cuagccucacuuaucuggc

SEQ ID NO: 698152 - RNA, 23 nt, Human
cucaccacuugcugucccucaaa

SEQ ID NO: 698153 - RNA, 24 nt, Human
cucagccucagcucaaaaccuggc

SEQ ID NO: 698154 - RNA, 21 nt, Human
cucccagcgaaaagacuacag

SEQ ID NO: 698155 - RNA, 26 nt, Human
cucucaccacuugcugucccucaaaa

SEQ ID NO: 698156 - RNA, 20 nt, Human
cugacucuaucagcacauac

SEQ ID NO: 698157 - RNA, 21 nt, Human
cuuugcaggcucagccucagc

SEQ ID NO: 698158 - RNA, 19 nt, Human
gaacaaauaugaauuagau

SEQ ID NO: 698159 - RNA, 24 nt, Human
gaacaaaugcaagucaacuaaaaa

SEQ ID NO: 698160 - RNA, 24 nt, Human
gagcauuugaaaaaaaaaaggguu

SEQ ID NO: 698161 - RNA, 21 nt, Human
gaugggagccucucccagcga

SEQ ID NO: 698162 - RNA, 18 nt, Human
gcucaggacccaggggag

SEQ ID NO: 698163 - RNA, 24 nt, Human
ggaaauaccggcucaggacccagg

SEQ ID NO: 698164 - RNA, 18 nt, Human
ggaauauucacugaaccc

SEQ ID NO: 698165 - RNA, 20 nt, Human
ggauguuggcuguuuuucaa

SEQ ID NO: 698166 - RNA, 19 nt, Human
gggaauauucacugaaccc

SEQ ID NO: 698167 - RNA, 18 nt, Human
ggggauugugagugggaa

SEQ ID NO: 698168 - RNA, 21 nt, Human
guaagacaaaaaucugccucu

SEQ ID NO: 698169 - RNA, 22 nt, Human
gucagagaacacagauuucaac

SEQ ID NO: 698170 - RNA, 19 nt, Human
guccaaguacaucuauguc

SEQ ID NO: 698171 - RNA, 18 nt, Human
uaaaaacagaaaacugag

SEQ ID NO: 698172 - RNA, 23 nt, Human
uaaaagccaaacucgaccuaagu

SEQ ID NO: 698173 - RNA, 31 nt, Human
uaaaauggagauguaagacaaaaaucugccu

SEQ ID NO: 698174 - RNA, 20 nt, Human
uaacuucugucagcuuucuc

SEQ ID NO: 698175 - RNA, 21 nt, Human
uaagacaaaaaucugccucuc

SEQ ID NO: 698176 - RNA, 21 nt, Human
uaauaagacucugcuuuggca

SEQ ID NO: 698177 - RNA, 21 nt, Human
uacagagaaaggcagauggga

SEQ ID NO: 698178 - RNA, 19 nt, Human
uacagcauuucugcccucu

SEQ ID NO: 698179 - RNA, 24 nt, Human
uacagcuuguguccuucauaggag

SEQ ID NO: 698180 - RNA, 23 nt, Human
uacugcaauucacaggggauguu

SEQ ID NO: 698181 - RNA, 24 nt, Human
uagaaaggauaugcaacuugaaca

SEQ ID NO: 698182 - RNA, 18 nt, Human
uagaggaggcugauggca

SEQ ID NO: 698183 - RNA, 20 nt, Human
uagaugauguaccccaggcc

SEQ ID NO: 698184 - RNA, 20 nt, Human
uaggcggcaggcacaacuaa

SEQ ID NO: 698185 - RNA, 19 nt, Human
uaugucagucugcucaguc

SEQ ID NO: 698186 - RNA, 24 nt, Human
ucaaauuaaaaacagaaaacugag

SEQ ID NO: 698187 - RNA, 20 nt, Human
ucaagaucuuuuuuuccagu

SEQ ID NO: 698188 - RNA, 23 nt, Human
ucacaggggauguuggcuguugc

SEQ ID NO: 698189 - RNA, 18 nt, Human
ucagcucaacaacacguc

SEQ ID NO: 698190 - RNA, 19 nt, Human
ucagcucaacaacacgucu

SEQ ID NO: 698191 - RNA, 22 nt, Human
ucaguccucaagccuccuuugu

SEQ ID NO: 698192 - RNA, 21 nt, Human
ucagugaucuucccuuccucu

SEQ ID NO: 698193 - RNA, 22 nt, Human
ucauccuucacucuaaauccau

SEQ ID NO: 698194 - RNA, 20 nt, Human
uccaaagaaaucauuauuug

SEQ ID NO: 698195 - RNA, 18 nt, Human
uccaaaguccugaacccc

SEQ ID NO: 698196 - RNA, 23 nt, Human
uccaccaccuccaaaguccugaa

SEQ ID NO: 698197 - RNA, 23 nt, Human
ucccagcgaaaagacuacagcuu

SEQ ID NO: 698198 - RNA, 24 nt, Human
ucccucaaaaagccgacucacccc

SEQ ID NO: 698199 - RNA, 19 nt, Human
uccucuguuccaccaccuc

SEQ ID NO: 698200 - RNA, 18 nt, Human
uccuguggacucagcgug

SEQ ID NO: 698201 - RNA, 24 nt, Human
ucuagccugaguuuacugugaugu

SEQ ID NO: 698202 - RNA, 20 nt, Human
ucugucagugaucuucccuu

SEQ ID NO: 698203 - RNA, 22 nt, Human
ugacucagggcaaguaacuucu

SEQ ID NO: 698204 - RNA, 18 nt, Human
ugagaauaaaaacugucu

SEQ ID NO: 698205 - RNA, 24 nt, Human
ugagacuauucccuguugaacccc

SEQ ID NO: 698206 - RNA, 24 nt, Human
ugaggaggguagaauuucaaguuc

SEQ ID NO: 698207 - RNA, 22 nt, Human
ugauaucuguauucacauauca

SEQ ID NO: 698208 - RNA, 23 nt, Human
ugauggcaacacaaaugaaaacu

SEQ ID NO: 698209 - RNA, 24 nt, Human
ugauggcaacacaaaugaaaacua

SEQ ID NO: 698210 - RNA, 19 nt, Human
ugauuagacugugagcuuu

SEQ ID NO: 698211 - RNA, 19 nt, Human
ugcauguucugggcucuca

SEQ ID NO: 698212 - RNA, 23 nt, Human
ugccugucucuucuuucaucauu

SEQ ID NO: 698213 - RNA, 26 nt, Human
ugcucccuacagaguauuucacacca

SEQ ID NO: 698214 - RNA, 18 nt, Human
ugcuuuguuccuuuacug

SEQ ID NO: 698215 - RNA, 21 nt, Human
uggacucagcgugaaccacug

SEQ ID NO: 698216 - RNA, 26 nt, Human
uggagauguaagacaaaaaucugccu

SEQ ID NO: 698217 - RNA, 19 nt, Human
uggaugguggugggagggc

SEQ ID NO: 698218 - RNA, 18 nt, Human
ugggaagagacaugcucc

SEQ ID NO: 698219 - RNA, 21 nt, Human
ugggaagagacaugcuccuug

SEQ ID NO: 698220 - RNA, 22 nt, Human
ugggaauauucacugaacccug

SEQ ID NO: 698221 - RNA, 24 nt, Human
ugggagccucucccagcgaaaaga

SEQ ID NO: 698222 - RNA, 20 nt, Human
ugggagggcuagcaggaaac

SEQ ID NO: 698223 - RNA, 23 nt, Human
ugggagggcuagcaggaaacuag

SEQ ID NO: 698224 - RNA, 22 nt, Human
uggugagguguuguccaaguac

SEQ ID NO: 698225 - RNA, 18 nt, Human
uguaagacaaaaaucugc

SEQ ID NO: 698226 - RNA, 22 nt, Human
uguaagacagaauaacaagcaa

SEQ ID NO: 698227 - RNA, 19 nt, Human
uguccacuuaacggaugac

SEQ ID NO: 698228 - RNA, 19 nt, Human
uuaaauaucugccauaaca

SEQ ID NO: 698229 - RNA, 21 nt, Human
uuacagagaaaggcagauggg

SEQ ID NO: 698230 - RNA, 19 nt, Human
uuagauguaaagagcuugg

SEQ ID NO: 698231 - RNA, 21 nt, Human
uucacuauggcguucucucca

SEQ ID NO: 698232 - RNA, 19 nt, Human
uucugucagcuuucucauc

SEQ ID NO: 698233 - RNA, 21 nt, Human
uugaaaaaaaaaaggguucac

SEQ ID NO: 698234 - RNA, 21 nt, Human
uugcucccuacagaguauuuc

SEQ ID NO: 698235 - RNA, 23 nt, Human
uuuacagauauguuuccuuuaua

SEQ ID NO: 698236 - RNA, 19 nt, Human
uuuagaguucaaaggaugg

SEQ ID NO: 698237 - RNA, 20 nt, Human
uuucucaucuauaaaaugga

SEQ ID NO: 698238 - RNA, 22 nt, Human
uuuguugggaaaaggauaugcc

SEQ ID NO: 698239 - RNA, 23 nt, Human
aagccaugccuuccccgccccug

SEQ ID NO: 698240 - RNA, 22 nt, Human
aggcuuggggcuguaccgcccg

SEQ ID NO: 698241 - RNA, 19 nt, Human
aggguguuaucuggggguc

SEQ ID NO: 698242 - RNA, 22 nt, Human
caagccaugccuuccccgcccc

SEQ ID NO: 698243 - RNA, 22 nt, Human
caccucguccugggccugucac

SEQ ID NO: 698244 - RNA, 22 nt, Human
cauuggggugcuccacccucuc

SEQ ID NO: 698245 - RNA, 24 nt, Human
ccacccccggcuucgccccaggcg

SEQ ID NO: 698246 - RNA, 19 nt, Human
ccacucuuaguccgccagc

SEQ ID NO: 698247 - RNA, 21 nt, Human
cccgccccuggggcccuggga

SEQ ID NO: 698248 - RNA, 25 nt, Human
cccggcuucgccccaggcgggggag

SEQ ID NO: 698249 - RNA, 24 nt, Human
ccucugaauauccuggccagcaag

SEQ ID NO: 698250 - RNA, 23 nt, Human
ccugggagcccuucagcuccugu

SEQ ID NO: 698251 - RNA, 24 nt, Human
ccuguccccauaauggguccuggg

SEQ ID NO: 698252 - RNA, 20 nt, Human
cgggaacagguccacugcca

SEQ ID NO: 698253 - RNA, 22 nt, Human
cuggccccuagcagcaggccaa

SEQ ID NO: 698254 - RNA, 21 nt, Human
cuuccuggucagggccccugg

SEQ ID NO: 698255 - RNA, 18 nt, Human
gccccaagaccccugugc

SEQ ID NO: 698256 - RNA, 25 nt, Human
gccuagaccagggacgccauggggg

SEQ ID NO: 698257 - RNA, 26 nt, Human
gccuagaccagggacgccaugggggc

SEQ ID NO: 698258 - RNA, 19 nt, Human
gccuggccaccucguccug

SEQ ID NO: 698259 - RNA, 19 nt, Human
gcuuggggcuguaccgccc

SEQ ID NO: 698260 - RNA, 20 nt, Human
ggacgccaugggggccgccu

SEQ ID NO: 698261 - RNA, 23 nt, Human
ggccccuagcagcaggccaaucc

SEQ ID NO: 698262 - RNA, 18 nt, Human
ggccugucacaagggaag

SEQ ID NO: 698263 - RNA, 18 nt, Human
ggcuguaccgcccgcccg

SEQ ID NO: 698264 - RNA, 26 nt, Human
ggcuguggggccccaagaccccugug

SEQ ID NO: 698265 - RNA, 21 nt, Human
ggcuuggggcuguaccgcccg

SEQ ID NO: 698266 - RNA, 20 nt, Human
gggccccuggccccuagcag

SEQ ID NO: 698267 - RNA, 24 nt, Human
gggcuguggggccccaagaccccu

SEQ ID NO: 698268 - RNA, 19 nt, Human
guggguugagcuggagggc

SEQ ID NO: 698269 - RNA, 22 nt, Human
uccccgccccuggggcccuggg

SEQ ID NO: 698270 - RNA, 27 nt, Human
ucgccgccacccccggcuucgccccag

SEQ ID NO: 698271 - RNA, 23 nt, Human
ucucacagugcggggucugcggg

SEQ ID NO: 698272 - RNA, 19 nt, Human
ucugaauauccuggccagc

SEQ ID NO: 698273 - RNA, 21 nt, Human
ucuggcccucacagccuuggc

SEQ ID NO: 698274 - RNA, 22 nt, Human
ucuuccuggucagggccccugg

SEQ ID NO: 698275 - RNA, 22 nt, Human
ugagcuggagggcuguggggcc

SEQ ID NO: 698276 - RNA, 22 nt, Human
uggccagcaagccaugccuucc

SEQ ID NO: 698277 - RNA, 25 nt, Human
uggccccuagcagcaggccaauccu

SEQ ID NO: 698278 - RNA, 18 nt, Human
uggguugagcuggagggc

SEQ ID NO: 698279 - RNA, 22 nt, Human
uuccccgccccuggggcccugg

SEQ ID NO: 698280 - RNA, 26 nt, Human
uuucuuguaggguguuaucugggggu

SEQ ID NO: 698281 - RNA, 23 nt, Human
aaaaaacaaaaacaaagaaaaca

SEQ ID NO: 698282 - RNA, 18 nt, Human
aaaaagucaagcaaauaa

SEQ ID NO: 698283 - RNA, 19 nt, Human
aaacaaagaaaacaagugu

SEQ ID NO: 698284 - RNA, 19 nt, Human
aaacaauaaaaacuaacag

SEQ ID NO: 698285 - RNA, 18 nt, Human
aacauuuuaucuaugucc

SEQ ID NO: 698286 - RNA, 18 nt, Human
aagcaaauaaaauuacau

SEQ ID NO: 698287 - RNA, 23 nt, Human
aagcaaauaaaauuacauaagca

SEQ ID NO: 698288 - RNA, 21 nt, Human
acagacauaaaugaaucccau

SEQ ID NO: 698289 - RNA, 18 nt, Human
accaugguucaaaucaca

SEQ ID NO: 698290 - RNA, 20 nt, Human
agaaagacagacauaaauga

SEQ ID NO: 698291 - RNA, 21 nt, Human
agggagggaguugccgcuagg

SEQ ID NO: 698292 - RNA, 19 nt, Human
auacaaacaacuucauuca

SEQ ID NO: 698293 - RNA, 19 nt, Human
aucuaaaaauauccaaagc

SEQ ID NO: 698294 - RNA, 24 nt, Human
caaaaaaauaguaucucuguaaca

SEQ ID NO: 698295 - RNA, 22 nt, Human
caaaagagagacucaccucuca

SEQ ID NO: 698296 - RNA, 19 nt, Human
caaacaacuucauucaggu

SEQ ID NO: 698297 - RNA, 25 nt, Human
cacaauaucauauaaaaagucaagc

SEQ ID NO: 698298 - RNA, 23 nt, Human
ccaaagcaccaaggcaaaagaga

SEQ ID NO: 698299 - RNA, 18 nt, Human
cccacuggcucacccggg

SEQ ID NO: 698300 - RNA, 21 nt, Human
cuaggcucuacgccaugaggu

SEQ ID NO: 698301 - RNA, 19 nt, Human
gaaggaaggauugcaggga

SEQ ID NO: 698302 - RNA, 19 nt, Human
gacagacauaaaugaaucc

SEQ ID NO: 698303 - RNA, 20 nt, Human
gauugcagggagggagggag

SEQ ID NO: 698304 - RNA, 24 nt, Human
gcaguuuucuuggaagaaaaaaaa

SEQ ID NO: 698305 - RNA, 23 nt, Human
gccaugaggucagacgccgcggc

SEQ ID NO: 698306 - RNA, 22 nt, Human
gcccucggcacauacgucccag

SEQ ID NO: 698307 - RNA, 19 nt, Human
ggacucggcugggagccug

SEQ ID NO: 698308 - RNA, 23 nt, Human
ggagggagggaguugccgcuagg

SEQ ID NO: 698309 - RNA, 24 nt, Human
gggagggagggaguugccgcuagg

SEQ ID NO: 698310 - RNA, 23 nt, Human
gguucagggguauuuccauugug

SEQ ID NO: 698311 - RNA, 23 nt, Human
uaaacucugcccauugcuugaaa

SEQ ID NO: 698312 - RNA, 21 nt, Human
uaacaguguaaauauaaggua

SEQ ID NO: 698313 - RNA, 21 nt, Human
uacaaacaacuucauucaggu

SEQ ID NO: 698314 - RNA, 23 nt, Human
uacauuacaguuuggggaacaaa

SEQ ID NO: 698315 - RNA, 27 nt, Human
uagaaagacagacauaaaugaauccca

SEQ ID NO: 698316 - RNA, 20 nt, Human
uauacaaacaacuucauuca

SEQ ID NO: 698317 - RNA, 25 nt, Human
ucaagcaaauaaaauuacauaagcc

SEQ ID NO: 698318 - RNA, 22 nt, Human
uccagaagaagcauaauaaauc

SEQ ID NO: 698319 - RNA, 20 nt, Human
ucuacgccaugaggucagac

SEQ ID NO: 698320 - RNA, 21 nt, Human
ugaggucagacgccgcggccc

SEQ ID NO: 698321 - RNA, 21 nt, Human
ugccauaaaaaacaaaaacaa

SEQ ID NO: 698322 - RNA, 24 nt, Human
ugccauaaaaaacaaaaacaaaga

SEQ ID NO: 698323 - RNA, 27 nt, Human
ugccauaaaaaacaaaaacaaagaaaa

SEQ ID NO: 698324 - RNA, 18 nt, Human
uggaggaacccaugcuac

SEQ ID NO: 698325 - RNA, 24 nt, Human
uggggaacaaaaaaaaaaugugga

SEQ ID NO: 698326 - RNA, 20 nt, Human
uucaaauuuacuguaaaaua

SEQ ID NO: 698327 - RNA, 21 nt, Human
uugccauaaaaaacaaaaaca

SEQ ID NO: 698328 - RNA, 19 nt, Human
uugcuugaaaccuuggagg

SEQ ID NO: 698329 - RNA, 20 nt, Human
uuggacaccugauuaaacuc

SEQ ID NO: 698330 - RNA, 24 nt, Human
uuguacacaaauauccuuuaugua

SEQ ID NO: 698331 - RNA, 26 nt, Human
uuuaauauaguaauuccaaccaaaaa

SEQ ID NO: 698332 - RNA, 25 nt, Human
aaaaaagcaaaaacugaggcuugaa

SEQ ID NO: 698333 - RNA, 22 nt, Human
aaaagaagaguacagaagaaaa

SEQ ID NO: 698334 - RNA, 23 nt, Human
aaacaauuaacugcuuccucuca

SEQ ID NO: 698335 - RNA, 19 nt, Human
aaaccaagccccuuuccca

SEQ ID NO: 698336 - RNA, 21 nt, Human
aaagaagccacagcuggccug

SEQ ID NO: 698337 - RNA, 23 nt, Human
aaagaagccacagcuggccugag

SEQ ID NO: 698338 - RNA, 21 nt, Human
aaagcugcagaggcaggcuga

SEQ ID NO: 698339 - RNA, 18 nt, Human
aaauauucuaagccgugg

SEQ ID NO: 698340 - RNA, 24 nt, Human
aaaugacaaagaaaagcaaauucc

SEQ ID NO: 698341 - RNA, 19 nt, Human
aaaugcuggugauuagcuu

SEQ ID NO: 698342 - RNA, 24 nt, Human
aacaacuaucccuaaagcacaaaa

SEQ ID NO: 698343 - RNA, 21 nt, Human
aacucuugccuuccccgcggc

SEQ ID NO: 698344 - RNA, 21 nt, Human
aagaaaaaaaaaaaauggcug

SEQ ID NO: 698345 - RNA, 19 nt, Human
aagaagaguacagaagaaa

SEQ ID NO: 698346 - RNA, 19 nt, Human
aagacacagaggaaaugaa

SEQ ID NO: 698347 - RNA, 19 nt, Human
aagagaacccuggccaagc

SEQ ID NO: 698348 - RNA, 23 nt, Human
aagcagcuuggcaucuuuccucu

SEQ ID NO: 698349 - RNA, 23 nt, Human
aagcggcaaugcuaugcgugggc

SEQ ID NO: 698350 - RNA, 24 nt, Human
aagcggcaaugcuaugcgugggcu

SEQ ID NO: 698351 - RNA, 18 nt, Human
aagcugaagcggcaaugc

SEQ ID NO: 698352 - RNA, 24 nt, Human
aagcugcagaggcaggcugagagg

SEQ ID NO: 698353 - RNA, 21 nt, Human
aauccagccuuacaaccaccc

SEQ ID NO: 698354 - RNA, 24 nt, Human
accaccccaugggcuaaaaggaug

SEQ ID NO: 698355 - RNA, 25 nt, Human
accccaugggcuaaaaggauggagg

SEQ ID NO: 698356 - RNA, 19 nt, Human
acccugagauauucagaaa

SEQ ID NO: 698357 - RNA, 18 nt, Human
agacaguccucagcaagc

SEQ ID NO: 698358 - RNA, 20 nt, Human
agagagagagaacuaacauu

SEQ ID NO: 698359 - RNA, 18 nt, Human
agauccagaggacuuggc

SEQ ID NO: 698360 - RNA, 19 nt, Human
agccacagcuggccugaga

SEQ ID NO: 698361 - RNA, 20 nt, Human
agcuccuuucucacuggcuu

SEQ ID NO: 698362 - RNA, 18 nt, Human
aggcaaaagaagaguaca

SEQ ID NO: 698363 - RNA, 21 nt, Human
aggcaaaagaagaguacagaa

SEQ ID NO: 698364 - RNA, 23 nt, Human
aggcaagacacucagaaaccaag

SEQ ID NO: 698365 - RNA, 20 nt, Human
aggcaggcugagagguggcu

SEQ ID NO: 698366 - RNA, 20 nt, Human
aggcugaccucagcaacacu

SEQ ID NO: 698367 - RNA, 21 nt, Human
agguaggaggaaggugguaga

SEQ ID NO: 698368 - RNA, 21 nt, Human
aguaaaugacagaaaugcuga

SEQ ID NO: 698369 - RNA, 25 nt, Human
aguaauccacccaaaauaaggcaac

SEQ ID NO: 698370 - RNA, 18 nt, Human
aguguuccagagcuguaa

SEQ ID NO: 698371 - RNA, 21 nt, Human
caaagaaaagcaaauucccac

SEQ ID NO: 698372 - RNA, 22 nt, Human
caaugggccaacaccacuugaa

SEQ ID NO: 698373 - RNA, 23 nt, Human
cacaguccgucgcagaacugccc

SEQ ID NO: 698374 - RNA, 20 nt, Human
caccaggaugacugggaaug

SEQ ID NO: 698375 - RNA, 18 nt, Human
caccuagauuggaagauu

SEQ ID NO: 698376 - RNA, 19 nt, Human
cagaaaccaagccccuuuc

SEQ ID NO: 698377 - RNA, 21 nt, Human
cagaaaccaagccccuuuccc

SEQ ID NO: 698378 - RNA, 18 nt, Human
cagcaacaccuagaauca

SEQ ID NO: 698379 - RNA, 21 nt, Human
cagcaacaccuagaaucaucu

SEQ ID NO: 698380 - RNA, 20 nt, Human
caguccgucgcagaacugcc

SEQ ID NO: 698381 - RNA, 19 nt, Human
caguccucagcaagcugaa

SEQ ID NO: 698382 - RNA, 18 nt, Human
caugauugagccaggugc

SEQ ID NO: 698383 - RNA, 18 nt, Human
cauuguaaagacaaagug

SEQ ID NO: 698384 - RNA, 22 nt, Human
ccaggugcuucccuguggucag

SEQ ID NO: 698385 - RNA, 22 nt, Human
ccaucucagcaaagaagccaca

SEQ ID NO: 698386 - RNA, 18 nt, Human
cccaaaaugacaaagaaa

SEQ ID NO: 698387 - RNA, 19 nt, Human
cccaaagacacagaggaaa

SEQ ID NO: 698388 - RNA, 19 nt, Human
cccaaaguguuccagagcu

SEQ ID NO: 698389 - RNA, 22 nt, Human
cccacccucuuugccuugauuu

SEQ ID NO: 698390 - RNA, 26 nt, Human
ccccuagauauccaaggacuugguuc

SEQ ID NO: 698391 - RNA, 20 nt, Human
cccuggacccaggccuuccc

SEQ ID NO: 698392 - RNA, 20 nt, Human
ccgucgcagaacugcccucc

SEQ ID NO: 698393 - RNA, 21 nt, Human
ccuccaucucagcaaagaagc

SEQ ID NO: 698394 - RNA, 21 nt, Human
ccucgggaaagaugggcugcu

SEQ ID NO: 698395 - RNA, 21 nt, Human
ccugagagcuugggggcuucu

SEQ ID NO: 698396 - RNA, 18 nt, Human
ccugugacuauggggaac

SEQ ID NO: 698397 - RNA, 23 nt, Human
ccuguggucagggaauguguggc

SEQ ID NO: 698398 - RNA, 19 nt, Human
ccuuguguggcccugugac

SEQ ID NO: 698399 - RNA, 23 nt, Human
ccuuuaaaaaagcaaaaacugag

SEQ ID NO: 698400 - RNA, 25 nt, Human
cggaacuuguaagaaacugccuuuu

SEQ ID NO: 698401 - RNA, 22 nt, Human
cgucgcagaacugcccuccuua

SEQ ID NO: 698402 - RNA, 24 nt, Human
cuacuccacagaguagauacagcc

SEQ ID NO: 698403 - RNA, 23 nt, Human
cuauaaguaucaaagccaaggcc

SEQ ID NO: 698404 - RNA, 23 nt, Human
cucacacauccugcauaaguuuc

SEQ ID NO: 698405 - RNA, 23 nt, Human
cucuggaugaucaacaaucggcc

SEQ ID NO: 698406 - RNA, 20 nt, Human
cugaggcuugaaaauguuaa

SEQ ID NO: 698407 - RNA, 23 nt, Human
cugcagaggcaggcugagaggug

SEQ ID NO: 698408 - RNA, 23 nt, Human
cugcugcauggccgacguguaug

SEQ ID NO: 698409 - RNA, 22 nt, Human
cugcuggaugaacuuaagaugc

SEQ ID NO: 698410 - RNA, 18 nt, Human
cuuaagaugcccuggacc

SEQ ID NO: 698411 - RNA, 24 nt, Human
cuuccccgcggccccccaucuuua

SEQ ID NO: 698412 - RNA, 22 nt, Human
cuugcaccaggcugaccucagc

SEQ ID NO: 698413 - RNA, 24 nt, Human
cuuggcccauuccugugguccugu

SEQ ID NO: 698414 - RNA, 20 nt, Human
cuuuaaaaaagcaaaaacug

SEQ ID NO: 698415 - RNA, 22 nt, Human
cuuucugccaaacagcuuuccc

SEQ ID NO: 698416 - RNA, 20 nt, Human
gaaaaaaaaagaugagaagg

SEQ ID NO: 698417 - RNA, 20 nt, Human
gaacaguuaaccgacaaagc

SEQ ID NO: 698418 - RNA, 21 nt, Human
gaaccaggcugccuggaagcc

SEQ ID NO: 698419 - RNA, 21 nt, Human
gaaccuucuucguacacugcc

SEQ ID NO: 698420 - RNA, 19 nt, Human
gaagcagcuuggcaucuuu

SEQ ID NO: 698421 - RNA, 19 nt, Human
gaagccacagcuggccuga

SEQ ID NO: 698422 - RNA, 18 nt, Human
gaaggcaaaagaagagua

SEQ ID NO: 698423 - RNA, 24 nt, Human
gacacagaggaaaugaaacucaua

SEQ ID NO: 698424 - RNA, 21 nt, Human
gacacauguuagaaggaaguc

SEQ ID NO: 698425 - RNA, 24 nt, Human
gagaaaggaauauuuucuaggaua

SEQ ID NO: 698426 - RNA, 22 nt, Human
gagaaguacaagcaccaggaug

SEQ ID NO: 698427 - RNA, 19 nt, Human
gaggcucuggaugaucaac

SEQ ID NO: 698428 - RNA, 20 nt, Human
gauaugaaaaaaaaagauga

SEQ ID NO: 698429 - RNA, 22 nt, Human
gccaaggccacggcugaguucu

SEQ ID NO: 698430 - RNA, 24 nt, Human
gccauggagaaaguuuguccuaaa

SEQ ID NO: 698431 - RNA, 21 nt, Human
gccuuccccgcggccccccau

SEQ ID NO: 698432 - RNA, 24 nt, Human
gcggccccccaucuuuacuuucaa

SEQ ID NO: 698433 - RNA, 21 nt, Human
gcucagugguaggugugacuu

SEQ ID NO: 698434 - RNA, 21 nt, Human
gcuggggauggauuggaaaau

SEQ ID NO: 698435 - RNA, 21 nt, Human
ggauaagagaaagcuggaggg

SEQ ID NO: 698436 - RNA, 19 nt, Human
ggaucauaggccauggaga

SEQ ID NO: 698437 - RNA, 20 nt, Human
gggaauguguggcuccacau

SEQ ID NO: 698438 - RNA, 20 nt, Human
ggggauggauuggaaaaugg

SEQ ID NO: 698439 - RNA, 20 nt, Human
gguccucuugauuuuucuuu

SEQ ID NO: 698440 - RNA, 22 nt, Human
guccuucuuacuuuucaggcug

SEQ ID NO: 698441 - RNA, 20 nt, Human
uaaaaauggcuaaaucugcu

SEQ ID NO: 698442 - RNA, 21 nt, Human
uaaagagacaaaucagcccca

SEQ ID NO: 698443 - RNA, 23 nt, Human
uaagaugcccuggacccaggccu

SEQ ID NO: 698444 - RNA, 21 nt, Human
uaagguaauuagauccagagg

SEQ ID NO: 698445 - RNA, 19 nt, Human
uaaguagcagacacuuccc

SEQ ID NO: 698446 - RNA, 23 nt, Human
uacccugagauauucagaaacaa

SEQ ID NO: 698447 - RNA, 19 nt, Human
uagauccagaggacuuggc

SEQ ID NO: 698448 - RNA, 21 nt, Human
uagccaagcccucaguccauc

SEQ ID NO: 698449 - RNA, 21 nt, Human
uaggagcaaugaaugaugugu

SEQ ID NO: 698450 - RNA, 20 nt, Human
uaucccaacuugcaccaggc

SEQ ID NO: 698451 - RNA, 20 nt, Human
ucacauguacuaacuaaagc

SEQ ID NO: 698452 - RNA, 19 nt, Human
ucagagguaucauaauguc

SEQ ID NO: 698453 - RNA, 22 nt, Human
ucagccccaaaguguuccagag

SEQ ID NO: 698454 - RNA, 21 nt, Human
uccuucuuacuuuucaggcug

SEQ ID NO: 698455 - RNA, 19 nt, Human
uccuuggcccauuccugug

SEQ ID NO: 698456 - RNA, 24 nt, Human
ucuugguuauucagggaagagggg

SEQ ID NO: 698457 - RNA, 20 nt, Human
ugaccucagcaacacuucca

SEQ ID NO: 698458 - RNA, 21 nt, Human
ugaccucagcaacacuuccau

SEQ ID NO: 698459 - RNA, 26 nt, Human
ugagaaggcaagacacucagaaacca

SEQ ID NO: 698460 - RNA, 21 nt, Human
ugagagguggcuccaagagaa

SEQ ID NO: 698461 - RNA, 18 nt, Human
ugaggaacugccaucaga

SEQ ID NO: 698462 - RNA, 20 nt, Human
ugaggaacugccaucagagg

SEQ ID NO: 698463 - RNA, 22 nt, Human
ugcugcauggccgacguguaug

SEQ ID NO: 698464 - RNA, 21 nt, Human
ugcugugugacaugauugagc

SEQ ID NO: 698465 - RNA, 19 nt, Human
uggaguaauccacccaaaa

SEQ ID NO: 698466 - RNA, 19 nt, Human
uggcacaaaacugaguuuc

SEQ ID NO: 698467 - RNA, 18 nt, Human
uggcaucuuuccucucca

SEQ ID NO: 698468 - RNA, 24 nt, Human
uggccaagccauuuauggucaggg

SEQ ID NO: 698469 - RNA, 25 nt, Human
uggccaagccauuuauggucagggg

SEQ ID NO: 698470 - RNA, 21 nt, Human
uggccugguucacccacccuc

SEQ ID NO: 698471 - RNA, 19 nt, Human
ugggaagaggaguuacugg

SEQ ID NO: 698472 - RNA, 24 nt, Human
ugggaggccuggccugcuagaggg

SEQ ID NO: 698473 - RNA, 21 nt, Human
ugggcuaaaaggauggaggau

SEQ ID NO: 698474 - RNA, 25 nt, Human
ugguaagcuccuuucucacuggcuu

SEQ ID NO: 698475 - RNA, 21 nt, Human
uggucaggggaguagccaagc

SEQ ID NO: 698476 - RNA, 24 nt, Human
uguaagaaacugccuuuuccugau

SEQ ID NO: 698477 - RNA, 19 nt, Human
uguacuaacuaaagcacaa

SEQ ID NO: 698478 - RNA, 23 nt, Human
ugucuccauccccuuggguccuc

SEQ ID NO: 698479 - RNA, 22 nt, Human
uguggcuccacaugguuccuac

SEQ ID NO: 698480 - RNA, 20 nt, Human
uguguaucauagcagaagua

SEQ ID NO: 698481 - RNA, 22 nt, Human
uguuccagagcuguaaaugaaa

SEQ ID NO: 698482 - RNA, 19 nt, Human
uuagauccagaggacuugg

SEQ ID NO: 698483 - RNA, 21 nt, Human
uucccaaaaugacaaagaaaa

SEQ ID NO: 698484 - RNA, 23 nt, Human
uucccaaaaugacaaagaaaagc

SEQ ID NO: 698485 - RNA, 19 nt, Human
uuccccuccuuuaaaaaag

SEQ ID NO: 698486 - RNA, 21 nt, Human
uuccucucacacauccugcau

SEQ ID NO: 698487 - RNA, 18 nt, Human
uugguucuuuucuccaag

SEQ ID NO: 698488 - RNA, 23 nt, Human
uuuucuguccuucuuacuuuuca

SEQ ID NO: 698489 - RNA, 18 nt, Human
aacucagaagaguaacaa

SEQ ID NO: 698490 - RNA, 22 nt, Human
acagcgcgagccgcacgcccac

SEQ ID NO: 698491 - RNA, 20 nt, Human
acucagaagaguaacaaagg

SEQ ID NO: 698492 - RNA, 24 nt, Human
agucucuggaacggggggagcagc

SEQ ID NO: 698493 - RNA, 18 nt, Human
aguguacuaaauuagaau

SEQ ID NO: 698494 - RNA, 24 nt, Human
gaacagcgcgagccgcacgcccac

SEQ ID NO: 698495 - RNA, 23 nt, Human
gcagcuccgucaccaggaaggcc

SEQ ID NO: 698496 - RNA, 20 nt, Human
gcuggaugagucucuggaac

SEQ ID NO: 698497 - RNA, 19 nt, Human
ggagcagcuccgucaccag

SEQ ID NO: 698498 - RNA, 19 nt, Human
ucaaaacacaucuuaagua

SEQ ID NO: 698499 - RNA, 23 nt, Human
uccuccggcuggaugagucucug

SEQ ID NO: 698500 - RNA, 21 nt, Human
ucugaacaccaaaucaaaaca

SEQ ID NO: 698501 - RNA, 28 nt, Human
ugagucucuggaacggggggagcagcuc

SEQ ID NO: 698502 - RNA, 27 nt, Human
aaaaaaaagacacuagggguuagagaa

SEQ ID NO: 698503 - RNA, 25 nt, Human
aaccuaaaagcaaaguugugaaaga

SEQ ID NO: 698504 - RNA, 19 nt, Human
aagaaaaaaaagacacuag

SEQ ID NO: 698505 - RNA, 19 nt, Human
aagggccagcuugccugcc

SEQ ID NO: 698506 - RNA, 22 nt, Human
acucccugggccaccaagguug

SEQ ID NO: 698507 - RNA, 19 nt, Human
agaaaaaaaagacacuagg

SEQ ID NO: 698508 - RNA, 24 nt, Human
agaaauccucuguccccaccuaac

SEQ ID NO: 698509 - RNA, 23 nt, Human
agacacuagggguuagagaagcc

SEQ ID NO: 698510 - RNA, 21 nt, Human
agcugcugggggugggacaag

SEQ ID NO: 698511 - RNA, 26 nt, Human
agcugcugggggugggacaagggugu

SEQ ID NO: 698512 - RNA, 18 nt, Human
aggguguaagggccuuga

SEQ ID NO: 698513 - RNA, 22 nt, Human
agugaggugaagaaaaaaaaga

SEQ ID NO: 698514 - RNA, 20 nt, Human
auuuuauucuucccacuccc

SEQ ID NO: 698515 - RNA, 19 nt, Human
caagguuggggagcugcca

SEQ ID NO: 698516 - RNA, 22 nt, Human
cacucccaucaucugauggggg

SEQ ID NO: 698517 - RNA, 26 nt, Human
caggacuguacccccuccuccacugg

SEQ ID NO: 698518 - RNA, 23 nt, Human
ccaccuaaccaggacuguacccc

SEQ ID NO: 698519 - RNA, 18 nt, Human
ccacucccaucaucugau

SEQ ID NO: 698520 - RNA, 19 nt, Human
ccauggugagcugcugggg

SEQ ID NO: 698521 - RNA, 19 nt, Human
cccuggguccugaggggcc

SEQ ID NO: 698522 - RNA, 21 nt, Human
ccuccgagugcucagggcgag

SEQ ID NO: 698523 - RNA, 19 nt, Human
ccucucguggccacugcuc

SEQ ID NO: 698524 - RNA, 21 nt, Human
ccucucguggccacugcucac

SEQ ID NO: 698525 - RNA, 20 nt, Human
ccuucaaccuaaaagcaaag

SEQ ID NO: 698526 - RNA, 18 nt, Human
cuccacugggcuguaccc

SEQ ID NO: 698527 - RNA, 26 nt, Human
cugaggcugcagccucacacucccug

SEQ ID NO: 698528 - RNA, 24 nt, Human
cugcagccucacacucccugggcc

SEQ ID NO: 698529 - RNA, 20 nt, Human
cuguacccccuccuccacug

SEQ ID NO: 698530 - RNA, 20 nt, Human
gaaauccucuguccccaccu

SEQ ID NO: 698531 - RNA, 18 nt, Human
gacaaggguguaagggcc

SEQ ID NO: 698532 - RNA, 19 nt, Human
gacuuugucugugucuuga

SEQ ID NO: 698533 - RNA, 20 nt, Human
gagagcauguuuuaaagcca

SEQ ID NO: 698534 - RNA, 20 nt, Human
gagcugccaaguuuuccugc

SEQ ID NO: 698535 - RNA, 23 nt, Human
gagcugcugggggugggacaagg

SEQ ID NO: 698536 - RNA, 18 nt, Human
gccauggugagcugcugg

SEQ ID NO: 698537 - RNA, 20 nt, Human
gccauggugagcugcugggg

SEQ ID NO: 698538 - RNA, 20 nt, Human
ggggaugaguguucagggaa

SEQ ID NO: 698539 - RNA, 20 nt, Human
gggggugggacaagggugua

SEQ ID NO: 698540 - RNA, 18 nt, Human
gucccuggcauucccugg

SEQ ID NO: 698541 - RNA, 23 nt, Human
uaagagagcauguuuuaaagcca

SEQ ID NO: 698542 - RNA, 23 nt, Human
uaguagagaguugguuuugccuu

SEQ ID NO: 698543 - RNA, 22 nt, Human
ucacugcauuuuauucuuccca

SEQ ID NO: 698544 - RNA, 24 nt, Human
ucccagccagccugccucucgugg

SEQ ID NO: 698545 - RNA, 21 nt, Human
ucccuggguccugaggggccu

SEQ ID NO: 698546 - RNA, 20 nt, Human
ucccuuauucaggugagggu

SEQ ID NO: 698547 - RNA, 25 nt, Human
ugaagaaaaaaaagacacuaggggu

SEQ ID NO: 698548 - RNA, 24 nt, Human
ugccaaccucaugucccagccagc

SEQ ID NO: 698549 - RNA, 19 nt, Human
ugccucucguggccacugc

SEQ ID NO: 698550 - RNA, 21 nt, Human
ugccuucaaccuaaaagcaaa

SEQ ID NO: 698551 - RNA, 21 nt, Human
ugcugggggugggacaagggu

SEQ ID NO: 698552 - RNA, 20 nt, Human
ugggggugggacaagggugu

SEQ ID NO: 698553 - RNA, 24 nt, Human
uguacccccuccuccacugggcug

SEQ ID NO: 698554 - RNA, 18 nt, Human
uucaggugagggucaaug

SEQ ID NO: 698555 - RNA, 19 nt, Human
uuccaagcauaggagugcc

SEQ ID NO: 698556 - RNA, 19 nt, Human
uugguggaaggguucagac

SEQ ID NO: 698557 - RNA, 20 nt, Human
accagcaggacccagcgggc

SEQ ID NO: 698558 - RNA, 21 nt, Human
acccugggcccuuuuugcccu

SEQ ID NO: 698559 - RNA, 20 nt, Human
accuggguccgcgggggccc

SEQ ID NO: 698560 - RNA, 19 nt, Human
agcccaggugagaaggugg

SEQ ID NO: 698561 - RNA, 20 nt, Human
aggcuccgaagcccacaacc

SEQ ID NO: 698562 - RNA, 19 nt, Human
aggcugaacgaggguggga

SEQ ID NO: 698563 - RNA, 19 nt, Human
aggcuucaucuucccucaa

SEQ ID NO: 698564 - RNA, 18 nt, Human
agggaccgugacccagag

SEQ ID NO: 698565 - RNA, 18 nt, Human
aggggagagagccugagg

SEQ ID NO: 698566 - RNA, 22 nt, Human
agguagaggugggagagcaggg

SEQ ID NO: 698567 - RNA, 19 nt, Human
auaacccugggcccuuuuu

SEQ ID NO: 698568 - RNA, 19 nt, Human
cacccccauuucuuugggg

SEQ ID NO: 698569 - RNA, 27 nt, Human
caccuucagcuccugguacaucaguuu

SEQ ID NO: 698570 - RNA, 21 nt, Human
cagcaugcacccccauuucuu

SEQ ID NO: 698571 - RNA, 25 nt, Human
cagcgggcuuucuuuuccgcagccu

SEQ ID NO: 698572 - RNA, 19 nt, Human
caggacccagcgggcuuuc

SEQ ID NO: 698573 - RNA, 24 nt, Human
cagugcgugccccaguccgggcuc

SEQ ID NO: 698574 - RNA, 21 nt, Human
ccaaacccugagggccucggc

SEQ ID NO: 698575 - RNA, 23 nt, Human
cccccauuucuuugggggcugau

SEQ ID NO: 698576 - RNA, 18 nt, Human
cccucccccagcucugcu

SEQ ID NO: 698577 - RNA, 19 nt, Human
ccgcagcgagaagcggggc

SEQ ID NO: 698578 - RNA, 21 nt, Human
ccucaaggcugggggauacgc

SEQ ID NO: 698579 - RNA, 21 nt, Human
ccuccgcugggccccagcuuc

SEQ ID NO: 698580 - RNA, 22 nt, Human
cucccccagcucugcugggucc

SEQ ID NO: 698581 - RNA, 18 nt, Human
cucucaggcgucugcugc

SEQ ID NO: 698582 - RNA, 19 nt, Human
cugcugcuaccuccgcugg

SEQ ID NO: 698583 - RNA, 21 nt, Human
cugggccccagcuucugucug

SEQ ID NO: 698584 - RNA, 19 nt, Human
cuggguccgcgggggccca

SEQ ID NO: 698585 - RNA, 22 nt, Human
gacagggaccgugacccagagc

SEQ ID NO: 698586 - RNA, 18 nt, Human
gacccagcgggcuuucuu

SEQ ID NO: 698587 - RNA, 20 nt, Human
gagaaggugggugugucagg

SEQ ID NO: 698588 - RNA, 19 nt, Human
gagcaccuggguccgcggg

SEQ ID NO: 698589 - RNA, 21 nt, Human
gagcaccuggguccgcggggg

SEQ ID NO: 698590 - RNA, 19 nt, Human
gccuuccacgccucaaucu

SEQ ID NO: 698591 - RNA, 21 nt, Human
gcggggccugugggacuccgc

SEQ ID NO: 698592 - RNA, 18 nt, Human
ggcucggcuccccagaca

SEQ ID NO: 698593 - RNA, 20 nt, Human
gggccagggggcaggccagc

SEQ ID NO: 698594 - RNA, 19 nt, Human
gggguggagguagaggugg

SEQ ID NO: 698595 - RNA, 18 nt, Human
ggggugggccagggggca

SEQ ID NO: 698596 - RNA, 21 nt, Human
gggugggaggaggggcggggc

SEQ ID NO: 698597 - RNA, 23 nt, Human
gguggagguagaggugggagagc

SEQ ID NO: 698598 - RNA, 21 nt, Human
ggugggaggaggggcggggcc

SEQ ID NO: 698599 - RNA, 23 nt, Human
uaacccugggcccuuuuugcccu

SEQ ID NO: 698600 - RNA, 22 nt, Human
uacgcagagcccaggugagaag

SEQ ID NO: 698601 - RNA, 24 nt, Human
ucaugggcagcucauuggcgggcu

SEQ ID NO: 698602 - RNA, 21 nt, Human
uccccagacacggucgcucca

SEQ ID NO: 698603 - RNA, 21 nt, Human
ucccccagcucugcugggucc

SEQ ID NO: 698604 - RNA, 21 nt, Human
uccgcugggccccagcuucug

SEQ ID NO: 698605 - RNA, 20 nt, Human
ucggcuccccagacacgguc

SEQ ID NO: 698606 - RNA, 24 nt, Human
ucugcaggcaccuucagcuccugg

SEQ ID NO: 698607 - RNA, 20 nt, Human
ucugcugggucccggggcca

SEQ ID NO: 698608 - RNA, 18 nt, Human
ucugucuggacaggcuga

SEQ ID NO: 698609 - RNA, 19 nt, Human
ugccccaguccgggcucac

SEQ ID NO: 698610 - RNA, 19 nt, Human
ugggaggaggggcggggcc

SEQ ID NO: 698611 - RNA, 22 nt, Human
ugggccccagcuucugucugga

SEQ ID NO: 698612 - RNA, 20 nt, Human
uggggcagacagaagcgggg

SEQ ID NO: 698613 - RNA, 20 nt, Human
uggggcagacagaagcgggg

SEQ ID NO: 698614 - RNA, 18 nt, Human
ugggggugggccaggggg

SEQ ID NO: 698615 - RNA, 22 nt, Human
ugucuggacaggcugaacgagg

SEQ ID NO: 698616 - RNA, 22 nt, Human
uucaugggcagcucauuggcgg

SEQ ID NO: 698617 - RNA, 24 nt, Human
uuuuuuuuuuuuacagacaaguua

SEQ ID NO: 698618 - RNA, 24 nt, Human
uuuuuuuuuuuuuuuuuuuuacag

SEQ ID NO: 698619 - RNA, 21 nt, Human
aaaaaaaaaaaucccccaaaa

SEQ ID NO: 698620 - RNA, 23 nt, Human
aaagcggucaaauccucgggcca

SEQ ID NO: 698621 - RNA, 21 nt, Human
aagcggcggcgcugcugcugc

SEQ ID NO: 698622 - RNA, 23 nt, Human
acaaacaugacgcugggaaagac

SEQ ID NO: 698623 - RNA, 20 nt, Human
acgcgcgaggcgccccaaac

SEQ ID NO: 698624 - RNA, 20 nt, Human
acgcggcgggcggcgggcgg

SEQ ID NO: 698625 - RNA, 20 nt, Human
agcacaggcggccugggcag

SEQ ID NO: 698626 - RNA, 20 nt, Human
agcucaggcgugugcgacag

SEQ ID NO: 698627 - RNA, 26 nt, Human
auccccacccaaaugaaccaaaauaa

SEQ ID NO: 698628 - RNA, 22 nt, Human
aucuccuuugacgugaucaaug

SEQ ID NO: 698629 - RNA, 24 nt, Human
augacgcugggaaagacaggcuug

SEQ ID NO: 698630 - RNA, 19 nt, Human
caccaagggaaaaccccuc

SEQ ID NO: 698631 - RNA, 22 nt, Human
cacccagagacgaguggugggg

SEQ ID NO: 698632 - RNA, 19 nt, Human
caccgcgcgaguagcgggc

SEQ ID NO: 698633 - RNA, 20 nt, Human
cagaaccacagcagacagua

SEQ ID NO: 698634 - RNA, 18 nt, Human
cagagacgaguggugggg

SEQ ID NO: 698635 - RNA, 21 nt, Human
cagcgcccgggcgaccuuggc

SEQ ID NO: 698636 - RNA, 22 nt, Human
cagcugccgggccagggcgugc

SEQ ID NO: 698637 - RNA, 22 nt, Human
cagguuuaaaaauccaucucuc

SEQ ID NO: 698638 - RNA, 21 nt, Human
caugacgcugggaaagacagg

SEQ ID NO: 698639 - RNA, 21 nt, Human
ccagggcccgcucccggacag

SEQ ID NO: 698640 - RNA, 18 nt, Human
ccaguccccuuccaaaaa

SEQ ID NO: 698641 - RNA, 21 nt, Human
cccaaacacgccgggcgacca

SEQ ID NO: 698642 - RNA, 21 nt, Human
cccacccaaaugaaccaaaau

SEQ ID NO: 698643 - RNA, 19 nt, Human
cccaggccacccacccaga

SEQ ID NO: 698644 - RNA, 21 nt, Human
cccaggccacccacccagaga

SEQ ID NO: 698645 - RNA, 25 nt, Human
cccccaaaaucuaagaacuuaguuu

SEQ ID NO: 698646 - RNA, 18 nt, Human
ccccccaacgcucaccac

SEQ ID NO: 698647 - RNA, 20 nt, Human
ccccccaacgcucaccacuc

SEQ ID NO: 698648 - RNA, 20 nt, Human
cccccgcgcgucuccucugc

SEQ ID NO: 698649 - RNA, 28 nt, Human
cccccgcgcgucuccucugccgccgccu

SEQ ID NO: 698650 - RNA, 20 nt, Human
cccgcgugucccggcucauc

SEQ ID NO: 698651 - RNA, 19 nt, Human
cccggcucauccgcggccg

SEQ ID NO: 698652 - RNA, 21 nt, Human
cccggcucauccgcggccgcg

SEQ ID NO: 698653 - RNA, 19 nt, Human
cccguaguaguccagggcc

SEQ ID NO: 698654 - RNA, 21 nt, Human
cccuggccacgggcaggccuc

SEQ ID NO: 698655 - RNA, 18 nt, Human
ccgagcccgcgugucccg

SEQ ID NO: 698656 - RNA, 18 nt, Human
ccgccgccuccgccaccg

SEQ ID NO: 698657 - RNA, 21 nt, Human
ccgcuggggccgagcccgcgu

SEQ ID NO: 698658 - RNA, 18 nt, Human
ccggcgcuggcggcgggg

SEQ ID NO: 698659 - RNA, 18 nt, Human
ccucgggggucccgggcg

SEQ ID NO: 698660 - RNA, 22 nt, Human
ccucgggggucccgggcgccuc

SEQ ID NO: 698661 - RNA, 18 nt, Human
ccugggggaggcguggaa

SEQ ID NO: 698662 - RNA, 24 nt, Human
ccuuggacccccccacuggcaagc

SEQ ID NO: 698663 - RNA, 25 nt, Human
cgccccaaacacgccgggcgaccau

SEQ ID NO: 698664 - RNA, 19 nt, Human
cgcggagcugcggucugga

SEQ ID NO: 698665 - RNA, 23 nt, Human
cgcgucuccucugccgccgccuc

SEQ ID NO: 698666 - RNA, 18 nt, Human
cggcccgcaaacagcgcc

SEQ ID NO: 698667 - RNA, 18 nt, Human
cggccugggcagcgucca

SEQ ID NO: 698668 - RNA, 28 nt, Human
cggcggcagcagcggcauccaggcgaag

SEQ ID NO: 698669 - RNA, 24 nt, Human
cgggcacggggcucccgcaggggc

SEQ ID NO: 698670 - RNA, 21 nt, Human
cgggccagggcgugcuggcgg

SEQ ID NO: 698671 - RNA, 22 nt, Human
cgggcgccuccggcaugucgcc

SEQ ID NO: 698672 - RNA, 19 nt, Human
cguccugugggugccggaa

SEQ ID NO: 698673 - RNA, 23 nt, Human
cucaucguuuaaaaaaaaaaauc

SEQ ID NO: 698674 - RNA, 21 nt, Human
cuccaccucagauacgcugug

SEQ ID NO: 698675 - RNA, 19 nt, Human
cuccucugccgccgccucc

SEQ ID NO: 698676 - RNA, 22 nt, Human
cucgggggucccgggcgccucc

SEQ ID NO: 698677 - RNA, 19 nt, Human
cucugcccuuggacccccc

SEQ ID NO: 698678 - RNA, 24 nt, Human
cucugcuuuggcaaaauccacgcg

SEQ ID NO: 698679 - RNA, 20 nt, Human
cugccgccgccuccgccacc

SEQ ID NO: 698680 - RNA, 20 nt, Human
cugcggucuggaccaccaag

SEQ ID NO: 698681 - RNA, 23 nt, Human
cuggggcugguccaguccccuuc

SEQ ID NO: 698682 - RNA, 29 nt, Human
gaaaaccccucauuuuagcacaggcggcc

SEQ ID NO: 698683 - RNA, 23 nt, Human
gaaggcccuucgcagcuccaccu

SEQ ID NO: 698684 - RNA, 19 nt, Human
gagcagcagcugccgggcc

SEQ ID NO: 698685 - RNA, 23 nt, Human
gcacgcgcgaggcgccccaaaca

SEQ ID NO: 698686 - RNA, 22 nt, Human
gcagcagcugccgggccagggc

SEQ ID NO: 698687 - RNA, 22 nt, Human
gccccaaacacgccgggcgacc

SEQ ID NO: 698688 - RNA, 19 nt, Human
gcccgggcgaccuuggccc

SEQ ID NO: 698689 - RNA, 18 nt, Human
gccgccgccuccgccacc

SEQ ID NO: 698690 - RNA, 21 nt, Human
gccugggcagcguccaagcuc

SEQ ID NO: 698691 - RNA, 20 nt, Human
gcucaccacuccggcugcgc

SEQ ID NO: 698692 - RNA, 23 nt, Human
gcucccgcaggggcggggcagcg

SEQ ID NO: 698693 - RNA, 22 nt, Human
ggaaagacaggcuugggcuagg

SEQ ID NO: 698694 - RNA, 20 nt, Human
ggcccagcucaggcgugugc

SEQ ID NO: 698695 - RNA, 21 nt, Human
gggacggcgggcgcgggcggc

SEQ ID NO: 698696 - RNA, 21 nt, Human
gggaguggcgagggcugguac

SEQ ID NO: 698697 - RNA, 19 nt, Human
gggcaaagcuaucuccuuu

SEQ ID NO: 698698 - RNA, 21 nt, Human
gggcgcgggcggcccuggggg

SEQ ID NO: 698699 - RNA, 23 nt, Human
gggcgcgggcggcccugggggag

SEQ ID NO: 698700 - RNA, 23 nt, Human
gggcgggcggaggccggaggcac

SEQ ID NO: 698701 - RNA, 19 nt, Human
gggguuggccuugccauag

SEQ ID NO: 698702 - RNA, 21 nt, Human
gggucgcggcggcaaggccuc

SEQ ID NO: 698703 - RNA, 18 nt, Human
gguaggguagagagggga

SEQ ID NO: 698704 - RNA, 22 nt, Human
ggugccggaaauucacguagcc

SEQ ID NO: 698705 - RNA, 19 nt, Human
guagagcaugccuugugcc

SEQ ID NO: 698706 - RNA, 19 nt, Human
gucccaggccacccaccca

SEQ ID NO: 698707 - RNA, 23 nt, Human
gucguacagcccguaguagucca

SEQ ID NO: 698708 - RNA, 18 nt, Human
gucuccucugccgccgcc

SEQ ID NO: 698709 - RNA, 20 nt, Human
uacugcugggggguaccgag

SEQ ID NO: 698710 - RNA, 19 nt, Human
uaucuccuuugacgugauc

SEQ ID NO: 698711 - RNA, 20 nt, Human
ucaccauguguucuucuucu

SEQ ID NO: 698712 - RNA, 19 nt, Human
ucagguccuccucacacac

SEQ ID NO: 698713 - RNA, 18 nt, Human
uccucgggcaucaggucc

SEQ ID NO: 698714 - RNA, 22 nt, Human
ucgccgacugcucccgccgccg

SEQ ID NO: 698715 - RNA, 18 nt, Human
ucucugcccuuggacccc

SEQ ID NO: 698716 - RNA, 24 nt, Human
ucuggaccaccaagggaaaacccc

SEQ ID NO: 698717 - RNA, 21 nt, Human
ugaccaccuccucgaugaugc

SEQ ID NO: 698718 - RNA, 18 nt, Human
ugaggaaggcauaggcac

SEQ ID NO: 698719 - RNA, 20 nt, Human
ugaguacagaaggugugggg

SEQ ID NO: 698720 - RNA, 19 nt, Human
ugcccuuggacccccccac

SEQ ID NO: 698721 - RNA, 23 nt, Human
ugccgggccagggcgugcuggcg

SEQ ID NO: 698722 - RNA, 18 nt, Human
ugcugggggguaccgagg

SEQ ID NO: 698723 - RNA, 21 nt, Human
uggcaaaauccacgcggagcu

SEQ ID NO: 698724 - RNA, 19 nt, Human
ugggaaaagucgcagggug

SEQ ID NO: 698725 - RNA, 23 nt, Human
ugggaaagacaggcuugggcuag

SEQ ID NO: 698726 - RNA, 19 nt, Human
ugggccauguccagguucu

SEQ ID NO: 698727 - RNA, 18 nt, Human
ugggugccggaaauucac

SEQ ID NO: 698728 - RNA, 23 nt, Human
uguccagguucuggaacuugagg

SEQ ID NO: 698729 - RNA, 21 nt, Human
uuggcaaaauccacgcggagc

SEQ ID NO: 698730 - RNA, 18 nt, Human
uuuacuggggcuggucca

SEQ ID NO: 698731 - RNA, 18 nt, Human
accggagugcgagguccg

SEQ ID NO: 698732 - RNA, 20 nt, Human
agaccgggaccggagugcga

SEQ ID NO: 698733 - RNA, 23 nt, Human
cgggaccggagugcgagguccgg

SEQ ID NO: 698734 - RNA, 20 nt, Human
uuacguggugaaacaaacuu

SEQ ID NO: 698735 - RNA, 21 nt, Human
uuuuuuuuuuuuuuuugccug

SEQ ID NO: 698736 - RNA, 21 nt, Human
uuuuuuuuuuuuuuuuugccu

SEQ ID NO: 698737 - RNA, 24 nt, Human
uuuuuuuuuuuuuuuuugccuguu

SEQ ID NO: 698738 - RNA, 20 nt, Human
uuuuuuuuuuuuuuuuuugg

SEQ ID NO: 698739 - RNA, 21 nt, Human
aaauauugccaaaugcuuucc

SEQ ID NO: 698740 - RNA, 21 nt, Human
aaauauugccaaaugcuuucc

SEQ ID NO: 698741 - RNA, 20 nt, Human
aacaacaaaagccaaccaaa

SEQ ID NO: 698742 - RNA, 20 nt, Human
aacaacaaaagccaaccaaa

SEQ ID NO: 698743 - RNA, 25 nt, Human
aacaacaaaagccaaccaaaaacaa

SEQ ID NO: 698744 - RNA, 25 nt, Human
aacaacaaaagccaaccaaaaacaa

SEQ ID NO: 698745 - RNA, 23 nt, Human
aagcccagcagguccugagugaa

SEQ ID NO: 698746 - RNA, 23 nt, Human
aagcccagcagguccugagugaa

SEQ ID NO: 698747 - RNA, 19 nt, Human
aaguaagaggaacaacaac

SEQ ID NO: 698748 - RNA, 19 nt, Human
aaguaagaggaacaacaac

SEQ ID NO: 698749 - RNA, 21 nt, Human
aauucacuucugccuuccuca

SEQ ID NO: 698750 - RNA, 21 nt, Human
aauucacuucugccuuccuca

SEQ ID NO: 698751 - RNA, 21 nt, Human
acaacaacaaaagccaaccaa

SEQ ID NO: 698752 - RNA, 22 nt, Human
acaacaacaaaagccaaccaaa

SEQ ID NO: 698753 - RNA, 22 nt, Human
acaacaacaaaagccaaccaaa

SEQ ID NO: 698754 - RNA, 20 nt, Human
acccagugcucugguuuaug

SEQ ID NO: 698755 - RNA, 20 nt, Human
acccagugcucugguuuaug

SEQ ID NO: 698756 - RNA, 19 nt, Human
acccccagccaccagcccu

SEQ ID NO: 698757 - RNA, 22 nt, Human
aggaacaacaacaaaagccaac

SEQ ID NO: 698758 - RNA, 22 nt, Human
aggaacaacaacaaaagccaac

SEQ ID NO: 698759 - RNA, 25 nt, Human
agguagccagugcaagacaucucac

SEQ ID NO: 698760 - RNA, 25 nt, Human
agguagccagugcaagacaucucac

SEQ ID NO: 698761 - RNA, 23 nt, Human
auugccaaaugcuuuccuuuagc

SEQ ID NO: 698762 - RNA, 27 nt, Human
caaaaacaagguagccagugcaagaca

SEQ ID NO: 698763 - RNA, 27 nt, Human
caaaaacaagguagccagugcaagaca

SEQ ID NO: 698764 - RNA, 21 nt, Human
caacaaaagccaaccaaaaac

SEQ ID NO: 698765 - RNA, 21 nt, Human
caacaaaagccaaccaaaaac

SEQ ID NO: 698766 - RNA, 20 nt, Human
caacaacaaaagccaaccaa

SEQ ID NO: 698767 - RNA, 20 nt, Human
caacaacaaaagccaaccaa

SEQ ID NO: 698768 - RNA, 21 nt, Human
caacaacaaaagccaaccaaa

SEQ ID NO: 698769 - RNA, 22 nt, Human
caagcauaucuuggccucuccc

SEQ ID NO: 698770 - RNA, 22 nt, Human
caagcauaucuuggccucuccc

SEQ ID NO: 698771 - RNA, 22 nt, Human
caccagcccucauccucucuac

SEQ ID NO: 698772 - RNA, 22 nt, Human
caccagcccucauccucucuac

SEQ ID NO: 698773 - RNA, 18 nt, Human
cacccuuucugucaagca

SEQ ID NO: 698774 - RNA, 18 nt, Human
cacccuuucugucaagca

SEQ ID NO: 698775 - RNA, 18 nt, Human
cacccuuucugucaagca

SEQ ID NO: 698776 - RNA, 25 nt, Human
ccaccagcccucauccucucuaccc

SEQ ID NO: 698777 - RNA, 24 nt, Human
ccaccaguccugaccgugggcccc

SEQ ID NO: 698778 - RNA, 24 nt, Human
ccaccaguccugaccgugggcccc

SEQ ID NO: 698779 - RNA, 19 nt, Human
ccacccaacucagaaagcc

SEQ ID NO: 698780 - RNA, 19 nt, Human
ccacccaacucagaaagcc

SEQ ID NO: 698781 - RNA, 22 nt, Human
ccagcagguccugagugaagcc

SEQ ID NO: 698782 - RNA, 22 nt, Human
ccagcagguccugagugaagcc

SEQ ID NO: 698783 - RNA, 21 nt, Human
ccccagccaccagcccucauc

SEQ ID NO: 698784 - RNA, 21 nt, Human
ccccagccaccagcccucauc

SEQ ID NO: 698785 - RNA, 19 nt, Human
cccucauccucucuaccca

SEQ ID NO: 698786 - RNA, 19 nt, Human
cccucauccucucuaccca

SEQ ID NO: 698787 - RNA, 21 nt, Human
ccgugggccccucaggggucu

SEQ ID NO: 698788 - RNA, 19 nt, Human
ccugcaguccccaccaguc

SEQ ID NO: 698789 - RNA, 22 nt, Human
cgccuuucccgccacccaacuc

SEQ ID NO: 698790 - RNA, 24 nt, Human
cuacccagugcucugguuuaugcu

SEQ ID NO: 698791 - RNA, 27 nt, Human
cucucucuacccuaguucuccaaauuc

SEQ ID NO: 698792 - RNA, 27 nt, Human
cucucucuacccuaguucuccaaauuc

SEQ ID NO: 698793 - RNA, 18 nt, Human
cugagugaagccgugggc

SEQ ID NO: 698794 - RNA, 18 nt, Human
cugagugaagccgugggc

SEQ ID NO: 698795 - RNA, 26 nt, Human
gccaccagcccucauccucucuaccc

SEQ ID NO: 698796 - RNA, 19 nt, Human
gccccucaggggucuggga

SEQ ID NO: 698797 - RNA, 24 nt, Human
gccucaaaaucacccuuucuguca

SEQ ID NO: 698798 - RNA, 24 nt, Human
gccucaaaaucacccuuucuguca

SEQ ID NO: 698799 - RNA, 21 nt, Human
gccuuucccgccacccaacuc

SEQ ID NO: 698800 - RNA, 20 nt, Human
gcuugucuccugacugcucu

SEQ ID NO: 698801 - RNA, 20 nt, Human
gcuugucuccugacugcucu

SEQ ID NO: 698802 - RNA, 24 nt, Human
ggucuacccccagccaccagcccu

SEQ ID NO: 698803 - RNA, 19 nt, Human
uaacugagccucaaaauca

SEQ ID NO: 698804 - RNA, 19 nt, Human
uaacugagccucaaaauca

SEQ ID NO: 698805 - RNA, 24 nt, Human
uaagaggaacaacaacaaaagcca

SEQ ID NO: 698806 - RNA, 24 nt, Human
uaagaggaacaacaacaaaagcca

SEQ ID NO: 698807 - RNA, 20 nt, Human
uaauaaauauugccaaaugc

SEQ ID NO: 698808 - RNA, 20 nt, Human
uaauaaauauugccaaaugc

SEQ ID NO: 698809 - RNA, 23 nt, Human
uacccagugcucugguuuaugcu

SEQ ID NO: 698810 - RNA, 21 nt, Human
uacccuaguucuccaaauuca

SEQ ID NO: 698811 - RNA, 21 nt, Human
uacccuaguucuccaaauuca

SEQ ID NO: 698812 - RNA, 23 nt, Human
uagcaaccucucucuacccuagu

SEQ ID NO: 698813 - RNA, 23 nt, Human
uagcaaccucucucuacccuagu

SEQ ID NO: 698814 - RNA, 25 nt, Human
uagcaaccucucucuacccuaguuc

SEQ ID NO: 698815 - RNA, 25 nt, Human
uagcaaccucucucuacccuaguuc

SEQ ID NO: 698816 - RNA, 24 nt, Human
uauugccaaaugcuuuccuuuagc

SEQ ID NO: 698817 - RNA, 22 nt, Human
ucauccucucuacccagugcuc

SEQ ID NO: 698818 - RNA, 22 nt, Human
ucauccucucuacccagugcuc

SEQ ID NO: 698819 - RNA, 18 nt, Human
uccugaccgugggccccu

SEQ ID NO: 698820 - RNA, 23 nt, Human
uccugagugaagccgugggcccu

SEQ ID NO: 698821 - RNA, 23 nt, Human
uccugagugaagccgugggcccu

SEQ ID NO: 698822 - RNA, 20 nt, Human
ugaaaagcguacaaaagaua

SEQ ID NO: 698823 - RNA, 20 nt, Human
ugaaaagcguacaaaagaua

SEQ ID NO: 698824 - RNA, 21 nt, Human
ugaagccgugggcccuccaaa

SEQ ID NO: 698825 - RNA, 21 nt, Human
ugaagccgugggcccuccaaa

SEQ ID NO: 698826 - RNA, 19 nt, Human
ugacauccugcaguccccc

SEQ ID NO: 698827 - RNA, 19 nt, Human
ugacauccugcaguccccc

SEQ ID NO: 698828 - RNA, 21 nt, Human
ugagugaagccgugggcccuc

SEQ ID NO: 698829 - RNA, 21 nt, Human
ugagugaagccgugggcccuc

SEQ ID NO: 698830 - RNA, 20 nt, Human
ugccuggucuguugguucgu

SEQ ID NO: 698831 - RNA, 27 nt, Human
ugccuggucuguugguucguuuuggga

SEQ ID NO: 698832 - RNA, 18 nt, Human
uggggguggggugaaaag

SEQ ID NO: 698833 - RNA, 18 nt, Human
uggggguggggugaaaag

SEQ ID NO: 698834 - RNA, 20 nt, Human
uuaaaagggcuccuggggua

SEQ ID NO: 698835 - RNA, 20 nt, Human
uuaaaagggcuccuggggua

SEQ ID NO: 698836 - RNA, 22 nt, Human
uuccucagguuugauaucuggc

SEQ ID NO: 698837 - RNA, 22 nt, Human
uuccucagguuugauaucuggc

SEQ ID NO: 698838 - RNA, 23 nt, Human
uuccucagguuugauaucuggca

SEQ ID NO: 698839 - RNA, 23 nt, Human
uuccucagguuugauaucuggca

SEQ ID NO: 698840 - RNA, 22 nt, Human
uugaaauauuaacugagccuca

SEQ ID NO: 698841 - RNA, 22 nt, Human
uugaaauauuaacugagccuca

SEQ ID NO: 698842 - RNA, 23 nt, Human
uugugcugaugccuggucuguug

SEQ ID NO: 698843 - RNA, 23 nt, Human
aagcgucgggcagcggaggcccg

SEQ ID NO: 698844 - RNA, 18 nt, Human
caaggcagcggcaccggc

SEQ ID NO: 698845 - RNA, 19 nt, Human
ccggcuggaaagaagcaag

SEQ ID NO: 698846 - RNA, 20 nt, Human
gcagcggcaccggcuggaaa

SEQ ID NO: 698847 - RNA, 23 nt, Human
gggcagcggaggcccgcgggugc

SEQ ID NO: 698848 - RNA, 19 nt, Human
gggggcaaggcagcggcac

SEQ ID NO: 698849 - RNA, 18 nt, Human
uccggggggcaaggcagc

SEQ ID NO: 698850 - RNA, 23 nt, Human
aagaggacauccuguugcaggcc

SEQ ID NO: 698851 - RNA, 21 nt, Human
accagccccacgcugaaggcc

SEQ ID NO: 698852 - RNA, 19 nt, Human
agccaggcgcccgccagca

SEQ ID NO: 698853 - RNA, 20 nt, Human
aggcggcgggcaggcagagc

SEQ ID NO: 698854 - RNA, 23 nt, Human
agggggccugcauggucugggcc

SEQ ID NO: 698855 - RNA, 22 nt, Human
caaggagaagcccagggccguc

SEQ ID NO: 698856 - RNA, 26 nt, Human
caccagccccacgcugaaggccgcgc

SEQ ID NO: 698857 - RNA, 22 nt, Human
caccaggaagcaguagggcccc

SEQ ID NO: 698858 - RNA, 22 nt, Human
caccggccgcacgcgcacgucc

SEQ ID NO: 698859 - RNA, 28 nt, Human
cagcaccaggaagcaguagggcccccag

SEQ ID NO: 698860 - RNA, 19 nt, Human
cagcagaugacgaagacga

SEQ ID NO: 698861 - RNA, 19 nt, Human
cagcagcagaugacgaagg

SEQ ID NO: 698862 - RNA, 20 nt, Human
cagcagcugcagcgcgcggc

SEQ ID NO: 698863 - RNA, 23 nt, Human
caggaaagcguccacauuccuag

SEQ ID NO: 698864 - RNA, 21 nt, Human
caggaagggcagcagguagca

SEQ ID NO: 698865 - RNA, 22 nt, Human
cagggcaaggagaagcccaggg

SEQ ID NO: 698866 - RNA, 24 nt, Human
ccagccccacgcugaaggccgcgc

SEQ ID NO: 698867 - RNA, 21 nt, Human
cccacauggccacguccccug

SEQ ID NO: 698868 - RNA, 23 nt, Human
cccacauggccacguccccugcc

SEQ ID NO: 698869 - RNA, 18 nt, Human
ccccaucaccgcgcaguu

SEQ ID NO: 698870 - RNA, 21 nt, Human
ccccaucaccgcgcaguugcc

SEQ ID NO: 698871 - RNA, 21 nt, Human
cccccagcagcagaugacgaa

SEQ ID NO: 698872 - RNA, 22 nt, Human
ccgcgcccagcugcgcgggguc

SEQ ID NO: 698873 - RNA, 21 nt, Human
ccugcauggucugggccugcc

SEQ ID NO: 698874 - RNA, 21 nt, Human
cgaagcacgagcugaagaagc

SEQ ID NO: 698875 - RNA, 22 nt, Human
cgcaccucgcugaagaagcgca

SEQ ID NO: 698876 - RNA, 21 nt, Human
cgcaguaacgguccaacgaga

SEQ ID NO: 698877 - RNA, 22 nt, Human
cgccagggccccgcggcggcgg

SEQ ID NO: 698878 - RNA, 18 nt, Human
gaagcacgagcugaagaa

SEQ ID NO: 698879 - RNA, 21 nt, Human
gacagcgacaggaugaaggcg

SEQ ID NO: 698880 - RNA, 20 nt, Human
gaggacggugguggccgugc

SEQ ID NO: 698881 - RNA, 23 nt, Human
gcagcaccaggaagcaguagggc

SEQ ID NO: 698882 - RNA, 23 nt, Human
gcaggccaccaccagccccacgc

SEQ ID NO: 698883 - RNA, 19 nt, Human
gcaguagggcccccagcag

SEQ ID NO: 698884 - RNA, 18 nt, Human
gccagggccccgcggcgg

SEQ ID NO: 698885 - RNA, 18 nt, Human
gcgcagcacgcgcgcgua

SEQ ID NO: 698886 - RNA, 18 nt, Human
ggaaagcguccacauucc

SEQ ID NO: 698887 - RNA, 24 nt, Human
ggcgcagaagccgcgccagggccc

SEQ ID NO: 698888 - RNA, 20 nt, Human
ggcuucuggcuugcagaccc

SEQ ID NO: 698889 - RNA, 22 nt, Human
gggguccggggagguccgguag

SEQ ID NO: 698890 - RNA, 24 nt, Human
guagcaggccaccaccagccccac

SEQ ID NO: 698891 - RNA, 22 nt, Human
ucacaaucacccccaucaccgc

SEQ ID NO: 698892 - RNA, 25 nt, Human
ucagccaggcgcccgccagcagcug

SEQ ID NO: 698893 - RNA, 20 nt, Human
ucccagggcaaggagaagcc

SEQ ID NO: 698894 - RNA, 22 nt, Human
ucccucucggcagaaaaguaca

SEQ ID NO: 698895 - RNA, 21 nt, Human
ugaagaagcgcagcacgcgcg

SEQ ID NO: 698896 - RNA, 20 nt, Human
ugaagagguccaggaaggcg

SEQ ID NO: 698897 - RNA, 19 nt, Human
ugagcguggacacgaugcc

SEQ ID NO: 698898 - RNA, 20 nt, Human
ugaugaggacggugguggcc

SEQ ID NO: 698899 - RNA, 23 nt, Human
ugccggugcuucacaaucacccc

SEQ ID NO: 698900 - RNA, 21 nt, Human
uggcccaggucagccagacgg

SEQ ID NO: 698901 - RNA, 18 nt, Human
uggcuugcagacccgggc

SEQ ID NO: 698902 - RNA, 20 nt, Human
uugcagaugugguaguggca

SEQ ID NO: 698903 - RNA, 19 nt, Human
uuuugcgggcccacauggc

SEQ ID NO: 698904 - RNA, 25 nt, Human
aacagcaggaaucccgaguaagacg

SEQ ID NO: 698905 - RNA, 21 nt, Human
aaugcaggaacagcaccagga

SEQ ID NO: 698906 - RNA, 19 nt, Human
acccaaggccacaacaaca

SEQ ID NO: 698907 - RNA, 19 nt, Human
accuugacggcagggaagg

SEQ ID NO: 698908 - RNA, 19 nt, Human
aggugaacaguaaggugag

SEQ ID NO: 698909 - RNA, 18 nt, Human
aggugggaaaggccagug

SEQ ID NO: 698910 - RNA, 22 nt, Human
caacaacagcaggaaucccgag

SEQ ID NO: 698911 - RNA, 26 nt, Human
caaggccacaacaacagcaggaaucc

SEQ ID NO: 698912 - RNA, 19 nt, Human
cacaacaacagcaggaauc

SEQ ID NO: 698913 - RNA, 26 nt, Human
caccccucagauuccccaguggccca

SEQ ID NO: 698914 - RNA, 23 nt, Human
cagcaccaggagcuagagcccaa

SEQ ID NO: 698915 - RNA, 21 nt, Human
cagcaggccuguccuguguuc

SEQ ID NO: 698916 - RNA, 20 nt, Human
caguggcccaggaaaaaaua

SEQ ID NO: 698917 - RNA, 18 nt, Human
ccaaggccacaacaacag

SEQ ID NO: 698918 - RNA, 25 nt, Human
ccacaacaacagcaggaaucccgag

SEQ ID NO: 698919 - RNA, 21 nt, Human
cccucagauuccccaguggcc

SEQ ID NO: 698920 - RNA, 18 nt, Human
cggcagggaaggcuggau

SEQ ID NO: 698921 - RNA, 20 nt, Human
cgggcacagaggccuagcag

SEQ ID NO: 698922 - RNA, 22 nt, Human
cuagagcccaacucuggccugu

SEQ ID NO: 698923 - RNA, 21 nt, Human
cugcauuuuauuugcaccuca

SEQ ID NO: 698924 - RNA, 20 nt, Human
cuuggucuuugccaagguag

SEQ ID NO: 698925 - RNA, 25 nt, Human
gaacagcaccaggagcuagagccca

SEQ ID NO: 698926 - RNA, 21 nt, Human
gaucagaccagcaaguauggg

SEQ ID NO: 698927 - RNA, 20 nt, Human
gccaccuugacggcagggaa

SEQ ID NO: 698928 - RNA, 19 nt, Human
uaagacgccaccuugacgg

SEQ ID NO: 698929 - RNA, 19 nt, Human
uacccaaggccacaacaac

SEQ ID NO: 698930 - RNA, 23 nt, Human
ugagcagaggugggaaaggccag

SEQ ID NO: 698931 - RNA, 20 nt, Human
uggccugugggcugucuccc

SEQ ID NO: 698932 - RNA, 22 nt, Human
uggccugugggcugucucccgg

SEQ ID NO: 698933 - RNA, 18 nt, Human
ugggaaaggccagugggu

SEQ ID NO: 698934 - RNA, 19 nt, Human
ugggaaaggccagugggug

SEQ ID NO: 698935 - RNA, 22 nt, Human
uuacccaaggccacaacaacag

SEQ ID NO: 698936 - RNA, 23 nt, Human
uuuuuuuuuuuuuuuuuucaaag

SEQ ID NO: 698937 - RNA, 24 nt, Human
aaccaaguccacuccuggccagua

SEQ ID NO: 698938 - RNA, 19 nt, Human
aaccaaugagaagguagcc

SEQ ID NO: 698939 - RNA, 21 nt, Human
aaccagaugcccgggagccug

SEQ ID NO: 698940 - RNA, 18 nt, Human
aagaggccggggcgcggc

SEQ ID NO: 698941 - RNA, 19 nt, Human
agaccagcccuccucccca

SEQ ID NO: 698942 - RNA, 18 nt, Human
agccagaggcaccaggcc

SEQ ID NO: 698943 - RNA, 21 nt, Human
agcccuaaccaaguccacucu

SEQ ID NO: 698944 - RNA, 20 nt, Human
agccuccagccagaggcacc

SEQ ID NO: 698945 - RNA, 23 nt, Human
agccuggccaguggaaguagccc

SEQ ID NO: 698946 - RNA, 21 nt, Human
aggcccccaaucucgccccgg

SEQ ID NO: 698947 - RNA, 19 nt, Human
agggaagggaagggguggg

SEQ ID NO: 698948 - RNA, 19 nt, Human
aggggccugggcccggggc

SEQ ID NO: 698949 - RNA, 18 nt, Human
aucuccucaggccacuag

SEQ ID NO: 698950 - RNA, 20 nt, Human
caaccagaugcccgggagcc

SEQ ID NO: 698951 - RNA, 18 nt, Human
caccaggcccuagcgggg

SEQ ID NO: 698952 - RNA, 22 nt, Human
caccuuaggcuugguggcgggg

SEQ ID NO: 698953 - RNA, 22 nt, Human
cacggccagcugcagcggcgcu

SEQ ID NO: 698954 - RNA, 21 nt, Human
cagcgagggcugucgccuccu

SEQ ID NO: 698955 - RNA, 19 nt, Human
cagcugacagcugaggggc

SEQ ID NO: 698956 - RNA, 20 nt, Human
ccaggacaccuuaggcuugg

SEQ ID NO: 698957 - RNA, 21 nt, Human
cccccgccgggaggagcccau

SEQ ID NO: 698958 - RNA, 25 nt, Human
ccccugaggagcggagaccagcccu

SEQ ID NO: 698959 - RNA, 24 nt, Human
cccucccaucuuuggccaaugaga

SEQ ID NO: 698960 - RNA, 20 nt, Human
cccuggaggucccgcggcgu

SEQ ID NO: 698961 - RNA, 23 nt, Human
ccucaggccacuagagucgcccc

SEQ ID NO: 698962 - RNA, 23 nt, Human
ccucgaccaacgggaugggcccu

SEQ ID NO: 698963 - RNA, 22 nt, Human
ccucggagccuggcggcggugg

SEQ ID NO: 698964 - RNA, 22 nt, Human
ccuggccaguggaaguagcccc

SEQ ID NO: 698965 - RNA, 23 nt, Human
ccuggccaguggaaguagccccg

SEQ ID NO: 698966 - RNA, 21 nt, Human
cgcaaccuccgcuagccgcgc

SEQ ID NO: 698967 - RNA, 23 nt, Human
cgccagagcacacugcuccaauc

SEQ ID NO: 698968 - RNA, 22 nt, Human
cggccgaggggggagcagcccu

SEQ ID NO: 698969 - RNA, 18 nt, Human
cggccucggagccuggcg

SEQ ID NO: 698970 - RNA, 19 nt, Human
cggccucggagccuggcgg

SEQ ID NO: 698971 - RNA, 19 nt, Human
cgggaugggcccuucccgc

SEQ ID NO: 698972 - RNA, 19 nt, Human
cguggauccaggacaccuu

SEQ ID NO: 698973 - RNA, 22 nt, Human
cguguggggcagugggaggcca

SEQ ID NO: 698974 - RNA, 19 nt, Human
cucgggcccugggcggcga

SEQ ID NO: 698975 - RNA, 23 nt, Human
cucuugcuggggcugggcgcggc

SEQ ID NO: 698976 - RNA, 18 nt, Human
cugacagcugaggggccu

SEQ ID NO: 698977 - RNA, 22 nt, Human
cugagccaaugagacgcaaccu

SEQ ID NO: 698978 - RNA, 23 nt, Human
cugcgaagcugagggagcugcgc

SEQ ID NO: 698979 - RNA, 18 nt, Human
cuggggcugggcgcggcc

SEQ ID NO: 698980 - RNA, 21 nt, Human
cugucuggucggagcgcucca

SEQ ID NO: 698981 - RNA, 19 nt, Human
gagccuccagccagaggca

SEQ ID NO: 698982 - RNA, 22 nt, Human
gagcggcugcaggaccugagcc

SEQ ID NO: 698983 - RNA, 20 nt, Human
gccacuagagucgccccugg

SEQ ID NO: 698984 - RNA, 24 nt, Human
gccagagcacacugcuccaaucca

SEQ ID NO: 698985 - RNA, 18 nt, Human
gcgcggcgcgcgcucggg

SEQ ID NO: 698986 - RNA, 20 nt, Human
gcgcggcguugggucgcggg

SEQ ID NO: 698987 - RNA, 21 nt, Human
gcgcggugcccggccaauagg

SEQ ID NO: 698988 - RNA, 23 nt, Human
gcggagaccagcccuccucccca

SEQ ID NO: 698989 - RNA, 18 nt, Human
ggagcagcccugcugggg

SEQ ID NO: 698990 - RNA, 25 nt, Human
ggcagaagugccucuggcugcaacc

SEQ ID NO: 698991 - RNA, 21 nt, Human
ggcgcugcgaagcugagggag

SEQ ID NO: 698992 - RNA, 21 nt, Human
ggcggggucagguggcggcgg

SEQ ID NO: 698993 - RNA, 19 nt, Human
ggcuccaagaggccggggc

SEQ ID NO: 698994 - RNA, 19 nt, Human
ggcuugguggcggggucag

SEQ ID NO: 698995 - RNA, 23 nt, Human
gggagccuccagccagaggcacc

SEQ ID NO: 698996 - RNA, 18 nt, Human
gggcagugggaggccauc

SEQ ID NO: 698997 - RNA, 23 nt, Human
ggggagaggcagcccgggcagaa

SEQ ID NO: 698998 - RNA, 22 nt, Human
uaagaaagcuuuggccaagccc

SEQ ID NO: 698999 - RNA, 19 nt, Human
uacaucuccucaggccacu

SEQ ID NO: 699000 - RNA, 21 nt, Human
ucaaccagaugcccgggagcc

SEQ ID NO: 699001 - RNA, 24 nt, Human
ucaggccacuagagucgccccugg

SEQ ID NO: 699002 - RNA, 22 nt, Human
ucgccuccucgggcagccccgg

SEQ ID NO: 699003 - RNA, 19 nt, Human
ucuauugggacggccaagg

SEQ ID NO: 699004 - RNA, 19 nt, Human
ucuggcugcaaccaaugag

SEQ ID NO: 699005 - RNA, 22 nt, Human
ugagccaaugagacgcaaccuc

SEQ ID NO: 699006 - RNA, 19 nt, Human
ugcccgggagccuggccag

SEQ ID NO: 699007 - RNA, 19 nt, Human
ugcuggggcugggcgcggc

SEQ ID NO: 699008 - RNA, 21 nt, Human
uggcgacagcgacaggccccc

SEQ ID NO: 699009 - RNA, 19 nt, Human
uggcggcgguggugagggc

SEQ ID NO: 699010 - RNA, 23 nt, Human
ugggacggacuaagccccugagg

SEQ ID NO: 699011 - RNA, 21 nt, Human
ugggaggccaucaaaaccaac

SEQ ID NO: 699012 - RNA, 21 nt, Human
uggggucaaccagaugcccgg

SEQ ID NO: 699013 - RNA, 21 nt, Human
ugggguggcgggcggcgcugc

SEQ ID NO: 699014 - RNA, 22 nt, Human
ugggucgcggguccgggggcug

SEQ ID NO: 699015 - RNA, 26 nt, Human
ugucgcugggcguccguuuccucuug

SEQ ID NO: 699016 - RNA, 20 nt, Human
uuaagaaagcuuuggccaag

SEQ ID NO: 699017 - RNA, 24 nt, Human
aaaaaaaaaaaaaaaugaaaaaaa

SEQ ID NO: 699018 - RNA, 18 nt, Human
aaaaaaccaaacaccgca

SEQ ID NO: 699019 - RNA, 20 nt, Human
aaaaaaccaaacaccgcaua

SEQ ID NO: 699020 - RNA, 21 nt, Human
aagaacaaaaaaccaaacacc

SEQ ID NO: 699021 - RNA, 26 nt, Human
aagaacaaaaaaccaaacaccgcaua

SEQ ID NO: 699022 - RNA, 22 nt, Human
aagcagcuuagaucucugagcu

SEQ ID NO: 699023 - RNA, 27 nt, Human
aauaaaaaaaaaaaaaaaugaaaaaaa

SEQ ID NO: 699024 - RNA, 25 nt, Human
acaauaacagagaugacauaagcac

SEQ ID NO: 699025 - RNA, 21 nt, Human
acagagucaguguccuggggc

SEQ ID NO: 699026 - RNA, 18 nt, Human
accaaacaccgcauauuc

SEQ ID NO: 699027 - RNA, 23 nt, Human
acuucccaucccacuucccaaac

SEQ ID NO: 699028 - RNA, 21 nt, Human
agcacagagagguacaaaguu

SEQ ID NO: 699029 - RNA, 20 nt, Human
agggaaguggggguuuggag

SEQ ID NO: 699030 - RNA, 21 nt, Human
aguuuguuuuucccauucuuc

SEQ ID NO: 699031 - RNA, 21 nt, Human
auaauaaaaaaaaaaaaaaau

SEQ ID NO: 699032 - RNA, 24 nt, Human
auauacaccauggaauacuaugca

SEQ ID NO: 699033 - RNA, 21 nt, Human
auguugcccauguacccuaaa

SEQ ID NO: 699034 - RNA, 22 nt, Human
caagaacaaaaaaccaaacacc

SEQ ID NO: 699035 - RNA, 24 nt, Human
caagaacaaaaaaccaaacaccgc

SEQ ID NO: 699036 - RNA, 22 nt, Human
caauagcaaagacuuggaacca

SEQ ID NO: 699037 - RNA, 21 nt, Human
cacauguauacauauguuacu

SEQ ID NO: 699038 - RNA, 22 nt, Human
ccaaacaccgcauauucucacu

SEQ ID NO: 699039 - RNA, 24 nt, Human
ccauaucuuuccuaacuucccauc

SEQ ID NO: 699040 - RNA, 24 nt, Human
cgcaccagcauggcacauguauac

SEQ ID NO: 699041 - RNA, 22 nt, Human
cuucccaucccacuucccaaac

SEQ ID NO: 699042 - RNA, 22 nt, Human
gaacaaaaaaccaaacaccgca

SEQ ID NO: 699043 - RNA, 21 nt, Human
gaaggaaagaagacaacgugg

SEQ ID NO: 699044 - RNA, 21 nt, Human
gagucaguguccuggggcugg

SEQ ID NO: 699045 - RNA, 19 nt, Human
gaugacauaagcacagaga

SEQ ID NO: 699046 - RNA, 22 nt, Human
gcaagaacaaaaaaccaaacac

SEQ ID NO: 699047 - RNA, 26 nt, Human
gcccauguacccuaaacuuuagagua

SEQ ID NO: 699048 - RNA, 20 nt, Human
ggaauggaacaaaugaagug

SEQ ID NO: 699049 - RNA, 19 nt, Human
ggacauggaugaaauugga

SEQ ID NO: 699050 - RNA, 18 nt, Human
gggaauaucacacucuug

SEQ ID NO: 699051 - RNA, 18 nt, Human
gggagggauagcauuggg

SEQ ID NO: 699052 - RNA, 22 nt, Human
gggucgggggaugggggaggga

SEQ ID NO: 699053 - RNA, 19 nt, Human
uaacagagaugacauaagc

SEQ ID NO: 699054 - RNA, 21 nt, Human
uaacagagaugacauaagcac

SEQ ID NO: 699055 - RNA, 22 nt, Human
uaacagagaugacauaagcaca

SEQ ID NO: 699056 - RNA, 24 nt, Human
uaacuucccaucccacuucccaaa

SEQ ID NO: 699057 - RNA, 18 nt, Human
uacccuaaacuuuagagu

SEQ ID NO: 699058 - RNA, 22 nt, Human
ucaguaaacuaucgcaagaaca

SEQ ID NO: 699059 - RNA, 28 nt, Human
ucccauaucuuuccuaacuucccauccc

SEQ ID NO: 699060 - RNA, 25 nt, Human
ucgcaagaacaaaaaaccaaacacc

SEQ ID NO: 699061 - RNA, 22 nt, Human
ucgggggaugggggagggauag

SEQ ID NO: 699062 - RNA, 20 nt, Human
ucucacucauaggugggaau

SEQ ID NO: 699063 - RNA, 24 nt, Human
ugaacaaugagaucacguggacac

SEQ ID NO: 699064 - RNA, 18 nt, Human
ugaagugggacguuugag

SEQ ID NO: 699065 - RNA, 18 nt, Human
ugaagugggacguuugag

SEQ ID NO: 699066 - RNA, 23 nt, Human
ugagggaaguggggguuuggagu

SEQ ID NO: 699067 - RNA, 24 nt, Human
ugagggaaguggggguuuggagug

SEQ ID NO: 699068 - RNA, 25 nt, Human
ugagggaaguggggguuuggagugu

SEQ ID NO: 699069 - RNA, 27 nt, Human
ugagggaaguggggguuuggaguguca

SEQ ID NO: 699070 - RNA, 19 nt, Human
uggaacaaaugaaguggga

SEQ ID NO: 699071 - RNA, 20 nt, Human
uggaauacuaugcagccaua

SEQ ID NO: 699072 - RNA, 20 nt, Human
uggauuaagaaaauguggcc

SEQ ID NO: 699073 - RNA, 19 nt, Human
uggcacauguauacauaug

SEQ ID NO: 699074 - RNA, 23 nt, Human
uggggucgggggaugggggaggg

SEQ ID NO: 699075 - RNA, 18 nt, Human
ugguggggucgggggaug

SEQ ID NO: 699076 - RNA, 24 nt, Human
ugguggugaaggaaagaagacaac

SEQ ID NO: 699077 - RNA, 27 nt, Human
uguauacauauguuacuaaccugcaca

SEQ ID NO: 699078 - RNA, 18 nt, Human
uuacugucauggucacaa

SEQ ID NO: 699079 - RNA, 19 nt, Human
uucuugguugggacccugg

SEQ ID NO: 699080 - RNA, 22 nt, Human
uuuauuacccaagaaucaggaa

SEQ ID NO: 699081 - RNA, 20 nt, Human
uuucuugguugggacccugg

SEQ ID NO: 699082 - RNA, 21 nt, Human
aggggcggccgcgcgcgcggg

SEQ ID NO: 699083 - RNA, 22 nt, Human
ccccggagccgcgccgaccucc

SEQ ID NO: 699084 - RNA, 22 nt, Human
ccgccgcgggcucugcccgcuc

SEQ ID NO: 699085 - RNA, 19 nt, Human
cgcgcgcgcgggggcccgg

SEQ ID NO: 699086 - RNA, 18 nt, Human
ugaguggaggggcggccg

SEQ ID NO: 699087 - RNA, 18 nt, Human
aaguggacacagaccaga

SEQ ID NO: 699088 - RNA, 18 nt, Human
aagugguggagccucagg

SEQ ID NO: 699089 - RNA, 21 nt, Human
acaggagcagcucugccuugg

SEQ ID NO: 699090 - RNA, 23 nt, Human
accuugagaggugccaacaaugg

SEQ ID NO: 699091 - RNA, 20 nt, Human
agaccccuucucucacacuu

SEQ ID NO: 699092 - RNA, 20 nt, Human
agacccgaggcagagaacag

SEQ ID NO: 699093 - RNA, 21 nt, Human
agacccgaggcagagaacagc

SEQ ID NO: 699094 - RNA, 26 nt, Human
aggcagacggugaggguggcccagga

SEQ ID NO: 699095 - RNA, 28 nt, Human
aggcagacggugaggguggcccaggagc

SEQ ID NO: 699096 - RNA, 19 nt, Human
aggcauuggaggggacagc

SEQ ID NO: 699097 - RNA, 21 nt, Human
aggccugugggcacuggggug

SEQ ID NO: 699098 - RNA, 24 nt, Human
auaguaauaagguuugccuguguc

SEQ ID NO: 699099 - RNA, 22 nt, Human
auggugugcugggggugggguu

SEQ ID NO: 699100 - RNA, 18 nt, Human
cagcgggacucuuuacuc

SEQ ID NO: 699101 - RNA, 24 nt, Human
caggcaggagcaggcacugaugcu

SEQ ID NO: 699102 - RNA, 21 nt, Human
caggcuguggcugagguggcu

SEQ ID NO: 699103 - RNA, 23 nt, Human
caucucuggucuggggcugaggg

SEQ ID NO: 699104 - RNA, 23 nt, Human
caucuggggccacaugcucacuc

SEQ ID NO: 699105 - RNA, 21 nt, Human
cauuccuggcaucaucggagg

SEQ ID NO: 699106 - RNA, 20 nt, Human
cauuggaggggacagccuug

SEQ ID NO: 699107 - RNA, 23 nt, Human
ccaccccacauggcauauaccac

SEQ ID NO: 699108 - RNA, 23 nt, Human
ccagaacugcuggggcccuccuc

SEQ ID NO: 699109 - RNA, 21 nt, Human
ccagauccuugggccgggucc

SEQ ID NO: 699110 - RNA, 18 nt, Human
ccccacauggcauauacc

SEQ ID NO: 699111 - RNA, 26 nt, Human
ccucugccacccaggcugcguccaac

SEQ ID NO: 699112 - RNA, 25 nt, Human
ccuggagaccccuucucucacacuu

SEQ ID NO: 699113 - RNA, 23 nt, Human
ccuugaacaccaagagcaaccuu

SEQ ID NO: 699114 - RNA, 24 nt, Human
ccuugaaugccugcuuugccuucu

SEQ ID NO: 699115 - RNA, 20 nt, Human
ccuuggacuugagcacgcug

SEQ ID NO: 699116 - RNA, 25 nt, Human
ccuuggacuugagcacgcugggcuu

SEQ ID NO: 699117 - RNA, 20 nt, Human
cgaggcagagaacagcucau

SEQ ID NO: 699118 - RNA, 18 nt, Human
cugacucaugggggguag

SEQ ID NO: 699119 - RNA, 21 nt, Human
cugcuguggcugaugcugucc

SEQ ID NO: 699120 - RNA, 27 nt, Human
cugcuguuuccugcagccucuuguuug

SEQ ID NO: 699121 - RNA, 20 nt, Human
cuuguacucuuuccagggac

SEQ ID NO: 699122 - RNA, 22 nt, Human
gagcaaccuugagaggugccaa

SEQ ID NO: 699123 - RNA, 19 nt, Human
gagcuggcgguguccgcac

SEQ ID NO: 699124 - RNA, 22 nt, Human
gaggccugugggcacuggggug

SEQ ID NO: 699125 - RNA, 22 nt, Human
gcacgcugggcuucucccacac

SEQ ID NO: 699126 - RNA, 21 nt, Human
gccugugggcacugggguggg

SEQ ID NO: 699127 - RNA, 21 nt, Human
gcuuugauuccuccuccuccu

SEQ ID NO: 699128 - RNA, 23 nt, Human
ggacacagaccagacuaaggaag

SEQ ID NO: 699129 - RNA, 18 nt, Human
ggaggccugugggcacug

SEQ ID NO: 699130 - RNA, 21 nt, Human
ggcaaggacugcacuagucca

SEQ ID NO: 699131 - RNA, 19 nt, Human
ggcauauaccacccaucuc

SEQ ID NO: 699132 - RNA, 19 nt, Human
ggccaggaggcacaggugg

SEQ ID NO: 699133 - RNA, 22 nt, Human
ggccaggaggcacagguggggg

SEQ ID NO: 699134 - RNA, 22 nt, Human
ggccuccaacacaucacaaucu

SEQ ID NO: 699135 - RNA, 18 nt, Human
gggccagggcaggcagga

SEQ ID NO: 699136 - RNA, 18 nt, Human
ggggcaggaugccaggug

SEQ ID NO: 699137 - RNA, 23 nt, Human
gguggggccaggaggcacaggug

SEQ ID NO: 699138 - RNA, 24 nt, Human
ggugggguuacuuuagaaaaagug

SEQ ID NO: 699139 - RNA, 24 nt, Human
gguuacuuuagaaaaaguggacac

SEQ ID NO: 699140 - RNA, 20 nt, Human
guccagaacugcuggggccc

SEQ ID NO: 699141 - RNA, 23 nt, Human
uaccacccaucucuggucugggg

SEQ ID NO: 699142 - RNA, 23 nt, Human
uagaaccucuaggucauccagau

SEQ ID NO: 699143 - RNA, 25 nt, Human
uagccccaucggaggaaaggguggg

SEQ ID NO: 699144 - RNA, 20 nt, Human
ucacacagacccgaggcaga

SEQ ID NO: 699145 - RNA, 19 nt, Human
uccagaacugcuggggccc

SEQ ID NO: 699146 - RNA, 19 nt, Human
uccaggaggccugugggca

SEQ ID NO: 699147 - RNA, 22 nt, Human
ucccuggagaccccuucucucc

SEQ ID NO: 699148 - RNA, 21 nt, Human
uccugcuguggcugaugcugu

SEQ ID NO: 699149 - RNA, 23 nt, Human
ucugccacccaggcugcguccaa

SEQ ID NO: 699150 - RNA, 22 nt, Human
ugaagugucuguggcagcugcu

SEQ ID NO: 699151 - RNA, 19 nt, Human
ugacaggcaccgcuggcau

SEQ ID NO: 699152 - RNA, 20 nt, Human
ugaggcagacggugagggug

SEQ ID NO: 699153 - RNA, 24 nt, Human
ugaggcagacggugaggguggccc

SEQ ID NO: 699154 - RNA, 23 nt, Human
ugagguggcuguggcugaagugu

SEQ ID NO: 699155 - RNA, 21 nt, Human
ugaguggugguggcgccccca

SEQ ID NO: 699156 - RNA, 18 nt, Human
ugcugcaggaaccccugu

SEQ ID NO: 699157 - RNA, 19 nt, Human
ugcugcugcuguuuccugc

SEQ ID NO: 699158 - RNA, 21 nt, Human
ugcugcugcuguuuccugcag

SEQ ID NO: 699159 - RNA, 24 nt, Human
ugcuuugccuucucccgguugcuc

SEQ ID NO: 699160 - RNA, 26 nt, Human
ugcuuugccuucucccgguugcucca

SEQ ID NO: 699161 - RNA, 22 nt, Human
uggaagcauugggggcaggaug

SEQ ID NO: 699162 - RNA, 24 nt, Human
uggccuccaacacaucacaaucuu

SEQ ID NO: 699163 - RNA, 21 nt, Human
uggcugagguggcuguggcug

SEQ ID NO: 699164 - RNA, 21 nt, Human
ugggacaggagcagcucugcc

SEQ ID NO: 699165 - RNA, 19 nt, Human
uggggccaggaggcacagg

SEQ ID NO: 699166 - RNA, 19 nt, Human
ugggggcaggaugccaggu

SEQ ID NO: 699167 - RNA, 19 nt, Human
ugggguggggccaggaggc

SEQ ID NO: 699168 - RNA, 20 nt, Human
uggugugcuggggguggggu

SEQ ID NO: 699169 - RNA, 20 nt, Human
uguggcagcugcugcugcug

SEQ ID NO: 699170 - RNA, 20 nt, Human
uuagguccuggguggaggaa

SEQ ID NO: 699171 - RNA, 19 nt, Human
uugauuccuccuccuccug

SEQ ID NO: 699172 - RNA, 18 nt, Human
uugucccucagcaguucc

SEQ ID NO: 699173 - RNA, 18 nt, Human
accccaaccgccuucccc

SEQ ID NO: 699174 - RNA, 19 nt, Human
agaaccccaaccgccuucc

SEQ ID NO: 699175 - RNA, 23 nt, Human
agaaccccaaccgccuuccccgc

SEQ ID NO: 699176 - RNA, 22 nt, Human
caaccgccuuccccgcgcuccc

SEQ ID NO: 699177 - RNA, 20 nt, Human
ucagaaccccaaccgccuuc

SEQ ID NO: 699178 - RNA, 22 nt, Human
ucagaaccccaaccgccuuccc

SEQ ID NO: 699179 - RNA, 23 nt, Human
ucgcgcgcagcugucagaacccc

SEQ ID NO: 699180 - RNA, 21 nt, Human
ucuggacucaggagagggccc

SEQ ID NO: 699181 - RNA, 20 nt, Human
ugagagagagcaggaucgcg

SEQ ID NO: 699182 - RNA, 20 nt, Human
ugcgcauguccacaggcggc

SEQ ID NO: 699183 - RNA, 20 nt, Human
uuuuuuuuuuuuuuuuuccu

SEQ ID NO: 699184 - RNA, 22 nt, Human
aaaaauaaaguacauaugccaa

SEQ ID NO: 699185 - RNA, 24 nt, Human
aaacaugacuuacuauacucaugc

SEQ ID NO: 699186 - RNA, 25 nt, Human
aaagagaaaacuauuugauaaauua

SEQ ID NO: 699187 - RNA, 24 nt, Human
aaagcguuucacccucccggggcu

SEQ ID NO: 699188 - RNA, 23 nt, Human
aacaaaaagaaaauuuuuucuaa

SEQ ID NO: 699189 - RNA, 22 nt, Human
aagcaucagacaugcagugaac

SEQ ID NO: 699190 - RNA, 23 nt, Human
aagcaucagacaugcagugaacu

SEQ ID NO: 699191 - RNA, 18 nt, Human
aagcauucacauugcuag

SEQ ID NO: 699192 - RNA, 24 nt, Human
aauaaagaaaauauaaaauaaaaa

SEQ ID NO: 699193 - RNA, 24 nt, Human
acaacaaaaauaugaaugaaaaaa

SEQ ID NO: 699194 - RNA, 23 nt, Human
acaaugcuauugccaccccacac

SEQ ID NO: 699195 - RNA, 23 nt, Human
acacccaucucuucccuuuucaa

SEQ ID NO: 699196 - RNA, 22 nt, Human
accaccauucccccacaucucc

SEQ ID NO: 699197 - RNA, 28 nt, Human
accaugaagguaugaaaaugcugugacc

SEQ ID NO: 699198 - RNA, 18 nt, Human
accccauucccucucaca

SEQ ID NO: 699199 - RNA, 19 nt, Human
acuaacacagacacaaaga

SEQ ID NO: 699200 - RNA, 23 nt, Human
acuauauaaaaaugguacuugga

SEQ ID NO: 699201 - RNA, 20 nt, Human
agaauaacacgguaaguagc

SEQ ID NO: 699202 - RNA, 22 nt, Human
agacaacaucacaguagauccc

SEQ ID NO: 699203 - RNA, 20 nt, Human
agcccuacacauagcaugcu

SEQ ID NO: 699204 - RNA, 21 nt, Human
aggcggagggcgagcgcgggg

SEQ ID NO: 699205 - RNA, 21 nt, Human
agggcuaauuuauuaaacacu

SEQ ID NO: 699206 - RNA, 23 nt, Human
auaaauuccuggaaacaacaaaa

SEQ ID NO: 699207 - RNA, 19 nt, Human
aucagaccguaaaaccuca

SEQ ID NO: 699208 - RNA, 24 nt, Human
aucagaccguaaaaccucagagua

SEQ ID NO: 699209 - RNA, 26 nt, Human
auggcacaaugcuauugccaccccac

SEQ ID NO: 699210 - RNA, 20 nt, Human
auugcuuuaauaccuguaau

SEQ ID NO: 699211 - RNA, 22 nt, Human
cacaaacaaagaagaugguaac

SEQ ID NO: 699212 - RNA, 21 nt, Human
cacaaugcuauugccacccca

SEQ ID NO: 699213 - RNA, 20 nt, Human
cacacacaggaccuacaaaa

SEQ ID NO: 699214 - RNA, 19 nt, Human
cacagacacaaagagaaaa

SEQ ID NO: 699215 - RNA, 20 nt, Human
cacagacacaaagagaaaac

SEQ ID NO: 699216 - RNA, 19 nt, Human
cacaggaccuacaaaauaa

SEQ ID NO: 699217 - RNA, 20 nt, Human
cacccaucucuucccuuuuc

SEQ ID NO: 699218 - RNA, 22 nt, Human
cacccaucucuucccuuuucaa

SEQ ID NO: 699219 - RNA, 27 nt, Human
caccccacacccaucucuucccuuuuc

SEQ ID NO: 699220 - RNA, 26 nt, Human
cagucugaccaccauucccccacauc

SEQ ID NO: 699221 - RNA, 21 nt, Human
caucacauuuaacaaaaagaa

SEQ ID NO: 699222 - RNA, 23 nt, Human
cauucccccacaucucccacccc

SEQ ID NO: 699223 - RNA, 20 nt, Human
cauucuuagccaaacucuga

SEQ ID NO: 699224 - RNA, 18 nt, Human
cauuuuacagggaagacu

SEQ ID NO: 699225 - RNA, 23 nt, Human
cccaaucacaugauuuucaucac

SEQ ID NO: 699226 - RNA, 19 nt, Human
cccaccccauucccucuca

SEQ ID NO: 699227 - RNA, 24 nt, Human
ccggaggcgacgcgggccuccucc

SEQ ID NO: 699228 - RNA, 21 nt, Human
ccuuuuuuugugaaaaauacu

SEQ ID NO: 699229 - RNA, 22 nt, Human
ccuuuuuuugugaaaaauacug

SEQ ID NO: 699230 - RNA, 20 nt, Human
cgguaaguagcaaaauaaua

SEQ ID NO: 699231 - RNA, 20 nt, Human
cuaaaauuucccccaauuag

SEQ ID NO: 699232 - RNA, 18 nt, Human
cucccggggcucgggcga

SEQ ID NO: 699233 - RNA, 24 nt, Human
cucgaaccacaguuugcuacagca

SEQ ID NO: 699234 - RNA, 25 nt, Human
cugaaugacaucucuuuugcacuga

SEQ ID NO: 699235 - RNA, 18 nt, Human
cuggguuuauaguugguu

SEQ ID NO: 699236 - RNA, 18 nt, Human
cuuagaucaugcuccauc

SEQ ID NO: 699237 - RNA, 18 nt, Human
gaaaaaaaacuccaagga

SEQ ID NO: 699238 - RNA, 23 nt, Human
gaccaccauucccccacaucucc

SEQ ID NO: 699239 - RNA, 21 nt, Human
gagcagcuuuaaaaacacuaa

SEQ ID NO: 699240 - RNA, 22 nt, Human
gcaacagcugauagaaacaaaa

SEQ ID NO: 699241 - RNA, 21 nt, Human
gcacaaugcuauugccacccc

SEQ ID NO: 699242 - RNA, 18 nt, Human
gcgcggggcgagcgcgag

SEQ ID NO: 699243 - RNA, 23 nt, Human
ggcuccugaccaucugaccauuu

SEQ ID NO: 699244 - RNA, 22 nt, Human
ggggcgagcgcgagccccgccg

SEQ ID NO: 699245 - RNA, 18 nt, Human
uaaaaacacuaacacaga

SEQ ID NO: 699246 - RNA, 21 nt, Human
uaaaaacacuaacacagacac

SEQ ID NO: 699247 - RNA, 22 nt, Human
uaaaaacauccauagcuuaagu

SEQ ID NO: 699248 - RNA, 21 nt, Human
uaaaaauggaacuguuuuuga

SEQ ID NO: 699249 - RNA, 18 nt, Human
uaaaaguguugaaaaaaa

SEQ ID NO: 699250 - RNA, 23 nt, Human
uaaaaguguugaaaaaaagacug

SEQ ID NO: 699251 - RNA, 23 nt, Human
uaaauaaagaaaauauaaaauaa

SEQ ID NO: 699252 - RNA, 19 nt, Human
uaacacagacacaaagaga

SEQ ID NO: 699253 - RNA, 26 nt, Human
uaacacagacacaaagagaaaacuau

SEQ ID NO: 699254 - RNA, 23 nt, Human
uaagaugaauaaaccaaaucuca

SEQ ID NO: 699255 - RNA, 23 nt, Human
uaauaacuagucaaucaacuuaa

SEQ ID NO: 699256 - RNA, 26 nt, Human
uacaccaugucugucaauagaauaag

SEQ ID NO: 699257 - RNA, 19 nt, Human
uacucaugcaagugcuuca

SEQ ID NO: 699258 - RNA, 21 nt, Human
uaguagucaaaacuagcugac

SEQ ID NO: 699259 - RNA, 21 nt, Human
uaugaaugaaaaaaaacucca

SEQ ID NO: 699260 - RNA, 22 nt, Human
uauuaaacacuuuacagguuuu

SEQ ID NO: 699261 - RNA, 18 nt, Human
ucaaucaacuuaaaacaa

SEQ ID NO: 699262 - RNA, 22 nt, Human
ucacaguagaucccaaucacau

SEQ ID NO: 699263 - RNA, 23 nt, Human
ucccaccccauucccucucacag

SEQ ID NO: 699264 - RNA, 21 nt, Human
ucuacaauuauuuugcagcug

SEQ ID NO: 699265 - RNA, 24 nt, Human
ucucacagauuucccacagguugc

SEQ ID NO: 699266 - RNA, 20 nt, Human
ucucccuuuucuuuuugguu

SEQ ID NO: 699267 - RNA, 19 nt, Human
ucucuucccuuuucaaaaa

SEQ ID NO: 699268 - RNA, 24 nt, Human
ucugauaggucauuuuauugaaac

SEQ ID NO: 699269 - RNA, 23 nt, Human
ugaaaaaaaacuccaaggaagua

SEQ ID NO: 699270 - RNA, 24 nt, Human
ugaaaauaccaccuuaacccuuaa

SEQ ID NO: 699271 - RNA, 18 nt, Human
ugaaaaugcugugacaaa

SEQ ID NO: 699272 - RNA, 22 nt, Human
ugaaauguacauaauaacuagu

SEQ ID NO: 699273 - RNA, 20 nt, Human
ugaaauucuacuuucugaua

SEQ ID NO: 699274 - RNA, 19 nt, Human
ugaacaucacuagaagcuc

SEQ ID NO: 699275 - RNA, 23 nt, Human
ugaacuagaaauauaucagcauu

SEQ ID NO: 699276 - RNA, 18 nt, Human
ugaagguaugaaaaugcu

SEQ ID NO: 699277 - RNA, 23 nt, Human
ugaauaaaccaaaucucacccug

SEQ ID NO: 699278 - RNA, 18 nt, Human
ugaaugaaaaaaaacucc

SEQ ID NO: 699279 - RNA, 23 nt, Human
ugagaaagacacggacagacaca

SEQ ID NO: 699280 - RNA, 20 nt, Human
ugagaacaaaacccaaaagu

SEQ ID NO: 699281 - RNA, 23 nt, Human
ugagaacaaaacccaaaaguuga

SEQ ID NO: 699282 - RNA, 20 nt, Human
ugccuuugaagacaacauca

SEQ ID NO: 699283 - RNA, 20 nt, Human
ugcuauugccaccccacacc

SEQ ID NO: 699284 - RNA, 19 nt, Human
ugcucgaaccacaguuugc

SEQ ID NO: 699285 - RNA, 24 nt, Human
ugcuuuaauaccuguaaucugcau

SEQ ID NO: 699286 - RNA, 23 nt, Human
uggcacaaugcuauugccacccc

SEQ ID NO: 699287 - RNA, 24 nt, Human
uggcacaguuauaaauaaagaaaa

SEQ ID NO: 699288 - RNA, 19 nt, Human
ugguacuuggaaauacuga

SEQ ID NO: 699289 - RNA, 19 nt, Human
ugucuacaauuauuuugca

SEQ ID NO: 699290 - RNA, 24 nt, Human
uguguacauucugaaauguacaua

SEQ ID NO: 699291 - RNA, 24 nt, Human
uuaaaaauuaucuaaaauuucccc

SEQ ID NO: 699292 - RNA, 22 nt, Human
uuacuaaggcaaggggcgggua

SEQ ID NO: 699293 - RNA, 19 nt, Human
uucacugcuccucuuacua

SEQ ID NO: 699294 - RNA, 18 nt, Human
uuccacacacaggaccua

SEQ ID NO: 699295 - RNA, 23 nt, Human
uucccucucacagauuucccaca

SEQ ID NO: 699296 - RNA, 19 nt, Human
uuccuggaaacaacaaaaa

SEQ ID NO: 699297 - RNA, 22 nt, Human
uugucuacaauuauuuugcagc

SEQ ID NO: 699298 - RNA, 20 nt, Human
uuuauaguugguuccacaca

SEQ ID NO: 699299 - RNA, 24 nt, Human
uuucacagguacuacaagaugguu

SEQ ID NO: 699300 - RNA, 25 nt, Human
uuugaacaaaaaaacaugacuuacu

SEQ ID NO: 699301 - RNA, 24 nt, Human
aaaacugaaaaagacaaaaaaaaa

SEQ ID NO: 699302 - RNA, 24 nt, Human
aaagugcugggauuagaggcguga

SEQ ID NO: 699303 - RNA, 23 nt, Human
aagcgauuccugccucagccucc

SEQ ID NO: 699304 - RNA, 19 nt, Human
aagugcugggauuagaggc

SEQ ID NO: 699305 - RNA, 26 nt, Human
aagugcugggauuagaggcgugagcc

SEQ ID NO: 699306 - RNA, 18 nt, Human
aauagcugggauuauagg

SEQ ID NO: 699307 - RNA, 28 nt, Human
aaucacucaaaaucaagcauguuguagg

SEQ ID NO: 699308 - RNA, 24 nt, Human
acaucuaucuauauauauaguggc

SEQ ID NO: 699309 - RNA, 19 nt, Human
acgggguuucacauguugg

SEQ ID NO: 699310 - RNA, 22 nt, Human
acgggguuucacauguuggcca

SEQ ID NO: 699311 - RNA, 23 nt, Human
acgggguuucacauguuggccag

SEQ ID NO: 699312 - RNA, 24 nt, Human
acgggguuucacauguuggccagg

SEQ ID NO: 699313 - RNA, 19 nt, Human
agaugauaaaacugaaaaa

SEQ ID NO: 699314 - RNA, 21 nt, Human
agaugauaaaacugaaaaaga

SEQ ID NO: 699315 - RNA, 18 nt, Human
agccuccagaauagcugg

SEQ ID NO: 699316 - RNA, 24 nt, Human
aguagugugaucucagcucacugc

SEQ ID NO: 699317 - RNA, 22 nt, Human
aguucuagaagcuucagggagg

SEQ ID NO: 699318 - RNA, 18 nt, Human
auagcugggauuauaggc

SEQ ID NO: 699319 - RNA, 24 nt, Human
caaagugcugggauuagaggcgug

SEQ ID NO: 699320 - RNA, 18 nt, Human
caagcgauuccugccuca

SEQ ID NO: 699321 - RNA, 22 nt, Human
cacauguuggccaggcuggucu

SEQ ID NO: 699322 - RNA, 21 nt, Human
caccacgccgccgcauaagcc

SEQ ID NO: 699323 - RNA, 24 nt, Human
cacugcaaccucugcuuuccaauu

SEQ ID NO: 699324 - RNA, 24 nt, Human
cacugcaaccucugcuuugggccu

SEQ ID NO: 699325 - RNA, 18 nt, Human
cagcuuccgcccggggag

SEQ ID NO: 699326 - RNA, 23 nt, Human
caguggagacgggguuucacaug

SEQ ID NO: 699327 - RNA, 18 nt, Human
cauguuggccaggcuggu

SEQ ID NO: 699328 - RNA, 20 nt, Human
cauguuggccaggcuggucu

SEQ ID NO: 699329 - RNA, 20 nt, Human
cauguuggccaggcuggucu

SEQ ID NO: 699330 - RNA, 24 nt, Human
cauguuggccaggcuggucuugaa

SEQ ID NO: 699331 - RNA, 22 nt, Human
ccaaagugcugggauuagaggc

SEQ ID NO: 699332 - RNA, 24 nt, Human
ccaaagugcugggauuagaggcgu

SEQ ID NO: 699333 - RNA, 21 nt, Human
ccacaccuucuuucugcucca

SEQ ID NO: 699334 - RNA, 23 nt, Human
ccagaauagcugggauuauaggc

SEQ ID NO: 699335 - RNA, 23 nt, Human
ccagaauagcugggauuauaggc

SEQ ID NO: 699336 - RNA, 19 nt, Human
ccauaaauuaauccaguag

SEQ ID NO: 699337 - RNA, 22 nt, Human
cccaagaugauaaaacugaaaa

SEQ ID NO: 699338 - RNA, 19 nt, Human
ccccaggcuggaguacagu

SEQ ID NO: 699339 - RNA, 23 nt, Human
ccgcauaagccccaccucacgcc

SEQ ID NO: 699340 - RNA, 21 nt, Human
ccugaccucgugaucuaccug

SEQ ID NO: 699341 - RNA, 24 nt, Human
cgacuuccggcaacugacacagcu

SEQ ID NO: 699342 - RNA, 18 nt, Human
cgcccggggaggaggcgg

SEQ ID NO: 699343 - RNA, 21 nt, Human
cggggaggaggcggggcuggc

SEQ ID NO: 699344 - RNA, 22 nt, Human
cucacugcaaccucugcuuucc

SEQ ID NO: 699345 - RNA, 24 nt, Human
cuccagaauagcugggauuauagg

SEQ ID NO: 699346 - RNA, 20 nt, Human
cugaaaaagacaaaaaaaaa

SEQ ID NO: 699347 - RNA, 19 nt, Human
cugcaaccucugcuuucca

SEQ ID NO: 699348 - RNA, 20 nt, Human
cugcaaccucugcuuuccaa

SEQ ID NO: 699349 - RNA, 23 nt, Human
cugccucagccuccagaauagcu

SEQ ID NO: 699350 - RNA, 24 nt, Human
cugccucgaccucccaaagugcug

SEQ ID NO: 699351 - RNA, 22 nt, Human
cuuucugcuccaguucuagaag

SEQ ID NO: 699352 - RNA, 18 nt, Human
gaccucgugaucuaccug

SEQ ID NO: 699353 - RNA, 22 nt, Human
gaccucgugaucuaccugccuc

SEQ ID NO: 699354 - RNA, 24 nt, Human
gacuuccggcaacugacacagcuu

SEQ ID NO: 699355 - RNA, 23 nt, Human
gagacgggguuucacauguuggc

SEQ ID NO: 699356 - RNA, 18 nt, Human
gauuagaggcgugagcca

SEQ ID NO: 699357 - RNA, 24 nt, Human
gauuauaggcgcccaccaccaugc

SEQ ID NO: 699358 - RNA, 22 nt, Human
gcaaccucugcuuuccaauuuc

SEQ ID NO: 699359 - RNA, 22 nt, Human
ggaguuucacucuuucccccag

SEQ ID NO: 699360 - RNA, 24 nt, Human
ggcuggucuugaauuccugaccuc

SEQ ID NO: 699361 - RNA, 22 nt, Human
gggguuucacauguuggccagg

SEQ ID NO: 699362 - RNA, 19 nt, Human
ggucuugaauuccugaccu

SEQ ID NO: 699363 - RNA, 22 nt, Human
guggagacgggguuucacaugu

SEQ ID NO: 699364 - RNA, 22 nt, Human
uaaauucuccacaacauaggau

SEQ ID NO: 699365 - RNA, 24 nt, Human
uaauuuuucuauuuucaguggaga

SEQ ID NO: 699366 - RNA, 23 nt, Human
uacaguagugugaucucagcucc

SEQ ID NO: 699367 - RNA, 19 nt, Human
uaccaaaauucuaacucaa

SEQ ID NO: 699368 - RNA, 23 nt, Human
uaccugccucgaccucccaaagu

SEQ ID NO: 699369 - RNA, 19 nt, Human
uagauauucauaagcuguc

SEQ ID NO: 699370 - RNA, 19 nt, Human
uaggcgcccaccaccaugc

SEQ ID NO: 699371 - RNA, 24 nt, Human
uagugugaucucagcucacugcaa

SEQ ID NO: 699372 - RNA, 19 nt, Human
uauuucaccacgccgccgc

SEQ ID NO: 699373 - RNA, 20 nt, Human
ucacucuuucccccaggcug

SEQ ID NO: 699374 - RNA, 22 nt, Human
ucacucuuucccccaggcugga

SEQ ID NO: 699375 - RNA, 23 nt, Human
ucacugcaaccucugcuuuccaa

SEQ ID NO: 699376 - RNA, 26 nt, Human
ucacugcaaccucugcuuugggcccu

SEQ ID NO: 699377 - RNA, 28 nt, Human
ucacugcaaccucugcuuugggcccucc

SEQ ID NO: 699378 - RNA, 25 nt, Human
ucacugcaaccucugcuuugggccu

SEQ ID NO: 699379 - RNA, 24 nt, Human
ucacugcaaccucugcuuugggcu

SEQ ID NO: 699380 - RNA, 26 nt, Human
ucacugcaaccucugcuuuggguacu

SEQ ID NO: 699381 - RNA, 26 nt, Human
ucacugcaaccucugcuuuggguccu

SEQ ID NO: 699382 - RNA, 28 nt, Human
ucacugcaaccucugcuuuggguccucc

SEQ ID NO: 699383 - RNA, 25 nt, Human
ucacugcaaccucugcuuugggucu

SEQ ID NO: 699384 - RNA, 23 nt, Human
ucaguggagacgggguuucacau

SEQ ID NO: 699385 - RNA, 24 nt, Human
uccagaauagcugggauuauaggc

SEQ ID NO: 699386 - RNA, 24 nt, Human
ucccaaagugcugggauuagaggc

SEQ ID NO: 699387 - RNA, 21 nt, Human
uccuaggcagguagcuggccu

SEQ ID NO: 699388 - RNA, 23 nt, Human
ucuacacugauuuuucauacagg

SEQ ID NO: 699389 - RNA, 23 nt, Human
ucucucagacuuccuuucggguu

SEQ ID NO: 699390 - RNA, 18 nt, Human
ucuuggagacacaugcca

SEQ ID NO: 699391 - RNA, 26 nt, Human
ugaacuggguucauaaccuacaucua

SEQ ID NO: 699392 - RNA, 26 nt, Human
ugauaaaacugaaaaagacaaaaaaa

SEQ ID NO: 699393 - RNA, 24 nt, Human
ugccucagccuccagaauagcugg

SEQ ID NO: 699394 - RNA, 24 nt, Human
ugccucgaccucccaaagugcugg

SEQ ID NO: 699395 - RNA, 22 nt, Human
ugcuccaguucuagaagcuuca

SEQ ID NO: 699396 - RNA, 24 nt, Human
uggccaggcuggucuugaauuccu

SEQ ID NO: 699397 - RNA, 18 nt, Human
uggcccugggccacaccu

SEQ ID NO: 699398 - RNA, 18 nt, Human
ugggauuagaggcgugag

SEQ ID NO: 699399 - RNA, 19 nt, Human
ugggauuagaggcgugagc

SEQ ID NO: 699400 - RNA, 22 nt, Human
ugggauuagaggcgugagccac

SEQ ID NO: 699401 - RNA, 24 nt, Human
ugggauuagaggcgugagccacag

SEQ ID NO: 699402 - RNA, 21 nt, Human
ugggauuauaggcgcccacca

SEQ ID NO: 699403 - RNA, 24 nt, Human
ugggauuauaggcgcccaccacca

SEQ ID NO: 699404 - RNA, 25 nt, Human
ugggauuauaggcgcccaccaccau

SEQ ID NO: 699405 - RNA, 21 nt, Human
uuaaucacucaaaaucaagca

SEQ ID NO: 699406 - RNA, 25 nt, Human
uuaaucacucaaaaucaagcauguu

SEQ ID NO: 699407 - RNA, 21 nt, Human
uucauaagcugucuuggagac

SEQ ID NO: 699408 - RNA, 24 nt, Human
uuccugaccucgugaucuaccugc

SEQ ID NO: 699409 - RNA, 18 nt, Human
uugacccaagaugauaaa

SEQ ID NO: 699410 - RNA, 21 nt, Human
uuucacauguuggccaggcug

SEQ ID NO: 699411 - RNA, 23 nt, Human
uuucacauguuggccaggcuggu

SEQ ID NO: 699412 - RNA, 23 nt, Human
uuucacucuuucccccaggcugg

SEQ ID NO: 699413 - RNA, 24 nt, Human
uuucacucuuucccccaggcugga

SEQ ID NO: 699414 - RNA, 24 nt, Human
uuuucaguggagacgggguuucac

SEQ ID NO: 699415 - RNA, 26 nt, Human
uuuuuuuuuuuugagauggaguuuca

SEQ ID NO: 699416 - RNA, 22 nt, Human
uuuuuuuuuuuuuugagaugga

SEQ ID NO: 699417 - RNA, 23 nt, Human
uuuuuuuuuuuuuuuuuuuuggg

SEQ ID NO: 699418 - RNA, 21 nt, Human
aagccugugagguucccuuca

SEQ ID NO: 699419 - RNA, 22 nt, Human
cccuggcuaagccugugagguu

SEQ ID NO: 699420 - RNA, 22 nt, Human
ccuucaaggcucugggacccag

SEQ ID NO: 699421 - RNA, 20 nt, Human
gcccuggcuaagccugugag

SEQ ID NO: 699422 - RNA, 20 nt, Human
aaguauuugaccagcagagc

SEQ ID NO: 699423 - RNA, 19 nt, Human
acaaaauaaauaacccaaa

SEQ ID NO: 699424 - RNA, 23 nt, Human
agcccuucuggagcuaggagugg

SEQ ID NO: 699425 - RNA, 22 nt, Human
aggaggagagaggggaaauagc

SEQ ID NO: 699426 - RNA, 18 nt, Human
aggaguggcaagaguggg

SEQ ID NO: 699427 - RNA, 18 nt, Human
agggagggaggaggcucc

SEQ ID NO: 699428 - RNA, 23 nt, Human
cacccccaaaaagcagcugcagg

SEQ ID NO: 699429 - RNA, 19 nt, Human
caggaaguacuguaguagc

SEQ ID NO: 699430 - RNA, 21 nt, Human
ccccacccccagauccugcaa

SEQ ID NO: 699431 - RNA, 19 nt, Human
cccccaaaaagcagcugca

SEQ ID NO: 699432 - RNA, 21 nt, Human
cccccagauccugcaaaagag

SEQ ID NO: 699433 - RNA, 19 nt, Human
cccuccccacccccagauc

SEQ ID NO: 699434 - RNA, 19 nt, Human
cuugucccuccccaccccc

SEQ ID NO: 699435 - RNA, 21 nt, Human
gaacuagcuugucccucccca

SEQ ID NO: 699436 - RNA, 19 nt, Human
gagaaguuucaagaagguu

SEQ ID NO: 699437 - RNA, 22 nt, Human
gcccagaccagagucaagccuc

SEQ ID NO: 699438 - RNA, 21 nt, Human
gcccugagcccuucuggagcu

SEQ ID NO: 699439 - RNA, 21 nt, Human
ggagaaguuucaagaagguuc

SEQ ID NO: 699440 - RNA, 20 nt, Human
ggcucccacgggagguaaac

SEQ ID NO: 699441 - RNA, 20 nt, Human
gggccaguggccgggccaaa

SEQ ID NO: 699442 - RNA, 24 nt, Human
ggggagaaguuucaagaagguucu

SEQ ID NO: 699443 - RNA, 22 nt, Human
gucccuccccacccccagaucc

SEQ ID NO: 699444 - RNA, 20 nt, Human
uaaacaccaggccuugcgua

SEQ ID NO: 699445 - RNA, 18 nt, Human
uaggagguuggggaacua

SEQ ID NO: 699446 - RNA, 18 nt, Human
ucacuuuaccaauacuga

SEQ ID NO: 699447 - RNA, 22 nt, Human
ucccacgggagguaaacaccag

SEQ ID NO: 699448 - RNA, 18 nt, Human
ucccagagggccacaggg

SEQ ID NO: 699449 - RNA, 23 nt, Human
ucucauuauuuuggggcgaaaau

SEQ ID NO: 699450 - RNA, 18 nt, Human
ugaaugggagaagucagg

SEQ ID NO: 699451 - RNA, 20 nt, Human
uggauuugguuuugagcagg

SEQ ID NO: 699452 - RNA, 19 nt, Human
ugggagaagucaggaagua

SEQ ID NO: 699453 - RNA, 22 nt, Human
ugggagaagucaggaaguacug

SEQ ID NO: 699454 - RNA, 21 nt, Human
uugguuuugagcagggacgug

SEQ ID NO: 699455 - RNA, 19 nt, Human
cacaaacaauugcaagggu

SEQ ID NO: 699456 - RNA, 21 nt, Human
cagggcccuggugucacaaag

SEQ ID NO: 699457 - RNA, 19 nt, Human
ccuaguuaaagcaccaggg

SEQ ID NO: 699458 - RNA, 20 nt, Human
uaaagcaccagggcccuggu

SEQ ID NO: 699459 - RNA, 24 nt, Human
uaagcgucacauauucacaaacaa

SEQ ID NO: 699460 - RNA, 22 nt, Human
uuuuuuuuuuuuuuuuuuacag

SEQ ID NO: 699461 - RNA, 21 nt, Human
aagagacccggagcucaaaua

SEQ ID NO: 699462 - RNA, 19 nt, Human
acaaugccagggaggaaga

SEQ ID NO: 699463 - RNA, 19 nt, Human
accccacaaugccagggag

SEQ ID NO: 699464 - RNA, 23 nt, Human
acgcaguuaaggaggagccaugu

SEQ ID NO: 699465 - RNA, 21 nt, Human
agagaucuuccauccccaccu

SEQ ID NO: 699466 - RNA, 22 nt, Human
aggaagacagguucuaucuaag

SEQ ID NO: 699467 - RNA, 20 nt, Human
aggaaggugaaguggcagca

SEQ ID NO: 699468 - RNA, 22 nt, Human
agucuaucaggaagaaggggaa

SEQ ID NO: 699469 - RNA, 21 nt, Human
agugucacgcccagaccccac

SEQ ID NO: 699470 - RNA, 23 nt, Human
agugucacgcccagaccccacaa

SEQ ID NO: 699471 - RNA, 24 nt, Human
auggggugauacauuagaagugcu

SEQ ID NO: 699472 - RNA, 19 nt, Human
cacacagcuccaagucuau

SEQ ID NO: 699473 - RNA, 25 nt, Human
cacacagcuccaagucuaucaggau

SEQ ID NO: 699474 - RNA, 19 nt, Human
cacagacagcaagcagcau

SEQ ID NO: 699475 - RNA, 21 nt, Human
cagaccccacaaugccaggga

SEQ ID NO: 699476 - RNA, 18 nt, Human
cagcaagcagcaugcucc

SEQ ID NO: 699477 - RNA, 22 nt, Human
cagcugcacaaaaagaaaagua

SEQ ID NO: 699478 - RNA, 24 nt, Human
caggcagccuuggaguggaggcac

SEQ ID NO: 699479 - RNA, 18 nt, Human
cccacaccucugcggacu

SEQ ID NO: 699480 - RNA, 24 nt, Human
ccccacaccucugcggacuaggac

SEQ ID NO: 699481 - RNA, 21 nt, Human
cggagcucaaauagcuuaaau

SEQ ID NO: 699482 - RNA, 18 nt, Human
cuggccgcugguccucuc

SEQ ID NO: 699483 - RNA, 22 nt, Human
gagaguccugcucugcgucugu

SEQ ID NO: 699484 - RNA, 23 nt, Human
ggcaggcugcagggcugguggcu

SEQ ID NO: 699485 - RNA, 19 nt, Human
gggcucagggggccccaac

SEQ ID NO: 699486 - RNA, 19 nt, Human
gguagaagagacccggagc

SEQ ID NO: 699487 - RNA, 24 nt, Human
gguagaagagacccggagcucaaa

SEQ ID NO: 699488 - RNA, 22 nt, Human
guggcucagggcucagggggcc

SEQ ID NO: 699489 - RNA, 19 nt, Human
uagaacaaugacuccaugg

SEQ ID NO: 699490 - RNA, 24 nt, Human
uagaaugcagguagaagagacccg

SEQ ID NO: 699491 - RNA, 18 nt, Human
ucacugaggcucuggccg

SEQ ID NO: 699492 - RNA, 22 nt, Human
ucacugaggcucuggccgcugg

SEQ ID NO: 699493 - RNA, 22 nt, Human
ucaggaagaaggggaaauggga

SEQ ID NO: 699494 - RNA, 20 nt, Human
ucaggaaggugaaguggcag

SEQ ID NO: 699495 - RNA, 19 nt, Human
ucccagugucacgcccaga

SEQ ID NO: 699496 - RNA, 23 nt, Human
ugaaguggcagcagagagagucc

SEQ ID NO: 699497 - RNA, 20 nt, Human
ugccagggaggaagacaggu

SEQ ID NO: 699498 - RNA, 22 nt, Human
ugcccuguccuccaggguggca

SEQ ID NO: 699499 - RNA, 19 nt, Human
uggcagcacaaagcugcug

SEQ ID NO: 699500 - RNA, 21 nt, Human
uggccgcugguccucucucag

SEQ ID NO: 699501 - RNA, 20 nt, Human
ugguggcucagggcucaggg

SEQ ID NO: 699502 - RNA, 20 nt, Human
uuagaagugcuccagggucc

SEQ ID NO: 699503 - RNA, 23 nt, Human
uuggaguggaggcacacagcucc

SEQ ID NO: 699504 - RNA, 19 nt, Human
uugugcccuguccuccagg

SEQ ID NO: 699505 - RNA, 22 nt, Human
aaaaagccaggacacaaaggug

SEQ ID NO: 699506 - RNA, 24 nt, Human
aaaaauaacccacaaugacuccaa

SEQ ID NO: 699507 - RNA, 27 nt, Human
aaauaacccacaaugacuccaaaucuu

SEQ ID NO: 699508 - RNA, 21 nt, Human
aacaacacauacuuggcaaaa

SEQ ID NO: 699509 - RNA, 19 nt, Human
aagauccuccaucccacca

SEQ ID NO: 699510 - RNA, 20 nt, Human
aagauccuccaucccaccaa

SEQ ID NO: 699511 - RNA, 23 nt, Human
aagauccuccaucccaccaaaaa

SEQ ID NO: 699512 - RNA, 21 nt, Human
aagcaacaacacauacuuggc

SEQ ID NO: 699513 - RNA, 26 nt, Human
aagcaacaagaauggugacacaacua

SEQ ID NO: 699514 - RNA, 20 nt, Human
acacaaaggugcuauugagg

SEQ ID NO: 699515 - RNA, 24 nt, Human
acccucuuccaaacuauuuaauuc

SEQ ID NO: 699516 - RNA, 24 nt, Human
acucuacugcucaaugcaaaaugg

SEQ ID NO: 699517 - RNA, 28 nt, Human
aggguccacauagagccacaaagggacu

SEQ ID NO: 699518 - RNA, 21 nt, Human
aguccccagacccgggucagu

SEQ ID NO: 699519 - RNA, 19 nt, Human
auaauuauguaaaaugcau

SEQ ID NO: 699520 - RNA, 23 nt, Human
augcaaaauggagaauauguggu

SEQ ID NO: 699521 - RNA, 26 nt, Human
caaaaauaacccacaaugacuccaaa

SEQ ID NO: 699522 - RNA, 22 nt, Human
caaaauggagaauauguggucc

SEQ ID NO: 699523 - RNA, 22 nt, Human
caacaacacauacuuggcaaaa

SEQ ID NO: 699524 - RNA, 23 nt, Human
caacaagaauggugacacaacua

SEQ ID NO: 699525 - RNA, 19 nt, Human
cacaaagggacucauccuc

SEQ ID NO: 699526 - RNA, 23 nt, Human
cacauacuuggcaaaaucuucua

SEQ ID NO: 699527 - RNA, 20 nt, Human
cacugucugacccuuuuaaa

SEQ ID NO: 699528 - RNA, 22 nt, Human
cagaaacaaaccaaacaacauc

SEQ ID NO: 699529 - RNA, 25 nt, Human
cagaaacaaaccaaacaacauccua

SEQ ID NO: 699530 - RNA, 23 nt, Human
caggacacaaaggugcuauugag

SEQ ID NO: 699531 - RNA, 19 nt, Human
caucccaccaaaaauaacc

SEQ ID NO: 699532 - RNA, 21 nt, Human
cauggaccacaugauuagccu

SEQ ID NO: 699533 - RNA, 18 nt, Human
ccacauagagccacaaag

SEQ ID NO: 699534 - RNA, 23 nt, Human
ccaccaaaaauaacccacaauga

SEQ ID NO: 699535 - RNA, 21 nt, Human
cccaggcuuaccuuccagaaa

SEQ ID NO: 699536 - RNA, 22 nt, Human
cccccuccacacugucugaccc

SEQ ID NO: 699537 - RNA, 28 nt, Human
ccccuccacacugucugacccuuuuaaa

SEQ ID NO: 699538 - RNA, 19 nt, Human
cggcaggcggcugcaauac

SEQ ID NO: 699539 - RNA, 21 nt, Human
cuacaggaaucgggaacgggg

SEQ ID NO: 699540 - RNA, 23 nt, Human
cucaaguuaucaaacaaaaaagu

SEQ ID NO: 699541 - RNA, 23 nt, Human
cuccaucccaccaaaaauaaccc

SEQ ID NO: 699542 - RNA, 18 nt, Human
cuugggacuaaacuguuc

SEQ ID NO: 699543 - RNA, 20 nt, Human
cuuuccacuguacucuacug

SEQ ID NO: 699544 - RNA, 20 nt, Human
gagaacuucugauuauacag

SEQ ID NO: 699545 - RNA, 21 nt, Human
gagccacaaagggacucaucc

SEQ ID NO: 699546 - RNA, 25 nt, Human
gcucuauaaaguucauaucaaauac

SEQ ID NO: 699547 - RNA, 19 nt, Human
ggcaauaagagaaaccgaa

SEQ ID NO: 699548 - RNA, 21 nt, Human
gggaacggggauguagaggaa

SEQ ID NO: 699549 - RNA, 23 nt, Human
gggaacucccccuccacacuguc

SEQ ID NO: 699550 - RNA, 21 nt, Human
uaaaaagcaacaagaauggug

SEQ ID NO: 699551 - RNA, 28 nt, Human
uaaaaagcaacaagaauggugacacaaa

SEQ ID NO: 699552 - RNA, 23 nt, Human
uaaauucaucaaugccauauuua

SEQ ID NO: 699553 - RNA, 24 nt, Human
uaacccacaaugacuccaaaucuu

SEQ ID NO: 699554 - RNA, 21 nt, Human
uaagagaaaccgaacggcgcc

SEQ ID NO: 699555 - RNA, 19 nt, Human
uaauccaacccucuuccaa

SEQ ID NO: 699556 - RNA, 21 nt, Human
uacaauugagguucagagaac

SEQ ID NO: 699557 - RNA, 23 nt, Human
uagccugauuuuuaaaaagcaac

SEQ ID NO: 699558 - RNA, 18 nt, Human
uauaucuuuauacaauuu

SEQ ID NO: 699559 - RNA, 24 nt, Human
uauuuuuaauacuuuaccccccuu

SEQ ID NO: 699560 - RNA, 21 nt, Human
ucagaaacaaaccaaacaaca

SEQ ID NO: 699561 - RNA, 19 nt, Human
uccacauagagccacaaag

SEQ ID NO: 699562 - RNA, 27 nt, Human
uccacuguacucuacugagcggguccg

SEQ ID NO: 699563 - RNA, 20 nt, Human
uccacuguacucuacugcuc

SEQ ID NO: 699564 - RNA, 18 nt, Human
uccccagacccgggucag

SEQ ID NO: 699565 - RNA, 18 nt, Human
ucgcuagaugaaacugcg

SEQ ID NO: 699566 - RNA, 20 nt, Human
ucucccaggcuuaccuuccc

SEQ ID NO: 699567 - RNA, 23 nt, Human
ugaaaaagccaggacacaaaggu

SEQ ID NO: 699568 - RNA, 24 nt, Human
ugaacaaacucauaauuauguaaa

SEQ ID NO: 699569 - RNA, 22 nt, Human
ugaaggcaauaagagaaaccga

SEQ ID NO: 699570 - RNA, 27 nt, Human
ugcaaaauuuaaacacucagaaacaaa

SEQ ID NO: 699571 - RNA, 18 nt, Human
ugcaauacagccgcuacu

SEQ ID NO: 699572 - RNA, 24 nt, Human
uggcauuugugcaggucaagcuuu

SEQ ID NO: 699573 - RNA, 23 nt, Human
ugucugcugcuuuugggcagagu

SEQ ID NO: 699574 - RNA, 21 nt, Human
uuaaauauccauaauugcaag

SEQ ID NO: 699575 - RNA, 31 nt, Human
uuaacacuuucagcaauugauucucucacag

SEQ ID NO: 699576 - RNA, 23 nt, Human
uuccagaaacuagaacauuaacc

SEQ ID NO: 699577 - RNA, 22 nt, Human
uugcuuaugugucucccaggcu

SEQ ID NO: 699578 - RNA, 25 nt, Human
uugucucacacauuuuauauaaagu

SEQ ID NO: 699579 - RNA, 21 nt, Human
uuuaaaaaaugaaaaagccag

SEQ ID NO: 699580 - RNA, 18 nt, Human
uuuaagauccuccauccc

SEQ ID NO: 699581 - RNA, 19 nt, Human
uuuaagauccuccauccca

SEQ ID NO: 699582 - RNA, 18 nt, Human
uuuuacaucaacuaaauu

SEQ ID NO: 699583 - RNA, 20 nt, Human
aaagugcugggauuacaggc

SEQ ID NO: 699584 - RNA, 20 nt, Human
aaagugcugggauuacaggc

SEQ ID NO: 699585 - RNA, 24 nt, Human
aaagugcugggauuacaggcguca

SEQ ID NO: 699586 - RNA, 24 nt, Human
aaagugcugggauuacaggcguca

SEQ ID NO: 699587 - RNA, 27 nt, Human
aagcgauucuccugccucggccuccca

SEQ ID NO: 699588 - RNA, 24 nt, Human
aaggauccucccaacucagccucc

SEQ ID NO: 699589 - RNA, 24 nt, Human
aaggauccucccaacucagccucc

SEQ ID NO: 699590 - RNA, 19 nt, Human
aagugcugggauuacaggc

SEQ ID NO: 699591 - RNA, 19 nt, Human
aagugcugggauuacaggc

SEQ ID NO: 699592 - RNA, 19 nt, Human
aagugcugggauuacaggc

SEQ ID NO: 699593 - RNA, 19 nt, Human
aagugcugggauuacaggc

SEQ ID NO: 699594 - RNA, 19 nt, Human
acggggucucacuauguug

SEQ ID NO: 699595 - RNA, 19 nt, Human
acggggucucacuauguug

SEQ ID NO: 699596 - RNA, 20 nt, Human
acggggucucacuauguugu

SEQ ID NO: 699597 - RNA, 20 nt, Human
acggggucucacuauguugu

SEQ ID NO: 699598 - RNA, 24 nt, Human
acggggucucacuauguuguccag

SEQ ID NO: 699599 - RNA, 24 nt, Human
acggggucucacuauguuguccag

SEQ ID NO: 699600 - RNA, 24 nt, Human
acuauguuguccaggcuggucucg

SEQ ID NO: 699601 - RNA, 24 nt, Human
acuauguuguccaggcuggucucg

SEQ ID NO: 699602 - RNA, 24 nt, Human
acuccugggcucaagcgauucucc

SEQ ID NO: 699603 - RNA, 24 nt, Human
acuccugggcucaagcgauucucc

SEQ ID NO: 699604 - RNA, 20 nt, Human
acucucucugcccccuuccu

SEQ ID NO: 699605 - RNA, 19 nt, Human
aggcuggagugcaguggca

SEQ ID NO: 699606 - RNA, 19 nt, Human
aggcuggagugcaguggca

SEQ ID NO: 699607 - RNA, 20 nt, Human
agugcaguggcacgaucaag

SEQ ID NO: 699608 - RNA, 20 nt, Human
agugcaguggcacgaucaag

SEQ ID NO: 699609 - RNA, 18 nt, Human
agugcugggauuacaggc

SEQ ID NO: 699610 - RNA, 18 nt, Human
agugcugggauuacaggc

SEQ ID NO: 699611 - RNA, 22 nt, Human
auuuuuauuuuauuuuuggaga

SEQ ID NO: 699612 - RNA, 19 nt, Human
caaaggauccucccaacuc

SEQ ID NO: 699613 - RNA, 19 nt, Human
caaaggauccucccaacuc

SEQ ID NO: 699614 - RNA, 25 nt, Human
caaagugcugggauuacaggcguca

SEQ ID NO: 699615 - RNA, 25 nt, Human
caaagugcugggauuacaggcguca

SEQ ID NO: 699616 - RNA, 24 nt, Human
caacucagccucccggguagcugg

SEQ ID NO: 699617 - RNA, 22 nt, Human
caagcgauucuccugccucggc

SEQ ID NO: 699618 - RNA, 22 nt, Human
caagcgauucuccugccucggc

SEQ ID NO: 699619 - RNA, 28 nt, Human
caagcgauucuccugccucggccuccca

SEQ ID NO: 699620 - RNA, 21 nt, Human
cacaccaggcuaauuugugua

SEQ ID NO: 699621 - RNA, 21 nt, Human
cacaccaggcuaauuugugua

SEQ ID NO: 699622 - RNA, 23 nt, Human
cacgaucaaggcucacugcaacc

SEQ ID NO: 699623 - RNA, 23 nt, Human
cacgaucaaggcucacugcaacc

SEQ ID NO: 699624 - RNA, 24 nt, Human
cacuauguuguccaggcuggucuc

SEQ ID NO: 699625 - RNA, 24 nt, Human
cacuauguuguccaggcuggucuc

SEQ ID NO: 699626 - RNA, 19 nt, Human
cagccaccauguauggcca

SEQ ID NO: 699627 - RNA, 19 nt, Human
cagggcucaaaggauccuc

SEQ ID NO: 699628 - RNA, 19 nt, Human
cagggcucaaaggauccuc

SEQ ID NO: 699629 - RNA, 22 nt, Human
cagggcucaaaggauccuccca

SEQ ID NO: 699630 - RNA, 20 nt, Human
cauaacucucucugcccccu

SEQ ID NO: 699631 - RNA, 23 nt, Human
ccaaagcugugggcgcggggcuc

SEQ ID NO: 699632 - RNA, 20 nt, Human
ccaaagugcugggauuacag

SEQ ID NO: 699633 - RNA, 22 nt, Human
ccaaagugcugggauuacaggc

SEQ ID NO: 699634 - RNA, 22 nt, Human
ccaaagugcugggauuacaggc

SEQ ID NO: 699635 - RNA, 22 nt, Human
ccaaagugcugggauuacaggc

SEQ ID NO: 699636 - RNA, 22 nt, Human
ccaaagugcugggauuacaggc

SEQ ID NO: 699637 - RNA, 24 nt, Human
ccaaagugcugggauuacaggcgu

SEQ ID NO: 699638 - RNA, 24 nt, Human
ccaaagugcugggauuacaggcgu

SEQ ID NO: 699639 - RNA, 19 nt, Human
ccccaggcuggagugcagu

SEQ ID NO: 699640 - RNA, 19 nt, Human
ccccaggcuggagugcagu

SEQ ID NO: 699641 - RNA, 19 nt, Human
cccccuuccuccuaguccc

SEQ ID NO: 699642 - RNA, 20 nt, Human
ccccuuccuccuagucccca

SEQ ID NO: 699643 - RNA, 24 nt, Human
ccucccaacucagccucccgggua

SEQ ID NO: 699644 - RNA, 24 nt, Human
ccucccaacucagccucccgggua

SEQ ID NO: 699645 - RNA, 27 nt, Human
ccucccaacucagccucccggguagcu

SEQ ID NO: 699646 - RNA, 27 nt, Human
ccucccaacucagccucccggguagcu

SEQ ID NO: 699647 - RNA, 20 nt, Human
ccucccggguagcugggacc

SEQ ID NO: 699648 - RNA, 20 nt, Human
ccucccggguagcugggacc

SEQ ID NO: 699649 - RNA, 20 nt, Human
ccugggcucaagcgauucuc

SEQ ID NO: 699650 - RNA, 20 nt, Human
ccugggcucaagcgauucuc

SEQ ID NO: 699651 - RNA, 23 nt, Human
ccugggcucaagcgauucuccug

SEQ ID NO: 699652 - RNA, 23 nt, Human
ccugggcucaagcgauucuccug

SEQ ID NO: 699653 - RNA, 21 nt, Human
cgaucaaggcucacugcaacc

SEQ ID NO: 699654 - RNA, 24 nt, Human
cggggucucacuauguuguccagg

SEQ ID NO: 699655 - RNA, 24 nt, Human
cggggucucacuauguuguccagg

SEQ ID NO: 699656 - RNA, 25 nt, Human
cguggagcucacgcuuggucugugc

SEQ ID NO: 699657 - RNA, 24 nt, Human
cucaagcgauucuccugccucggc

SEQ ID NO: 699658 - RNA, 24 nt, Human
cucaagcgauucuccugccucggc

SEQ ID NO: 699659 - RNA, 21 nt, Human
cucagccucccggguagcugg

SEQ ID NO: 699660 - RNA, 24 nt, Human
cucagccucccggguagcugggac

SEQ ID NO: 699661 - RNA, 24 nt, Human
cucagccucccggguagcugggac

SEQ ID NO: 699662 - RNA, 24 nt, Human
cucccggguagcugggaccacagg

SEQ ID NO: 699663 - RNA, 24 nt, Human
cucccggguagcugggaccacagg

SEQ ID NO: 699664 - RNA, 21 nt, Human
cuccugggcucaagcgauucu

SEQ ID NO: 699665 - RNA, 21 nt, Human
cuccugggcucaagcgauucu

SEQ ID NO: 699666 - RNA, 23 nt, Human
cuccugggcucaagcgauucucc

SEQ ID NO: 699667 - RNA, 25 nt, Human
cuccugggcucaagcgauucuccug

SEQ ID NO: 699668 - RNA, 19 nt, Human
cucucugcccccuuccucc

SEQ ID NO: 699669 - RNA, 23 nt, Human
cugccucggccucccaaagugcu

SEQ ID NO: 699670 - RNA, 23 nt, Human
cugccucggccucccaaagugcu

SEQ ID NO: 699671 - RNA, 18 nt, Human
cugucccccaggcuggag

SEQ ID NO: 699672 - RNA, 23 nt, Human
gacccgcguggagcucacgcuug

SEQ ID NO: 699673 - RNA, 20 nt, Human
gagacagggucgugcucugu

SEQ ID NO: 699674 - RNA, 18 nt, Human
gauuacaggcgucagcca

SEQ ID NO: 699675 - RNA, 18 nt, Human
gauuacaggcgucagcca

SEQ ID NO: 699676 - RNA, 21 nt, Human
gauuacaggcgucagccacca

SEQ ID NO: 699677 - RNA, 21 nt, Human
gauuacaggcgucagccacca

SEQ ID NO: 699678 - RNA, 24 nt, Human
gauuacaggcgucagccaccaugu

SEQ ID NO: 699679 - RNA, 24 nt, Human
gauuacaggcgucagccaccaugu

SEQ ID NO: 699680 - RNA, 24 nt, Human
gcgauggaaccggaggccaaagcu

SEQ ID NO: 699681 - RNA, 19 nt, Human
gcgggccaccacaccaggc

SEQ ID NO: 699682 - RNA, 19 nt, Human
gcgggccaccacaccaggc

SEQ ID NO: 699683 - RNA, 20 nt, Human
gcgucagccaccauguaugg

SEQ ID NO: 699684 - RNA, 20 nt, Human
gcgucagccaccauguaugg

SEQ ID NO: 699685 - RNA, 19 nt, Human
gcucugucccccaggcugg

SEQ ID NO: 699686 - RNA, 19 nt, Human
gcucugucccccaggcugg

SEQ ID NO: 699687 - RNA, 20 nt, Human
gcucugucccccaggcugga

SEQ ID NO: 699688 - RNA, 20 nt, Human
gcucugucccccaggcugga

SEQ ID NO: 699689 - RNA, 19 nt, Human
gcuggagugcaguggcacg

SEQ ID NO: 699690 - RNA, 19 nt, Human
gcuggagugcaguggcacg

SEQ ID NO: 699691 - RNA, 20 nt, Human
gcugggauuacaggcgucag

SEQ ID NO: 699692 - RNA, 20 nt, Human
gcugggauuacaggcgucag

SEQ ID NO: 699693 - RNA, 18 nt, Human
ggagacagggucgugcuc

SEQ ID NO: 699694 - RNA, 18 nt, Human
ggagacagggucgugcuc

SEQ ID NO: 699695 - RNA, 22 nt, Human
ggagacagggucgugcucuguc

SEQ ID NO: 699696 - RNA, 22 nt, Human
ggagacagggucgugcucuguc

SEQ ID NO: 699697 - RNA, 24 nt, Human
ggauuacaggcgucagccaccaug

SEQ ID NO: 699698 - RNA, 24 nt, Human
ggauuacaggcgucagccaccaug

SEQ ID NO: 699699 - RNA, 20 nt, Human
ggcauagaacaucccccuuu

SEQ ID NO: 699700 - RNA, 22 nt, Human
gggcucaagcgauucuccugcc

SEQ ID NO: 699701 - RNA, 22 nt, Human
gggcucaagcgauucuccugcc

SEQ ID NO: 699702 - RNA, 22 nt, Human
gggucucacuauguuguccagg

SEQ ID NO: 699703 - RNA, 24 nt, Human
ggucucacuauguuguccaggcug

SEQ ID NO: 699704 - RNA, 24 nt, Human
ggucucacuauguuguccaggcug

SEQ ID NO: 699705 - RNA, 24 nt, Human
uaauuuguguauuuuuugcauaga

SEQ ID NO: 699706 - RNA, 24 nt, Human
uaauuuguguauuuuuugcauaga

SEQ ID NO: 699707 - RNA, 19 nt, Human
uauguuguccaggcugguc

SEQ ID NO: 699708 - RNA, 21 nt, Human
uauguuguccaggcuggucuc

SEQ ID NO: 699709 - RNA, 24 nt, Human
uauguuguccaggcuggucucgaa

SEQ ID NO: 699710 - RNA, 24 nt, Human
uauguuguccaggcuggucucgaa

SEQ ID NO: 699711 - RNA, 23 nt, Human
uauuuuauuuuuggagacagggu

SEQ ID NO: 699712 - RNA, 23 nt, Human
uauuuuauuuuuggagacagggu

SEQ ID NO: 699713 - RNA, 23 nt, Human
uauuuuuauuuuauuuuuggaga

SEQ ID NO: 699714 - RNA, 23 nt, Human
ucacugcaaccucgacuuucagg

SEQ ID NO: 699715 - RNA, 23 nt, Human
ucacugcaaccucgacuuucagg

SEQ ID NO: 699716 - RNA, 23 nt, Human
ucacugcaaccucgacuuucagg

SEQ ID NO: 699717 - RNA, 23 nt, Human
ucacugcaaccucgacuuucagg

SEQ ID NO: 699718 - RNA, 24 nt, Human
ucacugcaaccucgacuuucaggg

SEQ ID NO: 699719 - RNA, 24 nt, Human
ucacugcaaccucgacuuucaggg

SEQ ID NO: 699720 - RNA, 21 nt, Human
ucagccaccauguauggccau

SEQ ID NO: 699721 - RNA, 24 nt, Human
ucagccaccauguauggccauuuc

SEQ ID NO: 699722 - RNA, 24 nt, Human
ucagccaccauguauggccauuuc

SEQ ID NO: 699723 - RNA, 23 nt, Human
ucagccucccggguagcugggac

SEQ ID NO: 699724 - RNA, 23 nt, Human
ucagccucccggguagcugggac

SEQ ID NO: 699725 - RNA, 24 nt, Human
ucccaaagugcugggauuacaggc

SEQ ID NO: 699726 - RNA, 24 nt, Human
ucccaaagugcugggauuacaggc

SEQ ID NO: 699727 - RNA, 24 nt, Human
ucccccaggcuggagugcaguggc

SEQ ID NO: 699728 - RNA, 24 nt, Human
ucccccaggcuggagugcaguggc

SEQ ID NO: 699729 - RNA, 18 nt, Human
ucccccuuuacgccuggg

SEQ ID NO: 699730 - RNA, 23 nt, Human
ucccggguagcugggaccacagg

SEQ ID NO: 699731 - RNA, 23 nt, Human
ucccggguagcugggaccacagg

SEQ ID NO: 699732 - RNA, 24 nt, Human
ucccggguagcugggaccacaggu

SEQ ID NO: 699733 - RNA, 24 nt, Human
ucccggguagcugggaccacaggu

SEQ ID NO: 699734 - RNA, 21 nt, Human
uccugggcucaagcgauucuc

SEQ ID NO: 699735 - RNA, 21 nt, Human
uccugggcucaagcgauucuc

SEQ ID NO: 699736 - RNA, 22 nt, Human
uccugggcucaagcgauucucc

SEQ ID NO: 699737 - RNA, 22 nt, Human
uccugggcucaagcgauucucc

SEQ ID NO: 699738 - RNA, 24 nt, Human
uccugggcucaagcgauucuccug

SEQ ID NO: 699739 - RNA, 24 nt, Human
uccugggcucaagcgauucuccug

SEQ ID NO: 699740 - RNA, 18 nt, Human
ucggccucccaaagugcu

SEQ ID NO: 699741 - RNA, 18 nt, Human
ucggccucccaaagugcu

SEQ ID NO: 699742 - RNA, 23 nt, Human
ucgugcucugucccccaggcugg

SEQ ID NO: 699743 - RNA, 23 nt, Human
ucgugcucugucccccaggcugg

SEQ ID NO: 699744 - RNA, 24 nt, Human
ucgugcucugucccccaggcugga

SEQ ID NO: 699745 - RNA, 24 nt, Human
ucgugcucugucccccaggcugga

SEQ ID NO: 699746 - RNA, 19 nt, Human
ucucacuauguuguccagg

SEQ ID NO: 699747 - RNA, 19 nt, Human
ucucacuauguuguccagg

SEQ ID NO: 699748 - RNA, 23 nt, Human
ucucacuauguuguccaggcugg

SEQ ID NO: 699749 - RNA, 23 nt, Human
ucucacuauguuguccaggcugg

SEQ ID NO: 699750 - RNA, 24 nt, Human
ucucacuauguuguccaggcuggu

SEQ ID NO: 699751 - RNA, 24 nt, Human
ucucacuauguuguccaggcuggu

SEQ ID NO: 699752 - RNA, 19 nt, Human
ucucgaacuccugggcuca

SEQ ID NO: 699753 - RNA, 22 nt, Human
ucucgaacuccugggcucaagc

SEQ ID NO: 699754 - RNA, 23 nt, Human
ucucgaacuccugggcucaagcg

SEQ ID NO: 699755 - RNA, 20 nt, Human
ucucggggucauaacucucu

SEQ ID NO: 699756 - RNA, 18 nt, Human
ucucucugcccccuuccc

SEQ ID NO: 699757 - RNA, 19 nt, Human
ucugucccccaggcuggag

SEQ ID NO: 699758 - RNA, 24 nt, Human
ucugucccccaggcuggagugcag

SEQ ID NO: 699759 - RNA, 24 nt, Human
ucugucccccaggcuggagugcag

SEQ ID NO: 699760 - RNA, 21 nt, Human
ugcccccuuccuccuaguccc

SEQ ID NO: 699761 - RNA, 22 nt, Human
ugcccccuuccuccuagucccc

SEQ ID NO: 699762 - RNA, 21 nt, Human
ugccucggccucccaaagugc

SEQ ID NO: 699763 - RNA, 21 nt, Human
ugccucggccucccaaagugc

SEQ ID NO: 699764 - RNA, 24 nt, Human
ugccucggccucccaaagugcugg

SEQ ID NO: 699765 - RNA, 24 nt, Human
ugccucggccucccaaagugcugg

SEQ ID NO: 699766 - RNA, 19 nt, Human
ugcucugucccccaggcug

SEQ ID NO: 699767 - RNA, 21 nt, Human
ugcucugucccccaggcugga

SEQ ID NO: 699768 - RNA, 21 nt, Human
ugcucugucccccaggcugga

SEQ ID NO: 699769 - RNA, 24 nt, Human
ugcucugucccccaggcuggagug

SEQ ID NO: 699770 - RNA, 24 nt, Human
ugcucugucccccaggcuggagug

SEQ ID NO: 699771 - RNA, 20 nt, Human
ugcugggauuacaggcguca

SEQ ID NO: 699772 - RNA, 20 nt, Human
ugcugggauuacaggcguca

SEQ ID NO: 699773 - RNA, 22 nt, Human
uggagacagggucgugcucugu

SEQ ID NO: 699774 - RNA, 21 nt, Human
uggagugcaguggcacgauca

SEQ ID NO: 699775 - RNA, 21 nt, Human
uggagugcaguggcacgauca

SEQ ID NO: 699776 - RNA, 24 nt, Human
uggagugcaguggcacgaucaagg

SEQ ID NO: 699777 - RNA, 24 nt, Human
uggagugcaguggcacgaucaagg

SEQ ID NO: 699778 - RNA, 21 nt, Human
ugggaccacaggugcgggcca

SEQ ID NO: 699779 - RNA, 21 nt, Human
ugggaccacaggugcgggcca

SEQ ID NO: 699780 - RNA, 24 nt, Human
ugggaccacaggugcgggccacca

SEQ ID NO: 699781 - RNA, 24 nt, Human
ugggaccacaggugcgggccacca

SEQ ID NO: 699782 - RNA, 18 nt, Human
ugggauuacaggcgucag

SEQ ID NO: 699783 - RNA, 18 nt, Human
ugggauuacaggcgucag

SEQ ID NO: 699784 - RNA, 22 nt, Human
ugggauuacaggcgucagccac

SEQ ID NO: 699785 - RNA, 22 nt, Human
ugggauuacaggcgucagccac

SEQ ID NO: 699786 - RNA, 24 nt, Human
ugggauuacaggcgucagccacca

SEQ ID NO: 699787 - RNA, 24 nt, Human
ugggauuacaggcgucagccacca

SEQ ID NO: 699788 - RNA, 25 nt, Human
ugggauuacaggcgucagccaccau

SEQ ID NO: 699789 - RNA, 25 nt, Human
ugggauuacaggcgucagccaccau

SEQ ID NO: 699790 - RNA, 24 nt, Human
ugggcucaagcgauucuccugccu

SEQ ID NO: 699791 - RNA, 24 nt, Human
ugggcucaagcgauucuccugccu

SEQ ID NO: 699792 - RNA, 24 nt, Human
uguccaggcuggucucgaacuccu

SEQ ID NO: 699793 - RNA, 24 nt, Human
uguccaggcuggucucgaacuccu

SEQ ID NO: 699794 - RNA, 24 nt, Human
ugucgacccgcguggagcucacgc

SEQ ID NO: 699795 - RNA, 19 nt, Human
uuggagacagggucgugcu

SEQ ID NO: 699796 - RNA, 19 nt, Human
uuggagacagggucgugcu

SEQ ID NO: 699797 - RNA, 25 nt, Human
uuucagggcucaaaggauccuccca

SEQ ID NO: 699798 - RNA, 25 nt, Human
aaagacaaaugaaguuuuuuagccc

SEQ ID NO: 699799 - RNA, 20 nt, Human
aacucacuguguaauaggac

SEQ ID NO: 699800 - RNA, 19 nt, Human
agaaaaucuagagcaaggg

SEQ ID NO: 699801 - RNA, 18 nt, Human
agagcaagggauaacuuc

SEQ ID NO: 699802 - RNA, 22 nt, Human
aggacacauuuuaauaaacaaa

SEQ ID NO: 699803 - RNA, 19 nt, Human
auaccaugacugggaagcc

SEQ ID NO: 699804 - RNA, 20 nt, Human
caaugucauuguuccagacc

SEQ ID NO: 699805 - RNA, 23 nt, Human
cagcugaacuuucagaugaaguu

SEQ ID NO: 699806 - RNA, 18 nt, Human
ccagacacuucugaaaau

SEQ ID NO: 699807 - RNA, 18 nt, Human
ccaguccacaccucugcc

SEQ ID NO: 699808 - RNA, 20 nt, Human
ccgcgugggagugccgcggc

SEQ ID NO: 699809 - RNA, 18 nt, Human
ccucugccggacagaggu

SEQ ID NO: 699810 - RNA, 19 nt, Human
cuuuuagcaugagcgguaa

SEQ ID NO: 699811 - RNA, 22 nt, Human
gaugaaguugacuucuacuuga

SEQ ID NO: 699812 - RNA, 19 nt, Human
gcgccggcuuuuccagccc

SEQ ID NO: 699813 - RNA, 19 nt, Human
gcgccggcuuuuccagccc

SEQ ID NO: 699814 - RNA, 21 nt, Human
gcuuuuccagcccuccugccc

SEQ ID NO: 699815 - RNA, 18 nt, Human
gggagugccgcggccuuu

SEQ ID NO: 699816 - RNA, 21 nt, Human
gugugucuuaaguuggcaaug

SEQ ID NO: 699817 - RNA, 21 nt, Human
uaaucuuuuaagguucucuua

SEQ ID NO: 699818 - RNA, 18 nt, Human
uaccaugacugggaagcc

SEQ ID NO: 699819 - RNA, 24 nt, Human
uacuguacaugggaucuuuacaua

SEQ ID NO: 699820 - RNA, 24 nt, Human
ucaguguguguuugucacugagug

SEQ ID NO: 699821 - RNA, 22 nt, Human
uccauuuucuucagaaaaucua

SEQ ID NO: 699822 - RNA, 18 nt, Human
ucccucaggccuucagug

SEQ ID NO: 699823 - RNA, 20 nt, Human
ugaaaaagacaaaugaaguu

SEQ ID NO: 699824 - RNA, 24 nt, Human
ugaaaacagcugaacuuucagaug

SEQ ID NO: 699825 - RNA, 22 nt, Human
ugaccagacacuucugaaaauc

SEQ ID NO: 699826 - RNA, 19 nt, Human
ugcggacuucgggguccgc

SEQ ID NO: 699827 - RNA, 20 nt, Human
uggucuccaguccacaccuc

SEQ ID NO: 699828 - RNA, 22 nt, Human
uguguaauaggacacauuuuaa

SEQ ID NO: 699829 - RNA, 20 nt, Human
uuaaaguuuuguauauugac

SEQ ID NO: 699830 - RNA, 18 nt, Human
uucagaaaaucuagagca

SEQ ID NO: 699831 - RNA, 21 nt, Human
uuuucaccaccauugcuugau

SEQ ID NO: 699832 - RNA, 21 nt, Human
uuuuccagcccuccugcccac

SEQ ID NO: 699833 - RNA, 24 nt, Human
uuuuuuauuuuuaauguuuuuaau

SEQ ID NO: 699834 - RNA, 18 nt, Human
aacaaaaucucccaugca

SEQ ID NO: 699835 - RNA, 23 nt, Human
aacugggcagucagaucugccaa

SEQ ID NO: 699836 - RNA, 23 nt, Human
aagggucuucuuaaauuggcucc

SEQ ID NO: 699837 - RNA, 18 nt, Human
acuggagccauccuugau

SEQ ID NO: 699838 - RNA, 21 nt, Human
aggaagacaguccaggccucc

SEQ ID NO: 699839 - RNA, 18 nt, Human
aggaaggagguucugagg

SEQ ID NO: 699840 - RNA, 19 nt, Human
aggaaggagguucugaggg

SEQ ID NO: 699841 - RNA, 18 nt, Human
aggcuguagcgccggcug

SEQ ID NO: 699842 - RNA, 21 nt, Human
agggggccugggugggggggc

SEQ ID NO: 699843 - RNA, 18 nt, Human
agggucauugggguggcu

SEQ ID NO: 699844 - RNA, 24 nt, Human
aguagcaagaaucuagaaccugaa

SEQ ID NO: 699845 - RNA, 21 nt, Human
caaagcacaucccagcucaga

SEQ ID NO: 699846 - RNA, 21 nt, Human
caccaccagcuuuuggggccc

SEQ ID NO: 699847 - RNA, 25 nt, Human
cacccugcccucugugacaauccug

SEQ ID NO: 699848 - RNA, 19 nt, Human
cacgacagucagguccagc

SEQ ID NO: 699849 - RNA, 23 nt, Human
cacugcgcugcugucaccaaggu

SEQ ID NO: 699850 - RNA, 19 nt, Human
cacuguggcuauggggaga

SEQ ID NO: 699851 - RNA, 22 nt, Human
cacuuagaugguuuucugaaau

SEQ ID NO: 699852 - RNA, 21 nt, Human
cagaguccaggcucaccacca

SEQ ID NO: 699853 - RNA, 25 nt, Human
cagcugggguugcaggauugagagg

SEQ ID NO: 699854 - RNA, 20 nt, Human
cagguccagccuccggggaa

SEQ ID NO: 699855 - RNA, 20 nt, Human
ccaaaccagcccgcccuaag

SEQ ID NO: 699856 - RNA, 21 nt, Human
ccagcugcucugcaucccaag

SEQ ID NO: 699857 - RNA, 23 nt, Human
cccgggggcuuagagcuuggggg

SEQ ID NO: 699858 - RNA, 19 nt, Human
cccugauuuuuagggggcc

SEQ ID NO: 699859 - RNA, 21 nt, Human
ccucugcauccaccgguggga

SEQ ID NO: 699860 - RNA, 22 nt, Human
ccucugugacaauccugugggu

SEQ ID NO: 699861 - RNA, 24 nt, Human
ccuuccugugggcaggaaucuugc

SEQ ID NO: 699862 - RNA, 19 nt, Human
cgccuuggguuugggcagc

SEQ ID NO: 699863 - RNA, 19 nt, Human
cuauggggagagaccccuc

SEQ ID NO: 699864 - RNA, 19 nt, Human
cucaccaccaagaauggcu

SEQ ID NO: 699865 - RNA, 18 nt, Human
cuccagccgcaggcccag

SEQ ID NO: 699866 - RNA, 19 nt, Human
cugagggucauuggggugg

SEQ ID NO: 699867 - RNA, 23 nt, Human
cugccaggcuguagcgccggcug

SEQ ID NO: 699868 - RNA, 24 nt, Human
cuugagaagacuugacgccucccu

SEQ ID NO: 699869 - RNA, 20 nt, Human
gaaccugaaggaagcuggug

SEQ ID NO: 699870 - RNA, 19 nt, Human
gagcuugggggugagagug

SEQ ID NO: 699871 - RNA, 22 nt, Human
gcccaggaaggagguucugagg

SEQ ID NO: 699872 - RNA, 21 nt, Human
gcgugguuccuccagcacuua

SEQ ID NO: 699873 - RNA, 21 nt, Human
gcucugugaucuucuccucca

SEQ ID NO: 699874 - RNA, 22 nt, Human
gcugugucuccucugcuugcug

SEQ ID NO: 699875 - RNA, 24 nt, Human
gcuuuuggggcccaagguccuaag

SEQ ID NO: 699876 - RNA, 18 nt, Human
ggaucucacaggcuggua

SEQ ID NO: 699877 - RNA, 20 nt, Human
ggcaaggucuucgccuuggg

SEQ ID NO: 699878 - RNA, 20 nt, Human
ggggagagaccccucuggca

SEQ ID NO: 699879 - RNA, 19 nt, Human
gggguggcugguguccuug

SEQ ID NO: 699880 - RNA, 23 nt, Human
gguucugagggucauuggggugg

SEQ ID NO: 699881 - RNA, 27 nt, Human
guacuggagccauccuugaugaacucu

SEQ ID NO: 699882 - RNA, 23 nt, Human
guuggcuggugucggauucccug

SEQ ID NO: 699883 - RNA, 19 nt, Human
uaacuuccgaagacaauaa

SEQ ID NO: 699884 - RNA, 20 nt, Human
uaacuuccgaagacaauaau

SEQ ID NO: 699885 - RNA, 21 nt, Human
uaaguagcaagaaucuagaac

SEQ ID NO: 699886 - RNA, 21 nt, Human
ucaaagcacaucccagcucag

SEQ ID NO: 699887 - RNA, 21 nt, Human
ucaaaucaguuuccacaaagc

SEQ ID NO: 699888 - RNA, 20 nt, Human
uccacaaagcuacuccccgu

SEQ ID NO: 699889 - RNA, 20 nt, Human
uccaggcucaccaccaagaa

SEQ ID NO: 699890 - RNA, 21 nt, Human
uccauguuaaccacauguggu

SEQ ID NO: 699891 - RNA, 23 nt, Human
uccucagucaccacccugcccuc

SEQ ID NO: 699892 - RNA, 20 nt, Human
uccuuggccaccaccuugac

SEQ ID NO: 699893 - RNA, 23 nt, Human
uccuuggccaccaccuugaccuc

SEQ ID NO: 699894 - RNA, 21 nt, Human
ucgccuuggguuugggcagcc

SEQ ID NO: 699895 - RNA, 22 nt, Human
ucuagaaccugaaggaagcugg

SEQ ID NO: 699896 - RNA, 21 nt, Human
ucucaaagcacaucccagcuc

SEQ ID NO: 699897 - RNA, 24 nt, Human
ucugcagcucaguuucugugagac

SEQ ID NO: 699898 - RNA, 19 nt, Human
ugaacucuggcaaggucuu

SEQ ID NO: 699899 - RNA, 24 nt, Human
ugaccucacaaggcauugaaaacu

SEQ ID NO: 699900 - RNA, 21 nt, Human
ugcaucccaaggcucugaggc

SEQ ID NO: 699901 - RNA, 19 nt, Human
ugccaggcuguagcgccgg

SEQ ID NO: 699902 - RNA, 21 nt, Human
ugcccgaggucuuuuagaggc

SEQ ID NO: 699903 - RNA, 24 nt, Human
ugcgcugcugucaccaagguugau

SEQ ID NO: 699904 - RNA, 25 nt, Human
uggcaaggucuucgccuuggguuug

SEQ ID NO: 699905 - RNA, 20 nt, Human
uggcugguguccuuggccac

SEQ ID NO: 699906 - RNA, 18 nt, Human
ugggcagccgaacguguu

SEQ ID NO: 699907 - RNA, 23 nt, Human
ugucggauucccugagaagcagc

SEQ ID NO: 699908 - RNA, 19 nt, Human
ugugggcaggaaucuugcu

SEQ ID NO: 699909 - RNA, 23 nt, Human
ugugguuuuaaaaugaaauaauc

SEQ ID NO: 699910 - RNA, 27 nt, Human
ugugguuuuaaaaugaaauaaucuugg

SEQ ID NO: 699911 - RNA, 19 nt, Human
uuccacaaagcuacucccc

SEQ ID NO: 699912 - RNA, 23 nt, Human
uuccuccagcacuuagaugguuu

SEQ ID NO: 699913 - RNA, 25 nt, Human
uugacgacuuuaaccaccugaugaa

SEQ ID NO: 699914 - RNA, 21 nt, Human
uugggcagccgaacguguugc

SEQ ID NO: 699915 - RNA, 22 nt, Human
uuuuagggggccuggguggggg

SEQ ID NO: 699916 - RNA, 23 nt, Human
aaaaugcuaaaacauaauccaua

SEQ ID NO: 699917 - RNA, 26 nt, Human
aaacagagagacaaaagaagggaccc

SEQ ID NO: 699918 - RNA, 20 nt, Human
aacaaacgaaagcauaaaag

SEQ ID NO: 699919 - RNA, 19 nt, Human
aacacagugaaaccccguc

SEQ ID NO: 699920 - RNA, 20 nt, Human
aacacagugaaaccccgucu

SEQ ID NO: 699921 - RNA, 21 nt, Human
aacacagugaaaccccgucuc

SEQ ID NO: 699922 - RNA, 21 nt, Human
aacaggaaaagaccaccuauc

SEQ ID NO: 699923 - RNA, 21 nt, Human
aaccaaugaccuacuaagaaa

SEQ ID NO: 699924 - RNA, 19 nt, Human
aacuugauuucaaaaaugg

SEQ ID NO: 699925 - RNA, 23 nt, Human
aagaucgcgccacugcacuccag

SEQ ID NO: 699926 - RNA, 23 nt, Human
aagguugacauguuuuaaacacc

SEQ ID NO: 699927 - RNA, 22 nt, Human
aauaucugcacacacugaguaa

SEQ ID NO: 699928 - RNA, 23 nt, Human
aaugaccuacuaagaaaagcaga

SEQ ID NO: 699929 - RNA, 18 nt, Human
aauggcuugaugguaggg

SEQ ID NO: 699930 - RNA, 21 nt, Human
acaaaauuccaucucaguuac

SEQ ID NO: 699931 - RNA, 24 nt, Human
acagagugagacucugucucaaaa

SEQ ID NO: 699932 - RNA, 24 nt, Human
accccgucucuacuaaaaauacaa

SEQ ID NO: 699933 - RNA, 23 nt, Human
acuaugguauuaaacaauccauu

SEQ ID NO: 699934 - RNA, 24 nt, Human
acuccagccugggugacagaguga

SEQ ID NO: 699935 - RNA, 24 nt, Human
acugcacuccagccugggugacag

SEQ ID NO: 699936 - RNA, 26 nt, Human
acugcacuccagccugggugacagag

SEQ ID NO: 699937 - RNA, 18 nt, Human
agaacagaaacagagaga

SEQ ID NO: 699938 - RNA, 19 nt, Human
agaacagaaacagagagac

SEQ ID NO: 699939 - RNA, 19 nt, Human
agaacagaaacagagagac

SEQ ID NO: 699940 - RNA, 18 nt, Human
agaaggggaggaagagua

SEQ ID NO: 699941 - RNA, 20 nt, Human
agagguugcagagagcuaag

SEQ ID NO: 699942 - RNA, 18 nt, Human
agaucagaagacuugaug

SEQ ID NO: 699943 - RNA, 22 nt, Human
agcagagugguauccaaaaauc

SEQ ID NO: 699944 - RNA, 24 nt, Human
agccugggugacagagugagacuc

SEQ ID NO: 699945 - RNA, 18 nt, Human
agcuccauauauuauguu

SEQ ID NO: 699946 - RNA, 20 nt, Human
agcugggccagguuucacau

SEQ ID NO: 699947 - RNA, 20 nt, Human
agcuuguuaacaggaaaaga

SEQ ID NO: 699948 - RNA, 21 nt, Human
aggaagaguaauucacagcau

SEQ ID NO: 699949 - RNA, 24 nt, Human
aggaggguggaucacgaggucagg

SEQ ID NO: 699950 - RNA, 29 nt, Human
aggcaagagauacauuuaaaagggacccc

SEQ ID NO: 699951 - RNA, 19 nt, Human
aggcagagguugcagagag

SEQ ID NO: 699952 - RNA, 24 nt, Human
aggcagagguugcagagagcuaag

SEQ ID NO: 699953 - RNA, 23 nt, Human
aguggcucaugccuguaauccca

SEQ ID NO: 699954 - RNA, 24 nt, Human
aguggcucaugccuguaaucccag

SEQ ID NO: 699955 - RNA, 24 nt, Human
agugguagcaguccuccccagagu

SEQ ID NO: 699956 - RNA, 24 nt, Human
agugguagcaguccuccccagagu

SEQ ID NO: 699957 - RNA, 28 nt, Human
auacagaaaaugaaaauaaagggacccc

SEQ ID NO: 699958 - RNA, 20 nt, Human
aucaauaccccuacaacgca

SEQ ID NO: 699959 - RNA, 18 nt, Human
aucaugucaagaguaguu

SEQ ID NO: 699960 - RNA, 20 nt, Human
aucccaguaagcuuucugac

SEQ ID NO: 699961 - RNA, 24 nt, Human
aucgcgccacugcacuccagccug

SEQ ID NO: 699962 - RNA, 24 nt, Human
augauauaaaauaauuaguauguc

SEQ ID NO: 699963 - RNA, 19 nt, Human
augccuguaaucccaguac

SEQ ID NO: 699964 - RNA, 18 nt, Human
auucuuguguugucuuga

SEQ ID NO: 699965 - RNA, 21 nt, Human
caaauucuccaaagcauaaau

SEQ ID NO: 699966 - RNA, 18 nt, Human
caacaguaccuguauuug

SEQ ID NO: 699967 - RNA, 23 nt, Human
caaccacauuaaagggugucaga

SEQ ID NO: 699968 - RNA, 23 nt, Human
caauaccccuacaacgcaccuuc

SEQ ID NO: 699969 - RNA, 22 nt, Human
cacuccagccugggugacagag

SEQ ID NO: 699970 - RNA, 22 nt, Human
cacuccagccugggugacagag

SEQ ID NO: 699971 - RNA, 24 nt, Human
cacuccagccugggugacagagug

SEQ ID NO: 699972 - RNA, 19 nt, Human
cacugcacuccagccuggg

SEQ ID NO: 699973 - RNA, 21 nt, Human
cacugcacuccagccugggug

SEQ ID NO: 699974 - RNA, 22 nt, Human
cacugcacuccagccuggguga

SEQ ID NO: 699975 - RNA, 23 nt, Human
cacugcacuccagccugggugac

SEQ ID NO: 699976 - RNA, 24 nt, Human
cacugcacuccagccugggugaca

SEQ ID NO: 699977 - RNA, 25 nt, Human
cacugcacuccagccugggugacag

SEQ ID NO: 699978 - RNA, 21 nt, Human
cacuuuucuaacaacagucca

SEQ ID NO: 699979 - RNA, 23 nt, Human
cagaaacagagagacaaaagaaa

SEQ ID NO: 699980 - RNA, 24 nt, Human
caguacuuugggagguggggcgga

SEQ ID NO: 699981 - RNA, 18 nt, Human
cagucagaacagaaacag

SEQ ID NO: 699982 - RNA, 22 nt, Human
cauaacucuuucugcuccccaa

SEQ ID NO: 699983 - RNA, 24 nt, Human
caugccuguaaucccaguacuuug

SEQ ID NO: 699984 - RNA, 22 nt, Human
cauuccucucaauggaacagcc

SEQ ID NO: 699985 - RNA, 21 nt, Human
ccaaggcaauaauuuaccaag

SEQ ID NO: 699986 - RNA, 20 nt, Human
ccacugcacuccagccuggg

SEQ ID NO: 699987 - RNA, 20 nt, Human
ccacugcacuccagccuggg

SEQ ID NO: 699988 - RNA, 20 nt, Human
ccacugcacuccagccuggg

SEQ ID NO: 699989 - RNA, 21 nt, Human
ccacugcacuccagccugggu

SEQ ID NO: 699990 - RNA, 21 nt, Human
ccacugcacuccagccugggu

SEQ ID NO: 699991 - RNA, 23 nt, Human
ccacugcacuccagccuggguga

SEQ ID NO: 699992 - RNA, 23 nt, Human
ccacugcacuccagccuggguga

SEQ ID NO: 699993 - RNA, 24 nt, Human
ccacugcacuccagccugggugac

SEQ ID NO: 699994 - RNA, 24 nt, Human
cccaaauacauauuuccaaaaauu

SEQ ID NO: 699995 - RNA, 24 nt, Human
cccaaauacauauuuccaaaaauu

SEQ ID NO: 699996 - RNA, 23 nt, Human
cccauuucagagaaggggaggaa

SEQ ID NO: 699997 - RNA, 19 nt, Human
ccgccccugaggugagcgc

SEQ ID NO: 699998 - RNA, 24 nt, Human
ccuacaacgcaccuucgucacuga

SEQ ID NO: 699999 - RNA, 23 nt, Human
ccuggcuaacacagugaaacccc

SEQ ID NO: 700000 - RNA, 24 nt, Human
ccuggcuaacacagugaaaccccg

SEQ ID NO: 700001 - RNA, 23 nt, Human
ccugggaggcagagguugcagag

SEQ ID NO: 700002 - RNA, 22 nt, Human
ccugggugacagagugagacuc

SEQ ID NO: 700003 - RNA, 22 nt, Human
ccuguaaucccaguacuuuggg

SEQ ID NO: 700004 - RNA, 21 nt, Human
ccuguagucccaguuacucag

SEQ ID NO: 700005 - RNA, 24 nt, Human
cgaggccguccuggcuaacacagu

SEQ ID NO: 700006 - RNA, 18 nt, Human
cgccccugaggugagcgc

SEQ ID NO: 700007 - RNA, 24 nt, Human
cgccuguagucccaguuacucagg

SEQ ID NO: 700008 - RNA, 21 nt, Human
cgcuccggagcuggaaauggg

SEQ ID NO: 700009 - RNA, 19 nt, Human
cgggggcccgccccugagg

SEQ ID NO: 700010 - RNA, 24 nt, Human
cucaugccuguaaucccaguacuu

SEQ ID NO: 700011 - RNA, 19 nt, Human
cucugucucaaaaaaaaaa

SEQ ID NO: 700012 - RNA, 22 nt, Human
cugaaguaccuagugagccaca

SEQ ID NO: 700013 - RNA, 21 nt, Human
cugaaguugggcccuauaaag

SEQ ID NO: 700014 - RNA, 19 nt, Human
cuuuuggucauacacugaa

SEQ ID NO: 700015 - RNA, 20 nt, Human
gaaaaucaaguuucuuccua

SEQ ID NO: 700016 - RNA, 24 nt, Human
gacagagugagacucugucucaaa

SEQ ID NO: 700017 - RNA, 22 nt, Human
gacuguguuaaccuucauguug

SEQ ID NO: 700018 - RNA, 18 nt, Human
gaggaagaguaauucaca

SEQ ID NO: 700019 - RNA, 23 nt, Human
gcacuccagccugggugacagag

SEQ ID NO: 700020 - RNA, 19 nt, Human
gccacugcacuccagccug

SEQ ID NO: 700021 - RNA, 24 nt, Human
gccacugcacuccagccuggguga

SEQ ID NO: 700022 - RNA, 19 nt, Human
gccgcgaacgcaggcgggg

SEQ ID NO: 700023 - RNA, 19 nt, Human
gcggggcgcagccgcccgc

SEQ ID NO: 700024 - RNA, 19 nt, Human
gcuaagaucgcgccacugc

SEQ ID NO: 700025 - RNA, 18 nt, Human
gcuacuucaugagaaagc

SEQ ID NO: 700026 - RNA, 18 nt, Human
ggagguggaggagggugg

SEQ ID NO: 700027 - RNA, 20 nt, Human
ggcgccgcgaacgcaggcgg

SEQ ID NO: 700028 - RNA, 18 nt, Human
ggcgugguggcgggcgcc

SEQ ID NO: 700029 - RNA, 22 nt, Human
ggcgugguggcgggcgccugua

SEQ ID NO: 700030 - RNA, 19 nt, Human
ggcugggugcaguggcuca

SEQ ID NO: 700031 - RNA, 18 nt, Human
gggagguggaggagggug

SEQ ID NO: 700032 - RNA, 18 nt, Human
gggcugggugagggcuug

SEQ ID NO: 700033 - RNA, 24 nt, Human
gggugcaguggcucaugccuguaa

SEQ ID NO: 700034 - RNA, 19 nt, Human
ggucaggagaucgaggccg

SEQ ID NO: 700035 - RNA, 21 nt, Human
gguggaucacgaggucaggag

SEQ ID NO: 700036 - RNA, 24 nt, Human
gguggcgggcgccuguagucccag

SEQ ID NO: 700037 - RNA, 18 nt, Human
guagaacaccagucagcu

SEQ ID NO: 700038 - RNA, 24 nt, Human
gugacagagugagacucugucuca

SEQ ID NO: 700039 - RNA, 25 nt, Human
guucacugauggugaccuucccucc

SEQ ID NO: 700040 - RNA, 21 nt, Human
guugcagagagcuaagaucgc

SEQ ID NO: 700041 - RNA, 23 nt, Human
uaaaacauaauccauauauacaa

SEQ ID NO: 700042 - RNA, 19 nt, Human
uaaauaacccucuaucaca

SEQ ID NO: 700043 - RNA, 25 nt, Human
uaaauaucugcacacacugaguaaa

SEQ ID NO: 700044 - RNA, 20 nt, Human
uaacaagaaauggcugcagg

SEQ ID NO: 700045 - RNA, 24 nt, Human
uaacacagugaaaccccgucucua

SEQ ID NO: 700046 - RNA, 22 nt, Human
uaacaguacaguacauuuguuu

SEQ ID NO: 700047 - RNA, 18 nt, Human
uaagaaaagcagaggauc

SEQ ID NO: 700048 - RNA, 21 nt, Human
uaaggcaaccauaagugaggc

SEQ ID NO: 700049 - RNA, 22 nt, Human
uaaugugauauuuaccucuagu

SEQ ID NO: 700050 - RNA, 24 nt, Human
uacaaaaaagccuacugcauucaa

SEQ ID NO: 700051 - RNA, 22 nt, Human
uacacaauuuguccuuuaccca

SEQ ID NO: 700052 - RNA, 22 nt, Human
uacagcauaaauuccuuuuuuu

SEQ ID NO: 700053 - RNA, 19 nt, Human
uaccauauagagauggaug

SEQ ID NO: 700054 - RNA, 22 nt, Human
uagaacaccagucagcugaggg

SEQ ID NO: 700055 - RNA, 18 nt, Human
uagaguucuuucaucugg

SEQ ID NO: 700056 - RNA, 22 nt, Human
uaggacaaacuauuuaaaaagc

SEQ ID NO: 700057 - RNA, 18 nt, Human
uagggcccuuuggaagcc

SEQ ID NO: 700058 - RNA, 27 nt, Human
uauaacaguacaguacauuuguuugga

SEQ ID NO: 700059 - RNA, 20 nt, Human
uauagagauggaugagacug

SEQ ID NO: 700060 - RNA, 18 nt, Human
uauuuggaccaggaaauu

SEQ ID NO: 700061 - RNA, 19 nt, Human
ucaauaccccuacaacgca

SEQ ID NO: 700062 - RNA, 23 nt, Human
ucaauaccccuacaacgcaccuu

SEQ ID NO: 700063 - RNA, 18 nt, Human
ucacgaggucaggagauc

SEQ ID NO: 700064 - RNA, 24 nt, Human
ucacgaggucaggagaucgaggcc

SEQ ID NO: 700065 - RNA, 22 nt, Human
ucacugauggugaccuucccuc

SEQ ID NO: 700066 - RNA, 22 nt, Human
ucagaacagaaacagagagaca

SEQ ID NO: 700067 - RNA, 23 nt, Human
ucaggccggacacucaucucacg

SEQ ID NO: 700068 - RNA, 23 nt, Human
ucaggccggacacucaucucacg

SEQ ID NO: 700069 - RNA, 18 nt, Human
ucagucuucugcuggcgc

SEQ ID NO: 700070 - RNA, 22 nt, Human
ucaugccuguaaucccaguacu

SEQ ID NO: 700071 - RNA, 23 nt, Human
uccagccugggugacagagugag

SEQ ID NO: 700072 - RNA, 24 nt, Human
uccagccugggugacagagugaga

SEQ ID NO: 700073 - RNA, 22 nt, Human
uccaucccgcuuguaaaauuca

SEQ ID NO: 700074 - RNA, 23 nt, Human
uccccaaauuguccugagaauuu

SEQ ID NO: 700075 - RNA, 18 nt, Human
ucccucuugccuuuaagg

SEQ ID NO: 700076 - RNA, 23 nt, Human
ucgcgccacugcacuccagccug

SEQ ID NO: 700077 - RNA, 18 nt, Human
ucuaacaacaguccaaga

SEQ ID NO: 700078 - RNA, 24 nt, Human
ucucuacuaaaaauacaaaaaauu

SEQ ID NO: 700079 - RNA, 21 nt, Human
ucugcagugguagcaguccuc

SEQ ID NO: 700080 - RNA, 21 nt, Human
ucugcagugguagcaguccuc

SEQ ID NO: 700081 - RNA, 23 nt, Human
ucuuacauuacauuucauaauug

SEQ ID NO: 700082 - RNA, 21 nt, Human
ucuuguguugucuugauugua

SEQ ID NO: 700083 - RNA, 22 nt, Human
ucuuuuucugucuccaaacuga

SEQ ID NO: 700084 - RNA, 25 nt, Human
ugaaagaaacuacaccaaccccggg

SEQ ID NO: 700085 - RNA, 22 nt, Human
ugaaauguacagcauaaauucc

SEQ ID NO: 700086 - RNA, 24 nt, Human
ugaaccugggaggcagagguugca

SEQ ID NO: 700087 - RNA, 20 nt, Human
ugaaguugggcccuauaaag

SEQ ID NO: 700088 - RNA, 19 nt, Human
ugagaaagcauggugccca

SEQ ID NO: 700089 - RNA, 21 nt, Human
ugagagccuuuugaagcagaa

SEQ ID NO: 700090 - RNA, 24 nt, Human
ugagcgcagcuccucgacgagcgg

SEQ ID NO: 700091 - RNA, 18 nt, Human
ugaguggaaccucugcca

SEQ ID NO: 700092 - RNA, 20 nt, Human
ugaguuaucugagaucagaa

SEQ ID NO: 700093 - RNA, 22 nt, Human
ugauaacuccagaagaugacac

SEQ ID NO: 700094 - RNA, 20 nt, Human
ugauggugaccuucccucuu

SEQ ID NO: 700095 - RNA, 22 nt, Human
ugauggugaccuucccucuugc

SEQ ID NO: 700096 - RNA, 20 nt, Human
ugauuugcuuuuaugcccuc

SEQ ID NO: 700097 - RNA, 23 nt, Human
ugccuguaaucccaguacuuugg

SEQ ID NO: 700098 - RNA, 23 nt, Human
ugccuguaaucccaguacuuugg

SEQ ID NO: 700099 - RNA, 20 nt, Human
uggaaccaauagagaguagu

SEQ ID NO: 700100 - RNA, 18 nt, Human
uggaaccccaaaggaaaa

SEQ ID NO: 700101 - RNA, 21 nt, Human
uggagaacugagcuaggcaca

SEQ ID NO: 700102 - RNA, 22 nt, Human
uggcucaugccuguaaucccag

SEQ ID NO: 700103 - RNA, 24 nt, Human
uggcucaugccuguaaucccagua

SEQ ID NO: 700104 - RNA, 21 nt, Human
uggcugcagguucucagucag

SEQ ID NO: 700105 - RNA, 22 nt, Human
uggcugggugcaguggcucaug

SEQ ID NO: 700106 - RNA, 24 nt, Human
uggcugggugcaguggcucaugcc

SEQ ID NO: 700107 - RNA, 22 nt, Human
ugggcccuauaaaguauuagaa

SEQ ID NO: 700108 - RNA, 18 nt, Human
ugggcugggugagggcuu

SEQ ID NO: 700109 - RNA, 21 nt, Human
ugggugacagagugagacucu

SEQ ID NO: 700110 - RNA, 24 nt, Human
ugguggcgggcgccuguaguccca

SEQ ID NO: 700111 - RNA, 22 nt, Human
uguaaaugagguauaguccuga

SEQ ID NO: 700112 - RNA, 28 nt, Human
uguaaccagauuuuucgauggcagcacc

SEQ ID NO: 700113 - RNA, 28 nt, Human
uguaaccagauuuuucgauggcagcacc

SEQ ID NO: 700114 - RNA, 23 nt, Human
uguccuuuacccauuucagagaa

SEQ ID NO: 700115 - RNA, 26 nt, Human
uguucagaaugcaacauauuauuaau

SEQ ID NO: 700116 - RNA, 20 nt, Human
uuaauacaccaaggcaauaa

SEQ ID NO: 700117 - RNA, 25 nt, Human
uuagaaaaacaauuuuauaaugugc

SEQ ID NO: 700118 - RNA, 18 nt, Human
uuagcugggcgugguggc

SEQ ID NO: 700119 - RNA, 24 nt, Human
uuagcugggcgugguggcgggcgc

SEQ ID NO: 700120 - RNA, 31 nt, Human
uucaguucugcagugguagcaguccuccccu

SEQ ID NO: 700121 - RNA, 31 nt, Human; identical to SEQ ID NO: 700120

SEQ ID NO: 700122 - RNA, 24 nt, Human
uugaaccugggaggcagagguugc

SEQ ID NO: 700123 - RNA, 22 nt, Human
uugcaccccuguugcaauacug

SEQ ID NO: 700124 - RNA, 23 nt, Human
uuggcugggugcaguggcucaug

SEQ ID NO: 700125 - RNA, 19 nt, Human
uugguuucaucugagaucu

SEQ ID NO: 700126 - RNA, 23 nt, Human
uuguagaugaguggaaccucugc

SEQ ID NO: 700127 - RNA, 24 nt, Human
uuuuccuaauggcuuccaugagaa

SEQ ID NO: 700128 - RNA, 24 nt, Human
uuuuuucaguccucuaguuuucuc

SEQ ID NO: 700129 - RNA, 18 nt, Human
aaaguaaggcaucccacc

SEQ ID NO: 700130 - RNA, 22 nt, Human
agacagagggauccacauucuu

SEQ ID NO: 700131 - RNA, 23 nt, Human
cagacgggguggggcgcccaagc

SEQ ID NO: 700132 - RNA, 18 nt, Human
cccagacagagggaucca

SEQ ID NO: 700133 - RNA, 19 nt, Human
cccagacagagggauccac

SEQ ID NO: 700134 - RNA, 22 nt, Human
ccgccguccugccgccgucucg

SEQ ID NO: 700135 - RNA, 21 nt, Human
ggagauggaugcaggacgcag

SEQ ID NO: 700136 - RNA, 20 nt, Human
uaaggcaucccaccccagac

SEQ ID NO: 700137 - RNA, 23 nt, Human
ucgccgcccgguucccccaucca

SEQ ID NO: 700138 - RNA, 24 nt, Human
ucuuuaaucaugaugcgggccacu

SEQ ID NO: 700139 - RNA, 25 nt, Human
uucuuuaaucaugaugcgggccacu

SEQ ID NO: 700140 - RNA, 22 nt, Human
uuuaaucaugaugcgggccacu

SEQ ID NO: 700141 - RNA, 25 nt, Human
aaaguccucucagcugcagcugccc

SEQ ID NO: 700142 - RNA, 21 nt, Human
aacagccaaaaagaaaaacag

SEQ ID NO: 700143 - RNA, 18 nt, Human
aagagcccucccagcugc

SEQ ID NO: 700144 - RNA, 26 nt, Human
acgcccagaagagcccucccagcugc

SEQ ID NO: 700145 - RNA, 21 nt, Human
agaagagcccucccagcugca

SEQ ID NO: 700146 - RNA, 21 nt, Human
cccggacgcccagaagagccc

SEQ ID NO: 700147 - RNA, 22 nt, Human
gccaaaaagaaaaacagaaauc

SEQ ID NO: 700148 - RNA, 20 nt, Human
uaagguuugacaacauggug

SEQ ID NO: 700149 - RNA, 21 nt, Human
uauggugugaaaguccucuca

SEQ ID NO: 700150 - RNA, 23 nt, Human
uauggugugaaaguccucucagc

SEQ ID NO: 700151 - RNA, 19 nt, Human
ucuccuuauggugugaaag

SEQ ID NO: 700152 - RNA, 23 nt, Human
ugaacauucuugugauggcucca

SEQ ID NO: 700153 - RNA, 19 nt, Human
ugcaaccagugccugcagc

SEQ ID NO: 700154 - RNA, 28 nt, Human
uuccaaaugaacauucuugugauggcuc

SEQ ID NO: 700155 - RNA, 22 nt, Human
uugacaacauggugacugccuu

SEQ ID NO: 700156 - RNA, 21 nt, Human
aaaugccuugaaaauaagaua

SEQ ID NO: 700157 - RNA, 25 nt, Human
cuuaaaacaagacauuaguuugccc

SEQ ID NO: 700158 - RNA, 23 nt, Human
guuucuuaaaacaagacauuagu

SEQ ID NO: 700159 - RNA, 23 nt, Human
uaguuugcccuucauuuccaaau

SEQ ID NO: 700160 - RNA, 21 nt, Human
ucagugguggacuaagcaguu

SEQ ID NO: 700161 - RNA, 21 nt, Human
ucccuauacauaaaaugaaaa

SEQ ID NO: 700162 - RNA, 26 nt, Human
uuaaaacaagacauuaguuugccuca

SEQ ID NO: 700163 - RNA, 19 nt, Human
uuuucuucagugguggacu

SEQ ID NO: 700164 - RNA, 19 nt, Human
aaaguacauugaucaaggu

SEQ ID NO: 700165 - RNA, 18 nt, Human
aacauguuuccagaauga

SEQ ID NO: 700166 - RNA, 18 nt, Human
aaccacacaaucaacuca

SEQ ID NO: 700167 - RNA, 24 nt, Human
aaccuaaucaauaucacuuaucaa

SEQ ID NO: 700168 - RNA, 25 nt, Human
aauaucacuuaucaaaagcaguggc

SEQ ID NO: 700169 - RNA, 20 nt, Human
acagcacagaccccaccaca

SEQ ID NO: 700170 - RNA, 21 nt, Human
acagcacagaccccaccacag

SEQ ID NO: 700171 - RNA, 24 nt, Human
acuggccccgcccccgggccgcgc

SEQ ID NO: 700172 - RNA, 23 nt, Human
aggggcaucuggcaacauccggc

SEQ ID NO: 700173 - RNA, 22 nt, Human
auaaagcaccuggcaaauagca

SEQ ID NO: 700174 - RNA, 21 nt, Human
caagaagauucaaccuaauca

SEQ ID NO: 700175 - RNA, 21 nt, Human
cacagcacagaccccaccaca

SEQ ID NO: 700176 - RNA, 19 nt, Human
cacagccuacuaaaaacag

SEQ ID NO: 700177 - RNA, 23 nt, Human
caccucugugcucacuguaauuc

SEQ ID NO: 700178 - RNA, 23 nt, Human
cagaacacauauccagggugugu

SEQ ID NO: 700179 - RNA, 19 nt, Human
ccacuggccccgcccccgg

SEQ ID NO: 700180 - RNA, 19 nt, Human
ccggaaauguuuaucacag

SEQ ID NO: 700181 - RNA, 26 nt, Human
cgcagccaaucgcucgcgccagcgcc

SEQ ID NO: 700182 - RNA, 25 nt, Human
cgccacaucgcccggccaauuggcg

SEQ ID NO: 700183 - RNA, 22 nt, Human
cuaguuuaaucugcuaauauga

SEQ ID NO: 700184 - RNA, 24 nt, Human
cuaguuuaaucugcuaauaugaaa

SEQ ID NO: 700185 - RNA, 19 nt, Human
cugguggugccaccucccu

SEQ ID NO: 700186 - RNA, 22 nt, Human
gaaugaauaaaccacacaauca

SEQ ID NO: 700187 - RNA, 19 nt, Human
gagcacagucugcggcgcg

SEQ ID NO: 700188 - RNA, 23 nt, Human
gcaaugcacagcacagaccccac

SEQ ID NO: 700189 - RNA, 20 nt, Human
gcacagcacagaccccacca

SEQ ID NO: 700190 - RNA, 20 nt, Human
gccugugacaacggcagacg

SEQ ID NO: 700191 - RNA, 24 nt, Human
gcgaagcaccgggaaccugagccg

SEQ ID NO: 700192 - RNA, 26 nt, Human
gcggcgcgcaccgcccacuggccccc

SEQ ID NO: 700193 - RNA, 22 nt, Human
ggcagacgcgcgaagcaccggg

SEQ ID NO: 700194 - RNA, 24 nt, Human
gggcaucuggcaacauccggcaua

SEQ ID NO: 700195 - RNA, 18 nt, Human
gggggucaacacgcccca

SEQ ID NO: 700196 - RNA, 23 nt, Human
gggguugacucuguccccuaggg

SEQ ID NO: 700197 - RNA, 19 nt, Human
uaaaaacagaguuucacuc

SEQ ID NO: 700198 - RNA, 20 nt, Human
uaaugauagaacuaaauuua

SEQ ID NO: 700199 - RNA, 23 nt, Human
uacuaaaaacagaguuucacuca

SEQ ID NO: 700200 - RNA, 19 nt, Human
uagaacacugaucagccuc

SEQ ID NO: 700201 - RNA, 21 nt, Human
uagcaaguccucugcaagugc

SEQ ID NO: 700202 - RNA, 22 nt, Human
uauaaaaaguacauugaucaag

SEQ ID NO: 700203 - RNA, 27 nt, Human
uauggcaaguuuauaaaaaguacauug

SEQ ID NO: 700204 - RNA, 18 nt, Human
ucaauaucacuuaucaaa

SEQ ID NO: 700205 - RNA, 19 nt, Human
uccacgccacaucgcccgg

SEQ ID NO: 700206 - RNA, 21 nt, Human
uccucugcaagugcuccggaa

SEQ ID NO: 700207 - RNA, 26 nt, Human
ugaauaaaccacacaaucaacucaga

SEQ ID NO: 700208 - RNA, 27 nt, Human
ugaauaaaccacacaaucaacucagaa

SEQ ID NO: 700209 - RNA, 22 nt, Human
ugacaacggcagacgcgcgaag

SEQ ID NO: 700210 - RNA, 21 nt, Human
ugacucuguccccuaggggcc

SEQ ID NO: 700211 - RNA, 22 nt, Human
ugauacauaaagcaccuggcaa

SEQ ID NO: 700212 - RNA, 21 nt, Human
ugcuaguuuaaucugcuaaua

SEQ ID NO: 700213 - RNA, 20 nt, Human
uggcaacauccggcauaacu

SEQ ID NO: 700214 - RNA, 19 nt, Human
uggccugugacaacggcag

SEQ ID NO: 700215 - RNA, 20 nt, Human
ugucgcuuagaaacagaaca

SEQ ID NO: 700216 - RNA, 19 nt, Human
ugugauacaaaauuauaag

SEQ ID NO: 700217 - RNA, 20 nt, Human
uguucaaauuucccauaagu

SEQ ID NO: 700218 - RNA, 19 nt, Human
uguuguuguuauuuuuuuc

SEQ ID NO: 700219 - RNA, 22 nt, Human
uucccuugaaccugcuccucac

SEQ ID NO: 700220 - RNA, 23 nt, Human
aaaaagaaaaacaugauacagag

SEQ ID NO: 700221 - RNA, 22 nt, Human
aaagaaaaacaugauacagaga

SEQ ID NO: 700222 - RNA, 23 nt, Human
aacaugauacagagaucccaucc

SEQ ID NO: 700223 - RNA, 19 nt, Human
acagccucaugguccagcc

SEQ ID NO: 700224 - RNA, 19 nt, Human
accuuggaggcuuggauaa

SEQ ID NO: 700225 - RNA, 28 nt, Human
acucugaaauaagugauuuaaaaagaaa

SEQ ID NO: 700226 - RNA, 21 nt, Human
agaugagaaauauggaaauaa

SEQ ID NO: 700227 - RNA, 19 nt, Human
agcuguggggagacagccu

SEQ ID NO: 700228 - RNA, 24 nt, Human
cagaaguggauaaacgucgaguca

SEQ ID NO: 700229 - RNA, 22 nt, Human
cauuacacauggcugacucgac

SEQ ID NO: 700230 - RNA, 22 nt, Human
cccuguuuuuuggagagggugu

SEQ ID NO: 700231 - RNA, 24 nt, Human
cccuuuugcccuguuuuuuggaga

SEQ ID NO: 700232 - RNA, 22 nt, Human
ccucaauggugcgucugccugc

SEQ ID NO: 700233 - RNA, 21 nt, Human
cucaagaucuccccaagacuu

SEQ ID NO: 700234 - RNA, 19 nt, Human
cucaugguccagccaggcu

SEQ ID NO: 700235 - RNA, 25 nt, Human
cucccugcaaccaggcagaugagaa

SEQ ID NO: 700236 - RNA, 23 nt, Human
cuggcugugacccgaccucucuu

SEQ ID NO: 700237 - RNA, 22 nt, Human
gcaaucaagugccccuuuugcc

SEQ ID NO: 700238 - RNA, 23 nt, Human
ggaaauaaggaaaagggaaaaug

SEQ ID NO: 700239 - RNA, 23 nt, Human
ggcaaucaagugccccuuuugcc

SEQ ID NO: 700240 - RNA, 19 nt, Human
ggcugugacccgaccucuc

SEQ ID NO: 700241 - RNA, 18 nt, Human
gggaaaaugaagauauga

SEQ ID NO: 700242 - RNA, 18 nt, Human
guuuuuuggagagggugu

SEQ ID NO: 700243 - RNA, 21 nt, Human
uaaagcaaguaugucuuuauu

SEQ ID NO: 700244 - RNA, 19 nt, Human
uauacaugaugggcaauca

SEQ ID NO: 700245 - RNA, 18 nt, Human
ucaaaugaacagaagugg

SEQ ID NO: 700246 - RNA, 18 nt, Human
ucaaaugaacagaagugg

SEQ ID NO: 700247 - RNA, 19 nt, Human
ucaaaugaacagaagugga

SEQ ID NO: 700248 - RNA, 21 nt, Human
ucaaaugaacagaaguggaua

SEQ ID NO: 700249 - RNA, 21 nt, Human
ucccauccugaccuuggaggc

SEQ ID NO: 700250 - RNA, 18 nt, Human
ucccugcaaccaggcaga

SEQ ID NO: 700251 - RNA, 23 nt, Human
uccuggguaucagauguggaacu

SEQ ID NO: 700252 - RNA, 19 nt, Human
ugaaauagugauuuauaca

SEQ ID NO: 700253 - RNA, 20 nt, Human
ugaacagaaguggauaaacg

SEQ ID NO: 700254 - RNA, 28 nt, Human
ugccccuuuugcccuguuuuuuggagaa

SEQ ID NO: 700255 - RNA, 24 nt, Human
ugccucaauggugcgucugccugc

SEQ ID NO: 700256 - RNA, 19 nt, Human
uggggagacagccucaugg

SEQ ID NO: 700257 - RNA, 23 nt, Human
uuggaagcuggagacuccugggu

SEQ ID NO: 700258 - RNA, 24 nt, Human
aaacagaaaguuuuuuuuccaaga

SEQ ID NO: 700259 - RNA, 23 nt, Human
aaacagacaaguaacaaagagaa

SEQ ID NO: 700260 - RNA, 21 nt, Human
aagaaagccauccgcugcuag

SEQ ID NO: 700261 - RNA, 23 nt, Human
aagaaauucaaauggaaacagac

SEQ ID NO: 700262 - RNA, 18 nt, Human
aagaaucuuguuuucuuu

SEQ ID NO: 700263 - RNA, 22 nt, Human
aagaaucuuguuuucuuuuuuu

SEQ ID NO: 700264 - RNA, 22 nt, Human
acuugguguacauuuaauagac

SEQ ID NO: 700265 - RNA, 20 nt, Human
aggaaugcuguuuguucuug

SEQ ID NO: 700266 - RNA, 24 nt, Human
augggaaugaaaauaauagauacc

SEQ ID NO: 700267 - RNA, 21 nt, Human
auguacucuugaaaauguguu

SEQ ID NO: 700268 - RNA, 26 nt, Human
auguuugcccaacauuuccuucuuuu

SEQ ID NO: 700269 - RNA, 23 nt, Human
caacagaauaaauuauauaucca

SEQ ID NO: 700270 - RNA, 21 nt, Human
cacccccagccuccugugggu

SEQ ID NO: 700271 - RNA, 24 nt, Human
cagaaaguuuuuuuuccaagauau

SEQ ID NO: 700272 - RNA, 24 nt, Human
caggauacaauaaaacccuggagu

SEQ ID NO: 700273 - RNA, 19 nt, Human
cagguuccacuuacucuuc

SEQ ID NO: 700274 - RNA, 18 nt, Human
ccaacauuuccuucuuuu

SEQ ID NO: 700275 - RNA, 22 nt, Human
ccaauuccacuucaucauauau

SEQ ID NO: 700276 - RNA, 22 nt, Human
cccaacauuuccuucuuuuguu

SEQ ID NO: 700277 - RNA, 18 nt, Human
ccuccuguggguaagaau

SEQ ID NO: 700278 - RNA, 18 nt, Human
ccuccuguggguaagaau

SEQ ID NO: 700279 - RNA, 23 nt, Human
ccuccuguggguaagaaucuugu

SEQ ID NO: 700280 - RNA, 20 nt, Human
ccucuuaugggaaugaaaau

SEQ ID NO: 700281 - RNA, 21 nt, Human
cuccuguggguaagaaucuug

SEQ ID NO: 700282 - RNA, 25 nt, Human
cugcuagguuaaacuccaagaacac

SEQ ID NO: 700283 - RNA, 23 nt, Human
gaacccgucuccugagaagcugg

SEQ ID NO: 700284 - RNA, 19 nt, Human
gacaaguaacaaagagaag

SEQ ID NO: 700285 - RNA, 24 nt, Human
gcacagugcuaaaucauauauagu

SEQ ID NO: 700286 - RNA, 20 nt, Human
gccuccuguggguaagaauu

SEQ ID NO: 700287 - RNA, 23 nt, Human
ggaaaaaacaaugcuucccugga

SEQ ID NO: 700288 - RNA, 23 nt, Human
ggggaucccuuuucuuguauugu

SEQ ID NO: 700289 - RNA, 20 nt, Human
guagagaaucucuaucuaca

SEQ ID NO: 700290 - RNA, 19 nt, Human
guauaaacggguaaguaga

SEQ ID NO: 700291 - RNA, 18 nt, Human
gucccuguugugauaucu

SEQ ID NO: 700292 - RNA, 22 nt, Human
uaagaaauucaaauggaaacag

SEQ ID NO: 700293 - RNA, 23 nt, Human
uacauuuacaaaaacuccuucug

SEQ ID NO: 700294 - RNA, 21 nt, Human
uaccuggggaucccuuuucuu

SEQ ID NO: 700295 - RNA, 25 nt, Human
uagauacugcaugcuuuuuuuuuuu

SEQ ID NO: 700296 - RNA, 23 nt, Human
uagcacccccagccuccuguggg

SEQ ID NO: 700297 - RNA, 25 nt, Human
uagcugauucucucucuauucgcuc

SEQ ID NO: 700298 - RNA, 22 nt, Human
uagguuaaacuccaagaacacu

SEQ ID NO: 700299 - RNA, 24 nt, Human
uaugggaaugaaaauaauagauac

SEQ ID NO: 700300 - RNA, 21 nt, Human
uauguuaaacuuucuacaaaa

SEQ ID NO: 700301 - RNA, 25 nt, Human
ucagaagucagccuauacaaacugu

SEQ ID NO: 700302 - RNA, 24 nt, Human
uccaagaacacuuuauuaagaaca

SEQ ID NO: 700303 - RNA, 19 nt, Human
ucccagguuccacuuacuc

SEQ ID NO: 700304 - RNA, 21 nt, Human
ucgcuccaccagauuaccugg

SEQ ID NO: 700305 - RNA, 19 nt, Human
ucuguuguugauucuguac

SEQ ID NO: 700306 - RNA, 19 nt, Human
ugagaaucuguuucugcug

SEQ ID NO: 700307 - RNA, 28 nt, Human
ugccagaauguugguauuucgggucccc

SEQ ID NO: 700308 - RNA, 28 nt, Human
uggaaacagacaaguaacaaagagaagu

SEQ ID NO: 700309 - RNA, 24 nt, Human
ugggaguaaaaaugaacugagaau

SEQ ID NO: 700310 - RNA, 24 nt, Human
uguaaaacaggcacuugauuugcu

SEQ ID NO: 700311 - RNA, 19 nt, Human
uuauaucaaaauguacucu

SEQ ID NO: 700312 - RNA, 18 nt, Human
uucaaguuuuucugccuu

SEQ ID NO: 700313 - RNA, 23 nt, Human
uucuuuugagaagcgcucccuuu

SEQ ID NO: 700314 - RNA, 24 nt, Human
aaguuucuugguuucucauggaaa

SEQ ID NO: 700315 - RNA, 22 nt, Human
acugaccacugucaaaccagug

SEQ ID NO: 700316 - RNA, 31 nt, Human
acuuuaaaacagcagccaaguagagaagggg

SEQ ID NO: 700317 - RNA, 19 nt, Human
agaaggguuggggaaggga

SEQ ID NO: 700318 - RNA, 21 nt, Human
aguagagaaggguuggggaag

SEQ ID NO: 700319 - RNA, 21 nt, Human
cauuuacuccaguuccugcuc

SEQ ID NO: 700320 - RNA, 23 nt, Human
ccaguuccugcuccaugugaaaa

SEQ ID NO: 700321 - RNA, 21 nt, Human
ccccagccccucuauucgguc

SEQ ID NO: 700322 - RNA, 21 nt, Human
ccccucgugcugccgccgcua

SEQ ID NO: 700323 - RNA, 20 nt, Human
ccgcucagcucuuuuccccu

SEQ ID NO: 700324 - RNA, 23 nt, Human
ccucgugcugccgccgcucgcac

SEQ ID NO: 700325 - RNA, 19 nt, Human
cgcucgcacccggcucucc

SEQ ID NO: 700326 - RNA, 25 nt, Human
cuauucggucucucacagacccacu

SEQ ID NO: 700327 - RNA, 19 nt, Human
cugccgccgcucgcacccg

SEQ ID NO: 700328 - RNA, 25 nt, Human
gacccacugucucccggcugacuuu

SEQ ID NO: 700329 - RNA, 20 nt, Human
gagaaggguuggggaaggga

SEQ ID NO: 700330 - RNA, 19 nt, Human
gcucgcacccggcucucca

SEQ ID NO: 700331 - RNA, 24 nt, Human
ggcaaacuuuaaaacagcagccaa

SEQ ID NO: 700332 - RNA, 20 nt, Human
ucacagacccacugucuccc

SEQ ID NO: 700333 - RNA, 27 nt, Human
ucgaaagagcuuuagacucuguaauaa

SEQ ID NO: 700334 - RNA, 19 nt, Human
ucgugcugccgccgcucgc

SEQ ID NO: 700335 - RNA, 18 nt, Human
ucucucacagacccacug

SEQ ID NO: 700336 - RNA, 25 nt, Human
ucuguaauaaaaauccaaauuuggg

SEQ ID NO: 700337 - RNA, 25 nt, Human
uggccccagccccucuauucggucu

SEQ ID NO: 700338 - RNA, 23 nt, Human
uguaacugaccacugucaaacca

SEQ ID NO: 700339 - RNA, 22 nt, Human
uuaaucaguauaaaaucgaaag

SEQ ID NO: 700340 - RNA, 26 nt, Human
uuauacaccuauuuuucuuccuucca

SEQ ID NO: 700341 - RNA, 21 nt, Human
uucucauggaaaacauuuuau

SEQ ID NO: 700342 - RNA, 21 nt, Human
uucuugguuucucauggaaaa

SEQ ID NO: 700343 - RNA, 30 nt, Human
aaacuaguuuuacuuuagcaccauucuuaa

SEQ ID NO: 700344 - RNA, 22 nt, Human
agcaggauucuugaucaugggg

SEQ ID NO: 700345 - RNA, 19 nt, Human
agcgccuuuaaccaggcgg

SEQ ID NO: 700346 - RNA, 26 nt, Human
caggugccgagggucuggaucagaaa

SEQ ID NO: 700347 - RNA, 24 nt, Human
ccuuccaugagcucuccgcagcuc

SEQ ID NO: 700348 - RNA, 18 nt, Human
gaucagaaaaaaaggcag

SEQ ID NO: 700349 - RNA, 19 nt, Human
guguaucugggcuucaugg

SEQ ID NO: 700350 - RNA, 24 nt, Human
uggaauuuuguguaucugggcuuc

SEQ ID NO: 700351 - RNA, 19 nt, Human
ugggaaauaagcgccuuua

SEQ ID NO: 700352 - RNA, 23 nt, Human
ccuuuggucuuagauacuucucu

SEQ ID NO: 700353 - RNA, 19 nt, Human
uaggcaggcacaaaaugcc

SEQ ID NO: 700354 - RNA, 18 nt, Human
uggauagcuaggcaggca

SEQ ID NO: 700355 - RNA, 19 nt, Human
uggucuguguuuucuccuu

SEQ ID NO: 700356 - RNA, 18 nt, Human
uuuuuuuuuuuuuuuccg

SEQ ID NO: 700357 - RNA, 21 nt, Human
uuuuuuuuuuuuuuuuuccga

SEQ ID NO: 700358 - RNA, 26 nt, Human
uuuuuuuuuuuuuuuuuccgaguuuu

SEQ ID NO: 700359 - RNA, 23 nt, Human
agaaaguggcaagccuauuuuca

SEQ ID NO: 700360 - RNA, 20 nt, Human
cucaaaaugaauuuucaguu

SEQ ID NO: 700361 - RNA, 19 nt, Human
ugagagaguagcuuucagg

SEQ ID NO: 700362 - RNA, 21 nt, Human
aaacgccgggagaggcaacaa

SEQ ID NO: 700363 - RNA, 20 nt, Human
aaagugccucuagcccgcgg

SEQ ID NO: 700364 - RNA, 23 nt, Human
aacaacggcccuccauguccccc

SEQ ID NO: 700365 - RNA, 24 nt, Human
aacagggcagccuguccaacagaa

SEQ ID NO: 700366 - RNA, 22 nt, Human
aacugagcuggcagccagcccc

SEQ ID NO: 700367 - RNA, 23 nt, Human
aaugcucauucaugcaugaaguu

SEQ ID NO: 700368 - RNA, 18 nt, Human
acagguaaagcuuccuuc

SEQ ID NO: 700369 - RNA, 21 nt, Human
acauauauacaccauuuuaca

SEQ ID NO: 700370 - RNA, 19 nt, Human
acccagggugugucugugg

SEQ ID NO: 700371 - RNA, 26 nt, Human
acccccagugccaggcagaagcccau

SEQ ID NO: 700372 - RNA, 21 nt, Human
acccuggacccagacuccuca

SEQ ID NO: 700373 - RNA, 20 nt, Human
agacuccucaauccacccag

SEQ ID NO: 700374 - RNA, 23 nt, Human
agagggggaagccgcugcccaga

SEQ ID NO: 700375 - RNA, 19 nt, Human
agccccagcaggccagaga

SEQ ID NO: 700376 - RNA, 22 nt, Human
aggaacccggggagggggaugg

SEQ ID NO: 700377 - RNA, 22 nt, Human
aggaggcuuucauauuccgugc

SEQ ID NO: 700378 - RNA, 24 nt, Human
aggcagagaggugagugucucagg

SEQ ID NO: 700379 - RNA, 22 nt, Human
aggcaggggaggggcuagaggg

SEQ ID NO: 700380 - RNA, 18 nt, Human
aggcaggggaggggcucg

SEQ ID NO: 700381 - RNA, 26 nt, Human
aggggccgaagagucaccaccgagcc

SEQ ID NO: 700382 - RNA, 23 nt, Human
aggggguucauuuccccaggaag

SEQ ID NO: 700383 - RNA, 26 nt, Human
caacaacggcccuccauguccccccu

SEQ ID NO: 700384 - RNA, 21 nt, Human
caacggcccuccauguccccc

SEQ ID NO: 700385 - RNA, 19 nt, Human
cacagccacgccgucccuc

SEQ ID NO: 700386 - RNA, 19 nt, Human
cacccuccacccccagugc

SEQ ID NO: 700387 - RNA, 22 nt, Human
cacccuccacccccagugccag

SEQ ID NO: 700388 - RNA, 19 nt, Human
cagacuccucaauccaccc

SEQ ID NO: 700389 - RNA, 21 nt, Human
cagcccccagccccagggcuc

SEQ ID NO: 700390 - RNA, 18 nt, Human
cagcccccugcccagccu

SEQ ID NO: 700391 - RNA, 21 nt, Human
cagcccccugcccagccugcc

SEQ ID NO: 700392 - RNA, 20 nt, Human
cagcucagcccccugcccag

SEQ ID NO: 700393 - RNA, 18 nt, Human
caggcacccugaggccug

SEQ ID NO: 700394 - RNA, 22 nt, Human
cagggcagccuguccaacagaa

SEQ ID NO: 700395 - RNA, 23 nt, Human
cauuuccccaggaagcacagcca

SEQ ID NO: 700396 - RNA, 22 nt, Human
ccaccgagccugugugggagga

SEQ ID NO: 700397 - RNA, 22 nt, Human
ccagcaggccagagagcccagu

SEQ ID NO: 700398 - RNA, 19 nt, Human
ccagccugccccacagccu

SEQ ID NO: 700399 - RNA, 19 nt, Human
ccagcucagcccccugccc

SEQ ID NO: 700400 - RNA, 24 nt, Human
ccagcucagcccccugcccagccu

SEQ ID NO: 700401 - RNA, 25 nt, Human
ccaguggcuuuugcuggggcccccu

SEQ ID NO: 700402 - RNA, 26 nt, Human
cccagccucagccccaacugcgaggc

SEQ ID NO: 700403 - RNA, 19 nt, Human
ccccaggaagcacagccac

SEQ ID NO: 700404 - RNA, 22 nt, Human
ccccaggggccgaagagucacc

SEQ ID NO: 700405 - RNA, 21 nt, Human
cccccagugccaggcagaagc

SEQ ID NO: 700406 - RNA, 24 nt, Human
cccccuugcugcucucccagccuc

SEQ ID NO: 700407 - RNA, 21 nt, Human
cccuaugccugcugaccacca

SEQ ID NO: 700408 - RNA, 22 nt, Human
cccugcccagccugccccacag

SEQ ID NO: 700409 - RNA, 19 nt, Human
cccuggacccagacuccuc

SEQ ID NO: 700410 - RNA, 23 nt, Human
ccuccugauggcgcaccuggucc

SEQ ID NO: 700411 - RNA, 20 nt, Human
ccuggcacagagaggcgccc

SEQ ID NO: 700412 - RNA, 18 nt, Human
ccuucccuccugccuccc

SEQ ID NO: 700413 - RNA, 24 nt, Human
cgcugccagcucagcccccugccc

SEQ ID NO: 700414 - RNA, 20 nt, Human
cggcccuccauguccccccu

SEQ ID NO: 700415 - RNA, 20 nt, Human
cgggagaggcaacaacggcc

SEQ ID NO: 700416 - RNA, 23 nt, Human
cucagccccaacugcgaggcaga

SEQ ID NO: 700417 - RNA, 19 nt, Human
cuccauguccccccuaggu

SEQ ID NO: 700418 - RNA, 25 nt, Human
cucccagaacugagcuggcagccag

SEQ ID NO: 700419 - RNA, 20 nt, Human
cuccugccucccuaugccug

SEQ ID NO: 700420 - RNA, 21 nt, Human
cugaccaccagcaagaaauug

SEQ ID NO: 700421 - RNA, 30 nt, Human
cugagcuggcagccagccccagccucagcc

SEQ ID NO: 700422 - RNA, 21 nt, Human
cugcccagccugccccacagc

SEQ ID NO: 700423 - RNA, 22 nt, Human
cugcucucccagccucccuggc

SEQ ID NO: 700424 - RNA, 23 nt, Human
cugugccuguggcccaggcgacc

SEQ ID NO: 700425 - RNA, 22 nt, Human
cuguggcccaggcgaccccagc

SEQ ID NO: 700426 - RNA, 23 nt, Human
cuuaucuccuuccaagguggggg

SEQ ID NO: 700427 - RNA, 20 nt, Human
cuucgaacugggaucucccc

SEQ ID NO: 700428 - RNA, 23 nt, Human
cuuuugcuggggcccccuccuua

SEQ ID NO: 700429 - RNA, 18 nt, Human
cuuuuuguuuuuccccag

SEQ ID NO: 700430 - RNA, 18 nt, Human
gacgcggaggagaggcgc

SEQ ID NO: 700431 - RNA, 20 nt, Human
gagaggcaacaacggcccuc

SEQ ID NO: 700432 - RNA, 19 nt, Human
gagcugcugugccuguggc

SEQ ID NO: 700433 - RNA, 19 nt, Human
gaggaggcuuucauauucc

SEQ ID NO: 700434 - RNA, 21 nt, Human
gccccagccucagccccaacu

SEQ ID NO: 700435 - RNA, 33 nt, Human
gcuggcagccagccccagccucagccccaaccg

SEQ ID NO: 700436 - RNA, 18 nt, Human
ggcucagagaggcuggcg

SEQ ID NO: 700437 - RNA, 19 nt, Human
gggcagggggcuggggcga

SEQ ID NO: 700438 - RNA, 21 nt, Human
gggcagggggcuggggcgagg

SEQ ID NO: 700439 - RNA, 19 nt, Human
ggggagggggaugggacag

SEQ ID NO: 700440 - RNA, 23 nt, Human
ggggcgggcagggggcuggggcg

SEQ ID NO: 700441 - RNA, 22 nt, Human
gggguguauggggaggggggcu

SEQ ID NO: 700442 - RNA, 18 nt, Human
guaaagugccucuagccc

SEQ ID NO: 700443 - RNA, 18 nt, Human
guguauggggaggggggc

SEQ ID NO: 700444 - RNA, 18 nt, Human
uaaagugccucuagcccg

SEQ ID NO: 700445 - RNA, 23 nt, Human
uauuuuauuuauacauauauaca

SEQ ID NO: 700446 - RNA, 19 nt, Human
ucacccaggaacagggcag

SEQ ID NO: 700447 - RNA, 24 nt, Human
ucaggccugggguguauggggagg

SEQ ID NO: 700448 - RNA, 24 nt, Human
ucccaaaguggggcgggcaggggg

SEQ ID NO: 700449 - RNA, 20 nt, Human
ucgugugcacccuccacccc

SEQ ID NO: 700450 - RNA, 22 nt, Human
ucgugugcacccuccaccccca

SEQ ID NO: 700451 - RNA, 19 nt, Human
ucuccuuccaagguggggg

SEQ ID NO: 700452 - RNA, 19 nt, Human
ucugcaagcagcuuuggcu

SEQ ID NO: 700453 - RNA, 18 nt, Human
ugaaggaacccggggagg

SEQ ID NO: 700454 - RNA, 19 nt, Human
ugaaguuuuucucuguugc

SEQ ID NO: 700455 - RNA, 18 nt, Human
ugacaaggugaccugaag

SEQ ID NO: 700456 - RNA, 21 nt, Human
ugagcugcugugccuguggcc

SEQ ID NO: 700457 - RNA, 19 nt, Human
ugcccagccugccccacag

SEQ ID NO: 700458 - RNA, 23 nt, Human
ugccccacagccugagccccagc

SEQ ID NO: 700459 - RNA, 20 nt, Human
ugcugcucucccagccuccc

SEQ ID NO: 700460 - RNA, 24 nt, Human
uggagggucccaaaguggggcggg

SEQ ID NO: 700461 - RNA, 22 nt, Human
uggcacagagaggcgcccuggg

SEQ ID NO: 700462 - RNA, 20 nt, Human
uggcagagagggccacaggc

SEQ ID NO: 700463 - RNA, 20 nt, Human
uggcagagagggccacaggc

SEQ ID NO: 700464 - RNA, 24 nt, Human
uggcgcaccuggucccccuugcug

SEQ ID NO: 700465 - RNA, 18 nt, Human
uggggaaagcggcuggag

SEQ ID NO: 700466 - RNA, 23 nt, Human
uggggccaaggcaguuucccugg

SEQ ID NO: 700467 - RNA, 23 nt, Human
ugucucaggcacccugaggccug

SEQ ID NO: 700468 - RNA, 26 nt, Human
uuccagcccccagccccagggcucug

SEQ ID NO: 700469 - RNA, 19 nt, Human
uuccgugccaugaccccuc

SEQ ID NO: 700470 - RNA, 21 nt, Human
uugcugcucucccagccuccc

SEQ ID NO: 700471 - RNA, 21 nt, Human
uuugcuggggcccccuccuua

SEQ ID NO: 700472 - RNA, 22 nt, Human
uuuuucucuguugcacccugga

SEQ ID NO: 700473 - RNA, 20 nt, Human
uuuuuguuuuuccccagggg

SEQ ID NO: 700474 - RNA, 24 nt, Human
aggccgcaggcaggcagcgaggga

SEQ ID NO: 700475 - RNA, 19 nt, Human
caagugcacugggcaggcc

SEQ ID NO: 700476 - RNA, 21 nt, Human
caggccgcaggcaggcagcga

SEQ ID NO: 700477 - RNA, 23 nt, Human
cagggcaggccgcaggcaggcag

SEQ ID NO: 700478 - RNA, 20 nt, Human
ccagcaagugcacugggcag

SEQ ID NO: 700479 - RNA, 18 nt, Human
ccugaggacacugaggac

SEQ ID NO: 700480 - RNA, 24 nt, Human
gggggccugaguccggggcuugag

SEQ ID NO: 700481 - RNA, 22 nt, Human
uccaccccaucaggcccuugcg

SEQ ID NO: 700482 - RNA, 20 nt, Human
ucuuccagcaagugcacugg

SEQ ID NO: 700483 - RNA, 20 nt, Human
ugaugacagcugggggggcc

SEQ ID NO: 700484 - RNA, 24 nt, Human
ugcacugggcaggccccugaggac

SEQ ID NO: 700485 - RNA, 20 nt, Human
ugggggggccgccaugccuu

SEQ ID NO: 700486 - RNA, 25 nt, Human
uuuuucgauugccuuugccuuuaau

SEQ ID NO: 700487 - RNA, 18 nt, Human
uuuuuuuuuuuuuuuucg

SEQ ID NO: 700488 - RNA, 22 nt, Human
uuuuuuuuuuuuuuuuucgauu

SEQ ID NO: 700489 - RNA, 21 nt, Human
agcuauagcucccccuggggu

SEQ ID NO: 700490 - RNA, 22 nt, Human
cacacaggucacauguuacggu

SEQ ID NO: 700491 - RNA, 18 nt, Human
caguggcgcagccgcagu

SEQ ID NO: 700492 - RNA, 19 nt, Human
cggggcuuuccuuccuggc

SEQ ID NO: 700493 - RNA, 23 nt, Human
cugguuccaggugacuaggucac

SEQ ID NO: 700494 - RNA, 23 nt, Human
gagcugguuccaggugacuaggu

SEQ ID NO: 700495 - RNA, 18 nt, Human
gcgcagccgcagugaguc

SEQ ID NO: 700496 - RNA, 20 nt, Human
gcugguuccaggugacuagg

SEQ ID NO: 700497 - RNA, 20 nt, Human
ggggaggggucccaguggcg

SEQ ID NO: 700498 - RNA, 20 nt, Human
ucaggagcugguuccaggug

SEQ ID NO: 700499 - RNA, 20 nt, Human
ugaagcuauagcucccccug

SEQ ID NO: 700500 - RNA, 21 nt, Human
ugacuaggucaccacauucca

SEQ ID NO: 700501 - RNA, 19 nt, Human
uggcugcaggugccucuug

SEQ ID NO: 700502 - RNA, 21 nt, Human
uggcugcaggugccucuuggg

SEQ ID NO: 700503 - RNA, 26 nt, Human
ugguaaugaggaaaguucacuugggg

SEQ ID NO: 700504 - RNA, 18 nt, Human
uucaggaugguaaugagg

SEQ ID NO: 700505 - RNA, 21 nt, Human
acccaaacccacuaucagggu

SEQ ID NO: 700506 - RNA, 18 nt, Human
agagagaggcagaccuaa

SEQ ID NO: 700507 - RNA, 19 nt, Human
agcacauacauuccauacc

SEQ ID NO: 700508 - RNA, 23 nt, Human
agcuggccugcucacccagcccc

SEQ ID NO: 700509 - RNA, 18 nt, Human
agggggucagcacauaca

SEQ ID NO: 700510 - RNA, 20 nt, Human
cacacacacacacacacaca

SEQ ID NO: 700511 - RNA, 22 nt, Human
cacacacacacacacacacaga

SEQ ID NO: 700512 - RNA, 23 nt, Human
ccacuaucagggucugugccugg

SEQ ID NO: 700513 - RNA, 22 nt, Human
ccuccuauccacaggagcccag

SEQ ID NO: 700514 - RNA, 23 nt, Human
cguuugaaacuaggucugucugg

SEQ ID NO: 700515 - RNA, 23 nt, Human
cuaagaucccuguuccaaucccc

SEQ ID NO: 700516 - RNA, 20 nt, Human
cuaucagggucugugccugg

SEQ ID NO: 700517 - RNA, 25 nt, Human
cuucacacacacacacacacacaga

SEQ ID NO: 700518 - RNA, 20 nt, Human
gagcccagauggaggggcca

SEQ ID NO: 700519 - RNA, 24 nt, Human
gccugggcaccaaaggggcaggca

SEQ ID NO: 700520 - RNA, 21 nt, Human
ggagcccagauggaggggcca

SEQ ID NO: 700521 - RNA, 18 nt, Human
ggcaccaaaggggcaggc

SEQ ID NO: 700522 - RNA, 19 nt, Human
uacagugagggcuuggcuc

SEQ ID NO: 700523 - RNA, 22 nt, Human
uaugccuuuucacagccucaca

SEQ ID NO: 700524 - RNA, 22 nt, Human
ucacacacacacacacacacag

SEQ ID NO: 700525 - RNA, 25 nt, Human
ucacccagccccuccuauccacagg

SEQ ID NO: 700526 - RNA, 24 nt, Human
uccgcaccgcucggcuccacccuc

SEQ ID NO: 700527 - RNA, 22 nt, Human
uccuucugaucagcucagggaa

SEQ ID NO: 700528 - RNA, 22 nt, Human
ucuccggagaaccaccagaucu

SEQ ID NO: 700529 - RNA, 18 nt, Human
ucuucuguacagugaggg

SEQ ID NO: 700530 - RNA, 22 nt, Human
ugaaacuaggucugucugguug

SEQ ID NO: 700531 - RNA, 20 nt, Human
ugccugggcaccaaaggggc

SEQ ID NO: 700532 - RNA, 22 nt, Human
ugccugggcaccaaaggggcag

SEQ ID NO: 700533 - RNA, 27 nt, Human
ugggggccuccuuugcagggggacacc

SEQ ID NO: 700534 - RNA, 18 nt, Human
uguaaaaaacuucacaca

SEQ ID NO: 700535 - RNA, 20 nt, Human
uucacacacacacacacaca

SEQ ID NO: 700536 - RNA, 21 nt, Human
uucacacacacacacacacac

SEQ ID NO: 700537 - RNA, 22 nt, Human
aaaccagagggagugggaaggc

SEQ ID NO: 700538 - RNA, 22 nt, Human
aacaugaaacgcuugaagagga

SEQ ID NO: 700539 - RNA, 18 nt, Human
aaccagagggagugggaa

SEQ ID NO: 700540 - RNA, 22 nt, Human
aaggugcaggccuuggacgugc

SEQ ID NO: 700541 - RNA, 25 nt, Human
accuacugcccuggggaaaccccag

SEQ ID NO: 700542 - RNA, 19 nt, Human
agaagauagaaaggucagc

SEQ ID NO: 700543 - RNA, 18 nt, Human
agacacuggcacuggccu

SEQ ID NO: 700544 - RNA, 18 nt, Human
agcaguguucuuagccuc

SEQ ID NO: 700545 - RNA, 19 nt, Human
agcaguguucuuagccucc

SEQ ID NO: 700546 - RNA, 23 nt, Human
aggagcaguaccugagccuagag

SEQ ID NO: 700547 - RNA, 18 nt, Human
agggagugggaaggcgua

SEQ ID NO: 700548 - RNA, 23 nt, Human
agggagugggaaggcguaugaga

SEQ ID NO: 700549 - RNA, 24 nt, Human
auggugcagaagagcaguguugga

SEQ ID NO: 700550 - RNA, 19 nt, Human
caagggccccuaggaccca

SEQ ID NO: 700551 - RNA, 24 nt, Human
cacauuuauuccacuucuugaagg

SEQ ID NO: 700552 - RNA, 21 nt, Human
caggaggccuccucuccuguu

SEQ ID NO: 700553 - RNA, 23 nt, Human
caguguuggaaucauucuaaugc

SEQ ID NO: 700554 - RNA, 25 nt, Human
caguugcaaugucugugccacccca

SEQ ID NO: 700555 - RNA, 22 nt, Human
cauccuggccagcagccaggag

SEQ ID NO: 700556 - RNA, 22 nt, Human
cccaggaccagcuggagccuca

SEQ ID NO: 700557 - RNA, 23 nt, Human
cccaggagcugggacuagugggu

SEQ ID NO: 700558 - RNA, 18 nt, Human
ccccacacucugagcugc

SEQ ID NO: 700559 - RNA, 23 nt, Human
ccccagagcuuucagggcucacu

SEQ ID NO: 700560 - RNA, 19 nt, Human
ccccaggaggccuccucuc

SEQ ID NO: 700561 - RNA, 21 nt, Human
ccccuaggacccacaggcagg

SEQ ID NO: 700562 - RNA, 24 nt, Human
ccccuaggacccacaggcagggcc

SEQ ID NO: 700563 - RNA, 21 nt, Human
cccugagucaggcaaaggcuc

SEQ ID NO: 700564 - RNA, 18 nt, Human
cccuggggaaaccccagg

SEQ ID NO: 700565 - RNA, 20 nt, Human
ccuaggacccacaggcaggg

SEQ ID NO: 700566 - RNA, 22 nt, Human
ccuauaaaccagagggaguggg

SEQ ID NO: 700567 - RNA, 21 nt, Human
ccuccugguagccaagggccc

SEQ ID NO: 700568 - RNA, 22 nt, Human
ccuggcugcaugucccaggacc

SEQ ID NO: 700569 - RNA, 20 nt, Human
cuggcacuggccuuggccac

SEQ ID NO: 700570 - RNA, 24 nt, Human
cuggcugcaugucccaggaccagc

SEQ ID NO: 700571 - RNA, 20 nt, Human
gaagcaaaggccacauuuau

SEQ ID NO: 700572 - RNA, 22 nt, Human
gagcugggacuaguggguuucu

SEQ ID NO: 700573 - RNA, 24 nt, Human
gagcugggacuaguggguuucuuc

SEQ ID NO: 700574 - RNA, 20 nt, Human
gaggaaggaagacugugaug

SEQ ID NO: 700575 - RNA, 19 nt, Human
gcugugcugcuucccaggg

SEQ ID NO: 700576 - RNA, 22 nt, Human
ggagagccaaaggggccccaag

SEQ ID NO: 700577 - RNA, 22 nt, Human
ggaggcucucuauguugccuga

SEQ ID NO: 700578 - RNA, 19 nt, Human
gggaguggagagagcugug

SEQ ID NO: 700579 - RNA, 21 nt, Human
gggaugggaucuugcccuggg

SEQ ID NO: 700580 - RNA, 22 nt, Human
ggggaugcaggcuugugggacu

SEQ ID NO: 700581 - RNA, 18 nt, Human
gucagaccaagcauagaa

SEQ ID NO: 700582 - RNA, 22 nt, Human
guggaagguaaugcuggcgaca

SEQ ID NO: 700583 - RNA, 22 nt, Human
uacugcccuggggaaaccccag

SEQ ID NO: 700584 - RNA, 18 nt, Human
uaguggguuucuucccug

SEQ ID NO: 700585 - RNA, 24 nt, Human
uaugagagcuucuucuccccacgg

SEQ ID NO: 700586 - RNA, 21 nt, Human
uauguugccugaggcuggcag

SEQ ID NO: 700587 - RNA, 23 nt, Human
ucagaccaagcauagaaagaaca

SEQ ID NO: 700588 - RNA, 21 nt, Human
ucaggcaaaggcucuuccugg

SEQ ID NO: 700589 - RNA, 22 nt, Human
ucauucaugagcaguguucuua

SEQ ID NO: 700590 - RNA, 20 nt, Human
ucccaacagagguggccugg

SEQ ID NO: 700591 - RNA, 18 nt, Human
ucccugccuccuuguggc

SEQ ID NO: 700592 - RNA, 19 nt, Human
uccugguagccaagggccc

SEQ ID NO: 700593 - RNA, 21 nt, Human
uccugugggucccaacagagg

SEQ ID NO: 700594 - RNA, 22 nt, Human
uccugugggucccaacagaggu

SEQ ID NO: 700595 - RNA, 20 nt, Human
ucuccuguuggcuagggagu

SEQ ID NO: 700596 - RNA, 20 nt, Human
ucugccccacacucugagcu

SEQ ID NO: 700597 - RNA, 25 nt, Human
ucugccccacacucugagcugcccu

SEQ ID NO: 700598 - RNA, 23 nt, Human
ucugucuguggcacguccaggag

SEQ ID NO: 700599 - RNA, 21 nt, Human
ugaaacgcuugaagaggaagg

SEQ ID NO: 700600 - RNA, 19 nt, Human
ugaaggugcaggccuugga

SEQ ID NO: 700601 - RNA, 23 nt, Human
ugagggagagccaaaggggcccc

SEQ ID NO: 700602 - RNA, 21 nt, Human
ugccaccccaggagcugggac

SEQ ID NO: 700603 - RNA, 18 nt, Human
uggaagguaaugcuggcg

SEQ ID NO: 700604 - RNA, 19 nt, Human
uggaagguaaugcuggcga

SEQ ID NO: 700605 - RNA, 23 nt, Human
uggcaguggugacccucagaaau

SEQ ID NO: 700606 - RNA, 19 nt, Human
uggccagcagccaggaggg

SEQ ID NO: 700607 - RNA, 23 nt, Human
uggccuggugcccagucucagcu

SEQ ID NO: 700608 - RNA, 21 nt, Human
ugggaugggaucuugcccugg

SEQ ID NO: 700609 - RNA, 21 nt, Human
ugggaugggaucuugcccugg

SEQ ID NO: 700610 - RNA, 23 nt, Human
ugggucccaacagagguggccug

SEQ ID NO: 700611 - RNA, 20 nt, Human
uggguuucuucccugccucc

SEQ ID NO: 700612 - RNA, 18 nt, Human
ugugaugggaugggaucu

SEQ ID NO: 700613 - RNA, 24 nt, Human
uguggcacguccaggagcugagcc

SEQ ID NO: 700614 - RNA, 19 nt, Human
uuggucucauggugcagaa

SEQ ID NO: 700615 - RNA, 19 nt, Human
aaaaacagcgucugccuuu

SEQ ID NO: 700616 - RNA, 18 nt, Human
aaccaagccacgggcccc

SEQ ID NO: 700617 - RNA, 22 nt, Human
agcgccaccgcaccgggagaga

SEQ ID NO: 700618 - RNA, 24 nt, Human
agggcgcccaccaggcgcucgaaa

SEQ ID NO: 700619 - RNA, 18 nt, Human
aucccucuucagccucca

SEQ ID NO: 700620 - RNA, 24 nt, Human
caaggggggcagacaccccaguca

SEQ ID NO: 700621 - RNA, 24 nt, Human
caccacgccgcccuccugcagggu

SEQ ID NO: 700622 - RNA, 23 nt, Human
cacccaggccugaggcccugugc

SEQ ID NO: 700623 - RNA, 24 nt, Human
cagacaccccagucagcccguguc

SEQ ID NO: 700624 - RNA, 22 nt, Human
cagccuccagagggggcggagg

SEQ ID NO: 700625 - RNA, 21 nt, Human
cagcggcagcuggcacagggc

SEQ ID NO: 700626 - RNA, 22 nt, Human
cagcuggcacagggccgacgcc

SEQ ID NO: 700627 - RNA, 21 nt, Human
cagggcccccaggaagucugg

SEQ ID NO: 700628 - RNA, 22 nt, Human
ccaccaggcgcucgaaacccga

SEQ ID NO: 700629 - RNA, 22 nt, Human
ccacgcgcagcggcagcuggca

SEQ ID NO: 700630 - RNA, 19 nt, Human
ccagagggggcggaggggg

SEQ ID NO: 700631 - RNA, 21 nt, Human
ccaggccugaggcccugugcu

SEQ ID NO: 700632 - RNA, 18 nt, Human
ccccaggaagucuggcag

SEQ ID NO: 700633 - RNA, 18 nt, Human
cccccccccaaggggggc

SEQ ID NO: 700634 - RNA, 18 nt, Human
ccccgggcccggacaccc

SEQ ID NO: 700635 - RNA, 20 nt, Human
cccgccccaggucccgcccc

SEQ ID NO: 700636 - RNA, 20 nt, Human
cccgggggauggaaguagcu

SEQ ID NO: 700637 - RNA, 23 nt, Human
ccugggaguccugacucuccucc

SEQ ID NO: 700638 - RNA, 23 nt, Human
ccugugcugcccccccccaaggg

SEQ ID NO: 700639 - RNA, 18 nt, Human
cgccccgggcccggacac

SEQ ID NO: 700640 - RNA, 26 nt, Human
cgcgcagcggcagcuggcacagggcc

SEQ ID NO: 700641 - RNA, 21 nt, Human
cggaaaagggcggguacggcg

SEQ ID NO: 700642 - RNA, 19 nt, Human
cggccacgcgcagcggcag

SEQ ID NO: 700643 - RNA, 21 nt, Human
cggcuccacaggucuacggcc

SEQ ID NO: 700644 - RNA, 22 nt, Human
cgggccgugcgccccgggcccg

SEQ ID NO: 700645 - RNA, 22 nt, Human
cggugcggaaaagggcggguac

SEQ ID NO: 700646 - RNA, 24 nt, Human
cguagcugccgggcgcccggcccu

SEQ ID NO: 700647 - RNA, 18 nt, Human
cgugcgccccgggcccgg

SEQ ID NO: 700648 - RNA, 23 nt, Human
cugugcuggguaguuugugcacu

SEQ ID NO: 700649 - RNA, 19 nt, Human
gaagggcccgggacacuug

SEQ ID NO: 700650 - RNA, 20 nt, Human
gaagggcccgggacacuugc

SEQ ID NO: 700651 - RNA, 23 nt, Human
gcccccaggaagucuggcaguug

SEQ ID NO: 700652 - RNA, 22 nt, Human
gcccggaacgcggggcgcgagg

SEQ ID NO: 700653 - RNA, 20 nt, Human
gcccugugcugccccccccc

SEQ ID NO: 700654 - RNA, 21 nt, Human
gccugaggcccugugcugccc

SEQ ID NO: 700655 - RNA, 18 nt, Human
gcgggccgugcgccccgg

SEQ ID NO: 700656 - RNA, 19 nt, Human
ggcaguugggagggcagug

SEQ ID NO: 700657 - RNA, 23 nt, Human
ggcgcgggaguccccgggggaug

SEQ ID NO: 700658 - RNA, 20 nt, Human
gggcagcacgcagcugagcg

SEQ ID NO: 700659 - RNA, 18 nt, Human
gggccccugcgcgcucag

SEQ ID NO: 700660 - RNA, 21 nt, Human
gggccccugcgcgcucaguuc

SEQ ID NO: 700661 - RNA, 20 nt, Human
gggcggagggggcugugcuu

SEQ ID NO: 700662 - RNA, 19 nt, Human
gggcggguacggcguccgg

SEQ ID NO: 700663 - RNA, 18 nt, Human
guccugacucuccuccua

SEQ ID NO: 700664 - RNA, 20 nt, Human
uaagucccgucccccgcccc

SEQ ID NO: 700665 - RNA, 20 nt, Human
ucagccuccagagggggcgg

SEQ ID NO: 700666 - RNA, 20 nt, Human
uccagagggggcggaggggg

SEQ ID NO: 700667 - RNA, 25 nt, Human
ucccccgccccaggucccgccccug

SEQ ID NO: 700668 - RNA, 21 nt, Human
ucccgccccuggucccacccc

SEQ ID NO: 700669 - RNA, 18 nt, Human
ucccggcgcgggaguccc

SEQ ID NO: 700670 - RNA, 21 nt, Human
ucgcugcacagcgccaccgca

SEQ ID NO: 700671 - RNA, 23 nt, Human
ucuaggugccagguggcacccag

SEQ ID NO: 700672 - RNA, 20 nt, Human
ugaaaccaagccacgggccc

SEQ ID NO: 700673 - RNA, 21 nt, Human
ugcuggguaguuugugcacuc

SEQ ID NO: 700674 - RNA, 21 nt, Human
uggaaucccucuucagccucc

SEQ ID NO: 700675 - RNA, 19 nt, Human
ugggagggcagugugaaga

SEQ ID NO: 700676 - RNA, 24 nt, Human
ugucuguggguggcaggggcuggg

SEQ ID NO: 700677 - RNA, 18 nt, Human
uucuaggugccagguggc

SEQ ID NO: 700678 - RNA, 21 nt, Human
uucuaggugccagguggcacc

SEQ ID NO: 700679 - RNA, 20 nt, Human
uuuuuuuuuuuuuugggcca

SEQ ID NO: 700680 - RNA, 24 nt, Human
uuuuuuuuuuuuuuuuuuuuuggg

SEQ ID NO: 700681 - RNA, 19 nt, Human
aagcacacugcucuuucug

SEQ ID NO: 700682 - RNA, 24 nt, Human
aagcacacugcucuuucuggaguu

SEQ ID NO: 700683 - RNA, 23 nt, Human
acagguccacgaucacgucgcgc

SEQ ID NO: 700684 - RNA, 21 nt, Human
accaccuggagccaaaagccu

SEQ ID NO: 700685 - RNA, 22 nt, Human
acccacccaccccacccccaac

SEQ ID NO: 700686 - RNA, 23 nt, Human
acccacccaccccacccccaacc

SEQ ID NO: 700687 - RNA, 22 nt, Human
acccaccccacccccaaccccc

SEQ ID NO: 700688 - RNA, 20 nt, Human
accccacccccaacccccac

SEQ ID NO: 700689 - RNA, 22 nt, Human
accccacccccaacccccacug

SEQ ID NO: 700690 - RNA, 19 nt, Human
acccccaacccccacuguc

SEQ ID NO: 700691 - RNA, 18 nt, Human
agacacccgggacugcgg

SEQ ID NO: 700692 - RNA, 21 nt, Human
agcagcagcgggcgcggggca

SEQ ID NO: 700693 - RNA, 19 nt, Human
agccaaaagccucuuuucc

SEQ ID NO: 700694 - RNA, 21 nt, Human
agccuggacugaagcauaagc

SEQ ID NO: 700695 - RNA, 18 nt, Human
agcucuaggcggcucugc

SEQ ID NO: 700696 - RNA, 23 nt, Human
cacagcucuaggcggcucugccu

SEQ ID NO: 700697 - RNA, 22 nt, Human
caccaggcgccgcugcgccucc

SEQ ID NO: 700698 - RNA, 31 nt, Human
cacccacccaccccacccccaacccccacuu

SEQ ID NO: 700699 - RNA, 22 nt, Human
cacccaccccacccccaacccc

SEQ ID NO: 700700 - RNA, 21 nt, Human
caccccacccccaacccccac

SEQ ID NO: 700701 - RNA, 20 nt, Human
cacccccaacccccacuguc

SEQ ID NO: 700702 - RNA, 24 nt, Human
cagaacaacacccaguagggugaa

SEQ ID NO: 700703 - RNA, 18 nt, Human
cagaguccucucucccuc

SEQ ID NO: 700704 - RNA, 21 nt, Human
cagagugggaaagggaauccc

SEQ ID NO: 700705 - RNA, 21 nt, Human
cagcacccacccaccccaccc

SEQ ID NO: 700706 - RNA, 23 nt, Human
cagcacccacccaccccaccccc

SEQ ID NO: 700707 - RNA, 19 nt, Human
cagcgggcgcggggcagcg

SEQ ID NO: 700708 - RNA, 25 nt, Human
cagcgggcgcggggcagcguggagc

SEQ ID NO: 700709 - RNA, 20 nt, Human
cagggucgaaggcucauucc

SEQ ID NO: 700710 - RNA, 22 nt, Human
caggugagggccagaacaacac

SEQ ID NO: 700711 - RNA, 20 nt, Human
caguguccguugcguugcgg

SEQ ID NO: 700712 - RNA, 20 nt, Human
ccaaaagccucuuuuccuaa

SEQ ID NO: 700713 - RNA, 20 nt, Human
ccaaccucuccagccuggac

SEQ ID NO: 700714 - RNA, 22 nt, Human
ccacccaccccacccccaaccc

SEQ ID NO: 700715 - RNA, 23 nt, Human
ccaccgccagcacccacccaccc

SEQ ID NO: 700716 - RNA, 20 nt, Human
ccacggcagcgggcccacgc

SEQ ID NO: 700717 - RNA, 21 nt, Human
ccagaguccucucucccucug

SEQ ID NO: 700718 - RNA, 18 nt, Human
ccagcacccacccacccc

SEQ ID NO: 700719 - RNA, 21 nt, Human
ccagcacccacccaccccacc

SEQ ID NO: 700720 - RNA, 28 nt, Human
ccagcacccacccaccccacccccaacc

SEQ ID NO: 700721 - RNA, 20 nt, Human
cccacccaccccacccccaa

SEQ ID NO: 700722 - RNA, 18 nt, Human
cccaccccacccccaacc

SEQ ID NO: 700723 - RNA, 22 nt, Human
cccaccccacccccaaccccca

SEQ ID NO: 700724 - RNA, 23 nt, Human
cccaccccacccccaacccccac

SEQ ID NO: 700725 - RNA, 18 nt, Human
cccacccccaacccccac

SEQ ID NO: 700726 - RNA, 27 nt, Human
cccacccccaacccccacuguccugac

SEQ ID NO: 700727 - RNA, 19 nt, Human
cccaccgccagcacccacc

SEQ ID NO: 700728 - RNA, 19 nt, Human
cccacgcgcgccacgugcc

SEQ ID NO: 700729 - RNA, 19 nt, Human
ccccaacccccacuguccu

SEQ ID NO: 700730 - RNA, 19 nt, Human
ccccaaggagguuuucucu

SEQ ID NO: 700731 - RNA, 18 nt, Human
ccccaaggcggccccagc

SEQ ID NO: 700732 - RNA, 20 nt, Human
ccccacccccaacccccacu

SEQ ID NO: 700733 - RNA, 24 nt, Human
ccccaccgccagcacccacccacc

SEQ ID NO: 700734 - RNA, 20 nt, Human
ccccaccgccucacccuccu

SEQ ID NO: 700735 - RNA, 21 nt, Human
ccccacuguccugaccaccug

SEQ ID NO: 700736 - RNA, 20 nt, Human
cccccaccgccucacccucc

SEQ ID NO: 700737 - RNA, 20 nt, Human
cccccugcaaucccccaccg

SEQ ID NO: 700738 - RNA, 22 nt, Human
ccccugcaaucccccaccgccu

SEQ ID NO: 700739 - RNA, 23 nt, Human
ccccugcaaucccccaccgccuc

SEQ ID NO: 700740 - RNA, 18 nt, Human
cccgccgcccagcgcugc

SEQ ID NO: 700741 - RNA, 18 nt, Human
cccgccgcccagcgcugc

SEQ ID NO: 700742 - RNA, 19 nt, Human
cccgcgcuacgcgcguccg

SEQ ID NO: 700743 - RNA, 27 nt, Human
cccuaccccggccccaaccucuccagc

SEQ ID NO: 700744 - RNA, 19 nt, Human
ccgcccagagccacggcag

SEQ ID NO: 700745 - RNA, 18 nt, Human
ccgccgcccagcgcugcc

SEQ ID NO: 700746 - RNA, 22 nt, Human
ccgcgccccaaggcggccccag

SEQ ID NO: 700747 - RNA, 22 nt, Human
ccgcgcuacgcgcguccgcgcc

SEQ ID NO: 700748 - RNA, 25 nt, Human
ccuccccucccacagguccacgauc

SEQ ID NO: 700749 - RNA, 19 nt, Human
ccugaccaccuggagccaa

SEQ ID NO: 700750 - RNA, 22 nt, Human
ccugcgcugccgcgccccaagg

SEQ ID NO: 700751 - RNA, 19 nt, Human
cgccccaaggcggccccag

SEQ ID NO: 700752 - RNA, 21 nt, Human
cgcccccugcaaucccccacc

SEQ ID NO: 700753 - RNA, 22 nt, Human
cgcccgccgcccagcgcugccc

SEQ ID NO: 700754 - RNA, 19 nt, Human
cgcgcccgccgcccagcgc

SEQ ID NO: 700755 - RNA, 25 nt, Human
cgcugaccgggcgaaggucggcgcc

SEQ ID NO: 700756 - RNA, 24 nt, Human
cguggagcagggcgagcaggggcg

SEQ ID NO: 700757 - RNA, 19 nt, Human
cucauuccgggguuccagc

SEQ ID NO: 700758 - RNA, 21 nt, Human
cucccaccaggcgccgcugcg

SEQ ID NO: 700759 - RNA, 19 nt, Human
cuccugccucccuaccccg

SEQ ID NO: 700760 - RNA, 20 nt, Human
cugaaguaagcgagcagcag

SEQ ID NO: 700761 - RNA, 21 nt, Human
cugaccaccuggagccaaaag

SEQ ID NO: 700762 - RNA, 24 nt, Human
cugaccaccuggagccaaaagccu

SEQ ID NO: 700763 - RNA, 22 nt, Human
cugcacagcucuaggcggcucu

SEQ ID NO: 700764 - RNA, 24 nt, Human
cuggccgcgcugggcccgggccug

SEQ ID NO: 700765 - RNA, 18 nt, Human
gagcagcagcagcgggcg

SEQ ID NO: 700766 - RNA, 21 nt, Human
gagcagcagcagcgggcgcgg

SEQ ID NO: 700767 - RNA, 26 nt, Human
gagcagcagcagcgggcgcggggcag

SEQ ID NO: 700768 - RNA, 20 nt, Human
gcagcagcagcgggcgcggg

SEQ ID NO: 700769 - RNA, 22 nt, Human
gcagcguggagcagggcgagca

SEQ ID NO: 700770 - RNA, 20 nt, Human
gccacgugccuccccuccca

SEQ ID NO: 700771 - RNA, 29 nt, Human
gccccaaccucuccagccuggacugaagg

SEQ ID NO: 700772 - RNA, 25 nt, Human
gcccccaaggagguuuucucucagc

SEQ ID NO: 700773 - RNA, 18 nt, Human
gccgcuccacagcagcag

SEQ ID NO: 700774 - RNA, 22 nt, Human
gccucccuaccccggccccaac

SEQ ID NO: 700775 - RNA, 18 nt, Human
gccugaagguggguggca

SEQ ID NO: 700776 - RNA, 19 nt, Human
gcgcggcgcgggggucggg

SEQ ID NO: 700777 - RNA, 18 nt, Human
gcgcugggcccgggccug

SEQ ID NO: 700778 - RNA, 22 nt, Human
gcgggcgcggggcagcguggag

SEQ ID NO: 700779 - RNA, 28 nt, Human
gcugggcccgggccugacugugggcggc

SEQ ID NO: 700780 - RNA, 22 nt, Human
ggaaagggaaucccuggccccc

SEQ ID NO: 700781 - RNA, 18 nt, Human
ggccgcagacacccggga

SEQ ID NO: 700782 - RNA, 22 nt, Human
ggcgcggcgcgggggucggggc

SEQ ID NO: 700783 - RNA, 20 nt, Human
ggcggcucugccugcgcugc

SEQ ID NO: 700784 - RNA, 26 nt, Human
gggcgagcaggggcgcggcgcggggg

SEQ ID NO: 700785 - RNA, 23 nt, Human
gggcgcggggcagcguggagcag

SEQ ID NO: 700786 - RNA, 21 nt, Human
gguggagcucugcucaaccua

SEQ ID NO: 700787 - RNA, 22 nt, Human
guccagaguccucucucccucu

SEQ ID NO: 700788 - RNA, 26 nt, Human
uaccccggccccaaccucuccagccu

SEQ ID NO: 700789 - RNA, 23 nt, Human
ucagccgcccccugcaauccccc

SEQ ID NO: 700790 - RNA, 29 nt, Human
ucagucaagggaaaguaugaggaggaaga

SEQ ID NO: 700791 - RNA, 30 nt, Human
ucagucaagggaaaguaugaggaggaagag

SEQ ID NO: 700792 - RNA, 23 nt, Human
uccacgaucacgucgcgcccgcc

SEQ ID NO: 700793 - RNA, 24 nt, Human
uccacgaucacgucgcgcccgccg

SEQ ID NO: 700794 - RNA, 21 nt, Human
ucccccaccgccucacccucc

SEQ ID NO: 700795 - RNA, 25 nt, Human
ucccccaccgccucacccuccuuca

SEQ ID NO: 700796 - RNA, 20 nt, Human
ucccccaucagaacaggggu

SEQ ID NO: 700797 - RNA, 18 nt, Human
ucccucuggccagagccu

SEQ ID NO: 700798 - RNA, 19 nt, Human
uccgcgccgcccagagcca

SEQ ID NO: 700799 - RNA, 21 nt, Human
uccgcgccgcccagagccacg

SEQ ID NO: 700800 - RNA, 23 nt, Human
uccgcgccgcccagagccacggu

SEQ ID NO: 700801 - RNA, 18 nt, Human
uccguugcguugcggccg

SEQ ID NO: 700802 - RNA, 19 nt, Human
uccguugcguugcggccgc

SEQ ID NO: 700803 - RNA, 19 nt, Human
uccuagguccagaguccuc

SEQ ID NO: 700804 - RNA, 21 nt, Human
ucgcgcagcaggcgguagcgc

SEQ ID NO: 700805 - RNA, 20 nt, Human
ucucucagccgcccccugcc

SEQ ID NO: 700806 - RNA, 19 nt, Human
ugacauggcuccugccucc

SEQ ID NO: 700807 - RNA, 22 nt, Human
ugaccgggcgaaggucggcgcc

SEQ ID NO: 700808 - RNA, 21 nt, Human
ugaggcagggaaugcggcuuc

SEQ ID NO: 700809 - RNA, 21 nt, Human
ugcaauuagggcucccggaac

SEQ ID NO: 700810 - RNA, 18 nt, Human
ugcccugcucccgcgcua

SEQ ID NO: 700811 - RNA, 23 nt, Human
ugccucccuaccccggccccaac

SEQ ID NO: 700812 - RNA, 23 nt, Human
ugcgaagggccgcgcguccagcg

SEQ ID NO: 700813 - RNA, 18 nt, Human
uggcagggccuugcugug

SEQ ID NO: 700814 - RNA, 21 nt, Human
uggcuccugccucccuacccc

SEQ ID NO: 700815 - RNA, 23 nt, Human
ugguggccucugcgaagggcccc

SEQ ID NO: 700816 - RNA, 22 nt, Human
uuccuagguccagaguccucuc

SEQ ID NO: 700817 - RNA, 21 nt, Human
uuucuuaguuugucauguuug

SEQ ID NO: 700818 - RNA, 21 nt, Human
uuuuucuuaguuugucauguu

SEQ ID NO: 700819 - RNA, 25 nt, Human
aaaaagaggcagaauucaauuucua

SEQ ID NO: 700820 - RNA, 18 nt, Human
aaagugcugggauuacaa

SEQ ID NO: 700821 - RNA, 24 nt, Human
aaagugcugggauuacaagcauga

SEQ ID NO: 700822 - RNA, 18 nt, Human
aagcaccugccaccaugg

SEQ ID NO: 700823 - RNA, 22 nt, Human
aaguagcugggauuacaagcac

SEQ ID NO: 700824 - RNA, 25 nt, Human
aaguagcugggauuacaagcaccug

SEQ ID NO: 700825 - RNA, 19 nt, Human
aagugcugggauuacaagc

SEQ ID NO: 700826 - RNA, 21 nt, Human
aagugcugggauuacaagcau

SEQ ID NO: 700827 - RNA, 26 nt, Human
aagugcugggauuacaagcaugagcc

SEQ ID NO: 700828 - RNA, 22 nt, Human
aaugagggaaaauaaagaggaa

SEQ ID NO: 700829 - RNA, 24 nt, Human
acaggguuucagcauauuggccag

SEQ ID NO: 700830 - RNA, 21 nt, Human
accucagccuaccaaagugcu

SEQ ID NO: 700831 - RNA, 25 nt, Human
agcaauccccuaccuagguauuuau

SEQ ID NO: 700832 - RNA, 24 nt, Human
agcugggauuacaagcaccugcca

SEQ ID NO: 700833 - RNA, 19 nt, Human
aggagcacagaaaugucac

SEQ ID NO: 700834 - RNA, 25 nt, Human
aggcuggagugcaguggcacaaucu

SEQ ID NO: 700835 - RNA, 19 nt, Human
agugcaaccucugccuucc

SEQ ID NO: 700836 - RNA, 21 nt, Human
agugcaguggcacaaucucag

SEQ ID NO: 700837 - RNA, 24 nt, Human
agugcaguggcacaaucucagcuc

SEQ ID NO: 700838 - RNA, 24 nt, Human
agugcugggauuacaagcaugagc

SEQ ID NO: 700839 - RNA, 20 nt, Human
augagccaccacgccuggcc

SEQ ID NO: 700840 - RNA, 23 nt, Human
augaggcagaagaauggcuaaaa

SEQ ID NO: 700841 - RNA, 24 nt, Human
augaggcagaagaauggcuaaaau

SEQ ID NO: 700842 - RNA, 25 nt, Human
auggcccagcaauccccuaccuagg

SEQ ID NO: 700843 - RNA, 18 nt, Human
auggugaugguaggagca

SEQ ID NO: 700844 - RNA, 21 nt, Human
auuacaagcaugagccaccac

SEQ ID NO: 700845 - RNA, 24 nt, Human
auuuuuguaauuuuaguagagaca

SEQ ID NO: 700846 - RNA, 24 nt, Human
caaagugcugggauuacaagcaug

SEQ ID NO: 700847 - RNA, 22 nt, Human
caagugauucuccugccucagc

SEQ ID NO: 700848 - RNA, 27 nt, Human
caagugauucuccugccucagccuccc

SEQ ID NO: 700849 - RNA, 24 nt, Human
caccauggccggcuaauuuuugua

SEQ ID NO: 700850 - RNA, 23 nt, Human
cacccaccucagccuaccaaagu

SEQ ID NO: 700851 - RNA, 24 nt, Human
caccucagccuaccaaagugcugg

SEQ ID NO: 700852 - RNA, 25 nt, Human
caccuucgggaccuuaauucucuaa

SEQ ID NO: 700853 - RNA, 20 nt, Human
cacuacucuggaaacaagau

SEQ ID NO: 700854 - RNA, 24 nt, Human
cagcauauuggccaggcuggacuc

SEQ ID NO: 700855 - RNA, 24 nt, Human
caggguuucagcauauuggccagg

SEQ ID NO: 700856 - RNA, 24 nt, Human
cauauuggccaggcuggacucgaa

SEQ ID NO: 700857 - RNA, 19 nt, Human
ccaaagugcugggauuaca

SEQ ID NO: 700858 - RNA, 22 nt, Human
ccaaagugcugggauuacaagc

SEQ ID NO: 700859 - RNA, 24 nt, Human
ccaaagugcugggauuacaagcau

SEQ ID NO: 700860 - RNA, 21 nt, Human
ccaccuucgggaccuuaauuc

SEQ ID NO: 700861 - RNA, 19 nt, Human
cccaaguagcugggauuac

SEQ ID NO: 700862 - RNA, 24 nt, Human
ccugaccucaggugauccacccac

SEQ ID NO: 700863 - RNA, 23 nt, Human
ccugccucagccucccaaguagc

SEQ ID NO: 700864 - RNA, 22 nt, Human
ccugguucaagugauucuccug

SEQ ID NO: 700865 - RNA, 24 nt, Human
ccuuccugguucaagugauucucc

SEQ ID NO: 700866 - RNA, 24 nt, Human
cucagccucccaaguagcugggau

SEQ ID NO: 700867 - RNA, 25 nt, Human
cuccugccucagccucccaaguagc

SEQ ID NO: 700868 - RNA, 20 nt, Human
cucuuguugcccaggcugga

SEQ ID NO: 700869 - RNA, 23 nt, Human
cugccucagccucccaaguagcu

SEQ ID NO: 700870 - RNA, 19 nt, Human
cuuccugguucaagugauu

SEQ ID NO: 700871 - RNA, 24 nt, Human
cuuguugcccaggcuggagugcag

SEQ ID NO: 700872 - RNA, 24 nt, Human
gaaaauaaagaggaaauaguugac

SEQ ID NO: 700873 - RNA, 21 nt, Human
gaaaugucacuacucuggaaa

SEQ ID NO: 700874 - RNA, 24 nt, Human
gaccucaggugauccacccaccuc

SEQ ID NO: 700875 - RNA, 18 nt, Human
gauuacaagcaugagcca

SEQ ID NO: 700876 - RNA, 21 nt, Human
gauucuccugccucagccucc

SEQ ID NO: 700877 - RNA, 19 nt, Human
gcccaggcuggagugcagu

SEQ ID NO: 700878 - RNA, 21 nt, Human
gcucuuguugcccaggcugga

SEQ ID NO: 700879 - RNA, 24 nt, Human
gcucuuguugcccaggcuggagug

SEQ ID NO: 700880 - RNA, 23 nt, Human
gcuggacucgaacuccugaccuc

SEQ ID NO: 700881 - RNA, 19 nt, Human
gcuggagugcaguggcaca

SEQ ID NO: 700882 - RNA, 19 nt, Human
ggauuacaagcaugagcca

SEQ ID NO: 700883 - RNA, 24 nt, Human
ggcuggacucgaacuccugaccuc

SEQ ID NO: 700884 - RNA, 21 nt, Human
gguucaagugauucuccugcc

SEQ ID NO: 700885 - RNA, 18 nt, Human
guagcugggauuacaagc

SEQ ID NO: 700886 - RNA, 21 nt, Human
gugauccacccaccucagccu

SEQ ID NO: 700887 - RNA, 24 nt, Human
gugauucuccugccucagccuccc

SEQ ID NO: 700888 - RNA, 24 nt, Human
gugcaaccucugccuuccugguuc

SEQ ID NO: 700889 - RNA, 24 nt, Human
uaauuuuuguaauuuuaguagaga

SEQ ID NO: 700890 - RNA, 22 nt, Human
uacaagcaugagccaccacgcc

SEQ ID NO: 700891 - RNA, 27 nt, Human
uaccagguauuuugcauuauuuacccu

SEQ ID NO: 700892 - RNA, 18 nt, Human
uaggagcacagaaauguc

SEQ ID NO: 700893 - RNA, 19 nt, Human
uaggagcacagaaauguca

SEQ ID NO: 700894 - RNA, 20 nt, Human
uaguagagacaggguuucag

SEQ ID NO: 700895 - RNA, 24 nt, Human
uaguagagacaggguuucagcaua

SEQ ID NO: 700896 - RNA, 20 nt, Human
uauggcccagcaauccccua

SEQ ID NO: 700897 - RNA, 19 nt, Human
ucaagugauucuccugccu

SEQ ID NO: 700898 - RNA, 18 nt, Human
ucagagccaggcugccac

SEQ ID NO: 700899 - RNA, 20 nt, Human
ucagccucccaaguagcugg

SEQ ID NO: 700900 - RNA, 20 nt, Human
ucaggugauccacccaccuc

SEQ ID NO: 700901 - RNA, 19 nt, Human
ucagugcaaccucugccuu

SEQ ID NO: 700902 - RNA, 24 nt, Human
ucagugcaaccucugccuuccugg

SEQ ID NO: 700903 - RNA, 21 nt, Human
uccacccaccucagccuacca

SEQ ID NO: 700904 - RNA, 20 nt, Human
uccugguucaagugauucuc

SEQ ID NO: 700905 - RNA, 23 nt, Human
uccugguucaagugauucuccuc

SEQ ID NO: 700906 - RNA, 23 nt, Human
uccugguucaagugauucuccug

SEQ ID NO: 700907 - RNA, 22 nt, Human
ucuuguugcccaggcuggagug

SEQ ID NO: 700908 - RNA, 19 nt, Human
ugaagauuuguaugugaau

SEQ ID NO: 700909 - RNA, 21 nt, Human
ugaccucaggugauccaccca

SEQ ID NO: 700910 - RNA, 24 nt, Human
ugaccucaggugauccacccaccu

SEQ ID NO: 700911 - RNA, 22 nt, Human
ugagggaaaauaaagaggaaau

SEQ ID NO: 700912 - RNA, 20 nt, Human
ugauucuccugccucagccu

SEQ ID NO: 700913 - RNA, 23 nt, Human
ugcaaccucugccuuccugguuc

SEQ ID NO: 700914 - RNA, 18 nt, Human
ugcccaggcuggagugca

SEQ ID NO: 700915 - RNA, 21 nt, Human
ugcccaggcuggagugcagug

SEQ ID NO: 700916 - RNA, 22 nt, Human
ugcccaggcuggagugcagugg

SEQ ID NO: 700917 - RNA, 24 nt, Human
ugcccaggcuggagugcaguggca

SEQ ID NO: 700918 - RNA, 24 nt, Human
ugccucagccucccaaguagcugg

SEQ ID NO: 700919 - RNA, 22 nt, Human
ugccuuccugguucaagugauu

SEQ ID NO: 700920 - RNA, 24 nt, Human
ugcucuuguugcccaggcuggagu

SEQ ID NO: 700921 - RNA, 25 nt, Human
ugcugggauuacaagcaugagccac

SEQ ID NO: 700922 - RNA, 18 nt, Human
uggagugcaguggcacaa

SEQ ID NO: 700923 - RNA, 23 nt, Human
uggagugcaguggcacaaucuca

SEQ ID NO: 700924 - RNA, 24 nt, Human
uggagugcaguggcacaaucucag

SEQ ID NO: 700925 - RNA, 18 nt, Human
uggcacaaucucagcuca

SEQ ID NO: 700926 - RNA, 24 nt, Human
uggccaggcuggacucgaacuccu

SEQ ID NO: 700927 - RNA, 22 nt, Human
ugggauuacaagcaccugccac

SEQ ID NO: 700928 - RNA, 24 nt, Human
ugggauuacaagcaccugccacca

SEQ ID NO: 700929 - RNA, 25 nt, Human
ugggauuacaagcaccugccaccau

SEQ ID NO: 700930 - RNA, 22 nt, Human
ugggauuacaagcaugagccac

SEQ ID NO: 700931 - RNA, 23 nt, Human
ugggauuacaagcaugagccacc

SEQ ID NO: 700932 - RNA, 24 nt, Human
ugggauuacaagcaugagccacca

SEQ ID NO: 700933 - RNA, 24 nt, Human
ugggauuacaagcaugagccacca

SEQ ID NO: 700934 - RNA, 20 nt, Human
uguuuugcaucuuucaauga

SEQ ID NO: 700935 - RNA, 24 nt, Human
uuaguagagacaggguuucagcau

SEQ ID NO: 700936 - RNA, 21 nt, Human
uucaagugauucuccugccuc

SEQ ID NO: 700937 - RNA, 23 nt, Human
uucaagugauucuccugccucag

SEQ ID NO: 700938 - RNA, 24 nt, Human
uucaagugauucuccugccucagc

SEQ ID NO: 700939 - RNA, 24 nt, Human
uugcccaggcuggagugcaguggc

SEQ ID NO: 700940 - RNA, 23 nt, Human
uugcucuuguugcccaggcugga

SEQ ID NO: 700941 - RNA, 22 nt, Human
uuuaagaaaugaggcagaagaa

SEQ ID NO: 700942 - RNA, 22 nt, Human
uuugcauuauuuacccuuucug

SEQ ID NO: 700943 - RNA, 24 nt, Human
uuugcucuuguugcccaggcugga

SEQ ID NO: 700944 - RNA, 24 nt, Human
uuuugcucuuguugcccaggcugg

SEQ ID NO: 700945 - RNA, 20 nt, Human
uuuuuguaauuuuaguagag

SEQ ID NO: 700946 - RNA, 19 nt, Human
aaccuccuccuccuccucc

SEQ ID NO: 700947 - RNA, 18 nt, Human
aaggcugaaaauuacacu

SEQ ID NO: 700948 - RNA, 24 nt, Human
aaggugcugguauuacaggcguga

SEQ ID NO: 700949 - RNA, 19 nt, Human
aaguccaggucuggaguuc

SEQ ID NO: 700950 - RNA, 24 nt, Human
accauauuggccaggcuggucuug

SEQ ID NO: 700951 - RNA, 19 nt, Human
acccaggcuggagugcagu

SEQ ID NO: 700952 - RNA, 19 nt, Human
accuccuccuccuccuccc

SEQ ID NO: 700953 - RNA, 20 nt, Human
accuccuccuccuccucccg

SEQ ID NO: 700954 - RNA, 24 nt, Human
acucgaguagcugggauuauaggc

SEQ ID NO: 700955 - RNA, 20 nt, Human
acuggguuucaccauauugg

SEQ ID NO: 700956 - RNA, 24 nt, Human
acuggguuucaccauauuggccag

SEQ ID NO: 700957 - RNA, 18 nt, Human
acuucugaaaacaucaug

SEQ ID NO: 700958 - RNA, 18 nt, Human
acuuugucacccaggcug

SEQ ID NO: 700959 - RNA, 25 nt, Human
acuuugucacccaggcuggagugca

SEQ ID NO: 700960 - RNA, 23 nt, Human
agccgaguguguuuccuucucag

SEQ ID NO: 700961 - RNA, 23 nt, Human
aggcagugaguucccaaauggag

SEQ ID NO: 700962 - RNA, 23 nt, Human
aggcgugagccacugugcucggc

SEQ ID NO: 700963 - RNA, 25 nt, Human
aggcuggagugcagugccgcuaucu

SEQ ID NO: 700964 - RNA, 19 nt, Human
aguagcugggauuauaggc

SEQ ID NO: 700965 - RNA, 21 nt, Human
aguagcugggauuauaggcau

SEQ ID NO: 700966 - RNA, 23 nt, Human
aguauuuuugccaagacagccuu

SEQ ID NO: 700967 - RNA, 20 nt, Human
agugaguucccaaauggagu

SEQ ID NO: 700968 - RNA, 24 nt, Human
agugcagugccgcuaucucggcuc

SEQ ID NO: 700969 - RNA, 23 nt, Human
auauuggccaggcuggucuugaa

SEQ ID NO: 700970 - RNA, 21 nt, Human
auggaguacgucacugugccc

SEQ ID NO: 700971 - RNA, 18 nt, Human
auuacaggcgugagccac

SEQ ID NO: 700972 - RNA, 20 nt, Human
auuacaggcgugagccacug

SEQ ID NO: 700973 - RNA, 21 nt, Human
auucuuauuccucauuuuaag

SEQ ID NO: 700974 - RNA, 21 nt, Human
caccauauuggccaggcuggu

SEQ ID NO: 700975 - RNA, 24 nt, Human
caccauauuggccaggcuggucuu

SEQ ID NO: 700976 - RNA, 27 nt, Human
caccauauuggccaggcuggucuugaa

SEQ ID NO: 700977 - RNA, 21 nt, Human
cacugugcucggcccuguuuc

SEQ ID NO: 700978 - RNA, 24 nt, Human
cacuuugucacccaggcuggagug

SEQ ID NO: 700979 - RNA, 24 nt, Human
cauauuggccaggcuggucuugaa

SEQ ID NO: 700980 - RNA, 21 nt, Human
caugccuagcuaauuuuugua

SEQ ID NO: 700981 - RNA, 23 nt, Human
cccggguucaugcaauucuccug

SEQ ID NO: 700982 - RNA, 24 nt, Human
ccucccggguucaugcaauucucc

SEQ ID NO: 700983 - RNA, 18 nt, Human
ccugaccucaagugaucc

SEQ ID NO: 700984 - RNA, 21 nt, Human
ccugaccucaagugauccgcc

SEQ ID NO: 700985 - RNA, 23 nt, Human
ccugaccucaagugauccgccug

SEQ ID NO: 700986 - RNA, 24 nt, Human
ccugccucaggcacucgaguagcu

SEQ ID NO: 700987 - RNA, 24 nt, Human
cuaaggugcugguauuacaggcgu

SEQ ID NO: 700988 - RNA, 19 nt, Human
cucacugcaaccuccuccu

SEQ ID NO: 700989 - RNA, 24 nt, Human
cucacuuugucacccaggcuggag

SEQ ID NO: 700990 - RNA, 22 nt, Human
cucauuuuaaguauuucuguuu

SEQ ID NO: 700991 - RNA, 21 nt, Human
cucccggguucaugcaauucu

SEQ ID NO: 700992 - RNA, 26 nt, Human
cuccugaccucaagugauccgccugc

SEQ ID NO: 700993 - RNA, 23 nt, Human
cucgaguagcugggauuauaggc

SEQ ID NO: 700994 - RNA, 24 nt, Human
cucgaguagcugggauuauaggca

SEQ ID NO: 700995 - RNA, 23 nt, Human
cuggcucagauggucuuggcccu

SEQ ID NO: 700996 - RNA, 23 nt, Human
cuggggguuccgcggcuuccucc

SEQ ID NO: 700997 - RNA, 24 nt, Human
cuggguuucaccauauuggccagg

SEQ ID NO: 700998 - RNA, 24 nt, Human
cugugcccagccgaguguguuucc

SEQ ID NO: 700999 - RNA, 24 nt, Human
gaccucaagugauccgccugccuc

SEQ ID NO: 701000 - RNA, 22 nt, Human
gaguagcugggauuauaggcau

SEQ ID NO: 701001 - RNA, 24 nt, Human
gaguagcugggauuauaggcaugc

SEQ ID NO: 701002 - RNA, 18 nt, Human
gauuauaggcaugcgcca

SEQ ID NO: 701003 - RNA, 29 nt, Human
gcaaccuccuccuccuccucccggguucc

SEQ ID NO: 701004 - RNA, 19 nt, Human
gccacugugcucggcccug

SEQ ID NO: 701005 - RNA, 22 nt, Human
gccuagcuaauuuuuguauuuu

SEQ ID NO: 701006 - RNA, 20 nt, Human
gcucacugcaaccuccuccu

SEQ ID NO: 701007 - RNA, 22 nt, Human
gcucacugcaaccuccuccucc

SEQ ID NO: 701008 - RNA, 23 nt, Human
gcuggucuugaacuccugaccuc

SEQ ID NO: 701009 - RNA, 24 nt, Human
ggauuauaggcaugcgccaucaug

SEQ ID NO: 701010 - RNA, 24 nt, Human
ggcuggucuugaacuccugaccuc

SEQ ID NO: 701011 - RNA, 21 nt, Human
ggguuucaccauauuggccag

SEQ ID NO: 701012 - RNA, 19 nt, Human
ggucuugaacuccugaccu

SEQ ID NO: 701013 - RNA, 18 nt, Human
guagcugggauuauaggc

SEQ ID NO: 701014 - RNA, 20 nt, Human
guagcugggauuauaggcau

SEQ ID NO: 701015 - RNA, 21 nt, Human
gugcugguauuacaggcguga

SEQ ID NO: 701016 - RNA, 21 nt, Human
uaaggugcugguauuacaggc

SEQ ID NO: 701017 - RNA, 24 nt, Human
uaauuuuuguauuuuuaguagaga

SEQ ID NO: 701018 - RNA, 22 nt, Human
uacaggcgugagccacugugcu

SEQ ID NO: 701019 - RNA, 19 nt, Human
uaguagagacuggguuuca

SEQ ID NO: 701020 - RNA, 24 nt, Human
uaguagagacuggguuucaccaua

SEQ ID NO: 701021 - RNA, 24 nt, Human
ucacaauuuuuuuuuuuuuuuuuu

SEQ ID NO: 701022 - RNA, 23 nt, Human
ucacccaggcuggagugcagugc

SEQ ID NO: 701023 - RNA, 18 nt, Human
ucacugcaaccuccuccc

SEQ ID NO: 701024 - RNA, 19 nt, Human
ucacugcaaccuccuccuc

SEQ ID NO: 701025 - RNA, 21 nt, Human
ucacugcaaccuccuccuccu

SEQ ID NO: 701026 - RNA, 21 nt, Human
ucacugcaaccuccuccuccu

SEQ ID NO: 701027 - RNA, 31 nt, Human
ucacugcaaccuccuccuccuccucccgggg

SEQ ID NO: 701028 - RNA, 24 nt, Human
ucacuuugucacccaggcuggagu

SEQ ID NO: 701029 - RNA, 21 nt, Human
ucccggguucaugcaauucuc

SEQ ID NO: 701030 - RNA, 24 nt, Human
ucccggguucaugcaauucuccug

SEQ ID NO: 701031 - RNA, 24 nt, Human
ucgaguagcugggauuauaggcau

SEQ ID NO: 701032 - RNA, 23 nt, Human
ucucacuuugucacccaggcugg

SEQ ID NO: 701033 - RNA, 24 nt, Human
ucucacuuugucacccaggcugga

SEQ ID NO: 701034 - RNA, 21 nt, Human
ucuugaacuccugaccucaag

SEQ ID NO: 701035 - RNA, 18 nt, Human
ugaccucaagugauccgc

SEQ ID NO: 701036 - RNA, 24 nt, Human
ugaccucaagugauccgccugccu

SEQ ID NO: 701037 - RNA, 23 nt, Human
ugagauggaguacgucacugugc

SEQ ID NO: 701038 - RNA, 21 nt, Human
ugccucaggcacucgaguagc

SEQ ID NO: 701039 - RNA, 23 nt, Human
uggagugcagugccgcuaucucg

SEQ ID NO: 701040 - RNA, 24 nt, Human
uggagugcagugccgcuaucucgg

SEQ ID NO: 701041 - RNA, 24 nt, Human
uggccaggcuggucuugaacuccu

SEQ ID NO: 701042 - RNA, 18 nt, Human
ugggauuauaggcaugcg

SEQ ID NO: 701043 - RNA, 19 nt, Human
ugggauuauaggcaugcgc

SEQ ID NO: 701044 - RNA, 21 nt, Human
ugggauuauaggcaugcgcca

SEQ ID NO: 701045 - RNA, 21 nt, Human
ugggauuauaggcaugcgcca

SEQ ID NO: 701046 - RNA, 22 nt, Human
ugggauuauaggcaugcgccau

SEQ ID NO: 701047 - RNA, 24 nt, Human
ugggauuauaggcaugcgccauca

SEQ ID NO: 701048 - RNA, 23 nt, Human
uggguuucaccauauuggccagg

SEQ ID NO: 701049 - RNA, 21 nt, Human
ugguauuacaggcgugagcca

SEQ ID NO: 701050 - RNA, 22 nt, Human
ugguauuacaggcgugagccac

SEQ ID NO: 701051 - RNA, 24 nt, Human
ugguauuacaggcgugagccacug

SEQ ID NO: 701052 - RNA, 25 nt, Human
ugguauuacaggcgugagccacugu

SEQ ID NO: 701053 - RNA, 24 nt, Human
uuaguagagacuggguuucaccau

SEQ ID NO: 701054 - RNA, 21 nt, Human
uucaaaguacugcaaagaauc

SEQ ID NO: 701055 - RNA, 24 nt, Human
uuucaccauauuggccaggcuggu

SEQ ID NO: 701056 - RNA, 24 nt, Human
uuugucacccaggcuggagugcag

SEQ ID NO: 701057 - RNA, 24 nt, Human
uuuuuaguagagacuggguuucac

SEQ ID NO: 701058 - RNA, 20 nt, Human
uuuuuguauuuuuaguagag

SEQ ID NO: 701059 - RNA, 26 nt, Human
uuuuuuuuuuuugagauggagucuca

SEQ ID NO: 701060 - RNA, 22 nt, Human
uuuuuuuuuuuuuugagaugga

SEQ ID NO: 701061 - RNA, 18 nt, Human
uuuuuuuuuuuuuuuuug

SEQ ID NO: 701062 - RNA, 25 nt, Human
aaaaggcucccaugcugagcagccc

SEQ ID NO: 701063 - RNA, 26 nt, Human
aaagcagagccagcuggugcaagaga

SEQ ID NO: 701064 - RNA, 19 nt, Human
aaaugauugacaagagauc

SEQ ID NO: 701065 - RNA, 19 nt, Human
aagcagagccagcuggugc

SEQ ID NO: 701066 - RNA, 19 nt, Human
aaggaagaaggugugcagc

SEQ ID NO: 701067 - RNA, 20 nt, Human
aaggaagaaggugugcagcg

SEQ ID NO: 701068 - RNA, 23 nt, Human
acagagcgcaaugaccugaacaa

SEQ ID NO: 701069 - RNA, 21 nt, Human
accgagcacagaagcaucagg

SEQ ID NO: 701070 - RNA, 24 nt, Human
accgagcacagaagcaucaggcca

SEQ ID NO: 701071 - RNA, 24 nt, Human
accgcucccucaaggaagaaggug

SEQ ID NO: 701072 - RNA, 23 nt, Human
agaaaaagcagagccagcuggug

SEQ ID NO: 701073 - RNA, 24 nt, Human
agacagagcgcaaugaccugaaca

SEQ ID NO: 701074 - RNA, 18 nt, Human
agaccccucccugcccuu

SEQ ID NO: 701075 - RNA, 23 nt, Human
agagaaggaccaccugcgcggug

SEQ ID NO: 701076 - RNA, 20 nt, Human
agaggggccuggggcucaag

SEQ ID NO: 701077 - RNA, 18 nt, Human
agccaggccuggcccaua

SEQ ID NO: 701078 - RNA, 19 nt, Human
aggagaaaacaguccggga

SEQ ID NO: 701079 - RNA, 24 nt, Human
aggagaaaacaguccgggauaaag

SEQ ID NO: 701080 - RNA, 23 nt, Human
aggagaagcgcaaggaggugacc

SEQ ID NO: 701081 - RNA, 22 nt, Human
aggcucccaugcugagcagccc

SEQ ID NO: 701082 - RNA, 18 nt, Human
agggcgcucagagcuggg

SEQ ID NO: 701083 - RNA, 18 nt, Human
agguaaaaauccaacggc

SEQ ID NO: 701084 - RNA, 23 nt, Human
caagacaaguaauacacccaggu

SEQ ID NO: 701085 - RNA, 24 nt, Human
caaguaauacacccaggucuugac

SEQ ID NO: 701086 - RNA, 25 nt, Human
cagaaaaagcagagccagcuggugc

SEQ ID NO: 701087 - RNA, 20 nt, Human
cagaccccucccugcccuuc

SEQ ID NO: 701088 - RNA, 20 nt, Human
cagagcccuggcagggcgcu

SEQ ID NO: 701089 - RNA, 20 nt, Human
caggaccaggccaaugaugc

SEQ ID NO: 701090 - RNA, 22 nt, Human
caggagcaccgagcacagaagc

SEQ ID NO: 701091 - RNA, 18 nt, Human
caggugccucucuagccu

SEQ ID NO: 701092 - RNA, 19 nt, Human
caggugccucucuagccug

SEQ ID NO: 701093 - RNA, 21 nt, Human
caucaggccagacugggccuc

SEQ ID NO: 701094 - RNA, 18 nt, Human
cccagggucacagaagcg

SEQ ID NO: 701095 - RNA, 24 nt, Human
cccgcagcaagcuugagagccuau

SEQ ID NO: 701096 - RNA, 22 nt, Human
cccugagaggaggccagagggg

SEQ ID NO: 701097 - RNA, 23 nt, Human
ccgcagcaagcuugagagccuau

SEQ ID NO: 701098 - RNA, 21 nt, Human
ccugaacaagaggguacagga

SEQ ID NO: 701099 - RNA, 22 nt, Human
ccugcagguaaaaauccaacgg

SEQ ID NO: 701100 - RNA, 24 nt, Human
ccugcgcggugagcacagcaaggc

SEQ ID NO: 701101 - RNA, 21 nt, Human
ccuguaaguguacagugggcu

SEQ ID NO: 701102 - RNA, 22 nt, Human
cgccuugcuacccaggagcacc

SEQ ID NO: 701103 - RNA, 18 nt, Human
cucaagagcccaccuccg

SEQ ID NO: 701104 - RNA, 23 nt, Human
cugcagacagagcgcaaugaccu

SEQ ID NO: 701105 - RNA, 24 nt, Human
cugcagcggcacaaccgcucccuc

SEQ ID NO: 701106 - RNA, 19 nt, Human
gacaagagaucacccaaag

SEQ ID NO: 701107 - RNA, 18 nt, Human
gacagagcgcaaugaccu

SEQ ID NO: 701108 - RNA, 18 nt, Human
gaccaggccaaugaugcu

SEQ ID NO: 701109 - RNA, 18 nt, Human
gagaagcgcaaggaggug

SEQ ID NO: 701110 - RNA, 22 nt, Human
gagaggggcugucaucuguagc

SEQ ID NO: 701111 - RNA, 23 nt, Human
gagcagcccauugcugaagccag

SEQ ID NO: 701112 - RNA, 23 nt, Human
gagcgcaaugaccugaacaagag

SEQ ID NO: 701113 - RNA, 18 nt, Human
gaggaggagaagcgcaag

SEQ ID NO: 701114 - RNA, 21 nt, Human
gaggaggccagaggggccugg

SEQ ID NO: 701115 - RNA, 21 nt, Human
gcagcaagcuugagagccuau

SEQ ID NO: 701116 - RNA, 24 nt, Human
gccagacugggccucaagagccca

SEQ ID NO: 701117 - RNA, 21 nt, Human
gcccugagaggaggccagagg

SEQ ID NO: 701118 - RNA, 18 nt, Human
gccuugcuacccaggagc

SEQ ID NO: 701119 - RNA, 19 nt, Human
gcugaagccaggauguucu

SEQ ID NO: 701120 - RNA, 18 nt, Human
ggagaaaacaguccggga

SEQ ID NO: 701121 - RNA, 19 nt, Human
ggagaagcugugccgggca

SEQ ID NO: 701122 - RNA, 26 nt, Human
ggauaaagaacuggagggccugcagg

SEQ ID NO: 701123 - RNA, 22 nt, Human
ggcccugcuugagauggcugag

SEQ ID NO: 701124 - RNA, 19 nt, Human
ggccuggggcucaagcacc

SEQ ID NO: 701125 - RNA, 22 nt, Human
ggcuggagaagcugugccgggc

SEQ ID NO: 701126 - RNA, 24 nt, Human
gggcccgggaggaggaggagaagc

SEQ ID NO: 701127 - RNA, 19 nt, Human
uaaaaggcucccaugcuga

SEQ ID NO: 701128 - RNA, 21 nt, Human
uaaaaggcucccaugcugagc

SEQ ID NO: 701129 - RNA, 27 nt, Human
uaaaaggcucccaugcugagcagccca

SEQ ID NO: 701130 - RNA, 19 nt, Human
uacagugggcuugcauugg

SEQ ID NO: 701131 - RNA, 27 nt, Human
ucaggagccccuugggcaucgcuuccc

SEQ ID NO: 701132 - RNA, 20 nt, Human
ucccaugcugagcagcccau

SEQ ID NO: 701133 - RNA, 21 nt, Human
ucccccagggucacagaagcu

SEQ ID NO: 701134 - RNA, 24 nt, Human
ucccuaggcagagcccuggcaggg

SEQ ID NO: 701135 - RNA, 19 nt, Human
ucccugcccuucagagcuc

SEQ ID NO: 701136 - RNA, 20 nt, Human
uccuacagaaaaagcagagc

SEQ ID NO: 701137 - RNA, 19 nt, Human
ucugugagcugaagagucu

SEQ ID NO: 701138 - RNA, 24 nt, Human
ugaagcuccuacagaaaaagcaga

SEQ ID NO: 701139 - RNA, 18 nt, Human
ugacaagagaucacccaa

SEQ ID NO: 701140 - RNA, 19 nt, Human
ugaccuggcuggcaucugg

SEQ ID NO: 701141 - RNA, 26 nt, Human
ugagaggaggccagaggggccugggg

SEQ ID NO: 701142 - RNA, 25 nt, Human
ugaggagaaaacaguccgggauaaa

SEQ ID NO: 701143 - RNA, 21 nt, Human
ugaugcuucucaguagccuua

SEQ ID NO: 701144 - RNA, 26 nt, Human
ugcaagagaaggaccaccugcgcggu

SEQ ID NO: 701145 - RNA, 21 nt, Human
ugcgugggaugaugugcuggu

SEQ ID NO: 701146 - RNA, 20 nt, Human
ugcugggaagggagcggcag

SEQ ID NO: 701147 - RNA, 21 nt, Human
ugcugguggccagggcucccu

SEQ ID NO: 701148 - RNA, 19 nt, Human
uguacagaugaagucagug

SEQ ID NO: 701149 - RNA, 21 nt, Human
ugucuugugagcagggcuugc

SEQ ID NO: 701150 - RNA, 24 nt, Human
ugugagcagggcuugcuuggucag

SEQ ID NO: 701151 - RNA, 20 nt, Human
uugacaagagaucacccaaa

SEQ ID NO: 701152 - RNA, 24 nt, Human
uugcauuggggaugggggugugua

SEQ ID NO: 701153 - RNA, 24 nt, Human
aaauaauuguguucagagacagac

SEQ ID NO: 701154 - RNA, 22 nt, Human
aacguggcccacuuuguccuca

SEQ ID NO: 701155 - RNA, 24 nt, Human
aaugcagaaacagaagccuccaga

SEQ ID NO: 701156 - RNA, 18 nt, Human
acgcugcuugcuuguagc

SEQ ID NO: 701157 - RNA, 20 nt, Human
agaagaaguaaaaaacgaug

SEQ ID NO: 701158 - RNA, 22 nt, Human
aggaagagugggucagaugaga

SEQ ID NO: 701159 - RNA, 19 nt, Human
aguuugagacuguuuaugu

SEQ ID NO: 701160 - RNA, 19 nt, Human
auaaaauagcucugccucu

SEQ ID NO: 701161 - RNA, 26 nt, Human
auccuaaagcccuuacaacuaagcca

SEQ ID NO: 701162 - RNA, 21 nt, Human
cagaagaaguaaaaaacgaug

SEQ ID NO: 701163 - RNA, 24 nt, Human
cagacccggggacucggaccgaga

SEQ ID NO: 701164 - RNA, 23 nt, Human
cagcaagccucuuuuaaugauuu

SEQ ID NO: 701165 - RNA, 21 nt, Human
cagcuuccagccacgcugcuu

SEQ ID NO: 701166 - RNA, 21 nt, Human
cauauucagccugauccuaaa

SEQ ID NO: 701167 - RNA, 24 nt, Human
ccaaacccuccaugcgggccgcac

SEQ ID NO: 701168 - RNA, 23 nt, Human
cccgugucagaugaagccggggc

SEQ ID NO: 701169 - RNA, 21 nt, Human
ccuccaggcggcuccagcuug

SEQ ID NO: 701170 - RNA, 20 nt, Human
ccucccggggcaggaccggc

SEQ ID NO: 701171 - RNA, 21 nt, Human
ccucccggggcaggaccggcc

SEQ ID NO: 701172 - RNA, 24 nt, Human
ccuucaguggaaggaagagugggu

SEQ ID NO: 701173 - RNA, 24 nt, Human
ccuuucgccuccaggagcugaaaa

SEQ ID NO: 701174 - RNA, 22 nt, Human
cgcccggccucacggacacaga

SEQ ID NO: 701175 - RNA, 22 nt, Human
cgccugugcaucccuuuggucc

SEQ ID NO: 701176 - RNA, 19 nt, Human
cggcuccagcuugggcgcc

SEQ ID NO: 701177 - RNA, 24 nt, Human
cucaccaccucuuaaccacaaauu

SEQ ID NO: 701178 - RNA, 30 nt, Human
cucucguggcagaaugcagaaacagaagcu

SEQ ID NO: 701179 - RNA, 19 nt, Human
cucuuuggcaagcacccag

SEQ ID NO: 701180 - RNA, 19 nt, Human
cucuuuggcaagcacccag

SEQ ID NO: 701181 - RNA, 27 nt, Human
cuucagaggucgccgaccgagcccucc

SEQ ID NO: 701182 - RNA, 21 nt, Human
gaacuuuuccaaacccuccau

SEQ ID NO: 701183 - RNA, 19 nt, Human
gagcccuccaggcggcucc

SEQ ID NO: 701184 - RNA, 19 nt, Human
gcccgugaagaccuucagu

SEQ ID NO: 701185 - RNA, 21 nt, Human
gcccuggggcaugcgagcccc

SEQ ID NO: 701186 - RNA, 21 nt, Human
gccuccgugaacuuuuccaaa

SEQ ID NO: 701187 - RNA, 18 nt, Human
gcuaacguggcccacuuu

SEQ ID NO: 701188 - RNA, 20 nt, Human
gcuacaaaauuuauccaagg

SEQ ID NO: 701189 - RNA, 22 nt, Human
uaaaaaagaacuacuaacuuuu

SEQ ID NO: 701190 - RNA, 23 nt, Human
uaccagaagaaguaaaaaacgau

SEQ ID NO: 701191 - RNA, 19 nt, Human
uauguuaagaaauguaaca

SEQ ID NO: 701192 - RNA, 24 nt, Human
ucaccaccucuuaaccacaaauug

SEQ ID NO: 701193 - RNA, 19 nt, Human
uccacuucuuaucucacca

SEQ ID NO: 701194 - RNA, 21 nt, Human
uccagcuugggcgccucggga

SEQ ID NO: 701195 - RNA, 21 nt, Human
uccagcuugggcgccucggga

SEQ ID NO: 701196 - RNA, 19 nt, Human
uccaugcgggccgcacaca

SEQ ID NO: 701197 - RNA, 18 nt, Human
ucgccgcccggccucacg

SEQ ID NO: 701198 - RNA, 21 nt, Human
ucuaaagaaaagaucaaggac

SEQ ID NO: 701199 - RNA, 22 nt, Human
ucucaccaccucuuaaccacaa

SEQ ID NO: 701200 - RNA, 21 nt, Human
ucucugcagaugcuaacgugg

SEQ ID NO: 701201 - RNA, 18 nt, Human
ucuuagcuggcccugggg

SEQ ID NO: 701202 - RNA, 18 nt, Human
ucuuaucucaccaccucu

SEQ ID NO: 701203 - RNA, 18 nt, Human
ugacaggcugaauucaga

SEQ ID NO: 701204 - RNA, 19 nt, Human
ugacuaaaaccaaaucuga

SEQ ID NO: 701205 - RNA, 19 nt, Human
ugcagaaacagaagccucc

SEQ ID NO: 701206 - RNA, 22 nt, Human
ugcagaaacagaagccuccaga

SEQ ID NO: 701207 - RNA, 19 nt, Human
ugcucggugcacucucuuc

SEQ ID NO: 701208 - RNA, 21 nt, Human
ugcucggugcacucucuucag

SEQ ID NO: 701209 - RNA, 24 nt, Human
uggccccaguggcuuucaaaaggg

SEQ ID NO: 701210 - RNA, 23 nt, Human
uuauccaaggauuccaauuaugc

SEQ ID NO: 701211 - RNA, 23 nt, Human
uucccaucagcuuccagccacgc

SEQ ID NO: 701212 - RNA, 18 nt, Human
uuuuuuuuccuucagcaa

SEQ ID NO: 701213 - RNA, 23 nt, Human
aaaaaaaacauacagcacgaaga

SEQ ID NO: 701214 - RNA, 18 nt, Human
aaagcacugccccgaccc

SEQ ID NO: 701215 - RNA, 18 nt, Human
aaagcacugccccgaccc

SEQ ID NO: 701216 - RNA, 26 nt, Human
aaagucaugugggaaaugcagguagg

SEQ ID NO: 701217 - RNA, 21 nt, Human
aaccuucagcuccugggacuc

SEQ ID NO: 701218 - RNA, 21 nt, Human
aagcacuaaagggccaguacc

SEQ ID NO: 701219 - RNA, 18 nt, Human
aagggggaaaaaaaaaaa

SEQ ID NO: 701220 - RNA, 22 nt, Human
aaugcagguagggcccuggagu

SEQ ID NO: 701221 - RNA, 21 nt, Human
acagcacgaagauaggaaguc

SEQ ID NO: 701222 - RNA, 21 nt, Human
accagauuugaggcugguuuu

SEQ ID NO: 701223 - RNA, 23 nt, Human
acccacucccccagccaccagcc

SEQ ID NO: 701224 - RNA, 24 nt, Human
acccacucccccagccaccagccc

SEQ ID NO: 701225 - RNA, 20 nt, Human
accccaaguuggaccacuuc

SEQ ID NO: 701226 - RNA, 23 nt, Human
accccagcucucaugaccacaaa

SEQ ID NO: 701227 - RNA, 20 nt, Human
acucccgcuuuuucucagua

SEQ ID NO: 701228 - RNA, 18 nt, Human
agaaacagagcugggggg

SEQ ID NO: 701229 - RNA, 23 nt, Human
agaaaccuucagcuccugggacu

SEQ ID NO: 701230 - RNA, 18 nt, Human
agagaaggagggggugug

SEQ ID NO: 701231 - RNA, 20 nt, Human
agagagaauggcaggaggag

SEQ ID NO: 701232 - RNA, 24 nt, Human
agagcacccagagcugcucaggca

SEQ ID NO: 701233 - RNA, 18 nt, Human
agagcugggggggucaag

SEQ ID NO: 701234 - RNA, 21 nt, Human
agcagcagcucacacccuacc

SEQ ID NO: 701235 - RNA, 23 nt, Human
agcagcucacacccuaccuuccc

SEQ ID NO: 701236 - RNA, 20 nt, Human
agcagcugugacaccucugc

SEQ ID NO: 701237 - RNA, 20 nt, Human
agcaggaagagaucuucccg

SEQ ID NO: 701238 - RNA, 19 nt, Human
agccaaaccccuagagaca

SEQ ID NO: 701239 - RNA, 19 nt, Human
agccagcaacugauaaccc

SEQ ID NO: 701240 - RNA, 18 nt, Human
agcuggcccagggggccu

SEQ ID NO: 701241 - RNA, 23 nt, Human
agcuggcccagggggccuggagc

SEQ ID NO: 701242 - RNA, 18 nt, Human
aggagugggguuggggga

SEQ ID NO: 701243 - RNA, 21 nt, Human
aggcaaaauugagacccaaag

SEQ ID NO: 701244 - RNA, 20 nt, Human
aggcaaaguuccugggagug

SEQ ID NO: 701245 - RNA, 24 nt, Human
agggacccaaagcagagaaggagg

SEQ ID NO: 701246 - RNA, 26 nt, Human
agggcagggcuucuuggguggggggc

SEQ ID NO: 701247 - RNA, 20 nt, Human
agguaggacccaagcucugg

SEQ ID NO: 701248 - RNA, 21 nt, Human
agguugugcugcugcuggccc

SEQ ID NO: 701249 - RNA, 21 nt, Human
agucccucucucccauacucc

SEQ ID NO: 701250 - RNA, 19 nt, Human
aguggaacugaagccuaaa

SEQ ID NO: 701251 - RNA, 19 nt, Human
aguggccagaaaccuucag

SEQ ID NO: 701252 - RNA, 20 nt, Human
auaccaguccguccacaucc

SEQ ID NO: 701253 - RNA, 20 nt, Human
auccagacaggggcguggga

SEQ ID NO: 701254 - RNA, 24 nt, Human
auccuuuaugaggacccauguggg

SEQ ID NO: 701255 - RNA, 19 nt, Human
aucucaucacuuugcccca

SEQ ID NO: 701256 - RNA, 18 nt, Human
auggaucuuuucuaaaug

SEQ ID NO: 701257 - RNA, 20 nt, Human
augggcccugugucucagga

SEQ ID NO: 701258 - RNA, 22 nt, Human
caaagagagaauauggacucac

SEQ ID NO: 701259 - RNA, 21 nt, Human
caaaguucaguggccagaaac

SEQ ID NO: 701260 - RNA, 24 nt, Human
caacaguagccaaaccccuagaga

SEQ ID NO: 701261 - RNA, 24 nt, Human
caagaauaguugggaggcuuccag

SEQ ID NO: 701262 - RNA, 18 nt, Human
caaggggacaacuuuccu

SEQ ID NO: 701263 - RNA, 22 nt, Human
cacaagggaggggauccagaca

SEQ ID NO: 701264 - RNA, 20 nt, Human
caccucugcuuuagccaaag

SEQ ID NO: 701265 - RNA, 23 nt, Human
caccucugcuuuagccaaaguuc

SEQ ID NO: 701266 - RNA, 24 nt, Human
cacucuccauuaguggccucugcu

SEQ ID NO: 701267 - RNA, 19 nt, Human
cacuggggaaccccaaguu

SEQ ID NO: 701268 - RNA, 18 nt, Human
cacuucuccaucacaacc

SEQ ID NO: 701269 - RNA, 23 nt, Human
cagacugggaucucuaaucuacc

SEQ ID NO: 701270 - RNA, 22 nt, Human
cagcacuuagaaacagagcugg

SEQ ID NO: 701271 - RNA, 22 nt, Human
cagccuucagcagcagcucaca

SEQ ID NO: 701272 - RNA, 23 nt, Human
cagcucacacccuaccuucccca

SEQ ID NO: 701273 - RNA, 21 nt, Human
cagcuucuguguggcaguccc

SEQ ID NO: 701274 - RNA, 19 nt, Human
caggacugggucugaccug

SEQ ID NO: 701275 - RNA, 20 nt, Human
caggcacagccagcaacuga

SEQ ID NO: 701276 - RNA, 19 nt, Human
caggcucuucccacucucc

SEQ ID NO: 701277 - RNA, 22 nt, Human
cagguguugucuucagcuucug

SEQ ID NO: 701278 - RNA, 20 nt, Human
caguagcuggcuucuccucc

SEQ ID NO: 701279 - RNA, 18 nt, Human
caucacaaccagauuuga

SEQ ID NO: 701280 - RNA, 25 nt, Human
caugaugcaugcgucaggagcuggu

SEQ ID NO: 701281 - RNA, 23 nt, Human
ccaaagagagaauauggacucac

SEQ ID NO: 701282 - RNA, 24 nt, Human
ccacauccuggccuuucccaggcu

SEQ ID NO: 701283 - RNA, 21 nt, Human
ccacaucuuuccaggcucuuc

SEQ ID NO: 701284 - RNA, 21 nt, Human
ccagaaaccuucagcuccugg

SEQ ID NO: 701285 - RNA, 23 nt, Human
ccagcacccaccaucacacccuc

SEQ ID NO: 701286 - RNA, 20 nt, Human
cccaaagagagaauauggac

SEQ ID NO: 701287 - RNA, 21 nt, Human
cccaccaucacacccucuguc

SEQ ID NO: 701288 - RNA, 26 nt, Human
cccacucccccagccaccagccccaa

SEQ ID NO: 701289 - RNA, 21 nt, Human
cccagcacccaccaucacacc

SEQ ID NO: 701290 - RNA, 23 nt, Human
cccagcacccaccaucacacccu

SEQ ID NO: 701291 - RNA, 22 nt, Human
cccagccaccagccccaagguc

SEQ ID NO: 701292 - RNA, 25 nt, Human
cccagccaccagccccaaggucggc

SEQ ID NO: 701293 - RNA, 18 nt, Human
ccccagggucaccuaggg

SEQ ID NO: 701294 - RNA, 20 nt, Human
cccguagcauagccuggagc

SEQ ID NO: 701295 - RNA, 22 nt, Human
cccugcugcuguggacugcugu

SEQ ID NO: 701296 - RNA, 21 nt, Human
cccugugcugagucuuaaccc

SEQ ID NO: 701297 - RNA, 21 nt, Human
ccgaagcagcugcugccccca

SEQ ID NO: 701298 - RNA, 19 nt, Human
ccuaaaugaacagauguca

SEQ ID NO: 701299 - RNA, 21 nt, Human
ccuagggaagugaaggcagac

SEQ ID NO: 701300 - RNA, 18 nt, Human
ccuccccucuucacagcc

SEQ ID NO: 701301 - RNA, 19 nt, Human
ccuccccucuucacagcca

SEQ ID NO: 701302 - RNA, 20 nt, Human
ccugcugagucuuccauacc

SEQ ID NO: 701303 - RNA, 21 nt, Human
ccugcugagucuuccauacca

SEQ ID NO: 701304 - RNA, 24 nt, Human
ccuguguuccccugaagcaggugu

SEQ ID NO: 701305 - RNA, 19 nt, Human
ccuuuuugucuggcugacc

SEQ ID NO: 701306 - RNA, 19 nt, Human
cgccuccccucuucacagc

SEQ ID NO: 701307 - RNA, 23 nt, Human
cuaaaugaacagaugucaggaug

SEQ ID NO: 701308 - RNA, 18 nt, Human
cuacccacucccccagcu

SEQ ID NO: 701309 - RNA, 19 nt, Human
cuacccccaugccaccccc

SEQ ID NO: 701310 - RNA, 25 nt, Human
cuacccccaugccacccccaggguc

SEQ ID NO: 701311 - RNA, 19 nt, Human
cucaaugccauaccagucc

SEQ ID NO: 701312 - RNA, 20 nt, Human
cucccagcacccaccaucac

SEQ ID NO: 701313 - RNA, 23 nt, Human
cucccagcacccaccaucacacc

SEQ ID NO: 701314 - RNA, 24 nt, Human
cucccagcacccaccaucacaccc

SEQ ID NO: 701315 - RNA, 19 nt, Human
cucccccagccaccagccc

SEQ ID NO: 701316 - RNA, 20 nt, Human
cucccccagccaccagcccc

SEQ ID NO: 701317 - RNA, 22 nt, Human
cucccccagccaccagccccaa

SEQ ID NO: 701318 - RNA, 21 nt, Human
cuccgccuacugucccucuca

SEQ ID NO: 701319 - RNA, 21 nt, Human
cuccugggacuccuacucucc

SEQ ID NO: 701320 - RNA, 22 nt, Human
cucucaugaccacaaaugguug

SEQ ID NO: 701321 - RNA, 20 nt, Human
cucucccuaccuugccuccu

SEQ ID NO: 701322 - RNA, 24 nt, Human
cugccagaggaugcucuuucccag

SEQ ID NO: 701323 - RNA, 21 nt, Human
cugcucaggcacagccagcaa

SEQ ID NO: 701324 - RNA, 23 nt, Human
cuggcgccuucucggagcuggcc

SEQ ID NO: 701325 - RNA, 18 nt, Human
cuggggaaccccaaguug

SEQ ID NO: 701326 - RNA, 20 nt, Human
cuggggcggugaggaagacg

SEQ ID NO: 701327 - RNA, 22 nt, Human
cuggggcggugaggaagacggg

SEQ ID NO: 701328 - RNA, 20 nt, Human
cuguggcuggagggcagggc

SEQ ID NO: 701329 - RNA, 23 nt, Human
cuucuccucccguagcauagccu

SEQ ID NO: 701330 - RNA, 22 nt, Human
cuuuuucaagcgccuguguucc

SEQ ID NO: 701331 - RNA, 26 nt, Human
gaaaaaaaaaacauacagcacgaaga

SEQ ID NO: 701332 - RNA, 19 nt, Human
gaacagaugucaggaugcc

SEQ ID NO: 701333 - RNA, 21 nt, Human
gaacagaugucaggaugccuc

SEQ ID NO: 701334 - RNA, 24 nt, Human
gaacagaugucaggaugccuccau

SEQ ID NO: 701335 - RNA, 20 nt, Human
gacccaaagcagagaaggag

SEQ ID NO: 701336 - RNA, 24 nt, Human
gacuaaaugagcagagacauggga

SEQ ID NO: 701337 - RNA, 19 nt, Human
gagaauggcaggaggagga

SEQ ID NO: 701338 - RNA, 22 nt, Human
gagagcacccagagcugcucag

SEQ ID NO: 701339 - RNA, 26 nt, Human
gagagcacccagagcugcucaggcac

SEQ ID NO: 701340 - RNA, 23 nt, Human
gagugggguugggggacagccuu

SEQ ID NO: 701341 - RNA, 27 nt, Human
gauuugaggcugguuuugaccuugugg

SEQ ID NO: 701342 - RNA, 25 nt, Human
gcaaagcacuaaagggccaguacca

SEQ ID NO: 701343 - RNA, 19 nt, Human
gcacuggggugggauuugg

SEQ ID NO: 701344 - RNA, 18 nt, Human
gcagcagcucacacccua

SEQ ID NO: 701345 - RNA, 20 nt, Human
gcagugcucucuucagcacc

SEQ ID NO: 701346 - RNA, 22 nt, Human
gcagugcucucuucagcaccag

SEQ ID NO: 701347 - RNA, 21 nt, Human
gcccagcaggggcccucacuc

SEQ ID NO: 701348 - RNA, 21 nt, Human
gcucacacccuaccuucccca

SEQ ID NO: 701349 - RNA, 22 nt, Human
ggaaagcacugccccgacccuc

SEQ ID NO: 701350 - RNA, 20 nt, Human
ggaaaggagggacaucucau

SEQ ID NO: 701351 - RNA, 18 nt, Human
ggagugaugggaagguuu

SEQ ID NO: 701352 - RNA, 18 nt, Human
ggccuggagcauggacag

SEQ ID NO: 701353 - RNA, 18 nt, Human
ggcuacaccuccucugcc

SEQ ID NO: 701354 - RNA, 18 nt, Human
ggcuggagggcagggcuu

SEQ ID NO: 701355 - RNA, 22 nt, Human
gggcagggcuucuugggugggg

SEQ ID NO: 701356 - RNA, 19 nt, Human
gggccggggauggaucuuu

SEQ ID NO: 701357 - RNA, 19 nt, Human
gggcggugaggaagacggg

SEQ ID NO: 701358 - RNA, 19 nt, Human
gggcucacaagggagggga

SEQ ID NO: 701359 - RNA, 20 nt, Human
gggcuguucucucuuuucuu

SEQ ID NO: 701360 - RNA, 20 nt, Human
ggucaagguugugcugcugc

SEQ ID NO: 701361 - RNA, 18 nt, Human
ggugugggaaaaagagga

SEQ ID NO: 701362 - RNA, 20 nt, Human
gucaagugacaauccuuccc

SEQ ID NO: 701363 - RNA, 22 nt, Human
guccacauccuggccuuuccca

SEQ ID NO: 701364 - RNA, 23 nt, Human
guccuugggccuggccagucuuc

SEQ ID NO: 701365 - RNA, 20 nt, Human
gugaagggggaaaaaaaaaa

SEQ ID NO: 701366 - RNA, 23 nt, Human
uaaagcaaagucacuucuccauc

SEQ ID NO: 701367 - RNA, 18 nt, Human
uaaagggccaguaccagu

SEQ ID NO: 701368 - RNA, 19 nt, Human
uaaaugaacagaugucagg

SEQ ID NO: 701369 - RNA, 20 nt, Human
uaaaugagcagagacauggg

SEQ ID NO: 701370 - RNA, 18 nt, Human
uacaccuccucugcccaa

SEQ ID NO: 701371 - RNA, 21 nt, Human
uacaucucccagcacccacca

SEQ ID NO: 701372 - RNA, 27 nt, Human
uacccacucccccagccaccagcccca

SEQ ID NO: 701373 - RNA, 21 nt, Human
uaccuuccccagacuugcacu

SEQ ID NO: 701374 - RNA, 20 nt, Human
uagccaaaguucaguggcca

SEQ ID NO: 701375 - RNA, 18 nt, Human
uagcuggcuucuccuccc

SEQ ID NO: 701376 - RNA, 21 nt, Human
uaugaacaggcaucugcuucc

SEQ ID NO: 701377 - RNA, 19 nt, Human
ucaagcgccuguguucccc

SEQ ID NO: 701378 - RNA, 18 nt, Human
ucacacccuaccuucccc

SEQ ID NO: 701379 - RNA, 22 nt, Human
ucacagaucaauucugucccgc

SEQ ID NO: 701380 - RNA, 24 nt, Human
ucacuuucacuuuuuaaccaggga

SEQ ID NO: 701381 - RNA, 20 nt, Human
ucagcacuuagaaacagagc

SEQ ID NO: 701382 - RNA, 19 nt, Human
ucaggccaaggaaaggagg

SEQ ID NO: 701383 - RNA, 24 nt, Human
ucaggcucaaugccauaccagucc

SEQ ID NO: 701384 - RNA, 23 nt, Human
ucaguagcuggcuucuccucccg

SEQ ID NO: 701385 - RNA, 22 nt, Human
ucaguagcuggcuuuuccucag

SEQ ID NO: 701386 - RNA, 22 nt, Human
ucagugccuucucucagcuccc

SEQ ID NO: 701387 - RNA, 19 nt, Human
uccaaggagagaagacaga

SEQ ID NO: 701388 - RNA, 19 nt, Human
ucccaggacggaugggccc

SEQ ID NO: 701389 - RNA, 26 nt, Human
ucccaggccaacaguagccaaacccc

SEQ ID NO: 701390 - RNA, 20 nt, Human
ucccaggcuacccacucccc

SEQ ID NO: 701391 - RNA, 18 nt, Human
ucccccagccaccagccc

SEQ ID NO: 701392 - RNA, 24 nt, Human
uccccugcuggggcggugaggaag

SEQ ID NO: 701393 - RNA, 24 nt, Human
ucccggggagcauuaugggcuguu

SEQ ID NO: 701394 - RNA, 21 nt, Human
uccuaggcacuggggaacccc

SEQ ID NO: 701395 - RNA, 20 nt, Human
uccucuucucuggugaaagg

SEQ ID NO: 701396 - RNA, 19 nt, Human
uccugggacuccuacucuc

SEQ ID NO: 701397 - RNA, 18 nt, Human
uccuugggccuggccagu

SEQ ID NO: 701398 - RNA, 19 nt, Human
uccuugggccuggccaguc

SEQ ID NO: 701399 - RNA, 24 nt, Human
uccuuucucucaucccuuuuccuu

SEQ ID NO: 701400 - RNA, 21 nt, Human
ucuacccccaugccaccccca

SEQ ID NO: 701401 - RNA, 19 nt, Human
ucuagguaggugggaaugg

SEQ ID NO: 701402 - RNA, 23 nt, Human
ucuccauuaguggccucugcucc

SEQ ID NO: 701403 - RNA, 18 nt, Human
ucucucagcucccaggcc

SEQ ID NO: 701404 - RNA, 20 nt, Human
ucucucaucccuuuuccuga

SEQ ID NO: 701405 - RNA, 18 nt, Human
ucucucauccuagccccu

SEQ ID NO: 701406 - RNA, 23 nt, Human
ucucuucagcaccagagcugcuu

SEQ ID NO: 701407 - RNA, 19 nt, Human
ucugcuuccuccuucaccu

SEQ ID NO: 701408 - RNA, 23 nt, Human
ucugucucucauccuagccccuc

SEQ ID NO: 701409 - RNA, 21 nt, Human
ucuuuguuuccauaugaacag

SEQ ID NO: 701410 - RNA, 19 nt, Human
ugaauaauccuuuaugagg

SEQ ID NO: 701411 - RNA, 24 nt, Human
ugaauaauccuuuaugaggaccca

SEQ ID NO: 701412 - RNA, 23 nt, Human
ugacaauccuuccccaccccagc

SEQ ID NO: 701413 - RNA, 19 nt, Human
ugacuucacugaagaggca

SEQ ID NO: 701414 - RNA, 19 nt, Human
ugaggcugguuuugauggc

SEQ ID NO: 701415 - RNA, 22 nt, Human
ugagucucucacagaucaauuc

SEQ ID NO: 701416 - RNA, 21 nt, Human
ugaucggugugggaaaaagag

SEQ ID NO: 701417 - RNA, 19 nt, Human
ugcaaggcuaaggcaucaa

SEQ ID NO: 701418 - RNA, 22 nt, Human
ugcagaaugcggccagagcuga

SEQ ID NO: 701419 - RNA, 22 nt, Human
ugcagguagggcccuggagugc

SEQ ID NO: 701420 - RNA, 25 nt, Human
ugccugcccgcacccuggccugguc

SEQ ID NO: 701421 - RNA, 23 nt, Human
ugcgucaggagcuggugagccug

SEQ ID NO: 701422 - RNA, 21 nt, Human
ugcucaggcacagccagcaac

SEQ ID NO: 701423 - RNA, 25 nt, Human
ugcucaggcacagccagcaacugau

SEQ ID NO: 701424 - RNA, 22 nt, Human
ugcugcugcuggcccugugcug

SEQ ID NO: 701425 - RNA, 18 nt, Human
ugcuguggcuggagggca

SEQ ID NO: 701426 - RNA, 19 nt, Human
ugcuguggcuggagggcag

SEQ ID NO: 701427 - RNA, 26 nt, Human
uggagggcagggcuucuugggucgaa

SEQ ID NO: 701428 - RNA, 24 nt, Human
uggauccgaagcagcugcugcccc

SEQ ID NO: 701429 - RNA, 18 nt, Human
uggcaggaggaggaggca

SEQ ID NO: 701430 - RNA, 21 nt, Human
uggcaggaggaggaggcauua

SEQ ID NO: 701431 - RNA, 27 nt, Human
uggccagaaaccuucagcuccugggac

SEQ ID NO: 701432 - RNA, 19 nt, Human
uggccuggucccugguccu

SEQ ID NO: 701433 - RNA, 19 nt, Human
uggcugaccuugaggaaug

SEQ ID NO: 701434 - RNA, 20 nt, Human
uggcuggagggcagggcuuc

SEQ ID NO: 701435 - RNA, 24 nt, Human
uggcuggagggcagggcuucuugg

SEQ ID NO: 701436 - RNA, 22 nt, Human
ugggaagggcaggaugccgagc

SEQ ID NO: 701437 - RNA, 18 nt, Human
ugggacaggcaaaguucc

SEQ ID NO: 701438 - RNA, 24 nt, Human
uggggcucacaagggaggggaucc

SEQ ID NO: 701439 - RNA, 19 nt, Human
ugggguugggggacagccu

SEQ ID NO: 701440 - RNA, 25 nt, Human
uggguccuugggccuggccagucuu

SEQ ID NO: 701441 - RNA, 25 nt, Human
uguaaauaaagucuauuuuucuccc

SEQ ID NO: 701442 - RNA, 19 nt, Human
ugugcugcugcuggcccug

SEQ ID NO: 701443 - RNA, 18 nt, Human
uuccaggcucuucccacu

SEQ ID NO: 701444 - RNA, 27 nt, Human
uuccccugcuggggcggugaggaagac

SEQ ID NO: 701445 - RNA, 21 nt, Human
uuccugaggccacaucuuucc

SEQ ID NO: 701446 - RNA, 21 nt, Human
uucuagguaggugggaaugga

SEQ ID NO: 701447 - RNA, 24 nt, Human
uugaauuuggugagagaagggacc

SEQ ID NO: 701448 - RNA, 18 nt, Human
uuggaccacuucaggcuc

SEQ ID NO: 701449 - RNA, 21 nt, Human
uugugcugcugcuggcccugu

SEQ ID NO: 701450 - RNA, 19 nt, Human
uuugaagccuaccuuguuc

SEQ ID NO: 701451 - RNA, 21 nt, Human
uuugccccaggcuacaccucc

SEQ ID NO: 701452 - RNA, 22 nt, Human
aaaaacacaagcauauguuggc

SEQ ID NO: 701453 - RNA, 18 nt, Human
acauuauucugccuacca

SEQ ID NO: 701454 - RNA, 22 nt, Human
accaggggugugagccugggau

SEQ ID NO: 701455 - RNA, 20 nt, Human
acgggcugcacggguucccc

SEQ ID NO: 701456 - RNA, 19 nt, Human
agaaacuggaaaacagauu

SEQ ID NO: 701457 - RNA, 22 nt, Human
agaggcagacgugcuggggcuu

SEQ ID NO: 701458 - RNA, 23 nt, Human
agauccuuaacauaaucacauuu

SEQ ID NO: 701459 - RNA, 21 nt, Human
agcaggaugagcuugguuugg

SEQ ID NO: 701460 - RNA, 19 nt, Human
agcaggcuccaggcagcuc

SEQ ID NO: 701461 - RNA, 22 nt, Human
agcaggcuccaggcagcucugc

SEQ ID NO: 701462 - RNA, 21 nt, Human
agcccagcaggcuccaggcag

SEQ ID NO: 701463 - RNA, 20 nt, Human
aggagagaagggcaguuaga

SEQ ID NO: 701464 - RNA, 19 nt, Human
aggcagcucugccucuccc

SEQ ID NO: 701465 - RNA, 20 nt, Human
aggcuccaggcagcucugcc

SEQ ID NO: 701466 - RNA, 25 nt, Human
aguccagccaccaggggugugagcc

SEQ ID NO: 701467 - RNA, 19 nt, Human
agucugaaaugggugucac

SEQ ID NO: 701468 - RNA, 21 nt, Human
caaaaccucuuuggacaugua

SEQ ID NO: 701469 - RNA, 20 nt, Human
caaggccccucacuccaucu

SEQ ID NO: 701470 - RNA, 24 nt, Human
caaguccagccaccagggguguga

SEQ ID NO: 701471 - RNA, 18 nt, Human
cacaaggauaacccagga

SEQ ID NO: 701472 - RNA, 24 nt, Human
cacaaggauaacccaggauugucu

SEQ ID NO: 701473 - RNA, 19 nt, Human
caccaaggcuuccaccagc

SEQ ID NO: 701474 - RNA, 26 nt, Human
caccaaggcuuccaccagcccagcag

SEQ ID NO: 701475 - RNA, 21 nt, Human
caccaggggugugagccuggg

SEQ ID NO: 701476 - RNA, 30 nt, Human
cacugagcugaaauccaugugucaagagcc

SEQ ID NO: 701477 - RNA, 20 nt, Human
cagaauccaccaaggcuucc

SEQ ID NO: 701478 - RNA, 22 nt, Human
cagaauccaccaaggcuuccac

SEQ ID NO: 701479 - RNA, 21 nt, Human
cagauucccccaaauagcuga

SEQ ID NO: 701480 - RNA, 24 nt, Human
cagauucccccaaauagcugagcc

SEQ ID NO: 701481 - RNA, 18 nt, Human
ccaaggcuuccaccagcc

SEQ ID NO: 701482 - RNA, 23 nt, Human
ccacaacaauucccagcccugag

SEQ ID NO: 701483 - RNA, 20 nt, Human
ccagaggcagacgugcuggg

SEQ ID NO: 701484 - RNA, 18 nt, Human
ccaggauugucuccucau

SEQ ID NO: 701485 - RNA, 20 nt, Human
ccaggggugugagccuggga

SEQ ID NO: 701486 - RNA, 21 nt, Human
cccagcucaaacccaguccca

SEQ ID NO: 701487 - RNA, 19 nt, Human
ccccaaauagcugagccac

SEQ ID NO: 701488 - RNA, 28 nt, Human
ccccucacuccaucuucaaaauuagaag

SEQ ID NO: 701489 - RNA, 24 nt, Human
cccugagcaggaugagcuugguuu

SEQ ID NO: 701490 - RNA, 21 nt, Human
ccuaccauagacccugagcag

SEQ ID NO: 701491 - RNA, 27 nt, Human
ccugccagaauccaccaaggcuuccaa

SEQ ID NO: 701492 - RNA, 23 nt, Human
cgugcuggggcuuagaaccacuc

SEQ ID NO: 701493 - RNA, 25 nt, Human
cucacuccaucuucaaaauuagaag

SEQ ID NO: 701494 - RNA, 19 nt, Human
cuccaggcagcucugccuc

SEQ ID NO: 701495 - RNA, 19 nt, Human
cugacucucccuuccugcc

SEQ ID NO: 701496 - RNA, 22 nt, Human
cugagcccacaaggauaaccca

SEQ ID NO: 701497 - RNA, 18 nt, Human
cugagcugaaauccaugu

SEQ ID NO: 701498 - RNA, 20 nt, Human
cugguccucacugaugggga

SEQ ID NO: 701499 - RNA, 18 nt, Human
gacgugcuggggcuuaga

SEQ ID NO: 701500 - RNA, 20 nt, Human
gagagaagggcaguuagaaa

SEQ ID NO: 701501 - RNA, 21 nt, Human
gaggcugggugaagccagagg

SEQ ID NO: 701502 - RNA, 20 nt, Human
gaugagcuugguuugggggc

SEQ ID NO: 701503 - RNA, 21 nt, Human
gccacaacaauucccagcccu

SEQ ID NO: 701504 - RNA, 19 nt, Human
gcccugagaguggggugga

SEQ ID NO: 701505 - RNA, 19 nt, Human
gccugccagaauccaccaa

SEQ ID NO: 701506 - RNA, 18 nt, Human
ggagugugcuguagccuc

SEQ ID NO: 701507 - RNA, 23 nt, Human
ggcaguuagaaaaggaggcuggg

SEQ ID NO: 701508 - RNA, 18 nt, Human
ggcugggugaagccagag

SEQ ID NO: 701509 - RNA, 19 nt, Human
gggugucacugagcugaaa

SEQ ID NO: 701510 - RNA, 18 nt, Human
guggagugugcuguagcc

SEQ ID NO: 701511 - RNA, 22 nt, Human
guggagugugcuguagccuccc

SEQ ID NO: 701512 - RNA, 22 nt, Human
gugugcuguagccucccucaca

SEQ ID NO: 701513 - RNA, 18 nt, Human
uaagcccagcucaaaccc

SEQ ID NO: 701514 - RNA, 20 nt, Human
ucaaacccagucccacugcc

SEQ ID NO: 701515 - RNA, 20 nt, Human
ucacugagcugaaauccaug

SEQ ID NO: 701516 - RNA, 19 nt, Human
ucccagcccugagaguggg

SEQ ID NO: 701517 - RNA, 21 nt, Human
ucucccuuccugccuccuucu

SEQ ID NO: 701518 - RNA, 22 nt, Human
ucugagaaacuggaaaacagau

SEQ ID NO: 701519 - RNA, 21 nt, Human
ugacucucccuuccugccucc

SEQ ID NO: 701520 - RNA, 20 nt, Human
ugagccugggauguguguga

SEQ ID NO: 701521 - RNA, 19 nt, Human
ugauggggaggagagaagg

SEQ ID NO: 701522 - RNA, 22 nt, Human
ugauggggaggagagaagggca

SEQ ID NO: 701523 - RNA, 23 nt, Human
uggaaaacagauucccccaaaua

SEQ ID NO: 701524 - RNA, 18 nt, Human
ugggauuaggauguggac

SEQ ID NO: 701525 - RNA, 18 nt, Human
uguaugguaacauaugca

SEQ ID NO: 701526 - RNA, 19 nt, Human
uguggaggucagaagucug

SEQ ID NO: 701527 - RNA, 22 nt, Human
uuccaccagcccagcaggcucc

SEQ ID NO: 701528 - RNA, 24 nt, Human
uucccccaaauagcugagccacaa

SEQ ID NO: 701529 - RNA, 23 nt, Human
uuccuccuucuaaaaacacaagc

SEQ ID NO: 701530 - RNA, 18 nt, Human
uuuuuuuuuuuuagaggu

SEQ ID NO: 701531 - RNA, 22 nt, Human
aaaaaaaaacagacuaggagaa

SEQ ID NO: 701532 - RNA, 24 nt, Human
aaaaaaaaacagacuaggagaaaa

SEQ ID NO: 701533 - RNA, 21 nt, Human
aaaaaacauauguacaagacc

SEQ ID NO: 701534 - RNA, 21 nt, Human
aaaaacccauucuaaaacuaa

SEQ ID NO: 701535 - RNA, 24 nt, Human
aaaaaggaaauaaaauaaaaaccc

SEQ ID NO: 701536 - RNA, 25 nt, Human
aaaaaggaaauaaaauaaaaaccca

SEQ ID NO: 701537 - RNA, 20 nt, Human
aaacauauguacaagacccu

SEQ ID NO: 701538 - RNA, 19 nt, Human
aaacuaaacuaaugaagca

SEQ ID NO: 701539 - RNA, 22 nt, Human
aaaggaaauaaaauaaaaaccc

SEQ ID NO: 701540 - RNA, 19 nt, Human
aaaggguuuucuaucuaca

SEQ ID NO: 701541 - RNA, 20 nt, Human
aaaugccaaguucaccauaa

SEQ ID NO: 701542 - RNA, 21 nt, Human
aagcaaaaaaaggguuuucua

SEQ ID NO: 701543 - RNA, 21 nt, Human
aagcaccccaaggaaauguua

SEQ ID NO: 701544 - RNA, 22 nt, Human
aaggaagagauucagggcucug

SEQ ID NO: 701545 - RNA, 18 nt, Human
aaugaagaggcagauaga

SEQ ID NO: 701546 - RNA, 24 nt, Human
aaugaagaggcagauagaaaagga

SEQ ID NO: 701547 - RNA, 25 nt, Human
acaacagucuuccaaauuauucucc

SEQ ID NO: 701548 - RNA, 23 nt, Human
acaaugcguauucagaaaaaucc

SEQ ID NO: 701549 - RNA, 26 nt, Human
accccaaggaaauguuaaaagcaaag

SEQ ID NO: 701550 - RNA, 19 nt, Human
agacaugguaaaacaggag

SEQ ID NO: 701551 - RNA, 23 nt, Human
agagaggagagagcagaaaaaga

SEQ ID NO: 701552 - RNA, 23 nt, Human
agaggagagagcagaaaaagaga

SEQ ID NO: 701553 - RNA, 21 nt, Human
agauagaaaaggagagacuga

SEQ ID NO: 701554 - RNA, 22 nt, Human
aggaagagauucagggcucuga

SEQ ID NO: 701555 - RNA, 18 nt, Human
aguggucacugugaagug

SEQ ID NO: 701556 - RNA, 20 nt, Human
aucuuuuuuuuuuuuuuuuu

SEQ ID NO: 701557 - RNA, 22 nt, Human
auuauucuccucuggauauuag

SEQ ID NO: 701558 - RNA, 24 nt, Human
caagauucccauucacaaaugcca

SEQ ID NO: 701559 - RNA, 22 nt, Human
caagcaccccaaggaaauguua

SEQ ID NO: 701560 - RNA, 23 nt, Human
caauccaggugcagagccgggaa

SEQ ID NO: 701561 - RNA, 21 nt, Human
caccauaaaagcagauaauuc

SEQ ID NO: 701562 - RNA, 23 nt, Human
caccuuugggucuagaguguauu

SEQ ID NO: 701563 - RNA, 21 nt, Human
caggaggacacugaugcuaca

SEQ ID NO: 701564 - RNA, 19 nt, Human
cauuuguugcacuguucuc

SEQ ID NO: 701565 - RNA, 22 nt, Human
ccaaaaaacauauguacaagac

SEQ ID NO: 701566 - RNA, 20 nt, Human
ccaagcaccccaaggaaaug

SEQ ID NO: 701567 - RNA, 23 nt, Human
ccacguuuuacuccuguguucuu

SEQ ID NO: 701568 - RNA, 23 nt, Human
ccacucaaccucccagggacggg

SEQ ID NO: 701569 - RNA, 24 nt, Human
ccauacagaucuucccuacaagac

SEQ ID NO: 701570 - RNA, 19 nt, Human
cccaauuucaugcccuuga

SEQ ID NO: 701571 - RNA, 18 nt, Human
ccccaccccugcacagag

SEQ ID NO: 701572 - RNA, 23 nt, Human
cccccgaauggcaaugcuggcau

SEQ ID NO: 701573 - RNA, 26 nt, Human
cccuccuaugaacaaguguucuucuc

SEQ ID NO: 701574 - RNA, 19 nt, Human
ccuccuaugaacaaguguu

SEQ ID NO: 701575 - RNA, 24 nt, Human
cgagaaagaauccggugcuccuug

SEQ ID NO: 701576 - RNA, 21 nt, Human
cugaaggccgacguggcccag

SEQ ID NO: 701577 - RNA, 22 nt, Human
gaaaaaaaaaacagacuaggag

SEQ ID NO: 701578 - RNA, 18 nt, Human
gaaauaaaauaaaaaccc

SEQ ID NO: 701579 - RNA, 22 nt, Human
gacccuguuuuuccucguguuc

SEQ ID NO: 701580 - RNA, 20 nt, Human
gagaaagaauccggugcucc

SEQ ID NO: 701581 - RNA, 23 nt, Human
gagcucuaugacaagaauuggag

SEQ ID NO: 701582 - RNA, 21 nt, Human
gcagaacccgagaaagaaucc

SEQ ID NO: 701583 - RNA, 18 nt, Human
ggaaauaaaauaaaaacc

SEQ ID NO: 701584 - RNA, 19 nt, Human
ggaaggaaaaaagccgaua

SEQ ID NO: 701585 - RNA, 19 nt, Human
ggcagauagaaaaggagag

SEQ ID NO: 701586 - RNA, 21 nt, Human
ggcauuuguugcacuguucuc

SEQ ID NO: 701587 - RNA, 22 nt, Human
uaaaaacccauucuaaaacuaa

SEQ ID NO: 701588 - RNA, 19 nt, Human
uagacccgcccccaccccu

SEQ ID NO: 701589 - RNA, 18 nt, Human
uauauauauauguauaua

SEQ ID NO: 701590 - RNA, 18 nt, Human
uauauauauguauauaua

SEQ ID NO: 701591 - RNA, 18 nt, Human
uauauauguauauauaua

SEQ ID NO: 701592 - RNA, 19 nt, Human
uauauauguauauauauau

SEQ ID NO: 701593 - RNA, 18 nt, Human
uauauguauauauauaua

SEQ ID NO: 701594 - RNA, 18 nt, Human
uauauguauauauauaua

SEQ ID NO: 701595 - RNA, 23 nt, Human
uauauguauauauauauaagggu

SEQ ID NO: 701596 - RNA, 22 nt, Human
uauguauauauauauaagggua

SEQ ID NO: 701597 - RNA, 24 nt, Human
uauguauauauauauaaggguaca

SEQ ID NO: 701598 - RNA, 21 nt, Human
uccauacagaucuucccuaca

SEQ ID NO: 701599 - RNA, 21 nt, Human
uccccacaacagucuuccaaa

SEQ ID NO: 701600 - RNA, 22 nt, Human
ucucugaaggccgacguggccc

SEQ ID NO: 701601 - RNA, 24 nt, Human
ucuucuuaguacucuguagugguc

SEQ ID NO: 701602 - RNA, 22 nt, Human
ugagagaggagagagcagaaaa

SEQ ID NO: 701603 - RNA, 23 nt, Human
ugaguacaugcagccuuucaacc

SEQ ID NO: 701604 - RNA, 22 nt, Human
ugcagagccgggaaaaaaaaaa

SEQ ID NO: 701605 - RNA, 23 nt, Human
ugcagagccgggaaaaaaaaaac

SEQ ID NO: 701606 - RNA, 25 nt, Human
ugugaacaagauucccauucacaaa

SEQ ID NO: 701607 - RNA, 24 nt, Human
uguuccccacaacagucuuccaaa

SEQ ID NO: 701608 - RNA, 23 nt, Human
uucacaaaugccaaguucaccau

SEQ ID NO: 701609 - RNA, 23 nt, Human
uucagggcucugacugguggggc

SEQ ID NO: 701610 - RNA, 21 nt, Human
uuggaguguugcuugcaaauc

SEQ ID NO: 701611 - RNA, 25 nt, Human
uuucuuguuuuugcuagcaauuaau

SEQ ID NO: 701612 - RNA, 18 nt, Human
aagccuuucccauucccc

SEQ ID NO: 701613 - RNA, 24 nt, Human
aagcugcuccccagagcucccccg

SEQ ID NO: 701614 - RNA, 19 nt, Human
acagccaaggaugugacac

SEQ ID NO: 701615 - RNA, 18 nt, Human
accaagccuuucccauuc

SEQ ID NO: 701616 - RNA, 22 nt, Human
accccucccuagaguccugccg

SEQ ID NO: 701617 - RNA, 19 nt, Human
agaggcaaauucccugagc

SEQ ID NO: 701618 - RNA, 23 nt, Human
agaggcaggggccucaugcucug

SEQ ID NO: 701619 - RNA, 22 nt, Human
aggcagagcuugcaaaguugug

SEQ ID NO: 701620 - RNA, 19 nt, Human
aggcuggaauuugagccca

SEQ ID NO: 701621 - RNA, 20 nt, Human
caacuccaugagguaggugu

SEQ ID NO: 701622 - RNA, 18 nt, Human
caaggagaggcaaauucc

SEQ ID NO: 701623 - RNA, 18 nt, Human
cacaacuccaugagguag

SEQ ID NO: 701624 - RNA, 22 nt, Human
caccaagccuuucccauucccc

SEQ ID NO: 701625 - RNA, 19 nt, Human
caccacaacuccaugaggu

SEQ ID NO: 701626 - RNA, 19 nt, Human
caccccucccuagaguccu

SEQ ID NO: 701627 - RNA, 20 nt, Human
cacuggguagggacagggag

SEQ ID NO: 701628 - RNA, 20 nt, Human
cagagcucccccgcugcagu

SEQ ID NO: 701629 - RNA, 20 nt, Human
caggcucucuucccaccuuu

SEQ ID NO: 701630 - RNA, 21 nt, Human
caggggcccugcaugccacuc

SEQ ID NO: 701631 - RNA, 20 nt, Human
cauggcaggggcccugcaug

SEQ ID NO: 701632 - RNA, 24 nt, Human
cauuucgcuuuguucuaucagagg

SEQ ID NO: 701633 - RNA, 21 nt, Human
cccacauuacagaugaggaaa

SEQ ID NO: 701634 - RNA, 25 nt, Human
cccauguaccaggcacuauuaagca

SEQ ID NO: 701635 - RNA, 19 nt, Human
cccgucugaggccagaucg

SEQ ID NO: 701636 - RNA, 20 nt, Human
ccguccugcuggcccuggcc

SEQ ID NO: 701637 - RNA, 21 nt, Human
ccuccuucugguucuuuucca

SEQ ID NO: 701638 - RNA, 23 nt, Human
ccuuggcagaagugcagguuguu

SEQ ID NO: 701639 - RNA, 26 nt, Human
cgcacccauggcaggggcccugcaug

SEQ ID NO: 701640 - RNA, 22 nt, Human
cugcauuuccuccuugcacugu

SEQ ID NO: 701641 - RNA, 20 nt, Human
cugccugcagaaaaggcuug

SEQ ID NO: 701642 - RNA, 22 nt, Human
gaacccaaggcagagcuugcaa

SEQ ID NO: 701643 - RNA, 20 nt, Human
gcaguugcccuggcugggaa

SEQ ID NO: 701644 - RNA, 20 nt, Human
gcaugggauugacagccaag

SEQ ID NO: 701645 - RNA, 19 nt, Human
gcaugggcaggcaugggag

SEQ ID NO: 701646 - RNA, 27 nt, Human
gccguccugcuggcccuggccuuggcc

SEQ ID NO: 701647 - RNA, 25 nt, Human
gcuggcccuggccuuggcagaagug

SEQ ID NO: 701648 - RNA, 18 nt, Human
ggagguggggcucuggac

SEQ ID NO: 701649 - RNA, 20 nt, Human
gucuacacaagcugcucccc

SEQ ID NO: 701650 - RNA, 20 nt, Human
uaccaggcacuauuaagcac

SEQ ID NO: 701651 - RNA, 20 nt, Human
ucaccacaacuccaugaggu

SEQ ID NO: 701652 - RNA, 22 nt, Human
uccccagagcucccccgcugca

SEQ ID NO: 701653 - RNA, 22 nt, Human
ucccugagcacuuugaauccau

SEQ ID NO: 701654 - RNA, 18 nt, Human
ucugaaacuccugccugc

SEQ ID NO: 701655 - RNA, 19 nt, Human
ugaagucacacagcuugug

SEQ ID NO: 701656 - RNA, 18 nt, Human
ugcccagccuccuucugg

SEQ ID NO: 701657 - RNA, 18 nt, Human
ugcccuggcugggaauga

SEQ ID NO: 701658 - RNA, 26 nt, Human
uggcagaagugcagguuguucugguu

SEQ ID NO: 701659 - RNA, 18 nt, Human
ugggauugacagccaagg

SEQ ID NO: 701660 - RNA, 21 nt, Human
ugguucuuuuccaggccuggu

SEQ ID NO: 701661 - RNA, 19 nt, Human
ugugaguggugaggcugga

SEQ ID NO: 701662 - RNA, 18 nt, Human
uuaaagacaugacuucau

SEQ ID NO: 701663 - RNA, 21 nt, Human
uucaucuucaccacaacucca

SEQ ID NO: 701664 - RNA, 23 nt, Human
uugcacugucauuucugccuugc

SEQ ID NO: 701665 - RNA, 20 nt, Human
aauuuucaacauaugcaggu

SEQ ID NO: 701666 - RNA, 19 nt, Human
caauaaauaauccuccccu

SEQ ID NO: 701667 - RNA, 19 nt, Human
caggugccuggggugguag

SEQ ID NO: 701668 - RNA, 22 nt, Human
ccccaaacuguccccaggagga

SEQ ID NO: 701669 - RNA, 20 nt, Human
ccugguggaaucucugccca

SEQ ID NO: 701670 - RNA, 20 nt, Human
cucaaaucuggcuggcucug

SEQ ID NO: 701671 - RNA, 20 nt, Human
cucaaccuuaucauagguca

SEQ ID NO: 701672 - RNA, 18 nt, Human
gucagucaguauugguaa

SEQ ID NO: 701673 - RNA, 24 nt, Human
uaaauacaauaaauaauccucccc

SEQ ID NO: 701674 - RNA, 20 nt, Human
uaauggacuaauuaaccugu

SEQ ID NO: 701675 - RNA, 21 nt, Human
uagccacaaaaauaagacuuu

SEQ ID NO: 701676 - RNA, 19 nt, Human
ucacaggugccuggggugg

SEQ ID NO: 701677 - RNA, 19 nt, Human
ucagcaucacaugucaguc

SEQ ID NO: 701678 - RNA, 22 nt, Human
uccccaaacuguccccaggagg

SEQ ID NO: 701679 - RNA, 18 nt, Human
uccugguggaaucucugc

SEQ ID NO: 701680 - RNA, 23 nt, Human
ucucucuguucagcgcgucucuu

SEQ ID NO: 701681 - RNA, 25 nt, Human
ucucugguuugguucccucaguugu

SEQ ID NO: 701682 - RNA, 24 nt, Human
ugaaaaaaguacauaauucaauau

SEQ ID NO: 701683 - RNA, 19 nt, Human
ugguagauuuaucuuggcc

SEQ ID NO: 701684 - RNA, 23 nt, Human
uguuggcucacaggugccugggg

SEQ ID NO: 701685 - RNA, 20 nt, Human
acaacauuucaacagcaaag

SEQ ID NO: 701686 - RNA, 19 nt, Human
accaaccgccccuuccucu

SEQ ID NO: 701687 - RNA, 19 nt, Human
aggaaaaggagugaaggga

SEQ ID NO: 701688 - RNA, 19 nt, Human
cacaaaugggagacuggca

SEQ ID NO: 701689 - RNA, 20 nt, Human
caccaaccgccccuuccucu

SEQ ID NO: 701690 - RNA, 22 nt, Human
ccacggaaaugucugucaccau

SEQ ID NO: 701691 - RNA, 25 nt, Human
ccaguagcaggcagcuuaggcuccu

SEQ ID NO: 701692 - RNA, 19 nt, Human
cugaguagcagacaacuga

SEQ ID NO: 701693 - RNA, 21 nt, Human
gcaccaaccgccccuuccucu

SEQ ID NO: 701694 - RNA, 21 nt, Human
gcccaguagcaggcagcuuag

SEQ ID NO: 701695 - RNA, 23 nt, Human
gcuccagucuucccccuugggua

SEQ ID NO: 701696 - RNA, 18 nt, Human
uagaauauuaggaagaaa

SEQ ID NO: 701697 - RNA, 18 nt, Human
uaggaagaaauguuggua

SEQ ID NO: 701698 - RNA, 22 nt, Human
uauagauggauggcauagguca

SEQ ID NO: 701699 - RNA, 25 nt, Human
ucuuagaaaaaaaaauuuccagacu

SEQ ID NO: 701700 - RNA, 20 nt, Human
uggaggccgcaccaaccgcc

SEQ ID NO: 701701 - RNA, 21 nt, Human
uggcauaggucacaaauggga

SEQ ID NO: 701702 - RNA, 21 nt, Human
aaaaacucuacccagacaaag

SEQ ID NO: 701703 - RNA, 18 nt, Human
aaaaagaaaccccccacu

SEQ ID NO: 701704 - RNA, 18 nt, Human
aaaaagaaaccccccacu

SEQ ID NO: 701705 - RNA, 23 nt, Human
aaacacggcuaaauaugggucac

SEQ ID NO: 701706 - RNA, 23 nt, Human
aaacacggcuaaauaugggucac

SEQ ID NO: 701707 - RNA, 19 nt, Human
aaacucuacccagacaaag

SEQ ID NO: 701708 - RNA, 21 nt, Human
aaccccccacucuuucccacu

SEQ ID NO: 701709 - RNA, 23 nt, Human
aagcauuaaaauacagaaaagcu

SEQ ID NO: 701710 - RNA, 22 nt, Human
aagcauuaaaauacagaaagcu

SEQ ID NO: 701711 - RNA, 20 nt, Human
accccccacucuuucccacu

SEQ ID NO: 701712 - RNA, 21 nt, Human
acgggaugggggcgggggccu

SEQ ID NO: 701713 - RNA, 21 nt, Human
acgggaugggggcgggggccu

SEQ ID NO: 701714 - RNA, 19 nt, Human
acucaaaaacucuacccag

SEQ ID NO: 701715 - RNA, 28 nt, Human
acugaacugcaaaaacucaaaaacucua

SEQ ID NO: 701716 - RNA, 28 nt, Human
acugaacugcaaaaacucaaaaacucua

SEQ ID NO: 701717 - RNA, 19 nt, Human
agacagagggauacugaac

SEQ ID NO: 701718 - RNA, 19 nt, Human
agacagagggauacugaac

SEQ ID NO: 701719 - RNA, 25 nt, Human
agcaacguggacgggaugggggcgg

SEQ ID NO: 701720 - RNA, 25 nt, Human
agcaacguggacgggaugggggcgg

SEQ ID NO: 701721 - RNA, 25 nt, Human
aggagccgcccccagaaccuccgcc

SEQ ID NO: 701722 - RNA, 19 nt, Human
aggaggaggaguccggacc

SEQ ID NO: 701723 - RNA, 22 nt, Human
aguagcugccuuguccaugguu

SEQ ID NO: 701724 - RNA, 18 nt, Human
auagccuuucugcuugcc

SEQ ID NO: 701725 - RNA, 23 nt, Human
caaaaacucuacccagacaaagu

SEQ ID NO: 701726 - RNA, 23 nt, Human
caaaaacucuacccagacaaagu

SEQ ID NO: 701727 - RNA, 20 nt, Human
caccgccacuggcauuccca

SEQ ID NO: 701728 - RNA, 18 nt, Human
caccgguggggcgggcug

SEQ ID NO: 701729 - RNA, 19 nt, Human
cacgacacagcaacgugga

SEQ ID NO: 701730 - RNA, 19 nt, Human
cacgacacagcaacgugga

SEQ ID NO: 701731 - RNA, 22 nt, Human
cagaaccuccgccguagccccc

SEQ ID NO: 701732 - RNA, 20 nt, Human
cauaaaaagaaaccccccac

SEQ ID NO: 701733 - RNA, 19 nt, Human
ccacagccgccggggucug

SEQ ID NO: 701734 - RNA, 21 nt, Human
ccaccaccgcccccgccgcca

SEQ ID NO: 701735 - RNA, 21 nt, Human
ccaccgcccccgccgccaccg

SEQ ID NO: 701736 - RNA, 20 nt, Human
ccagacauaaaaagaaaccc

SEQ ID NO: 701737 - RNA, 20 nt, Human
ccagacauaaaaagaaaccc

SEQ ID NO: 701738 - RNA, 19 nt, Human
ccauacccagcaccggcau

SEQ ID NO: 701739 - RNA, 20 nt, Human
ccaugguuauagccuuucug

SEQ ID NO: 701740 - RNA, 21 nt, Human
cccauagcuuccauacccagc

SEQ ID NO: 701741 - RNA, 22 nt, Human
ccccagaaccuccgccguagcc

SEQ ID NO: 701742 - RNA, 26 nt, Human
cccccaaaagccaccgguggggcggg

SEQ ID NO: 701743 - RNA, 20 nt, Human
cccccagaaccuccgccgua

SEQ ID NO: 701744 - RNA, 23 nt, Human
cccccagaaccuccgccguagcc

SEQ ID NO: 701745 - RNA, 25 nt, Human
cccccagaaccuccgccguagcccc

SEQ ID NO: 701746 - RNA, 21 nt, Human
ccccgggagcuguaguucgac

SEQ ID NO: 701747 - RNA, 20 nt, Human
ccccgugcggcugcuucuuc

SEQ ID NO: 701748 - RNA, 20 nt, Human
cccgugcggcugcuucuucc

SEQ ID NO: 701749 - RNA, 23 nt, Human
ccgcagccgccgccgccgcccuc

SEQ ID NO: 701750 - RNA, 21 nt, Human
ccgccacuggcauucccagaa

SEQ ID NO: 701751 - RNA, 19 nt, Human
ccgccgccaccgccacugg

SEQ ID NO: 701752 - RNA, 28 nt, Human
ccgccgccaccgccacuggcauucccag

SEQ ID NO: 701753 - RNA, 18 nt, Human
ccgccgcccuccugccac

SEQ ID NO: 701754 - RNA, 18 nt, Human
ccgccgccgcccuccugc

SEQ ID NO: 701755 - RNA, 25 nt, Human
ccgccuugugaggacugguaggagc

SEQ ID NO: 701756 - RNA, 24 nt, Human
cgaccgcagccgccgccgccgccc

SEQ ID NO: 701757 - RNA, 25 nt, Human
cgaccgcagccgccgccgccgcccu

SEQ ID NO: 701758 - RNA, 22 nt, Human
cgccgcccuccugccacagccg

SEQ ID NO: 701759 - RNA, 20 nt, Human
cgccugagccguagcuguuc

SEQ ID NO: 701760 - RNA, 21 nt, Human
cgggagcuguaguucgacugu

SEQ ID NO: 701761 - RNA, 22 nt, Human
cgggggcgagcgggcgggcggg

SEQ ID NO: 701762 - RNA, 18 nt, Human
cucaaaaacucuacccag

SEQ ID NO: 701763 - RNA, 24 nt, Human
cuccguacccauagcuuccauacc

SEQ ID NO: 701764 - RNA, 19 nt, Human
cugagccguagcuguuccc

SEQ ID NO: 701765 - RNA, 22 nt, Human
cugcaccucacgacacagcaac

SEQ ID NO: 701766 - RNA, 22 nt, Human
cugcaccucacgacacagcaac

SEQ ID NO: 701767 - RNA, 22 nt, Human
cugcuggguucaacugcaaugc

SEQ ID NO: 701768 - RNA, 22 nt, Human
cugguagcccgagccguaggag

SEQ ID NO: 701769 - RNA, 23 nt, Human
cugguagcccgagccguaggagg

SEQ ID NO: 701770 - RNA, 23 nt, Human
cuguucccgccgcuucggccucc

SEQ ID NO: 701771 - RNA, 23 nt, Human
gaagaggaggaggaggaguccgg

SEQ ID NO: 701772 - RNA, 19 nt, Human
gaaugacccagacauaaaa

SEQ ID NO: 701773 - RNA, 19 nt, Human
gaaugacccagacauaaaa

SEQ ID NO: 701774 - RNA, 24 nt, Human
gacgggaugggggcgggggccugg

SEQ ID NO: 701775 - RNA, 24 nt, Human
gacgggaugggggcgggggccugg

SEQ ID NO: 701776 - RNA, 22 nt, Human
gacugcugcuggcccugguggg

SEQ ID NO: 701777 - RNA, 18 nt, Human
gagaagaggaggaggagg

SEQ ID NO: 701778 - RNA, 23 nt, Human
gagccaccaccgcccccgccgcc

SEQ ID NO: 701779 - RNA, 20 nt, Human
gccacuguaguucuggccgg

SEQ ID NO: 701780 - RNA, 19 nt, Human
gcgagcgggcgggcgggca

SEQ ID NO: 701781 - RNA, 20 nt, Human
gcgagcgggcgggcgggcag

SEQ ID NO: 701782 - RNA, 22 nt, Human
ggaccgggggcgagcgggcggg

SEQ ID NO: 701783 - RNA, 21 nt, Human
ggacgggaugggggcgggggc

SEQ ID NO: 701784 - RNA, 21 nt, Human
ggacgggaugggggcgggggc

SEQ ID NO: 701785 - RNA, 21 nt, Human
ggacugguaggagcugggagg

SEQ ID NO: 701786 - RNA, 19 nt, Human
ggagcgcaggcagcugaca

SEQ ID NO: 701787 - RNA, 23 nt, Human
ggagcuguaguucgacugugagc

SEQ ID NO: 701788 - RNA, 21 nt, Human
ggcaccggugaguuguaguug

SEQ ID NO: 701789 - RNA, 22 nt, Human
ggcgggggccuggagggccagc

SEQ ID NO: 701790 - RNA, 24 nt, Human
gggagcuguaguucgacugugagc

SEQ ID NO: 701791 - RNA, 22 nt, Human
guaugaggagccgcccccagaa

SEQ ID NO: 701792 - RNA, 18 nt, Human
guggacgggaugggggcg

SEQ ID NO: 701793 - RNA, 18 nt, Human
guggacgggaugggggcg

SEQ ID NO: 701794 - RNA, 18 nt, Human
uaaaaagaaaccccccac

SEQ ID NO: 701795 - RNA, 20 nt, Human
uaaagcauuaaaauacagaa

SEQ ID NO: 701796 - RNA, 20 nt, Human
uaaagcauuaaaauacagaa

SEQ ID NO: 701797 - RNA, 27 nt, Human
uaacucacuucacaaaagcauuaacaa

SEQ ID NO: 701798 - RNA, 21 nt, Human
uaacugugaugcauaaaacuc

SEQ ID NO: 701799 - RNA, 21 nt, Human
uaacugugaugcauaaaacuc

SEQ ID NO: 701800 - RNA, 19 nt, Human
uaauggcaacuaacaaacc

SEQ ID NO: 701801 - RNA, 19 nt, Human
uaauggcaacuaacaaacc

SEQ ID NO: 701802 - RNA, 18 nt, Human
uacagaaagcucguuuaa

SEQ ID NO: 701803 - RNA, 23 nt, Human
uaccacuaacacgaagugugaau

SEQ ID NO: 701804 - RNA, 23 nt, Human
uaccacuaacacgaagugugaau

SEQ ID NO: 701805 - RNA, 18 nt, Human
uagcccccgugugacccu

SEQ ID NO: 701806 - RNA, 20 nt, Human
uagcuuccauacccagcacc

SEQ ID NO: 701807 - RNA, 22 nt, Human
uauaaaaacugaaacacuaaag

SEQ ID NO: 701808 - RNA, 21 nt, Human
uauuugucuacauucagcuua

SEQ ID NO: 701809 - RNA, 21 nt, Human
uauuugucuacauucagcuua

SEQ ID NO: 701810 - RNA, 21 nt, Human
uccccuucuucgaccgcagcc

SEQ ID NO: 701811 - RNA, 22 nt, Human
ucgaccgcagccgccgccgccg

SEQ ID NO: 701812 - RNA, 25 nt, Human
ucgaccgcagccgccgccgccgccc

SEQ ID NO: 701813 - RNA, 22 nt, Human
ucuacauucagcuuaauucaga

SEQ ID NO: 701814 - RNA, 22 nt, Human
ucuacauucagcuuaauucaga

SEQ ID NO: 701815 - RNA, 20 nt, Human
ugaacugcaaaaacucaaaa

SEQ ID NO: 701816 - RNA, 20 nt, Human
ugaacugcaaaaacucaaaa

SEQ ID NO: 701817 - RNA, 24 nt, Human
ugaacugcaaaaacucaaaaacuc

SEQ ID NO: 701818 - RNA, 24 nt, Human
ugaacugcaaaaacucaaaaacuc

SEQ ID NO: 701819 - RNA, 20 nt, Human
ugaguuaccacuaacacgaa

SEQ ID NO: 701820 - RNA, 20 nt, Human
ugaguuaccacuaacacgaa

SEQ ID NO: 701821 - RNA, 21 nt, Human
ugccacagccgccggggucug

SEQ ID NO: 701822 - RNA, 24 nt, Human
ugcccccaaaagccaccggugggg

SEQ ID NO: 701823 - RNA, 22 nt, Human
ugccccgccugagccguagcug

SEQ ID NO: 701824 - RNA, 25 nt, Human
ugccugaaugacccagacauaaaag

SEQ ID NO: 701825 - RNA, 25 nt, Human
ugccugaaugacccagacauaaaag

SEQ ID NO: 701826 - RNA, 21 nt, Human
ugcgagaagaggaggaggagg

SEQ ID NO: 701827 - RNA, 19 nt, Human
uggagggccagcugacaug

SEQ ID NO: 701828 - RNA, 25 nt, Human
ugggggcgggggccuggagggccag

SEQ ID NO: 701829 - RNA, 19 nt, Human
uggugggacugguagcccg

SEQ ID NO: 701830 - RNA, 22 nt, Human
ugucuggaaaucaaacuuuugc

SEQ ID NO: 701831 - RNA, 23 nt, Human
uuuaacucacuucaacaaaaagc

SEQ ID NO: 701832 - RNA, 25 nt, Human
uuuuuuuuuuuuaguuuuguuuuuu

SEQ ID NO: 701833 - RNA, 24 nt, Human
uuuuuuuuuuuuuuuuuuaguuuu

SEQ ID NO: 701834 - RNA, 22 nt, Human
caaugugcacacacacaaaaug

SEQ ID NO: 701835 - RNA, 22 nt, Human
cacaaaacacacaaugugcaca

SEQ ID NO: 701836 - RNA, 23 nt, Human
cggcagcagcgacagacacucag

SEQ ID NO: 701837 - RNA, 21 nt, Human
gagaaaccuuuauuuacaacc

SEQ ID NO: 701838 - RNA, 19 nt, Human
gaggcuggguggaggcggc

SEQ ID NO: 701839 - RNA, 19 nt, Human
gcacacacacaaaaugaac

SEQ ID NO: 701840 - RNA, 21 nt, Human
ggcggaggcuggguggaggcg

SEQ ID NO: 701841 - RNA, 24 nt, Human
uaccaugcgugcuccuggccgcgc

SEQ ID NO: 701842 - RNA, 25 nt, Human
uauuuacaaccaugggagucccaca

SEQ ID NO: 701843 - RNA, 18 nt, Human
ugugcacacacacaaaau

SEQ ID NO: 701844 - RNA, 20 nt, Human
ugugcacacacacaaaauga

SEQ ID NO: 701845 - RNA, 23 nt, Human
uuuuuuuuuuuuuuuuuuuuagg

SEQ ID NO: 701846 - RNA, 21 nt, Human
aagcaucuucuacagacaccc

SEQ ID NO: 701847 - RNA, 25 nt, Human
accacaguuuaauggaggaagcauc

SEQ ID NO: 701848 - RNA, 21 nt, Human
auggaggaagcaucuucuaca

SEQ ID NO: 701849 - RNA, 21 nt, Human
cagucuuccagaaccuccuca

SEQ ID NO: 701850 - RNA, 23 nt, Human
ccagucuuccagaaccuccucag

SEQ ID NO: 701851 - RNA, 25 nt, Human
cccaacugcugccccagucuuccaa

SEQ ID NO: 701852 - RNA, 19 nt, Human
uccccaacugcugccccag

SEQ ID NO: 701853 - RNA, 21 nt, Human
uccccaacugcugccccaguc

SEQ ID NO: 701854 - RNA, 22 nt, Human
uccccaacugcugccccagucu

SEQ ID NO: 701855 - RNA, 21 nt, Human
ucuacagacacccagacaucu

SEQ ID NO: 701856 - RNA, 19 nt, Human
ugacccaugcuucuucccc

SEQ ID NO: 701857 - RNA, 20 nt, Human
ugccccagucuuccagaacc

SEQ ID NO: 701858 - RNA, 24 nt, Human
ugccccagucuuccagaaccuccu

SEQ ID NO: 701859 - RNA, 24 nt, Human
ugcuucuuccccuugauauucuca

SEQ ID NO: 701860 - RNA, 23 nt, Human
agugacaggcaggggcuguccag

SEQ ID NO: 701861 - RNA, 22 nt, Human
cacagcccacccccauucccuc

SEQ ID NO: 701862 - RNA, 21 nt, Human
cagcagcccagcuccagagug

SEQ ID NO: 701863 - RNA, 22 nt, Human
cagcucuguccggggucggaga

SEQ ID NO: 701864 - RNA, 20 nt, Human
ccauucccucccucccgccc

SEQ ID NO: 701865 - RNA, 18 nt, Human
ccccauucccucccuccc

SEQ ID NO: 701866 - RNA, 19 nt, Human
cccgcccuccuggcccugg

SEQ ID NO: 701867 - RNA, 18 nt, Human
cccucccucccgcccucc

SEQ ID NO: 701868 - RNA, 21 nt, Human
ccgcccccacguugcccuggg

SEQ ID NO: 701869 - RNA, 24 nt, Human
ccgcccccacguugcccuggggcc

SEQ ID NO: 701870 - RNA, 21 nt, Human
ccgcccuccuggcccuggcca

SEQ ID NO: 701871 - RNA, 25 nt, Human
ccgccgccggccaaccaacgacgcu

SEQ ID NO: 701872 - RNA, 21 nt, Human
ccggggucggagagggggucc

SEQ ID NO: 701873 - RNA, 22 nt, Human
ccucccgcccuccuggcccugg

SEQ ID NO: 701874 - RNA, 25 nt, Human
ccucccgcccuccuggcccuggcca

SEQ ID NO: 701875 - RNA, 22 nt, Human
ccugaggcagcagcagcccagc

SEQ ID NO: 701876 - RNA, 18 nt, Human
gcucgcgccacacccuuc

SEQ ID NO: 701877 - RNA, 19 nt, Human
uccggggucggagaggggg

SEQ ID NO: 701878 - RNA, 22 nt, Human
uccuggcccuggccagcucagc

SEQ ID NO: 701879 - RNA, 21 nt, Human
ugaggcagcagcagcccagcu

SEQ ID NO: 701880 - RNA, 18 nt, Human
ugcgcacagcccaccccc

SEQ ID NO: 701881 - RNA, 21 nt, Human
uguccggggucggagaggggg

SEQ ID NO: 701882 - RNA, 24 nt, Human
aaagugcugggauuacaggcguga

SEQ ID NO: 701883 - RNA, 27 nt, Human
aaauagcugagauuacaggcacgagcc

SEQ ID NO: 701884 - RNA, 23 nt, Human
aacacaauucuacacaccugccu

SEQ ID NO: 701885 - RNA, 25 nt, Human
aagugauucuccugccucagccucc

SEQ ID NO: 701886 - RNA, 19 nt, Human
aagugcugggauuacaggc

SEQ ID NO: 701887 - RNA, 19 nt, Human
aagugcugggauuacaggc

SEQ ID NO: 701888 - RNA, 26 nt, Human
aagugcugggauuacaggcgugagcc

SEQ ID NO: 701889 - RNA, 22 nt, Human
aaucaaaucgaaacuucgggaa

SEQ ID NO: 701890 - RNA, 30 nt, Human
accagcuccgccagccgcuccgcgcgcgcc

SEQ ID NO: 701891 - RNA, 24 nt, Human
accauauuggccaggcuggucucg

SEQ ID NO: 701892 - RNA, 18 nt, Human
accuccucagccucccaa

SEQ ID NO: 701893 - RNA, 18 nt, Human
accucgcccggccccaca

SEQ ID NO: 701894 - RNA, 18 nt, Human
acgggguuucaccauauu

SEQ ID NO: 701895 - RNA, 20 nt, Human
acgggguuucaccauauugg

SEQ ID NO: 701896 - RNA, 24 nt, Human
acgggguuucaccauauuggccag

SEQ ID NO: 701897 - RNA, 21 nt, Human
acuccccggaacucccugcug

SEQ ID NO: 701898 - RNA, 19 nt, Human
agauuacaggcacgagcca

SEQ ID NO: 701899 - RNA, 20 nt, Human
aggaagcggacuacguuggc

SEQ ID NO: 701900 - RNA, 25 nt, Human
aggcuggagugcaguggcacgaucu

SEQ ID NO: 701901 - RNA, 21 nt, Human
agguucaagugauucuccugc

SEQ ID NO: 701902 - RNA, 22 nt, Human
agguucaagugauucuccugcc

SEQ ID NO: 701903 - RNA, 23 nt, Human
agguucaagugauucuccugccu

SEQ ID NO: 701904 - RNA, 24 nt, Human
agugauucuccugccucagccucc

SEQ ID NO: 701905 - RNA, 20 nt, Human
agugcaguggcacgaucucg

SEQ ID NO: 701906 - RNA, 23 nt, Human
agugcaguggcacgaucucggcu

SEQ ID NO: 701907 - RNA, 24 nt, Human
agugcaguggcacgaucucggcuc

SEQ ID NO: 701908 - RNA, 24 nt, Human
augauccgaccuccucagccuccc

SEQ ID NO: 701909 - RNA, 24 nt, Human
caaagugcugggauuacaggcgug

SEQ ID NO: 701910 - RNA, 23 nt, Human
caaauagcugagauuacaggcac

SEQ ID NO: 701911 - RNA, 22 nt, Human
caagugauucuccugccucagc

SEQ ID NO: 701912 - RNA, 26 nt, Human
caauagagacgggguuucaccauauu

SEQ ID NO: 701913 - RNA, 20 nt, Human
cacaggcuccccaacacugg

SEQ ID NO: 701914 - RNA, 21 nt, Human
caccauauuggccaggcuggu

SEQ ID NO: 701915 - RNA, 24 nt, Human
caccauauuggccaggcuggucuc

SEQ ID NO: 701916 - RNA, 27 nt, Human
caccauauuggccaggcuggucucgaa

SEQ ID NO: 701917 - RNA, 23 nt, Human
caccccccaccccagcugauuuc

SEQ ID NO: 701918 - RNA, 24 nt, Human
cacuauggccggcuaauuuuugua

SEQ ID NO: 701919 - RNA, 21 nt, Human
cacugcaaccuccgccuccca

SEQ ID NO: 701920 - RNA, 18 nt, Human
cagcauggacaugguugg

SEQ ID NO: 701921 - RNA, 21 nt, Human
cagcugggguucaggugcaca

SEQ ID NO: 701922 - RNA, 23 nt, Human
caggcuccccaacacuggccucc

SEQ ID NO: 701923 - RNA, 20 nt, Human
cagucgagcaagugcaggug

SEQ ID NO: 701924 - RNA, 24 nt, Human
cauauuggccaggcuggucucgaa

SEQ ID NO: 701925 - RNA, 24 nt, Human
caugauccgaccuccucagccucc

SEQ ID NO: 701926 - RNA, 22 nt, Human
ccaaagugcugggauuacaggc

SEQ ID NO: 701927 - RNA, 22 nt, Human
ccaaagugcugggauuacaggc

SEQ ID NO: 701928 - RNA, 24 nt, Human
ccaaagugcugggauuacaggcgu

SEQ ID NO: 701929 - RNA, 23 nt, Human
ccaaggcccacugagccugaggc

SEQ ID NO: 701930 - RNA, 24 nt, Human
ccaauagagacgggguuucaccau

SEQ ID NO: 701931 - RNA, 23 nt, Human
ccagcugauuucagugcgcagcu

SEQ ID NO: 701932 - RNA, 18 nt, Human
cccaaauagcugagauua

SEQ ID NO: 701933 - RNA, 23 nt, Human
cccacaaucuuaaccacugucca

SEQ ID NO: 701934 - RNA, 23 nt, Human
cccagguucaagugauucuccuc

SEQ ID NO: 701935 - RNA, 23 nt, Human
cccagguucaagugauucuccug

SEQ ID NO: 701936 - RNA, 19 nt, Human
cccgagugugggagcgagg

SEQ ID NO: 701937 - RNA, 18 nt, Human
ccgaccuccucagccucc

SEQ ID NO: 701938 - RNA, 20 nt, Human
ccgacuucaccgccaggagc

SEQ ID NO: 701939 - RNA, 24 nt, Human
ccgccucccagguucaagugauuc

SEQ ID NO: 701940 - RNA, 23 nt, Human
ccgggccucugguuuccacuuug

SEQ ID NO: 701941 - RNA, 23 nt, Human
ccguagcugcgcucuugccccca

SEQ ID NO: 701942 - RNA, 20 nt, Human
ccuccagcgccaccagcucc

SEQ ID NO: 701943 - RNA, 19 nt, Human
ccuccauguucccaccagc

SEQ ID NO: 701944 - RNA, 24 nt, Human
ccucccagguucaagugauucucc

SEQ ID NO: 701945 - RNA, 25 nt, Human
cgagugguccucaggccuagcugca

SEQ ID NO: 701946 - RNA, 22 nt, Human
cgccucccagguucaagugauu

SEQ ID NO: 701947 - RNA, 21 nt, Human
cgcucuugcccccacgugcgc

SEQ ID NO: 701948 - RNA, 19 nt, Human
cggcgcacuggccgcccgc

SEQ ID NO: 701949 - RNA, 24 nt, Human
cgggguuucaccauauuggccagg

SEQ ID NO: 701950 - RNA, 26 nt, Human
cuacacaccugccuccacaggcuccc

SEQ ID NO: 701951 - RNA, 24 nt, Human
cucacugcaaccuccgccucccag

SEQ ID NO: 701952 - RNA, 22 nt, Human
cucagaucccccaccucccgaa

SEQ ID NO: 701953 - RNA, 21 nt, Human
cuccacugcucaagaggaccc

SEQ ID NO: 701954 - RNA, 18 nt, Human
cuccauguucccaccagc

SEQ ID NO: 701955 - RNA, 21 nt, Human
cucccaaauagcugagauuac

SEQ ID NO: 701956 - RNA, 24 nt, Human
cucccaauagagacgggguuucac

SEQ ID NO: 701957 - RNA, 18 nt, Human
cucccagguucaagugau

SEQ ID NO: 701958 - RNA, 20 nt, Human
cuccgcgcgcgccucguccu

SEQ ID NO: 701959 - RNA, 24 nt, Human
cuccucagccucccaaagugcugg

SEQ ID NO: 701960 - RNA, 22 nt, Human
cucggccgccggcgcacuuggc

SEQ ID NO: 701961 - RNA, 23 nt, Human
cucguagugcucaggcgccgacu

SEQ ID NO: 701962 - RNA, 18 nt, Human
cucuugaccucaugaucc

SEQ ID NO: 701963 - RNA, 19 nt, Human
cugauccuggcucccacgc

SEQ ID NO: 701964 - RNA, 23 nt, Human
cugcaaccuccgccucccagguu

SEQ ID NO: 701965 - RNA, 24 nt, Human
cugcaaccuccgccucccagguuc

SEQ ID NO: 701966 - RNA, 23 nt, Human
cugccucagccucccaaauagcu

SEQ ID NO: 701967 - RNA, 21 nt, Human
cuugcccccacgugcgccgga

SEQ ID NO: 701968 - RNA, 21 nt, Human
cuuguaaacaguggaaaucac

SEQ ID NO: 701969 - RNA, 21 nt, Human
gaaaucacaacugacauuugu

SEQ ID NO: 701970 - RNA, 22 nt, Human
gaccucaugauccgaccuccuc

SEQ ID NO: 701971 - RNA, 24 nt, Human
gagacgggguuucaccauauuggc

SEQ ID NO: 701972 - RNA, 20 nt, Human
gaggggcccggaauucuugc

SEQ ID NO: 701973 - RNA, 18 nt, Human
gauuacaggcacgagcca

SEQ ID NO: 701974 - RNA, 22 nt, Human
gauuacaggcacgagccacuau

SEQ ID NO: 701975 - RNA, 18 nt, Human
gauuacaggcgugagcca

SEQ ID NO: 701976 - RNA, 20 nt, Human
gauuacaggcgugagccacc

SEQ ID NO: 701977 - RNA, 24 nt, Human
gauuacaggcgugagccaccucgc

SEQ ID NO: 701978 - RNA, 18 nt, Human
gcagccagccagucgagc

SEQ ID NO: 701979 - RNA, 22 nt, Human
gccagccgcuccgcgcgcgccu

SEQ ID NO: 701980 - RNA, 20 nt, Human
gccauuagcuuugguugggg

SEQ ID NO: 701981 - RNA, 19 nt, Human
gcccaggcuggagugcagu

SEQ ID NO: 701982 - RNA, 23 nt, Human
gcccaggcuggagugcaguggca

SEQ ID NO: 701983 - RNA, 25 nt, Human
gccugucucugacccguggggguga

SEQ ID NO: 701984 - RNA, 25 nt, Human
gcucugucgcccaggcuggagugca

SEQ ID NO: 701985 - RNA, 21 nt, Human
gcugucugggaaugccacggc

SEQ ID NO: 701986 - RNA, 20 nt, Human
ggaagcgggauccaccugau

SEQ ID NO: 701987 - RNA, 21 nt, Human
ggagauggagccaggauguag

SEQ ID NO: 701988 - RNA, 23 nt, Human
ggcauuuuccacaccccccaccc

SEQ ID NO: 701989 - RNA, 18 nt, Human
ggggcugaagccgcccaa

SEQ ID NO: 701990 - RNA, 23 nt, Human
gggguuucaccauauuggccagg

SEQ ID NO: 701991 - RNA, 19 nt, Human
ggucucgaacucuugaccu

SEQ ID NO: 701992 - RNA, 23 nt, Human
gucagcccagcuccagcuccacu

SEQ ID NO: 701993 - RNA, 24 nt, Human
gugauucuccugccucagccuccc

SEQ ID NO: 701994 - RNA, 19 nt, Human
gugggagcgaggggcccgg

SEQ ID NO: 701995 - RNA, 24 nt, Human
uaauuuuuguacucccaauagaga

SEQ ID NO: 701996 - RNA, 18 nt, Human
uacaggcgugagccaccu

SEQ ID NO: 701997 - RNA, 18 nt, Human
uagccgagugguccucag

SEQ ID NO: 701998 - RNA, 19 nt, Human
ucaagugauucuccugccu

SEQ ID NO: 701999 - RNA, 19 nt, Human
ucacugcaaccuccgccuc

SEQ ID NO: 702000 - RNA, 23 nt, Human
ucacugcaaccuccgccucccag

SEQ ID NO: 702001 - RNA, 24 nt, Human
ucacugcaaccuccgccucccagg

SEQ ID NO: 702002 - RNA, 27 nt, Human
ucacugcaaccuccgccucccagguuc

SEQ ID NO: 702003 - RNA, 21 nt, Human
ucacuuguaaacaguggaaau

SEQ ID NO: 702004 - RNA, 21 nt, Human
ucagccucccaaauagcugag

SEQ ID NO: 702005 - RNA, 22 nt, Human
uccacaggcuccccaacacugg

SEQ ID NO: 702006 - RNA, 24 nt, Human
ucccaaagugcugggauuacaggc

SEQ ID NO: 702007 - RNA, 24 nt, Human
ucccaaauagcugagauuacaggc

SEQ ID NO: 702008 - RNA, 21 nt, Human
ucccagguucaagugauucuc

SEQ ID NO: 702009 - RNA, 24 nt, Human
ucccagguucaagugauucuccug

SEQ ID NO: 702010 - RNA, 18 nt, Human
uccccaacacuggccucc

SEQ ID NO: 702011 - RNA, 19 nt, Human
ucccugcuggguuguccaa

SEQ ID NO: 702012 - RNA, 19 nt, Human
uccgaccuccucagccucc

SEQ ID NO: 702013 - RNA, 18 nt, Human
uccgcgcgcgccucgucc

SEQ ID NO: 702014 - RNA, 21 nt, Human
uccucagccucccaaagugcu

SEQ ID NO: 702015 - RNA, 20 nt, Human
uccucggggcccggggugcc

SEQ ID NO: 702016 - RNA, 24 nt, Human
ucgcccaggcuggagugcaguggc

SEQ ID NO: 702017 - RNA, 18 nt, Human
ucgcgcgccuccagcgcc

SEQ ID NO: 702018 - RNA, 22 nt, Human
ucucagaucccccaccucccga

SEQ ID NO: 702019 - RNA, 23 nt, Human
ucucagaucccccaccucccgaa

SEQ ID NO: 702020 - RNA, 26 nt, Human
ucuccugccucagccucccaaauagc

SEQ ID NO: 702021 - RNA, 21 nt, Human
ucucgaacucuugaccucaug

SEQ ID NO: 702022 - RNA, 24 nt, Human
ucugucgcccaggcuggagugcag

SEQ ID NO: 702023 - RNA, 22 nt, Human
ucuugcucugucgcccaggcug

SEQ ID NO: 702024 - RNA, 23 nt, Human
ucuugcucugucgcccaggcugg

SEQ ID NO: 702025 - RNA, 24 nt, Human
ucuugcucugucgcccaggcugga

SEQ ID NO: 702026 - RNA, 18 nt, Human
ugaagccgcccaacuggc

SEQ ID NO: 702027 - RNA, 21 nt, Human
ugagauuacaggcacgagcca

SEQ ID NO: 702028 - RNA, 22 nt, Human
ugagauuacaggcacgagccac

SEQ ID NO: 702029 - RNA, 22 nt, Human
ugagauuacaggcacgagccac

SEQ ID NO: 702030 - RNA, 23 nt, Human
ugagauuacaggcacgagccacu

SEQ ID NO: 702031 - RNA, 24 nt, Human
ugagauuacaggcacgagccacua

SEQ ID NO: 702032 - RNA, 26 nt, Human
ugagauuacaggcacgagccacuaug

SEQ ID NO: 702033 - RNA, 23 nt, Human
ugagccugaggcccagaccccgg

SEQ ID NO: 702034 - RNA, 26 nt, Human
ugauccgaccuccucagccucccaaa

SEQ ID NO: 702035 - RNA, 20 nt, Human
ugauucuccugccucagccu

SEQ ID NO: 702036 - RNA, 22 nt, Human
ugcaguggcacgaucucggcuc

SEQ ID NO: 702037 - RNA, 23 nt, Human
ugccacggcccuggauuagucac

SEQ ID NO: 702038 - RNA, 23 nt, Human
ugcccaauagaaagaggcggcgc

SEQ ID NO: 702039 - RNA, 27 nt, Human
ugccucagccucccaaauagcugagau

SEQ ID NO: 702040 - RNA, 24 nt, Human
ugcucugucgcccaggcuggagug

SEQ ID NO: 702041 - RNA, 24 nt, Human
ugcugggauuacaggcgugagcca

SEQ ID NO: 702042 - RNA, 21 nt, Human
uggaggcccggggcugaagcc

SEQ ID NO: 702043 - RNA, 23 nt, Human
uggagugcaguggcacgaucucg

SEQ ID NO: 702044 - RNA, 24 nt, Human
uggagugcaguggcacgaucucgg

SEQ ID NO: 702045 - RNA, 24 nt, Human
uggccaggcuggucucgaacucuu

SEQ ID NO: 702046 - RNA, 22 nt, Human
uggccggagaacagguggcggc

SEQ ID NO: 702047 - RNA, 24 nt, Human
uggccuccauguucccaccagccu

SEQ ID NO: 702048 - RNA, 25 nt, Human
uggcucccacgcucccaggucuccc

SEQ ID NO: 702049 - RNA, 18 nt, Human
ugggauuacaggcgugag

SEQ ID NO: 702050 - RNA, 19 nt, Human
ugggauuacaggcgugagc

SEQ ID NO: 702051 - RNA, 21 nt, Human
ugggauuacaggcgugagcca

SEQ ID NO: 702052 - RNA, 22 nt, Human
ugggauuacaggcgugagccac

SEQ ID NO: 702053 - RNA, 23 nt, Human
ugggauuacaggcgugagccacc

SEQ ID NO: 702054 - RNA, 23 nt, Human
ugggauuacaggcgugagccacc

SEQ ID NO: 702055 - RNA, 26 nt, Human
ugggauuacaggcgugagccaccucg

SEQ ID NO: 702056 - RNA, 27 nt, Human
ugggauuacaggcgugagccaccucgc

SEQ ID NO: 702057 - RNA, 20 nt, Human
ugggcaggacguaagguacc

SEQ ID NO: 702058 - RNA, 21 nt, Human
uguaaacaguggaaaucacaa

SEQ ID NO: 702059 - RNA, 21 nt, Human
uucaagugauucuccugccuc

SEQ ID NO: 702060 - RNA, 23 nt, Human
uucaagugauucuccugccucag

SEQ ID NO: 702061 - RNA, 24 nt, Human
uucaagugauucuccugccucagc

SEQ ID NO: 702062 - RNA, 24 nt, Human
uugcucugucgcccaggcuggagu

SEQ ID NO: 702063 - RNA, 20 nt, Human
uuggaggcccggggcugaag

SEQ ID NO: 702064 - RNA, 24 nt, Human
uuucaccauauuggccaggcuggu

SEQ ID NO: 702065 - RNA, 20 nt, Human
uuugguuggggugagugugg

SEQ ID NO: 702066 - RNA, 18 nt, Human
uuuuccacaccccccacc

SEQ ID NO: 702067 - RNA, 21 nt, Human
aaaaccagcagcuuacaaucc

SEQ ID NO: 702068 - RNA, 20 nt, Human
aaaagaguagagcuaacuca

SEQ ID NO: 702069 - RNA, 24 nt, Human
aaacaaaaagaagcauuuccccca

SEQ ID NO: 702070 - RNA, 19 nt, Human
aaggaaaugauaaaauagc

SEQ ID NO: 702071 - RNA, 21 nt, Human
auaaugaacagcucuacuaua

SEQ ID NO: 702072 - RNA, 22 nt, Human
auacauuuuuauaagagaaaaa

SEQ ID NO: 702073 - RNA, 18 nt, Human
aucuuaacaagugugaaa

SEQ ID NO: 702074 - RNA, 21 nt, Human
auggcauuugaaagcaaacac

SEQ ID NO: 702075 - RNA, 24 nt, Human
cacugugcauuguaacaauaaggc

SEQ ID NO: 702076 - RNA, 20 nt, Human
cagaacgcagagccccuccg

SEQ ID NO: 702077 - RNA, 22 nt, Human
cagagccccuccgggccuucuc

SEQ ID NO: 702078 - RNA, 24 nt, Human
cagcgccacuacagaacgcagagc

SEQ ID NO: 702079 - RNA, 25 nt, Human
cagcucuacuauaacaaagaauaau

SEQ ID NO: 702080 - RNA, 22 nt, Human
ccaagcagcgccacuacagaac

SEQ ID NO: 702081 - RNA, 22 nt, Human
ccagcagcuuacaauccgccac

SEQ ID NO: 702082 - RNA, 23 nt, Human
ccgcucuucccagccgcaaaacc

SEQ ID NO: 702083 - RNA, 23 nt, Human
cucgccgcucuucccagccgcaa

SEQ ID NO: 702084 - RNA, 24 nt, Human
cucuucccagccgcaaaaccagca

SEQ ID NO: 702085 - RNA, 23 nt, Human
gaaauauccauaaugaacagcuc

SEQ ID NO: 702086 - RNA, 23 nt, Human
gaacauaucacaguaucaaauac

SEQ ID NO: 702087 - RNA, 20 nt, Human
gaacccucucgccgcucuuc

SEQ ID NO: 702088 - RNA, 23 nt, Human
gcaaaaccagcagcuuacaaucc

SEQ ID NO: 702089 - RNA, 23 nt, Human
gcagcagaaauauccauaaugaa

SEQ ID NO: 702090 - RNA, 22 nt, Human
gcgccacuacagaacgcagagc

SEQ ID NO: 702091 - RNA, 18 nt, Human
uaaaaaaaaauccaguuu

SEQ ID NO: 702092 - RNA, 20 nt, Human
uaacaagugugaaaaguacu

SEQ ID NO: 702093 - RNA, 18 nt, Human
uaacucaguaacaggcaa

SEQ ID NO: 702094 - RNA, 22 nt, Human
uaagagaaaaauaugaaggaaa

SEQ ID NO: 702095 - RNA, 23 nt, Human
uacccaaucuuuugccaaaauua

SEQ ID NO: 702096 - RNA, 20 nt, Human
uagauagaacuaaaugauca

SEQ ID NO: 702097 - RNA, 21 nt, Human
uaucacaaacaaaaagaagca

SEQ ID NO: 702098 - RNA, 19 nt, Human
uaucacaguaucaaauaca

SEQ ID NO: 702099 - RNA, 18 nt, Human
ucacaaacaaaaagaagc

SEQ ID NO: 702100 - RNA, 27 nt, Human
ucauaauauuccaaauguaugacaguu

SEQ ID NO: 702101 - RNA, 18 nt, Human
uccacugugcauuguaac

SEQ ID NO: 702102 - RNA, 18 nt, Human
ugaaaaguacuugcucuc

SEQ ID NO: 702103 - RNA, 22 nt, Human
uggccaaauuuuaucaaaaauc

SEQ ID NO: 702104 - RNA, 23 nt, Human
ugggaaacugcucuuuauuuaga

SEQ ID NO: 702105 - RNA, 21 nt, Human
uuugccaaaauuaauuuagau

SEQ ID NO: 702106 - RNA, 19 nt, Human
uuugugggaaacugcucuu

SEQ ID NO: 702107 - RNA, 18 nt, Human
uuuuuuuuuuuuuuuuug

SEQ ID NO: 702108 - RNA, 19 nt, Human
uuuuuuuuuuuuuuuuugu

SEQ ID NO: 702109 - RNA, 25 nt, Human
uuuuuuuuuuuuuuuuuuuuguggg

SEQ ID NO: 702110 - RNA, 18 nt, Human
aaaccgagacgauaaaag

SEQ ID NO: 702111 - RNA, 19 nt, Human
aagugggaggcaggcaugg

SEQ ID NO: 702112 - RNA, 22 nt, Human
aagugggaggcaggcauggugc

SEQ ID NO: 702113 - RNA, 23 nt, Human
aaucaauauuuuuguuugaaaga

SEQ ID NO: 702114 - RNA, 22 nt, Human
acaggaaugcagggacguucug

SEQ ID NO: 702115 - RNA, 21 nt, Human
acaguagcagccccauccaga

SEQ ID NO: 702116 - RNA, 24 nt, Human
agaaggccagucuguccaugaaag

SEQ ID NO: 702117 - RNA, 20 nt, Human
agacaggaaugcagggacgu

SEQ ID NO: 702118 - RNA, 24 nt, Human
agcagcagggacagccaaguggga

SEQ ID NO: 702119 - RNA, 24 nt, Human
aggaagaccacuccggagggccac

SEQ ID NO: 702120 - RNA, 24 nt, Human
caaauuuauaguacagcuaagaag

SEQ ID NO: 702121 - RNA, 18 nt, Human
cacaccuggggaggcccc

SEQ ID NO: 702122 - RNA, 21 nt, Human
cacaguagcagccccauccag

SEQ ID NO: 702123 - RNA, 20 nt, Human
caccuggggaggccccuggu

SEQ ID NO: 702124 - RNA, 19 nt, Human
cagcagcagggacagccaa

SEQ ID NO: 702125 - RNA, 22 nt, Human
cagccccacaguagcagcccca

SEQ ID NO: 702126 - RNA, 19 nt, Human
cagccccauccagaggaag

SEQ ID NO: 702127 - RNA, 19 nt, Human
caggcccggagccccaggc

SEQ ID NO: 702128 - RNA, 24 nt, Human
caggcccggagccccaggcgcugg

SEQ ID NO: 702129 - RNA, 21 nt, Human
cauggugcacaccuggggagg

SEQ ID NO: 702130 - RNA, 18 nt, Human
ccacacuucugcagcauc

SEQ ID NO: 702131 - RNA, 20 nt, Human
cccugcgucuucugguuccg

SEQ ID NO: 702132 - RNA, 20 nt, Human
ccgagacgauaaaagaacaa

SEQ ID NO: 702133 - RNA, 21 nt, Human
ccgggccggguagccuucguc

SEQ ID NO: 702134 - RNA, 26 nt, Human
ccucugcagcccuggcacugccgccc

SEQ ID NO: 702135 - RNA, 22 nt, Human
ccugugccaaguguccuugggg

SEQ ID NO: 702136 - RNA, 21 nt, Human
ccuucgucucggagccgggcg

SEQ ID NO: 702137 - RNA, 23 nt, Human
cgcccagcccuccaucucagcgg

SEQ ID NO: 702138 - RNA, 18 nt, Human
cggggcagaaacgcggcg

SEQ ID NO: 702139 - RNA, 24 nt, Human
cggggcccuaaaagcagaaaucaa

SEQ ID NO: 702140 - RNA, 21 nt, Human
cucugcagcccuggcacugcc

SEQ ID NO: 702141 - RNA, 18 nt, Human
cugcagcccuggcacugc

SEQ ID NO: 702142 - RNA, 21 nt, Human
cuggcuaagugagcugggcuc

SEQ ID NO: 702143 - RNA, 23 nt, Human
gcagccccauccagaggaagacc

SEQ ID NO: 702144 - RNA, 21 nt, Human
gccccauccagaggaagacca

SEQ ID NO: 702145 - RNA, 22 nt, Human
gcggaagugaggaggagggucc

SEQ ID NO: 702146 - RNA, 18 nt, Human
gcuggcuaagugagcugg

SEQ ID NO: 702147 - RNA, 19 nt, Human
ggccacaggccucugcagc

SEQ ID NO: 702148 - RNA, 28 nt, Human
gggacagccaagugggaggcaggcaugg

SEQ ID NO: 702149 - RNA, 21 nt, Human
ggugcacaccuggggaggccc

SEQ ID NO: 702150 - RNA, 22 nt, Human
gugcaggcccggagccccaggc

SEQ ID NO: 702151 - RNA, 19 nt, Human
guguccuuggggucccgcc

SEQ ID NO: 702152 - RNA, 25 nt, Human
uaaaagcagaaaucaauauuuuugg

SEQ ID NO: 702153 - RNA, 20 nt, Human
uagcagccccauccagagga

SEQ ID NO: 702154 - RNA, 22 nt, Human
uauaguacagcuaagaaggcca

SEQ ID NO: 702155 - RNA, 22 nt, Human
uccagaggaagaccacuccgga

SEQ ID NO: 702156 - RNA, 20 nt, Human
uccaugaaagggagccgagg

SEQ ID NO: 702157 - RNA, 23 nt, Human
ucccuuuaugucuggauggaaac

SEQ ID NO: 702158 - RNA, 22 nt, Human
uccuuggggucccgccaugguc

SEQ ID NO: 702159 - RNA, 21 nt, Human
ugcaggcccggagccccaggc

SEQ ID NO: 702160 - RNA, 23 nt, Human
ugcaggcccggagccccaggcgc

SEQ ID NO: 702161 - RNA, 23 nt, Human
uggggaggccccuggugcagaag

SEQ ID NO: 702162 - RNA, 22 nt, Human
uggugcagaagcagccccacag

SEQ ID NO: 702163 - RNA, 18 nt, Human
uguggccggguccugccc

SEQ ID NO: 702164 - RNA, 18 nt, Human
uugaaagaugcagucaug

SEQ ID NO: 702165 - RNA, 22 nt, Human
uugaagccagcauuucccuuua

SEQ ID NO: 702166 - RNA, 23 nt, Human
uuggcuaaaaccgagacgauaaa

SEQ ID NO: 702167 - RNA, 20 nt, Human
uuuuuuuuuugaagccagca

SEQ ID NO: 702168 - RNA, 18 nt, Human
uuuuuuuuuuuuuuuuug

SEQ ID NO: 702169 - RNA, 21 nt, Human
aaagcaaagcagaugagguca

SEQ ID NO: 702170 - RNA, 19 nt, Human
aaagcagaugaggucagcc

SEQ ID NO: 702171 - RNA, 20 nt, Human
aaagcagaugaggucagccc

SEQ ID NO: 702172 - RNA, 20 nt, Human
acaugccaaagcaaagcaga

SEQ ID NO: 702173 - RNA, 22 nt, Human
aggaggaggggguaaucuagaa

SEQ ID NO: 702174 - RNA, 21 nt, Human
aggcaaggcucacaugccaaa

SEQ ID NO: 702175 - RNA, 19 nt, Human
augcccccuuaggcaaggc

SEQ ID NO: 702176 - RNA, 21 nt, Human
caaagcaaagcagaugagguc

SEQ ID NO: 702177 - RNA, 20 nt, Human
caaagcagaugaggucagcc

SEQ ID NO: 702178 - RNA, 22 nt, Human
cagauaugcccccuuaggcaag

SEQ ID NO: 702179 - RNA, 22 nt, Human
cagcccauggggacagagucag

SEQ ID NO: 702180 - RNA, 21 nt, Human
ccaaagcaaagcagaugaggu

SEQ ID NO: 702181 - RNA, 19 nt, Human
ccgcccgaggcgcccgcgg

SEQ ID NO: 702182 - RNA, 23 nt, Human
ccucccugggcaauggaaagagc

SEQ ID NO: 702183 - RNA, 24 nt, Human
cgaggcgcccgcggagaaaacccu

SEQ ID NO: 702184 - RNA, 18 nt, Human
cgcccgcggagaaaaccc

SEQ ID NO: 702185 - RNA, 23 nt, Human
cuagggacccagauaugcccccu

SEQ ID NO: 702186 - RNA, 21 nt, Human
cuagggccuucuagggaccca

SEQ ID NO: 702187 - RNA, 19 nt, Human
cucacaugccaaagcaaag

SEQ ID NO: 702188 - RNA, 20 nt, Human
cucacaugccaaagcaaagc

SEQ ID NO: 702189 - RNA, 18 nt, Human
gaggcgcccgcggagaaa

SEQ ID NO: 702190 - RNA, 20 nt, Human
gcaauggaaagagcuuugga

SEQ ID NO: 702191 - RNA, 23 nt, Human
ggcaauggaaagagcuuuggaga

SEQ ID NO: 702192 - RNA, 23 nt, Human
uaaaaaagagcgagcguguggca

SEQ ID NO: 702193 - RNA, 22 nt, Human
uaaucuagaagccccacaucua

SEQ ID NO: 702194 - RNA, 18 nt, Human
ucacaugccaaagcaaag

SEQ ID NO: 702195 - RNA, 19 nt, Human
ucuccagguuccgcccgag

SEQ ID NO: 702196 - RNA, 20 nt, Human
uggagaccagcccaugggga

SEQ ID NO: 702197 - RNA, 19 nt, Human
uggcaggaggaggggguaa

SEQ ID NO: 702198 - RNA, 27 nt, Human
uuuuuuuuuuuuuuuuuuuuuuugggg

SEQ ID NO: 702199 - RNA, 20 nt, Human
agggaguugcugguuuauuu

SEQ ID NO: 702200 - RNA, 21 nt, Human
cagcagcacaugggggccucg

SEQ ID NO: 702201 - RNA, 20 nt, Human
caucuuggccacucagcagc

SEQ ID NO: 702202 - RNA, 21 nt, Human
cccccaguguauagggcagcc

SEQ ID NO: 702203 - RNA, 20 nt, Human
ccucagacagagacggguca

SEQ ID NO: 702204 - RNA, 22 nt, Human
cuccagggguguggagcgugcc

SEQ ID NO: 702205 - RNA, 19 nt, Human
cuggcaucaucuuggccac

SEQ ID NO: 702206 - RNA, 18 nt, Human
guauagggcagccuggca

SEQ ID NO: 702207 - RNA, 18 nt, Human
guggagcgugccgaggcc

SEQ ID NO: 702208 - RNA, 22 nt, Human
uaggagccuggguccagccccc

SEQ ID NO: 702209 - RNA, 19 nt, Human
uggccacucagcagcacau

SEQ ID NO: 702210 - RNA, 22 nt, Human
aaccugcugcuuucccuucuuu

SEQ ID NO: 702211 - RNA, 25 nt, Human
aagaagccccaaccugcugcuuucc

SEQ ID NO: 702212 - RNA, 22 nt, Human
aagaauucagccucccuuaacc

SEQ ID NO: 702213 - RNA, 18 nt, Human
accugcugcuuucccuuc

SEQ ID NO: 702214 - RNA, 22 nt, Human
cccaaccugcugcuuucccuuc

SEQ ID NO: 702215 - RNA, 21 nt, Human
cuccaagaauucagccucccu

SEQ ID NO: 702216 - RNA, 22 nt, Human
cuggugacaggcucugaaguug

SEQ ID NO: 702217 - RNA, 24 nt, Human
gcaaaguuuucugugucauuaaaa

SEQ ID NO: 702218 - RNA, 24 nt, Human
uccaagaauucagccucccuuaac

SEQ ID NO: 702219 - RNA, 26 nt, Human
ucccuucagcuccaagaauucagccu

SEQ ID NO: 702220 - RNA, 22 nt, Human
ugaaacuacaggauuccuuccg

SEQ ID NO: 702221 - RNA, 18 nt, Human
ugcaaaggugaugcagca

SEQ ID NO: 702222 - RNA, 20 nt, Human
ugccuucaguuuuaggaccu

SEQ ID NO: 702223 - RNA, 22 nt, Human
uggaaugaaguuuucccuucag

SEQ ID NO: 702224 - RNA, 24 nt, Human
uggcaaaguugcaaaggugaugca

SEQ ID NO: 702225 - RNA, 18 nt, Human
uggccacaagaagcccca

SEQ ID NO: 702226 - RNA, 23 nt, Human
uggccacaagaagccccaaccug

SEQ ID NO: 702227 - RNA, 23 nt, Human
uuggaaugaaguuuucccuucag

SEQ ID NO: 702228 - RNA, 18 nt, Human
aagugccuugcgcuagaa

SEQ ID NO: 702229 - RNA, 20 nt, Human
aauuuuauuuuucuucccac

SEQ ID NO: 702230 - RNA, 19 nt, Human
acccucuugguggggccug

SEQ ID NO: 702231 - RNA, 22 nt, Human
accugaaggaaauuuuauuuuu

SEQ ID NO: 702232 - RNA, 18 nt, Human
agggacagggaggggcug

SEQ ID NO: 702233 - RNA, 21 nt, Human
caccccagaaguugucccgag

SEQ ID NO: 702234 - RNA, 21 nt, Human
caccccgaggggcagacagug

SEQ ID NO: 702235 - RNA, 20 nt, Human
caggagaagugcccgcggcg

SEQ ID NO: 702236 - RNA, 22 nt, Human
ccagaaguugucccgagcccag

SEQ ID NO: 702237 - RNA, 25 nt, Human
ccccaccccagaaguugucccgagc

SEQ ID NO: 702238 - RNA, 23 nt, Human
ccuaggccaagaggcggagaggc

SEQ ID NO: 702239 - RNA, 22 nt, Human
ccucacuggaacaucuuucuca

SEQ ID NO: 702240 - RNA, 23 nt, Human
cgaaaccccuccgagagggcugg

SEQ ID NO: 702241 - RNA, 23 nt, Human
cgagcgggcgcgggcggcgagcc

SEQ ID NO: 702242 - RNA, 22 nt, Human
cgcagcuucuucccuucggucc

SEQ ID NO: 702243 - RNA, 25 nt, Human
cggcggcaggagccgcaaacuuucu

SEQ ID NO: 702244 - RNA, 23 nt, Human
cggggagagcccaggagaagugc

SEQ ID NO: 702245 - RNA, 19 nt, Human
cuacagcccggcccaggug

SEQ ID NO: 702246 - RNA, 25 nt, Human
cuccuaggccaagaggcggagaggc

SEQ ID NO: 702247 - RNA, 20 nt, Human
cucgaagggacagggagggg

SEQ ID NO: 702248 - RNA, 20 nt, Human
cuugcgcuagaauuucugac

SEQ ID NO: 702249 - RNA, 22 nt, Human
cuuugcaccccaccccagaagu

SEQ ID NO: 702250 - RNA, 21 nt, Human
gaacgagcgggcgcgggcggc

SEQ ID NO: 702251 - RNA, 22 nt, Human
gaaguugucccgagcccagggc

SEQ ID NO: 702252 - RNA, 22 nt, Human
gagcccagggcggggaaggcgg

SEQ ID NO: 702253 - RNA, 22 nt, Human
gagccuccuaggccaagacccu

SEQ ID NO: 702254 - RNA, 24 nt, Human
gcgcagcuucuucccuucgguccg

SEQ ID NO: 702255 - RNA, 26 nt, Human
gcggcgcgcagggagacggacgacac

SEQ ID NO: 702256 - RNA, 18 nt, Human
gcgggcgcgggcggcgag

SEQ ID NO: 702257 - RNA, 20 nt, Human
ggcuggugugucacguuucu

SEQ ID NO: 702258 - RNA, 21 nt, Human
gggcggcgagccuccuaggcc

SEQ ID NO: 702259 - RNA, 18 nt, Human
ggugugauccacccucuu

SEQ ID NO: 702260 - RNA, 21 nt, Human
uacagcccggcccaggugucc

SEQ ID NO: 702261 - RNA, 22 nt, Human
ucaaucaagugggcaaaccuga

SEQ ID NO: 702262 - RNA, 20 nt, Human
ucucggggcaggacgcgguc

SEQ ID NO: 702263 - RNA, 20 nt, Human
ugaggugugauccacccucu

SEQ ID NO: 702264 - RNA, 19 nt, Human
ugcaccccaccccagaagu

SEQ ID NO: 702265 - RNA, 18 nt, Human
ugcccgcggcgcgcaggg

SEQ ID NO: 702266 - RNA, 22 nt, Human
ugcccguuguuguccuggacuc

SEQ ID NO: 702267 - RNA, 20 nt, Human
ugcgcuagaauuucugacac

SEQ ID NO: 702268 - RNA, 19 nt, Human
uggggccuggagagcuucu

SEQ ID NO: 702269 - RNA, 23 nt, Human
ugguggggccuggagagcuucuu

SEQ ID NO: 702270 - RNA, 20 nt, Human
ugucccgagcccagggcggg

SEQ ID NO: 702271 - RNA, 27 nt, Human
uguuugggggcugagagaucaggguuc

SEQ ID NO: 702272 - RNA, 19 nt, Human
uuggguagguguuuggggg

SEQ ID NO: 702273 - RNA, 22 nt, Human
uuuauuuuucuucccacugagg

SEQ ID NO: 702274 - RNA, 21 nt, Human
aaaacgcuaggacaaguacca

SEQ ID NO: 702275 - RNA, 20 nt, Human
aaaaucucuaagggaaacac

SEQ ID NO: 702276 - RNA, 21 nt, Human
aaaccuggcugaccuuccccg

SEQ ID NO: 702277 - RNA, 21 nt, Human
aaacugcaaacuauuuaaagu

SEQ ID NO: 702278 - RNA, 21 nt, Human
aaauucaaaagaauggagaug

SEQ ID NO: 702279 - RNA, 25 nt, Human
aagaaaggaaucauuuugcugaaua

SEQ ID NO: 702280 - RNA, 19 nt, Human
aagcaaagagaaaugggug

SEQ ID NO: 702281 - RNA, 24 nt, Human
aagggaaacacaagaucaaggugc

SEQ ID NO: 702282 - RNA, 23 nt, Human
aaggggaggggagggaggggaga

SEQ ID NO: 702283 - RNA, 18 nt, Human
accgugagaccucccaaa

SEQ ID NO: 702284 - RNA, 21 nt, Human
accgugagaccucccaaagac

SEQ ID NO: 702285 - RNA, 22 nt, Human
agagagacagagaauuauauag

SEQ ID NO: 702286 - RNA, 19 nt, Human
agcuucuucuguguguuuu

SEQ ID NO: 702287 - RNA, 18 nt, Human
aggaaucauuuugcugaa

SEQ ID NO: 702288 - RNA, 18 nt, Human
agggaaacacaagaucaa

SEQ ID NO: 702289 - RNA, 24 nt, Human
agggaaacacaagaucaaggugcu

SEQ ID NO: 702290 - RNA, 21 nt, Human
auagguucuuggcuagcggaa

SEQ ID NO: 702291 - RNA, 20 nt, Human
aucagcuuuacaaaaucucu

SEQ ID NO: 702292 - RNA, 24 nt, Human
auggagaagaaggggaggggaggg

SEQ ID NO: 702293 - RNA, 19 nt, Human
caaaacgcuaggacaagua

SEQ ID NO: 702294 - RNA, 21 nt, Human
caacuaucagcuuuacaaaau

SEQ ID NO: 702295 - RNA, 19 nt, Human
cacaugcauacauuuguau

SEQ ID NO: 702296 - RNA, 22 nt, Human
caccaaaaugcaaaaagacaaa

SEQ ID NO: 702297 - RNA, 19 nt, Human
cacccuguguaacccacag

SEQ ID NO: 702298 - RNA, 22 nt, Human
cacccuguguaacccacaggcc

SEQ ID NO: 702299 - RNA, 24 nt, Human
caggagagauccgaguggauggug

SEQ ID NO: 702300 - RNA, 18 nt, Human
cagggccucggcagaguc

SEQ ID NO: 702301 - RNA, 21 nt, Human
cauucugucagguguuggaag

SEQ ID NO: 702302 - RNA, 19 nt, Human
ccacagaaaaagggugugc

SEQ ID NO: 702303 - RNA, 22 nt, Human
ccacagaaaaagggugugcauu

SEQ ID NO: 702304 - RNA, 20 nt, Human
ccccugggguucucagggcc

SEQ ID NO: 702305 - RNA, 20 nt, Human
cccgguacccggcgcuccuc

SEQ ID NO: 702306 - RNA, 21 nt, Human
cccuggggggcgggaggcggg

SEQ ID NO: 702307 - RNA, 20 nt, Human
ccgaguggauggugaagugg

SEQ ID NO: 702308 - RNA, 23 nt, Human
ccuggggggcgggaggcggggcu

SEQ ID NO: 702309 - RNA, 19 nt, Human
ccugggguucucagggccu

SEQ ID NO: 702310 - RNA, 18 nt, Human
cgaguggauggugaagug

SEQ ID NO: 702311 - RNA, 24 nt, Human
cggccccugggguucucagggccu

SEQ ID NO: 702312 - RNA, 18 nt, Human
cggguggccucaaagcuc

SEQ ID NO: 702313 - RNA, 21 nt, Human
cguuguuuugcuggugccugu

SEQ ID NO: 702314 - RNA, 24 nt, Human
cuagaaaagccugcuuucucuuua

SEQ ID NO: 702315 - RNA, 18 nt, Human
cucccccggcccgguacc

SEQ ID NO: 702316 - RNA, 24 nt, Human
cucuacaccgugagaccucccaaa

SEQ ID NO: 702317 - RNA, 26 nt, Human
cucucuacaccgugagaccucccaaa

SEQ ID NO: 702318 - RNA, 22 nt, Human
cucuuguucuuuugaguaacca

SEQ ID NO: 702319 - RNA, 19 nt, Human
cugaagccugcagaagccc

SEQ ID NO: 702320 - RNA, 24 nt, Human
cugcuuugccuggggggggggggu

SEQ ID NO: 702321 - RNA, 20 nt, Human
cuuccccgagagcccgcggc

SEQ ID NO: 702322 - RNA, 22 nt, Human
cuuccccgccccuccucggccc

SEQ ID NO: 702323 - RNA, 18 nt, Human
gaccuuccccgccccucc

SEQ ID NO: 702324 - RNA, 19 nt, Human
gacgagauuucccucuggg

SEQ ID NO: 702325 - RNA, 20 nt, Human
gagaagaaggggaggggagg

SEQ ID NO: 702326 - RNA, 18 nt, Human
gaggagugacagaguuuc

SEQ ID NO: 702327 - RNA, 20 nt, Human
gaugaggaaauucaaaagaa

SEQ ID NO: 702328 - RNA, 24 nt, Human
gccauaagaaaucaagaaacaaag

SEQ ID NO: 702329 - RNA, 21 nt, Human
gcccuggggggcgggaggcgg

SEQ ID NO: 702330 - RNA, 24 nt, Human
gccgccuccgcagacuucucauuc

SEQ ID NO: 702331 - RNA, 20 nt, Human
gcggaagacaauucagaaca

SEQ ID NO: 702332 - RNA, 22 nt, Human
ggagaagaaggggaggggaggg

SEQ ID NO: 702333 - RNA, 19 nt, Human
ggagauggagaagaagggg

SEQ ID NO: 702334 - RNA, 18 nt, Human
gggagggaggggagagau

SEQ ID NO: 702335 - RNA, 23 nt, Human
ggggggggugcguagauacggga

SEQ ID NO: 702336 - RNA, 21 nt, Human
ggggugcguagauacgggauu

SEQ ID NO: 702337 - RNA, 23 nt, Human
ggugguucuggcaaaccuggcug

SEQ ID NO: 702338 - RNA, 22 nt, Human
uaaaaaaaucugugaauuuaac

SEQ ID NO: 702339 - RNA, 24 nt, Human
uaagaaaucaagaaacaaagaaaa

SEQ ID NO: 702340 - RNA, 24 nt, Human
uaagaacacaauaaacuucccucc

SEQ ID NO: 702341 - RNA, 18 nt, Human
uaagggaaacacaagauc

SEQ ID NO: 702342 - RNA, 22 nt, Human
uaauauguacacacauguacag

SEQ ID NO: 702343 - RNA, 22 nt, Human
uaccgcugcaggcacccugugu

SEQ ID NO: 702344 - RNA, 23 nt, Human
uagcaguaugcaaaaaaccaguu

SEQ ID NO: 702345 - RNA, 18 nt, Human
uaguucaacuaaaaggga

SEQ ID NO: 702346 - RNA, 20 nt, Human
uaucuuaacaucuucccuuu

SEQ ID NO: 702347 - RNA, 22 nt, Human
uaucuuaacaucuucccuuucu

SEQ ID NO: 702348 - RNA, 18 nt, Human
uaugaccuaaucuuuaau

SEQ ID NO: 702349 - RNA, 18 nt, Human
ucaagaaacaaagaaaag

SEQ ID NO: 702350 - RNA, 22 nt, Human
ucacaugcauacauuuguauac

SEQ ID NO: 702351 - RNA, 24 nt, Human
ucaggagagauccgaguggauggu

SEQ ID NO: 702352 - RNA, 21 nt, Human
ucagggccucggcagaguccc

SEQ ID NO: 702353 - RNA, 19 nt, Human
uccccgccccuccucggcc

SEQ ID NO: 702354 - RNA, 25 nt, Human
ucuacaccgugagaccucccaaaga

SEQ ID NO: 702355 - RNA, 28 nt, Human
ucuguauauuucacaugcauacagugug

SEQ ID NO: 702356 - RNA, 18 nt, Human
ucuuugguuugcucccga

SEQ ID NO: 702357 - RNA, 20 nt, Human
ucuuuguuugguugauuggu

SEQ ID NO: 702358 - RNA, 18 nt, Human
ugaaguggauggcugaag

SEQ ID NO: 702359 - RNA, 18 nt, Human
ugaccuaaucuuuaauga

SEQ ID NO: 702360 - RNA, 18 nt, Human
ugaccuuccccgccccuc

SEQ ID NO: 702361 - RNA, 21 nt, Human
ugaccuuccccgccccuccuc

SEQ ID NO: 702362 - RNA, 24 nt, Human
ugaguguccuuccgacgagauuuc

SEQ ID NO: 702363 - RNA, 21 nt, Human
ugcaggcacccuguguaaccc

SEQ ID NO: 702364 - RNA, 18 nt, Human
ugcauuuugcuuggcuuu

SEQ ID NO: 702365 - RNA, 22 nt, Human
ugcuccaacuaucagcuuuacu

SEQ ID NO: 702366 - RNA, 24 nt, Human
ugcuuggcuuugaacacguucacc

SEQ ID NO: 702367 - RNA, 22 nt, Human
uggagaagaaggggaggggagg

SEQ ID NO: 702368 - RNA, 23 nt, Human
uggagaagaaggggaggggaggg

SEQ ID NO: 702369 - RNA, 24 nt, Human
uggagaagaaggggaggggaggga

SEQ ID NO: 702370 - RNA, 21 nt, Human
uggcugaagccugcagaagcc

SEQ ID NO: 702371 - RNA, 21 nt, Human
uggggggcgggaggcggggcu

SEQ ID NO: 702372 - RNA, 23 nt, Human
uggggggcgggaggcggggcucg

SEQ ID NO: 702373 - RNA, 21 nt, Human
ugggugaauuuugugcgggug

SEQ ID NO: 702374 - RNA, 22 nt, Human
uguauacacaauaaaacugcaa

SEQ ID NO: 702375 - RNA, 18 nt, Human
uguauauuucacaugcau

SEQ ID NO: 702376 - RNA, 23 nt, Human
uguauauuucacaugcauacauu

SEQ ID NO: 702377 - RNA, 23 nt, Human
uguuuuccucuuccaaaacgcua

SEQ ID NO: 702378 - RNA, 23 nt, Human
uguuuuucucguuaaaaaaaucu

SEQ ID NO: 702379 - RNA, 18 nt, Human
uucaaaagaauggagaug

SEQ ID NO: 702380 - RNA, 22 nt, Human
uucaaaagaauggagauggaga

SEQ ID NO: 702381 - RNA, 24 nt, Human
uucaaauccaggcuagcuucgaaa

SEQ ID NO: 702382 - RNA, 19 nt, Human
uucaacuaaaagggauagc

SEQ ID NO: 702383 - RNA, 26 nt, Human
aaggaugaagagaagggguggauggg

SEQ ID NO: 702384 - RNA, 28 nt, Human
aaggaugaagagaagggguggauggggg

SEQ ID NO: 702385 - RNA, 18 nt, Human
aagggguggaugggaugg

SEQ ID NO: 702386 - RNA, 24 nt, Human
aaugaaggggacuccgaggaggga

SEQ ID NO: 702387 - RNA, 23 nt, Human
acaguaguaucucuuccaaccug

SEQ ID NO: 702388 - RNA, 23 nt, Human
agacagcagugaggguccagguu

SEQ ID NO: 702389 - RNA, 19 nt, Human
agcagaaaggaggcagaga

SEQ ID NO: 702390 - RNA, 22 nt, Human
agcagaaaggaggcagagacag

SEQ ID NO: 702391 - RNA, 26 nt, Human
agcauccucccauccuucccccaggc

SEQ ID NO: 702392 - RNA, 24 nt, Human
agccgucagugaggagcucucagg

SEQ ID NO: 702393 - RNA, 21 nt, Human
aggaggcagagacagcaguga

SEQ ID NO: 702394 - RNA, 24 nt, Human
agggaaggaugaagagaaggggug

SEQ ID NO: 702395 - RNA, 19 nt, Human
agggagugguggggugagg

SEQ ID NO: 702396 - RNA, 24 nt, Human
agggcgggcauggcugccgaggcc

SEQ ID NO: 702397 - RNA, 22 nt, Human
agggguggaugggaugggggca

SEQ ID NO: 702398 - RNA, 22 nt, Human
aggucauggggcuggaggguca

SEQ ID NO: 702399 - RNA, 19 nt, Human
auccucccauccuuccccc

SEQ ID NO: 702400 - RNA, 21 nt, Human
augaaggggacuccgaggagg

SEQ ID NO: 702401 - RNA, 18 nt, Human
augacacuacugcaacca

SEQ ID NO: 702402 - RNA, 20 nt, Human
caagacaagccaggccggcc

SEQ ID NO: 702403 - RNA, 18 nt, Human
caaggccuggguccaagc

SEQ ID NO: 702404 - RNA, 25 nt, Human
cacuacugcaaccaccccgccccaa

SEQ ID NO: 702405 - RNA, 19 nt, Human
cagaaaggaggcagagaca

SEQ ID NO: 702406 - RNA, 19 nt, Human
cagcagaaaggaggcagag

SEQ ID NO: 702407 - RNA, 21 nt, Human
cagcagaaaggaggcagagac

SEQ ID NO: 702408 - RNA, 21 nt, Human
cauucccucccaaggccuggg

SEQ ID NO: 702409 - RNA, 24 nt, Human
ccacaacacccccgccugggugag

SEQ ID NO: 702410 - RNA, 21 nt, Human
ccagagaccaaaauuggugcu

SEQ ID NO: 702411 - RNA, 20 nt, Human
cccacaacacccccgccugg

SEQ ID NO: 702412 - RNA, 18 nt, Human
cccaccauucccucccaa

SEQ ID NO: 702413 - RNA, 22 nt, Human
cccccaggccuucuggacccag

SEQ ID NO: 702414 - RNA, 21 nt, Human
cccggcuugggugcccaggga

SEQ ID NO: 702415 - RNA, 19 nt, Human
cccuucgugguuacggagg

SEQ ID NO: 702416 - RNA, 24 nt, Human
ccgccugggugagcucucggcugc

SEQ ID NO: 702417 - RNA, 20 nt, Human
ccucccauccuucccccagg

SEQ ID NO: 702418 - RNA, 21 nt, Human
ccuccccaccucguuuggggg

SEQ ID NO: 702419 - RNA, 19 nt, Human
ccuggcagggaggugggcc

SEQ ID NO: 702420 - RNA, 21 nt, Human
ccuuggcugcuggcccccugc

SEQ ID NO: 702421 - RNA, 22 nt, Human
cgauggccuguacccacaacac

SEQ ID NO: 702422 - RNA, 23 nt, Human
cgccccagugacugacaagacaa

SEQ ID NO: 702423 - RNA, 20 nt, Human
cuagaccccggcuugggugc

SEQ ID NO: 702424 - RNA, 18 nt, Human
cucaacgcccggcuacag

SEQ ID NO: 702425 - RNA, 22 nt, Human
cuccugccccagccccuuggcu

SEQ ID NO: 702426 - RNA, 21 nt, Human
cuucuggacccaggcuuucag

SEQ ID NO: 702427 - RNA, 19 nt, Human
gaaggaugaagagaagggg

SEQ ID NO: 702428 - RNA, 19 nt, Human
gaaggggacuccgaggagg

SEQ ID NO: 702429 - RNA, 22 nt, Human
gcaggucccuuccguucggccu

SEQ ID NO: 702430 - RNA, 22 nt, Human
gccccgcuacagccgcugccuc

SEQ ID NO: 702431 - RNA, 23 nt, Human
gcuggcccccugcuagaccccgg

SEQ ID NO: 702432 - RNA, 21 nt, Human
ggaggcagagacagcagugag

SEQ ID NO: 702433 - RNA, 22 nt, Human
ggagugguggggugaggggggg

SEQ ID NO: 702434 - RNA, 23 nt, Human
ggcgaagaguccguggaguugag

SEQ ID NO: 702435 - RNA, 21 nt, Human
ggcuacagccccgcuacagcc

SEQ ID NO: 702436 - RNA, 23 nt, Human
gggaauagggaaggaugaagaga

SEQ ID NO: 702437 - RNA, 18 nt, Human
ggggggcccagggcgggc

SEQ ID NO: 702438 - RNA, 18 nt, Human
guccaacgaagcgcggag

SEQ ID NO: 702439 - RNA, 24 nt, Human
gugacagcagaaaggaggcagaga

SEQ ID NO: 702440 - RNA, 19 nt, Human
uacagccccgcuacagccg

SEQ ID NO: 702441 - RNA, 21 nt, Human
uacugcaaccaccccgcccca

SEQ ID NO: 702442 - RNA, 23 nt, Human
uagaccccggcuugggugcccag

SEQ ID NO: 702443 - RNA, 20 nt, Human
ucacagggucgauggccugu

SEQ ID NO: 702444 - RNA, 22 nt, Human
ucacagggucgauggccuguac

SEQ ID NO: 702445 - RNA, 20 nt, Human
ucacgggagagagagagccc

SEQ ID NO: 702446 - RNA, 18 nt, Human
uccaagcauccucccauc

SEQ ID NO: 702447 - RNA, 18 nt, Human
uccagguuuacucuuugg

SEQ ID NO: 702448 - RNA, 19 nt, Human
ucccauccuucccccaggc

SEQ ID NO: 702449 - RNA, 19 nt, Human
ucccccaggccuucuggac

SEQ ID NO: 702450 - RNA, 20 nt, Human
ucccuuccguucggccuggc

SEQ ID NO: 702451 - RNA, 22 nt, Human
uccucccauccuucccccaggc

SEQ ID NO: 702452 - RNA, 22 nt, Human
ucuccugccccagccccuuggc

SEQ ID NO: 702453 - RNA, 24 nt, Human
ugaaggggacuccgaggagggagc

SEQ ID NO: 702454 - RNA, 22 nt, Human
ugacagcagaaaggaggcagag

SEQ ID NO: 702455 - RNA, 25 nt, Human
ugacaguauucugaagggcuccagc

SEQ ID NO: 702456 - RNA, 22 nt, Human
ugcccagggaguggugggguga

SEQ ID NO: 702457 - RNA, 19 nt, Human
ugccccagccccuuggcug

SEQ ID NO: 702458 - RNA, 23 nt, Human
ugccccagccccuuggcugcugg

SEQ ID NO: 702459 - RNA, 21 nt, Human
ugcuagaccccggcuugggug

SEQ ID NO: 702460 - RNA, 21 nt, Human
ugcuaugaacaggucaugggg

SEQ ID NO: 702461 - RNA, 21 nt, Human
uggagggagucacaggggagg

SEQ ID NO: 702462 - RNA, 19 nt, Human
uggcagggaggugggcccu

SEQ ID NO: 702463 - RNA, 21 nt, Human
uggggauggggggguugauga

SEQ ID NO: 702464 - RNA, 22 nt, Human
uggggugagggggggcccaggg

SEQ ID NO: 702465 - RNA, 18 nt, Human
ugguggggugaggggggg

SEQ ID NO: 702466 - RNA, 20 nt, Human
ugguggggugagggggggcc

SEQ ID NO: 702467 - RNA, 18 nt, Human
ugguggugacagcagaaa

SEQ ID NO: 702468 - RNA, 19 nt, Human
ugucuccugccccagcccc

SEQ ID NO: 702469 - RNA, 21 nt, Human
uguucccaccauucccuccca

SEQ ID NO: 702470 - RNA, 23 nt, Human
uuggcuacaguaguaucucuucc

SEQ ID NO: 702471 - RNA, 24 nt, Human
aaacaaaaaaagcagacuagaaaa

SEQ ID NO: 702472 - RNA, 24 nt, Human
aaagcauacuuuucauggaaccaa

SEQ ID NO: 702473 - RNA, 21 nt, Human
aaaucagguauuuauauuccu

SEQ ID NO: 702474 - RNA, 20 nt, Human
aacaguuaaaacacaaagca

SEQ ID NO: 702475 - RNA, 22 nt, Human
aacauacuccugcccuacacca

SEQ ID NO: 702476 - RNA, 18 nt, Human
aacuucuguucccucccu

SEQ ID NO: 702477 - RNA, 19 nt, Human
aagaagaaaagcuaauguu

SEQ ID NO: 702478 - RNA, 19 nt, Human
aagccauagaauauuuauu

SEQ ID NO: 702479 - RNA, 22 nt, Human
aagccugaaacacacaugaaua

SEQ ID NO: 702480 - RNA, 20 nt, Human
aaggucaaggcugcagugag

SEQ ID NO: 702481 - RNA, 18 nt, Human
aauucucuucagaaaggc

SEQ ID NO: 702482 - RNA, 25 nt, Human
aauuuugcaucucucccucuuacca

SEQ ID NO: 702483 - RNA, 19 nt, Human
acacaacauacuccugccc

SEQ ID NO: 702484 - RNA, 20 nt, Human
acaccuguaauuccaaaacc

SEQ ID NO: 702485 - RNA, 20 nt, Human
acagagcaagaacucaucuc

SEQ ID NO: 702486 - RNA, 22 nt, Human
acauguacugaaauggacaguu

SEQ ID NO: 702487 - RNA, 20 nt, Human
accuguaauuccaaaaccuu

SEQ ID NO: 702488 - RNA, 24 nt, Human
acugcacuccagccuaggugacag

SEQ ID NO: 702489 - RNA, 26 nt, Human
acugcacuccagccuaggugacagag

SEQ ID NO: 702490 - RNA, 23 nt, Human
agacaaaaauuuuaaauagagga

SEQ ID NO: 702491 - RNA, 22 nt, Human
agaguagagugugaaguagcuc

SEQ ID NO: 702492 - RNA, 23 nt, Human
agaucgauugaggccaggagcuc

SEQ ID NO: 702493 - RNA, 19 nt, Human
agcaaaaguaaguuucuca

SEQ ID NO: 702494 - RNA, 23 nt, Human
agcaaaauaugccacagcauaga

SEQ ID NO: 702495 - RNA, 24 nt, Human
agccugggcaacauagaaagaccc

SEQ ID NO: 702496 - RNA, 24 nt, Human
aggcacuugacauguacugaaaug

SEQ ID NO: 702497 - RNA, 25 nt, Human
aggcacuugacauguacugaaaugg

SEQ ID NO: 702498 - RNA, 24 nt, Human
aggcaugguggcucacaccuguaa

SEQ ID NO: 702499 - RNA, 23 nt, Human
aggcugcagugagccaugaucau

SEQ ID NO: 702500 - RNA, 19 nt, Human
auaaaggagcaaaaguaag

SEQ ID NO: 702501 - RNA, 23 nt, Human
auagaauauuuauugacauggaa

SEQ ID NO: 702502 - RNA, 20 nt, Human
auauaauucucuucagaaag

SEQ ID NO: 702503 - RNA, 23 nt, Human
aucaugccacugcacuccagccu

SEQ ID NO: 702504 - RNA, 19 nt, Human
augaauagaucauaaguuc

SEQ ID NO: 702505 - RNA, 19 nt, Human
augaauuaucaccucagca

SEQ ID NO: 702506 - RNA, 22 nt, Human
augccacugcacuccagccuag

SEQ ID NO: 702507 - RNA, 20 nt, Human
augccugucuguaaucccag

SEQ ID NO: 702508 - RNA, 19 nt, Human
auucugccaccucuauccc

SEQ ID NO: 702509 - RNA, 20 nt, Human
caaaaaaagcagacuagaaa

SEQ ID NO: 702510 - RNA, 24 nt, Human
caaaaaaagcagacuagaaaauca

SEQ ID NO: 702511 - RNA, 21 nt, Human
caacauacuccugcccuacac

SEQ ID NO: 702512 - RNA, 19 nt, Human
caacauagaaagacccuau

SEQ ID NO: 702513 - RNA, 22 nt, Human
caacauagaaagacccuaucuu

SEQ ID NO: 702514 - RNA, 27 nt, Human
cacaaagcauacuuuucauggaaccaa

SEQ ID NO: 702515 - RNA, 24 nt, Human
cacaccuguaauuccaaaaccuug

SEQ ID NO: 702516 - RNA, 24 nt, Human
cacagccuaacuucuaucauaguu

SEQ ID NO: 702517 - RNA, 18 nt, Human
caccaucccaaaguugcc

SEQ ID NO: 702518 - RNA, 19 nt, Human
caccuguaauuccaaaacc

SEQ ID NO: 702519 - RNA, 21 nt, Human
caccuguaauuccaaaaccuu

SEQ ID NO: 702520 - RNA, 20 nt, Human
cacuauauauaccucaaagc

SEQ ID NO: 702521 - RNA, 19 nt, Human
cacugcacuccagccuagg

SEQ ID NO: 702522 - RNA, 19 nt, Human
cacugcacuccagccuagg

SEQ ID NO: 702523 - RNA, 23 nt, Human
cacugcacuccagccuaggugac

SEQ ID NO: 702524 - RNA, 24 nt, Human
cacugcacuccagccuaggugaca

SEQ ID NO: 702525 - RNA, 25 nt, Human
cacugcacuccagccuaggugacag

SEQ ID NO: 702526 - RNA, 21 nt, Human
cagagaaaagagaaaaagacc

SEQ ID NO: 702527 - RNA, 19 nt, Human
cagaugauauaaccaagaa

SEQ ID NO: 702528 - RNA, 21 nt, Human
cagauggauacuccuggauuu

SEQ ID NO: 702529 - RNA, 21 nt, Human
cagcuucugcaauucccaucu

SEQ ID NO: 702530 - RNA, 23 nt, Human
caggccaggcaugguggcucaca

SEQ ID NO: 702531 - RNA, 23 nt, Human
cauucugccaccucuaucccacu

SEQ ID NO: 702532 - RNA, 23 nt, Human
ccaccucuaucccacucuacgaa

SEQ ID NO: 702533 - RNA, 19 nt, Human
ccacugcacuccagccuag

SEQ ID NO: 702534 - RNA, 20 nt, Human
ccacugcacuccagccuagg

SEQ ID NO: 702535 - RNA, 20 nt, Human
ccacugcacuccagccuagg

SEQ ID NO: 702536 - RNA, 21 nt, Human
ccacugcacuccagccuaggu

SEQ ID NO: 702537 - RNA, 24 nt, Human
ccacugcacuccagccuaggugac

SEQ ID NO: 702538 - RNA, 19 nt, Human
ccagccaauugacuuuagg

SEQ ID NO: 702539 - RNA, 22 nt, Human
ccauuugccacagccuaacuuc

SEQ ID NO: 702540 - RNA, 22 nt, Human
cccaaauaagccugaaacacac

SEQ ID NO: 702541 - RNA, 25 nt, Human
ccccuggaccugcccugcagccgcc

SEQ ID NO: 702542 - RNA, 22 nt, Human
ccugggcaacauagaaagaccc

SEQ ID NO: 702543 - RNA, 24 nt, Human
cucacaccuguaauuccaaaaccu

SEQ ID NO: 702544 - RNA, 19 nt, Human
cucccaaauaagccugaaa

SEQ ID NO: 702545 - RNA, 18 nt, Human
cuguaaucccagcuacuu

SEQ ID NO: 702546 - RNA, 20 nt, Human
cuguaaucccagcuacuugg

SEQ ID NO: 702547 - RNA, 21 nt, Human
gaucaugccacugcacuccag

SEQ ID NO: 702548 - RNA, 20 nt, Human
gaugaaguggugauuaaguu

SEQ ID NO: 702549 - RNA, 24 nt, Human
gcacuccagccuaggugacagagc

SEQ ID NO: 702550 - RNA, 19 nt, Human
gccaugaucaugccacugc

SEQ ID NO: 702551 - RNA, 21 nt, Human
gcuccuucucucugcaaaauc

SEQ ID NO: 702552 - RNA, 23 nt, Human
gcuggaaggucaaggcugcagug

SEQ ID NO: 702553 - RNA, 21 nt, Human
gggaaaaaaugggggggaggg

SEQ ID NO: 702554 - RNA, 23 nt, Human
gguggcucacaccuguaauucca

SEQ ID NO: 702555 - RNA, 23 nt, Human
guaaagcuauuuacuauaaccuu

SEQ ID NO: 702556 - RNA, 20 nt, Human
guagagugugaaguagcucc

SEQ ID NO: 702557 - RNA, 20 nt, Human
gugaagaucacaagaaaggu

SEQ ID NO: 702558 - RNA, 22 nt, Human
uaaaaaaaaaauaauauaagga

SEQ ID NO: 702559 - RNA, 20 nt, Human
uaaaaauaccaacgguaagg

SEQ ID NO: 702560 - RNA, 24 nt, Human
uaaagguaaaacaucagagaaaag

SEQ ID NO: 702561 - RNA, 18 nt, Human
uaacaaaggcacuugaca

SEQ ID NO: 702562 - RNA, 23 nt, Human
uaacacacuauaaaauaugucaa

SEQ ID NO: 702563 - RNA, 24 nt, Human
uaacaguuaaaacacaaagcauac

SEQ ID NO: 702564 - RNA, 20 nt, Human
uaaccaagaagaaaagcuaa

SEQ ID NO: 702565 - RNA, 23 nt, Human
uacacaacauacuccugcccuac

SEQ ID NO: 702566 - RNA, 23 nt, Human
uacacaacauacuccugcccuac

SEQ ID NO: 702567 - RNA, 18 nt, Human
uacuccuggauuuucacu

SEQ ID NO: 702568 - RNA, 22 nt, Human
uagagacauuucuucuccaccu

SEQ ID NO: 702569 - RNA, 21 nt, Human
uagaggggaaaaaaugggggg

SEQ ID NO: 702570 - RNA, 20 nt, Human
uaguucucccaaauaagccu

SEQ ID NO: 702571 - RNA, 20 nt, Human
uauauacaaaaucaugcaua

SEQ ID NO: 702572 - RNA, 24 nt, Human
ucaaagguaaauuucacuaucuaa

SEQ ID NO: 702573 - RNA, 22 nt, Human
ucagagaaaagagaaaaagacc

SEQ ID NO: 702574 - RNA, 21 nt, Human
uccaaaaccuuggcaggaaga

SEQ ID NO: 702575 - RNA, 20 nt, Human
uccaaacacaaaaaggucau

SEQ ID NO: 702576 - RNA, 21 nt, Human
uccaugcucuagcaccauccc

SEQ ID NO: 702577 - RNA, 21 nt, Human
uccaugcugaacuggcugacu

SEQ ID NO: 702578 - RNA, 20 nt, Human
ucccacucuacgaauguccc

SEQ ID NO: 702579 - RNA, 21 nt, Human
uccuggauuuucacuuaaucc

SEQ ID NO: 702580 - RNA, 20 nt, Human
ucucugcaaaaucuuggaac

SEQ ID NO: 702581 - RNA, 21 nt, Human
ucuggagugcagauggaaagc

SEQ ID NO: 702582 - RNA, 21 nt, Human
ucugggguggaaggagacuac

SEQ ID NO: 702583 - RNA, 24 nt, Human
ucuguaaucccagcuacuuggcag

SEQ ID NO: 702584 - RNA, 18 nt, Human
ugaaagauacauaaaggu

SEQ ID NO: 702585 - RNA, 23 nt, Human
ugaaauauguaggcuacaaaaca

SEQ ID NO: 702586 - RNA, 24 nt, Human
ugaaauggacaguuaauucaggua

SEQ ID NO: 702587 - RNA, 24 nt, Human
ugaauagaggggaaaaaauggggg

SEQ ID NO: 702588 - RNA, 30 nt, Human
ugaauagaggggaaaaaaugggggggaggg

SEQ ID NO: 702589 - RNA, 22 nt, Human
ugcagugagccaugaucaugcc

SEQ ID NO: 702590 - RNA, 19 nt, Human
uggaaagaaaaauaaccau

SEQ ID NO: 702591 - RNA, 20 nt, Human
uggaaggagacuacugacac

SEQ ID NO: 702592 - RNA, 20 nt, Human
uggaaggucaaggcugcagu

SEQ ID NO: 702593 - RNA, 19 nt, Human
uggcagaugauauaaccaa

SEQ ID NO: 702594 - RNA, 24 nt, Human
uggcaggaagaucgauugaggcca

SEQ ID NO: 702595 - RNA, 19 nt, Human
uggccccuggaccugcccu

SEQ ID NO: 702596 - RNA, 21 nt, Human
uggcucacaccuguaauucca

SEQ ID NO: 702597 - RNA, 23 nt, Human
uggcucacaccuguaauuccaaa

SEQ ID NO: 702598 - RNA, 23 nt, Human
uggcugacuuaagcagucaagga

SEQ ID NO: 702599 - RNA, 19 nt, Human
ugggcaacauagaaagacc

SEQ ID NO: 702600 - RNA, 21 nt, Human
ugggcaacauagaaagacccu

SEQ ID NO: 702601 - RNA, 24 nt, Human
ugguggcucacaccuguaauucca

SEQ ID NO: 702602 - RNA, 20 nt, Human
uguagaaaauuauuauaugg

SEQ ID NO: 702603 - RNA, 18 nt, Human
ugucaaagcaggccaggc

SEQ ID NO: 702604 - RNA, 23 nt, Human
ugucuguaaucccagcuacuugg

SEQ ID NO: 702605 - RNA, 23 nt, Human
uguuugccauuacaucugaaagu

SEQ ID NO: 702606 - RNA, 19 nt, Human
uuaaaagaaacgagaaugu

SEQ ID NO: 702607 - RNA, 23 nt, Human
uuaaacaaaaaaagcagacuaga

SEQ ID NO: 702608 - RNA, 21 nt, Human
uuaguucucccaaauaagccu

SEQ ID NO: 702609 - RNA, 23 nt, Human
uucagaaaggcucuguuucacua

SEQ ID NO: 702610 - RNA, 20 nt, Human
uucagagcuggagaauuuug

SEQ ID NO: 702611 - RNA, 18 nt, Human
uuccaaacacaaaaaggu

SEQ ID NO: 702612 - RNA, 18 nt, Human
uuccauuaagaguagagu

SEQ ID NO: 702613 - RNA, 18 nt, Human
uuggaacugagaaagccg

SEQ ID NO: 702614 - RNA, 20 nt, Human
uuuaacuucuuuaauuaugu

SEQ ID NO: 702615 - RNA, 22 nt, Human
uuuaacuucuuuaauuauguaa

SEQ ID NO: 702616 - RNA, 19 nt, Human
aagggcgccugggcccugc

SEQ ID NO: 702617 - RNA, 21 nt, Human
agaggagcggagcagggggag

SEQ ID NO: 702618 - RNA, 21 nt, Human
agggggaggagcgcugagacc

SEQ ID NO: 702619 - RNA, 21 nt, Human
cugggcccugcagaggagcgg

SEQ ID NO: 702620 - RNA, 19 nt, Human
gcggagcagggggaggagc

SEQ ID NO: 702621 - RNA, 18 nt, Human
guuuaaugagcccugucc

SEQ ID NO: 702622 - RNA, 22 nt, Human
uaaugagcccuguccagggccc

SEQ ID NO: 702623 - RNA, 22 nt, Human
ugcagaggagcggagcaggggg

SEQ ID NO: 702624 - RNA, 18 nt, Human
aaccuacagaauugaaag

SEQ ID NO: 702625 - RNA, 19 nt, Human
aaucuaaggggugguuuuc

SEQ ID NO: 702626 - RNA, 18 nt, Human
accugaaucaucgaucac

SEQ ID NO: 702627 - RNA, 19 nt, Human
acugacacauaaaugacac

SEQ ID NO: 702628 - RNA, 19 nt, Human
agaaaagagaaagaugucu

SEQ ID NO: 702629 - RNA, 22 nt, Human
agacggggcaacucuucagcuc

SEQ ID NO: 702630 - RNA, 18 nt, Human
aguugggcagaugaagag

SEQ ID NO: 702631 - RNA, 24 nt, Human
auaugagacugaagccuugaagac

SEQ ID NO: 702632 - RNA, 20 nt, Human
aucaucgaucacugugaagc

SEQ ID NO: 702633 - RNA, 20 nt, Human
caaucuaaggggugguuuuc

SEQ ID NO: 702634 - RNA, 18 nt, Human
cucuggucugagugucuc

SEQ ID NO: 702635 - RNA, 18 nt, Human
cugacacauaaaugacac

SEQ ID NO: 702636 - RNA, 20 nt, Human
cugacuguccagaaucuacu

SEQ ID NO: 702637 - RNA, 21 nt, Human
cuucucuggucugagugucuc

SEQ ID NO: 702638 - RNA, 21 nt, Human
gacaccuuggcuuuuuccacu

SEQ ID NO: 702639 - RNA, 22 nt, Human
gacgugcggcuucaacgcgagc

SEQ ID NO: 702640 - RNA, 19 nt, Human
guaggcgcaugcacacccc

SEQ ID NO: 702641 - RNA, 19 nt, Human
guccuuaucaccagagcuc

SEQ ID NO: 702642 - RNA, 23 nt, Human
uaaaaggcauaggagagugaaag

SEQ ID NO: 702643 - RNA, 23 nt, Human
uaaaggagacauggaacagagac

SEQ ID NO: 702644 - RNA, 23 nt, Human
uaaauagauuuguguaagcugaa

SEQ ID NO: 702645 - RNA, 23 nt, Human
uaaaugacaccuuggcuuuuucc

SEQ ID NO: 702646 - RNA, 23 nt, Human
uacauagaagaaaaggauauaug

SEQ ID NO: 702647 - RNA, 22 nt, Human
uagaaaagagaaagaugucuuu

SEQ ID NO: 702648 - RNA, 19 nt, Human
uagcuggguaauggcuggg

SEQ ID NO: 702649 - RNA, 19 nt, Human
uagcuuacacuacuaaauc

SEQ ID NO: 702650 - RNA, 19 nt, Human
uaggagagugaaagcaacg

SEQ ID NO: 702651 - RNA, 23 nt, Human
uaggauaagaaaguucaguaaaa

SEQ ID NO: 702652 - RNA, 21 nt, Human
uaucagaguggaauugggugu

SEQ ID NO: 702653 - RNA, 19 nt, Human
ucacugccauuuuuuuaac

SEQ ID NO: 702654 - RNA, 27 nt, Human
ucccucuuaagcauuaacuuuuucaaa

SEQ ID NO: 702655 - RNA, 20 nt, Human
ucuggccgaagugacugcug

SEQ ID NO: 702656 - RNA, 18 nt, Human
ucugugauugcuccagga

SEQ ID NO: 702657 - RNA, 19 nt, Human
ugaaaagcuacauccuuaa

SEQ ID NO: 702658 - RNA, 21 nt, Human
ugaaaagcuacauccuuaaua

SEQ ID NO: 702659 - RNA, 18 nt, Human
ugaaagccuaaagucuag

SEQ ID NO: 702660 - RNA, 21 nt, Human
ugaaaugggcagggauaagua

SEQ ID NO: 702661 - RNA, 22 nt, Human
ugaacugacacauaaaugacac

SEQ ID NO: 702662 - RNA, 23 nt, Human
ugaacugacacauaaaugacacc

SEQ ID NO: 702663 - RNA, 19 nt, Human
ugaccagaagugguuucuu

SEQ ID NO: 702664 - RNA, 22 nt, Human
ugagaagaaccaaaauguguuu

SEQ ID NO: 702665 - RNA, 18 nt, Human
ugcauuauuuuauauguu

SEQ ID NO: 702666 - RNA, 20 nt, Human
ugggaaggggaauacgugga

SEQ ID NO: 702667 - RNA, 21 nt, Human
ugguuucuuuuacuuuggggc

SEQ ID NO: 702668 - RNA, 19 nt, Human
ugugaagcgugagcugaag

SEQ ID NO: 702669 - RNA, 24 nt, Human
ugugcuaggauaagaaaguucagu

SEQ ID NO: 702670 - RNA, 23 nt, Human
uuacuuuggggcgguagcauugu

SEQ ID NO: 702671 - RNA, 19 nt, Human
uucacagcaaaugacgaug

SEQ ID NO: 702672 - RNA, 22 nt, Human
uucacagcaaaugacgaugauc

SEQ ID NO: 702673 - RNA, 19 nt, Human
uuggugagauucgugugac

SEQ ID NO: 702674 - RNA, 23 nt, Human
uuuuuuuuuuuuuuuuuggugag

SEQ ID NO: 702675 - RNA, 20 nt, Human
uuuuuuuuuuuuuuuuuugg

SEQ ID NO: 702676 - RNA, 22 nt, Human
agagauacauaucuuuaauggc

SEQ ID NO: 702677 - RNA, 22 nt, Human
caagaguccucaggguaaccca

SEQ ID NO: 702678 - RNA, 23 nt, Human
ucaguuaagcaagaguccucagg

SEQ ID NO: 702679 - RNA, 22 nt, Human
ucgaacucucaaaacuauagaa

SEQ ID NO: 702680 - RNA, 23 nt, Human
ucugaagguaucaugaaaaggaa

SEQ ID NO: 702681 - RNA, 22 nt, Human
gaggagcaggugggagcccggg

SEQ ID NO: 702682 - RNA, 21 nt, Human
gcccugccucaccugggcgga

SEQ ID NO: 702683 - RNA, 23 nt, Human
ggaggagcaggugggagcccggg

SEQ ID NO: 702684 - RNA, 25 nt, Human
uucaaucacucuuaaagacaccugg

SEQ ID NO: 702685 - RNA, 24 nt, Human
aaaacuucuaguauaauuacacau

SEQ ID NO: 702686 - RNA, 20 nt, Human
guaaugacaggaaugcauac

SEQ ID NO: 702687 - RNA, 19 nt, Human
uaaaacauugcauaguauu

SEQ ID NO: 702688 - RNA, 25 nt, Human
uaccuuuuguuguuuuccuacaaga

SEQ ID NO: 702689 - RNA, 24 nt, Human
uauaauuacacauaauuaccuuuu

SEQ ID NO: 702690 - RNA, 24 nt, Human
aaagagcugggauuacaggcguga

SEQ ID NO: 702691 - RNA, 21 nt, Human
aagagcugggauuacaggcgu

SEQ ID NO: 702692 - RNA, 23 nt, Human
aaugcaguggcaugaucacggcu

SEQ ID NO: 702693 - RNA, 20 nt, Human
aaugccacauggccaggaug

SEQ ID NO: 702694 - RNA, 22 nt, Human
acaaagagcugggauuacaggc

SEQ ID NO: 702695 - RNA, 24 nt, Human
acaaagagcugggauuacaggcgu

SEQ ID NO: 702696 - RNA, 20 nt, Human
acagacuggaaacaaugggc

SEQ ID NO: 702697 - RNA, 19 nt, Human
acaggguuuugucaugcug

SEQ ID NO: 702698 - RNA, 24 nt, Human
acaggguuuugucaugcugcccag

SEQ ID NO: 702699 - RNA, 21 nt, Human
accacaggugugugccaccau

SEQ ID NO: 702700 - RNA, 21 nt, Human
accccgacuucccuugucugg

SEQ ID NO: 702701 - RNA, 23 nt, Human
accucagccucccgaguagcugg

SEQ ID NO: 702702 - RNA, 21 nt, Human
acggucugugacaaugccaca

SEQ ID NO: 702703 - RNA, 18 nt, Human
agacaggguuuugucaug

SEQ ID NO: 702704 - RNA, 24 nt, Human
agagcugggauuacaggcgugagc

SEQ ID NO: 702705 - RNA, 25 nt, Human
agcauaaagggaagcuguggacagg

SEQ ID NO: 702706 - RNA, 19 nt, Human
agccaccgcaccuggccca

SEQ ID NO: 702707 - RNA, 21 nt, Human
agccucaacuucccaggcucc

SEQ ID NO: 702708 - RNA, 23 nt, Human
aguagcugggaccacaggugugu

SEQ ID NO: 702709 - RNA, 26 nt, Human
aucuguucuuucgucuaacaccugcu

SEQ ID NO: 702710 - RNA, 24 nt, Human
auuuuuguauuuuugguagagaca

SEQ ID NO: 702711 - RNA, 19 nt, Human
caaagagcugggauuacag

SEQ ID NO: 702712 - RNA, 21 nt, Human
caaagagcugggauuacaggc

SEQ ID NO: 702713 - RNA, 21 nt, Human
caaagagcugggauuacaggc

SEQ ID NO: 702714 - RNA, 24 nt, Human
caaagagcugggauuacaggcgug

SEQ ID NO: 702715 - RNA, 22 nt, Human
caacuucccaggcuccagcgau

SEQ ID NO: 702716 - RNA, 30 nt, Human
caacuucccaggcuccagcgauccucccuc

SEQ ID NO: 702717 - RNA, 23 nt, Human
cacaaagagcugggauuacaggc

SEQ ID NO: 702718 - RNA, 24 nt, Human
caccaugcguggcuaauuuuugua

SEQ ID NO: 702719 - RNA, 22 nt, Human
cacugcagccucaacuucccag

SEQ ID NO: 702720 - RNA, 21 nt, Human
cagacuggaaacaaugggcca

SEQ ID NO: 702721 - RNA, 22 nt, Human
cagcauaaagggaagcugugga

SEQ ID NO: 702722 - RNA, 20 nt, Human
cagccucaacuucccaggcu

SEQ ID NO: 702723 - RNA, 23 nt, Human
cagccucaacuucccaggcucca

SEQ ID NO: 702724 - RNA, 21 nt, Human
caggaacagacuggaaacaau

SEQ ID NO: 702725 - RNA, 24 nt, Human
caggguuuugucaugcugcccagg

SEQ ID NO: 702726 - RNA, 25 nt, Human
caggugugugccaccaugcguggcu

SEQ ID NO: 702727 - RNA, 18 nt, Human
caugcugcccaggcuggu

SEQ ID NO: 702728 - RNA, 24 nt, Human
caugcugcccaggcuggucuugaa

SEQ ID NO: 702729 - RNA, 19 nt, Human
ccaccgcaccuggcccaaa

SEQ ID NO: 702730 - RNA, 22 nt, Human
ccaccgcaccuggcccaaacac

SEQ ID NO: 702731 - RNA, 23 nt, Human
ccaccucagccucccgaguagcu

SEQ ID NO: 702732 - RNA, 27 nt, Human
ccagcgauccucccaccucagccuccc

SEQ ID NO: 702733 - RNA, 23 nt, Human
ccaggaugaugaugcauguggca

SEQ ID NO: 702734 - RNA, 23 nt, Human
cccaccucagccucccgaguagc

SEQ ID NO: 702735 - RNA, 18 nt, Human
cccucucccuccaagaau

SEQ ID NO: 702736 - RNA, 23 nt, Human
cccugacaccccgacuucccuug

SEQ ID NO: 702737 - RNA, 18 nt, Human
ccguuccccucucccucc

SEQ ID NO: 702738 - RNA, 21 nt, Human
ccucacgaucguauugugucu

SEQ ID NO: 702739 - RNA, 21 nt, Human
ccugagcucaaagaccucggc

SEQ ID NO: 702740 - RNA, 24 nt, Human
cucagccucccgaguagcugggac

SEQ ID NO: 702741 - RNA, 24 nt, Human
cuccagcgauccucccaccucagc

SEQ ID NO: 702742 - RNA, 24 nt, Human
cucccgaguagcugggaccacagg

SEQ ID NO: 702743 - RNA, 20 nt, Human
cuccugagcucaaagaccuc

SEQ ID NO: 702744 - RNA, 26 nt, Human
gaguagcugggaccacaggugugugc

SEQ ID NO: 702745 - RNA, 18 nt, Human
gaguuaggaggcuagcag

SEQ ID NO: 702746 - RNA, 18 nt, Human
gauuacaggcgugagcca

SEQ ID NO: 702747 - RNA, 22 nt, Human
gauuacaggcgugagccaccgc

SEQ ID NO: 702748 - RNA, 23 nt, Human
gauuacaggcgugagccaccgca

SEQ ID NO: 702749 - RNA, 19 nt, Human
gcuggaaugcaguggcaug

SEQ ID NO: 702750 - RNA, 24 nt, Human
ggcuggucuugaacuccugagcuc

SEQ ID NO: 702751 - RNA, 22 nt, Human
guagagacaggguuuugucaug

SEQ ID NO: 702752 - RNA, 24 nt, Human
gucaugcugcccaggcuggucuug

SEQ ID NO: 702753 - RNA, 22 nt, Human
uaaagggaagcuguggacagga

SEQ ID NO: 702754 - RNA, 24 nt, Human
uaauuuuuguauuuuugguagaga

SEQ ID NO: 702755 - RNA, 22 nt, Human
uacaggcgugagccaccgcacc

SEQ ID NO: 702756 - RNA, 23 nt, Human
uacaggcgugagccaccgcaccu

SEQ ID NO: 702757 - RNA, 21 nt, Human
uagcaggagagacggucugug

SEQ ID NO: 702758 - RNA, 23 nt, Human
uagcugggaccacaggugugugc

SEQ ID NO: 702759 - RNA, 19 nt, Human
ucacugcagccucaacuuc

SEQ ID NO: 702760 - RNA, 23 nt, Human
ucacugcagccucaacuucccag

SEQ ID NO: 702761 - RNA, 24 nt, Human
ucacugcagccucaacuucccagg

SEQ ID NO: 702762 - RNA, 23 nt, Human
ucagccucccgaguagcugggac

SEQ ID NO: 702763 - RNA, 21 nt, Human
ucccaggcuccagcgauccuc

SEQ ID NO: 702764 - RNA, 23 nt, Human
ucccgaguagcugggaccacagg

SEQ ID NO: 702765 - RNA, 24 nt, Human
ucccgaguagcugggaccacaggu

SEQ ID NO: 702766 - RNA, 26 nt, Human
uccucccaccucagccucccgaguag

SEQ ID NO: 702767 - RNA, 18 nt, Human
uccugagcucaaagaccu

SEQ ID NO: 702768 - RNA, 19 nt, Human
ucggccccacaaagagcug

SEQ ID NO: 702769 - RNA, 24 nt, Human
ucucucuccaucacacaggcugga

SEQ ID NO: 702770 - RNA, 24 nt, Human
ucuguucuuucgucuaacaccugc

SEQ ID NO: 702771 - RNA, 22 nt, Human
ucuugaacuccugagcucaaag

SEQ ID NO: 702772 - RNA, 23 nt, Human
ugaacuccugagcucaaagaccu

SEQ ID NO: 702773 - RNA, 22 nt, Human
ugagacagggucucucuccauc

SEQ ID NO: 702774 - RNA, 21 nt, Human
ugagacugauuuacuuaaugc

SEQ ID NO: 702775 - RNA, 18 nt, Human
ugcagccucaacuuccca

SEQ ID NO: 702776 - RNA, 24 nt, Human
ugcccaggcuggucuugaacuccu

SEQ ID NO: 702777 - RNA, 28 nt, Human
ugcccaggcuggucuugaacuccugagc

SEQ ID NO: 702778 - RNA, 22 nt, Human
ugcugcccaggcuggucuugaa

SEQ ID NO: 702779 - RNA, 25 nt, Human
ugcuggggaagacccaggcccugag

SEQ ID NO: 702780 - RNA, 26 nt, Human
ugcuggggaagacccaggcccugagu

SEQ ID NO: 702781 - RNA, 19 nt, Human
uggaaugcaguggcaugau

SEQ ID NO: 702782 - RNA, 24 nt, Human
uggaaugcaguggcaugaucacgg

SEQ ID NO: 702783 - RNA, 21 nt, Human
ugggaccacaggugugugcca

SEQ ID NO: 702784 - RNA, 24 nt, Human
ugggaccacaggugugugccacca

SEQ ID NO: 702785 - RNA, 18 nt, Human
ugggauuacaggcgugag

SEQ ID NO: 702786 - RNA, 19 nt, Human
ugggauuacaggcgugagc

SEQ ID NO: 702787 - RNA, 21 nt, Human
ugggauuacaggcgugagcca

SEQ ID NO: 702788 - RNA, 22 nt, Human
ugggauuacaggcgugagccac

SEQ ID NO: 702789 - RNA, 23 nt, Human
ugggauuacaggcgugagccacc

SEQ ID NO: 702790 - RNA, 24 nt, Human
ugggauuacaggcgugagccaccg

SEQ ID NO: 702791 - RNA, 24 nt, Human
ugguagagacaggguuuugucaug

SEQ ID NO: 702792 - RNA, 24 nt, Human
ugucaugcugcccaggcuggucuu

SEQ ID NO: 702793 - RNA, 27 nt, Human
ugucaugcugcccaggcuggucuugaa

SEQ ID NO: 702794 - RNA, 18 nt, Human
uguccguuccccucuccc

SEQ ID NO: 702795 - RNA, 23 nt, Human
ugucugguuuuaguuguuuccuu

SEQ ID NO: 702796 - RNA, 18 nt, Human
ugugugccaccaugcgug

SEQ ID NO: 702797 - RNA, 21 nt, Human
uguuugcuguccguuccccuc

SEQ ID NO: 702798 - RNA, 25 nt, Human
uucccaggcuccagcgauccuccca

SEQ ID NO: 702799 - RNA, 18 nt, Human
uugagacagggucucucu

SEQ ID NO: 702800 - RNA, 22 nt, Human
uugagacagggucucucuccau

SEQ ID NO: 702801 - RNA, 24 nt, Human
uugguagagacaggguuuugucau

SEQ ID NO: 702802 - RNA, 19 nt, Human
uugucaugcugcccaggcu

SEQ ID NO: 702803 - RNA, 21 nt, Human
uugucaugcugcccaggcugg

SEQ ID NO: 702804 - RNA, 23 nt, Human
uuuugucaugcugcccaggcugg

SEQ ID NO: 702805 - RNA, 21 nt, Human
uuuuugguagagacaggguuu

SEQ ID NO: 702806 - RNA, 21 nt, Human
uuuuugguagagacaggguuu

SEQ ID NO: 702807 - RNA, 20 nt, Human
uuuuuguauuuuugguagag

SEQ ID NO: 702808 - RNA, 23 nt, Human
uuuuuuuuuugagacagggucuc

SEQ ID NO: 702809 - RNA, 20 nt, Human
uuuuuuuuuuugagacaggg

SEQ ID NO: 702810 - RNA, 23 nt, Human
uuuuuuuuuuuugagacaggguc

SEQ ID NO: 702811 - RNA, 23 nt, Human
uuuuuuuuuuuuuugagacaggg

SEQ ID NO: 702812 - RNA, 18 nt, Human
cccaguaggagggcucgc

SEQ ID NO: 702813 - RNA, 21 nt, Human
ccuuggccauggagcccugcu

SEQ ID NO: 702814 - RNA, 20 nt, Human
gggcgugcccgaggugacgu

SEQ ID NO: 702815 - RNA, 19 nt, Human
ucccaguaggagggcucgc

SEQ ID NO: 702816 - RNA, 27 nt, Human
ucucacgguucuaguuguugcgcugcc

SEQ ID NO: 702817 - RNA, 18 nt, Human
ugggucgcgguugcugga

SEQ ID NO: 702818 - RNA, 21 nt, Human
uuagaggucugggcuuucuuc

SEQ ID NO: 702819 - RNA, 20 nt, Human
aaggggguccagggguuuau

SEQ ID NO: 702820 - RNA, 19 nt, Human
acaguacaugcagcagaau

SEQ ID NO: 702821 - RNA, 23 nt, Human
acuuugagaaaaugguugaggag

SEQ ID NO: 702822 - RNA, 18 nt, Human
agagcugagggaacaagg

SEQ ID NO: 702823 - RNA, 18 nt, Human
aggauugucuauguaaau

SEQ ID NO: 702824 - RNA, 19 nt, Human
agggaacaaggggguccag

SEQ ID NO: 702825 - RNA, 18 nt, Human
augcagcagaauauaccu

SEQ ID NO: 702826 - RNA, 19 nt, Human
caaaugucugcauauguug

SEQ ID NO: 702827 - RNA, 27 nt, Human
caaguucaagaucuuauaggauugucu

SEQ ID NO: 702828 - RNA, 19 nt, Human
ccggcaaaaaaaaaaaaaa

SEQ ID NO: 702829 - RNA, 22 nt, Human
cgacuccggcaaaaaaaaaaaa

SEQ ID NO: 702830 - RNA, 22 nt, Human
cgcucgacuccggcaaaaaaaa

SEQ ID NO: 702831 - RNA, 21 nt, Human
cuccggcaaaaaaaaaaaaaa

SEQ ID NO: 702832 - RNA, 25 nt, Human
cuuaaaaucuucaucauuggaauuc

SEQ ID NO: 702833 - RNA, 19 nt, Human
ggaacaaggggguccaggg

SEQ ID NO: 702834 - RNA, 24 nt, Human
ggaauaauauucauagcacaccag

SEQ ID NO: 702835 - RNA, 20 nt, Human
uacaacccauaaaauucaag

SEQ ID NO: 702836 - RNA, 18 nt, Human
uacaguacaugcagcaga

SEQ ID NO: 702837 - RNA, 23 nt, Human
uagaaugcccauuacuuugagaa

SEQ ID NO: 702838 - RNA, 24 nt, Human
uagcagcacccgcucgacuccggc

SEQ ID NO: 702839 - RNA, 22 nt, Human
uauauaaaaucuucagcugaag

SEQ ID NO: 702840 - RNA, 22 nt, Human
uccgcuagcagcacccgcucga

SEQ ID NO: 702841 - RNA, 18 nt, Human
ucuaaaucauagaaugcc

SEQ ID NO: 702842 - RNA, 21 nt, Human
ucuucuuucucuucucuucuu

SEQ ID NO: 702843 - RNA, 19 nt, Human
ucuuucucuucucuucuuu

SEQ ID NO: 702844 - RNA, 24 nt, Human
ugccuggaaaugcauuguuucuuc

SEQ ID NO: 702845 - RNA, 18 nt, Human
uggaauaauauucauagc

SEQ ID NO: 702846 - RNA, 18 nt, Human
uucuucuuucucuucucu

SEQ ID NO: 702847 - RNA, 24 nt, Human
uucuuucucuucucuucuuuuuaa

SEQ ID NO: 702848 - RNA, 22 nt, Human
uuucuucuuucucuucucuucu

SEQ ID NO: 702849 - RNA, 20 nt, Human
uuuguaaccauuuauauaca

SEQ ID NO: 702850 - RNA, 19 nt, Human
aacuguguuggaauccaag

SEQ ID NO: 702851 - RNA, 18 nt, Human
aagcaggaagggaaugga

SEQ ID NO: 702852 - RNA, 19 nt, Human
aagcaggaagggaauggag

SEQ ID NO: 702853 - RNA, 20 nt, Human
aaggacagugggcaagacca

SEQ ID NO: 702854 - RNA, 18 nt, Human
aagggagagggcugaagg

SEQ ID NO: 702855 - RNA, 20 nt, Human
acaaagcaaggagaaugaaa

SEQ ID NO: 702856 - RNA, 18 nt, Human
agcauggaggcaaaagga

SEQ ID NO: 702857 - RNA, 22 nt, Human
aggaagggaauggagaagaaaa

SEQ ID NO: 702858 - RNA, 26 nt, Human
aggagggggaaugaagaggucugggg

SEQ ID NO: 702859 - RNA, 25 nt, Human
agggggaaugaagaggucuggggga

SEQ ID NO: 702860 - RNA, 24 nt, Human
agucaggggauguggaagaaacug

SEQ ID NO: 702861 - RNA, 23 nt, Human
aguggggagaggggaggagaagg

SEQ ID NO: 702862 - RNA, 20 nt, Human
auacagcaccgaccucagca

SEQ ID NO: 702863 - RNA, 23 nt, Human
aucacaccuagcccucaccacag

SEQ ID NO: 702864 - RNA, 20 nt, Human
auccacuccucccugaaccc

SEQ ID NO: 702865 - RNA, 23 nt, Human
auuccaccuugcccccucuccca

SEQ ID NO: 702866 - RNA, 22 nt, Human
caccccucccuaccagggucug

SEQ ID NO: 702867 - RNA, 19 nt, Human
cacugugccauccacuccu

SEQ ID NO: 702868 - RNA, 20 nt, Human
cacugugccauccacuccuc

SEQ ID NO: 702869 - RNA, 21 nt, Human
cagcaccgaccucagcaugga

SEQ ID NO: 702870 - RNA, 26 nt, Human
cagcaccgaccucagcauggaggcaa

SEQ ID NO: 702871 - RNA, 19 nt, Human
cagcauggaggcaaaagga

SEQ ID NO: 702872 - RNA, 22 nt, Human
cagggucugaugcagccucagc

SEQ ID NO: 702873 - RNA, 19 nt, Human
ccaugcuaugccccagucc

SEQ ID NO: 702874 - RNA, 19 nt, Human
cccccaugcuaugccccag

SEQ ID NO: 702875 - RNA, 22 nt, Human
cccccucucccaggaugaaucc

SEQ ID NO: 702876 - RNA, 21 nt, Human
cccugaaccccuggccccagc

SEQ ID NO: 702877 - RNA, 26 nt, Human
ccguuaguggcugcggcaccccuccc

SEQ ID NO: 702878 - RNA, 19 nt, Human
ccucagcaccgggaguggg

SEQ ID NO: 702879 - RNA, 22 nt, Human
ccucagcauggaggcaaaagga

SEQ ID NO: 702880 - RNA, 19 nt, Human
cugcccccaugcuaugccc

SEQ ID NO: 702881 - RNA, 20 nt, Human
cugcccccaugcuaugcccc

SEQ ID NO: 702882 - RNA, 19 nt, Human
gaaaaaagcaggaagggaa

SEQ ID NO: 702883 - RNA, 21 nt, Human
gaaaaggacccucccucugaa

SEQ ID NO: 702884 - RNA, 18 nt, Human
gaauccucuuggcacaga

SEQ ID NO: 702885 - RNA, 21 nt, Human
gagaagaaaaguguugaucac

SEQ ID NO: 702886 - RNA, 18 nt, Human
gcaccccucccuaccagg

SEQ ID NO: 702887 - RNA, 21 nt, Human
gcagccucagcaccgggagug

SEQ ID NO: 702888 - RNA, 23 nt, Human
gcccccucucccaggaugaaucc

SEQ ID NO: 702889 - RNA, 20 nt, Human
ggggagaggggaggagaagg

SEQ ID NO: 702890 - RNA, 22 nt, Human
uacaaagcaaggagaaugaaaa

SEQ ID NO: 702891 - RNA, 24 nt, Human
uacaaagcaaggagaaugaaaagg

SEQ ID NO: 702892 - RNA, 30 nt, Human
uauuuaccuacccaaguuccuuuuacaugg

SEQ ID NO: 702893 - RNA, 20 nt, Human
ugaaaaaagcaggaagggaa

SEQ ID NO: 702894 - RNA, 21 nt, Human
ugaaaaggacccucccucuga

SEQ ID NO: 702895 - RNA, 19 nt, Human
ugaaauacagcaccgaccu

SEQ ID NO: 702896 - RNA, 23 nt, Human
ugaaauacagcaccgaccucagc

SEQ ID NO: 702897 - RNA, 22 nt, Human
ugaaccccuggccccagcacag

SEQ ID NO: 702898 - RNA, 22 nt, Human
ugaaggagagcacauaccguua

SEQ ID NO: 702899 - RNA, 19 nt, Human
uggagaagaaaaguguuga

SEQ ID NO: 702900 - RNA, 21 nt, Human
uggggagaggggaggagaagg

SEQ ID NO: 702901 - RNA, 18 nt, Human
uucaacuagggccagagc

SEQ ID NO: 702902 - RNA, 22 nt, Human
aacuugcuccucggauccgggc

SEQ ID NO: 702903 - RNA, 18 nt, Human
aggaagggaaauauugcg

SEQ ID NO: 702904 - RNA, 20 nt, Human
cccgagcucacgcgcgcccg

SEQ ID NO: 702905 - RNA, 23 nt, Human
cccgcacgcccggccgggcagcc

SEQ ID NO: 702906 - RNA, 25 nt, Human
cccggccgggcagcccgagcucacg

SEQ ID NO: 702907 - RNA, 20 nt, Human
cccugcaaggucgcccuucu

SEQ ID NO: 702908 - RNA, 23 nt, Human
cgccggggucccugcugaugcuc

SEQ ID NO: 702909 - RNA, 23 nt, Human
cuccucggauccgggcacacagc

SEQ ID NO: 702910 - RNA, 18 nt, Human
gcgacacgaaugaaggga

SEQ ID NO: 702911 - RNA, 22 nt, Human
ggaagggaaauauugcgacacg

SEQ ID NO: 702912 - RNA, 19 nt, Human
ggacagauuaacuugcucc

SEQ ID NO: 702913 - RNA, 19 nt, Human
ggccgggcagcccgagcuc

SEQ ID NO: 702914 - RNA, 20 nt, Human
uaccauguccccgcccgcac

SEQ ID NO: 702915 - RNA, 22 nt, Human
uacuaaguaucaaccgaacaag

SEQ ID NO: 702916 - RNA, 19 nt, Human
uaguuuuaaaaggaaggga

SEQ ID NO: 702917 - RNA, 19 nt, Human
ucccugcugaugcucgggg

SEQ ID NO: 702918 - RNA, 23 nt, Human
ucccugcugaugcucggggggag

SEQ ID NO: 702919 - RNA, 18 nt, Human
uccgccggggucccugcu

SEQ ID NO: 702920 - RNA, 21 nt, Human
uccguggaccagguuaccaug

SEQ ID NO: 702921 - RNA, 18 nt, Human
ucgcggcggcgagucccu

SEQ ID NO: 702922 - RNA, 22 nt, Human
uggccacggaguuacuaaguau

SEQ ID NO: 702923 - RNA, 24 nt, Human
cacuaaagaucugauaucccacuc

SEQ ID NO: 702924 - RNA, 19 nt, Human
ccuguuuauuaacauguug

SEQ ID NO: 702925 - RNA, 22 nt, Human
guagauguaucuucacacuaaa

SEQ ID NO: 702926 - RNA, 21 nt, Human
ucaaccuucacaguuuuaaaa

SEQ ID NO: 702927 - RNA, 19 nt, Human
uguagauguaucuucacac

SEQ ID NO: 702928 - RNA, 21 nt, Human
uguaucuucacacuaaagauc

SEQ ID NO: 702929 - RNA, 20 nt, Human
accuucuccugcuugucaga

SEQ ID NO: 702930 - RNA, 21 nt, Human
acgcugcacuccagcgcuggg

SEQ ID NO: 702931 - RNA, 22 nt, Human
acgcugcacuccagcgcugggc

SEQ ID NO: 702932 - RNA, 25 nt, Human
caaccagacagcuuuuuagacuaaa

SEQ ID NO: 702933 - RNA, 19 nt, Human
cagcucuuuauuaccaggg

SEQ ID NO: 702934 - RNA, 18 nt, Human
cagcugcagcucccuggg

SEQ ID NO: 702935 - RNA, 20 nt, Human
cccaugugcccacagcccga

SEQ ID NO: 702936 - RNA, 21 nt, Human
ccccaugugcccacagcccga

SEQ ID NO: 702937 - RNA, 23 nt, Human
ccuccaaggaaccugcggggccc

SEQ ID NO: 702938 - RNA, 20 nt, Human
ccucccagcucagggcuccu

SEQ ID NO: 702939 - RNA, 21 nt, Human
ccuuggagcugaccgggcccu

SEQ ID NO: 702940 - RNA, 22 nt, Human
cgaccgcccuccucguggcacg

SEQ ID NO: 702941 - RNA, 21 nt, Human
cuccugcuugucagaggugag

SEQ ID NO: 702942 - RNA, 22 nt, Human
cugaccgggcccuuaccuucuc

SEQ ID NO: 702943 - RNA, 18 nt, Human
cugcacuccagcgcuggg

SEQ ID NO: 702944 - RNA, 19 nt, Human
cugcacuccagcgcugggc

SEQ ID NO: 702945 - RNA, 20 nt, Human
cugcacuccagcgcugggca

SEQ ID NO: 702946 - RNA, 18 nt, Human
gagcgcgcuccuuggagc

SEQ ID NO: 702947 - RNA, 21 nt, Human
gagcgcgcuccuuggagcuga

SEQ ID NO: 702948 - RNA, 19 nt, Human
ggccuccgggaggcuuuga

SEQ ID NO: 702949 - RNA, 22 nt, Human
gggcuccagcugcagcucccug

SEQ ID NO: 702950 - RNA, 25 nt, Human
ugaccgggcccuuaccuucuccugc

SEQ ID NO: 702951 - RNA, 18 nt, Human
ugacuccacugaucggca

SEQ ID NO: 702952 - RNA, 26 nt, Human
ugauaggucagccuuugcugccuccc

SEQ ID NO: 702953 - RNA, 20 nt, Human
ugcacgcgcguggagcgcgc

SEQ ID NO: 702954 - RNA, 21 nt, Human
ugcgguggucaggcucgauac

SEQ ID NO: 702955 - RNA, 23 nt, Human
uggagcgcgcuccuuggagcuga

SEQ ID NO: 702956 - RNA, 23 nt, Human
ugugugcacgcgcguggagcgcg

SEQ ID NO: 702957 - RNA, 24 nt, Human
uuccuggcuugcgguggucaggcu

SEQ ID NO: 702958 - RNA, 20 nt, Human
aaaauagcugagggugagaa

SEQ ID NO: 702959 - RNA, 22 nt, Human
aaagaaagguuugaaguagcuc

SEQ ID NO: 702960 - RNA, 21 nt, Human
aaagccccacagaaauuccca

SEQ ID NO: 702961 - RNA, 19 nt, Human
aacuccaguaaaguagcau

SEQ ID NO: 702962 - RNA, 24 nt, Human
aagacaaaaaaaacauuggcuacc

SEQ ID NO: 702963 - RNA, 25 nt, Human
accaaucacauaacuuuuaauucac

SEQ ID NO: 702964 - RNA, 22 nt, Human
agaggaaagggggcgccacggg

SEQ ID NO: 702965 - RNA, 22 nt, Human
agcauccuccccaccuccaaac

SEQ ID NO: 702966 - RNA, 19 nt, Human
aguacacaauguacacuga

SEQ ID NO: 702967 - RNA, 23 nt, Human
agugcucagccaaugucccaaac

SEQ ID NO: 702968 - RNA, 19 nt, Human
augaacuagaagagcuucg

SEQ ID NO: 702969 - RNA, 25 nt, Human
caaaaaaaacauuggcuaccaaagg

SEQ ID NO: 702970 - RNA, 23 nt, Human
caaaaacaaguugccgcugaaaa

SEQ ID NO: 702971 - RNA, 23 nt, Human
cacaguaugacauuuacagcaga

SEQ ID NO: 702972 - RNA, 21 nt, Human
cagcagaagcauuaaacaauu

SEQ ID NO: 702973 - RNA, 19 nt, Human
caguaugacauuuacagca

SEQ ID NO: 702974 - RNA, 23 nt, Human
cauccuccccaccuccaaacacc

SEQ ID NO: 702975 - RNA, 22 nt, Human
caugcaccccaaaagcagcaaa

SEQ ID NO: 702976 - RNA, 19 nt, Human
ccaccuccaaacaccaacu

SEQ ID NO: 702977 - RNA, 20 nt, Human
ccaugaucuguuuccucuaa

SEQ ID NO: 702978 - RNA, 20 nt, Human
cccacaaaauagcugagggu

SEQ ID NO: 702979 - RNA, 24 nt, Human
cccaugaucuguuuccucuaaggc

SEQ ID NO: 702980 - RNA, 19 nt, Human
ccccaaaagcagcaaaaau

SEQ ID NO: 702981 - RNA, 24 nt, Human
ccccaugcaccccaaaagcagcaa

SEQ ID NO: 702982 - RNA, 19 nt, Human
cccgccgggccuccccggg

SEQ ID NO: 702983 - RNA, 21 nt, Human
ccgcugaaaagaaaauacuga

SEQ ID NO: 702984 - RNA, 26 nt, Human
ccuccaaacaccaacuuaagaaugga

SEQ ID NO: 702985 - RNA, 18 nt, Human
cgccugugaugacaagac

SEQ ID NO: 702986 - RNA, 22 nt, Human
cgggcgccgggggcggggcuuu

SEQ ID NO: 702987 - RNA, 19 nt, Human
cuccccaccuccaaacacc

SEQ ID NO: 702988 - RNA, 19 nt, Human
cuccccgggcuggcccggc

SEQ ID NO: 702989 - RNA, 18 nt, Human
gagggugagaauuuuagg

SEQ ID NO: 702990 - RNA, 20 nt, Human
gauucguuagggucuccaga

SEQ ID NO: 702991 - RNA, 24 nt, Human
gcaccccaaaagcagcaaaaaucc

SEQ ID NO: 702992 - RNA, 19 nt, Human
gcgccgggggcggggcuuu

SEQ ID NO: 702993 - RNA, 23 nt, Human
ggagcgggcgccgggggcggggc

SEQ ID NO: 702994 - RNA, 18 nt, Human
ggauuacagguguuaaca

SEQ ID NO: 702995 - RNA, 24 nt, Human
gggaaagugagaaggauuuaaagc

SEQ ID NO: 702996 - RNA, 21 nt, Human
gggaauuaguacacaauguac

SEQ ID NO: 702997 - RNA, 23 nt, Human
ggguagccagaauccuuugugga

SEQ ID NO: 702998 - RNA, 23 nt, Human
gguggagucgagagcgcucuggg

SEQ ID NO: 702999 - RNA, 21 nt, Human
gucccgccgggccuccccggg

SEQ ID NO: 703000 - RNA, 21 nt, Human
uaaaacagucaaacuugagga

SEQ ID NO: 703001 - RNA, 21 nt, Human
uaaaguagcauccuccccacc

SEQ ID NO: 703002 - RNA, 18 nt, Human
uacacaauguacacugaa

SEQ ID NO: 703003 - RNA, 20 nt, Human
uaccaaaggguagccagaau

SEQ ID NO: 703004 - RNA, 18 nt, Human
uaggaaggaaugaaagua

SEQ ID NO: 703005 - RNA, 21 nt, Human
ucaagguuuauaccauauaca

SEQ ID NO: 703006 - RNA, 20 nt, Human
uccccaccuccaaacaccaa

SEQ ID NO: 703007 - RNA, 21 nt, Human
uccuuaaguuugacaccaauc

SEQ ID NO: 703008 - RNA, 18 nt, Human
uccuuaguggauuacagg

SEQ ID NO: 703009 - RNA, 18 nt, Human
uccuuuguggacauugag

SEQ ID NO: 703010 - RNA, 19 nt, Human
uccuuuguggacauugaga

SEQ ID NO: 703011 - RNA, 19 nt, Human
ucugacccuauugagacag

SEQ ID NO: 703012 - RNA, 22 nt, Human
ucuguauuuccaaaaagccauu

SEQ ID NO: 703013 - RNA, 19 nt, Human
ugaaaagaaaauacugaau

SEQ ID NO: 703014 - RNA, 21 nt, Human
ugaaaagaaaauacugaauau

SEQ ID NO: 703015 - RNA, 19 nt, Human
ugacaagacaaaaaaaaca

SEQ ID NO: 703016 - RNA, 19 nt, Human
ugacaagacaaaaaaaaca

SEQ ID NO: 703017 - RNA, 23 nt, Human
ugacaagacaaaaaaaacauugg

SEQ ID NO: 703018 - RNA, 19 nt, Human
ugagcaaauugccauucag

SEQ ID NO: 703019 - RNA, 19 nt, Human
ugcaccccaaaagcagcaa

SEQ ID NO: 703020 - RNA, 20 nt, Human
uggauuacagguguuaacau

SEQ ID NO: 703021 - RNA, 19 nt, Human
uggcuaccaaaggguagcc

SEQ ID NO: 703022 - RNA, 26 nt, Human
ugggcaaaggaaaguuuucuugcggg

SEQ ID NO: 703023 - RNA, 18 nt, Human
uggggaaagugagaagga

SEQ ID NO: 703024 - RNA, 24 nt, Human
uggugguaagcaucuuacaaauac

SEQ ID NO: 703025 - RNA, 22 nt, Human
uguccgcuccucugguggaaca

SEQ ID NO: 703026 - RNA, 24 nt, Human
uguggacauugagacaugcacgca

SEQ ID NO: 703027 - RNA, 22 nt, Human
uuaaaacagucaaacuugagga

SEQ ID NO: 703028 - RNA, 21 nt, Human
uuggcuaccaaaggguagcca

SEQ ID NO: 703029 - RNA, 20 nt, Human
uuucacagucuauguacauu

SEQ ID NO: 703030 - RNA, 26 nt, Human
uuucacagucuauguacauuuauuug

SEQ ID NO: 703031 - RNA, 24 nt, Human
agacugaggugaaagcagacacuc

SEQ ID NO: 703032 - RNA, 22 nt, Human
agcagaaaaucugaacucugca

SEQ ID NO: 703033 - RNA, 27 nt, Human
agcagaaaaucugaacucugcacuagc

SEQ ID NO: 703034 - RNA, 21 nt, Human
agcagaaaggaaacauucuga

SEQ ID NO: 703035 - RNA, 23 nt, Human
cagaaaaucugaacucugcacua

SEQ ID NO: 703036 - RNA, 22 nt, Human
cagguccuuucagugcaggcug

SEQ ID NO: 703037 - RNA, 19 nt, Human
cccccgaacacagucuucc

SEQ ID NO: 703038 - RNA, 18 nt, Human
cgaacacagucuuccucc

SEQ ID NO: 703039 - RNA, 22 nt, Human
cuaugccagcucccccgaacac

SEQ ID NO: 703040 - RNA, 21 nt, Human
ggugaaucagccuucagguac

SEQ ID NO: 703041 - RNA, 19 nt, Human
guaagagcagaaaggaaac

SEQ ID NO: 703042 - RNA, 25 nt, Human
uagcuaugccagcucccccgaacaa

SEQ ID NO: 703043 - RNA, 23 nt, Human
uaugcagguccuuucagugcagg

SEQ ID NO: 703044 - RNA, 21 nt, Human
ucccccgaacacagucuuccu

SEQ ID NO: 703045 - RNA, 23 nt, Human
ugacaaaacaaugcuguguaaga

SEQ ID NO: 703046 - RNA, 21 nt, Human
ugcacagacauagucuaugca

SEQ ID NO: 703047 - RNA, 26 nt, Human
ugcacagacauagucuaugcaggucc

SEQ ID NO: 703048 - RNA, 23 nt, Human
ugccagcucccccgaacacaguc

SEQ ID NO: 703049 - RNA, 24 nt, Human
uguacagacugaggugaaagcaga

SEQ ID NO: 703050 - RNA, 22 nt, Human
uuaugaauucucauuuccaacu

SEQ ID NO: 703051 - RNA, 21 nt, Human
uucccaagguguaaaagauua

SEQ ID NO: 703052 - RNA, 18 nt, Human
aaacacuggcgcagcagc

SEQ ID NO: 703053 - RNA, 20 nt, Human
aauaagcuaguguuagaucu

SEQ ID NO: 703054 - RNA, 19 nt, Human
accgggaugcaggccgcag

SEQ ID NO: 703055 - RNA, 25 nt, Human
acguccacuccaaccggccugcauc

SEQ ID NO: 703056 - RNA, 19 nt, Human
agaccuucauuuaugagaa

SEQ ID NO: 703057 - RNA, 20 nt, Human
agagaaaauuccauuuuucu

SEQ ID NO: 703058 - RNA, 22 nt, Human
aucaaacaauauaacaccaaua

SEQ ID NO: 703059 - RNA, 22 nt, Human
caaaaauuaauuuuaaaaugac

SEQ ID NO: 703060 - RNA, 24 nt, Human
caccaauaucuacuaaaaucuacu

SEQ ID NO: 703061 - RNA, 19 nt, Human
caccuuuuuuaaccaaaca

SEQ ID NO: 703062 - RNA, 24 nt, Human
cagcuaggucgccacccacucagc

SEQ ID NO: 703063 - RNA, 24 nt, Human
cguccacuccaaccggccugcauc

SEQ ID NO: 703064 - RNA, 23 nt, Human
cuaaagcuuagcuaauuauuaac

SEQ ID NO: 703065 - RNA, 21 nt, Human
cuaggucgccacccacucagc

SEQ ID NO: 703066 - RNA, 19 nt, Human
gaaaugccauaauucaugg

SEQ ID NO: 703067 - RNA, 19 nt, Human
gacucgcucguucccggca

SEQ ID NO: 703068 - RNA, 20 nt, Human
gagcuuccaacacaaacacu

SEQ ID NO: 703069 - RNA, 19 nt, Human
gcaucagcugagcuuccaa

SEQ ID NO: 703070 - RNA, 24 nt, Human
ggauuggagaacauagcuagugag

SEQ ID NO: 703071 - RNA, 22 nt, Human
gguaauguaaauuuaagaagaa

SEQ ID NO: 703072 - RNA, 18 nt, Human
uaaaaauacacaguacaa

SEQ ID NO: 703073 - RNA, 22 nt, Human
uaacucaugucgaaccccacaa

SEQ ID NO: 703074 - RNA, 20 nt, Human
uaagaaaugccauaauucau

SEQ ID NO: 703075 - RNA, 22 nt, Human
uaagaagaaauuagcuuuucca

SEQ ID NO: 703076 - RNA, 19 nt, Human
uaucuugaaauuucagggg

SEQ ID NO: 703077 - RNA, 18 nt, Human
ucaaaggcuaaaggggag

SEQ ID NO: 703078 - RNA, 18 nt, Human
ucacuagggcugcagcgg

SEQ ID NO: 703079 - RNA, 20 nt, Human
ucaggauucuccagaauuca

SEQ ID NO: 703080 - RNA, 20 nt, Human
ucuacuaaaaucuacuagca

SEQ ID NO: 703081 - RNA, 22 nt, Human
ugagaacauaagcauauacuca

SEQ ID NO: 703082 - RNA, 19 nt, Human
ugagcuuccaacacaaaca

SEQ ID NO: 703083 - RNA, 19 nt, Human
uggaaaaguuaauauagca

SEQ ID NO: 703084 - RNA, 26 nt, Human
uucccggcaaugacguccacuccaag

SEQ ID NO: 703085 - RNA, 22 nt, Human
uuuuaaccaaacaauguuaaaa

SEQ ID NO: 703086 - RNA, 19 nt, Human
aaaccacaucaaaagaaaa

SEQ ID NO: 703087 - RNA, 19 nt, Human
acuccuuugcccagacugg

SEQ ID NO: 703088 - RNA, 25 nt, Human
acuccuuugcccagacugggagaca

SEQ ID NO: 703089 - RNA, 24 nt, Human
agacugggagacaaacauaccccu

SEQ ID NO: 703090 - RNA, 21 nt, Human
agcagugauaauaacucacac

SEQ ID NO: 703091 - RNA, 19 nt, Human
aucagccacacaaggagcu

SEQ ID NO: 703092 - RNA, 20 nt, Human
augucacagcuuccucaguu

SEQ ID NO: 703093 - RNA, 22 nt, Human
caaguccuaugucacagcuucc

SEQ ID NO: 703094 - RNA, 19 nt, Human
caauauguggcucacaaau

SEQ ID NO: 703095 - RNA, 22 nt, Human
cauaccccucccuccugaacug

SEQ ID NO: 703096 - RNA, 23 nt, Human
cccuccugaacuggauccccacc

SEQ ID NO: 703097 - RNA, 20 nt, Human
cccuuuccugccauucacuc

SEQ ID NO: 703098 - RNA, 20 nt, Human
ccuccugaacuggaucccca

SEQ ID NO: 703099 - RNA, 23 nt, Human
cucccuccugaacuggaucccca

SEQ ID NO: 703100 - RNA, 18 nt, Human
cugaacuacaucauuucc

SEQ ID NO: 703101 - RNA, 24 nt, Human
cugggagacaaacauaccccuccc

SEQ ID NO: 703102 - RNA, 20 nt, Human
cuuuaagguucaaagaaaaa

SEQ ID NO: 703103 - RNA, 20 nt, Human
gagauggcccuuuccugcca

SEQ ID NO: 703104 - RNA, 22 nt, Human
uaacucaauagaaagacagcag

SEQ ID NO: 703105 - RNA, 23 nt, Human
uagaacucccaauauguggcuca

SEQ ID NO: 703106 - RNA, 19 nt, Human
ucacucaaaucuagaacuc

SEQ ID NO: 703107 - RNA, 20 nt, Human
uccagacacaucagccacag

SEQ ID NO: 703108 - RNA, 21 nt, Human
uccccaccaccuuuccaaagg

SEQ ID NO: 703109 - RNA, 20 nt, Human
ugacaagaacuuuccagagc

SEQ ID NO: 703110 - RNA, 21 nt, Human
ugccauucacucaaaucuaga

SEQ ID NO: 703111 - RNA, 18 nt, Human
ugguauucaccacaaaga

SEQ ID NO: 703112 - RNA, 18 nt, Human
uggugggagcuuuucugc

SEQ ID NO: 703113 - RNA, 20 nt, Human
uucacucaaaucuagaacuc

SEQ ID NO: 703114 - RNA, 24 nt, Human
uuccaaaggccacuggacaugucu

SEQ ID NO: 703115 - RNA, 18 nt, Human
uucucuguagaauucuga

SEQ ID NO: 703116 - RNA, 21 nt, Human
uucucuguagaauucugagaa

SEQ ID NO: 703117 - RNA, 18 nt, Human
uugacaagaacuuuccag

SEQ ID NO: 703118 - RNA, 24 nt, Human
uuuuuuuuuuuuuuuuaaauuuuu

SEQ ID NO: 703119 - RNA, 24 nt, Human
aaauaaauaaauucacauuaggca

SEQ ID NO: 703120 - RNA, 26 nt, Human
acuucgaaggugcugaggccaaaaag

SEQ ID NO: 703121 - RNA, 23 nt, Human
agccucggugcucacagagacgg

SEQ ID NO: 703122 - RNA, 21 nt, Human
aggugcugaggccaaaaagcc

SEQ ID NO: 703123 - RNA, 18 nt, Human
cagcggcggcgcgucugg

SEQ ID NO: 703124 - RNA, 23 nt, Human
ccaggaaaggcagucugccaagg

SEQ ID NO: 703125 - RNA, 23 nt, Human
cccccgucgggaucgcccgugcc

SEQ ID NO: 703126 - RNA, 19 nt, Human
cccgugcccucuuccagga

SEQ ID NO: 703127 - RNA, 24 nt, Human
ccgaggugugaaguggccccuucc

SEQ ID NO: 703128 - RNA, 21 nt, Human
ccggcggccggcggccgcuuu

SEQ ID NO: 703129 - RNA, 19 nt, Human
cgaaggugcugaggccaaa

SEQ ID NO: 703130 - RNA, 18 nt, Human
cugccaaggaaccacuuc

SEQ ID NO: 703131 - RNA, 25 nt, Human
gcagagccuccugcuugccucaaag

SEQ ID NO: 703132 - RNA, 25 nt, Human
gccaaaaagccucggugcucacaga

SEQ ID NO: 703133 - RNA, 19 nt, Human
ggaggggcugagaagggcc

SEQ ID NO: 703134 - RNA, 25 nt, Human
ggcagcggcggcgcgucugggggcc

SEQ ID NO: 703135 - RNA, 20 nt, Human
ggcugagaagggccgccgcg

SEQ ID NO: 703136 - RNA, 23 nt, Human
uaaauaaauucacauuaggcaga

SEQ ID NO: 703137 - RNA, 18 nt, Human
ucccuccauggagggagg

SEQ ID NO: 703138 - RNA, 19 nt, Human
ucuagcccuaugggucccu

SEQ ID NO: 703139 - RNA, 20 nt, Human
ugagaagggccgccgcggug

SEQ ID NO: 703140 - RNA, 18 nt, Human
ugcccucuuccaggaaag

SEQ ID NO: 703141 - RNA, 18 nt, Human
uuuuuuuuuuuuuuuuug

SEQ ID NO: 703142 - RNA, 20 nt, Human
acgaggcggaguccaggucu

SEQ ID NO: 703143 - RNA, 19 nt, Human
cccaaggucauaccuaugc

SEQ ID NO: 703144 - RNA, 18 nt, Human
cccgagccccggggacga

SEQ ID NO: 703145 - RNA, 23 nt, Human
ccgugcaagcaagcuaaaccaaa

SEQ ID NO: 703146 - RNA, 23 nt, Human
ccuacaacccgugcaagcaagcu

SEQ ID NO: 703147 - RNA, 19 nt, Human
ccuaugcucaggugccuau

SEQ ID NO: 703148 - RNA, 20 nt, Human
ccugcacgccugcgacaggc

SEQ ID NO: 703149 - RNA, 21 nt, Human
cuuauggagccaaugucuucc

SEQ ID NO: 703150 - RNA, 22 nt, Human
gaauguucuuggcagauggagg

SEQ ID NO: 703151 - RNA, 21 nt, Human
gaguccaggucccugcacgcc

SEQ ID NO: 703152 - RNA, 20 nt, Human
gcccgagccccggggacgag

SEQ ID NO: 703153 - RNA, 19 nt, Human
ggaaaaaagaaauggaauu

SEQ ID NO: 703154 - RNA, 23 nt, Human
ggagccaaugucuucccaagguc

SEQ ID NO: 703155 - RNA, 20 nt, Human
gucccuuuuugguagguuuu

SEQ ID NO: 703156 - RNA, 20 nt, Human
uacuugcuuuuuucuuuauc

SEQ ID NO: 703157 - RNA, 21 nt, Human
ucccaaggucauaccuaugcu

SEQ ID NO: 703158 - RNA, 20 nt, Human
ucucuuggcauugcuuaugg

SEQ ID NO: 703159 - RNA, 23 nt, Human
ucucuuggcauugcuuauggagc

SEQ ID NO: 703160 - RNA, 19 nt, Human
ugcaagcaagcuaaaccaa

SEQ ID NO: 703161 - RNA, 22 nt, Human
ugcaucacccaaacucacuauu

SEQ ID NO: 703162 - RNA, 18 nt, Human
uugaucauucucuuggca

SEQ ID NO: 703163 - RNA, 21 nt, Human
aaauggggcaaucacaagagu

SEQ ID NO: 703164 - RNA, 21 nt, Human
aaauggggcaaucacaagagu

SEQ ID NO: 703165 - RNA, 18 nt, Human
aacacucuggcuuuuguu

SEQ ID NO: 703166 - RNA, 18 nt, Human
aacacucuggcuuuuguu

SEQ ID NO: 703167 - RNA, 20 nt, Human
aaccagggaaaucagggcca

SEQ ID NO: 703168 - RNA, 20 nt, Human
aaccagggaaaucagggcca

SEQ ID NO: 703169 - RNA, 20 nt, Human
aagugagucucaaaccaggg

SEQ ID NO: 703170 - RNA, 20 nt, Human
aagugagucucaaaccaggg

SEQ ID NO: 703171 - RNA, 26 nt, Human
acaauauaauaaauauauuaaauaua

SEQ ID NO: 703172 - RNA, 23 nt, Human
acagaugaagugagagcggguag

SEQ ID NO: 703173 - RNA, 21 nt, Human
acagcccaggagagaaaggcc

SEQ ID NO: 703174 - RNA, 22 nt, Human
agaaaaagguuuauuuggcuca

SEQ ID NO: 703175 - RNA, 24 nt, Human
agaacucacucacuguccccaccu

SEQ ID NO: 703176 - RNA, 19 nt, Human
agaccagagacagcccagg

SEQ ID NO: 703177 - RNA, 22 nt, Human
agaccagagacagcccaggaga

SEQ ID NO: 703178 - RNA, 18 nt, Human
agagacagcccaggagag

SEQ ID NO: 703179 - RNA, 22 nt, Human
aggaagugagucucaaaccagg

SEQ ID NO: 703180 - RNA, 22 nt, Human
aggaagugagucucaaaccagg

SEQ ID NO: 703181 - RNA, 18 nt, Human
aggcaggggcucgggccu

SEQ ID NO: 703182 - RNA, 19 nt, Human
agugagagcggguaggugc

SEQ ID NO: 703183 - RNA, 24 nt, Human
cacaucuccacaucaguccgcacc

SEQ ID NO: 703184 - RNA, 24 nt, Human
cacucuggcuuuuguugccagagg

SEQ ID NO: 703185 - RNA, 24 nt, Human
cacucuggcuuuuguugccagagg

SEQ ID NO: 703186 - RNA, 24 nt, Human
cagcuuccacucaauggcugaagg

SEQ ID NO: 703187 - RNA, 20 nt, Human
caucaguccgcaccgccacc

SEQ ID NO: 703188 - RNA, 19 nt, Human
ccagaccagagacagccca

SEQ ID NO: 703189 - RNA, 20 nt, Human
ccaggaaacccagagguagg

SEQ ID NO: 703190 - RNA, 20 nt, Human
ccagucaccgucugcagccu

SEQ ID NO: 703191 - RNA, 24 nt, Human
ccccaggguugggagaguucuuuc

SEQ ID NO: 703192 - RNA, 19 nt, Human
cccgggaaggcaggggcuc

SEQ ID NO: 703193 - RNA, 18 nt, Human
cccucuccuucuuggccc

SEQ ID NO: 703194 - RNA, 18 nt, Human
cccuguggggggacuugg

SEQ ID NO: 703195 - RNA, 18 nt, Human
cccuguggggggacuugg

SEQ ID NO: 703196 - RNA, 19 nt, Human
ccugcagaggcccuguggg

SEQ ID NO: 703197 - RNA, 19 nt, Human
ccugcagaggcccuguggg

SEQ ID NO: 703198 - RNA, 21 nt, Human
ccugcagaggcccuguggggg

SEQ ID NO: 703199 - RNA, 21 nt, Human
ccugcagaggcccuguggggg

SEQ ID NO: 703200 - RNA, 21 nt, Human
ccuguggggggacuuggccca

SEQ ID NO: 703201 - RNA, 21 nt, Human
ccuguggggggacuuggccca

SEQ ID NO: 703202 - RNA, 21 nt, Human
cuccacaucaguccgcaccgc

SEQ ID NO: 703203 - RNA, 21 nt, Human
cucuuuaacaaccagcucugg

SEQ ID NO: 703204 - RNA, 20 nt, Human
cuuggacucucaagaagggg

SEQ ID NO: 703205 - RNA, 20 nt, Human
cuuggacucucaagaagggg

SEQ ID NO: 703206 - RNA, 23 nt, Human
gaagccagggccagucaccgucu

SEQ ID NO: 703207 - RNA, 21 nt, Human
gcaccgccacccaggaagcca

SEQ ID NO: 703208 - RNA, 24 nt, Human
gccacccuuaggcaauuccuccua

SEQ ID NO: 703209 - RNA, 20 nt, Human
gcucacaguucugauggcuu

SEQ ID NO: 703210 - RNA, 21 nt, Human
gcugaauuucccgagagccag

SEQ ID NO: 703211 - RNA, 21 nt, Human
ggcagaaagugggcuggagug

SEQ ID NO: 703212 - RNA, 21 nt, Human
ggccuuucucccucuccuucu

SEQ ID NO: 703213 - RNA, 18 nt, Human
ggcucuuuaacaaccagc

SEQ ID NO: 703214 - RNA, 21 nt, Human
guccgcaccgccacccaggaa

SEQ ID NO: 703215 - RNA, 27 nt, Human
uaagagaacucacucacuguccccacc

SEQ ID NO: 703216 - RNA, 22 nt, Human
uacauaaaaauuauuucugcuc

SEQ ID NO: 703217 - RNA, 22 nt, Human
uacauaaaaauuauuucugcuc

SEQ ID NO: 703218 - RNA, 18 nt, Human
uaggccccaggguuggga

SEQ ID NO: 703219 - RNA, 18 nt, Human
ucacuguccccaccucgg

SEQ ID NO: 703220 - RNA, 27 nt, Human
ucccgagagccaggcugaccagaccag

SEQ ID NO: 703221 - RNA, 20 nt, Human
ucccucuccuucuuggccca

SEQ ID NO: 703222 - RNA, 22 nt, Human
ucccucuccuucuuggcccaaa

SEQ ID NO: 703223 - RNA, 19 nt, Human
uccgcaccgccacccagga

SEQ ID NO: 703224 - RNA, 24 nt, Human
uccgcaccgccacccaggaagcca

SEQ ID NO: 703225 - RNA, 24 nt, Human
uccuccuauacagcuaggccccag

SEQ ID NO: 703226 - RNA, 24 nt, Human
ucucaagaaggggguagcugccag

SEQ ID NO: 703227 - RNA, 24 nt, Human
ucucaagaaggggguagcugccag

SEQ ID NO: 703228 - RNA, 27 nt, Human
ucuccacaucaguccgcaccgccaccc

SEQ ID NO: 703229 - RNA, 24 nt, Human
ucuuggacucucaagaagggggua

SEQ ID NO: 703230 - RNA, 24 nt, Human
ucuuggacucucaagaagggggua

SEQ ID NO: 703231 - RNA, 22 nt, Human
ugaggaagugagucucaaacca

SEQ ID NO: 703232 - RNA, 22 nt, Human
ugaggaagugagucucaaacca

SEQ ID NO: 703233 - RNA, 19 nt, Human
uggcugaauuucccgagag

SEQ ID NO: 703234 - RNA, 20 nt, Human
ugggcaucaagauugggcau

SEQ ID NO: 703235 - RNA, 21 nt, Human
uggggcaaucacaagaguggg

SEQ ID NO: 703236 - RNA, 21 nt, Human
uggggcaaucacaagaguggg

SEQ ID NO: 703237 - RNA, 23 nt, Human
uuggcucacaguucugauggcug

SEQ ID NO: 703238 - RNA, 22 nt, Human
uuuuuuuuuuuucuguuuuuaa

SEQ ID NO: 703239 - RNA, 18 nt, Human
uuuuuuuuuuuuuuucug

SEQ ID NO: 703240 - RNA, 24 nt, Human
uuuuuuuuuuuuuuuucuguuuuu

SEQ ID NO: 703241 - RNA, 22 nt, Human
acccucacgcugcgugcccucu

SEQ ID NO: 703242 - RNA, 20 nt, Human
acucugaagucgaagauggg

SEQ ID NO: 703243 - RNA, 20 nt, Human
aggcaggcugggguggaggg

SEQ ID NO: 703244 - RNA, 23 nt, Human
aggcaggcugggguggaggggcu

SEQ ID NO: 703245 - RNA, 19 nt, Human
aggcugggguggaggggcu

SEQ ID NO: 703246 - RNA, 22 nt, Human
aggggcuggcggagccuggggg

SEQ ID NO: 703247 - RNA, 19 nt, Human
aggugggcugcuccagcuu

SEQ ID NO: 703248 - RNA, 19 nt, Human
aggugggcugcuccagcuu

SEQ ID NO: 703249 - RNA, 24 nt, Human
auagaggcuguuggcgcuggacag

SEQ ID NO: 703250 - RNA, 24 nt, Human
cacagccaggguuccagcuucacc

SEQ ID NO: 703251 - RNA, 21 nt, Human
cacagcuguggcccccgaagc

SEQ ID NO: 703252 - RNA, 20 nt, Human
cacagguguugaaccagugu

SEQ ID NO: 703253 - RNA, 20 nt, Human
cacagguguugaaccagugu

SEQ ID NO: 703254 - RNA, 20 nt, Human
cacagguguugaaccagugu

SEQ ID NO: 703255 - RNA, 19 nt, Human
caccaggaccaggcucuuc

SEQ ID NO: 703256 - RNA, 25 nt, Human
cacucggcacagccaggguuccagc

SEQ ID NO: 703257 - RNA, 24 nt, Human
cagcaggcaggcugggguggaggg

SEQ ID NO: 703258 - RNA, 24 nt, Human
cagcuccauaaggaagcacucgau

SEQ ID NO: 703259 - RNA, 23 nt, Human
caggcucuucuccuugggccucc

SEQ ID NO: 703260 - RNA, 19 nt, Human
caggucguguggccaggug

SEQ ID NO: 703261 - RNA, 19 nt, Human
caggucguguggccaggug

SEQ ID NO: 703262 - RNA, 19 nt, Human
caggucguguggccaggug

SEQ ID NO: 703263 - RNA, 27 nt, Human
caggugugacugcagguguggccggcg

SEQ ID NO: 703264 - RNA, 27 nt, Human
caggugugacugcagguguggccggcg

SEQ ID NO: 703265 - RNA, 22 nt, Human
ccacaggucguguggccaggug

SEQ ID NO: 703266 - RNA, 22 nt, Human
ccacaggucguguggccaggug

SEQ ID NO: 703267 - RNA, 22 nt, Human
ccacaggucguguggccaggug

SEQ ID NO: 703268 - RNA, 23 nt, Human
cccacagcuguggcccccgaagc

SEQ ID NO: 703269 - RNA, 21 nt, Human
cccccgaagcuccaggugcaa

SEQ ID NO: 703270 - RNA, 20 nt, Human
ccgcccaccucccaguacac

SEQ ID NO: 703271 - RNA, 19 nt, Human
ccucacgcugcgugcccuc

SEQ ID NO: 703272 - RNA, 20 nt, Human
ccucccagcugacagguccu

SEQ ID NO: 703273 - RNA, 24 nt, Human
ccucccagcugacagguccugccc

SEQ ID NO: 703274 - RNA, 23 nt, Human
ccuucugcaggggcaguuaggug

SEQ ID NO: 703275 - RNA, 23 nt, Human
ccuucugcaggggcaguuaggug

SEQ ID NO: 703276 - RNA, 23 nt, Human
ccuucugcaggggcaguuaggug

SEQ ID NO: 703277 - RNA, 23 nt, Human
cggcgcgcacacaugaagucaca

SEQ ID NO: 703278 - RNA, 23 nt, Human
cggcgcgcacacaugaagucaca

SEQ ID NO: 703279 - RNA, 23 nt, Human
cggcgcgcacacaugaagucaca

SEQ ID NO: 703280 - RNA, 20 nt, Human
cgggugucccaccaccuucu

SEQ ID NO: 703281 - RNA, 23 nt, Human
cuccuugggccucccagcugaca

SEQ ID NO: 703282 - RNA, 22 nt, Human
cucuaggugggcugcuccagcu

SEQ ID NO: 703283 - RNA, 22 nt, Human
cucuaggugggcugcuccagcu

SEQ ID NO: 703284 - RNA, 18 nt, Human
cugcagcaccgugcggcc

SEQ ID NO: 703285 - RNA, 18 nt, Human
cugggcggccgcggccag

SEQ ID NO: 703286 - RNA, 22 nt, Human
cuucugcagcaccgugcggccc

SEQ ID NO: 703287 - RNA, 19 nt, Human
gacaggcagaggcugaggc

SEQ ID NO: 703288 - RNA, 23 nt, Human
gagccuggggguccgcccaccuc

SEQ ID NO: 703289 - RNA, 19 nt, Human
gccgcgggcuggggcccgg

SEQ ID NO: 703290 - RNA, 20 nt, Human
gcggugcaggcgcuugggga

SEQ ID NO: 703291 - RNA, 22 nt, Human
ggaccaggcucuucuccuuggg

SEQ ID NO: 703292 - RNA, 19 nt, Human
ggagagggugggccgggcu

SEQ ID NO: 703293 - RNA, 19 nt, Human
ggagcucggcagggcuggg

SEQ ID NO: 703294 - RNA, 20 nt, Human
ggcccccgaagcuccaggug

SEQ ID NO: 703295 - RNA, 18 nt, Human
ggcccggggcuggggguc

SEQ ID NO: 703296 - RNA, 26 nt, Human
ggccgggcucuuaccucucaggagcc

SEQ ID NO: 703297 - RNA, 20 nt, Human
ggcugggguggaggggcugg

SEQ ID NO: 703298 - RNA, 19 nt, Human
ggggagccacggcgcugcc

SEQ ID NO: 703299 - RNA, 26 nt, Human
gggggucuguggcccggacagcuggg

SEQ ID NO: 703300 - RNA, 20 nt, Human
gucuggggggccguauagga

SEQ ID NO: 703301 - RNA, 21 nt, Human
gugcggcccuuguacaugaug

SEQ ID NO: 703302 - RNA, 18 nt, Human
guggaggggcuggcggag

SEQ ID NO: 703303 - RNA, 21 nt, Human
guggaggggcuggcggagccu

SEQ ID NO: 703304 - RNA, 19 nt, Human
gugggcugcuccagcuuuc

SEQ ID NO: 703305 - RNA, 19 nt, Human
gugggcugcuccagcuuuc

SEQ ID NO: 703306 - RNA, 20 nt, Human
uagccaccgacgcugccucg

SEQ ID NO: 703307 - RNA, 20 nt, Human
uagccaccgacgcugccucg

SEQ ID NO: 703308 - RNA, 20 nt, Human
uagccaccgacgcugccucg

SEQ ID NO: 703309 - RNA, 20 nt, Human
ucacagguguccacaggugu

SEQ ID NO: 703310 - RNA, 20 nt, Human
ucacagguguccacaggugu

SEQ ID NO: 703311 - RNA, 19 nt, Human
ucacaguuccgaggcagca

SEQ ID NO: 703312 - RNA, 21 nt, Human
uccaccagcucuuggaagaag

SEQ ID NO: 703313 - RNA, 21 nt, Human
ucccaguacaccuugcacuug

SEQ ID NO: 703314 - RNA, 23 nt, Human
uccuugggccucccagcugacag

SEQ ID NO: 703315 - RNA, 18 nt, Human
ucugaagucgaagauggg

SEQ ID NO: 703316 - RNA, 27 nt, Human
ucugcaggggcaguuagguggcugucc

SEQ ID NO: 703317 - RNA, 22 nt, Human
ugaagucacagguguugaacca

SEQ ID NO: 703318 - RNA, 22 nt, Human
ugaagucacagguguugaacca

SEQ ID NO: 703319 - RNA, 22 nt, Human
ugaagucacagguguugaacca

SEQ ID NO: 703320 - RNA, 22 nt, Human
ugacagguccugcccgaagccc

SEQ ID NO: 703321 - RNA, 21 nt, Human
ugcccgaagcccagguagaug

SEQ ID NO: 703322 - RNA, 24 nt, Human
ugccgugcccggaauuccaccagc

SEQ ID NO: 703323 - RNA, 20 nt, Human
uggcccccgaagcuccaggu

SEQ ID NO: 703324 - RNA, 18 nt, Human
uggcccggacagcugggu

SEQ ID NO: 703325 - RNA, 19 nt, Human
uggcgggaaggcgcaggcc

SEQ ID NO: 703326 - RNA, 19 nt, Human
uggcgggaaggcgcaggcc

SEQ ID NO: 703327 - RNA, 19 nt, Human
uggcgggaaggcgcaggcc

SEQ ID NO: 703328 - RNA, 19 nt, Human
ugggccucccagcugacag

SEQ ID NO: 703329 - RNA, 26 nt, Human
ugggggucuguggcccggacagcugg

SEQ ID NO: 703330 - RNA, 20 nt, Human
ugggguggaggggcuggcgg

SEQ ID NO: 703331 - RNA, 23 nt, Human
ugggguggaggggcuggcggagc

SEQ ID NO: 703332 - RNA, 18 nt, Human
uggugcggggacucuggg

SEQ ID NO: 703333 - RNA, 22 nt, Human
ugucacaguuccgaggcagcag

SEQ ID NO: 703334 - RNA, 20 nt, Human
ugucccaccaccuucugcag

SEQ ID NO: 703335 - RNA, 21 nt, Human
ugucccaccaccuucugcagc

SEQ ID NO: 703336 - RNA, 22 nt, Human
ugugacugcagguguggccggc

SEQ ID NO: 703337 - RNA, 22 nt, Human
ugugacugcagguguggccggc

SEQ ID NO: 703338 - RNA, 24 nt, Human
uguggccaggugucacaggugucc

SEQ ID NO: 703339 - RNA, 24 nt, Human
uguggccaggugucacaggugucc

SEQ ID NO: 703340 - RNA, 24 nt, Human
uguggccaggugucacaggugucc

SEQ ID NO: 703341 - RNA, 18 nt, Human
uuggcgcuggacaggcag

SEQ ID NO: 703342 - RNA, 23 nt, Human
aaagaaaugagaaacaaaguggc

SEQ ID NO: 703343 - RNA, 23 nt, Human
aaauauguauaauacaacuucau

SEQ ID NO: 703344 - RNA, 26 nt, Human
aaauuaaaaaaauaucaacuuacuau

SEQ ID NO: 703345 - RNA, 18 nt, Human
aagaagaagaaaaaagaa

SEQ ID NO: 703346 - RNA, 23 nt, Human
aagaagaagaaaaaagaaaugaa

SEQ ID NO: 703347 - RNA, 22 nt, Human
acaggggaguuaaagaagaaga

SEQ ID NO: 703348 - RNA, 19 nt, Human
accauuuacaaauuguauu

SEQ ID NO: 703349 - RNA, 28 nt, Human
agaagaaaaaagaaaugagaaacaaagg

SEQ ID NO: 703350 - RNA, 20 nt, Human
agaagaaaaaagaaaugagg

SEQ ID NO: 703351 - RNA, 25 nt, Human
agaagaagaaaaaagaaaugagaag

SEQ ID NO: 703352 - RNA, 21 nt, Human
agcagaugugucaagaccaga

SEQ ID NO: 703353 - RNA, 21 nt, Human
ccugcaguuuagauuugcuau

SEQ ID NO: 703354 - RNA, 18 nt, Human
cuguuuagauuccauuca

SEQ ID NO: 703355 - RNA, 21 nt, Human
gagaaacaaaguggcuuucuc

SEQ ID NO: 703356 - RNA, 18 nt, Human
gcuugcuuaaguuuaaau

SEQ ID NO: 703357 - RNA, 19 nt, Human
ugaacagagagagcagaug

SEQ ID NO: 703358 - RNA, 20 nt, Human
uggcuuucuccccacuuguc

SEQ ID NO: 703359 - RNA, 24 nt, Human
uguacuaauuacuucaaauagcag

SEQ ID NO: 703360 - RNA, 24 nt, Human
uuacaggggaguuaaagaagaaga

SEQ ID NO: 703361 - RNA, 21 nt, Human
uucauggucaaaacauuugaa

SEQ ID NO: 703362 - RNA, 20 nt, Human
uucgggugcaaaaauuuucc

SEQ ID NO: 703363 - RNA, 24 nt, Human
uuugaaccauuuacaaauuguauu

SEQ ID NO: 703364 - RNA, 23 nt, Human
aacaguagagccuaggaccuuca

SEQ ID NO: 703365 - RNA, 19 nt, Human
aagaccccgaccaucgggc

SEQ ID NO: 703366 - RNA, 27 nt, Human
aagcugcuuccguccuuacucuccggu

SEQ ID NO: 703367 - RNA, 25 nt, Human
acaauagguagcgugugcaugagcc

SEQ ID NO: 703368 - RNA, 21 nt, Human
acagaaaaagggccccucuga

SEQ ID NO: 703369 - RNA, 18 nt, Human
agaguauugggcaugcca

SEQ ID NO: 703370 - RNA, 24 nt, Human
agggcugugugacugaacguggcc

SEQ ID NO: 703371 - RNA, 18 nt, Human
aggggcaggccugauagc

SEQ ID NO: 703372 - RNA, 22 nt, Human
augagacaaaggaacaguagag

SEQ ID NO: 703373 - RNA, 22 nt, Human
caagggccugggcugccuuugu

SEQ ID NO: 703374 - RNA, 19 nt, Human
cacguccgugccuuccagg

SEQ ID NO: 703375 - RNA, 20 nt, Human
caggacaucccugggaguaa

SEQ ID NO: 703376 - RNA, 21 nt, Human
cagggccagcgggaucagcgc

SEQ ID NO: 703377 - RNA, 21 nt, Human
cauccaaacacuuccugaaac

SEQ ID NO: 703378 - RNA, 19 nt, Human
caugccagccaccaccagc

SEQ ID NO: 703379 - RNA, 23 nt, Human
ccaaagcugcuuccguccuuacu

SEQ ID NO: 703380 - RNA, 21 nt, Human
ccagccaaagcugcuuccguc

SEQ ID NO: 703381 - RNA, 19 nt, Human
ccccauucccagcugacua

SEQ ID NO: 703382 - RNA, 28 nt, Human
cccgaccaucgggcuccccagcccugac

SEQ ID NO: 703383 - RNA, 20 nt, Human
cccugugcagacccucugca

SEQ ID NO: 703384 - RNA, 23 nt, Human
ccucaccuuccucccucucccca

SEQ ID NO: 703385 - RNA, 24 nt, Human
ccucaccuuccucccucuccccag

SEQ ID NO: 703386 - RNA, 22 nt, Human
cucaccuuccucccucucccca

SEQ ID NO: 703387 - RNA, 24 nt, Human
cuccccagcccugaccgugccacc

SEQ ID NO: 703388 - RNA, 26 nt, Human
cugaaacaccuaauaagggcuggaca

SEQ ID NO: 703389 - RNA, 18 nt, Human
cugacucagaacagagga

SEQ ID NO: 703390 - RNA, 18 nt, Human
cugccuuugucugcccca

SEQ ID NO: 703391 - RNA, 22 nt, Human
gcaccaguguggaggggccaag

SEQ ID NO: 703392 - RNA, 18 nt, Human
gcgcccuuccagaugccc

SEQ ID NO: 703393 - RNA, 23 nt, Human
gcuuggcaagggccugggcugcc

SEQ ID NO: 703394 - RNA, 21 nt, Human
gggaguaagaccccgaccauc

SEQ ID NO: 703395 - RNA, 18 nt, Human
gggcagcaagcgaggaug

SEQ ID NO: 703396 - RNA, 23 nt, Human
gggguaaaugagacaaaggaaca

SEQ ID NO: 703397 - RNA, 21 nt, Human
gugcagacccucugcauccaa

SEQ ID NO: 703398 - RNA, 22 nt, Human
uacaguaguacagaaaaagggc

SEQ ID NO: 703399 - RNA, 21 nt, Human
ucaccuuccucccucucccca

SEQ ID NO: 703400 - RNA, 20 nt, Human
ucagcgccuguaggaacaag

SEQ ID NO: 703401 - RNA, 21 nt, Human
ucagcgggacgguguuccucu

SEQ ID NO: 703402 - RNA, 23 nt, Human
uccccagcccugaccgugccacc

SEQ ID NO: 703403 - RNA, 18 nt, Human
uccccaggcuugacuccc

SEQ ID NO: 703404 - RNA, 19 nt, Human
ucccugggaguaagacccc

SEQ ID NO: 703405 - RNA, 23 nt, Human
ugaccgugccacccucaccuucc

SEQ ID NO: 703406 - RNA, 18 nt, Human
ugagcaccagggccaugg

SEQ ID NO: 703407 - RNA, 23 nt, Human
ugagcuuggcaagggccugggcu

SEQ ID NO: 703408 - RNA, 21 nt, Human
ugagugaggcugcaggcagug

SEQ ID NO: 703409 - RNA, 26 nt, Human
ugcauccaaacacuuccugaaacacc

SEQ ID NO: 703410 - RNA, 19 nt, Human
ugcuuccguccuuacucuc

SEQ ID NO: 703411 - RNA, 22 nt, Human
ugggcugccuuugucugcccca

SEQ ID NO: 703412 - RNA, 21 nt, Human
ugugugcgcccuuccagauga

SEQ ID NO: 703413 - RNA, 19 nt, Human
uguugggaugcaccuuccc

SEQ ID NO: 703414 - RNA, 20 nt, Human
uuggaggugauggugagcuu

SEQ ID NO: 703415 - RNA, 20 nt, Human
uuuggaguucuacacacuuu

SEQ ID NO: 703416 - RNA, 18 nt, Human
uuuuuuuuuuuuuuuuug

SEQ ID NO: 703417 - RNA, 23 nt, Human
uuuuuuuuuuuuuuuuuggaguu

SEQ ID NO: 703418 - RNA, 20 nt, Human
accauucacuuuagggaaau

SEQ ID NO: 703419 - RNA, 20 nt, Human
cgaggacgagggggaauuca

SEQ ID NO: 703420 - RNA, 25 nt, Human
gacgagggggaauucacgaaaggga

SEQ ID NO: 703421 - RNA, 22 nt, Human
uaacacuguagacuguagcgca

SEQ ID NO: 703422 - RNA, 18 nt, Human
uuaaggugagcgaggacg

SEQ ID NO: 703423 - RNA, 19 nt, Human
aacuccuccccccuccccc

SEQ ID NO: 703424 - RNA, 22 nt, Human
aacuccuccccccucccccccg

SEQ ID NO: 703425 - RNA, 20 nt, Human
acacaagcacgugggggcau

SEQ ID NO: 703426 - RNA, 21 nt, Human
acuccuccccccucccccccg

SEQ ID NO: 703427 - RNA, 20 nt, Human
acucuauauacagaaaaggg

SEQ ID NO: 703428 - RNA, 24 nt, Human
acuggagccgccggcagaggccug

SEQ ID NO: 703429 - RNA, 22 nt, Human
caacuccuccccccuccccccc

SEQ ID NO: 703430 - RNA, 21 nt, Human
caccuggacgcgagcucggga

SEQ ID NO: 703431 - RNA, 22 nt, Human
caccuggacgcgagcucgggac

SEQ ID NO: 703432 - RNA, 23 nt, Human
cagccgcgccugccccgccgccc

SEQ ID NO: 703433 - RNA, 22 nt, Human
ccaacuccuccccccucccccc

SEQ ID NO: 703434 - RNA, 19 nt, Human
cccaacuccuccccccucc

SEQ ID NO: 703435 - RNA, 25 nt, Human
cccacauucccucccuccccaacuu

SEQ ID NO: 703436 - RNA, 18 nt, Human
ccccaacuccuccccccu

SEQ ID NO: 703437 - RNA, 20 nt, Human
ccccaacuccuccccccucc

SEQ ID NO: 703438 - RNA, 22 nt, Human
cccccgcaaaaguaaaagaaga

SEQ ID NO: 703439 - RNA, 21 nt, Human
ccccgccgcccagcuccgcgg

SEQ ID NO: 703440 - RNA, 24 nt, Human
cccggucggcccgacgaggcggcg

SEQ ID NO: 703441 - RNA, 18 nt, Human
ccgcgccugccccgccgc

SEQ ID NO: 703442 - RNA, 22 nt, Human
ccuccccccucccccccgcaaa

SEQ ID NO: 703443 - RNA, 23 nt, Human
ccucccuccccaacuccuccccc

SEQ ID NO: 703444 - RNA, 19 nt, Human
cggcccgacgaggcggcgg

SEQ ID NO: 703445 - RNA, 20 nt, Human
cugccccgccgcccagcucc

SEQ ID NO: 703446 - RNA, 19 nt, Human
cuggagccgccggcagagg

SEQ ID NO: 703447 - RNA, 20 nt, Human
gcagaggccuggccaccugg

SEQ ID NO: 703448 - RNA, 21 nt, Human
gccgcgccugccccgccgccc

SEQ ID NO: 703449 - RNA, 21 nt, Human
gggaaagagacacaagcacgu

SEQ ID NO: 703450 - RNA, 19 nt, Human
uaauuccucccacauuccc

SEQ ID NO: 703451 - RNA, 23 nt, Human
ucccccccgcaaaaguaaaagaa

SEQ ID NO: 703452 - RNA, 25 nt, Human
uccccccucccccccgcaaaaguca

SEQ ID NO: 703453 - RNA, 18 nt, Human
ugccccgccgcccagcuc

SEQ ID NO: 703454 - RNA, 19 nt, Human
uuauuagacaaaaauauau

SEQ ID NO: 703455 - RNA, 30 nt, Human
uuccucccacauucccucccuccccaacuu

SEQ ID NO: 703456 - RNA, 19 nt, Human
acacacaaaggcagacacg

SEQ ID NO: 703457 - RNA, 26 nt, Human
acuuucuuuguuuaguuuugcuuuua

SEQ ID NO: 703458 - RNA, 21 nt, Human
agaggggggccgacccccggg

SEQ ID NO: 703459 - RNA, 26 nt, Human
caaaaucaaccggacaaacaaaccuc

SEQ ID NO: 703460 - RNA, 20 nt, Human
cacguuuauucucacugaaa

SEQ ID NO: 703461 - RNA, 19 nt, Human
cacugaaacuccacccccc

SEQ ID NO: 703462 - RNA, 20 nt, Human
cagcucagcgccgcccgcgg

SEQ ID NO: 703463 - RNA, 19 nt, Human
cccccaaaaucaaccggac

SEQ ID NO: 703464 - RNA, 21 nt, Human
cccccaaaaucaaccggacaa

SEQ ID NO: 703465 - RNA, 24 nt, Human
cccccaaaaucaaccggacaaaca

SEQ ID NO: 703466 - RNA, 22 nt, Human
ccccccaaaaucaaccggacaa

SEQ ID NO: 703467 - RNA, 19 nt, Human
cccccgggccgcccagcuc

SEQ ID NO: 703468 - RNA, 18 nt, Human
ccccgggccgcccagcuc

SEQ ID NO: 703469 - RNA, 21 nt, Human
cgacccccgggccgcccagcu

SEQ ID NO: 703470 - RNA, 18 nt, Human
cggacaaacaaaccucac

SEQ ID NO: 703471 - RNA, 22 nt, Human
cggagaggggggccgacccccg

SEQ ID NO: 703472 - RNA, 28 nt, Human
cguacaauuugguucacacauauguaca

SEQ ID NO: 703473 - RNA, 22 nt, Human
cucacugaaacuccacccccca

SEQ ID NO: 703474 - RNA, 23 nt, Human
cucacugaaacuccaccccccaa

SEQ ID NO: 703475 - RNA, 24 nt, Human
cucacugaaacuccaccccccaaa

SEQ ID NO: 703476 - RNA, 18 nt, Human
gacccccgggccgcccag

SEQ ID NO: 703477 - RNA, 19 nt, Human
guuuuauuucuuuuucuua

SEQ ID NO: 703478 - RNA, 20 nt, Human
guuuuauuucuuuuucuuac

SEQ ID NO: 703479 - RNA, 19 nt, Human
uacacacacacaaaggcag

SEQ ID NO: 703480 - RNA, 24 nt, Human
uacauuucucuguauauauacaca

SEQ ID NO: 703481 - RNA, 20 nt, Human
uaguuuugcuuuuagguauc

SEQ ID NO: 703482 - RNA, 25 nt, Human
uauauacacacacacaaaggcagac

SEQ ID NO: 703483 - RNA, 18 nt, Human
ucaaccggacaaacaaac

SEQ ID NO: 703484 - RNA, 23 nt, Human
ucacugaaacuccaccccccaaa

SEQ ID NO: 703485 - RNA, 18 nt, Human
ugaaacuccaccccccaa

SEQ ID NO: 703486 - RNA, 23 nt, Human
uggcagcagcucauuuauuuagc

SEQ ID NO: 703487 - RNA, 20 nt, Human
uguuuaguuuugcuuuuagg

SEQ ID NO: 703488 - RNA, 22 nt, Human
acagcagaccacgcuucagaac

SEQ ID NO: 703489 - RNA, 18 nt, Human
agaagcccccucuccggu

SEQ ID NO: 703490 - RNA, 22 nt, Human
agcaucauauuauggagucgag

SEQ ID NO: 703491 - RNA, 27 nt, Human
agcugcaggcuucuaggcgcugggagg

SEQ ID NO: 703492 - RNA, 18 nt, Human
aggcccgacaggcccagg

SEQ ID NO: 703493 - RNA, 18 nt, Human
aggcgguggaggccccgg

SEQ ID NO: 703494 - RNA, 20 nt, Human
aucuggccucuucugcuccg

SEQ ID NO: 703495 - RNA, 24 nt, Human
cagaagcccccucuccgguggguu

SEQ ID NO: 703496 - RNA, 21 nt, Human
caggcuucuaggcgcugggag

SEQ ID NO: 703497 - RNA, 18 nt, Human
caggguaucuggccucuu

SEQ ID NO: 703498 - RNA, 20 nt, Human
ccccggcguggcagcgccgg

SEQ ID NO: 703499 - RNA, 23 nt, Human
cccggggcggacgggcggggccu

SEQ ID NO: 703500 - RNA, 27 nt, Human
cccuccugggcucgggacccgcccgcc

SEQ ID NO: 703501 - RNA, 22 nt, Human
ccugcaggguucugcgcgcugg

SEQ ID NO: 703502 - RNA, 24 nt, Human
ccugcaggguucugcgcgcugggg

SEQ ID NO: 703503 - RNA, 23 nt, Human
cgagugugcaagagucaacucag

SEQ ID NO: 703504 - RNA, 18 nt, Human
cgcggccacugcuccgga

SEQ ID NO: 703505 - RNA, 19 nt, Human
cgcggcccggggcggacgg

SEQ ID NO: 703506 - RNA, 21 nt, Human
cggcccggggcggacgggcgg

SEQ ID NO: 703507 - RNA, 24 nt, Human
cuccugggcucgggacccgcccgc

SEQ ID NO: 703508 - RNA, 24 nt, Human
gcccggggcggacgggcggggccu

SEQ ID NO: 703509 - RNA, 20 nt, Human
gcgcgcuggggccggcgugg

SEQ ID NO: 703510 - RNA, 18 nt, Human
ggcguggcagcgccgggc

SEQ ID NO: 703511 - RNA, 24 nt, Human
uacgucugaggaugaaaucggagg

SEQ ID NO: 703512 - RNA, 24 nt, Human
uaggcgcugggagggcgaagcagg

SEQ ID NO: 703513 - RNA, 18 nt, Human
uauuauggagucgagugu

SEQ ID NO: 703514 - RNA, 22 nt, Human
ucagaagcccccucuccggugg

SEQ ID NO: 703515 - RNA, 21 nt, Human
ucaggguaucuggccucuucu

SEQ ID NO: 703516 - RNA, 21 nt, Human
ucagugcaagugcuguuggug

SEQ ID NO: 703517 - RNA, 21 nt, Human
uccucuggaaacucagugaaa

SEQ ID NO: 703518 - RNA, 20 nt, Human
ucgcgguggccgcgcuaguc

SEQ ID NO: 703519 - RNA, 20 nt, Human
ugaaaagagucggcgccguc

SEQ ID NO: 703520 - RNA, 19 nt, Human
ugaagcaggcaauuauugg

SEQ ID NO: 703521 - RNA, 23 nt, Human
ugaagcaggcaauuauuggugug

SEQ ID NO: 703522 - RNA, 20 nt, Human
ugagcgcggguucccuccug

SEQ ID NO: 703523 - RNA, 24 nt, Human
ugugcaagagucaacucagugcaa

SEQ ID NO: 703524 - RNA, 27 nt, Human
uucgcgguggccgcgcuagucuuccuc

SEQ ID NO: 703525 - RNA, 19 nt, Human
cuccuguacuggcaaagau

SEQ ID NO: 703526 - RNA, 22 nt, Human
ggcugugggcugugggcugugg

SEQ ID NO: 703527 - RNA, 19 nt, Human
ugggcugugggcugugggc

SEQ ID NO: 703528 - RNA, 24 nt, Human
agagaggagaggagagggcagagc

SEQ ID NO: 703529 - RNA, 18 nt, Human
agcggcggccacguagag

SEQ ID NO: 703530 - RNA, 21 nt, Human
agugugcggccaggggcagaa

SEQ ID NO: 703531 - RNA, 21 nt, Human
augcagggagcaugcgagguc

SEQ ID NO: 703532 - RNA, 18 nt, Human
caaaggcucacauacucu

SEQ ID NO: 703533 - RNA, 20 nt, Human
caggggcagaaggacgaggg

SEQ ID NO: 703534 - RNA, 19 nt, Human
cagucuggugaaagcaggu

SEQ ID NO: 703535 - RNA, 23 nt, Human
cauccuggcgccuugggcugucc

SEQ ID NO: 703536 - RNA, 18 nt, Human
ccagaccgugucucucgg

SEQ ID NO: 703537 - RNA, 22 nt, Human
ccccuuccuuuuccccgcuagg

SEQ ID NO: 703538 - RNA, 21 nt, Human
ccuggcgccuugggcugucca

SEQ ID NO: 703539 - RNA, 22 nt, Human
cgccagggagcgcugagcuggg

SEQ ID NO: 703540 - RNA, 21 nt, Human
cuaacccugguaagucccaga

SEQ ID NO: 703541 - RNA, 19 nt, Human
cuccgggccggccgagaug

SEQ ID NO: 703542 - RNA, 24 nt, Human
cugaguuauccccuuccuuuuccc

SEQ ID NO: 703543 - RNA, 20 nt, Human
gacacagguggggcguggag

SEQ ID NO: 703544 - RNA, 21 nt, Human
gcaaagugugcggccaggggc

SEQ ID NO: 703545 - RNA, 20 nt, Human
gcgcaaagugugcggccagg

SEQ ID NO: 703546 - RNA, 25 nt, Human
gcgggcuggcagggagggguccccc

SEQ ID NO: 703547 - RNA, 23 nt, Human
ggccaggggcagaaggacgaggg

SEQ ID NO: 703548 - RNA, 21 nt, Human
gggagcaugcgagguccgcgg

SEQ ID NO: 703549 - RNA, 19 nt, Human
ggggcagaaggacgagggu

SEQ ID NO: 703550 - RNA, 24 nt, Human
gugugcggccaggggcagaaggac

SEQ ID NO: 703551 - RNA, 23 nt, Human
ucucucauaaauaacaauagaau

SEQ ID NO: 703552 - RNA, 21 nt, Human
ugcggccaggggcagaaggac

SEQ ID NO: 703553 - RNA, 18 nt, Human
uggagagacagagcggcg

SEQ ID NO: 703554 - RNA, 24 nt, Human
uggggcguggagagacagagcggc

SEQ ID NO: 703555 - RNA, 19 nt, Human
ugucuguuccucugaguua

SEQ ID NO: 703556 - RNA, 18 nt, Human
uugagugucuguuccucu

SEQ ID NO: 703557 - RNA, 20 nt, Human
agagucgacucaggcagcgg

SEQ ID NO: 703558 - RNA, 21 nt, Human
agggucguggggggcagcggg

SEQ ID NO: 703559 - RNA, 19 nt, Human
cagcggggaggaagagccg

SEQ ID NO: 703560 - RNA, 21 nt, Human
cgacucaggcagcggcggcgg

SEQ ID NO: 703561 - RNA, 22 nt, Human
gaggaagagccgagaaacugug

SEQ ID NO: 703562 - RNA, 21 nt, Human
gggucguggggggcagcgggg

SEQ ID NO: 703563 - RNA, 19 nt, Human
ggucguggggggcagcggg

SEQ ID NO: 703564 - RNA, 22 nt, Human
uagggucguggggggcagcggg

SEQ ID NO: 703565 - RNA, 20 nt, Human
uucaagguagggucgugggg

SEQ ID NO: 703566 - RNA, 18 nt, Human
uuugugggggccuucaag

SEQ ID NO: 703567 - RNA, 19 nt, Human
uuuuuuuuuugagggcuga

SEQ ID NO: 703568 - RNA, 19 nt, Human
uuuuuuuuuuuugagggcu

SEQ ID NO: 703569 - RNA, 19 nt, Human
uuuuuuuuuuuuugagggc

SEQ ID NO: 703570 - RNA, 22 nt, Human
uuuuuuuuuuuuuuuuugaggg

SEQ ID NO: 703571 - RNA, 22 nt, Human
aaagaaauauaaguuacccagu

SEQ ID NO: 703572 - RNA, 21 nt, Human
aacaggcaggaaagugagagg

SEQ ID NO: 703573 - RNA, 24 nt, Human
aacaggcaggaaagugagagggug

SEQ ID NO: 703574 - RNA, 20 nt, Human
aagcugguaaagugaaagca

SEQ ID NO: 703575 - RNA, 24 nt, Human
accccacugggaaacagagacaau

SEQ ID NO: 703576 - RNA, 20 nt, Human
agagacaaugcccaugaggg

SEQ ID NO: 703577 - RNA, 20 nt, Human
agccaccugagggcuccugg

SEQ ID NO: 703578 - RNA, 22 nt, Human
agcugcacucuggagaccaaua

SEQ ID NO: 703579 - RNA, 19 nt, Human
aggaaagugagagggugga

SEQ ID NO: 703580 - RNA, 23 nt, Human
aggaaugggaggagugauggugg

SEQ ID NO: 703581 - RNA, 18 nt, Human
aggaggagggaagcagag

SEQ ID NO: 703582 - RNA, 21 nt, Human
aggagggaagcagaggguggg

SEQ ID NO: 703583 - RNA, 20 nt, Human
augguggggaacugugggga

SEQ ID NO: 703584 - RNA, 23 nt, Human
augguggggaacuguggggagcc

SEQ ID NO: 703585 - RNA, 24 nt, Human
caaacaaaagccccaguguuggcu

SEQ ID NO: 703586 - RNA, 20 nt, Human
caacgucagcucccuccugu

SEQ ID NO: 703587 - RNA, 21 nt, Human
caagagugaguauaagacuug

SEQ ID NO: 703588 - RNA, 22 nt, Human
caagccaacgucagcucccucc

SEQ ID NO: 703589 - RNA, 26 nt, Human
caccagaguccacaggaaagcagcag

SEQ ID NO: 703590 - RNA, 22 nt, Human
caccaggcccuggcuuugcucc

SEQ ID NO: 703591 - RNA, 24 nt, Human
caccccacugggaaacagagacaa

SEQ ID NO: 703592 - RNA, 21 nt, Human
caccugagggcuccuggcuuc

SEQ ID NO: 703593 - RNA, 19 nt, Human
cacuuucccucccauccug

SEQ ID NO: 703594 - RNA, 19 nt, Human
cagaaaaggcuuggaauca

SEQ ID NO: 703595 - RNA, 22 nt, Human
cagcagcaucccuaggacucaa

SEQ ID NO: 703596 - RNA, 18 nt, Human
caggaucacgaggaggag

SEQ ID NO: 703597 - RNA, 24 nt, Human
caggccccaaggagggcucaagag

SEQ ID NO: 703598 - RNA, 18 nt, Human
caggguucuaggguugcc

SEQ ID NO: 703599 - RNA, 20 nt, Human
caggucucagguuucagggg

SEQ ID NO: 703600 - RNA, 25 nt, Human
ccaaaauaaauacuguggucaggcc

SEQ ID NO: 703601 - RNA, 20 nt, Human
cccagagccccaugccaccc

SEQ ID NO: 703602 - RNA, 28 nt, Human
cccaguugucuaugagaauccaacugcc

SEQ ID NO: 703603 - RNA, 20 nt, Human
cccaugagggugggccucug

SEQ ID NO: 703604 - RNA, 22 nt, Human
ccccaaaccucugcuuuuaugc

SEQ ID NO: 703605 - RNA, 23 nt, Human
cccccaaaccucugcuuuuaugc

SEQ ID NO: 703606 - RNA, 21 nt, Human
cccuccuuuuuuccuguugac

SEQ ID NO: 703607 - RNA, 19 nt, Human
ccucccauccugcccccuc

SEQ ID NO: 703608 - RNA, 20 nt, Human
ccuccucccuccuuuuuucc

SEQ ID NO: 703609 - RNA, 20 nt, Human
ccuccucccuccuuuuuucc

SEQ ID NO: 703610 - RNA, 24 nt, Human
ccugcccccucccaauggcagcua

SEQ ID NO: 703611 - RNA, 21 nt, Human
ccugucugcuuucuaagcagg

SEQ ID NO: 703612 - RNA, 22 nt, Human
cuaaaggcuucucuguuccuug

SEQ ID NO: 703613 - RNA, 23 nt, Human
cuaaaggcuucucuguuccuugg

SEQ ID NO: 703614 - RNA, 18 nt, Human
cucuccuuuucuguuuuc

SEQ ID NO: 703615 - RNA, 18 nt, Human
cucuggccucugucccuc

SEQ ID NO: 703616 - RNA, 21 nt, Human
cugagcccccaaaccucugcu

SEQ ID NO: 703617 - RNA, 23 nt, Human
cugucccucuccuuuucuguuuu

SEQ ID NO: 703618 - RNA, 18 nt, Human
cuuggaauuguacagaau

SEQ ID NO: 703619 - RNA, 19 nt, Human
gaaagcagcagauguugac

SEQ ID NO: 703620 - RNA, 21 nt, Human
gaaccaggaucacgaggagga

SEQ ID NO: 703621 - RNA, 19 nt, Human
gaagaagcugccagggagg

SEQ ID NO: 703622 - RNA, 20 nt, Human
gagggcggucgagugcacua

SEQ ID NO: 703623 - RNA, 22 nt, Human
gcagcaucccuaggacucaaaa

SEQ ID NO: 703624 - RNA, 19 nt, Human
gccccaugccacccaugua

SEQ ID NO: 703625 - RNA, 18 nt, Human
gcccuggcuuugcuccca

SEQ ID NO: 703626 - RNA, 21 nt, Human
gcuuuuccuccucccuccuuu

SEQ ID NO: 703627 - RNA, 21 nt, Human
ggaagauaaagagggaaucug

SEQ ID NO: 703628 - RNA, 19 nt, Human
ggaggacagguucugugac

SEQ ID NO: 703629 - RNA, 19 nt, Human
ggaggagggaagcagaggg

SEQ ID NO: 703630 - RNA, 24 nt, Human
ggcuauggaaccaggaucacgagg

SEQ ID NO: 703631 - RNA, 19 nt, Human
gggaaacagagacaaugcc

SEQ ID NO: 703632 - RNA, 18 nt, Human
gggaagcagaggguggga

SEQ ID NO: 703633 - RNA, 18 nt, Human
ggguuggggagggaucag

SEQ ID NO: 703634 - RNA, 19 nt, Human
uaaaaggaccccaaacaaa

SEQ ID NO: 703635 - RNA, 19 nt, Human
uaaaaggaccccaaacaaa

SEQ ID NO: 703636 - RNA, 18 nt, Human
uaaaggcuucucuguucc

SEQ ID NO: 703637 - RNA, 21 nt, Human
uaaccuggagauuuccaguaa

SEQ ID NO: 703638 - RNA, 19 nt, Human
uaaugcagacuccacacuu

SEQ ID NO: 703639 - RNA, 23 nt, Human
uacuguggucaggccucaggaac

SEQ ID NO: 703640 - RNA, 21 nt, Human
uaguuuuggugccagcucuuc

SEQ ID NO: 703641 - RNA, 18 nt, Human
uaugaaucaccagagucc

SEQ ID NO: 703642 - RNA, 19 nt, Human
uauggaaccaggaucacga

SEQ ID NO: 703643 - RNA, 22 nt, Human
uauuugugcuacauaaccagug

SEQ ID NO: 703644 - RNA, 24 nt, Human
ucagcucccuccuguggagugggg

SEQ ID NO: 703645 - RNA, 23 nt, Human
ucagguuucaggggggauggcag

SEQ ID NO: 703646 - RNA, 22 nt, Human
uccacaggaaagcagcagaugu

SEQ ID NO: 703647 - RNA, 22 nt, Human
ucccauccugcccccucccaau

SEQ ID NO: 703648 - RNA, 21 nt, Human
uccccagagccccaugccacc

SEQ ID NO: 703649 - RNA, 22 nt, Human
uccccagagccccaugccaccc

SEQ ID NO: 703650 - RNA, 18 nt, Human
ucccucuccuuuucuguu

SEQ ID NO: 703651 - RNA, 19 nt, Human
uccuaggagcuauuugugc

SEQ ID NO: 703652 - RNA, 23 nt, Human
uccucccuccuuuuuuccuguug

SEQ ID NO: 703653 - RNA, 24 nt, Human
uccucccugcuauuccagcuccag

SEQ ID NO: 703654 - RNA, 20 nt, Human
uccuggggauaaaaggaccc

SEQ ID NO: 703655 - RNA, 21 nt, Human
ucucucuucucagcucuuaau

SEQ ID NO: 703656 - RNA, 19 nt, Human
ucugucccucuccuuuucu

SEQ ID NO: 703657 - RNA, 20 nt, Human
ucuguuuucuucacuuuccc

SEQ ID NO: 703658 - RNA, 21 nt, Human
ucuucacuuucccucccaucc

SEQ ID NO: 703659 - RNA, 19 nt, Human
ugaagaagcugccagggag

SEQ ID NO: 703660 - RNA, 23 nt, Human
ugagagaaguagagaaaauacug

SEQ ID NO: 703661 - RNA, 21 nt, Human
ugagcccccaaaccucugcuu

SEQ ID NO: 703662 - RNA, 19 nt, Human
ugagggaagauaaagaggg

SEQ ID NO: 703663 - RNA, 27 nt, Human
ugauuacaaagaaauauaaguuacccu

SEQ ID NO: 703664 - RNA, 19 nt, Human
ugccaaaauaaauacugug

SEQ ID NO: 703665 - RNA, 19 nt, Human
ugcugcuucccaaagcugg

SEQ ID NO: 703666 - RNA, 19 nt, Human
uggaaggaaugggaggagu

SEQ ID NO: 703667 - RNA, 21 nt, Human
uggaaggaaugggaggaguga

SEQ ID NO: 703668 - RNA, 19 nt, Human
uggaaucaggaagccuaug

SEQ ID NO: 703669 - RNA, 20 nt, Human
ugggaggacagguucuguga

SEQ ID NO: 703670 - RNA, 18 nt, Human
uggggagauaguccagag

SEQ ID NO: 703671 - RNA, 25 nt, Human
ugguggggaacuguggggggagcac

SEQ ID NO: 703672 - RNA, 29 nt, Human
uguggcuuuuccuccucccuccuuuuuuc

SEQ ID NO: 703673 - RNA, 23 nt, Human
uguuuucuucacuuucccuccca

SEQ ID NO: 703674 - RNA, 22 nt, Human
uuccaccagagaaacccugcaa

SEQ ID NO: 703675 - RNA, 19 nt, Human
uuggaaggaaugggaggag

SEQ ID NO: 703676 - RNA, 20 nt, Human
uuuccuguugacucucccca

SEQ ID NO: 703677 - RNA, 21 nt, Human
aaaaauccagacuaaauccug

SEQ ID NO: 703678 - RNA, 18 nt, Human
aaacucccagguccuccc

SEQ ID NO: 703679 - RNA, 22 nt, Human
aaugauggaaacauauccaaaa

SEQ ID NO: 703680 - RNA, 24 nt, Human
aauuccagcaaccaauucuugcug

SEQ ID NO: 703681 - RNA, 22 nt, Human
acuggcagugaucacuuguccu

SEQ ID NO: 703682 - RNA, 18 nt, Human
auaaaggagcacaggcca

SEQ ID NO: 703683 - RNA, 26 nt, Human
auagcaggugccaacuggguccuuuu

SEQ ID NO: 703684 - RNA, 21 nt, Human
ccaccaagacacucgcugugc

SEQ ID NO: 703685 - RNA, 23 nt, Human
ccagcagcaacugaguauccaag

SEQ ID NO: 703686 - RNA, 21 nt, Human
ccaguuuccugaggauauccu

SEQ ID NO: 703687 - RNA, 21 nt, Human
ccugcacugcgcagaccccuc

SEQ ID NO: 703688 - RNA, 21 nt, Human
ccugcuuggcaguaacccugg

SEQ ID NO: 703689 - RNA, 21 nt, Human
cgaaguagcugcccuuggggc

SEQ ID NO: 703690 - RNA, 23 nt, Human
cgcuguacacugugagcuuuucc

SEQ ID NO: 703691 - RNA, 23 nt, Human
cugagaauccccaguaaacuccc

SEQ ID NO: 703692 - RNA, 21 nt, Human
cuuauaaaaauccagacuaaa

SEQ ID NO: 703693 - RNA, 22 nt, Human
cuuucuuuuucuuugaacagga

SEQ ID NO: 703694 - RNA, 22 nt, Human
gagaauccccaguaaacucccc

SEQ ID NO: 703695 - RNA, 22 nt, Human
gagcacaggccacaacuuuucc

SEQ ID NO: 703696 - RNA, 22 nt, Human
uagcugcccuuggggccgcugu

SEQ ID NO: 703697 - RNA, 22 nt, Human
uccagugauauaaaggagcaca

SEQ ID NO: 703698 - RNA, 21 nt, Human
uccggaucagcauugcuguuc

SEQ ID NO: 703699 - RNA, 19 nt, Human
ucggguauguggaagucca

SEQ ID NO: 703700 - RNA, 23 nt, Human
ucuccugccaguuuccugaggau

SEQ ID NO: 703701 - RNA, 21 nt, Human
ugaggauauccuugaaugagu

SEQ ID NO: 703702 - RNA, 22 nt, Human
ugcgcagaccccuccgcgggcc

SEQ ID NO: 703703 - RNA, 19 nt, Human
ugcuacauagcaggugcca

SEQ ID NO: 703704 - RNA, 21 nt, Human
uggaauuccagcaaccaauuc

SEQ ID NO: 703705 - RNA, 23 nt, Human
uguacacugugagcuuuuccacg

SEQ ID NO: 703706 - RNA, 20 nt, Human
uguugguggugucaaacggu

SEQ ID NO: 703707 - RNA, 20 nt, Human
uuccggcaaggagagaacuc

SEQ ID NO: 703708 - RNA, 21 nt, Human
uugaggucuuuggucuucuuu

SEQ ID NO: 703709 - RNA, 24 nt, Human
uugaggucuuuggucuucuuuuuu

SEQ ID NO: 703710 - RNA, 24 nt, Human
uuugcaaugauaucugcaacacug

SEQ ID NO: 703711 - RNA, 18 nt, Human
acacaugggccguggccc

SEQ ID NO: 703712 - RNA, 19 nt, Human
acuggcugauagccucucc

SEQ ID NO: 703713 - RNA, 21 nt, Human
aggaaaaaguaaugcaaagga

SEQ ID NO: 703714 - RNA, 20 nt, Human
aggaggccaggaggcggacg

SEQ ID NO: 703715 - RNA, 24 nt, Human
augcugcucuagaucauccugaag

SEQ ID NO: 703716 - RNA, 21 nt, Human
cauccugaaggaaaaaguaau

SEQ ID NO: 703717 - RNA, 24 nt, Human
ccaacagcuccaugcugcucuaga

SEQ ID NO: 703718 - RNA, 23 nt, Human
ccguggcccacucagcuuccccu

SEQ ID NO: 703719 - RNA, 19 nt, Human
cucagcuuccccucagccg

SEQ ID NO: 703720 - RNA, 22 nt, Human
gaggcggacgcccagacacggg

SEQ ID NO: 703721 - RNA, 26 nt, Human
ggaggcggacgcccagacacgggggc

SEQ ID NO: 703722 - RNA, 22 nt, Human
uugcacaaugcacagacacuuu

SEQ ID NO: 703723 - RNA, 23 nt, Human
uuuccuaaguuuacuuuuugcac

SEQ ID NO: 703724 - RNA, 18 nt, Human
uuuuuuuuuuuuuuuuug

SEQ ID NO: 703725 - RNA, 21 nt, Human
uuuuuuuuuuuuuuuuugcaa

SEQ ID NO: 703726 - RNA, 20 nt, Human
aaaaguacuaaacaaacacg

SEQ ID NO: 703727 - RNA, 22 nt, Human
aaacaaacacggacaggagagg

SEQ ID NO: 703728 - RNA, 23 nt, Human
aaacugacauuugcaaacgaugu

SEQ ID NO: 703729 - RNA, 22 nt, Human
aaaugaucaaugugaaaaaagc

SEQ ID NO: 703730 - RNA, 18 nt, Human
aacaaacacggacaggag

SEQ ID NO: 703731 - RNA, 18 nt, Human
aacagccccaucaccaac

SEQ ID NO: 703732 - RNA, 19 nt, Human
aacagccccaucaccaaca

SEQ ID NO: 703733 - RNA, 25 nt, Human
aaugaucaaugugaaaaaagccaaa

SEQ ID NO: 703734 - RNA, 19 nt, Human
aaugcaggaucuuuuuauu

SEQ ID NO: 703735 - RNA, 18 nt, Human
acaggagaggaaacugac

SEQ ID NO: 703736 - RNA, 21 nt, Human
agacaaacacaaauucuuuug

SEQ ID NO: 703737 - RNA, 18 nt, Human
agcagccaggugacaugg

SEQ ID NO: 703738 - RNA, 19 nt, Human
agcagccaggugacauggc

SEQ ID NO: 703739 - RNA, 20 nt, Human
agcugugaucaagccgagca

SEQ ID NO: 703740 - RNA, 19 nt, Human
agggagcugugaucaagcc

SEQ ID NO: 703741 - RNA, 24 nt, Human
auccccgcuccagccccucggaga

SEQ ID NO: 703742 - RNA, 26 nt, Human
caaacacggacaggagaggaaacuga

SEQ ID NO: 703743 - RNA, 19 nt, Human
caacaagcuggauguggca

SEQ ID NO: 703744 - RNA, 23 nt, Human
cacgcagaaaagucucaggacuc

SEQ ID NO: 703745 - RNA, 22 nt, Human
cagacuccgacccuuccugaca

SEQ ID NO: 703746 - RNA, 19 nt, Human
cagccccucggagaaggaa

SEQ ID NO: 703747 - RNA, 19 nt, Human
cagccccucggagaaggaa

SEQ ID NO: 703748 - RNA, 25 nt, Human
caggugacauggccaggcaccuucc

SEQ ID NO: 703749 - RNA, 23 nt, Human
cauggccaggcaccuuccuguac

SEQ ID NO: 703750 - RNA, 18 nt, Human
ccaaucccaaacaaucuu

SEQ ID NO: 703751 - RNA, 22 nt, Human
cccaucaccaacaccugugugc

SEQ ID NO: 703752 - RNA, 21 nt, Human
cgcagaaaagucucaggacuc

SEQ ID NO: 703753 - RNA, 24 nt, Human
cgccaagguccccuugcuuuaucc

SEQ ID NO: 703754 - RNA, 20 nt, Human
cuaccuagggagcugugauc

SEQ ID NO: 703755 - RNA, 24 nt, Human
cuagaaggucuucucuguggugcc

SEQ ID NO: 703756 - RNA, 20 nt, Human
cuggcccaggcucacuagaa

SEQ ID NO: 703757 - RNA, 24 nt, Human
cuucuugucuggccaggcuggggg

SEQ ID NO: 703758 - RNA, 18 nt, Human
cuugucuggccaggcugg

SEQ ID NO: 703759 - RNA, 23 nt, Human
gcagaaaagucucaggacucaga

SEQ ID NO: 703760 - RNA, 25 nt, Human
ggggcccagcauuccuggaagggag

SEQ ID NO: 703761 - RNA, 25 nt, Human
uaccuucaacaggcaucucaacagc

SEQ ID NO: 703762 - RNA, 22 nt, Human
uagaaggucuucucuguggugc

SEQ ID NO: 703763 - RNA, 19 nt, Human
uagcagccaggugacaugg

SEQ ID NO: 703764 - RNA, 23 nt, Human
uagccaucacgcagaaaagucuc

SEQ ID NO: 703765 - RNA, 21 nt, Human
uauaaaaguacuaaacaaaca

SEQ ID NO: 703766 - RNA, 22 nt, Human
uauaaaaguacuaaacaaacac

SEQ ID NO: 703767 - RNA, 23 nt, Human
ucaacagccccaucaccaacacc

SEQ ID NO: 703768 - RNA, 22 nt, Human
ucagaacuacaccauaaaugca

SEQ ID NO: 703769 - RNA, 23 nt, Human
ucagaacuacaccauaaaugcag

SEQ ID NO: 703770 - RNA, 23 nt, Human
ucuucuugucuggccaggcuggg

SEQ ID NO: 703771 - RNA, 18 nt, Human
ucuugucuggccaggcug

SEQ ID NO: 703772 - RNA, 18 nt, Human
ucuugucuggccaggcug

SEQ ID NO: 703773 - RNA, 19 nt, Human
ucuugucuggccaggcugg

SEQ ID NO: 703774 - RNA, 20 nt, Human
ucuugucuggccaggcuggg

SEQ ID NO: 703775 - RNA, 19 nt, Human
ugaaaaaagccaaacugua

SEQ ID NO: 703776 - RNA, 19 nt, Human
ugagagcgccaaggucccc

SEQ ID NO: 703777 - RNA, 22 nt, Human
ugaucaaugugaaaaaagccaa

SEQ ID NO: 703778 - RNA, 22 nt, Human
uggaagggagagacagcccagc

SEQ ID NO: 703779 - RNA, 19 nt, Human
ugugaaaaaagccaaacug

SEQ ID NO: 703780 - RNA, 22 nt, Human
uucuugucuggccaggcugggg

SEQ ID NO: 703781 - RNA, 30 nt, Human
aaaagaaaacaaaacauaaaggcaaagagg

SEQ ID NO: 703782 - RNA, 18 nt, Human
aaacaaaacauaaaggca

SEQ ID NO: 703783 - RNA, 22 nt, Human
aaacacgaaucauuuauucauc

SEQ ID NO: 703784 - RNA, 23 nt, Human
aaaccauaaacacacaugcauaa

SEQ ID NO: 703785 - RNA, 25 nt, Human
aaacccaaacaaagcccgaagcugg

SEQ ID NO: 703786 - RNA, 28 nt, Human
aaagaaaacaaaacauaaaggcaaagag

SEQ ID NO: 703787 - RNA, 23 nt, Human
aaaucagcuuagcgaagagccaa

SEQ ID NO: 703788 - RNA, 24 nt, Human
aacacaaucaaacccaaacaaagc

SEQ ID NO: 703789 - RNA, 23 nt, Human
aacauaaaggcaaagaggagaga

SEQ ID NO: 703790 - RNA, 20 nt, Human
aagcaaaccauaaacacaca

SEQ ID NO: 703791 - RNA, 19 nt, Human
aagcaccuccuucgacggc

SEQ ID NO: 703792 - RNA, 22 nt, Human
aagcucgggaugccagcaacag

SEQ ID NO: 703793 - RNA, 19 nt, Human
acaaaacauaaaggcaaag

SEQ ID NO: 703794 - RNA, 23 nt, Human
acacaaucaaacccaaacaaagc

SEQ ID NO: 703795 - RNA, 23 nt, Human
acacacaugcauaaaacuacaca

SEQ ID NO: 703796 - RNA, 18 nt, Human
accauaaacacacaugca

SEQ ID NO: 703797 - RNA, 21 nt, Human
accauaaacacacaugcauaa

SEQ ID NO: 703798 - RNA, 28 nt, Human
agaaaacaaaacauaaaggcaaagagga

SEQ ID NO: 703799 - RNA, 26 nt, Human
caaaccauaaacacacaugcauagug

SEQ ID NO: 703800 - RNA, 18 nt, Human
caaagcccgaagcugggg

SEQ ID NO: 703801 - RNA, 24 nt, Human
cacaaucaaacccaaacaaagccc

SEQ ID NO: 703802 - RNA, 23 nt, Human
cacacaugcauaaaacuacacac

SEQ ID NO: 703803 - RNA, 23 nt, Human
cacgaaucauuuauucaucuagc

SEQ ID NO: 703804 - RNA, 18 nt, Human
cacuuuaaaaagcaauaa

SEQ ID NO: 703805 - RNA, 23 nt, Human
cagcguccuggcuggcaagggag

SEQ ID NO: 703806 - RNA, 20 nt, Human
cagcuuugcagccccgucug

SEQ ID NO: 703807 - RNA, 27 nt, Human
cccgcggcucggagcaagccggggucc

SEQ ID NO: 703808 - RNA, 19 nt, Human
ccgccccgcgcccgccgcc

SEQ ID NO: 703809 - RNA, 20 nt, Human
ccgccccgcgcccgccgccu

SEQ ID NO: 703810 - RNA, 21 nt, Human
ccgcgcccgccgccuggcugc

SEQ ID NO: 703811 - RNA, 25 nt, Human
ccgcgcccgccgccuggcugccuuc

SEQ ID NO: 703812 - RNA, 25 nt, Human
ccucccggcucggcacggcgggucc

SEQ ID NO: 703813 - RNA, 21 nt, Human
cggcucggagcaagcggugca

SEQ ID NO: 703814 - RNA, 19 nt, Human
cggggcccgcgggcgagug

SEQ ID NO: 703815 - RNA, 19 nt, Human
cggugcagguaagcgggcc

SEQ ID NO: 703816 - RNA, 22 nt, Human
cuagucucaaacaguaguaaga

SEQ ID NO: 703817 - RNA, 20 nt, Human
gaagcaccuccuucgacggc

SEQ ID NO: 703818 - RNA, 24 nt, Human
gagccaaacacaaucaaacccaaa

SEQ ID NO: 703819 - RNA, 19 nt, Human
gagcuuuuguuucucucca

SEQ ID NO: 703820 - RNA, 18 nt, Human
gcaaagaggagagaaugc

SEQ ID NO: 703821 - RNA, 24 nt, Human
gcauuguucucucugggaagcgua

SEQ ID NO: 703822 - RNA, 23 nt, Human
gcccgaagcugggggggaaacca

SEQ ID NO: 703823 - RNA, 18 nt, Human
gcucggcaucucagggcc

SEQ ID NO: 703824 - RNA, 18 nt, Human
gcugccuuccggacgcgg

SEQ ID NO: 703825 - RNA, 20 nt, Human
ggggaaaaaagucuguggcg

SEQ ID NO: 703826 - RNA, 22 nt, Human
ggugaugcuggaucugugggag

SEQ ID NO: 703827 - RNA, 19 nt, Human
guuucucuccagccggugg

SEQ ID NO: 703828 - RNA, 27 nt, Human
uaaaaaagaaaacaaaacauaaaggca

SEQ ID NO: 703829 - RNA, 22 nt, Human
uaaaguguaaucagugcucuuc

SEQ ID NO: 703830 - RNA, 24 nt, Human
uaacuuagcacuuaauuaauccag

SEQ ID NO: 703831 - RNA, 21 nt, Human
uaagauuaagguuguaucugu

SEQ ID NO: 703832 - RNA, 23 nt, Human
uaauuaauccagucaucugugac

SEQ ID NO: 703833 - RNA, 22 nt, Human
uacaacgacacuagucucaaac

SEQ ID NO: 703834 - RNA, 21 nt, Human
uagcaggcggaccccgcggcu

SEQ ID NO: 703835 - RNA, 22 nt, Human
uauccaucuugcaaaaauaagc

SEQ ID NO: 703836 - RNA, 23 nt, Human
ucaaccaccaacuguugaagugu

SEQ ID NO: 703837 - RNA, 24 nt, Human
uccagccgguggggcuucugcugc

SEQ ID NO: 703838 - RNA, 21 nt, Human
ucccgggcgaccucggggccc

SEQ ID NO: 703839 - RNA, 23 nt, Human
uccgcaggccuagcaggcggacc

SEQ ID NO: 703840 - RNA, 22 nt, Human
ucucacagcauuguucucucug

SEQ ID NO: 703841 - RNA, 19 nt, Human
ucucagggccccuacggcc

SEQ ID NO: 703842 - RNA, 18 nt, Human
ucuccgcgagaagcaccu

SEQ ID NO: 703843 - RNA, 18 nt, Human
ucucucugggaagcguag

SEQ ID NO: 703844 - RNA, 22 nt, Human
ucucucugggaagcguagggau

SEQ ID NO: 703845 - RNA, 18 nt, Human
ucucugggaagcguaggg

SEQ ID NO: 703846 - RNA, 22 nt, Human
ugaaaaagucagcagcuaugug

SEQ ID NO: 703847 - RNA, 18 nt, Human
ugaaagagugaaacacga

SEQ ID NO: 703848 - RNA, 23 nt, Human
ugacacaaugcuaaacucucuca

SEQ ID NO: 703849 - RNA, 22 nt, Human
ugagcaauuugucuccuccugu

SEQ ID NO: 703850 - RNA, 21 nt, Human
ugcuaaacucucucacagcau

SEQ ID NO: 703851 - RNA, 19 nt, Human
uggcaagggaggaagcucg

SEQ ID NO: 703852 - RNA, 19 nt, Human
ugggcagggaggccaacac

SEQ ID NO: 703853 - RNA, 23 nt, Human
uguacaaccagcaacuggcauga

SEQ ID NO: 703854 - RNA, 26 nt, Human
uuaagauuaagguuguaucuguucac

SEQ ID NO: 703855 - RNA, 23 nt, Human
uuacaguaaagugcuacaacgac

SEQ ID NO: 703856 - RNA, 23 nt, Human
uuccggacgcgggcucggccucc

SEQ ID NO: 703857 - RNA, 18 nt, Human
uucgaguguacaaccagc

SEQ ID NO: 703858 - RNA, 22 nt, Human
uugcaaaaauaagcaaaccaua

SEQ ID NO: 703859 - RNA, 19 nt, Human
uugcagcuuugcagccccg

SEQ ID NO: 703860 - RNA, 24 nt, Human
uugcuuccacaggugggcagggag

SEQ ID NO: 703861 - RNA, 22 nt, Human
aaaaaggugcauuccccuaagc

SEQ ID NO: 703862 - RNA, 20 nt, Human
aaacuccaagcuccugcugg

SEQ ID NO: 703863 - RNA, 21 nt, Human
aaauauacaaagcauuuaaga

SEQ ID NO: 703864 - RNA, 20 nt, Human
aagaagaaaagaggaacacg

SEQ ID NO: 703865 - RNA, 27 nt, Human
aagaagaaaagaggaacacggcagggg

SEQ ID NO: 703866 - RNA, 21 nt, Human
aagcagggggaaggaggaggg

SEQ ID NO: 703867 - RNA, 19 nt, Human
aaugaucaguaaaaacaug

SEQ ID NO: 703868 - RNA, 24 nt, Human
acagcccuccucuccaaggcucag

SEQ ID NO: 703869 - RNA, 24 nt, Human
accuugccugccccguuccucagc

SEQ ID NO: 703870 - RNA, 18 nt, Human
agaaaguguacccuccaa

SEQ ID NO: 703871 - RNA, 22 nt, Human
agaagaaaagaggaacacggca

SEQ ID NO: 703872 - RNA, 27 nt, Human
agaagaaaagaggaacacggcaggggg

SEQ ID NO: 703873 - RNA, 22 nt, Human
agagaugggccccccaccgaga

SEQ ID NO: 703874 - RNA, 27 nt, Human
agagucccugggacacccccagguagc

SEQ ID NO: 703875 - RNA, 24 nt, Human
agccaccuucucuugugcucuggu

SEQ ID NO: 703876 - RNA, 27 nt, Human
agccccauccccuugcccagggccuca

SEQ ID NO: 703877 - RNA, 23 nt, Human
agcugugggcccaggcuuuggca

SEQ ID NO: 703878 - RNA, 22 nt, Human
aggaauggagagacaugucacc

SEQ ID NO: 703879 - RNA, 25 nt, Human
aggcaggguggacaaguaccaggug

SEQ ID NO: 703880 - RNA, 26 nt, Human
aggcaggguggacaaguaccaggugg

SEQ ID NO: 703881 - RNA, 20 nt, Human
aggcucagggcugagaacgg

SEQ ID NO: 703882 - RNA, 21 nt, Human
aggcuuuggcaggcccagcuu

SEQ ID NO: 703883 - RNA, 18 nt, Human
agggggaaggaggagggc

SEQ ID NO: 703884 - RNA, 28 nt, Human
agggggaaggaggagggccagagagcag

SEQ ID NO: 703885 - RNA, 21 nt, Human
agugagaaggaaagggaaaaa

SEQ ID NO: 703886 - RNA, 22 nt, Human
auccccacuccccaaacuccaa

SEQ ID NO: 703887 - RNA, 19 nt, Human
auccucagcucaagcccca

SEQ ID NO: 703888 - RNA, 21 nt, Human
caaaacaguuccaagcuugga

SEQ ID NO: 703889 - RNA, 21 nt, Human
caagccccaggucuaggaagg

SEQ ID NO: 703890 - RNA, 20 nt, Human
cacagccccauccccuugcc

SEQ ID NO: 703891 - RNA, 19 nt, Human
cagaaaacacuuugcagca

SEQ ID NO: 703892 - RNA, 22 nt, Human
cagaacccacggcucguccccc

SEQ ID NO: 703893 - RNA, 25 nt, Human
cagagagcagccggaaagaagaaaa

SEQ ID NO: 703894 - RNA, 20 nt, Human
cagcagagaugggcccccca

SEQ ID NO: 703895 - RNA, 21 nt, Human
cagcagagaugggccccccac

SEQ ID NO: 703896 - RNA, 21 nt, Human
cagggaggugggcaggguugg

SEQ ID NO: 703897 - RNA, 19 nt, Human
cagggccucacaugcccgg

SEQ ID NO: 703898 - RNA, 22 nt, Human
cauccucagcucaagccccagg

SEQ ID NO: 703899 - RNA, 20 nt, Human
cauuccccuaagcugagggg

SEQ ID NO: 703900 - RNA, 24 nt, Human
ccagguggcucucccuuucccucu

SEQ ID NO: 703901 - RNA, 20 nt, Human
cccaaacuccaagcuccugc

SEQ ID NO: 703902 - RNA, 23 nt, Human
cccacagccccauccccuugccc

SEQ ID NO: 703903 - RNA, 21 nt, Human
cccacuccccaaacuccaagc

SEQ ID NO: 703904 - RNA, 19 nt, Human
ccccacagccccauccccu

SEQ ID NO: 703905 - RNA, 26 nt, Human
ccccagagacugacugaaggcguuac

SEQ ID NO: 703906 - RNA, 21 nt, Human
ccccagguagccaccuucucu

SEQ ID NO: 703907 - RNA, 19 nt, Human
ccccauccccuugcccagg

SEQ ID NO: 703908 - RNA, 20 nt, Human
cccccacagccccauccccu

SEQ ID NO: 703909 - RNA, 18 nt, Human
cccccagguagccaccuu

SEQ ID NO: 703910 - RNA, 21 nt, Human
cccccagguagccaccuucuc

SEQ ID NO: 703911 - RNA, 22 nt, Human
cccccagguagccaccuucucu

SEQ ID NO: 703912 - RNA, 22 nt, Human
ccccuaagcugagggggaugga

SEQ ID NO: 703913 - RNA, 24 nt, Human
cccgcagccucugccggugcagcc

SEQ ID NO: 703914 - RNA, 21 nt, Human
cccuccaagaaaaagcuucug

SEQ ID NO: 703915 - RNA, 19 nt, Human
cccuccucuccaaggcuca

SEQ ID NO: 703916 - RNA, 19 nt, Human
ccgcagccucugccggugc

SEQ ID NO: 703917 - RNA, 19 nt, Human
ccgccccgcccccacagcc

SEQ ID NO: 703918 - RNA, 20 nt, Human
ccgccccgcccccacagccc

SEQ ID NO: 703919 - RNA, 22 nt, Human
ccgccccgcccccacagcccca

SEQ ID NO: 703920 - RNA, 20 nt, Human
ccggugcagccucggucucu

SEQ ID NO: 703921 - RNA, 24 nt, Human
ccuccgccgcuccgagcucugcag

SEQ ID NO: 703922 - RNA, 19 nt, Human
ccuggggggcaggacuggg

SEQ ID NO: 703923 - RNA, 24 nt, Human
cgccggcccgcgcguccgccccgc

SEQ ID NO: 703924 - RNA, 19 nt, Human
cggacucauccccacuccc

SEQ ID NO: 703925 - RNA, 25 nt, Human
cgucccauccucagcucaagcccca

SEQ ID NO: 703926 - RNA, 20 nt, Human
cguuacagcccuccucucca

SEQ ID NO: 703927 - RNA, 26 nt, Human
cguuacagcccuccucuccaaggcuc

SEQ ID NO: 703928 - RNA, 21 nt, Human
cucagcucaagccccaggucu

SEQ ID NO: 703929 - RNA, 19 nt, Human
cuccaagaaaaagcuucug

SEQ ID NO: 703930 - RNA, 22 nt, Human
cuccccaaacuccaagcuccug

SEQ ID NO: 703931 - RNA, 20 nt, Human
cuucugaagcccaugccgcc

SEQ ID NO: 703932 - RNA, 20 nt, Human
cuuugguuccacucagagaa

SEQ ID NO: 703933 - RNA, 23 nt, Human
gaaugaucaguaaaaacaugcaa

SEQ ID NO: 703934 - RNA, 18 nt, Human
gcagauacuucugaagcc

SEQ ID NO: 703935 - RNA, 20 nt, Human
gccccaggucuaggaauagg

SEQ ID NO: 703936 - RNA, 22 nt, Human
gccccgcagccucugccggugc

SEQ ID NO: 703937 - RNA, 20 nt, Human
gccucggucucugccuccgg

SEQ ID NO: 703938 - RNA, 23 nt, Human
gcuccuggggggcaggacugggg

SEQ ID NO: 703939 - RNA, 24 nt, Human
gcuucuuugguuccacucagagaa

SEQ ID NO: 703940 - RNA, 20 nt, Human
gcuugugcuccuggggggca

SEQ ID NO: 703941 - RNA, 22 nt, Human
ggaaggaggagggccagagagc

SEQ ID NO: 703942 - RNA, 20 nt, Human
ggaauagggacagugaagaa

SEQ ID NO: 703943 - RNA, 22 nt, Human
ggacaaguaccagguggcucuc

SEQ ID NO: 703944 - RNA, 19 nt, Human
ggacuggggguccuagcuc

SEQ ID NO: 703945 - RNA, 20 nt, Human
ggaggagggccagagagcag

SEQ ID NO: 703946 - RNA, 21 nt, Human
ggagggccagagagcagccgg

SEQ ID NO: 703947 - RNA, 23 nt, Human
ggccagagagcagccggaaagaa

SEQ ID NO: 703948 - RNA, 24 nt, Human
uacagcccuccucuccaaggcuca

SEQ ID NO: 703949 - RNA, 21 nt, Human
uagaaacgcguccaaaguaca

SEQ ID NO: 703950 - RNA, 22 nt, Human
uaucgaaugaucaguaaaaaca

SEQ ID NO: 703951 - RNA, 18 nt, Human
ucaagacagugggacaca

SEQ ID NO: 703952 - RNA, 22 nt, Human
uccaagaaaaagcuucugagga

SEQ ID NO: 703953 - RNA, 18 nt, Human
uccaagcuccugcuggug

SEQ ID NO: 703954 - RNA, 23 nt, Human
uccaccuacucagcagaacccac

SEQ ID NO: 703955 - RNA, 25 nt, Human
uccccacuccccaaacuccaagcuc

SEQ ID NO: 703956 - RNA, 19 nt, Human
uccccagagacugacugaa

SEQ ID NO: 703957 - RNA, 23 nt, Human
ucccccaaccgguccuuccccuu

SEQ ID NO: 703958 - RNA, 21 nt, Human
uccccuugcccagggccucac

SEQ ID NO: 703959 - RNA, 23 nt, Human
ucccucuguguuaucuuucaaaa

SEQ ID NO: 703960 - RNA, 20 nt, Human
ucccugggcacaucguccca

SEQ ID NO: 703961 - RNA, 22 nt, Human
ugagaaaauauacaaagcauuu

SEQ ID NO: 703962 - RNA, 21 nt, Human
ugagaaggaaagggaaaaagg

SEQ ID NO: 703963 - RNA, 25 nt, Human
ugccccguuccucagccgcccaucc

SEQ ID NO: 703964 - RNA, 21 nt, Human
ugggcaggguuggagaggaau

SEQ ID NO: 703965 - RNA, 19 nt, Human
ugggcugccggugcagcug

SEQ ID NO: 703966 - RNA, 26 nt, Human
ugguacagggaggugggcaggguugg

SEQ ID NO: 703967 - RNA, 24 nt, Human
uucaagacagugggacacagaaaa

SEQ ID NO: 703968 - RNA, 21 nt, Human
uuccccuugggcugccggugc

SEQ ID NO: 703969 - RNA, 19 nt, Human
uuccucagccgcccauccc

SEQ ID NO: 703970 - RNA, 24 nt, Human
uucugaggacuuuucuaauugugc

SEQ ID NO: 703971 - RNA, 24 nt, Human
uucuuugguuccacucagagaaca

SEQ ID NO: 703972 - RNA, 23 nt, Human
uugugcagauacuucugaagccc

SEQ ID NO: 703973 - RNA, 21 nt, Human
uuugcagcaucgccucucccu

SEQ ID NO: 703974 - RNA, 22 nt, Human
aaaaagccgggcaguucugaug

SEQ ID NO: 703975 - RNA, 19 nt, Human
aaacagaagaaucagauca

SEQ ID NO: 703976 - RNA, 21 nt, Human
aaagugggcauccugcagccc

SEQ ID NO: 703977 - RNA, 22 nt, Human
acagcacaaauccucagcacag

SEQ ID NO: 703978 - RNA, 23 nt, Human
acagcacaaauccucagcacagg

SEQ ID NO: 703979 - RNA, 18 nt, Human
acaguagagagcaggcgg

SEQ ID NO: 703980 - RNA, 23 nt, Human
acccagcaccccacaucuuccag

SEQ ID NO: 703981 - RNA, 20 nt, Human
accuccaugcacuggcucgg

SEQ ID NO: 703982 - RNA, 22 nt, Human
accugguacucucuuccauccc

SEQ ID NO: 703983 - RNA, 26 nt, Human
acucagcacuuucucuagcguccucc

SEQ ID NO: 703984 - RNA, 23 nt, Human
acugcuaucuuaagacacaaaaa

SEQ ID NO: 703985 - RNA, 21 nt, Human
acuuucucuagcguccuccau

SEQ ID NO: 703986 - RNA, 21 nt, Human
agacaccagcgcggaacuccc

SEQ ID NO: 703987 - RNA, 20 nt, Human
agacaccggcauggcagcca

SEQ ID NO: 703988 - RNA, 23 nt, Human
agagagcaggcggacggccccac

SEQ ID NO: 703989 - RNA, 22 nt, Human
agcugcuggcccagcgggugug

SEQ ID NO: 703990 - RNA, 22 nt, Human
aggaaaaacaaggaaggggccg

SEQ ID NO: 703991 - RNA, 21 nt, Human
aggacgcccagcuuccuuucc

SEQ ID NO: 703992 - RNA, 26 nt, Human
aggcagccuccuucccgggcuccagg

SEQ ID NO: 703993 - RNA, 21 nt, Human
aggcccaaagaccuggaauga

SEQ ID NO: 703994 - RNA, 23 nt, Human
agggagcagcagugcuggcuuag

SEQ ID NO: 703995 - RNA, 18 nt, Human
agggaguggggagucagg

SEQ ID NO: 703996 - RNA, 24 nt, Human
agggaguggggagucaggcagaag

SEQ ID NO: 703997 - RNA, 24 nt, Human
aggggucagacggcagagccagug

SEQ ID NO: 703998 - RNA, 22 nt, Human
aggggucuguggccuccucugg

SEQ ID NO: 703999 - RNA, 23 nt, Human
aggucagggaguggggagucagg

SEQ ID NO: 704000 - RNA, 22 nt, Human
caaauccucagcacaggcgcca

SEQ ID NO: 704001 - RNA, 22 nt, Human
caaugagagguggaccaggccu

SEQ ID NO: 704002 - RNA, 19 nt, Human
cacagcccgacaugggcag

SEQ ID NO: 704003 - RNA, 18 nt, Human
caccagcgcggaacuccc

SEQ ID NO: 704004 - RNA, 22 nt, Human
cacccagcaccccacaucuucc

SEQ ID NO: 704005 - RNA, 19 nt, Human
caccccucaccucccaucc

SEQ ID NO: 704006 - RNA, 22 nt, Human
cagaggacagcccggaagccuu

SEQ ID NO: 704007 - RNA, 22 nt, Human
cagccaggcagccuccuucccg

SEQ ID NO: 704008 - RNA, 24 nt, Human
cagcccagcugagccaggccgaag

SEQ ID NO: 704009 - RNA, 21 nt, Human
caggcggacggccccacuccc

SEQ ID NO: 704010 - RNA, 25 nt, Human
caucagagaaucagguuaaaaauua

SEQ ID NO: 704011 - RNA, 24 nt, Human
caugcaccgaucagccucccacag

SEQ ID NO: 704012 - RNA, 19 nt, Human
cauggcagccauacgcaca

SEQ ID NO: 704013 - RNA, 22 nt, Human
ccagcaccccacaucuuccagg

SEQ ID NO: 704014 - RNA, 18 nt, Human
ccagcccuguggugcucu

SEQ ID NO: 704015 - RNA, 24 nt, Human
ccauacgcacaccccucaccuccc

SEQ ID NO: 704016 - RNA, 24 nt, Human
cccaaaucacagcacaaauccuca

SEQ ID NO: 704017 - RNA, 25 nt, Human
cccaagcccugugccucccuccuca

SEQ ID NO: 704018 - RNA, 22 nt, Human
cccacugggaagagggccccga

SEQ ID NO: 704019 - RNA, 18 nt, Human
cccccaagggucccgguc

SEQ ID NO: 704020 - RNA, 19 nt, Human
ccccugaggggucuguggc

SEQ ID NO: 704021 - RNA, 19 nt, Human
cccucugggucccggcucc

SEQ ID NO: 704022 - RNA, 18 nt, Human
cccugugccucccuccuc

SEQ ID NO: 704023 - RNA, 18 nt, Human
ccgaucagccucccacag

SEQ ID NO: 704024 - RNA, 22 nt, Human
ccgccgccgccacuuccuccuc

SEQ ID NO: 704025 - RNA, 18 nt, Human
ccgccgccgccgccgcca

SEQ ID NO: 704026 - RNA, 19 nt, Human
ccgcgccuauccucaccua

SEQ ID NO: 704027 - RNA, 23 nt, Human
ccggaagccuuuuucacuuuuuc

SEQ ID NO: 704028 - RNA, 18 nt, Human
ccggcgcgcgccgcgagc

SEQ ID NO: 704029 - RNA, 20 nt, Human
ccgggcuccagggagcagca

SEQ ID NO: 704030 - RNA, 19 nt, Human
ccuccaugcacuggcucgg

SEQ ID NO: 704031 - RNA, 19 nt, Human
ccucccuccucaaaguggg

SEQ ID NO: 704032 - RNA, 18 nt, Human
ccuccucgggcggggagc

SEQ ID NO: 704033 - RNA, 21 nt, Human
ccuccucuggcuguggggagg

SEQ ID NO: 704034 - RNA, 19 nt, Human
ccuccuucccgggcuccag

SEQ ID NO: 704035 - RNA, 23 nt, Human
ccucgcccaagcccugugccucc

SEQ ID NO: 704036 - RNA, 21 nt, Human
ccugcagcccagcugagccag

SEQ ID NO: 704037 - RNA, 21 nt, Human
cgaggcucccgcgccuauccu

SEQ ID NO: 704038 - RNA, 20 nt, Human
cgcggaacuccccugagggg

SEQ ID NO: 704039 - RNA, 22 nt, Human
cgcugccccucugggucccggc

SEQ ID NO: 704040 - RNA, 18 nt, Human
cggaggaaaucgcccaca

SEQ ID NO: 704041 - RNA, 21 nt, Human
cgggacacucagcacuuucuc

SEQ ID NO: 704042 - RNA, 23 nt, Human
cucagggucagaacuaggaaagg

SEQ ID NO: 704043 - RNA, 18 nt, Human
cucccuggcaccugcugg

SEQ ID NO: 704044 - RNA, 22 nt, Human
cucugcagagggggcugccugg

SEQ ID NO: 704045 - RNA, 23 nt, Human
cucugcgcccugcgcugccccuc

SEQ ID NO: 704046 - RNA, 24 nt, Human
cugaugccucucacccagcacccc

SEQ ID NO: 704047 - RNA, 18 nt, Human
cugcacaguagagagcag

SEQ ID NO: 704048 - RNA, 24 nt, Human
cugcagaggcuucuccccaacccu

SEQ ID NO: 704049 - RNA, 23 nt, Human
cugcgcccugcgcugccccucug

SEQ ID NO: 704050 - RNA, 18 nt, Human
cuguggccuccucuggcu

SEQ ID NO: 704051 - RNA, 18 nt, Human
cuguggccuccucuggcu

SEQ ID NO: 704052 - RNA, 18 nt, Human
gaaaaacaaggaaggggc

SEQ ID NO: 704053 - RNA, 24 nt, Human
gaaggaccuccaugcacuggcucg

SEQ ID NO: 704054 - RNA, 19 nt, Human
gacaugggcaggcuucccc

SEQ ID NO: 704055 - RNA, 19 nt, Human
gagcaggcggacggcccca

SEQ ID NO: 704056 - RNA, 25 nt, Human
gagcaggcggacggccccacucccc

SEQ ID NO: 704057 - RNA, 20 nt, Human
gcacaccaggcagggugggg

SEQ ID NO: 704058 - RNA, 23 nt, Human
gcagugcaagaggccagccacgc

SEQ ID NO: 704059 - RNA, 20 nt, Human
gcccagacaccagcgcggaa

SEQ ID NO: 704060 - RNA, 21 nt, Human
gcccggaagccuuuuucacuu

SEQ ID NO: 704061 - RNA, 18 nt, Human
gccgcgagcgagugggca

SEQ ID NO: 704062 - RNA, 21 nt, Human
gccuccagccaggcagccucc

SEQ ID NO: 704063 - RNA, 21 nt, Human
gccuccucuggcuguggggag

SEQ ID NO: 704064 - RNA, 23 nt, Human
gcgccuauccucaccuaggugac

SEQ ID NO: 704065 - RNA, 25 nt, Human
gcgcgcagucccgccgccgccgccg

SEQ ID NO: 704066 - RNA, 21 nt, Human
gcgcggaacuccccugagggg

SEQ ID NO: 704067 - RNA, 19 nt, Human
gcuucccccaagggucccg

SEQ ID NO: 704068 - RNA, 20 nt, Human
ggaaaaacaaggaaggggca

SEQ ID NO: 704069 - RNA, 22 nt, Human
ggaaaaacaaggaaggggcagg

SEQ ID NO: 704070 - RNA, 24 nt, Human
ggaggaaaaacaaggaaggggcag

SEQ ID NO: 704071 - RNA, 19 nt, Human
ggagucaggcagaagggaa

SEQ ID NO: 704072 - RNA, 19 nt, Human
ggccugcugggugaggagg

SEQ ID NO: 704073 - RNA, 18 nt, Human
ggcuguggggagggaggg

SEQ ID NO: 704074 - RNA, 23 nt, Human
gggcaguucugauggccucugcc

SEQ ID NO: 704075 - RNA, 24 nt, Human
gggugggggcuaacaaagccuugg

SEQ ID NO: 704076 - RNA, 19 nt, Human
guccacuagagacaagggg

SEQ ID NO: 704077 - RNA, 22 nt, Human
uaaaaaacagaagaaucagauc

SEQ ID NO: 704078 - RNA, 25 nt, Human
uagcaucgccguugggaggaggagc

SEQ ID NO: 704079 - RNA, 18 nt, Human
uagcugcacaccaggcag

SEQ ID NO: 704080 - RNA, 20 nt, Human
uaggaaaggugacguacaga

SEQ ID NO: 704081 - RNA, 30 nt, Human
ucaaaguaaacugcuaucuuaagacacaag

SEQ ID NO: 704082 - RNA, 23 nt, Human
ucagccucccacagcccgacaug

SEQ ID NO: 704083 - RNA, 19 nt, Human
ucaggcagaagggaagcca

SEQ ID NO: 704084 - RNA, 23 nt, Human
ucagggaguggggagucaggcag

SEQ ID NO: 704085 - RNA, 18 nt, Human
uccacaguggccauggag

SEQ ID NO: 704086 - RNA, 21 nt, Human
uccaucccccacuaccccuca

SEQ ID NO: 704087 - RNA, 19 nt, Human
uccccaacccuuuucucug

SEQ ID NO: 704088 - RNA, 21 nt, Human
ucccgccgccgccgccgccac

SEQ ID NO: 704089 - RNA, 18 nt, Human
ucccgggcuccagggagc

SEQ ID NO: 704090 - RNA, 23 nt, Human
ucgggacacucagcacuuucucu

SEQ ID NO: 704091 - RNA, 22 nt, Human
ucucaaauguccacuagagaca

SEQ ID NO: 704092 - RNA, 24 nt, Human
ucucaaauguccacuagagacaag

SEQ ID NO: 704093 - RNA, 21 nt, Human
ucucugcagagggggcugccu

SEQ ID NO: 704094 - RNA, 18 nt, Human
ucugcagagggggcugcc

SEQ ID NO: 704095 - RNA, 23 nt, Human
ugaacccacugggaagagggccc

SEQ ID NO: 704096 - RNA, 20 nt, Human
ugagagguggaccaggccug

SEQ ID NO: 704097 - RNA, 20 nt, Human
ugagccaggccgaaggaccu

SEQ ID NO: 704098 - RNA, 19 nt, Human
ugaggagggacccagcagg

SEQ ID NO: 704099 - RNA, 24 nt, Human
ugaggggucuguggccuccucugg

SEQ ID NO: 704100 - RNA, 20 nt, Human
ugcaaacacaagcgugugua

SEQ ID NO: 704101 - RNA, 20 nt, Human
ugccuggaucaggggucaga

SEQ ID NO: 704102 - RNA, 22 nt, Human
ugcugggugaggagggacccag

SEQ ID NO: 704103 - RNA, 18 nt, Human
ugggagcugcuggcccag

SEQ ID NO: 704104 - RNA, 18 nt, Human
uggggagggagggguuag

SEQ ID NO: 704105 - RNA, 18 nt, Human
uggggagucaggcagaag

SEQ ID NO: 704106 - RNA, 20 nt, Human
ugucaugccgaggcucccgc

SEQ ID NO: 704107 - RNA, 20 nt, Human
ugugcacagacaccggcaug

SEQ ID NO: 704108 - RNA, 18 nt, Human
ugugcagaagcgaugggg

SEQ ID NO: 704109 - RNA, 19 nt, Human
ugugcagaagcgauggggg

SEQ ID NO: 704110 - RNA, 20 nt, Human
ugugcagaagcgaugggggg

SEQ ID NO: 704111 - RNA, 21 nt, Human
ugugcagaagcgauggggggc

SEQ ID NO: 704112 - RNA, 19 nt, Human
uuuccaaaaaagccgggca

SEQ ID NO: 704113 - RNA, 24 nt, Human
uuuccuguuccccagggcucaggg

SEQ ID NO: 704114 - RNA, 18 nt, Human
uuuuuuuuuuuuuugcgg

SEQ ID NO: 704115 - RNA, 18 nt, Human
uuuuuuuuuuuuuuuuug

SEQ ID NO: 704116 - RNA, 27 nt, Human
uuuuuuuuuuuuuuuuuugcgguuuga

SEQ ID NO: 704117 - RNA, 23 nt, Human
uuuuuuuuuuuuuuuuuuugcgg

SEQ ID NO: 704118 - RNA, 21 nt, Human
aaaacaaaacaaaacaaaaaa

SEQ ID NO: 704119 - RNA, 21 nt, Human
aaaacaaaacaaaacaaaaaa

SEQ ID NO: 704120 - RNA, 24 nt, Human
aaacaaaacaaaaaacaacaaacu

SEQ ID NO: 704121 - RNA, 24 nt, Human
aaacaaaacaaaaaacaacaaacu

SEQ ID NO: 704122 - RNA, 19 nt, Human
aaacaaaacaaaacaaaaa

SEQ ID NO: 704123 - RNA, 19 nt, Human
aaacaaaacaaaacaaaaa

SEQ ID NO: 704124 - RNA, 23 nt, Human
aaacaaaacaaaacaaaaaacaa

SEQ ID NO: 704125 - RNA, 23 nt, Human
aaacaaaacaaaacaaaaaacaa

SEQ ID NO: 704126 - RNA, 22 nt, Human
aaacaaaacaaaacaaaacaaa

SEQ ID NO: 704127 - RNA, 22 nt, Human
aaacaaaacaaaacaaaacaaa

SEQ ID NO: 704128 - RNA, 19 nt, Human
aaagaccuuuuccccuacu

SEQ ID NO: 704129 - RNA, 19 nt, Human
aaagaccuuuuccccuacu

SEQ ID NO: 704130 - RNA, 23 nt, Human
aacacacgcccaauuucagcaua

SEQ ID NO: 704131 - RNA, 23 nt, Human
aacacacgcccaauuucagcaua

SEQ ID NO: 704132 - RNA, 20 nt, Human
aacauggugaaacccugucu

SEQ ID NO: 704133 - RNA, 20 nt, Human
aacauggugaaacccugucu

SEQ ID NO: 704134 - RNA, 21 nt, Human
aacauggugaaacccugucuc

SEQ ID NO: 704135 - RNA, 21 nt, Human
aacauggugaaacccugucuc

SEQ ID NO: 704136 - RNA, 20 nt, Human
aaccaggaaggggcaggacc

SEQ ID NO: 704137 - RNA, 20 nt, Human
aaccaggaaggggcaggacc

SEQ ID NO: 704138 - RNA, 24 nt, Human
aaccauuucagccgcucuagccuc

SEQ ID NO: 704139 - RNA, 26 nt, Human
aagaaagaagcaaaaucaagccaaga

SEQ ID NO: 704140 - RNA, 26 nt, Human
aagaaagaagcaaaaucaagccaaga

SEQ ID NO: 704141 - RNA, 21 nt, Human
aaggacuccugggaacagaca

SEQ ID NO: 704142 - RNA, 21 nt, Human
aaggacuccugggaacagaca

SEQ ID NO: 704143 - RNA, 23 nt, Human
aaggcaggcggaucaagagguca

SEQ ID NO: 704144 - RNA, 23 nt, Human
aaggcaggcggaucaagagguca

SEQ ID NO: 704145 - RNA, 21 nt, Human
aaguaaauuccaaggcuggca

SEQ ID NO: 704146 - RNA, 21 nt, Human
aaguaaauuccaaggcuggca

SEQ ID NO: 704147 - RNA, 21 nt, Human
aaguaaauuccaaggcuggca

SEQ ID NO: 704148 - RNA, 23 nt, Human
aaguaccucuccagccauggugc

SEQ ID NO: 704149 - RNA, 21 nt, Human
aaguaccucugggaggaggag

SEQ ID NO: 704150 - RNA, 21 nt, Human
aaguagggggcccuguggggu

SEQ ID NO: 704151 - RNA, 21 nt, Human
aagucgcacuuaguauauccu

SEQ ID NO: 704152 - RNA, 21 nt, Human
aagucgcacuuaguauauccu

SEQ ID NO: 704153 - RNA, 24 nt, Human
aauggcuugaacccgggaggcgga

SEQ ID NO: 704154 - RNA, 24 nt, Human
aauggcuugaacccgggaggcgga

SEQ ID NO: 704155 - RNA, 18 nt, Human
aauuagccaggcauggug

SEQ ID NO: 704156 - RNA, 18 nt, Human
aauuagccaggcauggug

SEQ ID NO: 704157 - RNA, 22 nt, Human
aauucagaagcucugccuugag

SEQ ID NO: 704158 - RNA, 22 nt, Human
aauucagaagcucugccuugag

SEQ ID NO: 704159 - RNA, 20 nt, Human
aauuccaccccacuaaauac

SEQ ID NO: 704160 - RNA, 24 nt, Human
acaaaacaaaacaaaaaacaacaa

SEQ ID NO: 704161 - RNA, 24 nt, Human
acaaaacaaaacaaaaaacaacaa

SEQ ID NO: 704162 - RNA, 24 nt, Human
acaaaacaaaacaaaaaacaacaa

SEQ ID NO: 704163 - RNA, 24 nt, Human
acaaaacaaaacaaaaaacaacaa

SEQ ID NO: 704164 - RNA, 25 nt, Human
acaaaacaaaacaaaaaacaacaaa

SEQ ID NO: 704165 - RNA, 22 nt, Human
acaaaacaaaacaaaacaaaaa

SEQ ID NO: 704166 - RNA, 22 nt, Human
acaaaacaaaacaaaacaaaaa

SEQ ID NO: 704167 - RNA, 18 nt, Human
acaaggaaagagcccaga

SEQ ID NO: 704168 - RNA, 18 nt, Human
acacaucuccacagcacc

SEQ ID NO: 704169 - RNA, 18 nt, Human
acacaucuccacagcacc

SEQ ID NO: 704170 - RNA, 22 nt, Human
acagaacugaaacauacuuuaa

SEQ ID NO: 704171 - RNA, 22 nt, Human
acagaacugaaacauacuuuaa

SEQ ID NO: 704172 - RNA, 22 nt, Human
acagaagagagugggccccaga

SEQ ID NO: 704173 - RNA, 19 nt, Human
acagagcgagacuccgucu

SEQ ID NO: 704174 - RNA, 19 nt, Human
acagagcgagacuccgucu

SEQ ID NO: 704175 - RNA, 25 nt, Human
acagagcgagacuccgucuuuaaaa

SEQ ID NO: 704176 - RNA, 25 nt, Human
acagagcgagacuccgucuuuaaaa

SEQ ID NO: 704177 - RNA, 24 nt, Human
accaacauggugaaacccugucuc

SEQ ID NO: 704178 - RNA, 24 nt, Human
accaacauggugaaacccugucuc

SEQ ID NO: 704179 - RNA, 19 nt, Human
accacugcacuccagccug

SEQ ID NO: 704180 - RNA, 19 nt, Human
accacugcacuccagccug

SEQ ID NO: 704181 - RNA, 24 nt, Human
accacugcacuccagccuggguga

SEQ ID NO: 704182 - RNA, 24 nt, Human
accacugcacuccagccuggguga

SEQ ID NO: 704183 - RNA, 18 nt, Human
acccccgccauuuuugcu

SEQ ID NO: 704184 - RNA, 24 nt, Human
acccugucucuacuaaaaacacaa

SEQ ID NO: 704185 - RNA, 24 nt, Human
acccugucucuacuaaaaacacaa

SEQ ID NO: 704186 - RNA, 23 nt, Human
acccuguguaccuuccuccagca

SEQ ID NO: 704187 - RNA, 23 nt, Human
acccuguguaccuuccuccagca

SEQ ID NO: 704188 - RNA, 23 nt, Human
accucaaauucacagagccauga

SEQ ID NO: 704189 - RNA, 23 nt, Human
accucaaauucacagagccauga

SEQ ID NO: 704190 - RNA, 23 nt, Human
accucaaauucacagagccauga

SEQ ID NO: 704191 - RNA, 19 nt, Human
acgcccaauuucagcauac

SEQ ID NO: 704192 - RNA, 19 nt, Human
acgcccaauuucagcauac

SEQ ID NO: 704193 - RNA, 24 nt, Human
acugcacuccagccugggugacag

SEQ ID NO: 704194 - RNA, 24 nt, Human
acugcacuccagccugggugacag

SEQ ID NO: 704195 - RNA, 26 nt, Human
acugcacuccagccugggugacagag

SEQ ID NO: 704196 - RNA, 26 nt, Human
acugcacuccagccugggugacagag

SEQ ID NO: 704197 - RNA, 22 nt, Human
agaaagaaagaagcaaaaucaa

SEQ ID NO: 704198 - RNA, 22 nt, Human
agaaagaaagaagcaaaaucaa

SEQ ID NO: 704199 - RNA, 23 nt, Human
agaaagaagcaaaaucaagccaa

SEQ ID NO: 704200 - RNA, 23 nt, Human
agaaagaagcaaaaucaagccaa

SEQ ID NO: 704201 - RNA, 18 nt, Human
agaagcccuccaacacac

SEQ ID NO: 704202 - RNA, 18 nt, Human
agaagcccuccaacacac

SEQ ID NO: 704203 - RNA, 22 nt, Human
agaagcucugccuugagauaag

SEQ ID NO: 704204 - RNA, 22 nt, Human
agaagcucugccuugagauaag

SEQ ID NO: 704205 - RNA, 23 nt, Human
agacagaagagagugggccccag

SEQ ID NO: 704206 - RNA, 25 nt, Human
agacagaagagagugggccccagag

SEQ ID NO: 704207 - RNA, 18 nt, Human
agaccacccaugaucugg

SEQ ID NO: 704208 - RNA, 18 nt, Human
agaccacccaugaucugg

SEQ ID NO: 704209 - RNA, 24 nt, Human
agacugaggcaggagaauggcuug

SEQ ID NO: 704210 - RNA, 24 nt, Human
agacugaggcaggagaauggcuug

SEQ ID NO: 704211 - RNA, 23 nt, Human
agagcagcgguuuuaaauccuuu

SEQ ID NO: 704212 - RNA, 22 nt, Human
agcaccacaggcacaucucaaa

SEQ ID NO: 704213 - RNA, 21 nt, Human
agcagcugggauuacaggcau

SEQ ID NO: 704214 - RNA, 22 nt, Human
agccauggugcgcguagcaacc

SEQ ID NO: 704215 - RNA, 22 nt, Human
agccauggugcgcguagcaacc

SEQ ID NO: 704216 - RNA, 21 nt, Human
agcccagaaccaagcucaaga

SEQ ID NO: 704217 - RNA, 24 nt, Human
agcccgaccaacauggugaaaccc

SEQ ID NO: 704218 - RNA, 24 nt, Human
agcccgaccaacauggugaaaccc

SEQ ID NO: 704219 - RNA, 21 nt, Human
agccuaggaacccucaaagac

SEQ ID NO: 704220 - RNA, 21 nt, Human
agccuaggaacccucaaagac

SEQ ID NO: 704221 - RNA, 23 nt, Human
agccucugggauuauaggcguga

SEQ ID NO: 704222 - RNA, 24 nt, Human
agccugggugacagagcgagacuc

SEQ ID NO: 704223 - RNA, 24 nt, Human
agccugggugacagagcgagacuc

SEQ ID NO: 704224 - RNA, 21 nt, Human
agcuuucuuuuuucuuucuuu

SEQ ID NO: 704225 - RNA, 24 nt, Human
agcuuuuucuuuucuuucuuuuuu

SEQ ID NO: 704226 - RNA, 23 nt, Human
aggaaggccuggccacaagaggg

SEQ ID NO: 704227 - RNA, 23 nt, Human
aggaaggccuggccacaagaggg

SEQ ID NO: 704228 - RNA, 19 nt, Human
aggaggagguugcagugag

SEQ ID NO: 704229 - RNA, 20 nt, Human
aggaguuugagaccagcccg

SEQ ID NO: 704230 - RNA, 20 nt, Human
aggaguuugagaccagcccg

SEQ ID NO: 704231 - RNA, 24 nt, Human
aggcacgguggcucacaucuguaa

SEQ ID NO: 704232 - RNA, 24 nt, Human
aggcacgguggcucacaucuguaa

SEQ ID NO: 704233 - RNA, 24 nt, Human
aggcacgguggcucacaucuguaa

SEQ ID NO: 704234 - RNA, 18 nt, Human
aggcaggagaauggcuug

SEQ ID NO: 704235 - RNA, 18 nt, Human
aggcaggagaauggcuug

SEQ ID NO: 704236 - RNA, 24 nt, Human
aggcaggagaauggcuugaacccg

SEQ ID NO: 704237 - RNA, 24 nt, Human
aggcaggagaauggcuugaacccg

SEQ ID NO: 704238 - RNA, 24 nt, Human
aggcaggcggaucaagaggucagg

SEQ ID NO: 704239 - RNA, 24 nt, Human
aggcaggcggaucaagaggucagg

SEQ ID NO: 704240 - RNA, 23 nt, Human
aggcaggcgguuuuaaauccuuu

SEQ ID NO: 704241 - RNA, 24 nt, Human
aggcaugguggcacgcacccguaa

SEQ ID NO: 704242 - RNA, 24 nt, Human
aggcaugguggcacgcacccguaa

SEQ ID NO: 704243 - RNA, 24 nt, Human
aggccaaggagaucccccaaguac

SEQ ID NO: 704244 - RNA, 24 nt, Human
aggccaaggagaucccccaaguac

SEQ ID NO: 704245 - RNA, 23 nt, Human
aggccaaggcaggcggaucaaga

SEQ ID NO: 704246 - RNA, 23 nt, Human
aggccaaggcaggcggaucaaga

SEQ ID NO: 704247 - RNA, 23 nt, Human
aggccaaggcaggcgguuuuaaa

SEQ ID NO: 704248 - RNA, 19 nt, Human
aggcggagguuacagugag

SEQ ID NO: 704249 - RNA, 19 nt, Human
aggcggagguuacagugag

SEQ ID NO: 704250 - RNA, 24 nt, Human
aggcggagguuacagugagccaag

SEQ ID NO: 704251 - RNA, 24 nt, Human
aggcggagguuacagugagccaag

SEQ ID NO: 704252 - RNA, 24 nt, Human
aggcggaucaagaggucaggaguu

SEQ ID NO: 704253 - RNA, 24 nt, Human
aggcggaucaagaggucaggaguu

SEQ ID NO: 704254 - RNA, 21 nt, Human
aggcgugagccacugcgccca

SEQ ID NO: 704255 - RNA, 20 nt, Human
aggcucccgacacaacagcc

SEQ ID NO: 704256 - RNA, 20 nt, Human
aggcucccgacacaacagcc

SEQ ID NO: 704257 - RNA, 20 nt, Human
aggcucccgacacaacagcc

SEQ ID NO: 704258 - RNA, 22 nt, Human
agggucuguccaguaguuccag

SEQ ID NO: 704259 - RNA, 22 nt, Human
agggucuguccaguaguuccag

SEQ ID NO: 704260 - RNA, 24 nt, Human
aggugauccgccugccucagccuc

SEQ ID NO: 704261 - RNA, 19 nt, Human
agugguaggaaagggaggg

SEQ ID NO: 704262 - RNA, 18 nt, Human
auagaaauacaaucucac

SEQ ID NO: 704263 - RNA, 18 nt, Human
auagaaauacaaucucac

SEQ ID NO: 704264 - RNA, 18 nt, Human
aucaagaggucaggaguu

SEQ ID NO: 704265 - RNA, 21 nt, Human
aucaagaggucaggaguuuga

SEQ ID NO: 704266 - RNA, 24 nt, Human
aucauaccacugcacuccagccug

SEQ ID NO: 704267 - RNA, 24 nt, Human
aucauaccacugcacuccagccug

SEQ ID NO: 704268 - RNA, 22 nt, Human
aucccaucacuuugggaggcca

SEQ ID NO: 704269 - RNA, 22 nt, Human
aucccaucacuuugggaggcca

SEQ ID NO: 704270 - RNA, 22 nt, Human
augcagacaagguguuuuccag

SEQ ID NO: 704271 - RNA, 22 nt, Human
augcagacaagguguuuuccag

SEQ ID NO: 704272 - RNA, 22 nt, Human
augcagacaagguguuuuccag

SEQ ID NO: 704273 - RNA, 20 nt, Human
auuugucuaguuggauuuca

SEQ ID NO: 704274 - RNA, 20 nt, Human
auuugucuaguuggauuuca

SEQ ID NO: 704275 - RNA, 22 nt, Human
caaaacaaaacaaaacaaaaaa

SEQ ID NO: 704276 - RNA, 22 nt, Human
caaaacaaaacaaaacaaaaaa

SEQ ID NO: 704277 - RNA, 21 nt, Human
caacaaacucaucuuuacuga

SEQ ID NO: 704278 - RNA, 21 nt, Human
caacaaacucaucuuuacuga

SEQ ID NO: 704279 - RNA, 26 nt, Human
caacacacacacaagcucaacaaaga

SEQ ID NO: 704280 - RNA, 26 nt, Human
caacacacacacaagcucaacaaaga

SEQ ID NO: 704281 - RNA, 24 nt, Human
caacauggugaaacccugucucua

SEQ ID NO: 704282 - RNA, 24 nt, Human
caacauggugaaacccugucucua

SEQ ID NO: 704283 - RNA, 18 nt, Human
caaggaaagagcccagaa

SEQ ID NO: 704284 - RNA, 22 nt, Human
caaggcaggcggaucaagaggu

SEQ ID NO: 704285 - RNA, 22 nt, Human
caaggcaggcggaucaagaggu

SEQ ID NO: 704286 - RNA, 24 nt, Human
caaggcaggcggaucaagagguca

SEQ ID NO: 704287 - RNA, 24 nt, Human
caaggcaggcggaucaagagguca

SEQ ID NO: 704288 - RNA, 22 nt, Human
caaggcaggcgguuuuaaaucc

SEQ ID NO: 704289 - RNA, 25 nt, Human
caaguacagcaucagcuucacccug

SEQ ID NO: 704290 - RNA, 25 nt, Human
caaguacagcaucagcuucacccug

SEQ ID NO: 704291 - RNA, 19 nt, Human
cacaaaaaagagccuugac

SEQ ID NO: 704292 - RNA, 19 nt, Human
cacaaaaaagagccuugac

SEQ ID NO: 704293 - RNA, 26 nt, Human
cacacaagcucaacaaagagcuaaga

SEQ ID NO: 704294 - RNA, 26 nt, Human
cacacaagcucaacaaagagcuaaga

SEQ ID NO: 704295 - RNA, 18 nt, Human
cacacacacaagcucaac

SEQ ID NO: 704296 - RNA, 18 nt, Human
cacacacacaagcucaac

SEQ ID NO: 704297 - RNA, 24 nt, Human
cacagaaagaaagaagcaaaauca

SEQ ID NO: 704298 - RNA, 24 nt, Human
cacagaaagaaagaagcaaaauca

SEQ ID NO: 704299 - RNA, 23 nt, Human
cacagaacugaaacauacuuuaa

SEQ ID NO: 704300 - RNA, 23 nt, Human
cacagaacugaaacauacuuuaa

SEQ ID NO: 704301 - RNA, 25 nt, Human
cacagcaccacaggcacaucucaaa

SEQ ID NO: 704302 - RNA, 25 nt, Human
cacagcaccacaggcacaucucaaa

SEQ ID NO: 704303 - RNA, 18 nt, Human
cacaucuccacagcacca

SEQ ID NO: 704304 - RNA, 18 nt, Human
cacaucuccacagcacca

SEQ ID NO: 704305 - RNA, 24 nt, Human
cacaucuguaaucccaucacuuug

SEQ ID NO: 704306 - RNA, 24 nt, Human
cacaucuguaaucccaucacuuug

SEQ ID NO: 704307 - RNA, 24 nt, Human
cacaucuguaaucccaucacuuug

SEQ ID NO: 704308 - RNA, 21 nt, Human
cacccguaaucccagcuacuc

SEQ ID NO: 704309 - RNA, 24 nt, Human
cacccguaaucccagcuacucagg

SEQ ID NO: 704310 - RNA, 24 nt, Human
cacccguaaucccagcuacucagg

SEQ ID NO: 704311 - RNA, 22 nt, Human
caccucaaauucacagagccau

SEQ ID NO: 704312 - RNA, 22 nt, Human
caccucaaauucacagagccau

SEQ ID NO: 704313 - RNA, 22 nt, Human
caccucaaauucacagagccau

SEQ ID NO: 704314 - RNA, 19 nt, Human
caccucugcuuccccauga

SEQ ID NO: 704315 - RNA, 19 nt, Human
caccucugcuuccccauga

SEQ ID NO: 704316 - RNA, 19 nt, Human
caccucugcuuccccauga

SEQ ID NO: 704317 - RNA, 22 nt, Human
caccucugcuuccccaugaccu

SEQ ID NO: 704318 - RNA, 29 nt, Human
caccucugcuuccccaugaccuuuuccaa

SEQ ID NO: 704319 - RNA, 29 nt, Human
caccucugcuuccccaugaccuuuuccaa

SEQ ID NO: 704320 - RNA, 29 nt, Human
caccucugcuuccccaugaccuuuuccaa

SEQ ID NO: 704321 - RNA, 22 nt, Human
cacuccagccugggugacagag

SEQ ID NO: 704322 - RNA, 22 nt, Human
cacuccagccugggugacagag

SEQ ID NO: 704323 - RNA, 23 nt, Human
cacuccagccugggugacagagc

SEQ ID NO: 704324 - RNA, 24 nt, Human
cacuccagccugggugacagagcg

SEQ ID NO: 704325 - RNA, 24 nt, Human
cacuccagccugggugacagagcg

SEQ ID NO: 704326 - RNA, 19 nt, Human
cacugcacuccagccuggg

SEQ ID NO: 704327 - RNA, 19 nt, Human
cacugcacuccagccuggg

SEQ ID NO: 704328 - RNA, 19 nt, Human
cacugcacuccagccuggg

SEQ ID NO: 704329 - RNA, 21 nt, Human
cacugcacuccagccugggug

SEQ ID NO: 704330 - RNA, 21 nt, Human
cacugcacuccagccugggug

SEQ ID NO: 704331 - RNA, 22 nt, Human
cacugcacuccagccuggguga

SEQ ID NO: 704332 - RNA, 22 nt, Human
cacugcacuccagccuggguga

SEQ ID NO: 704333 - RNA, 23 nt, Human
cacugcacuccagccugggugac

SEQ ID NO: 704334 - RNA, 23 nt, Human
cacugcacuccagccugggugac

SEQ ID NO: 704335 - RNA, 24 nt, Human
cacugcacuccagccugggugaca

SEQ ID NO: 704336 - RNA, 24 nt, Human
cacugcacuccagccugggugaca

SEQ ID NO: 704337 - RNA, 24 nt, Human
cacugcacuccagccugggugaca

SEQ ID NO: 704338 - RNA, 25 nt, Human
cacugcacuccagccugggugacag

SEQ ID NO: 704339 - RNA, 25 nt, Human
cacugcacuccagccugggugacag

SEQ ID NO: 704340 - RNA, 18 nt, Human
cacuuugggaggccaagg

SEQ ID NO: 704341 - RNA, 18 nt, Human
cacuuugggaggccaagg

SEQ ID NO: 704342 - RNA, 21 nt, Human
cacuuugggaggccaaggcag

SEQ ID NO: 704343 - RNA, 21 nt, Human
cacuuugggaggccaaggcag

SEQ ID NO: 704344 - RNA, 21 nt, Human
cacuuugggaggccaaggcag

SEQ ID NO: 704345 - RNA, 24 nt, Human
cagaaccaagcucaagauaccuau

SEQ ID NO: 704346 - RNA, 22 nt, Human
cagaccacccaugaucuggucu

SEQ ID NO: 704347 - RNA, 22 nt, Human
cagaccacccaugaucuggucu

SEQ ID NO: 704348 - RNA, 18 nt, Human
cagagggaucccaguggc

SEQ ID NO: 704349 - RNA, 19 nt, Human
cagagggaucccaguggca

SEQ ID NO: 704350 - RNA, 23 nt, Human
cagcaccacaggcacaucucaaa

SEQ ID NO: 704351 - RNA, 19 nt, Human
cagccgccgaaggacuccu

SEQ ID NO: 704352 - RNA, 19 nt, Human
cagccgccgaaggacuccu

SEQ ID NO: 704353 - RNA, 19 nt, Human
cagccgccgaaggacuccu

SEQ ID NO: 704354 - RNA, 20 nt, Human
cagccucugggauuauaggc

SEQ ID NO: 704355 - RNA, 24 nt, Human
cagccucugggauuauaggcguga

SEQ ID NO: 704356 - RNA, 22 nt, Human
caggcggaucaagaggucagga

SEQ ID NO: 704357 - RNA, 22 nt, Human
caggcggaucaagaggucagga

SEQ ID NO: 704358 - RNA, 22 nt, Human
caggugauccgccugccucagc

SEQ ID NO: 704359 - RNA, 22 nt, Human
cagugucaucaccaaacaacca

SEQ ID NO: 704360 - RNA, 21 nt, Human
caucacuuugggaggccaagg

SEQ ID NO: 704361 - RNA, 21 nt, Human
caucacuuugggaggccaagg

SEQ ID NO: 704362 - RNA, 20 nt, Human
caucgcacucuagccugcug

SEQ ID NO: 704363 - RNA, 21 nt, Human
caucgcacucuagccugcugg

SEQ ID NO: 704364 - RNA, 24 nt, Human
caucgcacucuagccugcugggca

SEQ ID NO: 704365 - RNA, 23 nt, Human
caucuguaaucccaucacuuugg

SEQ ID NO: 704366 - RNA, 23 nt, Human
caucuguaaucccaucacuuugg

SEQ ID NO: 704367 - RNA, 23 nt, Human
caucuguaaucccaucacuuugg

SEQ ID NO: 704368 - RNA, 24 nt, Human
caucuguaaucccaucacuuuggg

SEQ ID NO: 704369 - RNA, 24 nt, Human
caucuguaaucccaucacuuuggg

SEQ ID NO: 704370 - RNA, 23 nt, Human
caugcaccaccaugccuggcuaa

SEQ ID NO: 704371 - RNA, 23 nt, Human
caugcaccacuaugccuggcuaa

SEQ ID NO: 704372 - RNA, 24 nt, Human
ccaaagagcuaagaagcccuccuu

SEQ ID NO: 704373 - RNA, 24 nt, Human
ccaaagagcuaagaagcccuccuu

SEQ ID NO: 704374 - RNA, 21 nt, Human
ccaacacacgcccaauuucag

SEQ ID NO: 704375 - RNA, 21 nt, Human
ccaacacacgcccaauuucag

SEQ ID NO: 704376 - RNA, 25 nt, Human
ccacaaaaaagagccuugacaaacc

SEQ ID NO: 704377 - RNA, 25 nt, Human
ccacaaaaaagagccuugacaaacc

SEQ ID NO: 704378 - RNA, 20 nt, Human
ccacagaaagaaagaagcaa

SEQ ID NO: 704379 - RNA, 20 nt, Human
ccacagaaagaaagaagcaa

SEQ ID NO: 704380 - RNA, 20 nt, Human
ccacugcacuccagccuggg

SEQ ID NO: 704381 - RNA, 20 nt, Human
ccacugcacuccagccuggg

SEQ ID NO: 704382 - RNA, 20 nt, Human
ccacugcacuccagccuggg

SEQ ID NO: 704383 - RNA, 20 nt, Human
ccacugcacuccagccuggg

SEQ ID NO: 704384 - RNA, 20 nt, Human
ccacugcacuccagccuggg

SEQ ID NO: 704385 - RNA, 21 nt, Human
ccacugcacuccagccugggu

SEQ ID NO: 704386 - RNA, 21 nt, Human
ccacugcacuccagccugggu

SEQ ID NO: 704387 - RNA, 21 nt, Human
ccacugcacuccagccugggu

SEQ ID NO: 704388 - RNA, 21 nt, Human
ccacugcacuccagccugggu

SEQ ID NO: 704389 - RNA, 23 nt, Human
ccacugcacuccagccuggguga

SEQ ID NO: 704390 - RNA, 23 nt, Human
ccacugcacuccagccuggguga

SEQ ID NO: 704391 - RNA, 24 nt, Human
ccacugcacuccagccugggugac

SEQ ID NO: 704392 - RNA, 24 nt, Human
ccacugcacuccagccugggugac

SEQ ID NO: 704393 - RNA, 20 nt, Human
ccacugcgcccagccuccag

SEQ ID NO: 704394 - RNA, 21 nt, Human
ccacugcgcccagccuccagu

SEQ ID NO: 704395 - RNA, 23 nt, Human
ccagugucaucaccaaacaacca

SEQ ID NO: 704396 - RNA, 23 nt, Human
ccaucgcacucuagccugcuggg

SEQ ID NO: 704397 - RNA, 21 nt, Human
ccauguuggucaggcugaucu

SEQ ID NO: 704398 - RNA, 21 nt, Human
ccauguuggucaggcugaucu

SEQ ID NO: 704399 - RNA, 21 nt, Human
cccacaaaaaagagccuugac

SEQ ID NO: 704400 - RNA, 18 nt, Human
cccagagauggaaggacc

SEQ ID NO: 704401 - RNA, 25 nt, Human
cccaugaccuuuuccauauccuucc

SEQ ID NO: 704402 - RNA, 25 nt, Human
cccaugaccuuuuccauauccuucc

SEQ ID NO: 704403 - RNA, 25 nt, Human
cccaugaccuuuuccauauccuucc

SEQ ID NO: 704404 - RNA, 19 nt, Human
ccccagagauggaaggacc

SEQ ID NO: 704405 - RNA, 20 nt, Human
ccccagagauggaaggaccc

SEQ ID NO: 704406 - RNA, 21 nt, Human
ccccagagauggaaggaccuc

SEQ ID NO: 704407 - RNA, 23 nt, Human
ccccagugucaucaccaaacaac

SEQ ID NO: 704408 - RNA, 24 nt, Human
ccccagugucaucaccaaacaacc

SEQ ID NO: 704409 - RNA, 22 nt, Human
cccccaaguacagcaucagcuu

SEQ ID NO: 704410 - RNA, 22 nt, Human
cccccaaguacagcaucagcuu

SEQ ID NO: 704411 - RNA, 21 nt, Human
ccccgccauuuuugcugucua

SEQ ID NO: 704412 - RNA, 22 nt, Human
cccgaccaacauggugaaaccc

SEQ ID NO: 704413 - RNA, 22 nt, Human
cccgaccaacauggugaaaccc

SEQ ID NO: 704414 - RNA, 19 nt, Human
cccucaaagaaauggggaa

SEQ ID NO: 704415 - RNA, 21 nt, Human
ccgccugccucagccucuggg

SEQ ID NO: 704416 - RNA, 23 nt, Human
ccucagccucugggauuauaggc

SEQ ID NO: 704417 - RNA, 21 nt, Human
ccuccaacacacgcccaauuu

SEQ ID NO: 704418 - RNA, 21 nt, Human
ccuccaacacacgcccaauuu

SEQ ID NO: 704419 - RNA, 24 nt, Human
ccuccaacacacgcccaauuucag

SEQ ID NO: 704420 - RNA, 24 nt, Human
ccuccaacacacgcccaauuucag

SEQ ID NO: 704421 - RNA, 18 nt, Human
ccugaccucaggugaucc

SEQ ID NO: 704422 - RNA, 21 nt, Human
ccugaccucaggugauccgcc

SEQ ID NO: 704423 - RNA, 23 nt, Human
ccugaccucaggugauccgccug

SEQ ID NO: 704424 - RNA, 19 nt, Human
ccugagcagcugggauuac

SEQ ID NO: 704425 - RNA, 23 nt, Human
ccugagcagcugggauuacaggc

SEQ ID NO: 704426 - RNA, 24 nt, Human
ccugagcagcugggauuacaggca

SEQ ID NO: 704427 - RNA, 19 nt, Human
ccuggccacaagagggcuc

SEQ ID NO: 704428 - RNA, 22 nt, Human
ccugggugacagagcgagacuc

SEQ ID NO: 704429 - RNA, 22 nt, Human
ccugggugacagagcgagacuc

SEQ ID NO: 704430 - RNA, 18 nt, Human
ccuucagcaggugacggc

SEQ ID NO: 704431 - RNA, 19 nt, Human
cgacacaacagccgccgaa

SEQ ID NO: 704432 - RNA, 19 nt, Human
cgacacaacagccgccgaa

SEQ ID NO: 704433 - RNA, 23 nt, Human
cgacacaacagccgccgaaggac

SEQ ID NO: 704434 - RNA, 23 nt, Human
cgacacaacagccgccgaaggac

SEQ ID NO: 704435 - RNA, 23 nt, Human
cgacacaacagccgccgaaggac

SEQ ID NO: 704436 - RNA, 19 nt, Human
cgcacccguaaucccagcu

SEQ ID NO: 704437 - RNA, 21 nt, Human
cggaucaagaggucaggaguu

SEQ ID NO: 704438 - RNA, 21 nt, Human
cggaucaagaggucaggaguu

SEQ ID NO: 704439 - RNA, 19 nt, Human
cguaaucccagcuacucag

SEQ ID NO: 704440 - RNA, 19 nt, Human
cguaaucccagcuacucag

SEQ ID NO: 704441 - RNA, 19 nt, Human
cgucaguacacaaggaaag

SEQ ID NO: 704442 - RNA, 24 nt, Human
cucacaucuguaaucccaucacuu

SEQ ID NO: 704443 - RNA, 24 nt, Human
cucacaucuguaaucccaucacuu

SEQ ID NO: 704444 - RNA, 24 nt, Human
cucacaucuguaaucccaucacuu

SEQ ID NO: 704445 - RNA, 24 nt, Human
cucagccucugggauuauaggcgu

SEQ ID NO: 704446 - RNA, 23 nt, Human
cucaggugauccgccugccucag

SEQ ID NO: 704447 - RNA, 23 nt, Human
cucauauucuucacaaguggccu

SEQ ID NO: 704448 - RNA, 18 nt, Human
cuccaaaugaccugagaa

SEQ ID NO: 704449 - RNA, 18 nt, Human
cuccaaaugaccugagaa

SEQ ID NO: 704450 - RNA, 24 nt, Human
cuccauguuggucaggcugaucuu

SEQ ID NO: 704451 - RNA, 26 nt, Human
cuccugaccucaggugauccgccugc

SEQ ID NO: 704452 - RNA, 22 nt, Human
cuccuucagcaggugacggccc

SEQ ID NO: 704453 - RNA, 23 nt, Human
cugagcagcugggauuacaggca

SEQ ID NO: 704454 - RNA, 24 nt, Human
cugagcagcugggauuacaggcau

SEQ ID NO: 704455 - RNA, 19 nt, Human
cuggccacaagagggcucu

SEQ ID NO: 704456 - RNA, 19 nt, Human
cuggccacaagagggcucu

SEQ ID NO: 704457 - RNA, 21 nt, Human
cuguaaucccaucacuuuggg

SEQ ID NO: 704458 - RNA, 19 nt, Human
gaaacccugucucuacuaa

SEQ ID NO: 704459 - RNA, 19 nt, Human
gaaacccugucucuacuaa

SEQ ID NO: 704460 - RNA, 19 nt, Human
gaagaaguagggggcccug

SEQ ID NO: 704461 - RNA, 21 nt, Human
gaagcccuccaacacacgccc

SEQ ID NO: 704462 - RNA, 24 nt, Human
gaagcccuccaacacacgcccuuc

SEQ ID NO: 704463 - RNA, 24 nt, Human
gaagcccuccaacacacgcccuuc

SEQ ID NO: 704464 - RNA, 21 nt, Human
gaaggccuggccacaagaggg

SEQ ID NO: 704465 - RNA, 21 nt, Human
gaaggccuggccacaagaggg

SEQ ID NO: 704466 - RNA, 18 nt, Human
gacacaacagccgccgaa

SEQ ID NO: 704467 - RNA, 21 nt, Human
gacacaacagccgccgaagga

SEQ ID NO: 704468 - RNA, 21 nt, Human
gacacaacagccgccgaagga

SEQ ID NO: 704469 - RNA, 21 nt, Human
gacacaacagccgccgaagga

SEQ ID NO: 704470 - RNA, 21 nt, Human
gacagagcgagacuccgucuu

SEQ ID NO: 704471 - RNA, 23 nt, Human
gaccaacauggugaaacccuguc

SEQ ID NO: 704472 - RNA, 23 nt, Human
gaccaacauggugaaacccuguc

SEQ ID NO: 704473 - RNA, 24 nt, Human
gaccucaggugauccgccugccuc

SEQ ID NO: 704474 - RNA, 23 nt, Human
gagaccagcccgaccaacauggu

SEQ ID NO: 704475 - RNA, 22 nt, Human
gagcagcugggauuacaggcau

SEQ ID NO: 704476 - RNA, 24 nt, Human
gagcagcugggauuacaggcaugc

SEQ ID NO: 704477 - RNA, 18 nt, Human
gagguuacagugagccaa

SEQ ID NO: 704478 - RNA, 18 nt, Human
gagguuacagugagccaa

SEQ ID NO: 704479 - RNA, 19 nt, Human
gagguuacagugagccaag

SEQ ID NO: 704480 - RNA, 19 nt, Human
gagguuacagugagccaag

SEQ ID NO: 704481 - RNA, 21 nt, Human
gaucaagaggucaggaguuug

SEQ ID NO: 704482 - RNA, 21 nt, Human
gaucaagaggucaggaguuug

SEQ ID NO: 704483 - RNA, 22 nt, Human
gaucaagaggucaggaguuuga

SEQ ID NO: 704484 - RNA, 22 nt, Human
gaucaagaggucaggaguuuga

SEQ ID NO: 704485 - RNA, 22 nt, Human
gaucccucaaagaaauggggaa

SEQ ID NO: 704486 - RNA, 24 nt, Human
gauuacaggcaugcaccaccaugc

SEQ ID NO: 704487 - RNA, 21 nt, Human
gauuacaggcaugcaccacua

SEQ ID NO: 704488 - RNA, 18 nt, Human
gauuauaggcgugagcca

SEQ ID NO: 704489 - RNA, 22 nt, Human
gauuauaggcgugagccacugc

SEQ ID NO: 704490 - RNA, 22 nt, Human
gauuauaggcgugagccacugc

SEQ ID NO: 704491 - RNA, 20 nt, Human
gcaccacuaugccuggcuaa

SEQ ID NO: 704492 - RNA, 24 nt, Human
gcacuccagccugggugacagagc

SEQ ID NO: 704493 - RNA, 24 nt, Human
gcacuccagccugggugacagagc

SEQ ID NO: 704494 - RNA, 18 nt, Human
gcagcugggauuacaggc

SEQ ID NO: 704495 - RNA, 20 nt, Human
gcagcugggauuacaggcau

SEQ ID NO: 704496 - RNA, 18 nt, Human
gcauacagcuaagacuac

SEQ ID NO: 704497 - RNA, 20 nt, Human
gccaagaucauaccacugca

SEQ ID NO: 704498 - RNA, 20 nt, Human
gccaagaucauaccacugca

SEQ ID NO: 704499 - RNA, 21 nt, Human
gccccagagauggaaggaccc

SEQ ID NO: 704500 - RNA, 18 nt, Human
gccucugggauuauaggc

SEQ ID NO: 704501 - RNA, 20 nt, Human
gccuggccacaagagggcuc

SEQ ID NO: 704502 - RNA, 20 nt, Human
gccuggccacaagagggcuc

SEQ ID NO: 704503 - RNA, 19 nt, Human
gcggaucaagaggucagga

SEQ ID NO: 704504 - RNA, 23 nt, Human
gcggaucaagaggucaggaguuu

SEQ ID NO: 704505 - RNA, 23 nt, Human
gcggaucaagaggucaggaguuu

SEQ ID NO: 704506 - RNA, 30 nt, Human
gcggaucaagaggucaggaguuugagaccc

SEQ ID NO: 704507 - RNA, 30 nt, Human; identical to SEQ ID NO: 704506

SEQ ID NO: 704508 - RNA, 27 nt, Human
gcuccagcuuuuucuuuucgggccgcc

SEQ ID NO: 704509 - RNA, 18 nt, Human
gcugaacaggagguacaa

SEQ ID NO: 704510 - RNA, 18 nt, Human
gcugaacaggagguacaa

SEQ ID NO: 704511 - RNA, 23 nt, Human
gcugaucuugaacuccugaccuc

SEQ ID NO: 704512 - RNA, 22 nt, Human
gcuugaacccgggaggcggagg

SEQ ID NO: 704513 - RNA, 22 nt, Human
gcuugaacccgggaggcggagg

SEQ ID NO: 704514 - RNA, 21 nt, Human
ggacaguaguuccuacagcug

SEQ ID NO: 704515 - RNA, 21 nt, Human
ggacaguaguuccuacagcug

SEQ ID NO: 704516 - RNA, 22 nt, Human
ggagaucccccaaguacagcau

SEQ ID NO: 704517 - RNA, 22 nt, Human
ggagaucccccaaguacagcau

SEQ ID NO: 704518 - RNA, 20 nt, Human
ggaggauggggcacauagcu

SEQ ID NO: 704519 - RNA, 21 nt, Human
ggaggcggagguuacagugag

SEQ ID NO: 704520 - RNA, 21 nt, Human
ggaggcggagguuacagugag

SEQ ID NO: 704521 - RNA, 20 nt, Human
ggagguuacagugagccaag

SEQ ID NO: 704522 - RNA, 20 nt, Human
ggagguuacagugagccaag

SEQ ID NO: 704523 - RNA, 24 nt, Human
ggagguuacagugagccaagauca

SEQ ID NO: 704524 - RNA, 24 nt, Human
ggagguuacagugagccaagauca

SEQ ID NO: 704525 - RNA, 24 nt, Human
ggagguugcagugagccgaaaucg

SEQ ID NO: 704526 - RNA, 20 nt, Human
ggaucaagaggucaggaguu

SEQ ID NO: 704527 - RNA, 20 nt, Human
ggaucaagaggucaggaguu

SEQ ID NO: 704528 - RNA, 25 nt, Human
ggaucaagaggucaggaguuugaga

SEQ ID NO: 704529 - RNA, 25 nt, Human
ggaucaagaggucaggaguuugaga

SEQ ID NO: 704530 - RNA, 24 nt, Human
ggauuacaggcaugcaccaccaug

SEQ ID NO: 704531 - RNA, 24 nt, Human
ggauuacaggcaugcaccacuaug

SEQ ID NO: 704532 - RNA, 23 nt, Human
ggccaaggagaucccccaaguac

SEQ ID NO: 704533 - RNA, 26 nt, Human
ggcggaucaagaggucaggaguuuga

SEQ ID NO: 704534 - RNA, 21 nt, Human
ggcuaggcacgguggcucaca

SEQ ID NO: 704535 - RNA, 21 nt, Human
ggcuaggcacgguggcucaca

SEQ ID NO: 704536 - RNA, 19 nt, Human
ggcugaacaggagguacaa

SEQ ID NO: 704537 - RNA, 24 nt, Human
ggcugagaaguaccucugggagga

SEQ ID NO: 704538 - RNA, 24 nt, Human
ggcugaucuugaacuccugaccuc

SEQ ID NO: 704539 - RNA, 18 nt, Human
gggaggaggagguugcag

SEQ ID NO: 704540 - RNA, 18 nt, Human
gggcaugaaggaggaugg

SEQ ID NO: 704541 - RNA, 23 nt, Human
ggggcaggaccaggcacugggaa

SEQ ID NO: 704542 - RNA, 23 nt, Human
ggggcaggaccaggcacugggaa

SEQ ID NO: 704543 - RNA, 22 nt, Human
gggguguagaagacaaauaagg

SEQ ID NO: 704544 - RNA, 18 nt, Human
ggguccaaauggggagga

SEQ ID NO: 704545 - RNA, 18 nt, Human
ggguccaaauggggagga

SEQ ID NO: 704546 - RNA, 21 nt, Human
ggguuucuccauguuggucag

SEQ ID NO: 704547 - RNA, 22 nt, Human
ggguuucuccauguuggucagg

SEQ ID NO: 704548 - RNA, 24 nt, Human
ggugauccgccugccucagccucu

SEQ ID NO: 704549 - RNA, 24 nt, Human
gguggcacgcacccguaaucccag

SEQ ID NO: 704550 - RNA, 23 nt, Human
gguggcucacaucuguaauccca

SEQ ID NO: 704551 - RNA, 23 nt, Human
gguggcucacaucuguaauccca

SEQ ID NO: 704552 - RNA, 23 nt, Human
gguggcucacaucuguaauccca

SEQ ID NO: 704553 - RNA, 18 nt, Human
guaaucccagcuacucag

SEQ ID NO: 704554 - RNA, 24 nt, Human
guaggguuucuccauguuggucag

SEQ ID NO: 704555 - RNA, 22 nt, Human
gucagcuuguauucaggaggac

SEQ ID NO: 704556 - RNA, 21 nt, Human
gugaaacccugucucuacuaa

SEQ ID NO: 704557 - RNA, 21 nt, Human
gugaaacccugucucuacuaa

SEQ ID NO: 704558 - RNA, 18 nt, Human
gugauccgccugccucag

SEQ ID NO: 704559 - RNA, 22 nt, Human
gugauccgccugccucagccuc

SEQ ID NO: 704560 - RNA, 21 nt, Human
guugcagugagccgaaaucgc

SEQ ID NO: 704561 - RNA, 22 nt, Human
uaaaaaaacaaaacaaaacaaa

SEQ ID NO: 704562 - RNA, 22 nt, Human
uaaaaaaacaaaacaaaacaaa

SEQ ID NO: 704563 - RNA, 27 nt, Human
uaaaaaaacaaaacaaaacaaaacaaa

SEQ ID NO: 704564 - RNA, 27 nt, Human
uaaaaaaacaaaacaaaacaaaacaaa

SEQ ID NO: 704565 - RNA, 21 nt, Human
uaaaaacacaaaaauuagcca

SEQ ID NO: 704566 - RNA, 21 nt, Human
uaaaaacacaaaaauuagcca

SEQ ID NO: 704567 - RNA, 19 nt, Human
uaaagcacuuguucuccaa

SEQ ID NO: 704568 - RNA, 19 nt, Human
uaaagcacuuguucuccaa

SEQ ID NO: 704569 - RNA, 18 nt, Human
uaagaagcccuccaacac

SEQ ID NO: 704570 - RNA, 18 nt, Human
uaagaagcccuccaacac

SEQ ID NO: 704571 - RNA, 25 nt, Human
uacacaacacacacacaagcucaac

SEQ ID NO: 704572 - RNA, 25 nt, Human
uacacaacacacacacaagcucaac

SEQ ID NO: 704573 - RNA, 19 nt, Human
uacacaaggaaagagccca

SEQ ID NO: 704574 - RNA, 23 nt, Human
uacacacaucuccacagcaccac

SEQ ID NO: 704575 - RNA, 23 nt, Human
uacacacaucuccacagcaccac

SEQ ID NO: 704576 - RNA, 20 nt, Human
uacagcuaagacuacacaac

SEQ ID NO: 704577 - RNA, 20 nt, Human
uacagcuaagacuacacaac

SEQ ID NO: 704578 - RNA, 24 nt, Human
uacagcuaagacuacacaacacac

SEQ ID NO: 704579 - RNA, 24 nt, Human
uacagcuaagacuacacaacacac

SEQ ID NO: 704580 - RNA, 22 nt, Human
uacaggcaugcaccaccaugcc

SEQ ID NO: 704581 - RNA, 22 nt, Human
uacaggcaugcaccacuaugcc

SEQ ID NO: 704582 - RNA, 22 nt, Human
uaccacugcacuccagccuggg

SEQ ID NO: 704583 - RNA, 22 nt, Human
uaccacugcacuccagccuggg

SEQ ID NO: 704584 - RNA, 18 nt, Human
uacccaggauuccuuccu

SEQ ID NO: 704585 - RNA, 21 nt, Human
uacccaggauuccuuccugau

SEQ ID NO: 704586 - RNA, 22 nt, Human
uacuaugcucuccacaacaaga

SEQ ID NO: 704587 - RNA, 19 nt, Human
uagaaauacaaucucacca

SEQ ID NO: 704588 - RNA, 19 nt, Human
uagaaauacaaucucacca

SEQ ID NO: 704589 - RNA, 19 nt, Human
uagaagggaagucaauggc

SEQ ID NO: 704590 - RNA, 20 nt, Human
uagaagggaagucaauggca

SEQ ID NO: 704591 - RNA, 18 nt, Human
uagccucuaauucccgcu

SEQ ID NO: 704592 - RNA, 22 nt, Human
uagcugacauuauuaaaaacac

SEQ ID NO: 704593 - RNA, 24 nt, Human
uaggguuucuccauguuggucagg

SEQ ID NO: 704594 - RNA, 19 nt, Human
uauaggcgugagccacugc

SEQ ID NO: 704595 - RNA, 24 nt, Human
ucaagaggucaggaguuugagacc

SEQ ID NO: 704596 - RNA, 24 nt, Human
ucaagaggucaggaguuugagacc

SEQ ID NO: 704597 - RNA, 25 nt, Human
ucaagaggucaggaguuugagaccc

SEQ ID NO: 704598 - RNA, 24 nt, Human
ucacaucuguaaucccaucacuuu

SEQ ID NO: 704599 - RNA, 24 nt, Human
ucacaucuguaaucccaucacuuu

SEQ ID NO: 704600 - RNA, 24 nt, Human
ucacaucuguaaucccaucacuuu

SEQ ID NO: 704601 - RNA, 22 nt, Human
ucaccaaacaaccauuucagcu

SEQ ID NO: 704602 - RNA, 20 nt, Human
ucagcaggugacggcccccu

SEQ ID NO: 704603 - RNA, 18 nt, Human
ucagcagugguaggaaag

SEQ ID NO: 704604 - RNA, 21 nt, Human
ucagcauacagcuaagacuac

SEQ ID NO: 704605 - RNA, 22 nt, Human
ucaggugauccgccugccucag

SEQ ID NO: 704606 - RNA, 23 nt, Human
ucauaccacugcacuccagccug

SEQ ID NO: 704607 - RNA, 23 nt, Human
ucauaccacugcacuccagccug

SEQ ID NO: 704608 - RNA, 18 nt, Human
uccaacacacgcccaauu

SEQ ID NO: 704609 - RNA, 18 nt, Human
uccaacacacgcccaauu

SEQ ID NO: 704610 - RNA, 20 nt, Human
uccaacacacgcccaauuuc

SEQ ID NO: 704611 - RNA, 20 nt, Human
uccaacacacgcccaauuuc

SEQ ID NO: 704612 - RNA, 24 nt, Human
uccacagaaagaaagaagcaaaau

SEQ ID NO: 704613 - RNA, 24 nt, Human
uccacagaaagaaagaagcaaaau

SEQ ID NO: 704614 - RNA, 23 nt, Human
uccagccugggugacagagcgag

SEQ ID NO: 704615 - RNA, 23 nt, Human
uccagccugggugacagagcgag

SEQ ID NO: 704616 - RNA, 24 nt, Human
uccagccugggugacagagcgaga

SEQ ID NO: 704617 - RNA, 24 nt, Human
uccagccugggugacagagcgaga

SEQ ID NO: 704618 - RNA, 24 nt, Human
uccauguuggucaggcugaucuug

SEQ ID NO: 704619 - RNA, 22 nt, Human
ucccacaaaaaagagccuugac

SEQ ID NO: 704620 - RNA, 22 nt, Human
ucccacaaaaaagagccuugac

SEQ ID NO: 704621 - RNA, 21 nt, Human
ucccaguggcacuucccaugg

SEQ ID NO: 704622 - RNA, 22 nt, Human
uccgccugccucagccucuggg

SEQ ID NO: 704623 - RNA, 20 nt, Human
uccgcgacuacagcgagggg

SEQ ID NO: 704624 - RNA, 23 nt, Human
uccuccagcaaaggaaggccugg

SEQ ID NO: 704625 - RNA, 23 nt, Human
uccuccagcaaaggaaggccugg

SEQ ID NO: 704626 - RNA, 24 nt, Human
uccugagcagcugggauuacaggc

SEQ ID NO: 704627 - RNA, 19 nt, Human
ucuagaacagcuggcccug

SEQ ID NO: 704628 - RNA, 22 nt, Human
ucuagaacagcuggcccugguc

SEQ ID NO: 704629 - RNA, 21 nt, Human
ucucaguuggagcuagagggc

SEQ ID NO: 704630 - RNA, 21 nt, Human
ucucaguuggagcuagagggc

SEQ ID NO: 704631 - RNA, 23 nt, Human
ucuccaaaugaccugagaaaucc

SEQ ID NO: 704632 - RNA, 23 nt, Human
ucuccaaaugaccugagaaaucc

SEQ ID NO: 704633 - RNA, 21 nt, Human
ucucuacuaaaaacacaaaaa

SEQ ID NO: 704634 - RNA, 21 nt, Human
ucucuacuaaaaacacaaaaa

SEQ ID NO: 704635 - RNA, 24 nt, Human
ucugcuuccccaugaccuuuucca

SEQ ID NO: 704636 - RNA, 24 nt, Human
ucugcuuccccaugaccuuuucca

SEQ ID NO: 704637 - RNA, 24 nt, Human
ucugcuuccccaugaccuuuucca

SEQ ID NO: 704638 - RNA, 23 nt, Human
ucuugaacuccugaccucaggug

SEQ ID NO: 704639 - RNA, 24 nt, Human
ugaaacuacagacaucaggggcca

SEQ ID NO: 704640 - RNA, 21 nt, Human
ugaacaggagguacaagagua

SEQ ID NO: 704641 - RNA, 21 nt, Human
ugaacaggagguacaagagua

SEQ ID NO: 704642 - RNA, 22 nt, Human
ugaauuccaccccacuaaauac

SEQ ID NO: 704643 - RNA, 22 nt, Human
ugaauuccaccccacuaaauac

SEQ ID NO: 704644 - RNA, 18 nt, Human
ugaccucaggugauccgc

SEQ ID NO: 704645 - RNA, 24 nt, Human
ugaccucaggugauccgccugccu

SEQ ID NO: 704646 - RNA, 23 nt, Human
ugacucauauucuucacaagugg

SEQ ID NO: 704647 - RNA, 23 nt, Human
ugacucauauucuucacaagugg

SEQ ID NO: 704648 - RNA, 23 nt, Human
ugacucauauucuucacaagugg

SEQ ID NO: 704649 - RNA, 24 nt, Human
ugagaccagcccgaccaacauggu

SEQ ID NO: 704650 - RNA, 24 nt, Human
ugagaccagcccgaccaacauggu

SEQ ID NO: 704651 - RNA, 23 nt, Human
ugagauaagaaccaggaaggggc

SEQ ID NO: 704652 - RNA, 23 nt, Human
ugagauaagaaccaggaaggggc

SEQ ID NO: 704653 - RNA, 26 nt, Human
ugagauaagaaccaggaaggggcagg

SEQ ID NO: 704654 - RNA, 26 nt, Human
ugagauaagaaccaggaaggggcagg

SEQ ID NO: 704655 - RNA, 22 nt, Human
ugagccgaaaucgcgccaucgc

SEQ ID NO: 704656 - RNA, 24 nt, Human
ugaggcaggagaauggcuugaacc

SEQ ID NO: 704657 - RNA, 24 nt, Human
ugaggcaggagaauggcuugaacc

SEQ ID NO: 704658 - RNA, 25 nt, Human
ugaggcaggagaauggcuugaaccc

SEQ ID NO: 704659 - RNA, 25 nt, Human
ugaggcaggagaauggcuugaaccc

SEQ ID NO: 704660 - RNA, 18 nt, Human
uggaaugaaggccugaaa

SEQ ID NO: 704661 - RNA, 18 nt, Human
uggaaugaaggccugaaa

SEQ ID NO: 704662 - RNA, 22 nt, Human
uggcacgcacccguaaucccag

SEQ ID NO: 704663 - RNA, 21 nt, Human
uggcucacaucuguaauccca

SEQ ID NO: 704664 - RNA, 21 nt, Human
uggcucacaucuguaauccca

SEQ ID NO: 704665 - RNA, 21 nt, Human
uggcucacaucuguaauccca

SEQ ID NO: 704666 - RNA, 20 nt, Human
uggcuugaacccgggaggcg

SEQ ID NO: 704667 - RNA, 20 nt, Human
uggcuugaacccgggaggcg

SEQ ID NO: 704668 - RNA, 24 nt, Human
uggcuugaacccgggaggcggagg

SEQ ID NO: 704669 - RNA, 24 nt, Human
uggcuugaacccgggaggcggagg

SEQ ID NO: 704670 - RNA, 24 nt, Human
ugggaggaggagguugcagugagc

SEQ ID NO: 704671 - RNA, 18 nt, Human
ugggaggccaaggcaggc

SEQ ID NO: 704672 - RNA, 24 nt, Human
ugggaggccaaggcaggcggauca

SEQ ID NO: 704673 - RNA, 24 nt, Human
ugggaggccaaggcaggcggauca

SEQ ID NO: 704674 - RNA, 21 nt, Human
ugggaggccaaggcaggcggu

SEQ ID NO: 704675 - RNA, 21 nt, Human
ugggauuacaggcaugcacca

SEQ ID NO: 704676 - RNA, 24 nt, Human
ugggauuacaggcaugcaccacca

SEQ ID NO: 704677 - RNA, 23 nt, Human
ugggauuacaggcaugcaccacu

SEQ ID NO: 704678 - RNA, 24 nt, Human
ugggauuacaggcaugcaccacua

SEQ ID NO: 704679 - RNA, 18 nt, Human
ugggauuauaggcgugag

SEQ ID NO: 704680 - RNA, 19 nt, Human
ugggauuauaggcgugagc

SEQ ID NO: 704681 - RNA, 21 nt, Human
ugggauuauaggcgugagcca

SEQ ID NO: 704682 - RNA, 22 nt, Human
ugggauuauaggcgugagccac

SEQ ID NO: 704683 - RNA, 22 nt, Human
ugggauuauaggcgugagccac

SEQ ID NO: 704684 - RNA, 24 nt, Human
ugggauuauaggcgugagccacug

SEQ ID NO: 704685 - RNA, 20 nt, Human
uggggaggaagaaagcaaug

SEQ ID NO: 704686 - RNA, 20 nt, Human
uggggaggaagaaagcaaug

SEQ ID NO: 704687 - RNA, 24 nt, Human
ugguaggaaagggagggagggcau

SEQ ID NO: 704688 - RNA, 24 nt, Human
uggucaggcugaucuugaacuccu

SEQ ID NO: 704689 - RNA, 18 nt, Human
ugguggaacaggccaagg

SEQ ID NO: 704690 - RNA, 18 nt, Human
ugguggaacaggccaagg

SEQ ID NO: 704691 - RNA, 18 nt, Human
ugguggauggugguagau

SEQ ID NO: 704692 - RNA, 18 nt, Human
ugguggauggugguagau

SEQ ID NO: 704693 - RNA, 22 nt, Human
ugguggauggugguagauggag

SEQ ID NO: 704694 - RNA, 22 nt, Human
ugguggauggugguagauggag

SEQ ID NO: 704695 - RNA, 20 nt, Human
uguagaagacaaauaaggca

SEQ ID NO: 704696 - RNA, 19 nt, Human
uuagggauuuccaaauagg

SEQ ID NO: 704697 - RNA, 19 nt, Human
uuagggauuuccaaauagg

SEQ ID NO: 704698 - RNA, 21 nt, Human
uuccccaugaccuuuuccaua

SEQ ID NO: 704699 - RNA, 19 nt, Human
uucucucacuugguggaac

SEQ ID NO: 704700 - RNA, 19 nt, Human
uucucucacuugguggaac

SEQ ID NO: 704701 - RNA, 22 nt, Human
uugcagugagccgaaaucgcgc

SEQ ID NO: 704702 - RNA, 23 nt, Human
uuggcuaggcacgguggcucaca

SEQ ID NO: 704703 - RNA, 23 nt, Human
uuggcuaggcacgguggcucaca

SEQ ID NO: 704704 - RNA, 28 nt, Human
uuggcuaggcacgguggcucacaucugu

SEQ ID NO: 704705 - RNA, 28 nt, Human
uuggcuaggcacgguggcucacaucugu

SEQ ID NO: 704706 - RNA, 28 nt, Human
uuggcuaggcacgguggcucacaucugu

SEQ ID NO: 704707 - RNA, 19 nt, Human
uuguuuuucuuuuuggauc

SEQ ID NO: 704708 - RNA, 19 nt, Human
uuguuuuucuuuuuggauc

SEQ ID NO: 704709 - RNA, 20 nt, Human
uuuaaacuacuacuaaagca

SEQ ID NO: 704710 - RNA, 20 nt, Human
uuuaaacuacuacuaaagca

SEQ ID NO: 704711 - RNA, 21 nt, Human
uuucuccauguuggucaggcu

SEQ ID NO: 704712 - RNA, 19 nt, Human
uuuugcucuuguugccagg

SEQ ID NO: 704713 - RNA, 19 nt, Human
uuuuuuuuuuuuuuuucaa

SEQ ID NO: 704714 - RNA, 28 nt, Human
uuccccgcaaacccucaccgguagagag

SEQ ID NO: 704715 - RNA, 24 nt, Human
aaacaaaugguaauuggaaucaga

SEQ ID NO: 704716 - RNA, 23 nt, Human
aaaguuaccguaauuuaugauua

SEQ ID NO: 704717 - RNA, 21 nt, Human
aacagcaaaaugacuuaaaac

SEQ ID NO: 704718 - RNA, 23 nt, Human
aagaggccaaagaagcagaaaug

SEQ ID NO: 704719 - RNA, 23 nt, Human
aagguccacaguaaaaucagaaa

SEQ ID NO: 704720 - RNA, 25 nt, Human
aagugauccucccaccuuggccucc

SEQ ID NO: 704721 - RNA, 25 nt, Human
aagugauccucccaccuuggccucc

SEQ ID NO: 704722 - RNA, 23 nt, Human
aauagaauuggguaaaaaacaaa

SEQ ID NO: 704723 - RNA, 20 nt, Human
aaucucguguuuccugcagc

SEQ ID NO: 704724 - RNA, 21 nt, Human
acaaacuugccuuuccaaugg

SEQ ID NO: 704725 - RNA, 22 nt, Human
acaaaguuuuacaauuauuaac

SEQ ID NO: 704726 - RNA, 26 nt, Human
acagagcagacaaaaggaucggcaaa

SEQ ID NO: 704727 - RNA, 25 nt, Human
acagcuuauugcagccugaacucuc

SEQ ID NO: 704728 - RNA, 24 nt, Human
acccaggcuggagugcagaggcau

SEQ ID NO: 704729 - RNA, 19 nt, Human
accggccccgucucgcccc

SEQ ID NO: 704730 - RNA, 18 nt, Human
acuauguuacccaggcag

SEQ ID NO: 704731 - RNA, 27 nt, Human
acucuuaucuaggaugugguucuguuc

SEQ ID NO: 704732 - RNA, 22 nt, Human
agaagcagaaaugagcagaaag

SEQ ID NO: 704733 - RNA, 21 nt, Human
agcaaaaugacuuaaaacuga

SEQ ID NO: 704734 - RNA, 25 nt, Human
agcagaaaggaguuggggcuugaug

SEQ ID NO: 704735 - RNA, 24 nt, Human
agcugggacuacaagcacaugcca

SEQ ID NO: 704736 - RNA, 25 nt, Human
aggaucggcaaaaggaaauggacaa

SEQ ID NO: 704737 - RNA, 19 nt, Human
aggcaaaagucaauucagc

SEQ ID NO: 704738 - RNA, 19 nt, Human
aggcacgccaggguggggg

SEQ ID NO: 704739 - RNA, 18 nt, Human
aggcaggucuugaacucc

SEQ ID NO: 704740 - RNA, 23 nt, Human
agugcagaggcaugaucacagcu

SEQ ID NO: 704741 - RNA, 19 nt, Human
aguucaagugauccuccca

SEQ ID NO: 704742 - RNA, 21 nt, Human
auaauggaauuuuucucuuca

SEQ ID NO: 704743 - RNA, 22 nt, Human
auagaaacaacacucaugucau

SEQ ID NO: 704744 - RNA, 21 nt, Human
aucuauuugaugaggucagau

SEQ ID NO: 704745 - RNA, 21 nt, Human
aucuccaucacccaggcugga

SEQ ID NO: 704746 - RNA, 23 nt, Human
aucuccaucacccaggcuggagu

SEQ ID NO: 704747 - RNA, 26 nt, Human
auuuuacucagccagguuucccaggg

SEQ ID NO: 704748 - RNA, 23 nt, Human
cacccaggcuggagugcagaggc

SEQ ID NO: 704749 - RNA, 21 nt, Human
caccccuuccauuuuaaucug

SEQ ID NO: 704750 - RNA, 24 nt, Human
caccucagccucccuaguagcugg

SEQ ID NO: 704751 - RNA, 24 nt, Human
cacuauguuacccaggcaggucuu

SEQ ID NO: 704752 - RNA, 31 nt, Human
cacuauguuacccaggcaggucuugaacucc

SEQ ID NO: 704753 - RNA, 21 nt, Human
cagcaaaaugacuuaaaacug

SEQ ID NO: 704754 - RNA, 21 nt, Human
cagccugaacucucagacuga

SEQ ID NO: 704755 - RNA, 23 nt, Human
cagccugaacucucagacugaag

SEQ ID NO: 704756 - RNA, 18 nt, Human
cagcuagaacaccuucca

SEQ ID NO: 704757 - RNA, 23 nt, Human
cagcuagaacaccuuccagacac

SEQ ID NO: 704758 - RNA, 19 nt, Human
cauuagaacaccuugguau

SEQ ID NO: 704759 - RNA, 18 nt, Human
cauuugggaggguggagg

SEQ ID NO: 704760 - RNA, 18 nt, Human
ccaaaaaaacuccauacc

SEQ ID NO: 704761 - RNA, 24 nt, Human
ccaaagaagcagaaaugagcagaa

SEQ ID NO: 704762 - RNA, 21 nt, Human
cccaggcuggagugcagaggc

SEQ ID NO: 704763 - RNA, 19 nt, Human
ccccucccgccaccuaccg

SEQ ID NO: 704764 - RNA, 20 nt, Human
ccccuggcaaccacuaggua

SEQ ID NO: 704765 - RNA, 23 nt, Human
ccgcggccggggcaggccggggc

SEQ ID NO: 704766 - RNA, 19 nt, Human
ccggccccgucucgccccg

SEQ ID NO: 704767 - RNA, 20 nt, Human
ccggcccggccccucccgcc

SEQ ID NO: 704768 - RNA, 24 nt, Human
ccuacugcuaauauuuucuuugga

SEQ ID NO: 704769 - RNA, 19 nt, Human
ccucccaccuuggccuccc

SEQ ID NO: 704770 - RNA, 18 nt, Human
ccuccuccucagccgcgg

SEQ ID NO: 704771 - RNA, 20 nt, Human
ccugaguucaagugauccuc

SEQ ID NO: 704772 - RNA, 23 nt, Human
ccugccacugauuacugaagucc

SEQ ID NO: 704773 - RNA, 21 nt, Human
ccuucuauuuguccuuuuaaa

SEQ ID NO: 704774 - RNA, 21 nt, Human
cgcggccggggcaggcacgcc

SEQ ID NO: 704775 - RNA, 24 nt, Human
cucagccucccuaguagcugggac

SEQ ID NO: 704776 - RNA, 18 nt, Human
cuccaucacccaggcugg

SEQ ID NO: 704777 - RNA, 19 nt, Human
cuccaucacccaggcugga

SEQ ID NO: 704778 - RNA, 20 nt, Human
cuccaucacccaggcuggag

SEQ ID NO: 704779 - RNA, 20 nt, Human
cuccuccuccuccuccuccu

SEQ ID NO: 704780 - RNA, 20 nt, Human
cuccuccuccuccuccuccu

SEQ ID NO: 704781 - RNA, 20 nt, Human
cuccuccuccuccuccuccu

SEQ ID NO: 704782 - RNA, 22 nt, Human
cuccuccuccuccuccuccuca

SEQ ID NO: 704783 - RNA, 24 nt, Human
cucucaaccugaucuuaguauuuc

SEQ ID NO: 704784 - RNA, 18 nt, Human
cucucuucauuuuacuca

SEQ ID NO: 704785 - RNA, 21 nt, Human
cuugugccaaaaucacucuuc

SEQ ID NO: 704786 - RNA, 21 nt, Human
cuuugagggaaaacacacagg

SEQ ID NO: 704787 - RNA, 23 nt, Human
gaacuugguggugacauuuggga

SEQ ID NO: 704788 - RNA, 19 nt, Human
gacauaguuauguaauucg

SEQ ID NO: 704789 - RNA, 21 nt, Human
gagccaccauacccggccuca

SEQ ID NO: 704790 - RNA, 18 nt, Human
gauuacaguugugagcca

SEQ ID NO: 704791 - RNA, 21 nt, Human
gauuacaguugugagccacca

SEQ ID NO: 704792 - RNA, 24 nt, Human
gauuacaguugugagccaccauac

SEQ ID NO: 704793 - RNA, 20 nt, Human
gcaugaucacagcuuauugc

SEQ ID NO: 704794 - RNA, 20 nt, Human
gccggcuccggcccggcccc

SEQ ID NO: 704795 - RNA, 21 nt, Human
gccggcuccggcccggccccu

SEQ ID NO: 704796 - RNA, 20 nt, Human
gcggccggggcaggcacgcc

SEQ ID NO: 704797 - RNA, 23 nt, Human
gcuggagugcagaggcaugauca

SEQ ID NO: 704798 - RNA, 24 nt, Human
ggcaucuccaucacccaggcugga

SEQ ID NO: 704799 - RNA, 23 nt, Human
gggauuacaguugugagccacca

SEQ ID NO: 704800 - RNA, 23 nt, Human
gggccuccgggccuggcccuccc

SEQ ID NO: 704801 - RNA, 22 nt, Human
ggggauuacaguugugagccac

SEQ ID NO: 704802 - RNA, 24 nt, Human
ggggauuacaguugugagccacca

SEQ ID NO: 704803 - RNA, 18 nt, Human
gggugggggccuccgggc

SEQ ID NO: 704804 - RNA, 18 nt, Human
guacaacucuccagaaau

SEQ ID NO: 704805 - RNA, 19 nt, Human
guggauagccugaaggcag

SEQ ID NO: 704806 - RNA, 19 nt, Human
gugggggccuccgggccug

SEQ ID NO: 704807 - RNA, 24 nt, Human
gugguucuguucaugcugcuuucu

SEQ ID NO: 704808 - RNA, 24 nt, Human
uaaaacugaguacaacucuccaga

SEQ ID NO: 704809 - RNA, 22 nt, Human
uaaaaucagaaagcugaaccuc

SEQ ID NO: 704810 - RNA, 19 nt, Human
uaacaugagcagugauuug

SEQ ID NO: 704811 - RNA, 19 nt, Human
uaagagauggcaucuccau

SEQ ID NO: 704812 - RNA, 23 nt, Human
uacaguugugagccaccauaccc

SEQ ID NO: 704813 - RNA, 21 nt, Human
uaccggccccgucucgccccg

SEQ ID NO: 704814 - RNA, 19 nt, Human
uagaaagcacuugacauug

SEQ ID NO: 704815 - RNA, 24 nt, Human
uaguagcugggacuacaagcacau

SEQ ID NO: 704816 - RNA, 24 nt, Human
uaguuaaaacuguugcugcauuca

SEQ ID NO: 704817 - RNA, 20 nt, Human
uauauucauaaaauugaaac

SEQ ID NO: 704818 - RNA, 18 nt, Human
uaugguguuuuguucuuc

SEQ ID NO: 704819 - RNA, 19 nt, Human
uaugguguuuuguucuucg

SEQ ID NO: 704820 - RNA, 23 nt, Human
uauguuacccaggcaggucuuga

SEQ ID NO: 704821 - RNA, 24 nt, Human
uauguuacccaggcaggucuugaa

SEQ ID NO: 704822 - RNA, 18 nt, Human
uauuuggaaaaaagauau

SEQ ID NO: 704823 - RNA, 25 nt, Human
ucaagugauccucccaccuuggccu

SEQ ID NO: 704824 - RNA, 18 nt, Human
ucacccaggcuggagugc

SEQ ID NO: 704825 - RNA, 18 nt, Human
ucacuugugccaaaauca

SEQ ID NO: 704826 - RNA, 22 nt, Human
ucagccagguuuuguacugaug

SEQ ID NO: 704827 - RNA, 18 nt, Human
uccacaguaaaaucagaa

SEQ ID NO: 704828 - RNA, 20 nt, Human
uccacaguaaaaucagaaag

SEQ ID NO: 704829 - RNA, 24 nt, Human
uccaucacccaggcuggagugcag

SEQ ID NO: 704830 - RNA, 21 nt, Human
ucccaccucagccucccuagu

SEQ ID NO: 704831 - RNA, 22 nt, Human
ucccaccucagccucccuagua

SEQ ID NO: 704832 - RNA, 18 nt, Human
ucccgccggcuccggccc

SEQ ID NO: 704833 - RNA, 22 nt, Human
ucccuaguagcugggacuacaa

SEQ ID NO: 704834 - RNA, 21 nt, Human
uccugaguucaagugauccuc

SEQ ID NO: 704835 - RNA, 19 nt, Human
ucggucacuugugccaaaa

SEQ ID NO: 704836 - RNA, 24 nt, Human
ucggucacuugugccaaaaucacu

SEQ ID NO: 704837 - RNA, 22 nt, Human
ucuacccagcuagaacaccuuc

SEQ ID NO: 704838 - RNA, 21 nt, Human
ucucaaacagagcagacaaaa

SEQ ID NO: 704839 - RNA, 19 nt, Human
ucucacuauguuacccagg

SEQ ID NO: 704840 - RNA, 26 nt, Human
ucucacuauguuacccaggcaggucu

SEQ ID NO: 704841 - RNA, 27 nt, Human
ucucacuauguuacccaggcaggucuu

SEQ ID NO: 704842 - RNA, 25 nt, Human
ucuccaucacccaggcuggagugca

SEQ ID NO: 704843 - RNA, 18 nt, Human
ucucgccccgucaccuag

SEQ ID NO: 704844 - RNA, 21 nt, Human
ucugaagccagugauauuguc

SEQ ID NO: 704845 - RNA, 23 nt, Human
ucuugaacuccugaguucaagug

SEQ ID NO: 704846 - RNA, 23 nt, Human
ugaaagagacaguaacuggagau

SEQ ID NO: 704847 - RNA, 24 nt, Human
ugaaagagacaguaacuggagaua

SEQ ID NO: 704848 - RNA, 25 nt, Human
ugaacuccugaguucaagugauccu

SEQ ID NO: 704849 - RNA, 26 nt, Human
ugacuagaccaagcagaaucucucaa

SEQ ID NO: 704850 - RNA, 20 nt, Human
ugacuucuuacaggccccuu

SEQ ID NO: 704851 - RNA, 18 nt, Human
ugagcagaaaggaguugg

SEQ ID NO: 704852 - RNA, 19 nt, Human
ugagcagaaaggaguuggg

SEQ ID NO: 704853 - RNA, 22 nt, Human
ugagcagaaaggaguuggggcu

SEQ ID NO: 704854 - RNA, 18 nt, Human
ugagggaaaacacacagg

SEQ ID NO: 704855 - RNA, 23 nt, Human
ugagggaaaacacacagggugag

SEQ ID NO: 704856 - RNA, 29 nt, Human
ugaggucucaccugaaggaacuugguggu

SEQ ID NO: 704857 - RNA, 24 nt, Human
ugaggucucacuauguuacccagg

SEQ ID NO: 704858 - RNA, 18 nt, Human
ugauuaaguucugggggc

SEQ ID NO: 704859 - RNA, 21 nt, Human
ugcaggagaauaucuggcaag

SEQ ID NO: 704860 - RNA, 18 nt, Human
ugccaccacaccaggcuc

SEQ ID NO: 704861 - RNA, 22 nt, Human
ugcgauauaauuuauuacagaa

SEQ ID NO: 704862 - RNA, 21 nt, Human
ugcugcauucaugaaugcccu

SEQ ID NO: 704863 - RNA, 22 nt, Human
ugcuugcugucagcauuguugc

SEQ ID NO: 704864 - RNA, 19 nt, Human
uggagugcagaggcaugau

SEQ ID NO: 704865 - RNA, 21 nt, Human
uggagugcagaggcaugauca

SEQ ID NO: 704866 - RNA, 18 nt, Human
uggcucagauggaagcaa

SEQ ID NO: 704867 - RNA, 21 nt, Human
ugggacuacaagcacaugcca

SEQ ID NO: 704868 - RNA, 24 nt, Human
ugggacuacaagcacaugccacca

SEQ ID NO: 704869 - RNA, 20 nt, Human
ugggaggguggagggaggca

SEQ ID NO: 704870 - RNA, 21 nt, Human
ugggaggguggagggaggcag

SEQ ID NO: 704871 - RNA, 20 nt, Human
ugggggccuccgggccuggc

SEQ ID NO: 704872 - RNA, 20 nt, Human
ugguaugagaauauauggaa

SEQ ID NO: 704873 - RNA, 18 nt, Human
uguauuuuaagcauuucc

SEQ ID NO: 704874 - RNA, 25 nt, Human
ugugagccaccauacccggccucau

SEQ ID NO: 704875 - RNA, 19 nt, Human
uguuauagugaacucaugg

SEQ ID NO: 704876 - RNA, 23 nt, Human
uguuuccugcagccugauagauu

SEQ ID NO: 704877 - RNA, 21 nt, Human
uguuuuguucuucggucacuu

SEQ ID NO: 704878 - RNA, 26 nt, Human
uuaaaauaaauguaagccauaguuaa

SEQ ID NO: 704879 - RNA, 26 nt, Human
uuacuacaucaaaacaaagagugaaa

SEQ ID NO: 704880 - RNA, 19 nt, Human
uuagaacaccuugguauaa

SEQ ID NO: 704881 - RNA, 22 nt, Human
uucaagcauuuuuguaagaggu

SEQ ID NO: 704882 - RNA, 23 nt, Human
uucaagugauccucccaccuugg

SEQ ID NO: 704883 - RNA, 24 nt, Human
uucaagugauccucccaccuuggc

SEQ ID NO: 704884 - RNA, 23 nt, Human
uuccaaaaaaacuccauacccau

SEQ ID NO: 704885 - RNA, 23 nt, Human
uuccagccugaauuuuucagauu

SEQ ID NO: 704886 - RNA, 26 nt, Human
uuccagccugaauuuuucagauugac

SEQ ID NO: 704887 - RNA, 23 nt, Human
uucccaccucagccucccuagua

SEQ ID NO: 704888 - RNA, 18 nt, Human
uuccugcagccugauaga

SEQ ID NO: 704889 - RNA, 25 nt, Human
uugacuagaccaagcagaaucucuc

SEQ ID NO: 704890 - RNA, 21 nt, Human
uugccauuuaaugaaugacau

SEQ ID NO: 704891 - RNA, 23 nt, Human
uugggaggguggagggaggcagu

SEQ ID NO: 704892 - RNA, 21 nt, Human
uuuaaaguguacaauuuggug

SEQ ID NO: 704893 - RNA, 26 nt, Human
uuuaacuucucaaacagagcagacaa

SEQ ID NO: 704894 - RNA, 19 nt, Human
uuuaagcauuuccuggugg

SEQ ID NO: 704895 - RNA, 23 nt, Human
aaaaaaaaaaaaaaaaaggaaag

SEQ ID NO: 704896 - RNA, 25 nt, Human
aaaaaaaaaaaaaaggaaaguauaa

SEQ ID NO: 704897 - RNA, 22 nt, Human
aaaaagcucggcugaugcuggc

SEQ ID NO: 704898 - RNA, 19 nt, Human
aaacuccagcagggcuggc

SEQ ID NO: 704899 - RNA, 21 nt, Human
agagaagagcccagggcugcc

SEQ ID NO: 704900 - RNA, 20 nt, Human
agggccccgcagcacgcccc

SEQ ID NO: 704901 - RNA, 19 nt, Human
agggcgaggggcagggcug

SEQ ID NO: 704902 - RNA, 23 nt, Human
agggcugggggcagguggguugc

SEQ ID NO: 704903 - RNA, 20 nt, Human
aggugggugggggcaucagg

SEQ ID NO: 704904 - RNA, 22 nt, Human
auauuaaaaaaaaaaaaaaaaa

SEQ ID NO: 704905 - RNA, 21 nt, Human
caacccuacccgagggucaac

SEQ ID NO: 704906 - RNA, 30 nt, Human
cacccccgacacccagagacuacaguacuu

SEQ ID NO: 704907 - RNA, 19 nt, Human
cagcagggcuggcgagggu

SEQ ID NO: 704908 - RNA, 18 nt, Human
caggacaacccuacccga

SEQ ID NO: 704909 - RNA, 21 nt, Human
caggacaacccuacccgaggg

SEQ ID NO: 704910 - RNA, 21 nt, Human
caguacuuaggaguuacacac

SEQ ID NO: 704911 - RNA, 22 nt, Human
caucagggcgaggggcagggcu

SEQ ID NO: 704912 - RNA, 20 nt, Human
ccacagcaaacuccagcagg

SEQ ID NO: 704913 - RNA, 24 nt, Human
ccagagaagagcccagggcugccu

SEQ ID NO: 704914 - RNA, 21 nt, Human
cccacagcaaacuccagcagg

SEQ ID NO: 704915 - RNA, 23 nt, Human
cccacagcaaacuccagcagggc

SEQ ID NO: 704916 - RNA, 26 nt, Human
cccacagcaaacuccagcagggcccc

SEQ ID NO: 704917 - RNA, 26 nt, Human
cccaggcaggacaacccuacccgagg

SEQ ID NO: 704918 - RNA, 18 nt, Human
cccagggcugccucguug

SEQ ID NO: 704919 - RNA, 27 nt, Human
cccagggcugccucguugggcgucucc

SEQ ID NO: 704920 - RNA, 18 nt, Human
ccccccuccuccucucuc

SEQ ID NO: 704921 - RNA, 23 nt, Human
cccccgacacccagagacuacag

SEQ ID NO: 704922 - RNA, 19 nt, Human
cccccgcccuggccacccc

SEQ ID NO: 704923 - RNA, 24 nt, Human
cccccuccuccucucucuucguca

SEQ ID NO: 704924 - RNA, 19 nt, Human
ccccgcccuggccaccccc

SEQ ID NO: 704925 - RNA, 21 nt, Human
ccccgcccuggccacccccga

SEQ ID NO: 704926 - RNA, 22 nt, Human
ccccgcccuggccacccccgac

SEQ ID NO: 704927 - RNA, 21 nt, Human
cccgcagcacgccccucucca

SEQ ID NO: 704928 - RNA, 24 nt, Human
cccgcagcacgccccucuccagcu

SEQ ID NO: 704929 - RNA, 24 nt, Human
cccuggccucggugccucuguccu

SEQ ID NO: 704930 - RNA, 21 nt, Human
ccgcucuuccuccuggguggc

SEQ ID NO: 704931 - RNA, 22 nt, Human
ccuccuccucucucuucgucac

SEQ ID NO: 704932 - RNA, 22 nt, Human
ccuggccacccccgacacccag

SEQ ID NO: 704933 - RNA, 21 nt, Human
cgagggugcgcccggcugccg

SEQ ID NO: 704934 - RNA, 18 nt, Human
cgcccuggccacccccga

SEQ ID NO: 704935 - RNA, 24 nt, Human
cgcuggaccgaggugggugggggc

SEQ ID NO: 704936 - RNA, 23 nt, Human
cgcuuggucccucuggguuuccu

SEQ ID NO: 704937 - RNA, 22 nt, Human
cucagcccgcucuuccuccugg

SEQ ID NO: 704938 - RNA, 18 nt, Human
cuccaccuccucccagcc

SEQ ID NO: 704939 - RNA, 20 nt, Human
cuccucuuccuccuccucca

SEQ ID NO: 704940 - RNA, 21 nt, Human
cugaguuucacaaaaaagcuc

SEQ ID NO: 704941 - RNA, 22 nt, Human
cuggaccgaggugggugggggc

SEQ ID NO: 704942 - RNA, 20 nt, Human
cuuccuccuccuccaccucc

SEQ ID NO: 704943 - RNA, 19 nt, Human
cuucuccucuuccuccucc

SEQ ID NO: 704944 - RNA, 21 nt, Human
gagguuccuuggaugggugcc

SEQ ID NO: 704945 - RNA, 24 nt, Human
gaguuucacaaaaaagcucggcug

SEQ ID NO: 704946 - RNA, 18 nt, Human
gcccacagcaaacuccag

SEQ ID NO: 704947 - RNA, 19 nt, Human
gcccugccaggacagccag

SEQ ID NO: 704948 - RNA, 22 nt, Human
ggagguuccuuggaugggugcc

SEQ ID NO: 704949 - RNA, 23 nt, Human
ggcugccgccuccugggcagggc

SEQ ID NO: 704950 - RNA, 20 nt, Human
gggcagggcugggggcaggu

SEQ ID NO: 704951 - RNA, 22 nt, Human
gggcagggcugggggcaggugg

SEQ ID NO: 704952 - RNA, 19 nt, Human
gggccccgcagcacgcccc

SEQ ID NO: 704953 - RNA, 23 nt, Human
gggcugggggcagguggguugca

SEQ ID NO: 704954 - RNA, 21 nt, Human
ggugggugggggcaucagggc

SEQ ID NO: 704955 - RNA, 21 nt, Human
gucccucuggguuuccucagc

SEQ ID NO: 704956 - RNA, 24 nt, Human
uaaaaaacaugugcaguugaaagc

SEQ ID NO: 704957 - RNA, 24 nt, Human
uaacugguggcuaucuguucauaa

SEQ ID NO: 704958 - RNA, 23 nt, Human
uccagcuucgcaucagggcgagg

SEQ ID NO: 704959 - RNA, 18 nt, Human
uccucagccgcguuuugg

SEQ ID NO: 704960 - RNA, 19 nt, Human
uccugccuccuucaaagug

SEQ ID NO: 704961 - RNA, 18 nt, Human
ucgcaucagggcgagggg

SEQ ID NO: 704962 - RNA, 21 nt, Human
ucuccagcuucgcaucagggc

SEQ ID NO: 704963 - RNA, 21 nt, Human
ucuccucuuccuccuccucca

SEQ ID NO: 704964 - RNA, 21 nt, Human
ucuggguuuccucagcccgcu

SEQ ID NO: 704965 - RNA, 21 nt, Human
ucuuccuccuccuccaccucc

SEQ ID NO: 704966 - RNA, 26 nt, Human
ucuuccuccuccuccaccuccucccc

SEQ ID NO: 704967 - RNA, 19 nt, Human
ugcaguugaaagcccugcc

SEQ ID NO: 704968 - RNA, 24 nt, Human
ugcaguugaaagcccugccaggac

SEQ ID NO: 704969 - RNA, 20 nt, Human
ugccaggacagccagucugu

SEQ ID NO: 704970 - RNA, 22 nt, Human
ugccucuguccugccuccuuca

SEQ ID NO: 704971 - RNA, 18 nt, Human
uggaugggugcccuggug

SEQ ID NO: 704972 - RNA, 25 nt, Human
uggccacccccgacacccagagacu

SEQ ID NO: 704973 - RNA, 21 nt, Human
ugggugggggcaucagggccc

SEQ ID NO: 704974 - RNA, 24 nt, Human
uggguuuccucagcccgcucuucc

SEQ ID NO: 704975 - RNA, 24 nt, Human
uguacaguuuuucaugcaccaaag

SEQ ID NO: 704976 - RNA, 24 nt, Human
uuaaaaaaaaaaaaaaaaaggaaa

SEQ ID NO: 704977 - RNA, 26 nt, Human
uuauagaaauccauauauauauugcu

SEQ ID NO: 704978 - RNA, 21 nt, Human
uucgcaucagggcgaggggca

SEQ ID NO: 704979 - RNA, 20 nt, Human
uuuccuucuccucuuccucc

SEQ ID NO: 704980 - RNA, 24 nt, Human
uuuccuucuccucuuccuccuccu

SEQ ID NO: 704981 - RNA, 18 nt, Human
uuugguugcaacucaugg

SEQ ID NO: 704982 - RNA, 19 nt, Human
uuuuuuuuuuuuuuuuuaa

SEQ ID NO: 704983 - RNA, 21 nt, Human
aagaaggcugacucaacaggc

SEQ ID NO: 704984 - RNA, 19 nt, Human
caagggcaggcccugagau

SEQ ID NO: 704985 - RNA, 19 nt, Human
cacggagcuuccuguaggg

SEQ ID NO: 704986 - RNA, 21 nt, Human
ccagcuccccuggcagccgag

SEQ ID NO: 704987 - RNA, 21 nt, Human
ccccagcugggcacacggagc

SEQ ID NO: 704988 - RNA, 22 nt, Human
gagauggggguccagagagaga

SEQ ID NO: 704989 - RNA, 20 nt, Human
gauggggguccagagagaga

SEQ ID NO: 704990 - RNA, 21 nt, Human
gggcaggcccugagauggggg

SEQ ID NO: 704991 - RNA, 18 nt, Human
ugagggaagaaggcugac

SEQ ID NO: 704992 - RNA, 20 nt, Human
uggcuccagcuccccuggca

SEQ ID NO: 704993 - RNA, 22 nt, Human
ugggaggacaccuucgcaggug

SEQ ID NO: 704994 - RNA, 21 nt, Human
aaaaaauuugauccgagaaac

SEQ ID NO: 704995 - RNA, 21 nt, Human
aacaggcacuaguccgacacg

SEQ ID NO: 704996 - RNA, 23 nt, Human
aacuucucuuuucucuuuuauaa

SEQ ID NO: 704997 - RNA, 24 nt, Human
aagaaaaagauccagaugaucuga

SEQ ID NO: 704998 - RNA, 19 nt, Human
aagggggccccugauggag

SEQ ID NO: 704999 - RNA, 18 nt, Human
aaguaauaccucuccuua

SEQ ID NO: 705000 - RNA, 18 nt, Human
aaguuaaaaaauuugauc

SEQ ID NO: 705001 - RNA, 24 nt, Human
aauauacauccacuuuuuuuguug

SEQ ID NO: 705002 - RNA, 23 nt, Human
aauuuuuuucuguuuucuuuuuu

SEQ ID NO: 705003 - RNA, 23 nt, Human
accccacccacccccguccccaa

SEQ ID NO: 705004 - RNA, 19 nt, Human
aggaaggagguggggaaga

SEQ ID NO: 705005 - RNA, 19 nt, Human
aggaagggggccccugaug

SEQ ID NO: 705006 - RNA, 22 nt, Human
auuugauccgagaaacaguuaa

SEQ ID NO: 705007 - RNA, 21 nt, Human
caaacuucucuuuucucuuuu

SEQ ID NO: 705008 - RNA, 19 nt, Human
caaagcccaauugugcuac

SEQ ID NO: 705009 - RNA, 19 nt, Human
caccacccccgggcccggc

SEQ ID NO: 705010 - RNA, 23 nt, Human
caccccacccacccccgucccca

SEQ ID NO: 705011 - RNA, 25 nt, Human
cacuuguuccugagucgcucuccug

SEQ ID NO: 705012 - RNA, 23 nt, Human
cagcagucuaaaaucacaagauc

SEQ ID NO: 705013 - RNA, 27 nt, Human
ccacccacccccguccccaaaaaagua

SEQ ID NO: 705014 - RNA, 24 nt, Human
ccccacccacccccguccccaaaa

SEQ ID NO: 705015 - RNA, 19 nt, Human
cccccgggcccggcgccgc

SEQ ID NO: 705016 - RNA, 21 nt, Human
ccccuaaguguaucccuccuc

SEQ ID NO: 705017 - RNA, 19 nt, Human
ccgccgccgccgcuuccuc

SEQ ID NO: 705018 - RNA, 20 nt, Human
ccggcgccgccgccgccgcu

SEQ ID NO: 705019 - RNA, 22 nt, Human
ccugcugucaccacccccgggc

SEQ ID NO: 705020 - RNA, 20 nt, Human
cgccgccgccgcuuccucuc

SEQ ID NO: 705021 - RNA, 20 nt, Human
cuuuuuuuuuuuuuuuuugu

SEQ ID NO: 705022 - RNA, 18 nt, Human
gaagaacacgaagaagaa

SEQ ID NO: 705023 - RNA, 19 nt, Human
gaccugcugucaccacccc

SEQ ID NO: 705024 - RNA, 19 nt, Human
gccaguagagcaggcucug

SEQ ID NO: 705025 - RNA, 19 nt, Human
gccccugauggaguaagaa

SEQ ID NO: 705026 - RNA, 22 nt, Human
gccgccgccgcuuccucuccca

SEQ ID NO: 705027 - RNA, 21 nt, Human
gccgccgcuuccucucccaca

SEQ ID NO: 705028 - RNA, 18 nt, Human
ggacuuaggaaggggaag

SEQ ID NO: 705029 - RNA, 18 nt, Human
gggaagaacacgaagaag

SEQ ID NO: 705030 - RNA, 23 nt, Human
ggggaagaacacgaagaagaagu

SEQ ID NO: 705031 - RNA, 22 nt, Human
guccuuuguauuuaugaugcaa

SEQ ID NO: 705032 - RNA, 23 nt, Human
guuaacucugcagcagucuaaaa

SEQ ID NO: 705033 - RNA, 23 nt, Human
guugacacggggggaggaagggg

SEQ ID NO: 705034 - RNA, 18 nt, Human
uaaaacugucuccaaagu

SEQ ID NO: 705035 - RNA, 18 nt, Human
uaaagaaaaagauccaga

SEQ ID NO: 705036 - RNA, 22 nt, Human
uaaagcaauauacauccacuuu

SEQ ID NO: 705037 - RNA, 24 nt, Human
uaccaaaaaaauaaaauaaaauaa

SEQ ID NO: 705038 - RNA, 19 nt, Human
uacccauuugccaaagccc

SEQ ID NO: 705039 - RNA, 24 nt, Human
uacccauuugccaaagcccaauug

SEQ ID NO: 705040 - RNA, 19 nt, Human
uaugaccaagaaaugggac

SEQ ID NO: 705041 - RNA, 28 nt, Human
uaugaccaagaaaugggacuuaggaagg

SEQ ID NO: 705042 - RNA, 24 nt, Human
ucaccccacccacccccgucccca

SEQ ID NO: 705043 - RNA, 26 nt, Human
ucaccccacccacccccguccccaaa

SEQ ID NO: 705044 - RNA, 20 nt, Human
ucucuucaccccacccaccc

SEQ ID NO: 705045 - RNA, 21 nt, Human
ucugcagcagucuaaaaucac

SEQ ID NO: 705046 - RNA, 18 nt, Human
ucuuuuuuuuuuuuuuuu

SEQ ID NO: 705047 - RNA, 18 nt, Human
ugaacuggaaaaggaagg

SEQ ID NO: 705048 - RNA, 22 nt, Human
ugacaguuaucaugcucuuccu

SEQ ID NO: 705049 - RNA, 24 nt, Human
ugagccccuaaguguaucccuccu

SEQ ID NO: 705050 - RNA, 20 nt, Human
ugauauguacaucacaauua

SEQ ID NO: 705051 - RNA, 23 nt, Human
ugggaucugugagccccuaagug

SEQ ID NO: 705052 - RNA, 21 nt, Human
uguaaauggcaaaaaauuuaa

SEQ ID NO: 705053 - RNA, 18 nt, Human
uguuuuguuuuguuuuua

SEQ ID NO: 705054 - RNA, 24 nt, Human
uuaaaaaauuugauccgagaaaca

SEQ ID NO: 705055 - RNA, 18 nt, Human
uuaacucugcagcagucu

SEQ ID NO: 705056 - RNA, 21 nt, Human
uuugccaaagcccaauugugc

SEQ ID NO: 705057 - RNA, 19 nt, Human
uuuuuuuuuuuuuuuguga

SEQ ID NO: 705058 - RNA, 18 nt, Human
uuuuuuuuuuuuuuuuug

SEQ ID NO: 705059 - RNA, 18 nt, Human
uuuuuuuuuuuuuuuuug

SEQ ID NO: 705060 - RNA, 19 nt, Human
uuuuuuuuuuuuuuuuugu

SEQ ID NO: 705061 - RNA, 18 nt, Human
aaggcccccaacccacag

SEQ ID NO: 705062 - RNA, 23 nt, Human
aaggccgcagcaggaggaacugg

SEQ ID NO: 705063 - RNA, 21 nt, Human
acccacaguaccguccccaau

SEQ ID NO: 705064 - RNA, 25 nt, Human
accccaaaucccugccugaggcugg

SEQ ID NO: 705065 - RNA, 18 nt, Human
agugggcaggggucuggg

SEQ ID NO: 705066 - RNA, 21 nt, Human
aucccugccugaggcugggga

SEQ ID NO: 705067 - RNA, 22 nt, Human
caacccacaguaccguccccaa

SEQ ID NO: 705068 - RNA, 23 nt, Human
caaggcccccaacccacaguacc

SEQ ID NO: 705069 - RNA, 18 nt, Human
cacugccuccagcacccc

SEQ ID NO: 705070 - RNA, 18 nt, Human
cagcaccccaaaucccug

SEQ ID NO: 705071 - RNA, 21 nt, Human
cagcaccccaaaucccugccu

SEQ ID NO: 705072 - RNA, 20 nt, Human
cagcaggaggaacuggacag

SEQ ID NO: 705073 - RNA, 19 nt, Human
caggaggaacuggacagcg

SEQ ID NO: 705074 - RNA, 22 nt, Human
ccacaugcuggacuaucacccc

SEQ ID NO: 705075 - RNA, 21 nt, Human
ccagcaccccaaaucccugcc

SEQ ID NO: 705076 - RNA, 18 nt, Human
cccacaguaccgucccca

SEQ ID NO: 705077 - RNA, 19 nt, Human
cccccaacccacaguaccg

SEQ ID NO: 705078 - RNA, 19 nt, Human
cccugccugaggcugggga

SEQ ID NO: 705079 - RNA, 18 nt, Human
ccugaggcuggggagaga

SEQ ID NO: 705080 - RNA, 18 nt, Human
cuccagcaccccaaaucc

SEQ ID NO: 705081 - RNA, 24 nt, Human
gagaaaguggggagcagccgguac

SEQ ID NO: 705082 - RNA, 18 nt, Human
ggaacuggacagcggagg

SEQ ID NO: 705083 - RNA, 21 nt, Human
ggagcagcuguagaaacccug

SEQ ID NO: 705084 - RNA, 21 nt, Human
ggcaugugcuuggccacugcc

SEQ ID NO: 705085 - RNA, 21 nt, Human
ggccacugccuccagcacccc

SEQ ID NO: 705086 - RNA, 20 nt, Human
gggagagaccucugccggcg

SEQ ID NO: 705087 - RNA, 23 nt, Human
gguccaggaccggguccgagaaa

SEQ ID NO: 705088 - RNA, 19 nt, Human
uccaaggccgcagcaggag

SEQ ID NO: 705089 - RNA, 19 nt, Human
uccaggaccggguccgaga

SEQ ID NO: 705090 - RNA, 24 nt, Human
uccccacaugcuggacuaucaccc

SEQ ID NO: 705091 - RNA, 22 nt, Human
ucccugccugaggccggggucc

SEQ ID NO: 705092 - RNA, 21 nt, Human
ucccugccugaggcuggggag

SEQ ID NO: 705093 - RNA, 22 nt, Human
ugccugaggcuggggagagacc

SEQ ID NO: 705094 - RNA, 19 nt, Human
ugcuuggccacugccucca

SEQ ID NO: 705095 - RNA, 24 nt, Human
ugggcaggggucuggguccaaggc

SEQ ID NO: 705096 - RNA, 19 nt, Human
aaauggcccugagacccga

SEQ ID NO: 705097 - RNA, 21 nt, Human
aaccacaccccagggcccagc

SEQ ID NO: 705098 - RNA, 20 nt, Human
aacccccagcuccgaaaauc

SEQ ID NO: 705099 - RNA, 25 nt, Human
aagaaaagacagacaagacacagaa

SEQ ID NO: 705100 - RNA, 21 nt, Human
aagaagaaaagacagacaaga

SEQ ID NO: 705101 - RNA, 19 nt, Human
aagaagaagaaaagacaga

SEQ ID NO: 705102 - RNA, 21 nt, Human
aagaagaagaaaagacagaca

SEQ ID NO: 705103 - RNA, 19 nt, Human
aaggggcaugagauguccc

SEQ ID NO: 705104 - RNA, 19 nt, Human
aaggggcuuggggucccca

SEQ ID NO: 705105 - RNA, 18 nt, Human
aagugguggauuggggcu

SEQ ID NO: 705106 - RNA, 18 nt, Human
acaccggagucuccuggc

SEQ ID NO: 705107 - RNA, 18 nt, Human
acaccuuccugggccuac

SEQ ID NO: 705108 - RNA, 20 nt, Human
acagagcaagacuccgucuc

SEQ ID NO: 705109 - RNA, 24 nt, Human
acagagcaagacuccgucucgaga

SEQ ID NO: 705110 - RNA, 22 nt, Human
acagugugagagaagaagcagg

SEQ ID NO: 705111 - RNA, 23 nt, Human
acagugugagagaagaagcaggg

SEQ ID NO: 705112 - RNA, 21 nt, Human
accacaccccagggcccagcg

SEQ ID NO: 705113 - RNA, 22 nt, Human
accccagggcccagcgagguca

SEQ ID NO: 705114 - RNA, 19 nt, Human
accucaccugaggauuuca

SEQ ID NO: 705115 - RNA, 24 nt, Human
accuugucucuacuaagaauacaa

SEQ ID NO: 705116 - RNA, 21 nt, Human
acgccaggaaaaggggguagg

SEQ ID NO: 705117 - RNA, 22 nt, Human
agaaaaaaaaaaggguggaagg

SEQ ID NO: 705118 - RNA, 27 nt, Human
agaaaaaaggaagaaaacagcaagggg

SEQ ID NO: 705119 - RNA, 19 nt, Human
agaaaaagaaaggaaaaga

SEQ ID NO: 705120 - RNA, 23 nt, Human
agaaaagacagacaagacacaga

SEQ ID NO: 705121 - RNA, 23 nt, Human
agaaaggaaaagaggcucguuaa

SEQ ID NO: 705122 - RNA, 21 nt, Human
agaagaagaaaagacagacaa

SEQ ID NO: 705123 - RNA, 20 nt, Human
agacaagaagaagaaaagac

SEQ ID NO: 705124 - RNA, 26 nt, Human
agacaagaagaagaaaagagggaccc

SEQ ID NO: 705125 - RNA, 27 nt, Human
agacaagacacagaaaaagagggaccc

SEQ ID NO: 705126 - RNA, 27 nt, Human
agacaagacacagaaaaagccuuucgg

SEQ ID NO: 705127 - RNA, 22 nt, Human
agagguugcagugagcugagau

SEQ ID NO: 705128 - RNA, 24 nt, Human
agagguugcagugagcugagauug

SEQ ID NO: 705129 - RNA, 23 nt, Human
agauuagguuggcgcacucugcu

SEQ ID NO: 705130 - RNA, 25 nt, Human
agcaaggggcaugagaugucccuuc

SEQ ID NO: 705131 - RNA, 23 nt, Human
agccgggcaugguggcgugugcc

SEQ ID NO: 705132 - RNA, 23 nt, Human
agccuggccaauauggugaaacc

SEQ ID NO: 705133 - RNA, 23 nt, Human
agccuggccaauauggugaaacc

SEQ ID NO: 705134 - RNA, 24 nt, Human
agccuggccaauauggugaaaccu

SEQ ID NO: 705135 - RNA, 21 nt, Human
agccuggugacagagcaagac

SEQ ID NO: 705136 - RNA, 23 nt, Human
agccuggugacagagcaagacuc

SEQ ID NO: 705137 - RNA, 19 nt, Human
agcgcucagcuccggggga

SEQ ID NO: 705138 - RNA, 20 nt, Human
agcuccgaaaaucacagaca

SEQ ID NO: 705139 - RNA, 18 nt, Human
aggaaggugugaguggug

SEQ ID NO: 705140 - RNA, 21 nt, Human
aggacagcacuuucaggcucu

SEQ ID NO: 705141 - RNA, 20 nt, Human
aggcagagguugcagugagc

SEQ ID NO: 705142 - RNA, 24 nt, Human
aggcagagguugcagugagcugag

SEQ ID NO: 705143 - RNA, 24 nt, Human
aggccaacaagggacauaucagaa

SEQ ID NO: 705144 - RNA, 23 nt, Human
aggccaaggcgggcagaucacga

SEQ ID NO: 705145 - RNA, 18 nt, Human
aggcgggcagaucacgag

SEQ ID NO: 705146 - RNA, 24 nt, Human
aggcgggcagaucacgaggucaag

SEQ ID NO: 705147 - RNA, 21 nt, Human
aggggguuccugaauggaacc

SEQ ID NO: 705148 - RNA, 20 nt, Human
agguaucauagaaaacacaa

SEQ ID NO: 705149 - RNA, 24 nt, Human
aguggcucacggcuguaaucccag

SEQ ID NO: 705150 - RNA, 19 nt, Human
auggagaaaaaaggaagaa

SEQ ID NO: 705151 - RNA, 24 nt, Human
auugcgccgcugcacuccagccug

SEQ ID NO: 705152 - RNA, 23 nt, Human
caagaagaagaaaagacagacaa

SEQ ID NO: 705153 - RNA, 24 nt, Human
caagaccagccuggccaauauggu

SEQ ID NO: 705154 - RNA, 24 nt, Human
caaggcgggcagaucacgagguca

SEQ ID NO: 705155 - RNA, 24 nt, Human
caauauggugaaaccuugucucua

SEQ ID NO: 705156 - RNA, 19 nt, Human
caccaggaccccauggacu

SEQ ID NO: 705157 - RNA, 18 nt, Human
cacccuggcuucaaggcu

SEQ ID NO: 705158 - RNA, 22 nt, Human
cacccuggcuucaaggcucauc

SEQ ID NO: 705159 - RNA, 24 nt, Human
cacggcuguaaucccagcacuuug

SEQ ID NO: 705160 - RNA, 22 nt, Human
cacuccagccuggugacagagc

SEQ ID NO: 705161 - RNA, 19 nt, Human
cacugccccaacugcccug

SEQ ID NO: 705162 - RNA, 27 nt, Human
cagacaagacacagaaaaagaaaggaa

SEQ ID NO: 705163 - RNA, 19 nt, Human
cagaucacgaggucaagag

SEQ ID NO: 705164 - RNA, 24 nt, Human
cagcacuuugggaggccaaggcgg

SEQ ID NO: 705165 - RNA, 20 nt, Human
cagcagcaguggcagaugcc

SEQ ID NO: 705166 - RNA, 21 nt, Human
cagcagcaguggcagaugccu

SEQ ID NO: 705167 - RNA, 23 nt, Human
cagcaguggcagaugccuuggcc

SEQ ID NO: 705168 - RNA, 21 nt, Human
caggagaacccaggaggcaga

SEQ ID NO: 705169 - RNA, 20 nt, Human
caggcagaccuccccugagg

SEQ ID NO: 705170 - RNA, 20 nt, Human
caucacagcagcuaguuucc

SEQ ID NO: 705171 - RNA, 19 nt, Human
caugacuagccacucccug

SEQ ID NO: 705172 - RNA, 21 nt, Human
ccacaccccagggcccagcga

SEQ ID NO: 705173 - RNA, 22 nt, Human
ccaggaggcagagguugcagug

SEQ ID NO: 705174 - RNA, 22 nt, Human
ccaguguccccggggucugggu

SEQ ID NO: 705175 - RNA, 22 nt, Human
cccaagauccccuccaccagga

SEQ ID NO: 705176 - RNA, 19 nt, Human
ccccaugacaucauccccc

SEQ ID NO: 705177 - RNA, 19 nt, Human
ccccauggacuaaugcagg

SEQ ID NO: 705178 - RNA, 20 nt, Human
cccccagcuccgaaaaucac

SEQ ID NO: 705179 - RNA, 20 nt, Human
cccggcacccuggcuucaag

SEQ ID NO: 705180 - RNA, 21 nt, Human
cccuaaauggcccugagaccc

SEQ ID NO: 705181 - RNA, 19 nt, Human
ccgcugcacuccagccugg

SEQ ID NO: 705182 - RNA, 20 nt, Human
ccgcugcacuccagccuggu

SEQ ID NO: 705183 - RNA, 23 nt, Human
ccgcugcacuccagccuggugac

SEQ ID NO: 705184 - RNA, 18 nt, Human
ccucccggcacccuggcu

SEQ ID NO: 705185 - RNA, 21 nt, Human
ccuggccaauauggugaaacc

SEQ ID NO: 705186 - RNA, 24 nt, Human
ccuggccaauauggugaaaccuug

SEQ ID NO: 705187 - RNA, 21 nt, Human
ccuggugacagagcaagacuc

SEQ ID NO: 705188 - RNA, 19 nt, Human
ccuguaaucccagcuacuc

SEQ ID NO: 705189 - RNA, 21 nt, Human
ccuguaaucccagcuacucgg

SEQ ID NO: 705190 - RNA, 19 nt, Human
ccuuccaagugugggcaga

SEQ ID NO: 705191 - RNA, 18 nt, Human
cgccgcugcacuccagcc

SEQ ID NO: 705192 - RNA, 20 nt, Human
cgcugcacuccagccuggug

SEQ ID NO: 705193 - RNA, 22 nt, Human
cgcugcacuccagccuggugac

SEQ ID NO: 705194 - RNA, 18 nt, Human
cggcugguaguggcaguc

SEQ ID NO: 705195 - RNA, 23 nt, Human
cggcuguaaucccagcacuuugg

SEQ ID NO: 705196 - RNA, 24 nt, Human
cggcuguaaucccagcacuuuggg

SEQ ID NO: 705197 - RNA, 22 nt, Human
cgggcagaucacgaggucaaga

SEQ ID NO: 705198 - RNA, 24 nt, Human
cgggugccccuccuguggggccuc

SEQ ID NO: 705199 - RNA, 24 nt, Human
cucacggcuguaaucccagcacuu

SEQ ID NO: 705200 - RNA, 24 nt, Human
cucagcuccgggggauacaggaag

SEQ ID NO: 705201 - RNA, 19 nt, Human
cucugcucaggacugagag

SEQ ID NO: 705202 - RNA, 21 nt, Human
cugcacuccagccuggugaca

SEQ ID NO: 705203 - RNA, 21 nt, Human
cugcacuccagccuggugaca

SEQ ID NO: 705204 - RNA, 22 nt, Human
cugcacuccagccuggugacag

SEQ ID NO: 705205 - RNA, 24 nt, Human
cugcacuccagccuggugacagag

SEQ ID NO: 705206 - RNA, 20 nt, Human
cugccuuacgagaccccuac

SEQ ID NO: 705207 - RNA, 20 nt, Human
cugcucaggacugagagcaa

SEQ ID NO: 705208 - RNA, 21 nt, Human
cuggcaucuaccgggugcccc

SEQ ID NO: 705209 - RNA, 21 nt, Human
cuggcaucuaccgggugcccc

SEQ ID NO: 705210 - RNA, 24 nt, Human
cuggccaauauggugaaaccuugu

SEQ ID NO: 705211 - RNA, 23 nt, Human
cuggcuucaaggcucaucuucag

SEQ ID NO: 705212 - RNA, 19 nt, Human
cugggccuacggggagcca

SEQ ID NO: 705213 - RNA, 18 nt, Human
cugguaguggcagucagc

SEQ ID NO: 705214 - RNA, 18 nt, Human
cuuacaacgccuccucag

SEQ ID NO: 705215 - RNA, 19 nt, Human
cuuacgagaccccuaccca

SEQ ID NO: 705216 - RNA, 19 nt, Human
gaaaccuugucucuacuaa

SEQ ID NO: 705217 - RNA, 23 nt, Human
gaacaggaaugaacccaaccaga

SEQ ID NO: 705218 - RNA, 22 nt, Human
gaacuggaggacugcucccccu

SEQ ID NO: 705219 - RNA, 24 nt, Human
gacagagcaagacuccgucucgag

SEQ ID NO: 705220 - RNA, 18 nt, Human
gacagcacuuucaggcuc

SEQ ID NO: 705221 - RNA, 23 nt, Human
gagauugcgccgcugcacuccag

SEQ ID NO: 705222 - RNA, 18 nt, Human
gagccaggggccuuggaa

SEQ ID NO: 705223 - RNA, 24 nt, Human
gaucacgaggucaagaguucaaga

SEQ ID NO: 705224 - RNA, 23 nt, Human
gcacuccagccuggugacagagc

SEQ ID NO: 705225 - RNA, 24 nt, Human
gccaauauggugaaaccuugucuc

SEQ ID NO: 705226 - RNA, 18 nt, Human
gcccacugccccaacugc

SEQ ID NO: 705227 - RNA, 22 nt, Human
gcgugugccuguaaucccagcu

SEQ ID NO: 705228 - RNA, 23 nt, Human
gcugcacuccagccuggugacag

SEQ ID NO: 705229 - RNA, 19 nt, Human
gcugggugcaguggcucac

SEQ ID NO: 705230 - RNA, 24 nt, Human
gcuugggguccccaugacaucauc

SEQ ID NO: 705231 - RNA, 21 nt, Human
ggacaaagucuugguucccuu

SEQ ID NO: 705232 - RNA, 22 nt, Human
ggaggcagagguugcagugagc

SEQ ID NO: 705233 - RNA, 24 nt, Human
ggauuggggcugggugcaguggcu

SEQ ID NO: 705234 - RNA, 19 nt, Human
ggcacccuggcuucaaggc

SEQ ID NO: 705235 - RNA, 18 nt, Human
ggcccccaguccccagca

SEQ ID NO: 705236 - RNA, 18 nt, Human
ggccguggcugauggcug

SEQ ID NO: 705237 - RNA, 24 nt, Human
gggcagaucacgaggucaagaguu

SEQ ID NO: 705238 - RNA, 18 nt, Human
gggcaugguggcgugugc

SEQ ID NO: 705239 - RNA, 24 nt, Human
gggcaugguggcgugugccuguaa

SEQ ID NO: 705240 - RNA, 23 nt, Human
gggcucuuucaggcaucccaccc

SEQ ID NO: 705241 - RNA, 21 nt, Human
ggggcugggugcaguggcuca

SEQ ID NO: 705242 - RNA, 18 nt, Human
ggggguggucagggcaga

SEQ ID NO: 705243 - RNA, 23 nt, Human
gggugccccuccuguggggccuc

SEQ ID NO: 705244 - RNA, 18 nt, Human
ggugcaguggcucacggc

SEQ ID NO: 705245 - RNA, 19 nt, Human
ggugcaguggcucacggcu

SEQ ID NO: 705246 - RNA, 23 nt, Human
ggugcaguggcucacggcuguaa

SEQ ID NO: 705247 - RNA, 24 nt, Human
gguggcgugugccuguaaucccag

SEQ ID NO: 705248 - RNA, 19 nt, Human
guccccaugacaucauccc

SEQ ID NO: 705249 - RNA, 21 nt, Human
gugagagcacagcaagugggg

SEQ ID NO: 705250 - RNA, 22 nt, Human
gugaggcaggagaacccaggag

SEQ ID NO: 705251 - RNA, 22 nt, Human
guggaaggaaagccaaggaagg

SEQ ID NO: 705252 - RNA, 23 nt, Human
guggcgugugccuguaaucccag

SEQ ID NO: 705253 - RNA, 19 nt, Human
guugcagugagcugagauu

SEQ ID NO: 705254 - RNA, 21 nt, Human
guugcagugagcugagauugc

SEQ ID NO: 705255 - RNA, 21 nt, Human
uaagcuagcugagggccccca

SEQ ID NO: 705256 - RNA, 22 nt, Human
uagccgggcaugguggcgugug

SEQ ID NO: 705257 - RNA, 23 nt, Human
uauaaaaagaaaagcuuaacgcc

SEQ ID NO: 705258 - RNA, 23 nt, Human
ucacaccggagucuccuggcugc

SEQ ID NO: 705259 - RNA, 22 nt, Human
ucaccugaggauuucacuggca

SEQ ID NO: 705260 - RNA, 24 nt, Human
ucacgaggucaagaguucaagacc

SEQ ID NO: 705261 - RNA, 21 nt, Human
ucaggcucuggggcauggaga

SEQ ID NO: 705262 - RNA, 18 nt, Human
ucaugugcaguagaguga

SEQ ID NO: 705263 - RNA, 19 nt, Human
uccccagauuggaaucgug

SEQ ID NO: 705264 - RNA, 20 nt, Human
uccccggggucuggguguca

SEQ ID NO: 705265 - RNA, 22 nt, Human
ucccuucgcauugagugagagc

SEQ ID NO: 705266 - RNA, 23 nt, Human
uccugggccuacggggagccagg

SEQ ID NO: 705267 - RNA, 21 nt, Human
ucucuacuaagaauacaaaaa

SEQ ID NO: 705268 - RNA, 25 nt, Human
ugaacccaaccagaugagaucacag

SEQ ID NO: 705269 - RNA, 19 nt, Human
ugacaucauccccccucuu

SEQ ID NO: 705270 - RNA, 18 nt, Human
ugagaugucccuuccucc

SEQ ID NO: 705271 - RNA, 19 nt, Human
ugaguggugaguggcccgu

SEQ ID NO: 705272 - RNA, 19 nt, Human
ugcccaagauccccuccac

SEQ ID NO: 705273 - RNA, 21 nt, Human
ugcccaggccaacaagggaca

SEQ ID NO: 705274 - RNA, 20 nt, Human
ugccccaacugcccuggcga

SEQ ID NO: 705275 - RNA, 23 nt, Human
ugccccaacugcccuggcgaugc

SEQ ID NO: 705276 - RNA, 24 nt, Human
ugccuguaaucccagcuacucggg

SEQ ID NO: 705277 - RNA, 24 nt, Human
uggccaauauggugaaaccuuguc

SEQ ID NO: 705278 - RNA, 21 nt, Human
uggcgugugccuguaauccca

SEQ ID NO: 705279 - RNA, 22 nt, Human
uggcgugugccuguaaucccag

SEQ ID NO: 705280 - RNA, 24 nt, Human
uggcgugugccuguaaucccagcu

SEQ ID NO: 705281 - RNA, 22 nt, Human
uggcucacggcuguaaucccag

SEQ ID NO: 705282 - RNA, 24 nt, Human
uggcucacggcuguaaucccagca

SEQ ID NO: 705283 - RNA, 24 nt, Human
ugggaggccaaggcgggcagauca

SEQ ID NO: 705284 - RNA, 19 nt, Human
ugggcacagaggggguugg

SEQ ID NO: 705285 - RNA, 19 nt, Human
ugggcacagaggggguugg

SEQ ID NO: 705286 - RNA, 19 nt, Human
uggggcugggugcaguggc

SEQ ID NO: 705287 - RNA, 24 nt, Human
ugguggcgugugccuguaauccca

SEQ ID NO: 705288 - RNA, 22 nt, Human
ugugagagaagaagcagggugu

SEQ ID NO: 705289 - RNA, 24 nt, Human
ugugggcagagagcccacugcccc

SEQ ID NO: 705290 - RNA, 24 nt, Human
uuagccgggcaugguggcgugugc

SEQ ID NO: 705291 - RNA, 22 nt, Human
uugcagugagcugagauugcgc

SEQ ID NO: 705292 - RNA, 23 nt, Human
uugcgccgcugcacuccagccug

SEQ ID NO: 705293 - RNA, 23 nt, Human
uuuuuuuuuuuuuuuuuuugggu

SEQ ID NO: 705294 - RNA, 24 nt, Human
uuuuuuuuuuuuuuuuuuuuuggg

SEQ ID NO: 705295 - RNA, 21 nt, Human
aaaaugccuaagcagagcugg

SEQ ID NO: 705296 - RNA, 23 nt, Human
aagcagagcuggagggaggcaaa

SEQ ID NO: 705297 - RNA, 18 nt, Human
aaugggacuggugagggu

SEQ ID NO: 705298 - RNA, 20 nt, Human
aaugggacuggugagggucg

SEQ ID NO: 705299 - RNA, 22 nt, Human
acacuuggguucugaguucaag

SEQ ID NO: 705300 - RNA, 22 nt, Human
agggaggcaaaugggacuggug

SEQ ID NO: 705301 - RNA, 19 nt, Human
aggggcaaaaugccuaagc

SEQ ID NO: 705302 - RNA, 18 nt, Human
agguucaaggcuggggaa

SEQ ID NO: 705303 - RNA, 26 nt, Human
aguuuuggggcuggauguagguggcu

SEQ ID NO: 705304 - RNA, 20 nt, Human
auccacacaggggcauggaa

SEQ ID NO: 705305 - RNA, 18 nt, Human
caccucaccccuugguug

SEQ ID NO: 705306 - RNA, 20 nt, Human
ccauucccugcugaggccug

SEQ ID NO: 705307 - RNA, 22 nt, Human
ccccauucccugcugaggccug

SEQ ID NO: 705308 - RNA, 18 nt, Human
cgggaucaccuggaccag

SEQ ID NO: 705309 - RNA, 20 nt, Human
cuaagcagagcuggagggag

SEQ ID NO: 705310 - RNA, 19 nt, Human
cugcugaggccugucccca

SEQ ID NO: 705311 - RNA, 18 nt, Human
cuggaccagggguccaac

SEQ ID NO: 705312 - RNA, 21 nt, Human
cuguccccaccucaccccuug

SEQ ID NO: 705313 - RNA, 19 nt, Human
cuugaccuggguuggaagg

SEQ ID NO: 705314 - RNA, 23 nt, Human
gaucaccuggaccagggguccaa

SEQ ID NO: 705315 - RNA, 24 nt, Human
gaugggagugucucuggguucaca

SEQ ID NO: 705316 - RNA, 20 nt, Human
gauuuggcaaugucuugacc

SEQ ID NO: 705317 - RNA, 21 nt, Human
gcaaaugggacuggugagggu

SEQ ID NO: 705318 - RNA, 19 nt, Human
gggcuggcguggggguagg

SEQ ID NO: 705319 - RNA, 22 nt, Human
gggguggggugguauucuccag

SEQ ID NO: 705320 - RNA, 24 nt, Human
gggucgggaucaccuggaccaggg

SEQ ID NO: 705321 - RNA, 25 nt, Human
gguaaugggggcugggugugaggga

SEQ ID NO: 705322 - RNA, 20 nt, Human
gugagggucgggaucaccug

SEQ ID NO: 705323 - RNA, 18 nt, Human
gugguauucuccaggucc

SEQ ID NO: 705324 - RNA, 22 nt, Human
uaacauauacgccccauucccu

SEQ ID NO: 705325 - RNA, 23 nt, Human
uaggcuccuguuuuaagugcugg

SEQ ID NO: 705326 - RNA, 20 nt, Human
uccacacaggggcauggaac

SEQ ID NO: 705327 - RNA, 23 nt, Human
uccccaccucaccccuugguugu

SEQ ID NO: 705328 - RNA, 20 nt, Human
ucccuagguaaugggggcug

SEQ ID NO: 705329 - RNA, 24 nt, Human
ucccugcugaggccuguccccacc

SEQ ID NO: 705330 - RNA, 23 nt, Human
uccuggguacagaucccaggggc

SEQ ID NO: 705331 - RNA, 23 nt, Human
ugaagccccaguuuuggggcugg

SEQ ID NO: 705332 - RNA, 24 nt, Human
ugaguucaagauuuggcaaugucu

SEQ ID NO: 705333 - RNA, 18 nt, Human
ugccuaagcagagcugga

SEQ ID NO: 705334 - RNA, 25 nt, Human
ugccuaagcagagcuggagggaggc

SEQ ID NO: 705335 - RNA, 20 nt, Human
ugccuugcuccaggccccag

SEQ ID NO: 705336 - RNA, 18 nt, Human
uggagggaggcaaauggg

SEQ ID NO: 705337 - RNA, 22 nt, Human
uggauguagguggcucuugguc

SEQ ID NO: 705338 - RNA, 22 nt, Human
ugggaaagggcucuggguccca

SEQ ID NO: 705339 - RNA, 23 nt, Human
ugggaaagggcucugggucccaa

SEQ ID NO: 705340 - RNA, 24 nt, Human
ugggcuggggguggggugguauuc

SEQ ID NO: 705341 - RNA, 20 nt, Human
uggggcuggauguagguggc

SEQ ID NO: 705342 - RNA, 22 nt, Human
uggggcuggcguggggguaggg

SEQ ID NO: 705343 - RNA, 18 nt, Human
uggguucacaauuugaaa

SEQ ID NO: 705344 - RNA, 26 nt, Human
uguagguggcucuuggucccgaccac

SEQ ID NO: 705345 - RNA, 23 nt, Human
uuaugggcugggggugggguggu

SEQ ID NO: 705346 - RNA, 21 nt, Human
uugguccuagguucaaggcug

SEQ ID NO: 705347 - RNA, 20 nt, Human
uuugguccaggguucaagau

SEQ ID NO: 705348 - RNA, 19 nt, Human
aagugcuggggggaaguga

SEQ ID NO: 705349 - RNA, 22 nt, Human
aagugcuggggggaagugagcu

SEQ ID NO: 705350 - RNA, 20 nt, Human
aggucccuagcacagccccc

SEQ ID NO: 705351 - RNA, 25 nt, Human
cagcuuccugccgccuucaccggaa

SEQ ID NO: 705352 - RNA, 22 nt, Human
caggauuguuccuccugggauc

SEQ ID NO: 705353 - RNA, 19 nt, Human
caggucccuagcacagccc

SEQ ID NO: 705354 - RNA, 18 nt, Human
caucaagaagugcugggg

SEQ ID NO: 705355 - RNA, 19 nt, Human
ccaaggcucagcucugcag

SEQ ID NO: 705356 - RNA, 22 nt, Human
ccaaggcucagcucugcaguuc

SEQ ID NO: 705357 - RNA, 21 nt, Human
ccacugcaggucccuagcaca

SEQ ID NO: 705358 - RNA, 18 nt, Human
ccacugccaaggcucagc

SEQ ID NO: 705359 - RNA, 18 nt, Human
cccgguuuucugaccucc

SEQ ID NO: 705360 - RNA, 21 nt, Human
ccgccuucaccggccugaccu

SEQ ID NO: 705361 - RNA, 20 nt, Human
ccuccgcgugucccugaccc

SEQ ID NO: 705362 - RNA, 20 nt, Human
ccuccugggaucgugcucca

SEQ ID NO: 705363 - RNA, 18 nt, Human
ccugacccgggccccagc

SEQ ID NO: 705364 - RNA, 23 nt, Human
ccugaccuccgcgugucccugac

SEQ ID NO: 705365 - RNA, 26 nt, Human
cuuccugccgccuucaccggccugac

SEQ ID NO: 705366 - RNA, 19 nt, Human
gaaagugggcaccagcccc

SEQ ID NO: 705367 - RNA, 21 nt, Human
gccccacugccaaggcucagc

SEQ ID NO: 705368 - RNA, 20 nt, Human
gcucugcaguucugccacug

SEQ ID NO: 705369 - RNA, 21 nt, Human
gucccuggcaauuuccuccag

SEQ ID NO: 705370 - RNA, 25 nt, Human
uauucaucacaucggagaucaucuc

SEQ ID NO: 705371 - RNA, 18 nt, Human
ucccaaggggucgcugcc

SEQ ID NO: 705372 - RNA, 22 nt, Human
ucccuagcacagcccccagggu

SEQ ID NO: 705373 - RNA, 18 nt, Human
uccugccgccuucaccgg

SEQ ID NO: 705374 - RNA, 21 nt, Human
ucugcaguucugccacugcag

SEQ ID NO: 705375 - RNA, 24 nt, Human
ucugggucccuggcaauuuccucc

SEQ ID NO: 705376 - RNA, 21 nt, Human
ugcugaguggaaagugggcac

SEQ ID NO: 705377 - RNA, 19 nt, Human
uggcuuccaagcacgcccc

SEQ ID NO: 705378 - RNA, 19 nt, Human
ugggucccuggcaauuucc

SEQ ID NO: 705379 - RNA, 22 nt, Human
uuaaaaaauccccagguuggau

SEQ ID NO: 705380 - RNA, 21 nt, Human
uuccugccgccuucaccggcc

SEQ ID NO: 705381 - RNA, 19 nt, Human
uuuauucguauucaucaca

SEQ ID NO: 705382 - RNA, 21 nt, Human
aaaaucagaagcagcacauca

SEQ ID NO: 705383 - RNA, 22 nt, Human
aaaaugcacauucauuuccuuc

SEQ ID NO: 705384 - RNA, 24 nt, Human
aaacacacgugaaacuucagacac

SEQ ID NO: 705385 - RNA, 25 nt, Human
aacacauuacuagcauuucaaaaau

SEQ ID NO: 705386 - RNA, 25 nt, Human
aaugauuuuuuuuuuuccuauaaga

SEQ ID NO: 705387 - RNA, 21 nt, Human
accaguuuccacugcacauca

SEQ ID NO: 705388 - RNA, 21 nt, Human
agaacauaggucuggacaagg

SEQ ID NO: 705389 - RNA, 22 nt, Human
agaacauaggucuggacaaggg

SEQ ID NO: 705390 - RNA, 24 nt, Human
agaaucuggcggcggcggcggcgg

SEQ ID NO: 705391 - RNA, 20 nt, Human
agaucauggcuguagguugg

SEQ ID NO: 705392 - RNA, 18 nt, Human
aucaaacagguggcaaag

SEQ ID NO: 705393 - RNA, 20 nt, Human
auuuuuuuuuuuccuauaag

SEQ ID NO: 705394 - RNA, 19 nt, Human
caaaaacgcaagcagaaca

SEQ ID NO: 705395 - RNA, 21 nt, Human
caaaaacgcaagcagaacaua

SEQ ID NO: 705396 - RNA, 23 nt, Human
caagaaaaaucagaagcagcaca

SEQ ID NO: 705397 - RNA, 18 nt, Human
caagggcaagcugcaacu

SEQ ID NO: 705398 - RNA, 24 nt, Human
caaguuuuguuuuauuuuuugucu

SEQ ID NO: 705399 - RNA, 21 nt, Human
cacaauuuaaugcuacagaaa

SEQ ID NO: 705400 - RNA, 21 nt, Human
cacacgugaaacuucagacac

SEQ ID NO: 705401 - RNA, 21 nt, Human
cagaacauaggucuggacaag

SEQ ID NO: 705402 - RNA, 20 nt, Human
caggcuaacacaugauguca

SEQ ID NO: 705403 - RNA, 23 nt, Human
caucuacuuuaacagccuuuuca

SEQ ID NO: 705404 - RNA, 19 nt, Human
caucuuugauuuuuaagag

SEQ ID NO: 705405 - RNA, 21 nt, Human
ccacugcacaucaaacaggug

SEQ ID NO: 705406 - RNA, 23 nt, Human
ccacugcacaucaaacagguggc

SEQ ID NO: 705407 - RNA, 27 nt, Human
ccaguuaaaaacgaaacaaugcaaaaa

SEQ ID NO: 705408 - RNA, 22 nt, Human
ccuauacaugcaugcugccaua

SEQ ID NO: 705409 - RNA, 25 nt, Human
ccuccagaaucuggcggcggcggcg

SEQ ID NO: 705410 - RNA, 27 nt, Human
ccuccuguuucaaaaacgcaagcagaa

SEQ ID NO: 705411 - RNA, 20 nt, Human
gcggcggcaaccgaucagcu

SEQ ID NO: 705412 - RNA, 21 nt, Human
ggacauacagagaguuucuuc

SEQ ID NO: 705413 - RNA, 21 nt, Human
ggaggguggugguuuucuuuc

SEQ ID NO: 705414 - RNA, 22 nt, Human
ggcggcggcggcggcggcaacc

SEQ ID NO: 705415 - RNA, 23 nt, Human
uaaaaugcacauucauuuccuuu

SEQ ID NO: 705416 - RNA, 18 nt, Human
uaaagaucauggcuguag

SEQ ID NO: 705417 - RNA, 21 nt, Human
uaaccaguuuccacugcacau

SEQ ID NO: 705418 - RNA, 23 nt, Human
uacaaaaauguaacaaaauaucc

SEQ ID NO: 705419 - RNA, 21 nt, Human
uaugaacaacuggcuuaacca

SEQ ID NO: 705420 - RNA, 18 nt, Human
ucauauguggguaagggu

SEQ ID NO: 705421 - RNA, 23 nt, Human
ucaucuaaagacguuuuucaaau

SEQ ID NO: 705422 - RNA, 23 nt, Human
ucugaggucuucucucugaaaca

SEQ ID NO: 705423 - RNA, 22 nt, Human
ugaggucuucucucugaaacau

SEQ ID NO: 705424 - RNA, 21 nt, Human
ugcaacaaauacuugcuggug

SEQ ID NO: 705425 - RNA, 24 nt, Human
ugcaacaaauacuugcuggugaaa

SEQ ID NO: 705426 - RNA, 18 nt, Human
ugcuaaagaucauggcug

SEQ ID NO: 705427 - RNA, 18 nt, Human
uggcggcggcggcggcgg

SEQ ID NO: 705428 - RNA, 20 nt, Human
uggcggcggcggcggcggca

SEQ ID NO: 705429 - RNA, 20 nt, Human
ugucugugaagucaugguga

SEQ ID NO: 705430 - RNA, 22 nt, Human
uguggguaaggguacagauucu

SEQ ID NO: 705431 - RNA, 24 nt, Human
uguuucaaaaacgcaagcagaaca

SEQ ID NO: 705432 - RNA, 23 nt, Human
uuaaaaugcaagaaaaaucagaa

SEQ ID NO: 705433 - RNA, 23 nt, Human
uucaauuggcaggcaaaacauuu

SEQ ID NO: 705434 - RNA, 19 nt, Human
uucacaauuuaaugcuaca

SEQ ID NO: 705435 - RNA, 21 nt, Human
uuuauuuuuuuuaauucccuu

SEQ ID NO: 705436 - RNA, 22 nt, Human
uuuuuauuagcugcaguagcug

SEQ ID NO: 705437 - RNA, 23 nt, Human
aaccaagaagcccugaagaccgg

SEQ ID NO: 705438 - RNA, 21 nt, Human
aagaagcccugaagaccggug

SEQ ID NO: 705439 - RNA, 23 nt, Human
aagcccugaagaccggugcacuu

SEQ ID NO: 705440 - RNA, 18 nt, Human
acccagaaccaguucccc

SEQ ID NO: 705441 - RNA, 22 nt, Human
acccagaaccaguucccccacc

SEQ ID NO: 705442 - RNA, 22 nt, Human
acuuugagauaugauggaaaaa

SEQ ID NO: 705443 - RNA, 21 nt, Human
agaaccaguucccccaccaaa

SEQ ID NO: 705444 - RNA, 24 nt, Human
augauggaaaaauauuacagguac

SEQ ID NO: 705445 - RNA, 21 nt, Human
caagugaaaacaaucuaacca

SEQ ID NO: 705446 - RNA, 21 nt, Human
caccaaagcuguggaaaacca

SEQ ID NO: 705447 - RNA, 18 nt, Human
cagaaccaguucccccac

SEQ ID NO: 705448 - RNA, 20 nt, Human
cagaaccaguucccccacca

SEQ ID NO: 705449 - RNA, 19 nt, Human
caucuccucccccaauggu

SEQ ID NO: 705450 - RNA, 23 nt, Human
ccaaagcuguggaaaaccaagaa

SEQ ID NO: 705451 - RNA, 19 nt, Human
ccaaugguguagugcccuc

SEQ ID NO: 705452 - RNA, 21 nt, Human
cccagaaccaguucccccacc

SEQ ID NO: 705453 - RNA, 23 nt, Human
ccccaccaaagcuguggaaaacc

SEQ ID NO: 705454 - RNA, 18 nt, Human
cuguggaaaaccaagaag

SEQ ID NO: 705455 - RNA, 19 nt, Human
gaagaagguguugaaggag

SEQ ID NO: 705456 - RNA, 21 nt, Human
gugaacccagaaccaguuccc

SEQ ID NO: 705457 - RNA, 23 nt, Human
guuccaggcaguagagcucccag

SEQ ID NO: 705458 - RNA, 21 nt, Human
uaaccagaaagcuuuaacguc

SEQ ID NO: 705459 - RNA, 19 nt, Human
uauuacagguacacaugga

SEQ ID NO: 705460 - RNA, 22 nt, Human
ucccccaauggucuugucacuu

SEQ ID NO: 705461 - RNA, 18 nt, Human
uccccgacaagcuaagag

SEQ ID NO: 705462 - RNA, 19 nt, Human
ucuuccuugccugugauga

SEQ ID NO: 705463 - RNA, 19 nt, Human
ugaacccagaaccaguucc

SEQ ID NO: 705464 - RNA, 19 nt, Human
ugaagaccggugcacuggu

SEQ ID NO: 705465 - RNA, 18 nt, Human
ugccugugaugagcugcu

SEQ ID NO: 705466 - RNA, 19 nt, Human
ugccugugaugagcugcuc

SEQ ID NO: 705467 - RNA, 21 nt, Human
uggaaaaauauuacagguaca

SEQ ID NO: 705468 - RNA, 24 nt, Human
uggaaaagacaugaucaccaagug

SEQ ID NO: 705469 - RNA, 21 nt, Human
uggagaugcaucaccauagug

SEQ ID NO: 705470 - RNA, 20 nt, Human
ugugaugagcugcucagggu

SEQ ID NO: 705471 - RNA, 22 nt, Human
uguggaaaaccaagaagcccug

SEQ ID NO: 705472 - RNA, 20 nt, Human
uugccugugaugagcugcuc

SEQ ID NO: 705473 - RNA, 21 nt, Human
aaggagagaggaaggaggagg

SEQ ID NO: 705474 - RNA, 19 nt, Human
accuuacaaggagagagga

SEQ ID NO: 705475 - RNA, 18 nt, Human
acuccccagccucugcau

SEQ ID NO: 705476 - RNA, 20 nt, Human
agacuccccagccucugcau

SEQ ID NO: 705477 - RNA, 18 nt, Human
agagaggaaggaggagga

SEQ ID NO: 705478 - RNA, 24 nt, Human
agagaggaaggaggaggacccugg

SEQ ID NO: 705479 - RNA, 23 nt, Human
agccuuaggagagagcaggcuuu

SEQ ID NO: 705480 - RNA, 20 nt, Human
aggcaggguagagggagcca

SEQ ID NO: 705481 - RNA, 22 nt, Human
aggcucccagcagcacaggugc

SEQ ID NO: 705482 - RNA, 22 nt, Human
aggcuggcuuaggccugggaau

SEQ ID NO: 705483 - RNA, 19 nt, Human
agggagggagguggagcug

SEQ ID NO: 705484 - RNA, 22 nt, Human
agggagguggagcuggaggagg

SEQ ID NO: 705485 - RNA, 22 nt, Human
caaggcaggguagagggagcca

SEQ ID NO: 705486 - RNA, 21 nt, Human
cagcaggccacuuauaaacac

SEQ ID NO: 705487 - RNA, 23 nt, Human
caggccucaaggcaggguagagg

SEQ ID NO: 705488 - RNA, 21 nt, Human
caggguagagggagccauggg

SEQ ID NO: 705489 - RNA, 23 nt, Human
caggugggugacaaccuggcauu

SEQ ID NO: 705490 - RNA, 19 nt, Human
caggugugacugcaaacag

SEQ ID NO: 705491 - RNA, 22 nt, Human
ccacuuauaaacacuaugagac

SEQ ID NO: 705492 - RNA, 18 nt, Human
ccagcugcccgggccucg

SEQ ID NO: 705493 - RNA, 18 nt, Human
ccagggagggaacagagg

SEQ ID NO: 705494 - RNA, 23 nt, Human
ccucgcaagauaggcugaaugag

SEQ ID NO: 705495 - RNA, 23 nt, Human
ccuuaggagagagcaggcuuugg

SEQ ID NO: 705496 - RNA, 22 nt, Human
cugcaaacaggccucaaggcag

SEQ ID NO: 705497 - RNA, 23 nt, Human
gagaggaaggaggaggacccugg

SEQ ID NO: 705498 - RNA, 19 nt, Human
gagggagguggagcuggag

SEQ ID NO: 705499 - RNA, 20 nt, Human
gcaggccacuuauaaacacu

SEQ ID NO: 705500 - RNA, 20 nt, Human
ggagagaggaaggaggagga

SEQ ID NO: 705501 - RNA, 20 nt, Human
ggagcacucacucccagcag

SEQ ID NO: 705502 - RNA, 23 nt, Human
ggagcuggaggaggacuuuccag

SEQ ID NO: 705503 - RNA, 23 nt, Human
ggagggagggagggagguggagc

SEQ ID NO: 705504 - RNA, 22 nt, Human
ggagggagguggagcuggagga

SEQ ID NO: 705505 - RNA, 20 nt, Human
gggagggagggagguggagc

SEQ ID NO: 705506 - RNA, 26 nt, Human
gugcugcuggcagucugggcacuguc

SEQ ID NO: 705507 - RNA, 24 nt, Human
guggagcuggaggaggacuuucca

SEQ ID NO: 705508 - RNA, 20 nt, Human
uacuccaggcucccagcagc

SEQ ID NO: 705509 - RNA, 22 nt, Human
uccagcugcccgggccucgcaa

SEQ ID NO: 705510 - RNA, 21 nt, Human
uccagggagggaacagaggga

SEQ ID NO: 705511 - RNA, 20 nt, Human
ucuggagggagggagggagg

SEQ ID NO: 705512 - RNA, 21 nt, Human
ugcaaacaggccucaaggcag

SEQ ID NO: 705513 - RNA, 23 nt, Human
ugcugcuggcagucugggcacug

SEQ ID NO: 705514 - RNA, 27 nt, Human
uggaggaggacuuuccagcugcccggg

SEQ ID NO: 705515 - RNA, 23 nt, Human
uggagggagggagggagguggag

SEQ ID NO: 705516 - RNA, 18 nt, Human
ugucaggagggagaggcu

SEQ ID NO: 705517 - RNA, 19 nt, Human
ugucaggagggagaggcug

SEQ ID NO: 705518 - RNA, 21 nt, Human
aaacuggauuucuuucugagu

SEQ ID NO: 705519 - RNA, 20 nt, Human
aaagagagagucaaugugcu

SEQ ID NO: 705520 - RNA, 24 nt, Human
aaaguacugggauuacagguguga

SEQ ID NO: 705521 - RNA, 20 nt, Human
aaccuccaccuccuggguuc

SEQ ID NO: 705522 - RNA, 18 nt, Human
aagaacaaaagugaggac

SEQ ID NO: 705523 - RNA, 23 nt, Human
aagcaggaaacugaaggagggac

SEQ ID NO: 705524 - RNA, 18 nt, Human
aaguacugggauuacagg

SEQ ID NO: 705525 - RNA, 26 nt, Human
aaguacugggauuacaggugugagcc

SEQ ID NO: 705526 - RNA, 19 nt, Human
aaguagcugggauuuuagg

SEQ ID NO: 705527 - RNA, 20 nt, Human
aaguugagcaucccaaaucc

SEQ ID NO: 705528 - RNA, 24 nt, Human
accaaguuggccaggcuggucuug

SEQ ID NO: 705529 - RNA, 18 nt, Human
acgggguuucaccaaguu

SEQ ID NO: 705530 - RNA, 20 nt, Human
acgggguuucaccaaguugg

SEQ ID NO: 705531 - RNA, 24 nt, Human
acgggguuucaccaaguuggccag

SEQ ID NO: 705532 - RNA, 18 nt, Human
acuaaggcuccaaaaggu

SEQ ID NO: 705533 - RNA, 26 nt, Human
acucugucacccagacuggaauacau

SEQ ID NO: 705534 - RNA, 24 nt, Human
agaggagcugaaagaagaucaggg

SEQ ID NO: 705535 - RNA, 25 nt, Human
agagguggugaugguuggauacagg

SEQ ID NO: 705536 - RNA, 19 nt, Human
agagucaaugugcuggugu

SEQ ID NO: 705537 - RNA, 19 nt, Human
agaugugucuaauaaacau

SEQ ID NO: 705538 - RNA, 22 nt, Human
agcaucccaaauccaaaaaucc

SEQ ID NO: 705539 - RNA, 24 nt, Human
agcgauucuccugccucagucucu

SEQ ID NO: 705540 - RNA, 19 nt, Human
aggaacaacaggaaccaag

SEQ ID NO: 705541 - RNA, 19 nt, Human
aggggugcaccaccacgcc

SEQ ID NO: 705542 - RNA, 18 nt, Human
agguggugaugguuggau

SEQ ID NO: 705543 - RNA, 22 nt, Human
aguuggccaggcuggucuugaa

SEQ ID NO: 705544 - RNA, 24 nt, Human
auagaggagcugaaagaagaucag

SEQ ID NO: 705545 - RNA, 19 nt, Human
caaaaauccaauauccaaa

SEQ ID NO: 705546 - RNA, 21 nt, Human
caaaaucugagauuuugagca

SEQ ID NO: 705547 - RNA, 28 nt, Human
caaaaugcuccaaaaucugagauuuuga

SEQ ID NO: 705548 - RNA, 24 nt, Human
caaaguacugggauuacaggugug

SEQ ID NO: 705549 - RNA, 19 nt, Human
caaauucuguugccaggaa

SEQ ID NO: 705550 - RNA, 20 nt, Human
caagcgauucuccugccuca

SEQ ID NO: 705551 - RNA, 21 nt, Human
caagcgauucuccugccucag

SEQ ID NO: 705552 - RNA, 26 nt, Human
caagugaucuccccccuuggccuccc

SEQ ID NO: 705553 - RNA, 24 nt, Human
caauggagcugauguaauaccauc

SEQ ID NO: 705554 - RNA, 18 nt, Human
cacauguaaccaacacac

SEQ ID NO: 705555 - RNA, 21 nt, Human
caccaaguuggccaggcuggu

SEQ ID NO: 705556 - RNA, 24 nt, Human
caccaaguuggccaggcuggucuu

SEQ ID NO: 705557 - RNA, 22 nt, Human
caccaccacgccuggcuaauuu

SEQ ID NO: 705558 - RNA, 23 nt, Human
cacucugucacccagacuggaau

SEQ ID NO: 705559 - RNA, 26 nt, Human
cacugcauuauuucucaauaagucaa

SEQ ID NO: 705560 - RNA, 22 nt, Human
cauccucuuccuuuuucagucu

SEQ ID NO: 705561 - RNA, 25 nt, Human
cauccucuuccuuuuucccucugaa

SEQ ID NO: 705562 - RNA, 23 nt, Human
cauuuuagaaagaguggucuggg

SEQ ID NO: 705563 - RNA, 20 nt, Human
ccaaaguacugggauuacag

SEQ ID NO: 705564 - RNA, 21 nt, Human
ccaaaguacugggauuacagg

SEQ ID NO: 705565 - RNA, 24 nt, Human
ccaaaguacugggauuacaggugu

SEQ ID NO: 705566 - RNA, 24 nt, Human
ccaccuccuggguucaagcgauuc

SEQ ID NO: 705567 - RNA, 20 nt, Human
ccauccucuuccuuuuucag

SEQ ID NO: 705568 - RNA, 20 nt, Human
ccuaaagaauaggaggaccc

SEQ ID NO: 705569 - RNA, 19 nt, Human
ccuccaccuccuggguuca

SEQ ID NO: 705570 - RNA, 24 nt, Human
ccuccuggguucaagcgauucucc

SEQ ID NO: 705571 - RNA, 18 nt, Human
ccucuuccuuuuucaguc

SEQ ID NO: 705572 - RNA, 23 nt, Human
ccuggguucaagcgauucuccug

SEQ ID NO: 705573 - RNA, 19 nt, Human
ccuuagguguuugacucag

SEQ ID NO: 705574 - RNA, 24 nt, Human
cgcuaaauauaaugcaaauauucc

SEQ ID NO: 705575 - RNA, 18 nt, Human
cuaaucccaagcauuuca

SEQ ID NO: 705576 - RNA, 18 nt, Human
cucaaguagcugggauuu

SEQ ID NO: 705577 - RNA, 23 nt, Human
cucaagugaucuccccccuuggc

SEQ ID NO: 705578 - RNA, 22 nt, Human
cucacuggaaccuccaccuccu

SEQ ID NO: 705579 - RNA, 24 nt, Human
cucacuggaaccuccaccuccugg

SEQ ID NO: 705580 - RNA, 24 nt, Human
cucagucucucaaguagcugggau

SEQ ID NO: 705581 - RNA, 24 nt, Human
cuccagagacuacacauguaaccu

SEQ ID NO: 705582 - RNA, 21 nt, Human
cuccuggguucaagcgauucu

SEQ ID NO: 705583 - RNA, 23 nt, Human
cugccucagucucucaaguagcu

SEQ ID NO: 705584 - RNA, 24 nt, Human
gaacaacaggaaccaagcuuccug

SEQ ID NO: 705585 - RNA, 26 nt, Human
gaagacgugucauucccgaauuccuc

SEQ ID NO: 705586 - RNA, 20 nt, Human
gagucaaugugcuggugugu

SEQ ID NO: 705587 - RNA, 22 nt, Human
gaguggucugggaagguuucuc

SEQ ID NO: 705588 - RNA, 18 nt, Human
gauuacaggugugagcca

SEQ ID NO: 705589 - RNA, 21 nt, Human
gauuacaggugugagccacca

SEQ ID NO: 705590 - RNA, 24 nt, Human
gauuacaggugugagccaccaugc

SEQ ID NO: 705591 - RNA, 21 nt, Human
gcagaggaagggccugcagga

SEQ ID NO: 705592 - RNA, 22 nt, Human
gccucagucucucaaguagcug

SEQ ID NO: 705593 - RNA, 24 nt, Human
gccucagucucucaaguagcuggg

SEQ ID NO: 705594 - RNA, 24 nt, Human
gccuggcuaauuuuuuuguauuuu

SEQ ID NO: 705595 - RNA, 23 nt, Human
gcuggucuugaacuccugaccuc

SEQ ID NO: 705596 - RNA, 18 nt, Human
ggaaacugaaggauccaa

SEQ ID NO: 705597 - RNA, 24 nt, Human
ggauuacaggugugagccaccaug

SEQ ID NO: 705598 - RNA, 18 nt, Human
ggccuggugacaaagaca

SEQ ID NO: 705599 - RNA, 24 nt, Human
ggcuggucuugaacuccugaccuc

SEQ ID NO: 705600 - RNA, 23 nt, Human
gggguuucaccaaguuggccagg

SEQ ID NO: 705601 - RNA, 22 nt, Human
ggguuucaccaaguuggccagg

SEQ ID NO: 705602 - RNA, 19 nt, Human
ggucuugaacuccugaccu

SEQ ID NO: 705603 - RNA, 19 nt, Human
gguggugaugguuggauac

SEQ ID NO: 705604 - RNA, 18 nt, Human
uaagguaggauucagguu

SEQ ID NO: 705605 - RNA, 24 nt, Human
uacaggugugagccaccaugccca

SEQ ID NO: 705606 - RNA, 24 nt, Human
uacugggauuacaggugugagcca

SEQ ID NO: 705607 - RNA, 20 nt, Human
uagcugaggcuggagguggg

SEQ ID NO: 705608 - RNA, 24 nt, Human
uaguaaagacgggguuucaccaag

SEQ ID NO: 705609 - RNA, 26 nt, Human
uaguaaagacgggguuucaccaaguu

SEQ ID NO: 705610 - RNA, 18 nt, Human
uaucaaagagagagucaa

SEQ ID NO: 705611 - RNA, 22 nt, Human
uaucaggaugggcccauccaac

SEQ ID NO: 705612 - RNA, 23 nt, Human
uaucaggaugggcccauccaacu

SEQ ID NO: 705613 - RNA, 25 nt, Human
uauccaaaaugcuccaaaaucugag

SEQ ID NO: 705614 - RNA, 24 nt, Human
uauuuauuuuuugagacagagucu

SEQ ID NO: 705615 - RNA, 20 nt, Human
uauuuuauuuauuuauuuuu

SEQ ID NO: 705616 - RNA, 21 nt, Human
ucaaauucuguugccaggaac

SEQ ID NO: 705617 - RNA, 19 nt, Human
ucaagcgauucuccugccu

SEQ ID NO: 705618 - RNA, 21 nt, Human
ucaauaagucaauccugcugc

SEQ ID NO: 705619 - RNA, 24 nt, Human
ucacuggaaccuccaccuccuggg

SEQ ID NO: 705620 - RNA, 25 nt, Human
ucacuggaaccuccaccuccugggu

SEQ ID NO: 705621 - RNA, 26 nt, Human
ucacuggaaccuccaccuccuggguu

SEQ ID NO: 705622 - RNA, 22 nt, Human
ucagguaggcagguuuaagucc

SEQ ID NO: 705623 - RNA, 27 nt, Human
uccaaaaucugaaaaaaaauugaaauc

SEQ ID NO: 705624 - RNA, 23 nt, Human
ucccaaaguacugggauuacagg

SEQ ID NO: 705625 - RNA, 24 nt, Human
uccuagauauucaaauucuguugc

SEQ ID NO: 705626 - RNA, 21 nt, Human
uccuggguucaagcgauucuc

SEQ ID NO: 705627 - RNA, 24 nt, Human
uccuggguucaagcgauucuccug

SEQ ID NO: 705628 - RNA, 18 nt, Human
ucucaaguagcugggauu

SEQ ID NO: 705629 - RNA, 24 nt, Human
ucucacucugucacccagacugga

SEQ ID NO: 705630 - RNA, 18 nt, Human
ucugggaagguuucucuu

SEQ ID NO: 705631 - RNA, 21 nt, Human
ucuugaacuccugaccucaag

SEQ ID NO: 705632 - RNA, 21 nt, Human
ugaaaaaaaauugaaaucuga

SEQ ID NO: 705633 - RNA, 22 nt, Human
ugaauuuuggauuuuuggauuu

SEQ ID NO: 705634 - RNA, 18 nt, Human
ugaccucaagugaucucc

SEQ ID NO: 705635 - RNA, 19 nt, Human
ugaccucaagugaucuccc

SEQ ID NO: 705636 - RNA, 19 nt, Human
ugacuuagauucuuggcuc

SEQ ID NO: 705637 - RNA, 18 nt, Human
ugagacagagucucacuc

SEQ ID NO: 705638 - RNA, 22 nt, Human
ugagacagagucucacucuguc

SEQ ID NO: 705639 - RNA, 18 nt, Human
ugaggcuggaggugggcc

SEQ ID NO: 705640 - RNA, 21 nt, Human
ugagguagaguccaaagggcc

SEQ ID NO: 705641 - RNA, 20 nt, Human
ugaucuccccccuuggccuc

SEQ ID NO: 705642 - RNA, 22 nt, Human
ugcuagcugaggcuggaggugg

SEQ ID NO: 705643 - RNA, 24 nt, Human
uggaauacauuggcaugauuuugg

SEQ ID NO: 705644 - RNA, 23 nt, Human
uggaggugggccagaccauccag

SEQ ID NO: 705645 - RNA, 21 nt, Human
uggcaugauuuuggcucacug

SEQ ID NO: 705646 - RNA, 22 nt, Human
uggcaugauuuuggcucacugg

SEQ ID NO: 705647 - RNA, 24 nt, Human
uggccaggcuggucuugaacuccu

SEQ ID NO: 705648 - RNA, 18 nt, Human
ugggauuacaggugugag

SEQ ID NO: 705649 - RNA, 22 nt, Human
ugggauuacaggugugagccac

SEQ ID NO: 705650 - RNA, 23 nt, Human
ugggauuacaggugugagccacc

SEQ ID NO: 705651 - RNA, 24 nt, Human
ugggauuacaggugugagccacca

SEQ ID NO: 705652 - RNA, 25 nt, Human
ugggauuacaggugugagccaccau

SEQ ID NO: 705653 - RNA, 21 nt, Human
ugggauuuuaggggugcacca

SEQ ID NO: 705654 - RNA, 23 nt, Human
uggguucaagcgauucuccugcc

SEQ ID NO: 705655 - RNA, 24 nt, Human
uggguucaagcgauucuccugccu

SEQ ID NO: 705656 - RNA, 23 nt, Human
uggguuggagagggacaagaaca

SEQ ID NO: 705657 - RNA, 24 nt, Human
uguggagaguggguuggagaggga

SEQ ID NO: 705658 - RNA, 21 nt, Human
uguugccaggaacaacaggag

SEQ ID NO: 705659 - RNA, 18 nt, Human
uuaguaaagacgggguuu

SEQ ID NO: 705660 - RNA, 23 nt, Human
uuaguaaagacgggguuucacca

SEQ ID NO: 705661 - RNA, 21 nt, Human
uucaagcgauucuccugccuc

SEQ ID NO: 705662 - RNA, 23 nt, Human
uucaagcgauucuccugccucag

SEQ ID NO: 705663 - RNA, 24 nt, Human
uucaagcgauucuccugccucagu

SEQ ID NO: 705664 - RNA, 25 nt, Human
uugcuuaguuaucaaagagagaguc

SEQ ID NO: 705665 - RNA, 20 nt, Human
uuggauuuuuggauuuggau

SEQ ID NO: 705666 - RNA, 24 nt, Human
uuggauuuuuggauuuggauacuc

SEQ ID NO: 705667 - RNA, 23 nt, Human
uuguauuuuuaguaaagacgggg

SEQ ID NO: 705668 - RNA, 21 nt, Human
uuuaaaauuaaaccuaaagaa

SEQ ID NO: 705669 - RNA, 21 nt, Human
uuucaccaaguuggccaggcu

SEQ ID NO: 705670 - RNA, 24 nt, Human
uuuuuaguaaagacgggguuucac

SEQ ID NO: 705671 - RNA, 24 nt, Human
uuuuuuguauuuuuaguaaagacg

SEQ ID NO: 705672 - RNA, 21 nt, Human
uuuuuuuuuuuuauaagaucu

SEQ ID NO: 705673 - RNA, 24 nt, Human
aaagugcugggauuauagguguga

SEQ ID NO: 705674 - RNA, 20 nt, Human
aaccaaagagccucgucaag

SEQ ID NO: 705675 - RNA, 21 nt, Human
aagcaucaagcuucuucuuca

SEQ ID NO: 705676 - RNA, 18 nt, Human
aagugauccucccuccuc

SEQ ID NO: 705677 - RNA, 18 nt, Human
aagugcugggauuauagg

SEQ ID NO: 705678 - RNA, 21 nt, Human
acaaagcaacuacaaaguucu

SEQ ID NO: 705679 - RNA, 23 nt, Human
acuuuaaaaggugucuaguugaa

SEQ ID NO: 705680 - RNA, 22 nt, Human
agagacagggucuuguucugcc

SEQ ID NO: 705681 - RNA, 20 nt, Human
aggacuagaaaaaccaaaga

SEQ ID NO: 705682 - RNA, 18 nt, Human
aggcacuuuaaaaggugu

SEQ ID NO: 705683 - RNA, 23 nt, Human
agugcaguggugugaucguagcu

SEQ ID NO: 705684 - RNA, 23 nt, Human
agugcaguggugugaucguagcu

SEQ ID NO: 705685 - RNA, 18 nt, Human
caaagcaacuacaaaguu

SEQ ID NO: 705686 - RNA, 24 nt, Human
caaagugcugggauuauaggugug

SEQ ID NO: 705687 - RNA, 23 nt, Human
caagaaauuuauuggaaaaaucc

SEQ ID NO: 705688 - RNA, 27 nt, Human
caagugauccucccuccucugccuccc

SEQ ID NO: 705689 - RNA, 19 nt, Human
caccgcgagaugugucccc

SEQ ID NO: 705690 - RNA, 19 nt, Human
cagccugaauuccuggguu

SEQ ID NO: 705691 - RNA, 20 nt, Human
caugcaggccagagugcagu

SEQ ID NO: 705692 - RNA, 21 nt, Human
ccaaagugcugggauuauagg

SEQ ID NO: 705693 - RNA, 24 nt, Human
ccaaagugcugggauuauaggugu

SEQ ID NO: 705694 - RNA, 23 nt, Human
ccaagauaaaaguaacuuuuuac

SEQ ID NO: 705695 - RNA, 23 nt, Human
ccaccgcgagauguguccccccg

SEQ ID NO: 705696 - RNA, 27 nt, Human
ccagagugcaugcaggccagagugcag

SEQ ID NO: 705697 - RNA, 23 nt, Human
ccccgcgccguggccuggaauuc

SEQ ID NO: 705698 - RNA, 25 nt, Human
ccccucccgccccgcgccguggccu

SEQ ID NO: 705699 - RNA, 24 nt, Human
cccgccccgcgccguggccuggaa

SEQ ID NO: 705700 - RNA, 23 nt, Human
cccgcgccguggccuggaauucc

SEQ ID NO: 705701 - RNA, 20 nt, Human
ccgcacgcgcuccugcggcc

SEQ ID NO: 705702 - RNA, 22 nt, Human
ccgcacgcgcuccugcggccgg

SEQ ID NO: 705703 - RNA, 21 nt, Human
ccgcgccguggccuggaauuc

SEQ ID NO: 705704 - RNA, 21 nt, Human
ccggcaaaguccacgccgcac

SEQ ID NO: 705705 - RNA, 19 nt, Human
ccucgccgcgcccccuccc

SEQ ID NO: 705706 - RNA, 20 nt, Human
ccucgucaaguccugccugc

SEQ ID NO: 705707 - RNA, 18 nt, Human
ccugccugcuaacuccuc

SEQ ID NO: 705708 - RNA, 18 nt, Human
ccuggaauucccaaguuu

SEQ ID NO: 705709 - RNA, 22 nt, Human
ccuggguucaagugauccuccc

SEQ ID NO: 705710 - RNA, 18 nt, Human
cgccagggcccaggccgg

SEQ ID NO: 705711 - RNA, 20 nt, Human
cgccgcgcccccucccgccc

SEQ ID NO: 705712 - RNA, 24 nt, Human
cuaauaccaguguucauuucuucc

SEQ ID NO: 705713 - RNA, 27 nt, Human
cugacagccaagcaucaagcuucuucu

SEQ ID NO: 705714 - RNA, 18 nt, Human
cugggauuauagguguga

SEQ ID NO: 705715 - RNA, 22 nt, Human
cuggguucaagugauccucccu

SEQ ID NO: 705716 - RNA, 20 nt, Human
cuuacugcagccugaauucc

SEQ ID NO: 705717 - RNA, 19 nt, Human
gaucguagcuuacugcagc

SEQ ID NO: 705718 - RNA, 19 nt, Human
gcgggccucgccgcgcccc

SEQ ID NO: 705719 - RNA, 22 nt, Human
ggccagagugcaguggugugau

SEQ ID NO: 705720 - RNA, 19 nt, Human
ggccagagugcaugcaggc

SEQ ID NO: 705721 - RNA, 20 nt, Human
ggcuguguggcgagcccggc

SEQ ID NO: 705722 - RNA, 19 nt, Human
guuuugccccgccggcggg

SEQ ID NO: 705723 - RNA, 20 nt, Human
uaaauccaagauaaaaguaa

SEQ ID NO: 705724 - RNA, 24 nt, Human
uagaggcacuuuaaaaggugucua

SEQ ID NO: 705725 - RNA, 18 nt, Human
uagcuuacugcagccuga

SEQ ID NO: 705726 - RNA, 23 nt, Human
uagcuuacugcagccugaauucc

SEQ ID NO: 705727 - RNA, 19 nt, Human
ucaaguccugccugcuaac

SEQ ID NO: 705728 - RNA, 21 nt, Human
ucagugguugaggacuagaaa

SEQ ID NO: 705729 - RNA, 23 nt, Human
ucagugguugaggacuagaaaaa

SEQ ID NO: 705730 - RNA, 21 nt, Human
uccacgccgcacgcgcuccug

SEQ ID NO: 705731 - RNA, 23 nt, Human
uccaugagcagcaugauuaguuu

SEQ ID NO: 705732 - RNA, 23 nt, Human
ucccaaagugcugggauuauagg

SEQ ID NO: 705733 - RNA, 24 nt, Human
ucccgccccgcgccguggccugga

SEQ ID NO: 705734 - RNA, 21 nt, Human
uccucugccucccaaagugcu

SEQ ID NO: 705735 - RNA, 20 nt, Human
uccugccugcuaacuccuca

SEQ ID NO: 705736 - RNA, 21 nt, Human
uccuggguucaagugauccuc

SEQ ID NO: 705737 - RNA, 21 nt, Human
ucgccgcgcccccucccgccc

SEQ ID NO: 705738 - RNA, 18 nt, Human
ucuucauaauaaauccaa

SEQ ID NO: 705739 - RNA, 18 nt, Human
ucuuuuuuuagagacagg

SEQ ID NO: 705740 - RNA, 23 nt, Human
ugacagccaagcaucaagcuucu

SEQ ID NO: 705741 - RNA, 22 nt, Human
ugauccucccuccucugccucc

SEQ ID NO: 705742 - RNA, 21 nt, Human
ugcaguggugugaucguagcu

SEQ ID NO: 705743 - RNA, 21 nt, Human
ugcaugcaggccagagugcag

SEQ ID NO: 705744 - RNA, 24 nt, Human
uggauuauaaauacaguuuggcca

SEQ ID NO: 705745 - RNA, 19 nt, Human
ugggauuauaggugugacg

SEQ ID NO: 705746 - RNA, 20 nt, Human
ugggauuauaggugugacgc

SEQ ID NO: 705747 - RNA, 24 nt, Human
ugggauuauaggugugacgcacca

SEQ ID NO: 705748 - RNA, 25 nt, Human
ugggauuauaggugugacgcaccau

SEQ ID NO: 705749 - RNA, 20 nt, Human
uggguucaagugauccuccc

SEQ ID NO: 705750 - RNA, 21 nt, Human
uggguucaagugauccucccu

SEQ ID NO: 705751 - RNA, 23 nt, Human
uuaaagugaucacuguucuuuuu

SEQ ID NO: 705752 - RNA, 23 nt, Human
uuacugcagccugaauuccuggg

SEQ ID NO: 705753 - RNA, 19 nt, Human
uuauaggugugacgcacca

SEQ ID NO: 705754 - RNA, 20 nt, Human
uuauuggaaaaauccaugag

SEQ ID NO: 705755 - RNA, 24 nt, Human
uucaagugauccucccuccucugc

SEQ ID NO: 705756 - RNA, 19 nt, Human
uucugccaugcaggccaga

SEQ ID NO: 705757 - RNA, 26 nt, Human
aagaguucagggcuguagagguggcc

SEQ ID NO: 705758 - RNA, 20 nt, Human
acagcagcaggggccaggca

SEQ ID NO: 705759 - RNA, 22 nt, Human
accuccuccaggacggccaguu

SEQ ID NO: 705760 - RNA, 26 nt, Human
agaggcucaugggccagugggugcac

SEQ ID NO: 705761 - RNA, 19 nt, Human
aggaacaggagugggggcu

SEQ ID NO: 705762 - RNA, 20 nt, Human
caagaguucagggcuguaga

SEQ ID NO: 705763 - RNA, 18 nt, Human
caccuccuccaggacggc

SEQ ID NO: 705764 - RNA, 19 nt, Human
cagcagcaggggccaggca

SEQ ID NO: 705765 - RNA, 20 nt, Human
cagcagcaggggccaggcag

SEQ ID NO: 705766 - RNA, 22 nt, Human
cagcagcaggggccaggcagag

SEQ ID NO: 705767 - RNA, 21 nt, Human
caggacagcagcaggggccag

SEQ ID NO: 705768 - RNA, 22 nt, Human
caggagugggggcugaggccag

SEQ ID NO: 705769 - RNA, 18 nt, Human
cagggcucaguucgcugc

SEQ ID NO: 705770 - RNA, 18 nt, Human
ccaagaagcaacaguugg

SEQ ID NO: 705771 - RNA, 22 nt, Human
ccccagggcucaguucgcugcc

SEQ ID NO: 705772 - RNA, 18 nt, Human
ccuccaggacggccacag

SEQ ID NO: 705773 - RNA, 25 nt, Human
ccuucagcuggguggcaccugaagc

SEQ ID NO: 705774 - RNA, 18 nt, Human
cugaagccccacccacaa

SEQ ID NO: 705775 - RNA, 20 nt, Human
gccccagggcucaguucgcu

SEQ ID NO: 705776 - RNA, 19 nt, Human
ggccacaggacagcagcag

SEQ ID NO: 705777 - RNA, 18 nt, Human
ggcuguagagguggccag

SEQ ID NO: 705778 - RNA, 18 nt, Human
uagagguggccagggacc

SEQ ID NO: 705779 - RNA, 25 nt, Human
ucaagaguucagggcuguagaggug

SEQ ID NO: 705780 - RNA, 23 nt, Human
ugcacaaggaacaggaguggggg

SEQ ID NO: 705781 - RNA, 24 nt, Human
ugcacaaggaacaggagugggggc

SEQ ID NO: 705782 - RNA, 18 nt, Human
ugccccaagaagcaacag

SEQ ID NO: 705783 - RNA, 25 nt, Human
ugccgagcgccccugcccacugcuu

SEQ ID NO: 705784 - RNA, 23 nt, Human
ugggcagcuauugcuggagagag

SEQ ID NO: 705785 - RNA, 23 nt, Human
uucgcugccccaagaagcaacag

SEQ ID NO: 705786 - RNA, 23 nt, Human
uuuuuuuuuuuuuuuuuuaauag

SEQ ID NO: 705787 - RNA, 24 nt, Human
aaacagaaaacuacacucccagga

SEQ ID NO: 705788 - RNA, 19 nt, Human
aaagugcugggauuacagg

SEQ ID NO: 705789 - RNA, 20 nt, Human
aaagugcugggauuacaggg

SEQ ID NO: 705790 - RNA, 24 nt, Human
aaagugcugggauuacagggguga

SEQ ID NO: 705791 - RNA, 24 nt, Human
aaguaaucgacccgccuuggccuc

SEQ ID NO: 705792 - RNA, 18 nt, Human
aagugcugggauuacagg

SEQ ID NO: 705793 - RNA, 21 nt, Human
aagugcugggauuacaggggu

SEQ ID NO: 705794 - RNA, 26 nt, Human
aagugcugggauuacaggggugagcc

SEQ ID NO: 705795 - RNA, 18 nt, Human
acacaauaccuggacacc

SEQ ID NO: 705796 - RNA, 22 nt, Human
acaguggagcagauccucuaaa

SEQ ID NO: 705797 - RNA, 25 nt, Human
acccgccuuggccucccaaagugcu

SEQ ID NO: 705798 - RNA, 20 nt, Human
acuacacucccaggaggcca

SEQ ID NO: 705799 - RNA, 23 nt, Human
agaagggacacugcugcguggug

SEQ ID NO: 705800 - RNA, 18 nt, Human
agccacugagcccagcca

SEQ ID NO: 705801 - RNA, 24 nt, Human
agccccagacacugaaauggggcu

SEQ ID NO: 705802 - RNA, 19 nt, Human
aggaacucagacccaagaa

SEQ ID NO: 705803 - RNA, 25 nt, Human
aggcuggagugcaguggcacgaucu

SEQ ID NO: 705804 - RNA, 18 nt, Human
agggacagugacccacaa

SEQ ID NO: 705805 - RNA, 18 nt, Human
agggugagggaugaggag

SEQ ID NO: 705806 - RNA, 20 nt, Human
agugcaguggcacgaucucg

SEQ ID NO: 705807 - RNA, 23 nt, Human
agugcaguggcacgaucucggcu

SEQ ID NO: 705808 - RNA, 24 nt, Human
agugcaguggcacgaucucggcuc

SEQ ID NO: 705809 - RNA, 24 nt, Human
auccucuaaaagcugggaugggga

SEQ ID NO: 705810 - RNA, 18 nt, Human
augggguuucacaauguu

SEQ ID NO: 705811 - RNA, 24 nt, Human
augggguuucacaauguuggccag

SEQ ID NO: 705812 - RNA, 19 nt, Human
auguuggccaggcuggucg

SEQ ID NO: 705813 - RNA, 24 nt, Human
caaagugcugggauuacaggggug

SEQ ID NO: 705814 - RNA, 21 nt, Human
caacacaucuaccagagcccc

SEQ ID NO: 705815 - RNA, 22 nt, Human
caagcaauucuccugccucagc

SEQ ID NO: 705816 - RNA, 21 nt, Human
cacaauguuggccaggcuggu

SEQ ID NO: 705817 - RNA, 22 nt, Human
cacaauguuggccaggcugguc

SEQ ID NO: 705818 - RNA, 19 nt, Human
cagccgggcccuccgagcu

SEQ ID NO: 705819 - RNA, 20 nt, Human
cagccgggcccuccgagcuc

SEQ ID NO: 705820 - RNA, 19 nt, Human
caggaggccaacuucuucc

SEQ ID NO: 705821 - RNA, 24 nt, Human
cauacacacaauaccuggacaccc

SEQ ID NO: 705822 - RNA, 19 nt, Human
ccaaagugcugggauuaca

SEQ ID NO: 705823 - RNA, 21 nt, Human
ccaaagugcugggauuacagg

SEQ ID NO: 705824 - RNA, 24 nt, Human
ccaaagugcugggauuacaggggu

SEQ ID NO: 705825 - RNA, 20 nt, Human
cccagacacugaaauggggc

SEQ ID NO: 705826 - RNA, 22 nt, Human
ccccagacacugaaauggggcu

SEQ ID NO: 705827 - RNA, 24 nt, Human
ccccggguagcugggauuacaggc

SEQ ID NO: 705828 - RNA, 23 nt, Human
ccccuaccuauaauaggaacuca

SEQ ID NO: 705829 - RNA, 24 nt, Human
cccggggcccccgcagcaccagcc

SEQ ID NO: 705830 - RNA, 23 nt, Human
cccggguagcugggauuacaggc

SEQ ID NO: 705831 - RNA, 24 nt, Human
cccggguagcugggauuacaggca

SEQ ID NO: 705832 - RNA, 24 nt, Human
cccuuuuucuggaguccaggcugg

SEQ ID NO: 705833 - RNA, 26 nt, Human
ccgccuucugaguucaagcaauucuu

SEQ ID NO: 705834 - RNA, 24 nt, Human
ccggguagcugggauuacaggcau

SEQ ID NO: 705835 - RNA, 19 nt, Human
ccuauaauaggaacucaga

SEQ ID NO: 705836 - RNA, 19 nt, Human
ccuccgagcucgcgccucg

SEQ ID NO: 705837 - RNA, 22 nt, Human
ccuccgagcucgcgccucgugc

SEQ ID NO: 705838 - RNA, 22 nt, Human
ccucuaaaagcugggaugggga

SEQ ID NO: 705839 - RNA, 20 nt, Human
ccugaccucaaguaaucgac

SEQ ID NO: 705840 - RNA, 21 nt, Human
ccuggacacccuuuuucugga

SEQ ID NO: 705841 - RNA, 24 nt, Human
ccuucugaguucaagcaauucucc

SEQ ID NO: 705842 - RNA, 22 nt, Human
cgagauggagucuugcucuguu

SEQ ID NO: 705843 - RNA, 18 nt, Human
cguggugacucugcuucc

SEQ ID NO: 705844 - RNA, 21 nt, Human
cucaacacaucuaccagagcc

SEQ ID NO: 705845 - RNA, 24 nt, Human
cucaacacaucuaccagagcccca

SEQ ID NO: 705846 - RNA, 23 nt, Human
cugcagccuccgccuucugaguu

SEQ ID NO: 705847 - RNA, 24 nt, Human
cugccucagccuccccggguagcu

SEQ ID NO: 705848 - RNA, 20 nt, Human
cugcuuccugucuggggcag

SEQ ID NO: 705849 - RNA, 22 nt, Human
cugcuuccugucuggggcagcu

SEQ ID NO: 705850 - RNA, 24 nt, Human
cugggagggcugaggaaggggaug

SEQ ID NO: 705851 - RNA, 18 nt, Human
cuguugaccaggcuggag

SEQ ID NO: 705852 - RNA, 20 nt, Human
cuuccagccaagaaaaggac

SEQ ID NO: 705853 - RNA, 24 nt, Human
cuuccugucuggggcagcuggaag

SEQ ID NO: 705854 - RNA, 23 nt, Human
gacagugacccacaacugccccc

SEQ ID NO: 705855 - RNA, 24 nt, Human
gaccucaaguaaucgacccgccuu

SEQ ID NO: 705856 - RNA, 23 nt, Human
gaggaaggggaugucaaccaaga

SEQ ID NO: 705857 - RNA, 18 nt, Human
gaggguggggccccuacc

SEQ ID NO: 705858 - RNA, 21 nt, Human
gaggugagagggagcaaagug

SEQ ID NO: 705859 - RNA, 20 nt, Human
gaguucaagcaauucuccug

SEQ ID NO: 705860 - RNA, 18 nt, Human
gauuacaggcaugugcca

SEQ ID NO: 705861 - RNA, 22 nt, Human
gauuacaggcaugugccacuac

SEQ ID NO: 705862 - RNA, 18 nt, Human
gauuacaggggugagcca

SEQ ID NO: 705863 - RNA, 23 nt, Human
gcacaacuaaaugcauacacaca

SEQ ID NO: 705864 - RNA, 18 nt, Human
gcagagaugggguuucac

SEQ ID NO: 705865 - RNA, 22 nt, Human
gcagagaugggguuucacaaug

SEQ ID NO: 705866 - RNA, 19 nt, Human
gccuaaugccaguauagga

SEQ ID NO: 705867 - RNA, 22 nt, Human
gccuuggccucccaaagugcug

SEQ ID NO: 705868 - RNA, 18 nt, Human
gcugaugggaagcccaga

SEQ ID NO: 705869 - RNA, 19 nt, Human
gcuggagugcaguggcacg

SEQ ID NO: 705870 - RNA, 23 nt, Human
gcuggucgugaacuccugaccuc

SEQ ID NO: 705871 - RNA, 26 nt, Human
ggacaggagaaaggucagggugaggg

SEQ ID NO: 705872 - RNA, 19 nt, Human
ggauuacaggcaugugcca

SEQ ID NO: 705873 - RNA, 19 nt, Human
ggccaggcuggucgugaac

SEQ ID NO: 705874 - RNA, 18 nt, Human
ggcuggggcguggccugg

SEQ ID NO: 705875 - RNA, 19 nt, Human
ggcuggggcguggccuggc

SEQ ID NO: 705876 - RNA, 24 nt, Human
ggcuggucgugaacuccugaccuc

SEQ ID NO: 705877 - RNA, 20 nt, Human
gggauggggaguaggcuggg

SEQ ID NO: 705878 - RNA, 20 nt, Human
gggcguggccuggcggggag

SEQ ID NO: 705879 - RNA, 21 nt, Human
ggggcguggccuggcggggag

SEQ ID NO: 705880 - RNA, 22 nt, Human
ggggcguggccuggcggggagc

SEQ ID NO: 705881 - RNA, 18 nt, Human
gggguuucacaauguugg

SEQ ID NO: 705882 - RNA, 22 nt, Human
gggguuucacaauguuggccag

SEQ ID NO: 705883 - RNA, 24 nt, Human
guaaucgacccgccuuggccuccc

SEQ ID NO: 705884 - RNA, 18 nt, Human
guagcugggauuacaggc

SEQ ID NO: 705885 - RNA, 19 nt, Human
guagcugggauuacaggca

SEQ ID NO: 705886 - RNA, 22 nt, Human
guagcugggauuacaggcaugu

SEQ ID NO: 705887 - RNA, 19 nt, Human
gugagccacugagcccagc

SEQ ID NO: 705888 - RNA, 19 nt, Human
guugaccaggcuggagugc

SEQ ID NO: 705889 - RNA, 24 nt, Human
uaacuuuuguauuuuuggcagaga

SEQ ID NO: 705890 - RNA, 19 nt, Human
uacacucccaggaggccaa

SEQ ID NO: 705891 - RNA, 23 nt, Human
uacaggcaugugccacuacgccc

SEQ ID NO: 705892 - RNA, 18 nt, Human
uacaggggugagccacug

SEQ ID NO: 705893 - RNA, 19 nt, Human
uacaggggugagccacuga

SEQ ID NO: 705894 - RNA, 24 nt, Human
uacaggggugagccacugagccca

SEQ ID NO: 705895 - RNA, 25 nt, Human
uaccuauaauaggaacucagaccca

SEQ ID NO: 705896 - RNA, 18 nt, Human
ucacugcagccuccgccu

SEQ ID NO: 705897 - RNA, 18 nt, Human
ucacugcagccuccgccu

SEQ ID NO: 705898 - RNA, 19 nt, Human
ucacugcagccuccgccuu

SEQ ID NO: 705899 - RNA, 22 nt, Human
ucacugcagccuccgccuucug

SEQ ID NO: 705900 - RNA, 24 nt, Human
ucacugcagccuccgccuucugag

SEQ ID NO: 705901 - RNA, 25 nt, Human
ucacugcagccuccgccuucugagu

SEQ ID NO: 705902 - RNA, 23 nt, Human
ucccaaagugcugggauuacagg

SEQ ID NO: 705903 - RNA, 20 nt, Human
ucccaggaggccaacuucuu

SEQ ID NO: 705904 - RNA, 22 nt, Human
uccgccuucugaguucaagccg

SEQ ID NO: 705905 - RNA, 26 nt, Human
ucuccugccucagccuccccggguag

SEQ ID NO: 705906 - RNA, 20 nt, Human
ucugaguucaagcaauucuc

SEQ ID NO: 705907 - RNA, 23 nt, Human
ucugaguucaagcaauucuccug

SEQ ID NO: 705908 - RNA, 21 nt, Human
ucugcuuccugucuggggcag

SEQ ID NO: 705909 - RNA, 24 nt, Human
ucuguugaccaggcuggagugcag

SEQ ID NO: 705910 - RNA, 23 nt, Human
ucuugcucuguugaccaggcugg

SEQ ID NO: 705911 - RNA, 24 nt, Human
ucuugcucuguugaccaggcugga

SEQ ID NO: 705912 - RNA, 19 nt, Human
ugaaauggggcugggaucg

SEQ ID NO: 705913 - RNA, 24 nt, Human
ugaccaggcuggagugcaguggca

SEQ ID NO: 705914 - RNA, 20 nt, Human
ugaccucaaguaaucgaccc

SEQ ID NO: 705915 - RNA, 21 nt, Human
ugaccucaaguaaucgacccg

SEQ ID NO: 705916 - RNA, 25 nt, Human
ugaccucaaguaaucgacccgccuu

SEQ ID NO: 705917 - RNA, 19 nt, Human
ugagagggagcaaaguggc

SEQ ID NO: 705918 - RNA, 20 nt, Human
ugaggaaggggaugucaacc

SEQ ID NO: 705919 - RNA, 21 nt, Human
ugaguucaagcaauucuccug

SEQ ID NO: 705920 - RNA, 24 nt, Human
ugaguucaagcaauucuccugccu

SEQ ID NO: 705921 - RNA, 23 nt, Human
ugcacuucccagaggugagaggg

SEQ ID NO: 705922 - RNA, 22 nt, Human
ugcaguggcacgaucucggcuc

SEQ ID NO: 705923 - RNA, 23 nt, Human
ugcauacacacaauaccuggaca

SEQ ID NO: 705924 - RNA, 25 nt, Human
ugccucagccuccccggguagcugg

SEQ ID NO: 705925 - RNA, 21 nt, Human
ugcguggugacucugcuuccu

SEQ ID NO: 705926 - RNA, 23 nt, Human
uggagugcaguggcacgaucucg

SEQ ID NO: 705927 - RNA, 24 nt, Human
uggagugcaguggcacgaucucgg

SEQ ID NO: 705928 - RNA, 24 nt, Human
uggcagagaugggguuucacaaug

SEQ ID NO: 705929 - RNA, 24 nt, Human
uggccaggcuggucgugaacuccu

SEQ ID NO: 705930 - RNA, 19 nt, Human
uggcuggggcguggccugg

SEQ ID NO: 705931 - RNA, 27 nt, Human
uggcuggggcguggccuggcggggaga

SEQ ID NO: 705932 - RNA, 20 nt, Human
ugggagggcugaggaagggg

SEQ ID NO: 705933 - RNA, 21 nt, Human
ugggagggcugaggaagggga

SEQ ID NO: 705934 - RNA, 18 nt, Human
ugggauggggaguaggcu

SEQ ID NO: 705935 - RNA, 18 nt, Human
ugggauuacaggcaugug

SEQ ID NO: 705936 - RNA, 21 nt, Human
ugggauuacaggcaugugcca

SEQ ID NO: 705937 - RNA, 22 nt, Human
ugggauuacaggcaugugccac

SEQ ID NO: 705938 - RNA, 22 nt, Human
ugggauuacaggcaugugccac

SEQ ID NO: 705939 - RNA, 24 nt, Human
ugggauuacaggcaugugccacua

SEQ ID NO: 705940 - RNA, 24 nt, Human
ugggauuacaggcaugugccacua

SEQ ID NO: 705941 - RNA, 19 nt, Human
ugggauuacaggggugagc

SEQ ID NO: 705942 - RNA, 22 nt, Human
ugggauuacaggggugagccac

SEQ ID NO: 705943 - RNA, 22 nt, Human
ugggauuacaggggugagccac

SEQ ID NO: 705944 - RNA, 24 nt, Human
ugggauuacaggggugagccacug

SEQ ID NO: 705945 - RNA, 18 nt, Human
uggggaguaggcugggag

SEQ ID NO: 705946 - RNA, 22 nt, Human
uggggcagcuggaagggacagu

SEQ ID NO: 705947 - RNA, 24 nt, Human
ugggguuucacaauguuggccagg

SEQ ID NO: 705948 - RNA, 21 nt, Human
uguauuuuuggcagagauggg

SEQ ID NO: 705949 - RNA, 31 nt, Human
ugugugcacaacuaaaugcauacacacagug

SEQ ID NO: 705950 - RNA, 21 nt, Human
uucaagcaauucuccugccuc

SEQ ID NO: 705951 - RNA, 24 nt, Human
uucaagcaauucuccugccucagc

SEQ ID NO: 705952 - RNA, 25 nt, Human
uucacaauguuggccaggcuggucg

SEQ ID NO: 705953 - RNA, 24 nt, Human
uuggcagagaugggguuucacaau

SEQ ID NO: 705954 - RNA, 18 nt, Human
uuggccucccaaagugcu

SEQ ID NO: 705955 - RNA, 21 nt, Human
uuucacaauguuggccaggcu

SEQ ID NO: 705956 - RNA, 22 nt, Human
uuucacaauguuggccaggcug

SEQ ID NO: 705957 - RNA, 24 nt, Human
uuuuuggcagagaugggguuucac

SEQ ID NO: 705958 - RNA, 24 nt, Human
uuuuuuuuuuucgagauggagucu

SEQ ID NO: 705959 - RNA, 18 nt, Human
uuuuuuuuuuuuuuuucg

SEQ ID NO: 705960 - RNA, 23 nt, Human
uuuuuuuuuuuuuuuuucgagau

SEQ ID NO: 705961 - RNA, 19 nt, Human
aagagagggcuggaacaga

SEQ ID NO: 705962 - RNA, 22 nt, Human
aaggagccagaaagcgagccgc

SEQ ID NO: 705963 - RNA, 19 nt, Human
acaaagcuagcucccacag

SEQ ID NO: 705964 - RNA, 24 nt, Human
acacgggguccccaucccccugcc

SEQ ID NO: 705965 - RNA, 23 nt, Human
agaaagcgagccgcgccagcccg

SEQ ID NO: 705966 - RNA, 24 nt, Human
agacaagagagggcuggaacagaa

SEQ ID NO: 705967 - RNA, 19 nt, Human
agaggaaaggcggcgggag

SEQ ID NO: 705968 - RNA, 18 nt, Human
aggaaaaaucgagcgggg

SEQ ID NO: 705969 - RNA, 18 nt, Human
aucccccuccccuccaca

SEQ ID NO: 705970 - RNA, 19 nt, Human
cacaaagggcugugggauu

SEQ ID NO: 705971 - RNA, 21 nt, Human
cacacgggguccccauccccc

SEQ ID NO: 705972 - RNA, 24 nt, Human
caucccccugccgccgccacagcc

SEQ ID NO: 705973 - RNA, 25 nt, Human
caucccugacucugguucacggucu

SEQ ID NO: 705974 - RNA, 24 nt, Human
cccacagaccccgcucagcaggcg

SEQ ID NO: 705975 - RNA, 21 nt, Human
cccccugccgccgccacagcc

SEQ ID NO: 705976 - RNA, 19 nt, Human
ccccgcucccuccggggag

SEQ ID NO: 705977 - RNA, 21 nt, Human
ccccugccgccgccacagcca

SEQ ID NO: 705978 - RNA, 18 nt, Human
ccgccacagccacccaga

SEQ ID NO: 705979 - RNA, 24 nt, Human
ccgcucgcuggggcugcccgaggc

SEQ ID NO: 705980 - RNA, 19 nt, Human
cggaaggagccagaaagcg

SEQ ID NO: 705981 - RNA, 22 nt, Human
cgggaggaagcuaaggcauccu

SEQ ID NO: 705982 - RNA, 19 nt, Human
cuccccuccacagagagga

SEQ ID NO: 705983 - RNA, 21 nt, Human
cugcccgaggcgcagcggcgg

SEQ ID NO: 705984 - RNA, 22 nt, Human
cugccgccgccacagccaccca

SEQ ID NO: 705985 - RNA, 18 nt, Human
cuggaaaucccccucccc

SEQ ID NO: 705986 - RNA, 23 nt, Human
cuggaaaucccccuccccuccac

SEQ ID NO: 705987 - RNA, 20 nt, Human
gagcucccggcgugcuuucc

SEQ ID NO: 705988 - RNA, 20 nt, Human
gaguugccgcucgcuggggc

SEQ ID NO: 705989 - RNA, 19 nt, Human
gaucuucaaccccuucccc

SEQ ID NO: 705990 - RNA, 18 nt, Human
gccacagccacccagaca

SEQ ID NO: 705991 - RNA, 21 nt, Human
gcuaaacuguucaugccaugc

SEQ ID NO: 705992 - RNA, 22 nt, Human
gcugugggauuccccgcucccu

SEQ ID NO: 705993 - RNA, 21 nt, Human
ggcucagaggaaaggcggcgg

SEQ ID NO: 705994 - RNA, 19 nt, Human
gggguccccaucccccugc

SEQ ID NO: 705995 - RNA, 27 nt, Human
gucgcuggaaaucccccuccccuccaa

SEQ ID NO: 705996 - RNA, 23 nt, Human
uaaggcauccuuuaaaagaacaa

SEQ ID NO: 705997 - RNA, 18 nt, Human
uccccacacggggucccc

SEQ ID NO: 705998 - RNA, 23 nt, Human
uccccggcuggcuggagcucccg

SEQ ID NO: 705999 - RNA, 23 nt, Human
ucgcuggaaaucccccuccccuc

SEQ ID NO: 706000 - RNA, 18 nt, Human
ucucuaguaggaaggcuc

SEQ ID NO: 706001 - RNA, 20 nt, Human
ucucuaguaggaaggcucag

SEQ ID NO: 706002 - RNA, 23 nt, Human
ucuucagucauuuuuguugguua

SEQ ID NO: 706003 - RNA, 26 nt, Human
ugaacuggacaaagccgcagagccag

SEQ ID NO: 706004 - RNA, 25 nt, Human
ugaccugucgcuggaaaucccccuc

SEQ ID NO: 706005 - RNA, 20 nt, Human
uggcuggagcucccggcgug

SEQ ID NO: 706006 - RNA, 18 nt, Human
uggggagggcuucccauu

SEQ ID NO: 706007 - RNA, 26 nt, Human
ugucgcuggaaaucccccuccccucc

SEQ ID NO: 706008 - RNA, 22 nt, Human
uguuuuguuuuguuucaauuua

SEQ ID NO: 706009 - RNA, 23 nt, Human
uuuaagaaacaaguuuuguuuug

SEQ ID NO: 706010 - RNA, 26 nt, Human
uuucccccugucuuuacaucccugac

SEQ ID NO: 706011 - RNA, 23 nt, Human
uuuuaguucacaggcauuauuaa

SEQ ID NO: 706012 - RNA, 20 nt, Human
aagaaggagcugagggaggg

SEQ ID NO: 706013 - RNA, 22 nt, Human
aagaggaaggggguuaacccca

SEQ ID NO: 706014 - RNA, 25 nt, Human
aagaggaaggggguuaaccccaaaa

SEQ ID NO: 706015 - RNA, 23 nt, Human
aagcccagggagacuuagugagg

SEQ ID NO: 706016 - RNA, 24 nt, Human
aagccugccccucucugccuccca

SEQ ID NO: 706017 - RNA, 18 nt, Human
aaggagcugagggagggu

SEQ ID NO: 706018 - RNA, 27 nt, Human
aaggagucagccugugccugagaggug

SEQ ID NO: 706019 - RNA, 19 nt, Human
aaggagucugggggacauu

SEQ ID NO: 706020 - RNA, 20 nt, Human
aaugaagaggacccucugaa

SEQ ID NO: 706021 - RNA, 20 nt, Human
aaugcugcagcaaacugguc

SEQ ID NO: 706022 - RNA, 22 nt, Human
acaccuugagccacccaaacaa

SEQ ID NO: 706023 - RNA, 25 nt, Human
agagcacccaggggaucuaugaaga

SEQ ID NO: 706024 - RNA, 19 nt, Human
agaggagacuggggcaucc

SEQ ID NO: 706025 - RNA, 24 nt, Human
agaggggcugagacaggugaggag

SEQ ID NO: 706026 - RNA, 18 nt, Human
agaggggggugggguguu

SEQ ID NO: 706027 - RNA, 18 nt, Human
agcagcggcagcaggagg

SEQ ID NO: 706028 - RNA, 19 nt, Human
agccuggaauuccuuugca

SEQ ID NO: 706029 - RNA, 20 nt, Human
agcuggugcaucuugagggg

SEQ ID NO: 706030 - RNA, 25 nt, Human
aggaaacugggggugucuagagagg

SEQ ID NO: 706031 - RNA, 19 nt, Human
aggaagaacuaaagagaug

SEQ ID NO: 706032 - RNA, 18 nt, Human
aggaaguugggcacaauc

SEQ ID NO: 706033 - RNA, 19 nt, Human
aggagacgccgggagaagg

SEQ ID NO: 706034 - RNA, 18 nt, Human
aggcaaggccuggggaug

SEQ ID NO: 706035 - RNA, 24 nt, Human
aggcagaagagccuggaauuccuu

SEQ ID NO: 706036 - RNA, 19 nt, Human
agggacugagaagggccuu

SEQ ID NO: 706037 - RNA, 18 nt, Human
agggcagauguaaaugcu

SEQ ID NO: 706038 - RNA, 24 nt, Human
agggcuggagaggggaagggguua

SEQ ID NO: 706039 - RNA, 21 nt, Human
aggggaagggguuaucuaaag

SEQ ID NO: 706040 - RNA, 22 nt, Human
aggggggugggguguugaaagg

SEQ ID NO: 706041 - RNA, 25 nt, Human
aggugucugggggcgucuagagggg

SEQ ID NO: 706042 - RNA, 22 nt, Human
agugguggagaggagacugggg

SEQ ID NO: 706043 - RNA, 23 nt, Human
agugguggagaggagacuggggc

SEQ ID NO: 706044 - RNA, 18 nt, Human
augcaggaguccagcugg

SEQ ID NO: 706045 - RNA, 19 nt, Human
auuuccagcagccagggga

SEQ ID NO: 706046 - RNA, 21 nt, Human
caacaaagccuggucgacacu

SEQ ID NO: 706047 - RNA, 19 nt, Human
caagaaggagcugagggag

SEQ ID NO: 706048 - RNA, 18 nt, Human
cagaaggggugcccaagc

SEQ ID NO: 706049 - RNA, 21 nt, Human
cagagcacccaggggaucuau

SEQ ID NO: 706050 - RNA, 22 nt, Human
cagagggaggaggaaaucucaa

SEQ ID NO: 706051 - RNA, 20 nt, Human
cagcagaggacaggguugcg

SEQ ID NO: 706052 - RNA, 18 nt, Human
cagcagcggcagcaggag

SEQ ID NO: 706053 - RNA, 19 nt, Human
cagcucccaccaggaaaaa

SEQ ID NO: 706054 - RNA, 23 nt, Human
cagcugcuauugcuagaguuugc

SEQ ID NO: 706055 - RNA, 20 nt, Human
caggaaaaaugucuggggug

SEQ ID NO: 706056 - RNA, 25 nt, Human
caggaggaagagaagcaaccacagc

SEQ ID NO: 706057 - RNA, 23 nt, Human
caggggccuguggaagcccagug

SEQ ID NO: 706058 - RNA, 21 nt, Human
cagugcuucagcucccaccag

SEQ ID NO: 706059 - RNA, 22 nt, Human
caugcaggaguccagcugggag

SEQ ID NO: 706060 - RNA, 18 nt, Human
ccaaagcuccauauccca

SEQ ID NO: 706061 - RNA, 20 nt, Human
ccaacaaagccuggucgaca

SEQ ID NO: 706062 - RNA, 23 nt, Human
ccagagccuccuaguagggcugg

SEQ ID NO: 706063 - RNA, 20 nt, Human
ccaggaggaagaacuaaaga

SEQ ID NO: 706064 - RNA, 21 nt, Human
ccucauggaucuggaaaggga

SEQ ID NO: 706065 - RNA, 18 nt, Human
ccugccccucucugccuc

SEQ ID NO: 706066 - RNA, 25 nt, Human
ccugccccucucugccucccaaaaa

SEQ ID NO: 706067 - RNA, 25 nt, Human
ccuugagccacccaaacaaggaaac

SEQ ID NO: 706068 - RNA, 18 nt, Human
cguugggggcaggucugg

SEQ ID NO: 706069 - RNA, 23 nt, Human
cucaguggggggggcagaagggg

SEQ ID NO: 706070 - RNA, 22 nt, Human
cuccaaagcuccauaucccagc

SEQ ID NO: 706071 - RNA, 19 nt, Human
cucguagaggccagaucag

SEQ ID NO: 706072 - RNA, 18 nt, Human
cucuacaggaguucuggg

SEQ ID NO: 706073 - RNA, 19 nt, Human
cucugcacucucaagaguc

SEQ ID NO: 706074 - RNA, 20 nt, Human
cucuucucugaaccuccaaa

SEQ ID NO: 706075 - RNA, 19 nt, Human
cugagaagggccuugggga

SEQ ID NO: 706076 - RNA, 26 nt, Human
gagaggggaagggguuaucuaaaggg

SEQ ID NO: 706077 - RNA, 21 nt, Human
gaguugggugugucuccaggg

SEQ ID NO: 706078 - RNA, 22 nt, Human
gauggugggggcuuggagacac

SEQ ID NO: 706079 - RNA, 18 nt, Human
gcaaggaggccaggggcc

SEQ ID NO: 706080 - RNA, 27 nt, Human
gccaagaaggagcugagggaggguuua

SEQ ID NO: 706081 - RNA, 18 nt, Human
gccacuccccaagcccag

SEQ ID NO: 706082 - RNA, 19 nt, Human
gccagucccagugugcuag

SEQ ID NO: 706083 - RNA, 23 nt, Human
gcggcagcaggaggaagagaagc

SEQ ID NO: 706084 - RNA, 20 nt, Human
gcgggguccauuuccagcag

SEQ ID NO: 706085 - RNA, 23 nt, Human
ggaaaggaguucccaaaaaugaa

SEQ ID NO: 706086 - RNA, 27 nt, Human
ggacaggguugcgggguccauuuccag

SEQ ID NO: 706087 - RNA, 21 nt, Human
ggagaagagcagaaaaggggu

SEQ ID NO: 706088 - RNA, 23 nt, Human
ggagacuggggcauccagagggu

SEQ ID NO: 706089 - RNA, 23 nt, Human
ggaguccagcugggagagugggg

SEQ ID NO: 706090 - RNA, 20 nt, Human
ggaguucuggggaagaaagg

SEQ ID NO: 706091 - RNA, 20 nt, Human
ggaguugggugugucuccag

SEQ ID NO: 706092 - RNA, 22 nt, Human
ggaucuggaaagggagcuggug

SEQ ID NO: 706093 - RNA, 23 nt, Human
ggauggggccaagaaggagcuga

SEQ ID NO: 706094 - RNA, 21 nt, Human
ggcgucuagaggggccaagaa

SEQ ID NO: 706095 - RNA, 23 nt, Human
ggcuuuggaaaggaguucccaaa

SEQ ID NO: 706096 - RNA, 18 nt, Human
gggcaaggaggccagggg

SEQ ID NO: 706097 - RNA, 22 nt, Human
gggcauccagaggguagaaaug

SEQ ID NO: 706098 - RNA, 24 nt, Human
gggccgggacucaaauguuaggaa

SEQ ID NO: 706099 - RNA, 23 nt, Human
ggggaagggguuaucuaaagggg

SEQ ID NO: 706100 - RNA, 18 nt, Human
ggggauggggccaagaag

SEQ ID NO: 706101 - RNA, 21 nt, Human
gggggcaggucuggggaaacc

SEQ ID NO: 706102 - RNA, 20 nt, Human
ggggggugggguguugaaag

SEQ ID NO: 706103 - RNA, 19 nt, Human
gggggugggguguugaaag

SEQ ID NO: 706104 - RNA, 22 nt, Human
ggggugggguguugaaagggag

SEQ ID NO: 706105 - RNA, 20 nt, Human
ggguggcuguggauccagga

SEQ ID NO: 706106 - RNA, 20 nt, Human
ggguguggggauggggccaa

SEQ ID NO: 706107 - RNA, 24 nt, Human
guagaauuugugcuaucugagugu

SEQ ID NO: 706108 - RNA, 20 nt, Human
gucucagggaaggcagaaga

SEQ ID NO: 706109 - RNA, 19 nt, Human
gugcccaagccugccccuc

SEQ ID NO: 706110 - RNA, 20 nt, Human
guggcuguggauccaggagg

SEQ ID NO: 706111 - RNA, 18 nt, Human
uaaagaggcugaaaggug

SEQ ID NO: 706112 - RNA, 22 nt, Human
uacaggaguucuggggaagaaa

SEQ ID NO: 706113 - RNA, 21 nt, Human
uagagaggccaagaggaacca

SEQ ID NO: 706114 - RNA, 25 nt, Human
uagaggccagaucagaggugagggu

SEQ ID NO: 706115 - RNA, 24 nt, Human
uagcagcagcggcagcaggaggaa

SEQ ID NO: 706116 - RNA, 18 nt, Human
uaggagaauguggcuguc

SEQ ID NO: 706117 - RNA, 19 nt, Human
uaggagaauguggcugucu

SEQ ID NO: 706118 - RNA, 20 nt, Human
uaggaggggccugggcaaug

SEQ ID NO: 706119 - RNA, 22 nt, Human
uagggcuggagaggggaagggg

SEQ ID NO: 706120 - RNA, 22 nt, Human
uauugcuagaguuugcuggggg

SEQ ID NO: 706121 - RNA, 21 nt, Human
ucagaggugaggguucucuuc

SEQ ID NO: 706122 - RNA, 22 nt, Human
ucagaugucggaucaaagcuuu

SEQ ID NO: 706123 - RNA, 21 nt, Human
ucaguggggggggcagaaggg

SEQ ID NO: 706124 - RNA, 19 nt, Human
uccaggagguuguaaagag

SEQ ID NO: 706125 - RNA, 20 nt, Human
ucccaaaaaugaagaggacc

SEQ ID NO: 706126 - RNA, 22 nt, Human
ucccaaaaaugaagaggaccuc

SEQ ID NO: 706127 - RNA, 19 nt, Human
uccccaagcccagggagac

SEQ ID NO: 706128 - RNA, 21 nt, Human
uccccaagcccagggagacuu

SEQ ID NO: 706129 - RNA, 18 nt, Human
ucuugggacugccuagag

SEQ ID NO: 706130 - RNA, 19 nt, Human
ugacacggcagcagcugcu

SEQ ID NO: 706131 - RNA, 20 nt, Human
ugaccccucaggcaaggccu

SEQ ID NO: 706132 - RNA, 18 nt, Human
ugagaggcugagaguuau

SEQ ID NO: 706133 - RNA, 19 nt, Human
ugagaggugucugggggcg

SEQ ID NO: 706134 - RNA, 21 nt, Human
ugagggguggcuguggaucca

SEQ ID NO: 706135 - RNA, 20 nt, Human
ugcagugguggagaggagac

SEQ ID NO: 706136 - RNA, 19 nt, Human
ugccaagaauagcccgggg

SEQ ID NO: 706137 - RNA, 19 nt, Human
ugccacuccccaagcccag

SEQ ID NO: 706138 - RNA, 25 nt, Human
ugccuggaaguggggguucuagagg

SEQ ID NO: 706139 - RNA, 25 nt, Human
uggaaaggaguucccaaaaaugaag

SEQ ID NO: 706140 - RNA, 24 nt, Human
uggaaagggagcuggugcaucuug

SEQ ID NO: 706141 - RNA, 26 nt, Human
ugggcuuugcaggaagcuggcaggag

SEQ ID NO: 706142 - RNA, 18 nt, Human
uggggauggggccaagaa

SEQ ID NO: 706143 - RNA, 23 nt, Human
ugggggacauuuacagaaccuag

SEQ ID NO: 706144 - RNA, 22 nt, Human
uggggugggaggaaguuucuca

SEQ ID NO: 706145 - RNA, 22 nt, Human
ugguggagaggagacuggggca

SEQ ID NO: 706146 - RNA, 22 nt, Human
ugucggaucaaagcuuugccuu

SEQ ID NO: 706147 - RNA, 22 nt, Human
ugucugggggcgucuagagggg

SEQ ID NO: 706148 - RNA, 23 nt, Human
ugugcuaucugaguguguguugg

SEQ ID NO: 706149 - RNA, 20 nt, Human
uguggggauggggccaagaa

SEQ ID NO: 706150 - RNA, 22 nt, Human
uguguguugggagaggcagccu

SEQ ID NO: 706151 - RNA, 24 nt, Human
uuaaccccaaaaugggauuaagag

SEQ ID NO: 706152 - RNA, 22 nt, Human
uucccaaaaaugaagaggaccc

SEQ ID NO: 706153 - RNA, 21 nt, Human
uugcauaguucucaguggggg

SEQ ID NO: 706154 - RNA, 20 nt, Human
uugggagaggcagccugacc

SEQ ID NO: 706155 - RNA, 24 nt, Human
uuuccuggcuacuuccccacuaug

SEQ ID NO: 706156 - RNA, 19 nt, Human
aaaccacaggcaccucccg

SEQ ID NO: 706157 - RNA, 19 nt, Human
aaaccacaggcaccucccg

SEQ ID NO: 706158 - RNA, 26 nt, Human
aaaucccccucuaauccaaaagaagc

SEQ ID NO: 706159 - RNA, 21 nt, Human
aacugucuuuccucucucuaa

SEQ ID NO: 706160 - RNA, 20 nt, Human
aagggucucuucaaaguggc

SEQ ID NO: 706161 - RNA, 19 nt, Human
acaggcaccucccggacuc

SEQ ID NO: 706162 - RNA, 19 nt, Human
accacaggcaccucccgga

SEQ ID NO: 706163 - RNA, 21 nt, Human
accccaacacccaggccccaa

SEQ ID NO: 706164 - RNA, 24 nt, Human
agaaggacaaagcucuaggcaaag

SEQ ID NO: 706165 - RNA, 22 nt, Human
agacccugcaggagcuacccag

SEQ ID NO: 706166 - RNA, 18 nt, Human
agucccccaccccacccc

SEQ ID NO: 706167 - RNA, 20 nt, Human
aguggugggugcaaaccaca

SEQ ID NO: 706168 - RNA, 24 nt, Human
auacuuacagccaaucagaucuag

SEQ ID NO: 706169 - RNA, 21 nt, Human
aucacaacuagucucucagcg

SEQ ID NO: 706170 - RNA, 21 nt, Human
caaaauagcaaaucacaacua

SEQ ID NO: 706171 - RNA, 21 nt, Human
cacaggcaccucccggacucc

SEQ ID NO: 706172 - RNA, 19 nt, Human
cacaguagagauacuuaca

SEQ ID NO: 706173 - RNA, 21 nt, Human
caccccaccccgaaucagggg

SEQ ID NO: 706174 - RNA, 18 nt, Human
cagccaaucagaucuaga

SEQ ID NO: 706175 - RNA, 24 nt, Human
caucaaaaaucccccucuaauccu

SEQ ID NO: 706176 - RNA, 20 nt, Human
ccaaucagaucuagaaggac

SEQ ID NO: 706177 - RNA, 19 nt, Human
cccaacacccaggccccaa

SEQ ID NO: 706178 - RNA, 20 nt, Human
cccaucaaaaaucccccucu

SEQ ID NO: 706179 - RNA, 22 nt, Human
ccccaaagucaguguacgcgcu

SEQ ID NO: 706180 - RNA, 18 nt, Human
ccccaacacccaggcccc

SEQ ID NO: 706181 - RNA, 19 nt, Human
cccccaccccaccccgaau

SEQ ID NO: 706182 - RNA, 23 nt, Human
ccccgaaucagggguuuaccaag

SEQ ID NO: 706183 - RNA, 18 nt, Human
cccgcaggggucccgggg

SEQ ID NO: 706184 - RNA, 20 nt, Human
ccgcacugugaaagugaaac

SEQ ID NO: 706185 - RNA, 21 nt, Human
ccucuaauccaaaagaagcuu

SEQ ID NO: 706186 - RNA, 19 nt, Human
cggacuccuuggaggugcu

SEQ ID NO: 706187 - RNA, 25 nt, Human
cuaauccaaaagaagcuuguaaccc

SEQ ID NO: 706188 - RNA, 18 nt, Human
cugacaguuugucccaag

SEQ ID NO: 706189 - RNA, 24 nt, Human
cugcaggagcuacccagggcaucc

SEQ ID NO: 706190 - RNA, 23 nt, Human
cuugaaaacugucuuuccucucu

SEQ ID NO: 706191 - RNA, 20 nt, Human
gccuagucccccaccccacc

SEQ ID NO: 706192 - RNA, 20 nt, Human
gcugacaguuugucccaagu

SEQ ID NO: 706193 - RNA, 21 nt, Human
ggagcuacccagggcauccag

SEQ ID NO: 706194 - RNA, 23 nt, Human
ggcaaaauagcaaaucacaacua

SEQ ID NO: 706195 - RNA, 26 nt, Human
uacacaguagagauacuuacagccaa

SEQ ID NO: 706196 - RNA, 22 nt, Human
uacuuacagccaaucagaucua

SEQ ID NO: 706197 - RNA, 19 nt, Human
uagcaaaucacaacuaguc

SEQ ID NO: 706198 - RNA, 21 nt, Human
ucaaaaaucccccucuaaucc

SEQ ID NO: 706199 - RNA, 20 nt, Human
uccaagaggguucuucugcu

SEQ ID NO: 706200 - RNA, 20 nt, Human
ucccaaaucguccaguccaa

SEQ ID NO: 706201 - RNA, 20 nt, Human
ucccaaguuuugaauuccca

SEQ ID NO: 706202 - RNA, 18 nt, Human
ucccaucaaaaauccccc

SEQ ID NO: 706203 - RNA, 21 nt, Human
ucccaucaaaaaucccccucu

SEQ ID NO: 706204 - RNA, 19 nt, Human
uccuaagcauucggcagcc

SEQ ID NO: 706205 - RNA, 21 nt, Human
ucuaagguugcuggcugaugg

SEQ ID NO: 706206 - RNA, 22 nt, Human
ucuagaaggacaaagcucuagg

SEQ ID NO: 706207 - RNA, 22 nt, Human
ugaaaacugucuuuccucucuc

SEQ ID NO: 706208 - RNA, 23 nt, Human
ugaauucccaaaucguccagucc

SEQ ID NO: 706209 - RNA, 20 nt, Human
uggcaagcauaucaucccgc

SEQ ID NO: 706210 - RNA, 21 nt, Human
uggugggugcaaaccacaggc

SEQ ID NO: 706211 - RNA, 22 nt, Human
ugugaaagugaaaccagacacu

SEQ ID NO: 706212 - RNA, 24 nt, Human
uugaaaacugucuuuccucucucu

SEQ ID NO: 706213 - RNA, 19 nt, Human
uuggaggugcugguuccgg

SEQ ID NO: 706214 - RNA, 23 nt, Human
aagccgcggggccgacccccuga

SEQ ID NO: 706215 - RNA, 21 nt, Human
accugcggguggccggggagu

SEQ ID NO: 706216 - RNA, 19 nt, Human
cagccccccaccccaagcc

SEQ ID NO: 706217 - RNA, 22 nt, Human
cagccccccaccccaagccgcc

SEQ ID NO: 706218 - RNA, 20 nt, Human
cccccugagggcugcgggcg

SEQ ID NO: 706219 - RNA, 21 nt, Human
ccccugagggcugcgggcgcc

SEQ ID NO: 706220 - RNA, 22 nt, Human
cccgccgcuguccagaggcgag

SEQ ID NO: 706221 - RNA, 18 nt, Human
cccgcugcagccccccac

SEQ ID NO: 706222 - RNA, 21 nt, Human
ccucggggcuccgcuccugcc

SEQ ID NO: 706223 - RNA, 22 nt, Human
ccugcggguggccggggagucc

SEQ ID NO: 706224 - RNA, 20 nt, Human
cgaauggagccgccggggcg

SEQ ID NO: 706225 - RNA, 22 nt, Human
cgccggcgccagcgcugagccc

SEQ ID NO: 706226 - RNA, 21 nt, Human
cgcgcgcgccgcucaccuccc

SEQ ID NO: 706227 - RNA, 22 nt, Human
cggcccgagggccccgcugcag

SEQ ID NO: 706228 - RNA, 23 nt, Human
cggcggccgccccgccgcugucc

SEQ ID NO: 706229 - RNA, 18 nt, Human
cggcggcgggggcggggc

SEQ ID NO: 706230 - RNA, 18 nt, Human
cucugugcaguccuccuc

SEQ ID NO: 706231 - RNA, 20 nt, Human
cugcagccccccaccccaag

SEQ ID NO: 706232 - RNA, 18 nt, Human
gccgccccgccgcugucc

SEQ ID NO: 706233 - RNA, 19 nt, Human
gcgccgcucaccucccucc

SEQ ID NO: 706234 - RNA, 20 nt, Human
gcgcgccgcucaccucccuc

SEQ ID NO: 706235 - RNA, 24 nt, Human
gcgcucccucggggcuccgcuccu

SEQ ID NO: 706236 - RNA, 20 nt, Human
gcggcgggggcggggccucu

SEQ ID NO: 706237 - RNA, 21 nt, Human
ggcccgggggucccugggcuc

SEQ ID NO: 706238 - RNA, 19 nt, Human
ggccucugugcaguccucc

SEQ ID NO: 706239 - RNA, 20 nt, Human
gggcccgcgcucccucgggg

SEQ ID NO: 706240 - RNA, 21 nt, Human
gggcggggccucugugcaguc

SEQ ID NO: 706241 - RNA, 18 nt, Human
gggggacuuucggcccga

SEQ ID NO: 706242 - RNA, 27 nt, Human
gguggccggggaguccucgccggcgcc

SEQ ID NO: 706243 - RNA, 26 nt, Human
guggccggggaguccucgccggcgcc

SEQ ID NO: 706244 - RNA, 23 nt, Human
uagcuccccgucuccggcgcucc

SEQ ID NO: 706245 - RNA, 22 nt, Human
ucccaagccgcggggccgaccc

SEQ ID NO: 706246 - RNA, 25 nt, Human
uccgcgcgcgccgcucaccucccuc

SEQ ID NO: 706247 - RNA, 30 nt, Human
uccgcgcgcgccgcucaccucccuccgcgg

SEQ ID NO: 706248 - RNA, 20 nt, Human
uccggcgcucccugcggccg

SEQ ID NO: 706249 - RNA, 22 nt, Human
uccggcgcucccugcggccgcg

SEQ ID NO: 706250 - RNA, 18 nt, Human
ucgcgccgccgacccucg

SEQ ID NO: 706251 - RNA, 22 nt, Human
ucgcgccgccgacccucgcgcc

SEQ ID NO: 706252 - RNA, 23 nt, Human
ugacgggggagcgcgccgucggg

SEQ ID NO: 706253 - RNA, 24 nt, Human
ugcagccccccaccccaagccgcc

SEQ ID NO: 706254 - RNA, 21 nt, Human
uguccagaggcgagaggcaaa

SEQ ID NO: 706255 - RNA, 23 nt, Human
aaguccagaaauccagagccaac

SEQ ID NO: 706256 - RNA, 18 nt, Human
agaaauccagagccaacc

SEQ ID NO: 706257 - RNA, 21 nt, Human
agacaggccugggcccugggc

SEQ ID NO: 706258 - RNA, 18 nt, Human
agaggagagcuggagacc

SEQ ID NO: 706259 - RNA, 21 nt, Human
agcugguggcugcugacccca

SEQ ID NO: 706260 - RNA, 19 nt, Human
aggaagccaaggggcccag

SEQ ID NO: 706261 - RNA, 22 nt, Human
agguggcuccccucacagaggg

SEQ ID NO: 706262 - RNA, 19 nt, Human
aucucaucugcccagccca

SEQ ID NO: 706263 - RNA, 23 nt, Human
caaggcaggaagccaaggggccc

SEQ ID NO: 706264 - RNA, 26 nt, Human
caccccagacaggccugggcccuggg

SEQ ID NO: 706265 - RNA, 18 nt, Human
cacgcuucauuaaaaagu

SEQ ID NO: 706266 - RNA, 25 nt, Human
cacgggccagguucuuccccucggg

SEQ ID NO: 706267 - RNA, 24 nt, Human
caucucaugccugcuggguuccac

SEQ ID NO: 706268 - RNA, 23 nt, Human
cauuaaaaaguccagaaauccag

SEQ ID NO: 706269 - RNA, 18 nt, Human
ccaaggcaggaagccaag

SEQ ID NO: 706270 - RNA, 22 nt, Human
ccaaggcaggaagccaaggggc

SEQ ID NO: 706271 - RNA, 22 nt, Human
ccagaaauccagagccaaccag

SEQ ID NO: 706272 - RNA, 20 nt, Human
cccagacaggccugggcccu

SEQ ID NO: 706273 - RNA, 23 nt, Human
cccagacaggccugggcccuggg

SEQ ID NO: 706274 - RNA, 20 nt, Human
ccccaccuccccacgggcca

SEQ ID NO: 706275 - RNA, 21 nt, Human
ccccagacaggccugggcccu

SEQ ID NO: 706276 - RNA, 21 nt, Human
cccccaccuccccacgggcca

SEQ ID NO: 706277 - RNA, 22 nt, Human
ccccccaccuccccacgggcca

SEQ ID NO: 706278 - RNA, 23 nt, Human
ccccccaccuccccacgggccag

SEQ ID NO: 706279 - RNA, 23 nt, Human
cccgcacccgccacguggcccca

SEQ ID NO: 706280 - RNA, 25 nt, Human
cccucugggcagcccuccucccaga

SEQ ID NO: 706281 - RNA, 21 nt, Human
cccucuuacugccgcugccgc

SEQ ID NO: 706282 - RNA, 21 nt, Human
ccgcaccccucugggcagccc

SEQ ID NO: 706283 - RNA, 21 nt, Human
ccgcugccgcugccgcugccu

SEQ ID NO: 706284 - RNA, 19 nt, Human
ccgcugccgcugccucugc

SEQ ID NO: 706285 - RNA, 21 nt, Human
ccucacagagggggagguugg

SEQ ID NO: 706286 - RNA, 18 nt, Human
ccuccugccuccuccccu

SEQ ID NO: 706287 - RNA, 21 nt, Human
ccucugggcagcccuccuccc

SEQ ID NO: 706288 - RNA, 20 nt, Human
ccugccuccuccccucccuc

SEQ ID NO: 706289 - RNA, 18 nt, Human
ccugggcccugggccagg

SEQ ID NO: 706290 - RNA, 23 nt, Human
cgcaccccucugggcagcccucc

SEQ ID NO: 706291 - RNA, 21 nt, Human
cggggcgccccaugcgcccuu

SEQ ID NO: 706292 - RNA, 21 nt, Human
cggucccccccaccuccccac

SEQ ID NO: 706293 - RNA, 22 nt, Human
cucccucuuacugccgcugcua

SEQ ID NO: 706294 - RNA, 23 nt, Human
cucugcuccgaaccccguagcuc

SEQ ID NO: 706295 - RNA, 22 nt, Human
cucuuacugccgcugccgcugc

SEQ ID NO: 706296 - RNA, 19 nt, Human
cugaccccaaggcaggaag

SEQ ID NO: 706297 - RNA, 26 nt, Human
cugaccccaaggcaggaagccaaggg

SEQ ID NO: 706298 - RNA, 21 nt, Human
gaaaguaggaucucaucugcc

SEQ ID NO: 706299 - RNA, 23 nt, Human
gaacaggcuuggcagcggucugg

SEQ ID NO: 706300 - RNA, 25 nt, Human
gaacaggcuuggcagcggucugggg

SEQ ID NO: 706301 - RNA, 23 nt, Human
gcagcagaaaagaccaccuugag

SEQ ID NO: 706302 - RNA, 24 nt, Human
gcagcagaaaagaccaccuugaga

SEQ ID NO: 706303 - RNA, 18 nt, Human
gcccucagguggcucccc

SEQ ID NO: 706304 - RNA, 20 nt, Human
gcccuccugccuccuccccu

SEQ ID NO: 706305 - RNA, 23 nt, Human
gccuccuccccucccucuuacug

SEQ ID NO: 706306 - RNA, 19 nt, Human
gccugcuggguuccacagc

SEQ ID NO: 706307 - RNA, 22 nt, Human
gcgcggccgggccggagggggc

SEQ ID NO: 706308 - RNA, 18 nt, Human
ggagagcuggagaccugg

SEQ ID NO: 706309 - RNA, 23 nt, Human
ggcccagguccucccugaguggu

SEQ ID NO: 706310 - RNA, 19 nt, Human
ggccggagggggcgcgcug

SEQ ID NO: 706311 - RNA, 19 nt, Human
gggaaggcuuggaaaaggg

SEQ ID NO: 706312 - RNA, 20 nt, Human
gggaggggccgcuagcgaca

SEQ ID NO: 706313 - RNA, 18 nt, Human
guccagaaauccagagcc

SEQ ID NO: 706314 - RNA, 22 nt, Human
uaaaaaguccagaaauccagag

SEQ ID NO: 706315 - RNA, 25 nt, Human
uagaggagagcuggagaccugggcg

SEQ ID NO: 706316 - RNA, 21 nt, Human
uagcagcagaaaagaccaccu

SEQ ID NO: 706317 - RNA, 21 nt, Human
uauccaaaagugagcccaggg

SEQ ID NO: 706318 - RNA, 23 nt, Human
ucaaggcgcggcgcuggggagcu

SEQ ID NO: 706319 - RNA, 23 nt, Human
ucagcgccguuucgguccccccc

SEQ ID NO: 706320 - RNA, 21 nt, Human
ucaucucaugccugcuggguu

SEQ ID NO: 706321 - RNA, 18 nt, Human
ucauuaaaaaguccagaa

SEQ ID NO: 706322 - RNA, 26 nt, Human
uccacagcccucagguggcuccccuc

SEQ ID NO: 706323 - RNA, 19 nt, Human
ucccccccaccuccccacg

SEQ ID NO: 706324 - RNA, 23 nt, Human
ucccccccaccuccccacgggcc

SEQ ID NO: 706325 - RNA, 20 nt, Human
ucucggcucggcucagcgcc

SEQ ID NO: 706326 - RNA, 22 nt, Human
ugaccccaaggcaggaagccaa

SEQ ID NO: 706327 - RNA, 20 nt, Human
ugagaccauguuguaauggg

SEQ ID NO: 706328 - RNA, 22 nt, Human
ugagcccaggguguuggggggu

SEQ ID NO: 706329 - RNA, 19 nt, Human
ugccgcugccucugcuccg

SEQ ID NO: 706330 - RNA, 26 nt, Human
ugccucugcuccgaaccccguagcuc

SEQ ID NO: 706331 - RNA, 20 nt, Human
uggcagcggucuggggucag

SEQ ID NO: 706332 - RNA, 23 nt, Human
uggggaaggcuuggaaaagggaa

SEQ ID NO: 706333 - RNA, 18 nt, Human
uggggucagggaaaggau

SEQ ID NO: 706334 - RNA, 20 nt, Human
uucggucccccccaccuccc

SEQ ID NO: 706335 - RNA, 19 nt, Human
uuggagcaguccaggcccu

SEQ ID NO: 706336 - RNA, 20 nt, Human
uuggcagcggucugggguca

SEQ ID NO: 706337 - RNA, 19 nt, Human
aaagugcugggauuacagg

SEQ ID NO: 706338 - RNA, 22 nt, Human
aaagugcugggauuacaggcga

SEQ ID NO: 706339 - RNA, 18 nt, Human
aagugcugggauuacagg

SEQ ID NO: 706340 - RNA, 19 nt, Human
aagugcugggauuacaggc

SEQ ID NO: 706341 - RNA, 24 nt, Human
aagugcugggauuacaggcgagcc

SEQ ID NO: 706342 - RNA, 19 nt, Human
acaggcgccugccaccacg

SEQ ID NO: 706343 - RNA, 19 nt, Human
acccaggcuggagugcagu

SEQ ID NO: 706344 - RNA, 23 nt, Human
acccaggcuggagugcaguggug

SEQ ID NO: 706345 - RNA, 25 nt, Human
accuugcccaccuucaguccccuca

SEQ ID NO: 706346 - RNA, 25 nt, Human
acucugucacccaggcuggagugca

SEQ ID NO: 706347 - RNA, 20 nt, Human
aguagaggugggguuucacc

SEQ ID NO: 706348 - RNA, 18 nt, Human
aguagcugggauuacagg

SEQ ID NO: 706349 - RNA, 20 nt, Human
agugcaguggugcggccucg

SEQ ID NO: 706350 - RNA, 23 nt, Human
agugcaguggugcggccucggcu

SEQ ID NO: 706351 - RNA, 24 nt, Human
agugcaguggugcggccucggcuc

SEQ ID NO: 706352 - RNA, 21 nt, Human
auucuccugccucagccuccc

SEQ ID NO: 706353 - RNA, 26 nt, Human
caaagugcugggauuacaggcgagcc

SEQ ID NO: 706354 - RNA, 18 nt, Human
caaccuccaccucccggg

SEQ ID NO: 706355 - RNA, 24 nt, Human
cacccaggcuggagugcaguggug

SEQ ID NO: 706356 - RNA, 18 nt, Human
caccguguuagccaggau

SEQ ID NO: 706357 - RNA, 22 nt, Human
caccguguuagccaggaugguc

SEQ ID NO: 706358 - RNA, 23 nt, Human
caccuucaguccccucauggugu

SEQ ID NO: 706359 - RNA, 21 nt, Human
caccuugcccaccuucagucc

SEQ ID NO: 706360 - RNA, 22 nt, Human
cacucugucacccaggcuggag

SEQ ID NO: 706361 - RNA, 23 nt, Human
cacucugucacccaggcuggagu

SEQ ID NO: 706362 - RNA, 21 nt, Human
caggcgccugccaccacgccc

SEQ ID NO: 706363 - RNA, 23 nt, Human
caggcgccugccaccacgcccgg

SEQ ID NO: 706364 - RNA, 26 nt, Human
caguagcugggauuacaggcgccugc

SEQ ID NO: 706365 - RNA, 28 nt, Human
caguccccucauggugucuuuaucuugg

SEQ ID NO: 706366 - RNA, 22 nt, Human
caugccauucuccugccucagc

SEQ ID NO: 706367 - RNA, 19 nt, Human
ccaaagugcugggauuaca

SEQ ID NO: 706368 - RNA, 22 nt, Human
ccaaagugcugggauuacaggc

SEQ ID NO: 706369 - RNA, 23 nt, Human
ccaaagugcugggauuacaggcg

SEQ ID NO: 706370 - RNA, 24 nt, Human
ccaagauccuuaacucucaccuuu

SEQ ID NO: 706371 - RNA, 24 nt, Human
ccaccuccccaagauccuuaacuc

SEQ ID NO: 706372 - RNA, 21 nt, Human
ccaguagcugggauuacaggc

SEQ ID NO: 706373 - RNA, 23 nt, Human
cccaguagcugggauuacaggcg

SEQ ID NO: 706374 - RNA, 23 nt, Human
ccccaguagcugggauuacaggc

SEQ ID NO: 706375 - RNA, 19 nt, Human
ccuccaccucccggguuca

SEQ ID NO: 706376 - RNA, 24 nt, Human
cucacucugucacccaggcuggag

SEQ ID NO: 706377 - RNA, 24 nt, Human
cucagccuccccaguagcugggau

SEQ ID NO: 706378 - RNA, 21 nt, Human
cucccggguucaugccauucu

SEQ ID NO: 706379 - RNA, 24 nt, Human
cucccugcaaccuccaccucccgg

SEQ ID NO: 706380 - RNA, 23 nt, Human
cuccugccucagccuccccagua

SEQ ID NO: 706381 - RNA, 18 nt, Human
cugcaaccuccaccuccc

SEQ ID NO: 706382 - RNA, 23 nt, Human
cugcaaccuccaccucccggguu

SEQ ID NO: 706383 - RNA, 24 nt, Human
cugcaaccuccaccucccggguuc

SEQ ID NO: 706384 - RNA, 22 nt, Human
cugccucagccuccccaguagc

SEQ ID NO: 706385 - RNA, 23 nt, Human
cugccucagccuccccaguagcu

SEQ ID NO: 706386 - RNA, 23 nt, Human
cugggauuacaggcgagccacug

SEQ ID NO: 706387 - RNA, 20 nt, Human
cuugcccaccuucagucccc

SEQ ID NO: 706388 - RNA, 18 nt, Human
gaggugggguuucaccgu

SEQ ID NO: 706389 - RNA, 24 nt, Human
gaggugggguuucaccguguuagc

SEQ ID NO: 706390 - RNA, 21 nt, Human
gauuacaggcgagccacugca

SEQ ID NO: 706391 - RNA, 18 nt, Human
gauuacaggcgccugcca

SEQ ID NO: 706392 - RNA, 23 nt, Human
gccucggccucccaaagugcugg

SEQ ID NO: 706393 - RNA, 18 nt, Human
gggguuucaccguguuag

SEQ ID NO: 706394 - RNA, 22 nt, Human
gggguuucaccguguuagccag

SEQ ID NO: 706395 - RNA, 22 nt, Human
ggguuucaccguguuagccagg

SEQ ID NO: 706396 - RNA, 18 nt, Human
guagcugggauuacaggc

SEQ ID NO: 706397 - RNA, 18 nt, Human
gugggguuucaccguguu

SEQ ID NO: 706398 - RNA, 19 nt, Human
gugggguuucaccguguua

SEQ ID NO: 706399 - RNA, 21 nt, Human
uacaggcgagccacugcaccc

SEQ ID NO: 706400 - RNA, 23 nt, Human
uacaggcgccugccaccacgccc

SEQ ID NO: 706401 - RNA, 21 nt, Human
uaguagaggugggguuucacc

SEQ ID NO: 706402 - RNA, 24 nt, Human
uaguagaggugggguuucaccgug

SEQ ID NO: 706403 - RNA, 26 nt, Human
uaguagaggugggguuucaccguguu

SEQ ID NO: 706404 - RNA, 24 nt, Human
ucacccaggcuggagugcaguggu

SEQ ID NO: 706405 - RNA, 24 nt, Human
ucaccguguuagccaggauggucu

SEQ ID NO: 706406 - RNA, 24 nt, Human
ucacucugucacccaggcuggagu

SEQ ID NO: 706407 - RNA, 18 nt, Human
ucagccuccccaguagcu

SEQ ID NO: 706408 - RNA, 20 nt, Human
ucagccuccccaguagcugg

SEQ ID NO: 706409 - RNA, 29 nt, Human
ucaguccccucauggugucuuuauccuac

SEQ ID NO: 706410 - RNA, 24 nt, Human
ucccaaagugcugggauuacaggc

SEQ ID NO: 706411 - RNA, 22 nt, Human
uccccaagauccuuaacucuca

SEQ ID NO: 706412 - RNA, 24 nt, Human
uccccaguagcugggauuacaggc

SEQ ID NO: 706413 - RNA, 21 nt, Human
ucccggguucaugccauucuc

SEQ ID NO: 706414 - RNA, 24 nt, Human
ucccggguucaugccauucuccug

SEQ ID NO: 706415 - RNA, 24 nt, Human
ucccugcaaccuccaccucccggg

SEQ ID NO: 706416 - RNA, 18 nt, Human
ucggccucccaaagugcu

SEQ ID NO: 706417 - RNA, 23 nt, Human
ucucacucugucacccaggcugg

SEQ ID NO: 706418 - RNA, 24 nt, Human
ucucacucugucacccaggcugga

SEQ ID NO: 706419 - RNA, 26 nt, Human
ucucacucugucacccaggcuggagu

SEQ ID NO: 706420 - RNA, 27 nt, Human
ucucacucugucacccaggcuggagug

SEQ ID NO: 706421 - RNA, 24 nt, Human
ucugucacccaggcuggagugcag

SEQ ID NO: 706422 - RNA, 20 nt, Human
ugaguuggagucucacucug

SEQ ID NO: 706423 - RNA, 23 nt, Human
ugauccgcccgccucggccuccc

SEQ ID NO: 706424 - RNA, 22 nt, Human
ugcaguggugcggccucggcuc

SEQ ID NO: 706425 - RNA, 19 nt, Human
ugccaccacgcccggcuau

SEQ ID NO: 706426 - RNA, 24 nt, Human
ugccucagccuccccaguagcugg

SEQ ID NO: 706427 - RNA, 22 nt, Human
ugcugggauuacaggcgagcca

SEQ ID NO: 706428 - RNA, 18 nt, Human
uggagugcaguggugcgg

SEQ ID NO: 706429 - RNA, 22 nt, Human
uggagugcaguggugcggccuc

SEQ ID NO: 706430 - RNA, 24 nt, Human
uggagugcaguggugcggccucgg

SEQ ID NO: 706431 - RNA, 20 nt, Human
ugggauuacaggcgagccac

SEQ ID NO: 706432 - RNA, 21 nt, Human
ugggauuacaggcgagccacu

SEQ ID NO: 706433 - RNA, 21 nt, Human
ugggauuacaggcgccugcca

SEQ ID NO: 706434 - RNA, 22 nt, Human
ugggauuacaggcgccugccac

SEQ ID NO: 706435 - RNA, 24 nt, Human
ugggauuacaggcgccugccacca

SEQ ID NO: 706436 - RNA, 24 nt, Human
ugggguuucaccguguuagccagg

SEQ ID NO: 706437 - RNA, 18 nt, Human
uuaguagaggugggguuu

SEQ ID NO: 706438 - RNA, 22 nt, Human
uuaguagaggugggguuucacc

SEQ ID NO: 706439 - RNA, 24 nt, Human
uuaguagaggugggguuucaccgu

SEQ ID NO: 706440 - RNA, 19 nt, Human
uucaugccauucuccugcc

SEQ ID NO: 706441 - RNA, 19 nt, Human
uuucaccguguuagccagg

SEQ ID NO: 706442 - RNA, 31 nt, Human
uuuuuaauuuuaguagaggugggguuucacc

SEQ ID NO: 706443 - RNA, 19 nt, Human
uuuuuuaauuuuaguagag

SEQ ID NO: 706444 - RNA, 26 nt, Human
uuuuuuuuuuuugaguuggagucuca

SEQ ID NO: 706445 - RNA, 22 nt, Human
uuuuuuuuuuuuuugaguugga

SEQ ID NO: 706446 - RNA, 23 nt, Human
uuuuuuuuuuuuuuuugaguugg

SEQ ID NO: 706447 - RNA, 18 nt, Human
uuuuuuuuuuuuuuuuug

SEQ ID NO: 706448 - RNA, 23 nt, Human
aaaaaggaaaacagccauuaaaa

SEQ ID NO: 706449 - RNA, 22 nt, Human
aauagaaaaaggaaaacagcca

SEQ ID NO: 706450 - RNA, 20 nt, Human
accuugugagccccugaguc

SEQ ID NO: 706451 - RNA, 20 nt, Human
agagaggauuuaaauagaaa

SEQ ID NO: 706452 - RNA, 18 nt, Human
agcaguaaauaggagucu

SEQ ID NO: 706453 - RNA, 19 nt, Human
aguaaauaguacaaaauga

SEQ ID NO: 706454 - RNA, 23 nt, Human
auccaugaacaguuuuaucccuu

SEQ ID NO: 706455 - RNA, 23 nt, Human
caguuuuaucccuugguuucuua

SEQ ID NO: 706456 - RNA, 21 nt, Human
caugugauuuaaaaaauaaaa

SEQ ID NO: 706457 - RNA, 23 nt, Human
cucgguuagagcccaggccagcg

SEQ ID NO: 706458 - RNA, 21 nt, Human
gaaaacagccauuaaaagcac

SEQ ID NO: 706459 - RNA, 22 nt, Human
uaaaagcaguaaauaggagucu

SEQ ID NO: 706460 - RNA, 23 nt, Human
uaaauagaaaaaggaaaacagcc

SEQ ID NO: 706461 - RNA, 24 nt, Human
uaaggugccgugagaugcuggcag

SEQ ID NO: 706462 - RNA, 18 nt, Human
uauguauauuuacauccu

SEQ ID NO: 706463 - RNA, 19 nt, Human
uccucgguuagagcccagg

SEQ ID NO: 706464 - RNA, 19 nt, Human
ucuggaguucucccgggau

SEQ ID NO: 706465 - RNA, 22 nt, Human
ugagccccugagucaagacccu

SEQ ID NO: 706466 - RNA, 18 nt, Human
ugccgugagaugcuggca

SEQ ID NO: 706467 - RNA, 24 nt, Human
ugccgugagaugcuggcaguuuua

SEQ ID NO: 706468 - RNA, 19 nt, Human
uuagagcccaggccagcgc

SEQ ID NO: 706469 - RNA, 18 nt, Human
aaaaagaaaaauacaucg

SEQ ID NO: 706470 - RNA, 23 nt, Human
aaaaccuuugccauacuucacaa

SEQ ID NO: 706471 - RNA, 22 nt, Human
aaagagaacuccagaaugugaa

SEQ ID NO: 706472 - RNA, 19 nt, Human
aaaguuuguccagaaggau

SEQ ID NO: 706473 - RNA, 18 nt, Human
aacugcaugcagaaaaaa

SEQ ID NO: 706474 - RNA, 28 nt, Human
aagcuuuuuuuuuaccaaaaugaaaaga

SEQ ID NO: 706475 - RNA, 18 nt, Human
aaggauggagggagaaag

SEQ ID NO: 706476 - RNA, 18 nt, Human
aauaaagagaacuccaga

SEQ ID NO: 706477 - RNA, 24 nt, Human
acaaaaagaaaaauacaucagcag

SEQ ID NO: 706478 - RNA, 22 nt, Human
acagcauggaggugguucugcc

SEQ ID NO: 706479 - RNA, 18 nt, Human
agaaaacauucauuucuu

SEQ ID NO: 706480 - RNA, 19 nt, Human
agcucagaagucuuggcuc

SEQ ID NO: 706481 - RNA, 23 nt, Human
agcuuugcucagucuucaugccc

SEQ ID NO: 706482 - RNA, 20 nt, Human
aggauggagggagaaaggga

SEQ ID NO: 706483 - RNA, 29 nt, Human
aggcaaaaaggcaaacuaaaagggacccc

SEQ ID NO: 706484 - RNA, 24 nt, Human
agggagaaagggagagaguuccag

SEQ ID NO: 706485 - RNA, 19 nt, Human
aggugguucugccuuuccc

SEQ ID NO: 706486 - RNA, 21 nt, Human
auaaagagaacuccagaaugu

SEQ ID NO: 706487 - RNA, 22 nt, Human
augcagaaaaaaugggggauuc

SEQ ID NO: 706488 - RNA, 20 nt, Human
auuacucccacaaguuauag

SEQ ID NO: 706489 - RNA, 22 nt, Human
cacaaaagccacaugggacaaa

SEQ ID NO: 706490 - RNA, 20 nt, Human
cacccagguuuucucccuca

SEQ ID NO: 706491 - RNA, 20 nt, Human
cacugggaaaggacacaccc

SEQ ID NO: 706492 - RNA, 22 nt, Human
cagaaugugaacccaauauauc

SEQ ID NO: 706493 - RNA, 20 nt, Human
cagcaggagcugugcacucc

SEQ ID NO: 706494 - RNA, 21 nt, Human
cagcaggagcugugcacuccu

SEQ ID NO: 706495 - RNA, 19 nt, Human
cagcaucugaauuugccug

SEQ ID NO: 706496 - RNA, 19 nt, Human
cagccgccccggcuguggc

SEQ ID NO: 706497 - RNA, 20 nt, Human
cauuuggggauuuccacuag

SEQ ID NO: 706498 - RNA, 23 nt, Human
ccaaaaugaaaagaaaacauuca

SEQ ID NO: 706499 - RNA, 21 nt, Human
cccaaaauguccaagacaauu

SEQ ID NO: 706500 - RNA, 23 nt, Human
cccauuuuggauucuugagcaac

SEQ ID NO: 706501 - RNA, 18 nt, Human
cccuauguccacagaccc

SEQ ID NO: 706502 - RNA, 18 nt, Human
cccuauguccacagaccc

SEQ ID NO: 706503 - RNA, 22 nt, Human
cgagcaggggaaguggaaggau

SEQ ID NO: 706504 - RNA, 19 nt, Human
cuagauggagccucucuau

SEQ ID NO: 706505 - RNA, 20 nt, Human
cuaggagaugacaugcagug

SEQ ID NO: 706506 - RNA, 21 nt, Human
gacggcggggccgagcagggg

SEQ ID NO: 706507 - RNA, 18 nt, Human
gagaaggggaaccugaug

SEQ ID NO: 706508 - RNA, 19 nt, Human
gagcaacaaaauacgauac

SEQ ID NO: 706509 - RNA, 23 nt, Human
gauggagggagaaagggagagag

SEQ ID NO: 706510 - RNA, 22 nt, Human
gcaacaaaauacgauaccuaga

SEQ ID NO: 706511 - RNA, 23 nt, Human
gcagaaaaaaugggggauuccuu

SEQ ID NO: 706512 - RNA, 20 nt, Human
gcaggauucccagcuuugcu

SEQ ID NO: 706513 - RNA, 24 nt, Human
gcaugcagaaaaaaugggggauuc

SEQ ID NO: 706514 - RNA, 19 nt, Human
gccaagaagggagaagggg

SEQ ID NO: 706515 - RNA, 25 nt, Human
gccaagaagggagaaggggaaccug

SEQ ID NO: 706516 - RNA, 23 nt, Human
gcuaaccacuggccaccagcucu

SEQ ID NO: 706517 - RNA, 22 nt, Human
ggagcugugcacuccugaggcc

SEQ ID NO: 706518 - RNA, 20 nt, Human
gggaaaggacacacccaggu

SEQ ID NO: 706519 - RNA, 24 nt, Human
gggacccggccugacggcggggcc

SEQ ID NO: 706520 - RNA, 26 nt, Human
gggggacccggccugacggcggggcc

SEQ ID NO: 706521 - RNA, 18 nt, Human
guccauguuuuuauuuca

SEQ ID NO: 706522 - RNA, 21 nt, Human
gugguucugccuuucccuggc

SEQ ID NO: 706523 - RNA, 21 nt, Human
uaacuguguaaucucugaggc

SEQ ID NO: 706524 - RNA, 20 nt, Human
uaaucucugaggcuuccccu

SEQ ID NO: 706525 - RNA, 20 nt, Human
uacauggcaaauaacgugcg

SEQ ID NO: 706526 - RNA, 19 nt, Human
uaccaaagucugucaaaca

SEQ ID NO: 706527 - RNA, 21 nt, Human
uagaaauuguuugcuacagca

SEQ ID NO: 706528 - RNA, 23 nt, Human
uauguccacagacccauuuugga

SEQ ID NO: 706529 - RNA, 19 nt, Human
ucccaaaauguccaagaca

SEQ ID NO: 706530 - RNA, 20 nt, Human
ucccuggcuccucacacucu

SEQ ID NO: 706531 - RNA, 23 nt, Human
ucccuggcuccucacacucuuuc

SEQ ID NO: 706532 - RNA, 19 nt, Human
ucuaaaacauaaaauaaga

SEQ ID NO: 706533 - RNA, 19 nt, Human
ucugccuuucccuggcucc

SEQ ID NO: 706534 - RNA, 18 nt, Human
ucugcuggcacaacggac

SEQ ID NO: 706535 - RNA, 18 nt, Human
ugaaaagaaaacauucau

SEQ ID NO: 706536 - RNA, 21 nt, Human
ugacggcagggaagggggacc

SEQ ID NO: 706537 - RNA, 19 nt, Human
ugagcaacaaaauacgaua

SEQ ID NO: 706538 - RNA, 21 nt, Human
ugaggcuuccccugagauuua

SEQ ID NO: 706539 - RNA, 21 nt, Human
ugcaggauucccagcuuugcu

SEQ ID NO: 706540 - RNA, 18 nt, Human
uggauuguuaccaaaguc

SEQ ID NO: 706541 - RNA, 20 nt, Human
uggcagagccuagauggagc

SEQ ID NO: 706542 - RNA, 20 nt, Human
ugguucugccuuucccuggc

SEQ ID NO: 706543 - RNA, 19 nt, Human
uguaaaagaaaagcacugg

SEQ ID NO: 706544 - RNA, 25 nt, Human
ugugaacccaauauaucuucccaaa

SEQ ID NO: 706545 - RNA, 18 nt, Human
uguuaaaacagcaagcuu

SEQ ID NO: 706546 - RNA, 21 nt, Human
uguuaaaacagcaagcuuuuu

SEQ ID NO: 706547 - RNA, 24 nt, Human
uucacaaaaagaaaaauacaucag

SEQ ID NO: 706548 - RNA, 21 nt, Human
uucaggaauaacaaucaggca

SEQ ID NO: 706549 - RNA, 18 nt, Human
uucauuaacaaaauauga

SEQ ID NO: 706550 - RNA, 23 nt, Human
uucucccucacuuugagccccaa

SEQ ID NO: 706551 - RNA, 18 nt, Human
uuuuuuuuuuuguguguu

SEQ ID NO: 706552 - RNA, 18 nt, Human
uuuuuuuuuuuuuuuuug

SEQ ID NO: 706553 - RNA, 24 nt, Human
uuuuuuuuuuuuuuuuuguguguu

SEQ ID NO: 706554 - RNA, 21 nt, Human
aaaucuguccuagacucaccg

SEQ ID NO: 706555 - RNA, 18 nt, Human
aacuggaaccagcaaaau

SEQ ID NO: 706556 - RNA, 25 nt, Human
aacuugcuuccccagaggcagucua

SEQ ID NO: 706557 - RNA, 22 nt, Human
aagcacugcuuauucucuuggc

SEQ ID NO: 706558 - RNA, 23 nt, Human
aaggguucucaggagggagcaca

SEQ ID NO: 706559 - RNA, 19 nt, Human
aaucuagaacugccagucu

SEQ ID NO: 706560 - RNA, 21 nt, Human
aauggacaacucuguaucccu

SEQ ID NO: 706561 - RNA, 21 nt, Human
acagaaucucaacuaaugagc

SEQ ID NO: 706562 - RNA, 18 nt, Human
acaggucuuuuuuuuuuu

SEQ ID NO: 706563 - RNA, 18 nt, Human
acccccuccacuuggccu

SEQ ID NO: 706564 - RNA, 23 nt, Human
acucugugaucagucuacagcca

SEQ ID NO: 706565 - RNA, 20 nt, Human
acuuuaaaaaaaaacaaccc

SEQ ID NO: 706566 - RNA, 22 nt, Human
agaaacauuacucuuuaguuuc

SEQ ID NO: 706567 - RNA, 22 nt, Human
agcacugccaagcaguccaccu

SEQ ID NO: 706568 - RNA, 21 nt, Human
auugccacugcuuccuugacu

SEQ ID NO: 706569 - RNA, 23 nt, Human
caaacuggaaccagcaaaaucuc

SEQ ID NO: 706570 - RNA, 24 nt, Human
caacuccauugggcaaacuggaac

SEQ ID NO: 706571 - RNA, 25 nt, Human
caccagugcuugccucuguggucaa

SEQ ID NO: 706572 - RNA, 23 nt, Human
caccccccuccccuagcaaaagc

SEQ ID NO: 706573 - RNA, 22 nt, Human
cacccccuuucacaguugggga

SEQ ID NO: 706574 - RNA, 21 nt, Human
caccucagccccgugaggcag

SEQ ID NO: 706575 - RNA, 19 nt, Human
cauuccauaaccuucccuc

SEQ ID NO: 706576 - RNA, 26 nt, Human
ccaaagccaacgggaaccuucacccc

SEQ ID NO: 706577 - RNA, 20 nt, Human
ccacaggucuuuuuuuuuuu

SEQ ID NO: 706578 - RNA, 20 nt, Human
ccaccuagucauuuacccag

SEQ ID NO: 706579 - RNA, 19 nt, Human
ccaggucaggccagaaaug

SEQ ID NO: 706580 - RNA, 19 nt, Human
ccaugagcuggccaggccc

SEQ ID NO: 706581 - RNA, 18 nt, Human
cccaggcuggcugcgacu

SEQ ID NO: 706582 - RNA, 20 nt, Human
ccccagaggcagucuauacc

SEQ ID NO: 706583 - RNA, 23 nt, Human
cccccaaccugcuuggccgcuca

SEQ ID NO: 706584 - RNA, 19 nt, Human
cccccuccccuagcaaaag

SEQ ID NO: 706585 - RNA, 19 nt, Human
cccugugcccuacaggguc

SEQ ID NO: 706586 - RNA, 23 nt, Human
cccugugcccuacagggucucac

SEQ ID NO: 706587 - RNA, 22 nt, Human
ccuccagucccaccucagcccc

SEQ ID NO: 706588 - RNA, 23 nt, Human
ccuccaucuugcuaccuugggga

SEQ ID NO: 706589 - RNA, 21 nt, Human
cuagaaacauuacucuuuagu

SEQ ID NO: 706590 - RNA, 22 nt, Human
cuccuagcacugccaagcaguc

SEQ ID NO: 706591 - RNA, 23 nt, Human
cucgaaauccuccagucccaccu

SEQ ID NO: 706592 - RNA, 24 nt, Human
cucgaaauccuccagucccaccuc

SEQ ID NO: 706593 - RNA, 23 nt, Human
cugaaguccugaguccaccuccu

SEQ ID NO: 706594 - RNA, 21 nt, Human
cugcggccaacauggcccagc

SEQ ID NO: 706595 - RNA, 19 nt, Human
cuggaaccagcaaaaucuc

SEQ ID NO: 706596 - RNA, 24 nt, Human
cuucaccagggggccaucugcggc

SEQ ID NO: 706597 - RNA, 22 nt, Human
gaguccaccuccuagcacugcc

SEQ ID NO: 706598 - RNA, 22 nt, Human
gcccucgaaauccuccaguccc

SEQ ID NO: 706599 - RNA, 21 nt, Human
ggcauuacagaaccacaagaa

SEQ ID NO: 706600 - RNA, 18 nt, Human
ggccagaaauguugcuuc

SEQ ID NO: 706601 - RNA, 21 nt, Human
ggcccagcucccaggcuggcu

SEQ ID NO: 706602 - RNA, 25 nt, Human
gggcaccccccuccccuagcaaaag

SEQ ID NO: 706603 - RNA, 18 nt, Human
gggcaggcgcccccaacc

SEQ ID NO: 706604 - RNA, 20 nt, Human
gucuuuuuuuuuuuuuugga

SEQ ID NO: 706605 - RNA, 22 nt, Human
gugcucuacagccagaaguugg

SEQ ID NO: 706606 - RNA, 19 nt, Human
guuggguccuaagccuuuc

SEQ ID NO: 706607 - RNA, 23 nt, Human
uaaaaaaaaacaacccacccagu

SEQ ID NO: 706608 - RNA, 25 nt, Human
uagaaucauugagauucucaacucc

SEQ ID NO: 706609 - RNA, 21 nt, Human
ucacagaaucucaacuaauga

SEQ ID NO: 706610 - RNA, 21 nt, Human
ucagggcaccccccuccccua

SEQ ID NO: 706611 - RNA, 25 nt, Human
ucccaccucagccccgugaggcaga

SEQ ID NO: 706612 - RNA, 19 nt, Human
uccccauauagaggaaucu

SEQ ID NO: 706613 - RNA, 21 nt, Human
uccccuagcaaaagcagggcg

SEQ ID NO: 706614 - RNA, 20 nt, Human
ucccuggagccuucauuccu

SEQ ID NO: 706615 - RNA, 21 nt, Human
ucuagaauugccacugcuucc

SEQ ID NO: 706616 - RNA, 22 nt, Human
ucuccacguaaaaucuguccua

SEQ ID NO: 706617 - RNA, 18 nt, Human
ucugcggccaacauggcc

SEQ ID NO: 706618 - RNA, 21 nt, Human
ucuuuccuucccagaguucug

SEQ ID NO: 706619 - RNA, 23 nt, Human
ucuuuuuuuuuuuuuuggucuuu

SEQ ID NO: 706620 - RNA, 25 nt, Human
ugccagggggaaugcugguuggguc

SEQ ID NO: 706621 - RNA, 27 nt, Human
ugcuuauucucuuggcugggugcucua

SEQ ID NO: 706622 - RNA, 18 nt, Human
uggacaacucuguauccc

SEQ ID NO: 706623 - RNA, 21 nt, Human
uggagccuucauuccuuuugg

SEQ ID NO: 706624 - RNA, 25 nt, Human
uggccaggcccccgcagugccaggg

SEQ ID NO: 706625 - RNA, 26 nt, Human
uggccaggcccccgcagugccagggg

SEQ ID NO: 706626 - RNA, 19 nt, Human
uggcccagcucccaggcug

SEQ ID NO: 706627 - RNA, 22 nt, Human
uggcugaguugagaagcaacac

SEQ ID NO: 706628 - RNA, 23 nt, Human
uggguccuaagccuuucuuuccu

SEQ ID NO: 706629 - RNA, 21 nt, Human
ugucuacuucccaaagccaac

SEQ ID NO: 706630 - RNA, 22 nt, Human
uuaccaccuagucauuuaccca

SEQ ID NO: 706631 - RNA, 21 nt, Human
uucaaagcacugcuuauucuc

SEQ ID NO: 706632 - RNA, 18 nt, Human
uucccuuguccacuaauu

SEQ ID NO: 706633 - RNA, 23 nt, Human
uuccuuuuggcauuacagaacca

SEQ ID NO: 706634 - RNA, 18 nt, Human
uugcuaccuuggggaagg

SEQ ID NO: 706635 - RNA, 21 nt, Human
uuggucuuuggucaaucaaga

SEQ ID NO: 706636 - RNA, 20 nt, Human
uuuccuucccagaguucugg

SEQ ID NO: 706637 - RNA, 21 nt, Human
uuucuuuccuucccagaguuc

SEQ ID NO: 706638 - RNA, 19 nt, Human
agacacacacaccaaaaaa

SEQ ID NO: 706639 - RNA, 19 nt, Human
agccaaagcaaaccagaau

SEQ ID NO: 706640 - RNA, 23 nt, Human
agccuugugguucuaccaagguc

SEQ ID NO: 706641 - RNA, 20 nt, Human
aggcauguaagauccagugg

SEQ ID NO: 706642 - RNA, 24 nt, Human
cggugaagacacacacaccaaaaa

SEQ ID NO: 706643 - RNA, 18 nt, Human
cuccagugcuucugcuuu

SEQ ID NO: 706644 - RNA, 18 nt, Human
cugucuacugacaugcag

SEQ ID NO: 706645 - RNA, 23 nt, Human
gagugagccaaagcaaaccagaa

SEQ ID NO: 706646 - RNA, 20 nt, Human
ggaagugggggguacagagg

SEQ ID NO: 706647 - RNA, 24 nt, Human
uaaaaagcgagugagccaaagcaa

SEQ ID NO: 706648 - RNA, 21 nt, Human
uaaaguaacuauuccagagaa

SEQ ID NO: 706649 - RNA, 21 nt, Human
ucucugggagccuugugguuc

SEQ ID NO: 706650 - RNA, 19 nt, Human
ugaggagagaugggugucu

SEQ ID NO: 706651 - RNA, 23 nt, Human
uggaguggaagugggggguacag

SEQ ID NO: 706652 - RNA, 21 nt, Human
ugggugucucugggagccuug

SEQ ID NO: 706653 - RNA, 25 nt, Human
uguaagauccagugguuuguaaaaa

SEQ ID NO: 706654 - RNA, 24 nt, Human
uguccuguugcuggcgcaggagca

SEQ ID NO: 706655 - RNA, 19 nt, Human
ugucuacugacaugcagag

SEQ ID NO: 706656 - RNA, 23 nt, Human
uguugcuggcgcaggagcauggg

SEQ ID NO: 706657 - RNA, 21 nt, Human
aaaucaggaccccucccuucc

SEQ ID NO: 706658 - RNA, 18 nt, Human
aacaaaugugaaggucaa

SEQ ID NO: 706659 - RNA, 26 nt, Human
aacccacuuucuagaucucucuccug

SEQ ID NO: 706660 - RNA, 18 nt, Human
aagaaaauagcuaucccu

SEQ ID NO: 706661 - RNA, 19 nt, Human
aagcccuccaggugauucc

SEQ ID NO: 706662 - RNA, 18 nt, Human
aauguccacuccacaugg

SEQ ID NO: 706663 - RNA, 20 nt, Human
acaccgccccccccacgggc

SEQ ID NO: 706664 - RNA, 25 nt, Human
acccggccccacccuccauuucccu

SEQ ID NO: 706665 - RNA, 22 nt, Human
acccugguuuggggcuguaucu

SEQ ID NO: 706666 - RNA, 23 nt, Human
acccugguuuggggcuguaucug

SEQ ID NO: 706667 - RNA, 19 nt, Human
accucucucucucucuucc

SEQ ID NO: 706668 - RNA, 18 nt, Human
acucugcuccccaagcca

SEQ ID NO: 706669 - RNA, 20 nt, Human
agcacauuuccaggggcuuu

SEQ ID NO: 706670 - RNA, 20 nt, Human
agccugggcuucgggucccg

SEQ ID NO: 706671 - RNA, 21 nt, Human
aggcggcgucggggguccugg

SEQ ID NO: 706672 - RNA, 18 nt, Human
agguuuuugaauguccac

SEQ ID NO: 706673 - RNA, 19 nt, Human
augugaaugacugugcccc

SEQ ID NO: 706674 - RNA, 21 nt, Human
auucacaccuugcugagcccc

SEQ ID NO: 706675 - RNA, 22 nt, Human
auucuguccauccauccacuca

SEQ ID NO: 706676 - RNA, 21 nt, Human
cacacauaaaaccccacccuu

SEQ ID NO: 706677 - RNA, 18 nt, Human
cacacuccccuacccucc

SEQ ID NO: 706678 - RNA, 20 nt, Human
cacagguucucaaagugugg

SEQ ID NO: 706679 - RNA, 20 nt, Human
cacauaaaaccccacccuuc

SEQ ID NO: 706680 - RNA, 18 nt, Human
caccacagguagauuccu

SEQ ID NO: 706681 - RNA, 20 nt, Human
caccaccuccgauaugcagu

SEQ ID NO: 706682 - RNA, 21 nt, Human
cacccacacuccccuacccuc

SEQ ID NO: 706683 - RNA, 22 nt, Human
cacccacacuccccuacccucc

SEQ ID NO: 706684 - RNA, 19 nt, Human
cacccccuccacuugucac

SEQ ID NO: 706685 - RNA, 21 nt, Human
caccgccccccccacgggccc

SEQ ID NO: 706686 - RNA, 24 nt, Human
caccgccccccccacgggcccccc

SEQ ID NO: 706687 - RNA, 18 nt, Human
cagcagagaccccugggg

SEQ ID NO: 706688 - RNA, 18 nt, Human
cagcuuccagacaccccc

SEQ ID NO: 706689 - RNA, 19 nt, Human
caugugcccaucuuggucc

SEQ ID NO: 706690 - RNA, 21 nt, Human
ccaaaguuaaacucuucagcu

SEQ ID NO: 706691 - RNA, 20 nt, Human
ccacacauaaaaccccaccc

SEQ ID NO: 706692 - RNA, 24 nt, Human
ccacucaugaacaaaugugaaggu

SEQ ID NO: 706693 - RNA, 23 nt, Human
ccacuuucuagaucucucuccug

SEQ ID NO: 706694 - RNA, 21 nt, Human
cccacacuccccuacccucca

SEQ ID NO: 706695 - RNA, 23 nt, Human
cccagaaccucucucucucucuu

SEQ ID NO: 706696 - RNA, 18 nt, Human
cccauccaacccccaaaa

SEQ ID NO: 706697 - RNA, 20 nt, Human
cccauccaacccccaaaagu

SEQ ID NO: 706698 - RNA, 24 nt, Human
cccauccaacccccaaaaguccau

SEQ ID NO: 706699 - RNA, 18 nt, Human
cccaucuugguccggcuc

SEQ ID NO: 706700 - RNA, 22 nt, Human
ccccaagccaugcacccugguu

SEQ ID NO: 706701 - RNA, 22 nt, Human
ccccaaggacacacugcuuucc

SEQ ID NO: 706702 - RNA, 18 nt, Human
ccccacccuccauuuccc

SEQ ID NO: 706703 - RNA, 22 nt, Human
ccccacccuccauuucccugaa

SEQ ID NO: 706704 - RNA, 18 nt, Human
ccccacgggccccccgaa

SEQ ID NO: 706705 - RNA, 31 nt, Human
ccccccacgggccccccgaagggugggagcu

SEQ ID NO: 706706 - RNA, 21 nt, Human
cccccccacgggccccccgaa

SEQ ID NO: 706707 - RNA, 24 nt, Human
ccccgcucugccugcuucccugaa

SEQ ID NO: 706708 - RNA, 23 nt, Human
ccccuacccuccaccacccgagg

SEQ ID NO: 706709 - RNA, 21 nt, Human
ccccugacaccgcccccccca

SEQ ID NO: 706710 - RNA, 21 nt, Human
ccccugggggguggcguccau

SEQ ID NO: 706711 - RNA, 25 nt, Human
ccccuuauuuugaggacaggaacug

SEQ ID NO: 706712 - RNA, 22 nt, Human
cccggccccacccuccauuucc

SEQ ID NO: 706713 - RNA, 20 nt, Human
cccugacaccgcccccccca

SEQ ID NO: 706714 - RNA, 25 nt, Human
cccuuucccacacauaaaaccccac

SEQ ID NO: 706715 - RNA, 22 nt, Human
ccgccccccccacgggcccccc

SEQ ID NO: 706716 - RNA, 24 nt, Human
ccuaugccuuacacuggccccagc

SEQ ID NO: 706717 - RNA, 18 nt, Human
ccuccauuucccugaaau

SEQ ID NO: 706718 - RNA, 22 nt, Human
ccuccuccuccuccaccaccuc

SEQ ID NO: 706719 - RNA, 23 nt, Human
ccugcucagcuuccagacacccc

SEQ ID NO: 706720 - RNA, 20 nt, Human
ccuggaggggagcacgugga

SEQ ID NO: 706721 - RNA, 19 nt, Human
ccuguaagaucucacucca

SEQ ID NO: 706722 - RNA, 22 nt, Human
ccuuacacuggccccagccuuc

SEQ ID NO: 706723 - RNA, 20 nt, Human
cgacuuccaaguauucacuu

SEQ ID NO: 706724 - RNA, 19 nt, Human
cggcagcagagaccccugg

SEQ ID NO: 706725 - RNA, 28 nt, Human
cuacagguuaguggcagcccugagugga

SEQ ID NO: 706726 - RNA, 24 nt, Human
cucacuccacuguaagaaaauagc

SEQ ID NO: 706727 - RNA, 18 nt, Human
cucagcuuccagacaccc

SEQ ID NO: 706728 - RNA, 20 nt, Human
cuccuccuccaccaccuccc

SEQ ID NO: 706729 - RNA, 21 nt, Human
cucucucuuccugccugugcc

SEQ ID NO: 706730 - RNA, 21 nt, Human
cugccaccugccgcgcgucgc

SEQ ID NO: 706731 - RNA, 21 nt, Human
cugcuaccaucuucccaucca

SEQ ID NO: 706732 - RNA, 22 nt, Human
cuggcccuuccuccccagaacc

SEQ ID NO: 706733 - RNA, 26 nt, Human
cugggcuucgggucccuuuccuccgg

SEQ ID NO: 706734 - RNA, 24 nt, Human
cuucccauccaacccccaaaaguc

SEQ ID NO: 706735 - RNA, 20 nt, Human
cuuucccaggccccucucca

SEQ ID NO: 706736 - RNA, 23 nt, Human
gacacccccuccacuugucacug

SEQ ID NO: 706737 - RNA, 21 nt, Human
gagugcggcgggggcccgagc

SEQ ID NO: 706738 - RNA, 18 nt, Human
gaguuucugggcccaaag

SEQ ID NO: 706739 - RNA, 20 nt, Human
gauccucagcuucuucucag

SEQ ID NO: 706740 - RNA, 23 nt, Human
gcccaaaguuaaacucuucagcc

SEQ ID NO: 706741 - RNA, 18 nt, Human
gccuggagugcggcgggg

SEQ ID NO: 706742 - RNA, 20 nt, Human
gccuggagugcggcgggggc

SEQ ID NO: 706743 - RNA, 21 nt, Human
gcuuccagacacccccuccac

SEQ ID NO: 706744 - RNA, 19 nt, Human
ggcccccggucugccacag

SEQ ID NO: 706745 - RNA, 21 nt, Human
ggcgucggggguccuggaggg

SEQ ID NO: 706746 - RNA, 19 nt, Human
gggaggcuggcagaagagg

SEQ ID NO: 706747 - RNA, 23 nt, Human
ggucagaaacccuuggaguggag

SEQ ID NO: 706748 - RNA, 19 nt, Human
gugcggcgggggcccgagc

SEQ ID NO: 706749 - RNA, 21 nt, Human
guugaguuucugggcccaaag

SEQ ID NO: 706750 - RNA, 23 nt, Human
guuucuagacuugagguucuggg

SEQ ID NO: 706751 - RNA, 23 nt, Human
uaacuccugacuuacauauuccc

SEQ ID NO: 706752 - RNA, 21 nt, Human
uaagaaaauagcuaucccugg

SEQ ID NO: 706753 - RNA, 23 nt, Human
uaccaagcccuccaggugauucc

SEQ ID NO: 706754 - RNA, 21 nt, Human
uagauuccucuguuuucccag

SEQ ID NO: 706755 - RNA, 21 nt, Human
uagugaacccacuuucuagau

SEQ ID NO: 706756 - RNA, 18 nt, Human
ucaugaacaaaugugaag

SEQ ID NO: 706757 - RNA, 23 nt, Human
ucauucuguccauccauccacuc

SEQ ID NO: 706758 - RNA, 24 nt, Human
uccaaguauucacuuagagcacag

SEQ ID NO: 706759 - RNA, 20 nt, Human
uccagcaacagcagcaugac

SEQ ID NO: 706760 - RNA, 24 nt, Human
uccaucauucuguccauccaucca

SEQ ID NO: 706761 - RNA, 27 nt, Human
ucccacacauaaaaccccacccuucac

SEQ ID NO: 706762 - RNA, 22 nt, Human
ucccaggccccucuccaggccc

SEQ ID NO: 706763 - RNA, 23 nt, Human
ucccaggccccucuccaggcccc

SEQ ID NO: 706764 - RNA, 21 nt, Human
uccccaagccaugcacccugg

SEQ ID NO: 706765 - RNA, 24 nt, Human
uccccaagccaugcacccugguuu

SEQ ID NO: 706766 - RNA, 23 nt, Human
uccccagaaccucucucucucuc

SEQ ID NO: 706767 - RNA, 21 nt, Human
ucccugaaaucaggaccccuc

SEQ ID NO: 706768 - RNA, 19 nt, Human
uccucagcuucuucucagc

SEQ ID NO: 706769 - RNA, 20 nt, Human
uccucaugugcccaucuugg

SEQ ID NO: 706770 - RNA, 18 nt, Human
uccuccuccaccaccucc

SEQ ID NO: 706771 - RNA, 25 nt, Human
uccuccuccuccuccuccuccacca

SEQ ID NO: 706772 - RNA, 21 nt, Human
uccuggaggggagcacgugga

SEQ ID NO: 706773 - RNA, 24 nt, Human
ucgcugggcgccuaggcggcgucg

SEQ ID NO: 706774 - RNA, 19 nt, Human
ucguucagucaccacaggu

SEQ ID NO: 706775 - RNA, 23 nt, Human
ucuacagguuaguggcagcccug

SEQ ID NO: 706776 - RNA, 21 nt, Human
ucuccuggcccuuccucccca

SEQ ID NO: 706777 - RNA, 24 nt, Human
ucuccuggcccuuccuccccaaca

SEQ ID NO: 706778 - RNA, 21 nt, Human
ucugggggacggggacuuucc

SEQ ID NO: 706779 - RNA, 20 nt, Human
ucugucuggaggaaaagggu

SEQ ID NO: 706780 - RNA, 24 nt, Human
ucuuccugccugugccugauaccu

SEQ ID NO: 706781 - RNA, 22 nt, Human
ugaaaucaggaccccucccuuc

SEQ ID NO: 706782 - RNA, 18 nt, Human
ugacaccgccccccccac

SEQ ID NO: 706783 - RNA, 24 nt, Human
ugagccccuugcaugccuucaucc

SEQ ID NO: 706784 - RNA, 20 nt, Human
ugaggacaggaaccagguuu

SEQ ID NO: 706785 - RNA, 22 nt, Human
ugauuccaacgcacacuggaga

SEQ ID NO: 706786 - RNA, 25 nt, Human
ugccuuccuccuccuccuccuccuc

SEQ ID NO: 706787 - RNA, 25 nt, Human
uggaguggagcccaaaaaucugugu

SEQ ID NO: 706788 - RNA, 18 nt, Human
uggcagaagaggugacug

SEQ ID NO: 706789 - RNA, 20 nt, Human
uggcagaagaggugacuggg

SEQ ID NO: 706790 - RNA, 21 nt, Human
uggcccuuccuccccagaacc

SEQ ID NO: 706791 - RNA, 22 nt, Human
uggggaggcuggcagaagaggu

SEQ ID NO: 706792 - RNA, 19 nt, Human
ugguccccaccucuugggu

SEQ ID NO: 706793 - RNA, 19 nt, Human
uggugaggguggagcuagg

SEQ ID NO: 706794 - RNA, 19 nt, Human
ugguuuggggcuguaucug

SEQ ID NO: 706795 - RNA, 22 nt, Human
ugugaaggucaaacacagacug

SEQ ID NO: 706796 - RNA, 19 nt, Human
ugugcccaucuugguccgg

SEQ ID NO: 706797 - RNA, 19 nt, Human
uguuuucccagguaccccu

SEQ ID NO: 706798 - RNA, 19 nt, Human
uucacccggccccacccuc

SEQ ID NO: 706799 - RNA, 18 nt, Human
uucaucuuccucucagcu

SEQ ID NO: 706800 - RNA, 18 nt, Human
uuccuaggggcucccugu

SEQ ID NO: 706801 - RNA, 20 nt, Human
uuccuccuccuccuccuccu

SEQ ID NO: 706802 - RNA, 25 nt, Human
uuccugccugugccugauaccugua

SEQ ID NO: 706803 - RNA, 20 nt, Human
uucucagcuucucuucaucu

SEQ ID NO: 706804 - RNA, 20 nt, Human
uuggaguggagcccaaaaau

SEQ ID NO: 706805 - RNA, 18 nt, Human
uuuaucugcuaccaucuu

SEQ ID NO: 706806 - RNA, 18 nt, Human
uuucccacacauaaaacc

SEQ ID NO: 706807 - RNA, 25 nt, Human
uuucugggcccaaaguuaaacucuu

SEQ ID NO: 706808 - RNA, 18 nt, Human
uuugaauguccacuccac

SEQ ID NO: 706809 - RNA, 21 nt, Human
uuuugguccccaccucuuggg

SEQ ID NO: 706810 - RNA, 21 nt, Human
agagaagcaaaccacgcccgg

SEQ ID NO: 706811 - RNA, 20 nt, Human
ccacgcccggcggccccgcg

SEQ ID NO: 706812 - RNA, 25 nt, Human
cgccagcagugacugagagaagcaa

SEQ ID NO: 706813 - RNA, 24 nt, Human
ggccuggagaggguccccggcgcg

SEQ ID NO: 706814 - RNA, 23 nt, Human
uaagaaagcgccagcagugacug

SEQ ID NO: 706815 - RNA, 25 nt, Human
ugagagaagcaaaccacgcccggcg

SEQ ID NO: 706816 - RNA, 21 nt, Human
uuggauaaagauuaagaaagc

SEQ ID NO: 706817 - RNA, 25 nt, Human
aaaaaacagaaacagguauaaagag

SEQ ID NO: 706818 - RNA, 30 nt, Human
aaaaauaaaaagaaagggacaacaaaaaag

SEQ ID NO: 706819 - RNA, 24 nt, Human
aaaagaaagcccagacacaucccc

SEQ ID NO: 706820 - RNA, 23 nt, Human
aaccuaucuccucaggcagcuag

SEQ ID NO: 706821 - RNA, 20 nt, Human
aagaaagggacaacaaaaaa

SEQ ID NO: 706822 - RNA, 20 nt, Human
aaggaacagagagagcuuca

SEQ ID NO: 706823 - RNA, 24 nt, Human
acaacaaaaaacagaaacagguau

SEQ ID NO: 706824 - RNA, 21 nt, Human
acacauccccaaacauucucc

SEQ ID NO: 706825 - RNA, 24 nt, Human
acagacauuuucccuaugcagaca

SEQ ID NO: 706826 - RNA, 21 nt, Human
acauucuccccacuuuuaaaa

SEQ ID NO: 706827 - RNA, 18 nt, Human
accauucaaagggaaaau

SEQ ID NO: 706828 - RNA, 18 nt, Human
accccggcucccuguccg

SEQ ID NO: 706829 - RNA, 20 nt, Human
accccggcucccuguccggc

SEQ ID NO: 706830 - RNA, 21 nt, Human
agaaagcccagacacaucccc

SEQ ID NO: 706831 - RNA, 19 nt, Human
agaaagggacaacaaaaaa

SEQ ID NO: 706832 - RNA, 24 nt, Human
agaaagggacaacaaaaaacagaa

SEQ ID NO: 706833 - RNA, 23 nt, Human
agacaagcaucgaggcuucaggc

SEQ ID NO: 706834 - RNA, 19 nt, Human
agaguucuagggaaagaug

SEQ ID NO: 706835 - RNA, 18 nt, Human
agaucagauuucuaaaga

SEQ ID NO: 706836 - RNA, 20 nt, Human
agcuccuguggcgccagcuc

SEQ ID NO: 706837 - RNA, 21 nt, Human
aggcagcuaaagcucugaaac

SEQ ID NO: 706838 - RNA, 22 nt, Human
aggcauuaaggccuuaaaaaua

SEQ ID NO: 706839 - RNA, 18 nt, Human
aggcucccgggaacagcu

SEQ ID NO: 706840 - RNA, 21 nt, Human
aggcucccgggaacagcuccc

SEQ ID NO: 706841 - RNA, 21 nt, Human
agguaugcuuugaaggaagcc

SEQ ID NO: 706842 - RNA, 19 nt, Human
auccccaaacauucucccc

SEQ ID NO: 706843 - RNA, 18 nt, Human
caaaaaacagaaacaggu

SEQ ID NO: 706844 - RNA, 22 nt, Human
caaaaagaaagcccagacacau

SEQ ID NO: 706845 - RNA, 23 nt, Human
caacaaaaaacagaaacagguau

SEQ ID NO: 706846 - RNA, 19 nt, Human
cacccccgggaaauaaggg

SEQ ID NO: 706847 - RNA, 23 nt, Human
caccccggcucccuguccggcuc

SEQ ID NO: 706848 - RNA, 22 nt, Human
cagaaggaacagagccaaggcg

SEQ ID NO: 706849 - RNA, 20 nt, Human
cagcucccgggcgccccacc

SEQ ID NO: 706850 - RNA, 20 nt, Human
caggaaaucaaggcuuaagg

SEQ ID NO: 706851 - RNA, 23 nt, Human
cauccccaaacauucuccccacu

SEQ ID NO: 706852 - RNA, 20 nt, Human
ccacagccaggcauuaaggc

SEQ ID NO: 706853 - RNA, 22 nt, Human
ccagacacauccccaaacauuc

SEQ ID NO: 706854 - RNA, 25 nt, Human
ccaugaccgccgggcucucccgcag

SEQ ID NO: 706855 - RNA, 20 nt, Human
cccacaccccuacaccacca

SEQ ID NO: 706856 - RNA, 22 nt, Human
cccaccgccggcucgcccauga

SEQ ID NO: 706857 - RNA, 20 nt, Human
cccccgggaaauaagggccc

SEQ ID NO: 706858 - RNA, 21 nt, Human
cccccgggaaauaagggcccc

SEQ ID NO: 706859 - RNA, 21 nt, Human
ccccggcgcucagccagcucc

SEQ ID NO: 706860 - RNA, 18 nt, Human
ccccuccacucccccugc

SEQ ID NO: 706861 - RNA, 23 nt, Human
ccccugggcggcaaucauccucc

SEQ ID NO: 706862 - RNA, 22 nt, Human
cccuccacucccccugcucucc

SEQ ID NO: 706863 - RNA, 23 nt, Human
cccuccacucccccugcucuccc

SEQ ID NO: 706864 - RNA, 25 nt, Human
cccuccacucccccugcucuccucg

SEQ ID NO: 706865 - RNA, 20 nt, Human
cccugguaaaaaugaaaugg

SEQ ID NO: 706866 - RNA, 27 nt, Human
ccgcuuugucgccgccguuccccucca

SEQ ID NO: 706867 - RNA, 23 nt, Human
ccuguccggcucagauaggggag

SEQ ID NO: 706868 - RNA, 22 nt, Human
cgggcccccgggggcagccccc

SEQ ID NO: 706869 - RNA, 19 nt, Human
cgguagcuccuguggcgcc

SEQ ID NO: 706870 - RNA, 26 nt, Human
cuaaagcucugaaacaagauuaauga

SEQ ID NO: 706871 - RNA, 20 nt, Human
cucacagacgccacagccag

SEQ ID NO: 706872 - RNA, 21 nt, Human
cucacagacgccacagccagg

SEQ ID NO: 706873 - RNA, 19 nt, Human
cucccgggaacagcuccca

SEQ ID NO: 706874 - RNA, 19 nt, Human
cucugcccagcauccauuc

SEQ ID NO: 706875 - RNA, 18 nt, Human
cugaaacaagauuaauga

SEQ ID NO: 706876 - RNA, 24 nt, Human
gagccgagaucagauuucuaaaga

SEQ ID NO: 706877 - RNA, 21 nt, Human
gcaggccgcgaggcucccccg

SEQ ID NO: 706878 - RNA, 19 nt, Human
gcauuggguccccaagccc

SEQ ID NO: 706879 - RNA, 19 nt, Human
gccagcuccccacguccuc

SEQ ID NO: 706880 - RNA, 20 nt, Human
gccuggcaaaaagaaagccc

SEQ ID NO: 706881 - RNA, 19 nt, Human
gcgccagcuccccacgucc

SEQ ID NO: 706882 - RNA, 20 nt, Human
gcgcucagccagcucccggg

SEQ ID NO: 706883 - RNA, 21 nt, Human
gcucccccggccgccgccucg

SEQ ID NO: 706884 - RNA, 22 nt, Human
gcugggaugcgggcgcaguuuc

SEQ ID NO: 706885 - RNA, 25 nt, Human
gcuuugucgccgccguuccccucca

SEQ ID NO: 706886 - RNA, 21 nt, Human
ggcgcucagccagcucccggg

SEQ ID NO: 706887 - RNA, 22 nt, Human
ggcgcucagccagcucccgggc

SEQ ID NO: 706888 - RNA, 21 nt, Human
gggacaacaaaaaacagaaac

SEQ ID NO: 706889 - RNA, 21 nt, Human
gggcgcaguuuccaccccggc

SEQ ID NO: 706890 - RNA, 21 nt, Human
ggggaacgggcgcagaguuca

SEQ ID NO: 706891 - RNA, 23 nt, Human
uaaugaaacaaggcaaugucuaa

SEQ ID NO: 706892 - RNA, 23 nt, Human
uagcuccuguggcgccagcuccc

SEQ ID NO: 706893 - RNA, 19 nt, Human
ucaggaaaucaaggcuuaa

SEQ ID NO: 706894 - RNA, 19 nt, Human
uccccaaacauucucccca

SEQ ID NO: 706895 - RNA, 21 nt, Human
uccccaaacauucuccccacu

SEQ ID NO: 706896 - RNA, 21 nt, Human
ucccugucccacaccccuaca

SEQ ID NO: 706897 - RNA, 19 nt, Human
ucucccgcaggccgcgagg

SEQ ID NO: 706898 - RNA, 19 nt, Human
ucugaaacaagauuaauga

SEQ ID NO: 706899 - RNA, 19 nt, Human
ucuugcugcaguuuaaagg

SEQ ID NO: 706900 - RNA, 26 nt, Human
ugaaacaagauuaaugaaacaaggca

SEQ ID NO: 706901 - RNA, 20 nt, Human
ugacuccuaguuucaaaucc

SEQ ID NO: 706902 - RNA, 20 nt, Human
ugcagacaccauuggcaggu

SEQ ID NO: 706903 - RNA, 18 nt, Human
ugcauuggguccccaagc

SEQ ID NO: 706904 - RNA, 21 nt, Human
uggaagguggcuguugguugg

SEQ ID NO: 706905 - RNA, 23 nt, Human
uggcaaaaagaaagcccagacac

SEQ ID NO: 706906 - RNA, 20 nt, Human
uggccucugcccagcaucca

SEQ ID NO: 706907 - RNA, 23 nt, Human
uggcgcugggaugcgggcgcagu

SEQ ID NO: 706908 - RNA, 21 nt, Human
ugucgccgccguuccccucca

SEQ ID NO: 706909 - RNA, 18 nt, Human
uucacgucugcuuggcgc

SEQ ID NO: 706910 - RNA, 22 nt, Human
uucagaguucuagggaaagaug

SEQ ID NO: 706911 - RNA, 20 nt, Human
uugacuccuaguuucaaauc

SEQ ID NO: 706912 - RNA, 24 nt, Human
uugcugcaguuuaaaggccugaag

SEQ ID NO: 706913 - RNA, 27 nt, Human
uuuaaaaauucauccauucagaguucu

SEQ ID NO: 706914 - RNA, 19 nt, Human
aucccuggggagggugccc

SEQ ID NO: 706915 - RNA, 19 nt, Human
cagaagaccgccuagaggc

SEQ ID NO: 706916 - RNA, 20 nt, Human
ccgccgcggucccaaccugc

SEQ ID NO: 706917 - RNA, 22 nt, Human
ccgccgcggucccaaccugcuc

SEQ ID NO: 706918 - RNA, 18 nt, Human
cgccuagaggcccgucau

SEQ ID NO: 706919 - RNA, 18 nt, Human
cugaagccagacccuccc

SEQ ID NO: 706920 - RNA, 21 nt, Human
gaaaggagggaggggacuuag

SEQ ID NO: 706921 - RNA, 22 nt, Human
gaaaggagggaggggacuuagc

SEQ ID NO: 706922 - RNA, 20 nt, Human
gacuuagccacagacaguaa

SEQ ID NO: 706923 - RNA, 25 nt, Human
uauauuuuuggaaaggagggagggg

SEQ ID NO: 706924 - RNA, 23 nt, Human
uccagauucgacccuggccuggg

SEQ ID NO: 706925 - RNA, 18 nt, Human
ucgacccuggccugggug

SEQ ID NO: 706926 - RNA, 21 nt, Human
ugagaaacugcucguggcaga

SEQ ID NO: 706927 - RNA, 23 nt, Human
uuuuuuuuuuuuuuuuuuuaugg

SEQ ID NO: 706928 - RNA, 20 nt, Human
aaagagggaccccagcugau

SEQ ID NO: 706929 - RNA, 23 nt, Human
aggcccccgaaaucccucuaccu

SEQ ID NO: 706930 - RNA, 18 nt, Human
caaaagagggaccccagc

SEQ ID NO: 706931 - RNA, 18 nt, Human
cccacaccucuguccuuu

SEQ ID NO: 706932 - RNA, 23 nt, Human
cccccgaaaucccucuaccugga

SEQ ID NO: 706933 - RNA, 29 nt, Human
cccccgaaaucccucuaccuggaguggag

SEQ ID NO: 706934 - RNA, 18 nt, Human
ccuggaguggaggaagcg

SEQ ID NO: 706935 - RNA, 18 nt, Human
ccuugggucucccacacc

SEQ ID NO: 706936 - RNA, 22 nt, Human
cucccacaccucuguccuuucc

SEQ ID NO: 706937 - RNA, 21 nt, Human
gggaccccagcugauugccac

SEQ ID NO: 706938 - RNA, 23 nt, Human
uaaguucuuggacucgggggcua

SEQ ID NO: 706939 - RNA, 18 nt, Human
uccaugagcuugggaggu

SEQ ID NO: 706940 - RNA, 21 nt, Human
ucccucuaccuggaguggagg

SEQ ID NO: 706941 - RNA, 21 nt, Human
uccuugcuucugagaaggccc

SEQ ID NO: 706942 - RNA, 19 nt, Human
ugccuaaguucuuggacuc

SEQ ID NO: 706943 - RNA, 21 nt, Human
ugccuaaguucuuggacucga

SEQ ID NO: 706944 - RNA, 22 nt, Human
uuauugucuuggggccccugcc

SEQ ID NO: 706945 - RNA, 20 nt, Human
uucuuggacucgggggcuau

SEQ ID NO: 706946 - RNA, 18 nt, Human
aggaagugggggagaagg

SEQ ID NO: 706947 - RNA, 21 nt, Human
cacccagccucuaggguggau

SEQ ID NO: 706948 - RNA, 18 nt, Human
cacccgaaagucacaucc

SEQ ID NO: 706949 - RNA, 20 nt, Human
cacccgaaagucacauccca

SEQ ID NO: 706950 - RNA, 21 nt, Human
cagccucuaggguggauggaa

SEQ ID NO: 706951 - RNA, 21 nt, Human
caugcugccccgacacccgaa

SEQ ID NO: 706952 - RNA, 24 nt, Human
cccgacacccgaaagucacauccc

SEQ ID NO: 706953 - RNA, 23 nt, Human
ccgaaagucacaucccaugucac

SEQ ID NO: 706954 - RNA, 21 nt, Human
ccgcuaaaguaaggaaguggg

SEQ ID NO: 706955 - RNA, 19 nt, Human
cgccgggagcgguggacua

SEQ ID NO: 706956 - RNA, 21 nt, Human
cgccgggagcgguggacuagg

SEQ ID NO: 706957 - RNA, 26 nt, Human
cucucacauaaaggagggucggugau

SEQ ID NO: 706958 - RNA, 20 nt, Human
cucucucacauaaaggaggg

SEQ ID NO: 706959 - RNA, 19 nt, Human
cugcacccagccucuaggg

SEQ ID NO: 706960 - RNA, 19 nt, Human
cugcacccagccucuaggg

SEQ ID NO: 706961 - RNA, 23 nt, Human
cuucauggugccguauggcugcc

SEQ ID NO: 706962 - RNA, 19 nt, Human
gcugccccgacacccgaaa

SEQ ID NO: 706963 - RNA, 21 nt, Human
gggagaggcggggagccggcg

SEQ ID NO: 706964 - RNA, 23 nt, Human
gggccaggcguccagcucguauc

SEQ ID NO: 706965 - RNA, 18 nt, Human
ggggagccggcgccggga

SEQ ID NO: 706966 - RNA, 23 nt, Human
ggggagccggcgccgggagcggu

SEQ ID NO: 706967 - RNA, 19 nt, Human
gugccguauggcugccaga

SEQ ID NO: 706968 - RNA, 18 nt, Human
uaggguggauggaaaaug

SEQ ID NO: 706969 - RNA, 20 nt, Human
ugccccgacacccgaaaguc

SEQ ID NO: 706970 - RNA, 20 nt, Human
uggguggacaugugcaaagc

SEQ ID NO: 706971 - RNA, 18 nt, Human
aaaaauauuuuuggcugu

SEQ ID NO: 706972 - RNA, 21 nt, Human
aaacagcaaccagccuagugc

SEQ ID NO: 706973 - RNA, 25 nt, Human
aacacaaaaguaaauagcaauguga

SEQ ID NO: 706974 - RNA, 22 nt, Human
aacacauuaauuugccacaaca

SEQ ID NO: 706975 - RNA, 19 nt, Human
aaccaacacaaaacaguua

SEQ ID NO: 706976 - RNA, 21 nt, Human
aaccaugcaagguaaacagca

SEQ ID NO: 706977 - RNA, 22 nt, Human
aagaaaacagaacggugcccag

SEQ ID NO: 706978 - RNA, 24 nt, Human
aagaaaacagaacggugcccagca

SEQ ID NO: 706979 - RNA, 21 nt, Human
aagaaaagaaagaaaacagaa

SEQ ID NO: 706980 - RNA, 23 nt, Human
aagcacaaauucacaaagagcaa

SEQ ID NO: 706981 - RNA, 18 nt, Human
aagguaaacagcaaccag

SEQ ID NO: 706982 - RNA, 19 nt, Human
aagguagugaaaagcccac

SEQ ID NO: 706983 - RNA, 28 nt, Human
aauaagugaugaaaaauauugucuucaa

SEQ ID NO: 706984 - RNA, 24 nt, Human
acaaaaguaaauagcaaugugaac

SEQ ID NO: 706985 - RNA, 20 nt, Human
agaaaagaaagaaaacagaa

SEQ ID NO: 706986 - RNA, 25 nt, Human
agaaauaagauuaugaaaaccacca

SEQ ID NO: 706987 - RNA, 20 nt, Human
agcagcauuuauaccaaggu

SEQ ID NO: 706988 - RNA, 18 nt, Human
agccuagugcaacuaacu

SEQ ID NO: 706989 - RNA, 24 nt, Human
aggaauggcaaaaagacccacagc

SEQ ID NO: 706990 - RNA, 21 nt, Human
auaaaacauguagaagagacu

SEQ ID NO: 706991 - RNA, 19 nt, Human
auauagaacagcuuuugca

SEQ ID NO: 706992 - RNA, 18 nt, Human
aucccaauagggaaugcu

SEQ ID NO: 706993 - RNA, 22 nt, Human
aucugacaacucagaacacaga

SEQ ID NO: 706994 - RNA, 26 nt, Human
auuuauaccaaggugcagugcccuuc

SEQ ID NO: 706995 - RNA, 27 nt, Human
caacacaaaacaguuauuuauucuccu

SEQ ID NO: 706996 - RNA, 20 nt, Human
cacagcgcgugcugcccucu

SEQ ID NO: 706997 - RNA, 21 nt, Human
cacagcgcgugcugcccucuc

SEQ ID NO: 706998 - RNA, 22 nt, Human
cacuccuuguaaguaucaucuc

SEQ ID NO: 706999 - RNA, 24 nt, Human
cagaaggagauacuacacauucau

SEQ ID NO: 707000 - RNA, 20 nt, Human
cauuugaaguccugauuaca

SEQ ID NO: 707001 - RNA, 21 nt, Human
ccacacaaauaucaguaacac

SEQ ID NO: 707002 - RNA, 19 nt, Human
cccaaacacaaaaguaaau

SEQ ID NO: 707003 - RNA, 18 nt, Human
cccagcagcauuuauacc

SEQ ID NO: 707004 - RNA, 22 nt, Human
ccucucacaccacucgccgcuu

SEQ ID NO: 707005 - RNA, 23 nt, Human
cuacacauucauugacuuaagca

SEQ ID NO: 707006 - RNA, 24 nt, Human
cuacacauucauugacuuaagcac

SEQ ID NO: 707007 - RNA, 22 nt, Human
cucagaacacagacuuuaucac

SEQ ID NO: 707008 - RNA, 24 nt, Human
cuccugaauaauaaagacaucaug

SEQ ID NO: 707009 - RNA, 19 nt, Human
cucucaguucuuuccaaca

SEQ ID NO: 707010 - RNA, 24 nt, Human
cuggcacacaaugugagaagagag

SEQ ID NO: 707011 - RNA, 24 nt, Human
cugugcacauagcuuuaaaauccc

SEQ ID NO: 707012 - RNA, 20 nt, Human
cuuaagcacaaauucacaaa

SEQ ID NO: 707013 - RNA, 26 nt, Human
cuuggcaaaugaauaacugagcccug

SEQ ID NO: 707014 - RNA, 19 nt, Human
cuuuccaacaugccccugg

SEQ ID NO: 707015 - RNA, 23 nt, Human
gaaaaccaccaaccaacacaaaa

SEQ ID NO: 707016 - RNA, 19 nt, Human
gaacaaaggcuuucuuuaa

SEQ ID NO: 707017 - RNA, 23 nt, Human
gacgacccaagagcguacugcau

SEQ ID NO: 707018 - RNA, 25 nt, Human
gcggaaugagagaagaaaguacuag

SEQ ID NO: 707019 - RNA, 21 nt, Human
gcuggguuuccccucuucuuu

SEQ ID NO: 707020 - RNA, 19 nt, Human
gcuuauauuuuggaaauua

SEQ ID NO: 707021 - RNA, 21 nt, Human
ggagcaccuaccaacauucag

SEQ ID NO: 707022 - RNA, 20 nt, Human
ggaggaauggcaaaaagacc

SEQ ID NO: 707023 - RNA, 19 nt, Human
ggugcagugcccuuccugg

SEQ ID NO: 707024 - RNA, 18 nt, Human
uaaaaagugaugaaaaaa

SEQ ID NO: 707025 - RNA, 26 nt, Human
uaagauuaugaaaaccaccaaccaac

SEQ ID NO: 707026 - RNA, 19 nt, Human
uacaagaaaaguaccuaac

SEQ ID NO: 707027 - RNA, 18 nt, Human
uaccaacaaguagcaucu

SEQ ID NO: 707028 - RNA, 18 nt, Human
uacugcauacuuggauag

SEQ ID NO: 707029 - RNA, 23 nt, Human
uagaagagacuaauauucugugg

SEQ ID NO: 707030 - RNA, 22 nt, Human
uagcaaugugaacaaaggcuuu

SEQ ID NO: 707031 - RNA, 24 nt, Human
uagcaaugugaacaaaggcuuucu

SEQ ID NO: 707032 - RNA, 24 nt, Human
uagcuuuaguaaacaauaagugau

SEQ ID NO: 707033 - RNA, 23 nt, Human
uagggaacucauaacagacugca

SEQ ID NO: 707034 - RNA, 21 nt, Human
uauaaaauauaacaacaaaaa

SEQ ID NO: 707035 - RNA, 20 nt, Human
uaugaaaaccaccaaccaac

SEQ ID NO: 707036 - RNA, 22 nt, Human
uaugaaaaccaccaaccaacac

SEQ ID NO: 707037 - RNA, 22 nt, Human
ucaagagaucugacaacucaga

SEQ ID NO: 707038 - RNA, 18 nt, Human
ucacaccacucgccgcuu

SEQ ID NO: 707039 - RNA, 18 nt, Human
ucacagguaaugacacuc

SEQ ID NO: 707040 - RNA, 21 nt, Human
ucagaacacagacuuuaucac

SEQ ID NO: 707041 - RNA, 23 nt, Human
ucagucagcucacagguaaugac

SEQ ID NO: 707042 - RNA, 22 nt, Human
ucaguucaaauauguguuagaa

SEQ ID NO: 707043 - RNA, 20 nt, Human
uccaacacauuaauuugcca

SEQ ID NO: 707044 - RNA, 22 nt, Human
uccaacacauuaauuugccaca

SEQ ID NO: 707045 - RNA, 22 nt, Human
uccacacaaauaucaguaacac

SEQ ID NO: 707046 - RNA, 19 nt, Human
uccaguacagaaauaagau

SEQ ID NO: 707047 - RNA, 21 nt, Human
ucccucguauuuucccccaaa

SEQ ID NO: 707048 - RNA, 18 nt, Human
ucgccgcuuuguugcucu

SEQ ID NO: 707049 - RNA, 22 nt, Human
ugaaaaaaaguagcuggcuggu

SEQ ID NO: 707050 - RNA, 19 nt, Human
ugaaaaauauugucuucaa

SEQ ID NO: 707051 - RNA, 21 nt, Human
ugaaaaauauugucuucaaga

SEQ ID NO: 707052 - RNA, 19 nt, Human
ugcagugcccuuccuggca

SEQ ID NO: 707053 - RNA, 26 nt, Human
ugccccugggucucaugagacgaccc

SEQ ID NO: 707054 - RNA, 20 nt, Human
ugcucuuucucucaguucuu

SEQ ID NO: 707055 - RNA, 24 nt, Human
uggcaaaugaauaacugagcccug

SEQ ID NO: 707056 - RNA, 18 nt, Human
uggcggaaugagagaaga

SEQ ID NO: 707057 - RNA, 24 nt, Human
uguaauggagcaccuaccaacauu

SEQ ID NO: 707058 - RNA, 25 nt, Human
uguaauggagcaccuaccaacauuc

SEQ ID NO: 707059 - RNA, 26 nt, Human
ugucuucuucuuuugauauugauauu

SEQ ID NO: 707060 - RNA, 22 nt, Human
uuagaaaaaagaucuauucugu

SEQ ID NO: 707061 - RNA, 20 nt, Human
uucaagagaucugacaacuc

SEQ ID NO: 707062 - RNA, 28 nt, Human
uucaagagaucugacaacucagaacaca

SEQ ID NO: 707063 - RNA, 19 nt, Human
uuccaacaugccccugggu

SEQ ID NO: 707064 - RNA, 24 nt, Human
uuccaacaugccccugggucucau

SEQ ID NO: 707065 - RNA, 18 nt, Human
uuccuggauuguaaugga

SEQ ID NO: 707066 - RNA, 19 nt, Human
uugaaaccaguccaccaau

SEQ ID NO: 707067 - RNA, 20 nt, Human
uugaaaccaguccaccaauu

SEQ ID NO: 707068 - RNA, 19 nt, Human
uugcauuauugcucuacau

SEQ ID NO: 707069 - RNA, 19 nt, Human
uuugccacaacacauuuac

SEQ ID NO: 707070 - RNA, 24 nt, Human
uuuuuuuuuuuuuuuuagauuuuu

SEQ ID NO: 707071 - RNA, 19 nt, Human
aaagagcccaguccuaaag

SEQ ID NO: 707072 - RNA, 23 nt, Human
aaagagcccaguccuaaagccac

SEQ ID NO: 707073 - RNA, 26 nt, Human
agaggagaggccaccguggggcacgc

SEQ ID NO: 707074 - RNA, 21 nt, Human
agcccaguccuaaagccaccc

SEQ ID NO: 707075 - RNA, 23 nt, Human
cacuguggguccaaggaugagcu

SEQ ID NO: 707076 - RNA, 19 nt, Human
cagagaugcucuagaaaca

SEQ ID NO: 707077 - RNA, 18 nt, Human
cagcagcuggggcacucc

SEQ ID NO: 707078 - RNA, 22 nt, Human
ccacuguggguccaaggaugag

SEQ ID NO: 707079 - RNA, 21 nt, Human
cuccaaagagcccaguccuaa

SEQ ID NO: 707080 - RNA, 22 nt, Human
cuggggcacuccugacaccgau

SEQ ID NO: 707081 - RNA, 18 nt, Human
uaucugaagacaucagca

SEQ ID NO: 707082 - RNA, 19 nt, Human
ucaguggaagcaaggagcc

SEQ ID NO: 707083 - RNA, 24 nt, Human
uccaaagagcccaguccuaaagcc

SEQ ID NO: 707084 - RNA, 23 nt, Human
ucuagaaacagcagcuggggcac

SEQ ID NO: 707085 - RNA, 20 nt, Human
ugaaaguacucaagagguca

SEQ ID NO: 707086 - RNA, 19 nt, Human
uggaagcaaggagccaaau

SEQ ID NO: 707087 - RNA, 18 nt, Human
uggguugcagagaugcuc

SEQ ID NO: 707088 - RNA, 21 nt, Human
uuguucccuucuuggcaaucc

SEQ ID NO: 707089 - RNA, 21 nt, Human
aacagaaagcguggcuccagc

SEQ ID NO: 707090 - RNA, 19 nt, Human
aaccagcacggaccccucc

SEQ ID NO: 707091 - RNA, 23 nt, Human
aagaggcgccacuguacaaggcu

SEQ ID NO: 707092 - RNA, 18 nt, Human
aaggcuucccggaggugg

SEQ ID NO: 707093 - RNA, 26 nt, Human
acuccaagaggcgccacuguacaagg

SEQ ID NO: 707094 - RNA, 18 nt, Human
acugagcuccagccagag

SEQ ID NO: 707095 - RNA, 21 nt, Human
acugagcuccagccagagggg

SEQ ID NO: 707096 - RNA, 21 nt, Human
agaaagcguggcuccagcuca

SEQ ID NO: 707097 - RNA, 22 nt, Human
agaggguggcugcugcugccuu

SEQ ID NO: 707098 - RNA, 21 nt, Human
agcgaugcuucuggccagggc

SEQ ID NO: 707099 - RNA, 18 nt, Human
aggccucaguccacucag

SEQ ID NO: 707100 - RNA, 23 nt, Human
agguggggcugguacaggugucc

SEQ ID NO: 707101 - RNA, 20 nt, Human
cacuguacaaggcuucccgg

SEQ ID NO: 707102 - RNA, 18 nt, Human
cagccagagggagagagg

SEQ ID NO: 707103 - RNA, 18 nt, Human
cagcggcugggcuccugc

SEQ ID NO: 707104 - RNA, 19 nt, Human
cagcucagaccaccccgga

SEQ ID NO: 707105 - RNA, 22 nt, Human
cagggcugggccaugcugucug

SEQ ID NO: 707106 - RNA, 23 nt, Human
ccagccaugcacacaggcagcca

SEQ ID NO: 707107 - RNA, 19 nt, Human
ccaugcacacaggcagcca

SEQ ID NO: 707108 - RNA, 18 nt, Human
ccuacugagcuccagcca

SEQ ID NO: 707109 - RNA, 25 nt, Human
ccucugccugggcagucugggcggg

SEQ ID NO: 707110 - RNA, 21 nt, Human
ccugcuggugaccacuugacu

SEQ ID NO: 707111 - RNA, 20 nt, Human
ccugggcagucugggcgggg

SEQ ID NO: 707112 - RNA, 22 nt, Human
ccuuugagaucuccgggguccc

SEQ ID NO: 707113 - RNA, 23 nt, Human
gaaccagcacggaccccuccccg

SEQ ID NO: 707114 - RNA, 22 nt, Human
gaagcuccgggcuccccugccc

SEQ ID NO: 707115 - RNA, 19 nt, Human
gcugcuccaugcccaccgg

SEQ ID NO: 707116 - RNA, 21 nt, Human
gcugcuccaugcccaccgggg

SEQ ID NO: 707117 - RNA, 21 nt, Human
gggcuggaggucuaccuccug

SEQ ID NO: 707118 - RNA, 27 nt, Human
ggggcugguacaggugucccuagagag

SEQ ID NO: 707119 - RNA, 20 nt, Human
uacccagggcuggaggucua

SEQ ID NO: 707120 - RNA, 23 nt, Human
ucaccagugccuuccagccaugc

SEQ ID NO: 707121 - RNA, 24 nt, Human
ucagaaccagcacggaccccuccc

SEQ ID NO: 707122 - RNA, 20 nt, Human
ucccuagagaguugucccua

SEQ ID NO: 707123 - RNA, 22 nt, Human
ucccuccagcucuccgaguccc

SEQ ID NO: 707124 - RNA, 19 nt, Human
uccggggucccuccagcuc

SEQ ID NO: 707125 - RNA, 19 nt, Human
ucuccgaguccguagggcc

SEQ ID NO: 707126 - RNA, 20 nt, Human
ugaccagaggaagcuccggg

SEQ ID NO: 707127 - RNA, 21 nt, Human
ugcccucugccugggcagucu

SEQ ID NO: 707128 - RNA, 18 nt, Human
ugccugggcagucugggc

SEQ ID NO: 707129 - RNA, 20 nt, Human
ugcuguucuccuucagcugc

SEQ ID NO: 707130 - RNA, 20 nt, Human
uggccagggcugggccaugc

SEQ ID NO: 707131 - RNA, 21 nt, Human
ugggacaucaccagugccuuc

SEQ ID NO: 707132 - RNA, 18 nt, Human
ugggagagaggguggcug

SEQ ID NO: 707133 - RNA, 18 nt, Human
ugguggcgggcagggccg

SEQ ID NO: 707134 - RNA, 20 nt, Human
ugucuugcuguucuccuuca

SEQ ID NO: 707135 - RNA, 24 nt, Human
uucccggagguggcggccacacga

SEQ ID NO: 707136 - RNA, 21 nt, Human
uuucugauucccacauucauc

SEQ ID NO: 707137 - RNA, 21 nt, Human
cacaaagcagaaaugccugaa

SEQ ID NO: 707138 - RNA, 22 nt, Human
cacaaagcagaaaugccugaaa

SEQ ID NO: 707139 - RNA, 21 nt, Human
cauacaccccauagcauuagc

SEQ ID NO: 707140 - RNA, 18 nt, Human
ucuaaaugaccuaaacuu

SEQ ID NO: 707141 - RNA, 19 nt, Human
ugacauauucauacacccc

SEQ ID NO: 707142 - RNA, 24 nt, Human
ugccugaaauuugaagguguuuac

SEQ ID NO: 707143 - RNA, 20 nt, Human
ugccuggaaagaaaaugaag

SEQ ID NO: 707144 - RNA, 18 nt, Human
uggcuaaagaacugcuau

SEQ ID NO: 707145 - RNA, 23 nt, Human
uuaaaagguaacgggcuuauaaa

SEQ ID NO: 707146 - RNA, 21 nt, Human
uuagcagcuguugauagccau

SEQ ID NO: 707147 - RNA, 23 nt, Human
uucauacaccccauagcauuagc

SEQ ID NO: 707148 - RNA, 21 nt, Human
uugaagguguuuacucccaua

SEQ ID NO: 707149 - RNA, 19 nt, Human
aaacaugaccugguucaug

SEQ ID NO: 707150 - RNA, 21 nt, Human
aaacaugaccugguucaugua

SEQ ID NO: 707151 - RNA, 24 nt, Human
aaacuucaagaaccaagcagggac

SEQ ID NO: 707152 - RNA, 23 nt, Human
aaagccaccgaggcugggagccg

SEQ ID NO: 707153 - RNA, 24 nt, Human
aacacaaggccaaacaugaccugg

SEQ ID NO: 707154 - RNA, 18 nt, Human
aagaaccaagcagggaca

SEQ ID NO: 707155 - RNA, 19 nt, Human
aagcagacaaugucuucca

SEQ ID NO: 707156 - RNA, 22 nt, Human
aagcagcccauaagucagaagc

SEQ ID NO: 707157 - RNA, 19 nt, Human
aagcagggacagggcaggc

SEQ ID NO: 707158 - RNA, 19 nt, Human
aagcccagaguucaagcag

SEQ ID NO: 707159 - RNA, 24 nt, Human
aaucaccaaaaaacacacgcaaac

SEQ ID NO: 707160 - RNA, 20 nt, Human
aaugguuuucacugauacau

SEQ ID NO: 707161 - RNA, 21 nt, Human
acaaacagccucaugguaggc

SEQ ID NO: 707162 - RNA, 19 nt, Human
acacaccuucacacaugcc

SEQ ID NO: 707163 - RNA, 22 nt, Human
acagauucugaccauuugacag

SEQ ID NO: 707164 - RNA, 19 nt, Human
acagggcaggcggagcuga

SEQ ID NO: 707165 - RNA, 19 nt, Human
acaugccauucucucugcu

SEQ ID NO: 707166 - RNA, 21 nt, Human
accacuuuacacagcaggucu

SEQ ID NO: 707167 - RNA, 21 nt, Human
acucauccuccuucccuccag

SEQ ID NO: 707168 - RNA, 24 nt, Human
acucauccuccuucccuccaggac

SEQ ID NO: 707169 - RNA, 21 nt, Human
agaaaggaaccacagcugaga

SEQ ID NO: 707170 - RNA, 20 nt, Human
agaaccaagcagggacaggg

SEQ ID NO: 707171 - RNA, 19 nt, Human
agacacuauggggaaccug

SEQ ID NO: 707172 - RNA, 20 nt, Human
agcaggggaggaaucucuac

SEQ ID NO: 707173 - RNA, 23 nt, Human
agcugagauccagagcuccuaua

SEQ ID NO: 707174 - RNA, 19 nt, Human
aggagcaaagugugcagaa

SEQ ID NO: 707175 - RNA, 20 nt, Human
aggcauucagauucuuaaaa

SEQ ID NO: 707176 - RNA, 21 nt, Human
aggccacacaugaagccccag

SEQ ID NO: 707177 - RNA, 23 nt, Human
auccuuucaacuuccuccccucu

SEQ ID NO: 707178 - RNA, 19 nt, Human
aucuaggguagcacugucc

SEQ ID NO: 707179 - RNA, 19 nt, Human
auggucccugauacauuau

SEQ ID NO: 707180 - RNA, 20 nt, Human
auuugcauaaugguuuucac

SEQ ID NO: 707181 - RNA, 18 nt, Human
caaaaaacacacgcaaac

SEQ ID NO: 707182 - RNA, 24 nt, Human
caaauaccuacucugcaccaagcc

SEQ ID NO: 707183 - RNA, 26 nt, Human
caaggccaaacaugaccugguucaug

SEQ ID NO: 707184 - RNA, 21 nt, Human
caccacuguaucucuugagac

SEQ ID NO: 707185 - RNA, 18 nt, Human
cacccagugggcuguagg

SEQ ID NO: 707186 - RNA, 20 nt, Human
caccuccacuuggaucucca

SEQ ID NO: 707187 - RNA, 24 nt, Human
cacgcaaaggcauucagauucuua

SEQ ID NO: 707188 - RNA, 23 nt, Human
cagaagaaagauggaguugaugg

SEQ ID NO: 707189 - RNA, 20 nt, Human
cagaagccaguauaucagag

SEQ ID NO: 707190 - RNA, 20 nt, Human
cagaagggcugguaugugug

SEQ ID NO: 707191 - RNA, 23 nt, Human
cagcaagugaagagaagauucag

SEQ ID NO: 707192 - RNA, 18 nt, Human
cagcaugagugauccugg

SEQ ID NO: 707193 - RNA, 26 nt, Human
cagcauggucccuggcacauaaucaa

SEQ ID NO: 707194 - RNA, 20 nt, Human
cagcccauaagucagaagcc

SEQ ID NO: 707195 - RNA, 21 nt, Human
cagcccauaagucagaagcca

SEQ ID NO: 707196 - RNA, 20 nt, Human
cagcugagauccagagcucc

SEQ ID NO: 707197 - RNA, 20 nt, Human
ccaaauaccuacucugcacc

SEQ ID NO: 707198 - RNA, 23 nt, Human
ccaacaagcccagauuccaaacc

SEQ ID NO: 707199 - RNA, 21 nt, Human
ccaacacaaggccaaacauga

SEQ ID NO: 707200 - RNA, 20 nt, Human
ccacagcugagauccagagc

SEQ ID NO: 707201 - RNA, 23 nt, Human
ccagaagggagaggacucucaca

SEQ ID NO: 707202 - RNA, 23 nt, Human
ccaggacucauccuccuucccuc

SEQ ID NO: 707203 - RNA, 22 nt, Human
ccaggggcccuucagauuuucu

SEQ ID NO: 707204 - RNA, 26 nt, Human
cccaggacucauccuccuucccucca

SEQ ID NO: 707205 - RNA, 25 nt, Human
ccccccuggaaccucauuugcuuaa

SEQ ID NO: 707206 - RNA, 20 nt, Human
ccccgcugcccucuccuucc

SEQ ID NO: 707207 - RNA, 20 nt, Human
ccccuccucugacuuucuca

SEQ ID NO: 707208 - RNA, 21 nt, Human
cccgccgagccuccugcugca

SEQ ID NO: 707209 - RNA, 20 nt, Human
cccgcugcccucuccuuccu

SEQ ID NO: 707210 - RNA, 19 nt, Human
cccucuccuuccuucuucc

SEQ ID NO: 707211 - RNA, 19 nt, Human
cccucuccuuccuucuucc

SEQ ID NO: 707212 - RNA, 18 nt, Human
cccucugagcuuggcacc

SEQ ID NO: 707213 - RNA, 18 nt, Human
cccuggcucugaaaggga

SEQ ID NO: 707214 - RNA, 20 nt, Human
ccgaaacaugacugcaggcc

SEQ ID NO: 707215 - RNA, 19 nt, Human
ccgcuggcuauacucgguc

SEQ ID NO: 707216 - RNA, 19 nt, Human
ccggccccgccgagccucc

SEQ ID NO: 707217 - RNA, 22 nt, Human
ccggccccgccgagccuccugc

SEQ ID NO: 707218 - RNA, 24 nt, Human
ccggccccgccgagccuccugcug

SEQ ID NO: 707219 - RNA, 18 nt, Human
ccucugccccgccggccc

SEQ ID NO: 707220 - RNA, 18 nt, Human
ccucuguuccaaucugga

SEQ ID NO: 707221 - RNA, 25 nt, Human
ccugcugcaggcggccccgcugccc

SEQ ID NO: 707222 - RNA, 22 nt, Human
ccugggaggcucacuaccauga

SEQ ID NO: 707223 - RNA, 21 nt, Human
ccuguccugggccuuuggagg

SEQ ID NO: 707224 - RNA, 25 nt, Human
ccuuccuucuuccuugccuaguccc

SEQ ID NO: 707225 - RNA, 24 nt, Human
ccuugagugcauucgucgcccucu

SEQ ID NO: 707226 - RNA, 21 nt, Human
ccuuggcuuucauugccuucu

SEQ ID NO: 707227 - RNA, 24 nt, Human
cgaucgcugcccacgcguccgugc

SEQ ID NO: 707228 - RNA, 19 nt, Human
cgccucugccccgccggcc

SEQ ID NO: 707229 - RNA, 20 nt, Human
cgggauuacaggcgcgguca

SEQ ID NO: 707230 - RNA, 21 nt, Human
cgggauuacaggcgcggucac

SEQ ID NO: 707231 - RNA, 19 nt, Human
cugagcuuggcacccagug

SEQ ID NO: 707232 - RNA, 21 nt, Human
cuggauggguacucuagguag

SEQ ID NO: 707233 - RNA, 18 nt, Human
cuucuaauugugacaucu

SEQ ID NO: 707234 - RNA, 19 nt, Human
cuuguggaucaacucuggg

SEQ ID NO: 707235 - RNA, 20 nt, Human
gaaccacagcugagauccag

SEQ ID NO: 707236 - RNA, 21 nt, Human
gaaccacagcugagauccaga

SEQ ID NO: 707237 - RNA, 20 nt, Human
gaacugccaaggucagacug

SEQ ID NO: 707238 - RNA, 25 nt, Human
gaccauaagggugcuacacgcagcc

SEQ ID NO: 707239 - RNA, 19 nt, Human
gaggcugggagccgcuggc

SEQ ID NO: 707240 - RNA, 23 nt, Human
gagguccaggucucucucuggcu

SEQ ID NO: 707241 - RNA, 21 nt, Human
gaguucaagcagacaaugucu

SEQ ID NO: 707242 - RNA, 21 nt, Human
gauuacaggcgcggucacacc

SEQ ID NO: 707243 - RNA, 20 nt, Human
gcaggcggccccgcugcccu

SEQ ID NO: 707244 - RNA, 21 nt, Human
gcccuucagauuuucuuucuc

SEQ ID NO: 707245 - RNA, 23 nt, Human
gccuuuggaggaaggaaugcagc

SEQ ID NO: 707246 - RNA, 26 nt, Human
gcucccaccuccacuuggaucuccac

SEQ ID NO: 707247 - RNA, 21 nt, Human
gcugcaggcggccccgcugcc

SEQ ID NO: 707248 - RNA, 23 nt, Human
gcugcccucuccuuccuucuucc

SEQ ID NO: 707249 - RNA, 21 nt, Human
ggaguugauggagcauugcuc

SEQ ID NO: 707250 - RNA, 19 nt, Human
ggcacaccaacaagcccag

SEQ ID NO: 707251 - RNA, 25 nt, Human
ggccuuuggaggaaggaaugcagcu

SEQ ID NO: 707252 - RNA, 20 nt, Human
ggcugggagccgcuggcuau

SEQ ID NO: 707253 - RNA, 22 nt, Human
gggcagggauuggaccacuuua

SEQ ID NO: 707254 - RNA, 21 nt, Human
gggcuggaaucuggacuuggg

SEQ ID NO: 707255 - RNA, 26 nt, Human
gggcuggagcuggccagaagggagag

SEQ ID NO: 707256 - RNA, 23 nt, Human
ggggagcgaguuguugcuuuucu

SEQ ID NO: 707257 - RNA, 20 nt, Human
gugugucuguuugugggugg

SEQ ID NO: 707258 - RNA, 19 nt, Human
guguguucugcaagaccau

SEQ ID NO: 707259 - RNA, 20 nt, Human
guuagauugucacuugcuca

SEQ ID NO: 707260 - RNA, 22 nt, Human
guuucuugguguguucugcaag

SEQ ID NO: 707261 - RNA, 21 nt, Human
uaacacaacggcauguguguc

SEQ ID NO: 707262 - RNA, 21 nt, Human
uaagcagcccauaagucagaa

SEQ ID NO: 707263 - RNA, 22 nt, Human
uaagucagaagccaguauauca

SEQ ID NO: 707264 - RNA, 23 nt, Human
uaauuagcaauuuaucauuugga

SEQ ID NO: 707265 - RNA, 19 nt, Human
uacacaccuguacuuagua

SEQ ID NO: 707266 - RNA, 23 nt, Human
uacacaccuguacuuaguagagc

SEQ ID NO: 707267 - RNA, 18 nt, Human
uacacagcaggucuuggc

SEQ ID NO: 707268 - RNA, 18 nt, Human
uacucggucucgccucug

SEQ ID NO: 707269 - RNA, 20 nt, Human
uagagaccccucugcucucc

SEQ ID NO: 707270 - RNA, 21 nt, Human
uagcaaaucuugcauaccagc

SEQ ID NO: 707271 - RNA, 21 nt, Human
uaugacacacaccuucacaca

SEQ ID NO: 707272 - RNA, 19 nt, Human
uauguacuaggcccugugu

SEQ ID NO: 707273 - RNA, 18 nt, Human
ucaccaaaaaacacacgc

SEQ ID NO: 707274 - RNA, 22 nt, Human
uccaaaucuccugucuggaccc

SEQ ID NO: 707275 - RNA, 19 nt, Human
uccaugaaucaccaaaaaa

SEQ ID NO: 707276 - RNA, 19 nt, Human
ucccaggacucauccuccu

SEQ ID NO: 707277 - RNA, 21 nt, Human
uccucuguuccaaucuggaga

SEQ ID NO: 707278 - RNA, 23 nt, Human
uccuuggcuuucauugccuucug

SEQ ID NO: 707279 - RNA, 21 nt, Human
ucuagaucucaggccaggggc

SEQ ID NO: 707280 - RNA, 22 nt, Human
ucucacagaaucuaggguagca

SEQ ID NO: 707281 - RNA, 21 nt, Human
ucuccuuggcuuucauugccu

SEQ ID NO: 707282 - RNA, 19 nt, Human
ucuuguggaucaacucugg

SEQ ID NO: 707283 - RNA, 19 nt, Human
ugagcuggcuuuaaguuag

SEQ ID NO: 707284 - RNA, 18 nt, Human
ugagggggcuggagcugg

SEQ ID NO: 707285 - RNA, 21 nt, Human
ugaugggcagaaaggaacugc

SEQ ID NO: 707286 - RNA, 20 nt, Human
ugccaaggucagacuguugg

SEQ ID NO: 707287 - RNA, 22 nt, Human
ugccaaggucagacuguugggg

SEQ ID NO: 707288 - RNA, 18 nt, Human
ugccaggaaccacaaaca

SEQ ID NO: 707289 - RNA, 18 nt, Human
ugccgggauuacaggcgc

SEQ ID NO: 707290 - RNA, 24 nt, Human
ugccgggauuacaggcgcggucac

SEQ ID NO: 707291 - RNA, 23 nt, Human
ugcuaugguacuuccucccagga

SEQ ID NO: 707292 - RNA, 22 nt, Human
ugcugcaggcggccccgcugcc

SEQ ID NO: 707293 - RNA, 20 nt, Human
uggacccuuccccuggcucu

SEQ ID NO: 707294 - RNA, 18 nt, Human
uggcuuggaggcagguuu

SEQ ID NO: 707295 - RNA, 22 nt, Human
ugggggcagggauuggaccacu

SEQ ID NO: 707296 - RNA, 18 nt, Human
uguacaggaggugcucag

SEQ ID NO: 707297 - RNA, 27 nt, Human
uguaugacacacaccuucacacauggu

SEQ ID NO: 707298 - RNA, 19 nt, Human
ugugguggcaccucccggg

SEQ ID NO: 707299 - RNA, 21 nt, Human
ugugguggcaccucccgggcg

SEQ ID NO: 707300 - RNA, 21 nt, Human
uuagagaccccucugcucucc

SEQ ID NO: 707301 - RNA, 23 nt, Human
uuaguauccuuucaacuuccucc

SEQ ID NO: 707302 - RNA, 21 nt, Human
uucaacauuuaccaaauaccu

SEQ ID NO: 707303 - RNA, 22 nt, Human
uucaacuuccuccccucuggcu

SEQ ID NO: 707304 - RNA, 20 nt, Human
uucaugaauggcuuggaggc

SEQ ID NO: 707305 - RNA, 23 nt, Human
uucauguacaggaggugcucagg

SEQ ID NO: 707306 - RNA, 21 nt, Human
uuccccuggcucugaaaggga

SEQ ID NO: 707307 - RNA, 23 nt, Human
uucccucuugagcuuucuccaca

SEQ ID NO: 707308 - RNA, 24 nt, Human
uugcugacuccuguuggaugcucc

SEQ ID NO: 707309 - RNA, 25 nt, Human
uugcuugcagaaucucacagaaucu

SEQ ID NO: 707310 - RNA, 25 nt, Human
uuuaagacucuuccaacggguauuu

SEQ ID NO: 707311 - RNA, 20 nt, Human
uuuaucggcagcaugguccc

SEQ ID NO: 707312 - RNA, 22 nt, Human
uuucgggggccagcucuuuauu

SEQ ID NO: 707313 - RNA, 22 nt, Human
uuugauugcugacuccuguugg

SEQ ID NO: 707314 - RNA, 20 nt, Human
uuuuuuuuuuuuuucggggg

SEQ ID NO: 707315 - RNA, 19 nt, Human
aacaugcugaugcugaaga

SEQ ID NO: 707316 - RNA, 19 nt, Human
aagcagcagauggcuucca

SEQ ID NO: 707317 - RNA, 22 nt, Human
aagcagcagauggcuuccagga

SEQ ID NO: 707318 - RNA, 18 nt, Human
aaggcccucuucuuccgc

SEQ ID NO: 707319 - RNA, 22 nt, Human
acacgccauacuucuugugggc

SEQ ID NO: 707320 - RNA, 23 nt, Human
acguagagggggcaguugggggc

SEQ ID NO: 707321 - RNA, 21 nt, Human
agaaagacggggaugaacagg

SEQ ID NO: 707322 - RNA, 21 nt, Human
agagggaucugcaggacucug

SEQ ID NO: 707323 - RNA, 20 nt, Human
agcagggugaugagggugga

SEQ ID NO: 707324 - RNA, 24 nt, Human
aggaagcuuauuauggccacgaug

SEQ ID NO: 707325 - RNA, 19 nt, Human
aggcaggagguggcacagg

SEQ ID NO: 707326 - RNA, 20 nt, Human
aggcaggagguggcacaggg

SEQ ID NO: 707327 - RNA, 24 nt, Human
aggcaggagguggcacaggguugg

SEQ ID NO: 707328 - RNA, 25 nt, Human
aggcaggagguggcacaggguuggg

SEQ ID NO: 707329 - RNA, 21 nt, Human
aggcucuugcgccguagcagu

SEQ ID NO: 707330 - RNA, 19 nt, Human
agggaucugcaggacucug

SEQ ID NO: 707331 - RNA, 22 nt, Human
aggugcuggaugccgcaggucc

SEQ ID NO: 707332 - RNA, 19 nt, Human
augaugcugugcacgggca

SEQ ID NO: 707333 - RNA, 21 nt, Human
augcgcugccacugcuccgga

SEQ ID NO: 707334 - RNA, 22 nt, Human
cacacaccacguggucagcaaa

SEQ ID NO: 707335 - RNA, 22 nt, Human
cacagaauaggagcccaguuga

SEQ ID NO: 707336 - RNA, 20 nt, Human
cacaggcaggagguggcaca

SEQ ID NO: 707337 - RNA, 22 nt, Human
caccacguggucagcaaacuug

SEQ ID NO: 707338 - RNA, 19 nt, Human
caccagcagcugcgauggc

SEQ ID NO: 707339 - RNA, 22 nt, Human
caccucauccuccgacuggucg

SEQ ID NO: 707340 - RNA, 23 nt, Human
cagaaguagaaggaggucaggag

SEQ ID NO: 707341 - RNA, 22 nt, Human
cagaauaggagcccaguugauc

SEQ ID NO: 707342 - RNA, 20 nt, Human
cagcagcagcacgauggggu

SEQ ID NO: 707343 - RNA, 19 nt, Human
cagcaggaugcucuuguug

SEQ ID NO: 707344 - RNA, 24 nt, Human
cagcaggcuguccagguuguccac

SEQ ID NO: 707345 - RNA, 22 nt, Human
cagccuccgggcccacugcagg

SEQ ID NO: 707346 - RNA, 18 nt, Human
cagggugcagaagaggau

SEQ ID NO: 707347 - RNA, 20 nt, Human
caguucagaaagacggggau

SEQ ID NO: 707348 - RNA, 23 nt, Human
caugcggccuggcagcucggacc

SEQ ID NO: 707349 - RNA, 20 nt, Human
ccagcagcugcgauggccag

SEQ ID NO: 707350 - RNA, 21 nt, Human
ccagcagcugcgauggccaga

SEQ ID NO: 707351 - RNA, 20 nt, Human
ccagcaguucagaaagacgg

SEQ ID NO: 707352 - RNA, 19 nt, Human
ccaggacgggcgcgaugcu

SEQ ID NO: 707353 - RNA, 18 nt, Human
ccaggaugugccggggcc

SEQ ID NO: 707354 - RNA, 21 nt, Human
ccaggcccagcagcagccggg

SEQ ID NO: 707355 - RNA, 25 nt, Human
ccagguuguccacagagcccuccau

SEQ ID NO: 707356 - RNA, 26 nt, Human
cccagcagcagccgggugauggugau

SEQ ID NO: 707357 - RNA, 22 nt, Human
cccagggccccuucacuucccg

SEQ ID NO: 707358 - RNA, 19 nt, Human
ccccgagaaggcccucuuc

SEQ ID NO: 707359 - RNA, 22 nt, Human
cccgagaaggcccucuucuucc

SEQ ID NO: 707360 - RNA, 19 nt, Human
cccgaugaggcacacgcca

SEQ ID NO: 707361 - RNA, 24 nt, Human
cccguguguccucacaguccucca

SEQ ID NO: 707362 - RNA, 20 nt, Human
cccugggagcugccuccggu

SEQ ID NO: 707363 - RNA, 20 nt, Human
ccgacccgagggagaagcga

SEQ ID NO: 707364 - RNA, 19 nt, Human
ccgccauguaguccuccuc

SEQ ID NO: 707365 - RNA, 22 nt, Human
ccgcccggccugccugcuuggg

SEQ ID NO: 707366 - RNA, 24 nt, Human
ccgccgcccggccugccugcuugg

SEQ ID NO: 707367 - RNA, 24 nt, Human
ccgccgcccguguggcggcccugg

SEQ ID NO: 707368 - RNA, 19 nt, Human
ccgccgcgcgccucccggc

SEQ ID NO: 707369 - RNA, 18 nt, Human
ccggacccucgugcagcc

SEQ ID NO: 707370 - RNA, 19 nt, Human
ccucacacaccacgugguc

SEQ ID NO: 707371 - RNA, 18 nt, Human
ccucccgcuucagcccga

SEQ ID NO: 707372 - RNA, 24 nt, Human
ccucccgcuucagcccgaugaggc

SEQ ID NO: 707373 - RNA, 22 nt, Human
ccucccggcagacgccccccgg

SEQ ID NO: 707374 - RNA, 19 nt, Human
ccuccgggcccacugcagg

SEQ ID NO: 707375 - RNA, 22 nt, Human
ccuccgggcccacugcaggcuc

SEQ ID NO: 707376 - RNA, 18 nt, Human
ccugguugaacauggcug

SEQ ID NO: 707377 - RNA, 21 nt, Human
cgcagcggcggccagaagauc

SEQ ID NO: 707378 - RNA, 18 nt, Human
cgcaugagguccuggucu

SEQ ID NO: 707379 - RNA, 26 nt, Human
cgccuugcggcucagccuccgggccc

SEQ ID NO: 707380 - RNA, 19 nt, Human
cgcucugcguaggccggug

SEQ ID NO: 707381 - RNA, 25 nt, Human
cggcaggcggaacaugaaggccagg

SEQ ID NO: 707382 - RNA, 21 nt, Human
cggccaggaugugccggggcc

SEQ ID NO: 707383 - RNA, 20 nt, Human
cggccggcggcgaacggcag

SEQ ID NO: 707384 - RNA, 22 nt, Human
cggcggcgaacggcaggcggaa

SEQ ID NO: 707385 - RNA, 26 nt, Human
cgggccggacccucgugcagccccug

SEQ ID NO: 707386 - RNA, 22 nt, Human
cggguucagcaggaugcucuug

SEQ ID NO: 707387 - RNA, 18 nt, Human
cgugaugaugaagggcag

SEQ ID NO: 707388 - RNA, 22 nt, Human
cucggcgcucauggugcucucc

SEQ ID NO: 707389 - RNA, 18 nt, Human
cugaagacgcggccggcg

SEQ ID NO: 707390 - RNA, 19 nt, Human
cugcagugggagcaccacg

SEQ ID NO: 707391 - RNA, 22 nt, Human
cugggaccacagagggaucugc

SEQ ID NO: 707392 - RNA, 21 nt, Human
cuugaacccguaggccuuggc

SEQ ID NO: 707393 - RNA, 19 nt, Human
gaaguagaaggaggucagg

SEQ ID NO: 707394 - RNA, 20 nt, Human
gaagugguggucgggcuugu

SEQ ID NO: 707395 - RNA, 20 nt, Human
gaccugguugaacauggcug

SEQ ID NO: 707396 - RNA, 19 nt, Human
gacugguagagcagugugu

SEQ ID NO: 707397 - RNA, 20 nt, Human
gagaagcaucgucuccagga

SEQ ID NO: 707398 - RNA, 24 nt, Human
gcagcagaagggggcuuucacagg

SEQ ID NO: 707399 - RNA, 24 nt, Human
gcagccccagcauccgaugcccag

SEQ ID NO: 707400 - RNA, 24 nt, Human
gcagccccugccccgagaaggccc

SEQ ID NO: 707401 - RNA, 22 nt, Human
gcaggcuguccagguuguccac

SEQ ID NO: 707402 - RNA, 18 nt, Human
gcagggugcagaagagga

SEQ ID NO: 707403 - RNA, 18 nt, Human
gccacuguccccauggag

SEQ ID NO: 707404 - RNA, 23 nt, Human
gccccagggccccuucacuuccc

SEQ ID NO: 707405 - RNA, 24 nt, Human
gcccccgccgcgcgccucccggca

SEQ ID NO: 707406 - RNA, 20 nt, Human
gccccgagaaggcccucuuc

SEQ ID NO: 707407 - RNA, 21 nt, Human
gccccugccccgagaaggccc

SEQ ID NO: 707408 - RNA, 18 nt, Human
gccuccgggcccacugca

SEQ ID NO: 707409 - RNA, 23 nt, Human
gcgcauguuggaaggguggguga

SEQ ID NO: 707410 - RNA, 22 nt, Human
gcucgcaugagguccuggucuu

SEQ ID NO: 707411 - RNA, 22 nt, Human
gcugcccccgcccccaccgccg

SEQ ID NO: 707412 - RNA, 22 nt, Human
gcuguaguugcccccugacuuc

SEQ ID NO: 707413 - RNA, 19 nt, Human
ggacgagucauugaaggag

SEQ ID NO: 707414 - RNA, 22 nt, Human
ggcacgaugaaguuguacagcc

SEQ ID NO: 707415 - RNA, 18 nt, Human
ggcucagccuccgggccc

SEQ ID NO: 707416 - RNA, 20 nt, Human
gggcaggcgggccggacccu

SEQ ID NO: 707417 - RNA, 21 nt, Human
gggcgugacgucaccguagcc

SEQ ID NO: 707418 - RNA, 18 nt, Human
ggguggaggucgccgggc

SEQ ID NO: 707419 - RNA, 22 nt, Human
guagcccacgguggagaaggug

SEQ ID NO: 707420 - RNA, 23 nt, Human
guccgcauagaugaugccacacu

SEQ ID NO: 707421 - RNA, 18 nt, Human
gugaagcucuugcccucg

SEQ ID NO: 707422 - RNA, 22 nt, Human
gugaugaugaagggcagagugu

SEQ ID NO: 707423 - RNA, 23 nt, Human
gugauggugaucauguaguccuu

SEQ ID NO: 707424 - RNA, 18 nt, Human
uacgugcggauccacagg

SEQ ID NO: 707425 - RNA, 18 nt, Human
uagaugccaauggggauc

SEQ ID NO: 707426 - RNA, 22 nt, Human
uagcagugggugcucugcgggg

SEQ ID NO: 707427 - RNA, 20 nt, Human
ucacaggcaggagguggcac

SEQ ID NO: 707428 - RNA, 21 nt, Human
ucaccgagaucugggacuggg

SEQ ID NO: 707429 - RNA, 18 nt, Human
ucagaggcggccaggaug

SEQ ID NO: 707430 - RNA, 22 nt, Human
ucagcccgaugaggcacacgcc

SEQ ID NO: 707431 - RNA, 20 nt, Human
ucagcuuguucuugaacccg

SEQ ID NO: 707432 - RNA, 19 nt, Human
ucaggagggacagguucuc

SEQ ID NO: 707433 - RNA, 21 nt, Human
uccagagguagacgagcuccu

SEQ ID NO: 707434 - RNA, 18 nt, Human
uccccgugaaaacgaggc

SEQ ID NO: 707435 - RNA, 20 nt, Human
uccccgugaaaacgaggcac

SEQ ID NO: 707436 - RNA, 18 nt, Human
ucccuccuggccgcggga

SEQ ID NO: 707437 - RNA, 24 nt, Human
uccggagacuccugucccuccugg

SEQ ID NO: 707438 - RNA, 18 nt, Human
uccguggugaugcugagg

SEQ ID NO: 707439 - RNA, 21 nt, Human
uccucacacaccacgugguca

SEQ ID NO: 707440 - RNA, 18 nt, Human
uccucacaguccuccacg

SEQ ID NO: 707441 - RNA, 21 nt, Human
uccucacaguccuccacguuc

SEQ ID NO: 707442 - RNA, 28 nt, Human
uccuccucacacaccacguggucaggau

SEQ ID NO: 707443 - RNA, 18 nt, Human
uccuggccgcgggacgug

SEQ ID NO: 707444 - RNA, 18 nt, Human
ucgaucuugagggagcug

SEQ ID NO: 707445 - RNA, 21 nt, Human
ucgcaugagguccuggucuuu

SEQ ID NO: 707446 - RNA, 18 nt, Human
ucggcgcuggaggagcag

SEQ ID NO: 707447 - RNA, 22 nt, Human
ucucgcccgcccgcuccaggug

SEQ ID NO: 707448 - RNA, 19 nt, Human
ucugcagccgugcgguccc

SEQ ID NO: 707449 - RNA, 19 nt, Human
ucugccgcuccauccagag

SEQ ID NO: 707450 - RNA, 18 nt, Human
ucuugaacccguaggccu

SEQ ID NO: 707451 - RNA, 21 nt, Human
ugaggguggaggucgccgggc

SEQ ID NO: 707452 - RNA, 18 nt, Human
ugagguccuggucuuuga

SEQ ID NO: 707453 - RNA, 23 nt, Human
ugaugaugaagggcagaguguug

SEQ ID NO: 707454 - RNA, 24 nt, Human
ugaugaugaagggcagaguguuga

SEQ ID NO: 707455 - RNA, 18 nt, Human
ugccacugcuccggagac

SEQ ID NO: 707456 - RNA, 19 nt, Human
ugccgcagguccccgugaa

SEQ ID NO: 707457 - RNA, 19 nt, Human
uggaggagcagagcuucug

SEQ ID NO: 707458 - RNA, 24 nt, Human
uggaucgcccacagugucaucuuu

SEQ ID NO: 707459 - RNA, 18 nt, Human
uggcacaggguuggggag

SEQ ID NO: 707460 - RNA, 19 nt, Human
ugggacugggcucugaggu

SEQ ID NO: 707461 - RNA, 20 nt, Human
uggggcacaggaugaccacc

SEQ ID NO: 707462 - RNA, 21 nt, Human
uggugaugcugaggcugggga

SEQ ID NO: 707463 - RNA, 20 nt, Human
uguccagccgcaggcagcag

SEQ ID NO: 707464 - RNA, 22 nt, Human
uguccagguuguccacagagcc

SEQ ID NO: 707465 - RNA, 18 nt, Human
ugugggcguggaaggccg

SEQ ID NO: 707466 - RNA, 20 nt, Human
uguugugcuugcagcccuug

SEQ ID NO: 707467 - RNA, 23 nt, Human
uucacaggcaggagguggcacag

SEQ ID NO: 707468 - RNA, 22 nt, Human
uucacggcccaggcgcgcagga

SEQ ID NO: 707469 - RNA, 20 nt, Human
uugaacccguaggccuuggc

SEQ ID NO: 707470 - RNA, 24 nt, Human
uugcccccugacuucugccgcucc

SEQ ID NO: 707471 - RNA, 19 nt, Human
uuggaaagagccagagagu

SEQ ID NO: 707472 - RNA, 22 nt, Human
uuggaagggugggugagcuccg

SEQ ID NO: 707473 - RNA, 25 nt, Human
uuguccagcagcagcacgauggggu

SEQ ID NO: 707474 - RNA, 21 nt, Human
uuguuuucagguuugaggauc

SEQ ID NO: 707475 - RNA, 26 nt, Human
uuugggcagccccagcauccugacag

SEQ ID NO: 707476 - RNA, 23 nt, Human
aaucagaaagcuguccauaguau

SEQ ID NO: 707477 - RNA, 20 nt, Human
acccgcugugcgccuuccuc

SEQ ID NO: 707478 - RNA, 19 nt, Human
acgccggaagcuuuggucc

SEQ ID NO: 707479 - RNA, 19 nt, Human
caaguggcagaaagaggag

SEQ ID NO: 707480 - RNA, 19 nt, Human
cagaaagcuguccauagua

SEQ ID NO: 707481 - RNA, 19 nt, Human
cagaauacagaaauccaca

SEQ ID NO: 707482 - RNA, 24 nt, Human
cagcgcacaaguggcagaaagagg

SEQ ID NO: 707483 - RNA, 21 nt, Human
cauccagugaugucauuuaac

SEQ ID NO: 707484 - RNA, 21 nt, Human
ccaagcccgacacagucccug

SEQ ID NO: 707485 - RNA, 19 nt, Human
ccuccugccgcuagggagc

SEQ ID NO: 707486 - RNA, 21 nt, Human
ccugcaaaguuugaacauuug

SEQ ID NO: 707487 - RNA, 20 nt, Human
ccugugcacacugccggucg

SEQ ID NO: 707488 - RNA, 19 nt, Human
cgccuuccuccuccugccg

SEQ ID NO: 707489 - RNA, 19 nt, Human
cuaguagaugaagcaauau

SEQ ID NO: 707490 - RNA, 24 nt, Human
cuccugccgcuagggagccgggag

SEQ ID NO: 707491 - RNA, 22 nt, Human
cugguggcggccgggauucccc

SEQ ID NO: 707492 - RNA, 20 nt, Human
ggagacagggagcagaggaa

SEQ ID NO: 707493 - RNA, 19 nt, Human
gggagccgggagugcgcgg

SEQ ID NO: 707494 - RNA, 23 nt, Human
gggcgccacaaaguuggggacac

SEQ ID NO: 707495 - RNA, 24 nt, Human
uacugcaaucuaagcaguuuuggg

SEQ ID NO: 707496 - RNA, 19 nt, Human
uaugcuguuuuaugcucca

SEQ ID NO: 707497 - RNA, 24 nt, Human
ucagcaaaaauuaauuaagaugag

SEQ ID NO: 707498 - RNA, 20 nt, Human
ucaguugggagaaugaagau

SEQ ID NO: 707499 - RNA, 19 nt, Human
uccacauacuacacucagu

SEQ ID NO: 707500 - RNA, 22 nt, Human
ucuccuuggcgcacccucucca

SEQ ID NO: 707501 - RNA, 19 nt, Human
ugaaaaagaagauagggau

SEQ ID NO: 707502 - RNA, 22 nt, Human
ugaaaaagaagauagggauaua

SEQ ID NO: 707503 - RNA, 21 nt, Human
ugaaauacuaagaauaugcug

SEQ ID NO: 707504 - RNA, 25 nt, Human
ugaacauuugcuauuuaccccaaca

SEQ ID NO: 707505 - RNA, 21 nt, Human
ugaagcaauauaucagcaaaa

SEQ ID NO: 707506 - RNA, 22 nt, Human
ugaugaaugucaaaaugccugc

SEQ ID NO: 707507 - RNA, 19 nt, Human
ugcuuuaucauuuuaguua

SEQ ID NO: 707508 - RNA, 18 nt, Human
uggcacggccccuggugg

SEQ ID NO: 707509 - RNA, 27 nt, Human
uggcagaaagaggagacagggagcaga

SEQ ID NO: 707510 - RNA, 18 nt, Human
uguaaacucauguacugc

SEQ ID NO: 707511 - RNA, 24 nt, Human
uguucacuaccucacuuuuacaua

SEQ ID NO: 707512 - RNA, 26 nt, Human
uuauuuaguaauuccaguguagaaau

SEQ ID NO: 707513 - RNA, 23 nt, Human
uucaugaaauacuaagaauaugc

SEQ ID NO: 707514 - RNA, 24 nt, Human
uucauuauuuuaaagccauaaugu

SEQ ID NO: 707515 - RNA, 24 nt, Human
uuccccgggcucccgaagggguua

SEQ ID NO: 707516 - RNA, 22 nt, Human
uuuaacauauauuucccauuuu

SEQ ID NO: 707517 - RNA, 22 nt, Human
uuuuuagcuuuagagguuuugg

SEQ ID NO: 707518 - RNA, 22 nt, Human
uuuuuuuuuuuuuuagcuuuag

SEQ ID NO: 707519 - RNA, 23 nt, Human
uuuuuuuuuuuuuuuuuagcuuu

SEQ ID NO: 707520 - RNA, 20 nt, Human
aaauuuggggccacagagua

SEQ ID NO: 707521 - RNA, 22 nt, Human
aagaaaaaacgagucaucagaa

SEQ ID NO: 707522 - RNA, 21 nt, Human
aggcaaaaaacuacaaacagc

SEQ ID NO: 707523 - RNA, 20 nt, Human
agggaggcaggcuggcgggg

SEQ ID NO: 707524 - RNA, 27 nt, Human
aguagaagaaaaaacgagucaucagaa

SEQ ID NO: 707525 - RNA, 22 nt, Human
agucaucagaaucaaaaacuaa

SEQ ID NO: 707526 - RNA, 24 nt, Human
caaguccugagcuccccaagaccu

SEQ ID NO: 707527 - RNA, 20 nt, Human
cagaaucaaaaacuaaagag

SEQ ID NO: 707528 - RNA, 19 nt, Human
ccacagaguagaagaaaaa

SEQ ID NO: 707529 - RNA, 18 nt, Human
ccccugaaacccggcagg

SEQ ID NO: 707530 - RNA, 25 nt, Human
ccccugaaacccggcaggaggcggg

SEQ ID NO: 707531 - RNA, 22 nt, Human
cccgcugcugccgaggagagag

SEQ ID NO: 707532 - RNA, 23 nt, Human
ccuccacugucccccugaaaccc

SEQ ID NO: 707533 - RNA, 22 nt, Human
ccuggauccuccacuguccccc

SEQ ID NO: 707534 - RNA, 20 nt, Human
ccuuccucugccucccgcug

SEQ ID NO: 707535 - RNA, 28 nt, Human
cggcaggaggcgggaugggaggucgacc

SEQ ID NO: 707536 - RNA, 23 nt, Human
cuccccaagaccuggauccucca

SEQ ID NO: 707537 - RNA, 20 nt, Human
cugaacggguagcugggcug

SEQ ID NO: 707538 - RNA, 21 nt, Human
cugaacggguagcugggcugg

SEQ ID NO: 707539 - RNA, 18 nt, Human
cuggaugggaaagcucuu

SEQ ID NO: 707540 - RNA, 18 nt, Human
gaacggguagcugggcug

SEQ ID NO: 707541 - RNA, 19 nt, Human
gaggcaggcuggcgggggg

SEQ ID NO: 707542 - RNA, 20 nt, Human
ggacccuaggugcgcuccgc

SEQ ID NO: 707543 - RNA, 23 nt, Human
ggauggggagcacaagagguggg

SEQ ID NO: 707544 - RNA, 22 nt, Human
gggagggaggcaggcuggcggg

SEQ ID NO: 707545 - RNA, 19 nt, Human
gggcuggggggacggaaga

SEQ ID NO: 707546 - RNA, 20 nt, Human
guccugagcuccccaagacc

SEQ ID NO: 707547 - RNA, 21 nt, Human
guggaaagauuuuuuuuucuu

SEQ ID NO: 707548 - RNA, 19 nt, Human
uaaaaggcaaaaaacuaca

SEQ ID NO: 707549 - RNA, 24 nt, Human
uaaaaggcaaaaaacuacaaacag

SEQ ID NO: 707550 - RNA, 20 nt, Human
uagaagaaaaaacgagucau

SEQ ID NO: 707551 - RNA, 24 nt, Human
uaggugcgcuccgcuccggggagg

SEQ ID NO: 707552 - RNA, 24 nt, Human
uauaaaauuuggggccacagagua

SEQ ID NO: 707553 - RNA, 20 nt, Human
ucagaaucaaaaacuaaaga

SEQ ID NO: 707554 - RNA, 22 nt, Human
ucccgcugcugccgaggagaga

SEQ ID NO: 707555 - RNA, 24 nt, Human
uccuccacugucccccugaaaccc

SEQ ID NO: 707556 - RNA, 21 nt, Human
uccucugccucccgcugcugc

SEQ ID NO: 707557 - RNA, 19 nt, Human
ucugccgccuuccucugcc

SEQ ID NO: 707558 - RNA, 20 nt, Human
uggaaagauuuuuuuuucuu

SEQ ID NO: 707559 - RNA, 28 nt, Human
aagauaaggcaagaugcauuaaacagaa

SEQ ID NO: 707560 - RNA, 23 nt, Human
acaguaauaaaaaaagauaaggc

SEQ ID NO: 707561 - RNA, 23 nt, Human
acugaauuuauuaauacagcauu

SEQ ID NO: 707562 - RNA, 22 nt, Human
agauuucaaacaaauacagcuc

SEQ ID NO: 707563 - RNA, 26 nt, Human
aggacagaugcuggugauggucuuug

SEQ ID NO: 707564 - RNA, 26 nt, Human
caaaaaauaaauauaguggaaugcaa

SEQ ID NO: 707565 - RNA, 19 nt, Human
cguaucaagcaucuuaugc

SEQ ID NO: 707566 - RNA, 20 nt, Human
cuggugauggucuuuggcac

SEQ ID NO: 707567 - RNA, 18 nt, Human
uaaaaaaagauaaggcaa

SEQ ID NO: 707568 - RNA, 19 nt, Human
uaaggcaagaugcauuaaa

SEQ ID NO: 707569 - RNA, 26 nt, Human
uaaggcaagaugcauuaaacagaaac

SEQ ID NO: 707570 - RNA, 20 nt, Human
uacaauuucauugcagacac

SEQ ID NO: 707571 - RNA, 23 nt, Human
ucacaaaaucuucacuuuuggaa

SEQ ID NO: 707572 - RNA, 18 nt, Human
uggaaugcaaguuugagg

SEQ ID NO: 707573 - RNA, 18 nt, Human
uuucaaacaaauacagcu

SEQ ID NO: 707574 - RNA, 22 nt, Human
uuuuccucugcguuuuuacaga

SEQ ID NO: 707575 - RNA, 26 nt, Human
uuuugccaaaaaauaaauauagugga

SEQ ID NO: 707576 - RNA, 22 nt, Human
aagaggagggacauuguuccag

SEQ ID NO: 707577 - RNA, 26 nt, Human
aaguacaaggcagguaucagccacug

SEQ ID NO: 707578 - RNA, 24 nt, Human
aauauuugucuucuugcauuagaa

SEQ ID NO: 707579 - RNA, 19 nt, Human
aaugggucuuuaagggcga

SEQ ID NO: 707580 - RNA, 21 nt, Human
agcugacaccuuuauaucuug

SEQ ID NO: 707581 - RNA, 20 nt, Human
aggcagguaucagccacugg

SEQ ID NO: 707582 - RNA, 22 nt, Human
agucuugcccucaggccuugga

SEQ ID NO: 707583 - RNA, 19 nt, Human
auauaucuguaucugcuca

SEQ ID NO: 707584 - RNA, 22 nt, Human
auuguuccagauugggguugac

SEQ ID NO: 707585 - RNA, 22 nt, Human
cacacuuaaaacuagcugacac

SEQ ID NO: 707586 - RNA, 21 nt, Human
caccuaaaacugaaaggaaaa

SEQ ID NO: 707587 - RNA, 19 nt, Human
cagagcccugccugcgccu

SEQ ID NO: 707588 - RNA, 23 nt, Human
caguuuuuguuucaagacaaaga

SEQ ID NO: 707589 - RNA, 22 nt, Human
cauucaaaauaguuuccuucau

SEQ ID NO: 707590 - RNA, 18 nt, Human
ccccagagcccugccugc

SEQ ID NO: 707591 - RNA, 21 nt, Human
ccccagagcccugccugcgcc

SEQ ID NO: 707592 - RNA, 21 nt, Human
ccggccccggucucuaggugc

SEQ ID NO: 707593 - RNA, 22 nt, Human
ccggccccggucucuaggugcc

SEQ ID NO: 707594 - RNA, 21 nt, Human
ccucacagcuccgcgaucgca

SEQ ID NO: 707595 - RNA, 19 nt, Human
ccugcgccucacagcuccg

SEQ ID NO: 707596 - RNA, 24 nt, Human
cggcugccacgucuccggccccgg

SEQ ID NO: 707597 - RNA, 22 nt, Human
cucauaaguaaaacagugauug

SEQ ID NO: 707598 - RNA, 26 nt, Human
cuccgcgaucgcacccgcgcgccgcc

SEQ ID NO: 707599 - RNA, 22 nt, Human
cugguaaauuugguuugcuucu

SEQ ID NO: 707600 - RNA, 19 nt, Human
cuugaccaccuaaauuugg

SEQ ID NO: 707601 - RNA, 24 nt, Human
gccccagagcccugccugcgccuc

SEQ ID NO: 707602 - RNA, 19 nt, Human
gccccggucucuaggugcc

SEQ ID NO: 707603 - RNA, 19 nt, Human
gccugaaggcagugugaaa

SEQ ID NO: 707604 - RNA, 19 nt, Human
gcgcccgcgcccagcaaac

SEQ ID NO: 707605 - RNA, 21 nt, Human
ggagaacaaucauuuauguuu

SEQ ID NO: 707606 - RNA, 18 nt, Human
ggagggacauuguuccag

SEQ ID NO: 707607 - RNA, 25 nt, Human
ggcauuuguuucuuuauugaaaaua

SEQ ID NO: 707608 - RNA, 24 nt, Human
uaaaacaguuuuuguuucaagaca

SEQ ID NO: 707609 - RNA, 24 nt, Human
uaaguaaaacagugauugugcaaa

SEQ ID NO: 707610 - RNA, 19 nt, Human
uaccuggaaaguggaaauu

SEQ ID NO: 707611 - RNA, 24 nt, Human
uacuuucgcaccuaaaacugaaag

SEQ ID NO: 707612 - RNA, 18 nt, Human
uagcugacaccuuuauau

SEQ ID NO: 707613 - RNA, 19 nt, Human
uagcugacaccuuuauauc

SEQ ID NO: 707614 - RNA, 29 nt, Human
ucuaagaggagggacauuguuccguccgg

SEQ ID NO: 707615 - RNA, 19 nt, Human
ucuaccuggaaaguggaaa

SEQ ID NO: 707616 - RNA, 21 nt, Human
ucucuaggugccccagagccc

SEQ ID NO: 707617 - RNA, 19 nt, Human
ucuggcgggcagggcggcu

SEQ ID NO: 707618 - RNA, 21 nt, Human
ugaaaaaauucaaaccaguaa

SEQ ID NO: 707619 - RNA, 23 nt, Human
ugaaaaaauucaaaccaguaaaa

SEQ ID NO: 707620 - RNA, 22 nt, Human
ugacugauuacuuucgcaccua

SEQ ID NO: 707621 - RNA, 18 nt, Human
ugacuugcucaucaugag

SEQ ID NO: 707622 - RNA, 19 nt, Human
ugagaaggucuucugggug

SEQ ID NO: 707623 - RNA, 19 nt, Human
ugccccagagcccugccug

SEQ ID NO: 707624 - RNA, 20 nt, Human
ugccccagagcccugccugc

SEQ ID NO: 707625 - RNA, 29 nt, Human
ugcccucaggccuuggagaacaaucauuu

SEQ ID NO: 707626 - RNA, 21 nt, Human
ugcugaaauccacacuaaaca

SEQ ID NO: 707627 - RNA, 23 nt, Human
uggaaaguggaaauucacaagaa

SEQ ID NO: 707628 - RNA, 24 nt, Human
uggaaaguggaaauucacaagaac

SEQ ID NO: 707629 - RNA, 19 nt, Human
uggcgggcagggcggcugc

SEQ ID NO: 707630 - RNA, 18 nt, Human
uguaucugcucauaaguc

SEQ ID NO: 707631 - RNA, 18 nt, Human
ugugaaagugaaauaagu

SEQ ID NO: 707632 - RNA, 23 nt, Human
uguucacaucuguaucugcugga

SEQ ID NO: 707633 - RNA, 18 nt, Human
uguugcagugaggcacca

SEQ ID NO: 707634 - RNA, 24 nt, Human
uuagaacacaagcauuguggaugg

SEQ ID NO: 707635 - RNA, 20 nt, Human
uucugggugggaugaucagg

SEQ ID NO: 707636 - RNA, 20 nt, Human
aacaaaauaacuguccaucc

SEQ ID NO: 707637 - RNA, 27 nt, Human
aagcaacaccaccaccucuggcacuca

SEQ ID NO: 707638 - RNA, 19 nt, Human
acccaggccuauuacccgg

SEQ ID NO: 707639 - RNA, 19 nt, Human
cacccccuuucccagccag

SEQ ID NO: 707640 - RNA, 20 nt, Human
cacccccuuucccagccagg

SEQ ID NO: 707641 - RNA, 22 nt, Human
caccucuggcacucagggaccc

SEQ ID NO: 707642 - RNA, 25 nt, Human
cagagggggccucccccugaggccc

SEQ ID NO: 707643 - RNA, 18 nt, Human
caggcccaucccugggaa

SEQ ID NO: 707644 - RNA, 19 nt, Human
ccacacccccuuucccagc

SEQ ID NO: 707645 - RNA, 21 nt, Human
ccacacccccuuucccagcca

SEQ ID NO: 707646 - RNA, 23 nt, Human
ccacacccccuuucccagccagg

SEQ ID NO: 707647 - RNA, 22 nt, Human
ccccugaggcccccauuggccc

SEQ ID NO: 707648 - RNA, 24 nt, Human
ccgccuccaccgcccgagccccgg

SEQ ID NO: 707649 - RNA, 21 nt, Human
cggccagaggguuugggggcc

SEQ ID NO: 707650 - RNA, 22 nt, Human
cucccagguauccaagaauaaa

SEQ ID NO: 707651 - RNA, 22 nt, Human
cugaggcauccuggccucccuu

SEQ ID NO: 707652 - RNA, 20 nt, Human
gaagauaagcaacaccacca

SEQ ID NO: 707653 - RNA, 19 nt, Human
gccgcgcuccggcuccgcc

SEQ ID NO: 707654 - RNA, 19 nt, Human
gcuccggcuccgccuccac

SEQ ID NO: 707655 - RNA, 22 nt, Human
gcuuuggacuucuuuugagaug

SEQ ID NO: 707656 - RNA, 18 nt, Human
ggcacaugauucccgcuu

SEQ ID NO: 707657 - RNA, 25 nt, Human
uaagcaacaccaccaccucuggcac

SEQ ID NO: 707658 - RNA, 18 nt, Human
ucaacaaaauaacugucc

SEQ ID NO: 707659 - RNA, 18 nt, Human
uccacacccccuuuccca

SEQ ID NO: 707660 - RNA, 23 nt, Human
uccaccgcccgagccccggcgcc

SEQ ID NO: 707661 - RNA, 22 nt, Human
ucccggaagauggguuauuugc

SEQ ID NO: 707662 - RNA, 19 nt, Human
ucccggggcuccgcugagg

SEQ ID NO: 707663 - RNA, 21 nt, Human
ucccugggaaccacauuucca

SEQ ID NO: 707664 - RNA, 23 nt, Human
ucccugggaaccacauuuccaga

SEQ ID NO: 707665 - RNA, 21 nt, Human
uccuggaagccugcucuuucc

SEQ ID NO: 707666 - RNA, 19 nt, Human
ugaggcauccuggccuccc

SEQ ID NO: 707667 - RNA, 21 nt, Human
ugagugggacccaggccuauu

SEQ ID NO: 707668 - RNA, 22 nt, Human
uggccgcgcuccggcuccgccu

SEQ ID NO: 707669 - RNA, 21 nt, Human
uguacaaaaacaaugauacuc

SEQ ID NO: 707670 - RNA, 22 nt, Human
uuuuaacacugaggcauccugg

SEQ ID NO: 707671 - RNA, 21 nt, Human
aauacauauaggauacuugau

SEQ ID NO: 707672 - RNA, 19 nt, Human
acagcuggcucuauccucc

SEQ ID NO: 707673 - RNA, 19 nt, Human
agaaaggaauacauauagg

SEQ ID NO: 707674 - RNA, 18 nt, Human
caucgcccccgcccgcac

SEQ ID NO: 707675 - RNA, 20 nt, Human
cauucucguuccuccgauca

SEQ ID NO: 707676 - RNA, 20 nt, Human
cccgcccgcacgugcagccg

SEQ ID NO: 707677 - RNA, 19 nt, Human
cccgcgccgagccaaccgc

SEQ ID NO: 707678 - RNA, 19 nt, Human
cgcaucgcccccgcccgca

SEQ ID NO: 707679 - RNA, 21 nt, Human
cgccgagccaaccgccgccaa

SEQ ID NO: 707680 - RNA, 23 nt, Human
cgccgagccaaccgccgccaaca

SEQ ID NO: 707681 - RNA, 21 nt, Human
cucccgcgccgagccaaccgc

SEQ ID NO: 707682 - RNA, 19 nt, Human
gacuaucgcaggagaggug

SEQ ID NO: 707683 - RNA, 18 nt, Human
gagcacccaggacuaucg

SEQ ID NO: 707684 - RNA, 20 nt, Human
gagguggaacagaugaagug

SEQ ID NO: 707685 - RNA, 20 nt, Human
uaaccccuugggccacaucu

SEQ ID NO: 707686 - RNA, 19 nt, Human
ucaguggagcacccaggac

SEQ ID NO: 707687 - RNA, 18 nt, Human
ucccgcgccgagccaacc

SEQ ID NO: 707688 - RNA, 24 nt, Human
uccuccgaucagugacgcaucgcc

SEQ ID NO: 707689 - RNA, 26 nt, Human
ucuauccuccaaucaguggagcacca

SEQ ID NO: 707690 - RNA, 20 nt, Human
ucucuguaaaucugaagagu

SEQ ID NO: 707691 - RNA, 19 nt, Human
ugauaagacuguggcugaa

SEQ ID NO: 707692 - RNA, 19 nt, Human
uucucuguaaaucugaaga

SEQ ID NO: 707693 - RNA, 18 nt, Human
aaaaaagcaucuacacac

SEQ ID NO: 707694 - RNA, 22 nt, Human
aaaacccacguaaugaaaaagu

SEQ ID NO: 707695 - RNA, 18 nt, Human
aaacaacaaagaaaaaag

SEQ ID NO: 707696 - RNA, 19 nt, Human
aaacaacaaagaaaaaagc

SEQ ID NO: 707697 - RNA, 21 nt, Human
aaacaacaaagaaaaaagcau

SEQ ID NO: 707698 - RNA, 22 nt, Human
aaacagcccugaauuuugaaau

SEQ ID NO: 707699 - RNA, 24 nt, Human
aaacagcccugaauuuugaaaugu

SEQ ID NO: 707700 - RNA, 20 nt, Human
aaaccuacucccucccucua

SEQ ID NO: 707701 - RNA, 22 nt, Human
aagaaggggaccacgaagaaaa

SEQ ID NO: 707702 - RNA, 18 nt, Human
aagucaguuuuacaagcc

SEQ ID NO: 707703 - RNA, 19 nt, Human
aauucaggaggccuucccu

SEQ ID NO: 707704 - RNA, 18 nt, Human
acagaagccagaaugcag

SEQ ID NO: 707705 - RNA, 25 nt, Human
agaaaucaguaacaacuuugcucau

SEQ ID NO: 707706 - RNA, 21 nt, Human
agaagaaggggaccacgaaga

SEQ ID NO: 707707 - RNA, 22 nt, Human
agaagaaggggaccacgaagaa

SEQ ID NO: 707708 - RNA, 21 nt, Human
auggaauaagguggggagaag

SEQ ID NO: 707709 - RNA, 24 nt, Human
caaaaccuacucccucccucuaag

SEQ ID NO: 707710 - RNA, 22 nt, Human
caaagaaaaaagcaucuacaca

SEQ ID NO: 707711 - RNA, 22 nt, Human
caagcaaugucauuuuugaaac

SEQ ID NO: 707712 - RNA, 24 nt, Human
caccaucaaccucuucaaaaccua

SEQ ID NO: 707713 - RNA, 18 nt, Human
cagaagccagaaugcaga

SEQ ID NO: 707714 - RNA, 19 nt, Human
cagaagccagaaugcagag

SEQ ID NO: 707715 - RNA, 19 nt, Human
cagacauuuugacauaagu

SEQ ID NO: 707716 - RNA, 22 nt, Human
caucaaacucaauucaggaggc

SEQ ID NO: 707717 - RNA, 22 nt, Human
ccacgaagaaaaacacuuagac

SEQ ID NO: 707718 - RNA, 18 nt, Human
cccaccaccaucaaccuc

SEQ ID NO: 707719 - RNA, 23 nt, Human
ccccaccaccaucaaccucuuca

SEQ ID NO: 707720 - RNA, 21 nt, Human
cccuccccaccaccaucaacc

SEQ ID NO: 707721 - RNA, 31 nt, Human
cccuccccaccaccaucaaccucuucaaaaa

SEQ ID NO: 707722 - RNA, 21 nt, Human
ccuccccaccaccaucaaccu

SEQ ID NO: 707723 - RNA, 21 nt, Human
cggcagcgacggaggcccgag

SEQ ID NO: 707724 - RNA, 27 nt, Human
cuccccaccaccaucaaccucuucaaa

SEQ ID NO: 707725 - RNA, 25 nt, Human
cugcagugucccuuuuuauaucaug

SEQ ID NO: 707726 - RNA, 22 nt, Human
cuucaaaaccuacucccucccu

SEQ ID NO: 707727 - RNA, 19 nt, Human
cuuccgagaacaaaauggg

SEQ ID NO: 707728 - RNA, 21 nt, Human
gaagaaaaacacuuagacaau

SEQ ID NO: 707729 - RNA, 20 nt, Human
gagaacaaaaugggaggacg

SEQ ID NO: 707730 - RNA, 25 nt, Human
gagaagaaggggaccacgaagaaaa

SEQ ID NO: 707731 - RNA, 20 nt, Human
gcagacauuuugacauaagu

SEQ ID NO: 707732 - RNA, 18 nt, Human
gccucaaaucaaaacuaa

SEQ ID NO: 707733 - RNA, 18 nt, Human
gcggcagcgacggaggcc

SEQ ID NO: 707734 - RNA, 25 nt, Human
gcugcagacauuuugacauaaguuu

SEQ ID NO: 707735 - RNA, 18 nt, Human
ggaauaagguggggagaa

SEQ ID NO: 707736 - RNA, 20 nt, Human
ggacuaaacuuuauugacaa

SEQ ID NO: 707737 - RNA, 20 nt, Human
ggagauacaagaaaucagua

SEQ ID NO: 707738 - RNA, 20 nt, Human
ggcccgagcggcgguuggcg

SEQ ID NO: 707739 - RNA, 23 nt, Human
gggaugccucaaaucaaaacuaa

SEQ ID NO: 707740 - RNA, 18 nt, Human
ggggagaagaaggggacc

SEQ ID NO: 707741 - RNA, 24 nt, Human
guaaagcaacaggaauccugggag

SEQ ID NO: 707742 - RNA, 18 nt, Human
guacaaauccaauuagga

SEQ ID NO: 707743 - RNA, 25 nt, Human
uaaaaaaggacuaaacuuuauugac

SEQ ID NO: 707744 - RNA, 21 nt, Human
uaaacaacaaagaaaaaagca

SEQ ID NO: 707745 - RNA, 21 nt, Human
uaaaucuuaaacagcccugaa

SEQ ID NO: 707746 - RNA, 23 nt, Human
uaacguuaaaaauugcaucaacu

SEQ ID NO: 707747 - RNA, 24 nt, Human
uaccuauuuaggcagacuuacaca

SEQ ID NO: 707748 - RNA, 20 nt, Human
uacuaugacugaaagauucu

SEQ ID NO: 707749 - RNA, 22 nt, Human
uacuuugucuuuuuaaauacug

SEQ ID NO: 707750 - RNA, 18 nt, Human
uaggcagacuuacacaug

SEQ ID NO: 707751 - RNA, 21 nt, Human
ucaaaaccuacucccucccuc

SEQ ID NO: 707752 - RNA, 23 nt, Human
ucaaaacuaagagaaacuuaaca

SEQ ID NO: 707753 - RNA, 18 nt, Human
ucaaccucuucaaaaccu

SEQ ID NO: 707754 - RNA, 25 nt, Human
uccaagugaacuuuucauggagugc

SEQ ID NO: 707755 - RNA, 18 nt, Human
ugaaauguagccuaguuu

SEQ ID NO: 707756 - RNA, 22 nt, Human
ugcagaguuaagaauggaauaa

SEQ ID NO: 707757 - RNA, 20 nt, Human
uggcagagcgggagcgguag

SEQ ID NO: 707758 - RNA, 23 nt, Human
uggcuaaaaagcucugcaucaaa

SEQ ID NO: 707759 - RNA, 21 nt, Human
ugggauucugcaacuacaacu

SEQ ID NO: 707760 - RNA, 23 nt, Human
ugggauucugcaacuacaacuuu

SEQ ID NO: 707761 - RNA, 18 nt, Human
ugucccuuuuuauaucau

SEQ ID NO: 707762 - RNA, 19 nt, Human
uuaaaaauugcaucaacua

SEQ ID NO: 707763 - RNA, 23 nt, Human
uuuuaaaauacuacauacagaag

SEQ ID NO: 707764 - RNA, 19 nt, Human
uuuuccccucauguuuguu

SEQ ID NO: 707765 - RNA, 23 nt, Human
aacccccgaccccgcccgcgccc

SEQ ID NO: 707766 - RNA, 22 nt, Human
acacuacagaacauuucaagac

SEQ ID NO: 707767 - RNA, 20 nt, Human
accccgcccgcgcccccagc

SEQ ID NO: 707768 - RNA, 20 nt, Human
acuuguaauuggcuucccuu

SEQ ID NO: 707769 - RNA, 19 nt, Human
acuuugaacaguauacagg

SEQ ID NO: 707770 - RNA, 18 nt, Human
agcaagaggagacuuugc

SEQ ID NO: 707771 - RNA, 22 nt, Human
aggcaguccacggcgauccccg

SEQ ID NO: 707772 - RNA, 18 nt, Human
aggcgcacggggggcggc

SEQ ID NO: 707773 - RNA, 20 nt, Human
aguaguuuuaaguuccaucc

SEQ ID NO: 707774 - RNA, 23 nt, Human
auguuggcaagagaaaaaaaaac

SEQ ID NO: 707775 - RNA, 21 nt, Human
cacccgagccacagcugcgac

SEQ ID NO: 707776 - RNA, 18 nt, Human
caccugccagcacccgag

SEQ ID NO: 707777 - RNA, 19 nt, Human
cagcacccgagccacagcu

SEQ ID NO: 707778 - RNA, 20 nt, Human
cagcacccgagccacagcug

SEQ ID NO: 707779 - RNA, 18 nt, Human
cagcaccugccagcaccc

SEQ ID NO: 707780 - RNA, 20 nt, Human
cagcggcggggacccggggg

SEQ ID NO: 707781 - RNA, 23 nt, Human
cagcggcggggacccgggggccg

SEQ ID NO: 707782 - RNA, 22 nt, Human
ccagcaccugccagcacccgag

SEQ ID NO: 707783 - RNA, 21 nt, Human
ccagcgccggcggcccccgcg

SEQ ID NO: 707784 - RNA, 18 nt, Human
cccagcgccggcggcccc

SEQ ID NO: 707785 - RNA, 20 nt, Human
cccccgaccccgcccgcgcc

SEQ ID NO: 707786 - RNA, 18 nt, Human
ccccgauccccgguggcc

SEQ ID NO: 707787 - RNA, 22 nt, Human
ccccgccagucccgccagcacc

SEQ ID NO: 707788 - RNA, 24 nt, Human
ccccgccagucccgccagcaccug

SEQ ID NO: 707789 - RNA, 24 nt, Human
cccgaccccgcccgcgcccccagc

SEQ ID NO: 707790 - RNA, 20 nt, Human
cccgagccacagcugcgacc

SEQ ID NO: 707791 - RNA, 19 nt, Human
cccgccagcaccugccagc

SEQ ID NO: 707792 - RNA, 23 nt, Human
cccggcaacccccgaccccgccc

SEQ ID NO: 707793 - RNA, 21 nt, Human
ccgaccgcucagccccgaucc

SEQ ID NO: 707794 - RNA, 21 nt, Human
ccgagccacagcugcgaccug

SEQ ID NO: 707795 - RNA, 22 nt, Human
ccugccagcacccgagccacag

SEQ ID NO: 707796 - RNA, 20 nt, Human
ccuuuaaaaugaaaggugag

SEQ ID NO: 707797 - RNA, 25 nt, Human
cggccggaaggcggcggcggcggca

SEQ ID NO: 707798 - RNA, 24 nt, Human
cggcgccccugaggcaguccacgg

SEQ ID NO: 707799 - RNA, 18 nt, Human
cggcggcccccgcgcucc

SEQ ID NO: 707800 - RNA, 23 nt, Human
cgggccgagcgggcugcggcgcc

SEQ ID NO: 707801 - RNA, 26 nt, Human
cuuaacacuacagaacauuucaagac

SEQ ID NO: 707802 - RNA, 24 nt, Human
gaccccgcccgcgcccccagcggg

SEQ ID NO: 707803 - RNA, 20 nt, Human
gaggagcgggcgcgggcggc

SEQ ID NO: 707804 - RNA, 23 nt, Human
gaggagcgggcgcgggcggcgcg

SEQ ID NO: 707805 - RNA, 18 nt, Human
gauguggacuccaggcgc

SEQ ID NO: 707806 - RNA, 22 nt, Human
gcaguccacggcgauccccgcc

SEQ ID NO: 707807 - RNA, 20 nt, Human
gcccucgggccgagcgggcu

SEQ ID NO: 707808 - RNA, 24 nt, Human
gcggcagcagcggccaagccgggc

SEQ ID NO: 707809 - RNA, 20 nt, Human
gcggcgcgguuaggcgggcc

SEQ ID NO: 707810 - RNA, 22 nt, Human
gcggcggcggcggcacgggggc

SEQ ID NO: 707811 - RNA, 18 nt, Human
gcgggccgaggaggagcg

SEQ ID NO: 707812 - RNA, 19 nt, Human
gggcggcgcccggcaaccc

SEQ ID NO: 707813 - RNA, 21 nt, Human
gggcggcgcccggcaaccccc

SEQ ID NO: 707814 - RNA, 22 nt, Human
gggcggcgcgguuaggcgggcc

SEQ ID NO: 707815 - RNA, 21 nt, Human
guccacggcgauccccgccag

SEQ ID NO: 707816 - RNA, 23 nt, Human
uauacagacuggaaauaacaaaa

SEQ ID NO: 707817 - RNA, 22 nt, Human
uccacggcgauccccgccaguc

SEQ ID NO: 707818 - RNA, 23 nt, Human
ucccgccagcaccugccagcacc

SEQ ID NO: 707819 - RNA, 24 nt, Human
ucccgccagcaccugccagcaccc

SEQ ID NO: 707820 - RNA, 18 nt, Human
ucuauggaaaccuuuaaa

SEQ ID NO: 707821 - RNA, 22 nt, Human
uuaaaaagggauuguucauaga

SEQ ID NO: 707822 - RNA, 19 nt, Human
uucaagacuugaguuacaa

SEQ ID NO: 707823 - RNA, 20 nt, Human
uuuaaguuccauccauucag

SEQ ID NO: 707824 - RNA, 21 nt, Human
uuugauuuauuuaaaaaggga

SEQ ID NO: 707825 - RNA, 19 nt, Human
uuuuaaguuccauccauuc

SEQ ID NO: 707826 - RNA, 20 nt, Human
aaaaaaaagaaauagcaaga

SEQ ID NO: 707827 - RNA, 25 nt, Human
aaaaaaaagauuuuucacagaugaa

SEQ ID NO: 707828 - RNA, 21 nt, Human
aaaaaguaaaaacugccauac

SEQ ID NO: 707829 - RNA, 23 nt, Human
aaaacagaagcccccaaacagaa

SEQ ID NO: 707830 - RNA, 21 nt, Human
aaacaaaacagaagcccccaa

SEQ ID NO: 707831 - RNA, 18 nt, Human
aaacagaagcccccaaac

SEQ ID NO: 707832 - RNA, 25 nt, Human
aagaaaaagcaugugagacacagaa

SEQ ID NO: 707833 - RNA, 21 nt, Human
aagaaauagcaagagugaccg

SEQ ID NO: 707834 - RNA, 20 nt, Human
aagucccccccacccugcuu

SEQ ID NO: 707835 - RNA, 21 nt, Human
acaaaacagaagcccccaaac

SEQ ID NO: 707836 - RNA, 21 nt, Human
agacacagaacaggcgagaga

SEQ ID NO: 707837 - RNA, 19 nt, Human
agagagugagggcccggca

SEQ ID NO: 707838 - RNA, 27 nt, Human
agcaagagugacuuuuuuuuuuccuuu

SEQ ID NO: 707839 - RNA, 24 nt, Human
aggaggcggcggcggcggcggcgg

SEQ ID NO: 707840 - RNA, 19 nt, Human
aggcgagagagugagggcc

SEQ ID NO: 707841 - RNA, 18 nt, Human
auaaguucugcuuugcuc

SEQ ID NO: 707842 - RNA, 21 nt, Human
aucucgcuaucuucucuggcu

SEQ ID NO: 707843 - RNA, 22 nt, Human
augcccccaagucccccccacc

SEQ ID NO: 707844 - RNA, 19 nt, Human
caaaacagaagcccccaaa

SEQ ID NO: 707845 - RNA, 20 nt, Human
caaaacagaagcccccaaac

SEQ ID NO: 707846 - RNA, 21 nt, Human
caaaacagaagcccccaaacc

SEQ ID NO: 707847 - RNA, 21 nt, Human
caaacaaaacagaagccccca

SEQ ID NO: 707848 - RNA, 23 nt, Human
caaacaaaacagaagcccccaaa

SEQ ID NO: 707849 - RNA, 23 nt, Human
caaacagaacaaaauggaaaaaa

SEQ ID NO: 707850 - RNA, 30 nt, Human
caaacagaacaaaauggaaaaaaaaaagaa

SEQ ID NO: 707851 - RNA, 21 nt, Human
caaggaauguuccaccucuaa

SEQ ID NO: 707852 - RNA, 21 nt, Human
cagaagcccccaaacagaaca

SEQ ID NO: 707853 - RNA, 24 nt, Human
cagggcgggagggagagaagaggg

SEQ ID NO: 707854 - RNA, 26 nt, Human
cagggcgggagggagagaagaggggg

SEQ ID NO: 707855 - RNA, 23 nt, Human
cagguucaggaaggcuggggggu

SEQ ID NO: 707856 - RNA, 23 nt, Human
ccaauuuugaaagaaaaagcaug

SEQ ID NO: 707857 - RNA, 20 nt, Human
ccagggcgggagggagagaa

SEQ ID NO: 707858 - RNA, 20 nt, Human
cccaagucccccccacccug

SEQ ID NO: 707859 - RNA, 21 nt, Human
cccaagucccccccacccugc

SEQ ID NO: 707860 - RNA, 20 nt, Human
ccccaagucccccccacccu

SEQ ID NO: 707861 - RNA, 22 nt, Human
ccccaguacuccccacggcacc

SEQ ID NO: 707862 - RNA, 18 nt, Human
cccccccacccugcuugc

SEQ ID NO: 707863 - RNA, 27 nt, Human
ccugcaauacaacaccugguccaagga

SEQ ID NO: 707864 - RNA, 22 nt, Human
ccuggcgcggaggcugaagcug

SEQ ID NO: 707865 - RNA, 24 nt, Human
cgccaaacaaaacagaagccccca

SEQ ID NO: 707866 - RNA, 25 nt, Human
cgccaaacaaaacagaagcccccaa

SEQ ID NO: 707867 - RNA, 19 nt, Human
cggcucaacgcgggaacaa

SEQ ID NO: 707868 - RNA, 20 nt, Human
cgggccuggcgcggaggcug

SEQ ID NO: 707869 - RNA, 18 nt, Human
cucgcuaucuucucuggc

SEQ ID NO: 707870 - RNA, 21 nt, Human
cugcaauacaacaccuggucc

SEQ ID NO: 707871 - RNA, 22 nt, Human
cugcuuugcucuuuguguuuuu

SEQ ID NO: 707872 - RNA, 22 nt, Human
cuggcucaacauggaaggaucc

SEQ ID NO: 707873 - RNA, 18 nt, Human
gaagaauagagacuuuuu

SEQ ID NO: 707874 - RNA, 18 nt, Human
gacacagaacaggcgaga

SEQ ID NO: 707875 - RNA, 19 nt, Human
gagccagggcgggagggag

SEQ ID NO: 707876 - RNA, 19 nt, Human
gagggagagaagagggggc

SEQ ID NO: 707877 - RNA, 19 nt, Human
gagugacuuuuuuuuuucc

SEQ ID NO: 707878 - RNA, 18 nt, Human
gccaaacaaaacagaagc

SEQ ID NO: 707879 - RNA, 21 nt, Human
gccaaacaaaacagaagcccc

SEQ ID NO: 707880 - RNA, 18 nt, Human
gccgggccuggcgcggag

SEQ ID NO: 707881 - RNA, 19 nt, Human
gcggcggcggcggcggcgg

SEQ ID NO: 707882 - RNA, 19 nt, Human
gcggcggcggcggcggcuc

SEQ ID NO: 707883 - RNA, 29 nt, Human
gcugaggaggcggcggcggcggcggcgac

SEQ ID NO: 707884 - RNA, 19 nt, Human
ggaagggguccugcaauac

SEQ ID NO: 707885 - RNA, 19 nt, Human
ggaggggggacgggcgggg

SEQ ID NO: 707886 - RNA, 21 nt, Human
ggcggcggcucaacgcgggaa

SEQ ID NO: 707887 - RNA, 24 nt, Human
ggcgggagggagagaagagggggc

SEQ ID NO: 707888 - RNA, 20 nt, Human
guccugggaggggggacggg

SEQ ID NO: 707889 - RNA, 23 nt, Human
gugagacacagaacaggcgagag

SEQ ID NO: 707890 - RNA, 19 nt, Human
uaaaaacaagagggccgag

SEQ ID NO: 707891 - RNA, 24 nt, Human
uaaaaaguaaaaacugccauacaa

SEQ ID NO: 707892 - RNA, 18 nt, Human
uccaaggaauguuccacc

SEQ ID NO: 707893 - RNA, 20 nt, Human
uccccacggcaccaucgcuc

SEQ ID NO: 707894 - RNA, 19 nt, Human
uccccaguacuccccacgg

SEQ ID NO: 707895 - RNA, 24 nt, Human
ucccccccacccugcuugccgcga

SEQ ID NO: 707896 - RNA, 21 nt, Human
uccucagagaggcagguucag

SEQ ID NO: 707897 - RNA, 25 nt, Human
ucgccaaacaaaacagaagccccca

SEQ ID NO: 707898 - RNA, 26 nt, Human
ucgccaaacaaaacagaagcccccaa

SEQ ID NO: 707899 - RNA, 24 nt, Human
ucucucgccaaacaaaacagaagc

SEQ ID NO: 707900 - RNA, 22 nt, Human
ugaaaagacaacagaccagucc

SEQ ID NO: 707901 - RNA, 18 nt, Human
ugaaagaaaaagcaugug

SEQ ID NO: 707902 - RNA, 19 nt, Human
ugaagaauagagacuuuuu

SEQ ID NO: 707903 - RNA, 20 nt, Human
ugcaauacaacaccuggucc

SEQ ID NO: 707904 - RNA, 20 nt, Human
ugcccccaagucccccccac

SEQ ID NO: 707905 - RNA, 20 nt, Human
ugcccccaagucccccccac

SEQ ID NO: 707906 - RNA, 23 nt, Human
uggcgcggaggcugaagcugagg

SEQ ID NO: 707907 - RNA, 19 nt, Human
ugggggaagggguccugca

SEQ ID NO: 707908 - RNA, 19 nt, Human
uuuauaaguucugcuuugc

SEQ ID NO: 707909 - RNA, 18 nt, Human
uuuucaguuucaaucucc

SEQ ID NO: 707910 - RNA, 22 nt, Human
uuuucaguuucaaucuccucuu

SEQ ID NO: 707911 - RNA, 25 nt, Human
uuuuguuaucauuuauuugugaagu

SEQ ID NO: 707912 - RNA, 22 nt, Human
uuuuuaaaaguuuauuuuaaaa

SEQ ID NO: 707913 - RNA, 22 nt, Human
uuuuuuguuguucucauuuugu

SEQ ID NO: 707914 - RNA, 20 nt, Human
uuuuuuuuuuuuuuugaggu

SEQ ID NO: 707915 - RNA, 22 nt, Human
uuuuuuuuuuuuuuuuuugagg

SEQ ID NO: 707916 - RNA, 22 nt, Human
aaagauaccaaccugagauaag

SEQ ID NO: 707917 - RNA, 19 nt, Human
aaaugugucuauauacugu

SEQ ID NO: 707918 - RNA, 19 nt, Human
aagauaccaaccugagaua

SEQ ID NO: 707919 - RNA, 19 nt, Human
aauguaccaaauuaaaugu

SEQ ID NO: 707920 - RNA, 21 nt, Human
acacagucaagucuggggugc

SEQ ID NO: 707921 - RNA, 24 nt, Human
agaggugagcuuccaugugcauga

SEQ ID NO: 707922 - RNA, 22 nt, Human
aguggcaugggauccacugcug

SEQ ID NO: 707923 - RNA, 18 nt, Human
aucauuuuuacuccaguu

SEQ ID NO: 707924 - RNA, 21 nt, Human
caaagagaaaaaauaaacaau

SEQ ID NO: 707925 - RNA, 20 nt, Human
cagauacccuaacacugcca

SEQ ID NO: 707926 - RNA, 21 nt, Human
ccaaccugagauaagagcuga

SEQ ID NO: 707927 - RNA, 28 nt, Human
cucauucuuuaaaaaaaaaaaaaaaaaa

SEQ ID NO: 707928 - RNA, 22 nt, Human
cuggauuugaugaaagauacca

SEQ ID NO: 707929 - RNA, 19 nt, Human
cugggcaaggugagccaga

SEQ ID NO: 707930 - RNA, 21 nt, Human
gcuuauauggcucuggcucuu

SEQ ID NO: 707931 - RNA, 20 nt, Human
ggaaaaaaaauuccaacaag

SEQ ID NO: 707932 - RNA, 21 nt, Human
ggaaaugugcagcgguccuug

SEQ ID NO: 707933 - RNA, 18 nt, Human
ggcauccuggcacagagg

SEQ ID NO: 707934 - RNA, 19 nt, Human
uaaacagauacccuaacac

SEQ ID NO: 707935 - RNA, 24 nt, Human
uaaacagauacccuaacacugcca

SEQ ID NO: 707936 - RNA, 28 nt, Human
uaaacagauacccuaacacuguaaugac

SEQ ID NO: 707937 - RNA, 23 nt, Human
uaagaugagcacacaaaucucug

SEQ ID NO: 707938 - RNA, 24 nt, Human
uacauacauaaaaaaucuugagug

SEQ ID NO: 707939 - RNA, 18 nt, Human
uacuccaguuuguaguua

SEQ ID NO: 707940 - RNA, 19 nt, Human
uacugauaauuugcaaagg

SEQ ID NO: 707941 - RNA, 23 nt, Human
ucauugguauuaaaaacucccuc

SEQ ID NO: 707942 - RNA, 19 nt, Human
ucuaaaaccaaagagaaaa

SEQ ID NO: 707943 - RNA, 21 nt, Human
ucuggccccgcugcagccacg

SEQ ID NO: 707944 - RNA, 20 nt, Human
ucuuuaaaaaaaaaaaaaaa

SEQ ID NO: 707945 - RNA, 26 nt, Human
ugaaagauaccaaccugagauaagag

SEQ ID NO: 707946 - RNA, 20 nt, Human
ugacuucuucacaacagucc

SEQ ID NO: 707947 - RNA, 19 nt, Human
ugcucuggccccgcugcag

SEQ ID NO: 707948 - RNA, 19 nt, Human
uggccccgcugcagccacg

SEQ ID NO: 707949 - RNA, 19 nt, Human
ugggaaaaaauaaauccau

SEQ ID NO: 707950 - RNA, 23 nt, Human
ugggaaaggucuuuaucugcacu

SEQ ID NO: 707951 - RNA, 20 nt, Human
uguacauuacaccagcagcu

SEQ ID NO: 707952 - RNA, 20 nt, Human
uuaaaaaaaaaaaaaaaaaa

SEQ ID NO: 707953 - RNA, 22 nt, Human
uucuuuggaaaaaaaauuccaa

SEQ ID NO: 707954 - RNA, 23 nt, Human
uuggaaaugugcagcgguccuug

SEQ ID NO: 707955 - RNA, 21 nt, Human
uuguuuuguuuuaaaaaaaua

SEQ ID NO: 707956 - RNA, 24 nt, Human
uuuauacauacauaaaaaaucuug

SEQ ID NO: 707957 - RNA, 24 nt, Human
aaacaaaaaguaaagaacacucgg

SEQ ID NO: 707958 - RNA, 22 nt, Human
aaacuuccggggaagaucccac

SEQ ID NO: 707959 - RNA, 27 nt, Human
aaacuuccggggaagaucccaccccuu

SEQ ID NO: 707960 - RNA, 23 nt, Human
aaccaaacaaaaaguaaagaaca

SEQ ID NO: 707961 - RNA, 23 nt, Human
aagcaggaacccucacaacccga

SEQ ID NO: 707962 - RNA, 20 nt, Human
aucccaccccuuccacucaa

SEQ ID NO: 707963 - RNA, 24 nt, Human
caaaacuuccggggaagaucccac

SEQ ID NO: 707964 - RNA, 19 nt, Human
caaaauauccccacuuccc

SEQ ID NO: 707965 - RNA, 22 nt, Human
cacaaauacauuuucuccaaaa

SEQ ID NO: 707966 - RNA, 24 nt, Human
cacaacccgagccuccacgaaauu

SEQ ID NO: 707967 - RNA, 20 nt, Human
caccccuuccacucaacgag

SEQ ID NO: 707968 - RNA, 25 nt, Human
caccccuuccacucaacgaggcuug

SEQ ID NO: 707969 - RNA, 25 nt, Human
caccgccgacuccgaagcaggaacc

SEQ ID NO: 707970 - RNA, 21 nt, Human
ccaccuucuagcgugaaaccu

SEQ ID NO: 707971 - RNA, 23 nt, Human
cgagccgcugauuggaggggcuu

SEQ ID NO: 707972 - RNA, 22 nt, Human
cgccgacuccgaagcaggaacc

SEQ ID NO: 707973 - RNA, 19 nt, Human
cgugaaaccucaaccaaac

SEQ ID NO: 707974 - RNA, 21 nt, Human
gaaaauguacaaaauaucccc

SEQ ID NO: 707975 - RNA, 25 nt, Human
gagaaagaguauaucuaaaauacac

SEQ ID NO: 707976 - RNA, 20 nt, Human
gaucccaccccuuccacuca

SEQ ID NO: 707977 - RNA, 19 nt, Human
ggaagaucccaccccuucc

SEQ ID NO: 707978 - RNA, 22 nt, Human
gugaaaccucaaccaaacaaaa

SEQ ID NO: 707979 - RNA, 24 nt, Human
uccacgaaauucaaacuugccgca

SEQ ID NO: 707980 - RNA, 23 nt, Human
ucuaaaauacacuuugaugaaca

SEQ ID NO: 707981 - RNA, 19 nt, Human
ugaaggaaaauguuuggau

SEQ ID NO: 707982 - RNA, 21 nt, Human
uucaaacuugccgcaccgagc

SEQ ID NO: 707983 - RNA, 20 nt, Human
aaacugaaaggaaacaagau

SEQ ID NO: 707984 - RNA, 21 nt, Human
aaauagaaaaaccaugaagau

SEQ ID NO: 707985 - RNA, 20 nt, Human
aacagcauucugaccaauga

SEQ ID NO: 707986 - RNA, 23 nt, Human
aacuucccuucaaugggaagcau

SEQ ID NO: 707987 - RNA, 25 nt, Human
aacuuggcccucacaaaucaacagg

SEQ ID NO: 707988 - RNA, 24 nt, Human
aagaagaccacugaauacuaaaga

SEQ ID NO: 707989 - RNA, 22 nt, Human
aagcugaccaucucacaaaagc

SEQ ID NO: 707990 - RNA, 20 nt, Human
aagucaucuuuaugaugcca

SEQ ID NO: 707991 - RNA, 18 nt, Human
aaucucuacucccaucuc

SEQ ID NO: 707992 - RNA, 21 nt, Human
acaguacaaauuuaaacagaa

SEQ ID NO: 707993 - RNA, 23 nt, Human
acauauuagaaacaugucagaac

SEQ ID NO: 707994 - RNA, 23 nt, Human
accaaagcugaccaucucacaaa

SEQ ID NO: 707995 - RNA, 23 nt, Human
accaucucacaaaagcaaaacca

SEQ ID NO: 707996 - RNA, 20 nt, Human
acgaagauaacagugcccuc

SEQ ID NO: 707997 - RNA, 22 nt, Human
auauuagaaacaugucagaaca

SEQ ID NO: 707998 - RNA, 23 nt, Human
caaaccccagcuccaagaaaaug

SEQ ID NO: 707999 - RNA, 21 nt, Human
caagaaguuuccaaucucaaa

SEQ ID NO: 708000 - RNA, 22 nt, Human
caaucaagccaugucauuuccc

SEQ ID NO: 708001 - RNA, 18 nt, Human
cagaacaaucaagccaug

SEQ ID NO: 708002 - RNA, 20 nt, Human
caguaacauccacaaauguc

SEQ ID NO: 708003 - RNA, 18 nt, Human
cagugaacaucaucuggu

SEQ ID NO: 708004 - RNA, 24 nt, Human
caucucacaaaagcaaaaccaaac

SEQ ID NO: 708005 - RNA, 23 nt, Human
cauuauggaauuucagcagugaa

SEQ ID NO: 708006 - RNA, 22 nt, Human
ccaucucacaaaagcaaaacca

SEQ ID NO: 708007 - RNA, 21 nt, Human
cccucguugccaucauucauu

SEQ ID NO: 708008 - RNA, 18 nt, Human
ccugaaaagaagaccacu

SEQ ID NO: 708009 - RNA, 22 nt, Human
ccuuaaaagccccagaugaaaa

SEQ ID NO: 708010 - RNA, 23 nt, Human
cgcccuggccacauauuagaaac

SEQ ID NO: 708011 - RNA, 23 nt, Human
cuccaagaaaaugugagagagaa

SEQ ID NO: 708012 - RNA, 20 nt, Human
gaaaacuacaucuuucuucc

SEQ ID NO: 708013 - RNA, 24 nt, Human
gaacacacauguuguggagagcac

SEQ ID NO: 708014 - RNA, 20 nt, Human
gccaugucauuuccccaaau

SEQ ID NO: 708015 - RNA, 19 nt, Human
ggggcacuguccaaaauuc

SEQ ID NO: 708016 - RNA, 24 nt, Human
uaaguucuguucaaggcaagaagu

SEQ ID NO: 708017 - RNA, 21 nt, Human
uagcaaguccuuaaaagcccc

SEQ ID NO: 708018 - RNA, 21 nt, Human
uaguuugcuuuauuuuaaaac

SEQ ID NO: 708019 - RNA, 22 nt, Human
uauaaaacacuuauacagauaa

SEQ ID NO: 708020 - RNA, 24 nt, Human
uauaaaacacuuauacagauaaau

SEQ ID NO: 708021 - RNA, 18 nt, Human
uauaaagcauuuaaaaaa

SEQ ID NO: 708022 - RNA, 24 nt, Human
uauacaauuguuuucaaaacugga

SEQ ID NO: 708023 - RNA, 20 nt, Human
uauagcaaguccuuaaaagc

SEQ ID NO: 708024 - RNA, 18 nt, Human
uaucagaaauagaaaaac

SEQ ID NO: 708025 - RNA, 22 nt, Human
uaucagaaauagaaaaaccaug

SEQ ID NO: 708026 - RNA, 19 nt, Human
uauuccaaauauuacuccu

SEQ ID NO: 708027 - RNA, 20 nt, Human
ucagaacacacauguugugg

SEQ ID NO: 708028 - RNA, 23 nt, Human
ucccaucuccuaauacucccagc

SEQ ID NO: 708029 - RNA, 19 nt, Human
uccugguaggauacucugg

SEQ ID NO: 708030 - RNA, 18 nt, Human
ucuccuaauacucccagc

SEQ ID NO: 708031 - RNA, 20 nt, Human
ugaaaggaaacaagauggua

SEQ ID NO: 708032 - RNA, 20 nt, Human
ugaacaugaacauguguaac

SEQ ID NO: 708033 - RNA, 25 nt, Human
ugaucauugaaaacaaacgaagaua

SEQ ID NO: 708034 - RNA, 24 nt, Human
ugcaguaacauccacaaauguccu

SEQ ID NO: 708035 - RNA, 18 nt, Human
uggagagcaccaaagcug

SEQ ID NO: 708036 - RNA, 24 nt, Human
uggagagcaccaaagcugaccagu

SEQ ID NO: 708037 - RNA, 23 nt, Human
ugggaagcauuauggaauuucag

SEQ ID NO: 708038 - RNA, 20 nt, Human
uguccaaaaauaugcauaua

SEQ ID NO: 708039 - RNA, 21 nt, Human
uguccaaaauucaauacugau

SEQ ID NO: 708040 - RNA, 20 nt, Human
uguggagagcaccaaagcug

SEQ ID NO: 708041 - RNA, 22 nt, Human
uuaaaacaguaacuuccuuaua

SEQ ID NO: 708042 - RNA, 23 nt, Human
uucaaaccccagcuccaagaaaa

SEQ ID NO: 708043 - RNA, 21 nt, Human
uuccuauucaaaccccagcuc

SEQ ID NO: 708044 - RNA, 19 nt, Human
uuuccaaucucaaauauuu

SEQ ID NO: 708045 - RNA, 22 nt, Human
aaaaaaaccacaaauaagugaa

SEQ ID NO: 708046 - RNA, 23 nt, Human
aaaaagcacaaauaaaauauuac

SEQ ID NO: 708047 - RNA, 22 nt, Human
aaacaauccaaccacauaagca

SEQ ID NO: 708048 - RNA, 25 nt, Human
aaccuaaccacuuugggaaaggcag

SEQ ID NO: 708049 - RNA, 24 nt, Human
aagaaggagcuuaggagagccuca

SEQ ID NO: 708050 - RNA, 20 nt, Human
aagggagggaggaauggcag

SEQ ID NO: 708051 - RNA, 24 nt, Human
aagugaccacaccguaauaaaaau

SEQ ID NO: 708052 - RNA, 22 nt, Human
aauguccaucuaaauaagugac

SEQ ID NO: 708053 - RNA, 21 nt, Human
acagacaguaucuccaaaccg

SEQ ID NO: 708054 - RNA, 19 nt, Human
accuaaaauaaaaaagacc

SEQ ID NO: 708055 - RNA, 21 nt, Human
agacuaaaaucacccagcaac

SEQ ID NO: 708056 - RNA, 23 nt, Human
agagauaaaugaggauuuagauc

SEQ ID NO: 708057 - RNA, 23 nt, Human
agcaaagggucacucugcuccca

SEQ ID NO: 708058 - RNA, 19 nt, Human
agcugagaaaaaaaccaca

SEQ ID NO: 708059 - RNA, 25 nt, Human
aggaagcacugguucucuguagggg

SEQ ID NO: 708060 - RNA, 29 nt, Human
aggcacaaaguggagauagaagggacccc

SEQ ID NO: 708061 - RNA, 18 nt, Human
agggagggaggaauggca

SEQ ID NO: 708062 - RNA, 23 nt, Human
aguccccaccucacauccacaga

SEQ ID NO: 708063 - RNA, 24 nt, Human
agugucuguccucccccaaguaac

SEQ ID NO: 708064 - RNA, 27 nt, Human
auagaacauucaacauaaaaccuaaaa

SEQ ID NO: 708065 - RNA, 24 nt, Human
caaauuaagaaauuauacauuuug

SEQ ID NO: 708066 - RNA, 18 nt, Human
caagcauggcgagucacc

SEQ ID NO: 708067 - RNA, 23 nt, Human
caauccaaccacauaagcagcag

SEQ ID NO: 708068 - RNA, 20 nt, Human
caccacagugucuguccucc

SEQ ID NO: 708069 - RNA, 23 nt, Human
caccaggaagcagagggugccaa

SEQ ID NO: 708070 - RNA, 21 nt, Human
cacuuugggaaaggcagcaga

SEQ ID NO: 708071 - RNA, 21 nt, Human
cagaaaaaaaaaaugccuuca

SEQ ID NO: 708072 - RNA, 23 nt, Human
cagaauagcugagaaaaaaacca

SEQ ID NO: 708073 - RNA, 24 nt, Human
cagagcagcaccaggaagcagagg

SEQ ID NO: 708074 - RNA, 21 nt, Human
cagagccuccagugacaguaa

SEQ ID NO: 708075 - RNA, 25 nt, Human
cagcaaagccaaagcuucaucuuug

SEQ ID NO: 708076 - RNA, 20 nt, Human
cagcagaaaaaaaaaaugcc

SEQ ID NO: 708077 - RNA, 24 nt, Human
cagcagaaaaaaaaaaugccuuca

SEQ ID NO: 708078 - RNA, 23 nt, Human
cagcccaggggaaaggagggcga

SEQ ID NO: 708079 - RNA, 20 nt, Human
cagcucgggccgcugcaggg

SEQ ID NO: 708080 - RNA, 20 nt, Human
caggagggcucugaucucac

SEQ ID NO: 708081 - RNA, 18 nt, Human
cauggcgagucaccccca

SEQ ID NO: 708082 - RNA, 23 nt, Human
ccagcccugcccuggggcgggag

SEQ ID NO: 708083 - RNA, 22 nt, Human
cccacagcugacgcuuugaaac

SEQ ID NO: 708084 - RNA, 23 nt, Human
cccagcaucagcaaagggucacu

SEQ ID NO: 708085 - RNA, 21 nt, Human
ccccagcaucagcaaaggguc

SEQ ID NO: 708086 - RNA, 19 nt, Human
cccccaaauauccaggaag

SEQ ID NO: 708087 - RNA, 23 nt, Human
cccccaaauauccaggaagacaa

SEQ ID NO: 708088 - RNA, 23 nt, Human
cccccgggcuguacccucccagc

SEQ ID NO: 708089 - RNA, 24 nt, Human
cccccgggcuguacccucccagcc

SEQ ID NO: 708090 - RNA, 20 nt, Human
cccugccucgccugccccuc

SEQ ID NO: 708091 - RNA, 23 nt, Human
ccgcccccgggcuguacccuccc

SEQ ID NO: 708092 - RNA, 23 nt, Human
ccucccagcccugcccuggggcg

SEQ ID NO: 708093 - RNA, 21 nt, Human
ccuccccugaaagcucuccag

SEQ ID NO: 708094 - RNA, 20 nt, Human
ccuggcagccuagcccaugu

SEQ ID NO: 708095 - RNA, 19 nt, Human
cgagucagagcagcaccag

SEQ ID NO: 708096 - RNA, 21 nt, Human
cgcagcccaggggaaaggagg

SEQ ID NO: 708097 - RNA, 20 nt, Human
cgcccggcccggggcagcga

SEQ ID NO: 708098 - RNA, 24 nt, Human
cggcccggggcagcgaggacgcgg

SEQ ID NO: 708099 - RNA, 24 nt, Human
cgggaggggcggcaauacuggagg

SEQ ID NO: 708100 - RNA, 22 nt, Human
cgggcagcgccgccgcggaagc

SEQ ID NO: 708101 - RNA, 22 nt, Human
cggggcacggggcgggcuggga

SEQ ID NO: 708102 - RNA, 23 nt, Human
cuaaaaucacccagcaacagguc

SEQ ID NO: 708103 - RNA, 18 nt, Human
cuaaaguagccacauggc

SEQ ID NO: 708104 - RNA, 24 nt, Human
cucagaauagcugagaaaaaaacc

SEQ ID NO: 708105 - RNA, 19 nt, Human
cucugcucccacagcugac

SEQ ID NO: 708106 - RNA, 25 nt, Human
cugcaagaacuaccgacacuccucu

SEQ ID NO: 708107 - RNA, 20 nt, Human
cuucuuggcaauauuacuaa

SEQ ID NO: 708108 - RNA, 26 nt, Human
gaacauucaacauaaaaccuaaaaua

SEQ ID NO: 708109 - RNA, 20 nt, Human
gagaaaaaaaccacaaauaa

SEQ ID NO: 708110 - RNA, 20 nt, Human
gagucacccccaaauauccg

SEQ ID NO: 708111 - RNA, 24 nt, Human
gcagcaccaggaagcagagggugc

SEQ ID NO: 708112 - RNA, 18 nt, Human
gcccuggggcgggagggg

SEQ ID NO: 708113 - RNA, 18 nt, Human
gcccugucugaacccugg

SEQ ID NO: 708114 - RNA, 21 nt, Human
gcggccccauggcgucucagc

SEQ ID NO: 708115 - RNA, 18 nt, Human
gcggcggccgggaggcga

SEQ ID NO: 708116 - RNA, 19 nt, Human
gcuuauuauucaaauuaag

SEQ ID NO: 708117 - RNA, 23 nt, Human
gcuuggcagacccuccuccucca

SEQ ID NO: 708118 - RNA, 23 nt, Human
ggaggggcggcaauacuggaggg

SEQ ID NO: 708119 - RNA, 18 nt, Human
ggaggggcggcccugccu

SEQ ID NO: 708120 - RNA, 19 nt, Human
ggcgggcggggcacggggc

SEQ ID NO: 708121 - RNA, 27 nt, Human
gggaaaaaaaauauuuaauguaaaugu

SEQ ID NO: 708122 - RNA, 20 nt, Human
gggagggaggaauggcagaa

SEQ ID NO: 708123 - RNA, 22 nt, Human
gggcggcccugccucgccugcc

SEQ ID NO: 708124 - RNA, 24 nt, Human
guaaacaauccaaccacauaagca

SEQ ID NO: 708125 - RNA, 24 nt, Human
uaaacgcuuauuauucaaauuaag

SEQ ID NO: 708126 - RNA, 20 nt, Human
uaaauaagugaccacaccgu

SEQ ID NO: 708127 - RNA, 27 nt, Human
uacaaauaaauaaauaagcucagaaua

SEQ ID NO: 708128 - RNA, 23 nt, Human
uaccaucaucaucucuuuuccaa

SEQ ID NO: 708129 - RNA, 22 nt, Human
uacugcaagaacuaccgacacu

SEQ ID NO: 708130 - RNA, 21 nt, Human
uagaagagauaaaugaggauu

SEQ ID NO: 708131 - RNA, 22 nt, Human
uagauccccuccccccagcauc

SEQ ID NO: 708132 - RNA, 19 nt, Human
uagcugagaaaaaaaccac

SEQ ID NO: 708133 - RNA, 24 nt, Human
uagcugagaaaaaaaccacaaaua

SEQ ID NO: 708134 - RNA, 24 nt, Human
uaggagagccucaggcgugcagug

SEQ ID NO: 708135 - RNA, 19 nt, Human
uauccaggaagacaagugg

SEQ ID NO: 708136 - RNA, 19 nt, Human
ucaccagcaaagccaaagc

SEQ ID NO: 708137 - RNA, 20 nt, Human
ucacugagaugccacuagug

SEQ ID NO: 708138 - RNA, 22 nt, Human
ucauuuaaaaaaggaagggagg

SEQ ID NO: 708139 - RNA, 27 nt, Human
uccaaaccuaaccacuuugggaaaggc

SEQ ID NO: 708140 - RNA, 19 nt, Human
uccaaccacauaagcagca

SEQ ID NO: 708141 - RNA, 20 nt, Human
uccacagacaguaucuccaa

SEQ ID NO: 708142 - RNA, 19 nt, Human
uccccaccucacauccaca

SEQ ID NO: 708143 - RNA, 24 nt, Human
uccccuccccccagcaucagcaaa

SEQ ID NO: 708144 - RNA, 22 nt, Human
ucuccaggcacaaaguggagau

SEQ ID NO: 708145 - RNA, 19 nt, Human
ugaaagaaggagcuuagga

SEQ ID NO: 708146 - RNA, 20 nt, Human
ugaauugucaauuucuccuc

SEQ ID NO: 708147 - RNA, 26 nt, Human
ugagaaaaaaaccacaaauaagugaa

SEQ ID NO: 708148 - RNA, 19 nt, Human
ugagaugccacuaguguaa

SEQ ID NO: 708149 - RNA, 21 nt, Human
ugagaugccacuaguguaaaa

SEQ ID NO: 708150 - RNA, 22 nt, Human
ugaggcaggccacgguauacug

SEQ ID NO: 708151 - RNA, 21 nt, Human
ugccucgccugccccucaucc

SEQ ID NO: 708152 - RNA, 19 nt, Human
ugccugcucaggagggcuc

SEQ ID NO: 708153 - RNA, 25 nt, Human
ugccuucaguuuuaauaaugaggcu

SEQ ID NO: 708154 - RNA, 18 nt, Human
ugcucccacagcugacgc

SEQ ID NO: 708155 - RNA, 23 nt, Human
uggcaauauuacuaaaguagcca

SEQ ID NO: 708156 - RNA, 25 nt, Human
uggcagccuagcccaugugcgggca

SEQ ID NO: 708157 - RNA, 21 nt, Human
uggcgagucacccccaaauau

SEQ ID NO: 708158 - RNA, 23 nt, Human
uggcgucucagcccucagacccu

SEQ ID NO: 708159 - RNA, 21 nt, Human
ugggaaaggcagcagaaaaaa

SEQ ID NO: 708160 - RNA, 18 nt, Human
uggggaaauggcuuaaaa

SEQ ID NO: 708161 - RNA, 23 nt, Human
ugggucuggggaggcgcugcuga

SEQ ID NO: 708162 - RNA, 22 nt, Human
ugguucaaacaacuuuaaugac

SEQ ID NO: 708163 - RNA, 23 nt, Human
uuaaaaagcacaaauaaaauauu

SEQ ID NO: 708164 - RNA, 23 nt, Human
uucgagucagagcagcaccagga

SEQ ID NO: 708165 - RNA, 18 nt, Human
uuggcaauauuacuaaag

SEQ ID NO: 708166 - RNA, 18 nt, Human
uuggcagacccuccuccu

SEQ ID NO: 708167 - RNA, 22 nt, Human
uuucuguauaucaagacuacaa

SEQ ID NO: 708168 - RNA, 22 nt, Human
aaaaaaacagccacaaauucaa

SEQ ID NO: 708169 - RNA, 26 nt, Human
aaacagaagacaggaacuccacaggg

SEQ ID NO: 708170 - RNA, 22 nt, Human
aaacagccacaaauucaacuuc

SEQ ID NO: 708171 - RNA, 21 nt, Human
aaagacaucaccccaaccucc

SEQ ID NO: 708172 - RNA, 20 nt, Human
aaaggaccaggaccccagag

SEQ ID NO: 708173 - RNA, 22 nt, Human
aagaggccucuguccuggccug

SEQ ID NO: 708174 - RNA, 20 nt, Human
aagcaggggaggcuugaggu

SEQ ID NO: 708175 - RNA, 23 nt, Human
aaggagcaggugcuuucucagag

SEQ ID NO: 708176 - RNA, 18 nt, Human
acaaaggaccaggacccc

SEQ ID NO: 708177 - RNA, 24 nt, Human
acaacaacaucgcccgccuagagc

SEQ ID NO: 708178 - RNA, 21 nt, Human
acagaagacaggaacuccaca

SEQ ID NO: 708179 - RNA, 19 nt, Human
acagcgccacgguggagug

SEQ ID NO: 708180 - RNA, 19 nt, Human
acaggcaggcaucacagag

SEQ ID NO: 708181 - RNA, 19 nt, Human
accaggaccccagacggcg

SEQ ID NO: 708182 - RNA, 20 nt, Human
accaggacuggggacauucc

SEQ ID NO: 708183 - RNA, 22 nt, Human
accccaaccuccagcucugcau

SEQ ID NO: 708184 - RNA, 25 nt, Human
accccaaccuccagcucugcauggg

SEQ ID NO: 708185 - RNA, 22 nt, Human
accuggcgggcaaccagcuggc

SEQ ID NO: 708186 - RNA, 19 nt, Human
acgugcagccgcuggagcu

SEQ ID NO: 708187 - RNA, 22 nt, Human
acuccgcgugcccccgccgguc

SEQ ID NO: 708188 - RNA, 18 nt, Human
acugccgcuccgcgccgc

SEQ ID NO: 708189 - RNA, 18 nt, Human
agaaaaaaaaacagccac

SEQ ID NO: 708190 - RNA, 25 nt, Human
agaaaaggcaacccagucuaggggu

SEQ ID NO: 708191 - RNA, 21 nt, Human
agaaagcaggggaggcuugag

SEQ ID NO: 708192 - RNA, 21 nt, Human
agaagacaggaacuccacagg

SEQ ID NO: 708193 - RNA, 18 nt, Human
agaagagagacaugcccc

SEQ ID NO: 708194 - RNA, 20 nt, Human
agagacaugcccccaaccuc

SEQ ID NO: 708195 - RNA, 24 nt, Human
agagacaugcccccaaccucggcg

SEQ ID NO: 708196 - RNA, 22 nt, Human
agaggaaaggcccagagaggcc

SEQ ID NO: 708197 - RNA, 20 nt, Human
agccccuggccagucugcaa

SEQ ID NO: 708198 - RNA, 19 nt, Human
agcgcggccacgagauguu

SEQ ID NO: 708199 - RNA, 19 nt, Human
agcugcuggaggaccaggc

SEQ ID NO: 708200 - RNA, 22 nt, Human
aggaagacuuaaggagcaggug

SEQ ID NO: 708201 - RNA, 22 nt, Human
aggaagggguggcagggccuug

SEQ ID NO: 708202 - RNA, 20 nt, Human
aggcccagcuagaaggcggg

SEQ ID NO: 708203 - RNA, 21 nt, Human
aggcugcaccaccgccugcag

SEQ ID NO: 708204 - RNA, 22 nt, Human
aggcuugaggugugcccagaag

SEQ ID NO: 708205 - RNA, 18 nt, Human
aggggaggggggcgaggg

SEQ ID NO: 708206 - RNA, 18 nt, Human
agggguggcagggccuug

SEQ ID NO: 708207 - RNA, 19 nt, Human
auaagggugaccaacgugg

SEQ ID NO: 708208 - RNA, 19 nt, Human
cacaacaacagccugcgcg

SEQ ID NO: 708209 - RNA, 18 nt, Human
cacagagcuaaaggggag

SEQ ID NO: 708210 - RNA, 24 nt, Human
caccaccgccugcagccacacugg

SEQ ID NO: 708211 - RNA, 25 nt, Human
caccugcaggagagggacuucagca

SEQ ID NO: 708212 - RNA, 20 nt, Human
cacgcgucugcggcugaacc

SEQ ID NO: 708213 - RNA, 22 nt, Human
cacuagcaaccggcugcgcggc

SEQ ID NO: 708214 - RNA, 19 nt, Human
cagaaaaaaaaacagccac

SEQ ID NO: 708215 - RNA, 20 nt, Human
cagagcuaaaggggaggggg

SEQ ID NO: 708216 - RNA, 18 nt, Human
cagcagccucaucugcau

SEQ ID NO: 708217 - RNA, 21 nt, Human
cagccaccgccuccagccccg

SEQ ID NO: 708218 - RNA, 22 nt, Human
cagccccuggccagucugcaag

SEQ ID NO: 708219 - RNA, 23 nt, Human
cagccgcagcagcccgcgcaacc

SEQ ID NO: 708220 - RNA, 20 nt, Human
cagcgggguaagcgccuccu

SEQ ID NO: 708221 - RNA, 18 nt, Human
caggcacauguguaccuu

SEQ ID NO: 708222 - RNA, 18 nt, Human
caucaaccgcuccaagcc

SEQ ID NO: 708223 - RNA, 20 nt, Human
caucaccccaaccuccagcu

SEQ ID NO: 708224 - RNA, 19 nt, Human
ccaccgccuccagccccgg

SEQ ID NO: 708225 - RNA, 24 nt, Human
ccagagucuccuggacguauccca

SEQ ID NO: 708226 - RNA, 21 nt, Human
ccagcagccugccgcugcuac

SEQ ID NO: 708227 - RNA, 21 nt, Human
ccagcuggcgcggcugcugga

SEQ ID NO: 708228 - RNA, 19 nt, Human
cccaaccucggcgcccuuu

SEQ ID NO: 708229 - RNA, 20 nt, Human
cccagcuagaaggcggguug

SEQ ID NO: 708230 - RNA, 21 nt, Human
ccccaacaccucccuugaagc

SEQ ID NO: 708231 - RNA, 20 nt, Human
ccccagaagcacugagcucu

SEQ ID NO: 708232 - RNA, 26 nt, Human
ccccagacggcagccaaaugcagcca

SEQ ID NO: 708233 - RNA, 18 nt, Human
ccccagccucgcgagggc

SEQ ID NO: 708234 - RNA, 19 nt, Human
ccccagggagaggaagacc

SEQ ID NO: 708235 - RNA, 20 nt, Human
cccccaaccucggcgcccuu

SEQ ID NO: 708236 - RNA, 21 nt, Human
cccccagggagaggaagaccc

SEQ ID NO: 708237 - RNA, 18 nt, Human
ccccgcgccuggcgcucc

SEQ ID NO: 708238 - RNA, 25 nt, Human
ccccuggccagucugcaaguccugc

SEQ ID NO: 708239 - RNA, 22 nt, Human
cccgcaaccgcagccaccgccu

SEQ ID NO: 708240 - RNA, 21 nt, Human
cccgcgcaaccgccgccuccg

SEQ ID NO: 708241 - RNA, 25 nt, Human
cccgcgcaaccgccgccuccggccg

SEQ ID NO: 708242 - RNA, 19 nt, Human
cccgcugggaaucccgcca

SEQ ID NO: 708243 - RNA, 19 nt, Human
cccucaagccaccugccua

SEQ ID NO: 708244 - RNA, 21 nt, Human
cccucgcccuguagggcugga

SEQ ID NO: 708245 - RNA, 23 nt, Human
cccucuguccacgugcagccgcu

SEQ ID NO: 708246 - RNA, 24 nt, Human
ccgaacugcugccgcugcugcugc

SEQ ID NO: 708247 - RNA, 19 nt, Human
ccgcagccaccgccuccag

SEQ ID NO: 708248 - RNA, 20 nt, Human
ccgcagccaccgccuccagc

SEQ ID NO: 708249 - RNA, 18 nt, Human
ccgccgccuccggccgcc

SEQ ID NO: 708250 - RNA, 18 nt, Human
ccgccgccuccggccgcc

SEQ ID NO: 708251 - RNA, 19 nt, Human
ccgcgagcccaggcccagc

SEQ ID NO: 708252 - RNA, 19 nt, Human
ccgcgccgccggcugccca

SEQ ID NO: 708253 - RNA, 23 nt, Human
ccgcgugcccccgccggucgccu

SEQ ID NO: 708254 - RNA, 22 nt, Human
ccgcugcugcugcuacuacugc

SEQ ID NO: 708255 - RNA, 20 nt, Human
ccguguggagcugcgggagg

SEQ ID NO: 708256 - RNA, 22 nt, Human
ccuagcacugcuggaccucagc

SEQ ID NO: 708257 - RNA, 21 nt, Human
ccuccagcccgagcccagccc

SEQ ID NO: 708258 - RNA, 19 nt, Human
ccucgcccuguagggcugg

SEQ ID NO: 708259 - RNA, 20 nt, Human
ccucgcccuguagggcugga

SEQ ID NO: 708260 - RNA, 27 nt, Human
ccugcacaacaacagccugcgcgcccu

SEQ ID NO: 708261 - RNA, 21 nt, Human
ccugcagacacuguuccugca

SEQ ID NO: 708262 - RNA, 23 nt, Human
ccugcagccccuggccagucugc

SEQ ID NO: 708263 - RNA, 21 nt, Human
ccugccaagccuccggcuacc

SEQ ID NO: 708264 - RNA, 20 nt, Human
ccuggaucaaggagggcggc

SEQ ID NO: 708265 - RNA, 25 nt, Human
ccuggaucaaggagggcggccagcc

SEQ ID NO: 708266 - RNA, 18 nt, Human
ccuggcccagcugcgcgu

SEQ ID NO: 708267 - RNA, 19 nt, Human
ccuggcccagcugcgcgug

SEQ ID NO: 708268 - RNA, 18 nt, Human
ccuggccugcaaaacccc

SEQ ID NO: 708269 - RNA, 21 nt, Human
ccuggccugcaaaaccccaac

SEQ ID NO: 708270 - RNA, 20 nt, Human
cgagaggcccugcagccccu

SEQ ID NO: 708271 - RNA, 30 nt, Human
cgaggcgggcagcauggccuuccgcgcccc

SEQ ID NO: 708272 - RNA, 18 nt, Human
cgcaaccgcagccaccgc

SEQ ID NO: 708273 - RNA, 18 nt, Human
cgcaugcuccgucaguaa

SEQ ID NO: 708274 - RNA, 21 nt, Human
cgcccagguuccuaaaaacag

SEQ ID NO: 708275 - RNA, 19 nt, Human
cgccccaaggagcuugggg

SEQ ID NO: 708276 - RNA, 21 nt, Human
cgccgccggcugcccagcagc

SEQ ID NO: 708277 - RNA, 23 nt, Human
cgcggaugacgugggcgccggag

SEQ ID NO: 708278 - RNA, 19 nt, Human
cggcagcgagccccggccc

SEQ ID NO: 708279 - RNA, 23 nt, Human
cggcagugccgacggggcugccc

SEQ ID NO: 708280 - RNA, 22 nt, Human
cggcauccgacacgggcagcgg

SEQ ID NO: 708281 - RNA, 21 nt, Human
cggcccgaggcgggcagcaug

SEQ ID NO: 708282 - RNA, 20 nt, Human
cggcccggaacagggggcgg

SEQ ID NO: 708283 - RNA, 21 nt, Human
cggccugcagacacuguuccu

SEQ ID NO: 708284 - RNA, 19 nt, Human
cguaagaggcgugagugcc

SEQ ID NO: 708285 - RNA, 20 nt, Human
cgucaacgacuacuuggacg

SEQ ID NO: 708286 - RNA, 20 nt, Human
cuccagcccgagcccagccu

SEQ ID NO: 708287 - RNA, 23 nt, Human
cuccgcgacgagcgcggccacga

SEQ ID NO: 708288 - RNA, 18 nt, Human
cuccgcgugcccccgccg

SEQ ID NO: 708289 - RNA, 22 nt, Human
cucggcgcccuuuuuccucacg

SEQ ID NO: 708290 - RNA, 22 nt, Human
cucuguccaacuucaaccccag

SEQ ID NO: 708291 - RNA, 21 nt, Human
cugcauggggggggucccucg

SEQ ID NO: 708292 - RNA, 21 nt, Human
cugccgagacuggccugccaa

SEQ ID NO: 708293 - RNA, 19 nt, Human
cugcgccggcucuaccugc

SEQ ID NO: 708294 - RNA, 20 nt, Human
cuggaggaccaggcucuagc

SEQ ID NO: 708295 - RNA, 24 nt, Human
cuggaucaaggagggcggccagcg

SEQ ID NO: 708296 - RNA, 21 nt, Human
cuggcucucgacugccgagac

SEQ ID NO: 708297 - RNA, 24 nt, Human
cuucaaccccagaagcacugagcu

SEQ ID NO: 708298 - RNA, 21 nt, Human
cuuccgaaaagacaucacccc

SEQ ID NO: 708299 - RNA, 18 nt, Human
cuugaggugugcccagaa

SEQ ID NO: 708300 - RNA, 20 nt, Human
gaccugcggguugccugccc

SEQ ID NO: 708301 - RNA, 20 nt, Human
gagcaaggacuggccggcag

SEQ ID NO: 708302 - RNA, 22 nt, Human
gagcaggugcuuucucagagac

SEQ ID NO: 708303 - RNA, 18 nt, Human
gagcccccgcgccuggcg

SEQ ID NO: 708304 - RNA, 22 nt, Human
gaggaccugcggguugccugcc

SEQ ID NO: 708305 - RNA, 18 nt, Human
gaggagagacccuaggcc

SEQ ID NO: 708306 - RNA, 23 nt, Human
gaggguccggcggaggcgcccgc

SEQ ID NO: 708307 - RNA, 21 nt, Human
gcagcagccgcagcagcccgc

SEQ ID NO: 708308 - RNA, 23 nt, Human
gcaggugcaggccuccauuccau

SEQ ID NO: 708309 - RNA, 20 nt, Human
gcaguagggagcaggcucau

SEQ ID NO: 708310 - RNA, 24 nt, Human
gcccccaaccucggcgcccuuuuu

SEQ ID NO: 708311 - RNA, 23 nt, Human
gccccgcgaagggcggggcgaca

SEQ ID NO: 708312 - RNA, 22 nt, Human
gccccucgcccuguagggcugg

SEQ ID NO: 708313 - RNA, 20 nt, Human
gcccugagggcccccgaacu

SEQ ID NO: 708314 - RNA, 20 nt, Human
gcccugcgguugcgcgucgu

SEQ ID NO: 708315 - RNA, 19 nt, Human
gcccugggcguggccacac

SEQ ID NO: 708316 - RNA, 19 nt, Human
gcccuguagggcuggaaua

SEQ ID NO: 708317 - RNA, 19 nt, Human
gccgagacuggccugccaa

SEQ ID NO: 708318 - RNA, 19 nt, Human
gccggcugcccagcagccu

SEQ ID NO: 708319 - RNA, 22 nt, Human
gcgcagccgcgccugcuggagc

SEQ ID NO: 708320 - RNA, 20 nt, Human
gcgcccgcugacugcggccc

SEQ ID NO: 708321 - RNA, 23 nt, Human
gcugaaccgcggaagggccggug

SEQ ID NO: 708322 - RNA, 19 nt, Human
gcugacugcggcccggaac

SEQ ID NO: 708323 - RNA, 20 nt, Human
gcugcugcuacuacugccgc

SEQ ID NO: 708324 - RNA, 22 nt, Human
gcuggagcucacagccaaccug

SEQ ID NO: 708325 - RNA, 18 nt, Human
ggagcugcgggaggacgg

SEQ ID NO: 708326 - RNA, 19 nt, Human
ggaguguggcgcccugcgg

SEQ ID NO: 708327 - RNA, 19 nt, Human
ggcccgaggcgggcagcau

SEQ ID NO: 708328 - RNA, 21 nt, Human
ggcccggaacagggggcgggg

SEQ ID NO: 708329 - RNA, 19 nt, Human
ggccggcagugccgacggg

SEQ ID NO: 708330 - RNA, 20 nt, Human
ggccggugaggaaccgggcc

SEQ ID NO: 708331 - RNA, 23 nt, Human
ggccugugucucacccagagcua

SEQ ID NO: 708332 - RNA, 18 nt, Human
gggaggccccaacaccuc

SEQ ID NO: 708333 - RNA, 21 nt, Human
gggggccuccgggggagggag

SEQ ID NO: 708334 - RNA, 22 nt, Human
gggggccuccgggggagggagc

SEQ ID NO: 708335 - RNA, 22 nt, Human
ggggggcgagggugaagggccu

SEQ ID NO: 708336 - RNA, 20 nt, Human
ggggugcccccagggagagg

SEQ ID NO: 708337 - RNA, 20 nt, Human
ggugaggaaccgggccucgg

SEQ ID NO: 708338 - RNA, 19 nt, Human
gugaagggccugccgcccc

SEQ ID NO: 708339 - RNA, 23 nt, Human
guggacagaaaaaaaaacagcca

SEQ ID NO: 708340 - RNA, 19 nt, Human
uaaggagcaggugcuuucu

SEQ ID NO: 708341 - RNA, 19 nt, Human
uacagcucaggcacccuuu

SEQ ID NO: 708342 - RNA, 21 nt, Human
uaccuugaugacccccuccag

SEQ ID NO: 708343 - RNA, 24 nt, Human
uaccuugaugacccccuccagccc

SEQ ID NO: 708344 - RNA, 19 nt, Human
uacuacugccgcuccgcgc

SEQ ID NO: 708345 - RNA, 20 nt, Human
uaggaaggcccagcauagug

SEQ ID NO: 708346 - RNA, 20 nt, Human
ucaaggagggcggccagcgg

SEQ ID NO: 708347 - RNA, 23 nt, Human
uccaacuucaaccccagaagcac

SEQ ID NO: 708348 - RNA, 21 nt, Human
uccacugcuagggccgcgggc

SEQ ID NO: 708349 - RNA, 19 nt, Human
uccgacacgggcagcggca

SEQ ID NO: 708350 - RNA, 19 nt, Human
uccgcgacgagcgcggcca

SEQ ID NO: 708351 - RNA, 21 nt, Human
uccgcgacgagcgcggccacg

SEQ ID NO: 708352 - RNA, 24 nt, Human
uccgcgcgcagccgcgccugcugg

SEQ ID NO: 708353 - RNA, 27 nt, Human
ucgcgcugcuggcgcucacggcgcugc

SEQ ID NO: 708354 - RNA, 23 nt, Human
ucguaggccuggcccagcugcgc

SEQ ID NO: 708355 - RNA, 21 nt, Human
ucugcaaguccugcgccucac

SEQ ID NO: 708356 - RNA, 24 nt, Human
ucugcggcugaaccgcggaagggc

SEQ ID NO: 708357 - RNA, 25 nt, Human
ucuguaacaggcaggcaucacagag

SEQ ID NO: 708358 - RNA, 18 nt, Human
ugaccaggacuggggaca

SEQ ID NO: 708359 - RNA, 22 nt, Human
ugaggggaggcagacaaaauug

SEQ ID NO: 708360 - RNA, 18 nt, Human
ugcaaaaccccaacugca

SEQ ID NO: 708361 - RNA, 21 nt, Human
ugcacaacaacagccugcgcg

SEQ ID NO: 708362 - RNA, 18 nt, Human
ugcccagaagcaagguag

SEQ ID NO: 708363 - RNA, 23 nt, Human
ugccccagccucgcgagggccgg

SEQ ID NO: 708364 - RNA, 18 nt, Human
ugccccgcgaagggcggg

SEQ ID NO: 708365 - RNA, 20 nt, Human
ugcccgguggccauguuggg

SEQ ID NO: 708366 - RNA, 21 nt, Human
ugcgcccugcacuggcugggg

SEQ ID NO: 708367 - RNA, 20 nt, Human
ugcgggagugggugugcugg

SEQ ID NO: 708368 - RNA, 18 nt, Human
ugcugccgcugcugcugc

SEQ ID NO: 708369 - RNA, 19 nt, Human
uggaauaguuagaaaaggc

SEQ ID NO: 708370 - RNA, 22 nt, Human
uggaaucccaaagcauuugcac

SEQ ID NO: 708371 - RNA, 20 nt, Human
uggaccucagcaggaaccag

SEQ ID NO: 708372 - RNA, 21 nt, Human
uggccggccacaguaggaucu

SEQ ID NO: 708373 - RNA, 24 nt, Human
uggccugcaaaaccccaacugcac

SEQ ID NO: 708374 - RNA, 19 nt, Human
uggcgcucacggcgcugcu

SEQ ID NO: 708375 - RNA, 19 nt, Human
uggcgcuccagagucuccu

SEQ ID NO: 708376 - RNA, 24 nt, Human
uggcuggguggcaggguaggggga

SEQ ID NO: 708377 - RNA, 19 nt, Human
uggggucaaggaaggggug

SEQ ID NO: 708378 - RNA, 20 nt, Human
uggggucaaggaaggggugg

SEQ ID NO: 708379 - RNA, 21 nt, Human
ugugggaggugggaaagaggc

SEQ ID NO: 708380 - RNA, 21 nt, Human
uuagaaaaggcaacccagucu

SEQ ID NO: 708381 - RNA, 23 nt, Human
uuagcagcacccucaagccaccu

SEQ ID NO: 708382 - RNA, 26 nt, Human
aaaaguguacauucuucaguuucucc

SEQ ID NO: 708383 - RNA, 24 nt, Human
aaacuagaccuauuucuccuucca

SEQ ID NO: 708384 - RNA, 18 nt, Human
aaacugcugauuuuuucu

SEQ ID NO: 708385 - RNA, 19 nt, Human
aaagaagcacaucaacugu

SEQ ID NO: 708386 - RNA, 20 nt, Human
aaagaugcccaacagaaccc

SEQ ID NO: 708387 - RNA, 22 nt, Human
aaaguguacauucuucaguuuc

SEQ ID NO: 708388 - RNA, 18 nt, Human
aacaagcauauuugcccu

SEQ ID NO: 708389 - RNA, 27 nt, Human
aaccauauaauuucagugaaaaucaag

SEQ ID NO: 708390 - RNA, 21 nt, Human
aacuagcgaagcucacaaggc

SEQ ID NO: 708391 - RNA, 20 nt, Human
aagcaaaaggcaacaagcau

SEQ ID NO: 708392 - RNA, 18 nt, Human
aagcaggauuaaggaggu

SEQ ID NO: 708393 - RNA, 20 nt, Human
aagcugccccucacuccucc

SEQ ID NO: 708394 - RNA, 21 nt, Human
aagcugccccucacuccucca

SEQ ID NO: 708395 - RNA, 18 nt, Human
acaaauggaucuacacaa

SEQ ID NO: 708396 - RNA, 19 nt, Human
acaugucugggcugcugcc

SEQ ID NO: 708397 - RNA, 23 nt, Human
accaaaguugucauuuaaauaag

SEQ ID NO: 708398 - RNA, 19 nt, Human
accaacgccuuuucaagca

SEQ ID NO: 708399 - RNA, 21 nt, Human
accaaucaccacuacacugcu

SEQ ID NO: 708400 - RNA, 18 nt, Human
accacaaaaaaaccgaga

SEQ ID NO: 708401 - RNA, 22 nt, Human
acgaacccucagagcggucggc

SEQ ID NO: 708402 - RNA, 19 nt, Human
acugagugccgacuaugca

SEQ ID NO: 708403 - RNA, 26 nt, Human
acugcaccacaaaaaaaccgagauug

SEQ ID NO: 708404 - RNA, 20 nt, Human
acugcacuccaguucccaag

SEQ ID NO: 708405 - RNA, 23 nt, Human
acugcacuccaguucccaaggaa

SEQ ID NO: 708406 - RNA, 18 nt, Human
agaauaagaggucccacc

SEQ ID NO: 708407 - RNA, 24 nt, Human
aggcaacaagcauuuuuacaagca

SEQ ID NO: 708408 - RNA, 21 nt, Human
auaaagcaaaaggcaacaagc

SEQ ID NO: 708409 - RNA, 21 nt, Human
aucaaaaccuuuaaugcucag

SEQ ID NO: 708410 - RNA, 22 nt, Human
augcagggccugguugcccaca

SEQ ID NO: 708411 - RNA, 28 nt, Human
augcccaacagaacccaaugaaucagaa

SEQ ID NO: 708412 - RNA, 21 nt, Human
caaaaaaaccgagauugauaa

SEQ ID NO: 708413 - RNA, 22 nt, Human
caaaaaagcccuccuguguaac

SEQ ID NO: 708414 - RNA, 19 nt, Human
caaacuuaagcugccccuc

SEQ ID NO: 708415 - RNA, 22 nt, Human
caagauacccgagaaaaguccu

SEQ ID NO: 708416 - RNA, 22 nt, Human
caaggagauaaauacccagaac

SEQ ID NO: 708417 - RNA, 24 nt, Human
caaggagauaaauacccagaacac

SEQ ID NO: 708418 - RNA, 26 nt, Human
caauaacaucucauuaacacucuggu

SEQ ID NO: 708419 - RNA, 25 nt, Human
cacaagcaauaauaaaacugcauuu

SEQ ID NO: 708420 - RNA, 22 nt, Human
cacccagcucauacugcacucc

SEQ ID NO: 708421 - RNA, 18 nt, Human
caccccuguucucccucu

SEQ ID NO: 708422 - RNA, 22 nt, Human
caccugcugagcaccauuuggc

SEQ ID NO: 708423 - RNA, 24 nt, Human
cacuauuugagaauaagagguccc

SEQ ID NO: 708424 - RNA, 19 nt, Human
cacugcaccacaaaaaaac

SEQ ID NO: 708425 - RNA, 19 nt, Human
cacugcaccacaaaaaaac

SEQ ID NO: 708426 - RNA, 20 nt, Human
cacugcaccacaaaaaaacc

SEQ ID NO: 708427 - RNA, 18 nt, Human
cagaacaaaggcaaucuu

SEQ ID NO: 708428 - RNA, 21 nt, Human
cagaacccaaugaaucagaag

SEQ ID NO: 708429 - RNA, 22 nt, Human
cagaauggcaggugggaggaug

SEQ ID NO: 708430 - RNA, 18 nt, Human
cagccaguaagucuaugu

SEQ ID NO: 708431 - RNA, 24 nt, Human
cauaggaaaagucuuugggauuuc

SEQ ID NO: 708432 - RNA, 22 nt, Human
caucucauuaacacucuggucc

SEQ ID NO: 708433 - RNA, 22 nt, Human
ccaaguaccaaggauccuuacu

SEQ ID NO: 708434 - RNA, 27 nt, Human
ccaagugacacccagcucauacugcac

SEQ ID NO: 708435 - RNA, 22 nt, Human
ccacugcaccacaaaaaaaccg

SEQ ID NO: 708436 - RNA, 23 nt, Human
ccagaacacauuaagccuacuga

SEQ ID NO: 708437 - RNA, 18 nt, Human
ccagcauugcuacagcca

SEQ ID NO: 708438 - RNA, 18 nt, Human
ccccaaaaaagcccuccu

SEQ ID NO: 708439 - RNA, 22 nt, Human
ccccaaacuuaagcugccccuc

SEQ ID NO: 708440 - RNA, 22 nt, Human
cccccaaaaaagcccuccugug

SEQ ID NO: 708441 - RNA, 25 nt, Human
ccccccaaaaaagcccuccugugua

SEQ ID NO: 708442 - RNA, 19 nt, Human
ccccuugcucccuuuccca

SEQ ID NO: 708443 - RNA, 24 nt, Human
ccucaaaugugagucgccuagucu

SEQ ID NO: 708444 - RNA, 21 nt, Human
ccucaguucaacagaugccac

SEQ ID NO: 708445 - RNA, 18 nt, Human
ccuguguaacaaaaaagc

SEQ ID NO: 708446 - RNA, 24 nt, Human
ccuuccacugcaccacaaaaaaac

SEQ ID NO: 708447 - RNA, 18 nt, Human
cggcguuucuacccuccc

SEQ ID NO: 708448 - RNA, 24 nt, Human
cucccuuucccaccccuguucucc

SEQ ID NO: 708449 - RNA, 23 nt, Human
cugcacuccaguucccaaggaaa

SEQ ID NO: 708450 - RNA, 20 nt, Human
cuguacuggucaucccccca

SEQ ID NO: 708451 - RNA, 21 nt, Human
cuguguaacaaaaaagcacug

SEQ ID NO: 708452 - RNA, 22 nt, Human
gaaaaauaaauaaaauagacaa

SEQ ID NO: 708453 - RNA, 23 nt, Human
gaaaagucuuugggauuucucca

SEQ ID NO: 708454 - RNA, 24 nt, Human
gaagcuaaaagggacacuucagug

SEQ ID NO: 708455 - RNA, 18 nt, Human
gaaggaagcuguuaaccc

SEQ ID NO: 708456 - RNA, 24 nt, Human
gaauaaacaaaauccaugauauuu

SEQ ID NO: 708457 - RNA, 18 nt, Human
gaccuauuucuccuuccu

SEQ ID NO: 708458 - RNA, 18 nt, Human
gagcccauucuuuccuug

SEQ ID NO: 708459 - RNA, 21 nt, Human
gcccaacagaacccaaugaau

SEQ ID NO: 708460 - RNA, 18 nt, Human
gcucccuuucccaccccu

SEQ ID NO: 708461 - RNA, 22 nt, Human
gcucccuuucccaccccuguuc

SEQ ID NO: 708462 - RNA, 21 nt, Human
gucuauguuuucaauguucuu

SEQ ID NO: 708463 - RNA, 23 nt, Human
uaaaaaaaacaucaauucagaaa

SEQ ID NO: 708464 - RNA, 22 nt, Human
uaaaauaaacuuaccaaggggc

SEQ ID NO: 708465 - RNA, 19 nt, Human
uaaaaugccuaguacauag

SEQ ID NO: 708466 - RNA, 19 nt, Human
uaacaagcauauuugcccu

SEQ ID NO: 708467 - RNA, 23 nt, Human
uaacaggccagcauugcuacagc

SEQ ID NO: 708468 - RNA, 18 nt, Human
uaacccagcacagcagca

SEQ ID NO: 708469 - RNA, 24 nt, Human
uaacccagcacagcagcacaccuc

SEQ ID NO: 708470 - RNA, 20 nt, Human
uaagaggucccaccugcucc

SEQ ID NO: 708471 - RNA, 24 nt, Human
uacacugaagauaaagcaaaaggc

SEQ ID NO: 708472 - RNA, 23 nt, Human
uacagccaguaagucuauguuuu

SEQ ID NO: 708473 - RNA, 25 nt, Human
uaucaaaauacacuuuucacuggga

SEQ ID NO: 708474 - RNA, 18 nt, Human
uauuugcaacuacauaua

SEQ ID NO: 708475 - RNA, 22 nt, Human
uauuuuaguaacucauagugua

SEQ ID NO: 708476 - RNA, 21 nt, Human
ucaagcauuacagcaaagcca

SEQ ID NO: 708477 - RNA, 23 nt, Human
ucaaguugaagcaggauuaagga

SEQ ID NO: 708478 - RNA, 22 nt, Human
ucacuccuccagccagcccucc

SEQ ID NO: 708479 - RNA, 24 nt, Human
ucagagcggucggcgcagcucaca

SEQ ID NO: 708480 - RNA, 23 nt, Human
uccacauguugauuuaauaaagu

SEQ ID NO: 708481 - RNA, 21 nt, Human
uccacugcaccacaaaaaaac

SEQ ID NO: 708482 - RNA, 21 nt, Human
uccaugauauuuuaguaacuc

SEQ ID NO: 708483 - RNA, 19 nt, Human
ucccccagagcugcucaac

SEQ ID NO: 708484 - RNA, 21 nt, Human
uccccccaaaaaagcccuccu

SEQ ID NO: 708485 - RNA, 22 nt, Human
uccccccaaaaaagcccuccug

SEQ ID NO: 708486 - RNA, 25 nt, Human
uccccccaaaaaagcccuccugugu

SEQ ID NO: 708487 - RNA, 24 nt, Human
ucucaaucucuucugcaauaacau

SEQ ID NO: 708488 - RNA, 24 nt, Human
ucuccagacuuuuagacagaacaa

SEQ ID NO: 708489 - RNA, 19 nt, Human
ucugggcugcugccuaaga

SEQ ID NO: 708490 - RNA, 20 nt, Human
ucuguacuggucaucccccc

SEQ ID NO: 708491 - RNA, 23 nt, Human
ugaaaugugauuuguucaaggcu

SEQ ID NO: 708492 - RNA, 21 nt, Human
ugaagauaaagcaaaaggcaa

SEQ ID NO: 708493 - RNA, 19 nt, Human
ugcuacagccaguaagucu

SEQ ID NO: 708494 - RNA, 19 nt, Human
ugcucccuuucccaccccu

SEQ ID NO: 708495 - RNA, 21 nt, Human
ugcucccuuucccaccccugu

SEQ ID NO: 708496 - RNA, 22 nt, Human
uggaacaaaacuauaucuuugc

SEQ ID NO: 708497 - RNA, 19 nt, Human
uggcggcagggaccgcgaa

SEQ ID NO: 708498 - RNA, 19 nt, Human
ugggagaaaaaacugcuga

SEQ ID NO: 708499 - RNA, 24 nt, Human
uggucauccccccaaaaaagcccu

SEQ ID NO: 708500 - RNA, 26 nt, Human
uguggaacaaaacuauaucuuugccc

SEQ ID NO: 708501 - RNA, 22 nt, Human
uuaaagaugcccaacagaaccc

SEQ ID NO: 708502 - RNA, 19 nt, Human
uuaacccagcacagcagca

SEQ ID NO: 708503 - RNA, 25 nt, Human
uuaacccagcacagcagcacaccuc

SEQ ID NO: 708504 - RNA, 20 nt, Human
uuaaugcucaguuuucacaa

SEQ ID NO: 708505 - RNA, 21 nt, Human
uucacaaacacagucaagucu

SEQ ID NO: 708506 - RNA, 24 nt, Human
uucacaagauaaucaaguugaagc

SEQ ID NO: 708507 - RNA, 20 nt, Human
uucagaauauaaaaaaaugc

SEQ ID NO: 708508 - RNA, 22 nt, Human
aaacacauauacagaguacccc

SEQ ID NO: 708509 - RNA, 23 nt, Human
aaagaagaaacacauauacagag

SEQ ID NO: 708510 - RNA, 26 nt, Human
aauugcuuuuucccuuuaacuuccau

SEQ ID NO: 708511 - RNA, 26 nt, Human
accuucuuuagcaacuuuccuuguug

SEQ ID NO: 708512 - RNA, 18 nt, Human
auuuauuugccggcugga

SEQ ID NO: 708513 - RNA, 22 nt, Human
caacaaugucauaguugguuuu

SEQ ID NO: 708514 - RNA, 21 nt, Human
cacccuuuuucccaaguuuug

SEQ ID NO: 708515 - RNA, 18 nt, Human
cacugaguugucugcuuu

SEQ ID NO: 708516 - RNA, 24 nt, Human
cagaguaccccaauuaccaguaug

SEQ ID NO: 708517 - RNA, 22 nt, Human
caguaugguggacccuaccccu

SEQ ID NO: 708518 - RNA, 21 nt, Human
ccauuugggcuucuuggcugc

SEQ ID NO: 708519 - RNA, 22 nt, Human
gcuucaguucuuucuucuucuu

SEQ ID NO: 708520 - RNA, 22 nt, Human
uauacagaguaccccaauuacc

SEQ ID NO: 708521 - RNA, 24 nt, Human
uauuuuuaugaaaucuguuuuuuu

SEQ ID NO: 708522 - RNA, 20 nt, Human
ucauaguugguuuuaucacu

SEQ ID NO: 708523 - RNA, 24 nt, Human
ucuuucuucuucuuuuugaagucc

SEQ ID NO: 708524 - RNA, 24 nt, Human
ucuuuggugauuuguccccuugcu

SEQ ID NO: 708525 - RNA, 27 nt, Human
ucuuuggugauuuguccccuugcugcu

SEQ ID NO: 708526 - RNA, 19 nt, Human
ugaaaucuguuuuuuucuu

SEQ ID NO: 708527 - RNA, 22 nt, Human
ugauuuguccccuugcugcuua

SEQ ID NO: 708528 - RNA, 18 nt, Human
uggcuggaauuuucucuu

SEQ ID NO: 708529 - RNA, 19 nt, Human
uggcuggaauuuucucuuc

SEQ ID NO: 708530 - RNA, 27 nt, Human
uuaaaaaagaccauuuaaaaaaacaau

SEQ ID NO: 708531 - RNA, 22 nt, Human
uucuuggcugcugauucaucuu

SEQ ID NO: 708532 - RNA, 21 nt, Human
uuggaaaugucuuugaagaac

SEQ ID NO: 708533 - RNA, 24 nt, Human
uuucugcauugggaaacagaacag

SEQ ID NO: 708534 - RNA, 20 nt, Human
uuuuucccuuuaacuuccau

SEQ ID NO: 708535 - RNA, 24 nt, Human
uuuuucuugugcugucuuuguauu

SEQ ID NO: 708536 - RNA, 22 nt, Human
uuuuuuuuuuuuaaaaaagacc

SEQ ID NO: 708537 - RNA, 19 nt, Human
aaaagaaaguuguauggga

SEQ ID NO: 708538 - RNA, 28 nt, Human
aaauguaggccaagugugguggcucacg

SEQ ID NO: 708539 - RNA, 25 nt, Human
aaccaccugugauuugaacacuuga

SEQ ID NO: 708540 - RNA, 21 nt, Human
aaccccgucucuaccaaaaau

SEQ ID NO: 708541 - RNA, 23 nt, Human
aagguggguggaucacuugaggu

SEQ ID NO: 708542 - RNA, 25 nt, Human
aagguggguggaucacuugagguca

SEQ ID NO: 708543 - RNA, 24 nt, Human
aagugugguggcucacgcauguaa

SEQ ID NO: 708544 - RNA, 22 nt, Human
aauaaacauauaaacuaaagug

SEQ ID NO: 708545 - RNA, 21 nt, Human
aauauggcgaaaccccgucuc

SEQ ID NO: 708546 - RNA, 22 nt, Human
aauguacaauaaaugcacugaa

SEQ ID NO: 708547 - RNA, 19 nt, Human
acaagccugccuguguaau

SEQ ID NO: 708548 - RNA, 20 nt, Human
acagagcaugcuugugcuug

SEQ ID NO: 708549 - RNA, 18 nt, Human
acccaaauucuaccacuc

SEQ ID NO: 708550 - RNA, 24 nt, Human
accccgucucuaccaaaaauacaa

SEQ ID NO: 708551 - RNA, 18 nt, Human
acugcacuguagccuggg

SEQ ID NO: 708552 - RNA, 21 nt, Human
acugcacuguagccugggcag

SEQ ID NO: 708553 - RNA, 20 nt, Human
acuggaauaaggaauaccag

SEQ ID NO: 708554 - RNA, 24 nt, Human
acuguagccugggcagcacaguga

SEQ ID NO: 708555 - RNA, 24 nt, Human
acuugaggucaggaguuugagacc

SEQ ID NO: 708556 - RNA, 21 nt, Human
agaaagcaguuucuacauucu

SEQ ID NO: 708557 - RNA, 19 nt, Human
agcacagugagacuccguc

SEQ ID NO: 708558 - RNA, 24 nt, Human
agcacuuugggagaccaagguggg

SEQ ID NO: 708559 - RNA, 22 nt, Human
agccugggcagcacagugagac

SEQ ID NO: 708560 - RNA, 24 nt, Human
agccugggcagcacagugagacuc

SEQ ID NO: 708561 - RNA, 21 nt, Human
agcuggguguggugacagaug

SEQ ID NO: 708562 - RNA, 18 nt, Human
aggagaauugcuugaaaa

SEQ ID NO: 708563 - RNA, 24 nt, Human
aggcaggagaauugcuugaaaacc

SEQ ID NO: 708564 - RNA, 26 nt, Human
aggcaggagaauugcuugaaaaccug

SEQ ID NO: 708565 - RNA, 24 nt, Human
aggcggagauuggagagagccaag

SEQ ID NO: 708566 - RNA, 21 nt, Human
aggcugaggcaggagaauugc

SEQ ID NO: 708567 - RNA, 24 nt, Human
aggcugaggcaggagaauugcuug

SEQ ID NO: 708568 - RNA, 23 nt, Human
agguggguggaucacuugagguc

SEQ ID NO: 708569 - RNA, 21 nt, Human
aguuguaugggaguugagugg

SEQ ID NO: 708570 - RNA, 20 nt, Human
aucacuugaggucaggaguu

SEQ ID NO: 708571 - RNA, 26 nt, Human
aucacuuuccuacccaaauucuacca

SEQ ID NO: 708572 - RNA, 24 nt, Human
aucgagccacugcacuguagccug

SEQ ID NO: 708573 - RNA, 22 nt, Human
augcauuucuuagaacguaucc

SEQ ID NO: 708574 - RNA, 25 nt, Human
auguagccgcacuguaauaguuuuc

SEQ ID NO: 708575 - RNA, 22 nt, Human
caacggcagcaggagcgcgggc

SEQ ID NO: 708576 - RNA, 24 nt, Human
caagguggguggaucacuugaggu

SEQ ID NO: 708577 - RNA, 22 nt, Human
caauauggcgaaaccccgucuc

SEQ ID NO: 708578 - RNA, 24 nt, Human
caauauggcgaaaccccgucucua

SEQ ID NO: 708579 - RNA, 25 nt, Human
cacaagauucccuaacuaugcauuu

SEQ ID NO: 708580 - RNA, 24 nt, Human
cacgcauguaaucccagcacuuug

SEQ ID NO: 708581 - RNA, 20 nt, Human
cacuauacaaaaucucagaa

SEQ ID NO: 708582 - RNA, 20 nt, Human
cacugauuucugacauccuc

SEQ ID NO: 708583 - RNA, 23 nt, Human
cacugcacuguagccugggcagc

SEQ ID NO: 708584 - RNA, 24 nt, Human
cacugcacuguagccugggcagca

SEQ ID NO: 708585 - RNA, 23 nt, Human
cacuugaggucaggaguuugaga

SEQ ID NO: 708586 - RNA, 24 nt, Human
cagcacuuugggagaccaaggugg

SEQ ID NO: 708587 - RNA, 21 nt, Human
cagcaggcaagacaaauaggc

SEQ ID NO: 708588 - RNA, 21 nt, Human
caggcaggaauuccaggguag

SEQ ID NO: 708589 - RNA, 19 nt, Human
caucucaaucacuauacaa

SEQ ID NO: 708590 - RNA, 20 nt, Human
cauguggcuaguggcucauu

SEQ ID NO: 708591 - RNA, 22 nt, Human
cauguggcuaguggcucauugg

SEQ ID NO: 708592 - RNA, 20 nt, Human
ccacugcacuguagccuggg

SEQ ID NO: 708593 - RNA, 21 nt, Human
ccacugcacuguagccugggc

SEQ ID NO: 708594 - RNA, 24 nt, Human
ccacugcacuguagccugggcagc

SEQ ID NO: 708595 - RNA, 22 nt, Human
ccaguacaguagccacuaacca

SEQ ID NO: 708596 - RNA, 23 nt, Human
ccugggcagcacagugagacucc

SEQ ID NO: 708597 - RNA, 25 nt, Human
cgacggcagcagcggcgaggcccag

SEQ ID NO: 708598 - RNA, 24 nt, Human
cgcauguaaucccagcacuuuggg

SEQ ID NO: 708599 - RNA, 21 nt, Human
cgcgggcagcgcggcccggag

SEQ ID NO: 708600 - RNA, 19 nt, Human
cggcgaggcccagcaacgg

SEQ ID NO: 708601 - RNA, 24 nt, Human
cucacgcauguaaucccagcacuu

SEQ ID NO: 708602 - RNA, 24 nt, Human
cuccauggucaguacacugauuuc

SEQ ID NO: 708603 - RNA, 23 nt, Human
cuccgucauauauauauauauau

SEQ ID NO: 708604 - RNA, 25 nt, Human
cuuaaaaucacuuauuccccauuuc

SEQ ID NO: 708605 - RNA, 22 nt, Human
cuuuaucuuuccuguuuuuggu

SEQ ID NO: 708606 - RNA, 22 nt, Human
gacaguccgcgacggcagcagc

SEQ ID NO: 708607 - RNA, 23 nt, Human
gacuuaaucacuuuccuacccaa

SEQ ID NO: 708608 - RNA, 24 nt, Human
gaucacuugaggucaggaguuuga

SEQ ID NO: 708609 - RNA, 24 nt, Human
gccacugcacuguagccugggcag

SEQ ID NO: 708610 - RNA, 20 nt, Human
ggaaaauuacucguuucagc

SEQ ID NO: 708611 - RNA, 22 nt, Human
ggaucacuugaggucaggaguu

SEQ ID NO: 708612 - RNA, 19 nt, Human
gggaaaguacaaaagguau

SEQ ID NO: 708613 - RNA, 19 nt, Human
ggucaggaguuugagacca

SEQ ID NO: 708614 - RNA, 21 nt, Human
gguggaucacuugaggucagg

SEQ ID NO: 708615 - RNA, 24 nt, Human
gguggcucacgcauguaaucccag

SEQ ID NO: 708616 - RNA, 29 nt, Human
gguguuaaaaguuguaaaauuuucuucaa

SEQ ID NO: 708617 - RNA, 18 nt, Human
guaaaauuuucuucaucu

SEQ ID NO: 708618 - RNA, 21 nt, Human
guaaaauuuucuucaucuaaa

SEQ ID NO: 708619 - RNA, 22 nt, Human
guaggccaagugugguggcuca

SEQ ID NO: 708620 - RNA, 24 nt, Human
guggcucacgcauguaaucccagc

SEQ ID NO: 708621 - RNA, 24 nt, Human
guguggugacagaugucugugguc

SEQ ID NO: 708622 - RNA, 22 nt, Human
guuucagcuuuuucauuuuuuu

SEQ ID NO: 708623 - RNA, 23 nt, Human
uaaaaagauacacauucuagagg

SEQ ID NO: 708624 - RNA, 21 nt, Human
uaaaaauguuacuggaauaag

SEQ ID NO: 708625 - RNA, 22 nt, Human
uaaacauauaaacuaaaguggg

SEQ ID NO: 708626 - RNA, 23 nt, Human
uaaagcagcuauuuuggaagagc

SEQ ID NO: 708627 - RNA, 23 nt, Human
uaaagcucuaauauccaauguca

SEQ ID NO: 708628 - RNA, 21 nt, Human
uaacaacugucuuggaacuga

SEQ ID NO: 708629 - RNA, 24 nt, Human
uaaggugccuguuauagauguucu

SEQ ID NO: 708630 - RNA, 22 nt, Human
uaauauguaaguguuaaccuaa

SEQ ID NO: 708631 - RNA, 18 nt, Human
uacaaaaaguuagcuggg

SEQ ID NO: 708632 - RNA, 19 nt, Human
uacacaagcuggaacuuug

SEQ ID NO: 708633 - RNA, 22 nt, Human
uaccaaaaauacaaaaaguuag

SEQ ID NO: 708634 - RNA, 22 nt, Human
uagaaaguaucaaaauguacaa

SEQ ID NO: 708635 - RNA, 20 nt, Human
uagaacguauccccauugau

SEQ ID NO: 708636 - RNA, 18 nt, Human
uagaggaauaagagaaaa

SEQ ID NO: 708637 - RNA, 21 nt, Human
uagguagaaaguaucaaaaug

SEQ ID NO: 708638 - RNA, 21 nt, Human
uaguauaucuaucuaucuccc

SEQ ID NO: 708639 - RNA, 20 nt, Human
uauagaacaguguuuccuua

SEQ ID NO: 708640 - RNA, 20 nt, Human
uaugcacauaauucuguaua

SEQ ID NO: 708641 - RNA, 19 nt, Human
ucacuugaggucaggaguu

SEQ ID NO: 708642 - RNA, 22 nt, Human
ucauuaaugauagugccauuaa

SEQ ID NO: 708643 - RNA, 20 nt, Human
uccccagaagaaaguaagau

SEQ ID NO: 708644 - RNA, 18 nt, Human
ucuaccacuccuuuaaga

SEQ ID NO: 708645 - RNA, 21 nt, Human
ucucuaccaaaaauacaaaaa

SEQ ID NO: 708646 - RNA, 19 nt, Human
ucugaacaaaagagaccau

SEQ ID NO: 708647 - RNA, 21 nt, Human
ucugacauccucuaugcuuuc

SEQ ID NO: 708648 - RNA, 21 nt, Human
ucugcaguauucagcacagua

SEQ ID NO: 708649 - RNA, 21 nt, Human
ucuguggucccagcuacuaag

SEQ ID NO: 708650 - RNA, 23 nt, Human
ugaaaaaugaaaccaaauauuga

SEQ ID NO: 708651 - RNA, 22 nt, Human
ugaaaaccugcaaggcggagau

SEQ ID NO: 708652 - RNA, 24 nt, Human
ugacagaugucuguggucccagcu

SEQ ID NO: 708653 - RNA, 25 nt, Human
ugacagugauaacaauggcuuaagc

SEQ ID NO: 708654 - RNA, 26 nt, Human
ugaggcaggagaauugcuugaaaacc

SEQ ID NO: 708655 - RNA, 27 nt, Human
ugaggcaggagaauugcuugaaaaccu

SEQ ID NO: 708656 - RNA, 18 nt, Human
ugaggucaggaguuugag

SEQ ID NO: 708657 - RNA, 24 nt, Human
ugcacugaaaacuuugaucacugu

SEQ ID NO: 708658 - RNA, 18 nt, Human
ugccuguuauagauguuc

SEQ ID NO: 708659 - RNA, 20 nt, Human
ugcuuucuacuuugauggcu

SEQ ID NO: 708660 - RNA, 21 nt, Human
uggaacuuuguugccauuagu

SEQ ID NO: 708661 - RNA, 19 nt, Human
uggaagguaggauuuaaga

SEQ ID NO: 708662 - RNA, 23 nt, Human
uggaccacauauagaacaguguu

SEQ ID NO: 708663 - RNA, 23 nt, Human
uggaucacuugaggucaggaguu

SEQ ID NO: 708664 - RNA, 24 nt, Human
uggaucacuugaggucaggaguuu

SEQ ID NO: 708665 - RNA, 27 nt, Human
uggaucacuugaggucaggaguuugag

SEQ ID NO: 708666 - RNA, 19 nt, Human
uggcuaguggcucauugga

SEQ ID NO: 708667 - RNA, 21 nt, Human
uggcucacgcauguaauccca

SEQ ID NO: 708668 - RNA, 24 nt, Human
uggcucacgcauguaaucccagca

SEQ ID NO: 708669 - RNA, 24 nt, Human
ugggagaccaagguggguggauca

SEQ ID NO: 708670 - RNA, 24 nt, Human
uggguggaucacuugaggucagga

SEQ ID NO: 708671 - RNA, 24 nt, Human
uggugacagaugucugugguccca

SEQ ID NO: 708672 - RNA, 24 nt, Human
ugguggcucacgcauguaauccca

SEQ ID NO: 708673 - RNA, 19 nt, Human
uguagguuugggacaaaau

SEQ ID NO: 708674 - RNA, 24 nt, Human
ugucuguggucccagcuacuaagg

SEQ ID NO: 708675 - RNA, 22 nt, Human
ugugaugaguguuuucgauuca

SEQ ID NO: 708676 - RNA, 26 nt, Human
uguuacuggaauaaggaauaccauua

SEQ ID NO: 708677 - RNA, 21 nt, Human
uguuuuucuucgguuuuugcu

SEQ ID NO: 708678 - RNA, 19 nt, Human
uuagcuggguguggugaca

SEQ ID NO: 708679 - RNA, 24 nt, Human
uuagcuggguguggugacagaugu

SEQ ID NO: 708680 - RNA, 23 nt, Human
uuagcuggguguggugaccacgg

SEQ ID NO: 708681 - RNA, 21 nt, Human
uucaagugacagauucugccu

SEQ ID NO: 708682 - RNA, 23 nt, Human
uucaagugacagauucugccuuu

SEQ ID NO: 708683 - RNA, 21 nt, Human
uucuuuaucuuuccuguuuuu

SEQ ID NO: 708684 - RNA, 22 nt, Human
uucuuugagccucagacuucua

SEQ ID NO: 708685 - RNA, 20 nt, Human
uuuaaaauguuauucugaau

SEQ ID NO: 708686 - RNA, 22 nt, Human
uuuaaacuaaauuuacuuaaau

SEQ ID NO: 708687 - RNA, 23 nt, Human
uuuucauuuuuuuacuccccaaa

SEQ ID NO: 708688 - RNA, 24 nt, Human
aaaaaaaagagcacaaaugcaugg

SEQ ID NO: 708689 - RNA, 20 nt, Human
aaaaaagagcacaaaugcau

SEQ ID NO: 708690 - RNA, 23 nt, Human
aaaacaaacugaaacauaagccc

SEQ ID NO: 708691 - RNA, 28 nt, Human
aaacaaacugaaacauaagccggacccc

SEQ ID NO: 708692 - RNA, 19 nt, Human
aaacaaaucaccauccuuc

SEQ ID NO: 708693 - RNA, 21 nt, Human
aaacagaacggaaaacaaacu

SEQ ID NO: 708694 - RNA, 21 nt, Human
aaauacaaaaaccaugaaaca

SEQ ID NO: 708695 - RNA, 20 nt, Human
aacaaaucaccauccuucaa

SEQ ID NO: 708696 - RNA, 22 nt, Human
aagaaaaagacuaagaacaaaa

SEQ ID NO: 708697 - RNA, 25 nt, Human
aagaaaaagacuaagaacaaaaagu

SEQ ID NO: 708698 - RNA, 19 nt, Human
aagaacaucaauuuuacaa

SEQ ID NO: 708699 - RNA, 26 nt, Human
aauuuagaaacaaauuuuauuuaaga

SEQ ID NO: 708700 - RNA, 26 nt, Human
acaagaaaaagacuaagaacaaaaag

SEQ ID NO: 708701 - RNA, 20 nt, Human
acucaaauacaaaaaccaug

SEQ ID NO: 708702 - RNA, 20 nt, Human
acuuugaaaugagaaaagga

SEQ ID NO: 708703 - RNA, 21 nt, Human
acuuugaaaugagaaaaggag

SEQ ID NO: 708704 - RNA, 25 nt, Human
agaacaaaaaguguuuacagauaca

SEQ ID NO: 708705 - RNA, 21 nt, Human
agaacggaaaacaaacugaaa

SEQ ID NO: 708706 - RNA, 18 nt, Human
auccagaucuucccagca

SEQ ID NO: 708707 - RNA, 21 nt, Human
aucuuccuucuuucccuucca

SEQ ID NO: 708708 - RNA, 18 nt, Human
augaagaugaacuuuugu

SEQ ID NO: 708709 - RNA, 24 nt, Human
caaaaaccaugaaacaaaucacca

SEQ ID NO: 708710 - RNA, 19 nt, Human
caacaauuugagcaaagau

SEQ ID NO: 708711 - RNA, 22 nt, Human
caacuuugaaaugagaaaagga

SEQ ID NO: 708712 - RNA, 26 nt, Human
caaucuuccuucuuucccuuccaaga

SEQ ID NO: 708713 - RNA, 22 nt, Human
cacauagcauuaacacauauua

SEQ ID NO: 708714 - RNA, 21 nt, Human
cacugguagcaacuuugaaau

SEQ ID NO: 708715 - RNA, 23 nt, Human
cagaacggaaaacaaacugaaac

SEQ ID NO: 708716 - RNA, 18 nt, Human
cauccuucaacaauuugg

SEQ ID NO: 708717 - RNA, 18 nt, Human
caugaaacaaaucaccau

SEQ ID NO: 708718 - RNA, 25 nt, Human
caugaaacaaaucaccauccuucaa

SEQ ID NO: 708719 - RNA, 24 nt, Human
ccaaccaacaaucuuccuucuuuc

SEQ ID NO: 708720 - RNA, 19 nt, Human
ccagaaaaccguggcuaca

SEQ ID NO: 708721 - RNA, 23 nt, Human
cugcaaugaagaugaacuuuugu

SEQ ID NO: 708722 - RNA, 18 nt, Human
cuuauagaucuucuggga

SEQ ID NO: 708723 - RNA, 21 nt, Human
gaagugggagauacaaccuag

SEQ ID NO: 708724 - RNA, 21 nt, Human
ggagauacaaccuagaaagaa

SEQ ID NO: 708725 - RNA, 24 nt, Human
uaaaauaucaacuuuuccagaaaa

SEQ ID NO: 708726 - RNA, 23 nt, Human
uacaaccuagaaagaaaggcagg

SEQ ID NO: 708727 - RNA, 23 nt, Human
uacaagaaaaagacuaagaacaa

SEQ ID NO: 708728 - RNA, 25 nt, Human
uacaagaaaaagacuaagaacaaaa

SEQ ID NO: 708729 - RNA, 21 nt, Human
uacaauuccuaaaauaucaac

SEQ ID NO: 708730 - RNA, 21 nt, Human
uagaaagaaaggcagguaucu

SEQ ID NO: 708731 - RNA, 22 nt, Human
uagaacgugcauuagacucaaa

SEQ ID NO: 708732 - RNA, 23 nt, Human
uagacucaaauacaaaaaccaug

SEQ ID NO: 708733 - RNA, 22 nt, Human
uaggaaccaccagcauucaagc

SEQ ID NO: 708734 - RNA, 27 nt, Human
ucaaauacaaaaaccaugaaacaaauc

SEQ ID NO: 708735 - RNA, 20 nt, Human
ucaacuaggcaauaaaaugu

SEQ ID NO: 708736 - RNA, 21 nt, Human
ucaagcaccauaaaaaaaaaa

SEQ ID NO: 708737 - RNA, 18 nt, Human
ucugaaauacaauuccua

SEQ ID NO: 708738 - RNA, 19 nt, Human
ucugcaaugaagaugaacu

SEQ ID NO: 708739 - RNA, 23 nt, Human
ucuguaaucagggaagguucugc

SEQ ID NO: 708740 - RNA, 18 nt, Human
ucuuccuucuuucccuuc

SEQ ID NO: 708741 - RNA, 22 nt, Human
ugaaaucauccaagauucugua

SEQ ID NO: 708742 - RNA, 22 nt, Human
ugaaccuuuggcacuaggaauc

SEQ ID NO: 708743 - RNA, 18 nt, Human
ugagcaaagauagaaugc

SEQ ID NO: 708744 - RNA, 21 nt, Human
uggguuuucagguauauacau

SEQ ID NO: 708745 - RNA, 23 nt, Human
uugaaaugagaaaaggagcuuac

SEQ ID NO: 708746 - RNA, 26 nt, Human
uuugagcaaagauagaaugccuaaga

SEQ ID NO: 708747 - RNA, 24 nt, Human
aaauaacagagcuccagagaaaga

SEQ ID NO: 708748 - RNA, 21 nt, Human
aaccuccugcaaacacccgca

SEQ ID NO: 708749 - RNA, 23 nt, Human
aacugcauugaggguacagccuu

SEQ ID NO: 708750 - RNA, 21 nt, Human
aagucgcagcuguuaauccug

SEQ ID NO: 708751 - RNA, 22 nt, Human
aagucgcagcuguuaauccuga

SEQ ID NO: 708752 - RNA, 24 nt, Human
aauacaauuuauuauuauuacauu

SEQ ID NO: 708753 - RNA, 18 nt, Human
aauccgugaagacaggcc

SEQ ID NO: 708754 - RNA, 28 nt, Human
acagagcuccagagaaagagggaacgcc

SEQ ID NO: 708755 - RNA, 21 nt, Human
accgcccccuucagugccccg

SEQ ID NO: 708756 - RNA, 18 nt, Human
acgccgaagcgccacggc

SEQ ID NO: 708757 - RNA, 22 nt, Human
acucuguugcaggcuccuuacu

SEQ ID NO: 708758 - RNA, 21 nt, Human
agcccagcgaguacugcaacc

SEQ ID NO: 708759 - RNA, 22 nt, Human
caagucaggguccuggaccgcc

SEQ ID NO: 708760 - RNA, 18 nt, Human
cacccgagacgaccucag

SEQ ID NO: 708761 - RNA, 18 nt, Human
cagagcuccagagaaaga

SEQ ID NO: 708762 - RNA, 19 nt, Human
cagcgcccaccacaggcua

SEQ ID NO: 708763 - RNA, 21 nt, Human
ccaaagcuugaauuuacaugg

SEQ ID NO: 708764 - RNA, 18 nt, Human
ccaccacaggcuaaaccc

SEQ ID NO: 708765 - RNA, 20 nt, Human
cccccgagccucgcgugcuc

SEQ ID NO: 708766 - RNA, 19 nt, Human
ccccgagccucgcgugcuc

SEQ ID NO: 708767 - RNA, 18 nt, Human
ccccgugccgcccccgag

SEQ ID NO: 708768 - RNA, 22 nt, Human
ccccgugccgcccccgagccuc

SEQ ID NO: 708769 - RNA, 18 nt, Human
ccccuaaacaacaaaacu

SEQ ID NO: 708770 - RNA, 21 nt, Human
ccccuaaacaacaaaacucug

SEQ ID NO: 708771 - RNA, 22 nt, Human
cccgcagcgcccaccacaggcu

SEQ ID NO: 708772 - RNA, 18 nt, Human
cccggcccgcccgcggga

SEQ ID NO: 708773 - RNA, 18 nt, Human
ccgcccccuucagugccc

SEQ ID NO: 708774 - RNA, 19 nt, Human
ccgcccccuucagugcccc

SEQ ID NO: 708775 - RNA, 18 nt, Human
ccgccccgugccgccccc

SEQ ID NO: 708776 - RNA, 22 nt, Human
ccucacccgagacgaccucagc

SEQ ID NO: 708777 - RNA, 18 nt, Human
ccucgcgugcucgcgccg

SEQ ID NO: 708778 - RNA, 23 nt, Human
ccugcaaacacccgcagcgccca

SEQ ID NO: 708779 - RNA, 23 nt, Human
ccuugcugaaggguccuuucuug

SEQ ID NO: 708780 - RNA, 22 nt, Human
cgcccccgagccucgcgugcuc

SEQ ID NO: 708781 - RNA, 22 nt, Human
cgcccccuaaacaacaaaacuc

SEQ ID NO: 708782 - RNA, 22 nt, Human
cgugccgcccccgagccucgcg

SEQ ID NO: 708783 - RNA, 24 nt, Human
cuaaagucgcagcuguuaauccug

SEQ ID NO: 708784 - RNA, 25 nt, Human
cucaaaauaacagagcuccagagaa

SEQ ID NO: 708785 - RNA, 18 nt, Human
cuccaauacaauuuauua

SEQ ID NO: 708786 - RNA, 23 nt, Human
cuuccggcgcgaccuccucaccc

SEQ ID NO: 708787 - RNA, 22 nt, Human
cuugcugaaggguccuuucuug

SEQ ID NO: 708788 - RNA, 24 nt, Human
cuugucaacuccuaguuagccugc

SEQ ID NO: 708789 - RNA, 20 nt, Human
gagaagaaaauauaccccac

SEQ ID NO: 708790 - RNA, 21 nt, Human
gagacaagucaggguccugga

SEQ ID NO: 708791 - RNA, 19 nt, Human
gaugaugaaucuggaaaaa

SEQ ID NO: 708792 - RNA, 22 nt, Human
gccgcgcccccuaaacaacaaa

SEQ ID NO: 708793 - RNA, 24 nt, Human
gcugcaaggugaagggagcggugc

SEQ ID NO: 708794 - RNA, 18 nt, Human
ggugcggugccgcgcccc

SEQ ID NO: 708795 - RNA, 21 nt, Human
gucuucuugugguuguuacca

SEQ ID NO: 708796 - RNA, 19 nt, Human
gugaagggagcggugcggu

SEQ ID NO: 708797 - RNA, 21 nt, Human
gugaugacagcaaaacuaaaa

SEQ ID NO: 708798 - RNA, 21 nt, Human
gugccgcgcccccuaaacaac

SEQ ID NO: 708799 - RNA, 23 nt, Human
uaaaccccgccccgugccgcccc

SEQ ID NO: 708800 - RNA, 19 nt, Human
uaaccgcgagacaagucag

SEQ ID NO: 708801 - RNA, 24 nt, Human
uaacuaagaaagaacaguuucacu

SEQ ID NO: 708802 - RNA, 24 nt, Human
uacagccuugcugaaggguccuuu

SEQ ID NO: 708803 - RNA, 22 nt, Human
uaccacaagccaaagcuugaau

SEQ ID NO: 708804 - RNA, 26 nt, Human
uacugcaaccuccugcaaagggcccu

SEQ ID NO: 708805 - RNA, 26 nt, Human
uauuauacucaaaauaacagagcucc

SEQ ID NO: 708806 - RNA, 21 nt, Human
ucaaugaugaugaaucuggaa

SEQ ID NO: 708807 - RNA, 25 nt, Human
ucagcccagcgaguacugcaaccuc

SEQ ID NO: 708808 - RNA, 22 nt, Human
ucaggguccuggaccgcccccu

SEQ ID NO: 708809 - RNA, 19 nt, Human
uccagagaaagacaguuaa

SEQ ID NO: 708810 - RNA, 26 nt, Human
uccagagaaagacaguuaacuaagaa

SEQ ID NO: 708811 - RNA, 18 nt, Human
uccuggaccgcccccuuc

SEQ ID NO: 708812 - RNA, 19 nt, Human
uggaccgcccccuucagug

SEQ ID NO: 708813 - RNA, 24 nt, Human
uuacaugggcaucaggccaagucu

SEQ ID NO: 708814 - RNA, 19 nt, Human
uucuugacagucaaugaug

SEQ ID NO: 708815 - RNA, 24 nt, Human
uugacagucaaugaugaugaaucu

SEQ ID NO: 708816 - RNA, 22 nt, Human
aaaagaaaaagaaaauugagag

SEQ ID NO: 708817 - RNA, 24 nt, Human
aaaagaaaaagaaaauugagagag

SEQ ID NO: 708818 - RNA, 18 nt, Human
aaacagaagaaaccaaag

SEQ ID NO: 708819 - RNA, 19 nt, Human
aaaccaaagaaaaacacac

SEQ ID NO: 708820 - RNA, 28 nt, Human
aaagaaaaacacacuucauguaaacaaa

SEQ ID NO: 708821 - RNA, 20 nt, Human
aaagaaaauugagagagagg

SEQ ID NO: 708822 - RNA, 25 nt, Human
aacacacuucauguaaacaacagaa

SEQ ID NO: 708823 - RNA, 18 nt, Human
aaccuggggcgccgcacu

SEQ ID NO: 708824 - RNA, 23 nt, Human
aagaaaccaaagaaaaacacacu

SEQ ID NO: 708825 - RNA, 19 nt, Human
aaggaugaggauacagaga

SEQ ID NO: 708826 - RNA, 21 nt, Human
acccuguugccaggccaccgg

SEQ ID NO: 708827 - RNA, 19 nt, Human
acucuuugcuuacugcagg

SEQ ID NO: 708828 - RNA, 25 nt, Human
agaaaagaaaaagaaaauugagaga

SEQ ID NO: 708829 - RNA, 22 nt, Human
aggaauuucagauaacaaaugu

SEQ ID NO: 708830 - RNA, 18 nt, Human
aggcagaaccaauauaau

SEQ ID NO: 708831 - RNA, 19 nt, Human
augccagaggcagaaccaa

SEQ ID NO: 708832 - RNA, 18 nt, Human
caaagaaaaacacacuuc

SEQ ID NO: 708833 - RNA, 20 nt, Human
caaaugugaaaaguugaaau

SEQ ID NO: 708834 - RNA, 19 nt, Human
cacacaaaucugugugugg

SEQ ID NO: 708835 - RNA, 23 nt, Human
cacacaaaucuguguguggcuaa

SEQ ID NO: 708836 - RNA, 18 nt, Human
cagcaugccagaggcaga

SEQ ID NO: 708837 - RNA, 20 nt, Human
cagcaugccagaggcagaac

SEQ ID NO: 708838 - RNA, 23 nt, Human
cagcaugccagaggcagaaccaa

SEQ ID NO: 708839 - RNA, 23 nt, Human
cauguaaacaacagaacacuaug

SEQ ID NO: 708840 - RNA, 22 nt, Human
ccaccggguccggcccagccuu

SEQ ID NO: 708841 - RNA, 23 nt, Human
ccggguccggcccagccuugauu

SEQ ID NO: 708842 - RNA, 20 nt, Human
cuacaauaaaagccacacaa

SEQ ID NO: 708843 - RNA, 19 nt, Human
cuaccagcaugccagaggc

SEQ ID NO: 708844 - RNA, 24 nt, Human
cucgccgcgccuguuacugccucc

SEQ ID NO: 708845 - RNA, 24 nt, Human
gaaaaacacacuucauguaaacaa

SEQ ID NO: 708846 - RNA, 22 nt, Human
gaaaauaauaaguuaggauggc

SEQ ID NO: 708847 - RNA, 22 nt, Human
uaacaaaugugaaaaguugaaa

SEQ ID NO: 708848 - RNA, 23 nt, Human
uaacaggaaauaggaauuucaga

SEQ ID NO: 708849 - RNA, 18 nt, Human
uagaaaacagggaaaugu

SEQ ID NO: 708850 - RNA, 25 nt, Human
uagaaaacagggaaauguccuucaa

SEQ ID NO: 708851 - RNA, 20 nt, Human
uagaaaaugaguucaaccau

SEQ ID NO: 708852 - RNA, 19 nt, Human
ucacucauccucgcuucgc

SEQ ID NO: 708853 - RNA, 27 nt, Human
ucauguaaacaacagaacacuaugcua

SEQ ID NO: 708854 - RNA, 18 nt, Human
uggaaaacagaagaaacc

SEQ ID NO: 708855 - RNA, 24 nt, Human
uggaaaacagaagaaaccaaagaa

SEQ ID NO: 708856 - RNA, 23 nt, Human
ugucuggaggagaaccucuggaa

SEQ ID NO: 708857 - RNA, 25 nt, Human
uguuaacaggaaauaggaauuucag

SEQ ID NO: 708858 - RNA, 20 nt, Human
uuacugcaggucuugucugg

SEQ ID NO: 708859 - RNA, 24 nt, Human
uuacugccuccacggaucacucag

SEQ ID NO: 708860 - RNA, 23 nt, Human
uuaguuggaaaacagaagaaacc

SEQ ID NO: 708861 - RNA, 21 nt, Human
aaaaagaaacauggaauccau

SEQ ID NO: 708862 - RNA, 24 nt, Human
aaauggccagccagcuuggggagc

SEQ ID NO: 708863 - RNA, 18 nt, Human
aacaacaucacauaucca

SEQ ID NO: 708864 - RNA, 19 nt, Human
aacauggagaaaaagauga

SEQ ID NO: 708865 - RNA, 22 nt, Human
aacucuguuaccucugcauccc

SEQ ID NO: 708866 - RNA, 21 nt, Human
aagcaagggugagacagccac

SEQ ID NO: 708867 - RNA, 19 nt, Human
aagccucuucuuuaggaau

SEQ ID NO: 708868 - RNA, 20 nt, Human
aagguccauucuuccuuagg

SEQ ID NO: 708869 - RNA, 21 nt, Human
aagguugucaggggagucugu

SEQ ID NO: 708870 - RNA, 20 nt, Human
aaugcccacccuccacaggc

SEQ ID NO: 708871 - RNA, 21 nt, Human
aauuuuauuucauugcaauga

SEQ ID NO: 708872 - RNA, 18 nt, Human
acacacacacauacacac

SEQ ID NO: 708873 - RNA, 22 nt, Human
accucugcaucccaccugugcc

SEQ ID NO: 708874 - RNA, 18 nt, Human
accuggagggcaggugag

SEQ ID NO: 708875 - RNA, 22 nt, Human
agaaggaggcuuagccccagaa

SEQ ID NO: 708876 - RNA, 23 nt, Human
agacagccacauuccucauccuc

SEQ ID NO: 708877 - RNA, 20 nt, Human
agauccugaucaccgcccag

SEQ ID NO: 708878 - RNA, 21 nt, Human
agaugguguuguagaugccuu

SEQ ID NO: 708879 - RNA, 21 nt, Human
agcaauggcaacagaugaaga

SEQ ID NO: 708880 - RNA, 25 nt, Human
aggcacaugugucaccuacaugugg

SEQ ID NO: 708881 - RNA, 19 nt, Human
aggcagaagagggaaucag

SEQ ID NO: 708882 - RNA, 21 nt, Human
aggcagaagagggaaucagag

SEQ ID NO: 708883 - RNA, 22 nt, Human
aggcaguuuauggccauauagg

SEQ ID NO: 708884 - RNA, 20 nt, Human
agggcuggggcuggucuggu

SEQ ID NO: 708885 - RNA, 20 nt, Human
agggguuccugaaaugucug

SEQ ID NO: 708886 - RNA, 20 nt, Human
agguguagcaucuccucacc

SEQ ID NO: 708887 - RNA, 20 nt, Human
agguugucaggggagucugu

SEQ ID NO: 708888 - RNA, 23 nt, Human
aguuucuucaucuccaaaauggg

SEQ ID NO: 708889 - RNA, 26 nt, Human
auaaauaaaccucuuuauagcuucau

SEQ ID NO: 708890 - RNA, 20 nt, Human
auaaauauaaauaaaccucc

SEQ ID NO: 708891 - RNA, 23 nt, Human
auccauugagcaauggggaaagg

SEQ ID NO: 708892 - RNA, 22 nt, Human
auggagaggaauaaagggcugg

SEQ ID NO: 708893 - RNA, 21 nt, Human
auuuuucuaccuuucucccuc

SEQ ID NO: 708894 - RNA, 21 nt, Human
caagagcucuuuguucuugcu

SEQ ID NO: 708895 - RNA, 28 nt, Human
caagauggugucccagauagagcugaag

SEQ ID NO: 708896 - RNA, 20 nt, Human
caagggucaccacuaaaugc

SEQ ID NO: 708897 - RNA, 18 nt, Human
cacacacagcagcaaaau

SEQ ID NO: 708898 - RNA, 22 nt, Human
cacacacagcagcaaaauggcc

SEQ ID NO: 708899 - RNA, 23 nt, Human
cacacacuuacacacacacauac

SEQ ID NO: 708900 - RNA, 22 nt, Human
cacacagcagcaaaauggccag

SEQ ID NO: 708901 - RNA, 20 nt, Human
caccuccacacacagcagca

SEQ ID NO: 708902 - RNA, 24 nt, Human
caccucugcuuccugccuaacuaa

SEQ ID NO: 708903 - RNA, 23 nt, Human
cacuaaaugcccacccuccacag

SEQ ID NO: 708904 - RNA, 20 nt, Human
cacucccaccccgagccagg

SEQ ID NO: 708905 - RNA, 21 nt, Human
cagaaaaaaauacugacaaau

SEQ ID NO: 708906 - RNA, 21 nt, Human
cagauagagcugaagaaggca

SEQ ID NO: 708907 - RNA, 25 nt, Human
cagcaauggcaacagaugaagagga

SEQ ID NO: 708908 - RNA, 24 nt, Human
cagcagcaauggcaacagaugaag

SEQ ID NO: 708909 - RNA, 25 nt, Human
cagcgccccgggcccuggagggagg

SEQ ID NO: 708910 - RNA, 18 nt, Human
cagucaccaccaagagcu

SEQ ID NO: 708911 - RNA, 18 nt, Human
caguguguguccuuggga

SEQ ID NO: 708912 - RNA, 20 nt, Human
cauacacacaguuuuugccc

SEQ ID NO: 708913 - RNA, 22 nt, Human
caucccaccugugccauaccgu

SEQ ID NO: 708914 - RNA, 21 nt, Human
caucuguaaacauugcacagg

SEQ ID NO: 708915 - RNA, 18 nt, Human
cauuaaacacccaauuuc

SEQ ID NO: 708916 - RNA, 23 nt, Human
ccacaucccuggguuuggugcag

SEQ ID NO: 708917 - RNA, 18 nt, Human
ccacccuccacaggccua

SEQ ID NO: 708918 - RNA, 23 nt, Human
ccagaggucuucuucauccuucu

SEQ ID NO: 708919 - RNA, 22 nt, Human
ccagggaaucuccugguugcug

SEQ ID NO: 708920 - RNA, 21 nt, Human
ccaucuguuuugcaagcaagg

SEQ ID NO: 708921 - RNA, 26 nt, Human
ccccaagaaaaagaaacauggaaucc

SEQ ID NO: 708922 - RNA, 18 nt, Human
ccccccaagaaaaagaaa

SEQ ID NO: 708923 - RNA, 23 nt, Human
ccccccuuuuccuuuaagaagcc

SEQ ID NO: 708924 - RNA, 21 nt, Human
ccccgugaacuuacccucccc

SEQ ID NO: 708925 - RNA, 18 nt, Human
cccggugauccgcccucc

SEQ ID NO: 708926 - RNA, 22 nt, Human
cccucccugcuccccccaagaa

SEQ ID NO: 708927 - RNA, 21 nt, Human
ccggagccuggcuaaagcugc

SEQ ID NO: 708928 - RNA, 20 nt, Human
ccuccacacacagcagcaaa

SEQ ID NO: 708929 - RNA, 18 nt, Human
ccuccuuccacguuacuu

SEQ ID NO: 708930 - RNA, 22 nt, Human
ccucuggcugccguccggagcc

SEQ ID NO: 708931 - RNA, 19 nt, Human
cuaaacaggcagugauggu

SEQ ID NO: 708932 - RNA, 18 nt, Human
cucccucccugcuccccc

SEQ ID NO: 708933 - RNA, 22 nt, Human
cucuccagcauuaaacacccaa

SEQ ID NO: 708934 - RNA, 18 nt, Human
cugacagcgccccgggcc

SEQ ID NO: 708935 - RNA, 23 nt, Human
cugagugaugucugagugggggu

SEQ ID NO: 708936 - RNA, 23 nt, Human
cuguuaugugaagggcacagcca

SEQ ID NO: 708937 - RNA, 20 nt, Human
cuucucuggcugcuggcccc

SEQ ID NO: 708938 - RNA, 25 nt, Human
cuucuucuucuucuuguucuucucu

SEQ ID NO: 708939 - RNA, 20 nt, Human
cuucuugguguuuggucaag

SEQ ID NO: 708940 - RNA, 21 nt, Human
gaaaggagcaauggggaaagg

SEQ ID NO: 708941 - RNA, 20 nt, Human
gaaguggaaagaagagagug

SEQ ID NO: 708942 - RNA, 21 nt, Human
gagcaagcaguugccauggaa

SEQ ID NO: 708943 - RNA, 19 nt, Human
gagcaauggggaaaggccu

SEQ ID NO: 708944 - RNA, 18 nt, Human
gaggaauaaagggcuggg

SEQ ID NO: 708945 - RNA, 21 nt, Human
gaggacucccaggcagauggu

SEQ ID NO: 708946 - RNA, 19 nt, Human
gagggcugggacauuugug

SEQ ID NO: 708947 - RNA, 24 nt, Human
gaucccuccuuucccaacaaacac

SEQ ID NO: 708948 - RNA, 20 nt, Human
gcaccuuugagggagucugg

SEQ ID NO: 708949 - RNA, 24 nt, Human
gcacugggacuccucuaguuacgc

SEQ ID NO: 708950 - RNA, 18 nt, Human
gcaggcccaggaggacuc

SEQ ID NO: 708951 - RNA, 18 nt, Human
gcagguccugggcucaaa

SEQ ID NO: 708952 - RNA, 19 nt, Human
gccacuggcagcaccucca

SEQ ID NO: 708953 - RNA, 28 nt, Human
gccaggaaagguugucaggggagucuga

SEQ ID NO: 708954 - RNA, 23 nt, Human
gccauaccgugcacacaucacaa

SEQ ID NO: 708955 - RNA, 20 nt, Human
gcccaagugagcaaauagaa

SEQ ID NO: 708956 - RNA, 18 nt, Human
gcccuggagggaggugug

SEQ ID NO: 708957 - RNA, 18 nt, Human
ggaaaagagaggccccau

SEQ ID NO: 708958 - RNA, 18 nt, Human
ggagaaaggcacuuugcu

SEQ ID NO: 708959 - RNA, 21 nt, Human
gggcuggggcuggucuggugc

SEQ ID NO: 708960 - RNA, 20 nt, Human
ggggaaaggagcaaugggga

SEQ ID NO: 708961 - RNA, 22 nt, Human
gggguuccugaaaugucugugu

SEQ ID NO: 708962 - RNA, 18 nt, Human
gggugagagcaaguccau

SEQ ID NO: 708963 - RNA, 21 nt, Human
ggugcaggcagauggcaaguc

SEQ ID NO: 708964 - RNA, 19 nt, Human
gguugccucugcacuccca

SEQ ID NO: 708965 - RNA, 21 nt, Human
gguuuuugcuauuuccccccu

SEQ ID NO: 708966 - RNA, 22 nt, Human
guaguaaacaaucgcugaacac

SEQ ID NO: 708967 - RNA, 23 nt, Human
guggcaguucagggacagaggcu

SEQ ID NO: 708968 - RNA, 23 nt, Human
gugugucuguaucaagacacaca

SEQ ID NO: 708969 - RNA, 21 nt, Human
guguugccuucugugagacug

SEQ ID NO: 708970 - RNA, 23 nt, Human
guuucaucccuggggugagagca

SEQ ID NO: 708971 - RNA, 22 nt, Human
uaaacaaucgcugaacacccgc

SEQ ID NO: 708972 - RNA, 20 nt, Human
uaaacuucuagagcauaacu

SEQ ID NO: 708973 - RNA, 18 nt, Human
uaaauuaugauucacagg

SEQ ID NO: 708974 - RNA, 19 nt, Human
uaacuaaacaggcagugau

SEQ ID NO: 708975 - RNA, 22 nt, Human
uacacacacuuacacacacaca

SEQ ID NO: 708976 - RNA, 18 nt, Human
uacauguccucacauacc

SEQ ID NO: 708977 - RNA, 21 nt, Human
uaccauggcgaaggcggugac

SEQ ID NO: 708978 - RNA, 22 nt, Human
uaccucaaggcacaugugucac

SEQ ID NO: 708979 - RNA, 18 nt, Human
uagaaaacccuggugcaa

SEQ ID NO: 708980 - RNA, 22 nt, Human
uagaauauaucuuuccuuuaau

SEQ ID NO: 708981 - RNA, 25 nt, Human
uagaguuagaaauaggaaagcaugc

SEQ ID NO: 708982 - RNA, 21 nt, Human
uaggaagccucuucuuuagga

SEQ ID NO: 708983 - RNA, 23 nt, Human
uauuccucuuccagcuuuggguu

SEQ ID NO: 708984 - RNA, 22 nt, Human
uauuucagggguuccugaaaug

SEQ ID NO: 708985 - RNA, 24 nt, Human
uauuuccccccuuuuccuuuaaga

SEQ ID NO: 708986 - RNA, 25 nt, Human
uauuuuucuuggaaagguggcugcc

SEQ ID NO: 708987 - RNA, 19 nt, Human
uccaaaauggggaacaauc

SEQ ID NO: 708988 - RNA, 20 nt, Human
uccacacacagcagcaaaau

SEQ ID NO: 708989 - RNA, 19 nt, Human
uccaguguugccuucugug

SEQ ID NO: 708990 - RNA, 23 nt, Human
uccauucuagggggacugagagg

SEQ ID NO: 708991 - RNA, 23 nt, Human
ucccggaucccggugauccgccc

SEQ ID NO: 708992 - RNA, 21 nt, Human
ucccugcuccccccaagaaaa

SEQ ID NO: 708993 - RNA, 23 nt, Human
uccuagaucauaucugacacuac

SEQ ID NO: 708994 - RNA, 18 nt, Human
ucgcugaacacccgcccu

SEQ ID NO: 708995 - RNA, 19 nt, Human
ucuccccagccauccauuc

SEQ ID NO: 708996 - RNA, 21 nt, Human
ucuccugguugcugccccguc

SEQ ID NO: 708997 - RNA, 25 nt, Human
ucuccugguugcugccccgucugac

SEQ ID NO: 708998 - RNA, 26 nt, Human
ucucggccagaacugcuuuccuggag

SEQ ID NO: 708999 - RNA, 25 nt, Human
ucuucuucuucuucuucuucuuguu

SEQ ID NO: 709000 - RNA, 25 nt, Human
ucuucuucuucuuguucuucucugg

SEQ ID NO: 709001 - RNA, 21 nt, Human
ucuucuuguucuucucuggcu

SEQ ID NO: 709002 - RNA, 23 nt, Human
ucuuguucuucucuggcugcugg

SEQ ID NO: 709003 - RNA, 18 nt, Human
ugaacuuacccuccccag

SEQ ID NO: 709004 - RNA, 20 nt, Human
ugacacuacgucucagcugu

SEQ ID NO: 709005 - RNA, 23 nt, Human
ugagaagugaguuucuggguguu

SEQ ID NO: 709006 - RNA, 19 nt, Human
ugagagggcaaaugugacu

SEQ ID NO: 709007 - RNA, 21 nt, Human
ugagagguggagacaggaagg

SEQ ID NO: 709008 - RNA, 21 nt, Human
ugagggagucuggucuccaag

SEQ ID NO: 709009 - RNA, 21 nt, Human
ugaguaccaagcagcccaagu

SEQ ID NO: 709010 - RNA, 22 nt, Human
ugaugagugggaggccugagug

SEQ ID NO: 709011 - RNA, 19 nt, Human
ugcaagcaagggugagaca

SEQ ID NO: 709012 - RNA, 21 nt, Human
ugcacacaucacaaccuuaug

SEQ ID NO: 709013 - RNA, 19 nt, Human
ugccccgucugacagcgcc

SEQ ID NO: 709014 - RNA, 19 nt, Human
ugcguugucaggggaucuc

SEQ ID NO: 709015 - RNA, 21 nt, Human
ugcugagugguuugcgggggu

SEQ ID NO: 709016 - RNA, 20 nt, Human
uggaaaguucuguaaguguu

SEQ ID NO: 709017 - RNA, 23 nt, Human
uggaaggagugaaaauggagagg

SEQ ID NO: 709018 - RNA, 24 nt, Human
uggaaggagugaaaauggagagga

SEQ ID NO: 709019 - RNA, 18 nt, Human
uggagacaggaagggcag

SEQ ID NO: 709020 - RNA, 20 nt, Human
uggagaggaauaaagggcug

SEQ ID NO: 709021 - RNA, 21 nt, Human
uggagaggaauaaagggcugg

SEQ ID NO: 709022 - RNA, 20 nt, Human
uggagggagguguggguucc

SEQ ID NO: 709023 - RNA, 18 nt, Human
uggaucacauuaaacacc

SEQ ID NO: 709024 - RNA, 22 nt, Human
uggcaacagaugaagaggagug

SEQ ID NO: 709025 - RNA, 22 nt, Human
uggcagcaccuccacacacagc

SEQ ID NO: 709026 - RNA, 19 nt, Human
uggggaaaagagaggcccc

SEQ ID NO: 709027 - RNA, 22 nt, Human
uggggaaaagagaggccccauu

SEQ ID NO: 709028 - RNA, 22 nt, Human
uggucccggaucccggugaucc

SEQ ID NO: 709029 - RNA, 24 nt, Human
uggugucccagauagagcugaaga

SEQ ID NO: 709030 - RNA, 21 nt, Human
uggugugucuguaucaagaca

SEQ ID NO: 709031 - RNA, 23 nt, Human
ugguguuguagaugccuucuugg

SEQ ID NO: 709032 - RNA, 23 nt, Human
ugguguuuggucaagaugguguc

SEQ ID NO: 709033 - RNA, 18 nt, Human
ugguugccucugcacucc

SEQ ID NO: 709034 - RNA, 20 nt, Human
uguccuggugagcaguggca

SEQ ID NO: 709035 - RNA, 19 nt, Human
ugugaugaucaccaagagu

SEQ ID NO: 709036 - RNA, 20 nt, Human
uguggguuccuuuuugguug

SEQ ID NO: 709037 - RNA, 21 nt, Human
uguguguuugaauuuuacaga

SEQ ID NO: 709038 - RNA, 23 nt, Human
uuaacucugcuucccaaccucac

SEQ ID NO: 709039 - RNA, 22 nt, Human
uucaaaggagcaagcaguugcc

SEQ ID NO: 709040 - RNA, 25 nt, Human
uucaaaggagcaagcaguugccaug

SEQ ID NO: 709041 - RNA, 21 nt, Human
uucagauccugaucaccgccc

SEQ ID NO: 709042 - RNA, 19 nt, Human
uucauccuucuucuucuuc

SEQ ID NO: 709043 - RNA, 23 nt, Human
uucuugcuuugcguugucagggg

SEQ ID NO: 709044 - RNA, 18 nt, Human
uugagucucaguuucuuc

SEQ ID NO: 709045 - RNA, 21 nt, Human
uugcaagcaagggugagacag

SEQ ID NO: 709046 - RNA, 24 nt, Human
uuggacccuuuauauuuuucuugg

SEQ ID NO: 709047 - RNA, 20 nt, Human
uuggguuugggcaugccacu

SEQ ID NO: 709048 - RNA, 18 nt, Human
uugucaggggagucugug

SEQ ID NO: 709049 - RNA, 24 nt, Human
uuucuggguguuucaucccugggg

SEQ ID NO: 709050 - RNA, 18 nt, Human
uuucuucaucuccaaaau

SEQ ID NO: 709051 - RNA, 19 nt, Human
uuuuucuuuuguguguguu

SEQ ID NO: 709052 - RNA, 21 nt, Human
aaacuacugugccagcaagcc

SEQ ID NO: 709053 - RNA, 24 nt, Human
aaagugcugggauuacaggcguga

SEQ ID NO: 709054 - RNA, 23 nt, Human
aaauaacccuuuauaaacgacua

SEQ ID NO: 709055 - RNA, 24 nt, Human
aaauuuuuguauuuuuaguagaga

SEQ ID NO: 709056 - RNA, 21 nt, Human
aacaggaagcuacacccuuga

SEQ ID NO: 709057 - RNA, 22 nt, Human
aacgacuaaugaaccaacuaca

SEQ ID NO: 709058 - RNA, 25 nt, Human
aagcccacgggccgagaggcccuga

SEQ ID NO: 709059 - RNA, 21 nt, Human
aaguaucucuucaaauuauac

SEQ ID NO: 709060 - RNA, 19 nt, Human
aagugcugggauuacaggc

SEQ ID NO: 709061 - RNA, 19 nt, Human
aagugcugggauuacaggc

SEQ ID NO: 709062 - RNA, 26 nt, Human
aagugcugggauuacaggcgugagcc

SEQ ID NO: 709063 - RNA, 23 nt, Human
aauuuuuguauuuuuaguagaga

SEQ ID NO: 709064 - RNA, 25 nt, Human
accaacuacagacaguauaccaaug

SEQ ID NO: 709065 - RNA, 18 nt, Human
accauguuggccaggccg

SEQ ID NO: 709066 - RNA, 18 nt, Human
acgggguuucaccauguu

SEQ ID NO: 709067 - RNA, 23 nt, Human
acgggguuucaccauguuggcca

SEQ ID NO: 709068 - RNA, 24 nt, Human
acgggguuucaccauguuggccag

SEQ ID NO: 709069 - RNA, 19 nt, Human
acuacagacaguauaccaa

SEQ ID NO: 709070 - RNA, 23 nt, Human
aggcgugagccacugugucuggc

SEQ ID NO: 709071 - RNA, 18 nt, Human
aguagcugggauuacagg

SEQ ID NO: 709072 - RNA, 18 nt, Human
aguggcaugaucuuggcu

SEQ ID NO: 709073 - RNA, 24 nt, Human
aguggcaugaucuuggcucacugc

SEQ ID NO: 709074 - RNA, 26 nt, Human
auuauaccuuuaacaaaacaagcauu

SEQ ID NO: 709075 - RNA, 24 nt, Human
auuuuuguauuuuuaguagagacg

SEQ ID NO: 709076 - RNA, 22 nt, Human
caaaacaagcauuaucaagaga

SEQ ID NO: 709077 - RNA, 24 nt, Human
caaagugcugggauuacaggcgug

SEQ ID NO: 709078 - RNA, 24 nt, Human
caaauuuuuguauuuuuaguagag

SEQ ID NO: 709079 - RNA, 21 nt, Human
caaccaguuaacccuuugaga

SEQ ID NO: 709080 - RNA, 20 nt, Human
caagcgauccuccugccuca

SEQ ID NO: 709081 - RNA, 22 nt, Human
caagcgauccuccugccucagc

SEQ ID NO: 709082 - RNA, 27 nt, Human
caagcgauccuccugccucagcccccc

SEQ ID NO: 709083 - RNA, 18 nt, Human
caccauguuggccaggcc

SEQ ID NO: 709084 - RNA, 21 nt, Human
caccauguuggccaggccggu

SEQ ID NO: 709085 - RNA, 24 nt, Human
caccauguuggccaggccggucuc

SEQ ID NO: 709086 - RNA, 27 nt, Human
caccauguuggccaggccggucucaaa

SEQ ID NO: 709087 - RNA, 18 nt, Human
cacugcaaccucugccuc

SEQ ID NO: 709088 - RNA, 19 nt, Human
cagccccccuaguagcugg

SEQ ID NO: 709089 - RNA, 21 nt, Human
cagguucaagcgauccuccug

SEQ ID NO: 709090 - RNA, 24 nt, Human
cauacagcccccauuaugaaacac

SEQ ID NO: 709091 - RNA, 24 nt, Human
cauguuggccaggccggucucaaa

SEQ ID NO: 709092 - RNA, 22 nt, Human
ccaaagugcugggauuacaggc

SEQ ID NO: 709093 - RNA, 22 nt, Human
ccaaagugcugggauuacaggc

SEQ ID NO: 709094 - RNA, 24 nt, Human
ccaaagugcugggauuacaggcgu

SEQ ID NO: 709095 - RNA, 20 nt, Human
ccaccaugcccagcaaauuu

SEQ ID NO: 709096 - RNA, 22 nt, Human
ccagccucugaucuccuaaucu

SEQ ID NO: 709097 - RNA, 19 nt, Human
cccacgggccgagaggccc

SEQ ID NO: 709098 - RNA, 23 nt, Human
cccacgggccgagaggcccugaa

SEQ ID NO: 709099 - RNA, 24 nt, Human
cccagugccgaaacuucgccccuc

SEQ ID NO: 709100 - RNA, 23 nt, Human
ccccagugccgaaacuucgcccc

SEQ ID NO: 709101 - RNA, 24 nt, Human
ccccuaguagcugggauuacaggc

SEQ ID NO: 709102 - RNA, 23 nt, Human
cccuaguagcugggauuacaggc

SEQ ID NO: 709103 - RNA, 22 nt, Human
cccuccgcaggguccggcaccu

SEQ ID NO: 709104 - RNA, 23 nt, Human
ccgccgaccuggaaugcugagga

SEQ ID NO: 709105 - RNA, 19 nt, Human
ccggucccagcagagacgc

SEQ ID NO: 709106 - RNA, 22 nt, Human
ccggucucaaacuccugaccuu

SEQ ID NO: 709107 - RNA, 23 nt, Human
ccuaguagcugggauuacaggca

SEQ ID NO: 709108 - RNA, 25 nt, Human
ccuccugccucagccccccuaguag

SEQ ID NO: 709109 - RNA, 24 nt, Human
ccucucagguucaagcgauccucc

SEQ ID NO: 709110 - RNA, 24 nt, Human
cgaccuggaaugcugaggaacuga

SEQ ID NO: 709111 - RNA, 18 nt, Human
cuacagacaguauaccaa

SEQ ID NO: 709112 - RNA, 22 nt, Human
cuaguagcugggauuacaggca

SEQ ID NO: 709113 - RNA, 24 nt, Human
cucacugcaaccucugccucucag

SEQ ID NO: 709114 - RNA, 24 nt, Human
cucagccccccuaguagcugggau

SEQ ID NO: 709115 - RNA, 20 nt, Human
cucagguucaagcgauccuc

SEQ ID NO: 709116 - RNA, 24 nt, Human
cuccugaccuugugaucugcccgc

SEQ ID NO: 709117 - RNA, 25 nt, Human
cuccugccucagccccccuaguagc

SEQ ID NO: 709118 - RNA, 21 nt, Human
cucguucuguugcucagacug

SEQ ID NO: 709119 - RNA, 24 nt, Human
cugcaaccucugccucucagguuc

SEQ ID NO: 709120 - RNA, 24 nt, Human
cuggaguaaaguggcaugaucuug

SEQ ID NO: 709121 - RNA, 21 nt, Human
gaaugcugaggaacugaaugg

SEQ ID NO: 709122 - RNA, 22 nt, Human
gaccuugugaucugcccgccuc

SEQ ID NO: 709123 - RNA, 23 nt, Human
gaccuugugaucugcccgccucc

SEQ ID NO: 709124 - RNA, 24 nt, Human
gagacgggguuucaccauguuggc

SEQ ID NO: 709125 - RNA, 18 nt, Human
gauuacaggcacgcgcca

SEQ ID NO: 709126 - RNA, 18 nt, Human
gauuacaggcgugagcca

SEQ ID NO: 709127 - RNA, 21 nt, Human
gauuacaggcgugagccacug

SEQ ID NO: 709128 - RNA, 24 nt, Human
gauuacaggcgugagccacugugu

SEQ ID NO: 709129 - RNA, 25 nt, Human
gcaagccauauuauuaauauauaau

SEQ ID NO: 709130 - RNA, 19 nt, Human
gccacucaccaccuccagc

SEQ ID NO: 709131 - RNA, 21 nt, Human
gccacugugucuggccuuuga

SEQ ID NO: 709132 - RNA, 21 nt, Human
gcucacugcaaccucugccuc

SEQ ID NO: 709133 - RNA, 21 nt, Human
ggaaagcguccgcacgcccuc

SEQ ID NO: 709134 - RNA, 21 nt, Human
ggacauucauuugauuuccag

SEQ ID NO: 709135 - RNA, 20 nt, Human
ggacuuuuuugaaauaucug

SEQ ID NO: 709136 - RNA, 24 nt, Human
ggccggucucaaacuccugaccuu

SEQ ID NO: 709137 - RNA, 22 nt, Human
ggggacccccucgacacagucc

SEQ ID NO: 709138 - RNA, 23 nt, Human
gggguuucaccauguuggccagg

SEQ ID NO: 709139 - RNA, 22 nt, Human
ggguuucaccauguuggccagg

SEQ ID NO: 709140 - RNA, 23 nt, Human
guagagacgggguuucaccaugu

SEQ ID NO: 709141 - RNA, 18 nt, Human
gugaucugcccgccuccc

SEQ ID NO: 709142 - RNA, 21 nt, Human
guucuuuuucuuucaugggug

SEQ ID NO: 709143 - RNA, 26 nt, Human
uaacaaaacaagcauuaucaagagaa

SEQ ID NO: 709144 - RNA, 25 nt, Human
uaacccuuugagaaaagaauuuuug

SEQ ID NO: 709145 - RNA, 18 nt, Human
uaagacccuaagcucuuc

SEQ ID NO: 709146 - RNA, 24 nt, Human
uaagaucccacaaguagaauauua

SEQ ID NO: 709147 - RNA, 24 nt, Human
uacaggcacgcgccaccaugccca

SEQ ID NO: 709148 - RNA, 23 nt, Human
uacaggcgugagccacugugucu

SEQ ID NO: 709149 - RNA, 22 nt, Human
uacugugccagcaagccauauu

SEQ ID NO: 709150 - RNA, 22 nt, Human
uagagacgggguuucaccaugu

SEQ ID NO: 709151 - RNA, 24 nt, Human
uaguagagacgggguuucaccaug

SEQ ID NO: 709152 - RNA, 26 nt, Human
uaguagagacgggguuucaccauguu

SEQ ID NO: 709153 - RNA, 27 nt, Human
uaguagcugggauuacaggcacgcgcc

SEQ ID NO: 709154 - RNA, 21 nt, Human
uaucaagagaagguccagccu

SEQ ID NO: 709155 - RNA, 22 nt, Human
uaucaagagaagguccagccuc

SEQ ID NO: 709156 - RNA, 27 nt, Human
uaugaaacacagauaacaggguaaacc

SEQ ID NO: 709157 - RNA, 22 nt, Human
ucaccauaaacaucccagcugu

SEQ ID NO: 709158 - RNA, 19 nt, Human
ucacugcaaccucugccuc

SEQ ID NO: 709159 - RNA, 24 nt, Human
ucacugcaaccucugccucucagg

SEQ ID NO: 709160 - RNA, 21 nt, Human
ucauacagcccccauuaugaa

SEQ ID NO: 709161 - RNA, 24 nt, Human
ucccaaagugcugggauuacaggc

SEQ ID NO: 709162 - RNA, 21 nt, Human
ucccagcugucugaggagaga

SEQ ID NO: 709163 - RNA, 21 nt, Human
ucucagguucaagcgauccuc

SEQ ID NO: 709164 - RNA, 24 nt, Human
ucucagguucaagcgauccuccug

SEQ ID NO: 709165 - RNA, 23 nt, Human
ucucguucuguugcucagacugg

SEQ ID NO: 709166 - RNA, 24 nt, Human
ucucguucuguugcucagacugga

SEQ ID NO: 709167 - RNA, 23 nt, Human
ucugcccgccucccaaagugcug

SEQ ID NO: 709168 - RNA, 21 nt, Human
ucugcuaaacucuuaaugcca

SEQ ID NO: 709169 - RNA, 18 nt, Human
ucugugcugauuucucuu

SEQ ID NO: 709170 - RNA, 24 nt, Human
ucuuucauggguggucauaaaagu

SEQ ID NO: 709171 - RNA, 18 nt, Human
ugaacauacuauucaaaa

SEQ ID NO: 709172 - RNA, 24 nt, Human
ugcccagcaaauuuuuguauuuuu

SEQ ID NO: 709173 - RNA, 21 nt, Human
ugccucagccccccuaguagc

SEQ ID NO: 709174 - RNA, 24 nt, Human
ugccucagccccccuaguagcugg

SEQ ID NO: 709175 - RNA, 26 nt, Human
ugccucagccccccuaguagcuggga

SEQ ID NO: 709176 - RNA, 24 nt, Human
ugcucagacuggaguaaaguggca

SEQ ID NO: 709177 - RNA, 24 nt, Human
ugcugggauuacaggcgugagcca

SEQ ID NO: 709178 - RNA, 20 nt, Human
uggaaaauaagggucuuuaa

SEQ ID NO: 709179 - RNA, 19 nt, Human
uggagcuaagaccacccgc

SEQ ID NO: 709180 - RNA, 24 nt, Human
uggaguaaaguggcaugaucuugg

SEQ ID NO: 709181 - RNA, 18 nt, Human
uggcaaccaguuaacccu

SEQ ID NO: 709182 - RNA, 19 nt, Human
uggcaugaucuuggcucac

SEQ ID NO: 709183 - RNA, 21 nt, Human
uggcaugaucuuggcucacug

SEQ ID NO: 709184 - RNA, 24 nt, Human
uggccaggccggucucaaacuccu

SEQ ID NO: 709185 - RNA, 21 nt, Human
ugggauuacaggcacgcgcca

SEQ ID NO: 709186 - RNA, 22 nt, Human
ugggauuacaggcacgcgccac

SEQ ID NO: 709187 - RNA, 24 nt, Human
ugggauuacaggcacgcgccacca

SEQ ID NO: 709188 - RNA, 18 nt, Human
ugggauuacaggcgugag

SEQ ID NO: 709189 - RNA, 21 nt, Human
ugggauuacaggcgugagcca

SEQ ID NO: 709190 - RNA, 22 nt, Human
ugggauuacaggcgugagccac

SEQ ID NO: 709191 - RNA, 22 nt, Human
ugggauuacaggcgugagccac

SEQ ID NO: 709192 - RNA, 22 nt, Human
ugggauuacaggcgugagccac

SEQ ID NO: 709193 - RNA, 23 nt, Human
ugggauuacaggcgugagccacu

SEQ ID NO: 709194 - RNA, 24 nt, Human
ugggauuacaggcgugagccacug

SEQ ID NO: 709195 - RNA, 21 nt, Human
ugggggacuggagcuaagacc

SEQ ID NO: 709196 - RNA, 18 nt, Human
uguacaggccauuucacc

SEQ ID NO: 709197 - RNA, 21 nt, Human
uguauuuuuaguagagacggg

SEQ ID NO: 709198 - RNA, 20 nt, Human
ugucugaggagagagaaggc

SEQ ID NO: 709199 - RNA, 20 nt, Human
uuaaacacuuuaaagauaaa

SEQ ID NO: 709200 - RNA, 22 nt, Human
uuaaugccaaccgacucgggga

SEQ ID NO: 709201 - RNA, 24 nt, Human
uuacuuauuuauuuauuuauuuug

SEQ ID NO: 709202 - RNA, 18 nt, Human
uuaguagagacgggguuu

SEQ ID NO: 709203 - RNA, 22 nt, Human
uuaguagagacgggguuucacc

SEQ ID NO: 709204 - RNA, 24 nt, Human
uuaguagagacgggguuucaccau

SEQ ID NO: 709205 - RNA, 25 nt, Human
uuauuuauuuauuuacuuauuuauu

SEQ ID NO: 709206 - RNA, 19 nt, Human
uuauuuauuuauuuauuua

SEQ ID NO: 709207 - RNA, 20 nt, Human
uucaaaauggcaaccaguua

SEQ ID NO: 709208 - RNA, 21 nt, Human
uucaagcgauccuccugccuc

SEQ ID NO: 709209 - RNA, 24 nt, Human
uucaagcgauccuccugccucagc

SEQ ID NO: 709210 - RNA, 21 nt, Human
uucauuugauuuccagccauu

SEQ ID NO: 709211 - RNA, 23 nt, Human
uuguauuuuuaguagagacgggg

SEQ ID NO: 709212 - RNA, 22 nt, Human
uuuacuuauuuauuuauuuauu

SEQ ID NO: 709213 - RNA, 20 nt, Human
uuuaguagagacgggguuuu

SEQ ID NO: 709214 - RNA, 22 nt, Human
uuuauuuacuuauuuauuuauu

SEQ ID NO: 709215 - RNA, 22 nt, Human
uuuauuuauuuauuuacuuauu

SEQ ID NO: 709216 - RNA, 24 nt, Human
uuucaccauguuggccaggccggu

SEQ ID NO: 709217 - RNA, 24 nt, Human
uuuuuaguagagacgggguuucac

SEQ ID NO: 709218 - RNA, 23 nt, Human
acauaguuaccuuuaacucagug

SEQ ID NO: 709219 - RNA, 19 nt, Human
acuucugcugcugcuaugc

SEQ ID NO: 709220 - RNA, 21 nt, Human
agaaagaacuucuuuuaaaga

SEQ ID NO: 709221 - RNA, 23 nt, Human
aggcaagaggaugcaucuuucuu

SEQ ID NO: 709222 - RNA, 18 nt, Human
aggcagcagggugcccag

SEQ ID NO: 709223 - RNA, 21 nt, Human
augcuuucuaugaaugauguu

SEQ ID NO: 709224 - RNA, 19 nt, Human
caaaacagugccccaccug

SEQ ID NO: 709225 - RNA, 22 nt, Human
caacucugcaugaaacaccaac

SEQ ID NO: 709226 - RNA, 24 nt, Human
caaucaccagccuugaaaggcagc

SEQ ID NO: 709227 - RNA, 21 nt, Human
caccaaaacagugccccaccu

SEQ ID NO: 709228 - RNA, 23 nt, Human
cauacaacucugcaugaaacacc

SEQ ID NO: 709229 - RNA, 22 nt, Human
cucagugguuaucuaauagcuc

SEQ ID NO: 709230 - RNA, 18 nt, Human
cuucugcugcugcuaugc

SEQ ID NO: 709231 - RNA, 20 nt, Human
gcagggugcccaggugaagc

SEQ ID NO: 709232 - RNA, 23 nt, Human
ggcaaaaugaagcuauuugcuga

SEQ ID NO: 709233 - RNA, 19 nt, Human
guggucaauaauuuaaaau

SEQ ID NO: 709234 - RNA, 22 nt, Human
uacaccucaaaguauauccuuu

SEQ ID NO: 709235 - RNA, 20 nt, Human
uaccuuuaacucagugguua

SEQ ID NO: 709236 - RNA, 24 nt, Human
uaguuuuuaacuugaucuaaauua

SEQ ID NO: 709237 - RNA, 20 nt, Human
uauccgagcaaucaccagcc

SEQ ID NO: 709238 - RNA, 19 nt, Human
uauguauaaacauguaugu

SEQ ID NO: 709239 - RNA, 21 nt, Human
uauguauaaacauguauguaa

SEQ ID NO: 709240 - RNA, 19 nt, Human
uccgagcaaucaccagccu

SEQ ID NO: 709241 - RNA, 24 nt, Human
uccgagcaaucaccagccuugaaa

SEQ ID NO: 709242 - RNA, 22 nt, Human
ucuuucuuccugguguacaagc

SEQ ID NO: 709243 - RNA, 22 nt, Human
ugaaacaccaacaacugggaau

SEQ ID NO: 709244 - RNA, 22 nt, Human
ugaagcuggccuguuuucuaaa

SEQ ID NO: 709245 - RNA, 18 nt, Human
ugcccaggugaagcuggc

SEQ ID NO: 709246 - RNA, 21 nt, Human
uggaugcacacuuugugugua

SEQ ID NO: 709247 - RNA, 22 nt, Human
uguaggcuguauauguaucgga

SEQ ID NO: 709248 - RNA, 20 nt, Human
uguaucggauuucuucaaag

SEQ ID NO: 709249 - RNA, 22 nt, Human
uuaaaaaaacuccaagccuucc

SEQ ID NO: 709250 - RNA, 22 nt, Human
uuauaugcuuaaucuguacacc

SEQ ID NO: 709251 - RNA, 19 nt, Human
aagcagccgaggggccagc

SEQ ID NO: 709252 - RNA, 19 nt, Human
aagcagccgaggggccagg

SEQ ID NO: 709253 - RNA, 21 nt, Human
aagucccccccgagccagaga

SEQ ID NO: 709254 - RNA, 23 nt, Human
aagucccccccgagccagagaag

SEQ ID NO: 709255 - RNA, 18 nt, Human
aauuuuguuuccccguca

SEQ ID NO: 709256 - RNA, 22 nt, Human
accccagagggggcugagaagc

SEQ ID NO: 709257 - RNA, 24 nt, Human
agaaguccuggagaaugggcaucc

SEQ ID NO: 709258 - RNA, 22 nt, Human
agagaauaauuuuguuuccccg

SEQ ID NO: 709259 - RNA, 22 nt, Human
agaugcagccccccaaacacag

SEQ ID NO: 709260 - RNA, 23 nt, Human
agccagagaagcagccgaggggc

SEQ ID NO: 709261 - RNA, 20 nt, Human
agcggggggacgacaaccag

SEQ ID NO: 709262 - RNA, 21 nt, Human
agggggcugagaagcgggggg

SEQ ID NO: 709263 - RNA, 22 nt, Human
aguugggccucucuggggcugu

SEQ ID NO: 709264 - RNA, 18 nt, Human
auacaguuuguugcuugu

SEQ ID NO: 709265 - RNA, 27 nt, Human
augaaugucauuuucugccccugucgg

SEQ ID NO: 709266 - RNA, 23 nt, Human
caagaauaaaacccaggcugcag

SEQ ID NO: 709267 - RNA, 24 nt, Human
cacagcacuccauggaugaggacu

SEQ ID NO: 709268 - RNA, 19 nt, Human
cagcagaugcagcccccca

SEQ ID NO: 709269 - RNA, 22 nt, Human
cagcagaugcagccccccaaac

SEQ ID NO: 709270 - RNA, 25 nt, Human
ccaaacacagcacuccauggaugag

SEQ ID NO: 709271 - RNA, 21 nt, Human
ccagguccaguucaggggucc

SEQ ID NO: 709272 - RNA, 23 nt, Human
ccaguucagggguccggaucuga

SEQ ID NO: 709273 - RNA, 20 nt, Human
cccccaaacacagcacucca

SEQ ID NO: 709274 - RNA, 22 nt, Human
ccccccgagccagagaagcagc

SEQ ID NO: 709275 - RNA, 22 nt, Human
cggagaggagagaggaacccca

SEQ ID NO: 709276 - RNA, 26 nt, Human
cucaaauguccuuucccucucagaga

SEQ ID NO: 709277 - RNA, 27 nt, Human
cucaaauguccuuucccucucagagaa

SEQ ID NO: 709278 - RNA, 24 nt, Human
cucacccucaccuuccugcaaacu

SEQ ID NO: 709279 - RNA, 19 nt, Human
cugcaguacuccugggacc

SEQ ID NO: 709280 - RNA, 22 nt, Human
cuguuccacacaaaaaacaaag

SEQ ID NO: 709281 - RNA, 19 nt, Human
gagaaguccuggagaaugg

SEQ ID NO: 709282 - RNA, 22 nt, Human
gcaaagagugggcggagaggag

SEQ ID NO: 709283 - RNA, 22 nt, Human
gccuggguccugagaugugcug

SEQ ID NO: 709284 - RNA, 24 nt, Human
gggcagugagcaaagagugggcga

SEQ ID NO: 709285 - RNA, 22 nt, Human
uagcacugagaaaggggccaga

SEQ ID NO: 709286 - RNA, 18 nt, Human
ucaaaagaugaaugucau

SEQ ID NO: 709287 - RNA, 20 nt, Human
uccacacaaaaaacaaagaa

SEQ ID NO: 709288 - RNA, 21 nt, Human
ucccggucagggccaggccaa

SEQ ID NO: 709289 - RNA, 18 nt, Human
ucccugcaguacuccugg

SEQ ID NO: 709290 - RNA, 19 nt, Human
ucccugcaguacuccuggg

SEQ ID NO: 709291 - RNA, 18 nt, Human
ucucaucaauuuugcuug

SEQ ID NO: 709292 - RNA, 25 nt, Human
uggaauagaacaauccauuugaaua

SEQ ID NO: 709293 - RNA, 18 nt, Human
uggagaaguccuggagaa

SEQ ID NO: 709294 - RNA, 21 nt, Human
uggaugaggacucaaaagaug

SEQ ID NO: 709295 - RNA, 19 nt, Human
ugggcggagaggagagagg

SEQ ID NO: 709296 - RNA, 21 nt, Human
uggggccagucuauugccugg

SEQ ID NO: 709297 - RNA, 21 nt, Human
uggucaugccugagaccagaa

SEQ ID NO: 709298 - RNA, 30 nt, Human
uguuucccucaaauguccuuucccucucaa

SEQ ID NO: 709299 - RNA, 18 nt, Human
uuucugccccugugucuc

SEQ ID NO: 709300 - RNA, 22 nt, Human
aaugggcuugacacuuucaaau

SEQ ID NO: 709301 - RNA, 21 nt, Human
acagaauagaaggugagugcc

SEQ ID NO: 709302 - RNA, 24 nt, Human
caagggcuccugccugccuggaca

SEQ ID NO: 709303 - RNA, 20 nt, Human
cacggaggacacgagacugc

SEQ ID NO: 709304 - RNA, 22 nt, Human
ccucaagggcuccugccugccu

SEQ ID NO: 709305 - RNA, 21 nt, Human
uaagaaaaucuaaaucuggca

SEQ ID NO: 709306 - RNA, 23 nt, Human
uagaaaaaauauuagaaucaaaa

SEQ ID NO: 709307 - RNA, 25 nt, Human
uauaaaagaaagcugcaguuuuaaa

SEQ ID NO: 709308 - RNA, 18 nt, Human
uauaaauaauagaaaaaa

SEQ ID NO: 709309 - RNA, 23 nt, Human
uaucugaaugggcuugacacuuu

SEQ ID NO: 709310 - RNA, 20 nt, Human
uccacagcaaagcgcugccc

SEQ ID NO: 709311 - RNA, 19 nt, Human
ucccagggcaccggcucgc

SEQ ID NO: 709312 - RNA, 19 nt, Human
ugagugccaggccccugag

SEQ ID NO: 709313 - RNA, 20 nt, Human
uucaaguuaacagaggcuug

SEQ ID NO: 709314 - RNA, 19 nt, Human
uuccacagcaaagcgcugc

SEQ ID NO: 709315 - RNA, 22 nt, Human
uuccucaagggcuccugccugc

SEQ ID NO: 709316 - RNA, 24 nt, Human
aaaaaagaagggguacugacaaag

SEQ ID NO: 709317 - RNA, 19 nt, Human
aaaaagacaccccuccccc

SEQ ID NO: 709318 - RNA, 20 nt, Human
aaaacaaaacagaacacacc

SEQ ID NO: 709319 - RNA, 20 nt, Human
aaaacagaacacaccacaga

SEQ ID NO: 709320 - RNA, 19 nt, Human
aaaagagaccccagaagca

SEQ ID NO: 709321 - RNA, 19 nt, Human
aaaagcaaccacggguagc

SEQ ID NO: 709322 - RNA, 18 nt, Human
aaacaaauggggugaaac

SEQ ID NO: 709323 - RNA, 22 nt, Human
aaacacugucucacuuccuaag

SEQ ID NO: 709324 - RNA, 21 nt, Human
aaacgacaauuccaaagaaca

SEQ ID NO: 709325 - RNA, 24 nt, Human
aaacgcccccuccccccauugcaa

SEQ ID NO: 709326 - RNA, 24 nt, Human
aaagacaccccuccccccaacccu

SEQ ID NO: 709327 - RNA, 24 nt, Human
aaagcaaaaagacaccccuccccc

SEQ ID NO: 709328 - RNA, 20 nt, Human
aaagccagcacaggacagga

SEQ ID NO: 709329 - RNA, 19 nt, Human
aaaggaaccauaagcucgg

SEQ ID NO: 709330 - RNA, 22 nt, Human
aaaggccuuuucuaggcacaag

SEQ ID NO: 709331 - RNA, 19 nt, Human
aaagugcugggauaacagg

SEQ ID NO: 709332 - RNA, 23 nt, Human
aaagugcugggauaacaggcgua

SEQ ID NO: 709333 - RNA, 19 nt, Human
aaauguugggaaguuaugc

SEQ ID NO: 709334 - RNA, 20 nt, Human
aacaaguagcucuagagugc

SEQ ID NO: 709335 - RNA, 22 nt, Human
aaccaaaaacaaaacagaacac

SEQ ID NO: 709336 - RNA, 19 nt, Human
aaccaccccccccaaacau

SEQ ID NO: 709337 - RNA, 20 nt, Human
aaccaccccccccaaacauc

SEQ ID NO: 709338 - RNA, 24 nt, Human
aaccucaggugaucugcccaccuc

SEQ ID NO: 709339 - RNA, 23 nt, Human
aacgcaggcaccuggcacauccc

SEQ ID NO: 709340 - RNA, 18 nt, Human
aacuacccucuaaccacc

SEQ ID NO: 709341 - RNA, 25 nt, Human
aagaaacagagcaagcagaaaggug

SEQ ID NO: 709342 - RNA, 21 nt, Human
aagaacacucaacaagggcgg

SEQ ID NO: 709343 - RNA, 21 nt, Human
aagaauaagaggaagccaaga

SEQ ID NO: 709344 - RNA, 18 nt, Human
aagacaccccucccccca

SEQ ID NO: 709345 - RNA, 24 nt, Human
aagagcacuccauugucuugacuc

SEQ ID NO: 709346 - RNA, 22 nt, Human
aagagugccacagaaacccacc

SEQ ID NO: 709347 - RNA, 22 nt, Human
aagaugccagccccacucaugg

SEQ ID NO: 709348 - RNA, 25 nt, Human
aagcaaccacggguagcucuuccca

SEQ ID NO: 709349 - RNA, 20 nt, Human
aagcacacacccaccccaag

SEQ ID NO: 709350 - RNA, 21 nt, Human
aagcacacacccaccccaagc

SEQ ID NO: 709351 - RNA, 22 nt, Human
aagcagaaaggugccagccaug

SEQ ID NO: 709352 - RNA, 23 nt, Human
aagcagaaaggugccagccaugg

SEQ ID NO: 709353 - RNA, 20 nt, Human
aagcagagccuaagcugacc

SEQ ID NO: 709354 - RNA, 21 nt, Human
aagcauaaauacggcagguac

SEQ ID NO: 709355 - RNA, 19 nt, Human
aagcauacaaaggaaaccc

SEQ ID NO: 709356 - RNA, 24 nt, Human
aagcauacaaaggaaacccaagca

SEQ ID NO: 709357 - RNA, 24 nt, Human
aaggacuuggaggccuucucuuca

SEQ ID NO: 709358 - RNA, 21 nt, Human
aaggcaccaaaaggacuugga

SEQ ID NO: 709359 - RNA, 23 nt, Human
aaguacuggcagcacggggagcu

SEQ ID NO: 709360 - RNA, 22 nt, Human
aaucuccgcucacugcaaccuc

SEQ ID NO: 709361 - RNA, 19 nt, Human
aauguugggaaguuaugcc

SEQ ID NO: 709362 - RNA, 24 nt, Human
aauuuguuuuaaaaccagacagaa

SEQ ID NO: 709363 - RNA, 19 nt, Human
acaaaacagaacacaccac

SEQ ID NO: 709364 - RNA, 26 nt, Human
acaaaacagaacacaccacagacccu

SEQ ID NO: 709365 - RNA, 26 nt, Human
acaaaguacccuacaacuacccuucc

SEQ ID NO: 709366 - RNA, 24 nt, Human
acaaggcaccaaaaggacuuggag

SEQ ID NO: 709367 - RNA, 23 nt, Human
acaaguugaaaaccacacagcaa

SEQ ID NO: 709368 - RNA, 21 nt, Human
acaccaggccuagaaaaacca

SEQ ID NO: 709369 - RNA, 21 nt, Human
acaggacugcaaucuuagcuc

SEQ ID NO: 709370 - RNA, 24 nt, Human
acagggcucuccaccugcggcugu

SEQ ID NO: 709371 - RNA, 20 nt, Human
accacacagcaaaguaaggc

SEQ ID NO: 709372 - RNA, 23 nt, Human
accaccccccccaaacaucccug

SEQ ID NO: 709373 - RNA, 22 nt, Human
accauguuggccaggcuggucu

SEQ ID NO: 709374 - RNA, 18 nt, Human
acccagaaccauccccua

SEQ ID NO: 709375 - RNA, 21 nt, Human
acccaggaucacaagaaugac

SEQ ID NO: 709376 - RNA, 23 nt, Human
acggagaaggaguuugcuaugug

SEQ ID NO: 709377 - RNA, 24 nt, Human
acuacccucuaaccacccccccca

SEQ ID NO: 709378 - RNA, 18 nt, Human
acugggacugcuggagaa

SEQ ID NO: 709379 - RNA, 21 nt, Human
agaaaaaccaacuaggaaggc

SEQ ID NO: 709380 - RNA, 21 nt, Human
agaaaacagacacuuugucca

SEQ ID NO: 709381 - RNA, 26 nt, Human
agaaaagccagcacaggacaggagug

SEQ ID NO: 709382 - RNA, 27 nt, Human
agaaaagccagcacaggaccggacccc

SEQ ID NO: 709383 - RNA, 24 nt, Human
agaacacaccacagacccuaaucc

SEQ ID NO: 709384 - RNA, 19 nt, Human
agaaccauccccuaccuuc

SEQ ID NO: 709385 - RNA, 19 nt, Human
agaaggaucugugaacgug

SEQ ID NO: 709386 - RNA, 23 nt, Human
agacaccccuccccccaacccuu

SEQ ID NO: 709387 - RNA, 21 nt, Human
agacagaauuucgcucuuguu

SEQ ID NO: 709388 - RNA, 19 nt, Human
agacccuaauccugggcag

SEQ ID NO: 709389 - RNA, 20 nt, Human
agacuuccacagccacccag

SEQ ID NO: 709390 - RNA, 20 nt, Human
agagcaauggaaaccuacag

SEQ ID NO: 709391 - RNA, 20 nt, Human
agaguuuucgaagugggggc

SEQ ID NO: 709392 - RNA, 21 nt, Human
agaugaacagcgguccaagug

SEQ ID NO: 709393 - RNA, 22 nt, Human
agauguuuuuuuaaacagaggg

SEQ ID NO: 709394 - RNA, 20 nt, Human
agcacacacccaccccaagc

SEQ ID NO: 709395 - RNA, 22 nt, Human
agcacagauccuugguccacca

SEQ ID NO: 709396 - RNA, 19 nt, Human
agcaugccauacauaucug

SEQ ID NO: 709397 - RNA, 22 nt, Human
agccaugggcgccuggcguucc

SEQ ID NO: 709398 - RNA, 21 nt, Human
agccccaggcuucugaccggc

SEQ ID NO: 709399 - RNA, 24 nt, Human
agcgauucuccugccucagccucc

SEQ ID NO: 709400 - RNA, 18 nt, Human
agcucggaaggcagagug

SEQ ID NO: 709401 - RNA, 20 nt, Human
aggaaggaggaggcagggag

SEQ ID NO: 709402 - RNA, 21 nt, Human
aggaaggaggaggcagggagg

SEQ ID NO: 709403 - RNA, 22 nt, Human
aggaaggaggaggcagggaggg

SEQ ID NO: 709404 - RNA, 24 nt, Human
aggaaggaggaggcagggaggggg

SEQ ID NO: 709405 - RNA, 21 nt, Human
aggaggaggcagggagggggc

SEQ ID NO: 709406 - RNA, 22 nt, Human
aggcaagaaacagagcaagcag

SEQ ID NO: 709407 - RNA, 24 nt, Human
aggcaagaaacagagcaagcagaa

SEQ ID NO: 709408 - RNA, 22 nt, Human
aggcaggaaggaggaggcaggg

SEQ ID NO: 709409 - RNA, 19 nt, Human
aggcagggagggggccugg

SEQ ID NO: 709410 - RNA, 20 nt, Human
aggcagggagggggccuggg

SEQ ID NO: 709411 - RNA, 21 nt, Human
aggcagggagggggccugggc

SEQ ID NO: 709412 - RNA, 19 nt, Human
agggaucccauaucagguc

SEQ ID NO: 709413 - RNA, 21 nt, Human
agggguucuuagggucccagg

SEQ ID NO: 709414 - RNA, 21 nt, Human
aggucccaaaagagaccccag

SEQ ID NO: 709415 - RNA, 22 nt, Human
aggugccugcugcgcaguuugc

SEQ ID NO: 709416 - RNA, 20 nt, Human
agguucaagcgauucuccug

SEQ ID NO: 709417 - RNA, 21 nt, Human
aguagcugggauuacaggugc

SEQ ID NO: 709418 - RNA, 19 nt, Human
agucaugguuucaugcagu

SEQ ID NO: 709419 - RNA, 19 nt, Human
agugggaagacauguccuc

SEQ ID NO: 709420 - RNA, 21 nt, Human
aucaggugaacagggcucucc

SEQ ID NO: 709421 - RNA, 21 nt, Human
aucaucuacccagagagugac

SEQ ID NO: 709422 - RNA, 25 nt, Human
augacaacaaaaggaaaguggcuau

SEQ ID NO: 709423 - RNA, 21 nt, Human
augcagaacuggaaucauaua

SEQ ID NO: 709424 - RNA, 18 nt, Human
augggguuucaccauguu

SEQ ID NO: 709425 - RNA, 22 nt, Human
augggguuucaccauguuggcc

SEQ ID NO: 709426 - RNA, 23 nt, Human
augggguuucaccauguuggcca

SEQ ID NO: 709427 - RNA, 24 nt, Human
augggguuucaccauguuggccag

SEQ ID NO: 709428 - RNA, 24 nt, Human
auguacauuuaaaaaauccauaca

SEQ ID NO: 709429 - RNA, 19 nt, Human
auuacaggugccugccacu

SEQ ID NO: 709430 - RNA, 20 nt, Human
caaaaagacaccccuccccc

SEQ ID NO: 709431 - RNA, 19 nt, Human
caaaagcaaaaagacaccc

SEQ ID NO: 709432 - RNA, 25 nt, Human
caaaauuagaacaagcuagcccaac

SEQ ID NO: 709433 - RNA, 24 nt, Human
caaagugcugggauaacaggcgua

SEQ ID NO: 709434 - RNA, 23 nt, Human
caaaucccucaguuacugggaag

SEQ ID NO: 709435 - RNA, 24 nt, Human
caaaugacacuacuauuccugcac

SEQ ID NO: 709436 - RNA, 20 nt, Human
caacuacccucuaaccaccc

SEQ ID NO: 709437 - RNA, 22 nt, Human
caagaaugacaacaaaaggaaa

SEQ ID NO: 709438 - RNA, 20 nt, Human
caagagaaggaucugugaac

SEQ ID NO: 709439 - RNA, 22 nt, Human
caagcacgaaaggcuacaugga

SEQ ID NO: 709440 - RNA, 21 nt, Human
caagcagaaaggugccagcca

SEQ ID NO: 709441 - RNA, 22 nt, Human
caagcgauucuccugccucagc

SEQ ID NO: 709442 - RNA, 22 nt, Human
caagugacccucccugaacacc

SEQ ID NO: 709443 - RNA, 26 nt, Human
cacaacgcaggcaccuggcacauccc

SEQ ID NO: 709444 - RNA, 23 nt, Human
cacaagggagaaaccaaaaacaa

SEQ ID NO: 709445 - RNA, 22 nt, Human
cacacaggcgcacgcacgcaau

SEQ ID NO: 709446 - RNA, 20 nt, Human
cacacccaccccaagcuuca

SEQ ID NO: 709447 - RNA, 20 nt, Human
cacagacuuggcucugcugu

SEQ ID NO: 709448 - RNA, 20 nt, Human
cacagauccuugguccacca

SEQ ID NO: 709449 - RNA, 19 nt, Human
caccaaaagcaaaaagaca

SEQ ID NO: 709450 - RNA, 21 nt, Human
caccaaaagcaaaaagacacc

SEQ ID NO: 709451 - RNA, 23 nt, Human
caccaaaagcaaaaagacacccc

SEQ ID NO: 709452 - RNA, 18 nt, Human
caccaggccuagaaaaac

SEQ ID NO: 709453 - RNA, 21 nt, Human
caccauguuggccaggcuggu

SEQ ID NO: 709454 - RNA, 23 nt, Human
caccauguuggccaggcuggucu

SEQ ID NO: 709455 - RNA, 24 nt, Human
caccauguuggccaggcuggucuu

SEQ ID NO: 709456 - RNA, 27 nt, Human
caccauguuggccaggcuggucuugaa

SEQ ID NO: 709457 - RNA, 18 nt, Human
cacccagaaccauccccu

SEQ ID NO: 709458 - RNA, 20 nt, Human
cacccagaaccauccccuac

SEQ ID NO: 709459 - RNA, 26 nt, Human
cacccagaaccauccccuaccuucaa

SEQ ID NO: 709460 - RNA, 19 nt, Human
cacccaggaucacaagaau

SEQ ID NO: 709461 - RNA, 19 nt, Human
caccccccccaaacauccc

SEQ ID NO: 709462 - RNA, 21 nt, Human
caccccuccccccaacccuuu

SEQ ID NO: 709463 - RNA, 23 nt, Human
caccccuccccccaacccuuuuu

SEQ ID NO: 709464 - RNA, 22 nt, Human
caccucacagacuuccacagcc

SEQ ID NO: 709465 - RNA, 24 nt, Human
caccucgaccucccaaagugcugg

SEQ ID NO: 709466 - RNA, 19 nt, Human
cacucuuucacccaaccuc

SEQ ID NO: 709467 - RNA, 25 nt, Human
cagcagccauaaggcaagaaacaga

SEQ ID NO: 709468 - RNA, 23 nt, Human
cagccaaaguggccaaaauuaga

SEQ ID NO: 709469 - RNA, 19 nt, Human
cagcccagagaagugucag

SEQ ID NO: 709470 - RNA, 23 nt, Human
cagcgccaccucccucuccuccu

SEQ ID NO: 709471 - RNA, 21 nt, Human
caggcgcacgcacgcaaucug

SEQ ID NO: 709472 - RNA, 21 nt, Human
caguugcucagggcaccagca

SEQ ID NO: 709473 - RNA, 18 nt, Human
caucccugaagcccaggc

SEQ ID NO: 709474 - RNA, 23 nt, Human
cauggagacugcaaaucccaaug

SEQ ID NO: 709475 - RNA, 24 nt, Human
cauguuggccaggcuggucuugaa

SEQ ID NO: 709476 - RNA, 22 nt, Human
ccaaagugcugggauaacaggc

SEQ ID NO: 709477 - RNA, 24 nt, Human
ccaaagugcugggauaacaggcgu

SEQ ID NO: 709478 - RNA, 19 nt, Human
ccacagaaacccacccagg

SEQ ID NO: 709479 - RNA, 21 nt, Human
ccacagacuuggcucugcugu

SEQ ID NO: 709480 - RNA, 23 nt, Human
ccaccucacagacuuccacagcc

SEQ ID NO: 709481 - RNA, 18 nt, Human
ccaccucccucuccuccu

SEQ ID NO: 709482 - RNA, 24 nt, Human
ccaccuucuagguucaagcgauuc

SEQ ID NO: 709483 - RNA, 23 nt, Human
ccacgugaacaaguagcucuaga

SEQ ID NO: 709484 - RNA, 22 nt, Human
ccagaagcacacacccacccca

SEQ ID NO: 709485 - RNA, 23 nt, Human
ccagaagcacacacccaccccaa

SEQ ID NO: 709486 - RNA, 20 nt, Human
ccagccaugggcgccuggcg

SEQ ID NO: 709487 - RNA, 18 nt, Human
ccaggcuggagugccaug

SEQ ID NO: 709488 - RNA, 21 nt, Human
cccaaaagagaccccagaagc

SEQ ID NO: 709489 - RNA, 18 nt, Human
cccaaccgaguucacacc

SEQ ID NO: 709490 - RNA, 19 nt, Human
cccaccucgaccucccaaa

SEQ ID NO: 709491 - RNA, 21 nt, Human
cccaggaucacaagaaugaca

SEQ ID NO: 709492 - RNA, 19 nt, Human
cccauuuccccccuuuuga

SEQ ID NO: 709493 - RNA, 20 nt, Human
ccccaaacaucccugaagcc

SEQ ID NO: 709494 - RNA, 23 nt, Human
ccccaagcuucagggguucuuag

SEQ ID NO: 709495 - RNA, 20 nt, Human
ccccacagagcgacagcagg

SEQ ID NO: 709496 - RNA, 22 nt, Human
ccccacagagcgacagcaggcu

SEQ ID NO: 709497 - RNA, 26 nt, Human
ccccaggcuucugaccggcaggcccu

SEQ ID NO: 709498 - RNA, 24 nt, Human
ccccaguugcagguguuuuaaggg

SEQ ID NO: 709499 - RNA, 22 nt, Human
cccccaaacaucccugaagccc

SEQ ID NO: 709500 - RNA, 24 nt, Human
cccccaaacaucccugaagcccag

SEQ ID NO: 709501 - RNA, 24 nt, Human
ccccccuuuugaaucuaaauccaa

SEQ ID NO: 709502 - RNA, 23 nt, Human
cccgaguagcugggauuacaggu

SEQ ID NO: 709503 - RNA, 24 nt, Human
cccgaguagcugggauuacaggug

SEQ ID NO: 709504 - RNA, 20 nt, Human
cccucuaaccacccccccca

SEQ ID NO: 709505 - RNA, 19 nt, Human
cccugaacaccaagggacc

SEQ ID NO: 709506 - RNA, 21 nt, Human
ccgaguagcugggauuacagg

SEQ ID NO: 709507 - RNA, 22 nt, Human
ccgccggcucagccugcucccc

SEQ ID NO: 709508 - RNA, 24 nt, Human
ccgucgagcccuggcaacuggggg

SEQ ID NO: 709509 - RNA, 24 nt, Human
ccuaaccucaggugaucugcccac

SEQ ID NO: 709510 - RNA, 19 nt, Human
ccuaccagccccaggcuuc

SEQ ID NO: 709511 - RNA, 21 nt, Human
ccuccaauaauccugaaaauc

SEQ ID NO: 709512 - RNA, 22 nt, Human
ccucuaaccaccccccccaaac

SEQ ID NO: 709513 - RNA, 24 nt, Human
ccugccucagccucccgaguagcu

SEQ ID NO: 709514 - RNA, 21 nt, Human
ccuucuaaaaguccucacaag

SEQ ID NO: 709515 - RNA, 24 nt, Human
ccuucuagguucaagcgauucucc

SEQ ID NO: 709516 - RNA, 18 nt, Human
ccuugguccaccagcgcc

SEQ ID NO: 709517 - RNA, 24 nt, Human
cgacuaaaacaagguaacacugaa

SEQ ID NO: 709518 - RNA, 20 nt, Human
cgagaggccacaguugcugg

SEQ ID NO: 709519 - RNA, 21 nt, Human
cgagaggccacaguugcuggg

SEQ ID NO: 709520 - RNA, 21 nt, Human
cgcaggcaccuggcacauccc

SEQ ID NO: 709521 - RNA, 18 nt, Human
cgcccccuccccccauug

SEQ ID NO: 709522 - RNA, 18 nt, Human
cggccagaugaacagcgg

SEQ ID NO: 709523 - RNA, 19 nt, Human
cggcuguugcuucgcaaaa

SEQ ID NO: 709524 - RNA, 24 nt, Human
cucacacuaccucuccagcaacug

SEQ ID NO: 709525 - RNA, 23 nt, Human
cucacugcaaccuccaccuucua

SEQ ID NO: 709526 - RNA, 24 nt, Human
cucagccucccgaguagcugggau

SEQ ID NO: 709527 - RNA, 21 nt, Human
cuccaauaauccugaaaaucc

SEQ ID NO: 709528 - RNA, 19 nt, Human
cuccaccugcggcuguugc

SEQ ID NO: 709529 - RNA, 18 nt, Human
cucccccucccauggguc

SEQ ID NO: 709530 - RNA, 25 nt, Human
cuccccucucacccagaaccauccc

SEQ ID NO: 709531 - RNA, 20 nt, Human
cucgucuuuauagcucugcc

SEQ ID NO: 709532 - RNA, 23 nt, Human
cucucacccagaaccauccccua

SEQ ID NO: 709533 - RNA, 21 nt, Human
cucuuguuguccaggcuggag

SEQ ID NO: 709534 - RNA, 22 nt, Human
cucuuguuguccaggcuggagu

SEQ ID NO: 709535 - RNA, 24 nt, Human
cugcaaccuccaccuucuagguuc

SEQ ID NO: 709536 - RNA, 18 nt, Human
cuggaggugaggaccagc

SEQ ID NO: 709537 - RNA, 19 nt, Human
gaagacauguccuccccac

SEQ ID NO: 709538 - RNA, 19 nt, Human
gaagcacacacccacccca

SEQ ID NO: 709539 - RNA, 18 nt, Human
gacaaugacuuaagcccc

SEQ ID NO: 709540 - RNA, 18 nt, Human
gacagcaggcuggcuucc

SEQ ID NO: 709541 - RNA, 20 nt, Human
gacaggagugaggacaggag

SEQ ID NO: 709542 - RNA, 19 nt, Human
gacaugaaguuguggcguc

SEQ ID NO: 709543 - RNA, 20 nt, Human
gacccucccugaacaccaag

SEQ ID NO: 709544 - RNA, 19 nt, Human
gacuaaaacaagguaacac

SEQ ID NO: 709545 - RNA, 18 nt, Human
gacuuggcucugcuguga

SEQ ID NO: 709546 - RNA, 22 nt, Human
gagaaaccaaaaacaaaacaga

SEQ ID NO: 709547 - RNA, 22 nt, Human
gagaaggggaguugccuugaug

SEQ ID NO: 709548 - RNA, 20 nt, Human
gagaaugguuuuuuccucuu

SEQ ID NO: 709549 - RNA, 18 nt, Human
gagaugggguuucaccau

SEQ ID NO: 709550 - RNA, 24 nt, Human
gagaugggguuucaccauguuggc

SEQ ID NO: 709551 - RNA, 18 nt, Human
gagcuugcaagagacagg

SEQ ID NO: 709552 - RNA, 19 nt, Human
gaggcagggagggggccug

SEQ ID NO: 709553 - RNA, 22 nt, Human
gaggucccaaaagagaccccag

SEQ ID NO: 709554 - RNA, 24 nt, Human
gaguacaaguugaaaaccacacag

SEQ ID NO: 709555 - RNA, 18 nt, Human
gauuacaggugccugcca

SEQ ID NO: 709556 - RNA, 22 nt, Human
gcaagaaacagagcaagcagaa

SEQ ID NO: 709557 - RNA, 24 nt, Human
gcauaaaacugaagaaaacagcca

SEQ ID NO: 709558 - RNA, 19 nt, Human
gccaccucccucuccuccu

SEQ ID NO: 709559 - RNA, 18 nt, Human
gccagcacaggacaggag

SEQ ID NO: 709560 - RNA, 19 nt, Human
gccagggaggguggcaggg

SEQ ID NO: 709561 - RNA, 23 nt, Human
gcccccuccccccauugcaagac

SEQ ID NO: 709562 - RNA, 23 nt, Human
gccuagaaaaaccaacuaggaag

SEQ ID NO: 709563 - RNA, 20 nt, Human
gccucagccucccgaguagc

SEQ ID NO: 709564 - RNA, 21 nt, Human
gccugaacucaauuauagacu

SEQ ID NO: 709565 - RNA, 18 nt, Human
gcgaaacgcccccucccc

SEQ ID NO: 709566 - RNA, 21 nt, Human
gcgaaacgcccccucccccca

SEQ ID NO: 709567 - RNA, 24 nt, Human
gcgauucuccugccucagccuccc

SEQ ID NO: 709568 - RNA, 18 nt, Human
gcggggcccgcacccugc

SEQ ID NO: 709569 - RNA, 23 nt, Human
gcugaacaugcgauuugcaguua

SEQ ID NO: 709570 - RNA, 23 nt, Human
gcuggucuugaacuccuaaccuc

SEQ ID NO: 709571 - RNA, 20 nt, Human
ggacaggagugaggacagga

SEQ ID NO: 709572 - RNA, 19 nt, Human
ggagcaucacaggcaggaa

SEQ ID NO: 709573 - RNA, 19 nt, Human
ggagcuugcaagagacagg

SEQ ID NO: 709574 - RNA, 18 nt, Human
ggaggaaggugggcuuag

SEQ ID NO: 709575 - RNA, 21 nt, Human
ggagggggccugggcuccuug

SEQ ID NO: 709576 - RNA, 18 nt, Human
ggaugaugacucccccuc

SEQ ID NO: 709577 - RNA, 19 nt, Human
ggcaagguggggggccuga

SEQ ID NO: 709578 - RNA, 21 nt, Human
ggccaccucacagacuuccac

SEQ ID NO: 709579 - RNA, 24 nt, Human
ggcuggucuugaacuccuaaccuc

SEQ ID NO: 709580 - RNA, 19 nt, Human
ggcuuaggaggcugcuggc

SEQ ID NO: 709581 - RNA, 21 nt, Human
ggcuuccccacaaauguaagg

SEQ ID NO: 709582 - RNA, 20 nt, Human
gggaagcaaaauagaccaaa

SEQ ID NO: 709583 - RNA, 21 nt, Human
gggaagcaaaauagaccaaaa

SEQ ID NO: 709584 - RNA, 24 nt, Human
gggaaggagagggagaaaugggag

SEQ ID NO: 709585 - RNA, 19 nt, Human
gggaggaaggugggcuuag

SEQ ID NO: 709586 - RNA, 22 nt, Human
gggagggggccugggcuccuug

SEQ ID NO: 709587 - RNA, 21 nt, Human
gggauuagaacugacucaaaa

SEQ ID NO: 709588 - RNA, 27 nt, Human
ggggagcggguagcacagauccuuggu

SEQ ID NO: 709589 - RNA, 21 nt, Human
ggggagcuugcaagagacagg

SEQ ID NO: 709590 - RNA, 21 nt, Human
ggggcuggaagcucugggcuu

SEQ ID NO: 709591 - RNA, 22 nt, Human
gggguuucaccauguuggccag

SEQ ID NO: 709592 - RNA, 23 nt, Human
gggguuucuuaaauguugggaag

SEQ ID NO: 709593 - RNA, 20 nt, Human
ggguggcagggggagggggg

SEQ ID NO: 709594 - RNA, 22 nt, Human
gguguccuuggcugccgucgag

SEQ ID NO: 709595 - RNA, 19 nt, Human
gguucugccaccauuaccu

SEQ ID NO: 709596 - RNA, 25 nt, Human
guagaaaacagacacuuuguccaca

SEQ ID NO: 709597 - RNA, 23 nt, Human
guagagaugggguuucaccaugu

SEQ ID NO: 709598 - RNA, 18 nt, Human
guagcugggauuacaggu

SEQ ID NO: 709599 - RNA, 24 nt, Human
gucagggaaggagagggagaaaug

SEQ ID NO: 709600 - RNA, 20 nt, Human
gugaacagggcucuccaccu

SEQ ID NO: 709601 - RNA, 24 nt, Human
gugaucugcccaccucgaccuccc

SEQ ID NO: 709602 - RNA, 20 nt, Human
gugcagcuaucagcgcccgg

SEQ ID NO: 709603 - RNA, 24 nt, Human
gugggcuuaggaggcugcuggcug

SEQ ID NO: 709604 - RNA, 22 nt, Human
guggggccagaggagaguuuuc

SEQ ID NO: 709605 - RNA, 20 nt, Human
guguuuuaagggacagaaag

SEQ ID NO: 709606 - RNA, 22 nt, Human
guuccagaaaagccagcacagg

SEQ ID NO: 709607 - RNA, 21 nt, Human
guugcugggguagguuuacgu

SEQ ID NO: 709608 - RNA, 18 nt, Human
guuguccaggcuggagug

SEQ ID NO: 709609 - RNA, 22 nt, Human
guuuguggaagaauaagaggaa

SEQ ID NO: 709610 - RNA, 19 nt, Human
uaaaacugaagaaaacagc

SEQ ID NO: 709611 - RNA, 23 nt, Human
uaaaagagugccacagaaaccca

SEQ ID NO: 709612 - RNA, 22 nt, Human
uaaaaguccucacaaggcacca

SEQ ID NO: 709613 - RNA, 18 nt, Human
uaaccucaggugaucugc

SEQ ID NO: 709614 - RNA, 22 nt, Human
uaacucccaucaucacugcacc

SEQ ID NO: 709615 - RNA, 24 nt, Human
uaacucccaucaucacugcaccuc

SEQ ID NO: 709616 - RNA, 19 nt, Human
uaagcugaccccagccacu

SEQ ID NO: 709617 - RNA, 19 nt, Human
uaagugacuuggagaaggg

SEQ ID NO: 709618 - RNA, 25 nt, Human
uaauuuuuuguauuuuuaguagagg

SEQ ID NO: 709619 - RNA, 33 nt, Human
uacaccuaauuuuuuguauuuuuaguagagaag

SEQ ID NO: 709620 - RNA, 23 nt, Human
uaccucuccagcaacuggcacaa

SEQ ID NO: 709621 - RNA, 24 nt, Human
uagaccucuaagaugaugcuacau

SEQ ID NO: 709622 - RNA, 22 nt, Human
uagagagggaugaaggccucca

SEQ ID NO: 709623 - RNA, 22 nt, Human
uagagaugggguuucaccaugu

SEQ ID NO: 709624 - RNA, 25 nt, Human
uagcacacccguccacugggaagca

SEQ ID NO: 709625 - RNA, 23 nt, Human
uagcucuucccauuucugcaacc

SEQ ID NO: 709626 - RNA, 27 nt, Human
uaggauggguguucucuaaugggggag

SEQ ID NO: 709627 - RNA, 21 nt, Human
uagggucccaggguuuccggu

SEQ ID NO: 709628 - RNA, 24 nt, Human
uaguagagaugggguuucaccaug

SEQ ID NO: 709629 - RNA, 26 nt, Human
uaguagagaugggguuucaccauguu

SEQ ID NO: 709630 - RNA, 22 nt, Human
uauagcucugccacuccaggga

SEQ ID NO: 709631 - RNA, 22 nt, Human
uaucaggugaacagggcucucc

SEQ ID NO: 709632 - RNA, 24 nt, Human
uaucaucuacccagagagugacuc

SEQ ID NO: 709633 - RNA, 24 nt, Human
uauuaggcaagguggggggccuga

SEQ ID NO: 709634 - RNA, 18 nt, Human
uauugcacaacccggaag

SEQ ID NO: 709635 - RNA, 19 nt, Human
uauuugaucauuuguucca

SEQ ID NO: 709636 - RNA, 23 nt, Human
ucacugcaaccuccaccuucuag

SEQ ID NO: 709637 - RNA, 24 nt, Human
ucacugcaaccuccaccuucuagg

SEQ ID NO: 709638 - RNA, 27 nt, Human
ucacugcaaccuccaccuucuagguuc

SEQ ID NO: 709639 - RNA, 21 nt, Human
ucacugcaccuccaaggaggg

SEQ ID NO: 709640 - RNA, 23 nt, Human
ucacugcaccuccaagggggccc

SEQ ID NO: 709641 - RNA, 20 nt, Human
ucacugggacaaccuugagc

SEQ ID NO: 709642 - RNA, 20 nt, Human
ucagccucccgaguagcugg

SEQ ID NO: 709643 - RNA, 22 nt, Human
ucagggcaccagcagccuuagu

SEQ ID NO: 709644 - RNA, 24 nt, Human
uccacagccacccagcugggccag

SEQ ID NO: 709645 - RNA, 23 nt, Human
uccacaugaggaccaccaagggc

SEQ ID NO: 709646 - RNA, 19 nt, Human
uccaccagcgccaccuccc

SEQ ID NO: 709647 - RNA, 18 nt, Human
uccacugggaagcagagc

SEQ ID NO: 709648 - RNA, 19 nt, Human
uccauggaagauaagaauu

SEQ ID NO: 709649 - RNA, 20 nt, Human
uccauuuuauauauaacuau

SEQ ID NO: 709650 - RNA, 23 nt, Human
ucccaaagccaaaugccuuggca

SEQ ID NO: 709651 - RNA, 24 nt, Human
ucccaaagugcugggauaacaggc

SEQ ID NO: 709652 - RNA, 25 nt, Human
ucccaugggucccauuucucccccc

SEQ ID NO: 709653 - RNA, 23 nt, Human
ucccauuucucccccaguugcag

SEQ ID NO: 709654 - RNA, 23 nt, Human
ucccgaguagcugggauuacagg

SEQ ID NO: 709655 - RNA, 24 nt, Human
ucccgaguagcugggauuacaggu

SEQ ID NO: 709656 - RNA, 20 nt, Human
ucccucuguuagaggagaga

SEQ ID NO: 709657 - RNA, 22 nt, Human
uccuuggcugccgucgagcccu

SEQ ID NO: 709658 - RNA, 22 nt, Human
ucgcucuuguuguccaggcugg

SEQ ID NO: 709659 - RNA, 23 nt, Human
ucgcucuuguuguccaggcugga

SEQ ID NO: 709660 - RNA, 19 nt, Human
ucggcccccaccaagagga

SEQ ID NO: 709661 - RNA, 22 nt, Human
ucuaaaaguccucacaaggcac

SEQ ID NO: 709662 - RNA, 22 nt, Human
ucuaagcagugggaagacaugu

SEQ ID NO: 709663 - RNA, 23 nt, Human
ucuagagugcuuuuaggcagagu

SEQ ID NO: 709664 - RNA, 24 nt, Human
ucuccugccucagccucccgagua

SEQ ID NO: 709665 - RNA, 20 nt, Human
ucugaccggcaggcccuggg

SEQ ID NO: 709666 - RNA, 21 nt, Human
ucugcucacacuaccucucca

SEQ ID NO: 709667 - RNA, 27 nt, Human
ucugcugugaaauaaacgugccaggga

SEQ ID NO: 709668 - RNA, 18 nt, Human
ucugcuguguugaaacca

SEQ ID NO: 709669 - RNA, 23 nt, Human
ucuggauugaguugucacguccc

SEQ ID NO: 709670 - RNA, 18 nt, Human
ucugucagggcuguuuga

SEQ ID NO: 709671 - RNA, 21 nt, Human
ucuuagggucccaggguuucc

SEQ ID NO: 709672 - RNA, 25 nt, Human
ucuuccucacugggacaaccuugag

SEQ ID NO: 709673 - RNA, 20 nt, Human
ugaacaaguagcucuagagu

SEQ ID NO: 709674 - RNA, 19 nt, Human
ugaacagcgguccaaguga

SEQ ID NO: 709675 - RNA, 23 nt, Human
ugaacgccccuucuaaaaguccu

SEQ ID NO: 709676 - RNA, 20 nt, Human
ugaaugcuugugaauggcug

SEQ ID NO: 709677 - RNA, 18 nt, Human
ugacaaaguacccuacaa

SEQ ID NO: 709678 - RNA, 19 nt, Human
ugacaaaguacccuacaac

SEQ ID NO: 709679 - RNA, 23 nt, Human
ugacaaaguacccuacaacuacc

SEQ ID NO: 709680 - RNA, 19 nt, Human
ugacacagccuggagagca

SEQ ID NO: 709681 - RNA, 19 nt, Human
ugaccuaauccuccaauaa

SEQ ID NO: 709682 - RNA, 21 nt, Human
ugacucaaaagcuuucagcac

SEQ ID NO: 709683 - RNA, 22 nt, Human
ugacucccccucccaugggucc

SEQ ID NO: 709684 - RNA, 20 nt, Human
ugacuuaagccccaucguga

SEQ ID NO: 709685 - RNA, 18 nt, Human
ugaggacaggagguggcc

SEQ ID NO: 709686 - RNA, 20 nt, Human
ugaggacaggagguggccug

SEQ ID NO: 709687 - RNA, 24 nt, Human
ugaggacaggagguggccugaggg

SEQ ID NO: 709688 - RNA, 24 nt, Human
ugaggaccaccaagggccuaccag

SEQ ID NO: 709689 - RNA, 21 nt, Human
ugagggaggaagagcacucca

SEQ ID NO: 709690 - RNA, 24 nt, Human
ugaucugcccaccucgaccuccca

SEQ ID NO: 709691 - RNA, 23 nt, Human
ugcaacagucagacauguaugug

SEQ ID NO: 709692 - RNA, 20 nt, Human
ugcaagguggagcuaacacu

SEQ ID NO: 709693 - RNA, 22 nt, Human
ugccacagaaacccacccagga

SEQ ID NO: 709694 - RNA, 20 nt, Human
ugccauaggcccuuaagcaa

SEQ ID NO: 709695 - RNA, 21 nt, Human
ugcccaccucgaccucccaaa

SEQ ID NO: 709696 - RNA, 18 nt, Human
ugcccccugcucggcccc

SEQ ID NO: 709697 - RNA, 20 nt, Human
ugccucaaaacagaguucgg

SEQ ID NO: 709698 - RNA, 24 nt, Human
ugccucagccucccgaguagcugg

SEQ ID NO: 709699 - RNA, 23 nt, Human
ugccuugggacaugaacagacaa

SEQ ID NO: 709700 - RNA, 24 nt, Human
ugcucugcucacacuaccucucca

SEQ ID NO: 709701 - RNA, 20 nt, Human
ugcuguuugguuugguuuug

SEQ ID NO: 709702 - RNA, 23 nt, Human
ugcuucgcaaaauauccuuccuc

SEQ ID NO: 709703 - RNA, 23 nt, Human
uggaaaccuacaggcaugagaau

SEQ ID NO: 709704 - RNA, 19 nt, Human
uggaaaggaccacuggcug

SEQ ID NO: 709705 - RNA, 19 nt, Human
uggaagaauaagaggaagc

SEQ ID NO: 709706 - RNA, 18 nt, Human
uggcaacacagucugugu

SEQ ID NO: 709707 - RNA, 19 nt, Human
uggcaagauuucagcugcu

SEQ ID NO: 709708 - RNA, 24 nt, Human
uggccaggcuggucuugaacuccu

SEQ ID NO: 709709 - RNA, 18 nt, Human
uggcccagacacacaugg

SEQ ID NO: 709710 - RNA, 18 nt, Human
uggccgcucucuucuugc

SEQ ID NO: 709711 - RNA, 21 nt, Human
ugggaagacauguccucccca

SEQ ID NO: 709712 - RNA, 24 nt, Human
ugggaagcaaaauagaccaaaagg

SEQ ID NO: 709713 - RNA, 19 nt, Human
ugggacaaccuugagcugg

SEQ ID NO: 709714 - RNA, 22 nt, Human
ugggaccacauccaaggcauga

SEQ ID NO: 709715 - RNA, 22 nt, Human
ugggauaacaggcguaagcuac

SEQ ID NO: 709716 - RNA, 24 nt, Human
ugggauaacaggcguaagcuacug

SEQ ID NO: 709717 - RNA, 21 nt, Human
ugggauuacaggugccugcca

SEQ ID NO: 709718 - RNA, 22 nt, Human
ugggauuacaggugccugccac

SEQ ID NO: 709719 - RNA, 22 nt, Human
ugggauuacaggugccugccac

SEQ ID NO: 709720 - RNA, 24 nt, Human
ugggauuacaggugccugccacua

SEQ ID NO: 709721 - RNA, 27 nt, Human
ugggccuuuuaaaaaaaaucugggggu

SEQ ID NO: 709722 - RNA, 23 nt, Human
ugggcuuaggaggcugcuggcug

SEQ ID NO: 709723 - RNA, 18 nt, Human
uggggccagaggagaguu

SEQ ID NO: 709724 - RNA, 26 nt, Human
uggggcugaagcccuugagacuuagu

SEQ ID NO: 709725 - RNA, 20 nt, Human
ugggggcuggaagcucuggg

SEQ ID NO: 709726 - RNA, 21 nt, Human
ugggggcuggaagcucugggc

SEQ ID NO: 709727 - RNA, 23 nt, Human
uggggguggggaaaauaacggag

SEQ ID NO: 709728 - RNA, 24 nt, Human
ugggguuucaccauguuggccagg

SEQ ID NO: 709729 - RNA, 24 nt, Human
ugguacaaucuccgcucacugcaa

SEQ ID NO: 709730 - RNA, 20 nt, Human
ugguaggagcucgagucacg

SEQ ID NO: 709731 - RNA, 20 nt, Human
ugguugggccaccucacaga

SEQ ID NO: 709732 - RNA, 24 nt, Human
ugucagaaagaugaccaguauucc

SEQ ID NO: 709733 - RNA, 18 nt, Human
uguccaggcuggagugcc

SEQ ID NO: 709734 - RNA, 21 nt, Human
uguccaggcuggagugccaug

SEQ ID NO: 709735 - RNA, 24 nt, Human
uguccaggcuggagugccauggua

SEQ ID NO: 709736 - RNA, 20 nt, Human
ugucuguuggcuuccccaca

SEQ ID NO: 709737 - RNA, 24 nt, Human
ugugagggaaggggccagaaaggc

SEQ ID NO: 709738 - RNA, 23 nt, Human
ugugucuguuggcuuccccacaa

SEQ ID NO: 709739 - RNA, 20 nt, Human
uguguugaaaccaaacugcc

SEQ ID NO: 709740 - RNA, 19 nt, Human
uguuuuaaaaccagacaga

SEQ ID NO: 709741 - RNA, 19 nt, Human
uguuuuaagggacagaaag

SEQ ID NO: 709742 - RNA, 21 nt, Human
uuacaggugccugccacuaca

SEQ ID NO: 709743 - RNA, 22 nt, Human
uuagaacaucaagaauugaagu

SEQ ID NO: 709744 - RNA, 18 nt, Human
uuaguagagaugggguuu

SEQ ID NO: 709745 - RNA, 22 nt, Human
uuaguagagaugggguuucacc

SEQ ID NO: 709746 - RNA, 24 nt, Human
uuaguagagaugggguuucaccau

SEQ ID NO: 709747 - RNA, 19 nt, Human
uuaucuaugauguaaguga

SEQ ID NO: 709748 - RNA, 21 nt, Human
uucaagcgauucuccugccuc

SEQ ID NO: 709749 - RNA, 23 nt, Human
uucaagcgauucuccugccucag

SEQ ID NO: 709750 - RNA, 24 nt, Human
uucaagcgauucuccugccucagc

SEQ ID NO: 709751 - RNA, 18 nt, Human
uucacaccauccuucugg

SEQ ID NO: 709752 - RNA, 23 nt, Human
uuccaaaugacacuacuauuccu

SEQ ID NO: 709753 - RNA, 23 nt, Human
uucgcaaaauauccuuccucucc

SEQ ID NO: 709754 - RNA, 24 nt, Human
uucgcucuuguuguccaggcugga

SEQ ID NO: 709755 - RNA, 20 nt, Human
uucggagguucuuaauuggg

SEQ ID NO: 709756 - RNA, 24 nt, Human
uucuagguucaagcgauucuccug

SEQ ID NO: 709757 - RNA, 23 nt, Human
uugccaagcacgaaaggcuacau

SEQ ID NO: 709758 - RNA, 18 nt, Human
uugcccccugcucggccc

SEQ ID NO: 709759 - RNA, 19 nt, Human
uugcucagggcaccagcag

SEQ ID NO: 709760 - RNA, 22 nt, Human
uugcucagggcaccagcagccu

SEQ ID NO: 709761 - RNA, 21 nt, Human
uuggaggugucuggcagagcc

SEQ ID NO: 709762 - RNA, 23 nt, Human
uuguauuuuuaguagagaugggg

SEQ ID NO: 709763 - RNA, 26 nt, Human
uuuaaacagaggaaccgaaaaaugag

SEQ ID NO: 709764 - RNA, 24 nt, Human
uuucaccauguuggccaggcuggu

SEQ ID NO: 709765 - RNA, 22 nt, Human
uuucgcucuuguuguccaggcu

SEQ ID NO: 709766 - RNA, 24 nt, Human
uuucgcucuuguuguccaggcugg

SEQ ID NO: 709767 - RNA, 25 nt, Human
uuucucagcaaccauuucggucugg

SEQ ID NO: 709768 - RNA, 23 nt, Human
uuucuggaggugccugcugcgca

SEQ ID NO: 709769 - RNA, 19 nt, Human
uuuuacauaaaauaaaccc

SEQ ID NO: 709770 - RNA, 20 nt, Human
uuuuguauuuuuaguagaga

SEQ ID NO: 709771 - RNA, 24 nt, Human
uuuuuaguagagaugggguuucac

SEQ ID NO: 709772 - RNA, 23 nt, Human
uuuuuguauuuuuaguagagaag

SEQ ID NO: 709773 - RNA, 20 nt, Human
aaaaagccacacugagccca

SEQ ID NO: 709774 - RNA, 21 nt, Human
aaaaguauuacagcaaggaca

SEQ ID NO: 709775 - RNA, 18 nt, Human
aaagggcuccuuguaaga

SEQ ID NO: 709776 - RNA, 24 nt, Human
aagcagaagcagauucuccacaug

SEQ ID NO: 709777 - RNA, 22 nt, Human
aagcagauucuccacauguaga

SEQ ID NO: 709778 - RNA, 19 nt, Human
aagcgcgcuacuaagaaca

SEQ ID NO: 709779 - RNA, 19 nt, Human
aaggaccaaggcuaugagc

SEQ ID NO: 709780 - RNA, 21 nt, Human
acaaagcuuuuggccaaauaa

SEQ ID NO: 709781 - RNA, 20 nt, Human
acacagccacacugcccaaa

SEQ ID NO: 709782 - RNA, 22 nt, Human
acacugagcccacucuuccugu

SEQ ID NO: 709783 - RNA, 21 nt, Human
accaagagaucauaauacaaa

SEQ ID NO: 709784 - RNA, 19 nt, Human
accaccugcuguauccuuc

SEQ ID NO: 709785 - RNA, 21 nt, Human
accucaucacccccaaagcca

SEQ ID NO: 709786 - RNA, 20 nt, Human
accugacaagcccuuuguuu

SEQ ID NO: 709787 - RNA, 21 nt, Human
agaaguucuuucauaaagaaa

SEQ ID NO: 709788 - RNA, 22 nt, Human
agccacacugagcccacucuuc

SEQ ID NO: 709789 - RNA, 27 nt, Human
auaguuggaaaaaagccacacugagcc

SEQ ID NO: 709790 - RNA, 22 nt, Human
caaagagaucaaagagucagga

SEQ ID NO: 709791 - RNA, 18 nt, Human
caagaugagaccuuccuu

SEQ ID NO: 709792 - RNA, 28 nt, Human
cacagaccaagagaucauaauacaaagc

SEQ ID NO: 709793 - RNA, 18 nt, Human
caccucaucacccccaaa

SEQ ID NO: 709794 - RNA, 20 nt, Human
caccucaucacccccaaagc

SEQ ID NO: 709795 - RNA, 20 nt, Human
cacuacacagccacacugcc

SEQ ID NO: 709796 - RNA, 22 nt, Human
cacuacacagccacacugccca

SEQ ID NO: 709797 - RNA, 25 nt, Human
cacuacacagccacacugcccuuug

SEQ ID NO: 709798 - RNA, 20 nt, Human
cacugcccaaagcgcgcuac

SEQ ID NO: 709799 - RNA, 23 nt, Human
cagaccaagagaucauaauacaa

SEQ ID NO: 709800 - RNA, 24 nt, Human
cagaccaagagaucauaauacaaa

SEQ ID NO: 709801 - RNA, 21 nt, Human
cagccacacugcccaaagcgc

SEQ ID NO: 709802 - RNA, 21 nt, Human
ccaaagcgcgcuacuaagaac

SEQ ID NO: 709803 - RNA, 23 nt, Human
ccacacugagcccacucuuccug

SEQ ID NO: 709804 - RNA, 19 nt, Human
cccaaugcauuuacauaaa

SEQ ID NO: 709805 - RNA, 21 nt, Human
ccccaccucaucacccccaaa

SEQ ID NO: 709806 - RNA, 22 nt, Human
cccccacuuucuaauuccagcc

SEQ ID NO: 709807 - RNA, 21 nt, Human
cuaacaaaaaaaggggaugau

SEQ ID NO: 709808 - RNA, 20 nt, Human
cugcuguauccuuccccacc

SEQ ID NO: 709809 - RNA, 23 nt, Human
cuuuguuucuaacaaaaaaaggg

SEQ ID NO: 709810 - RNA, 21 nt, Human
gaaaggcagcuugccggcuua

SEQ ID NO: 709811 - RNA, 21 nt, Human
gaagcagauucuccacaugua

SEQ ID NO: 709812 - RNA, 25 nt, Human
gaaguucuuucauaaagaaaugcuu

SEQ ID NO: 709813 - RNA, 19 nt, Human
gacugcaugaguguugaaa

SEQ ID NO: 709814 - RNA, 22 nt, Human
gagcccacucuuccugugaggc

SEQ ID NO: 709815 - RNA, 22 nt, Human
gaggcaagaugagaccuuccuu

SEQ ID NO: 709816 - RNA, 25 nt, Human
ggcauggaaaucacaguacagaauu

SEQ ID NO: 709817 - RNA, 19 nt, Human
gugacugcaugaguguuga

SEQ ID NO: 709818 - RNA, 19 nt, Human
gugaggcaagaugagaccu

SEQ ID NO: 709819 - RNA, 20 nt, Human
uaaagaaaugcuuaacuuua

SEQ ID NO: 709820 - RNA, 18 nt, Human
uaaagcagaagcagauuc

SEQ ID NO: 709821 - RNA, 19 nt, Human
uaaagcagaagcagauucu

SEQ ID NO: 709822 - RNA, 22 nt, Human
uaaagcagaagcagauucucca

SEQ ID NO: 709823 - RNA, 21 nt, Human
uaacagugaaaucauuaaaca

SEQ ID NO: 709824 - RNA, 19 nt, Human
uaacucguagagcuucuca

SEQ ID NO: 709825 - RNA, 21 nt, Human
uaacuuuauuuaaccuagagu

SEQ ID NO: 709826 - RNA, 22 nt, Human
uaagaacacugguccuacaaag

SEQ ID NO: 709827 - RNA, 18 nt, Human
uaagaggcaaagcaucaa

SEQ ID NO: 709828 - RNA, 19 nt, Human
uacagcaaggacagggaaa

SEQ ID NO: 709829 - RNA, 26 nt, Human
uacagcaaggacagggaaagaugaaa

SEQ ID NO: 709830 - RNA, 18 nt, Human
uacaguaaaaacccaaug

SEQ ID NO: 709831 - RNA, 18 nt, Human
uauuucauguacagaggc

SEQ ID NO: 709832 - RNA, 22 nt, Human
uccacauguagaacuuggcaga

SEQ ID NO: 709833 - RNA, 18 nt, Human
uccacgucauagaccccc

SEQ ID NO: 709834 - RNA, 19 nt, Human
uccauaguuggaaaaaagc

SEQ ID NO: 709835 - RNA, 18 nt, Human
uccaugauuucucucuuu

SEQ ID NO: 709836 - RNA, 24 nt, Human
uccccaccucaucacccccaaagc

SEQ ID NO: 709837 - RNA, 24 nt, Human
ugacgccauaaacugugccugccu

SEQ ID NO: 709838 - RNA, 20 nt, Human
ugacugcaugaguguugaaa

SEQ ID NO: 709839 - RNA, 18 nt, Human
ugagcaagccauaugugg

SEQ ID NO: 709840 - RNA, 24 nt, Human
ugauauuuuaaagcagaagcagau

SEQ ID NO: 709841 - RNA, 24 nt, Human
ugcccaaagcgcgcuacuaagaac

SEQ ID NO: 709842 - RNA, 20 nt, Human
ugcugggauacaagcacgca

SEQ ID NO: 709843 - RNA, 24 nt, Human
uggaaaaaagccacacugagccca

SEQ ID NO: 709844 - RNA, 24 nt, Human
uucuccacauguagaacuuggcag

SEQ ID NO: 709845 - RNA, 19 nt, Human
uuuucagucucaucugggu

SEQ ID NO: 709846 - RNA, 18 nt, Human
aaaaucacagccaaacca

SEQ ID NO: 709847 - RNA, 20 nt, Human
aaacagacuuugaaaaaaug

SEQ ID NO: 709848 - RNA, 24 nt, Human
aaacccaagguuaaggaccagugg

SEQ ID NO: 709849 - RNA, 26 nt, Human
aaaguccucccacugacuugcuacuc

SEQ ID NO: 709850 - RNA, 24 nt, Human
aacaaaacuuaaaaaaaguaucac

SEQ ID NO: 709851 - RNA, 18 nt, Human
aaccccugucccugccuc

SEQ ID NO: 709852 - RNA, 19 nt, Human
aaccuugccucaccucuca

SEQ ID NO: 709853 - RNA, 19 nt, Human
aagccagagcucggaggca

SEQ ID NO: 709854 - RNA, 19 nt, Human
aaggaccagugaagaauag

SEQ ID NO: 709855 - RNA, 21 nt, Human
aaggcuucuggagagacaggc

SEQ ID NO: 709856 - RNA, 19 nt, Human
acagccugagccuccauuc

SEQ ID NO: 709857 - RNA, 18 nt, Human
accaggugcuguuacaaa

SEQ ID NO: 709858 - RNA, 19 nt, Human
acccaaacagagaagccuu

SEQ ID NO: 709859 - RNA, 22 nt, Human
acgcuacccaaacagagaagcc

SEQ ID NO: 709860 - RNA, 26 nt, Human
agaaaaaagucaggcuugucuuguaa

SEQ ID NO: 709861 - RNA, 23 nt, Human
agagaagccuucuuuuuaaaacc

SEQ ID NO: 709862 - RNA, 18 nt, Human
aggaacaagugagcaucc

SEQ ID NO: 709863 - RNA, 22 nt, Human
aggcaaagcuguugccacaauc

SEQ ID NO: 709864 - RNA, 19 nt, Human
aggcaagggcuccacagug

SEQ ID NO: 709865 - RNA, 23 nt, Human
aggcuuccugucuccugucucuu

SEQ ID NO: 709866 - RNA, 21 nt, Human
aggugaggagagggcaagagg

SEQ ID NO: 709867 - RNA, 22 nt, Human
aguuagagaaauucauauucaa

SEQ ID NO: 709868 - RNA, 23 nt, Human
augcuugaaacagcaaauucaac

SEQ ID NO: 709869 - RNA, 19 nt, Human
caaaaucacagccaaacca

SEQ ID NO: 709870 - RNA, 20 nt, Human
caagauaaaaacaaaacuua

SEQ ID NO: 709871 - RNA, 24 nt, Human
caagguaaucagagaaaaaaguca

SEQ ID NO: 709872 - RNA, 21 nt, Human
cacucugcagacgucucaacc

SEQ ID NO: 709873 - RNA, 23 nt, Human
cagagcucggaggcaagggcucc

SEQ ID NO: 709874 - RNA, 19 nt, Human
cagccaugcacaugaauca

SEQ ID NO: 709875 - RNA, 18 nt, Human
cagcguauucucaaaugu

SEQ ID NO: 709876 - RNA, 18 nt, Human
cauucugcaaacaucugc

SEQ ID NO: 709877 - RNA, 19 nt, Human
cauucugucagcguuaacc

SEQ ID NO: 709878 - RNA, 23 nt, Human
ccaacaggcaagauaaaaacaaa

SEQ ID NO: 709879 - RNA, 23 nt, Human
ccaagaagagaaaacaaaacgga

SEQ ID NO: 709880 - RNA, 21 nt, Human
ccaggggugaaaaaguccucc

SEQ ID NO: 709881 - RNA, 22 nt, Human
cccagcuagagucaugggcccc

SEQ ID NO: 709882 - RNA, 22 nt, Human
cccuuacauuucagagaccccc

SEQ ID NO: 709883 - RNA, 20 nt, Human
cggcaaauccuaaauuuugc

SEQ ID NO: 709884 - RNA, 21 nt, Human
cuaaagaaucucacauuauca

SEQ ID NO: 709885 - RNA, 20 nt, Human
cuagaaucuccaucacugaa

SEQ ID NO: 709886 - RNA, 20 nt, Human
cuaggacugaccucugcgcc

SEQ ID NO: 709887 - RNA, 22 nt, Human
cucauguguucugacuucaggu

SEQ ID NO: 709888 - RNA, 23 nt, Human
cuccugaaagcagcuugagaaaa

SEQ ID NO: 709889 - RNA, 24 nt, Human
cucgggcuggcgaucgggcagccc

SEQ ID NO: 709890 - RNA, 23 nt, Human
cuggugcaucuggaaaaugaggu

SEQ ID NO: 709891 - RNA, 24 nt, Human
cugugucaguuuuucauagaacgg

SEQ ID NO: 709892 - RNA, 21 nt, Human
cuuccugucuccugucucuuc

SEQ ID NO: 709893 - RNA, 22 nt, Human
cuugaaacagcaaauucaacaa

SEQ ID NO: 709894 - RNA, 19 nt, Human
gaaaggcuucuggagagac

SEQ ID NO: 709895 - RNA, 20 nt, Human
gacaaguuaucuccauccau

SEQ ID NO: 709896 - RNA, 21 nt, Human
gacuuccagucccacaggcuc

SEQ ID NO: 709897 - RNA, 22 nt, Human
gacuugcuacuccuuagacuuc

SEQ ID NO: 709898 - RNA, 20 nt, Human
gagaaaaauaaaacagaaaa

SEQ ID NO: 709899 - RNA, 19 nt, Human
gcaaacauggccccugggc

SEQ ID NO: 709900 - RNA, 22 nt, Human
gcaaagacaggggcaagcugug

SEQ ID NO: 709901 - RNA, 19 nt, Human
ggaaugcuaaaauuauaaa

SEQ ID NO: 709902 - RNA, 22 nt, Human
ggaucuauugggaaugcuaaaa

SEQ ID NO: 709903 - RNA, 24 nt, Human
ggaugcugcuugugauuacugaga

SEQ ID NO: 709904 - RNA, 19 nt, Human
gggcagcccagggcccgac

SEQ ID NO: 709905 - RNA, 20 nt, Human
ggugaggagagggcaagagg

SEQ ID NO: 709906 - RNA, 21 nt, Human
guagagcauaaauggcacccc

SEQ ID NO: 709907 - RNA, 20 nt, Human
gugcauuguggaugguaagu

SEQ ID NO: 709908 - RNA, 21 nt, Human
uaaaacagaaaagacaaagaa

SEQ ID NO: 709909 - RNA, 23 nt, Human
uaaaacagaaaagacaaagaacc

SEQ ID NO: 709910 - RNA, 19 nt, Human
uaaaacccaagguuaagga

SEQ ID NO: 709911 - RNA, 21 nt, Human
uaaaacccaagguuaaggacc

SEQ ID NO: 709912 - RNA, 23 nt, Human
uaaaacccaagguuaaggaccag

SEQ ID NO: 709913 - RNA, 18 nt, Human
uaaagcaaaaucuuccag

SEQ ID NO: 709914 - RNA, 22 nt, Human
uaaagcaaaaucuuccagaguc

SEQ ID NO: 709915 - RNA, 24 nt, Human
uaaagcaaaaucuuccagagucuu

SEQ ID NO: 709916 - RNA, 22 nt, Human
uaaaguagaugcccagcauauu

SEQ ID NO: 709917 - RNA, 23 nt, Human
uaacacagaggucucaaaugugc

SEQ ID NO: 709918 - RNA, 20 nt, Human
uaagaacaauaaaauccuaa

SEQ ID NO: 709919 - RNA, 23 nt, Human
uaagaacaauaaaauccuaaccu

SEQ ID NO: 709920 - RNA, 20 nt, Human
uacucagcucuuacgcuacc

SEQ ID NO: 709921 - RNA, 18 nt, Human
uacuccugucagccaugc

SEQ ID NO: 709922 - RNA, 23 nt, Human
uacugugauggaacugcagaacu

SEQ ID NO: 709923 - RNA, 20 nt, Human
uagcuccaauuugacacuag

SEQ ID NO: 709924 - RNA, 21 nt, Human
uagugaaccuggagaagagcu

SEQ ID NO: 709925 - RNA, 24 nt, Human
ucaaaaccuuucagcacugguucc

SEQ ID NO: 709926 - RNA, 23 nt, Human
ucacccugcucauguguucugac

SEQ ID NO: 709927 - RNA, 20 nt, Human
uccaauuugacacuagacac

SEQ ID NO: 709928 - RNA, 24 nt, Human
uccagcaucucaguaggaacaagu

SEQ ID NO: 709929 - RNA, 22 nt, Human
ucccaagaagagaaaacaaaac

SEQ ID NO: 709930 - RNA, 20 nt, Human
ucccauucaggaugaaccuu

SEQ ID NO: 709931 - RNA, 21 nt, Human
uccccaaaguggcuaaagaau

SEQ ID NO: 709932 - RNA, 23 nt, Human
uccugcucacguucuuuucaaga

SEQ ID NO: 709933 - RNA, 24 nt, Human
uccuugcuaacuuauuaauaggag

SEQ ID NO: 709934 - RNA, 23 nt, Human
ucucaaauguauugaagccaaca

SEQ ID NO: 709935 - RNA, 20 nt, Human
ucugcaaacaucugcgaugc

SEQ ID NO: 709936 - RNA, 23 nt, Human
ucugcaaacaucugcgaugcccu

SEQ ID NO: 709937 - RNA, 24 nt, Human
ucugcaaacaucugcgaugcccuu

SEQ ID NO: 709938 - RNA, 19 nt, Human
ucugcagacgucucaaccu

SEQ ID NO: 709939 - RNA, 21 nt, Human
ucugcagacgucucaaccugg

SEQ ID NO: 709940 - RNA, 22 nt, Human
ucugcuagcuccugaaagcagc

SEQ ID NO: 709941 - RNA, 19 nt, Human
ucugucagcguuaaccuga

SEQ ID NO: 709942 - RNA, 21 nt, Human
ugaaaaaguccucccacugac

SEQ ID NO: 709943 - RNA, 23 nt, Human
ugacagaugucucccaagaagag

SEQ ID NO: 709944 - RNA, 23 nt, Human
ugagagaaaaggaggugaggaga

SEQ ID NO: 709945 - RNA, 26 nt, Human
ugagagaaaaggaggugaggagaggg

SEQ ID NO: 709946 - RNA, 19 nt, Human
ugagccuccauucugucag

SEQ ID NO: 709947 - RNA, 25 nt, Human
ugauaauaauaaaucaauucaccua

SEQ ID NO: 709948 - RNA, 19 nt, Human
ugauauuuaaucuagaauc

SEQ ID NO: 709949 - RNA, 19 nt, Human
ugcaaggaagcaguaaccu

SEQ ID NO: 709950 - RNA, 22 nt, Human
ugcacaaaaagggaaaacaccc

SEQ ID NO: 709951 - RNA, 28 nt, Human
ugcacaaaaagggaaaacacccuauuuc

SEQ ID NO: 709952 - RNA, 24 nt, Human
ugccucaccucucacccugcucau

SEQ ID NO: 709953 - RNA, 19 nt, Human
uggagagacaggcucccca

SEQ ID NO: 709954 - RNA, 18 nt, Human
uggagguccaaggugccc

SEQ ID NO: 709955 - RNA, 19 nt, Human
uggcaguggggaagaggag

SEQ ID NO: 709956 - RNA, 21 nt, Human
uggccccugggcuccaacugu

SEQ ID NO: 709957 - RNA, 23 nt, Human
uggcgacucaagucagacgaugu

SEQ ID NO: 709958 - RNA, 19 nt, Human
uggcuaaggcuggccuaca

SEQ ID NO: 709959 - RNA, 21 nt, Human
ugguagugaaccaguacuccu

SEQ ID NO: 709960 - RNA, 24 nt, Human
ugugcacaaaaagggaaaacaccc

SEQ ID NO: 709961 - RNA, 24 nt, Human
uguggaugguaaguccucgggcug

SEQ ID NO: 709962 - RNA, 19 nt, Human
uuaauacaucaaugcgagu

SEQ ID NO: 709963 - RNA, 22 nt, Human
uucagguuccagagucacugag

SEQ ID NO: 709964 - RNA, 22 nt, Human
uucauagaacggccucuuccgu

SEQ ID NO: 709965 - RNA, 20 nt, Human
uuccugguuugacagauguc

SEQ ID NO: 709966 - RNA, 21 nt, Human
uucgacuuuuuuugcaaggaa

SEQ ID NO: 709967 - RNA, 26 nt, Human
aaaaaauaaaacccaccucuucucuc

SEQ ID NO: 709968 - RNA, 21 nt, Human
aaaagugcuggugucaacaug

SEQ ID NO: 709969 - RNA, 21 nt, Human
aacagagaaaccagcccugaa

SEQ ID NO: 709970 - RNA, 20 nt, Human
aacaugcacuccagucacag

SEQ ID NO: 709971 - RNA, 19 nt, Human
aacauggagaaaccccauc

SEQ ID NO: 709972 - RNA, 20 nt, Human
aacauggagaaaccccaucu

SEQ ID NO: 709973 - RNA, 21 nt, Human
aacauggagaaaccccaucuc

SEQ ID NO: 709974 - RNA, 19 nt, Human
aaccaagccaccccauggc

SEQ ID NO: 709975 - RNA, 24 nt, Human
aaccaggagguggagguugcagug

SEQ ID NO: 709976 - RNA, 18 nt, Human
aagaaaaacaaaaagccu

SEQ ID NO: 709977 - RNA, 23 nt, Human
aagcaagaaaaacaaaaagccua

SEQ ID NO: 709978 - RNA, 24 nt, Human
aagcaagaaaaacaaaaagccuag

SEQ ID NO: 709979 - RNA, 22 nt, Human
aaguccucauagaaaagggaaa

SEQ ID NO: 709980 - RNA, 24 nt, Human
aaguggggcuuuuugcccuugggc

SEQ ID NO: 709981 - RNA, 23 nt, Human
aaucgcuugaaccaggaggugga

SEQ ID NO: 709982 - RNA, 21 nt, Human
aaugguagggacaacacugga

SEQ ID NO: 709983 - RNA, 24 nt, Human
acaaaaaaccuccacguauggcca

SEQ ID NO: 709984 - RNA, 21 nt, Human
acaaaaagccuaggguugccc

SEQ ID NO: 709985 - RNA, 24 nt, Human
acaaaauacaucuuuuguaaacaa

SEQ ID NO: 709986 - RNA, 27 nt, Human
acaaacgcagcacaaggccaacaacaa

SEQ ID NO: 709987 - RNA, 21 nt, Human
acagagaggaaacgacaugaa

SEQ ID NO: 709988 - RNA, 20 nt, Human
acaugcacuccagucacagg

SEQ ID NO: 709989 - RNA, 24 nt, Human
accagucacaugggguuugugggc

SEQ ID NO: 709990 - RNA, 20 nt, Human
acccacuguuuucagaccca

SEQ ID NO: 709991 - RNA, 24 nt, Human
accccaucucuacuaaaaauacaa

SEQ ID NO: 709992 - RNA, 24 nt, Human
acgcaguagccgcuugguggccug

SEQ ID NO: 709993 - RNA, 25 nt, Human
acuccagccugggcaacaagaguga

SEQ ID NO: 709994 - RNA, 23 nt, Human
acuggagugaagaaaccaagcca

SEQ ID NO: 709995 - RNA, 20 nt, Human
agaaaaacaaaaagccuagg

SEQ ID NO: 709996 - RNA, 21 nt, Human
agaaccacccaaccugagcuu

SEQ ID NO: 709997 - RNA, 18 nt, Human
agacaggauggaaagugg

SEQ ID NO: 709998 - RNA, 25 nt, Human
agagaaaccagcccugaaauguuua

SEQ ID NO: 709999 - RNA, 22 nt, Human
agaucacuugaggucgggaguu

SEQ ID NO: 710000 - RNA, 21 nt, Human
agcaagaaaaacaaaaagccu

SEQ ID NO: 710001 - RNA, 23 nt, Human
agccaggugugguggcaggcgcc

SEQ ID NO: 710002 - RNA, 26 nt, Human
aggccugagaaucgcuugaaccagga

SEQ ID NO: 710003 - RNA, 21 nt, Human
aggcgccuguaaucccaacua

SEQ ID NO: 710004 - RNA, 21 nt, Human
aggcgggcagaucacuugagg

SEQ ID NO: 710005 - RNA, 22 nt, Human
aggcgggcagaucacuugaggg

SEQ ID NO: 710006 - RNA, 23 nt, Human
aggcgggcagaucacuugagguc

SEQ ID NO: 710007 - RNA, 26 nt, Human
aggcgggcagaucacuugaggucggg

SEQ ID NO: 710008 - RNA, 23 nt, Human
aggcuggcuuugcugcuggagag

SEQ ID NO: 710009 - RNA, 22 nt, Human
agguccaccuuauucucuggug

SEQ ID NO: 710010 - RNA, 21 nt, Human
agguggagguugcagugagcc

SEQ ID NO: 710011 - RNA, 24 nt, Human
agguggagguugcagugagccgag

SEQ ID NO: 710012 - RNA, 24 nt, Human
aggugugguggcaggcgccuguaa

SEQ ID NO: 710013 - RNA, 21 nt, Human
agugaagaaaccaagccaccc

SEQ ID NO: 710014 - RNA, 24 nt, Human
auggugccauugcacuccagccug

SEQ ID NO: 710015 - RNA, 24 nt, Human
auugcacuccagccugggcaacaa

SEQ ID NO: 710016 - RNA, 20 nt, Human
auugcacugucagaucugaa

SEQ ID NO: 710017 - RNA, 24 nt, Human
caaaaacaacaacaaaaaaccucc

SEQ ID NO: 710018 - RNA, 25 nt, Human
caaaaacaacaacaaaaaaccucca

SEQ ID NO: 710019 - RNA, 18 nt, Human
caacaacaaaaaaccucc

SEQ ID NO: 710020 - RNA, 22 nt, Human
caacaacaaaaaaccuccacgu

SEQ ID NO: 710021 - RNA, 24 nt, Human
caacaacaaaaaggaauaaaagca

SEQ ID NO: 710022 - RNA, 21 nt, Human
caagccccaggcuggcuuugc

SEQ ID NO: 710023 - RNA, 24 nt, Human
caaggcgggcagaucacuugaggu

SEQ ID NO: 710024 - RNA, 21 nt, Human
caccuuauucucuggugucca

SEQ ID NO: 710025 - RNA, 24 nt, Human
cacgccuguaaucccagcacuuug

SEQ ID NO: 710026 - RNA, 23 nt, Human
cacuccagccugggcaacaagag

SEQ ID NO: 710027 - RNA, 23 nt, Human
cacuccagccugggcaacaagag

SEQ ID NO: 710028 - RNA, 25 nt, Human
cacuccagccugggcaacaagagug

SEQ ID NO: 710029 - RNA, 19 nt, Human
cacuggagugaagaaacca

SEQ ID NO: 710030 - RNA, 22 nt, Human
cagacccacuguagaggccaca

SEQ ID NO: 710031 - RNA, 20 nt, Human
cagagauggcuauaaacacc

SEQ ID NO: 710032 - RNA, 24 nt, Human
cagaucacuugaggucgggaguuu

SEQ ID NO: 710033 - RNA, 20 nt, Human
cagcacaaggccaacaacaa

SEQ ID NO: 710034 - RNA, 22 nt, Human
cagcacaaggccaacaacaaaa

SEQ ID NO: 710035 - RNA, 24 nt, Human
cagcacuuugggaggccaaggcgg

SEQ ID NO: 710036 - RNA, 20 nt, Human
cagcagaaccugugucaagu

SEQ ID NO: 710037 - RNA, 25 nt, Human
cagcagugacaacucagcagaaccu

SEQ ID NO: 710038 - RNA, 22 nt, Human
cagcccagguccuauuccaucc

SEQ ID NO: 710039 - RNA, 24 nt, Human
cagccugaccaacauggagaaacc

SEQ ID NO: 710040 - RNA, 29 nt, Human
caggagguggagguugcagugacaacggu

SEQ ID NO: 710041 - RNA, 24 nt, Human
caggagguggagguugcagugagc

SEQ ID NO: 710042 - RNA, 20 nt, Human
caggauggaaaguggaggca

SEQ ID NO: 710043 - RNA, 23 nt, Human
cagucacaggggggagaaagccc

SEQ ID NO: 710044 - RNA, 25 nt, Human
cauccuguucaguauccuccucacu

SEQ ID NO: 710045 - RNA, 19 nt, Human
caugcaagccccaggcugg

SEQ ID NO: 710046 - RNA, 19 nt, Human
cauugcacuccagccuggg

SEQ ID NO: 710047 - RNA, 21 nt, Human
cauugcacuccagccugggca

SEQ ID NO: 710048 - RNA, 22 nt, Human
cauugcacuccagccugggcaa

SEQ ID NO: 710049 - RNA, 24 nt, Human
cauugcacuccagccugggcaaca

SEQ ID NO: 710050 - RNA, 21 nt, Human
ccacccaaccugagcuuggca

SEQ ID NO: 710051 - RNA, 27 nt, Human
ccaccucuucucucuucucaauagaaa

SEQ ID NO: 710052 - RNA, 20 nt, Human
ccaggagguggagguugcag

SEQ ID NO: 710053 - RNA, 20 nt, Human
ccauugcacuccagccuggg

SEQ ID NO: 710054 - RNA, 21 nt, Human
ccauugcacuccagccugggc

SEQ ID NO: 710055 - RNA, 23 nt, Human
ccauugcacuccagccugggcaa

SEQ ID NO: 710056 - RNA, 24 nt, Human
ccauugcacuccagccugggcaac

SEQ ID NO: 710057 - RNA, 18 nt, Human
ccccauggcugucccagg

SEQ ID NO: 710058 - RNA, 21 nt, Human
cccuccccgcuccacuuucuc

SEQ ID NO: 710059 - RNA, 20 nt, Human
cccuugggcaucagcauggg

SEQ ID NO: 710060 - RNA, 19 nt, Human
ccuacaacuaucugaagag

SEQ ID NO: 710061 - RNA, 24 nt, Human
ccugaccaacauggagaaacccca

SEQ ID NO: 710062 - RNA, 22 nt, Human
ccuuuaugcucuggguccuuca

SEQ ID NO: 710063 - RNA, 24 nt, Human
cgagauggugccauugcacuccag

SEQ ID NO: 710064 - RNA, 22 nt, Human
cgcaguagccgcuugguggccu

SEQ ID NO: 710065 - RNA, 23 nt, Human
cgccuguaaucccaacuacuugg

SEQ ID NO: 710066 - RNA, 24 nt, Human
cgccuguaaucccaacuacuuggg

SEQ ID NO: 710067 - RNA, 24 nt, Human
cgccuguaaucccagcacuuuggg

SEQ ID NO: 710068 - RNA, 18 nt, Human
cggauuccugagguccac

SEQ ID NO: 710069 - RNA, 21 nt, Human
cggccuuguuggauugaagau

SEQ ID NO: 710070 - RNA, 18 nt, Human
cgggcagaucacuugagg

SEQ ID NO: 710071 - RNA, 22 nt, Human
cuaagcaccagaauuggauaug

SEQ ID NO: 710072 - RNA, 19 nt, Human
cucaaaaacaacaacaaaa

SEQ ID NO: 710073 - RNA, 22 nt, Human
cucacgccuguaaucccagcac

SEQ ID NO: 710074 - RNA, 24 nt, Human
cucacgccuguaaucccagcacuu

SEQ ID NO: 710075 - RNA, 24 nt, Human
cucugccgggugcgguggcucacg

SEQ ID NO: 710076 - RNA, 20 nt, Human
cuggccuuaagugcacagaa

SEQ ID NO: 710077 - RNA, 21 nt, Human
gaagaugaccagcccaggucc

SEQ ID NO: 710078 - RNA, 22 nt, Human
gagcagcagugacaacucagca

SEQ ID NO: 710079 - RNA, 25 nt, Human
gagcagcagugacaacucagcagaa

SEQ ID NO: 710080 - RNA, 21 nt, Human
gagguugcagugagccgagau

SEQ ID NO: 710081 - RNA, 24 nt, Human
gaucacuugaggucgggaguuuga

SEQ ID NO: 710082 - RNA, 19 nt, Human
gcacagaaccacccaaccu

SEQ ID NO: 710083 - RNA, 19 nt, Human
gcagcacaaggccaacaac

SEQ ID NO: 710084 - RNA, 22 nt, Human
gccauugcacuccagccugggc

SEQ ID NO: 710085 - RNA, 24 nt, Human
gccauugcacuccagccugggcaa

SEQ ID NO: 710086 - RNA, 21 nt, Human
gcucuggguccuucaaaccag

SEQ ID NO: 710087 - RNA, 18 nt, Human
ggagguugcagugagccg

SEQ ID NO: 710088 - RNA, 20 nt, Human
ggagguugcagugagccgag

SEQ ID NO: 710089 - RNA, 22 nt, Human
ggagguugcagugagccgagau

SEQ ID NO: 710090 - RNA, 24 nt, Human
ggagguugcagugagccgagaugg

SEQ ID NO: 710091 - RNA, 19 nt, Human
ggaguuugagaccagccug

SEQ ID NO: 710092 - RNA, 22 nt, Human
ggauucccuccccgcuccacuu

SEQ ID NO: 710093 - RNA, 25 nt, Human
ggcagaucacuugaggucgggaguu

SEQ ID NO: 710094 - RNA, 24 nt, Human
ggcgccuguaaucccaacuacuug

SEQ ID NO: 710095 - RNA, 21 nt, Human
ggcucacgccuguaaucccag

SEQ ID NO: 710096 - RNA, 21 nt, Human
ggggcuuuuugcccuugggca

SEQ ID NO: 710097 - RNA, 24 nt, Human
gggugcgguggcucacgccuguaa

SEQ ID NO: 710098 - RNA, 20 nt, Human
ggucaccccugccugccacc

SEQ ID NO: 710099 - RNA, 19 nt, Human
ggucgggaguuugagacca

SEQ ID NO: 710100 - RNA, 23 nt, Human
gguggcucacgccuguaauccca

SEQ ID NO: 710101 - RNA, 24 nt, Human
gguggcucacgccuguaaucccag

SEQ ID NO: 710102 - RNA, 22 nt, Human
gucacaggggggagaaagccca

SEQ ID NO: 710103 - RNA, 23 nt, Human
gucauugugcagggcaggaaaag

SEQ ID NO: 710104 - RNA, 21 nt, Human
gucccuguuccuaagcaccag

SEQ ID NO: 710105 - RNA, 23 nt, Human
gugaccacuggccuuaagugcac

SEQ ID NO: 710106 - RNA, 21 nt, Human
guggccuguuacucagggcgc

SEQ ID NO: 710107 - RNA, 18 nt, Human
guggugguuggaauguca

SEQ ID NO: 710108 - RNA, 23 nt, Human
guucacuuccuuaaaggaagugg

SEQ ID NO: 710109 - RNA, 24 nt, Human
guugcagugagccgagauggugcc

SEQ ID NO: 710110 - RNA, 20 nt, Human
uaaaaauacaaaauuagcca

SEQ ID NO: 710111 - RNA, 22 nt, Human
uaaaaauacaaaauuagccagg

SEQ ID NO: 710112 - RNA, 23 nt, Human
uaaaaauacaaaauuagccaggu

SEQ ID NO: 710113 - RNA, 19 nt, Human
uaaaacaaggguuugugac

SEQ ID NO: 710114 - RNA, 23 nt, Human
uaaaagcaagaaaaacaaaaagc

SEQ ID NO: 710115 - RNA, 21 nt, Human
uaaacaaacgcagcacaaggc

SEQ ID NO: 710116 - RNA, 20 nt, Human
uaagcuaggauucccucccc

SEQ ID NO: 710117 - RNA, 25 nt, Human
uacagcacagaaccacccaaccuga

SEQ ID NO: 710118 - RNA, 19 nt, Human
uacaguggcagccuccgag

SEQ ID NO: 710119 - RNA, 20 nt, Human
uaccuuccuugcccaggaac

SEQ ID NO: 710120 - RNA, 22 nt, Human
uagaaaauggugcagaagagac

SEQ ID NO: 710121 - RNA, 21 nt, Human
uauaaacaccccacucuuccu

SEQ ID NO: 710122 - RNA, 20 nt, Human
ucaaaaggaaaaaaauaaaa

SEQ ID NO: 710123 - RNA, 25 nt, Human
ucaacaugcaagccccaggcuggcu

SEQ ID NO: 710124 - RNA, 21 nt, Human
ucacccaacgcugccccaaau

SEQ ID NO: 710125 - RNA, 18 nt, Human
ucagucucaaaaacaaca

SEQ ID NO: 710126 - RNA, 23 nt, Human
ucagucucaaaaacaacaacaaa

SEQ ID NO: 710127 - RNA, 21 nt, Human
ucauuauaaaacucugccggg

SEQ ID NO: 710128 - RNA, 22 nt, Human
uccacacgucuguccuauugca

SEQ ID NO: 710129 - RNA, 24 nt, Human
uccagagauggcuauaaacacccc

SEQ ID NO: 710130 - RNA, 19 nt, Human
uccauacagcacagaacca

SEQ ID NO: 710131 - RNA, 22 nt, Human
uccauccauacagcacagaacc

SEQ ID NO: 710132 - RNA, 22 nt, Human
uccuaccuuccuugcccaggaa

SEQ ID NO: 710133 - RNA, 19 nt, Human
uccucauagaaaagggaaa

SEQ ID NO: 710134 - RNA, 23 nt, Human
ucgcuugaaccaggagguggagg

SEQ ID NO: 710135 - RNA, 22 nt, Human
ucuacccaagaaauggcuuacu

SEQ ID NO: 710136 - RNA, 20 nt, Human
ucucuacuaaaaauacaaaa

SEQ ID NO: 710137 - RNA, 18 nt, Human
ucugguguagaaaauggu

SEQ ID NO: 710138 - RNA, 22 nt, Human
ucugguguagaaaauggugcag

SEQ ID NO: 710139 - RNA, 19 nt, Human
ucuuuggcuucucuuuugu

SEQ ID NO: 710140 - RNA, 22 nt, Human
ucuuuuccggauuccugagguc

SEQ ID NO: 710141 - RNA, 24 nt, Human
ugagaccagccugaccaacaugga

SEQ ID NO: 710142 - RNA, 23 nt, Human
ugagagaccuuuaugcucugggu

SEQ ID NO: 710143 - RNA, 22 nt, Human
ugagccgagauggugccauugc

SEQ ID NO: 710144 - RNA, 21 nt, Human
ugagcuuggcaacuacagugg

SEQ ID NO: 710145 - RNA, 18 nt, Human
ugagggccagcaggucac

SEQ ID NO: 710146 - RNA, 18 nt, Human
ugaggucgggaguuugag

SEQ ID NO: 710147 - RNA, 23 nt, Human
ugaguaguucuuauaacagucca

SEQ ID NO: 710148 - RNA, 20 nt, Human
ugagucuggagcagcaguga

SEQ ID NO: 710149 - RNA, 19 nt, Human
ugagugaacugggaaaacu

SEQ ID NO: 710150 - RNA, 19 nt, Human
ugcacuccagccugggcaa

SEQ ID NO: 710151 - RNA, 22 nt, Human
ugcacuccagccugggcaacaa

SEQ ID NO: 710152 - RNA, 20 nt, Human
ugcagaaaaagugcuggugu

SEQ ID NO: 710153 - RNA, 24 nt, Human
ugccauugcacuccagccugggca

SEQ ID NO: 710154 - RNA, 18 nt, Human
uggaaaguggaggcagca

SEQ ID NO: 710155 - RNA, 25 nt, Human
uggaaucaaaaggaaaaaaauaaaa

SEQ ID NO: 710156 - RNA, 18 nt, Human
uggagagaagucuggcca

SEQ ID NO: 710157 - RNA, 23 nt, Human
uggagaggaguuuccuccucuac

SEQ ID NO: 710158 - RNA, 20 nt, Human
uggauaugaacagagaaacc

SEQ ID NO: 710159 - RNA, 21 nt, Human
uggcaagggcagacccacugu

SEQ ID NO: 710160 - RNA, 23 nt, Human
uggcagccuccgagccuagagug

SEQ ID NO: 710161 - RNA, 21 nt, Human
uggccccaagguccugcuugu

SEQ ID NO: 710162 - RNA, 22 nt, Human
uggcucacgccuguaaucccag

SEQ ID NO: 710163 - RNA, 24 nt, Human
uggcucacgccuguaaucccagca

SEQ ID NO: 710164 - RNA, 21 nt, Human
uggcugguggugguuggaaug

SEQ ID NO: 710165 - RNA, 18 nt, Human
uggcuguaaugucuggcu

SEQ ID NO: 710166 - RNA, 20 nt, Human
ugggaaaacugcucuuuggc

SEQ ID NO: 710167 - RNA, 20 nt, Human
ugggaagcugaggccugagg

SEQ ID NO: 710168 - RNA, 18 nt, Human
ugggagaaaagauuggaa

SEQ ID NO: 710169 - RNA, 24 nt, Human
ugggaggccaaggcgggcagauca

SEQ ID NO: 710170 - RNA, 22 nt, Human
ugguagggacaacacuggagug

SEQ ID NO: 710171 - RNA, 25 nt, Human
uggugcagaagagacugcggccggu

SEQ ID NO: 710172 - RNA, 24 nt, Human
ugguggcaggcgccuguaauccca

SEQ ID NO: 710173 - RNA, 25 nt, Human
uguaaacaaacgcagcacaaggcca

SEQ ID NO: 710174 - RNA, 19 nt, Human
uguaagcuucucagucuuu

SEQ ID NO: 710175 - RNA, 19 nt, Human
ugugcagaaaaagugcugg

SEQ ID NO: 710176 - RNA, 20 nt, Human
ugugcagaaaaagugcuggu

SEQ ID NO: 710177 - RNA, 22 nt, Human
ugugggcacuaucugcagaccc

SEQ ID NO: 710178 - RNA, 19 nt, Human
uuaaaggaaguggggcuuu

SEQ ID NO: 710179 - RNA, 25 nt, Human
uucagacccagacaggauggaaagu

SEQ ID NO: 710180 - RNA, 23 nt, Human
uugaaccaggagguggagguugc

SEQ ID NO: 710181 - RNA, 18 nt, Human
uugcagugagccgagaug

SEQ ID NO: 710182 - RNA, 22 nt, Human
uugcagugagccgagauggugc

SEQ ID NO: 710183 - RNA, 24 nt, Human
uugggaagcugaggccugagaauc

SEQ ID NO: 710184 - RNA, 21 nt, Human
uugggcaucagcauggguccc

SEQ ID NO: 710185 - RNA, 18 nt, Human
uuugcuaccacugucaaa

SEQ ID NO: 710186 - RNA, 19 nt, Human
uuuuccggauuccugaggu

SEQ ID NO: 710187 - RNA, 18 nt, Human
uuuuuuguuuuagguucc

SEQ ID NO: 710188 - RNA, 19 nt, Human
aaaagaccccuccgccccu

SEQ ID NO: 710189 - RNA, 20 nt, Human
aagagaaaagggguagguag

SEQ ID NO: 710190 - RNA, 20 nt, Human
aagaggccagaagcggccca

SEQ ID NO: 710191 - RNA, 22 nt, Human
acuguagucuaaagggcaagag

SEQ ID NO: 710192 - RNA, 20 nt, Human
agagaaaagggguagguagg

SEQ ID NO: 710193 - RNA, 19 nt, Human
agagggcagacauccaagc

SEQ ID NO: 710194 - RNA, 19 nt, Human
aggaaagaagaaggaaaag

SEQ ID NO: 710195 - RNA, 23 nt, Human
aggcacagggcaaguuucuguaa

SEQ ID NO: 710196 - RNA, 23 nt, Human
aggccagaagcggcccagaggga

SEQ ID NO: 710197 - RNA, 19 nt, Human
aggggacaaggaaagguag

SEQ ID NO: 710198 - RNA, 21 nt, Human
aggggacaaggaaagguagga

SEQ ID NO: 710199 - RNA, 21 nt, Human
caaggcaggcagccauggucc

SEQ ID NO: 710200 - RNA, 18 nt, Human
cacagaccucugcccauc

SEQ ID NO: 710201 - RNA, 22 nt, Human
cacagaccucugcccauccccu

SEQ ID NO: 710202 - RNA, 18 nt, Human
cagcgaguccccgcagcc

SEQ ID NO: 710203 - RNA, 25 nt, Human
cagcucugaaaagagaaggggcaau

SEQ ID NO: 710204 - RNA, 20 nt, Human
ccagaccaaacacagaccuc

SEQ ID NO: 710205 - RNA, 22 nt, Human
ccagcccaggggacaaggaaag

SEQ ID NO: 710206 - RNA, 23 nt, Human
ccccuuggccuuuggcccauggc

SEQ ID NO: 710207 - RNA, 19 nt, Human
cccgcagccucacucgcca

SEQ ID NO: 710208 - RNA, 21 nt, Human
cccuccgcugcucagcgaguc

SEQ ID NO: 710209 - RNA, 19 nt, Human
cccuuggccuuuggcccau

SEQ ID NO: 710210 - RNA, 22 nt, Human
ccuacggcacggcacggccggg

SEQ ID NO: 710211 - RNA, 20 nt, Human
ccuuuggcccauggcuccaa

SEQ ID NO: 710212 - RNA, 19 nt, Human
cgccugggcaugcugggaa

SEQ ID NO: 710213 - RNA, 20 nt, Human
cggcccagagggagcuaugg

SEQ ID NO: 710214 - RNA, 21 nt, Human
cugugcagccagcccagggga

SEQ ID NO: 710215 - RNA, 21 nt, Human
cuuggccuuuggcccauggcc

SEQ ID NO: 710216 - RNA, 19 nt, Human
gagcuaugguuccucccca

SEQ ID NO: 710217 - RNA, 20 nt, Human
gcagccagcccaggggacaa

SEQ ID NO: 710218 - RNA, 20 nt, Human
gcccauggcuccaagaggcc

SEQ ID NO: 710219 - RNA, 21 nt, Human
gggccagcucugaaaagagaa

SEQ ID NO: 710220 - RNA, 21 nt, Human
ggggaacugggccagaccaaa

SEQ ID NO: 710221 - RNA, 19 nt, Human
uaugguuccuccccaaggc

SEQ ID NO: 710222 - RNA, 22 nt, Human
uccaagaggccagaagcggccc

SEQ ID NO: 710223 - RNA, 26 nt, Human
uccccuuggccuuuggcccauggcuc

SEQ ID NO: 710224 - RNA, 22 nt, Human
uccgcugcucagcgaguccccg

SEQ ID NO: 710225 - RNA, 23 nt, Human
uccucugugcagccagcccaggg

SEQ ID NO: 710226 - RNA, 21 nt, Human
ucugugcagccagcccagggg

SEQ ID NO: 710227 - RNA, 26 nt, Human
ugggagcccugcgauccgauguggcg

SEQ ID NO: 710228 - RNA, 19 nt, Human
ugggggacacaggcacagg

SEQ ID NO: 710229 - RNA, 25 nt, Human
ugggggacacaggcacagggcaagg

SEQ ID NO: 710230 - RNA, 19 nt, Human
ugggguagagggcagacau

SEQ ID NO: 710231 - RNA, 18 nt, Human
aaauacuguaucuuugaa

SEQ ID NO: 710232 - RNA, 22 nt, Human
caaguacauuaaaacaaaucuu

SEQ ID NO: 710233 - RNA, 18 nt, Human
ccacagguaaagguccaa

SEQ ID NO: 710234 - RNA, 23 nt, Human
cuccugggacaccgccacugcuu

SEQ ID NO: 710235 - RNA, 21 nt, Human
cuuuaauaaaaaauacaaaaa

SEQ ID NO: 710236 - RNA, 24 nt, Human
gaguucuguuuuuuccgguuccuc

SEQ ID NO: 710237 - RNA, 20 nt, Human
ggccaguguugccuccacag

SEQ ID NO: 710238 - RNA, 21 nt, Human
ucaagauagacucuuucaaac

SEQ ID NO: 710239 - RNA, 22 nt, Human
ucuaagacuuuccucuucuugg

SEQ ID NO: 710240 - RNA, 23 nt, Human
ugccuccacagguaaagggggaa

SEQ ID NO: 710241 - RNA, 22 nt, Human
uuggccaguguugccuccacag

SEQ ID NO: 710242 - RNA, 19 nt, Human
aaacaaacaggcacguugg

SEQ ID NO: 710243 - RNA, 24 nt, Human
acccccucugcccuccccucuccu

SEQ ID NO: 710244 - RNA, 19 nt, Human
aggcacguugguaguuggc

SEQ ID NO: 710245 - RNA, 22 nt, Human
aguacccucacccccucugccc

SEQ ID NO: 710246 - RNA, 19 nt, Human
cagaauaguacccucaccc

SEQ ID NO: 710247 - RNA, 21 nt, Human
cccucacccccucugcccucc

SEQ ID NO: 710248 - RNA, 18 nt, Human
ccuccugcugcugacuuc

SEQ ID NO: 710249 - RNA, 20 nt, Human
ccuccugcugcugacuucuc

SEQ ID NO: 710250 - RNA, 19 nt, Human
cucacccccucugcccucc

SEQ ID NO: 710251 - RNA, 19 nt, Human
cuccuagauggucaccaua

SEQ ID NO: 710252 - RNA, 18 nt, Human
gaaguucuucaagggcac

SEQ ID NO: 710253 - RNA, 20 nt, Human
gagacgccugagcgccguaa

SEQ ID NO: 710254 - RNA, 18 nt, Human
gauuaggaaguucuucaa

SEQ ID NO: 710255 - RNA, 22 nt, Human
uauaaagaauggauauagguuu

SEQ ID NO: 710256 - RNA, 19 nt, Human
uauagguuuucucaauccu

SEQ ID NO: 710257 - RNA, 24 nt, Human
uauauacauuuauaaguguacaua

SEQ ID NO: 710258 - RNA, 21 nt, Human
uaugauggagagaaggaaaga

SEQ ID NO: 710259 - RNA, 24 nt, Human
uaugauguauuuuauguacaugga

SEQ ID NO: 710260 - RNA, 18 nt, Human
ucaauccagaauaguacc

SEQ ID NO: 710261 - RNA, 22 nt, Human
ugagcacggagcuucagggcgc

SEQ ID NO: 710262 - RNA, 23 nt, Human
ugcugcugacuucuccauaguga

SEQ ID NO: 710263 - RNA, 20 nt, Human
uggaaaauuuucuacaagag

SEQ ID NO: 710264 - RNA, 24 nt, Human
uguacauaugauguauuuuaugua

SEQ ID NO: 710265 - RNA, 18 nt, Human
uuccuuggcgucuccuga

SEQ ID NO: 710266 - RNA, 21 nt, Human
aaagcuccagcucuaccuucc

SEQ ID NO: 710267 - RNA, 21 nt, Human
accuuccccugaccccaaguc

SEQ ID NO: 710268 - RNA, 20 nt, Human
agcaagggacgcggcacaga

SEQ ID NO: 710269 - RNA, 21 nt, Human
caagggacgcggcacagacgc

SEQ ID NO: 710270 - RNA, 22 nt, Human
ccucagaaguccaccggggucc

SEQ ID NO: 710271 - RNA, 22 nt, Human
uaaaagcuccagcucuaccuuc

SEQ ID NO: 710272 - RNA, 22 nt, Human
uccccugaccccaagucuaggg

SEQ ID NO: 710273 - RNA, 23 nt, Human
ucuguaaaagcuccagcucuacc

SEQ ID NO: 710274 - RNA, 22 nt, Human
aaaaaaaaaccccacaucucag

SEQ ID NO: 710275 - RNA, 18 nt, Human
aaaaacacaaaaaauggc

SEQ ID NO: 710276 - RNA, 22 nt, Human
aaagaaaauaauuuaaaaacac

SEQ ID NO: 710277 - RNA, 19 nt, Human
aacuuaauaaaaagaacau

SEQ ID NO: 710278 - RNA, 22 nt, Human
aagaauacagggaaaaaacagc

SEQ ID NO: 710279 - RNA, 24 nt, Human
aagccuuauuagucucucaacgau

SEQ ID NO: 710280 - RNA, 20 nt, Human
aagugaucaguauucuggaa

SEQ ID NO: 710281 - RNA, 23 nt, Human
aaugauaagugaacugaaaaaaa

SEQ ID NO: 710282 - RNA, 20 nt, Human
aauuacaaaauuuccacaaa

SEQ ID NO: 710283 - RNA, 26 nt, Human
acacaaugauguuguguaaaagguua

SEQ ID NO: 710284 - RNA, 18 nt, Human
acagauggguauucucca

SEQ ID NO: 710285 - RNA, 21 nt, Human
accaaaaacuccagucugugg

SEQ ID NO: 710286 - RNA, 18 nt, Human
agaaaccaccaaaaugau

SEQ ID NO: 710287 - RNA, 21 nt, Human
agagccugaagugaggacuag

SEQ ID NO: 710288 - RNA, 20 nt, Human
agauuuauggcccacagccc

SEQ ID NO: 710289 - RNA, 18 nt, Human
agcagcuuguuguagacg

SEQ ID NO: 710290 - RNA, 24 nt, Human
aggaagacuguacaggguguguug

SEQ ID NO: 710291 - RNA, 19 nt, Human
aggcccccgggccacagcu

SEQ ID NO: 710292 - RNA, 20 nt, Human
aggcccccgggccacagcuc

SEQ ID NO: 710293 - RNA, 23 nt, Human
agggaaaaaacagccagucaggg

SEQ ID NO: 710294 - RNA, 25 nt, Human
agucauucagcauguagauacuaaa

SEQ ID NO: 710295 - RNA, 21 nt, Human
agucugugggaagugcacaga

SEQ ID NO: 710296 - RNA, 29 nt, Human
caaaauuuccacaaacacagcagucuucc

SEQ ID NO: 710297 - RNA, 18 nt, Human
cacagacuucacuucugu

SEQ ID NO: 710298 - RNA, 22 nt, Human
caccaaaaacuccagucugugg

SEQ ID NO: 710299 - RNA, 25 nt, Human
caccaaaaacuccagucugugggaa

SEQ ID NO: 710300 - RNA, 25 nt, Human
caccaaacccccaauuuuuuagcaa

SEQ ID NO: 710301 - RNA, 21 nt, Human
cacuuccggacaaguugggaa

SEQ ID NO: 710302 - RNA, 21 nt, Human
cauaggcaaacaugugguguu

SEQ ID NO: 710303 - RNA, 21 nt, Human
ccacaaacacagcagucuucc

SEQ ID NO: 710304 - RNA, 22 nt, Human
ccacagccccuauuaccaccua

SEQ ID NO: 710305 - RNA, 23 nt, Human
ccagaagaggcccccgggccaca

SEQ ID NO: 710306 - RNA, 24 nt, Human
ccaugaucauacuggguaauuauu

SEQ ID NO: 710307 - RNA, 20 nt, Human
cccacagccccuauuaccac

SEQ ID NO: 710308 - RNA, 21 nt, Human
cccucuuuuccuucccucuuc

SEQ ID NO: 710309 - RNA, 21 nt, Human
ccucaaaaaaaaaaagugauc

SEQ ID NO: 710310 - RNA, 21 nt, Human
ccugguccagaagaggccccc

SEQ ID NO: 710311 - RNA, 21 nt, Human
cugaaaaaaaaaaaaccccac

SEQ ID NO: 710312 - RNA, 22 nt, Human
cuggcucuauucagcaccaaaa

SEQ ID NO: 710313 - RNA, 25 nt, Human
cuuaauaaaaagaacaugaucuucu

SEQ ID NO: 710314 - RNA, 21 nt, Human
gaaaaaacagccagucagggg

SEQ ID NO: 710315 - RNA, 19 nt, Human
gacuugcccucuuuuccuu

SEQ ID NO: 710316 - RNA, 23 nt, Human
gaggcccccgggccacagcucuu

SEQ ID NO: 710317 - RNA, 18 nt, Human
gaggguguggaauuuuug

SEQ ID NO: 710318 - RNA, 20 nt, Human
gcccucuuuuccuucccucu

SEQ ID NO: 710319 - RNA, 21 nt, Human
gugaacugaaaaaaaaaaaac

SEQ ID NO: 710320 - RNA, 19 nt, Human
guuguagacgaucuccuuc

SEQ ID NO: 710321 - RNA, 22 nt, Human
uaaaaagaacaugaucuucuuu

SEQ ID NO: 710322 - RNA, 19 nt, Human
uaaaaauauacuguagugu

SEQ ID NO: 710323 - RNA, 20 nt, Human
uaacaagauaaagaaaauaa

SEQ ID NO: 710324 - RNA, 22 nt, Human
uaacacagaaaccaccaaaaug

SEQ ID NO: 710325 - RNA, 30 nt, Human
uacaaagcccaaaaucacuauaauaaagag

SEQ ID NO: 710326 - RNA, 26 nt, Human
uacacacaacaaucagauuucuucac

SEQ ID NO: 710327 - RNA, 21 nt, Human
uaccuuucacucuauaaacuu

SEQ ID NO: 710328 - RNA, 21 nt, Human
uagguucaggacuugcccucu

SEQ ID NO: 710329 - RNA, 20 nt, Human
uauuaccaccuaaauccagc

SEQ ID NO: 710330 - RNA, 18 nt, Human
ucaacccagaagauaccu

SEQ ID NO: 710331 - RNA, 24 nt, Human
ucagcaccaaaaacuccagucugu

SEQ ID NO: 710332 - RNA, 22 nt, Human
ucauaggcaaacaugugguguu

SEQ ID NO: 710333 - RNA, 22 nt, Human
uccacaaacacagcagucuucc

SEQ ID NO: 710334 - RNA, 24 nt, Human
uccacaaacacagcagucuuccau

SEQ ID NO: 710335 - RNA, 19 nt, Human
ucuacaguuuauacacucu

SEQ ID NO: 710336 - RNA, 20 nt, Human
ucuccagacccaagguucuc

SEQ ID NO: 710337 - RNA, 23 nt, Human
ugaaaaaaaaaaaaccccacauc

SEQ ID NO: 710338 - RNA, 26 nt, Human
ugaaaaaaaaaaaaccccacaucuca

SEQ ID NO: 710339 - RNA, 18 nt, Human
ugaaaagagccugaagug

SEQ ID NO: 710340 - RNA, 22 nt, Human
ugaacugaaaaaaaaaaaaccc

SEQ ID NO: 710341 - RNA, 24 nt, Human
ugaacugaaaaaaaaaaaacccca

SEQ ID NO: 710342 - RNA, 19 nt, Human
ugagagcucagcagaggca

SEQ ID NO: 710343 - RNA, 21 nt, Human
ugcauuugaucugggccagcu

SEQ ID NO: 710344 - RNA, 22 nt, Human
ugccucaaaaaaaaaaagugau

SEQ ID NO: 710345 - RNA, 23 nt, Human
uggaauuuuugaugaaaagagcc

SEQ ID NO: 710346 - RNA, 22 nt, Human
uguagauacuaaaaauauacug

SEQ ID NO: 710347 - RNA, 21 nt, Human
ugugcuuaggucuguauucag

SEQ ID NO: 710348 - RNA, 27 nt, Human
uguggaaugcagacuaacgagaucuaa

SEQ ID NO: 710349 - RNA, 23 nt, Human
uguuguagacgaucuccuucugc

SEQ ID NO: 710350 - RNA, 20 nt, Human
uguuguugcuguuuauuuuu

SEQ ID NO: 710351 - RNA, 21 nt, Human
uuaaacuaguuacacaacuga

SEQ ID NO: 710352 - RNA, 21 nt, Human
uuuccacaaacacagcagucu

SEQ ID NO: 710353 - RNA, 21 nt, Human
aacucccuccuucccacccug

SEQ ID NO: 710354 - RNA, 18 nt, Human
aagagggcucccaggauc

SEQ ID NO: 710355 - RNA, 23 nt, Human
aagcuacugcccagcucccccuc

SEQ ID NO: 710356 - RNA, 20 nt, Human
aaggaaaugggagugaccac

SEQ ID NO: 710357 - RNA, 24 nt, Human
aaggagacaagaaaauggucucca

SEQ ID NO: 710358 - RNA, 24 nt, Human
acaaccacaggugcccacccccac

SEQ ID NO: 710359 - RNA, 27 nt, Human
acaaccacaggugcccacccccacccc

SEQ ID NO: 710360 - RNA, 19 nt, Human
accacuuaacgacaaacaa

SEQ ID NO: 710361 - RNA, 20 nt, Human
agacaagaaaauggucucca

SEQ ID NO: 710362 - RNA, 20 nt, Human
agagaacagcagagcccaca

SEQ ID NO: 710363 - RNA, 18 nt, Human
agaguuugcccaaacucc

SEQ ID NO: 710364 - RNA, 26 nt, Human
agccagcacugugggccccaggugga

SEQ ID NO: 710365 - RNA, 19 nt, Human
aggaagggaaaggguagua

SEQ ID NO: 710366 - RNA, 23 nt, Human
agggggaagaagccagcacugug

SEQ ID NO: 710367 - RNA, 21 nt, Human
agucccacgugcccuaggcac

SEQ ID NO: 710368 - RNA, 20 nt, Human
caaaccccuggagguacccu

SEQ ID NO: 710369 - RNA, 21 nt, Human
caaacucccuccuucccaccc

SEQ ID NO: 710370 - RNA, 25 nt, Human
caacuccauacucaguacgaaaaga

SEQ ID NO: 710371 - RNA, 19 nt, Human
caagccagcccggguccgc

SEQ ID NO: 710372 - RNA, 22 nt, Human
caagccagcccggguccgccag

SEQ ID NO: 710373 - RNA, 20 nt, Human
cacccacucagggauggcca

SEQ ID NO: 710374 - RNA, 19 nt, Human
cacccccaccccaagcuac

SEQ ID NO: 710375 - RNA, 24 nt, Human
cacccccaccccaagcuacugccc

SEQ ID NO: 710376 - RNA, 19 nt, Human
cagaauucugccaagaccc

SEQ ID NO: 710377 - RNA, 23 nt, Human
cagagcccacagcucugccacuc

SEQ ID NO: 710378 - RNA, 21 nt, Human
cagcacugugggccccaggug

SEQ ID NO: 710379 - RNA, 22 nt, Human
cagcacugugggccccaggugg

SEQ ID NO: 710380 - RNA, 24 nt, Human
cagcagagcccacagcucugccac

SEQ ID NO: 710381 - RNA, 26 nt, Human
cagggcccugccugagcucuucaggg

SEQ ID NO: 710382 - RNA, 19 nt, Human
caggugcaaugcuccccag

SEQ ID NO: 710383 - RNA, 18 nt, Human
caggugcccacccccacc

SEQ ID NO: 710384 - RNA, 21 nt, Human
ccacccacuccucaugccagg

SEQ ID NO: 710385 - RNA, 26 nt, Human
ccacccacuccucaugccaggugcaa

SEQ ID NO: 710386 - RNA, 18 nt, Human
ccacgugcccuaggcacu

SEQ ID NO: 710387 - RNA, 27 nt, Human
cccacccccaccccaagcuacugccca

SEQ ID NO: 710388 - RNA, 18 nt, Human
cccacgugcccuaggcac

SEQ ID NO: 710389 - RNA, 22 nt, Human
cccacuccucaugccaggugca

SEQ ID NO: 710390 - RNA, 22 nt, Human
cccagaaggaacaugaguguuc

SEQ ID NO: 710391 - RNA, 21 nt, Human
ccccaagcuacugcccagcuc

SEQ ID NO: 710392 - RNA, 19 nt, Human
ccccacaagccagcccggg

SEQ ID NO: 710393 - RNA, 22 nt, Human
ccccacaagccagcccgggucu

SEQ ID NO: 710394 - RNA, 24 nt, Human
cccccaccccaagcuacugcccag

SEQ ID NO: 710395 - RNA, 23 nt, Human
ccgccgcugccagagccgccgcc

SEQ ID NO: 710396 - RNA, 18 nt, Human
ccucagggcagugcaugg

SEQ ID NO: 710397 - RNA, 25 nt, Human
ccucaugccaggugcaaugcucccc

SEQ ID NO: 710398 - RNA, 19 nt, Human
ccuucaggcugaguccugg

SEQ ID NO: 710399 - RNA, 23 nt, Human
cgaaaagagggcucccaggaucu

SEQ ID NO: 710400 - RNA, 25 nt, Human
cgacaaacaaaagcagauuguaccu

SEQ ID NO: 710401 - RNA, 20 nt, Human
cuaggcacugaccucauacc

SEQ ID NO: 710402 - RNA, 24 nt, Human
cucccuccuucccacccugcugga

SEQ ID NO: 710403 - RNA, 20 nt, Human
cucugggcuaggaagaacuc

SEQ ID NO: 710404 - RNA, 19 nt, Human
cugaaggacccccauggug

SEQ ID NO: 710405 - RNA, 28 nt, Human
cugcaagacacacugauauacccaauuu

SEQ ID NO: 710406 - RNA, 19 nt, Human
cugccacucugauaugucc

SEQ ID NO: 710407 - RNA, 19 nt, Human
cugccacucugauaugucc

SEQ ID NO: 710408 - RNA, 20 nt, Human
gaagaaaaaggaagggaaag

SEQ ID NO: 710409 - RNA, 27 nt, Human
gaagaagccagcacugugggccccagg

SEQ ID NO: 710410 - RNA, 18 nt, Human
gaccucauaccugccuca

SEQ ID NO: 710411 - RNA, 18 nt, Human
gagcagcuuccuucaggc

SEQ ID NO: 710412 - RNA, 20 nt, Human
gagccgccgccuccucccuc

SEQ ID NO: 710413 - RNA, 20 nt, Human
gccagcacugugggccccag

SEQ ID NO: 710414 - RNA, 23 nt, Human
gcccaaacucccuccuucccacc

SEQ ID NO: 710415 - RNA, 24 nt, Human
gcccaaacucccuccuucccaccc

SEQ ID NO: 710416 - RNA, 20 nt, Human
gccgacacugucgccgccgc

SEQ ID NO: 710417 - RNA, 18 nt, Human
gccucaggagcagcuucc

SEQ ID NO: 710418 - RNA, 20 nt, Human
gcucugggcuaggaagaacu

SEQ ID NO: 710419 - RNA, 23 nt, Human
ggaagaaaaaggaagggaaaggg

SEQ ID NO: 710420 - RNA, 19 nt, Human
ggaagaagccagcacugug

SEQ ID NO: 710421 - RNA, 21 nt, Human
ggagcggagggggggucaggc

SEQ ID NO: 710422 - RNA, 21 nt, Human
ggccccagguggccccaucuc

SEQ ID NO: 710423 - RNA, 18 nt, Human
gggaaggagacaagaaaa

SEQ ID NO: 710424 - RNA, 21 nt, Human
gggagcugcacuucaagcuca

SEQ ID NO: 710425 - RNA, 18 nt, Human
gggauggggcccuaggga

SEQ ID NO: 710426 - RNA, 23 nt, Human
gggcauggcuacccucagggcag

SEQ ID NO: 710427 - RNA, 19 nt, Human
ggggggucaggccgacacu

SEQ ID NO: 710428 - RNA, 18 nt, Human
uaaaaaguugggcaaagc

SEQ ID NO: 710429 - RNA, 18 nt, Human
uaaaggaaaugggaguga

SEQ ID NO: 710430 - RNA, 20 nt, Human
uacaggaugcaggagagaac

SEQ ID NO: 710431 - RNA, 19 nt, Human
uaggaagaacuccagggaa

SEQ ID NO: 710432 - RNA, 19 nt, Human
uaggauggcucuacaacuc

SEQ ID NO: 710433 - RNA, 21 nt, Human
uagggaagaaaaaggaaggga

SEQ ID NO: 710434 - RNA, 18 nt, Human
uauggcagacagcggugc

SEQ ID NO: 710435 - RNA, 20 nt, Human
ucaagagggggaagaagcca

SEQ ID NO: 710436 - RNA, 21 nt, Human
ucaggagcagcuuccuucagg

SEQ ID NO: 710437 - RNA, 20 nt, Human
uccauacucaguacgaaaag

SEQ ID NO: 710438 - RNA, 22 nt, Human
ucccacgugcccuaggcacuga

SEQ ID NO: 710439 - RNA, 24 nt, Human
ucgccgccgcugccagagccgccg

SEQ ID NO: 710440 - RNA, 27 nt, Human
ucgccgccgcugccagagccgccgccu

SEQ ID NO: 710441 - RNA, 24 nt, Human
ucuccacccacucagggauggccc

SEQ ID NO: 710442 - RNA, 25 nt, Human
ucugcaagacacacugaggucguaa

SEQ ID NO: 710443 - RNA, 28 nt, Human
ucugcaagacacacugauauacccagaa

SEQ ID NO: 710444 - RNA, 24 nt, Human
ucugggcuaggaagaaccgggguc

SEQ ID NO: 710445 - RNA, 19 nt, Human
ucuguguugucggccaaga

SEQ ID NO: 710446 - RNA, 20 nt, Human
ugagcucuucaggggaugga

SEQ ID NO: 710447 - RNA, 19 nt, Human
ugaggggagagagcgagcu

SEQ ID NO: 710448 - RNA, 24 nt, Human
ugagucuacaggaugcaggagaga

SEQ ID NO: 710449 - RNA, 24 nt, Human
ugcccacccccaccccaagcuacu

SEQ ID NO: 710450 - RNA, 18 nt, Human
ugcuggggccccugcugc

SEQ ID NO: 710451 - RNA, 24 nt, Human
ugcuggggccccugcugcuguggg

SEQ ID NO: 710452 - RNA, 19 nt, Human
uggcacugggauggggccc

SEQ ID NO: 710453 - RNA, 20 nt, Human
uggcacugggauggggcccu

SEQ ID NO: 710454 - RNA, 19 nt, Human
uggcaggggaaaguuccca

SEQ ID NO: 710455 - RNA, 21 nt, Human
uggccccaucucaggaaugac

SEQ ID NO: 710456 - RNA, 18 nt, Human
uggcuacccucagggcag

SEQ ID NO: 710457 - RNA, 19 nt, Human
uggcugaaggacccccaug

SEQ ID NO: 710458 - RNA, 22 nt, Human
ugggauggggcccuagggagcc

SEQ ID NO: 710459 - RNA, 18 nt, Human
ugggcaaagcaagggcau

SEQ ID NO: 710460 - RNA, 23 nt, Human
uggggguggggagcuggaugcug

SEQ ID NO: 710461 - RNA, 20 nt, Human
ugguaucagggaugagaguu

SEQ ID NO: 710462 - RNA, 25 nt, Human
uuacugcuggggccccugcugcugu

SEQ ID NO: 710463 - RNA, 24 nt, Human
uuauagcagguucuccuggccagc

SEQ ID NO: 710464 - RNA, 22 nt, Human
uucaggggauggagaggaggcc

SEQ ID NO: 710465 - RNA, 25 nt, Human
uucaggggauggagaggaggccacc

SEQ ID NO: 710466 - RNA, 22 nt, Human
uuccugccaucuagcgcugccc

SEQ ID NO: 710467 - RNA, 30 nt, Human
uugcccaaacucccuccuucccacccugcc

SEQ ID NO: 710468 - RNA, 24 nt, Human
uuuguuacugcuggggccccugcu

SEQ ID NO: 710469 - RNA, 23 nt, Human
aaaaccaacacugucaggaaccu

SEQ ID NO: 710470 - RNA, 23 nt, Human
aaacaagagaagagacaggcugu

SEQ ID NO: 710471 - RNA, 24 nt, Human
aaaccagcccccaaaccagcuguu

SEQ ID NO: 710472 - RNA, 22 nt, Human
aaccaacacugucaggaaccug

SEQ ID NO: 710473 - RNA, 18 nt, Human
aaguagcugcaggggaug

SEQ ID NO: 710474 - RNA, 20 nt, Human
acaaggagaggucaagccaa

SEQ ID NO: 710475 - RNA, 21 nt, Human
acacacaacaccagggaaacc

SEQ ID NO: 710476 - RNA, 24 nt, Human
acacacaacaccagggaaaccagc

SEQ ID NO: 710477 - RNA, 18 nt, Human
acccucuggcuggaggag

SEQ ID NO: 710478 - RNA, 19 nt, Human
acccuggcagccucagaac

SEQ ID NO: 710479 - RNA, 23 nt, Human
acgcugcaucuucagggaaagcc

SEQ ID NO: 710480 - RNA, 18 nt, Human
acuaaacaagagaagaga

SEQ ID NO: 710481 - RNA, 18 nt, Human
agcucuccccgcgccccc

SEQ ID NO: 710482 - RNA, 22 nt, Human
aguaacuaaacaagagaagaga

SEQ ID NO: 710483 - RNA, 23 nt, Human
caacaccagggaaaccagccccc

SEQ ID NO: 710484 - RNA, 21 nt, Human
caacacugucaggaaccuggc

SEQ ID NO: 710485 - RNA, 23 nt, Human
cacaacaccagggaaaccagccc

SEQ ID NO: 710486 - RNA, 21 nt, Human
caccuccccuccccaauguca

SEQ ID NO: 710487 - RNA, 22 nt, Human
cagaacccaggggucaggggcu

SEQ ID NO: 710488 - RNA, 25 nt, Human
cagaauuacuucuucauuuccagau

SEQ ID NO: 710489 - RNA, 22 nt, Human
cagcauucccucuccaagguuc

SEQ ID NO: 710490 - RNA, 18 nt, Human
cagccgcuggagcggugg

SEQ ID NO: 710491 - RNA, 18 nt, Human
cagcguaugggaccggcg

SEQ ID NO: 710492 - RNA, 25 nt, Human
cagcuguugguaagaugccuugggu

SEQ ID NO: 710493 - RNA, 19 nt, Human
ccaaguagcugcaggggau

SEQ ID NO: 710494 - RNA, 20 nt, Human
ccagcucuccccgcgccccc

SEQ ID NO: 710495 - RNA, 24 nt, Human
ccccaaaccagcuguugguaagau

SEQ ID NO: 710496 - RNA, 19 nt, Human
ccccaaugucauuuucuuu

SEQ ID NO: 710497 - RNA, 19 nt, Human
cccccaaaccagcuguugg

SEQ ID NO: 710498 - RNA, 20 nt, Human
ccccgccgccgccgccgcgc

SEQ ID NO: 710499 - RNA, 25 nt, Human
ccccgccgccgccgccgcgcguccg

SEQ ID NO: 710500 - RNA, 19 nt, Human
cccgcccagcucuccccgc

SEQ ID NO: 710501 - RNA, 22 nt, Human
cccggucaccuccacgcggccg

SEQ ID NO: 710502 - RNA, 19 nt, Human
ccgacgcgcccccgccgcc

SEQ ID NO: 710503 - RNA, 22 nt, Human
ccgacgcgcccccgccgccgcc

SEQ ID NO: 710504 - RNA, 23 nt, Human
ccgcccagcucuccccgcgcccc

SEQ ID NO: 710505 - RNA, 18 nt, Human
ccgccgccgccgccgcgc

SEQ ID NO: 710506 - RNA, 26 nt, Human
ccgccgccgccgccgcgcguccgccg

SEQ ID NO: 710507 - RNA, 26 nt, Human
ccgccgccgccgccgcgcguccgccg

SEQ ID NO: 710508 - RNA, 19 nt, Human
ccgccgcgcguccgccggc

SEQ ID NO: 710509 - RNA, 20 nt, Human
ccgccgcgcguccgccggcu

SEQ ID NO: 710510 - RNA, 19 nt, Human
ccgccgcgcucucgcucgc

SEQ ID NO: 710511 - RNA, 22 nt, Human
ccggagcccgcggccgccgcgc

SEQ ID NO: 710512 - RNA, 18 nt, Human
ccucccucccagccccuc

SEQ ID NO: 710513 - RNA, 19 nt, Human
ccucccucccagccccucc

SEQ ID NO: 710514 - RNA, 25 nt, Human
ccucuggcuggaggagugguggagc

SEQ ID NO: 710515 - RNA, 19 nt, Human
ccuggcccugggagggcuc

SEQ ID NO: 710516 - RNA, 24 nt, Human
ccuguggcgaggacaggccggggc

SEQ ID NO: 710517 - RNA, 20 nt, Human
ccuugguuuguagcccaggg

SEQ ID NO: 710518 - RNA, 22 nt, Human
cgagcugcaagcgacccuggca

SEQ ID NO: 710519 - RNA, 23 nt, Human
cgauccucccucccagccccucc

SEQ ID NO: 710520 - RNA, 21 nt, Human
cgccgccgccgccgcgcgucc

SEQ ID NO: 710521 - RNA, 18 nt, Human
cgccggagcccgcggccg

SEQ ID NO: 710522 - RNA, 22 nt, Human
cgcgcccccgccgccgccgccg

SEQ ID NO: 710523 - RNA, 22 nt, Human
cggagcaccuccccuccccaau

SEQ ID NO: 710524 - RNA, 21 nt, Human
cggcgcggggaggacuugggc

SEQ ID NO: 710525 - RNA, 20 nt, Human
cguggucgugugucuguccc

SEQ ID NO: 710526 - RNA, 22 nt, Human
cguggucgugugucugucccuc

SEQ ID NO: 710527 - RNA, 22 nt, Human
cuauuuugagaaaagcugggag

SEQ ID NO: 710528 - RNA, 19 nt, Human
cucagaacccaggggucag

SEQ ID NO: 710529 - RNA, 18 nt, Human
cuccccgcgcccccucgg

SEQ ID NO: 710530 - RNA, 26 nt, Human
cucuugcauucuaacacugggucauu

SEQ ID NO: 710531 - RNA, 25 nt, Human
cugggaggcggagcaccuccccucc

SEQ ID NO: 710532 - RNA, 19 nt, Human
gaacagcagccuugguuug

SEQ ID NO: 710533 - RNA, 18 nt, Human
gaacauucugcaaaagua

SEQ ID NO: 710534 - RNA, 23 nt, Human
gaacccaggggucaggggcucau

SEQ ID NO: 710535 - RNA, 21 nt, Human
gaaguaaugugguuuguauga

SEQ ID NO: 710536 - RNA, 20 nt, Human
gagucgaagggguuuaggug

SEQ ID NO: 710537 - RNA, 20 nt, Human
gcagcugacagggcuccugg

SEQ ID NO: 710538 - RNA, 23 nt, Human
gccgagcugcaagcgacccuggc

SEQ ID NO: 710539 - RNA, 19 nt, Human
gcgcccggcgcgcuccggc

SEQ ID NO: 710540 - RNA, 22 nt, Human
gcucucgcucgcugcgcccagc

SEQ ID NO: 710541 - RNA, 18 nt, Human
ggaaaccagcccccaaac

SEQ ID NO: 710542 - RNA, 18 nt, Human
ggaccggcggaggagaag

SEQ ID NO: 710543 - RNA, 18 nt, Human
ggaggagaaggcgcgguc

SEQ ID NO: 710544 - RNA, 19 nt, Human
ggaggagugguggagccag

SEQ ID NO: 710545 - RNA, 19 nt, Human
ggcagccucagaacccagg

SEQ ID NO: 710546 - RNA, 21 nt, Human
ggcggaggagaaggcgcgguc

SEQ ID NO: 710547 - RNA, 20 nt, Human
ggggcucaucgauccucccu

SEQ ID NO: 710548 - RNA, 23 nt, Human
guggagccaggacugggccuuca

SEQ ID NO: 710549 - RNA, 18 nt, Human
guggucgugugucugucc

SEQ ID NO: 710550 - RNA, 22 nt, Human
uaaaauagcacauaacaagggc

SEQ ID NO: 710551 - RNA, 20 nt, Human
uaacacacaacaccagggaa

SEQ ID NO: 710552 - RNA, 23 nt, Human
uaacuaaacaagagaagagacag

SEQ ID NO: 710553 - RNA, 28 nt, Human
uagguaacacacaacaccagggaaacca

SEQ ID NO: 710554 - RNA, 29 nt, Human
uauacacaugauaaacacagcauacaugg

SEQ ID NO: 710555 - RNA, 23 nt, Human
uauugccguaaguaacuaaacaa

SEQ ID NO: 710556 - RNA, 19 nt, Human
ucaaagcagaagagucgaa

SEQ ID NO: 710557 - RNA, 20 nt, Human
ucccagccccuccuaaucaa

SEQ ID NO: 710558 - RNA, 21 nt, Human
ucgcggccccugacagcagcc

SEQ ID NO: 710559 - RNA, 21 nt, Human
ucgugugucugucccuccggc

SEQ ID NO: 710560 - RNA, 19 nt, Human
ugacagggcuccuggaguu

SEQ ID NO: 710561 - RNA, 31 nt, Human
ugaccaauguuacacugauuaaaauagcacc

SEQ ID NO: 710562 - RNA, 23 nt, Human
ugacccgaaugcucccuggaggc

SEQ ID NO: 710563 - RNA, 19 nt, Human
ugagaaaagcugggaggcg

SEQ ID NO: 710564 - RNA, 21 nt, Human
ugagaaaagcugggaggcgga

SEQ ID NO: 710565 - RNA, 19 nt, Human
ugcauucuaacacuggguc

SEQ ID NO: 710566 - RNA, 19 nt, Human
ugccccacacgauguggga

SEQ ID NO: 710567 - RNA, 21 nt, Human
uggaggagugguggagccagg

SEQ ID NO: 710568 - RNA, 18 nt, Human
uggcauuaauacuaacac

SEQ ID NO: 710569 - RNA, 23 nt, Human
ugggaccggcggaggagaaggcg

SEQ ID NO: 710570 - RNA, 20 nt, Human
ugggaggcggagcaccuccc

SEQ ID NO: 710571 - RNA, 23 nt, Human
ugggaugaacagcagccuugguu

SEQ ID NO: 710572 - RNA, 24 nt, Human
ugggcgguggcgccgcguggucgu

SEQ ID NO: 710573 - RNA, 19 nt, Human
uggguggaggcgugggcgg

SEQ ID NO: 710574 - RNA, 18 nt, Human
ugucugucccuccggcga

SEQ ID NO: 710575 - RNA, 23 nt, Human
ugugcaaaaaccaacacugucag

SEQ ID NO: 710576 - RNA, 21 nt, Human
uuaauacuaacacagaauacu

SEQ ID NO: 710577 - RNA, 19 nt, Human
uuccucugaacucaugugc

SEQ ID NO: 710578 - RNA, 21 nt, Human
uuccucugaacucaugugcaa

SEQ ID NO: 710579 - RNA, 25 nt, Human
aaaaaacuagucuaccugcucccac

SEQ ID NO: 710580 - RNA, 21 nt, Human
aaaaacacucgacuacaaagc

SEQ ID NO: 710581 - RNA, 24 nt, Human
aaaacaaaacaaagcaaaaaaaac

SEQ ID NO: 710582 - RNA, 22 nt, Human
aaaacaccagaaugauagagua

SEQ ID NO: 710583 - RNA, 21 nt, Human
aaaacacucgacuacaaagca

SEQ ID NO: 710584 - RNA, 18 nt, Human
aaacaaaacaaagcaaaa

SEQ ID NO: 710585 - RNA, 19 nt, Human
aaacaaaacaaagcaaaaa

SEQ ID NO: 710586 - RNA, 25 nt, Human
aaacagcugggaaacucucuacuuu

SEQ ID NO: 710587 - RNA, 18 nt, Human
aaaccaaacaaaacaaaa

SEQ ID NO: 710588 - RNA, 22 nt, Human
aaaccaaacaaaacaaaacaaa

SEQ ID NO: 710589 - RNA, 25 nt, Human
aaaccaaacaaaacaaaacaaagca

SEQ ID NO: 710590 - RNA, 19 nt, Human
aacaaaguccucaacacaa

SEQ ID NO: 710591 - RNA, 19 nt, Human
aagaagaaugccacuuggu

SEQ ID NO: 710592 - RNA, 20 nt, Human
aagauggugaaaccccaucu

SEQ ID NO: 710593 - RNA, 19 nt, Human
aagcaaaaucugcaaggcg

SEQ ID NO: 710594 - RNA, 19 nt, Human
aagcaaaccaaacucugua

SEQ ID NO: 710595 - RNA, 26 nt, Human
aagcaaaccaaacucuguaaagaaca

SEQ ID NO: 710596 - RNA, 22 nt, Human
aagcaaaugaauauacuuaaau

SEQ ID NO: 710597 - RNA, 19 nt, Human
aauaaaaccgagggcuuaa

SEQ ID NO: 710598 - RNA, 19 nt, Human
aaucauggucaaauauuua

SEQ ID NO: 710599 - RNA, 24 nt, Human
aaugucugcuaguguuuggauaac

SEQ ID NO: 710600 - RNA, 21 nt, Human
acaaaacaaucccagaccucg

SEQ ID NO: 710601 - RNA, 20 nt, Human
acaaagcaaaaaaaacuuuc

SEQ ID NO: 710602 - RNA, 22 nt, Human
acagaaugagacuccauuaaaa

SEQ ID NO: 710603 - RNA, 24 nt, Human
accccaucucuacuaaaaauacaa

SEQ ID NO: 710604 - RNA, 20 nt, Human
accgagaucacgccacugca

SEQ ID NO: 710605 - RNA, 18 nt, Human
acgccacugcacuccagc

SEQ ID NO: 710606 - RNA, 22 nt, Human
acgccacugcacuccagccugg

SEQ ID NO: 710607 - RNA, 18 nt, Human
acugcacuccagccuggg

SEQ ID NO: 710608 - RNA, 24 nt, Human
acugcacuccagccugggugacag

SEQ ID NO: 710609 - RNA, 22 nt, Human
agaauauccaaagaaugucccc

SEQ ID NO: 710610 - RNA, 18 nt, Human
agacaaaauccacgugug

SEQ ID NO: 710611 - RNA, 19 nt, Human
agacaaauaugggcuaaaa

SEQ ID NO: 710612 - RNA, 24 nt, Human
agacgcaguggcaggcaccuguaa

SEQ ID NO: 710613 - RNA, 23 nt, Human
agagguugcagugaaccgagauc

SEQ ID NO: 710614 - RNA, 24 nt, Human
agagguugcagugaaccgagauca

SEQ ID NO: 710615 - RNA, 21 nt, Human
agcauuuugggaggccgaggc

SEQ ID NO: 710616 - RNA, 24 nt, Human
agcauuuugggaggccgaggcggg

SEQ ID NO: 710617 - RNA, 24 nt, Human
agccuggccaagauggugaaaccc

SEQ ID NO: 710618 - RNA, 24 nt, Human
agccugggugacagaaugagacuc

SEQ ID NO: 710619 - RNA, 21 nt, Human
aggaagaaacggagaaagcaa

SEQ ID NO: 710620 - RNA, 23 nt, Human
aggacaggcuugguuuuuuugaa

SEQ ID NO: 710621 - RNA, 21 nt, Human
aggcaggagaaucgcuugaac

SEQ ID NO: 710622 - RNA, 24 nt, Human
aggcaggagaaucgcuugaacaug

SEQ ID NO: 710623 - RNA, 19 nt, Human
aggcaggugacuucugggg

SEQ ID NO: 710624 - RNA, 21 nt, Human
aggccgaggcggguggaccac

SEQ ID NO: 710625 - RNA, 24 nt, Human
aggcggguggaccacaaggucagg

SEQ ID NO: 710626 - RNA, 22 nt, Human
agucuaggcugggcgcguggcu

SEQ ID NO: 710627 - RNA, 20 nt, Human
agugcugcaaauucacauca

SEQ ID NO: 710628 - RNA, 24 nt, Human
aguggcaggcaccuguaaucccag

SEQ ID NO: 710629 - RNA, 21 nt, Human
auagaguaagaaaauagaacu

SEQ ID NO: 710630 - RNA, 24 nt, Human
aucacgccacugcacuccagccug

SEQ ID NO: 710631 - RNA, 20 nt, Human
auccacgugugaaauggagc

SEQ ID NO: 710632 - RNA, 24 nt, Human
auuuuauucacucuaguugagaaa

SEQ ID NO: 710633 - RNA, 23 nt, Human
caauaaaaccgagggcuuaaaaa

SEQ ID NO: 710634 - RNA, 24 nt, Human
caccuguaaucccagcuacucagg

SEQ ID NO: 710635 - RNA, 24 nt, Human
caccuguaaucccagcuacucagg

SEQ ID NO: 710636 - RNA, 18 nt, Human
cacggcaugugaggccug

SEQ ID NO: 710637 - RNA, 18 nt, Human
cacuccagccugggugac

SEQ ID NO: 710638 - RNA, 22 nt, Human
cacuccagccugggugacagaa

SEQ ID NO: 710639 - RNA, 24 nt, Human
cacuccagccugggugacagaaug

SEQ ID NO: 710640 - RNA, 19 nt, Human
cacugcacuccagccuggg

SEQ ID NO: 710641 - RNA, 19 nt, Human
cacugcacuccagccuggg

SEQ ID NO: 710642 - RNA, 22 nt, Human
cacugcacuccagccuggguga

SEQ ID NO: 710643 - RNA, 23 nt, Human
cacugcacuccagccugggugac

SEQ ID NO: 710644 - RNA, 24 nt, Human
cacugcacuccagccugggugaca

SEQ ID NO: 710645 - RNA, 24 nt, Human
cacugcacuccagccugggugaca

SEQ ID NO: 710646 - RNA, 24 nt, Human
cagacacauuuaaaacaaaacaaa

SEQ ID NO: 710647 - RNA, 24 nt, Human
cagacucuuaggcuuugcagugaa

SEQ ID NO: 710648 - RNA, 24 nt, Human
cagauucucaaguucauacucuuc

SEQ ID NO: 710649 - RNA, 24 nt, Human
cagcauuuugggaggccgaggcgg

SEQ ID NO: 710650 - RNA, 24 nt, Human
caugcauguaaucccagcauuuug

SEQ ID NO: 710651 - RNA, 20 nt, Human
cauggaacuugcagaucacc

SEQ ID NO: 710652 - RNA, 25 nt, Human
cauggaacuugcagaucaccuaaua

SEQ ID NO: 710653 - RNA, 19 nt, Human
cauggucaaauauuuauau

SEQ ID NO: 710654 - RNA, 21 nt, Human
cauucaaaucuauuuccaaaa

SEQ ID NO: 710655 - RNA, 21 nt, Human
ccacaaggucaggaguucaag

SEQ ID NO: 710656 - RNA, 24 nt, Human
ccacaaggucaggaguucaagacc

SEQ ID NO: 710657 - RNA, 22 nt, Human
ccacucugcuccagcuguuggu

SEQ ID NO: 710658 - RNA, 20 nt, Human
ccacugcacuccagccuggg

SEQ ID NO: 710659 - RNA, 20 nt, Human
ccacugcacuccagccuggg

SEQ ID NO: 710660 - RNA, 20 nt, Human
ccacugcacuccagccuggg

SEQ ID NO: 710661 - RNA, 21 nt, Human
ccacugcacuccagccugggu

SEQ ID NO: 710662 - RNA, 21 nt, Human
ccacugcacuccagccugggu

SEQ ID NO: 710663 - RNA, 23 nt, Human
ccacugcacuccagccuggguga

SEQ ID NO: 710664 - RNA, 24 nt, Human
ccacugcacuccagccugggugac

SEQ ID NO: 710665 - RNA, 19 nt, Human
ccauuucaaguuuauucuc

SEQ ID NO: 710666 - RNA, 20 nt, Human
cccagaccucggauauaauu

SEQ ID NO: 710667 - RNA, 23 nt, Human
cccagccucacacguuccccggc

SEQ ID NO: 710668 - RNA, 23 nt, Human
ccccggcggaagucuaagcugcu

SEQ ID NO: 710669 - RNA, 19 nt, Human
cccugggcucccagggcuc

SEQ ID NO: 710670 - RNA, 22 nt, Human
ccuaaaucugcuccaauucauu

SEQ ID NO: 710671 - RNA, 21 nt, Human
ccuaaccccugggcucccagg

SEQ ID NO: 710672 - RNA, 24 nt, Human
ccuggccaagauggugaaacccca

SEQ ID NO: 710673 - RNA, 22 nt, Human
ccugggugacagaaugagacuc

SEQ ID NO: 710674 - RNA, 21 nt, Human
ccuguaaucccagcuacucag

SEQ ID NO: 710675 - RNA, 19 nt, Human
ccuuccagcugucguagcc

SEQ ID NO: 710676 - RNA, 26 nt, Human
cgccacugcacuccagccugggugac

SEQ ID NO: 710677 - RNA, 22 nt, Human
cguggcaguggcugucagagcu

SEQ ID NO: 710678 - RNA, 24 nt, Human
cguggcucaugcauguaaucccag

SEQ ID NO: 710679 - RNA, 23 nt, Human
cuagucuaggcugggcgcguggc

SEQ ID NO: 710680 - RNA, 24 nt, Human
cucaugcauguaaucccagcauuu

SEQ ID NO: 710681 - RNA, 21 nt, Human
cuguaaucccagcuacucagg

SEQ ID NO: 710682 - RNA, 24 nt, Human
cugugggcuggagauaaaccaugc

SEQ ID NO: 710683 - RNA, 19 nt, Human
cuuagcagcaggcagucug

SEQ ID NO: 710684 - RNA, 21 nt, Human
cuugcuguuguggagagucca

SEQ ID NO: 710685 - RNA, 23 nt, Human
gaaaaacacucgacuacaaagca

SEQ ID NO: 710686 - RNA, 26 nt, Human
gaaagcaaaugaauauacuuaaauca

SEQ ID NO: 710687 - RNA, 18 nt, Human
gaagaaacggagaaagca

SEQ ID NO: 710688 - RNA, 18 nt, Human
gaaugccacuuggugugu

SEQ ID NO: 710689 - RNA, 21 nt, Human
gacacagaggaggaggcagga

SEQ ID NO: 710690 - RNA, 24 nt, Human
gaccacaaggucaggaguucaaga

SEQ ID NO: 710691 - RNA, 23 nt, Human
gagaucacgccacugcacuccag

SEQ ID NO: 710692 - RNA, 23 nt, Human
gagcuuucuuugcauaaucaugg

SEQ ID NO: 710693 - RNA, 24 nt, Human
gaggcggguggaccacaaggucag

SEQ ID NO: 710694 - RNA, 18 nt, Human
gauagagcuggcuccuag

SEQ ID NO: 710695 - RNA, 22 nt, Human
gcaaggcgucccagccucacac

SEQ ID NO: 710696 - RNA, 22 nt, Human
gcagcaggcagucuguuuaagc

SEQ ID NO: 710697 - RNA, 19 nt, Human
gcagugaaaugucuagacc

SEQ ID NO: 710698 - RNA, 24 nt, Human
gccaagauggugaaaccccaucuc

SEQ ID NO: 710699 - RNA, 19 nt, Human
gccacugcacuccagccug

SEQ ID NO: 710700 - RNA, 24 nt, Human
gccacugcacuccagccuggguga

SEQ ID NO: 710701 - RNA, 20 nt, Human
gcugcaaauucacaucaguc

SEQ ID NO: 710702 - RNA, 21 nt, Human
gcugugggcuggagauaaacc

SEQ ID NO: 710703 - RNA, 25 nt, Human
ggcaauuuuucuaccauguuauuua

SEQ ID NO: 710704 - RNA, 19 nt, Human
ggcaccuguaaucccagcu

SEQ ID NO: 710705 - RNA, 20 nt, Human
ggcagagguugcagugaacc

SEQ ID NO: 710706 - RNA, 20 nt, Human
ggccaagauggugaaacccc

SEQ ID NO: 710707 - RNA, 20 nt, Human
gggaaacucucuacuuuucu

SEQ ID NO: 710708 - RNA, 23 nt, Human
gggcgcguggcucaugcauguaa

SEQ ID NO: 710709 - RNA, 20 nt, Human
gggcugaggcaggagaaucg

SEQ ID NO: 710710 - RNA, 24 nt, Human
gggcugaggcaggagaaucgcuug

SEQ ID NO: 710711 - RNA, 19 nt, Human
ggugacuucuggggccugg

SEQ ID NO: 710712 - RNA, 23 nt, Human
gguggaccacaaggucaggaguu

SEQ ID NO: 710713 - RNA, 19 nt, Human
gguguguguuugugugugu

SEQ ID NO: 710714 - RNA, 26 nt, Human
gguuguuguuuuuaauaugucuaaug

SEQ ID NO: 710715 - RNA, 24 nt, Human
guaaaugcagacaaaauccacgug

SEQ ID NO: 710716 - RNA, 26 nt, Human
gucguagccuccaggugacagguuuc

SEQ ID NO: 710717 - RNA, 24 nt, Human
guggcucaugcauguaaucccagc

SEQ ID NO: 710718 - RNA, 23 nt, Human
guggguguguguuugugugugug

SEQ ID NO: 710719 - RNA, 22 nt, Human
gugucacggcaugugaggccug

SEQ ID NO: 710720 - RNA, 19 nt, Human
guguguguuugugugugug

SEQ ID NO: 710721 - RNA, 21 nt, Human
uaaaaauacaaaaauuagcca

SEQ ID NO: 710722 - RNA, 20 nt, Human
uaaaaugggcaauaaaaccc

SEQ ID NO: 710723 - RNA, 20 nt, Human
uaaacaaagucaaaagcaau

SEQ ID NO: 710724 - RNA, 19 nt, Human
uaacacuguaaauaaugaa

SEQ ID NO: 710725 - RNA, 18 nt, Human
uaaccccugggcucccag

SEQ ID NO: 710726 - RNA, 25 nt, Human
uaagaaaaugcaaugaaaacaccag

SEQ ID NO: 710727 - RNA, 22 nt, Human
uaagccaacaacccaaauaauu

SEQ ID NO: 710728 - RNA, 18 nt, Human
uacauuacuuaaaagccu

SEQ ID NO: 710729 - RNA, 23 nt, Human
uacauuacuuaaaagccugugua

SEQ ID NO: 710730 - RNA, 24 nt, Human
uacucuuccuaucacccuguguac

SEQ ID NO: 710731 - RNA, 23 nt, Human
uagaaagcaaaugaauauacuua

SEQ ID NO: 710732 - RNA, 19 nt, Human
uagagcuggcuccuaggaa

SEQ ID NO: 710733 - RNA, 22 nt, Human
uagaguaagaaaauagaacuga

SEQ ID NO: 710734 - RNA, 24 nt, Human
uaggauuagaaaagaauaauguaa

SEQ ID NO: 710735 - RNA, 24 nt, Human
uagggaggaaacuuagacucguug

SEQ ID NO: 710736 - RNA, 20 nt, Human
uaguggguacucaaaaaugc

SEQ ID NO: 710737 - RNA, 23 nt, Human
ucacgccacugcacuccagccug

SEQ ID NO: 710738 - RNA, 20 nt, Human
ucaugcauguaaucccagca

SEQ ID NO: 710739 - RNA, 18 nt, Human
uccacaaaaaaaaaauga

SEQ ID NO: 710740 - RNA, 24 nt, Human
uccagccugggugacagaaugaga

SEQ ID NO: 710741 - RNA, 23 nt, Human
uccauuaaaaaaaaaaaaaaaaa

SEQ ID NO: 710742 - RNA, 19 nt, Human
ucccagggcucucccuccc

SEQ ID NO: 710743 - RNA, 25 nt, Human
ucccuggaguuccucccgagggucu

SEQ ID NO: 710744 - RNA, 21 nt, Human
ucucuacuaaaaauacaaaaa

SEQ ID NO: 710745 - RNA, 19 nt, Human
ucucuacuuuucuuuuucu

SEQ ID NO: 710746 - RNA, 19 nt, Human
ucugccauucucaggcugg

SEQ ID NO: 710747 - RNA, 26 nt, Human
ugaaaacaccagaaugauuggagacc

SEQ ID NO: 710748 - RNA, 19 nt, Human
ugaaaccccaucucuacua

SEQ ID NO: 710749 - RNA, 19 nt, Human
ugaaagcaaaaucugcaag

SEQ ID NO: 710750 - RNA, 22 nt, Human
ugaaauuacugaaaaggagcug

SEQ ID NO: 710751 - RNA, 23 nt, Human
ugaggcaggagaaucgcuugaac

SEQ ID NO: 710752 - RNA, 20 nt, Human
ugaguacaggucaugaaagc

SEQ ID NO: 710753 - RNA, 22 nt, Human
ugaugcaggcuuugaaaaacac

SEQ ID NO: 710754 - RNA, 22 nt, Human
ugaugcuaagaagaaugccacu

SEQ ID NO: 710755 - RNA, 21 nt, Human
ugaugugguaaaacagcuggg

SEQ ID NO: 710756 - RNA, 23 nt, Human
ugaugugguaaaacagcugggaa

SEQ ID NO: 710757 - RNA, 24 nt, Human
ugcagacaaaauccacgugugaaa

SEQ ID NO: 710758 - RNA, 24 nt, Human
ugcauguaaucccagcauuuuggg

SEQ ID NO: 710759 - RNA, 18 nt, Human
ugccaaggagauaguggg

SEQ ID NO: 710760 - RNA, 21 nt, Human
ugcuccagcuguugguccuug

SEQ ID NO: 710761 - RNA, 22 nt, Human
uggaccacaaggucaggaguuc

SEQ ID NO: 710762 - RNA, 21 nt, Human
uggcucaugcauguaauccca

SEQ ID NO: 710763 - RNA, 22 nt, Human
uggcucaugcauguaaucccag

SEQ ID NO: 710764 - RNA, 24 nt, Human
uggcucaugcauguaaucccagca

SEQ ID NO: 710765 - RNA, 19 nt, Human
ugggaggccgaggcgggug

SEQ ID NO: 710766 - RNA, 24 nt, Human
ugggaggccgaggcggguggacca

SEQ ID NO: 710767 - RNA, 20 nt, Human
uggguuugcauuaaauugug

SEQ ID NO: 710768 - RNA, 24 nt, Human
ugguuugguuuuuauuccuguuug

SEQ ID NO: 710769 - RNA, 19 nt, Human
uguaagcuaaucugcccaa

SEQ ID NO: 710770 - RNA, 23 nt, Human
ugugacacagaggaggaggcagg

SEQ ID NO: 710771 - RNA, 20 nt, Human
ugugaggccugcagagaugu

SEQ ID NO: 710772 - RNA, 22 nt, Human
ugugaguucugugggugugugu

SEQ ID NO: 710773 - RNA, 20 nt, Human
uguggguguguguuugugug

SEQ ID NO: 710774 - RNA, 20 nt, Human
uguguaaacaaagaagauaa

SEQ ID NO: 710775 - RNA, 21 nt, Human
ugugugcauugugcauuuccu

SEQ ID NO: 710776 - RNA, 22 nt, Human
uguuguggagaguccaggccuc

SEQ ID NO: 710777 - RNA, 19 nt, Human
uguuuguguguguguucau

SEQ ID NO: 710778 - RNA, 26 nt, Human
uuaaaaaccaaacaaaacaaaacaaa

SEQ ID NO: 710779 - RNA, 22 nt, Human
uuaaaacaaaacaaaguccuca

SEQ ID NO: 710780 - RNA, 18 nt, Human
uuaguucuuuuccuucuu

SEQ ID NO: 710781 - RNA, 19 nt, Human
uuauuugccccccuaucuu

SEQ ID NO: 710782 - RNA, 18 nt, Human
uucacucuaguugagaaa

SEQ ID NO: 710783 - RNA, 19 nt, Human
uucccuguggcugggagca

SEQ ID NO: 710784 - RNA, 23 nt, Human
uuccuaaccccugggcucccagg

SEQ ID NO: 710785 - RNA, 18 nt, Human
uuccuacuuguugucucu

SEQ ID NO: 710786 - RNA, 20 nt, Human
uucuggggccugggcgccuc

SEQ ID NO: 710787 - RNA, 20 nt, Human
uugcagugaaccgagaucac

SEQ ID NO: 710788 - RNA, 24 nt, Human
uugguguguguguaaacaaagaag

SEQ ID NO: 710789 - RNA, 24 nt, Human
uuguuucuuuaaggccauuuucag

SEQ ID NO: 710790 - RNA, 24 nt, Human
uuucuuugcauaaucauggucaaa

SEQ ID NO: 710791 - RNA, 21 nt, Human
uuuguuagaauacagcaguuc

SEQ ID NO: 710792 - RNA, 20 nt, Human
uuuuguggaugagaagcuga

SEQ ID NO: 710793 - RNA, 20 nt, Human
aaaaaacaaaggucagccca

SEQ ID NO: 710794 - RNA, 21 nt, Human
aaaaauccuccacucaaauac

SEQ ID NO: 710795 - RNA, 20 nt, Human
aaaacaguacaguaaauccc

SEQ ID NO: 710796 - RNA, 19 nt, Human
aaacaaauauaguacacau

SEQ ID NO: 710797 - RNA, 21 nt, Human
aaacauacauucgacaccuuc

SEQ ID NO: 710798 - RNA, 21 nt, Human
aaacccagaguaagaagcuga

SEQ ID NO: 710799 - RNA, 19 nt, Human
aaauauuuggcugagaucg

SEQ ID NO: 710800 - RNA, 22 nt, Human
aacaguacaguaaaucccauuc

SEQ ID NO: 710801 - RNA, 22 nt, Human
aacaguagccccuugcaccccc

SEQ ID NO: 710802 - RNA, 19 nt, Human
aagaaaugugaauuaaaau

SEQ ID NO: 710803 - RNA, 22 nt, Human
aagcaucagaaacacagaugcc

SEQ ID NO: 710804 - RNA, 19 nt, Human
aauguguuugggacuugcu

SEQ ID NO: 710805 - RNA, 21 nt, Human
acaacagugucaccuuaaagc

SEQ ID NO: 710806 - RNA, 21 nt, Human
acaacugcagugagggggaaa

SEQ ID NO: 710807 - RNA, 20 nt, Human
acacucacuccuccacucua

SEQ ID NO: 710808 - RNA, 23 nt, Human
acagaugccacaccccuucagaa

SEQ ID NO: 710809 - RNA, 18 nt, Human
acagcaggaaaaucccag

SEQ ID NO: 710810 - RNA, 20 nt, Human
accaguggaaaaacuaaagu

SEQ ID NO: 710811 - RNA, 21 nt, Human
acccucuugguguggaugcca

SEQ ID NO: 710812 - RNA, 26 nt, Human
agaaccaacaaugccacagguaguua

SEQ ID NO: 710813 - RNA, 21 nt, Human
agaaugaggaauaaaccacca

SEQ ID NO: 710814 - RNA, 24 nt, Human
agcaggaaaaucccagaugaauuu

SEQ ID NO: 710815 - RNA, 22 nt, Human
agcugcaggaagcccuccuaug

SEQ ID NO: 710816 - RNA, 22 nt, Human
aggagugacugcaucuaacaag

SEQ ID NO: 710817 - RNA, 22 nt, Human
agggacaggcccaaaucucaca

SEQ ID NO: 710818 - RNA, 22 nt, Human
aggucagcccacaaucaaagua

SEQ ID NO: 710819 - RNA, 20 nt, Human
aucuaacaagaggacuaaca

SEQ ID NO: 710820 - RNA, 18 nt, Human
augaauuuucugucuugu

SEQ ID NO: 710821 - RNA, 23 nt, Human
caacagugucaccuuaaagcuuc

SEQ ID NO: 710822 - RNA, 24 nt, Human
cacauggcauuugcacaaccaaug

SEQ ID NO: 710823 - RNA, 20 nt, Human
cacccccccacaagugaagc

SEQ ID NO: 710824 - RNA, 22 nt, Human
cacccccccacaagugaagcug

SEQ ID NO: 710825 - RNA, 22 nt, Human
cacccccgcccggcgccggggg

SEQ ID NO: 710826 - RNA, 25 nt, Human
caccggcaccucaucacaacacccu

SEQ ID NO: 710827 - RNA, 22 nt, Human
cacgcaaaguuccaacuccuca

SEQ ID NO: 710828 - RNA, 27 nt, Human
cagaaccaacaaugccacagguaguua

SEQ ID NO: 710829 - RNA, 24 nt, Human
cagaagaaugugccagccacagca

SEQ ID NO: 710830 - RNA, 18 nt, Human
cagaugaauuuucugucu

SEQ ID NO: 710831 - RNA, 27 nt, Human
cagauuuucuaaaguagugguucacau

SEQ ID NO: 710832 - RNA, 20 nt, Human
cagcggcuggcggcggcccc

SEQ ID NO: 710833 - RNA, 21 nt, Human
caguagccccuugcacccccc

SEQ ID NO: 710834 - RNA, 20 nt, Human
caguguaauguguuugggac

SEQ ID NO: 710835 - RNA, 20 nt, Human
caguguaauguguuugggac

SEQ ID NO: 710836 - RNA, 19 nt, Human
cagugucaccuuaaagcuu

SEQ ID NO: 710837 - RNA, 21 nt, Human
caucucauuaugcuacuuacu

SEQ ID NO: 710838 - RNA, 21 nt, Human
ccaauggucgcggccaccccc

SEQ ID NO: 710839 - RNA, 21 nt, Human
ccacugauguauaaacauaca

SEQ ID NO: 710840 - RNA, 23 nt, Human
ccacugauguauaaacauacauu

SEQ ID NO: 710841 - RNA, 24 nt, Human
cccaaaagauugaucagaaaggca

SEQ ID NO: 710842 - RNA, 19 nt, Human
ccccacccccccacaagug

SEQ ID NO: 710843 - RNA, 20 nt, Human
ccccuucccccaccccccca

SEQ ID NO: 710844 - RNA, 20 nt, Human
ccgccccuucccccaccccc

SEQ ID NO: 710845 - RNA, 22 nt, Human
ccgccccuucccccaccccccc

SEQ ID NO: 710846 - RNA, 27 nt, Human
ccgccccuucccccacccccccacaag

SEQ ID NO: 710847 - RNA, 18 nt, Human
ccgggccgaauguagccg

SEQ ID NO: 710848 - RNA, 24 nt, Human
ccuaaggucaccuaagccuagaac

SEQ ID NO: 710849 - RNA, 19 nt, Human
ccugcauuucugagaccgc

SEQ ID NO: 710850 - RNA, 23 nt, Human
cgaaggcauauucugacaacuaa

SEQ ID NO: 710851 - RNA, 18 nt, Human
cgccccuucccccacccc

SEQ ID NO: 710852 - RNA, 21 nt, Human
cggccacccccgcccggcgcc

SEQ ID NO: 710853 - RNA, 21 nt, Human
cuaaacuggcauugagggaca

SEQ ID NO: 710854 - RNA, 18 nt, Human
cuagaaaaaugagaaaaa

SEQ ID NO: 710855 - RNA, 18 nt, Human
cucacaaaguaacuuaaa

SEQ ID NO: 710856 - RNA, 26 nt, Human
cucccuguuaccauacuucauaagaa

SEQ ID NO: 710857 - RNA, 21 nt, Human
cugagaccgccccuuccccca

SEQ ID NO: 710858 - RNA, 25 nt, Human
cugauuguuaaaaaaacaaagguca

SEQ ID NO: 710859 - RNA, 19 nt, Human
cugcacauggcauuugcac

SEQ ID NO: 710860 - RNA, 19 nt, Human
cugcauagaucucagcugc

SEQ ID NO: 710861 - RNA, 23 nt, Human
cugcccaccuccgccuguucagc

SEQ ID NO: 710862 - RNA, 19 nt, Human
cuggcauugagggacaggc

SEQ ID NO: 710863 - RNA, 23 nt, Human
cuggcggcggccccgccccuuuc

SEQ ID NO: 710864 - RNA, 22 nt, Human
cuguguacaaacuuuaacaaag

SEQ ID NO: 710865 - RNA, 28 nt, Human
cuucccccacccccccacaagugaagcu

SEQ ID NO: 710866 - RNA, 23 nt, Human
cuucucagagggucaugcaccuu

SEQ ID NO: 710867 - RNA, 18 nt, Human
gaagcccuccuauggccu

SEQ ID NO: 710868 - RNA, 18 nt, Human
gaauaaucacuggcucuu

SEQ ID NO: 710869 - RNA, 19 nt, Human
gaauguagccgccuggacc

SEQ ID NO: 710870 - RNA, 20 nt, Human
gaccgccccuucccccaccc

SEQ ID NO: 710871 - RNA, 21 nt, Human
gagaaaagaggcuaaaaaugc

SEQ ID NO: 710872 - RNA, 32 nt, Human
gagaccgccccuucccccacccccccacaagg

SEQ ID NO: 710873 - RNA, 20 nt, Human
gaugccauggggccaugcug

SEQ ID NO: 710874 - RNA, 24 nt, Human
gauuguguggaaauuucauaagca

SEQ ID NO: 710875 - RNA, 20 nt, Human
gcaaaguuccaacuccucac

SEQ ID NO: 710876 - RNA, 19 nt, Human
gccccuucccccacccccc

SEQ ID NO: 710877 - RNA, 18 nt, Human
ggccgggccgaauguagc

SEQ ID NO: 710878 - RNA, 22 nt, Human
gggugggaccugggaaccugca

SEQ ID NO: 710879 - RNA, 21 nt, Human
guccugguuuccacgugaacc

SEQ ID NO: 710880 - RNA, 18 nt, Human
gugccagccacagcagga

SEQ ID NO: 710881 - RNA, 25 nt, Human
uaaaaaaacaaaggucagcccacaa

SEQ ID NO: 710882 - RNA, 26 nt, Human
uaaaaaaugcacuaacuagccuaaag

SEQ ID NO: 710883 - RNA, 24 nt, Human
uaaaaggcuagcagauaagaacca

SEQ ID NO: 710884 - RNA, 27 nt, Human
uaaaaggcuagcagauaagaaccagug

SEQ ID NO: 710885 - RNA, 22 nt, Human
uaaaaugaacaauggaccaacu

SEQ ID NO: 710886 - RNA, 20 nt, Human
uaaaaugaacaauggaccac

SEQ ID NO: 710887 - RNA, 25 nt, Human
uaaaaugaacaauggaccacaggug

SEQ ID NO: 710888 - RNA, 25 nt, Human
uaaaaugcuccaaaaauguuuugga

SEQ ID NO: 710889 - RNA, 21 nt, Human
uaaagcacuuauuccagguaa

SEQ ID NO: 710890 - RNA, 18 nt, Human
uaacacguaucaagugcu

SEQ ID NO: 710891 - RNA, 21 nt, Human
uaagcaauuuugaaaaaaaga

SEQ ID NO: 710892 - RNA, 19 nt, Human
uaaucuaggugucucccuc

SEQ ID NO: 710893 - RNA, 22 nt, Human
uacagucaaacaucauguugcc

SEQ ID NO: 710894 - RNA, 25 nt, Human
uacaguuaguagagcagaaacuucu

SEQ ID NO: 710895 - RNA, 19 nt, Human
uaccauacuucauaagaaa

SEQ ID NO: 710896 - RNA, 18 nt, Human
uaccauguuaaugcuggu

SEQ ID NO: 710897 - RNA, 22 nt, Human
uagccccuugcaccccccagug

SEQ ID NO: 710898 - RNA, 19 nt, Human
uaggaggguggauccuagc

SEQ ID NO: 710899 - RNA, 18 nt, Human
uaggguggauuucauuca

SEQ ID NO: 710900 - RNA, 19 nt, Human
ucacagcaggccugaacug

SEQ ID NO: 710901 - RNA, 21 nt, Human
ucacuaggugaccaggaggag

SEQ ID NO: 710902 - RNA, 19 nt, Human
ucagcccagugacuucuca

SEQ ID NO: 710903 - RNA, 22 nt, Human
uccacagaaugaggaauaaacc

SEQ ID NO: 710904 - RNA, 28 nt, Human
uccacagaaugaggaauaaaccaccauu

SEQ ID NO: 710905 - RNA, 19 nt, Human
uccacgugaacccaaaaga

SEQ ID NO: 710906 - RNA, 18 nt, Human
uccagcaaguuuccucac

SEQ ID NO: 710907 - RNA, 25 nt, Human
uccagggaacaccuggaauaaucac

SEQ ID NO: 710908 - RNA, 19 nt, Human
ucccagacucacuugaccu

SEQ ID NO: 710909 - RNA, 19 nt, Human
ucccccacccccccacaag

SEQ ID NO: 710910 - RNA, 20 nt, Human
uccgccaauggucgcggcca

SEQ ID NO: 710911 - RNA, 22 nt, Human
uccgccaauggucgcggccacc

SEQ ID NO: 710912 - RNA, 19 nt, Human
uccuggcucugucccugcu

SEQ ID NO: 710913 - RNA, 23 nt, Human
ucuacaguuaguagagcagaaac

SEQ ID NO: 710914 - RNA, 18 nt, Human
ucugucccugcucacuag

SEQ ID NO: 710915 - RNA, 19 nt, Human
ugaaaaaccacaaguuuag

SEQ ID NO: 710916 - RNA, 22 nt, Human
ugaaaauacgcaaaacacgcaa

SEQ ID NO: 710917 - RNA, 19 nt, Human
ugacuccuggcucuguccc

SEQ ID NO: 710918 - RNA, 23 nt, Human
ugacuucucagagggucaugcac

SEQ ID NO: 710919 - RNA, 22 nt, Human
ugaguggauuaucuaauuaaaa

SEQ ID NO: 710920 - RNA, 21 nt, Human
ugaugagauuacagucaaaca

SEQ ID NO: 710921 - RNA, 20 nt, Human
ugcugcugcaccgaggaccg

SEQ ID NO: 710922 - RNA, 23 nt, Human
uggaauaaucacuggcucuuggg

SEQ ID NO: 710923 - RNA, 21 nt, Human
uggaguggcacuuguugagag

SEQ ID NO: 710924 - RNA, 24 nt, Human
uggaguggcacuuguugagaggau

SEQ ID NO: 710925 - RNA, 18 nt, Human
uggaguguuuugugugcu

SEQ ID NO: 710926 - RNA, 26 nt, Human
uggcacugcacuugacuccuggcucu

SEQ ID NO: 710927 - RNA, 21 nt, Human
ugguguggaugccauggggcc

SEQ ID NO: 710928 - RNA, 21 nt, Human
uguaauguguuugggacuugc

SEQ ID NO: 710929 - RNA, 19 nt, Human
ugucuuguuaccucugagc

SEQ ID NO: 710930 - RNA, 18 nt, Human
uguugagaggauggccug

SEQ ID NO: 710931 - RNA, 24 nt, Human
uuaaagcagauuuucuaaaguagu

SEQ ID NO: 710932 - RNA, 22 nt, Human
uuaaagcuucaucaaagauuca

SEQ ID NO: 710933 - RNA, 24 nt, Human
uuacagcccuuuauauaucuuuua

SEQ ID NO: 710934 - RNA, 19 nt, Human
uucagauauuuguuccaua

SEQ ID NO: 710935 - RNA, 20 nt, Human
uuccacugauguauaaacau

SEQ ID NO: 710936 - RNA, 23 nt, Human
uuccauaaugugcagaauauccu

SEQ ID NO: 710937 - RNA, 22 nt, Human
uucccaugaaaaucuauuuuau

SEQ ID NO: 710938 - RNA, 23 nt, Human
uucccaugaaaaucuauuuuaua

SEQ ID NO: 710939 - RNA, 24 nt, Human
uuugcacaaccaaugagucggagg

SEQ ID NO: 710940 - RNA, 20 nt, Human
uuuuacauucacagauuggc

SEQ ID NO: 710941 - RNA, 23 nt, Human
uuuuuacauucacagauuggcug

SEQ ID NO: 710942 - RNA, 22 nt, Human
aaaaaagcaauuuauaaaggca

SEQ ID NO: 710943 - RNA, 22 nt, Human
aaaacaaacuaguuuuuguuuu

SEQ ID NO: 710944 - RNA, 23 nt, Human
aaagaugacaaauuuuuagauaa

SEQ ID NO: 710945 - RNA, 24 nt, Human
aaagugcugggauuauaggcuuga

SEQ ID NO: 710946 - RNA, 18 nt, Human
aaauagccucaaaaugau

SEQ ID NO: 710947 - RNA, 24 nt, Human
aagacacaaaagaggacuuaaaca

SEQ ID NO: 710948 - RNA, 24 nt, Human
aagcaagagauggaaaaagucaga

SEQ ID NO: 710949 - RNA, 25 nt, Human
aagcaagagauggaaaaagucagaa

SEQ ID NO: 710950 - RNA, 19 nt, Human
aagugcugggauuauaggc

SEQ ID NO: 710951 - RNA, 19 nt, Human
aagugcugggauuauaggc

SEQ ID NO: 710952 - RNA, 21 nt, Human
aauuaugguaccaugcagcuu

SEQ ID NO: 710953 - RNA, 22 nt, Human
acaaaacagaacauucauggau

SEQ ID NO: 710954 - RNA, 22 nt, Human
acaaacaagacgcuaguaugca

SEQ ID NO: 710955 - RNA, 26 nt, Human
acaaagaaaaauucugucauucccca

SEQ ID NO: 710956 - RNA, 23 nt, Human
acacauacuccaccaauccacca

SEQ ID NO: 710957 - RNA, 18 nt, Human
acaguaugccaguuuccc

SEQ ID NO: 710958 - RNA, 18 nt, Human
accauguuggccaggcug

SEQ ID NO: 710959 - RNA, 23 nt, Human
acccugccuccaaaaaaaaagca

SEQ ID NO: 710960 - RNA, 24 nt, Human
acucuguacauacauuucacaaca

SEQ ID NO: 710961 - RNA, 18 nt, Human
acugcucuccagccuggg

SEQ ID NO: 710962 - RNA, 24 nt, Human
acugcucuccagccugggugacag

SEQ ID NO: 710963 - RNA, 24 nt, Human
acugugccacugcucuccagccug

SEQ ID NO: 710964 - RNA, 23 nt, Human
agccgggcaugguggcgcacgcc

SEQ ID NO: 710965 - RNA, 19 nt, Human
aggacaaauaccuucccuc

SEQ ID NO: 710966 - RNA, 21 nt, Human
aggcagugaaauuacaauuau

SEQ ID NO: 710967 - RNA, 24 nt, Human
aggugcaguagcucaugccuguaa

SEQ ID NO: 710968 - RNA, 22 nt, Human
agguuucaccauguuggccagg

SEQ ID NO: 710969 - RNA, 24 nt, Human
agguuucaccauguuggccagggg

SEQ ID NO: 710970 - RNA, 22 nt, Human
aguagcucaugccuguaauccc

SEQ ID NO: 710971 - RNA, 22 nt, Human
aguagcucaugccuguaauccc

SEQ ID NO: 710972 - RNA, 24 nt, Human
aguagcucaugccuguaaucccgg

SEQ ID NO: 710973 - RNA, 19 nt, Human
agucaauuuaaacaggccu

SEQ ID NO: 710974 - RNA, 24 nt, Human
agugcugggauuauaggcuugagc

SEQ ID NO: 710975 - RNA, 18 nt, Human
aguugaaaaaacaaguaa

SEQ ID NO: 710976 - RNA, 22 nt, Human
auaaaauuuaaaauuuccucau

SEQ ID NO: 710977 - RNA, 19 nt, Human
aucugccugccuuggccuc

SEQ ID NO: 710978 - RNA, 19 nt, Human
augccuguaaucccggcac

SEQ ID NO: 710979 - RNA, 33 nt, Human
augggguuucagguuucaccauguuggccagga

SEQ ID NO: 710980 - RNA, 24 nt, Human
caaaacaccaaauguaccuauaag

SEQ ID NO: 710981 - RNA, 18 nt, Human
caaagugcugggauuaua

SEQ ID NO: 710982 - RNA, 22 nt, Human
caagagauggaaaaagucagaa

SEQ ID NO: 710983 - RNA, 18 nt, Human
caaggagaguuccccucu

SEQ ID NO: 710984 - RNA, 23 nt, Human
cacaaaaggcaaaguaaagucaa

SEQ ID NO: 710985 - RNA, 21 nt, Human
caccauguuggccaggcuggu

SEQ ID NO: 710986 - RNA, 23 nt, Human
caccauguuggccaggcuggucu

SEQ ID NO: 710987 - RNA, 24 nt, Human
caccauguuggccaggcuggucuu

SEQ ID NO: 710988 - RNA, 27 nt, Human
caccauguuggccaggcuggucuuaaa

SEQ ID NO: 710989 - RNA, 20 nt, Human
caccccuacccucuuucucc

SEQ ID NO: 710990 - RNA, 24 nt, Human
cacugcucuccagccugggugaca

SEQ ID NO: 710991 - RNA, 20 nt, Human
cacuguauacaagaacaaac

SEQ ID NO: 710992 - RNA, 24 nt, Human
cagccuaauaaaugacagcacgaa

SEQ ID NO: 710993 - RNA, 18 nt, Human
cagcugagagaguucugc

SEQ ID NO: 710994 - RNA, 23 nt, Human
cagcugagagaguucugucucuc

SEQ ID NO: 710995 - RNA, 22 nt, Human
cagguuucaccauguuggccag

SEQ ID NO: 710996 - RNA, 23 nt, Human
caguaguuuuuaaaaggccccaa

SEQ ID NO: 710997 - RNA, 19 nt, Human
cauccaucuucccuacagu

SEQ ID NO: 710998 - RNA, 23 nt, Human
caugcaccaccacaccuggcuaa

SEQ ID NO: 710999 - RNA, 24 nt, Human
caugccuguaaucccggcacuuug

SEQ ID NO: 711000 - RNA, 24 nt, Human
cauguuggccaggcuggucuuaaa

SEQ ID NO: 711001 - RNA, 22 nt, Human
ccaaagugcugggauuauaggc

SEQ ID NO: 711002 - RNA, 23 nt, Human
ccaaagugcugggauuauaggcu

SEQ ID NO: 711003 - RNA, 22 nt, Human
ccaccaugccucgccuaaaagc

SEQ ID NO: 711004 - RNA, 18 nt, Human
ccacugcucuccagccug

SEQ ID NO: 711005 - RNA, 20 nt, Human
ccacugcucuccagccuggg

SEQ ID NO: 711006 - RNA, 21 nt, Human
ccacugcucuccagccugggu

SEQ ID NO: 711007 - RNA, 21 nt, Human
ccacugcucuccagccugggu

SEQ ID NO: 711008 - RNA, 24 nt, Human
ccacugcucuccagccugggugac

SEQ ID NO: 711009 - RNA, 23 nt, Human
ccagccaggcuuucucaaaacua

SEQ ID NO: 711010 - RNA, 24 nt, Human
cccaaagugcugggauuauaggcu

SEQ ID NO: 711011 - RNA, 21 nt, Human
cccacacacaaauaaugaaac

SEQ ID NO: 711012 - RNA, 24 nt, Human
ccuccaaaaaaaaagcaauuuaua

SEQ ID NO: 711013 - RNA, 19 nt, Human
ccucgccuaaaagcaaaau

SEQ ID NO: 711014 - RNA, 21 nt, Human
ccugaccucaaaugaucugcc

SEQ ID NO: 711015 - RNA, 23 nt, Human
ccugaccucaaaugaucugccug

SEQ ID NO: 711016 - RNA, 21 nt, Human
ccugagccccagcuacucggg

SEQ ID NO: 711017 - RNA, 24 nt, Human
ccugccuccaaaaaaaaagcaauu

SEQ ID NO: 711018 - RNA, 22 nt, Human
ccugccuuggccucccaaagug

SEQ ID NO: 711019 - RNA, 24 nt, Human
ccugccuuggccucccaaagugcu

SEQ ID NO: 711020 - RNA, 22 nt, Human
ccuguaaucccggcacuuuggg

SEQ ID NO: 711021 - RNA, 23 nt, Human
cgccugagccccagcuacucggg

SEQ ID NO: 711022 - RNA, 20 nt, Human
cggcacuuugggaggcuaag

SEQ ID NO: 711023 - RNA, 19 nt, Human
cucaaaaaaaaaaaaagca

SEQ ID NO: 711024 - RNA, 21 nt, Human
cucaaaaaaaaaaaaagcacc

SEQ ID NO: 711025 - RNA, 25 nt, Human
cucaagccucagcuaaggauggauc

SEQ ID NO: 711026 - RNA, 23 nt, Human
cucaugccuguaaucccggcacu

SEQ ID NO: 711027 - RNA, 24 nt, Human
cucaugccuguaaucccggcacuu

SEQ ID NO: 711028 - RNA, 18 nt, Human
cuccaccaauccaccaaa

SEQ ID NO: 711029 - RNA, 18 nt, Human
cuccagccugggugacag

SEQ ID NO: 711030 - RNA, 26 nt, Human
cuccugaccucaaaugaucugccugc

SEQ ID NO: 711031 - RNA, 23 nt, Human
cucgggaggcugggauuacaggc

SEQ ID NO: 711032 - RNA, 24 nt, Human
cucgggaggcugggauuacaggca

SEQ ID NO: 711033 - RNA, 18 nt, Human
cugacccacacuccccug

SEQ ID NO: 711034 - RNA, 22 nt, Human
cugcagugagcuaugacugugc

SEQ ID NO: 711035 - RNA, 21 nt, Human
cugucucucuccauguaggau

SEQ ID NO: 711036 - RNA, 26 nt, Human
gaauucuuauuaaaaaaaacaaaaca

SEQ ID NO: 711037 - RNA, 25 nt, Human
gacccacacuccccuggcucuccac

SEQ ID NO: 711038 - RNA, 23 nt, Human
gaccucaaaugaucugccugccu

SEQ ID NO: 711039 - RNA, 19 nt, Human
gagaaacacaaaaggcaaa

SEQ ID NO: 711040 - RNA, 18 nt, Human
gagcuaugacugugccac

SEQ ID NO: 711041 - RNA, 18 nt, Human
gaggcugggauuacaggc

SEQ ID NO: 711042 - RNA, 20 nt, Human
gaggcugggauuacaggcau

SEQ ID NO: 711043 - RNA, 21 nt, Human
gauuauaggcuugagccacca

SEQ ID NO: 711044 - RNA, 24 nt, Human
gauuauaggcuugagccaccaugc

SEQ ID NO: 711045 - RNA, 18 nt, Human
gcacgccugagccccagc

SEQ ID NO: 711046 - RNA, 19 nt, Human
gcacuuugggaggcuaagg

SEQ ID NO: 711047 - RNA, 22 nt, Human
gcacuuugggaggcuaaggagg

SEQ ID NO: 711048 - RNA, 19 nt, Human
gccacugcucuccagccug

SEQ ID NO: 711049 - RNA, 24 nt, Human
gccacugcucuccagccuggguga

SEQ ID NO: 711050 - RNA, 18 nt, Human
gccaguuucccaccccua

SEQ ID NO: 711051 - RNA, 24 nt, Human
gcccagguguucgaggcugcagug

SEQ ID NO: 711052 - RNA, 19 nt, Human
gccugagccccagcuacuc

SEQ ID NO: 711053 - RNA, 22 nt, Human
gccuuggccucccaaagugcug

SEQ ID NO: 711054 - RNA, 24 nt, Human
gcugaaauacagggaauuuuacua

SEQ ID NO: 711055 - RNA, 19 nt, Human
gcugcagugagcuaugacu

SEQ ID NO: 711056 - RNA, 23 nt, Human
gcuggucuuaaacuccugaccuc

SEQ ID NO: 711057 - RNA, 22 nt, Human
ggaaaugucuucaaggcucaga

SEQ ID NO: 711058 - RNA, 18 nt, Human
ggagaaauauaaugaccc

SEQ ID NO: 711059 - RNA, 18 nt, Human
ggaggcugggauuacagg

SEQ ID NO: 711060 - RNA, 24 nt, Human
ggauuauaggcuugagccaccaug

SEQ ID NO: 711061 - RNA, 23 nt, Human
ggcaugguggcgcacgccugagc

SEQ ID NO: 711062 - RNA, 21 nt, Human
ggccaggugcaguagcucaug

SEQ ID NO: 711063 - RNA, 24 nt, Human
ggcuggucuuaaacuccugaccuc

SEQ ID NO: 711064 - RNA, 24 nt, Human
gggaggcugggauuacaggcaugc

SEQ ID NO: 711065 - RNA, 22 nt, Human
gggcaugguggcgcacgccuga

SEQ ID NO: 711066 - RNA, 20 nt, Human
gggucucaaaaaaaaaaaaa

SEQ ID NO: 711067 - RNA, 19 nt, Human
guaaagucaauuuaaacag

SEQ ID NO: 711068 - RNA, 19 nt, Human
gucucaaaaaaaaaaaaag

SEQ ID NO: 711069 - RNA, 21 nt, Human
gucucucuccauguaggaucc

SEQ ID NO: 711070 - RNA, 20 nt, Human
guucuuaaacaaggacaucu

SEQ ID NO: 711071 - RNA, 22 nt, Human
uaaaaaaaacaaaacagaacau

SEQ ID NO: 711072 - RNA, 22 nt, Human
uaaacaggccucacaaaaauca

SEQ ID NO: 711073 - RNA, 24 nt, Human
uaagaaaacacuguauacaagaac

SEQ ID NO: 711074 - RNA, 24 nt, Human
uaagacacaaaagaggacuuaaac

SEQ ID NO: 711075 - RNA, 24 nt, Human
uaagagaguuugucagaccuggug

SEQ ID NO: 711076 - RNA, 21 nt, Human
uaaggagaaauauaaugaccc

SEQ ID NO: 711077 - RNA, 24 nt, Human
uaaggagaaauauaaugacccaca

SEQ ID NO: 711078 - RNA, 19 nt, Human
uacaagaacaaacacuaga

SEQ ID NO: 711079 - RNA, 22 nt, Human
uacaggcaugcaccaccacacc

SEQ ID NO: 711080 - RNA, 23 nt, Human
uaccaugcagcuuauuuccccau

SEQ ID NO: 711081 - RNA, 19 nt, Human
uaccuaauauguacccaca

SEQ ID NO: 711082 - RNA, 21 nt, Human
uacuccaccaauccaccaaac

SEQ ID NO: 711083 - RNA, 22 nt, Human
uagauaaaauugagaaacacaa

SEQ ID NO: 711084 - RNA, 23 nt, Human
uagauagcuuacauuaaagucuc

SEQ ID NO: 711085 - RNA, 24 nt, Human
uagcucaugccuguaaucccggca

SEQ ID NO: 711086 - RNA, 18 nt, Human
uagcuuguuucagauucg

SEQ ID NO: 711087 - RNA, 19 nt, Human
uaguuuuuaaaaggcccca

SEQ ID NO: 711088 - RNA, 19 nt, Human
uauaaugacccacauguua

SEQ ID NO: 711089 - RNA, 26 nt, Human
uauacaagaacaaacacuagacuacc

SEQ ID NO: 711090 - RNA, 21 nt, Human
ucaagagaaagcccaucagga

SEQ ID NO: 711091 - RNA, 18 nt, Human
ucacuucagcccaggugu

SEQ ID NO: 711092 - RNA, 19 nt, Human
uccagccugggugacagag

SEQ ID NO: 711093 - RNA, 20 nt, Human
uccagccugggugacagaga

SEQ ID NO: 711094 - RNA, 24 nt, Human
ucccaaagugcugggauuauaggc

SEQ ID NO: 711095 - RNA, 21 nt, Human
uccccuggcucuccacuuuua

SEQ ID NO: 711096 - RNA, 27 nt, Human
uccccuggcucuccacuuuuaggcaca

SEQ ID NO: 711097 - RNA, 18 nt, Human
uccugaccucaaaugauc

SEQ ID NO: 711098 - RNA, 23 nt, Human
ucgggaggcugggauuacaggca

SEQ ID NO: 711099 - RNA, 24 nt, Human
ucgggaggcugggauuacaggcau

SEQ ID NO: 711100 - RNA, 28 nt, Human
ucuaucagacuuuguuccagaaacuauu

SEQ ID NO: 711101 - RNA, 24 nt, Human
ucuaugaccaaggaaaaccggggc

SEQ ID NO: 711102 - RNA, 19 nt, Human
ucuccagccugggugacag

SEQ ID NO: 711103 - RNA, 23 nt, Human
ucucugccauaaucuaccaucag

SEQ ID NO: 711104 - RNA, 20 nt, Human
ucugagagugucagcugaga

SEQ ID NO: 711105 - RNA, 21 nt, Human
ugaaaaaacaaguaacagaau

SEQ ID NO: 711106 - RNA, 24 nt, Human
ugaaaaaacaaguaacagaauuaa

SEQ ID NO: 711107 - RNA, 24 nt, Human
ugaaauuacaauuaugaaauuuuc

SEQ ID NO: 711108 - RNA, 24 nt, Human
ugaagcaagagauggaaaaaguca

SEQ ID NO: 711109 - RNA, 23 nt, Human
ugacacacacacauacuccacca

SEQ ID NO: 711110 - RNA, 23 nt, Human
ugaccaaggaaaacuuuuaggau

SEQ ID NO: 711111 - RNA, 23 nt, Human
ugacccacauguuaauuuauauu

SEQ ID NO: 711112 - RNA, 18 nt, Human
ugaccucaaaugaucugc

SEQ ID NO: 711113 - RNA, 21 nt, Human
ugauuaaacugaccuuuccuu

SEQ ID NO: 711114 - RNA, 18 nt, Human
ugccugccuuggccuccc

SEQ ID NO: 711115 - RNA, 23 nt, Human
ugccuguaaucccggcacuuugg

SEQ ID NO: 711116 - RNA, 18 nt, Human
uggaugggcaaagaaagg

SEQ ID NO: 711117 - RNA, 24 nt, Human
uggccaggcuggucuuaaacuccu

SEQ ID NO: 711118 - RNA, 19 nt, Human
uggcuugccagagaggcag

SEQ ID NO: 711119 - RNA, 24 nt, Human
ugggaggcuaaggagggaggauca

SEQ ID NO: 711120 - RNA, 21 nt, Human
ugggauuacaggcaugcacca

SEQ ID NO: 711121 - RNA, 24 nt, Human
ugggauuacaggcaugcaccacca

SEQ ID NO: 711122 - RNA, 18 nt, Human
ugggauuauaggcuugag

SEQ ID NO: 711123 - RNA, 21 nt, Human
ugggauuauaggcuugagcca

SEQ ID NO: 711124 - RNA, 22 nt, Human
ugggauuauaggcuugagccac

SEQ ID NO: 711125 - RNA, 24 nt, Human
ugggauuauaggcuugagccacca

SEQ ID NO: 711126 - RNA, 25 nt, Human
ugggauuauaggcuugagccaccau

SEQ ID NO: 711127 - RNA, 22 nt, Human
ugggguuucagguuucaccaug

SEQ ID NO: 711128 - RNA, 20 nt, Human
ugguagagaugggguuucag

SEQ ID NO: 711129 - RNA, 24 nt, Human
uguaccucuuucaccacagggcua

SEQ ID NO: 711130 - RNA, 19 nt, Human
ugucuuaaggaguaagaga

SEQ ID NO: 711131 - RNA, 22 nt, Human
ugugaaaauagccucaaaauga

SEQ ID NO: 711132 - RNA, 24 nt, Human
uuagauagcuuacauuaaagucuc

SEQ ID NO: 711133 - RNA, 18 nt, Human
uuagccgggcaugguggc

SEQ ID NO: 711134 - RNA, 21 nt, Human
uuccagccaggcuuucucaaa

SEQ ID NO: 711135 - RNA, 20 nt, Human
uucccagugcaaaacaccaa

SEQ ID NO: 711136 - RNA, 24 nt, Human
uucugcaucauguauaucccaaaa

SEQ ID NO: 711137 - RNA, 18 nt, Human
uuggccucccaaagugcu

SEQ ID NO: 711138 - RNA, 25 nt, Human
uugggaggcuaaggagggaggauca

SEQ ID NO: 711139 - RNA, 23 nt, Human
uugguagagaugggguuucaggu

SEQ ID NO: 711140 - RNA, 24 nt, Human
uuucaccauguuggccaggcuggu

SEQ ID NO: 711141 - RNA, 25 nt, Human
uuucucaaaacuagggcagaauuuu

SEQ ID NO: 711142 - RNA, 22 nt, Human
uuugucuuaaggaguaagagag

SEQ ID NO: 711143 - RNA, 20 nt, Human
uuuucuaucagacuuuguuc

SEQ ID NO: 711144 - RNA, 22 nt, Human
uuuuugguagagaugggguuuc

SEQ ID NO: 711145 - RNA, 23 nt, Human
uuuuuguuuuugagccagggucu

SEQ ID NO: 711146 - RNA, 21 nt, Human
uuuuuuauuuuuuugguagag

SEQ ID NO: 711147 - RNA, 23 nt, Human
uuuuuugguagagaugggguuuc

SEQ ID NO: 711148 - RNA, 18 nt, Human
aaaaagcaaaauaaaaau

SEQ ID NO: 711149 - RNA, 19 nt, Human
aaaauuucugaccugguua

SEQ ID NO: 711150 - RNA, 21 nt, Human
aaagcaaauauucaaaggguu

SEQ ID NO: 711151 - RNA, 19 nt, Human
aaaguauguuuaaugguug

SEQ ID NO: 711152 - RNA, 21 nt, Human
aagcaaaauaaaaauccucug

SEQ ID NO: 711153 - RNA, 22 nt, Human
aagcaaaauaaaaauccucuga

SEQ ID NO: 711154 - RNA, 18 nt, Human
aaguauguuuaaugguug

SEQ ID NO: 711155 - RNA, 18 nt, Human
accugggaaguaaauugu

SEQ ID NO: 711156 - RNA, 18 nt, Human
acuggacacagaagcaca

SEQ ID NO: 711157 - RNA, 18 nt, Human
acuuuauuccaaaaucuc

SEQ ID NO: 711158 - RNA, 21 nt, Human
agaaaaacuccaccaauagua

SEQ ID NO: 711159 - RNA, 21 nt, Human
agaaaacuggacacagaagca

SEQ ID NO: 711160 - RNA, 26 nt, Human
aggagauaacaggaguuuuuaauagc

SEQ ID NO: 711161 - RNA, 23 nt, Human
agggggucuccgcacuucggggg

SEQ ID NO: 711162 - RNA, 20 nt, Human
agguauaugcucacaacaua

SEQ ID NO: 711163 - RNA, 23 nt, Human
aucugauugaugagguacagauu

SEQ ID NO: 711164 - RNA, 22 nt, Human
caaagucugaaaugccaaaaag

SEQ ID NO: 711165 - RNA, 21 nt, Human
caacauaagugaguaugagac

SEQ ID NO: 711166 - RNA, 19 nt, Human
caauacauugauguccucc

SEQ ID NO: 711167 - RNA, 20 nt, Human
cacugaucaaagucugaaau

SEQ ID NO: 711168 - RNA, 23 nt, Human
cagauuaaaaagcaauacaagug

SEQ ID NO: 711169 - RNA, 20 nt, Human
caguacagcaaacucaucuc

SEQ ID NO: 711170 - RNA, 22 nt, Human
cauaucccuucucccauucuca

SEQ ID NO: 711171 - RNA, 20 nt, Human
caugaaaagccuguguaaug

SEQ ID NO: 711172 - RNA, 19 nt, Human
caugucaccagagcacugu

SEQ ID NO: 711173 - RNA, 20 nt, Human
ccaauaguagaaacaaagua

SEQ ID NO: 711174 - RNA, 18 nt, Human
ccacaaguaaaaaacugg

SEQ ID NO: 711175 - RNA, 20 nt, Human
cccacaaguaaaaaacuggu

SEQ ID NO: 711176 - RNA, 19 nt, Human
cucacuuuauuccaaaauc

SEQ ID NO: 711177 - RNA, 26 nt, Human
cuuuaaaacuccccugguuuccauuu

SEQ ID NO: 711178 - RNA, 23 nt, Human
cuuuggaaaggggaagugggcac

SEQ ID NO: 711179 - RNA, 21 nt, Human
gagacuuuucaagcaagcacu

SEQ ID NO: 711180 - RNA, 20 nt, Human
gcaguguuuccuuuaaaaag

SEQ ID NO: 711181 - RNA, 24 nt, Human
uaaaaaccauaaugccuugacuga

SEQ ID NO: 711182 - RNA, 24 nt, Human
uaaaaagcaauacaagugcacuua

SEQ ID NO: 711183 - RNA, 19 nt, Human
uaaaagcaaauauucaaag

SEQ ID NO: 711184 - RNA, 19 nt, Human
uaagugaguaugagaccug

SEQ ID NO: 711185 - RNA, 18 nt, Human
uaauaccccaaaaucuua

SEQ ID NO: 711186 - RNA, 18 nt, Human
uauagaaaaacuccacca

SEQ ID NO: 711187 - RNA, 23 nt, Human
uauagcauagucucauauuuuga

SEQ ID NO: 711188 - RNA, 22 nt, Human
uauguguacaguuuauauucca

SEQ ID NO: 711189 - RNA, 23 nt, Human
uauuucacugacaauuuguuuau

SEQ ID NO: 711190 - RNA, 25 nt, Human
ucacaacauaucccuucucccauuc

SEQ ID NO: 711191 - RNA, 23 nt, Human
ucacacccacaaguaaaaaacug

SEQ ID NO: 711192 - RNA, 21 nt, Human
ucaguacagcaaacucaucuc

SEQ ID NO: 711193 - RNA, 25 nt, Human
uccaaaaucucauuuauuucacuga

SEQ ID NO: 711194 - RNA, 22 nt, Human
uccccugguuuccauuuaaaug

SEQ ID NO: 711195 - RNA, 21 nt, Human
ugaauaaaauuucugaccugg

SEQ ID NO: 711196 - RNA, 26 nt, Human
ugaauaucaugauuacaaaacaggua

SEQ ID NO: 711197 - RNA, 23 nt, Human
ugacacauauauuuaucauguca

SEQ ID NO: 711198 - RNA, 27 nt, Human
ugauuacaaaacagguauuaagaacug

SEQ ID NO: 711199 - RNA, 20 nt, Human
ugcagcgucaguacagcaaa

SEQ ID NO: 711200 - RNA, 21 nt, Human
ugccaaaaagcaaaauaaaaa

SEQ ID NO: 711201 - RNA, 22 nt, Human
ugcuuuggaaaggggaaguggg

SEQ ID NO: 711202 - RNA, 25 nt, Human
ugcuuuggaaaggggaagugggcac

SEQ ID NO: 711203 - RNA, 24 nt, Human
ugucacaaagccuuuauuaacagg

SEQ ID NO: 711204 - RNA, 19 nt, Human
ugucuugaucuaguugaaa

SEQ ID NO: 711205 - RNA, 26 nt, Human
uguguaaugaagccuggguccuuuaa

SEQ ID NO: 711206 - RNA, 25 nt, Human
uuaaaugcuuuaacauugagucauc

SEQ ID NO: 711207 - RNA, 22 nt, Human
uuuaaugaccugaaauucaaac

SEQ ID NO: 711208 - RNA, 26 nt, Human
aaaaauacauaauacagaaaccaaaa

SEQ ID NO: 711209 - RNA, 18 nt, Human
aaaacacaacagaaacaa

SEQ ID NO: 711210 - RNA, 24 nt, Human
aaaacacaacagaaacaaaaccag

SEQ ID NO: 711211 - RNA, 24 nt, Human
aaacacaacagaaacaaaaccaga

SEQ ID NO: 711212 - RNA, 25 nt, Human
aaaccaaaacaaaacacaacagaaa

SEQ ID NO: 711213 - RNA, 28 nt, Human
aaaccaaaacaaaacacaacagaaacaa

SEQ ID NO: 711214 - RNA, 22 nt, Human
aaaccccagccuagugggccca

SEQ ID NO: 711215 - RNA, 20 nt, Human
aaaucaaagaaauuuauugg

SEQ ID NO: 711216 - RNA, 26 nt, Human
aacaaaacacaacagaaacaaaacca

SEQ ID NO: 711217 - RNA, 25 nt, Human
aacagaaacaaaaccagaaacccca

SEQ ID NO: 711218 - RNA, 25 nt, Human
aaccagaaaccccagccuagugggc

SEQ ID NO: 711219 - RNA, 19 nt, Human
acaaaaauacauaauacag

SEQ ID NO: 711220 - RNA, 22 nt, Human
acaaaacacaacagaaacaaaa

SEQ ID NO: 711221 - RNA, 25 nt, Human
acaaaacacaacagaaacaaaacca

SEQ ID NO: 711222 - RNA, 28 nt, Human
acaaaacacaacagaaacaaaaccagaa

SEQ ID NO: 711223 - RNA, 19 nt, Human
acaacagaaacaaaaccag

SEQ ID NO: 711224 - RNA, 22 nt, Human
acaacagaaacaaaaccagaaa

SEQ ID NO: 711225 - RNA, 22 nt, Human
acagaaacaaaaccagaaaccc

SEQ ID NO: 711226 - RNA, 21 nt, Human
caaaacaaaacacaacagaaa

SEQ ID NO: 711227 - RNA, 21 nt, Human
caaaacacaacagaaacaaaa

SEQ ID NO: 711228 - RNA, 27 nt, Human
caaaacacaacagaaacaaaaccagaa

SEQ ID NO: 711229 - RNA, 19 nt, Human
caaaaccagaaaccccagc

SEQ ID NO: 711230 - RNA, 21 nt, Human
caaaaccagaaaccccagccu

SEQ ID NO: 711231 - RNA, 23 nt, Human
caacagaaacaaaaccagaaacc

SEQ ID NO: 711232 - RNA, 23 nt, Human
ccaaaacaaaacacaacagaaac

SEQ ID NO: 711233 - RNA, 22 nt, Human
ccagacucccacaaagcauggc

SEQ ID NO: 711234 - RNA, 19 nt, Human
gaaacaaaaccagaaaccc

SEQ ID NO: 711235 - RNA, 20 nt, Human
gaaacaaaaccagaaacccc

SEQ ID NO: 711236 - RNA, 20 nt, Human
uacauaauacagaaaccaaa

SEQ ID NO: 711237 - RNA, 19 nt, Human
uccgggacucuucgauggc

SEQ ID NO: 711238 - RNA, 23 nt, Human
ucuuccgggacucuucgaugggg

SEQ ID NO: 711239 - RNA, 23 nt, Human
ugugccgacccagacucccacaa

SEQ ID NO: 711240 - RNA, 23 nt, Human
aaaaagaaaagaaaaggaucugg

SEQ ID NO: 711241 - RNA, 20 nt, Human
aacuauuaaagaguuucuaa

SEQ ID NO: 711242 - RNA, 19 nt, Human
acagagaagagcucacaaa

SEQ ID NO: 711243 - RNA, 23 nt, Human
acggacagucuucuagagcagca

SEQ ID NO: 711244 - RNA, 22 nt, Human
acuauuaaaaagcuaggaaaga

SEQ ID NO: 711245 - RNA, 22 nt, Human
acuugugccacaaugacuccuc

SEQ ID NO: 711246 - RNA, 19 nt, Human
agaaaagaaaaggaucugg

SEQ ID NO: 711247 - RNA, 23 nt, Human
aucuucuaggcaggaguagagau

SEQ ID NO: 711248 - RNA, 22 nt, Human
caaugacuccucccccuagcuc

SEQ ID NO: 711249 - RNA, 19 nt, Human
cacaaugacuccucccccu

SEQ ID NO: 711250 - RNA, 20 nt, Human
cauuucgaucuucuaggcaa

SEQ ID NO: 711251 - RNA, 25 nt, Human
cuagagcagcaggacgcugacagag

SEQ ID NO: 711252 - RNA, 23 nt, Human
cuugugccacaaugacuccuccc

SEQ ID NO: 711253 - RNA, 21 nt, Human
gagcaauuaaaaagaaaagaa

SEQ ID NO: 711254 - RNA, 20 nt, Human
gaguagagaugaggaacaca

SEQ ID NO: 711255 - RNA, 20 nt, Human
ggcagcuguuuacaagucug

SEQ ID NO: 711256 - RNA, 18 nt, Human
uaaaaagaaaagaaaagg

SEQ ID NO: 711257 - RNA, 21 nt, Human
uacauacaaccaguuuguaua

SEQ ID NO: 711258 - RNA, 24 nt, Human
uagagcagcaggacgcugacagag

SEQ ID NO: 711259 - RNA, 22 nt, Human
uaguuucucagccagccagccc

SEQ ID NO: 711260 - RNA, 20 nt, Human
uauguacaaauacuugugcc

SEQ ID NO: 711261 - RNA, 24 nt, Human
uauuaaaaagcuaggaaagauuag

SEQ ID NO: 711262 - RNA, 19 nt, Human
ucuaggcaggaguagagau

SEQ ID NO: 711263 - RNA, 22 nt, Human
ucuaggcaggaguagagaugag

SEQ ID NO: 711264 - RNA, 19 nt, Human
ugacuccucccccuagcuc

SEQ ID NO: 711265 - RNA, 20 nt, Human
ugacuccucccccuagcucc

SEQ ID NO: 711266 - RNA, 24 nt, Human
ugauacauacaaccaguuuguaua

SEQ ID NO: 711267 - RNA, 19 nt, Human
ugccgggggaguggggcag

SEQ ID NO: 711268 - RNA, 21 nt, Human
uggaacgaagaguagguagug

SEQ ID NO: 711269 - RNA, 19 nt, Human
uuaaaaagaaaagaaaagg

SEQ ID NO: 711270 - RNA, 22 nt, Human
uugggccuucuuucgcacaucu

SEQ ID NO: 711271 - RNA, 21 nt, Human
aaaaaaagcggaaggagccaa

SEQ ID NO: 711272 - RNA, 25 nt, Human
aaaaaaagcggaaggagccgguacc

SEQ ID NO: 711273 - RNA, 22 nt, Human
aaacuuaagacugacauucugg

SEQ ID NO: 711274 - RNA, 20 nt, Human
accccacaagucccuggagc

SEQ ID NO: 711275 - RNA, 20 nt, Human
acccuuucacuugaccccaa

SEQ ID NO: 711276 - RNA, 22 nt, Human
accggaccacaagccacccggc

SEQ ID NO: 711277 - RNA, 21 nt, Human
acgggaagccccucccacccc

SEQ ID NO: 711278 - RNA, 24 nt, Human
agaacucagcauuacuguccacca

SEQ ID NO: 711279 - RNA, 19 nt, Human
agccugaucagugugagac

SEQ ID NO: 711280 - RNA, 18 nt, Human
aggacuaucccccuaccc

SEQ ID NO: 711281 - RNA, 22 nt, Human
aggugcugaagagugaugccuc

SEQ ID NO: 711282 - RNA, 21 nt, Human
cacacuugaucaggacuaucc

SEQ ID NO: 711283 - RNA, 18 nt, Human
caccccacaagucccugg

SEQ ID NO: 711284 - RNA, 19 nt, Human
cagaccgaugcugcaggug

SEQ ID NO: 711285 - RNA, 23 nt, Human
caugcccugcagcgaacagacca

SEQ ID NO: 711286 - RNA, 21 nt, Human
ccaccccacaagucccuggag

SEQ ID NO: 711287 - RNA, 20 nt, Human
ccagaccgaugcugcaggug

SEQ ID NO: 711288 - RNA, 19 nt, Human
cccacaagucccuggagcc

SEQ ID NO: 711289 - RNA, 25 nt, Human
cccccuacccuuucacuugacccca

SEQ ID NO: 711290 - RNA, 19 nt, Human
ccucucuggcccugagccu

SEQ ID NO: 711291 - RNA, 23 nt, Human
ccugcagcuuccgcugacaccac

SEQ ID NO: 711292 - RNA, 24 nt, Human
cuaaggaguuugcuggaaauccac

SEQ ID NO: 711293 - RNA, 22 nt, Human
gaagccccucccaccccacaag

SEQ ID NO: 711294 - RNA, 20 nt, Human
gaucauggcuaaggaguuug

SEQ ID NO: 711295 - RNA, 20 nt, Human
gcagaagaucuucaauaagg

SEQ ID NO: 711296 - RNA, 20 nt, Human
gcagcgaacagaccaggugc

SEQ ID NO: 711297 - RNA, 24 nt, Human
gcagcgaacagaccaggugcugaa

SEQ ID NO: 711298 - RNA, 23 nt, Human
gccccucccaccccacaaguccc

SEQ ID NO: 711299 - RNA, 20 nt, Human
ggcucugacacccacaaauc

SEQ ID NO: 711300 - RNA, 20 nt, Human
ucaauaaggaugggcugaag

SEQ ID NO: 711301 - RNA, 18 nt, Human
uccaaaaaaagcggaagg

SEQ ID NO: 711302 - RNA, 21 nt, Human
ucccccuacccuuucacuuga

SEQ ID NO: 711303 - RNA, 20 nt, Human
uccuuuugauccaccccagc

SEQ ID NO: 711304 - RNA, 23 nt, Human
ucgaaugcuguucuccccagacc

SEQ ID NO: 711305 - RNA, 26 nt, Human
ucugacacccacaaauccucguggau

SEQ ID NO: 711306 - RNA, 25 nt, Human
ucuugcucucuuguugccucucugg

SEQ ID NO: 711307 - RNA, 19 nt, Human
ugaauggagaauaguuggc

SEQ ID NO: 711308 - RNA, 20 nt, Human
ugaauggagaauaguuggca

SEQ ID NO: 711309 - RNA, 23 nt, Human
ugaauggagaauaguuggcagaa

SEQ ID NO: 711310 - RNA, 25 nt, Human
ugagacagaacucagcauuacuguc

SEQ ID NO: 711311 - RNA, 18 nt, Human
uggaaauccacagguuau

SEQ ID NO: 711312 - RNA, 21 nt, Human
ugggcucugacacccacaaau

SEQ ID NO: 711313 - RNA, 21 nt, Human
ugugagacagaacucagcauu

SEQ ID NO: 711314 - RNA, 23 nt, Human
uguugcugaaacuuaagacugac

SEQ ID NO: 711315 - RNA, 23 nt, Human
uuccacuguuugcugguguugcu

SEQ ID NO: 711316 - RNA, 20 nt, Human
uugcugguguugcugaaacu

SEQ ID NO: 711317 - RNA, 26 nt, Human
aaacaagaagagaggagaggggaccc

SEQ ID NO: 711318 - RNA, 18 nt, Human
aacaucuaaauuuaaacc

SEQ ID NO: 711319 - RNA, 27 nt, Human
aagaaaccaaacaaugcagugggcacc

SEQ ID NO: 711320 - RNA, 20 nt, Human
aaguagaaggagugacaaua

SEQ ID NO: 711321 - RNA, 23 nt, Human
aucaaacaccaauaaaaauggca

SEQ ID NO: 711322 - RNA, 22 nt, Human
caacaaucuaagcaaaucucaa

SEQ ID NO: 711323 - RNA, 24 nt, Human
cauuccaauaaucaaacaccaaua

SEQ ID NO: 711324 - RNA, 20 nt, Human
cauucuagaauaccagggua

SEQ ID NO: 711325 - RNA, 22 nt, Human
cuaauuggaacaaacacauuua

SEQ ID NO: 711326 - RNA, 21 nt, Human
gaacaaacacauuuauguaaa

SEQ ID NO: 711327 - RNA, 19 nt, Human
gaagagaggagaggagaga

SEQ ID NO: 711328 - RNA, 24 nt, Human
ggcagcaguacaacaaucuaagca

SEQ ID NO: 711329 - RNA, 21 nt, Human
uaaaagaaaccaaacaaugca

SEQ ID NO: 711330 - RNA, 21 nt, Human
uaacucugcuuuuuaaagcaa

SEQ ID NO: 711331 - RNA, 25 nt, Human
uacaacaaucuaagcaaaucucaaa

SEQ ID NO: 711332 - RNA, 24 nt, Human
uacaacauacuuguaauuagaacu

SEQ ID NO: 711333 - RNA, 18 nt, Human
uacauucuagaauaccag

SEQ ID NO: 711334 - RNA, 21 nt, Human
uagaaggagugacaauauggc

SEQ ID NO: 711335 - RNA, 22 nt, Human
uagaaggagugacaauauggca

SEQ ID NO: 711336 - RNA, 23 nt, Human
uggaacaaacacauuuauguaaa

SEQ ID NO: 711337 - RNA, 25 nt, Human
ugguaaaagaaaccaaacaaugcau

SEQ ID NO: 711338 - RNA, 20 nt, Human
ugugcaaaaaucuaacucug

SEQ ID NO: 711339 - RNA, 20 nt, Human
uucacaacuacuuuugaaca

SEQ ID NO: 711340 - RNA, 27 nt, Human
uuccaauaaucaaacaccaagguaccc

SEQ ID NO: 711341 - RNA, 22 nt, Human
aaaaugcuacauggcccaaagc

SEQ ID NO: 711342 - RNA, 22 nt, Human
aaacaaauuaaaaagcuaugug

SEQ ID NO: 711343 - RNA, 24 nt, Human
aaaggcacaaacaaaucaacaggg

SEQ ID NO: 711344 - RNA, 25 nt, Human
aaaucaaagccacuauggcaaagaa

SEQ ID NO: 711345 - RNA, 20 nt, Human
aagaaaaagucuguacagcc

SEQ ID NO: 711346 - RNA, 19 nt, Human
aagcaaaaauguaacaggc

SEQ ID NO: 711347 - RNA, 19 nt, Human
aagcaccaccagccccacu

SEQ ID NO: 711348 - RNA, 24 nt, Human
aagccacuaauucagcaagaucca

SEQ ID NO: 711349 - RNA, 25 nt, Human
aaguaccuuuuuggcagaaucaucc

SEQ ID NO: 711350 - RNA, 23 nt, Human
aaguucuuuuuaucucccccacc

SEQ ID NO: 711351 - RNA, 24 nt, Human
aauucuccacauauuuguauuuuu

SEQ ID NO: 711352 - RNA, 21 nt, Human
accaccgcuucucccgcccug

SEQ ID NO: 711353 - RNA, 18 nt, Human
accgcuucucccgcccug

SEQ ID NO: 711354 - RNA, 20 nt, Human
acuacagccuccgcuaccac

SEQ ID NO: 711355 - RNA, 21 nt, Human
agcaagauccaggagaaagag

SEQ ID NO: 711356 - RNA, 25 nt, Human
aggagaaagagggcuacuuuuagaa

SEQ ID NO: 711357 - RNA, 19 nt, Human
aggcacaaacaaaucaaca

SEQ ID NO: 711358 - RNA, 19 nt, Human
auaaaguacugcuagguac

SEQ ID NO: 711359 - RNA, 24 nt, Human
caaagaaacaggagauuguacaga

SEQ ID NO: 711360 - RNA, 25 nt, Human
caaagaaacaggagauuguacagau

SEQ ID NO: 711361 - RNA, 21 nt, Human
caaaucagauauauacacacc

SEQ ID NO: 711362 - RNA, 22 nt, Human
caccaccagccccacuacagcc

SEQ ID NO: 711363 - RNA, 23 nt, Human
caccaccagccccacuacagccu

SEQ ID NO: 711364 - RNA, 19 nt, Human
cacuauggcaaagaaacag

SEQ ID NO: 711365 - RNA, 24 nt, Human
cacuuccugucccgcaguuggaag

SEQ ID NO: 711366 - RNA, 22 nt, Human
cagaaaauccuauuuacccaga

SEQ ID NO: 711367 - RNA, 20 nt, Human
cagcaacagauuaauaauuu

SEQ ID NO: 711368 - RNA, 18 nt, Human
cagcugauccaucccacu

SEQ ID NO: 711369 - RNA, 23 nt, Human
cauccaaagaguuuuucacagcu

SEQ ID NO: 711370 - RNA, 26 nt, Human
ccaaaucagauauauacacacccaca

SEQ ID NO: 711371 - RNA, 22 nt, Human
ccaccccccaagccacuaauuc

SEQ ID NO: 711372 - RNA, 19 nt, Human
ccacuacagccuccgcuac

SEQ ID NO: 711373 - RNA, 22 nt, Human
cccagaaaagcaaauuaaaaua

SEQ ID NO: 711374 - RNA, 20 nt, Human
cccgcaguuggaagcaccac

SEQ ID NO: 711375 - RNA, 24 nt, Human
ccuccgcuaccaccgcuucucccg

SEQ ID NO: 711376 - RNA, 18 nt, Human
ccugucccgcaguuggaa

SEQ ID NO: 711377 - RNA, 22 nt, Human
cgcuacggccacuuccuguccc

SEQ ID NO: 711378 - RNA, 20 nt, Human
cuacagcuagacaucagagc

SEQ ID NO: 711379 - RNA, 21 nt, Human
cucccgcccuguacagcugcc

SEQ ID NO: 711380 - RNA, 23 nt, Human
cuuucccagaaaagcaaauuaaa

SEQ ID NO: 711381 - RNA, 21 nt, Human
cuuuuuggcagaaucauccaa

SEQ ID NO: 711382 - RNA, 19 nt, Human
gacaaaacagggacuuuuu

SEQ ID NO: 711383 - RNA, 20 nt, Human
gagacuacagcuagacauca

SEQ ID NO: 711384 - RNA, 18 nt, Human
gcccaaagcuauacuaua

SEQ ID NO: 711385 - RNA, 23 nt, Human
gccuccgcuaccaccgcuucucc

SEQ ID NO: 711386 - RNA, 20 nt, Human
ggaagcaccaccagccccac

SEQ ID NO: 711387 - RNA, 18 nt, Human
ggcaguuaauaaaaggca

SEQ ID NO: 711388 - RNA, 26 nt, Human
guauuuuuccagaaguaccuuuuugg

SEQ ID NO: 711389 - RNA, 21 nt, Human
gugaaggaaagcugucauaca

SEQ ID NO: 711390 - RNA, 24 nt, Human
uaaaagcaaaaauguaacaggcag

SEQ ID NO: 711391 - RNA, 30 nt, Human
uaaaaggcacaaacaaaucaacagggauaa

SEQ ID NO: 711392 - RNA, 23 nt, Human
uaaaaugcuacauggcccaaagc

SEQ ID NO: 711393 - RNA, 19 nt, Human
uaaaauuucaggacaaaac

SEQ ID NO: 711394 - RNA, 25 nt, Human
uaaguucuuuuuaucucccccaccc

SEQ ID NO: 711395 - RNA, 20 nt, Human
uacccagaauagacuaaaau

SEQ ID NO: 711396 - RNA, 19 nt, Human
uagcaaaacugcuuuccca

SEQ ID NO: 711397 - RNA, 24 nt, Human
uagcaaaacugcuuucccagaaaa

SEQ ID NO: 711398 - RNA, 30 nt, Human
uauauacacacccacaaaaauagugugugg

SEQ ID NO: 711399 - RNA, 23 nt, Human
uccaaagaguuuuucacagcuga

SEQ ID NO: 711400 - RNA, 21 nt, Human
uccaacaagccgcuacggcca

SEQ ID NO: 711401 - RNA, 23 nt, Human
uccaacaagccgcuacggccacu

SEQ ID NO: 711402 - RNA, 23 nt, Human
uggaagcaccaccagccccacua

SEQ ID NO: 711403 - RNA, 24 nt, Human
uggcaaagaaacaggagauuguac

SEQ ID NO: 711404 - RNA, 21 nt, Human
ugguuaaaagcaaaaauguaa

SEQ ID NO: 711405 - RNA, 24 nt, Human
uguacagauggugaggcgaccauc

SEQ ID NO: 711406 - RNA, 20 nt, Human
ugucagaaaauccuauuuac

SEQ ID NO: 711407 - RNA, 24 nt, Human
ugucagaaaauccuauuuacccag

SEQ ID NO: 711408 - RNA, 24 nt, Human
uuaaaauaaugcaaucagcagauc

SEQ ID NO: 711409 - RNA, 23 nt, Human
uuaacauuucuuacuuuacccau

SEQ ID NO: 711410 - RNA, 25 nt, Human
uuacccagaauagacuaaaauuuca

SEQ ID NO: 711411 - RNA, 21 nt, Human
uuaucucccccaccccccaag

SEQ ID NO: 711412 - RNA, 21 nt, Human
uucuuuuuaucucccccaccc

SEQ ID NO: 711413 - RNA, 25 nt, Human
uugaaauaggaauuaagagucagca

SEQ ID NO: 711414 - RNA, 23 nt, Human
uuuagcaaaacugcuuucccaga

SEQ ID NO: 711415 - RNA, 19 nt, Human
uuuaucucccccacccccc

SEQ ID NO: 711416 - RNA, 23 nt, Human
uuucacagcugauccaucccacu

SEQ ID NO: 711417 - RNA, 22 nt, Human
aacacauucuuuacaacugccu

SEQ ID NO: 711418 - RNA, 25 nt, Human
aacugccuucuuaacagaaaauuac

SEQ ID NO: 711419 - RNA, 22 nt, Human
acauguauaugugauaugaaga

SEQ ID NO: 711420 - RNA, 24 nt, Human
auacauguauaugugauaugaaga

SEQ ID NO: 711421 - RNA, 18 nt, Human
cagaaaauuacuguagua

SEQ ID NO: 711422 - RNA, 21 nt, Human
cagaaaauuacuguaguauau

SEQ ID NO: 711423 - RNA, 23 nt, Human
ggauuucccccaucuccccacuu

SEQ ID NO: 711424 - RNA, 18 nt, Human
gucuuaaaucucucuucc

SEQ ID NO: 711425 - RNA, 20 nt, Human
uagaguuuuauauauauaca

SEQ ID NO: 711426 - RNA, 18 nt, Human
uauauauauacauguaua

SEQ ID NO: 711427 - RNA, 20 nt, Human
uauauauauacauguauaug

SEQ ID NO: 711428 - RNA, 22 nt, Human
uauauauauacauguauaugug

SEQ ID NO: 711429 - RNA, 26 nt, Human
ucccccaucuccccacuuagcaguaa

SEQ ID NO: 711430 - RNA, 23 nt, Human
ugaaaucuaaugucaaagaguuu

SEQ ID NO: 711431 - RNA, 22 nt, Human
uguacaaucaauaagucuuaaa

SEQ ID NO: 711432 - RNA, 24 nt, Human
ugugauaugaagagacugauguac

SEQ ID NO: 711433 - RNA, 20 nt, Human
ugugcaguugugaaaucuaa

SEQ ID NO: 711434 - RNA, 26 nt, Human
uuacaggccaauaaguucaauugugc

SEQ ID NO: 711435 - RNA, 20 nt, Human
uuuuuagguuuauauaaaca

SEQ ID NO: 711436 - RNA, 22 nt, Human
uccaaauaauuaucucuaaagc

SEQ ID NO: 711437 - RNA, 24 nt, Human
ucuaaagcaaauccuuuguuaguu

SEQ ID NO: 711438 - RNA, 21 nt, Human
ugugaaguaagcuauaaaaau

SEQ ID NO: 711439 - RNA, 23 nt, Human
aagcaacucuagcuccaaaccag

SEQ ID NO: 711440 - RNA, 25 nt, Human
acaccuccauagagugucuauggac

SEQ ID NO: 711441 - RNA, 21 nt, Human
aggggaggcagacaaccagaa

SEQ ID NO: 711442 - RNA, 24 nt, Human
aguugcuuccucucucaccaggaa

SEQ ID NO: 711443 - RNA, 19 nt, Human
auagagugucuauggaccc

SEQ ID NO: 711444 - RNA, 23 nt, Human
caccaggaagcaacucuagcucc

SEQ ID NO: 711445 - RNA, 21 nt, Human
cagcaaagagcagaaagggac

SEQ ID NO: 711446 - RNA, 20 nt, Human
cagcgccacauggagaaaga

SEQ ID NO: 711447 - RNA, 19 nt, Human
caggaagcaacucuagcuc

SEQ ID NO: 711448 - RNA, 19 nt, Human
cauggagaaagauaauuca

SEQ ID NO: 711449 - RNA, 21 nt, Human
ccaaaccagaugggugauuca

SEQ ID NO: 711450 - RNA, 23 nt, Human
gaaaggacacagcaaagagcaga

SEQ ID NO: 711451 - RNA, 23 nt, Human
gaaaugccugacccagcacccuc

SEQ ID NO: 711452 - RNA, 22 nt, Human
gggaggcagacaaccagaagga

SEQ ID NO: 711453 - RNA, 20 nt, Human
uaaaaauucugaaaggacac

SEQ ID NO: 711454 - RNA, 21 nt, Human
ucacauccacauuauguuccu

SEQ ID NO: 711455 - RNA, 22 nt, Human
ugaaaggacacagcaaagagca

SEQ ID NO: 711456 - RNA, 21 nt, Human
ugaggggaggcagacaaccag

SEQ ID NO: 711457 - RNA, 22 nt, Human
ugccaucagccuaucaggaaau

SEQ ID NO: 711458 - RNA, 21 nt, Human
uguuccugguaaaaauucuga

SEQ ID NO: 711459 - RNA, 19 nt, Human
uuguguuuuuaggauuaag

SEQ ID NO: 711460 - RNA, 20 nt, Human
uuguucagcaaugauuacag

SEQ ID NO: 711461 - RNA, 22 nt, Human
acagcaggugaacagucucccu

SEQ ID NO: 711462 - RNA, 23 nt, Human
agaaaagagagcagaauccccau

SEQ ID NO: 711463 - RNA, 24 nt, Human
agcagaauccccauauccucuuca

SEQ ID NO: 711464 - RNA, 24 nt, Human
auacuuccaaacaggaguacacag

SEQ ID NO: 711465 - RNA, 24 nt, Human
cacagcaggugaacagucucccuc

SEQ ID NO: 711466 - RNA, 18 nt, Human
cagaauccccauauccuc

SEQ ID NO: 711467 - RNA, 21 nt, Human
cagaauccccauauccucuuc

SEQ ID NO: 711468 - RNA, 23 nt, Human
caggccauuuaugagaagaaagu

SEQ ID NO: 711469 - RNA, 21 nt, Human
ccgcugccgaccucgcugugc

SEQ ID NO: 711470 - RNA, 21 nt, Human
ccgcugccgaccucgcugugc

SEQ ID NO: 711471 - RNA, 21 nt, Human
ccgcugccgaccucgcugugc

SEQ ID NO: 711472 - RNA, 21 nt, Human
ccgcugccgaccucgcugugc

SEQ ID NO: 711473 - RNA, 21 nt, Human
ccgcugccgaccucgcugugc

SEQ ID NO: 711474 - RNA, 21 nt, Human
ccgcugccgaccucgcugugc

SEQ ID NO: 711475 - RNA, 21 nt, Human
ccgcugccgaccucgcugugc

SEQ ID NO: 711476 - RNA, 19 nt, Human
ccucgcugccgcugccgac

SEQ ID NO: 711477 - RNA, 19 nt, Human
ccucgcugccgcugccgac

SEQ ID NO: 711478 - RNA, 18 nt, Human
gaaaaagacuuagaacaa

SEQ ID NO: 711479 - RNA, 18 nt, Human
gagcacagcgcgcgccgc

SEQ ID NO: 711480 - RNA, 22 nt, Human
ucgcugccgcugccgaccucgc

SEQ ID NO: 711481 - RNA, 22 nt, Human
ucgcugccgcugccgaccucgc

SEQ ID NO: 711482 - RNA, 26 nt, Human
ugagaagaaaguccauauaaacccca

SEQ ID NO: 711483 - RNA, 20 nt, Human
ugccgcugccgaccucgcug

SEQ ID NO: 711484 - RNA, 20 nt, Human
ugccgcugccgaccucgcug

SEQ ID NO: 711485 - RNA, 23 nt, Human
uuuacauguaaauaagaaaagag

SEQ ID NO: 711486 - RNA, 26 nt, Human
aaaaacaauccacaguugagcaguug

SEQ ID NO: 711487 - RNA, 20 nt, Human
aaggaaaaguaaaaaacaau

SEQ ID NO: 711488 - RNA, 22 nt, Human
aggaaaaguaaaaaacaaucca

SEQ ID NO: 711489 - RNA, 25 nt, Human
cagcgaagaaaaauauauacgaacc

SEQ ID NO: 711490 - RNA, 26 nt, Human
cugccgagcugccccacgagccgcac

SEQ ID NO: 711491 - RNA, 23 nt, Human
gcgaagaaaaauauauacgaacc

SEQ ID NO: 711492 - RNA, 24 nt, Human
guaacagcgaagaaaaauauauac

SEQ ID NO: 711493 - RNA, 23 nt, Human
uaaaaaacaauccacaguugagc

SEQ ID NO: 711494 - RNA, 24 nt, Human
uaaaaaacaauccacaguugagca

SEQ ID NO: 711495 - RNA, 19 nt, Human
uuacauguacaaaugcugc

SEQ ID NO: 711496 - RNA, 26 nt, Human
aaaaaaaaaaaaaucaggcacaaaaa

SEQ ID NO: 711497 - RNA, 23 nt, Human
aaaaaaaaaaaucaggcacaaaa

SEQ ID NO: 711498 - RNA, 24 nt, Human
aaaaaaaacaaaaacaguaacaac

SEQ ID NO: 711499 - RNA, 19 nt, Human
aaaaaaacaaaaacaguaa

SEQ ID NO: 711500 - RNA, 22 nt, Human
aaaaaacaaaaacaguaacaac

SEQ ID NO: 711501 - RNA, 22 nt, Human
aaacaaaaacaguaacaacaac

SEQ ID NO: 711502 - RNA, 24 nt, Human
aaacaaaaacaguaacaacaacaa

SEQ ID NO: 711503 - RNA, 18 nt, Human
aaacacacaaauggucag

SEQ ID NO: 711504 - RNA, 23 nt, Human
aaacacacaaauggucagaaaug

SEQ ID NO: 711505 - RNA, 19 nt, Human
aaacagaacacaaauccca

SEQ ID NO: 711506 - RNA, 23 nt, Human
aaacagaacacaaaucccaacaa

SEQ ID NO: 711507 - RNA, 29 nt, Human
aaagggaaaaauuaaauagcuucagaggg

SEQ ID NO: 711508 - RNA, 30 nt, Human
aaauaaaccaucccuucccuuccccccacc

SEQ ID NO: 711509 - RNA, 22 nt, Human
aacagaacacaaaucccaacaa

SEQ ID NO: 711510 - RNA, 22 nt, Human
aacugaggcaggaaguaaggau

SEQ ID NO: 711511 - RNA, 26 nt, Human
aacuucacaaaggcagaggcccagcc

SEQ ID NO: 711512 - RNA, 19 nt, Human
aagaagcaaaggaaaaagc

SEQ ID NO: 711513 - RNA, 21 nt, Human
aagaagcaaaggaaaaagcac

SEQ ID NO: 711514 - RNA, 20 nt, Human
aagagaaaggggagggggag

SEQ ID NO: 711515 - RNA, 25 nt, Human
aagcaaguacaaaaacagaacacaa

SEQ ID NO: 711516 - RNA, 21 nt, Human
aagcacaaagcgucugaguca

SEQ ID NO: 711517 - RNA, 25 nt, Human
aaggggagggggagagacucuagag

SEQ ID NO: 711518 - RNA, 24 nt, Human
aauaccaaucuuagaguacaacug

SEQ ID NO: 711519 - RNA, 18 nt, Human
acaaacucguggcuauga

SEQ ID NO: 711520 - RNA, 19 nt, Human
acaaagcggcgccggcccc

SEQ ID NO: 711521 - RNA, 18 nt, Human
acaauaggaaagggaaaa

SEQ ID NO: 711522 - RNA, 22 nt, Human
acaccccggucucaagaagcaa

SEQ ID NO: 711523 - RNA, 24 nt, Human
acaccccggucucaagaagcaaag

SEQ ID NO: 711524 - RNA, 21 nt, Human
acagaacacaaaucccaacaa

SEQ ID NO: 711525 - RNA, 24 nt, Human
acaguaacaacaacaaacacacaa

SEQ ID NO: 711526 - RNA, 20 nt, Human
accaucccuucccuuccccc

SEQ ID NO: 711527 - RNA, 19 nt, Human
acccggccgccagcaccgc

SEQ ID NO: 711528 - RNA, 19 nt, Human
acguguuguuggaggaggc

SEQ ID NO: 711529 - RNA, 21 nt, Human
acucugugacuacaagagcca

SEQ ID NO: 711530 - RNA, 18 nt, Human
acuguuccugcacuuuua

SEQ ID NO: 711531 - RNA, 21 nt, Human
agaaaugucauccuuaaaccc

SEQ ID NO: 711532 - RNA, 26 nt, Human
agccaguccuccgaccuuuucaccca

SEQ ID NO: 711533 - RNA, 19 nt, Human
aggaaaaacaggccacaga

SEQ ID NO: 711534 - RNA, 20 nt, Human
aggaaaaagcacaaagcguc

SEQ ID NO: 711535 - RNA, 20 nt, Human
aggcaggaaguaaggaugcu

SEQ ID NO: 711536 - RNA, 19 nt, Human
aggggagggggagagacuc

SEQ ID NO: 711537 - RNA, 18 nt, Human
aguauaaagucagaggaa

SEQ ID NO: 711538 - RNA, 24 nt, Human
aguaugaaaacagcguuucagaaa

SEQ ID NO: 711539 - RNA, 23 nt, Human
aguccuccgaccuuuucacccag

SEQ ID NO: 711540 - RNA, 19 nt, Human
auaggaaagggaaaaauua

SEQ ID NO: 711541 - RNA, 19 nt, Human
auggaaaagagugaaaaag

SEQ ID NO: 711542 - RNA, 23 nt, Human
caaagccuugcaggugaggugac

SEQ ID NO: 711543 - RNA, 23 nt, Human
caaaucccaacaacaugguuuuu

SEQ ID NO: 711544 - RNA, 24 nt, Human
caagaagcaaaggaaaaagcacaa

SEQ ID NO: 711545 - RNA, 20 nt, Human
caaguacaaaaacagaacac

SEQ ID NO: 711546 - RNA, 24 nt, Human
caaguccuuccuggaaauggaaaa

SEQ ID NO: 711547 - RNA, 20 nt, Human
caaguguuggaaagaaagag

SEQ ID NO: 711548 - RNA, 23 nt, Human
cacaaaccccaccuccccuggga

SEQ ID NO: 711549 - RNA, 24 nt, Human
cacaccccggucucaagaagcaaa

SEQ ID NO: 711550 - RNA, 21 nt, Human
cacacgcacacacauggaccg

SEQ ID NO: 711551 - RNA, 20 nt, Human
cacgaaacccuucaagggcu

SEQ ID NO: 711552 - RNA, 19 nt, Human
cacucugugacuacaagag

SEQ ID NO: 711553 - RNA, 23 nt, Human
cagacaaaucuacgacaaaaaaa

SEQ ID NO: 711554 - RNA, 21 nt, Human
cagaguucuggcauaacacau

SEQ ID NO: 711555 - RNA, 21 nt, Human
cagccugcagccaaacuccag

SEQ ID NO: 711556 - RNA, 19 nt, Human
cagcuaaaaacuguaaaac

SEQ ID NO: 711557 - RNA, 24 nt, Human
caguaacaacaacaaacacacaaa

SEQ ID NO: 711558 - RNA, 22 nt, Human
caucccuucccuuccccccacc

SEQ ID NO: 711559 - RNA, 23 nt, Human
ccaaaagaguuaaguuucaaaaa

SEQ ID NO: 711560 - RNA, 22 nt, Human
ccaaacuccagcaucccacacc

SEQ ID NO: 711561 - RNA, 19 nt, Human
ccaagcaaguacaaaaaca

SEQ ID NO: 711562 - RNA, 22 nt, Human
ccacaaagccuugcaggugagg

SEQ ID NO: 711563 - RNA, 20 nt, Human
ccagccucagacuaucaaaa

SEQ ID NO: 711564 - RNA, 19 nt, Human
ccaucccuucccuuccccc

SEQ ID NO: 711565 - RNA, 18 nt, Human
ccccccaccccaccccca

SEQ ID NO: 711566 - RNA, 21 nt, Human
cccucucacagcccgcugcaa

SEQ ID NO: 711567 - RNA, 18 nt, Human
ccgaaccaaacacgccgu

SEQ ID NO: 711568 - RNA, 26 nt, Human
ccgccagcaccgccgaccccucccag

SEQ ID NO: 711569 - RNA, 25 nt, Human
ccgccgaccccucccagagugacgc

SEQ ID NO: 711570 - RNA, 19 nt, Human
ccggccccucucacagccc

SEQ ID NO: 711571 - RNA, 23 nt, Human
ccggucucaagaagcaaaggaaa

SEQ ID NO: 711572 - RNA, 22 nt, Human
ccucagacuaucaaaacaaagu

SEQ ID NO: 711573 - RNA, 23 nt, Human
ccuccacagcugugucugucaug

SEQ ID NO: 711574 - RNA, 24 nt, Human
ccuccccugggagcuuguaacaaa

SEQ ID NO: 711575 - RNA, 25 nt, Human
ccuccgaccuuuucacccagugcca

SEQ ID NO: 711576 - RNA, 20 nt, Human
cgcugcaagccggcagcgcu

SEQ ID NO: 711577 - RNA, 23 nt, Human
cggucucaagaagcaaaggaaaa

SEQ ID NO: 711578 - RNA, 21 nt, Human
cgguguauguacuguaucccu

SEQ ID NO: 711579 - RNA, 21 nt, Human
cguauaaaacaccauaucaca

SEQ ID NO: 711580 - RNA, 19 nt, Human
cgucggggcagcagaccug

SEQ ID NO: 711581 - RNA, 20 nt, Human
cuagucuaacaaacugcagu

SEQ ID NO: 711582 - RNA, 22 nt, Human
cuauggaauccuccaaccucag

SEQ ID NO: 711583 - RNA, 18 nt, Human
cucaacgauuuuuccuac

SEQ ID NO: 711584 - RNA, 19 nt, Human
cuccaaccucagcucuagu

SEQ ID NO: 711585 - RNA, 23 nt, Human
cuccagcaucccacaccgcagcu

SEQ ID NO: 711586 - RNA, 21 nt, Human
cucugccccaggccccccucc

SEQ ID NO: 711587 - RNA, 22 nt, Human
cucugccccaggccccccucca

SEQ ID NO: 711588 - RNA, 23 nt, Human
cugaaugccaaagcuuggaagcc

SEQ ID NO: 711589 - RNA, 22 nt, Human
cugcagccaaacuccagcaucc

SEQ ID NO: 711590 - RNA, 18 nt, Human
cugcagccacucugugac

SEQ ID NO: 711591 - RNA, 22 nt, Human
cugcauguagggaaguuggaag

SEQ ID NO: 711592 - RNA, 23 nt, Human
cuucacggagccccuucuuagag

SEQ ID NO: 711593 - RNA, 23 nt, Human
cuuccaaagcuguauugucuaca

SEQ ID NO: 711594 - RNA, 20 nt, Human
cuucccuuccccccaccccc

SEQ ID NO: 711595 - RNA, 20 nt, Human
cuuggcaugacuccuaugcc

SEQ ID NO: 711596 - RNA, 21 nt, Human
cuuugcuuuugccccaaaaga

SEQ ID NO: 711597 - RNA, 18 nt, Human
cuuuucuuuccuccacuu

SEQ ID NO: 711598 - RNA, 21 nt, Human
gaagacacaaaccccaccucc

SEQ ID NO: 711599 - RNA, 24 nt, Human
gaccgaaccaaacacgccguggaa

SEQ ID NO: 711600 - RNA, 25 nt, Human
gagcagggagggggcuuucucagug

SEQ ID NO: 711601 - RNA, 18 nt, Human
gagccccuucuuagagca

SEQ ID NO: 711602 - RNA, 23 nt, Human
gagcgcacugcaggcagcgcggc

SEQ ID NO: 711603 - RNA, 22 nt, Human
gagcucacacgaaacccuucaa

SEQ ID NO: 711604 - RNA, 20 nt, Human
gcaaauaaaccaucccuucc

SEQ ID NO: 711605 - RNA, 23 nt, Human
gcacuauggaauccuccaaccuc

SEQ ID NO: 711606 - RNA, 22 nt, Human
gccaaaccuuuuuuuuucuucu

SEQ ID NO: 711607 - RNA, 24 nt, Human
gccccaggccccccuccaggguac

SEQ ID NO: 711608 - RNA, 20 nt, Human
gccugcagccaaacuccagc

SEQ ID NO: 711609 - RNA, 25 nt, Human
gcgcggcucugggaagaaccgccuc

SEQ ID NO: 711610 - RNA, 21 nt, Human
gcugacaugagggcuaugcuu

SEQ ID NO: 711611 - RNA, 25 nt, Human
gcuuuucuuuccuccacuuuucaaa

SEQ ID NO: 711612 - RNA, 24 nt, Human
ggaaauggaaaagagugaaaaaga

SEQ ID NO: 711613 - RNA, 25 nt, Human
ggaccgaaccaaacacgccguggaa

SEQ ID NO: 711614 - RNA, 22 nt, Human
ggacuguaacugacaaaaauaa

SEQ ID NO: 711615 - RNA, 21 nt, Human
ggagggggagagacucuagag

SEQ ID NO: 711616 - RNA, 20 nt, Human
ggcacaaaaaaaucgagcuc

SEQ ID NO: 711617 - RNA, 24 nt, Human
gggcagcagaccugcaucagaggg

SEQ ID NO: 711618 - RNA, 20 nt, Human
ggggaggggauagaaacgcu

SEQ ID NO: 711619 - RNA, 22 nt, Human
gguuuuccuguuacgacgcuca

SEQ ID NO: 711620 - RNA, 24 nt, Human
gucaggcaacuuuaguccuccucc

SEQ ID NO: 711621 - RNA, 19 nt, Human
gugcaaaucagacacgaca

SEQ ID NO: 711622 - RNA, 21 nt, Human
gugucugucaugcuugcuuca

SEQ ID NO: 711623 - RNA, 21 nt, Human
guuucuuugguaacugaggca

SEQ ID NO: 711624 - RNA, 22 nt, Human
uaaccuguaugagacuuccccu

SEQ ID NO: 711625 - RNA, 22 nt, Human
uaagagcacuuuauuauuguuc

SEQ ID NO: 711626 - RNA, 19 nt, Human
uaaggaugcuacauuagac

SEQ ID NO: 711627 - RNA, 21 nt, Human
uacaaaaacagaacacaaauc

SEQ ID NO: 711628 - RNA, 23 nt, Human
uacaaaaacagaacacaaauccc

SEQ ID NO: 711629 - RNA, 22 nt, Human
uacacacaugaagagaagguca

SEQ ID NO: 711630 - RNA, 21 nt, Human
uacauuagacagauguuccac

SEQ ID NO: 711631 - RNA, 21 nt, Human
uacgaggaagcguauaaaaca

SEQ ID NO: 711632 - RNA, 25 nt, Human
uagaaaccagcuauuuuuucuccau

SEQ ID NO: 711633 - RNA, 24 nt, Human
uagcaaguguuggaaagaaagaga

SEQ ID NO: 711634 - RNA, 19 nt, Human
uagcaauaacaaacucgug

SEQ ID NO: 711635 - RNA, 20 nt, Human
uauacacacgcacacacaug

SEQ ID NO: 711636 - RNA, 24 nt, Human
uauacacacgcacacacauggacc

SEQ ID NO: 711637 - RNA, 24 nt, Human
uaugcaaaaguuaaaaaaaaaaaa

SEQ ID NO: 711638 - RNA, 26 nt, Human
uauguacuguauccccgaucgaguau

SEQ ID NO: 711639 - RNA, 24 nt, Human
uauuacagauuuacacacaugaag

SEQ ID NO: 711640 - RNA, 26 nt, Human
ucaaaaaauaccuacaaauuucucug

SEQ ID NO: 711641 - RNA, 25 nt, Human
ucaaaaucacccauauagaaaagug

SEQ ID NO: 711642 - RNA, 24 nt, Human
ucagaaaugucauccuuaaacccu

SEQ ID NO: 711643 - RNA, 25 nt, Human
ucagcucuagucuaacaaacugcca

SEQ ID NO: 711644 - RNA, 18 nt, Human
ucagugcaccagggaccc

SEQ ID NO: 711645 - RNA, 19 nt, Human
ucagugcaccagggacccg

SEQ ID NO: 711646 - RNA, 20 nt, Human
ucaucauggcuugugacuga

SEQ ID NO: 711647 - RNA, 24 nt, Human
ucauugaccaaaaaggagcagcug

SEQ ID NO: 711648 - RNA, 19 nt, Human
ucccacaccgcagcugacc

SEQ ID NO: 711649 - RNA, 18 nt, Human
ucccaggaguguccuccc

SEQ ID NO: 711650 - RNA, 18 nt, Human
uccccccaccccaccccc

SEQ ID NO: 711651 - RNA, 23 nt, Human
uccccugggagcuuguaacaaag

SEQ ID NO: 711652 - RNA, 22 nt, Human
ucccuuccccccaccccacccc

SEQ ID NO: 711653 - RNA, 18 nt, Human
ucccuucccuucccccca

SEQ ID NO: 711654 - RNA, 19 nt, Human
uccuacagaaaauauaggg

SEQ ID NO: 711655 - RNA, 20 nt, Human
uccuccaaccucagcucuag

SEQ ID NO: 711656 - RNA, 21 nt, Human
uccuuacaaguccuuccugga

SEQ ID NO: 711657 - RNA, 22 nt, Human
uccuuacaaguccuuccuggaa

SEQ ID NO: 711658 - RNA, 24 nt, Human
ucgugagccucuggugggccaggu

SEQ ID NO: 711659 - RNA, 21 nt, Human
ugaaaacagcguuucagaagu

SEQ ID NO: 711660 - RNA, 22 nt, Human
ugaaugauuacaauaggaaagg

SEQ ID NO: 711661 - RNA, 19 nt, Human
ugacaaaaauaaacuaauu

SEQ ID NO: 711662 - RNA, 23 nt, Human
ugacuccuaugccgccgcuuccu

SEQ ID NO: 711663 - RNA, 18 nt, Human
ugaguagcuccuggcucu

SEQ ID NO: 711664 - RNA, 25 nt, Human
ugcaaaaguuaaaaaaaaaaaaauc

SEQ ID NO: 711665 - RNA, 18 nt, Human
ugcacaggaucagccucu

SEQ ID NO: 711666 - RNA, 21 nt, Human
ugcaccagggacccggccgcc

SEQ ID NO: 711667 - RNA, 19 nt, Human
ugcaggugaggugaccacg

SEQ ID NO: 711668 - RNA, 21 nt, Human
ugccaaagcuuggaagcccag

SEQ ID NO: 711669 - RNA, 20 nt, Human
ugccccaggccccccuccag

SEQ ID NO: 711670 - RNA, 19 nt, Human
uggaagacacaaaccccac

SEQ ID NO: 711671 - RNA, 24 nt, Human
ugggccaggugggacacagcacac

SEQ ID NO: 711672 - RNA, 22 nt, Human
ugguagagucugcaguccaguu

SEQ ID NO: 711673 - RNA, 22 nt, Human
uguagcaaguguuggaaagaaa

SEQ ID NO: 711674 - RNA, 21 nt, Human
ugucagccugcagccaaacuc

SEQ ID NO: 711675 - RNA, 18 nt, Human
uguggaguccuggccccg

SEQ ID NO: 711676 - RNA, 26 nt, Human
uuaaaaaaaaaaaaaucaggcacaaa

SEQ ID NO: 711677 - RNA, 19 nt, Human
uuccccccaccccaccccc

SEQ ID NO: 711678 - RNA, 20 nt, Human
uuccccccaccccacccccu

SEQ ID NO: 711679 - RNA, 23 nt, Human
uuccuccacuuuucaaaggccug

SEQ ID NO: 711680 - RNA, 23 nt, Human
uugcaaauaaaccaucccuuccc

SEQ ID NO: 711681 - RNA, 22 nt, Human
uugcaagcaccugaaaucuaga

SEQ ID NO: 711682 - RNA, 18 nt, Human
uugcaggugaggugacca

SEQ ID NO: 711683 - RNA, 24 nt, Human
uugucuacauuaaaaaaaacaaaa

SEQ ID NO: 711684 - RNA, 21 nt, Human
uuucacccagugccaauuucc

SEQ ID NO: 711685 - RNA, 18 nt, Human
aaacaucugacuccgccg

SEQ ID NO: 711686 - RNA, 18 nt, Human
aaacaucugacucugcug

SEQ ID NO: 711687 - RNA, 24 nt, Human
aaacccacucuuugaauaugggag

SEQ ID NO: 711688 - RNA, 20 nt, Human
aaaguacccagaaacaucug

SEQ ID NO: 711689 - RNA, 23 nt, Human
aacaagguaaguggcauauccau

SEQ ID NO: 711690 - RNA, 24 nt, Human
aacagaaaggaggaauccacccag

SEQ ID NO: 711691 - RNA, 24 nt, Human
aacauccauaugguccuaaguagc

SEQ ID NO: 711692 - RNA, 20 nt, Human
aacaugcuuuaaggcacaaa

SEQ ID NO: 711693 - RNA, 23 nt, Human
aacccaaacccgcucuuugaaua

SEQ ID NO: 711694 - RNA, 25 nt, Human
aacccaggccaccauuaacacccaa

SEQ ID NO: 711695 - RNA, 20 nt, Human
aaccuggcucugccaccagc

SEQ ID NO: 711696 - RNA, 20 nt, Human
aacuaaaccuccccugcucu

SEQ ID NO: 711697 - RNA, 21 nt, Human
aagaaacugaggaugcgauca

SEQ ID NO: 711698 - RNA, 24 nt, Human
aagacaagcauggagcccacuaga

SEQ ID NO: 711699 - RNA, 22 nt, Human
aagaggcaacccagggaagcca

SEQ ID NO: 711700 - RNA, 19 nt, Human
aagaggccccagccacagc

SEQ ID NO: 711701 - RNA, 18 nt, Human
aagcaaguuacagaugcc

SEQ ID NO: 711702 - RNA, 26 nt, Human
aagccagggccaggugggcaauggga

SEQ ID NO: 711703 - RNA, 26 nt, Human
aagccagggccaggugggcaauggga

SEQ ID NO: 711704 - RNA, 19 nt, Human
aagcccaggaggcccggaa

SEQ ID NO: 711705 - RNA, 19 nt, Human
aagcccaucugccucagag

SEQ ID NO: 711706 - RNA, 19 nt, Human
aaggaaacagggaauucca

SEQ ID NO: 711707 - RNA, 22 nt, Human
aaggaggaaggugcccccaggg

SEQ ID NO: 711708 - RNA, 23 nt, Human
aagggguugcaggaagcaagagg

SEQ ID NO: 711709 - RNA, 20 nt, Human
aaucuaugugagcuguccuu

SEQ ID NO: 711710 - RNA, 21 nt, Human
acacagccacugacacacgcc

SEQ ID NO: 711711 - RNA, 20 nt, Human
acagacacaugcauugaaca

SEQ ID NO: 711712 - RNA, 25 nt, Human
acagagucugccccucccaccaaag

SEQ ID NO: 711713 - RNA, 25 nt, Human
acagagucugccccucucaccaaag

SEQ ID NO: 711714 - RNA, 18 nt, Human
acagaugcaugggcauga

SEQ ID NO: 711715 - RNA, 18 nt, Human
acagcccaggagaggccc

SEQ ID NO: 711716 - RNA, 18 nt, Human
acauggcagaaaagaggc

SEQ ID NO: 711717 - RNA, 22 nt, Human
accacugggaagggagucgguc

SEQ ID NO: 711718 - RNA, 19 nt, Human
acccccagcccaagagaac

SEQ ID NO: 711719 - RNA, 21 nt, Human
acccucauccccaaggaaaca

SEQ ID NO: 711720 - RNA, 18 nt, Human
accgagcugcagaggaca

SEQ ID NO: 711721 - RNA, 20 nt, Human
acgcagcuucaccccagaaa

SEQ ID NO: 711722 - RNA, 19 nt, Human
acgcagggucugcagaugc

SEQ ID NO: 711723 - RNA, 21 nt, Human
acgcuacgcccuggcccugaa

SEQ ID NO: 711724 - RNA, 24 nt, Human
acuccgucaccucucuaugcccca

SEQ ID NO: 711725 - RNA, 23 nt, Human
acugacagaaacccaacaaccaa

SEQ ID NO: 711726 - RNA, 21 nt, Human
acugccugaggggugacuccg

SEQ ID NO: 711727 - RNA, 22 nt, Human
acuggccuugcacuugcaacgc

SEQ ID NO: 711728 - RNA, 23 nt, Human
acuuugcuggccccggcccugac

SEQ ID NO: 711729 - RNA, 24 nt, Human
acuuugcuggcccuggcccugacc

SEQ ID NO: 711730 - RNA, 19 nt, Human
agaaaagaggcaacccagg

SEQ ID NO: 711731 - RNA, 23 nt, Human
agaaaggaagcaccugcccagga

SEQ ID NO: 711732 - RNA, 22 nt, Human
agaaggaugaacccacgccccu

SEQ ID NO: 711733 - RNA, 22 nt, Human
agaaggaugaacucacgccccu

SEQ ID NO: 711734 - RNA, 23 nt, Human
agacaagacaagcauggagccca

SEQ ID NO: 711735 - RNA, 22 nt, Human
agacaauuccaaagcuggagca

SEQ ID NO: 711736 - RNA, 19 nt, Human
agacacaacccaggccacc

SEQ ID NO: 711737 - RNA, 22 nt, Human
agaccaacuaaaccuccccugc

SEQ ID NO: 711738 - RNA, 21 nt, Human
agaccacagagucugccccuc

SEQ ID NO: 711739 - RNA, 19 nt, Human
agagacagaccuggggagc

SEQ ID NO: 711740 - RNA, 21 nt, Human
agagacagaccuggggaggca

SEQ ID NO: 711741 - RNA, 21 nt, Human
agagacagaccuggggaggca

SEQ ID NO: 711742 - RNA, 21 nt, Human
agcagcgccagcaccagcaca

SEQ ID NO: 711743 - RNA, 25 nt, Human
agccaaagucaguguccuuuccccu

SEQ ID NO: 711744 - RNA, 19 nt, Human
agccaagagcuacguucuc

SEQ ID NO: 711745 - RNA, 21 nt, Human
agccacagcaugagaugagcc

SEQ ID NO: 711746 - RNA, 25 nt, Human
agcccaucucccucagagccuccag

SEQ ID NO: 711747 - RNA, 19 nt, Human
agccugugcuggcucagau

SEQ ID NO: 711748 - RNA, 20 nt, Human
agcggccccgugugcaggau

SEQ ID NO: 711749 - RNA, 22 nt, Human
agcugccaucggcucgagaggc

SEQ ID NO: 711750 - RNA, 23 nt, Human
aggacaucauggucacccaaccc

SEQ ID NO: 711751 - RNA, 25 nt, Human
aggagaggaucccaggacugccuga

SEQ ID NO: 711752 - RNA, 19 nt, Human
aggaggagcgagggaagaa

SEQ ID NO: 711753 - RNA, 18 nt, Human
aggaugccuguguggagg

SEQ ID NO: 711754 - RNA, 18 nt, Human
aggcagaaggaugaaccc

SEQ ID NO: 711755 - RNA, 22 nt, Human
aggcagcccugagccucccagg

SEQ ID NO: 711756 - RNA, 21 nt, Human
aggcagccuaggauacaugag

SEQ ID NO: 711757 - RNA, 20 nt, Human
aggcaggcagggcuuggggg

SEQ ID NO: 711758 - RNA, 20 nt, Human
aggcaggcagggcuuggggg

SEQ ID NO: 711759 - RNA, 22 nt, Human
aggcaggcagggcuugggggug

SEQ ID NO: 711760 - RNA, 21 nt, Human
aggcagggcugggcagcgagg

SEQ ID NO: 711761 - RNA, 23 nt, Human
aggcagggcugggcagcgagggc

SEQ ID NO: 711762 - RNA, 21 nt, Human
aggccccaugguggcaggggu

SEQ ID NO: 711763 - RNA, 21 nt, Human
aggccccgugguggcaggggu

SEQ ID NO: 711764 - RNA, 19 nt, Human
aggccucagcagccucugc

SEQ ID NO: 711765 - RNA, 21 nt, Human
aggcggggcugggcagugagg

SEQ ID NO: 711766 - RNA, 19 nt, Human
aggcugcagaggugcuggc

SEQ ID NO: 711767 - RNA, 26 nt, Human
aggcugcagcuuuucugggguggcug

SEQ ID NO: 711768 - RNA, 20 nt, Human
agggaagaagucgcauggug

SEQ ID NO: 711769 - RNA, 22 nt, Human
agggaaggacacagcccagggc

SEQ ID NO: 711770 - RNA, 18 nt, Human
agggagcccuggugggga

SEQ ID NO: 711771 - RNA, 22 nt, Human
agggaggagggcauccaccagg

SEQ ID NO: 711772 - RNA, 22 nt, Human
aggggaggacacagcccagggc

SEQ ID NO: 711773 - RNA, 22 nt, Human
aggggaggacacagcccagggc

SEQ ID NO: 711774 - RNA, 22 nt, Human
aggggaguacacagcccagggc

SEQ ID NO: 711775 - RNA, 19 nt, Human
aggugaggguggggaagac

SEQ ID NO: 711776 - RNA, 23 nt, Human
aggugaggugggaagcggaggca

SEQ ID NO: 711777 - RNA, 21 nt, Human
aguagaaggauacagccuaaa

SEQ ID NO: 711778 - RNA, 20 nt, Human
aguggagaggcuccccugga

SEQ ID NO: 711779 - RNA, 22 nt, Human
aguggugucuggggucacgggc

SEQ ID NO: 711780 - RNA, 18 nt, Human
aguucuccccgcaagccu

SEQ ID NO: 711781 - RNA, 20 nt, Human
auagaagcaacucugucacc

SEQ ID NO: 711782 - RNA, 24 nt, Human
auagaagcaacucugucaccucca

SEQ ID NO: 711783 - RNA, 19 nt, Human
aucauggucacccaacccu

SEQ ID NO: 711784 - RNA, 25 nt, Human
aucucccucagagccuccagagaca

SEQ ID NO: 711785 - RNA, 18 nt, Human
aucucucucccucccucc

SEQ ID NO: 711786 - RNA, 18 nt, Human
aucucucucccucccucc

SEQ ID NO: 711787 - RNA, 23 nt, Human
augaugaugguggugaugaagau

SEQ ID NO: 711788 - RNA, 21 nt, Human
augcccagacgggagccucac

SEQ ID NO: 711789 - RNA, 20 nt, Human
augggccccucuguggcugc

SEQ ID NO: 711790 - RNA, 18 nt, Human
auguagauguguguaugu

SEQ ID NO: 711791 - RNA, 24 nt, Human
augucacaguguuacauggaaagu

SEQ ID NO: 711792 - RNA, 19 nt, Human
caacaaccaaaaggugucc

SEQ ID NO: 711793 - RNA, 24 nt, Human
caacccaggccaccauuaacaccc

SEQ ID NO: 711794 - RNA, 21 nt, Human
caagacaagcauggagcccac

SEQ ID NO: 711795 - RNA, 19 nt, Human
caagaccggggucccggac

SEQ ID NO: 711796 - RNA, 23 nt, Human
caagaccggggucccggacacgg

SEQ ID NO: 711797 - RNA, 19 nt, Human
caagagaacagccaacacc

SEQ ID NO: 711798 - RNA, 23 nt, Human
caagguaaguggcauauccauca

SEQ ID NO: 711799 - RNA, 24 nt, Human
caaguuacagaugcaugggcauga

SEQ ID NO: 711800 - RNA, 19 nt, Human
caaucuaugugagcugucc

SEQ ID NO: 711801 - RNA, 21 nt, Human
cacaagaccggggucccggac

SEQ ID NO: 711802 - RNA, 23 nt, Human
cacacagccacugacacacgccc

SEQ ID NO: 711803 - RNA, 19 nt, Human
cacacuccugcacacagcc

SEQ ID NO: 711804 - RNA, 19 nt, Human
cacagcaucauggguggag

SEQ ID NO: 711805 - RNA, 19 nt, Human
cacagcucagacacucuuu

SEQ ID NO: 711806 - RNA, 27 nt, Human
cacaguccacgaagccucgcauccccc

SEQ ID NO: 711807 - RNA, 24 nt, Human
caccacauggaccaggacacaguc

SEQ ID NO: 711808 - RNA, 19 nt, Human
caccacauuuccccacgca

SEQ ID NO: 711809 - RNA, 19 nt, Human
caccacauuuccccaugca

SEQ ID NO: 711810 - RNA, 18 nt, Human
caccagcaggcuugcagu

SEQ ID NO: 711811 - RNA, 21 nt, Human
caccaggcccuccaucuccug

SEQ ID NO: 711812 - RNA, 18 nt, Human
cacccaacccucaucccc

SEQ ID NO: 711813 - RNA, 18 nt, Human
cacccaacccucaucccc

SEQ ID NO: 711814 - RNA, 20 nt, Human
cacccaacccucauccccaa

SEQ ID NO: 711815 - RNA, 19 nt, Human
cacccaaccgucaucccca

SEQ ID NO: 711816 - RNA, 19 nt, Human
cacccccagugaccucugc

SEQ ID NO: 711817 - RNA, 20 nt, Human
caccugggcaaagccugagc

SEQ ID NO: 711818 - RNA, 19 nt, Human
caccugggcagagcuggag

SEQ ID NO: 711819 - RNA, 20 nt, Human
caccuugagguacagcagga

SEQ ID NO: 711820 - RNA, 19 nt, Human
cacgcccucagccccaccc

SEQ ID NO: 711821 - RNA, 20 nt, Human
cacgcccucagccccacccc

SEQ ID NO: 711822 - RNA, 20 nt, Human
cacugaagugagggcaaggu

SEQ ID NO: 711823 - RNA, 23 nt, Human
cacugacacacgcccucgugcac

SEQ ID NO: 711824 - RNA, 21 nt, Human
cacugggugggaccuugcacc

SEQ ID NO: 711825 - RNA, 19 nt, Human
cacuuccucucucucucuc

SEQ ID NO: 711826 - RNA, 21 nt, Human
cagaaacccaacaaccaaaag

SEQ ID NO: 711827 - RNA, 23 nt, Human
cagaacucgaggaggcagcccug

SEQ ID NO: 711828 - RNA, 18 nt, Human
cagaagccaggugaggug

SEQ ID NO: 711829 - RNA, 24 nt, Human
cagagucugccccucccaccaaag

SEQ ID NO: 711830 - RNA, 24 nt, Human
cagagucugccccucucaccaaag

SEQ ID NO: 711831 - RNA, 19 nt, Human
cagaucaaaagaacugacu

SEQ ID NO: 711832 - RNA, 22 nt, Human
cagcagcgccagcaccagcaca

SEQ ID NO: 711833 - RNA, 20 nt, Human
cagcaggcuugcaguccugg

SEQ ID NO: 711834 - RNA, 20 nt, Human
cagcaggcuugcagucuugg

SEQ ID NO: 711835 - RNA, 18 nt, Human
cagccaacacccaccucg

SEQ ID NO: 711836 - RNA, 20 nt, Human
cagccaauauugcccaggag

SEQ ID NO: 711837 - RNA, 19 nt, Human
cagcccaagagaacagcca

SEQ ID NO: 711838 - RNA, 19 nt, Human
cagcccccaagcccaucuc

SEQ ID NO: 711839 - RNA, 21 nt, Human
cagcccccaagcccaucuccc

SEQ ID NO: 711840 - RNA, 23 nt, Human
cagcccccaagcccaucucccuc

SEQ ID NO: 711841 - RNA, 19 nt, Human
cagcccucauuccuagggg

SEQ ID NO: 711842 - RNA, 21 nt, Human
cagcugcaggguaccugggac

SEQ ID NO: 711843 - RNA, 24 nt, Human
cagcugcccaggcccagaaggaaa

SEQ ID NO: 711844 - RNA, 19 nt, Human
cagcugccccagcucugag

SEQ ID NO: 711845 - RNA, 24 nt, Human
cagcugccccagcucugagggagg

SEQ ID NO: 711846 - RNA, 19 nt, Human
cagcuggccacccguccca

SEQ ID NO: 711847 - RNA, 21 nt, Human
caggccccaggccagcaaggg

SEQ ID NO: 711848 - RNA, 22 nt, Human
caggcccuggguuacaaacccu

SEQ ID NO: 711849 - RNA, 22 nt, Human
caggccuggcaccagcacuuug

SEQ ID NO: 711850 - RNA, 19 nt, Human
cagggccaggugggcaaug

SEQ ID NO: 711851 - RNA, 19 nt, Human
cagggccaggugggcaaug

SEQ ID NO: 711852 - RNA, 26 nt, Human
cagggcccaggaaggacaagggggcc

SEQ ID NO: 711853 - RNA, 18 nt, Human
cagugaccucugcccuuu

SEQ ID NO: 711854 - RNA, 21 nt, Human
cagugaccucugcccuuuccc

SEQ ID NO: 711855 - RNA, 18 nt, Human
cagugggucuaaaggaga

SEQ ID NO: 711856 - RNA, 18 nt, Human
cagugggucuaaaggaga

SEQ ID NO: 711857 - RNA, 23 nt, Human
caucacagugcuguccagacccc

SEQ ID NO: 711858 - RNA, 18 nt, Human
cauccaacccucaucccc

SEQ ID NO: 711859 - RNA, 20 nt, Human
caucgcccacaugccugcug

SEQ ID NO: 711860 - RNA, 21 nt, Human
caucugaggcaaggacuaauu

SEQ ID NO: 711861 - RNA, 19 nt, Human
caugcgcucuugcucuugc

SEQ ID NO: 711862 - RNA, 25 nt, Human
cauuuacuucucaaucaccuacaua

SEQ ID NO: 711863 - RNA, 20 nt, Human
ccaagagaacagccaacacc

SEQ ID NO: 711864 - RNA, 23 nt, Human
ccaagugagcucuagccaccugc

SEQ ID NO: 711865 - RNA, 19 nt, Human
ccacacccggggcuggagc

SEQ ID NO: 711866 - RNA, 23 nt, Human
ccacagagucugccccucccacc

SEQ ID NO: 711867 - RNA, 23 nt, Human
ccacagagucugccccucucacc

SEQ ID NO: 711868 - RNA, 24 nt, Human
ccaccaggcccuccaucuccuggg

SEQ ID NO: 711869 - RNA, 21 nt, Human
ccacccaggacaugcccagac

SEQ ID NO: 711870 - RNA, 23 nt, Human
ccacccaggacaugcccagacgg

SEQ ID NO: 711871 - RNA, 25 nt, Human
ccaccccugccucacauggcaacgc

SEQ ID NO: 711872 - RNA, 23 nt, Human
ccaccugccuacccugccaucug

SEQ ID NO: 711873 - RNA, 23 nt, Human
ccacgcccccugcccgugcaugg

SEQ ID NO: 711874 - RNA, 19 nt, Human
ccacuggccuugcacuugc

SEQ ID NO: 711875 - RNA, 21 nt, Human
ccacuggccuugcacuugcaa

SEQ ID NO: 711876 - RNA, 26 nt, Human
ccacugggaagggagucggucacaga

SEQ ID NO: 711877 - RNA, 22 nt, Human
ccagagacagaccuggggaggc

SEQ ID NO: 711878 - RNA, 22 nt, Human
ccagagacagaccuggggaggc

SEQ ID NO: 711879 - RNA, 19 nt, Human
ccagcacuuugagccucag

SEQ ID NO: 711880 - RNA, 22 nt, Human
ccagcagaagcccaggaggccc

SEQ ID NO: 711881 - RNA, 19 nt, Human
ccagcccaagagaacagcc

SEQ ID NO: 711882 - RNA, 22 nt, Human
ccagcccaagcucugcuccauc

SEQ ID NO: 711883 - RNA, 21 nt, Human
ccagcccagcccagaggcucu

SEQ ID NO: 711884 - RNA, 23 nt, Human
ccaggacacaguccacgaagccu

SEQ ID NO: 711885 - RNA, 21 nt, Human
ccaggacaucauggucaccca

SEQ ID NO: 711886 - RNA, 24 nt, Human
ccaggagcccacaccuugagguac

SEQ ID NO: 711887 - RNA, 20 nt, Human
ccaggaggagcgagggaaga

SEQ ID NO: 711888 - RNA, 22 nt, Human
ccaggcagacuagaggacccga

SEQ ID NO: 711889 - RNA, 26 nt, Human
ccagggccaggugggcaaugggaggc

SEQ ID NO: 711890 - RNA, 26 nt, Human
ccagggccaggugggcaaugggaggc

SEQ ID NO: 711891 - RNA, 23 nt, Human
ccauagccuaggguagaccugga

SEQ ID NO: 711892 - RNA, 22 nt, Human
ccaugggccccucuguggcuga

SEQ ID NO: 711893 - RNA, 20 nt, Human
ccaugguggcaggggugggg

SEQ ID NO: 711894 - RNA, 21 nt, Human
ccaugugcuagaggcagcucc

SEQ ID NO: 711895 - RNA, 19 nt, Human
cccaagagaacagccaaca

SEQ ID NO: 711896 - RNA, 21 nt, Human
cccaagagaacagccaacacc

SEQ ID NO: 711897 - RNA, 23 nt, Human
cccaaggaaacacagcccagggc

SEQ ID NO: 711898 - RNA, 21 nt, Human
cccacagaacucgaggaggca

SEQ ID NO: 711899 - RNA, 24 nt, Human
cccacagaacucgaggaggcagcc

SEQ ID NO: 711900 - RNA, 21 nt, Human
cccacauggcagaaaagaggc

SEQ ID NO: 711901 - RNA, 18 nt, Human
cccaccaaagcccaggca

SEQ ID NO: 711902 - RNA, 24 nt, Human
cccagaaacaucugacucugcugu

SEQ ID NO: 711903 - RNA, 19 nt, Human
cccagcacagaggcaguca

SEQ ID NO: 711904 - RNA, 21 nt, Human
cccagcccagaggcucugcag

SEQ ID NO: 711905 - RNA, 22 nt, Human
cccagcugcccaggcccagaag

SEQ ID NO: 711906 - RNA, 21 nt, Human
cccaggaggcccggaaggcac

SEQ ID NO: 711907 - RNA, 23 nt, Human
cccaggcagaaggaugaacccac

SEQ ID NO: 711908 - RNA, 21 nt, Human
cccaggccccaggccagcaag

SEQ ID NO: 711909 - RNA, 22 nt, Human
cccagugaccucugcccuuucc

SEQ ID NO: 711910 - RNA, 19 nt, Human
cccaguugucacuugccuu

SEQ ID NO: 711911 - RNA, 23 nt, Human
cccaucucccucagagccuccag

SEQ ID NO: 711912 - RNA, 22 nt, Human
ccccagaaacugacagaaaccc

SEQ ID NO: 711913 - RNA, 24 nt, Human
ccccagaaacugacagaaacccaa

SEQ ID NO: 711914 - RNA, 24 nt, Human
ccccagaaacugacagaaaccucg

SEQ ID NO: 711915 - RNA, 25 nt, Human
ccccagccacagcaugagaugagcc

SEQ ID NO: 711916 - RNA, 23 nt, Human
ccccagugaccucugcccuuucc

SEQ ID NO: 711917 - RNA, 18 nt, Human
cccccagaccuuggcccu

SEQ ID NO: 711918 - RNA, 24 nt, Human
cccccagcccaagagaacagccaa

SEQ ID NO: 711919 - RNA, 26 nt, Human
cccccagcccaagagaacagccaaca

SEQ ID NO: 711920 - RNA, 20 nt, Human
cccccugagcugcagcucaa

SEQ ID NO: 711921 - RNA, 23 nt, Human
cccccuggacaugaccaccuccc

SEQ ID NO: 711922 - RNA, 20 nt, Human
ccccucucuccuuuuguguc

SEQ ID NO: 711923 - RNA, 21 nt, Human
ccccucuguggcugcugccug

SEQ ID NO: 711924 - RNA, 23 nt, Human
ccccugagcugcagcucaagggc

SEQ ID NO: 711925 - RNA, 26 nt, Human
ccccugggaggcagcugccccagcuc

SEQ ID NO: 711926 - RNA, 20 nt, Human
cccgagcaugucagcucugc

SEQ ID NO: 711927 - RNA, 21 nt, Human
cccgcaagccuggagggagca

SEQ ID NO: 711928 - RNA, 20 nt, Human
cccggcccugaccgcagcac

SEQ ID NO: 711929 - RNA, 18 nt, Human
cccucagccccaccccac

SEQ ID NO: 711930 - RNA, 25 nt, Human
cccugagcugcagcucaagggccuc

SEQ ID NO: 711931 - RNA, 20 nt, Human
cccugaguggaugcaccugg

SEQ ID NO: 711932 - RNA, 23 nt, Human
cccugaguggaugcaccuggcuc

SEQ ID NO: 711933 - RNA, 21 nt, Human
ccggugcaggcccacagaacu

SEQ ID NO: 711934 - RNA, 23 nt, Human
ccuaacacccuggaaucccugcc

SEQ ID NO: 711935 - RNA, 18 nt, Human
ccuagagcccccaagccc

SEQ ID NO: 711936 - RNA, 18 nt, Human
ccuagagcccccaagccc

SEQ ID NO: 711937 - RNA, 23 nt, Human
ccuagagcccccaagcccaucuc

SEQ ID NO: 711938 - RNA, 18 nt, Human
ccuaggcacagcccagga

SEQ ID NO: 711939 - RNA, 23 nt, Human
ccucacaggauggacaguggugu

SEQ ID NO: 711940 - RNA, 19 nt, Human
ccucagagccuccagagac

SEQ ID NO: 711941 - RNA, 21 nt, Human
ccucagagccuccagagacag

SEQ ID NO: 711942 - RNA, 23 nt, Human
ccucagagccuccagagacagaa

SEQ ID NO: 711943 - RNA, 23 nt, Human
ccucagagccuccagagacagaa

SEQ ID NO: 711944 - RNA, 19 nt, Human
ccucagccccaccccaccc

SEQ ID NO: 711945 - RNA, 21 nt, Human
ccucagccccaccccaccccu

SEQ ID NO: 711946 - RNA, 22 nt, Human
ccucccuccuucccucccuccc

SEQ ID NO: 711947 - RNA, 20 nt, Human
ccuccgugucacagcugccc

SEQ ID NO: 711948 - RNA, 23 nt, Human
ccuccuacagcccccaagcccau

SEQ ID NO: 711949 - RNA, 23 nt, Human
ccuccuagagcccccaagcccau

SEQ ID NO: 711950 - RNA, 23 nt, Human
ccuccuagagcccccaagcccau

SEQ ID NO: 711951 - RNA, 22 nt, Human
ccuccuccuacagcccccaagc

SEQ ID NO: 711952 - RNA, 22 nt, Human
ccuccuccuagagcccccaagc

SEQ ID NO: 711953 - RNA, 22 nt, Human
ccuccuccuagagcccccaagc

SEQ ID NO: 711954 - RNA, 20 nt, Human
ccuccugggacaaacccaaa

SEQ ID NO: 711955 - RNA, 21 nt, Human
ccuccugggacaaacccaaac

SEQ ID NO: 711956 - RNA, 24 nt, Human
ccucgcaucccccugagcugcagc

SEQ ID NO: 711957 - RNA, 21 nt, Human
ccucucuccuuuugugucucu

SEQ ID NO: 711958 - RNA, 19 nt, Human
ccugaccgcagcacuugga

SEQ ID NO: 711959 - RNA, 19 nt, Human
ccugaccgcagcacuugga

SEQ ID NO: 711960 - RNA, 20 nt, Human
ccugagcugcagcucaaggg

SEQ ID NO: 711961 - RNA, 24 nt, Human
ccugccucacauggcaacgcaggg

SEQ ID NO: 711962 - RNA, 23 nt, Human
ccugcuggggcagggucugcuau

SEQ ID NO: 711963 - RNA, 23 nt, Human
ccugcuggggcagggucugcuau

SEQ ID NO: 711964 - RNA, 22 nt, Human
ccuggagggagcauggccucca

SEQ ID NO: 711965 - RNA, 21 nt, Human
ccuggcccagaccugccucuc

SEQ ID NO: 711966 - RNA, 20 nt, Human
ccuggcccugaccgcagcac

SEQ ID NO: 711967 - RNA, 23 nt, Human
ccuuuucacauccugugcuguuu

SEQ ID NO: 711968 - RNA, 23 nt, Human
ccuuuugcaucugaggcaaggac

SEQ ID NO: 711969 - RNA, 23 nt, Human
ccuuuugcauuugaggcaaggac

SEQ ID NO: 711970 - RNA, 22 nt, Human
cgagggaagaagucgcauggug

SEQ ID NO: 711971 - RNA, 20 nt, Human
cgcccucagccccaccccac

SEQ ID NO: 711972 - RNA, 21 nt, Human
cgcccucagccccaccccacc

SEQ ID NO: 711973 - RNA, 19 nt, Human
cgcccuggcccugaagacg

SEQ ID NO: 711974 - RNA, 22 nt, Human
cggcagagaggacggauguggg

SEQ ID NO: 711975 - RNA, 21 nt, Human
cggucacagagggaaagagaa

SEQ ID NO: 711976 - RNA, 22 nt, Human
cgugcugcacacaguccaaggg

SEQ ID NO: 711977 - RNA, 22 nt, Human
cuacagcccccaagcccaucuc

SEQ ID NO: 711978 - RNA, 23 nt, Human
cuagagcccccaagcccaucugc

SEQ ID NO: 711979 - RNA, 21 nt, Human
cucaaucuaugugagcugucc

SEQ ID NO: 711980 - RNA, 20 nt, Human
cucacaagccugugagccac

SEQ ID NO: 711981 - RNA, 23 nt, Human
cucacagagaaccugaggcccag

SEQ ID NO: 711982 - RNA, 21 nt, Human
cucacagcucagacacucuuc

SEQ ID NO: 711983 - RNA, 24 nt, Human
cucagaccacagagucugccccuc

SEQ ID NO: 711984 - RNA, 22 nt, Human
cucagccccaccccaccccugc

SEQ ID NO: 711985 - RNA, 22 nt, Human
cucaggccuggcaccagcacuu

SEQ ID NO: 711986 - RNA, 24 nt, Human
cucauccccaaggaaacacagccc

SEQ ID NO: 711987 - RNA, 18 nt, Human
cuccagagucugggccug

SEQ ID NO: 711988 - RNA, 18 nt, Human
cuccccgcaagccuggag

SEQ ID NO: 711989 - RNA, 22 nt, Human
cucggggccccacaggauggcc

SEQ ID NO: 711990 - RNA, 19 nt, Human
cucucucuaucucucuccc

SEQ ID NO: 711991 - RNA, 20 nt, Human
cucucucucucuaucucucu

SEQ ID NO: 711992 - RNA, 22 nt, Human
cugacacccuggaaucccugcc

SEQ ID NO: 711993 - RNA, 20 nt, Human
cugacacccuggagucccug

SEQ ID NO: 711994 - RNA, 21 nt, Human
cugacagccucagccugugcu

SEQ ID NO: 711995 - RNA, 19 nt, Human
cugacuauucuaauuacgu

SEQ ID NO: 711996 - RNA, 18 nt, Human
cugacuauucuaauuacu

SEQ ID NO: 711997 - RNA, 19 nt, Human
cugagcccagagucccacc

SEQ ID NO: 711998 - RNA, 24 nt, Human
cugaggcaaggacuaauugagauu

SEQ ID NO: 711999 - RNA, 18 nt, Human
cugcagaggacagguuuc

SEQ ID NO: 712000 - RNA, 18 nt, Human
cugcagcaccuuccacug

SEQ ID NO: 712001 - RNA, 27 nt, Human
cugcccagaaacaucugacuccgccgu

SEQ ID NO: 712002 - RNA, 19 nt, Human
cugcccagcggccccgugu

SEQ ID NO: 712003 - RNA, 22 nt, Human
cugcugccuggguccaagcuga

SEQ ID NO: 712004 - RNA, 23 nt, Human
cuggcccuggcccugaccgcagc

SEQ ID NO: 712005 - RNA, 22 nt, Human
cugggacaaacccaaacccacu

SEQ ID NO: 712006 - RNA, 22 nt, Human
cugggacaaacccaaacccgcu

SEQ ID NO: 712007 - RNA, 20 nt, Human
cugggccugggaucccugca

SEQ ID NO: 712008 - RNA, 21 nt, Human
cugggguacaaugcaaaguga

SEQ ID NO: 712009 - RNA, 20 nt, Human
cugugcuguuuucagcauca

SEQ ID NO: 712010 - RNA, 20 nt, Human
cuguuccugccuuuucacau

SEQ ID NO: 712011 - RNA, 24 nt, Human
cuuccuguaaccaagggcugaaag

SEQ ID NO: 712012 - RNA, 19 nt, Human
cuuugaccagcaucucucc

SEQ ID NO: 712013 - RNA, 22 nt, Human
cuuugcuggcccuggcccugac

SEQ ID NO: 712014 - RNA, 21 nt, Human
gaaacugacagaaacccaaca

SEQ ID NO: 712015 - RNA, 20 nt, Human
gaagacggaggaggagccga

SEQ ID NO: 712016 - RNA, 23 nt, Human
gaaggacaagggggccugcuggg

SEQ ID NO: 712017 - RNA, 23 nt, Human
gaaggacaagggggccugcuggg

SEQ ID NO: 712018 - RNA, 19 nt, Human
gaaguucuccccgcaagcc

SEQ ID NO: 712019 - RNA, 18 nt, Human
gacacacgcccucgugca

SEQ ID NO: 712020 - RNA, 21 nt, Human
gacauccugggggugugaggg

SEQ ID NO: 712021 - RNA, 20 nt, Human
gaccaggacccaggaaggac

SEQ ID NO: 712022 - RNA, 20 nt, Human
gacccagcaggcagcgacgg

SEQ ID NO: 712023 - RNA, 21 nt, Human
gaccugccucucucuuuccuc

SEQ ID NO: 712024 - RNA, 21 nt, Human
gaccugcgucucucuuuccuc

SEQ ID NO: 712025 - RNA, 18 nt, Human
gacgggagccucacagga

SEQ ID NO: 712026 - RNA, 26 nt, Human
gagaaugaugugcugagaccaacuaa

SEQ ID NO: 712027 - RNA, 20 nt, Human
gagaggcccaggccccaggc

SEQ ID NO: 712028 - RNA, 19 nt, Human
gagccacucagagccgcga

SEQ ID NO: 712029 - RNA, 21 nt, Human
gagcccccaagcccaucuccc

SEQ ID NO: 712030 - RNA, 22 nt, Human
gagcccccaagcccaucugccu

SEQ ID NO: 712031 - RNA, 21 nt, Human
gagcguagccaugagccacgc

SEQ ID NO: 712032 - RNA, 21 nt, Human
gagcugggguugagcaccucc

SEQ ID NO: 712033 - RNA, 20 nt, Human
gagcuuacuccaccuccgcc

SEQ ID NO: 712034 - RNA, 22 nt, Human
gaggaaggugcccccagggccc

SEQ ID NO: 712035 - RNA, 18 nt, Human
gaggaggagccgagagcu

SEQ ID NO: 712036 - RNA, 22 nt, Human
gaggaggcaugucccagcaugg

SEQ ID NO: 712037 - RNA, 22 nt, Human
gaggaggcaugucccagcaugg

SEQ ID NO: 712038 - RNA, 20 nt, Human
gaggaguagcugacaaggca

SEQ ID NO: 712039 - RNA, 23 nt, Human
gaggaucccaggacugccugagg

SEQ ID NO: 712040 - RNA, 18 nt, Human
gaggaugccuguguggag

SEQ ID NO: 712041 - RNA, 23 nt, Human
gaggcaggcagggcuugggggug

SEQ ID NO: 712042 - RNA, 23 nt, Human
gaggguggggaagacaauuccaa

SEQ ID NO: 712043 - RNA, 21 nt, Human
gagucccugccuccuccuaga

SEQ ID NO: 712044 - RNA, 18 nt, Human
gagugcacagacaacagc

SEQ ID NO: 712045 - RNA, 21 nt, Human
gaucccaggacugccugaggg

SEQ ID NO: 712046 - RNA, 19 nt, Human
gauucaauguccacacccg

SEQ ID NO: 712047 - RNA, 25 nt, Human
gcacagcccaggagagggggaacgc

SEQ ID NO: 712048 - RNA, 22 nt, Human
gcagaagcccaggaggcccgga

SEQ ID NO: 712049 - RNA, 20 nt, Human
gcagaggacagguuucugga

SEQ ID NO: 712050 - RNA, 18 nt, Human
gcagccuaggauacauga

SEQ ID NO: 712051 - RNA, 21 nt, Human
gcaggcccacagaacucgagg

SEQ ID NO: 712052 - RNA, 22 nt, Human
gcaggcugcagaggugcuggca

SEQ ID NO: 712053 - RNA, 26 nt, Human
gcagugcuggcugaggacaggcgggg

SEQ ID NO: 712054 - RNA, 26 nt, Human
gcagugcuggcuggggacaggcaggg

SEQ ID NO: 712055 - RNA, 21 nt, Human
gcauauccaucaccucacaca

SEQ ID NO: 712056 - RNA, 18 nt, Human
gcccacaugccugcugug

SEQ ID NO: 712057 - RNA, 24 nt, Human
gcccacaugccugcugugugcgua

SEQ ID NO: 712058 - RNA, 21 nt, Human
gcccagaaauugcaucgugcu

SEQ ID NO: 712059 - RNA, 18 nt, Human
gcccaggagaggaguagc

SEQ ID NO: 712060 - RNA, 24 nt, Human
gcccaggagaggcccaggccccag

SEQ ID NO: 712061 - RNA, 26 nt, Human
gcccaggguaucuuggacacccagcc

SEQ ID NO: 712062 - RNA, 19 nt, Human
gccccagccacagcaugag

SEQ ID NO: 712063 - RNA, 23 nt, Human
gccccggcccugaccgcagcacu

SEQ ID NO: 712064 - RNA, 18 nt, Human
gccccucccaccaaagcc

SEQ ID NO: 712065 - RNA, 22 nt, Human
gccccuggggcccaggccucag

SEQ ID NO: 712066 - RNA, 22 nt, Human
gccccuggggcccaggccucag

SEQ ID NO: 712067 - RNA, 19 nt, Human
gcccguucaccaucauaga

SEQ ID NO: 712068 - RNA, 23 nt, Human
gcccuggcccugaccgcagcacu

SEQ ID NO: 712069 - RNA, 22 nt, Human
gcgacggggcccucacaagccu

SEQ ID NO: 712070 - RNA, 22 nt, Human
gcgccagcaccagcacacccag

SEQ ID NO: 712071 - RNA, 21 nt, Human
gcucuugcucuugcucacuca

SEQ ID NO: 712072 - RNA, 24 nt, Human
gcuggccccggcccugaccgcagc

SEQ ID NO: 712073 - RNA, 19 nt, Human
ggaaagccagcccaagcuc

SEQ ID NO: 712074 - RNA, 23 nt, Human
ggaaggacaagggggccugcugg

SEQ ID NO: 712075 - RNA, 23 nt, Human
ggaaggacaagggggccugcugg

SEQ ID NO: 712076 - RNA, 19 nt, Human
ggaauuccugucauuugcu

SEQ ID NO: 712077 - RNA, 22 nt, Human
ggacacaguccacgaagccucg

SEQ ID NO: 712078 - RNA, 20 nt, Human
ggacacggggguugggggug

SEQ ID NO: 712079 - RNA, 21 nt, Human
ggacuuugcuggccccggccc

SEQ ID NO: 712080 - RNA, 21 nt, Human
ggacuuugcuggcccuggccc

SEQ ID NO: 712081 - RNA, 21 nt, Human
ggagaggcccaggccccaggc

SEQ ID NO: 712082 - RNA, 20 nt, Human
ggagcacccgggcacugaag

SEQ ID NO: 712083 - RNA, 18 nt, Human
ggaggagccgagagcucg

SEQ ID NO: 712084 - RNA, 21 nt, Human
ggagggagcauggccuccagc

SEQ ID NO: 712085 - RNA, 22 nt, Human
ggaggucccucacagagaaccu

SEQ ID NO: 712086 - RNA, 18 nt, Human
ggaggugaggguggggaa

SEQ ID NO: 712087 - RNA, 19 nt, Human
ggaguuucuucacugugcg

SEQ ID NO: 712088 - RNA, 19 nt, Human
ggaucccaggacugccuga

SEQ ID NO: 712089 - RNA, 21 nt, Human
ggcagaaaagaggcaacccag

SEQ ID NO: 712090 - RNA, 25 nt, Human
ggcccagcaggcugcagaggugcug

SEQ ID NO: 712091 - RNA, 18 nt, Human
ggcccggaaggcacagug

SEQ ID NO: 712092 - RNA, 19 nt, Human
ggccucucucugagcccag

SEQ ID NO: 712093 - RNA, 20 nt, Human
ggccugauggcagcuggcca

SEQ ID NO: 712094 - RNA, 23 nt, Human
ggcggagucccugugagccuggc

SEQ ID NO: 712095 - RNA, 21 nt, Human
ggcugggguccaggcugaacu

SEQ ID NO: 712096 - RNA, 20 nt, Human
gggaaggacacagcccaggg

SEQ ID NO: 712097 - RNA, 21 nt, Human
gggaggcagcugccccagcuc

SEQ ID NO: 712098 - RNA, 20 nt, Human
gggaggccccaugguggcag

SEQ ID NO: 712099 - RNA, 18 nt, Human
gggcaaagccugagcacc

SEQ ID NO: 712100 - RNA, 19 nt, Human
gggcaccauggacacccaa

SEQ ID NO: 712101 - RNA, 19 nt, Human
gggcaccauggacacccaa

SEQ ID NO: 712102 - RNA, 22 nt, Human
gggcagagcuggagcacccggg

SEQ ID NO: 712103 - RNA, 20 nt, Human
gggcauggccugugagacug

SEQ ID NO: 712104 - RNA, 23 nt, Human
gggcuggagcguagccaugagcc

SEQ ID NO: 712105 - RNA, 20 nt, Human
gggucacugucaccacccac

SEQ ID NO: 712106 - RNA, 24 nt, Human
ggucacagaaugcaggacauagag

SEQ ID NO: 712107 - RNA, 20 nt, Human
ggugggucccugcugcagca

SEQ ID NO: 712108 - RNA, 26 nt, Human
guaaaauacacaagaacagcccaaaa

SEQ ID NO: 712109 - RNA, 20 nt, Human
guagccaugagccacgcccc

SEQ ID NO: 712110 - RNA, 24 nt, Human
guccacgacuaacccccagcccaa

SEQ ID NO: 712111 - RNA, 18 nt, Human
guccccacagguccgugg

SEQ ID NO: 712112 - RNA, 19 nt, Human
guccccacagguccguggc

SEQ ID NO: 712113 - RNA, 24 nt, Human
guccguggcgguugccguauuggg

SEQ ID NO: 712114 - RNA, 31 nt, Human
guggugaugaagauggcaauggcuuccuuuu

SEQ ID NO: 712115 - RNA, 19 nt, Human
gugugugugugccucugcu

SEQ ID NO: 712116 - RNA, 23 nt, Human
guucaugugaaugucauccaggc

SEQ ID NO: 712117 - RNA, 19 nt, Human
guuccugccuuuucacauc

SEQ ID NO: 712118 - RNA, 22 nt, Human
uaaaaaugcacaccacaggcuc

SEQ ID NO: 712119 - RNA, 23 nt, Human
uaaaccuccccugcucuucccac

SEQ ID NO: 712120 - RNA, 19 nt, Human
uaacccugugaaguucagg

SEQ ID NO: 712121 - RNA, 22 nt, Human
uaagcuggguuagcuaaggagc

SEQ ID NO: 712122 - RNA, 26 nt, Human
uacacaaaauacccagcaucgcccac

SEQ ID NO: 712123 - RNA, 18 nt, Human
uacccagaaacaucugac

SEQ ID NO: 712124 - RNA, 22 nt, Human
uaccccggggagagccacagca

SEQ ID NO: 712125 - RNA, 21 nt, Human
uacuucacugggugggaccuu

SEQ ID NO: 712126 - RNA, 20 nt, Human
uagacagaagccaggugagg

SEQ ID NO: 712127 - RNA, 21 nt, Human
uagagcccccaagcccaucuc

SEQ ID NO: 712128 - RNA, 24 nt, Human
uaugggugccuggggcaggucuca

SEQ ID NO: 712129 - RNA, 23 nt, Human
uaugugcaucccacucauacaca

SEQ ID NO: 712130 - RNA, 22 nt, Human
ucaacaugcauuuaaggcacaa

SEQ ID NO: 712131 - RNA, 21 nt, Human
ucaacaugcuuuaaggcacaa

SEQ ID NO: 712132 - RNA, 21 nt, Human
ucaaucauucacacagacaca

SEQ ID NO: 712133 - RNA, 23 nt, Human
ucacacagacacaugcauugaac

SEQ ID NO: 712134 - RNA, 21 nt, Human
ucacauggcaacgcagggucu

SEQ ID NO: 712135 - RNA, 23 nt, Human
ucacuggugucacucacaggaag

SEQ ID NO: 712136 - RNA, 19 nt, Human
ucagaccacagagucugcc

SEQ ID NO: 712137 - RNA, 19 nt, Human
ucagaccacagagucugcc

SEQ ID NO: 712138 - RNA, 19 nt, Human
ucaggccuggcaccagcac

SEQ ID NO: 712139 - RNA, 21 nt, Human
ucagugaaggccuccagaguc

SEQ ID NO: 712140 - RNA, 25 nt, Human
ucaucccccuggacaugaccaccuc

SEQ ID NO: 712141 - RNA, 21 nt, Human
ucauuccuaggggaguacaca

SEQ ID NO: 712142 - RNA, 20 nt, Human
uccaaagcuggagcacuggc

SEQ ID NO: 712143 - RNA, 24 nt, Human
uccacaucagggaccacacaagac

SEQ ID NO: 712144 - RNA, 18 nt, Human
uccacgggccuccuguga

SEQ ID NO: 712145 - RNA, 18 nt, Human
uccacgggccuccuguga

SEQ ID NO: 712146 - RNA, 19 nt, Human
uccacugggugggacccgg

SEQ ID NO: 712147 - RNA, 21 nt, Human
uccagguuaugggugccuggg

SEQ ID NO: 712148 - RNA, 18 nt, Human
uccaucaucccccuggac

SEQ ID NO: 712149 - RNA, 22 nt, Human
uccauuggaaccuggcucugcc

SEQ ID NO: 712150 - RNA, 23 nt, Human
ucccaaggccgagcuggggcgcu

SEQ ID NO: 712151 - RNA, 18 nt, Human
ucccgcucucuugguugg

SEQ ID NO: 712152 - RNA, 20 nt, Human
ucccgguugucacuugccuu

SEQ ID NO: 712153 - RNA, 20 nt, Human
ucccuaggggaggacacagc

SEQ ID NO: 712154 - RNA, 23 nt, Human
ucccucagagccuccagagacag

SEQ ID NO: 712155 - RNA, 23 nt, Human
ucccucagagccuccagagacag

SEQ ID NO: 712156 - RNA, 23 nt, Human
ucccugccuccuccuacagcccc

SEQ ID NO: 712157 - RNA, 24 nt, Human
ucccugccuccuccuagagccccc

SEQ ID NO: 712158 - RNA, 24 nt, Human
ucccugccuccuccuagagccccc

SEQ ID NO: 712159 - RNA, 22 nt, Human
ucccugcugcagcaccuuccac

SEQ ID NO: 712160 - RNA, 23 nt, Human
ucccugugcggaguccacgggcc

SEQ ID NO: 712161 - RNA, 22 nt, Human
uccggacagccagggaccaaag

SEQ ID NO: 712162 - RNA, 18 nt, Human
uccuacagcccccaagcc

SEQ ID NO: 712163 - RNA, 21 nt, Human
uccuggguggggccugauggc

SEQ ID NO: 712164 - RNA, 19 nt, Human
ucgcccacaugccugcugu

SEQ ID NO: 712165 - RNA, 21 nt, Human
ucuaaaggagaggaucccagg

SEQ ID NO: 712166 - RNA, 19 nt, Human
ucuaaaggagaggauccug

SEQ ID NO: 712167 - RNA, 24 nt, Human
ucuaggagguuggcagagggagac

SEQ ID NO: 712168 - RNA, 19 nt, Human
ucucggggccccacagggu

SEQ ID NO: 712169 - RNA, 26 nt, Human
ucucggggccccacaggguggcucca

SEQ ID NO: 712170 - RNA, 22 nt, Human
ucucugacuauucuaauuacau

SEQ ID NO: 712171 - RNA, 22 nt, Human
ucucugacuauucuaauuacgu

SEQ ID NO: 712172 - RNA, 22 nt, Human
ucucugacuauucuaauuacgu

SEQ ID NO: 712173 - RNA, 22 nt, Human
ucucugacuauucuaauuacgu

SEQ ID NO: 712174 - RNA, 22 nt, Human
ucugccucagagcauccagaga

SEQ ID NO: 712175 - RNA, 21 nt, Human
ucugcuccaucccuagccaaa

SEQ ID NO: 712176 - RNA, 21 nt, Human
ucugggguggcugggaucagu

SEQ ID NO: 712177 - RNA, 20 nt, Human
ucuguccccagcagaagccc

SEQ ID NO: 712178 - RNA, 22 nt, Human
ucuucuggcuacuuuucucuga

SEQ ID NO: 712179 - RNA, 23 nt, Human
ucuugguuggacagcucuccauc

SEQ ID NO: 712180 - RNA, 20 nt, Human
ugaaagagggaacgguuucc

SEQ ID NO: 712181 - RNA, 23 nt, Human
ugaaagagggaacgguuuccugg

SEQ ID NO: 712182 - RNA, 21 nt, Human
ugaagagcacagaggggggua

SEQ ID NO: 712183 - RNA, 19 nt, Human
ugaaggaccaggacccagg

SEQ ID NO: 712184 - RNA, 19 nt, Human
ugaaggaccagggcccagg

SEQ ID NO: 712185 - RNA, 22 nt, Human
ugaaggccuccagagucugggc

SEQ ID NO: 712186 - RNA, 18 nt, Human
ugaaugucauuucuggcu

SEQ ID NO: 712187 - RNA, 18 nt, Human
ugaaugucauuucuggcu

SEQ ID NO: 712188 - RNA, 18 nt, Human
ugaaugucauuucuggcu

SEQ ID NO: 712189 - RNA, 22 nt, Human
ugacauagacagaagccaggug

SEQ ID NO: 712190 - RNA, 22 nt, Human
ugacaucaguacaacauccaua

SEQ ID NO: 712191 - RNA, 18 nt, Human
ugaccucugcccuuuccc

SEQ ID NO: 712192 - RNA, 19 nt, Human
ugacuccucccaucagcag

SEQ ID NO: 712193 - RNA, 20 nt, Human
ugagaugagcccaucaagcc

SEQ ID NO: 712194 - RNA, 19 nt, Human
ugagaugauacacaucagg

SEQ ID NO: 712195 - RNA, 20 nt, Human
ugagcagccaccaggagccc

SEQ ID NO: 712196 - RNA, 21 nt, Human
ugagcagccaccaggagccca

SEQ ID NO: 712197 - RNA, 22 nt, Human
ugagcaugucaccgggaugggc

SEQ ID NO: 712198 - RNA, 20 nt, Human
ugagcccagagucccacccc

SEQ ID NO: 712199 - RNA, 21 nt, Human
ugagcccagagucccaccccu

SEQ ID NO: 712200 - RNA, 22 nt, Human
ugagcccagagucccaccccug

SEQ ID NO: 712201 - RNA, 18 nt, Human
ugagcgagugcacagaca

SEQ ID NO: 712202 - RNA, 21 nt, Human
ugagcugccaucggcucgaga

SEQ ID NO: 712203 - RNA, 23 nt, Human
ugagcuguccuugugaaaugggu

SEQ ID NO: 712204 - RNA, 19 nt, Human
ugaggacaggcggggcugg

SEQ ID NO: 712205 - RNA, 19 nt, Human
ugagggaggagggcaucca

SEQ ID NO: 712206 - RNA, 23 nt, Human
ugagggcaaggccucggggcccc

SEQ ID NO: 712207 - RNA, 23 nt, Human
ugagggcaaggucucggggcccc

SEQ ID NO: 712208 - RNA, 21 nt, Human
ugaggugggaagcggaggcag

SEQ ID NO: 712209 - RNA, 20 nt, Human
ugaguggaugcaccuggcuc

SEQ ID NO: 712210 - RNA, 21 nt, Human
ugcaacagaucaaaagaacug

SEQ ID NO: 712211 - RNA, 23 nt, Human
ugcacaggaggaagaugaugaug

SEQ ID NO: 712212 - RNA, 21 nt, Human
ugcacaggaggaugaugauga

SEQ ID NO: 712213 - RNA, 20 nt, Human
ugcaggaagcaagaggcccc

SEQ ID NO: 712214 - RNA, 20 nt, Human
ugcaggauucaucuggaccu

SEQ ID NO: 712215 - RNA, 25 nt, Human
ugcaugggcacaagugugugugugg

SEQ ID NO: 712216 - RNA, 20 nt, Human
ugccagcgccauucccacag

SEQ ID NO: 712217 - RNA, 18 nt, Human
ugccauagcacccaaccc

SEQ ID NO: 712218 - RNA, 18 nt, Human
ugcccagaaacaucugac

SEQ ID NO: 712219 - RNA, 20 nt, Human
ugcccaggagaggaguagcu

SEQ ID NO: 712220 - RNA, 18 nt, Human
ugcccaggaugccauagc

SEQ ID NO: 712221 - RNA, 25 nt, Human
ugcccaggaugccauagcacccaac

SEQ ID NO: 712222 - RNA, 22 nt, Human
ugcccaggcccagaaggaaagc

SEQ ID NO: 712223 - RNA, 23 nt, Human
ugcccaggcccagaaggaaagcc

SEQ ID NO: 712224 - RNA, 24 nt, Human
ugcccaggcccagaaggaaagccc

SEQ ID NO: 712225 - RNA, 20 nt, Human
ugccccagcucugagggagg

SEQ ID NO: 712226 - RNA, 20 nt, Human
ugccccagggagcaugacau

SEQ ID NO: 712227 - RNA, 21 nt, Human
ugccccagggagcaugacauu

SEQ ID NO: 712228 - RNA, 19 nt, Human
ugccggagucccugugagc

SEQ ID NO: 712229 - RNA, 23 nt, Human
ugccucagagcauccagagacag

SEQ ID NO: 712230 - RNA, 21 nt, Human
ugccucagccuuuccaucugc

SEQ ID NO: 712231 - RNA, 21 nt, Human
ugccucagcuuuuccaucugc

SEQ ID NO: 712232 - RNA, 18 nt, Human
ugccuguguggagggguc

SEQ ID NO: 712233 - RNA, 23 nt, Human
ugcuccaucccuagccaaaguca

SEQ ID NO: 712234 - RNA, 23 nt, Human
ugcugugugucuguacacacaua

SEQ ID NO: 712235 - RNA, 20 nt, Human
uggaagauucaauguccaca

SEQ ID NO: 712236 - RNA, 18 nt, Human
uggaaucccugccuccuc

SEQ ID NO: 712237 - RNA, 24 nt, Human
uggacacccaacccucauccccag

SEQ ID NO: 712238 - RNA, 24 nt, Human
uggacacccaacccucauccccag

SEQ ID NO: 712239 - RNA, 24 nt, Human
uggacauccaacccucauccccag

SEQ ID NO: 712240 - RNA, 20 nt, Human
uggaggaggcagggaaguuc

SEQ ID NO: 712241 - RNA, 22 nt, Human
uggaggaggcagggaaguucuc

SEQ ID NO: 712242 - RNA, 22 nt, Human
uggaggcccgacccucaucccu

SEQ ID NO: 712243 - RNA, 25 nt, Human
uggagggacuuggagcaagguccuu

SEQ ID NO: 712244 - RNA, 18 nt, Human
uggagggagcauggccuc

SEQ ID NO: 712245 - RNA, 24 nt, Human
uggcaccugggcagagcuggagca

SEQ ID NO: 712246 - RNA, 22 nt, Human
uggcagaaaagaggcaacccag

SEQ ID NO: 712247 - RNA, 22 nt, Human
uggcagaggcuggggauccagg

SEQ ID NO: 712248 - RNA, 23 nt, Human
uggcagaggcuggggauccaggc

SEQ ID NO: 712249 - RNA, 22 nt, Human
uggcagaggcugggguccaggc

SEQ ID NO: 712250 - RNA, 21 nt, Human
uggcagccagaugccagcgcc

SEQ ID NO: 712251 - RNA, 22 nt, Human
uggcaggggugggacaccuggu

SEQ ID NO: 712252 - RNA, 18 nt, Human
uggcauauccaucaccuc

SEQ ID NO: 712253 - RNA, 18 nt, Human
uggcccagaccugccucu

SEQ ID NO: 712254 - RNA, 20 nt, Human
uggccuagugugugcugcag

SEQ ID NO: 712255 - RNA, 18 nt, Human
uggccuccagcaccccca

SEQ ID NO: 712256 - RNA, 19 nt, Human
uggcggagucccugugagc

SEQ ID NO: 712257 - RNA, 23 nt, Human
uggcugaggacaggcggggcugg

SEQ ID NO: 712258 - RNA, 25 nt, Human
uggcugaggacaggcggggcugggc

SEQ ID NO: 712259 - RNA, 26 nt, Human
uggcugaggagacagcugcaggguac

SEQ ID NO: 712260 - RNA, 25 nt, Human
uggcuggggacaggcagggcugggc

SEQ ID NO: 712261 - RNA, 22 nt, Human
ugggaacacugagcagccacca

SEQ ID NO: 712262 - RNA, 21 nt, Human
ugggaggccccgugguggcag

SEQ ID NO: 712263 - RNA, 19 nt, Human
ugggaucccugcagugcug

SEQ ID NO: 712264 - RNA, 20 nt, Human
ugggauggaggugagggugg

SEQ ID NO: 712265 - RNA, 20 nt, Human
uggggagccauuuccucagg

SEQ ID NO: 712266 - RNA, 19 nt, Human
uggggcccaggccucagca

SEQ ID NO: 712267 - RNA, 19 nt, Human
uggggcccaggccucagca

SEQ ID NO: 712268 - RNA, 24 nt, Human
ugggggcaccagcccagcccagag

SEQ ID NO: 712269 - RNA, 26 nt, Human
ugggggcaccagcccagcccagaggc

SEQ ID NO: 712270 - RNA, 19 nt, Human
uggggucacgggcagcccu

SEQ ID NO: 712271 - RNA, 21 nt, Human
ugguuucuccuauaugugccc

SEQ ID NO: 712272 - RNA, 26 nt, Human
uguaaucacaaguguccuucuaggag

SEQ ID NO: 712273 - RNA, 23 nt, Human
uguacagauauuaauaaugaugu

SEQ ID NO: 712274 - RNA, 19 nt, Human
ugucacaguguuacaugga

SEQ ID NO: 712275 - RNA, 25 nt, Human
ugucauuugcuuuggauccaggagc

SEQ ID NO: 712276 - RNA, 18 nt, Human
uguccuugugaaaugggu

SEQ ID NO: 712277 - RNA, 21 nt, Human
ugucucagaccacagagucug

SEQ ID NO: 712278 - RNA, 18 nt, Human
ugucuggggucacgggca

SEQ ID NO: 712279 - RNA, 23 nt, Human
ugugaaguucaggucaccagcag

SEQ ID NO: 712280 - RNA, 23 nt, Human
ugugcaugggcacaagugugugu

SEQ ID NO: 712281 - RNA, 26 nt, Human
ugugcaugggcacaagugugugugug

SEQ ID NO: 712282 - RNA, 23 nt, Human
ugugcaugggcccaagugugugu

SEQ ID NO: 712283 - RNA, 24 nt, Human
uguggugagaacauuuaaaaucuc

SEQ ID NO: 712284 - RNA, 20 nt, Human
ugugucucuauuuuuaauug

SEQ ID NO: 712285 - RNA, 26 nt, Human
ugugugcaugggcacaagugugugug

SEQ ID NO: 712286 - RNA, 18 nt, Human
ugugugucuguacacaca

SEQ ID NO: 712287 - RNA, 22 nt, Human
ugugugucuguacacacauaug

SEQ ID NO: 712288 - RNA, 26 nt, Human
ugugugucuguacacacauauguuuu

SEQ ID NO: 712289 - RNA, 22 nt, Human
uguguguguggcucugcugugu

SEQ ID NO: 712290 - RNA, 21 nt, Human
uguguuagagggagcauucgg

SEQ ID NO: 712291 - RNA, 20 nt, Human
uguuuuggguuuuuuugugu

SEQ ID NO: 712292 - RNA, 19 nt, Human
uuaaaacaagguaaguggc

SEQ ID NO: 712293 - RNA, 18 nt, Human
uuccagguuaugggugcc

SEQ ID NO: 712294 - RNA, 24 nt, Human
uuccagguuaugggugccuggggc

SEQ ID NO: 712295 - RNA, 21 nt, Human
uuccgugaagagucuauugcu

SEQ ID NO: 712296 - RNA, 19 nt, Human
uucucccaagugagcucua

SEQ ID NO: 712297 - RNA, 22 nt, Human
uugaauaugggagggacuuugc

SEQ ID NO: 712298 - RNA, 22 nt, Human
uugaauaugggagggacuuugc

SEQ ID NO: 712299 - RNA, 24 nt, Human
uugaggcaaggacuaauugagauu

SEQ ID NO: 712300 - RNA, 21 nt, Human
uugcaccccugccuuccuaac

SEQ ID NO: 712301 - RNA, 28 nt, Human
uugcagauuaacuccacuggccuugcac

SEQ ID NO: 712302 - RNA, 27 nt, Human
uuuaaaauggguuagaaaugccuucaa

SEQ ID NO: 712303 - RNA, 20 nt, Human
uuuagcaauuuugaaauagu

SEQ ID NO: 712304 - RNA, 22 nt, Human
uuugaugggauggaggugaggg

SEQ ID NO: 712305 - RNA, 24 nt, Human
uuugcaucugaggcaaggacuaau

SEQ ID NO: 712306 - RNA, 24 nt, Human
uuugcugguccuccuggggcucug

SEQ ID NO: 712307 - RNA, 18 nt, Human
uuugggguuuuuuugugu

SEQ ID NO: 712308 - RNA, 28 nt, Human
aaaaauaguaagaaaaacaccgguaccc

SEQ ID NO: 712309 - RNA, 20 nt, Human
aacacaggaggagcaggcag

SEQ ID NO: 712310 - RNA, 20 nt, Human
aaccaaacacagaaaggucc

SEQ ID NO: 712311 - RNA, 18 nt, Human
aaggucccaagagucagc

SEQ ID NO: 712312 - RNA, 19 nt, Human
acaccucaggccacagacu

SEQ ID NO: 712313 - RNA, 22 nt, Human
accaaacacagaaaggucccag

SEQ ID NO: 712314 - RNA, 22 nt, Human
agacgagaaccaaacacagaaa

SEQ ID NO: 712315 - RNA, 21 nt, Human
agcaauuuuucuauugaauua

SEQ ID NO: 712316 - RNA, 22 nt, Human
aggagcaggcaggagcccuggc

SEQ ID NO: 712317 - RNA, 25 nt, Human
aggcagaaaaugugacauuucaaga

SEQ ID NO: 712318 - RNA, 24 nt, Human
aggcaggagcccuggcaccugugc

SEQ ID NO: 712319 - RNA, 23 nt, Human
agggaacaccaaaccacugagcc

SEQ ID NO: 712320 - RNA, 21 nt, Human
aggugcccacuaucgccaccc

SEQ ID NO: 712321 - RNA, 19 nt, Human
agguugcuauaauaaaaau

SEQ ID NO: 712322 - RNA, 23 nt, Human
aguaaagggacuacaacaagaua

SEQ ID NO: 712323 - RNA, 20 nt, Human
augcagccaaagccucugga

SEQ ID NO: 712324 - RNA, 19 nt, Human
auuauccuuuuauuuuucu

SEQ ID NO: 712325 - RNA, 21 nt, Human
auuuaugauccaauuuagcua

SEQ ID NO: 712326 - RNA, 22 nt, Human
caaacacagaaaggucccaaga

SEQ ID NO: 712327 - RNA, 22 nt, Human
caaaccacugagccaagacgag

SEQ ID NO: 712328 - RNA, 22 nt, Human
caccucaggccacagacucuaa

SEQ ID NO: 712329 - RNA, 19 nt, Human
cacugagccaagacgagaa

SEQ ID NO: 712330 - RNA, 23 nt, Human
cagaccaugcagccaaagccucu

SEQ ID NO: 712331 - RNA, 20 nt, Human
caggagcccuggcaccugug

SEQ ID NO: 712332 - RNA, 24 nt, Human
ccaaaguaaaaagccaaguuuuau

SEQ ID NO: 712333 - RNA, 21 nt, Human
ccaagacgagaaccaaacaca

SEQ ID NO: 712334 - RNA, 25 nt, Human
ccacugagccaagacgagaaccaaa

SEQ ID NO: 712335 - RNA, 18 nt, Human
ccagagcagacaccucag

SEQ ID NO: 712336 - RNA, 21 nt, Human
cccacuaucgccacccagagc

SEQ ID NO: 712337 - RNA, 24 nt, Human
cccagagcagacaccucaggccac

SEQ ID NO: 712338 - RNA, 24 nt, Human
ccuggcaccugugcuaaacgucac

SEQ ID NO: 712339 - RNA, 21 nt, Human
cggcggcagcggcggcggcug

SEQ ID NO: 712340 - RNA, 21 nt, Human
cugagccaagacgagaaccaa

SEQ ID NO: 712341 - RNA, 21 nt, Human
cugaggugcccacuaucgcca

SEQ ID NO: 712342 - RNA, 20 nt, Human
cuuagagggaaggcagaaaa

SEQ ID NO: 712343 - RNA, 18 nt, Human
cuugaagaauuugaaagg

SEQ ID NO: 712344 - RNA, 20 nt, Human
gaacaccaaaccacugagcc

SEQ ID NO: 712345 - RNA, 21 nt, Human
gaaccaaacacagaaaggucc

SEQ ID NO: 712346 - RNA, 18 nt, Human
gaauuugaaaggcaagua

SEQ ID NO: 712347 - RNA, 22 nt, Human
gagcaggcaggagcccuggcac

SEQ ID NO: 712348 - RNA, 24 nt, Human
gagcccuggcaccugugcuaaacg

SEQ ID NO: 712349 - RNA, 21 nt, Human
gcacaucuauauacauacaca

SEQ ID NO: 712350 - RNA, 19 nt, Human
gcccauguacccaaaguaa

SEQ ID NO: 712351 - RNA, 23 nt, Human
gcggcggcggcugcugucccggu

SEQ ID NO: 712352 - RNA, 18 nt, Human
gcuaaacgucaccgaccu

SEQ ID NO: 712353 - RNA, 21 nt, Human
ggaggacggcggcagcggcgg

SEQ ID NO: 712354 - RNA, 18 nt, Human
ggcggcagcggcggcggc

SEQ ID NO: 712355 - RNA, 20 nt, Human
ggcggcggcugcugucccgg

SEQ ID NO: 712356 - RNA, 21 nt, Human
gggaaggcagaaaaugugaca

SEQ ID NO: 712357 - RNA, 21 nt, Human
guacccaaaguaaaaagccaa

SEQ ID NO: 712358 - RNA, 22 nt, Human
uaagaaaaacacgauguaaaau

SEQ ID NO: 712359 - RNA, 30 nt, Human
uaagaaaaacacgauguaaaauacaucaag

SEQ ID NO: 712360 - RNA, 18 nt, Human
uagacaggggaggacggc

SEQ ID NO: 712361 - RNA, 23 nt, Human
uauauauauuuauaugcacaucu

SEQ ID NO: 712362 - RNA, 23 nt, Human
ucaaaauauacuacauaaacccc

SEQ ID NO: 712363 - RNA, 20 nt, Human
ucaagaauacuucccauguu

SEQ ID NO: 712364 - RNA, 20 nt, Human
ucagcucgagacagcuccgg

SEQ ID NO: 712365 - RNA, 20 nt, Human
ugaaaggcaaguauauuuaa

SEQ ID NO: 712366 - RNA, 20 nt, Human
ugcacaucuauauacauaca

SEQ ID NO: 712367 - RNA, 23 nt, Human
ugcagacgagggaacaccaaacc

SEQ ID NO: 712368 - RNA, 24 nt, Human
uugcuauaauaaaaauauauugcu

SEQ ID NO: 712369 - RNA, 20 nt, Human
uuuuauuuuucuuuucugag

SEQ ID NO: 712370 - RNA, 20 nt, Human
aacccuggcuaccagauuca

SEQ ID NO: 712371 - RNA, 18 nt, Human
auuuaaaaauggcagaac

SEQ ID NO: 712372 - RNA, 24 nt, Human
ccccaaguucgagggaacccuggc

SEQ ID NO: 712373 - RNA, 22 nt, Human
uaaaaauggcagaacaagaaca

SEQ ID NO: 712374 - RNA, 22 nt, Human
uaaaaauggcagaacaagaaca

SEQ ID NO: 712375 - RNA, 24 nt, Human
uaaaaauggcagaacaagaacaca

SEQ ID NO: 712376 - RNA, 24 nt, Human
uaaaaauggcagaacaagaacaca

SEQ ID NO: 712377 - RNA, 23 nt, Human
uaacagaaaccuugauuuaaaaa

SEQ ID NO: 712378 - RNA, 20 nt, Human
uacuuugcuuuuaaaaagau

SEQ ID NO: 712379 - RNA, 22 nt, Human
ugagcuacaacaugguggcagg

SEQ ID NO: 712380 - RNA, 20 nt, Human
ugauuuaaaaauggcagaac

SEQ ID NO: 712381 - RNA, 23 nt, Human
ugcccacccgaaaacucacagcg

SEQ ID NO: 712382 - RNA, 21 nt, Human
ugcgucugcccacccgaaaac

SEQ ID NO: 712383 - RNA, 22 nt, Human
uggaaugccucguuaacagaaa

SEQ ID NO: 712384 - RNA, 22 nt, Human
uggaaugccucguuaacagaaa

SEQ ID NO: 712385 - RNA, 21 nt, Human
uuauuaaaaaaaaaaaaaaaa

SEQ ID NO: 712386 - RNA, 24 nt, Human
uuuacuuugcuuuuaaaaagaucc

SEQ ID NO: 712387 - RNA, 20 nt, Human
aaaacacaaacaugaaacca

SEQ ID NO: 712388 - RNA, 23 nt, Human
aaacccucagggggcuaggcucc

SEQ ID NO: 712389 - RNA, 19 nt, Human
aaagguagcugggggcugc

SEQ ID NO: 712390 - RNA, 19 nt, Human
aaauggcaaggcuguggcc

SEQ ID NO: 712391 - RNA, 25 nt, Human
aacaacugcccuggccgccuccaca

SEQ ID NO: 712392 - RNA, 19 nt, Human
aagacgccacauucgcuaa

SEQ ID NO: 712393 - RNA, 23 nt, Human
aagaggcaugacagagggguuug

SEQ ID NO: 712394 - RNA, 20 nt, Human
aagaggcugcccugguaucg

SEQ ID NO: 712395 - RNA, 22 nt, Human
aagcaucucccgaaccuuccca

SEQ ID NO: 712396 - RNA, 20 nt, Human
aaggaagcaucucccgaacc

SEQ ID NO: 712397 - RNA, 24 nt, Human
aagugaaccugagugaggccaaga

SEQ ID NO: 712398 - RNA, 26 nt, Human
acaaauucacaaaacuggcuacaaaa

SEQ ID NO: 712399 - RNA, 18 nt, Human
acacaagggagcgcaccg

SEQ ID NO: 712400 - RNA, 22 nt, Human
acaugaaaccagcuaaaggcca

SEQ ID NO: 712401 - RNA, 18 nt, Human
acauggcaagguguggca

SEQ ID NO: 712402 - RNA, 20 nt, Human
acccagggcacggccacuca

SEQ ID NO: 712403 - RNA, 22 nt, Human
accccaggcccucccugacagc

SEQ ID NO: 712404 - RNA, 23 nt, Human
accccagggauucugucucucac

SEQ ID NO: 712405 - RNA, 20 nt, Human
accugagugaggccaagaag

SEQ ID NO: 712406 - RNA, 18 nt, Human
acugcccaacaucccaca

SEQ ID NO: 712407 - RNA, 19 nt, Human
agacauggucuccaugacc

SEQ ID NO: 712408 - RNA, 18 nt, Human
agaccugggagagaaggc

SEQ ID NO: 712409 - RNA, 22 nt, Human
agagcggcuggagugcaagcca

SEQ ID NO: 712410 - RNA, 18 nt, Human
agcacggcaacacccaca

SEQ ID NO: 712411 - RNA, 19 nt, Human
agcagauggccccuggccc

SEQ ID NO: 712412 - RNA, 20 nt, Human
agcaggugggcucccucucu

SEQ ID NO: 712413 - RNA, 19 nt, Human
agccaacacaagggagcgc

SEQ ID NO: 712414 - RNA, 23 nt, Human
agccccugcagccccagaaacag

SEQ ID NO: 712415 - RNA, 21 nt, Human
aggaagcaucucccgaaccuu

SEQ ID NO: 712416 - RNA, 20 nt, Human
aggcagcacacccagggcaa

SEQ ID NO: 712417 - RNA, 18 nt, Human
aggcagccggagaggagc

SEQ ID NO: 712418 - RNA, 19 nt, Human
aggcaggguuugugggcaa

SEQ ID NO: 712419 - RNA, 18 nt, Human
aggcugacacacccgcug

SEQ ID NO: 712420 - RNA, 19 nt, Human
aggcugcaggggcgggcag

SEQ ID NO: 712421 - RNA, 18 nt, Human
agggagcaugaauccagc

SEQ ID NO: 712422 - RNA, 21 nt, Human
agguggcugugacucagccag

SEQ ID NO: 712423 - RNA, 21 nt, Human
aucugucgccccagcccccag

SEQ ID NO: 712424 - RNA, 22 nt, Human
augccuccggcaggagcuacag

SEQ ID NO: 712425 - RNA, 25 nt, Human
caaaaagacuaugcuagaaggucag

SEQ ID NO: 712426 - RNA, 20 nt, Human
caaaacacaaacaugaaacc

SEQ ID NO: 712427 - RNA, 22 nt, Human
caaaacacaaacaugaaaccag

SEQ ID NO: 712428 - RNA, 24 nt, Human
caaaacacaaacaugaaaccagcc

SEQ ID NO: 712429 - RNA, 21 nt, Human
caaacuucaaagcuguccucu

SEQ ID NO: 712430 - RNA, 22 nt, Human
caacagauccaccaaauuucua

SEQ ID NO: 712431 - RNA, 30 nt, Human
caacagauccaccaaauuucuacccaacaa

SEQ ID NO: 712432 - RNA, 19 nt, Human
cacacccagggcacggcca

SEQ ID NO: 712433 - RNA, 18 nt, Human
cacaccccagcccugccu

SEQ ID NO: 712434 - RNA, 21 nt, Human
cacacugaaaacacaaaucau

SEQ ID NO: 712435 - RNA, 20 nt, Human
cacagcuugucccuuccugc

SEQ ID NO: 712436 - RNA, 22 nt, Human
cacaguacaaguaacaagcaaa

SEQ ID NO: 712437 - RNA, 23 nt, Human
caccagggggauacagagcggug

SEQ ID NO: 712438 - RNA, 18 nt, Human
cacccaacaacugcccug

SEQ ID NO: 712439 - RNA, 20 nt, Human
cacccaacaacugcccuggc

SEQ ID NO: 712440 - RNA, 19 nt, Human
cacccacauauugggaacu

SEQ ID NO: 712441 - RNA, 23 nt, Human
cacgcccccgcaccaggagaccc

SEQ ID NO: 712442 - RNA, 21 nt, Human
cagcacaccccagcccugccu

SEQ ID NO: 712443 - RNA, 18 nt, Human
cagccaacagauccacca

SEQ ID NO: 712444 - RNA, 21 nt, Human
cagccccugggccccacgggu

SEQ ID NO: 712445 - RNA, 18 nt, Human
cagccugugcggggaggc

SEQ ID NO: 712446 - RNA, 22 nt, Human
cagcucagggaagccccugcag

SEQ ID NO: 712447 - RNA, 22 nt, Human
cagcuggcaccguccaccuccc

SEQ ID NO: 712448 - RNA, 20 nt, Human
caggagcuacagcaaccaga

SEQ ID NO: 712449 - RNA, 22 nt, Human
caguacaaguaacaagcaaauu

SEQ ID NO: 712450 - RNA, 19 nt, Human
caguguggggccagagggu

SEQ ID NO: 712451 - RNA, 20 nt, Human
cauagagcagagcccaugug

SEQ ID NO: 712452 - RNA, 21 nt, Human
ccacaccccagucccacgaca

SEQ ID NO: 712453 - RNA, 19 nt, Human
ccacagagaagggcugcca

SEQ ID NO: 712454 - RNA, 24 nt, Human
ccacaggaaggccugcuauagagg

SEQ ID NO: 712455 - RNA, 25 nt, Human
ccaccccaggcccucccugacagcc

SEQ ID NO: 712456 - RNA, 19 nt, Human
ccaccucccucacugccuc

SEQ ID NO: 712457 - RNA, 23 nt, Human
ccaccugagcuagcaacaccauc

SEQ ID NO: 712458 - RNA, 25 nt, Human
ccagucaaaacacaaacaugaaacc

SEQ ID NO: 712459 - RNA, 23 nt, Human
ccaucuuuucagccaacagaucc

SEQ ID NO: 712460 - RNA, 19 nt, Human
ccauuuggaaguuaguuag

SEQ ID NO: 712461 - RNA, 22 nt, Human
cccaacgguggcagagccaugg

SEQ ID NO: 712462 - RNA, 22 nt, Human
cccacacacugaaaacacaaau

SEQ ID NO: 712463 - RNA, 21 nt, Human
cccacaccccagucccacgac

SEQ ID NO: 712464 - RNA, 20 nt, Human
cccacauauugggaacuuga

SEQ ID NO: 712465 - RNA, 22 nt, Human
cccaccgccccggcuuuccugc

SEQ ID NO: 712466 - RNA, 21 nt, Human
cccagccccugggccccacgg

SEQ ID NO: 712467 - RNA, 22 nt, Human
ccccaccgccccggcuuuccug

SEQ ID NO: 712468 - RNA, 21 nt, Human
ccccacgcccagugguacucc

SEQ ID NO: 712469 - RNA, 22 nt, Human
ccccagaaacagccuaugugcu

SEQ ID NO: 712470 - RNA, 23 nt, Human
ccccagcccccaggacagcuucc

SEQ ID NO: 712471 - RNA, 18 nt, Human
ccccagcccugccugggc

SEQ ID NO: 712472 - RNA, 21 nt, Human
ccccagcccugccugggccca

SEQ ID NO: 712473 - RNA, 22 nt, Human
ccccagcccugccugggcccac

SEQ ID NO: 712474 - RNA, 22 nt, Human
ccccaggacagcuuccccacac

SEQ ID NO: 712475 - RNA, 23 nt, Human
ccccaggcccucccugacagccc

SEQ ID NO: 712476 - RNA, 21 nt, Human
ccccagggugaggagccaggg

SEQ ID NO: 712477 - RNA, 21 nt, Human
cccccaccccaggcccucccu

SEQ ID NO: 712478 - RNA, 20 nt, Human
cccccaggacagcuucccca

SEQ ID NO: 712479 - RNA, 23 nt, Human
cccccccaccgccccggcuuucc

SEQ ID NO: 712480 - RNA, 18 nt, Human
ccccgcaccaggagaccc

SEQ ID NO: 712481 - RNA, 18 nt, Human
ccccgggucuacgcuuuc

SEQ ID NO: 712482 - RNA, 18 nt, Human
ccccugacugcugcgugg

SEQ ID NO: 712483 - RNA, 19 nt, Human
ccccugcagccccagaaac

SEQ ID NO: 712484 - RNA, 18 nt, Human
cccuaacaagcacccucc

SEQ ID NO: 712485 - RNA, 24 nt, Human
cccucaggacugggcucccccuaa

SEQ ID NO: 712486 - RNA, 23 nt, Human
cccucuggagggccaguccagca

SEQ ID NO: 712487 - RNA, 21 nt, Human
cccugagugcgcauagggccc

SEQ ID NO: 712488 - RNA, 21 nt, Human
cccugccugggcccacacccc

SEQ ID NO: 712489 - RNA, 22 nt, Human
cccuugggguggggcccuucug

SEQ ID NO: 712490 - RNA, 20 nt, Human
ccggggacaacagagacugc

SEQ ID NO: 712491 - RNA, 23 nt, Human
ccuaggcgaaccucccucccaga

SEQ ID NO: 712492 - RNA, 22 nt, Human
ccucagaggcaggguuuguggg

SEQ ID NO: 712493 - RNA, 19 nt, Human
ccucaggacugggcucccc

SEQ ID NO: 712494 - RNA, 27 nt, Human
ccuccagucaaaacacaaacaugaaac

SEQ ID NO: 712495 - RNA, 19 nt, Human
ccucccaccccagcccuaa

SEQ ID NO: 712496 - RNA, 18 nt, Human
ccucccugacagccccca

SEQ ID NO: 712497 - RNA, 19 nt, Human
ccucugggcugcaguaguu

SEQ ID NO: 712498 - RNA, 21 nt, Human
ccugcugcccauggggacacc

SEQ ID NO: 712499 - RNA, 28 nt, Human
ccuggcccccaccccaggcccucccuga

SEQ ID NO: 712500 - RNA, 21 nt, Human
cgccacauucgcuaaaagcca

SEQ ID NO: 712501 - RNA, 24 nt, Human
cggccaggccaggcucucccccag

SEQ ID NO: 712502 - RNA, 22 nt, Human
cggugcccagcucugccgggga

SEQ ID NO: 712503 - RNA, 19 nt, Human
cgguggcugggccuacaac

SEQ ID NO: 712504 - RNA, 22 nt, Human
cuacaaaagugcuuugaacgcg

SEQ ID NO: 712505 - RNA, 21 nt, Human
cuacagcaaccagaggugagc

SEQ ID NO: 712506 - RNA, 19 nt, Human
cuauccuaucuaggcuaca

SEQ ID NO: 712507 - RNA, 20 nt, Human
cucagugaccugucagccac

SEQ ID NO: 712508 - RNA, 21 nt, Human
cuccccagaagugaaccugag

SEQ ID NO: 712509 - RNA, 22 nt, Human
cuccccauuggccacucacccu

SEQ ID NO: 712510 - RNA, 21 nt, Human
cuccuaagccagcccaauugc

SEQ ID NO: 712511 - RNA, 22 nt, Human
cucucugggacccgacaccacu

SEQ ID NO: 712512 - RNA, 18 nt, Human
cugaaaacacaaaucauu

SEQ ID NO: 712513 - RNA, 24 nt, Human
cugccaucugcuaacccugcccca

SEQ ID NO: 712514 - RNA, 18 nt, Human
cugcccaacaucccacag

SEQ ID NO: 712515 - RNA, 22 nt, Human
cugcccaacaucccacagggaa

SEQ ID NO: 712516 - RNA, 19 nt, Human
cugcugcaugccucagccu

SEQ ID NO: 712517 - RNA, 21 nt, Human
cuggaauccugcaggggcccc

SEQ ID NO: 712518 - RNA, 24 nt, Human
cuggagggccaguccagcacccca

SEQ ID NO: 712519 - RNA, 25 nt, Human
cugggccccgggucuacgcuuucug

SEQ ID NO: 712520 - RNA, 26 nt, Human
cuggggccaucaugcuggugggggug

SEQ ID NO: 712521 - RNA, 21 nt, Human
cuguggccccagccccugggc

SEQ ID NO: 712522 - RNA, 20 nt, Human
cuugaggagaaagaagguga

SEQ ID NO: 712523 - RNA, 20 nt, Human
cuugcuggucgaugggacca

SEQ ID NO: 712524 - RNA, 25 nt, Human
gacccgacaccacucaggaagcuuu

SEQ ID NO: 712525 - RNA, 23 nt, Human
gagcaaacccucagggggcuagg

SEQ ID NO: 712526 - RNA, 20 nt, Human
gagccacuugcuccuaagcc

SEQ ID NO: 712527 - RNA, 18 nt, Human
gagcugucugccugcugc

SEQ ID NO: 712528 - RNA, 22 nt, Human
gauagccaccauuuucuccccu

SEQ ID NO: 712529 - RNA, 22 nt, Human
gcaaauuccugagagacuagag

SEQ ID NO: 712530 - RNA, 19 nt, Human
gcaagacauggccaugugc

SEQ ID NO: 712531 - RNA, 19 nt, Human
gcaaggcagccggagagga

SEQ ID NO: 712532 - RNA, 25 nt, Human
gcaccaguuauuuuuagccuuauga

SEQ ID NO: 712533 - RNA, 19 nt, Human
gcacggccacucacgcccc

SEQ ID NO: 712534 - RNA, 25 nt, Human
gcacuaagccccccccaaccggagg

SEQ ID NO: 712535 - RNA, 24 nt, Human
gcagccccagaaacagccuaugug

SEQ ID NO: 712536 - RNA, 22 nt, Human
gcaucucccgaaccuucccaag

SEQ ID NO: 712537 - RNA, 19 nt, Human
gccagcacaccccagcccu

SEQ ID NO: 712538 - RNA, 22 nt, Human
gcccagugguacuccgggggca

SEQ ID NO: 712539 - RNA, 19 nt, Human
gccccagcccccaggacag

SEQ ID NO: 712540 - RNA, 22 nt, Human
gccugugcggggaggccaggcu

SEQ ID NO: 712541 - RNA, 24 nt, Human
gcgcuccgggcgcggaccccgcgc

SEQ ID NO: 712542 - RNA, 23 nt, Human
gcucagacaggcagcacacccag

SEQ ID NO: 712543 - RNA, 22 nt, Human
gcucugggaccugcccagugcc

SEQ ID NO: 712544 - RNA, 19 nt, Human
gcugcaggggcgggcagac

SEQ ID NO: 712545 - RNA, 19 nt, Human
gcugcaguaguucugugga

SEQ ID NO: 712546 - RNA, 20 nt, Human
gcugccaucugcuaacccug

SEQ ID NO: 712547 - RNA, 19 nt, Human
gcuguggggcugggggcuu

SEQ ID NO: 712548 - RNA, 21 nt, Human
gcuuuccugcaggcuuagccc

SEQ ID NO: 712549 - RNA, 18 nt, Human
ggaagccccugcagcccc

SEQ ID NO: 712550 - RNA, 22 nt, Human
ggacauggcuuacccucuggag

SEQ ID NO: 712551 - RNA, 20 nt, Human
ggacgcccuucaccccugag

SEQ ID NO: 712552 - RNA, 21 nt, Human
ggacugggcucccccuaagcu

SEQ ID NO: 712553 - RNA, 22 nt, Human
ggcaacacccacaacauccagc

SEQ ID NO: 712554 - RNA, 18 nt, Human
ggcaagguuugagggcag

SEQ ID NO: 712555 - RNA, 22 nt, Human
ggcacaggacaggcaggcgggg

SEQ ID NO: 712556 - RNA, 21 nt, Human
ggccaggcucucccccaggca

SEQ ID NO: 712557 - RNA, 21 nt, Human
ggccccgggucuacgcuuucu

SEQ ID NO: 712558 - RNA, 21 nt, Human
ggccccuggcccccaccccag

SEQ ID NO: 712559 - RNA, 23 nt, Human
ggcccuaacaagcacccuccaaa

SEQ ID NO: 712560 - RNA, 21 nt, Human
ggcugggucauuucucccuaa

SEQ ID NO: 712561 - RNA, 23 nt, Human
ggcuguggccccagccccugggc

SEQ ID NO: 712562 - RNA, 21 nt, Human
gggagaccugggagagaaggc

SEQ ID NO: 712563 - RNA, 24 nt, Human
gggaggcccuaacaagcacccucc

SEQ ID NO: 712564 - RNA, 22 nt, Human
gggcacaggacaggcaggcggg

SEQ ID NO: 712565 - RNA, 20 nt, Human
gggcaggucacccacacccc

SEQ ID NO: 712566 - RNA, 24 nt, Human
gggcaguguggcagcuucgggccc

SEQ ID NO: 712567 - RNA, 18 nt, Human
gggcgcggaccccgcgcc

SEQ ID NO: 712568 - RNA, 24 nt, Human
gggcucccccuaagcugacaaggg

SEQ ID NO: 712569 - RNA, 25 nt, Human
gggcugccaucugcuaacccugccg

SEQ ID NO: 712570 - RNA, 21 nt, Human
ggggccagcaggguggagugc

SEQ ID NO: 712571 - RNA, 24 nt, Human
ggucugccauuaaaaaaaaaaaaa

SEQ ID NO: 712572 - RNA, 22 nt, Human
gguggagugcaggaacaggcug

SEQ ID NO: 712573 - RNA, 22 nt, Human
gguggcuuuggaaugagugggg

SEQ ID NO: 712574 - RNA, 27 nt, Human
guaaggcaagaggguauggcaacgaaa

SEQ ID NO: 712575 - RNA, 24 nt, Human
guggccccagccccugggccccac

SEQ ID NO: 712576 - RNA, 21 nt, Human
guggcuuuggaaugagugggg

SEQ ID NO: 712577 - RNA, 21 nt, Human
guuuucuuuuuaauguggacu

SEQ ID NO: 712578 - RNA, 23 nt, Human
uaaacaacguuucccaaaaagca

SEQ ID NO: 712579 - RNA, 23 nt, Human
uaagauuuaaacaacguuuccca

SEQ ID NO: 712580 - RNA, 19 nt, Human
uaagccccccccaccgccc

SEQ ID NO: 712581 - RNA, 19 nt, Human
uaagccccccccaccgccc

SEQ ID NO: 712582 - RNA, 20 nt, Human
uaaggccaaaugguucuggu

SEQ ID NO: 712583 - RNA, 18 nt, Human
uacagcaaccagagguga

SEQ ID NO: 712584 - RNA, 19 nt, Human
uaccugucaccaugugccu

SEQ ID NO: 712585 - RNA, 22 nt, Human
uagcagauggccccuggccccc

SEQ ID NO: 712586 - RNA, 21 nt, Human
uagcugggggcugcugcaugc

SEQ ID NO: 712587 - RNA, 20 nt, Human
uaggggcagggagcaugaau

SEQ ID NO: 712588 - RNA, 18 nt, Human
uauccuaucuaggcuaca

SEQ ID NO: 712589 - RNA, 20 nt, Human
ucaaccugcagaagcgaggc

SEQ ID NO: 712590 - RNA, 21 nt, Human
ucaccaugugccucccacccc

SEQ ID NO: 712591 - RNA, 19 nt, Human
ucaccggaaccaaccaugc

SEQ ID NO: 712592 - RNA, 18 nt, Human
ucacugccucugccuucc

SEQ ID NO: 712593 - RNA, 27 nt, Human
uccacagcuagggaagcuugcucagac

SEQ ID NO: 712594 - RNA, 18 nt, Human
uccaucccagggugggua

SEQ ID NO: 712595 - RNA, 23 nt, Human
uccaucuuuucagccaacagauc

SEQ ID NO: 712596 - RNA, 26 nt, Human
ucccaggguggguaucagccaucuuc

SEQ ID NO: 712597 - RNA, 21 nt, Human
uccccacacacugaaaacaca

SEQ ID NO: 712598 - RNA, 18 nt, Human
ucccgaaccuucccaagc

SEQ ID NO: 712599 - RNA, 24 nt, Human
uccggcaggagcuacagcaaccag

SEQ ID NO: 712600 - RNA, 22 nt, Human
uccugccaccaggccugaaugg

SEQ ID NO: 712601 - RNA, 18 nt, Human
ucgcuaaaagccagauuc

SEQ ID NO: 712602 - RNA, 23 nt, Human
ucuaagcagaagggauagccacc

SEQ ID NO: 712603 - RNA, 23 nt, Human
ucuccacauucacccaacaacug

SEQ ID NO: 712604 - RNA, 19 nt, Human
ucucccgaaccuucccaag

SEQ ID NO: 712605 - RNA, 26 nt, Human
ucucucagggcuguggggcugggggc

SEQ ID NO: 712606 - RNA, 23 nt, Human
ucugccauuaaaaaaaaaaaaaa

SEQ ID NO: 712607 - RNA, 21 nt, Human
ucugcccuuccucagucuccc

SEQ ID NO: 712608 - RNA, 24 nt, Human
ucugggaaauggccaaaugugguc

SEQ ID NO: 712609 - RNA, 24 nt, Human
ucuuggguucggcuguccgggauc

SEQ ID NO: 712610 - RNA, 20 nt, Human
ucuuucucuucuuuucucuu

SEQ ID NO: 712611 - RNA, 21 nt, Human
ugaaaacacaaaucauuugcc

SEQ ID NO: 712612 - RNA, 22 nt, Human
ugaaaacacaaaucauuugcca

SEQ ID NO: 712613 - RNA, 24 nt, Human
ugaaaacacaaaucauuugccagc

SEQ ID NO: 712614 - RNA, 22 nt, Human
ugaagcacggcaacacccacaa

SEQ ID NO: 712615 - RNA, 19 nt, Human
ugacaccaaggcagagccc

SEQ ID NO: 712616 - RNA, 23 nt, Human
ugagaaugaaaaucuguacgucu

SEQ ID NO: 712617 - RNA, 18 nt, Human
ugagcaggcagauggccu

SEQ ID NO: 712618 - RNA, 25 nt, Human
ugaggugggugaugugcccugguua

SEQ ID NO: 712619 - RNA, 25 nt, Human
ugaggugggugaugugcccugguug

SEQ ID NO: 712620 - RNA, 19 nt, Human
ugagugaaagaagcugcgg

SEQ ID NO: 712621 - RNA, 21 nt, Human
ugcaggggcgggcagacccug

SEQ ID NO: 712622 - RNA, 21 nt, Human
ugccacugcccccagcugggg

SEQ ID NO: 712623 - RNA, 18 nt, Human
ugcccaccugcucgcagc

SEQ ID NO: 712624 - RNA, 25 nt, Human
ugcccagugcccggcauaccccaug

SEQ ID NO: 712625 - RNA, 24 nt, Human
ugcccgagccccggugcgcggcca

SEQ ID NO: 712626 - RNA, 20 nt, Human
ugcccugguuacagccagca

SEQ ID NO: 712627 - RNA, 25 nt, Human
ugccgguggcugggccuacaacaga

SEQ ID NO: 712628 - RNA, 21 nt, Human
ugcuagaaggucagacuaucc

SEQ ID NO: 712629 - RNA, 23 nt, Human
uggagggccaguccagcacccca

SEQ ID NO: 712630 - RNA, 19 nt, Human
uggagugaccgucauucca

SEQ ID NO: 712631 - RNA, 19 nt, Human
uggcacggcuugcuucugg

SEQ ID NO: 712632 - RNA, 23 nt, Human
uggcaggcaagguuugagggcag

SEQ ID NO: 712633 - RNA, 22 nt, Human
uggcccccaccccaggcccucc

SEQ ID NO: 712634 - RNA, 24 nt, Human
uggccccuggcccccaccccaggc

SEQ ID NO: 712635 - RNA, 18 nt, Human
uggcuuuggaaugagugg

SEQ ID NO: 712636 - RNA, 20 nt, Human
ugggaaauggccaaaugugg

SEQ ID NO: 712637 - RNA, 20 nt, Human
ugggcagacuuggggugaag

SEQ ID NO: 712638 - RNA, 22 nt, Human
ugggcagacuuggggugaguac

SEQ ID NO: 712639 - RNA, 23 nt, Human
uggggagguggcaggcaagguuu

SEQ ID NO: 712640 - RNA, 19 nt, Human
uggggccaucaugcuggug

SEQ ID NO: 712641 - RNA, 21 nt, Human
uggggccaucaugcugguggg

SEQ ID NO: 712642 - RNA, 18 nt, Human
uggggcccuucugggaaa

SEQ ID NO: 712643 - RNA, 22 nt, Human
ugggggcugcugcaugccucag

SEQ ID NO: 712644 - RNA, 21 nt, Human
uggugggcacaggacaggcag

SEQ ID NO: 712645 - RNA, 21 nt, Human
uggugggcacaggacaggcag

SEQ ID NO: 712646 - RNA, 21 nt, Human
ugucugcucagagccaccagc

SEQ ID NO: 712647 - RNA, 24 nt, Human
ugucugcucagagccaccagcucu

SEQ ID NO: 712648 - RNA, 22 nt, Human
uguuuuguuuucuuuuuaaugu

SEQ ID NO: 712649 - RNA, 20 nt, Human
uucacaaaacuggcuacaaa

SEQ ID NO: 712650 - RNA, 22 nt, Human
uuccuugggcccgagacuccgg

SEQ ID NO: 712651 - RNA, 22 nt, Human
uucgcuaaaagccagauuccca

SEQ ID NO: 712652 - RNA, 23 nt, Human
uucuugaggagaaagaaggugag

SEQ ID NO: 712653 - RNA, 23 nt, Human
uugcuccuaagccagcccaauug

SEQ ID NO: 712654 - RNA, 20 nt, Human
aaaauugcaguaugaacuga

SEQ ID NO: 712655 - RNA, 18 nt, Human
aaacaccuagacauuucu

SEQ ID NO: 712656 - RNA, 21 nt, Human
aacucccgcuggaauuucuac

SEQ ID NO: 712657 - RNA, 18 nt, Human
aagaaggaagaagguaag

SEQ ID NO: 712658 - RNA, 21 nt, Human
aagacaaaggcuaaggugagc

SEQ ID NO: 712659 - RNA, 24 nt, Human
acacacuuuccucuucuugacugu

SEQ ID NO: 712660 - RNA, 20 nt, Human
agacuccuagcauucaaucu

SEQ ID NO: 712661 - RNA, 19 nt, Human
aggcaaguggcagagccag

SEQ ID NO: 712662 - RNA, 23 nt, Human
aggcccagguccucacccuggcc

SEQ ID NO: 712663 - RNA, 21 nt, Human
agugagcacaaagguccucuc

SEQ ID NO: 712664 - RNA, 23 nt, Human
aucacugccuccugggccaaagu

SEQ ID NO: 712665 - RNA, 23 nt, Human
aucuaaaaucuucuugugaacca

SEQ ID NO: 712666 - RNA, 18 nt, Human
aucuggccucuucuuugg

SEQ ID NO: 712667 - RNA, 20 nt, Human
aucuguuuuauuaaacaccu

SEQ ID NO: 712668 - RNA, 19 nt, Human
augcauccaagacucaucu

SEQ ID NO: 712669 - RNA, 20 nt, Human
auuaaacaccuagacauuuc

SEQ ID NO: 712670 - RNA, 22 nt, Human
auuucuggcacauguuucccaa

SEQ ID NO: 712671 - RNA, 22 nt, Human
auuugcucaaagacaaaggcua

SEQ ID NO: 712672 - RNA, 22 nt, Human
caaagacaaaggcuaaggugag

SEQ ID NO: 712673 - RNA, 18 nt, Human
caaaggcuaaggugagca

SEQ ID NO: 712674 - RNA, 19 nt, Human
caaagugagcacaaagguc

SEQ ID NO: 712675 - RNA, 24 nt, Human
cacugccuccugggccaaagugag

SEQ ID NO: 712676 - RNA, 20 nt, Human
caugagcaucacugccuccu

SEQ ID NO: 712677 - RNA, 20 nt, Human
ccaagcggggggaaagauca

SEQ ID NO: 712678 - RNA, 21 nt, Human
ccagaccugggucuucacacc

SEQ ID NO: 712679 - RNA, 18 nt, Human
cccacaggcucccucuuu

SEQ ID NO: 712680 - RNA, 21 nt, Human
ccccugugauuuuugcuaccu

SEQ ID NO: 712681 - RNA, 20 nt, Human
ccucaaaaucuauacucucc

SEQ ID NO: 712682 - RNA, 20 nt, Human
ccucacccuggcccagcgac

SEQ ID NO: 712683 - RNA, 24 nt, Human
ccugcccgcucuggccccuaagag

SEQ ID NO: 712684 - RNA, 18 nt, Human
ccuggcccagcgacucau

SEQ ID NO: 712685 - RNA, 24 nt, Human
cgagaccaacccuugggacagcgg

SEQ ID NO: 712686 - RNA, 20 nt, Human
cgcagccgaaagcgcgagac

SEQ ID NO: 712687 - RNA, 23 nt, Human
cuaaggugagcaccagggucucu

SEQ ID NO: 712688 - RNA, 25 nt, Human
cuacaggucaauaugcuaaucauau

SEQ ID NO: 712689 - RNA, 19 nt, Human
cuagacauuucuggcacau

SEQ ID NO: 712690 - RNA, 24 nt, Human
cucaaagacaaaggcuaaggugag

SEQ ID NO: 712691 - RNA, 18 nt, Human
cucugggccaggagucag

SEQ ID NO: 712692 - RNA, 20 nt, Human
cuggcacauguuucccaaau

SEQ ID NO: 712693 - RNA, 27 nt, Human
cuggccucuucuuugggaaggacggcc

SEQ ID NO: 712694 - RNA, 20 nt, Human
cuucuugugaaccagggauu

SEQ ID NO: 712695 - RNA, 24 nt, Human
cuugcauuugucuucuaagguagg

SEQ ID NO: 712696 - RNA, 19 nt, Human
cuuuccucuucuugacugu

SEQ ID NO: 712697 - RNA, 23 nt, Human
gaaacuucuuccuuccaaaucaa

SEQ ID NO: 712698 - RNA, 20 nt, Human
gaacccacaggcucccucuu

SEQ ID NO: 712699 - RNA, 19 nt, Human
gagggcagacaccauugcc

SEQ ID NO: 712700 - RNA, 18 nt, Human
gcaagaaacuucuuccuu

SEQ ID NO: 712701 - RNA, 18 nt, Human
gcacagaccagaaaugac

SEQ ID NO: 712702 - RNA, 18 nt, Human
gcucuauuuuuguuaucc

SEQ ID NO: 712703 - RNA, 30 nt, Human
ggaaacaauauagggagucaggucacagcc

SEQ ID NO: 712704 - RNA, 19 nt, Human
ggccccuaagaggcaccag

SEQ ID NO: 712705 - RNA, 21 nt, Human
guugcugaugcucuauuuuug

SEQ ID NO: 712706 - RNA, 18 nt, Human
uaaagucaugcaaccaug

SEQ ID NO: 712707 - RNA, 23 nt, Human
uaaggugagcaccagggucucug

SEQ ID NO: 712708 - RNA, 21 nt, Human
uaagugugagaaaacccaggc

SEQ ID NO: 712709 - RNA, 20 nt, Human
uagcauucaaucuacauuua

SEQ ID NO: 712710 - RNA, 21 nt, Human
ucaaucuacauuuacucuccc

SEQ ID NO: 712711 - RNA, 24 nt, Human
ucacugccuccugggccaaaguga

SEQ ID NO: 712712 - RNA, 24 nt, Human
ucuacaacugaggaaacaauauag

SEQ ID NO: 712713 - RNA, 21 nt, Human
ucucugagaacccacaggcuc

SEQ ID NO: 712714 - RNA, 28 nt, Human
ucuggccucuucuuugggaaggacggcc

SEQ ID NO: 712715 - RNA, 21 nt, Human
ucugggccaggagucaggagg

SEQ ID NO: 712716 - RNA, 23 nt, Human
ucugugaggcuaccaagcggggg

SEQ ID NO: 712717 - RNA, 25 nt, Human
ugaaaugaaaacgauuaugagccca

SEQ ID NO: 712718 - RNA, 19 nt, Human
ugagcacaaagguccucuc

SEQ ID NO: 712719 - RNA, 19 nt, Human
ugagcaccagggucucugg

SEQ ID NO: 712720 - RNA, 24 nt, Human
ugaggugagaaguucugaaaguca

SEQ ID NO: 712721 - RNA, 24 nt, Human
uggaauuucuaccuggaaaggguu

SEQ ID NO: 712722 - RNA, 23 nt, Human
uggcgcaggugcuuaagauuugg

SEQ ID NO: 712723 - RNA, 23 nt, Human
uucaguaggguuuuucauagguc

SEQ ID NO: 712724 - RNA, 25 nt, Human
uuucauaggucacugaaugcauccu

SEQ ID NO: 712725 - RNA, 20 nt, Human
aaaacaguaacaaaaacccc

SEQ ID NO: 712726 - RNA, 24 nt, Human
aaaacccaaaucaacaaagaccaa

SEQ ID NO: 712727 - RNA, 20 nt, Human
aaaagcacacaguguuaauc

SEQ ID NO: 712728 - RNA, 25 nt, Human
aaaauacuacuauaauuucaaagca

SEQ ID NO: 712729 - RNA, 26 nt, Human
aaacaaaagccaaaaauuaaacugua

SEQ ID NO: 712730 - RNA, 21 nt, Human
aaacaacaacaaaaauucuac

SEQ ID NO: 712731 - RNA, 26 nt, Human
aaacaacaacaaaaauucuacaucua

SEQ ID NO: 712732 - RNA, 21 nt, Human
aaacaccaauaacaauaaaac

SEQ ID NO: 712733 - RNA, 20 nt, Human
aaacaguaacaaaaacccca

SEQ ID NO: 712734 - RNA, 24 nt, Human
aaacaguaacaaaaaccccaacaa

SEQ ID NO: 712735 - RNA, 24 nt, Human
aaauagccauaaacacaaacaucc

SEQ ID NO: 712736 - RNA, 25 nt, Human
aaaucaacaaagaccaagauaaagg

SEQ ID NO: 712737 - RNA, 19 nt, Human
aacaauaaaacucuauaag

SEQ ID NO: 712738 - RNA, 20 nt, Human
aacauggcauaaaucuaucu

SEQ ID NO: 712739 - RNA, 27 nt, Human
aaccccaacaaaacccaaaucaacaaa

SEQ ID NO: 712740 - RNA, 20 nt, Human
aacuuuagcacacuugacug

SEQ ID NO: 712741 - RNA, 23 nt, Human
aaggaaaaaagggcaauuaaaaa

SEQ ID NO: 712742 - RNA, 21 nt, Human
aaggcaacaggaaccucaaag

SEQ ID NO: 712743 - RNA, 24 nt, Human
aaguacucgaaauuauauauagcu

SEQ ID NO: 712744 - RNA, 18 nt, Human
aauuaaaaaaauacaacu

SEQ ID NO: 712745 - RNA, 24 nt, Human
acaaaaaccccaacaaaacccaaa

SEQ ID NO: 712746 - RNA, 24 nt, Human
acaaacuuuagcacacuugacugu

SEQ ID NO: 712747 - RNA, 18 nt, Human
acaguaacaaaaacccca

SEQ ID NO: 712748 - RNA, 20 nt, Human
accaguucagaaauccagga

SEQ ID NO: 712749 - RNA, 20 nt, Human
acccugaaagcucagcuugg

SEQ ID NO: 712750 - RNA, 23 nt, Human
acuccacugucacucugaaacaa

SEQ ID NO: 712751 - RNA, 23 nt, Human
acugcaauuuuuuaaacaaaaac

SEQ ID NO: 712752 - RNA, 23 nt, Human
acuggcuacaacaccgugugcac

SEQ ID NO: 712753 - RNA, 25 nt, Human
agaaaacaacaacaaaaauucuaca

SEQ ID NO: 712754 - RNA, 18 nt, Human
agaaaucaaaauguacag

SEQ ID NO: 712755 - RNA, 22 nt, Human
agaagaugaggaaugccuauca

SEQ ID NO: 712756 - RNA, 23 nt, Human
agacaggaagaaaaacauuuugg

SEQ ID NO: 712757 - RNA, 24 nt, Human
agacaggaagaaaaacauuuuggg

SEQ ID NO: 712758 - RNA, 19 nt, Human
agcgggcgacagcuaccgc

SEQ ID NO: 712759 - RNA, 20 nt, Human
aggaaaaaagggcaauuaaa

SEQ ID NO: 712760 - RNA, 19 nt, Human
aggaagaaaaacauuuugg

SEQ ID NO: 712761 - RNA, 18 nt, Human
aggccggaacgaggcgaa

SEQ ID NO: 712762 - RNA, 19 nt, Human
agggagcgccgacggcacc

SEQ ID NO: 712763 - RNA, 25 nt, Human
aguaacaaaaaccccaacaaaaccc

SEQ ID NO: 712764 - RNA, 19 nt, Human
aguuccauuuucagacagg

SEQ ID NO: 712765 - RNA, 23 nt, Human
auuuucagacaggaagaaaaaca

SEQ ID NO: 712766 - RNA, 27 nt, Human
auuuuuuccauacaaaagcacacagug

SEQ ID NO: 712767 - RNA, 24 nt, Human
caaaaaccccaacaaaacccaaau

SEQ ID NO: 712768 - RNA, 27 nt, Human
caaaaaccccaacaaaacccaaaucaa

SEQ ID NO: 712769 - RNA, 22 nt, Human
caaagaccaagauaaaggugug

SEQ ID NO: 712770 - RNA, 20 nt, Human
caaagcaaauuaacauggca

SEQ ID NO: 712771 - RNA, 24 nt, Human
caaaucaacaaagaccaagauaaa

SEQ ID NO: 712772 - RNA, 20 nt, Human
caacuuaaaaaggcaacagg

SEQ ID NO: 712773 - RNA, 21 nt, Human
caauucuauacagcaaaaaga

SEQ ID NO: 712774 - RNA, 27 nt, Human
caauuuuuuaaacaaaaacaaaagcca

SEQ ID NO: 712775 - RNA, 24 nt, Human
caccaugacggccguugcugggcc

SEQ ID NO: 712776 - RNA, 19 nt, Human
caccgugugcacacccagu

SEQ ID NO: 712777 - RNA, 22 nt, Human
cagaauggucaaacucuuggca

SEQ ID NO: 712778 - RNA, 19 nt, Human
cagcugccacagggcccuu

SEQ ID NO: 712779 - RNA, 22 nt, Human
cagcugccacagggcccuuuag

SEQ ID NO: 712780 - RNA, 18 nt, Human
caggaaacacaauauuac

SEQ ID NO: 712781 - RNA, 26 nt, Human
caggaaacacaauauuacaagaacca

SEQ ID NO: 712782 - RNA, 21 nt, Human
caggaagaaaaacauuuuggg

SEQ ID NO: 712783 - RNA, 19 nt, Human
cagguaaacaccaauaaca

SEQ ID NO: 712784 - RNA, 19 nt, Human
caguuucaauccucugaag

SEQ ID NO: 712785 - RNA, 24 nt, Human
ccaauaacaauaaaacucuauaag

SEQ ID NO: 712786 - RNA, 20 nt, Human
ccacugucacucugaaacaa

SEQ ID NO: 712787 - RNA, 26 nt, Human
cccaaauagccauaaacacaaacauc

SEQ ID NO: 712788 - RNA, 19 nt, Human
ccccgcggucacgcaacca

SEQ ID NO: 712789 - RNA, 25 nt, Human
ccuacuguaauuuaaaaacaguaac

SEQ ID NO: 712790 - RNA, 20 nt, Human
ccuucuuuaaaaauacagaa

SEQ ID NO: 712791 - RNA, 20 nt, Human
cgacagcuaccgccgccagc

SEQ ID NO: 712792 - RNA, 23 nt, Human
cggcaccaugacggccguugcug

SEQ ID NO: 712793 - RNA, 20 nt, Human
cgugugcacacccaguuccu

SEQ ID NO: 712794 - RNA, 24 nt, Human
cuacaacaccgugugcacacccag

SEQ ID NO: 712795 - RNA, 18 nt, Human
gaacaguuuugcaguccc

SEQ ID NO: 712796 - RNA, 23 nt, Human
gaacuggcuacaacaccgugugc

SEQ ID NO: 712797 - RNA, 22 nt, Human
gacaacacaaguacaggaggaa

SEQ ID NO: 712798 - RNA, 23 nt, Human
gacaacacaaguacaggaggaac

SEQ ID NO: 712799 - RNA, 21 nt, Human
gacagcugccacagggcccuu

SEQ ID NO: 712800 - RNA, 19 nt, Human
gcaaaugaauauauauuuu

SEQ ID NO: 712801 - RNA, 21 nt, Human
gcugaaaucaaaagcagcuua

SEQ ID NO: 712802 - RNA, 25 nt, Human
ggaaaaaagggcaauuaaaaaaaua

SEQ ID NO: 712803 - RNA, 23 nt, Human
ggaccccgcggucacgcaaccaa

SEQ ID NO: 712804 - RNA, 30 nt, Human
uaaaaacaguaacaaaaaccccaacaaaag

SEQ ID NO: 712805 - RNA, 19 nt, Human
uaaaaucacuaagaaacac

SEQ ID NO: 712806 - RNA, 24 nt, Human
uaaacaccaauaacaauaaaacuc

SEQ ID NO: 712807 - RNA, 22 nt, Human
uaaagugaaaccaaaacauguu

SEQ ID NO: 712808 - RNA, 22 nt, Human
uaacaaaaaccccaacaaaacc

SEQ ID NO: 712809 - RNA, 23 nt, Human
uaacauggcauaaaucuaucuuu

SEQ ID NO: 712810 - RNA, 24 nt, Human
uaagagauaaacaauuuauacagu

SEQ ID NO: 712811 - RNA, 19 nt, Human
uaagcaauucuauacagca

SEQ ID NO: 712812 - RNA, 19 nt, Human
uacaaagaaagcuguucau

SEQ ID NO: 712813 - RNA, 24 nt, Human
uacaacaccgugugcacacccagu

SEQ ID NO: 712814 - RNA, 22 nt, Human
uacagugaacuucaccaaaucc

SEQ ID NO: 712815 - RNA, 20 nt, Human
uacaugcaauacaugcauuu

SEQ ID NO: 712816 - RNA, 21 nt, Human
uacuuuuuaaaaaacauuaca

SEQ ID NO: 712817 - RNA, 20 nt, Human
uagaacuauaaacaggugac

SEQ ID NO: 712818 - RNA, 20 nt, Human
uagagugcaccugugaucuu

SEQ ID NO: 712819 - RNA, 22 nt, Human
uagagugcaccugugaucuugg

SEQ ID NO: 712820 - RNA, 19 nt, Human
uagcaaggugccuauccca

SEQ ID NO: 712821 - RNA, 25 nt, Human
uagcacacuugacuguuaaaacaac

SEQ ID NO: 712822 - RNA, 22 nt, Human
uagccauaaacacaaacauccc

SEQ ID NO: 712823 - RNA, 20 nt, Human
uagguauucagguaaacacc

SEQ ID NO: 712824 - RNA, 23 nt, Human
uauacagcaaaaagagaaugauu

SEQ ID NO: 712825 - RNA, 19 nt, Human
uauuauugugaagaagaug

SEQ ID NO: 712826 - RNA, 25 nt, Human
ucaaaagcagcuuaaauugacaaac

SEQ ID NO: 712827 - RNA, 22 nt, Human
ucaguguuauguguagagugca

SEQ ID NO: 712828 - RNA, 18 nt, Human
ucccauucuucacugcaa

SEQ ID NO: 712829 - RNA, 18 nt, Human
ucgccgccgcaccgaggc

SEQ ID NO: 712830 - RNA, 21 nt, Human
ugaaaccaaaacauguucaac

SEQ ID NO: 712831 - RNA, 21 nt, Human
ugaaaccaaaacauguucaac

SEQ ID NO: 712832 - RNA, 18 nt, Human
ugaaagaaagagugauau

SEQ ID NO: 712833 - RNA, 22 nt, Human
ugaaaucaaaagcagcuuaaau

SEQ ID NO: 712834 - RNA, 27 nt, Human
ugaaaucaaaagcagcuuaaauugaca

SEQ ID NO: 712835 - RNA, 18 nt, Human
ugaagaagaugaggaaug

SEQ ID NO: 712836 - RNA, 24 nt, Human
ugauuguuuuugcaugucccccug

SEQ ID NO: 712837 - RNA, 23 nt, Human
ugcacacccaguuccugcagaau

SEQ ID NO: 712838 - RNA, 23 nt, Human
ugccacagggcccuuuaguccuc

SEQ ID NO: 712839 - RNA, 20 nt, Human
ugcuauucaacagauguccu

SEQ ID NO: 712840 - RNA, 20 nt, Human
uggcuacaacaccgugugca

SEQ ID NO: 712841 - RNA, 19 nt, Human
uguaaaaagaaauggaauc

SEQ ID NO: 712842 - RNA, 23 nt, Human
uuaaaaacaguaacaaaaacccc

SEQ ID NO: 712843 - RNA, 21 nt, Human
uuaaacaaaaacaaaagccaa

SEQ ID NO: 712844 - RNA, 22 nt, Human
uuaaacaaaaacaaaagccaaa

SEQ ID NO: 712845 - RNA, 21 nt, Human
uuccagugacagcugccacag

SEQ ID NO: 712846 - RNA, 19 nt, Human
uuccaucauuauuuucaag

SEQ ID NO: 712847 - RNA, 18 nt, Human
uucuacaucuaagcggcu

SEQ ID NO: 712848 - RNA, 20 nt, Human
uugcagucccaggacuagga

SEQ ID NO: 712849 - RNA, 19 nt, Human
uugcaugucccccugcuua

SEQ ID NO: 712850 - RNA, 20 nt, Human
uugcugggccgcggaggccg

SEQ ID NO: 712851 - RNA, 23 nt, Human
uuuaaaaacaguaacaaaaaccc

SEQ ID NO: 712852 - RNA, 26 nt, Human
uuuaaaaacaguaacaaaaaccccaa

SEQ ID NO: 712853 - RNA, 25 nt, Human
aaaagcccagaagguauccaccaag

SEQ ID NO: 712854 - RNA, 18 nt, Human
aaagcccagaagguaucc

SEQ ID NO: 712855 - RNA, 26 nt, Human
aacucauuuccccaagccacgcaggc

SEQ ID NO: 712856 - RNA, 18 nt, Human
acacacacacaaaacaca

SEQ ID NO: 712857 - RNA, 20 nt, Human
acacacacacaaaacacagc

SEQ ID NO: 712858 - RNA, 21 nt, Human
agccacgcaggccauggccuc

SEQ ID NO: 712859 - RNA, 22 nt, Human
aggaguaggugggaguuuaagg

SEQ ID NO: 712860 - RNA, 22 nt, Human
cacacacaaaacacagccccca

SEQ ID NO: 712861 - RNA, 23 nt, Human
cagcaggcucuccucaguggucu

SEQ ID NO: 712862 - RNA, 23 nt, Human
cagcaggugugugcauugaugcu

SEQ ID NO: 712863 - RNA, 22 nt, Human
ccaccaacucauuuccccaagc

SEQ ID NO: 712864 - RNA, 18 nt, Human
ccccaagccacgcaggcc

SEQ ID NO: 712865 - RNA, 26 nt, Human
ccccaagccacgcaggccauggccuc

SEQ ID NO: 712866 - RNA, 20 nt, Human
cuccuuauuccaggaguagg

SEQ ID NO: 712867 - RNA, 19 nt, Human
gagagggaaaugggggagg

SEQ ID NO: 712868 - RNA, 21 nt, Human
ggagagggaaaugggggaggg

SEQ ID NO: 712869 - RNA, 19 nt, Human
gggcaaguucaaaagccca

SEQ ID NO: 712870 - RNA, 26 nt, Human
gggggagagggaaaugggggaggggg

SEQ ID NO: 712871 - RNA, 22 nt, Human
uauacacacacacaaaacacag

SEQ ID NO: 712872 - RNA, 22 nt, Human
ucagcucagcaggcucuccuca

SEQ ID NO: 712873 - RNA, 24 nt, Human
uccaccaacucauuuccccaagcc

SEQ ID NO: 712874 - RNA, 23 nt, Human
uccuuauuccaggaguagguggg

SEQ ID NO: 712875 - RNA, 21 nt, Human
ucugguuucugaaacaagacu

SEQ ID NO: 712876 - RNA, 18 nt, Human
ugaaacuacaugccuucc

SEQ ID NO: 712877 - RNA, 21 nt, Human
ugaaacuacaugccuuccaga

SEQ ID NO: 712878 - RNA, 22 nt, Human
ugaaauggguaagacaggguca

SEQ ID NO: 712879 - RNA, 22 nt, Human
ugaaauggguaagacaggguca

SEQ ID NO: 712880 - RNA, 22 nt, Human
uuccagaaaucaaaagcaacag

SEQ ID NO: 712881 - RNA, 19 nt, Human
uugaaacuacaugccuucc

SEQ ID NO: 712882 - RNA, 25 nt, Human
aaaucaccaccaccaccaccacccu

SEQ ID NO: 712883 - RNA, 23 nt, Human
aaucaccaccaccaccaccaccc

SEQ ID NO: 712884 - RNA, 25 nt, Human
acaaauaacuaccccaaaucaccac

SEQ ID NO: 712885 - RNA, 23 nt, Human
acuuugcaggguauucuuugggg

SEQ ID NO: 712886 - RNA, 22 nt, Human
aggcaucuuguaccagaaggca

SEQ ID NO: 712887 - RNA, 25 nt, Human
caaaucaccaccaccaccaccaccc

SEQ ID NO: 712888 - RNA, 19 nt, Human
cacaguaugggacaaaggu

SEQ ID NO: 712889 - RNA, 20 nt, Human
caccaccaccaccaccaccc

SEQ ID NO: 712890 - RNA, 21 nt, Human
caccaccaccaccaccacccu

SEQ ID NO: 712891 - RNA, 19 nt, Human
ccuucaccuguuucagcca

SEQ ID NO: 712892 - RNA, 21 nt, Human
cgcaggacuuugauucugugc

SEQ ID NO: 712893 - RNA, 20 nt, Human
cuaccccaaaucaccaccac

SEQ ID NO: 712894 - RNA, 21 nt, Human
gccugagcgcaagggagccgg

SEQ ID NO: 712895 - RNA, 24 nt, Human
uaccaaaugaagagcuuaaacuua

SEQ ID NO: 712896 - RNA, 19 nt, Human
uaccagaaggcaggcucug

SEQ ID NO: 712897 - RNA, 20 nt, Human
uaccagaaggcaggcucugc

SEQ ID NO: 712898 - RNA, 22 nt, Human
uaccccaaaucaccaccaccac

SEQ ID NO: 712899 - RNA, 21 nt, Human
ucaccaccaccaccaccaccc

SEQ ID NO: 712900 - RNA, 25 nt, Human
ucaccaccaccaccaccacccuugc

SEQ ID NO: 712901 - RNA, 22 nt, Human
uccacaggcaucuuguaccaga

SEQ ID NO: 712902 - RNA, 23 nt, Human
uccgcaggacuuugauucugugc

SEQ ID NO: 712903 - RNA, 23 nt, Human
ucucauauauugccuaaauacca

SEQ ID NO: 712904 - RNA, 21 nt, Human
ugggacaaagguuuacacuuu

SEQ ID NO: 712905 - RNA, 24 nt, Human
uuacaaaugaacaaaaaaaauuuu

SEQ ID NO: 712906 - RNA, 26 nt, Human
uuacaguucacaaaacuguaucugaa

SEQ ID NO: 712907 - RNA, 22 nt, Human
uugggggaauguuaaauacugu

SEQ ID NO: 712908 - RNA, 19 nt, Human
uuugcagaaaauaaaagau

SEQ ID NO: 712909 - RNA, 20 nt, Human
cagcugccugcaggauccag

SEQ ID NO: 712910 - RNA, 18 nt, Human
ccccggacaaaccuggug

SEQ ID NO: 712911 - RNA, 23 nt, Human
ccugcgcugccgcgccugccgga

SEQ ID NO: 712912 - RNA, 18 nt, Human
gccggaugauggccaggc

SEQ ID NO: 712913 - RNA, 19 nt, Human
guacuccuuccucuucucc

SEQ ID NO: 712914 - RNA, 19 nt, Human
guagccuuugaggaagucg

SEQ ID NO: 712915 - RNA, 19 nt, Human
uacuccuuccucuucuccc

SEQ ID NO: 712916 - RNA, 19 nt, Human
ugcagaugcccuucaggaa

SEQ ID NO: 712917 - RNA, 19 nt, Human
ugcgggacacguacacgug

SEQ ID NO: 712918 - RNA, 22 nt, Human
ugcugcagaugcccuucaggaa

SEQ ID NO: 712919 - RNA, 18 nt, Human
aaaaaaaaaaagaaagaa

SEQ ID NO: 712920 - RNA, 29 nt, Human
aaaacaaaaacaaaaacaaaaaaacuuuc

SEQ ID NO: 712921 - RNA, 30 nt, Human
aaacaaacaaaaccugagaagaaaucaagg

SEQ ID NO: 712922 - RNA, 20 nt, Human
aaacccaggacaugagccca

SEQ ID NO: 712923 - RNA, 19 nt, Human
aaagcaucccugcccccug

SEQ ID NO: 712924 - RNA, 21 nt, Human
aaagcgcccaucccuaacccu

SEQ ID NO: 712925 - RNA, 18 nt, Human
aaagcucaccuacucucc

SEQ ID NO: 712926 - RNA, 20 nt, Human
aacaguuccuggguguuucc

SEQ ID NO: 712927 - RNA, 23 nt, Human
aacauccugauuuuguacuuuuu

SEQ ID NO: 712928 - RNA, 21 nt, Human
aaccugacugcuacuuggaua

SEQ ID NO: 712929 - RNA, 22 nt, Human
aaccugagaagaaaucaagucc

SEQ ID NO: 712930 - RNA, 20 nt, Human
aaccugcugauucuuucccu

SEQ ID NO: 712931 - RNA, 21 nt, Human
aacucggcucucccuucccga

SEQ ID NO: 712932 - RNA, 22 nt, Human
aagaaaccugcccucgcuaggc

SEQ ID NO: 712933 - RNA, 22 nt, Human
aagcaaaaggugaacaacagag

SEQ ID NO: 712934 - RNA, 21 nt, Human
aagcaaacucaaaauuaaaca

SEQ ID NO: 712935 - RNA, 20 nt, Human
aagcaggggagcugugugaa

SEQ ID NO: 712936 - RNA, 24 nt, Human
aagccagcucuauccaccccuaca

SEQ ID NO: 712937 - RNA, 23 nt, Human
acaaaaacaaaaaaacuuucaag

SEQ ID NO: 712938 - RNA, 19 nt, Human
acaaacaaacaaacaaaac

SEQ ID NO: 712939 - RNA, 24 nt, Human
acaaagcaauggacagugaaaaac

SEQ ID NO: 712940 - RNA, 23 nt, Human
acaaaucccacagaguuucuugg

SEQ ID NO: 712941 - RNA, 21 nt, Human
acagacccaggcaaacuaaca

SEQ ID NO: 712942 - RNA, 21 nt, Human
acagagagucuuaguuuggac

SEQ ID NO: 712943 - RNA, 21 nt, Human
acagaguuucuuggcacaaug

SEQ ID NO: 712944 - RNA, 19 nt, Human
acagcccagaaggaaagcc

SEQ ID NO: 712945 - RNA, 21 nt, Human
accccggacucagaaaaacag

SEQ ID NO: 712946 - RNA, 20 nt, Human
acccuggcucagagcaggag

SEQ ID NO: 712947 - RNA, 18 nt, Human
acguccaaugagagacca

SEQ ID NO: 712948 - RNA, 19 nt, Human
acuugaugcuuuuucucca

SEQ ID NO: 712949 - RNA, 19 nt, Human
agaaaggaggggaccaggg

SEQ ID NO: 712950 - RNA, 23 nt, Human
agacagacccaggcaaacuaaca

SEQ ID NO: 712951 - RNA, 18 nt, Human
agacccaagucacagcga

SEQ ID NO: 712952 - RNA, 20 nt, Human
agagaagcagauuucuucug

SEQ ID NO: 712953 - RNA, 23 nt, Human
agagaccaacaggccccugaccu

SEQ ID NO: 712954 - RNA, 20 nt, Human
agagaggaugggaaacuagg

SEQ ID NO: 712955 - RNA, 22 nt, Human
agaggaaagagaaggcugggag

SEQ ID NO: 712956 - RNA, 21 nt, Human
agaggagcccaggccucuccu

SEQ ID NO: 712957 - RNA, 22 nt, Human
agauaagagaacaaacagugca

SEQ ID NO: 712958 - RNA, 25 nt, Human
agauuaaggaaacaaacaaacaaac

SEQ ID NO: 712959 - RNA, 21 nt, Human
agcacgucugggaccaggugg

SEQ ID NO: 712960 - RNA, 22 nt, Human
agcagccaggcccaauguggaa

SEQ ID NO: 712961 - RNA, 18 nt, Human
agccacaaaacaaaaaca

SEQ ID NO: 712962 - RNA, 18 nt, Human
agccacaaaacaaaaaca

SEQ ID NO: 712963 - RNA, 20 nt, Human
aggaaccaaagcuacugcca

SEQ ID NO: 712964 - RNA, 28 nt, Human
aggagccacaaaacaaaaacaaaaacaa

SEQ ID NO: 712965 - RNA, 27 nt, Human
aggcaggagaagaaggaagagggaccc

SEQ ID NO: 712966 - RNA, 18 nt, Human
aggcaggugguccccagg

SEQ ID NO: 712967 - RNA, 19 nt, Human
aggcaggugguccccagga

SEQ ID NO: 712968 - RNA, 24 nt, Human
aggcaggugguccccaggaccaag

SEQ ID NO: 712969 - RNA, 20 nt, Human
aggccccugaccuaagucag

SEQ ID NO: 712970 - RNA, 21 nt, Human
agggagggagguaccaacaag

SEQ ID NO: 712971 - RNA, 20 nt, Human
aggguagaagcuacaagggc

SEQ ID NO: 712972 - RNA, 21 nt, Human
agguaccaacaaggugaggug

SEQ ID NO: 712973 - RNA, 20 nt, Human
aggugguaaaggagaagaca

SEQ ID NO: 712974 - RNA, 21 nt, Human
aguagaggagcccaggccucu

SEQ ID NO: 712975 - RNA, 19 nt, Human
agucacagcgaaaacaaca

SEQ ID NO: 712976 - RNA, 21 nt, Human
aguugguuuggccuccacaga

SEQ ID NO: 712977 - RNA, 21 nt, Human
auaaagcacugaagcucaaaa

SEQ ID NO: 712978 - RNA, 18 nt, Human
aucauugugaaaaauaca

SEQ ID NO: 712979 - RNA, 19 nt, Human
auggaggacaauauuccau

SEQ ID NO: 712980 - RNA, 22 nt, Human
auggaguucugcuuuccccagu

SEQ ID NO: 712981 - RNA, 25 nt, Human
auguggaagggugggcuugguuucc

SEQ ID NO: 712982 - RNA, 20 nt, Human
auuaaagagccaaaacccag

SEQ ID NO: 712983 - RNA, 22 nt, Human
caaaauacagauaagagaacaa

SEQ ID NO: 712984 - RNA, 21 nt, Human
caaagcuacugccagaagccu

SEQ ID NO: 712985 - RNA, 24 nt, Human
caaauucuaccccuucacacacau

SEQ ID NO: 712986 - RNA, 19 nt, Human
caacaggcacugaaaucaa

SEQ ID NO: 712987 - RNA, 21 nt, Human
caacucaggccacacuucugg

SEQ ID NO: 712988 - RNA, 23 nt, Human
caagaucgacacuuagaugcuaa

SEQ ID NO: 712989 - RNA, 22 nt, Human
caagccacacagaugcaaagaa

SEQ ID NO: 712990 - RNA, 19 nt, Human
caaggcccucucugccaac

SEQ ID NO: 712991 - RNA, 26 nt, Human
cacaaagcaauggacagugaaaaaca

SEQ ID NO: 712992 - RNA, 19 nt, Human
cacaccaagaaccugacug

SEQ ID NO: 712993 - RNA, 24 nt, Human
caccccucacuggcaccccucacc

SEQ ID NO: 712994 - RNA, 23 nt, Human
cacgcaccccucacuggcacccc

SEQ ID NO: 712995 - RNA, 20 nt, Human
cacuggauuaauccagaaag

SEQ ID NO: 712996 - RNA, 24 nt, Human
cagaaaaacagcgccacgggccgc

SEQ ID NO: 712997 - RNA, 22 nt, Human
cagaaggaaagccagcucuauc

SEQ ID NO: 712998 - RNA, 23 nt, Human
cagaaggaaagccagcucuaucc

SEQ ID NO: 712999 - RNA, 18 nt, Human
cagaaugggcagcugguc

SEQ ID NO: 713000 - RNA, 25 nt, Human
cagacccaggcaaacuaacaaacaa

SEQ ID NO: 713001 - RNA, 19 nt, Human
cagcccagcucugcagcag

SEQ ID NO: 713002 - RNA, 28 nt, Human
cagcugggcucagugggaucuaaaaacc

SEQ ID NO: 713003 - RNA, 20 nt, Human
caggugguccccaggaccaa

SEQ ID NO: 713004 - RNA, 25 nt, Human
caguuccuggguguuuccgguucug

SEQ ID NO: 713005 - RNA, 19 nt, Human
caucacaccaagaaccuga

SEQ ID NO: 713006 - RNA, 24 nt, Human
cauucaagcagagaaccccaaauc

SEQ ID NO: 713007 - RNA, 20 nt, Human
ccaaagcuacugccagaagc

SEQ ID NO: 713008 - RNA, 21 nt, Human
ccacaaagagaggacgaggac

SEQ ID NO: 713009 - RNA, 21 nt, Human
ccacaccccuccacccuguuc

SEQ ID NO: 713010 - RNA, 19 nt, Human
ccacagaaggagaaagccc

SEQ ID NO: 713011 - RNA, 22 nt, Human
ccacagaaggagaaagcccaaa

SEQ ID NO: 713012 - RNA, 24 nt, Human
ccacccuguucaggauagucauuu

SEQ ID NO: 713013 - RNA, 22 nt, Human
ccagcuaguccccaaaucaccu

SEQ ID NO: 713014 - RNA, 18 nt, Human
ccaggcaaacuaacaaac

SEQ ID NO: 713015 - RNA, 18 nt, Human
ccaggcacagaaaggggg

SEQ ID NO: 713016 - RNA, 19 nt, Human
ccaguuuacccuaaguauc

SEQ ID NO: 713017 - RNA, 21 nt, Human
cccaaggugagccaauuucua

SEQ ID NO: 713018 - RNA, 22 nt, Human
cccacaccccuccacccuguuc

SEQ ID NO: 713019 - RNA, 21 nt, Human
cccaggcaaacuaacaaacaa

SEQ ID NO: 713020 - RNA, 23 nt, Human
cccaggcaaacuaacaaacaagg

SEQ ID NO: 713021 - RNA, 23 nt, Human
ccccaggagucaggguuuccuuc

SEQ ID NO: 713022 - RNA, 22 nt, Human
ccccccauagcaggcuagacaa

SEQ ID NO: 713023 - RNA, 18 nt, Human
cccccuccuuccucagac

SEQ ID NO: 713024 - RNA, 19 nt, Human
ccccucacuggcaccccuc

SEQ ID NO: 713025 - RNA, 24 nt, Human
cccucaccaucucccauacauucc

SEQ ID NO: 713026 - RNA, 19 nt, Human
cccugcccaaaccugaauc

SEQ ID NO: 713027 - RNA, 21 nt, Human
ccuaacccugagcucagggga

SEQ ID NO: 713028 - RNA, 21 nt, Human
ccugcugauucuuucccuggg

SEQ ID NO: 713029 - RNA, 19 nt, Human
ccugugggcagggcuaguc

SEQ ID NO: 713030 - RNA, 20 nt, Human
ccuucuggaggggcauggaa

SEQ ID NO: 713031 - RNA, 20 nt, Human
ccuugaaguagcucuaggca

SEQ ID NO: 713032 - RNA, 20 nt, Human
cgccgacccucguccucggc

SEQ ID NO: 713033 - RNA, 18 nt, Human
cgggggcagcccccgccg

SEQ ID NO: 713034 - RNA, 21 nt, Human
cuaacccaauggcaguggccc

SEQ ID NO: 713035 - RNA, 24 nt, Human
cuagacauaacuucagaccguacc

SEQ ID NO: 713036 - RNA, 25 nt, Human
cuagcacugagacccaagucacagc

SEQ ID NO: 713037 - RNA, 23 nt, Human
cuagucucauaacaaaaugagga

SEQ ID NO: 713038 - RNA, 24 nt, Human
cuagucucauaacaaaaugaggaa

SEQ ID NO: 713039 - RNA, 23 nt, Human
cucaaacaggcacuacuguuucc

SEQ ID NO: 713040 - RNA, 20 nt, Human
cucacuggcaccccucacca

SEQ ID NO: 713041 - RNA, 19 nt, Human
cucccugccagugcucccc

SEQ ID NO: 713042 - RNA, 24 nt, Human
cucucaaaccaacagguggcccug

SEQ ID NO: 713043 - RNA, 22 nt, Human
cugaagcucaaaauagagguga

SEQ ID NO: 713044 - RNA, 24 nt, Human
cugcugggucagguccuccuggcu

SEQ ID NO: 713045 - RNA, 21 nt, Human
cuggaccaaacaguucccagg

SEQ ID NO: 713046 - RNA, 18 nt, Human
cugggcucagugggaucu

SEQ ID NO: 713047 - RNA, 26 nt, Human
cuuucagucccaucacaccaagaacc

SEQ ID NO: 713048 - RNA, 23 nt, Human
gaaagcucaccuacucuccuagg

SEQ ID NO: 713049 - RNA, 20 nt, Human
gacccaagucacagcgaaaa

SEQ ID NO: 713050 - RNA, 23 nt, Human
gacugcagccucgggccacaacc

SEQ ID NO: 713051 - RNA, 19 nt, Human
gagcugccaaggcucuggc

SEQ ID NO: 713052 - RNA, 18 nt, Human
gaggaugggaaacuaggg

SEQ ID NO: 713053 - RNA, 26 nt, Human
gauccccaaggcaagaagacacuuga

SEQ ID NO: 713054 - RNA, 20 nt, Human
gaucugaggacccgacauaa

SEQ ID NO: 713055 - RNA, 27 nt, Human
gcaaaaagcaaaaggugaacaacagag

SEQ ID NO: 713056 - RNA, 22 nt, Human
gcaaaauggaggcagccagucc

SEQ ID NO: 713057 - RNA, 18 nt, Human
gcaccccucaccaucucc

SEQ ID NO: 713058 - RNA, 18 nt, Human
gcaggugguccccaggac

SEQ ID NO: 713059 - RNA, 24 nt, Human
gccacgggccgcuccgccugagcc

SEQ ID NO: 713060 - RNA, 24 nt, Human
gccaggccaccccggacucagaaa

SEQ ID NO: 713061 - RNA, 21 nt, Human
gccucagucucuccuuccucc

SEQ ID NO: 713062 - RNA, 21 nt, Human
gccuggaguaaucauuaaaga

SEQ ID NO: 713063 - RNA, 19 nt, Human
gcuccagcccaagcugaag

SEQ ID NO: 713064 - RNA, 24 nt, Human
gcugcucucuacucgcucugccuc

SEQ ID NO: 713065 - RNA, 23 nt, Human
ggaaaauacugcugcuguuuucu

SEQ ID NO: 713066 - RNA, 21 nt, Human
ggaaacuaggguagaagcuac

SEQ ID NO: 713067 - RNA, 19 nt, Human
ggaaccaaagcuacugccg

SEQ ID NO: 713068 - RNA, 22 nt, Human
ggagguaccaacaaggugaggu

SEQ ID NO: 713069 - RNA, 26 nt, Human
ggaguggggugggacauggaaggggu

SEQ ID NO: 713070 - RNA, 24 nt, Human
ggcaaagaguugguuuggccucca

SEQ ID NO: 713071 - RNA, 23 nt, Human
ggcaggugguccccaggaccaag

SEQ ID NO: 713072 - RNA, 22 nt, Human
gggaaaagggugggcuuggaaa

SEQ ID NO: 713073 - RNA, 22 nt, Human
gggcagagaaccugcugauucu

SEQ ID NO: 713074 - RNA, 18 nt, Human
ggggagggaagggacagg

SEQ ID NO: 713075 - RNA, 18 nt, Human
ggguccuuccccaacccc

SEQ ID NO: 713076 - RNA, 22 nt, Human
gguagaagcuacaagggcuaag

SEQ ID NO: 713077 - RNA, 19 nt, Human
guuguccuuugaaaggacg

SEQ ID NO: 713078 - RNA, 23 nt, Human
uaaaaaacauaucuaauaaagca

SEQ ID NO: 713079 - RNA, 20 nt, Human
uaaaacacaaagcaauggac

SEQ ID NO: 713080 - RNA, 21 nt, Human
uaacaaaaugaggaaaucuag

SEQ ID NO: 713081 - RNA, 21 nt, Human
uaacccaauggcaguggccca

SEQ ID NO: 713082 - RNA, 19 nt, Human
uaagagaacaaacagugca

SEQ ID NO: 713083 - RNA, 20 nt, Human
uaagaucaauaagaagcauc

SEQ ID NO: 713084 - RNA, 20 nt, Human
uaagaucaauaagaagcauc

SEQ ID NO: 713085 - RNA, 19 nt, Human
uaagcucaaaauacagaua

SEQ ID NO: 713086 - RNA, 21 nt, Human
uacccauccugcccuuuaaaa

SEQ ID NO: 713087 - RNA, 23 nt, Human
uaccccagcccccaccauacuuc

SEQ ID NO: 713088 - RNA, 23 nt, Human
uacuguuuccuuggcugccagga

SEQ ID NO: 713089 - RNA, 23 nt, Human
uagagaaaugaaaggacagggga

SEQ ID NO: 713090 - RNA, 19 nt, Human
uagaggcaggagaagaagg

SEQ ID NO: 713091 - RNA, 24 nt, Human
uaggcagggagggcaagagaacac

SEQ ID NO: 713092 - RNA, 19 nt, Human
uaguuaggauguccacugc

SEQ ID NO: 713093 - RNA, 23 nt, Human
uauaacuuagugggaugguugag

SEQ ID NO: 713094 - RNA, 21 nt, Human
uauccaggccuuuccaggaga

SEQ ID NO: 713095 - RNA, 19 nt, Human
uaugggaaguauaccucug

SEQ ID NO: 713096 - RNA, 21 nt, Human
ucacagcgaaaacaacaggcu

SEQ ID NO: 713097 - RNA, 19 nt, Human
ucagaaaaacagcgccacg

SEQ ID NO: 713098 - RNA, 24 nt, Human
ucagauggagacagcccagaagga

SEQ ID NO: 713099 - RNA, 24 nt, Human
ucaguccuagcacuaagcucaaaa

SEQ ID NO: 713100 - RNA, 23 nt, Human
ucauucccuggaucacaacacac

SEQ ID NO: 713101 - RNA, 22 nt, Human
uccaaugagagaccaacaggcc

SEQ ID NO: 713102 - RNA, 25 nt, Human
uccacgcaccccucacuggcacccc

SEQ ID NO: 713103 - RNA, 24 nt, Human
ucccacaccccuccacccuguuca

SEQ ID NO: 713104 - RNA, 24 nt, Human
ucccaguagcucuuaggcagggag

SEQ ID NO: 713105 - RNA, 22 nt, Human
ucccgacaguuguccuuugaaa

SEQ ID NO: 713106 - RNA, 20 nt, Human
uccuggguguuuccgguucu

SEQ ID NO: 713107 - RNA, 18 nt, Human
uccuucaucuugacuaac

SEQ ID NO: 713108 - RNA, 19 nt, Human
ucguccucggccggcugcc

SEQ ID NO: 713109 - RNA, 21 nt, Human
ucucaaacgacuaaaugcugg

SEQ ID NO: 713110 - RNA, 18 nt, Human
ucuccuagguccuucugg

SEQ ID NO: 713111 - RNA, 18 nt, Human
ucucucacuuuggaaaga

SEQ ID NO: 713112 - RNA, 19 nt, Human
ucucucccugccagugcuc

SEQ ID NO: 713113 - RNA, 19 nt, Human
ucugaagucuuaucuagac

SEQ ID NO: 713114 - RNA, 19 nt, Human
ucugccucuuuuugucucc

SEQ ID NO: 713115 - RNA, 18 nt, Human
ucuuggaugcuggacagu

SEQ ID NO: 713116 - RNA, 20 nt, Human
ugaaaggacaggggaaggaa

SEQ ID NO: 713117 - RNA, 24 nt, Human
ugaccgggguggguccuuccccaa

SEQ ID NO: 713118 - RNA, 21 nt, Human
ugagcaggaaggauccaguuu

SEQ ID NO: 713119 - RNA, 20 nt, Human
ugagcucaggggaaaagggu

SEQ ID NO: 713120 - RNA, 22 nt, Human
ugaggugguaaaggagaagaca

SEQ ID NO: 713121 - RNA, 21 nt, Human
ugauuuuguacuuuuuggugg

SEQ ID NO: 713122 - RNA, 20 nt, Human
ugccaaggcccucucugcca

SEQ ID NO: 713123 - RNA, 19 nt, Human
ugccaggccaccccggacu

SEQ ID NO: 713124 - RNA, 21 nt, Human
ugcccccaucucacaagacug

SEQ ID NO: 713125 - RNA, 24 nt, Human
ugcccucucaucaaagccuaaaug

SEQ ID NO: 713126 - RNA, 26 nt, Human
ugcucucuacucgcucugccucuuuu

SEQ ID NO: 713127 - RNA, 20 nt, Human
uggaaagcaucccugccccc

SEQ ID NO: 713128 - RNA, 19 nt, Human
uggaaggcgggacccccuc

SEQ ID NO: 713129 - RNA, 21 nt, Human
uggaaggcgggacccccuccu

SEQ ID NO: 713130 - RNA, 20 nt, Human
uggaagggguagggucagau

SEQ ID NO: 713131 - RNA, 19 nt, Human
uggaauucuuucaguccca

SEQ ID NO: 713132 - RNA, 18 nt, Human
uggacagucuauaacugg

SEQ ID NO: 713133 - RNA, 21 nt, Human
uggcacaugccagggagacaa

SEQ ID NO: 713134 - RNA, 20 nt, Human
uggcaccccucaccaucucc

SEQ ID NO: 713135 - RNA, 21 nt, Human
uggcagcaaggcccuacaaag

SEQ ID NO: 713136 - RNA, 18 nt, Human
ugggagccagccacaaag

SEQ ID NO: 713137 - RNA, 26 nt, Human
ugggagccagccacaaagagaggacg

SEQ ID NO: 713138 - RNA, 21 nt, Human
ugggaguggggugggacaugg

SEQ ID NO: 713139 - RNA, 22 nt, Human
uggggugggacauggaaggggu

SEQ ID NO: 713140 - RNA, 20 nt, Human
ugguuucuuucccacacccc

SEQ ID NO: 713141 - RNA, 19 nt, Human
uguguugagguggaaggcc

SEQ ID NO: 713142 - RNA, 18 nt, Human
uguuuccuuggcugccag

SEQ ID NO: 713143 - RNA, 23 nt, Human
uuaaaaaaaaaaagaaagaaaga

SEQ ID NO: 713144 - RNA, 25 nt, Human
uuaaaaaacauaucuaauaaagcaa

SEQ ID NO: 713145 - RNA, 19 nt, Human
uucagucagcugggcucag

SEQ ID NO: 713146 - RNA, 22 nt, Human
uucaguguacuaucacuuugcc

SEQ ID NO: 713147 - RNA, 18 nt, Human
uuccuggguguuuccggu

SEQ ID NO: 713148 - RNA, 24 nt, Human
uucuaaagcuggaccaaacaguuc

SEQ ID NO: 713149 - RNA, 21 nt, Human
uuggcuccaggggagucuacc

SEQ ID NO: 713150 - RNA, 24 nt, Human
uuucugaaguucucagcugagauu

SEQ ID NO: 713151 - RNA, 20 nt, Human
aaaaauaagaaaaagccaac

SEQ ID NO: 713152 - RNA, 24 nt, Human
aaacacaauuagaaaagaacugga

SEQ ID NO: 713153 - RNA, 18 nt, Human
aaacgcuggcagcugacu

SEQ ID NO: 713154 - RNA, 18 nt, Human
aacacagcagccaggaac

SEQ ID NO: 713155 - RNA, 23 nt, Human
aacccuucccccagcacccccug

SEQ ID NO: 713156 - RNA, 21 nt, Human
aagagcagagaccccggaaga

SEQ ID NO: 713157 - RNA, 18 nt, Human
aagguucugggugagcug

SEQ ID NO: 713158 - RNA, 22 nt, Human
acaaauucuccaugccaggaac

SEQ ID NO: 713159 - RNA, 18 nt, Human
accccggaagagaaaccc

SEQ ID NO: 713160 - RNA, 19 nt, Human
acgguggccuccugccagg

SEQ ID NO: 713161 - RNA, 21 nt, Human
agaugguggugaggggugagg

SEQ ID NO: 713162 - RNA, 23 nt, Human
agcugacuccuaauuucagaaac

SEQ ID NO: 713163 - RNA, 18 nt, Human
aggagguuugcuggugaa

SEQ ID NO: 713164 - RNA, 18 nt, Human
aggccuggggcugaggcu

SEQ ID NO: 713165 - RNA, 23 nt, Human
aggugcagcuuugcuacaagaaa

SEQ ID NO: 713166 - RNA, 18 nt, Human
auaagaaaaagccaacau

SEQ ID NO: 713167 - RNA, 26 nt, Human
aucagccccagccccaggcgccccuu

SEQ ID NO: 713168 - RNA, 23 nt, Human
augcugugcucccggaguguggc

SEQ ID NO: 713169 - RNA, 18 nt, Human
caaaggcgacgggcccgc

SEQ ID NO: 713170 - RNA, 19 nt, Human
caagacgguggccuccugc

SEQ ID NO: 713171 - RNA, 19 nt, Human
cacaaucagccccagcccc

SEQ ID NO: 713172 - RNA, 23 nt, Human
cacacugcagccacacaaaaacg

SEQ ID NO: 713173 - RNA, 21 nt, Human
caccgcccacaaucagcccca

SEQ ID NO: 713174 - RNA, 22 nt, Human
caggaacaaagcccuuggcuaa

SEQ ID NO: 713175 - RNA, 21 nt, Human
caggaacaaauucuccaugcc

SEQ ID NO: 713176 - RNA, 24 nt, Human
caggaacaaauucuccaugccagg

SEQ ID NO: 713177 - RNA, 18 nt, Human
caggaccucagcaggagg

SEQ ID NO: 713178 - RNA, 20 nt, Human
caggagguuugcuggugaag

SEQ ID NO: 713179 - RNA, 20 nt, Human
cagggcucccaaacgcuucc

SEQ ID NO: 713180 - RNA, 21 nt, Human
cauagagcccugugggugcag

SEQ ID NO: 713181 - RNA, 18 nt, Human
ccacacaaaaacgcuggc

SEQ ID NO: 713182 - RNA, 19 nt, Human
ccaccgcccacaaucagcc

SEQ ID NO: 713183 - RNA, 23 nt, Human
ccaccgcccacaaucagccccag

SEQ ID NO: 713184 - RNA, 20 nt, Human
ccaggcacacugcagccacc

SEQ ID NO: 713185 - RNA, 20 nt, Human
ccagggccgguguggggagg

SEQ ID NO: 713186 - RNA, 21 nt, Human
ccaugccaggaacaaagcccu

SEQ ID NO: 713187 - RNA, 20 nt, Human
cccacagccgucccgggguc

SEQ ID NO: 713188 - RNA, 20 nt, Human
cccagccccaggcgccccuu

SEQ ID NO: 713189 - RNA, 19 nt, Human
cccaggcacacugcagcca

SEQ ID NO: 713190 - RNA, 19 nt, Human
cccaggcacacugcagcca

SEQ ID NO: 713191 - RNA, 20 nt, Human
cccaggcacacugcagccac

SEQ ID NO: 713192 - RNA, 18 nt, Human
ccccacagccgucccggg

SEQ ID NO: 713193 - RNA, 18 nt, Human
ccccagccccaggcgccc

SEQ ID NO: 713194 - RNA, 19 nt, Human
ccccaggcgccccuugccg

SEQ ID NO: 713195 - RNA, 23 nt, Human
cccccagcacccccuggaaacac

SEQ ID NO: 713196 - RNA, 18 nt, Human
cccugcaacaggcccucc

SEQ ID NO: 713197 - RNA, 22 nt, Human
cccugugggugcaguguggggc

SEQ ID NO: 713198 - RNA, 23 nt, Human
ccucaggaaggguaacgcgugcu

SEQ ID NO: 713199 - RNA, 19 nt, Human
ccucccaugcacuggaagg

SEQ ID NO: 713200 - RNA, 23 nt, Human
ccugcccucccaugcacuggaag

SEQ ID NO: 713201 - RNA, 23 nt, Human
ccugggcaguuagguccacccac

SEQ ID NO: 713202 - RNA, 26 nt, Human
ccuggggcugaggcuaugcccagggc

SEQ ID NO: 713203 - RNA, 27 nt, Human
cgcccugccccugcaacaggcccucca

SEQ ID NO: 713204 - RNA, 20 nt, Human
cuccaggagcugccaaaggc

SEQ ID NO: 713205 - RNA, 20 nt, Human
cuccaugccaggaacaaagc

SEQ ID NO: 713206 - RNA, 22 nt, Human
cucggcaggacagaggccuggg

SEQ ID NO: 713207 - RNA, 24 nt, Human
cuggaaacacagcagccaggaaca

SEQ ID NO: 713208 - RNA, 22 nt, Human
cuggaaggcucuggaaguagcu

SEQ ID NO: 713209 - RNA, 21 nt, Human
cugggugagcuggaaugggug

SEQ ID NO: 713210 - RNA, 24 nt, Human
cugucgcauagagcccugugggug

SEQ ID NO: 713211 - RNA, 25 nt, Human
cuugcugggugguggccucaggcug

SEQ ID NO: 713212 - RNA, 24 nt, Human
gaaacacaauuagaaaagaacugg

SEQ ID NO: 713213 - RNA, 22 nt, Human
gaacccuucccccagcaccccc

SEQ ID NO: 713214 - RNA, 24 nt, Human
gaagguucugggugagcuggaaug

SEQ ID NO: 713215 - RNA, 18 nt, Human
gagcagagaccccggaag

SEQ ID NO: 713216 - RNA, 25 nt, Human
gagcugccaaaggcgacgggcccgc

SEQ ID NO: 713217 - RNA, 18 nt, Human
gaggggugagggcagggc

SEQ ID NO: 713218 - RNA, 21 nt, Human
gcauguccacagcucuccagg

SEQ ID NO: 713219 - RNA, 23 nt, Human
gccucaggcuguuccugggcccc

SEQ ID NO: 713220 - RNA, 18 nt, Human
ggcagggcgugggguggu

SEQ ID NO: 713221 - RNA, 21 nt, Human
ggccucaggcuguuccugggc

SEQ ID NO: 713222 - RNA, 20 nt, Human
ggcuguuccugggccccugu

SEQ ID NO: 713223 - RNA, 18 nt, Human
ggcuugcugggugguggc

SEQ ID NO: 713224 - RNA, 21 nt, Human
gggccuuugcagaagcagcuc

SEQ ID NO: 713225 - RNA, 21 nt, Human
ggugaggggugagggcagggc

SEQ ID NO: 713226 - RNA, 19 nt, Human
gguguggggagggacaugg

SEQ ID NO: 713227 - RNA, 20 nt, Human
guggugaggggugagggcag

SEQ ID NO: 713228 - RNA, 22 nt, Human
guguggggagggacaugggggc

SEQ ID NO: 713229 - RNA, 21 nt, Human
uaaaaaauaagaaaaagccaa

SEQ ID NO: 713230 - RNA, 26 nt, Human
uagagcccugugggugcaguguggcg

SEQ ID NO: 713231 - RNA, 20 nt, Human
uccaccgcccacaaucagcc

SEQ ID NO: 713232 - RNA, 19 nt, Human
uccacggaacccuuccccc

SEQ ID NO: 713233 - RNA, 20 nt, Human
uccacggaacccuuccccca

SEQ ID NO: 713234 - RNA, 27 nt, Human
uccaugccaggaacaaagccggggucc

SEQ ID NO: 713235 - RNA, 20 nt, Human
ucccaugcacuggaaggcuc

SEQ ID NO: 713236 - RNA, 27 nt, Human
uccugggccccugucgcauagagcccc

SEQ ID NO: 713237 - RNA, 22 nt, Human
ucuccaggagcugccaaaggcg

SEQ ID NO: 713238 - RNA, 25 nt, Human
ucucgcuccacggaacccuuccccc

SEQ ID NO: 713239 - RNA, 23 nt, Human
ugacccucagcaaacgaaaagga

SEQ ID NO: 713240 - RNA, 19 nt, Human
ugcagcacgaacugagggg

SEQ ID NO: 713241 - RNA, 18 nt, Human
ugccccgugugauacagg

SEQ ID NO: 713242 - RNA, 24 nt, Human
ugcccgugagcugggcccaggcac

SEQ ID NO: 713243 - RNA, 21 nt, Human
ugcugggugguggccucaggc

SEQ ID NO: 713244 - RNA, 23 nt, Human
uggaaacacagcagccaggaaca

SEQ ID NO: 713245 - RNA, 18 nt, Human
uggaaugggugauaaggc

SEQ ID NO: 713246 - RNA, 18 nt, Human
uggggagggacauggggg

SEQ ID NO: 713247 - RNA, 19 nt, Human
uggggccccacagccgucc

SEQ ID NO: 713248 - RNA, 23 nt, Human
ugggguggugcucagcccugggg

SEQ ID NO: 713249 - RNA, 24 nt, Human
ugggguggugcucagcccugggga

SEQ ID NO: 713250 - RNA, 19 nt, Human
uggugaggggugagggcag

SEQ ID NO: 713251 - RNA, 22 nt, Human
ugguggugaggggugagggcag

SEQ ID NO: 713252 - RNA, 19 nt, Human
uguuggggucugugacccu

SEQ ID NO: 713253 - RNA, 21 nt, Human
uuugcuggugaagguucuggg

SEQ ID NO: 713254 - RNA, 24 nt, Human
aaaaaguuuccuccagagaugaag

SEQ ID NO: 713255 - RNA, 26 nt, Human
aaaauauucucaaucuaaacucaaaa

SEQ ID NO: 713256 - RNA, 18 nt, Human
aaacauuuuuaucacagc

SEQ ID NO: 713257 - RNA, 19 nt, Human
aacauuuuuaucacagcuc

SEQ ID NO: 713258 - RNA, 18 nt, Human
aauugccuuaagaaaaau

SEQ ID NO: 713259 - RNA, 21 nt, Human
acaauugacuaaacaucugaa

SEQ ID NO: 713260 - RNA, 20 nt, Human
agguggaauuguaccacaaa

SEQ ID NO: 713261 - RNA, 19 nt, Human
auaaagaagaugagacauc

SEQ ID NO: 713262 - RNA, 18 nt, Human
caaacugauagaaaagaa

SEQ ID NO: 713263 - RNA, 21 nt, Human
ccacaccuuauucaaccuaac

SEQ ID NO: 713264 - RNA, 18 nt, Human
ccccgccgcuccgcagcc

SEQ ID NO: 713265 - RNA, 18 nt, Human
cucaaaauggaauaaaga

SEQ ID NO: 713266 - RNA, 22 nt, Human
cuccgcuucaggcuaauccaga

SEQ ID NO: 713267 - RNA, 21 nt, Human
gccccgccgcuccgcagccgg

SEQ ID NO: 713268 - RNA, 19 nt, Human
ggacucuagcacaggaaau

SEQ ID NO: 713269 - RNA, 23 nt, Human
gugcaauuauacaguagauaucu

SEQ ID NO: 713270 - RNA, 25 nt, Human
uaacagaaaagcauuuuccacaccu

SEQ ID NO: 713271 - RNA, 24 nt, Human
uaauauacaaacugauagaaaaga

SEQ ID NO: 713272 - RNA, 23 nt, Human
uacacuauugaaaaccuuccuuu

SEQ ID NO: 713273 - RNA, 20 nt, Human
uaccacaaagaauagucuca

SEQ ID NO: 713274 - RNA, 23 nt, Human
uacuaacagaaaagcauuuucca

SEQ ID NO: 713275 - RNA, 20 nt, Human
uagcacaggaaaugucucuu

SEQ ID NO: 713276 - RNA, 18 nt, Human
uaugauagguggaauugu

SEQ ID NO: 713277 - RNA, 23 nt, Human
uauugaaaaccuuccuuucaaau

SEQ ID NO: 713278 - RNA, 20 nt, Human
ucuagcacaggaaaugucuc

SEQ ID NO: 713279 - RNA, 23 nt, Human
ucuagcacaggaaaugucucuug

SEQ ID NO: 713280 - RNA, 21 nt, Human
ucuccgcuucaggcuaaucca

SEQ ID NO: 713281 - RNA, 21 nt, Human
ucucgccccgccgcuccgcag

SEQ ID NO: 713282 - RNA, 24 nt, Human
ucucugccuucagaaaauaaaaau

SEQ ID NO: 713283 - RNA, 19 nt, Human
uggaauuguaccacaaaga

SEQ ID NO: 713284 - RNA, 24 nt, Human
uggguuuauuuuuacugcaguuuu

SEQ ID NO: 713285 - RNA, 20 nt, Human
uguaggaaugauuuagcauc

SEQ ID NO: 713286 - RNA, 21 nt, Human
uucacauaugauagguggaau

SEQ ID NO: 713287 - RNA, 24 nt, Human
uugcaauaaaaaucagaagaguau

SEQ ID NO: 713288 - RNA, 25 nt, Human
uuguaggaaugauuuagcaucuggg

SEQ ID NO: 713289 - RNA, 19 nt, Human
aaaaaaguuggaagcccuc

SEQ ID NO: 713290 - RNA, 23 nt, Human
aaaaacuaaaaaguuuugaacaa

SEQ ID NO: 713291 - RNA, 21 nt, Human
aaaaaguuuugaacaaggcug

SEQ ID NO: 713292 - RNA, 24 nt, Human
aaaccagaagcucaacaugcuccu

SEQ ID NO: 713293 - RNA, 21 nt, Human
aaacuccaaguauuaaccuca

SEQ ID NO: 713294 - RNA, 19 nt, Human
aaacuugcacacuguaucc

SEQ ID NO: 713295 - RNA, 22 nt, Human
aaccagaagcucaacaugcucc

SEQ ID NO: 713296 - RNA, 22 nt, Human
aacucacuccuucuguucucca

SEQ ID NO: 713297 - RNA, 22 nt, Human
acacaguagucacuguaaucca

SEQ ID NO: 713298 - RNA, 20 nt, Human
agaacagagaccauaaaugu

SEQ ID NO: 713299 - RNA, 23 nt, Human
agaauccuguccaaacucuccuc

SEQ ID NO: 713300 - RNA, 25 nt, Human
agaauccuguccaaacucuccucau

SEQ ID NO: 713301 - RNA, 19 nt, Human
agacccccauagaguggcg

SEQ ID NO: 713302 - RNA, 18 nt, Human
agagaagguauaucugau

SEQ ID NO: 713303 - RNA, 18 nt, Human
agaggagacgguaauggc

SEQ ID NO: 713304 - RNA, 23 nt, Human
agauuuuaagccuucaacaacuu

SEQ ID NO: 713305 - RNA, 23 nt, Human
agcuaaaccuaccgugucuggaa

SEQ ID NO: 713306 - RNA, 20 nt, Human
agcucagugaguaaaugugu

SEQ ID NO: 713307 - RNA, 22 nt, Human
aggagacgguaauggcacuuaa

SEQ ID NO: 713308 - RNA, 18 nt, Human
auaaaaauauaagugcau

SEQ ID NO: 713309 - RNA, 19 nt, Human
aucuccucuguaugaacuc

SEQ ID NO: 713310 - RNA, 25 nt, Human
auuuggaugauuacuuacugguaau

SEQ ID NO: 713311 - RNA, 23 nt, Human
caagauucccaaacaguuuauua

SEQ ID NO: 713312 - RNA, 18 nt, Human
caagcuaguagaaaaaaa

SEQ ID NO: 713313 - RNA, 23 nt, Human
caaugacuuucuuucuccgaucu

SEQ ID NO: 713314 - RNA, 21 nt, Human
cacaaagucaugcagacaaga

SEQ ID NO: 713315 - RNA, 18 nt, Human
caccaagauucccaaaca

SEQ ID NO: 713316 - RNA, 20 nt, Human
cagaagcucaacaugcuccu

SEQ ID NO: 713317 - RNA, 20 nt, Human
ccacccaaugacuuucuuuc

SEQ ID NO: 713318 - RNA, 19 nt, Human
ccccaaauggcaacuuaaa

SEQ ID NO: 713319 - RNA, 22 nt, Human
ccccauagaguggcgauccaaa

SEQ ID NO: 713320 - RNA, 23 nt, Human
ccggaaucuguaccacccaauga

SEQ ID NO: 713321 - RNA, 20 nt, Human
ccuauaaacugaaacuacuu

SEQ ID NO: 713322 - RNA, 18 nt, Human
cgauccaaagaacggcag

SEQ ID NO: 713323 - RNA, 23 nt, Human
cucaguaagcaaugaagaaaaac

SEQ ID NO: 713324 - RNA, 24 nt, Human
cuccccccagauuaaguucucaaa

SEQ ID NO: 713325 - RNA, 19 nt, Human
cugaaugucaaaaucugaa

SEQ ID NO: 713326 - RNA, 20 nt, Human
cuggcgcugaagcugcguag

SEQ ID NO: 713327 - RNA, 21 nt, Human
cuugcacacuguauccaaagg

SEQ ID NO: 713328 - RNA, 22 nt, Human
cuuuuuuuuuuuaaaggcaacc

SEQ ID NO: 713329 - RNA, 18 nt, Human
gaacacauuugcagauaa

SEQ ID NO: 713330 - RNA, 20 nt, Human
gccggaaucuguaccaccca

SEQ ID NO: 713331 - RNA, 24 nt, Human
gcgccggaaucuguaccacccaau

SEQ ID NO: 713332 - RNA, 20 nt, Human
gucacauuuaacugcuuugu

SEQ ID NO: 713333 - RNA, 24 nt, Human
guggaaacacacagcacugaaggu

SEQ ID NO: 713334 - RNA, 23 nt, Human
guguugcugauuugugagucacu

SEQ ID NO: 713335 - RNA, 18 nt, Human
uaaaacucacuccuucug

SEQ ID NO: 713336 - RNA, 21 nt, Human
uaaauggugggucuugcuguu

SEQ ID NO: 713337 - RNA, 18 nt, Human
uaaaugucuuuccuccac

SEQ ID NO: 713338 - RNA, 20 nt, Human
uaaauuuaccaguauaucca

SEQ ID NO: 713339 - RNA, 24 nt, Human
uaccaguauauccaugaaucgcac

SEQ ID NO: 713340 - RNA, 18 nt, Human
uagcugauaacaacugga

SEQ ID NO: 713341 - RNA, 18 nt, Human
uagugcaagagguaaguu

SEQ ID NO: 713342 - RNA, 18 nt, Human
ucacugaugcuaaacguu

SEQ ID NO: 713343 - RNA, 20 nt, Human
uccaucaaagaaaaaauaau

SEQ ID NO: 713344 - RNA, 19 nt, Human
uccuccacagauaaaacua

SEQ ID NO: 713345 - RNA, 20 nt, Human
ucuguucuccacugcugugu

SEQ ID NO: 713346 - RNA, 23 nt, Human
ucuuaccucucccaguaaaaauc

SEQ ID NO: 713347 - RNA, 18 nt, Human
ucuugucuuaccucuccc

SEQ ID NO: 713348 - RNA, 25 nt, Human
ucuuuauucaccaagauucccaaac

SEQ ID NO: 713349 - RNA, 19 nt, Human
ugaaaaugaaucuuuauuc

SEQ ID NO: 713350 - RNA, 24 nt, Human
ugaaacuugcacacuguauccaaa

SEQ ID NO: 713351 - RNA, 18 nt, Human
ugaacaaggcugaugguu

SEQ ID NO: 713352 - RNA, 19 nt, Human
ugaacaaggcugaugguua

SEQ ID NO: 713353 - RNA, 21 nt, Human
ugagaaagcaguucucccccc

SEQ ID NO: 713354 - RNA, 22 nt, Human
ugagaaagcaguucucccccca

SEQ ID NO: 713355 - RNA, 19 nt, Human
ugcgccggaaucuguacca

SEQ ID NO: 713356 - RNA, 22 nt, Human
ugcuguguguccuccaagauuc

SEQ ID NO: 713357 - RNA, 20 nt, Human
uggagaguuucuuuuguuua

SEQ ID NO: 713358 - RNA, 23 nt, Human
uggagcucagugaguaaaugugu

SEQ ID NO: 713359 - RNA, 19 nt, Human
ugggcaaaacuagaaaaca

SEQ ID NO: 713360 - RNA, 22 nt, Human
ugggcaaaacuagaaaacaagu

SEQ ID NO: 713361 - RNA, 21 nt, Human
ugucaugaaacuugcacacug

SEQ ID NO: 713362 - RNA, 21 nt, Human
ugucuuaccucucccaguaaa

SEQ ID NO: 713363 - RNA, 18 nt, Human
uuaaaagacagaccccca

SEQ ID NO: 713364 - RNA, 23 nt, Human
uuaaauaaaaauauaagugcauc

SEQ ID NO: 713365 - RNA, 24 nt, Human
uuacagauuuuaacuaguucaaag

SEQ ID NO: 713366 - RNA, 23 nt, Human
uucagcuugaaaaugaaucuuua

SEQ ID NO: 713367 - RNA, 23 nt, Human
uugaaggcugcugcuaaacuugu

SEQ ID NO: 713368 - RNA, 25 nt, Human
uugugggcaaaacuagaaaacaagu

SEQ ID NO: 713369 - RNA, 19 nt, Human
uuguuucccuuugaaaaag

SEQ ID NO: 713370 - RNA, 22 nt, Human
uuuaagaauccuguccaaacuc

SEQ ID NO: 713371 - RNA, 22 nt, Human
uuuaagccuucaacaacuuccu

SEQ ID NO: 713372 - RNA, 20 nt, Human
uuuuuuuuuuaaaggcaacc

SEQ ID NO: 713373 - RNA, 24 nt, Human
aaagugcugggauuacaggcguga

SEQ ID NO: 713374 - RNA, 23 nt, Human
aagccacaaauaccgaguucaaa

SEQ ID NO: 713375 - RNA, 19 nt, Human
aagugcugggauuacaggc

SEQ ID NO: 713376 - RNA, 19 nt, Human
aagugcugggauuacaggc

SEQ ID NO: 713377 - RNA, 26 nt, Human
aagugcugggauuacaggcgugagcc

SEQ ID NO: 713378 - RNA, 21 nt, Human
aauccggccaauccccggcag

SEQ ID NO: 713379 - RNA, 24 nt, Human
aauuuuuuauuuuuaguagagaug

SEQ ID NO: 713380 - RNA, 21 nt, Human
acaaccuccgccucuggguuc

SEQ ID NO: 713381 - RNA, 26 nt, Human
acccuacaggauacccugcacaggga

SEQ ID NO: 713382 - RNA, 22 nt, Human
accucagguuauccacccgccu

SEQ ID NO: 713383 - RNA, 24 nt, Human
agacagacaaauauuuuacaaggg

SEQ ID NO: 713384 - RNA, 25 nt, Human
agccacaaauaccgaguucaaaucu

SEQ ID NO: 713385 - RNA, 23 nt, Human
aggcgugagccacagugcccggc

SEQ ID NO: 713386 - RNA, 18 nt, Human
agguuauccacccgccuu

SEQ ID NO: 713387 - RNA, 18 nt, Human
aguagcugggauuacagg

SEQ ID NO: 713388 - RNA, 19 nt, Human
aguagcugggauuacaggc

SEQ ID NO: 713389 - RNA, 19 nt, Human
aguagcugggauuacaggc

SEQ ID NO: 713390 - RNA, 25 nt, Human
aguagcugggauuacaggcgcacgc

SEQ ID NO: 713391 - RNA, 24 nt, Human
agugcaauggugugauuucggcuc

SEQ ID NO: 713392 - RNA, 19 nt, Human
aucucaguuuuggggaauc

SEQ ID NO: 713393 - RNA, 21 nt, Human
augggguuucuccauguuggu

SEQ ID NO: 713394 - RNA, 24 nt, Human
auuccggcagucaggcugaaauga

SEQ ID NO: 713395 - RNA, 22 nt, Human
caaagaaagcggaaagggugaa

SEQ ID NO: 713396 - RNA, 20 nt, Human
caaagggccgccucugaguc

SEQ ID NO: 713397 - RNA, 19 nt, Human
caaagugcugggauuacag

SEQ ID NO: 713398 - RNA, 21 nt, Human
caaagugcugggauuacaggc

SEQ ID NO: 713399 - RNA, 21 nt, Human
caaagugcugggauuacaggc

SEQ ID NO: 713400 - RNA, 24 nt, Human
caaagugcugggauuacaggcgug

SEQ ID NO: 713401 - RNA, 25 nt, Human
cacagugcccggccuuuuuuuuuuu

SEQ ID NO: 713402 - RNA, 25 nt, Human
cacccccggcccgccugcgaauccu

SEQ ID NO: 713403 - RNA, 24 nt, Human
cacccgccuugguaucgcaaagug

SEQ ID NO: 713404 - RNA, 22 nt, Human
caggcgauucuccugccucagc

SEQ ID NO: 713405 - RNA, 18 nt, Human
cagucaggcugaaaugaa

SEQ ID NO: 713406 - RNA, 19 nt, Human
cauuagaaaacaaggagau

SEQ ID NO: 713407 - RNA, 21 nt, Human
ccacagugcccggccuuuuuu

SEQ ID NO: 713408 - RNA, 19 nt, Human
ccauguuggucaggcuggu

SEQ ID NO: 713409 - RNA, 22 nt, Human
ccauguuggucaggcuggucuc

SEQ ID NO: 713410 - RNA, 23 nt, Human
ccauguuggucaggcuggucucg

SEQ ID NO: 713411 - RNA, 22 nt, Human
cccccgcucccacccccggccc

SEQ ID NO: 713412 - RNA, 24 nt, Human
ccccggcccgccugcgaaucccuc

SEQ ID NO: 713413 - RNA, 21 nt, Human
ccggcccccgcucccaccccc

SEQ ID NO: 713414 - RNA, 22 nt, Human
ccggcccccgcucccacccccg

SEQ ID NO: 713415 - RNA, 21 nt, Human
ccuacaggcucacagggcugg

SEQ ID NO: 713416 - RNA, 23 nt, Human
ccucuggguucaggcgauucucc

SEQ ID NO: 713417 - RNA, 20 nt, Human
cggcccccgcucccaccccc

SEQ ID NO: 713418 - RNA, 21 nt, Human
cggguuccagguucucaaccu

SEQ ID NO: 713419 - RNA, 24 nt, Human
cuaauuuuuuauuuuuaguagaga

SEQ ID NO: 713420 - RNA, 23 nt, Human
cuacaaccuccgccucuggguuc

SEQ ID NO: 713421 - RNA, 24 nt, Human
cucagccucuugaguagcugggau

SEQ ID NO: 713422 - RNA, 24 nt, Human
cucagguuauccacccgccuuggu

SEQ ID NO: 713423 - RNA, 24 nt, Human
cuccauguuggucaggcuggucuc

SEQ ID NO: 713424 - RNA, 22 nt, Human
cuccugccucagccucuugagu

SEQ ID NO: 713425 - RNA, 22 nt, Human
cucugauuccggcagucaggcu

SEQ ID NO: 713426 - RNA, 24 nt, Human
cucuggguucaggcgauucuccug

SEQ ID NO: 713427 - RNA, 23 nt, Human
cugccucagccucuugaguagcu

SEQ ID NO: 713428 - RNA, 30 nt, Human
cugcgaaucccuccuuggccgcaagguccu

SEQ ID NO: 713429 - RNA, 23 nt, Human
cuugaguagcugggauuacaggc

SEQ ID NO: 713430 - RNA, 21 nt, Human
gaaaaggaaaaaacacgcgug

SEQ ID NO: 713431 - RNA, 24 nt, Human
gagaugggguuucuccauguuggu

SEQ ID NO: 713432 - RNA, 18 nt, Human
gauuacaggcgcacgcca

SEQ ID NO: 713433 - RNA, 18 nt, Human
gauuacaggcgugagcca

SEQ ID NO: 713434 - RNA, 19 nt, Human
gauuacaggcgugagccac

SEQ ID NO: 713435 - RNA, 24 nt, Human
gauuacaggcgugagccacagugc

SEQ ID NO: 713436 - RNA, 24 nt, Human
gcaaagugcugggauuacaggcgu

SEQ ID NO: 713437 - RNA, 23 nt, Human
gcacaacacgcaccaauuagcaa

SEQ ID NO: 713438 - RNA, 24 nt, Human
gcccaagcuggagugcaauggugu

SEQ ID NO: 713439 - RNA, 23 nt, Human
gccguauuucugcuggccagaga

SEQ ID NO: 713440 - RNA, 22 nt, Human
gcgauucuccugccucagccuc

SEQ ID NO: 713441 - RNA, 18 nt, Human
gcggccggccaaucacag

SEQ ID NO: 713442 - RNA, 23 nt, Human
gcucccacccccggcccgccugc

SEQ ID NO: 713443 - RNA, 19 nt, Human
ggaggacaggaacagacuu

SEQ ID NO: 713444 - RNA, 24 nt, Human
ggcgauucuccugccucagccucu

SEQ ID NO: 713445 - RNA, 19 nt, Human
gggaggacaggaacagacu

SEQ ID NO: 713446 - RNA, 18 nt, Human
gggguuucuccauguugg

SEQ ID NO: 713447 - RNA, 22 nt, Human
gggguuucuccauguuggucag

SEQ ID NO: 713448 - RNA, 19 nt, Human
ggguaauaaaaacagcuac

SEQ ID NO: 713449 - RNA, 20 nt, Human
ggguucaggcgauucuccug

SEQ ID NO: 713450 - RNA, 22 nt, Human
ggguuucuccauguuggucagg

SEQ ID NO: 713451 - RNA, 27 nt, Human
gguaauaaaaacagcuacagcgcaaga

SEQ ID NO: 713452 - RNA, 18 nt, Human
guagcugggauuacaggc

SEQ ID NO: 713453 - RNA, 18 nt, Human
gugaauuuucuugaaauc

SEQ ID NO: 713454 - RNA, 22 nt, Human
guugugaggcacagagaaaggg

SEQ ID NO: 713455 - RNA, 20 nt, Human
uaaaaaaaagagacagacaa

SEQ ID NO: 713456 - RNA, 25 nt, Human
uaaaaaaaagagacagacaaauauu

SEQ ID NO: 713457 - RNA, 22 nt, Human
uaauuuuuuauuuuuaguagag

SEQ ID NO: 713458 - RNA, 23 nt, Human
uaauuuuuuauuuuuaguagaga

SEQ ID NO: 713459 - RNA, 23 nt, Human
uacaggcgugagccacagugccc

SEQ ID NO: 713460 - RNA, 18 nt, Human
uagaaaacaaggagauug

SEQ ID NO: 713461 - RNA, 24 nt, Human
uaguagagaugggguuucuccaug

SEQ ID NO: 713462 - RNA, 24 nt, Human
uauucauuagaaaacaaggagauu

SEQ ID NO: 713463 - RNA, 19 nt, Human
ucacuacaaccuccgccuc

SEQ ID NO: 713464 - RNA, 23 nt, Human
ucacuacaaccuccgccucuggg

SEQ ID NO: 713465 - RNA, 23 nt, Human
ucacuacaaccuccgccucuggg

SEQ ID NO: 713466 - RNA, 26 nt, Human
ucacuacaaccuccgccucuggguuc

SEQ ID NO: 713467 - RNA, 20 nt, Human
ucagccucuugaguagcugg

SEQ ID NO: 713468 - RNA, 19 nt, Human
ucaggcgauucuccugccu

SEQ ID NO: 713469 - RNA, 19 nt, Human
ucaguuuuggggaaucuua

SEQ ID NO: 713470 - RNA, 22 nt, Human
uccaaaguugaagcagcucaac

SEQ ID NO: 713471 - RNA, 23 nt, Human
uccagcaagucacuucacuuuca

SEQ ID NO: 713472 - RNA, 23 nt, Human
ucccacccccggcccgccugcga

SEQ ID NO: 713473 - RNA, 22 nt, Human
uccccaguaguaaaauaggggu

SEQ ID NO: 713474 - RNA, 19 nt, Human
ucccccuuugcccagucgg

SEQ ID NO: 713475 - RNA, 25 nt, Human
uccccggcaggcagaggcaaagggc

SEQ ID NO: 713476 - RNA, 22 nt, Human
uccuacaggcucacagggcugg

SEQ ID NO: 713477 - RNA, 24 nt, Human
ucgcaaagugcugggauuacaggc

SEQ ID NO: 713478 - RNA, 23 nt, Human
ucgcuauuguugcccaagcugga

SEQ ID NO: 713479 - RNA, 25 nt, Human
ucucacccgcggcucugauuccggc

SEQ ID NO: 713480 - RNA, 24 nt, Human
ucuugaguagcugggauuacaggc

SEQ ID NO: 713481 - RNA, 23 nt, Human
ugcaauggugugauuucggcucc

SEQ ID NO: 713482 - RNA, 21 nt, Human
ugcccaagcuggagugcaaug

SEQ ID NO: 713483 - RNA, 24 nt, Human
ugccucagccucuugaguagcugg

SEQ ID NO: 713484 - RNA, 25 nt, Human
ugcugggauuacaggcgugagccac

SEQ ID NO: 713485 - RNA, 23 nt, Human
uggagugcaauggugugauuucg

SEQ ID NO: 713486 - RNA, 24 nt, Human
uggagugcaauggugugauuucgg

SEQ ID NO: 713487 - RNA, 19 nt, Human
ugggauuacaggcgcacca

SEQ ID NO: 713488 - RNA, 21 nt, Human
ugggauuacaggcgcacgcca

SEQ ID NO: 713489 - RNA, 18 nt, Human
ugggauuacaggcgugag

SEQ ID NO: 713490 - RNA, 19 nt, Human
ugggauuacaggcgugagc

SEQ ID NO: 713491 - RNA, 21 nt, Human
ugggauuacaggcgugagcca

SEQ ID NO: 713492 - RNA, 22 nt, Human
ugggauuacaggcgugagccac

SEQ ID NO: 713493 - RNA, 22 nt, Human
ugggauuacaggcgugagccac

SEQ ID NO: 713494 - RNA, 24 nt, Human
ugggauuacaggcgugagccacag

SEQ ID NO: 713495 - RNA, 26 nt, Human
ugggauuacaggcgugagccacagug

SEQ ID NO: 713496 - RNA, 27 nt, Human
ugggauuacaggcgugagccacagugc

SEQ ID NO: 713497 - RNA, 24 nt, Human
ugggguuucuccauguuggucagg

SEQ ID NO: 713498 - RNA, 24 nt, Human
uggguucaggcgauucuccugccu

SEQ ID NO: 713499 - RNA, 25 nt, Human
uggucaggcuggucucgaacucccu

SEQ ID NO: 713500 - RNA, 24 nt, Human
uggugugauuucggcucacuacaa

SEQ ID NO: 713501 - RNA, 20 nt, Human
uguugcccaagcuggagugc

SEQ ID NO: 713502 - RNA, 18 nt, Human
uuaguagagaugggguuu

SEQ ID NO: 713503 - RNA, 22 nt, Human
uuaguagagaugggguuucucc

SEQ ID NO: 713504 - RNA, 24 nt, Human
uuaguagagaugggguuucuccau

SEQ ID NO: 713505 - RNA, 18 nt, Human
uucaggcgauucuccugc

SEQ ID NO: 713506 - RNA, 21 nt, Human
uucaggcgauucuccugccuc

SEQ ID NO: 713507 - RNA, 23 nt, Human
uucaggcgauucuccugccucag

SEQ ID NO: 713508 - RNA, 23 nt, Human
uuccaggucacccuacaggauac

SEQ ID NO: 713509 - RNA, 24 nt, Human
uucgcuauuguugcccaagcugga

SEQ ID NO: 713510 - RNA, 18 nt, Human
uugcccaagcuggagugc

SEQ ID NO: 713511 - RNA, 23 nt, Human
uuguugcccaagcuggagugcaa

SEQ ID NO: 713512 - RNA, 24 nt, Human
uuuaaaaaaaagagacagacaaau

SEQ ID NO: 713513 - RNA, 21 nt, Human
uuucuccauguuggucaggcu

SEQ ID NO: 713514 - RNA, 19 nt, Human
uuuggaagcggguuccagg

SEQ ID NO: 713515 - RNA, 22 nt, Human
uuuuauuuuuaguagagauggg

SEQ ID NO: 713516 - RNA, 22 nt, Human
uuuuuaguagagaugggguuuc

SEQ ID NO: 713517 - RNA, 28 nt, Human
uuuuuuauuuuuaguagagaugggguuu

SEQ ID NO: 713518 - RNA, 21 nt, Human
aaaaagaaaaaaaagaaagaa

SEQ ID NO: 713519 - RNA, 19 nt, Human
aaacacacacaaagcaaca

SEQ ID NO: 713520 - RNA, 24 nt, Human
aaacgacagagagccacagcccag

SEQ ID NO: 713521 - RNA, 21 nt, Human
aaagugagcaaagaaggaaag

SEQ ID NO: 713522 - RNA, 20 nt, Human
aaaugccauuaguaauaaaa

SEQ ID NO: 713523 - RNA, 23 nt, Human
aacaagagcaaaacgguuagcaa

SEQ ID NO: 713524 - RNA, 23 nt, Human
aacaagauuuuuaaaaucccacu

SEQ ID NO: 713525 - RNA, 20 nt, Human
aacagcucuuuuauacauca

SEQ ID NO: 713526 - RNA, 19 nt, Human
aacauggugaaaccccguc

SEQ ID NO: 713527 - RNA, 20 nt, Human
aacauggugaaaccccgucu

SEQ ID NO: 713528 - RNA, 21 nt, Human
aacauggugaaaccccgucuc

SEQ ID NO: 713529 - RNA, 23 nt, Human
aacauuaaaaggcauucaaacag

SEQ ID NO: 713530 - RNA, 19 nt, Human
aagaggccccuacaucugc

SEQ ID NO: 713531 - RNA, 19 nt, Human
aagcaggguucauacugua

SEQ ID NO: 713532 - RNA, 21 nt, Human
aagccgaggugggcagaucac

SEQ ID NO: 713533 - RNA, 19 nt, Human
aaggaugagcauauggugg

SEQ ID NO: 713534 - RNA, 27 nt, Human
aaggauuuuguuuuacuucuuuauaga

SEQ ID NO: 713535 - RNA, 25 nt, Human
aagggccuucgccccuuacucccca

SEQ ID NO: 713536 - RNA, 24 nt, Human
aaucgcuugaacccgggaggcaga

SEQ ID NO: 713537 - RNA, 20 nt, Human
acaaaaauuagcugggugag

SEQ ID NO: 713538 - RNA, 20 nt, Human
acaaaagcgaaacuccgucu

SEQ ID NO: 713539 - RNA, 21 nt, Human
acaaaagcgaaacuccgucuc

SEQ ID NO: 713540 - RNA, 24 nt, Human
accacaaacgacagagagccacag

SEQ ID NO: 713541 - RNA, 20 nt, Human
accacaccuggggccucagc

SEQ ID NO: 713542 - RNA, 25 nt, Human
acccacaccugccuccccuccccac

SEQ ID NO: 713543 - RNA, 24 nt, Human
accccgucucuacugaaaauacaa

SEQ ID NO: 713544 - RNA, 20 nt, Human
accugccuccccuccccacc

SEQ ID NO: 713545 - RNA, 23 nt, Human
acuucucugacaacauggugcca

SEQ ID NO: 713546 - RNA, 27 nt, Human
agaaaaaaaagaaagaaaaugccagag

SEQ ID NO: 713547 - RNA, 21 nt, Human
agaagccaaggagcagaaagu

SEQ ID NO: 713548 - RNA, 23 nt, Human
agaagucaaacacacacaaagca

SEQ ID NO: 713549 - RNA, 19 nt, Human
agacacacacacaaagccc

SEQ ID NO: 713550 - RNA, 19 nt, Human
agacacacacacaaagccc

SEQ ID NO: 713551 - RNA, 24 nt, Human
agacacacacacaaagcccauccu

SEQ ID NO: 713552 - RNA, 18 nt, Human
agacagaauugcacaaau

SEQ ID NO: 713553 - RNA, 22 nt, Human
agagcugggggaggcugggggc

SEQ ID NO: 713554 - RNA, 23 nt, Human
agagcuugcagugagccgagauc

SEQ ID NO: 713555 - RNA, 22 nt, Human
agaucaccugaggucaggaguu

SEQ ID NO: 713556 - RNA, 18 nt, Human
agcaaaaccuccaaaugu

SEQ ID NO: 713557 - RNA, 24 nt, Human
agcacuuugggaagccgagguggg

SEQ ID NO: 713558 - RNA, 22 nt, Human
agccuggccaacauggugaaac

SEQ ID NO: 713559 - RNA, 24 nt, Human
agccuggccaacauggugaaaccc

SEQ ID NO: 713560 - RNA, 22 nt, Human
agcgaacauugugacauagguc

SEQ ID NO: 713561 - RNA, 23 nt, Human
agcugggugagguggugggugcc

SEQ ID NO: 713562 - RNA, 22 nt, Human
aggaaggguggagacccugggu

SEQ ID NO: 713563 - RNA, 24 nt, Human
aggaaggguggagacccuggguuu

SEQ ID NO: 713564 - RNA, 20 nt, Human
aggcaagaaagauguuuagu

SEQ ID NO: 713565 - RNA, 21 nt, Human
aggcagagcuugcagugagcc

SEQ ID NO: 713566 - RNA, 24 nt, Human
aggcagagcuugcagugagccgag

SEQ ID NO: 713567 - RNA, 22 nt, Human
aggcaggaaggaugagcauaug

SEQ ID NO: 713568 - RNA, 24 nt, Human
aggcaggagaaucgcuugaacccg

SEQ ID NO: 713569 - RNA, 20 nt, Human
aggcugaggcaggagaaucg

SEQ ID NO: 713570 - RNA, 24 nt, Human
aggcugaggcaggagaaucgcuug

SEQ ID NO: 713571 - RNA, 22 nt, Human
aggguacuggaugccugggccu

SEQ ID NO: 713572 - RNA, 21 nt, Human
aggucucuggcaccagggcuc

SEQ ID NO: 713573 - RNA, 22 nt, Human
aggugggcagaucaccugaggu

SEQ ID NO: 713574 - RNA, 26 nt, Human
aggugggcagaucaccugaggucagg

SEQ ID NO: 713575 - RNA, 21 nt, Human
agugaaggggggacggugggg

SEQ ID NO: 713576 - RNA, 23 nt, Human
agugaaggggggacgguggggag

SEQ ID NO: 713577 - RNA, 25 nt, Human
agugaaggggggacgguggggaggg

SEQ ID NO: 713578 - RNA, 19 nt, Human
aucccugcauccugcugcc

SEQ ID NO: 713579 - RNA, 21 nt, Human
auccugcugccauggaaaugg

SEQ ID NO: 713580 - RNA, 24 nt, Human
auccugucauuguacuccagcuug

SEQ ID NO: 713581 - RNA, 21 nt, Human
augcaaaauguuuucccuuga

SEQ ID NO: 713582 - RNA, 19 nt, Human
caaaaacacaaaucaaauc

SEQ ID NO: 713583 - RNA, 27 nt, Human
caaaaagaaaaaaaagaaagaaaaugc

SEQ ID NO: 713584 - RNA, 21 nt, Human
caaacacacacaaagcaacau

SEQ ID NO: 713585 - RNA, 24 nt, Human
caaagaaggaaagaaagggcaggc

SEQ ID NO: 713586 - RNA, 23 nt, Human
caaagcccauccuggauccuuuc

SEQ ID NO: 713587 - RNA, 22 nt, Human
caacagaacagccugucccucu

SEQ ID NO: 713588 - RNA, 24 nt, Human
caacauggugaaaccccgucucua

SEQ ID NO: 713589 - RNA, 23 nt, Human
caacauggugccaucuagaagcc

SEQ ID NO: 713590 - RNA, 18 nt, Human
caacgcagaacuccccag

SEQ ID NO: 713591 - RNA, 20 nt, Human
caagaucaaaguccaaaccc

SEQ ID NO: 713592 - RNA, 20 nt, Human
caagcccagccaaugacucc

SEQ ID NO: 713593 - RNA, 18 nt, Human
caauacaaaugaaaacaa

SEQ ID NO: 713594 - RNA, 21 nt, Human
cacacacaaagcaacauuuua

SEQ ID NO: 713595 - RNA, 19 nt, Human
cacacacacaaagcccauc

SEQ ID NO: 713596 - RNA, 26 nt, Human
cacaggaauaaguccguccacucaac

SEQ ID NO: 713597 - RNA, 18 nt, Human
caccaaagagagaaaaca

SEQ ID NO: 713598 - RNA, 22 nt, Human
caccaaagagagaaaacaacaa

SEQ ID NO: 713599 - RNA, 23 nt, Human
caccugaggucaggaguuugaga

SEQ ID NO: 713600 - RNA, 20 nt, Human
caccuguggcuuuuagaagu

SEQ ID NO: 713601 - RNA, 18 nt, Human
cacuggccacccacccug

SEQ ID NO: 713602 - RNA, 24 nt, Human
cacuggccacccacccugggcggc

SEQ ID NO: 713603 - RNA, 19 nt, Human
cagagauugaucugugggg

SEQ ID NO: 713604 - RNA, 24 nt, Human
cagaucaccugaggucaggaguuu

SEQ ID NO: 713605 - RNA, 18 nt, Human
cagauguugguuccucug

SEQ ID NO: 713606 - RNA, 25 nt, Human
cagcaccacaaacgacagagagcca

SEQ ID NO: 713607 - RNA, 21 nt, Human
cagcacuuugggaagccgagg

SEQ ID NO: 713608 - RNA, 24 nt, Human
cagcacuuugggaagccgaggugg

SEQ ID NO: 713609 - RNA, 19 nt, Human
cagcagcaauuucaggcag

SEQ ID NO: 713610 - RNA, 20 nt, Human
cagcagccaugguugucuaa

SEQ ID NO: 713611 - RNA, 24 nt, Human
cagcuacuugggaggcugaggcag

SEQ ID NO: 713612 - RNA, 24 nt, Human
caggaauaaguccguccacucaac

SEQ ID NO: 713613 - RNA, 22 nt, Human
caggccccuuuguuccuuuugg

SEQ ID NO: 713614 - RNA, 24 nt, Human
caggccuguaauuccagcacuuug

SEQ ID NO: 713615 - RNA, 19 nt, Human
caggcucuucccuagcccc

SEQ ID NO: 713616 - RNA, 18 nt, Human
caggugaagagugaggug

SEQ ID NO: 713617 - RNA, 24 nt, Human
cagguuccauccagaaagggaguc

SEQ ID NO: 713618 - RNA, 24 nt, Human
cagguuuuacuggggaaugauggc

SEQ ID NO: 713619 - RNA, 19 nt, Human
caguagacaccaucacagc

SEQ ID NO: 713620 - RNA, 24 nt, Human
caguagacaccaucacagcaccac

SEQ ID NO: 713621 - RNA, 20 nt, Human
cauaaacagagugcuucucu

SEQ ID NO: 713622 - RNA, 21 nt, Human
cauaaggaaaaucaacaugac

SEQ ID NO: 713623 - RNA, 19 nt, Human
cauaaucccuucauuuugu

SEQ ID NO: 713624 - RNA, 22 nt, Human
caucacagcaccacaaacgaca

SEQ ID NO: 713625 - RNA, 23 nt, Human
caugcaaaauguuuucccuugau

SEQ ID NO: 713626 - RNA, 18 nt, Human
cauuguacuccagcuugg

SEQ ID NO: 713627 - RNA, 19 nt, Human
cauuguacuccagcuuggg

SEQ ID NO: 713628 - RNA, 19 nt, Human
cauuguacuccagcuuggg

SEQ ID NO: 713629 - RNA, 19 nt, Human
cauuguacuccagcuuggg

SEQ ID NO: 713630 - RNA, 22 nt, Human
cauuguacuccagcuuggggga

SEQ ID NO: 713631 - RNA, 23 nt, Human
cauuguacuccagcuugggggac

SEQ ID NO: 713632 - RNA, 25 nt, Human
cauuguacuccagcuugggggacaa

SEQ ID NO: 713633 - RNA, 21 nt, Human
ccacaaacgacagagagccac

SEQ ID NO: 713634 - RNA, 19 nt, Human
ccacaccuggggccucagc

SEQ ID NO: 713635 - RNA, 23 nt, Human
ccagggcucccugcagagcuggg

SEQ ID NO: 713636 - RNA, 22 nt, Human
ccaucugccugugugcuauuuc

SEQ ID NO: 713637 - RNA, 18 nt, Human
ccccaggauuaaaggccu

SEQ ID NO: 713638 - RNA, 24 nt, Human
ccccuccccaccacaccuggggcc

SEQ ID NO: 713639 - RNA, 21 nt, Human
ccccuuuguuccuuuuggugu

SEQ ID NO: 713640 - RNA, 22 nt, Human
cccgcaguuugccgcccgcgcc

SEQ ID NO: 713641 - RNA, 18 nt, Human
cccucaggucaggcaccc

SEQ ID NO: 713642 - RNA, 20 nt, Human
cccucccacagguccugugu

SEQ ID NO: 713643 - RNA, 24 nt, Human
cccuccccaccacaccuggggccu

SEQ ID NO: 713644 - RNA, 18 nt, Human
ccgcccgcgccuccccgc

SEQ ID NO: 713645 - RNA, 23 nt, Human
ccuggccaacauggugaaacccc

SEQ ID NO: 713646 - RNA, 24 nt, Human
ccuggccaacauggugaaaccccg

SEQ ID NO: 713647 - RNA, 18 nt, Human
ccuguaaucccagcuacu

SEQ ID NO: 713648 - RNA, 19 nt, Human
ccuguaaucccagcuacuu

SEQ ID NO: 713649 - RNA, 21 nt, Human
ccuguaaucccagcuacuugg

SEQ ID NO: 713650 - RNA, 22 nt, Human
ccuguaauuccagcacuuuggg

SEQ ID NO: 713651 - RNA, 20 nt, Human
cgaggugggcagaucaccug

SEQ ID NO: 713652 - RNA, 24 nt, Human
cgaggugggcagaucaccugaggu

SEQ ID NO: 713653 - RNA, 26 nt, Human
cgaggugggcagaucaccugagguca

SEQ ID NO: 713654 - RNA, 23 nt, Human
cgcgcagcccgcacggcccgcac

SEQ ID NO: 713655 - RNA, 18 nt, Human
cgggugggguggcucagg

SEQ ID NO: 713656 - RNA, 19 nt, Human
cuagcccccagaguccucc

SEQ ID NO: 713657 - RNA, 24 nt, Human
cucaggccuguaauuccagcacuu

SEQ ID NO: 713658 - RNA, 22 nt, Human
cuccgcccgguacuggcugcgg

SEQ ID NO: 713659 - RNA, 20 nt, Human
cucugagaaauccagagggg

SEQ ID NO: 713660 - RNA, 26 nt, Human
cugagcucuagcccuggggaugcagc

SEQ ID NO: 713661 - RNA, 19 nt, Human
cugagggcucaagcccagc

SEQ ID NO: 713662 - RNA, 18 nt, Human
cugccccuggcuggcccc

SEQ ID NO: 713663 - RNA, 18 nt, Human
cuucgccccuuacucccc

SEQ ID NO: 713664 - RNA, 24 nt, Human
cuugcagugagccgagauccuguc

SEQ ID NO: 713665 - RNA, 20 nt, Human
cuuugcaaggugcugaccuc

SEQ ID NO: 713666 - RNA, 23 nt, Human
cuuugggaagccgaggugggcag

SEQ ID NO: 713667 - RNA, 18 nt, Human
gaaaaacacaaagagugc

SEQ ID NO: 713668 - RNA, 19 nt, Human
gaaaccccgucucuacuga

SEQ ID NO: 713669 - RNA, 18 nt, Human
gaaagggcaggcaugggg

SEQ ID NO: 713670 - RNA, 18 nt, Human
gaaauaaacaagcuuugg

SEQ ID NO: 713671 - RNA, 20 nt, Human
gaaaugcgaguuuauguauc

SEQ ID NO: 713672 - RNA, 23 nt, Human
gaacacaugccauaugcuucugg

SEQ ID NO: 713673 - RNA, 21 nt, Human
gaacagccugucccucuagaa

SEQ ID NO: 713674 - RNA, 20 nt, Human
gaacccgggaggcagagcuu

SEQ ID NO: 713675 - RNA, 21 nt, Human
gaaggggggacgguggggagg

SEQ ID NO: 713676 - RNA, 22 nt, Human
gaagucaaacacacacaaagca

SEQ ID NO: 713677 - RNA, 18 nt, Human
gaauaaucagauucuguc

SEQ ID NO: 713678 - RNA, 18 nt, Human
gacacacacacaaagccc

SEQ ID NO: 713679 - RNA, 21 nt, Human
gacuacacagcagagccagac

SEQ ID NO: 713680 - RNA, 19 nt, Human
gagaaaacaacaaaaggca

SEQ ID NO: 713681 - RNA, 23 nt, Human
gagaaucgcuugaacccgggagg

SEQ ID NO: 713682 - RNA, 21 nt, Human
gagacucuuccaacagaacag

SEQ ID NO: 713683 - RNA, 23 nt, Human
gagaguagccuggccaacauggu

SEQ ID NO: 713684 - RNA, 18 nt, Human
gagcuugcagugagccga

SEQ ID NO: 713685 - RNA, 24 nt, Human
gaucaccugaggucaggaguuuga

SEQ ID NO: 713686 - RNA, 18 nt, Human
gauuuauauauauacaca

SEQ ID NO: 713687 - RNA, 19 nt, Human
gcaaaaccuccaaaugugg

SEQ ID NO: 713688 - RNA, 21 nt, Human
gcaacaggacuuggaacugug

SEQ ID NO: 713689 - RNA, 20 nt, Human
gcagcagcaauuucaggcag

SEQ ID NO: 713690 - RNA, 21 nt, Human
gcaucuuugcaaggugcugac

SEQ ID NO: 713691 - RNA, 24 nt, Human
gccaacauggugaaaccccgucuc

SEQ ID NO: 713692 - RNA, 19 nt, Human
gccacacuucccggaggca

SEQ ID NO: 713693 - RNA, 19 nt, Human
gccacagguccacugggcu

SEQ ID NO: 713694 - RNA, 21 nt, Human
gcgcggcucugacgccuccgc

SEQ ID NO: 713695 - RNA, 21 nt, Human
gcggcucugacgccuccgccc

SEQ ID NO: 713696 - RNA, 24 nt, Human
gcucugacgccuccgcccgguacu

SEQ ID NO: 713697 - RNA, 20 nt, Human
ggacgguggggaggguuggg

SEQ ID NO: 713698 - RNA, 22 nt, Human
ggagaggaaaugucuucaggcc

SEQ ID NO: 713699 - RNA, 19 nt, Human
ggagucgcaggcauguucu

SEQ ID NO: 713700 - RNA, 25 nt, Human
ggcagaucaccugaggucaggaguu

SEQ ID NO: 713701 - RNA, 18 nt, Human
ggccagaggccagacggc

SEQ ID NO: 713702 - RNA, 23 nt, Human
ggccuguaauuccagcacuuugg

SEQ ID NO: 713703 - RNA, 21 nt, Human
ggcugggggcaugucagaguc

SEQ ID NO: 713704 - RNA, 22 nt, Human
gggagaaggucucuggcaccag

SEQ ID NO: 713705 - RNA, 20 nt, Human
gggaugcagccuuuccaaag

SEQ ID NO: 713706 - RNA, 18 nt, Human
gggcacagggccacaggc

SEQ ID NO: 713707 - RNA, 22 nt, Human
gggcagcagcaauuucaggcag

SEQ ID NO: 713708 - RNA, 20 nt, Human
gggcggcgguacagcagcca

SEQ ID NO: 713709 - RNA, 24 nt, Human
gggugggguggcucaggccuguaa

SEQ ID NO: 713710 - RNA, 23 nt, Human
gguggcucaggccuguaauucca

SEQ ID NO: 713711 - RNA, 24 nt, Human
gguggcucaggccuguaauuccag

SEQ ID NO: 713712 - RNA, 23 nt, Human
gguggugggugccuguaauccca

SEQ ID NO: 713713 - RNA, 24 nt, Human
gguggugggugccuguaaucccag

SEQ ID NO: 713714 - RNA, 22 nt, Human
gucauuguacuccagcuugggg

SEQ ID NO: 713715 - RNA, 18 nt, Human
guccucacuggccaccca

SEQ ID NO: 713716 - RNA, 22 nt, Human
guggggaugugcgcuacccaca

SEQ ID NO: 713717 - RNA, 18 nt, Human
uaaacagagugcuucucu

SEQ ID NO: 713718 - RNA, 23 nt, Human
uaagaaaauaggccggguggggu

SEQ ID NO: 713719 - RNA, 18 nt, Human
uaaggcaagaaagauguu

SEQ ID NO: 713720 - RNA, 21 nt, Human
uaaggccaguccucacuggcc

SEQ ID NO: 713721 - RNA, 18 nt, Human
uaauuuguaaaaugacuu

SEQ ID NO: 713722 - RNA, 27 nt, Human
uacagcagccaugguugucuaagggcc

SEQ ID NO: 713723 - RNA, 18 nt, Human
uacagcguucaaaaaguu

SEQ ID NO: 713724 - RNA, 19 nt, Human
uaccugggagagaagggau

SEQ ID NO: 713725 - RNA, 19 nt, Human
uacguggacaucuauggug

SEQ ID NO: 713726 - RNA, 23 nt, Human
uacguggacaucuauggugacug

SEQ ID NO: 713727 - RNA, 19 nt, Human
uacuccagcuugggggaca

SEQ ID NO: 713728 - RNA, 25 nt, Human
uacuccagcuugggggacaaaagcg

SEQ ID NO: 713729 - RNA, 23 nt, Human
uacugaaaauacaaaaauuagcu

SEQ ID NO: 713730 - RNA, 23 nt, Human
uagcccccagaguccuccagccu

SEQ ID NO: 713731 - RNA, 24 nt, Human
uagccuggccaacauggugaaacc

SEQ ID NO: 713732 - RNA, 19 nt, Human
uagcugggugagguggugg

SEQ ID NO: 713733 - RNA, 22 nt, Human
uagggagaaaugggagaagguc

SEQ ID NO: 713734 - RNA, 20 nt, Human
uaguaauaaaaacaguuguc

SEQ ID NO: 713735 - RNA, 20 nt, Human
uaucaaggaaaugcaacaau

SEQ ID NO: 713736 - RNA, 25 nt, Human
ucaaaaagaaaaaaaagaaagaaaa

SEQ ID NO: 713737 - RNA, 22 nt, Human
ucaaacacacacaaagcaacau

SEQ ID NO: 713738 - RNA, 23 nt, Human
ucacagcaccacaaacgacagag

SEQ ID NO: 713739 - RNA, 18 nt, Human
ucaccaccacuugucaaa

SEQ ID NO: 713740 - RNA, 19 nt, Human
ucaccugaggucaggaguu

SEQ ID NO: 713741 - RNA, 19 nt, Human
ucacggcguccagccugac

SEQ ID NO: 713742 - RNA, 21 nt, Human
ucacuggccacccacccuggg

SEQ ID NO: 713743 - RNA, 19 nt, Human
ucaggaacuggccugugcc

SEQ ID NO: 713744 - RNA, 19 nt, Human
ucaggcaggaaggaugagc

SEQ ID NO: 713745 - RNA, 22 nt, Human
ucaggccuguaauuccagcacu

SEQ ID NO: 713746 - RNA, 19 nt, Human
ucauaagggcuuagguuaa

SEQ ID NO: 713747 - RNA, 22 nt, Human
ucauuguacuccagcuuggggg

SEQ ID NO: 713748 - RNA, 24 nt, Human
ucauuguacuccagcuugggggac

SEQ ID NO: 713749 - RNA, 21 nt, Human
uccagaggggaggagaggaaa

SEQ ID NO: 713750 - RNA, 21 nt, Human
uccagccucugccaagaggcc

SEQ ID NO: 713751 - RNA, 21 nt, Human
uccagccugacacugugaagc

SEQ ID NO: 713752 - RNA, 22 nt, Human
uccauaugauuccagaguacaa

SEQ ID NO: 713753 - RNA, 20 nt, Human
uccccagacaugccuagucu

SEQ ID NO: 713754 - RNA, 22 nt, Human
uccccagacaugccuagucuac

SEQ ID NO: 713755 - RNA, 20 nt, Human
uccccaggauuaaaggccuc

SEQ ID NO: 713756 - RNA, 22 nt, Human
uccccgcgcccgcgcagcccgc

SEQ ID NO: 713757 - RNA, 22 nt, Human
uccgucucaaaaagaaaaaaaa

SEQ ID NO: 713758 - RNA, 24 nt, Human
uccuaaggacgggggugcuacugu

SEQ ID NO: 713759 - RNA, 20 nt, Human
uccucacuggccacccaccc

SEQ ID NO: 713760 - RNA, 18 nt, Human
uccugguguccugcugug

SEQ ID NO: 713761 - RNA, 18 nt, Human
ucgcuugaacccgggagg

SEQ ID NO: 713762 - RNA, 23 nt, Human
ucucuacugaaaauacaaaaauu

SEQ ID NO: 713763 - RNA, 20 nt, Human
ucucugagaaauccagaggg

SEQ ID NO: 713764 - RNA, 18 nt, Human
ucucuguggucccuaucu

SEQ ID NO: 713765 - RNA, 21 nt, Human
ucugagaaauccagaggggag

SEQ ID NO: 713766 - RNA, 19 nt, Human
ucuguuuugauuuuguuuc

SEQ ID NO: 713767 - RNA, 23 nt, Human
ugaaauuacaaaucaaacuuuuu

SEQ ID NO: 713768 - RNA, 19 nt, Human
ugaaggcacaaggauggcu

SEQ ID NO: 713769 - RNA, 20 nt, Human
ugagcaaagaaggaaagaaa

SEQ ID NO: 713770 - RNA, 24 nt, Human
ugaggcaggagaaucgcuugaacc

SEQ ID NO: 713771 - RNA, 25 nt, Human
ugaggcaggagaaucgcuugaaccc

SEQ ID NO: 713772 - RNA, 18 nt, Human
ugaggucaggaguuugag

SEQ ID NO: 713773 - RNA, 20 nt, Human
ugauuuucacuacucaguug

SEQ ID NO: 713774 - RNA, 19 nt, Human
ugcagccuuuccaaaggcu

SEQ ID NO: 713775 - RNA, 19 nt, Human
ugccauuaguaauaaaaac

SEQ ID NO: 713776 - RNA, 21 nt, Human
ugccauuaguaauaaaaacag

SEQ ID NO: 713777 - RNA, 22 nt, Human
ugccgcccgcgccuccccgcgc

SEQ ID NO: 713778 - RNA, 21 nt, Human
ugccuggugcacuucucacag

SEQ ID NO: 713779 - RNA, 24 nt, Human
ugccuguaaucccagcuacuuggg

SEQ ID NO: 713780 - RNA, 21 nt, Human
ugcgaugggcagcagcaauuu

SEQ ID NO: 713781 - RNA, 21 nt, Human
ugcuuuguaaaagcaccugug

SEQ ID NO: 713782 - RNA, 19 nt, Human
uggcaagaucaaaguccaa

SEQ ID NO: 713783 - RNA, 24 nt, Human
uggccaacauggugaaaccccguc

SEQ ID NO: 713784 - RNA, 24 nt, Human
uggcucaggccuguaauuccagca

SEQ ID NO: 713785 - RNA, 23 nt, Human
uggcuggggcuacagaugugcca

SEQ ID NO: 713786 - RNA, 20 nt, Human
ugggaagccgaggugggcag

SEQ ID NO: 713787 - RNA, 24 nt, Human
ugggaagccgaggugggcagauca

SEQ ID NO: 713788 - RNA, 20 nt, Human
ugggagagaagggaugaggc

SEQ ID NO: 713789 - RNA, 19 nt, Human
ugggaggcugaggcaggag

SEQ ID NO: 713790 - RNA, 23 nt, Human
ugggaggcugaggcaggagaauc

SEQ ID NO: 713791 - RNA, 24 nt, Human
ugggcagaucaccugaggucagga

SEQ ID NO: 713792 - RNA, 21 nt, Human
uggggaaugauggcaagauca

SEQ ID NO: 713793 - RNA, 24 nt, Human
ugggugagguggugggugccugua

SEQ ID NO: 713794 - RNA, 21 nt, Human
ugguggaauaauguguaugug

SEQ ID NO: 713795 - RNA, 22 nt, Human
uggugggugccuguaaucccag

SEQ ID NO: 713796 - RNA, 24 nt, Human
uggugggugccuguaaucccagcu

SEQ ID NO: 713797 - RNA, 19 nt, Human
uguaauauagcuacaauau

SEQ ID NO: 713798 - RNA, 21 nt, Human
uguacugacauuucaaaaaca

SEQ ID NO: 713799 - RNA, 18 nt, Human
uguagcuaccccucacug

SEQ ID NO: 713800 - RNA, 23 nt, Human
ugucauuguacuccagcuugggg

SEQ ID NO: 713801 - RNA, 21 nt, Human
uguccugugggccacugggca

SEQ ID NO: 713802 - RNA, 18 nt, Human
ugugaugggcaaauaacu

SEQ ID NO: 713803 - RNA, 23 nt, Human
ugugggccacugggcacagggcc

SEQ ID NO: 713804 - RNA, 25 nt, Human
ugugggcucaugcgaugggcagcag

SEQ ID NO: 713805 - RNA, 22 nt, Human
ugugugggcucaugcgaugggc

SEQ ID NO: 713806 - RNA, 19 nt, Human
uuaaacaucaagacggcau

SEQ ID NO: 713807 - RNA, 24 nt, Human
uuagcugggugagguggugggugc

SEQ ID NO: 713808 - RNA, 18 nt, Human
uucaagaaaggcauagga

SEQ ID NO: 713809 - RNA, 19 nt, Human
uugcagugagccgagaucc

SEQ ID NO: 713810 - RNA, 21 nt, Human
uugcagugagccgagaucccc

SEQ ID NO: 713811 - RNA, 21 nt, Human
uugcagugagccgagauccug

SEQ ID NO: 713812 - RNA, 22 nt, Human
uugcagugagccgagauccugu

SEQ ID NO: 713813 - RNA, 24 nt, Human
uugggaggcugaggcaggagaauc

SEQ ID NO: 713814 - RNA, 19 nt, Human
uuucaagaaaggcauagga

SEQ ID NO: 713815 - RNA, 22 nt, Human
uuucaggcaggaaggaugagca

SEQ ID NO: 713816 - RNA, 24 nt, Human
uuuccagcaaaaccuccaaaugug

SEQ ID NO: 713817 - RNA, 24 nt, Human
aaaaagaaaaagccauucuacaaa

SEQ ID NO: 713818 - RNA, 22 nt, Human
aaaauaacauuuucucaaaacu

SEQ ID NO: 713819 - RNA, 23 nt, Human
aaacagauguauacaguuaaaau

SEQ ID NO: 713820 - RNA, 20 nt, Human
aaacaucacauauguugagu

SEQ ID NO: 713821 - RNA, 22 nt, Human
aagaaaaagccauucuacaaaa

SEQ ID NO: 713822 - RNA, 22 nt, Human
aagcagaauuacaaugcaugua

SEQ ID NO: 713823 - RNA, 24 nt, Human
aaugccgcaacaagcuuccugcca

SEQ ID NO: 713824 - RNA, 18 nt, Human
accuauugucuuaagugg

SEQ ID NO: 713825 - RNA, 21 nt, Human
acuguaaaaauucuuccugga

SEQ ID NO: 713826 - RNA, 20 nt, Human
acuucaaaaaucagucaccc

SEQ ID NO: 713827 - RNA, 20 nt, Human
agaauuacaaugcauguaac

SEQ ID NO: 713828 - RNA, 19 nt, Human
agggaaggaagagaaucag

SEQ ID NO: 713829 - RNA, 20 nt, Human
aguauuguuacaaaccaguu

SEQ ID NO: 713830 - RNA, 18 nt, Human
aguuuuauucccacuccc

SEQ ID NO: 713831 - RNA, 22 nt, Human
aucugagggccauaaacaucac

SEQ ID NO: 713832 - RNA, 18 nt, Human
augggguuucuauuugca

SEQ ID NO: 713833 - RNA, 22 nt, Human
caaaagauaauucacauuugaa

SEQ ID NO: 713834 - RNA, 20 nt, Human
caacuaaauuaacaaaugaa

SEQ ID NO: 713835 - RNA, 19 nt, Human
caagauauuugaagacuua

SEQ ID NO: 713836 - RNA, 22 nt, Human
cagggaaggaagagaaucagaa

SEQ ID NO: 713837 - RNA, 22 nt, Human
caguaaaaauaacauuuucuca

SEQ ID NO: 713838 - RNA, 24 nt, Human
caguagaaaugggguuucuauuug

SEQ ID NO: 713839 - RNA, 24 nt, Human
cauuugaaaaauuaucuaccugaa

SEQ ID NO: 713840 - RNA, 19 nt, Human
ccauucuacaaaaacugca

SEQ ID NO: 713841 - RNA, 23 nt, Human
ccugugacaaaaggaaccggggc

SEQ ID NO: 713842 - RNA, 20 nt, Human
cgaggaaaaccauagagcua

SEQ ID NO: 713843 - RNA, 24 nt, Human
cuaacuggaaaaaacauuuugcuu

SEQ ID NO: 713844 - RNA, 21 nt, Human
cucccuauuacauaauuucuc

SEQ ID NO: 713845 - RNA, 24 nt, Human
cugaaagguacacauacacaccua

SEQ ID NO: 713846 - RNA, 18 nt, Human
cuuacaaucacccuagcc

SEQ ID NO: 713847 - RNA, 18 nt, Human
cuucaaaaaucagucacc

SEQ ID NO: 713848 - RNA, 19 nt, Human
cuugcaaacaguaaaauuu

SEQ ID NO: 713849 - RNA, 18 nt, Human
gaaaaagccauucuacaa

SEQ ID NO: 713850 - RNA, 19 nt, Human
gaaaaagguaacauccaca

SEQ ID NO: 713851 - RNA, 24 nt, Human
gaaaaagguaacauccacaaugac

SEQ ID NO: 713852 - RNA, 21 nt, Human
gaauagaacucuuaagaggaa

SEQ ID NO: 713853 - RNA, 23 nt, Human
gcuguguuucucuauuuuuacua

SEQ ID NO: 713854 - RNA, 24 nt, Human
ggaaucacauccauguugcuuuca

SEQ ID NO: 713855 - RNA, 22 nt, Human
gggaaaaagguuagaucaaugc

SEQ ID NO: 713856 - RNA, 18 nt, Human
guaagcaaauauccuuac

SEQ ID NO: 713857 - RNA, 22 nt, Human
gugggugcaaguucugcucugu

SEQ ID NO: 713858 - RNA, 24 nt, Human
uaaaauauaaccugcccacaggaa

SEQ ID NO: 713859 - RNA, 18 nt, Human
uaaacaucacauauguug

SEQ ID NO: 713860 - RNA, 24 nt, Human
uaacacacacacacaacuaaauua

SEQ ID NO: 713861 - RNA, 22 nt, Human
uaacagaauaaaaguaaccaaa

SEQ ID NO: 713862 - RNA, 20 nt, Human
uaaccaaagguuaaagcaau

SEQ ID NO: 713863 - RNA, 24 nt, Human
uaagaugaaagagcaauacacuua

SEQ ID NO: 713864 - RNA, 18 nt, Human
uaagcaaauauccuuacc

SEQ ID NO: 713865 - RNA, 22 nt, Human
uaagcaaauauccuuaccaaga

SEQ ID NO: 713866 - RNA, 18 nt, Human
uaaguaguuuuauuccca

SEQ ID NO: 713867 - RNA, 24 nt, Human
uacaaaaacugcaacugaaauggg

SEQ ID NO: 713868 - RNA, 18 nt, Human
uacaauaaaagggucaug

SEQ ID NO: 713869 - RNA, 23 nt, Human
uacaguuuuucuucuguuuaaaa

SEQ ID NO: 713870 - RNA, 20 nt, Human
uaccugugacaaaaggaaca

SEQ ID NO: 713871 - RNA, 20 nt, Human
uacucuuucuucaauucugu

SEQ ID NO: 713872 - RNA, 24 nt, Human
uauacaucacacugaguaagaauc

SEQ ID NO: 713873 - RNA, 23 nt, Human
uauacuucaaaaaucagucaccc

SEQ ID NO: 713874 - RNA, 19 nt, Human
uauuacagaguucuuacaa

SEQ ID NO: 713875 - RNA, 24 nt, Human
uauuacagaguucuuacaaucacc

SEQ ID NO: 713876 - RNA, 20 nt, Human
ucaaaaaucagucacccuac

SEQ ID NO: 713877 - RNA, 24 nt, Human
ucaaauuaaacagauguauacagu

SEQ ID NO: 713878 - RNA, 18 nt, Human
ucacuuccgaucuggggc

SEQ ID NO: 713879 - RNA, 19 nt, Human
ucaguagaaaugggguuuc

SEQ ID NO: 713880 - RNA, 25 nt, Human
ucauggccuucuuaaacagcuuucu

SEQ ID NO: 713881 - RNA, 20 nt, Human
ucauuuuuauugccccucuc

SEQ ID NO: 713882 - RNA, 23 nt, Human
ucgaauuccugacacgccgaauc

SEQ ID NO: 713883 - RNA, 21 nt, Human
ucuccgucacuuccgaucugg

SEQ ID NO: 713884 - RNA, 18 nt, Human
ucuucuguuuaaaacuag

SEQ ID NO: 713885 - RNA, 21 nt, Human
ucuuuauaggccacugcuuuu

SEQ ID NO: 713886 - RNA, 20 nt, Human
ucuuugagauacuguaaaaa

SEQ ID NO: 713887 - RNA, 22 nt, Human
ucuuugagauacuguaaaaauu

SEQ ID NO: 713888 - RNA, 23 nt, Human
ugaaagguacacauacacaccua

SEQ ID NO: 713889 - RNA, 19 nt, Human
ugaccauaucuuauagacu

SEQ ID NO: 713890 - RNA, 23 nt, Human
ugagaaauuaaacucuaaauucg

SEQ ID NO: 713891 - RNA, 19 nt, Human
uggcagguauuuccucugc

SEQ ID NO: 713892 - RNA, 21 nt, Human
uggugggugcaaguucugcuc

SEQ ID NO: 713893 - RNA, 25 nt, Human
uggugggugcaaguucugcucuguu

SEQ ID NO: 713894 - RNA, 23 nt, Human
uguaagcaaauauccuuaccaag

SEQ ID NO: 713895 - RNA, 19 nt, Human
uguuucucuauuuuuacua

SEQ ID NO: 713896 - RNA, 21 nt, Human
uuaacacacacacacaacuaa

SEQ ID NO: 713897 - RNA, 22 nt, Human
uucacacguaaauaaguauuau

SEQ ID NO: 713898 - RNA, 22 nt, Human
uugcaaccacacagcggccauu

SEQ ID NO: 713899 - RNA, 20 nt, Human
uuggcaaagcuuuuuuuuuu

SEQ ID NO: 713900 - RNA, 19 nt, Human
uuguuuccaacaguucuua

SEQ ID NO: 713901 - RNA, 24 nt, Human
uuuaacagaauaaaaguaaccaaa

SEQ ID NO: 713902 - RNA, 24 nt, Human
uuucuucuguuuaaaacuaggaug

SEQ ID NO: 713903 - RNA, 18 nt, Human
aaugcuggaaaggaagga

SEQ ID NO: 713904 - RNA, 21 nt, Human
accacagaauuaccaaaacug

SEQ ID NO: 713905 - RNA, 24 nt, Human
accacagaauuaccaaaacugcaa

SEQ ID NO: 713906 - RNA, 19 nt, Human
accugagcacagaagacuc

SEQ ID NO: 713907 - RNA, 23 nt, Human
agcagggaagcgccgucuuccag

SEQ ID NO: 713908 - RNA, 19 nt, Human
agccggcagcgggggcggc

SEQ ID NO: 713909 - RNA, 22 nt, Human
aggcugcagaguggcgacgucu

SEQ ID NO: 713910 - RNA, 18 nt, Human
aggggggugacaggaggu

SEQ ID NO: 713911 - RNA, 24 nt, Human
aguggccuauugcccgccuccaug

SEQ ID NO: 713912 - RNA, 23 nt, Human
aguggugcugagcauccacgcaa

SEQ ID NO: 713913 - RNA, 18 nt, Human
auaaaaauaacgucagug

SEQ ID NO: 713914 - RNA, 23 nt, Human
auaaauagaccacagaauuacca

SEQ ID NO: 713915 - RNA, 21 nt, Human
cacagaagacucggcucccca

SEQ ID NO: 713916 - RNA, 20 nt, Human
cacagaauuaccaaaacugc

SEQ ID NO: 713917 - RNA, 20 nt, Human
cagcaccccugccagccagg

SEQ ID NO: 713918 - RNA, 22 nt, Human
cagccagcagcaccccugccag

SEQ ID NO: 713919 - RNA, 21 nt, Human
caggucuagagauaugacccg

SEQ ID NO: 713920 - RNA, 22 nt, Human
caggucuagagauaugacccga

SEQ ID NO: 713921 - RNA, 21 nt, Human
cagugcuguggggaaugcugg

SEQ ID NO: 713922 - RNA, 19 nt, Human
caguggcccucuucucauc

SEQ ID NO: 713923 - RNA, 23 nt, Human
ccaugccugcuguugaccucuuc

SEQ ID NO: 713924 - RNA, 18 nt, Human
ccccggggccuggggcuc

SEQ ID NO: 713925 - RNA, 25 nt, Human
cccucugcugggcugccgccucucc

SEQ ID NO: 713926 - RNA, 18 nt, Human
ccgcugaguggaucggug

SEQ ID NO: 713927 - RNA, 18 nt, Human
cgcccccggacccggagc

SEQ ID NO: 713928 - RNA, 22 nt, Human
cgccccggccuccgugaagccc

SEQ ID NO: 713929 - RNA, 23 nt, Human
cgggggcggcuguaacugugagg

SEQ ID NO: 713930 - RNA, 18 nt, Human
cgugaccgcucgcccccg

SEQ ID NO: 713931 - RNA, 23 nt, Human
cgugcauagagcccucugcuggg

SEQ ID NO: 713932 - RNA, 21 nt, Human
cuccauggucaugccuuugcu

SEQ ID NO: 713933 - RNA, 28 nt, Human
cuccccaugccugcuguugaccucuuca

SEQ ID NO: 713934 - RNA, 21 nt, Human
cucguggugcgccguggcccu

SEQ ID NO: 713935 - RNA, 23 nt, Human
cugcugggaacccguucuuugag

SEQ ID NO: 713936 - RNA, 23 nt, Human
cugggcugccgccucuccccugg

SEQ ID NO: 713937 - RNA, 23 nt, Human
cuguggggaaugcuggaaaggaa

SEQ ID NO: 713938 - RNA, 18 nt, Human
gaauuaccaaaacugcaa

SEQ ID NO: 713939 - RNA, 22 nt, Human
gacccggagcgugggcggggau

SEQ ID NO: 713940 - RNA, 22 nt, Human
gagcgugggcggggauuucguc

SEQ ID NO: 713941 - RNA, 19 nt, Human
gcagugcuguggggaaugc

SEQ ID NO: 713942 - RNA, 18 nt, Human
gcccuagcagccagcagc

SEQ ID NO: 713943 - RNA, 22 nt, Human
gcuggagucguggcuacuccgg

SEQ ID NO: 713944 - RNA, 19 nt, Human
ggacccggagcgugggcgg

SEQ ID NO: 713945 - RNA, 18 nt, Human
ggagaagguugcuggccg

SEQ ID NO: 713946 - RNA, 24 nt, Human
gggaccggcugcuacagcagggaa

SEQ ID NO: 713947 - RNA, 18 nt, Human
gggcggggauuucgucac

SEQ ID NO: 713948 - RNA, 18 nt, Human
gggugguggcuggagucg

SEQ ID NO: 713949 - RNA, 20 nt, Human
gguaggugggcagaacagca

SEQ ID NO: 713950 - RNA, 18 nt, Human
ggucaugccuuugcuugg

SEQ ID NO: 713951 - RNA, 19 nt, Human
gguuggaggcugugggggg

SEQ ID NO: 713952 - RNA, 24 nt, Human
gguuggaggcugugggggguggcc

SEQ ID NO: 713953 - RNA, 19 nt, Human
gucaugaaggagcggugcc

SEQ ID NO: 713954 - RNA, 18 nt, Human
guggcagccacuggcaug

SEQ ID NO: 713955 - RNA, 22 nt, Human
uaaauagaccacagaauuacca

SEQ ID NO: 713956 - RNA, 21 nt, Human
uaaauagaccacagaauuacu

SEQ ID NO: 713957 - RNA, 21 nt, Human
uaacgucagugggugguggcu

SEQ ID NO: 713958 - RNA, 18 nt, Human
uacuccgggaggggggug

SEQ ID NO: 713959 - RNA, 18 nt, Human
ucaguguuggcgcucggc

SEQ ID NO: 713960 - RNA, 22 nt, Human
uccacgcaaccguaugggaccg

SEQ ID NO: 713961 - RNA, 21 nt, Human
ucccaggccgcagaagugacc

SEQ ID NO: 713962 - RNA, 22 nt, Human
ucccuccucgcugcuggagaac

SEQ ID NO: 713963 - RNA, 23 nt, Human
ucccucugcuugacggggcugag

SEQ ID NO: 713964 - RNA, 26 nt, Human
ucccucugcuugacggggcugagggg

SEQ ID NO: 713965 - RNA, 23 nt, Human
ucuuugagcguuuuggcauugug

SEQ ID NO: 713966 - RNA, 22 nt, Human
ugaccugcgguggaguucccuc

SEQ ID NO: 713967 - RNA, 21 nt, Human
ugccagacugcugggaacccg

SEQ ID NO: 713968 - RNA, 23 nt, Human
ugccugcuguugaccucuucauc

SEQ ID NO: 713969 - RNA, 21 nt, Human
ugcuggccgggugaaagugcc

SEQ ID NO: 713970 - RNA, 23 nt, Human
ugcugggaacccguucuuugagc

SEQ ID NO: 713971 - RNA, 22 nt, Human
uggaaaacagguuugaaacccg

SEQ ID NO: 713972 - RNA, 19 nt, Human
uggcaguggcccucuucuc

SEQ ID NO: 713973 - RNA, 23 nt, Human
uggcauugugguggcagccacug

SEQ ID NO: 713974 - RNA, 18 nt, Human
uggccgggugaaagugcc

SEQ ID NO: 713975 - RNA, 21 nt, Human
ugggugguggcuggagucgug

SEQ ID NO: 713976 - RNA, 19 nt, Human
uggugcgccguggcccucg

SEQ ID NO: 713977 - RNA, 21 nt, Human
uguaacugugaggaaggcugc

SEQ ID NO: 713978 - RNA, 18 nt, Human
ugugaggaaggcugcaga

SEQ ID NO: 713979 - RNA, 19 nt, Human
uguggaaaacagguuugaa

SEQ ID NO: 713980 - RNA, 22 nt, Human
uugacggggcugaggggcccga

SEQ ID NO: 713981 - RNA, 25 nt, Human
uuucgucacgugacguugccgcggg

SEQ ID NO: 713982 - RNA, 20 nt, Human
uuugcaguggugcugagcau

SEQ ID NO: 713983 - RNA, 25 nt, Human
aaaacaaacaaacaaacaaaaaaca

SEQ ID NO: 713984 - RNA, 22 nt, Human
aaacaaacaaaaaacaaccugu

SEQ ID NO: 713985 - RNA, 25 nt, Human
aaacaaccuguggcuuccaaauccc

SEQ ID NO: 713986 - RNA, 24 nt, Human
aaauaggagguaggacaccaugag

SEQ ID NO: 713987 - RNA, 24 nt, Human
aaauggccauuaaaaaaacaaaca

SEQ ID NO: 713988 - RNA, 23 nt, Human
aacaaacaaacaaacaaaaaaca

SEQ ID NO: 713989 - RNA, 24 nt, Human
acaaaaaacaaccuguggcuucca

SEQ ID NO: 713990 - RNA, 19 nt, Human
acaaacaaaaaacaaccug

SEQ ID NO: 713991 - RNA, 22 nt, Human
acaaacaaacaaacaaaaaacc

SEQ ID NO: 713992 - RNA, 20 nt, Human
acccucaaaucuacucacuc

SEQ ID NO: 713993 - RNA, 18 nt, Human
agaaaucuuguauccccu

SEQ ID NO: 713994 - RNA, 18 nt, Human
aggacaccaugaguggca

SEQ ID NO: 713995 - RNA, 21 nt, Human
auuaaaaaaacaaacaaacaa

SEQ ID NO: 713996 - RNA, 18 nt, Human
auuuauucauaaagauuu

SEQ ID NO: 713997 - RNA, 30 nt, Human
caaaaaacaaccuguggcuuccaaaucccu

SEQ ID NO: 713998 - RNA, 26 nt, Human
caagcaucccuucaaguuccugaccc

SEQ ID NO: 713999 - RNA, 21 nt, Human
caucugagcaugaaacuagcu

SEQ ID NO: 714000 - RNA, 21 nt, Human
caugaaacuagcuaauuuuaa

SEQ ID NO: 714001 - RNA, 24 nt, Human
ccaaaguaagaaucucaguaagaa

SEQ ID NO: 714002 - RNA, 22 nt, Human
ccaaagucaaagcuaaagaugc

SEQ ID NO: 714003 - RNA, 23 nt, Human
ccaggagagaagaaaauguuuua

SEQ ID NO: 714004 - RNA, 24 nt, Human
cccucaaaucuacucacuccaagc

SEQ ID NO: 714005 - RNA, 25 nt, Human
ccugaccccaaaguaagaaucucag

SEQ ID NO: 714006 - RNA, 18 nt, Human
cuggucccacccauguuc

SEQ ID NO: 714007 - RNA, 21 nt, Human
cuucuaauucguggucuggga

SEQ ID NO: 714008 - RNA, 23 nt, Human
gacaucugagcaugaaacuagcu

SEQ ID NO: 714009 - RNA, 24 nt, Human
gagcaauaacugcaacaaccccgg

SEQ ID NO: 714010 - RNA, 24 nt, Human
gccauuaaaaaaacaaacaaacaa

SEQ ID NO: 714011 - RNA, 19 nt, Human
gggagggaaaaggguagug

SEQ ID NO: 714012 - RNA, 19 nt, Human
guacagagacuugcccaaa

SEQ ID NO: 714013 - RNA, 26 nt, Human
uaaaauggccauuaaaaaaacaaaca

SEQ ID NO: 714014 - RNA, 18 nt, Human
uaacugcaacagucuggc

SEQ ID NO: 714015 - RNA, 22 nt, Human
uaucacagaggucaagccgaag

SEQ ID NO: 714016 - RNA, 23 nt, Human
uauuuauuuaucacagaggucag

SEQ ID NO: 714017 - RNA, 24 nt, Human
ucauaaagauuucuggucccaccc

SEQ ID NO: 714018 - RNA, 19 nt, Human
uccaaauaggagguaggac

SEQ ID NO: 714019 - RNA, 26 nt, Human
uccaaaucccuuaucuuuucauuuau

SEQ ID NO: 714020 - RNA, 27 nt, Human
uccaaaucccuuaucuuuucauuuauu

SEQ ID NO: 714021 - RNA, 26 nt, Human
ucccuuaucuuuucauuuauucauaa

SEQ ID NO: 714022 - RNA, 21 nt, Human
uccugaccccaaaguaagaau

SEQ ID NO: 714023 - RNA, 21 nt, Human
ucuacucacuccaagcauccc

SEQ ID NO: 714024 - RNA, 18 nt, Human
ucuuccacauaucuucua

SEQ ID NO: 714025 - RNA, 20 nt, Human
ugcauguaagaaaucuugua

SEQ ID NO: 714026 - RNA, 22 nt, Human
uggccauuaaaaaaacaaacaa

SEQ ID NO: 714027 - RNA, 20 nt, Human
ugggagggaaaaggguagug

SEQ ID NO: 714028 - RNA, 22 nt, Human
uuaaaaaaacaaacaaacaaac

SEQ ID NO: 714029 - RNA, 23 nt, Human
uuguaucaauauaccccaauccu

SEQ ID NO: 714030 - RNA, 21 nt, Human
uuuaaaauggccauuuaauac

SEQ ID NO: 714031 - RNA, 23 nt, Human
aaaaauucuucauucaaucugcu

SEQ ID NO: 714032 - RNA, 21 nt, Human
aaaacagccuuuuugguucuu

SEQ ID NO: 714033 - RNA, 23 nt, Human
aaaauucuucauucaaucugcuu

SEQ ID NO: 714034 - RNA, 22 nt, Human
aaacagccuuuuugguucuuua

SEQ ID NO: 714035 - RNA, 18 nt, Human
aaaccaaaacaaaacaaa

SEQ ID NO: 714036 - RNA, 22 nt, Human
aaagucccauggcaaucaccaa

SEQ ID NO: 714037 - RNA, 24 nt, Human
aauuacagcagaaaaacaaaaaca

SEQ ID NO: 714038 - RNA, 22 nt, Human
acaaaacaaauacuguauaaaa

SEQ ID NO: 714039 - RNA, 21 nt, Human
accccggaacacuuccguacc

SEQ ID NO: 714040 - RNA, 21 nt, Human
accggggcaguuccaggccgg

SEQ ID NO: 714041 - RNA, 23 nt, Human
agcagaaaaacaaaaacauuuuc

SEQ ID NO: 714042 - RNA, 19 nt, Human
aggaaaagaaaguauaaaa

SEQ ID NO: 714043 - RNA, 19 nt, Human
aggaaaccauagagcaguc

SEQ ID NO: 714044 - RNA, 19 nt, Human
agggauaaacacggaagga

SEQ ID NO: 714045 - RNA, 23 nt, Human
auacauuccaguuaccuuugauu

SEQ ID NO: 714046 - RNA, 19 nt, Human
auaguauaauagcaguguu

SEQ ID NO: 714047 - RNA, 24 nt, Human
auauaauggaaauaaaguuuuauc

SEQ ID NO: 714048 - RNA, 21 nt, Human
aucccaacaucaccuaucugc

SEQ ID NO: 714049 - RNA, 23 nt, Human
auguaugcuuuuuuuuuucuugg

SEQ ID NO: 714050 - RNA, 19 nt, Human
auucagcccuauuccaguc

SEQ ID NO: 714051 - RNA, 21 nt, Human
caaaaccaaaacaaaacaaau

SEQ ID NO: 714052 - RNA, 22 nt, Human
caacaucaccuaucugcacagc

SEQ ID NO: 714053 - RNA, 20 nt, Human
cacccaaaaaaaaaauaaaa

SEQ ID NO: 714054 - RNA, 23 nt, Human
caccuaucugcacagcuaaaaau

SEQ ID NO: 714055 - RNA, 19 nt, Human
cagcagaaaaacaaaaaca

SEQ ID NO: 714056 - RNA, 19 nt, Human
cauuauauacacucaaaac

SEQ ID NO: 714057 - RNA, 21 nt, Human
ccaaaacaaaacaaauacugu

SEQ ID NO: 714058 - RNA, 20 nt, Human
ccacggaccccggaacacuu

SEQ ID NO: 714059 - RNA, 18 nt, Human
ccauaaucacauauguau

SEQ ID NO: 714060 - RNA, 23 nt, Human
cccauggcaaucaccaauugcuu

SEQ ID NO: 714061 - RNA, 22 nt, Human
ccccggaacacuuccguaccgg

SEQ ID NO: 714062 - RNA, 26 nt, Human
ccgcgcgggacgguccgccgccuccc

SEQ ID NO: 714063 - RNA, 18 nt, Human
ccggggcaguuccaggcc

SEQ ID NO: 714064 - RNA, 20 nt, Human
ccucccucuccugcucccca

SEQ ID NO: 714065 - RNA, 25 nt, Human
cuaucugcacagcuaaaaauucuuc

SEQ ID NO: 714066 - RNA, 18 nt, Human
cucuugccuggcccucug

SEQ ID NO: 714067 - RNA, 18 nt, Human
gauucaaacacauuuauu

SEQ ID NO: 714068 - RNA, 22 nt, Human
gccucccucuccugcuccccac

SEQ ID NO: 714069 - RNA, 21 nt, Human
gcgggacgguccgccgccucc

SEQ ID NO: 714070 - RNA, 22 nt, Human
ggaacagacccaauuaugacag

SEQ ID NO: 714071 - RNA, 22 nt, Human
uacacucaaaaccaaaacaaaa

SEQ ID NO: 714072 - RNA, 19 nt, Human
uacagcagaaaaacaaaaa

SEQ ID NO: 714073 - RNA, 22 nt, Human
uaccggggcaguuccaggccgg

SEQ ID NO: 714074 - RNA, 19 nt, Human
uauaaaauuagagauucaa

SEQ ID NO: 714075 - RNA, 22 nt, Human
uauaauagcaguguugcuggaa

SEQ ID NO: 714076 - RNA, 23 nt, Human
uauccucacuggaaaaaaaugau

SEQ ID NO: 714077 - RNA, 21 nt, Human
ucaaaaccaaaacaaaacaaa

SEQ ID NO: 714078 - RNA, 23 nt, Human
ucagcccuauuccagucuuccca

SEQ ID NO: 714079 - RNA, 24 nt, Human
ucagcccuauuccagucuucccac

SEQ ID NO: 714080 - RNA, 18 nt, Human
uccagggacagaaaaauc

SEQ ID NO: 714081 - RNA, 23 nt, Human
ucccauggcaaucaccaauugcu

SEQ ID NO: 714082 - RNA, 23 nt, Human
uccguaccggggcaguuccaggc

SEQ ID NO: 714083 - RNA, 20 nt, Human
ugauuucauauauggacucc

SEQ ID NO: 714084 - RNA, 23 nt, Human
ugcagaauuacagcagaaaaaca

SEQ ID NO: 714085 - RNA, 29 nt, Human
ugcagacacccaaaaaaaaaagggagucc

SEQ ID NO: 714086 - RNA, 22 nt, Human
ugccuggcccucugaaauacug

SEQ ID NO: 714087 - RNA, 19 nt, Human
ugcuuuuuuuuuucuugga

SEQ ID NO: 714088 - RNA, 19 nt, Human
ugggaaaagucccauggca

SEQ ID NO: 714089 - RNA, 21 nt, Human
ugguaguaaaaggaacagacc

SEQ ID NO: 714090 - RNA, 21 nt, Human
uuaaauggacucuucaguuga

SEQ ID NO: 714091 - RNA, 24 nt, Human
uuccuaguucugcacaggauaauu

SEQ ID NO: 714092 - RNA, 26 nt, Human
uugccaaguuaaucacugcaaauugu

SEQ ID NO: 714093 - RNA, 23 nt, Human
uuggaaccauauugcuaaugcug

SEQ ID NO: 714094 - RNA, 19 nt, Human
uuuaacuccucuauuggaa

SEQ ID NO: 714095 - RNA, 18 nt, Human
uuugucauuaaaucaaua

SEQ ID NO: 714096 - RNA, 24 nt, Human
uuuuccaucccaacaucaccuauc

SEQ ID NO: 714097 - RNA, 21 nt, Human
uuuugaaaaauauucccagcu

SEQ ID NO: 714098 - RNA, 22 nt, Human
uuuuuuucuuuuaaaggaaacc

SEQ ID NO: 714099 - RNA, 24 nt, Human
uuuuuuuuucuuggacaaaaauau

SEQ ID NO: 714100 - RNA, 23 nt, Human
aaagggagugaggucuccagagg

SEQ ID NO: 714101 - RNA, 19 nt, Human
aacuaugcuggaaugagau

SEQ ID NO: 714102 - RNA, 19 nt, Human
aagacaaaagaaaaaucca

SEQ ID NO: 714103 - RNA, 22 nt, Human
aagacaaaagaaaaauccaaaa

SEQ ID NO: 714104 - RNA, 19 nt, Human
aauacaaaagcugaaaaua

SEQ ID NO: 714105 - RNA, 22 nt, Human
acagcaacagagacuggguuaa

SEQ ID NO: 714106 - RNA, 31 nt, Human
acagcaacagagacuggguuaaagugugccc

SEQ ID NO: 714107 - RNA, 21 nt, Human
accccaacaggaacaauuagc

SEQ ID NO: 714108 - RNA, 22 nt, Human
accugcuuuuccacguggcgcc

SEQ ID NO: 714109 - RNA, 22 nt, Human
agaaaaauccaaaacuaugcug

SEQ ID NO: 714110 - RNA, 21 nt, Human
agacaaaagaaaaauccaaaa

SEQ ID NO: 714111 - RNA, 18 nt, Human
agcccgcgcugccccgcc

SEQ ID NO: 714112 - RNA, 25 nt, Human
aggugccccuucagaucagaauucc

SEQ ID NO: 714113 - RNA, 20 nt, Human
auaagacaaaagaaaaaucc

SEQ ID NO: 714114 - RNA, 24 nt, Human
auaagacaaaagaaaaauccaaaa

SEQ ID NO: 714115 - RNA, 22 nt, Human
aucacuguuggaggaugagagg

SEQ ID NO: 714116 - RNA, 21 nt, Human
augaugauguuacguguaguu

SEQ ID NO: 714117 - RNA, 20 nt, Human
auggcaagagucuaaggcac

SEQ ID NO: 714118 - RNA, 20 nt, Human
caaaacggagcagagacuca

SEQ ID NO: 714119 - RNA, 21 nt, Human
caaaguaagggucuuucuguu

SEQ ID NO: 714120 - RNA, 21 nt, Human
cacggacggcuuccgccucuu

SEQ ID NO: 714121 - RNA, 19 nt, Human
cacugugaaagcuucagcc

SEQ ID NO: 714122 - RNA, 20 nt, Human
cacugugaaagcuucagccu

SEQ ID NO: 714123 - RNA, 22 nt, Human
cacuguuggaggaugagaggga

SEQ ID NO: 714124 - RNA, 18 nt, Human
cacuuugugggagugaac

SEQ ID NO: 714125 - RNA, 22 nt, Human
cagcaacagagacuggguuaaa

SEQ ID NO: 714126 - RNA, 18 nt, Human
cagccuuuaccccugggc

SEQ ID NO: 714127 - RNA, 19 nt, Human
cagucucugcacugugaaa

SEQ ID NO: 714128 - RNA, 27 nt, Human
cauagaggaccaaaguaaaugugacag

SEQ ID NO: 714129 - RNA, 19 nt, Human
cauauauuacaucuaccuu

SEQ ID NO: 714130 - RNA, 23 nt, Human
cauucaguaucugucaccccaac

SEQ ID NO: 714131 - RNA, 19 nt, Human
ccaaaacuaugcuggaaug

SEQ ID NO: 714132 - RNA, 24 nt, Human
ccagcugauuuuuaaauaaagcua

SEQ ID NO: 714133 - RNA, 19 nt, Human
ccccgccgcacucagcugu

SEQ ID NO: 714134 - RNA, 23 nt, Human
ccccgccgcacucagcuguuccg

SEQ ID NO: 714135 - RNA, 24 nt, Human
cccuacacagaagacggccagaaa

SEQ ID NO: 714136 - RNA, 19 nt, Human
ccgcacucagcuguuccgc

SEQ ID NO: 714137 - RNA, 20 nt, Human
ccgccgcacucagcuguucc

SEQ ID NO: 714138 - RNA, 22 nt, Human
ccgccgcgcuccccgccagccc

SEQ ID NO: 714139 - RNA, 23 nt, Human
cgccagcccgcgcugccccgcac

SEQ ID NO: 714140 - RNA, 24 nt, Human
cgguaaaaaggaauccauaaauac

SEQ ID NO: 714141 - RNA, 22 nt, Human
cgucucagugagaaccagacac

SEQ ID NO: 714142 - RNA, 21 nt, Human
cuaacacaauccaaccuuuag

SEQ ID NO: 714143 - RNA, 23 nt, Human
cuaacacaauccaaccuuuagca

SEQ ID NO: 714144 - RNA, 20 nt, Human
cuaaugguuccacauuuagu

SEQ ID NO: 714145 - RNA, 21 nt, Human
cugcuuguugucaucacuguu

SEQ ID NO: 714146 - RNA, 23 nt, Human
cuguuggaggaugagagggauuc

SEQ ID NO: 714147 - RNA, 22 nt, Human
cuucagccuuuaccccugggcu

SEQ ID NO: 714148 - RNA, 24 nt, Human
cuuucuaaugguuccacauuuagu

SEQ ID NO: 714149 - RNA, 22 nt, Human
gaaaaauccaaaacuaugcugg

SEQ ID NO: 714150 - RNA, 22 nt, Human
gaaaauguguguucuucacucc

SEQ ID NO: 714151 - RNA, 22 nt, Human
gaccagaugugguccuggguuc

SEQ ID NO: 714152 - RNA, 25 nt, Human
gagugaggucuccagagggggaggu

SEQ ID NO: 714153 - RNA, 19 nt, Human
gaugcuucuguuugcuggu

SEQ ID NO: 714154 - RNA, 23 nt, Human
gcgcuccccgccagcccgcgcug

SEQ ID NO: 714155 - RNA, 23 nt, Human
gggaguuguggugagggaggugg

SEQ ID NO: 714156 - RNA, 21 nt, Human
guccuggguucugggcauggc

SEQ ID NO: 714157 - RNA, 23 nt, Human
guggcgcccgccgcgcuccccgc

SEQ ID NO: 714158 - RNA, 25 nt, Human
uaacacaauccaaccuuuagcauug

SEQ ID NO: 714159 - RNA, 22 nt, Human
uaaccauagggggucuccacaa

SEQ ID NO: 714160 - RNA, 21 nt, Human
uaagaccaaaugagaauauuc

SEQ ID NO: 714161 - RNA, 23 nt, Human
uacaaaacggagcagagacucaa

SEQ ID NO: 714162 - RNA, 25 nt, Human
uacaaaagcugaaaauacuguguca

SEQ ID NO: 714163 - RNA, 20 nt, Human
uacaaagagaacacuguguu

SEQ ID NO: 714164 - RNA, 21 nt, Human
uacauagaggaccaaaguaaa

SEQ ID NO: 714165 - RNA, 20 nt, Human
uaccccugggcuugaugcuu

SEQ ID NO: 714166 - RNA, 23 nt, Human
uaccuugcugaccagaugugguc

SEQ ID NO: 714167 - RNA, 23 nt, Human
ucaaagucaucucgacuuccuua

SEQ ID NO: 714168 - RNA, 20 nt, Human
ucacuguuggaggaugagag

SEQ ID NO: 714169 - RNA, 22 nt, Human
uccccgccagcccgcgcugccc

SEQ ID NO: 714170 - RNA, 20 nt, Human
ucuguuccuuguccuggucu

SEQ ID NO: 714171 - RNA, 22 nt, Human
ucuguuugcuggugagcucagg

SEQ ID NO: 714172 - RNA, 24 nt, Human
ugacacgguaaaaaggaauccaua

SEQ ID NO: 714173 - RNA, 18 nt, Human
ugacaugaagguuaugcu

SEQ ID NO: 714174 - RNA, 20 nt, Human
ugacuguacaaaacggagca

SEQ ID NO: 714175 - RNA, 23 nt, Human
ugagaaccagacaccacuuugug

SEQ ID NO: 714176 - RNA, 22 nt, Human
ugcccaggcuagcagucucugc

SEQ ID NO: 714177 - RNA, 23 nt, Human
ugccccgcacagcucgcuccagc

SEQ ID NO: 714178 - RNA, 19 nt, Human
uggaauacaaaagcugaaa

SEQ ID NO: 714179 - RNA, 23 nt, Human
uggaauacaaaagcugaaaauac

SEQ ID NO: 714180 - RNA, 19 nt, Human
uggaggaugagagggauuc

SEQ ID NO: 714181 - RNA, 24 nt, Human
uggcacggacggcuuccgccucuu

SEQ ID NO: 714182 - RNA, 20 nt, Human
uggcgcccgccgcgcucccc

SEQ ID NO: 714183 - RNA, 23 nt, Human
ugucaaguucauauagauacccu

SEQ ID NO: 714184 - RNA, 19 nt, Human
ugugguccuggguucuggg

SEQ ID NO: 714185 - RNA, 24 nt, Human
uuaaaauaagacaaaagaaaaauc

SEQ ID NO: 714186 - RNA, 20 nt, Human
uugaugcuucuguuugcugg

SEQ ID NO: 714187 - RNA, 22 nt, Human
uuuccacguggcgcccgccgcg

SEQ ID NO: 714188 - RNA, 19 nt, Human
aaaccacaucuccuuccac

SEQ ID NO: 714189 - RNA, 22 nt, Human
aaccacacauggcucacuuaag

SEQ ID NO: 714190 - RNA, 22 nt, Human
acaaaguucauagacccucuca

SEQ ID NO: 714191 - RNA, 18 nt, Human
acaacucagcaaccacac

SEQ ID NO: 714192 - RNA, 22 nt, Human
acaccagggcccccagacaaac

SEQ ID NO: 714193 - RNA, 24 nt, Human
acaccagggcccccagacaaacca

SEQ ID NO: 714194 - RNA, 28 nt, Human
acaccagggcccccagacaaaccacacc

SEQ ID NO: 714195 - RNA, 20 nt, Human
acaucuccuuccacccuccc

SEQ ID NO: 714196 - RNA, 23 nt, Human
accacacauggcucacuuaaggu

SEQ ID NO: 714197 - RNA, 19 nt, Human
accucagagaaagccaaca

SEQ ID NO: 714198 - RNA, 24 nt, Human
acggucucauggccuugcugaggu

SEQ ID NO: 714199 - RNA, 25 nt, Human
acuauagagaaaccacaucuccuuc

SEQ ID NO: 714200 - RNA, 18 nt, Human
acuguguccuuugauaca

SEQ ID NO: 714201 - RNA, 24 nt, Human
agaaaccacaucuccuuccacccu

SEQ ID NO: 714202 - RNA, 25 nt, Human
agacaaaccacacauggccggaccc

SEQ ID NO: 714203 - RNA, 19 nt, Human
agcggugggagagggguga

SEQ ID NO: 714204 - RNA, 21 nt, Human
agcugaugcccaugcuccugg

SEQ ID NO: 714205 - RNA, 24 nt, Human
aggaccucagaagacccccucaaa

SEQ ID NO: 714206 - RNA, 19 nt, Human
agucacuguuuacugaguc

SEQ ID NO: 714207 - RNA, 23 nt, Human
agucacuguuuacugagucuaga

SEQ ID NO: 714208 - RNA, 23 nt, Human
auagagaaaccacaucuccuucc

SEQ ID NO: 714209 - RNA, 19 nt, Human
caaaggauuuccgguccaa

SEQ ID NO: 714210 - RNA, 25 nt, Human
caacagcuaaagaacagauguccac

SEQ ID NO: 714211 - RNA, 21 nt, Human
caagaguuuagucugagguuu

SEQ ID NO: 714212 - RNA, 21 nt, Human
cacacauggcucacuuaaggu

SEQ ID NO: 714213 - RNA, 20 nt, Human
caccucagagaaagccaaca

SEQ ID NO: 714214 - RNA, 21 nt, Human
cacuucaaaaaauacucugag

SEQ ID NO: 714215 - RNA, 23 nt, Human
cagagaaagccaacagcuaaaga

SEQ ID NO: 714216 - RNA, 23 nt, Human
cagcaaccacaccagggccccca

SEQ ID NO: 714217 - RNA, 24 nt, Human
cagcaaccacaccagggcccccag

SEQ ID NO: 714218 - RNA, 22 nt, Human
cagcacaauggaucaagcagag

SEQ ID NO: 714219 - RNA, 22 nt, Human
cagcggugggagaggggugagg

SEQ ID NO: 714220 - RNA, 21 nt, Human
ccacaccagggcccccagaca

SEQ ID NO: 714221 - RNA, 25 nt, Human
cccccagacaaaccacacauggcuc

SEQ ID NO: 714222 - RNA, 20 nt, Human
ccccucaaauucagaacaaa

SEQ ID NO: 714223 - RNA, 23 nt, Human
ccgguaguagcagcugcauccuu

SEQ ID NO: 714224 - RNA, 21 nt, Human
ccucagagaaagccaacagcu

SEQ ID NO: 714225 - RNA, 21 nt, Human
ccuuccacccucccccuggac

SEQ ID NO: 714226 - RNA, 20 nt, Human
ccuuccucaccuucucccca

SEQ ID NO: 714227 - RNA, 20 nt, Human
ccuuccucaccuucucccca

SEQ ID NO: 714228 - RNA, 18 nt, Human
cucagaagacccccucaa

SEQ ID NO: 714229 - RNA, 23 nt, Human
cuccggcccuacaaauacccauc

SEQ ID NO: 714230 - RNA, 27 nt, Human
cuccugaaacccaccuaccaagccgcc

SEQ ID NO: 714231 - RNA, 21 nt, Human
cugaaaaauuuacuagaggcu

SEQ ID NO: 714232 - RNA, 22 nt, Human
cugaggagggacagggugaaag

SEQ ID NO: 714233 - RNA, 23 nt, Human
cugagguuugauuggaagcccau

SEQ ID NO: 714234 - RNA, 23 nt, Human
cuugagcuacaacucagcaacca

SEQ ID NO: 714235 - RNA, 22 nt, Human
gaaagaccuaaggaaauaagga

SEQ ID NO: 714236 - RNA, 18 nt, Human
gacagcggugggagaggg

SEQ ID NO: 714237 - RNA, 18 nt, Human
gacugcuccugaaaccca

SEQ ID NO: 714238 - RNA, 22 nt, Human
gacuguguccuuugauacaugg

SEQ ID NO: 714239 - RNA, 21 nt, Human
gagaaaccacaucuccuucca

SEQ ID NO: 714240 - RNA, 21 nt, Human
gaggagggacagggugaaagg

SEQ ID NO: 714241 - RNA, 21 nt, Human
gcagaggaaaauaucagugag

SEQ ID NO: 714242 - RNA, 19 nt, Human
gcccccagacaaaccacac

SEQ ID NO: 714243 - RNA, 20 nt, Human
gcuaaagaacagauguccac

SEQ ID NO: 714244 - RNA, 19 nt, Human
gcugaugcccaugcuccug

SEQ ID NO: 714245 - RNA, 18 nt, Human
ggacagcggugggagagg

SEQ ID NO: 714246 - RNA, 24 nt, Human
ggaggcggugaagacccaagacua

SEQ ID NO: 714247 - RNA, 19 nt, Human
ggcccccagacaaaccaca

SEQ ID NO: 714248 - RNA, 24 nt, Human
ggcccuacaaauacccaucucuau

SEQ ID NO: 714249 - RNA, 22 nt, Human
ggcugaacgagcagugaugggg

SEQ ID NO: 714250 - RNA, 18 nt, Human
ggcuuuuggagagaggcc

SEQ ID NO: 714251 - RNA, 18 nt, Human
ggugaagacccaagacua

SEQ ID NO: 714252 - RNA, 22 nt, Human
ggugacccuuccucaccuucuc

SEQ ID NO: 714253 - RNA, 19 nt, Human
uaaggugccacacaccucc

SEQ ID NO: 714254 - RNA, 23 nt, Human
uacaauagugacugcuccugaaa

SEQ ID NO: 714255 - RNA, 21 nt, Human
uagaggagggagguagaauca

SEQ ID NO: 714256 - RNA, 18 nt, Human
uagggggucagacugguc

SEQ ID NO: 714257 - RNA, 18 nt, Human
uaguagcagcugcauccu

SEQ ID NO: 714258 - RNA, 25 nt, Human
ucaaaaaauacucugaggagggaca

SEQ ID NO: 714259 - RNA, 21 nt, Human
ucaagcagaggaaaauaucag

SEQ ID NO: 714260 - RNA, 18 nt, Human
ucagaacaaaggauuucc

SEQ ID NO: 714261 - RNA, 18 nt, Human
ucaggacagcggugggag

SEQ ID NO: 714262 - RNA, 18 nt, Human
uccuuccacccucccccu

SEQ ID NO: 714263 - RNA, 22 nt, Human
ucugaaaaauuuacuagaggcu

SEQ ID NO: 714264 - RNA, 18 nt, Human
ugaacgagcagugauggg

SEQ ID NO: 714265 - RNA, 18 nt, Human
ugaagacccaagacuagg

SEQ ID NO: 714266 - RNA, 20 nt, Human
ugacagagggugacccuucc

SEQ ID NO: 714267 - RNA, 19 nt, Human
ugacugcuccugaaaccca

SEQ ID NO: 714268 - RNA, 19 nt, Human
ugagguaaggugccacaca

SEQ ID NO: 714269 - RNA, 21 nt, Human
ugagguaaggugccacacacc

SEQ ID NO: 714270 - RNA, 20 nt, Human
ugcuccugaaacccaccuac

SEQ ID NO: 714271 - RNA, 18 nt, Human
ugcugagguaaggugcca

SEQ ID NO: 714272 - RNA, 20 nt, Human
uggacuguguccuuugauac

SEQ ID NO: 714273 - RNA, 19 nt, Human
uggcaggguggguauuugg

SEQ ID NO: 714274 - RNA, 18 nt, Human
uggguucggcauguugug

SEQ ID NO: 714275 - RNA, 21 nt, Human
uguucuguauguuuucuccuc

SEQ ID NO: 714276 - RNA, 18 nt, Human
uguuuucuccucuugagc

SEQ ID NO: 714277 - RNA, 24 nt, Human
uuaagguagaaaccaaaaccugcu

SEQ ID NO: 714278 - RNA, 26 nt, Human
uuaagguagaaaccaaaaccugcuuu

SEQ ID NO: 714279 - RNA, 18 nt, Human
uuccacccucccccugga

SEQ ID NO: 714280 - RNA, 19 nt, Human
uuucuccucuugagcuaca

SEQ ID NO: 714281 - RNA, 22 nt, Human
aaagcaaaaggccacagagggc

SEQ ID NO: 714282 - RNA, 24 nt, Human
aaagcaaaaggccacagagggcuc

SEQ ID NO: 714283 - RNA, 23 nt, Human
aagcagcagaaucuggaggagca

SEQ ID NO: 714284 - RNA, 21 nt, Human
acagggaaaacagaauuucca

SEQ ID NO: 714285 - RNA, 23 nt, Human
acauuaaagaaaggcugccugaa

SEQ ID NO: 714286 - RNA, 21 nt, Human
accugggaucacucugacagg

SEQ ID NO: 714287 - RNA, 23 nt, Human
acuucuauuaaggcagcuggaag

SEQ ID NO: 714288 - RNA, 24 nt, Human
agaugaaacagaauuucauggaga

SEQ ID NO: 714289 - RNA, 18 nt, Human
agccaguugcucuggccu

SEQ ID NO: 714290 - RNA, 23 nt, Human
aggagcaggaagagagcccagag

SEQ ID NO: 714291 - RNA, 21 nt, Human
aggaguaacagaaguuaugac

SEQ ID NO: 714292 - RNA, 19 nt, Human
agggaguguugugcugagu

SEQ ID NO: 714293 - RNA, 26 nt, Human
aguacaacuaagcgaggccuucaacu

SEQ ID NO: 714294 - RNA, 20 nt, Human
caaagcaaaaggccacagag

SEQ ID NO: 714295 - RNA, 24 nt, Human
caaaugaaaacagguaccccucuu

SEQ ID NO: 714296 - RNA, 21 nt, Human
caacucccaaaacgugaaagg

SEQ ID NO: 714297 - RNA, 23 nt, Human
caagcacagcugccaggagccag

SEQ ID NO: 714298 - RNA, 22 nt, Human
cacagugcuucccccauccucu

SEQ ID NO: 714299 - RNA, 22 nt, Human
caccacaaucccccuguacaga

SEQ ID NO: 714300 - RNA, 23 nt, Human
caccacaaucccccuguacagag

SEQ ID NO: 714301 - RNA, 20 nt, Human
cacgcaaagcaaaaggccac

SEQ ID NO: 714302 - RNA, 20 nt, Human
cacuacccaaaagacuugag

SEQ ID NO: 714303 - RNA, 25 nt, Human
cagaagcaaaagcuguaucauccaa

SEQ ID NO: 714304 - RNA, 20 nt, Human
cagcuuccaggaaccguuac

SEQ ID NO: 714305 - RNA, 18 nt, Human
caggguucaccauccaaa

SEQ ID NO: 714306 - RNA, 18 nt, Human
cauccaaucccaaagcca

SEQ ID NO: 714307 - RNA, 22 nt, Human
ccaaagccaccccuguggggaa

SEQ ID NO: 714308 - RNA, 24 nt, Human
ccaaaggaguaacagaaguuauga

SEQ ID NO: 714309 - RNA, 22 nt, Human
cccaaaagacuugaguacuucu

SEQ ID NO: 714310 - RNA, 19 nt, Human
cccacagugcuucccccau

SEQ ID NO: 714311 - RNA, 22 nt, Human
cccccuguacagaggggucugu

SEQ ID NO: 714312 - RNA, 25 nt, Human
ccgagucauuuucccucucccacuu

SEQ ID NO: 714313 - RNA, 23 nt, Human
ccucucccacuugcauucgagag

SEQ ID NO: 714314 - RNA, 20 nt, Human
ccugcagcgaggaguacugu

SEQ ID NO: 714315 - RNA, 27 nt, Human
cuacacagaagcaaaagcuguaucauc

SEQ ID NO: 714316 - RNA, 24 nt, Human
cuacagcugcaugggcaccaaaaa

SEQ ID NO: 714317 - RNA, 25 nt, Human
cugccaggagccaguugcucuggcc

SEQ ID NO: 714318 - RNA, 25 nt, Human
gaaacggacaagcacagcugccagg

SEQ ID NO: 714319 - RNA, 19 nt, Human
gcaaagcaaaaggccacag

SEQ ID NO: 714320 - RNA, 21 nt, Human
gcaaagcaaaaggccacagag

SEQ ID NO: 714321 - RNA, 21 nt, Human
gcaaagcaaaaggccacagag

SEQ ID NO: 714322 - RNA, 20 nt, Human
gcacagcugccaggagccag

SEQ ID NO: 714323 - RNA, 18 nt, Human
gcaggaagagagcccaga

SEQ ID NO: 714324 - RNA, 23 nt, Human
gcccacccuaggacuugaauggc

SEQ ID NO: 714325 - RNA, 18 nt, Human
gccuugauucucacucac

SEQ ID NO: 714326 - RNA, 21 nt, Human
ggaaagcagcagaaucuggag

SEQ ID NO: 714327 - RNA, 18 nt, Human
gggacgggccaggaggaa

SEQ ID NO: 714328 - RNA, 28 nt, Human
guaaugcaauccaacacaauaugcuaca

SEQ ID NO: 714329 - RNA, 23 nt, Human
guggucuucccacagugcuuccc

SEQ ID NO: 714330 - RNA, 23 nt, Human
uagcuaugggccaaaggaguaac

SEQ ID NO: 714331 - RNA, 18 nt, Human
uauguacagguauacuac

SEQ ID NO: 714332 - RNA, 19 nt, Human
ucaagacaaacuuugcaac

SEQ ID NO: 714333 - RNA, 23 nt, Human
ucaccacaaucccccuguacaga

SEQ ID NO: 714334 - RNA, 22 nt, Human
ucauccaaucccaaagccaccc

SEQ ID NO: 714335 - RNA, 19 nt, Human
uccagcucacuacccaaaa

SEQ ID NO: 714336 - RNA, 21 nt, Human
ucccacuguccagccaucuuu

SEQ ID NO: 714337 - RNA, 19 nt, Human
ucugacaggaaacggacaa

SEQ ID NO: 714338 - RNA, 21 nt, Human
ucugacaggaaacggacaagc

SEQ ID NO: 714339 - RNA, 18 nt, Human
ugaaaacagguaccccuc

SEQ ID NO: 714340 - RNA, 22 nt, Human
ugaaaacauuaaagaaaggcug

SEQ ID NO: 714341 - RNA, 22 nt, Human
ugagcuacagaauacaaaccaa

SEQ ID NO: 714342 - RNA, 23 nt, Human
ugccaaugagagggcccagcuuc

SEQ ID NO: 714343 - RNA, 22 nt, Human
ugccaggagccaguugcucugg

SEQ ID NO: 714344 - RNA, 21 nt, Human
ugccaguaaugcaauccaaca

SEQ ID NO: 714345 - RNA, 18 nt, Human
ugcuucccccauccucuc

SEQ ID NO: 714346 - RNA, 19 nt, Human
uggccucagucuccaauug

SEQ ID NO: 714347 - RNA, 20 nt, Human
ugggaugcuucacaacgugc

SEQ ID NO: 714348 - RNA, 24 nt, Human
ugucaagacaaacuuugcaacugg

SEQ ID NO: 714349 - RNA, 18 nt, Human
uguuacaaggagaaauug

SEQ ID NO: 714350 - RNA, 22 nt, Human
uucaccauccaaaauggcgacu

SEQ ID NO: 714351 - RNA, 20 nt, Human
uuccacggugccgcccucug

SEQ ID NO: 714352 - RNA, 19 nt, Human
uuguccuuucucugccagu

SEQ ID NO: 714353 - RNA, 23 nt, Human
uuuccuguaggcuuuccagcuca

SEQ ID NO: 714354 - RNA, 21 nt, Human
aaaaacauuccugcaauaguc

SEQ ID NO: 714355 - RNA, 22 nt, Human
aaacacccacagaacauggcaa

SEQ ID NO: 714356 - RNA, 18 nt, Human
aaacagacuguuaagacu

SEQ ID NO: 714357 - RNA, 22 nt, Human
aaacagaucaaugauccagcaa

SEQ ID NO: 714358 - RNA, 20 nt, Human
aaacaugguuuguagcaaaa

SEQ ID NO: 714359 - RNA, 19 nt, Human
aaaccccacccuuggcucc

SEQ ID NO: 714360 - RNA, 18 nt, Human
aaagcccccagaacgcag

SEQ ID NO: 714361 - RNA, 18 nt, Human
aaccgugugcccgugccc

SEQ ID NO: 714362 - RNA, 19 nt, Human
aaccugccaaacacccaca

SEQ ID NO: 714363 - RNA, 20 nt, Human
aagcagucuuuuacaaggga

SEQ ID NO: 714364 - RNA, 19 nt, Human
acauggcaaugaagcccua

SEQ ID NO: 714365 - RNA, 20 nt, Human
accagggccuucaucaguga

SEQ ID NO: 714366 - RNA, 25 nt, Human
acccaaugcaagcucugcaacccuu

SEQ ID NO: 714367 - RNA, 19 nt, Human
accugcaacuguuuccaga

SEQ ID NO: 714368 - RNA, 19 nt, Human
acgggagcgcaagggcuug

SEQ ID NO: 714369 - RNA, 18 nt, Human
acuacagaggggccagga

SEQ ID NO: 714370 - RNA, 19 nt, Human
agaagaaaaagcccccaga

SEQ ID NO: 714371 - RNA, 23 nt, Human
agaauggacagauaauauagaaa

SEQ ID NO: 714372 - RNA, 22 nt, Human
agagccucuucuuuccccaccc

SEQ ID NO: 714373 - RNA, 27 nt, Human
agcagcacugauugauuucccaguagg

SEQ ID NO: 714374 - RNA, 24 nt, Human
aggaagaaugaaacuuaaaaaaaa

SEQ ID NO: 714375 - RNA, 24 nt, Human
agugcuuucuccucaccagggccu

SEQ ID NO: 714376 - RNA, 21 nt, Human
caaaaucauaaaaaaggcccc

SEQ ID NO: 714377 - RNA, 18 nt, Human
caaaguccuugccagcau

SEQ ID NO: 714378 - RNA, 18 nt, Human
caaccaagacgcccgcag

SEQ ID NO: 714379 - RNA, 20 nt, Human
caaggaccucagcagaaggc

SEQ ID NO: 714380 - RNA, 19 nt, Human
caaugcaagcucugcaacc

SEQ ID NO: 714381 - RNA, 19 nt, Human
caccacagcuauguuguac

SEQ ID NO: 714382 - RNA, 20 nt, Human
caccacagcuauguuguacg

SEQ ID NO: 714383 - RNA, 18 nt, Human
caccagggccuucaucag

SEQ ID NO: 714384 - RNA, 21 nt, Human
caccagggccuucaucaguga

SEQ ID NO: 714385 - RNA, 20 nt, Human
caccccuaccuguccacacc

SEQ ID NO: 714386 - RNA, 19 nt, Human
cacccugucacucccagcc

SEQ ID NO: 714387 - RNA, 22 nt, Human
cacgcaaggaccucagcagaag

SEQ ID NO: 714388 - RNA, 24 nt, Human
cacuuugaaucugcaccuucucca

SEQ ID NO: 714389 - RNA, 24 nt, Human
cagagccucuucuuuccccacccc

SEQ ID NO: 714390 - RNA, 19 nt, Human
cagauaauauagaaaugcu

SEQ ID NO: 714391 - RNA, 24 nt, Human
cagcaaucgcugcucaaaagaagg

SEQ ID NO: 714392 - RNA, 28 nt, Human
cagcagcacugauugauuucccaguagg

SEQ ID NO: 714393 - RNA, 22 nt, Human
cagcaguggagaaggggacugg

SEQ ID NO: 714394 - RNA, 20 nt, Human
cagccagccaccguccgccu

SEQ ID NO: 714395 - RNA, 19 nt, Human
cagccgggaccucucaggc

SEQ ID NO: 714396 - RNA, 21 nt, Human
cagccgggaccucucaggcau

SEQ ID NO: 714397 - RNA, 30 nt, Human
cauggcaaugaagcccuacaugcuuuuaaa

SEQ ID NO: 714398 - RNA, 22 nt, Human
ccaaacacccacagaacauggc

SEQ ID NO: 714399 - RNA, 22 nt, Human
ccaaagccauagcugggaccuu

SEQ ID NO: 714400 - RNA, 24 nt, Human
ccaacaccugcaacuguuuccaga

SEQ ID NO: 714401 - RNA, 22 nt, Human
ccagaacgcagagccucuucuu

SEQ ID NO: 714402 - RNA, 23 nt, Human
ccauuaagccaccacagcuaugu

SEQ ID NO: 714403 - RNA, 23 nt, Human
cccaaaaauguaaaauccuggag

SEQ ID NO: 714404 - RNA, 26 nt, Human
cccaaaaauguaaaauccuggagagc

SEQ ID NO: 714405 - RNA, 26 nt, Human
cccaccccuaccuguccacaccccca

SEQ ID NO: 714406 - RNA, 19 nt, Human
ccccaccccuaccugucca

SEQ ID NO: 714407 - RNA, 23 nt, Human
ccccaccccuaccuguccacacc

SEQ ID NO: 714408 - RNA, 25 nt, Human
ccccaggggccgaagccacguuguc

SEQ ID NO: 714409 - RNA, 23 nt, Human
ccccggccgcgcaacccgcggug

SEQ ID NO: 714410 - RNA, 24 nt, Human
ccccuaccuguccacacccccagc

SEQ ID NO: 714411 - RNA, 21 nt, Human
cccgaaccgugugcccgugcc

SEQ ID NO: 714412 - RNA, 21 nt, Human
cccgcggugccgcugcagcca

SEQ ID NO: 714413 - RNA, 23 nt, Human
cccgggccgcgacugcacagaag

SEQ ID NO: 714414 - RNA, 18 nt, Human
ccgcagccacuacagagg

SEQ ID NO: 714415 - RNA, 19 nt, Human
ccgcggugccgcugcagcc

SEQ ID NO: 714416 - RNA, 24 nt, Human
ccgcuggagcauccccggccgcgc

SEQ ID NO: 714417 - RNA, 22 nt, Human
ccguguuuguaaugaacuuaac

SEQ ID NO: 714418 - RNA, 23 nt, Human
ccucaggagccgcucacuuugaa

SEQ ID NO: 714419 - RNA, 19 nt, Human
ccuggggcccucugcuggg

SEQ ID NO: 714420 - RNA, 20 nt, Human
ccuuggcggcucuccucagg

SEQ ID NO: 714421 - RNA, 27 nt, Human
cgcccgggccgcgacugcacagaaggc

SEQ ID NO: 714422 - RNA, 19 nt, Human
cgcugagccggagcgcagg

SEQ ID NO: 714423 - RNA, 18 nt, Human
cggcuggaacguggacgg

SEQ ID NO: 714424 - RNA, 19 nt, Human
cggcuuucacuuccaggcc

SEQ ID NO: 714425 - RNA, 20 nt, Human
cggugccgcugcagccagcc

SEQ ID NO: 714426 - RNA, 22 nt, Human
cguguuuguaaugaacuuacca

SEQ ID NO: 714427 - RNA, 19 nt, Human
cuccaacgaaagccugagg

SEQ ID NO: 714428 - RNA, 22 nt, Human
cuccagcucucaggcccagguc

SEQ ID NO: 714429 - RNA, 19 nt, Human
cucccagccgggaccucuc

SEQ ID NO: 714430 - RNA, 20 nt, Human
cugggaccuuggagauccug

SEQ ID NO: 714431 - RNA, 18 nt, Human
cuuuccccaccccuaccu

SEQ ID NO: 714432 - RNA, 21 nt, Human
gaaaaacuaugguauugcuga

SEQ ID NO: 714433 - RNA, 19 nt, Human
gaaagccugagugccuucc

SEQ ID NO: 714434 - RNA, 22 nt, Human
gaagaaaaagcccccagaacgc

SEQ ID NO: 714435 - RNA, 24 nt, Human
gaagacacuuugggcuugccguag

SEQ ID NO: 714436 - RNA, 18 nt, Human
gacacuuugggcuugccg

SEQ ID NO: 714437 - RNA, 23 nt, Human
gaccucagcagaaggcucagcac

SEQ ID NO: 714438 - RNA, 22 nt, Human
gagccggagcgcaggcuccaga

SEQ ID NO: 714439 - RNA, 19 nt, Human
gagcguggcuggcugggag

SEQ ID NO: 714440 - RNA, 23 nt, Human
gaggagaagaaaaagcccccaga

SEQ ID NO: 714441 - RNA, 18 nt, Human
gaggcagcaguggagaag

SEQ ID NO: 714442 - RNA, 22 nt, Human
gauuucaucuuccucccaacac

SEQ ID NO: 714443 - RNA, 22 nt, Human
gcaaccccaggggccgaagcca

SEQ ID NO: 714444 - RNA, 24 nt, Human
gcacacaacuuaugggaacuuaca

SEQ ID NO: 714445 - RNA, 20 nt, Human
gcaguggagaaggggacugg

SEQ ID NO: 714446 - RNA, 18 nt, Human
gccacguuguccaaagcc

SEQ ID NO: 714447 - RNA, 19 nt, Human
gcccguuuggcuauaugac

SEQ ID NO: 714448 - RNA, 18 nt, Human
gccggagcgcaggcucca

SEQ ID NO: 714449 - RNA, 24 nt, Human
gcucaacagaagugcaguuccacc

SEQ ID NO: 714450 - RNA, 19 nt, Human
ggacauucacugguuccuc

SEQ ID NO: 714451 - RNA, 22 nt, Human
ggagagagagagaaacgggagc

SEQ ID NO: 714452 - RNA, 20 nt, Human
ggccccacauucuuaaaggu

SEQ ID NO: 714453 - RNA, 20 nt, Human
ggcugcgcugggcucccggg

SEQ ID NO: 714454 - RNA, 22 nt, Human
ggcugggagagcugcacgccag

SEQ ID NO: 714455 - RNA, 23 nt, Human
ggcuuggaggaaugagugugcuc

SEQ ID NO: 714456 - RNA, 24 nt, Human
gggaaucacugagguuacccaaaa

SEQ ID NO: 714457 - RNA, 20 nt, Human
gggaggcagcaguggagaag

SEQ ID NO: 714458 - RNA, 18 nt, Human
gggcauaacgggaaggag

SEQ ID NO: 714459 - RNA, 20 nt, Human
gggggaggagaagaaaaagc

SEQ ID NO: 714460 - RNA, 24 nt, Human
ggggggcauaacgggaaggaggcg

SEQ ID NO: 714461 - RNA, 20 nt, Human
gguaagagccgggggcugcg

SEQ ID NO: 714462 - RNA, 20 nt, Human
guagucuucuuugugcuuuc

SEQ ID NO: 714463 - RNA, 21 nt, Human
gucgcugagccggagcgcagg

SEQ ID NO: 714464 - RNA, 23 nt, Human
guggagaaggggacuggccgcgu

SEQ ID NO: 714465 - RNA, 18 nt, Human
guguuuguaaugaacuua

SEQ ID NO: 714466 - RNA, 23 nt, Human
uaagacaucucaacaauguugga

SEQ ID NO: 714467 - RNA, 19 nt, Human
uaagacuaacagaaaccaa

SEQ ID NO: 714468 - RNA, 19 nt, Human
uaagagccgggggcugcgc

SEQ ID NO: 714469 - RNA, 20 nt, Human
uaccuguccacacccccagc

SEQ ID NO: 714470 - RNA, 22 nt, Human
uacugacaaacccugcagacac

SEQ ID NO: 714471 - RNA, 21 nt, Human
uaugugacauauucuugugcg

SEQ ID NO: 714472 - RNA, 23 nt, Human
ucaaccaagacgcccgcagccac

SEQ ID NO: 714473 - RNA, 22 nt, Human
ucaccagggccuucaucaguga

SEQ ID NO: 714474 - RNA, 19 nt, Human
ucacuuccaggccugagca

SEQ ID NO: 714475 - RNA, 21 nt, Human
ucagaaccucgugcacacaac

SEQ ID NO: 714476 - RNA, 18 nt, Human
ucagauaccuaauuguac

SEQ ID NO: 714477 - RNA, 27 nt, Human
ucagauaccuaauuguacaaaauugac

SEQ ID NO: 714478 - RNA, 23 nt, Human
uccgcagaacugagagcucaaca

SEQ ID NO: 714479 - RNA, 20 nt, Human
ucgcaggugaaaccccaccc

SEQ ID NO: 714480 - RNA, 23 nt, Human
ucucaggcccaggucagacacuu

SEQ ID NO: 714481 - RNA, 19 nt, Human
ucugcaccuucuccagcuc

SEQ ID NO: 714482 - RNA, 21 nt, Human
ucugcaccuucuccagcucuc

SEQ ID NO: 714483 - RNA, 19 nt, Human
ugaaaaaccgaggcuccug

SEQ ID NO: 714484 - RNA, 23 nt, Human
ugaaacuuaaaaaaaaaaaagaa

SEQ ID NO: 714485 - RNA, 18 nt, Human
ugacaaaacgauuacaga

SEQ ID NO: 714486 - RNA, 23 nt, Human
ugacaaacccugcagacacuagu

SEQ ID NO: 714487 - RNA, 19 nt, Human
ugacuuacccauaaaaagg

SEQ ID NO: 714488 - RNA, 19 nt, Human
ugauccagcaaucgcugcu

SEQ ID NO: 714489 - RNA, 20 nt, Human
ugaucguaaacaaaguccuu

SEQ ID NO: 714490 - RNA, 18 nt, Human
ugcagacgguagcugcgg

SEQ ID NO: 714491 - RNA, 18 nt, Human
ugccaaacacccacagaa

SEQ ID NO: 714492 - RNA, 22 nt, Human
ugccauggagccggucaggcag

SEQ ID NO: 714493 - RNA, 18 nt, Human
uggacuuccaaguccacu

SEQ ID NO: 714494 - RNA, 20 nt, Human
uggcaauuuuacuuaggaaa

SEQ ID NO: 714495 - RNA, 24 nt, Human
uggccgcguuuugcugaaaaaccg

SEQ ID NO: 714496 - RNA, 19 nt, Human
uggcuccaugaaugaauga

SEQ ID NO: 714497 - RNA, 23 nt, Human
uggcugggagagcugcacgccag

SEQ ID NO: 714498 - RNA, 19 nt, Human
ugggaccuuggagauccug

SEQ ID NO: 714499 - RNA, 18 nt, Human
ugguuuugacaggaggug

SEQ ID NO: 714500 - RNA, 24 nt, Human
uguaaugagaauuuuuaaaaaauu

SEQ ID NO: 714501 - RNA, 22 nt, Human
uguagcaaaagauucaaccaag

SEQ ID NO: 714502 - RNA, 21 nt, Human
uuaaaagacagcucgauuuca

SEQ ID NO: 714503 - RNA, 19 nt, Human
uuacaaaauauuguuaaga

SEQ ID NO: 714504 - RNA, 23 nt, Human
uuacagaguaggcgaagaacaga

SEQ ID NO: 714505 - RNA, 25 nt, Human
uucaaccaagacgcccgcagccacu

SEQ ID NO: 714506 - RNA, 20 nt, Human
uuggcuccaugaaugaauga

SEQ ID NO: 714507 - RNA, 21 nt, Human
uuggcuccaugaaugaaugag

SEQ ID NO: 714508 - RNA, 19 nt, Human
uuuccagauuuucugugua

SEQ ID NO: 714509 - RNA, 21 nt, Human
uuuccagauuuucuguguagu

SEQ ID NO: 714510 - RNA, 22 nt, Human
uuugcucaccuuaauuguuuca

SEQ ID NO: 714511 - RNA, 18 nt, Human
aaaaaaccaaaacaacaa

SEQ ID NO: 714512 - RNA, 25 nt, Human
aaaaaaccaaaacaacaaacaaaac

SEQ ID NO: 714513 - RNA, 29 nt, Human
aaaaaaccaaaacaacaaacagugggcac

SEQ ID NO: 714514 - RNA, 21 nt, Human
aaaaaggagggguucagcuca

SEQ ID NO: 714515 - RNA, 23 nt, Human
aaaacaacaaacaaaacccccaa

SEQ ID NO: 714516 - RNA, 18 nt, Human
aaaagccuuuggguugcu

SEQ ID NO: 714517 - RNA, 20 nt, Human
aaaauaccauucugcuacaa

SEQ ID NO: 714518 - RNA, 23 nt, Human
aaacaaacaaaaaucccccaaac

SEQ ID NO: 714519 - RNA, 26 nt, Human
aaacaaguacacuuagaaaggguuuc

SEQ ID NO: 714520 - RNA, 19 nt, Human
aaacaggaaaaacaaacaa

SEQ ID NO: 714521 - RNA, 23 nt, Human
aaacccccaaacaggaaaaacaa

SEQ ID NO: 714522 - RNA, 22 nt, Human
aaacugcccccagagugaccga

SEQ ID NO: 714523 - RNA, 18 nt, Human
aaaggagggguucagcuc

SEQ ID NO: 714524 - RNA, 21 nt, Human
aaccaaaacaacaaacaaaac

SEQ ID NO: 714525 - RNA, 25 nt, Human
aaccaaaacaacaaacaaaaccccc

SEQ ID NO: 714526 - RNA, 23 nt, Human
aacccccaaacaggaaaaacaaa

SEQ ID NO: 714527 - RNA, 20 nt, Human
aagcauccagacaucuguga

SEQ ID NO: 714528 - RNA, 19 nt, Human
aagcucaagggccgggcag

SEQ ID NO: 714529 - RNA, 19 nt, Human
aaggauggggagacagugg

SEQ ID NO: 714530 - RNA, 19 nt, Human
acaaaacccccaaacagga

SEQ ID NO: 714531 - RNA, 22 nt, Human
acaaaacccccaaacaggaaaa

SEQ ID NO: 714532 - RNA, 25 nt, Human
acaacaaacaaaacccccaaacagg

SEQ ID NO: 714533 - RNA, 21 nt, Human
acagauggcagcucccuucca

SEQ ID NO: 714534 - RNA, 24 nt, Human
accaaaacaacaaacaaaaccccc

SEQ ID NO: 714535 - RNA, 18 nt, Human
acccaaccuuuucagcug

SEQ ID NO: 714536 - RNA, 21 nt, Human
accuuguggcuuuuacaaagc

SEQ ID NO: 714537 - RNA, 21 nt, Human
acuugaggaaaauaccauucu

SEQ ID NO: 714538 - RNA, 21 nt, Human
agaaaccucaaguagguuuuc

SEQ ID NO: 714539 - RNA, 21 nt, Human
agaccagugacuggcagcccu

SEQ ID NO: 714540 - RNA, 19 nt, Human
agagggacagauggcagcu

SEQ ID NO: 714541 - RNA, 20 nt, Human
agaugcugggggcaggcagg

SEQ ID NO: 714542 - RNA, 18 nt, Human
agcaccuuugacuuuucu

SEQ ID NO: 714543 - RNA, 19 nt, Human
agcccuggccucuggugag

SEQ ID NO: 714544 - RNA, 25 nt, Human
agcugcuucuguggagaggaaggug

SEQ ID NO: 714545 - RNA, 22 nt, Human
aggcagggggaguggaggaggu

SEQ ID NO: 714546 - RNA, 22 nt, Human
aggccuccaccccccagaccag

SEQ ID NO: 714547 - RNA, 18 nt, Human
agguaagaaagagcuuuu

SEQ ID NO: 714548 - RNA, 19 nt, Human
agugugaaguagcugaaca

SEQ ID NO: 714549 - RNA, 24 nt, Human
aguuucacuccuggggaggaauga

SEQ ID NO: 714550 - RNA, 18 nt, Human
auaacaccaguuagcaug

SEQ ID NO: 714551 - RNA, 20 nt, Human
auguggcucagggaaagggg

SEQ ID NO: 714552 - RNA, 24 nt, Human
caaaaaucccccaaaccacauauu

SEQ ID NO: 714553 - RNA, 21 nt, Human
caaaacaacaaacaaaacccc

SEQ ID NO: 714554 - RNA, 24 nt, Human
caaaacccccaaacaggaaaaaca

SEQ ID NO: 714555 - RNA, 25 nt, Human
caaaacccccaaacaggaaaaacaa

SEQ ID NO: 714556 - RNA, 21 nt, Human
caaacaaaaaucccccaaacc

SEQ ID NO: 714557 - RNA, 22 nt, Human
caaacaaaaaucccccaaacca

SEQ ID NO: 714558 - RNA, 27 nt, Human
caaacaaaaaucccccaaaccacauau

SEQ ID NO: 714559 - RNA, 22 nt, Human
caaacaaaacccccaaacagga

SEQ ID NO: 714560 - RNA, 20 nt, Human
caaaccacauauuaaaaaug

SEQ ID NO: 714561 - RNA, 21 nt, Human
caaagcaaacugugcgggggc

SEQ ID NO: 714562 - RNA, 23 nt, Human
caacaaacaaaacccccaaacag

SEQ ID NO: 714563 - RNA, 26 nt, Human
caauaguuaaaguaauaaaaacauac

SEQ ID NO: 714564 - RNA, 19 nt, Human
cacagcaucuaaacugccc

SEQ ID NO: 714565 - RNA, 27 nt, Human
cacaguacaaggcugaagcaccuuuga

SEQ ID NO: 714566 - RNA, 24 nt, Human
cacccugcccucagcucaggccuc

SEQ ID NO: 714567 - RNA, 22 nt, Human
cagagcucuguacaugcucccc

SEQ ID NO: 714568 - RNA, 19 nt, Human
cagauggcagcucccuucc

SEQ ID NO: 714569 - RNA, 19 nt, Human
cagauggcagcucccuucc

SEQ ID NO: 714570 - RNA, 22 nt, Human
cagcagcaguacaaacacuaaa

SEQ ID NO: 714571 - RNA, 23 nt, Human
cagcagcaguacaaacacuaaaa

SEQ ID NO: 714572 - RNA, 21 nt, Human
cagcucaggccuccacccccc

SEQ ID NO: 714573 - RNA, 22 nt, Human
caguacaaggcugaagcaccuu

SEQ ID NO: 714574 - RNA, 20 nt, Human
cauuuuguaagcuucaaacc

SEQ ID NO: 714575 - RNA, 19 nt, Human
ccaaaaaaaaccaaaacaa

SEQ ID NO: 714576 - RNA, 22 nt, Human
ccaaaaaaaaccaaaacaacaa

SEQ ID NO: 714577 - RNA, 31 nt, Human
ccaaaaaaaaccaaaacaacaaacaaaaccu

SEQ ID NO: 714578 - RNA, 23 nt, Human
ccaaaacaacaaacaaaaccccc

SEQ ID NO: 714579 - RNA, 20 nt, Human
ccaaggccauuuccaaaagc

SEQ ID NO: 714580 - RNA, 20 nt, Human
ccaccuuuaaaaagaaaaac

SEQ ID NO: 714581 - RNA, 24 nt, Human
ccaucuccaucuugugguggaucc

SEQ ID NO: 714582 - RNA, 22 nt, Human
cccagagugaccgaggcaccgg

SEQ ID NO: 714583 - RNA, 21 nt, Human
cccaguguuugucuaaacugc

SEQ ID NO: 714584 - RNA, 20 nt, Human
cccccaaacaggaaaaacaa

SEQ ID NO: 714585 - RNA, 23 nt, Human
ccuccaccccccagaccagugac

SEQ ID NO: 714586 - RNA, 21 nt, Human
ccugcagcacagccccucgag

SEQ ID NO: 714587 - RNA, 23 nt, Human
cucagcucaggccuccacccccc

SEQ ID NO: 714588 - RNA, 21 nt, Human
cucaggccuccaccccccaga

SEQ ID NO: 714589 - RNA, 23 nt, Human
cugcuucuguggagaggaaggug

SEQ ID NO: 714590 - RNA, 23 nt, Human
cuggagccuggaauccuuugcuu

SEQ ID NO: 714591 - RNA, 21 nt, Human
cuguggaacaugcugaccucc

SEQ ID NO: 714592 - RNA, 18 nt, Human
gaaaaacugugggcaauc

SEQ ID NO: 714593 - RNA, 18 nt, Human
gaaaaguuggggacaggc

SEQ ID NO: 714594 - RNA, 21 nt, Human
gaacaaaaaacuuaagagauu

SEQ ID NO: 714595 - RNA, 24 nt, Human
gacacgaugccagcugccagcaag

SEQ ID NO: 714596 - RNA, 18 nt, Human
gacgucaaggugaguuca

SEQ ID NO: 714597 - RNA, 18 nt, Human
gacuauaugaagcaaaaa

SEQ ID NO: 714598 - RNA, 24 nt, Human
gcaagggcuagggccaagggcucg

SEQ ID NO: 714599 - RNA, 22 nt, Human
gcacacaggucaggcacccugc

SEQ ID NO: 714600 - RNA, 18 nt, Human
gcagacguacaaagcaaa

SEQ ID NO: 714601 - RNA, 21 nt, Human
gcccaguguuugucuaaacug

SEQ ID NO: 714602 - RNA, 21 nt, Human
gcccaugugugcacaugacug

SEQ ID NO: 714603 - RNA, 19 nt, Human
gccccucgaguucucuucc

SEQ ID NO: 714604 - RNA, 21 nt, Human
gccugcagcacagccccucga

SEQ ID NO: 714605 - RNA, 21 nt, Human
gcucaggccuccaccccccag

SEQ ID NO: 714606 - RNA, 18 nt, Human
ggaaaauaccauucugcu

SEQ ID NO: 714607 - RNA, 23 nt, Human
ggaacaugcugaccucccagugu

SEQ ID NO: 714608 - RNA, 18 nt, Human
ggcaagaagcucaagggc

SEQ ID NO: 714609 - RNA, 21 nt, Human
ggccaagggcucggcugcugg

SEQ ID NO: 714610 - RNA, 22 nt, Human
ggcuugaggcauaguaacaugg

SEQ ID NO: 714611 - RNA, 21 nt, Human
gggagacagugggcaagaagc

SEQ ID NO: 714612 - RNA, 23 nt, Human
ggguacauacaaaauaacaccag

SEQ ID NO: 714613 - RNA, 19 nt, Human
ggucaggcacccugcccuc

SEQ ID NO: 714614 - RNA, 20 nt, Human
gguguuccucccucccaccu

SEQ ID NO: 714615 - RNA, 18 nt, Human
guacugugucuugggugg

SEQ ID NO: 714616 - RNA, 18 nt, Human
gugcugaccaucuccauc

SEQ ID NO: 714617 - RNA, 20 nt, Human
guggaacaugcugaccuccc

SEQ ID NO: 714618 - RNA, 21 nt, Human
guguauacacagagcucugua

SEQ ID NO: 714619 - RNA, 19 nt, Human
guuugugcugaccaucucc

SEQ ID NO: 714620 - RNA, 22 nt, Human
guuugugcugaccaucuccauc

SEQ ID NO: 714621 - RNA, 23 nt, Human
uaaaaugaaacaaauaagcccuu

SEQ ID NO: 714622 - RNA, 21 nt, Human
uaauauacacuuuaaagagga

SEQ ID NO: 714623 - RNA, 18 nt, Human
uacaaacacuaaaagcaa

SEQ ID NO: 714624 - RNA, 23 nt, Human
uacagcaauauauucauaaauac

SEQ ID NO: 714625 - RNA, 22 nt, Human
uaucggaucuacuuuucccuuu

SEQ ID NO: 714626 - RNA, 24 nt, Human
ucaaggcagaguuaaggaguuuuu

SEQ ID NO: 714627 - RNA, 22 nt, Human
ucacagcaucuaaacugccccc

SEQ ID NO: 714628 - RNA, 19 nt, Human
ucagaccagaaaccucaag

SEQ ID NO: 714629 - RNA, 21 nt, Human
ucagcucaggccuccaccccc

SEQ ID NO: 714630 - RNA, 21 nt, Human
uccagugagauuuugcccuga

SEQ ID NO: 714631 - RNA, 20 nt, Human
ucccuggcauuuucuacacu

SEQ ID NO: 714632 - RNA, 19 nt, Human
uccuggggaggaaugagac

SEQ ID NO: 714633 - RNA, 21 nt, Human
ucgcccaguguuugucuaaac

SEQ ID NO: 714634 - RNA, 23 nt, Human
ucgcugaaugacaacggugauuc

SEQ ID NO: 714635 - RNA, 23 nt, Human
ugaacaaaaaacuuaagagauug

SEQ ID NO: 714636 - RNA, 21 nt, Human
ugaaguagcugaacaaaaaac

SEQ ID NO: 714637 - RNA, 20 nt, Human
ugacugucacacauggguuc

SEQ ID NO: 714638 - RNA, 18 nt, Human
ugagacaguucuuaccuu

SEQ ID NO: 714639 - RNA, 22 nt, Human
ugagagcggaagugcuaagaug

SEQ ID NO: 714640 - RNA, 18 nt, Human
ugagcccaguuucugacc

SEQ ID NO: 714641 - RNA, 30 nt, Human
ugcccaaaaaaaaccaaaacaacaaacaag

SEQ ID NO: 714642 - RNA, 23 nt, Human
ugcuuugugugcuccuaggacuu

SEQ ID NO: 714643 - RNA, 21 nt, Human
uggaggaggaggccugagagc

SEQ ID NO: 714644 - RNA, 21 nt, Human
uggaggaggaggccugagagc

SEQ ID NO: 714645 - RNA, 19 nt, Human
uggaggaggaggccugagg

SEQ ID NO: 714646 - RNA, 19 nt, Human
uggcaacacaagaaagaac

SEQ ID NO: 714647 - RNA, 18 nt, Human
uggcagcccuggccucug

SEQ ID NO: 714648 - RNA, 18 nt, Human
uggcagcccuggccucug

SEQ ID NO: 714649 - RNA, 20 nt, Human
uggcagcccuggccucuggu

SEQ ID NO: 714650 - RNA, 21 nt, Human
uggcagcccuggccucuggug

SEQ ID NO: 714651 - RNA, 19 nt, Human
uggccucuggugagggccc

SEQ ID NO: 714652 - RNA, 22 nt, Human
uggcuaauauacacuuuaaaga

SEQ ID NO: 714653 - RNA, 24 nt, Human
ugguaagggaugagcuacguuuuu

SEQ ID NO: 714654 - RNA, 24 nt, Human
ugucauagaaaauccaaccaaggg

SEQ ID NO: 714655 - RNA, 24 nt, Human
uguggagaggaaggugcuuguuga

SEQ ID NO: 714656 - RNA, 20 nt, Human
uucaauauuuuaauguccug

SEQ ID NO: 714657 - RNA, 20 nt, Human
uuccagggaaaagccuuugg

SEQ ID NO: 714658 - RNA, 21 nt, Human
uuccagggaaaagccuuuggg

SEQ ID NO: 714659 - RNA, 21 nt, Human
uugugguggaucccuggcauu

SEQ ID NO: 714660 - RNA, 25 nt, Human
uuuaaagaggaacagaaucgguuug

SEQ ID NO: 714661 - RNA, 19 nt, Human
uuucacuccuggggaggaa

SEQ ID NO: 714662 - RNA, 19 nt, Human
uuucagcugaagcaaguuu

SEQ ID NO: 714663 - RNA, 22 nt, Human
uuuuucuuaguuuauucguguu

SEQ ID NO: 714664 - RNA, 21 nt, Human
aaaggaacuggcagaggaggc

SEQ ID NO: 714665 - RNA, 19 nt, Human
aaagugcugggauuacagg

SEQ ID NO: 714666 - RNA, 19 nt, Human
aaagugcugggauuacagg

SEQ ID NO: 714667 - RNA, 23 nt, Human
aaagugcugggauuacaggugua

SEQ ID NO: 714668 - RNA, 23 nt, Human
aacugaauuuuaaaaaucaggaa

SEQ ID NO: 714669 - RNA, 19 nt, Human
aaguagcugggacuacagg

SEQ ID NO: 714670 - RNA, 20 nt, Human
aaguagcugggacuacaggc

SEQ ID NO: 714671 - RNA, 25 nt, Human
aaguagcugggacuacaggcgccca

SEQ ID NO: 714672 - RNA, 18 nt, Human
aagugcugggauuacagg

SEQ ID NO: 714673 - RNA, 19 nt, Human
aagugcugggauuacaggu

SEQ ID NO: 714674 - RNA, 26 nt, Human
aagugcugggauuacagguguaagcc

SEQ ID NO: 714675 - RNA, 23 nt, Human
acaggcgcccaccaccacacccg

SEQ ID NO: 714676 - RNA, 18 nt, Human
acaggguuucaccauguu

SEQ ID NO: 714677 - RNA, 19 nt, Human
acaggguuucaccauguua

SEQ ID NO: 714678 - RNA, 20 nt, Human
acaggguuucaccauguuag

SEQ ID NO: 714679 - RNA, 24 nt, Human
acaggguuucaccauguuagccag

SEQ ID NO: 714680 - RNA, 18 nt, Human
acagguguaagccaccgu

SEQ ID NO: 714681 - RNA, 19 nt, Human
acccaggcuggagugcagu

SEQ ID NO: 714682 - RNA, 24 nt, Human
accucggugccugugauuccucaa

SEQ ID NO: 714683 - RNA, 20 nt, Human
aggaagggcgagucccggug

SEQ ID NO: 714684 - RNA, 23 nt, Human
aggcuggaaccggaccgggccug

SEQ ID NO: 714685 - RNA, 25 nt, Human
aggcuggagugcaguagcgugaucu

SEQ ID NO: 714686 - RNA, 21 nt, Human
agggaggauggguccagcuug

SEQ ID NO: 714687 - RNA, 22 nt, Human
aguagagacaggguuucaccau

SEQ ID NO: 714688 - RNA, 20 nt, Human
agugcaguagcgugaucucg

SEQ ID NO: 714689 - RNA, 24 nt, Human
agugcaguagcgugaucucggcuc

SEQ ID NO: 714690 - RNA, 21 nt, Human
aucaaguuucuccccguaaau

SEQ ID NO: 714691 - RNA, 24 nt, Human
caaagugcugggauuacaggugua

SEQ ID NO: 714692 - RNA, 19 nt, Human
cacaccucuuucaauaaag

SEQ ID NO: 714693 - RNA, 18 nt, Human
caccauguuagccaggau

SEQ ID NO: 714694 - RNA, 22 nt, Human
caccauguuagccaggaugguc

SEQ ID NO: 714695 - RNA, 24 nt, Human
caccauguuagccaggauggucuc

SEQ ID NO: 714696 - RNA, 20 nt, Human
caccugggccggugugcugc

SEQ ID NO: 714697 - RNA, 22 nt, Human
cagagaacaaccucggugccuu

SEQ ID NO: 714698 - RNA, 23 nt, Human
cagcgcaaaccucggcuacguag

SEQ ID NO: 714699 - RNA, 19 nt, Human
cagcugguuuguacucugc

SEQ ID NO: 714700 - RNA, 21 nt, Human
caggcgcccaccaccacaccc

SEQ ID NO: 714701 - RNA, 24 nt, Human
caggguuucaccauguuagccagg

SEQ ID NO: 714702 - RNA, 22 nt, Human
cauaccauucuccugccucagc

SEQ ID NO: 714703 - RNA, 21 nt, Human
ccaaagugcugggauuacagg

SEQ ID NO: 714704 - RNA, 21 nt, Human
ccaaagugcugggauuacagg

SEQ ID NO: 714705 - RNA, 24 nt, Human
ccaaagugcugggauuacaggugu

SEQ ID NO: 714706 - RNA, 23 nt, Human
cccaaguagcugggacuacaggc

SEQ ID NO: 714707 - RNA, 23 nt, Human
cccaaguagcugggacuacaggc

SEQ ID NO: 714708 - RNA, 21 nt, Human
cccucugugagcagggaggau

SEQ ID NO: 714709 - RNA, 24 nt, Human
ccucccugguucauaccauucucc

SEQ ID NO: 714710 - RNA, 23 nt, Human
ccucggcuacguagcuccccuca

SEQ ID NO: 714711 - RNA, 23 nt, Human
ccugccucagccucccaaguagc

SEQ ID NO: 714712 - RNA, 24 nt, Human
ccugccucagccucccaaguagcu

SEQ ID NO: 714713 - RNA, 22 nt, Human
ccuuuccuuuccuuuccuuguc

SEQ ID NO: 714714 - RNA, 24 nt, Human
ccuuuccuuuccuuuccuugucuc

SEQ ID NO: 714715 - RNA, 21 nt, Human
cgcccaccaccacacccggcu

SEQ ID NO: 714716 - RNA, 24 nt, Human
cgccucggccucccaaagugcugg

SEQ ID NO: 714717 - RNA, 19 nt, Human
cggcagcgcaaaccucggc

SEQ ID NO: 714718 - RNA, 20 nt, Human
cggcggcagcgcaaaccucg

SEQ ID NO: 714719 - RNA, 24 nt, Human
cgugcugucacccaggcuggagug

SEQ ID NO: 714720 - RNA, 23 nt, Human
cuaauuuuuuguauuuuuaguag

SEQ ID NO: 714721 - RNA, 24 nt, Human
cucagccucccaaguagcugggac

SEQ ID NO: 714722 - RNA, 24 nt, Human
cuccugaccucgugaucugcucgc

SEQ ID NO: 714723 - RNA, 22 nt, Human
cucugcuaucuucccagaauca

SEQ ID NO: 714724 - RNA, 24 nt, Human
cugcaagcuccgccucccugguuc

SEQ ID NO: 714725 - RNA, 22 nt, Human
cugcggugucuucccacaucac

SEQ ID NO: 714726 - RNA, 21 nt, Human
cuucccagaaucaaguuucuc

SEQ ID NO: 714727 - RNA, 19 nt, Human
cuuuccuuuccuugucucu

SEQ ID NO: 714728 - RNA, 19 nt, Human
cuuuccuuuccuuuccuuu

SEQ ID NO: 714729 - RNA, 22 nt, Human
gaccucgugaucugcucgccuc

SEQ ID NO: 714730 - RNA, 24 nt, Human
gaccucgugaucugcucgccucgg

SEQ ID NO: 714731 - RNA, 23 nt, Human
gaugcggggauuguugagaggga

SEQ ID NO: 714732 - RNA, 18 nt, Human
gauuacagguguaagcca

SEQ ID NO: 714733 - RNA, 21 nt, Human
gauuacagguguaagccaccg

SEQ ID NO: 714734 - RNA, 22 nt, Human
gcaccugggccggugugcugcg

SEQ ID NO: 714735 - RNA, 20 nt, Human
gcagggaggauggguccagc

SEQ ID NO: 714736 - RNA, 24 nt, Human
gcugucacccaggcuggagugcag

SEQ ID NO: 714737 - RNA, 24 nt, Human
ggauggucucggucuccugaccuc

SEQ ID NO: 714738 - RNA, 24 nt, Human
ggauuacagguguaagccaccgug

SEQ ID NO: 714739 - RNA, 22 nt, Human
ggcagauucaaaauauuucuuu

SEQ ID NO: 714740 - RNA, 20 nt, Human
gggccuggcggcggcagcga

SEQ ID NO: 714741 - RNA, 24 nt, Human
gguuucaccauguuagccaggaug

SEQ ID NO: 714742 - RNA, 19 nt, Human
guacagcagagaacaaccu

SEQ ID NO: 714743 - RNA, 21 nt, Human
gucccggugagugagcucugc

SEQ ID NO: 714744 - RNA, 21 nt, Human
gugaucucggcucacugcaag

SEQ ID NO: 714745 - RNA, 26 nt, Human
uaaagaaagugcaaacuugcaguaca

SEQ ID NO: 714746 - RNA, 26 nt, Human
uaaagaaagugcaaacuugcaguaca

SEQ ID NO: 714747 - RNA, 24 nt, Human
uaaauaacugaauuuuaaaaauca

SEQ ID NO: 714748 - RNA, 23 nt, Human
uaacugaauuuuaaaaaucagga

SEQ ID NO: 714749 - RNA, 24 nt, Human
uaauuuuuuguauuuuuaguagag

SEQ ID NO: 714750 - RNA, 25 nt, Human
uaauuuuuuguauuuuuaguagaga

SEQ ID NO: 714751 - RNA, 22 nt, Human
uacagcagagaacaaccucggu

SEQ ID NO: 714752 - RNA, 22 nt, Human
uagagacaggguuucaccaugu

SEQ ID NO: 714753 - RNA, 24 nt, Human
uaguagagacaggguuucaccaug

SEQ ID NO: 714754 - RNA, 25 nt, Human
uaguagagacaggguuucaccaugu

SEQ ID NO: 714755 - RNA, 24 nt, Human
ucaccauguuagccaggauggucu

SEQ ID NO: 714756 - RNA, 22 nt, Human
ucacccaggcuggagugcagua

SEQ ID NO: 714757 - RNA, 19 nt, Human
ucacugcaagcuccgccuc

SEQ ID NO: 714758 - RNA, 19 nt, Human
ucacugcaagcuccgccuc

SEQ ID NO: 714759 - RNA, 24 nt, Human
ucacugcaagcuccgccucccugg

SEQ ID NO: 714760 - RNA, 24 nt, Human
ucacugcaagcuccgccucccugg

SEQ ID NO: 714761 - RNA, 25 nt, Human
ucacugcaagcuccgccucccuggu

SEQ ID NO: 714762 - RNA, 18 nt, Human
ucagccucccaaguagcu

SEQ ID NO: 714763 - RNA, 20 nt, Human
ucagccucccaaguagcugg

SEQ ID NO: 714764 - RNA, 21 nt, Human
ucauaccauucuccugccuca

SEQ ID NO: 714765 - RNA, 23 nt, Human
ucccaaagugcugggauuacagg

SEQ ID NO: 714766 - RNA, 24 nt, Human
ucccaaguagcugggacuacaggc

SEQ ID NO: 714767 - RNA, 24 nt, Human
ucccugguucauaccauucuccug

SEQ ID NO: 714768 - RNA, 18 nt, Human
ucccugugaaacagaagu

SEQ ID NO: 714769 - RNA, 21 nt, Human
uccguguuuuuguaaauguac

SEQ ID NO: 714770 - RNA, 19 nt, Human
uccuuuccuugucucucca

SEQ ID NO: 714771 - RNA, 22 nt, Human
uccuuuuuccaucagccucccu

SEQ ID NO: 714772 - RNA, 24 nt, Human
ucgccucggccucccaaagugcug

SEQ ID NO: 714773 - RNA, 19 nt, Human
ucggcuacguagcuccccu

SEQ ID NO: 714774 - RNA, 21 nt, Human
ucgugcugucacccaggcugg

SEQ ID NO: 714775 - RNA, 22 nt, Human
ucgugcugucacccaggcugga

SEQ ID NO: 714776 - RNA, 24 nt, Human
ucgugcugucacccaggcuggagu

SEQ ID NO: 714777 - RNA, 26 nt, Human
ucuccugccucagccucccaaguagc

SEQ ID NO: 714778 - RNA, 23 nt, Human
ucucgugcugucacccaggcugg

SEQ ID NO: 714779 - RNA, 24 nt, Human
ucucgugcugucacccaggcugga

SEQ ID NO: 714780 - RNA, 23 nt, Human
ucugcggugucuucccacaucac

SEQ ID NO: 714781 - RNA, 18 nt, Human
ugagagggaucuguaaga

SEQ ID NO: 714782 - RNA, 22 nt, Human
ugagcagggaggauggguccag

SEQ ID NO: 714783 - RNA, 18 nt, Human
ugagugagcucugcggug

SEQ ID NO: 714784 - RNA, 22 nt, Human
ugcaguagcgugaucucggcuc

SEQ ID NO: 714785 - RNA, 24 nt, Human
ugccucagccucccaaguagcugg

SEQ ID NO: 714786 - RNA, 26 nt, Human
ugcuaucuucccagaaucaaguuucu

SEQ ID NO: 714787 - RNA, 24 nt, Human
ugcugggauuacagguguaagcca

SEQ ID NO: 714788 - RNA, 19 nt, Human
uggagugcaguagcgugau

SEQ ID NO: 714789 - RNA, 23 nt, Human
uggagugcaguagcgugaucucg

SEQ ID NO: 714790 - RNA, 24 nt, Human
uggagugcaguagcgugaucucgg

SEQ ID NO: 714791 - RNA, 21 nt, Human
ugggacuacaggcgcccacca

SEQ ID NO: 714792 - RNA, 24 nt, Human
ugggacuacaggcgcccaccacca

SEQ ID NO: 714793 - RNA, 18 nt, Human
ugggauuacagguguaag

SEQ ID NO: 714794 - RNA, 21 nt, Human
ugggauuacagguguaagcca

SEQ ID NO: 714795 - RNA, 22 nt, Human
ugggauuacagguguaagccac

SEQ ID NO: 714796 - RNA, 23 nt, Human
ugggauuacagguguaagccacc

SEQ ID NO: 714797 - RNA, 23 nt, Human
ugggauuacagguguaagccacc

SEQ ID NO: 714798 - RNA, 24 nt, Human
ugggauuacagguguaagccaccg

SEQ ID NO: 714799 - RNA, 20 nt, Human
ugugugaccacagugcccuc

SEQ ID NO: 714800 - RNA, 23 nt, Human
uguugagagggaucuguaagagc

SEQ ID NO: 714801 - RNA, 24 nt, Human
uuaguagagacaggguuucaccau

SEQ ID NO: 714802 - RNA, 19 nt, Human
uucccacaucacaccuugg

SEQ ID NO: 714803 - RNA, 23 nt, Human
uucccacaucacaccuuggacug

SEQ ID NO: 714804 - RNA, 20 nt, Human
uuccucacaaugcccaugcc

SEQ ID NO: 714805 - RNA, 19 nt, Human
uuucaccauguuagccagg

SEQ ID NO: 714806 - RNA, 20 nt, Human
uuucaccauguuagccagga

SEQ ID NO: 714807 - RNA, 22 nt, Human
uuuuguauuuuuaguagagaca

SEQ ID NO: 714808 - RNA, 24 nt, Human
uuuuuaguagagacaggguuucac

SEQ ID NO: 714809 - RNA, 21 nt, Human
uuuuuguauuuuuaguagaga

SEQ ID NO: 714810 - RNA, 20 nt, Human
aaaaagaacuggcuucaaca

SEQ ID NO: 714811 - RNA, 24 nt, Human
aaaaagaacuggcuucaacaacua

SEQ ID NO: 714812 - RNA, 24 nt, Human
aaaaagauaacaaguugguacuga

SEQ ID NO: 714813 - RNA, 27 nt, Human
agagacuccaagaucggaggggagggc

SEQ ID NO: 714814 - RNA, 24 nt, Human
agcgaagagggauuuaaaaaaucu

SEQ ID NO: 714815 - RNA, 18 nt, Human
agcugggucugugcuggc

SEQ ID NO: 714816 - RNA, 19 nt, Human
agggcccacucccuggagc

SEQ ID NO: 714817 - RNA, 20 nt, Human
agguaccagugaggcugagg

SEQ ID NO: 714818 - RNA, 21 nt, Human
augaccaagacaaaaaagaac

SEQ ID NO: 714819 - RNA, 22 nt, Human
cacaggacccucgggaauagcc

SEQ ID NO: 714820 - RNA, 21 nt, Human
cacucgaggcggggccgggcu

SEQ ID NO: 714821 - RNA, 20 nt, Human
cagacucauagccuccccua

SEQ ID NO: 714822 - RNA, 19 nt, Human
cagcagcccagguuucucc

SEQ ID NO: 714823 - RNA, 21 nt, Human
cagccugccagggacaaagca

SEQ ID NO: 714824 - RNA, 22 nt, Human
cagcuggacugacagccugcca

SEQ ID NO: 714825 - RNA, 21 nt, Human
caguuuuccgagugcccaggc

SEQ ID NO: 714826 - RNA, 23 nt, Human
cauagccuccccuaaagggcaga

SEQ ID NO: 714827 - RNA, 24 nt, Human
ccaagacaaaaaagaacuggcuuc

SEQ ID NO: 714828 - RNA, 25 nt, Human
ccaagacaaaaaagaacuggcuuca

SEQ ID NO: 714829 - RNA, 20 nt, Human
ccagcuggacugacagccug

SEQ ID NO: 714830 - RNA, 19 nt, Human
cccacagagccagccugcc

SEQ ID NO: 714831 - RNA, 22 nt, Human
ccccaagcgugcugcagaaaaa

SEQ ID NO: 714832 - RNA, 24 nt, Human
ccccuccagcuggacugacagccu

SEQ ID NO: 714833 - RNA, 19 nt, Human
cccucuacucuugcucccc

SEQ ID NO: 714834 - RNA, 22 nt, Human
ccuccaagaccuugaauagccc

SEQ ID NO: 714835 - RNA, 22 nt, Human
ccuccugucccagacucauagc

SEQ ID NO: 714836 - RNA, 19 nt, Human
cuaaagggcagaagguacc

SEQ ID NO: 714837 - RNA, 21 nt, Human
cucagcagcccagguuucucc

SEQ ID NO: 714838 - RNA, 19 nt, Human
cuccaagaucggaggggag

SEQ ID NO: 714839 - RNA, 19 nt, Human
cugcugcccacaaucccca

SEQ ID NO: 714840 - RNA, 24 nt, Human
cugggucugugcuggccuccaaga

SEQ ID NO: 714841 - RNA, 21 nt, Human
gagccuacugacccccuccag

SEQ ID NO: 714842 - RNA, 20 nt, Human
gaguccugagguaacaguuu

SEQ ID NO: 714843 - RNA, 23 nt, Human
gccaacacccguggcuuuccuca

SEQ ID NO: 714844 - RNA, 24 nt, Human
ggaggggagggcccacucccugga

SEQ ID NO: 714845 - RNA, 24 nt, Human
gguuucuccauuucccccucuggg

SEQ ID NO: 714846 - RNA, 18 nt, Human
gugaggcugaggcugaag

SEQ ID NO: 714847 - RNA, 18 nt, Human
uaaaaaaucucaacuucc

SEQ ID NO: 714848 - RNA, 22 nt, Human
uaaagcaagcgaagagggauuu

SEQ ID NO: 714849 - RNA, 20 nt, Human
uaacaaguugguacugaaaa

SEQ ID NO: 714850 - RNA, 26 nt, Human
uagccucagauaaggaaaaagauaac

SEQ ID NO: 714851 - RNA, 25 nt, Human
uagugggcgugggaugagacaucau

SEQ ID NO: 714852 - RNA, 21 nt, Human
uccaagaucggaggggagggc

SEQ ID NO: 714853 - RNA, 18 nt, Human
uccagcgccacggcgucu

SEQ ID NO: 714854 - RNA, 20 nt, Human
ucccacagagccagccugcc

SEQ ID NO: 714855 - RNA, 21 nt, Human
uccccaagcgugcugcagaaa

SEQ ID NO: 714856 - RNA, 18 nt, Human
uccccagguagccucaga

SEQ ID NO: 714857 - RNA, 25 nt, Human
uccccuggaagagggacccucagca

SEQ ID NO: 714858 - RNA, 22 nt, Human
ucccucaugaccaagacaaaaa

SEQ ID NO: 714859 - RNA, 27 nt, Human
ucccucaugaccaagacaaaaaagaac

SEQ ID NO: 714860 - RNA, 23 nt, Human
ugacagugucccacagagccagc

SEQ ID NO: 714861 - RNA, 19 nt, Human
ugaccaagacaaaaaagaa

SEQ ID NO: 714862 - RNA, 23 nt, Human
ugaccaagacaaaaaagaacugg

SEQ ID NO: 714863 - RNA, 21 nt, Human
ugacccccuccagcuggacug

SEQ ID NO: 714864 - RNA, 23 nt, Human
ugccagagaaaacguuuaauucc

SEQ ID NO: 714865 - RNA, 21 nt, Human
ugccagggacaaagcaggacc

SEQ ID NO: 714866 - RNA, 21 nt, Human
ugcccacaauccccagguagc

SEQ ID NO: 714867 - RNA, 21 nt, Human
uggaagagggacccucagcau

SEQ ID NO: 714868 - RNA, 22 nt, Human
ugggcucugaauuuguccuccu

SEQ ID NO: 714869 - RNA, 20 nt, Human
uuagguaauguggccauagu

SEQ ID NO: 714870 - RNA, 19 nt, Human
uucccucaugaccaagaca

SEQ ID NO: 714871 - RNA, 25 nt, Human
uuuaaaaaaucucaacuuccuuuuc

SEQ ID NO: 714872 - RNA, 25 nt, Human
aaaaaaaaacgggucauagaccaaa

SEQ ID NO: 714873 - RNA, 25 nt, Human
aaaaaaaacgggucauagaccaaag

SEQ ID NO: 714874 - RNA, 21 nt, Human
aaaaaaacgggucauagacca

SEQ ID NO: 714875 - RNA, 23 nt, Human
aaaaaaacgggucauagaccaaa

SEQ ID NO: 714876 - RNA, 25 nt, Human
aaaaaacaaaacaaaacaaaaaaaa

SEQ ID NO: 714877 - RNA, 22 nt, Human
aaaaagaaaugugguacacugg

SEQ ID NO: 714878 - RNA, 26 nt, Human
aaaacaaaacaaaacaaaaaaaaaaa

SEQ ID NO: 714879 - RNA, 23 nt, Human
aaaacaaagaaacaaacgaaaaa

SEQ ID NO: 714880 - RNA, 26 nt, Human
aaaacaagacacacaggaucuaccuu

SEQ ID NO: 714881 - RNA, 25 nt, Human
aaacaaaaaaaaaaacgggucauag

SEQ ID NO: 714882 - RNA, 19 nt, Human
aaacaaaacaaaacaaaaa

SEQ ID NO: 714883 - RNA, 20 nt, Human
aaacaaaaccaaaaccaaaa

SEQ ID NO: 714884 - RNA, 27 nt, Human
aaacaagacacacaggaagccuuucgg

SEQ ID NO: 714885 - RNA, 21 nt, Human
aaacaagacacacaggaucua

SEQ ID NO: 714886 - RNA, 28 nt, Human
aaaccaaaaccaaaaaagaguaggaaga

SEQ ID NO: 714887 - RNA, 21 nt, Human
aaaccccaucuccacaaaaaa

SEQ ID NO: 714888 - RNA, 22 nt, Human
aaagaaacaaacgaaaaaacaa

SEQ ID NO: 714889 - RNA, 26 nt, Human
aacaaaacaaaaaaaaaaacggguca

SEQ ID NO: 714890 - RNA, 23 nt, Human
aacaaaaccaaaaccaaaaaaga

SEQ ID NO: 714891 - RNA, 24 nt, Human
aacauaccauuaaaagacaaucaa

SEQ ID NO: 714892 - RNA, 23 nt, Human
aacauagccaaaacaaaucucaa

SEQ ID NO: 714893 - RNA, 20 nt, Human
aacaugguaaaacucugucu

SEQ ID NO: 714894 - RNA, 21 nt, Human
aacaugguaaaacucugucuc

SEQ ID NO: 714895 - RNA, 20 nt, Human
aacauggugaaaccccaucc

SEQ ID NO: 714896 - RNA, 20 nt, Human
aacauggugaaaccccaucu

SEQ ID NO: 714897 - RNA, 20 nt, Human
aacauggugaaaccccaucu

SEQ ID NO: 714898 - RNA, 21 nt, Human
aacauggugaaaccccaucuc

SEQ ID NO: 714899 - RNA, 22 nt, Human
aacauggugaaaccccaucucc

SEQ ID NO: 714900 - RNA, 20 nt, Human
aacuacuuuuuaacaaaaau

SEQ ID NO: 714901 - RNA, 19 nt, Human
aagagggaggugaagggag

SEQ ID NO: 714902 - RNA, 19 nt, Human
aauacaaacaacagcaaaa

SEQ ID NO: 714903 - RNA, 24 nt, Human
aaucacuugaacccaggggauaga

SEQ ID NO: 714904 - RNA, 19 nt, Human
aauggaucauaggcuggcc

SEQ ID NO: 714905 - RNA, 23 nt, Human
aaugguaucugggcucucggcgc

SEQ ID NO: 714906 - RNA, 26 nt, Human
acaaaacaaaaaaaaaaacgggucau

SEQ ID NO: 714907 - RNA, 23 nt, Human
acaaaacaaaacaaaaaaaaaaa

SEQ ID NO: 714908 - RNA, 19 nt, Human
acaaaacaaaaccaaaacc

SEQ ID NO: 714909 - RNA, 21 nt, Human
acaaacaacagcaaaaauaug

SEQ ID NO: 714910 - RNA, 22 nt, Human
acaagagaaucacuugaaccca

SEQ ID NO: 714911 - RNA, 22 nt, Human
acacuuguaaucccaaaacuuu

SEQ ID NO: 714912 - RNA, 24 nt, Human
acagaacaagacuccaucucaaaa

SEQ ID NO: 714913 - RNA, 21 nt, Human
accaaaguauaaagcuuaaaa

SEQ ID NO: 714914 - RNA, 30 nt, Human
accagaaaacaagacacacaggaucuaccu

SEQ ID NO: 714915 - RNA, 24 nt, Human
acccaggcuggaguacaguggugu

SEQ ID NO: 714916 - RNA, 23 nt, Human
accccaucuccacaaaaaauaca

SEQ ID NO: 714917 - RNA, 26 nt, Human
acgccacugcaccccagccggguguc

SEQ ID NO: 714918 - RNA, 22 nt, Human
acgccacugcaccccagccugg

SEQ ID NO: 714919 - RNA, 20 nt, Human
acggaguuucgccauaggcc

SEQ ID NO: 714920 - RNA, 22 nt, Human
acggaguuucgccauaggcccg

SEQ ID NO: 714921 - RNA, 18 nt, Human
acuacauacaaauauggu

SEQ ID NO: 714922 - RNA, 18 nt, Human
acugcaccccagccuggg

SEQ ID NO: 714923 - RNA, 24 nt, Human
acugcaccccagccugggugacag

SEQ ID NO: 714924 - RNA, 18 nt, Human
acuuugucacccaggcug

SEQ ID NO: 714925 - RNA, 25 nt, Human
acuuugucacccaggcuggaguaca

SEQ ID NO: 714926 - RNA, 24 nt, Human
agaaaaacaggucaauggaacaaa

SEQ ID NO: 714927 - RNA, 22 nt, Human
agaaacaaacgaaaaaacaaaa

SEQ ID NO: 714928 - RNA, 22 nt, Human
agaaucacuugaacccagggga

SEQ ID NO: 714929 - RNA, 24 nt, Human
agacaagagaaucacuugaaccca

SEQ ID NO: 714930 - RNA, 19 nt, Human
agaccuguacacugaaaac

SEQ ID NO: 714931 - RNA, 27 nt, Human
agagaaaaacaggucaauggaacaaaa

SEQ ID NO: 714932 - RNA, 19 nt, Human
agagauugcagugagccaa

SEQ ID NO: 714933 - RNA, 23 nt, Human
agagauugcagugagccaagauc

SEQ ID NO: 714934 - RNA, 23 nt, Human
agcaccaaggcucacgccuguaa

SEQ ID NO: 714935 - RNA, 18 nt, Human
agccaccacacccugccu

SEQ ID NO: 714936 - RNA, 19 nt, Human
agccaccacacccugccug

SEQ ID NO: 714937 - RNA, 20 nt, Human
agccuggaagugccucggcg

SEQ ID NO: 714938 - RNA, 22 nt, Human
agccuggccaacaugguaaaac

SEQ ID NO: 714939 - RNA, 24 nt, Human
agccuggccaacaugguaaaacuc

SEQ ID NO: 714940 - RNA, 22 nt, Human
agccuggccaacauggugaaac

SEQ ID NO: 714941 - RNA, 24 nt, Human
agccugggugacagaacaagacuc

SEQ ID NO: 714942 - RNA, 22 nt, Human
agcuuauuagaaaaaggaguag

SEQ ID NO: 714943 - RNA, 22 nt, Human
agcuugggcaacauagugagac

SEQ ID NO: 714944 - RNA, 26 nt, Human
agcuugggcaacauagugagacaguc

SEQ ID NO: 714945 - RNA, 24 nt, Human
aggacugcuugaggccaggaguuu

SEQ ID NO: 714946 - RNA, 22 nt, Human
aggacuuaacauagccaaaaca

SEQ ID NO: 714947 - RNA, 24 nt, Human
aggcucacgccuguaaucccagca

SEQ ID NO: 714948 - RNA, 21 nt, Human
agggaggugaagggagggugg

SEQ ID NO: 714949 - RNA, 23 nt, Human
aggugggaggacugcuugaggcc

SEQ ID NO: 714950 - RNA, 22 nt, Human
aggugggucacuugaggucagg

SEQ ID NO: 714951 - RNA, 19 nt, Human
aguacaguggugugaucuc

SEQ ID NO: 714952 - RNA, 21 nt, Human
aguacaguggugugaucucag

SEQ ID NO: 714953 - RNA, 23 nt, Human
aguggcucacgccugugaucuca

SEQ ID NO: 714954 - RNA, 24 nt, Human
aguggugugaucucagcucacugc

SEQ ID NO: 714955 - RNA, 22 nt, Human
aguucaacaucaauuguauuuc

SEQ ID NO: 714956 - RNA, 26 nt, Human
auagaagacaaaacauuaauaccuag

SEQ ID NO: 714957 - RNA, 22 nt, Human
auagagcaaagggcaguccuuu

SEQ ID NO: 714958 - RNA, 24 nt, Human
aucacgccacugcaccccagccug

SEQ ID NO: 714959 - RNA, 21 nt, Human
aucuaccuucuuccuguccag

SEQ ID NO: 714960 - RNA, 22 nt, Human
auggaacaaaacagaguccuga

SEQ ID NO: 714961 - RNA, 20 nt, Human
auguaauuuacaaaaacacc

SEQ ID NO: 714962 - RNA, 19 nt, Human
auguguguccuuccuuccc

SEQ ID NO: 714963 - RNA, 21 nt, Human
auugugaucuugggaugggaa

SEQ ID NO: 714964 - RNA, 23 nt, Human
auuucacuguccccuuccaaagu

SEQ ID NO: 714965 - RNA, 18 nt, Human
caaaacaaaaccaaaacc

SEQ ID NO: 714966 - RNA, 25 nt, Human
caaaacaaagaaacaaacgaaaaaa

SEQ ID NO: 714967 - RNA, 19 nt, Human
caaaacagaguccugaaau

SEQ ID NO: 714968 - RNA, 24 nt, Human
caaaacuuugggaggccaaggugg

SEQ ID NO: 714969 - RNA, 26 nt, Human
caaacgaaaaaacaaaacaaaacaaa

SEQ ID NO: 714970 - RNA, 19 nt, Human
caaaguauaaagcuuaaaa

SEQ ID NO: 714971 - RNA, 24 nt, Human
caaaguucuaggauuacaggcaua

SEQ ID NO: 714972 - RNA, 21 nt, Human
caacacccaaagcauaaaaga

SEQ ID NO: 714973 - RNA, 24 nt, Human
caacacuuugagaagcuaaggugg

SEQ ID NO: 714974 - RNA, 21 nt, Human
caacagcaaaaauaugacgca

SEQ ID NO: 714975 - RNA, 24 nt, Human
caacaugguaaaacucugucucua

SEQ ID NO: 714976 - RNA, 18 nt, Human
caacauggugaaacccca

SEQ ID NO: 714977 - RNA, 20 nt, Human
caagaaaaagugaaggugga

SEQ ID NO: 714978 - RNA, 24 nt, Human
caaggcucacgccuguaaucccag

SEQ ID NO: 714979 - RNA, 20 nt, Human
caaggugggucacuugaggu

SEQ ID NO: 714980 - RNA, 22 nt, Human
caaggugggucacuugagguca

SEQ ID NO: 714981 - RNA, 20 nt, Human
caagugauccucccaccuca

SEQ ID NO: 714982 - RNA, 18 nt, Human
cacacuuguaaucccaaa

SEQ ID NO: 714983 - RNA, 24 nt, Human
cacacuuguaaucccaaaacuuug

SEQ ID NO: 714984 - RNA, 22 nt, Human
caccacacccugccuguuccca

SEQ ID NO: 714985 - RNA, 18 nt, Human
caccaugagaacucacag

SEQ ID NO: 714986 - RNA, 22 nt, Human
cacccaucuaggccucccaaag

SEQ ID NO: 714987 - RNA, 23 nt, Human
cacccaucuaggccucccaaagu

SEQ ID NO: 714988 - RNA, 18 nt, Human
caccccauagccacaagc

SEQ ID NO: 714989 - RNA, 20 nt, Human
caccccauagccacaagcca

SEQ ID NO: 714990 - RNA, 21 nt, Human
caccccauagccacaagccac

SEQ ID NO: 714991 - RNA, 23 nt, Human
cacgccuguaaucccagcacaug

SEQ ID NO: 714992 - RNA, 24 nt, Human
cacgccugugaucucaacacuuug

SEQ ID NO: 714993 - RNA, 23 nt, Human
cacugcaccccagccugggugac

SEQ ID NO: 714994 - RNA, 27 nt, Human
cacugcaccccagccugggugacagaa

SEQ ID NO: 714995 - RNA, 19 nt, Human
cacugcagucuugaccucu

SEQ ID NO: 714996 - RNA, 22 nt, Human
cacuugaggucaggaguuugaa

SEQ ID NO: 714997 - RNA, 23 nt, Human
cacuuguaaucccaaaacuuugg

SEQ ID NO: 714998 - RNA, 24 nt, Human
cacuuguaaucccaaaacuuuggg

SEQ ID NO: 714999 - RNA, 22 nt, Human
cacuuugucacccaggcuggag

SEQ ID NO: 715000 - RNA, 18 nt, Human
cagaaaacaagacacaca

SEQ ID NO: 715001 - RNA, 23 nt, Human
cagaacaagacuccaucucaaaa

SEQ ID NO: 715002 - RNA, 25 nt, Human
cagccuggccaacauggugaaaccc

SEQ ID NO: 715003 - RNA, 24 nt, Human
cagcucacugcagucuugaccucu

SEQ ID NO: 715004 - RNA, 23 nt, Human
caugcaccaccacaccuggcuaa

SEQ ID NO: 715005 - RNA, 24 nt, Human
cauuuaaaaaacacacuguaacaa

SEQ ID NO: 715006 - RNA, 19 nt, Human
ccaaaaccaaaaaagagua

SEQ ID NO: 715007 - RNA, 18 nt, Human
ccaaagcauaaaagaaca

SEQ ID NO: 715008 - RNA, 24 nt, Human
ccaaaguucuaggauuacaggcau

SEQ ID NO: 715009 - RNA, 19 nt, Human
ccacaaaaaauacaaacaa

SEQ ID NO: 715010 - RNA, 20 nt, Human
ccacaaaaaauacaaacaac

SEQ ID NO: 715011 - RNA, 22 nt, Human
ccacaagccacaccagccacca

SEQ ID NO: 715012 - RNA, 20 nt, Human
ccacugcaccccagccuggg

SEQ ID NO: 715013 - RNA, 21 nt, Human
ccacugcaccccagccugggu

SEQ ID NO: 715014 - RNA, 23 nt, Human
ccacugcaccccagccuggguga

SEQ ID NO: 715015 - RNA, 24 nt, Human
ccacugcaccccagccugggugac

SEQ ID NO: 715016 - RNA, 23 nt, Human
ccagcuugggcaacauagugaga

SEQ ID NO: 715017 - RNA, 18 nt, Human
ccaucuccacaaaaaaua

SEQ ID NO: 715018 - RNA, 22 nt, Human
cccacacuuguaaucccaaaac

SEQ ID NO: 715019 - RNA, 26 nt, Human
ccucccaccucagccugccguguaac

SEQ ID NO: 715020 - RNA, 22 nt, Human
ccugagcucaagugauccaccc

SEQ ID NO: 715021 - RNA, 23 nt, Human
ccugagcucaagugauccaccca

SEQ ID NO: 715022 - RNA, 20 nt, Human
ccuggccaacaugguaaaac

SEQ ID NO: 715023 - RNA, 24 nt, Human
ccuggccaacaugguaaaacucug

SEQ ID NO: 715024 - RNA, 23 nt, Human
ccuggccaacauggugaaacccc

SEQ ID NO: 715025 - RNA, 25 nt, Human
ccuggccaacauggugaaaccccaa

SEQ ID NO: 715026 - RNA, 22 nt, Human
ccugggugacagaacaagacuc

SEQ ID NO: 715027 - RNA, 18 nt, Human
ccuguaaucccagcuacu

SEQ ID NO: 715028 - RNA, 21 nt, Human
ccuguaaucccagcuacuugg

SEQ ID NO: 715029 - RNA, 22 nt, Human
ccuguaaucccagcuacuuggg

SEQ ID NO: 715030 - RNA, 19 nt, Human
ccuguucccaaauuucaca

SEQ ID NO: 715031 - RNA, 26 nt, Human
cgccacugcaccccagccugggugac

SEQ ID NO: 715032 - RNA, 23 nt, Human
cgccuguaaucccagcacauggg

SEQ ID NO: 715033 - RNA, 22 nt, Human
cggccugugccuguaaucccag

SEQ ID NO: 715034 - RNA, 27 nt, Human
cucaaaacaaagaaacaaacgaaaaaa

SEQ ID NO: 715035 - RNA, 21 nt, Human
cucaagugauccacccaucua

SEQ ID NO: 715036 - RNA, 22 nt, Human
cucacgccuguaaucccagcac

SEQ ID NO: 715037 - RNA, 24 nt, Human
cucacgccuguaaucccagcacau

SEQ ID NO: 715038 - RNA, 22 nt, Human
cucacgccugugaucucaacac

SEQ ID NO: 715039 - RNA, 24 nt, Human
cucacgccugugaucucaacacuu

SEQ ID NO: 715040 - RNA, 23 nt, Human
cucacugcagucuugaccucugg

SEQ ID NO: 715041 - RNA, 24 nt, Human
cucacuuugucacccaggcuggag

SEQ ID NO: 715042 - RNA, 21 nt, Human
cucccaccucagccugccgug

SEQ ID NO: 715043 - RNA, 24 nt, Human
cuggaguacaguggugugaucuca

SEQ ID NO: 715044 - RNA, 23 nt, Human
cuggccaacauggugaaacccca

SEQ ID NO: 715045 - RNA, 27 nt, Human
cuggccaacauggugaaaccccaucuu

SEQ ID NO: 715046 - RNA, 18 nt, Human
cugugccuguaaucccag

SEQ ID NO: 715047 - RNA, 23 nt, Human
cuguucccaaauuucacaucaaa

SEQ ID NO: 715048 - RNA, 25 nt, Human
cuugccaaccaccagcucucacgcc

SEQ ID NO: 715049 - RNA, 19 nt, Human
cuuuagcucaggaguucaa

SEQ ID NO: 715050 - RNA, 22 nt, Human
gaaaaaacaaaacaaaacaaaa

SEQ ID NO: 715051 - RNA, 21 nt, Human
gaaaccccaucuccacaaaaa

SEQ ID NO: 715052 - RNA, 21 nt, Human
gacaacuacuuuuuaacaaaa

SEQ ID NO: 715053 - RNA, 21 nt, Human
gacuacaggcaugcaccacca

SEQ ID NO: 715054 - RNA, 24 nt, Human
gacugcuugaggccaggaguuuga

SEQ ID NO: 715055 - RNA, 23 nt, Human
gagaccagcuugggcaacauagu

SEQ ID NO: 715056 - RNA, 18 nt, Human
gagauugcagugagccaa

SEQ ID NO: 715057 - RNA, 23 nt, Human
gauagagauugcagugagccaag

SEQ ID NO: 715058 - RNA, 18 nt, Human
gauuacaggcauaagcca

SEQ ID NO: 715059 - RNA, 21 nt, Human
gauuacaggcauaagccacca

SEQ ID NO: 715060 - RNA, 21 nt, Human
gcacauggggaggacgaggca

SEQ ID NO: 715061 - RNA, 24 nt, Human
gccaacaugguaaaacucugucuc

SEQ ID NO: 715062 - RNA, 19 nt, Human
gccaaccaccagcucucac

SEQ ID NO: 715063 - RNA, 20 nt, Human
gccaagaucacgccacugca

SEQ ID NO: 715064 - RNA, 24 nt, Human
gccacugcaccccagccuggguga

SEQ ID NO: 715065 - RNA, 18 nt, Human
gcccgggcuggucuggaa

SEQ ID NO: 715066 - RNA, 25 nt, Human
gccuggccaacauggugaaacccca

SEQ ID NO: 715067 - RNA, 20 nt, Human
gccuguaaucccagcuacuu

SEQ ID NO: 715068 - RNA, 23 nt, Human
gcggccugugccuguaaucccag

SEQ ID NO: 715069 - RNA, 20 nt, Human
gcucucggcgccucacuccu

SEQ ID NO: 715070 - RNA, 23 nt, Human
gcuggucuggaacuccugagcuc

SEQ ID NO: 715071 - RNA, 18 nt, Human
ggaaaaaaaauugugauc

SEQ ID NO: 715072 - RNA, 22 nt, Human
ggaguaggggucgggugcagug

SEQ ID NO: 715073 - RNA, 24 nt, Human
ggauagagauugcagugagccaag

SEQ ID NO: 715074 - RNA, 19 nt, Human
ggauuacaggcauaagcca

SEQ ID NO: 715075 - RNA, 22 nt, Human
ggauuacaggcauaagccacca

SEQ ID NO: 715076 - RNA, 25 nt, Human
ggccaacauggugaaaccccaucuc

SEQ ID NO: 715077 - RNA, 19 nt, Human
ggccaggaguuugagacca

SEQ ID NO: 715078 - RNA, 22 nt, Human
ggccaggaguuugagaccagcu

SEQ ID NO: 715079 - RNA, 24 nt, Human
ggccgcgguggcccacacuuguaa

SEQ ID NO: 715080 - RNA, 24 nt, Human
ggcggccugugccuguaaucccag

SEQ ID NO: 715081 - RNA, 20 nt, Human
ggcucacgccuguaauccca

SEQ ID NO: 715082 - RNA, 22 nt, Human
ggcuggaguacaguggugugau

SEQ ID NO: 715083 - RNA, 18 nt, Human
gggaaaagauuucucgga

SEQ ID NO: 715084 - RNA, 24 nt, Human
gggcguggcggccugugccuguaa

SEQ ID NO: 715085 - RNA, 21 nt, Human
ggggucgggugcaguggcuca

SEQ ID NO: 715086 - RNA, 20 nt, Human
gggucacuugaggucaggaa

SEQ ID NO: 715087 - RNA, 22 nt, Human
gggucacuugaggucaggaguu

SEQ ID NO: 715088 - RNA, 22 nt, Human
gggucgggugcaguggcucacg

SEQ ID NO: 715089 - RNA, 24 nt, Human
gggugcaguggcucacgccuguga

SEQ ID NO: 715090 - RNA, 24 nt, Human
ggucacuugaggucaggaguuuga

SEQ ID NO: 715091 - RNA, 20 nt, Human
ggucuggaacuccugagcuc

SEQ ID NO: 715092 - RNA, 23 nt, Human
gguggcccacacuuguaauccca

SEQ ID NO: 715093 - RNA, 21 nt, Human
guccuuccuucccaaauagcc

SEQ ID NO: 715094 - RNA, 19 nt, Human
gucucuacuaaaaauacaa

SEQ ID NO: 715095 - RNA, 24 nt, Human
gugauccacccaucuaggccuccc

SEQ ID NO: 715096 - RNA, 20 nt, Human
gugggucacuugaggucagg

SEQ ID NO: 715097 - RNA, 22 nt, Human
guucaagugauccucccaccuc

SEQ ID NO: 715098 - RNA, 18 nt, Human
uaaaagaacaaacgaaua

SEQ ID NO: 715099 - RNA, 24 nt, Human
uaaaagaacaaacgaauaaacugg

SEQ ID NO: 715100 - RNA, 19 nt, Human
uaaacccacauauacauuu

SEQ ID NO: 715101 - RNA, 24 nt, Human
uaacaaaaaugcaaaggugauaga

SEQ ID NO: 715102 - RNA, 24 nt, Human
uaacacuucuagaaguaaaaagga

SEQ ID NO: 715103 - RNA, 24 nt, Human
uaacauagccaaaacaaaucucaa

SEQ ID NO: 715104 - RNA, 22 nt, Human
uaagagauucaaauguaaccau

SEQ ID NO: 715105 - RNA, 18 nt, Human
uaagccaccacacccugc

SEQ ID NO: 715106 - RNA, 24 nt, Human
uaaggugggaggacugcuugaggc

SEQ ID NO: 715107 - RNA, 26 nt, Human
uaaggugggaggacugcuugaggcca

SEQ ID NO: 715108 - RNA, 21 nt, Human
uaauuuacaaaaacaccauga

SEQ ID NO: 715109 - RNA, 24 nt, Human
uaauuuuuucuauuuuuuguagag

SEQ ID NO: 715110 - RNA, 21 nt, Human
uacaauacacaugaccagaaa

SEQ ID NO: 715111 - RNA, 26 nt, Human
uacaauacacaugaccagaaaacaag

SEQ ID NO: 715112 - RNA, 22 nt, Human
uacaggcaugcaccaccacacc

SEQ ID NO: 715113 - RNA, 22 nt, Human
uacaguggugugaucucagcuc

SEQ ID NO: 715114 - RNA, 23 nt, Human
uacauacacuacauacaaauaug

SEQ ID NO: 715115 - RNA, 24 nt, Human
uagccgggcguggcggccugugcc

SEQ ID NO: 715116 - RNA, 20 nt, Human
uagcucaggaguucaacaca

SEQ ID NO: 715117 - RNA, 22 nt, Human
uaggauuacaggcauaagccac

SEQ ID NO: 715118 - RNA, 24 nt, Human
uaggauuacaggcauaagccacca

SEQ ID NO: 715119 - RNA, 24 nt, Human
uaggauuacaggcauaagccacca

SEQ ID NO: 715120 - RNA, 23 nt, Human
uaggcuggccgcgguggcccaca

SEQ ID NO: 715121 - RNA, 23 nt, Human
uaugguauuggcauucaggagag

SEQ ID NO: 715122 - RNA, 27 nt, Human
ucaaaacaaagaaacaaacgaaaaaac

SEQ ID NO: 715123 - RNA, 21 nt, Human
ucaaaacuaugaaaugcugac

SEQ ID NO: 715124 - RNA, 18 nt, Human
ucaauggaacaaaacaga

SEQ ID NO: 715125 - RNA, 20 nt, Human
ucacgccaaaaugguaucug

SEQ ID NO: 715126 - RNA, 23 nt, Human
ucacgccacugcaccccagccug

SEQ ID NO: 715127 - RNA, 19 nt, Human
ucacugcagucuugaccuc

SEQ ID NO: 715128 - RNA, 23 nt, Human
ucacugcagucuugaccucuggg

SEQ ID NO: 715129 - RNA, 21 nt, Human
ucacuguccccuuccaaagug

SEQ ID NO: 715130 - RNA, 24 nt, Human
ucacuuugucacccaggcuggagu

SEQ ID NO: 715131 - RNA, 23 nt, Human
ucagccugccguguaacugugac

SEQ ID NO: 715132 - RNA, 22 nt, Human
uccaucucaaaacaaagaaaca

SEQ ID NO: 715133 - RNA, 24 nt, Human
ucccaaaguucuaggauuacaggc

SEQ ID NO: 715134 - RNA, 25 nt, Human
uccuucccaaauagccagaugauaa

SEQ ID NO: 715135 - RNA, 20 nt, Human
ucuaaaaucaaagagggagg

SEQ ID NO: 715136 - RNA, 26 nt, Human
ucuacagaccaucaucuucacuugca

SEQ ID NO: 715137 - RNA, 20 nt, Human
ucuauagcuucuaaaaucaa

SEQ ID NO: 715138 - RNA, 23 nt, Human
ucucacuuugucacccaggcugg

SEQ ID NO: 715139 - RNA, 24 nt, Human
ucucacuuugucacccaggcugga

SEQ ID NO: 715140 - RNA, 21 nt, Human
ucucuacuaaaaauacaaaaa

SEQ ID NO: 715141 - RNA, 21 nt, Human
ucuggaacuccugagcucaag

SEQ ID NO: 715142 - RNA, 24 nt, Human
ugaaaccagccuggccaacauggu

SEQ ID NO: 715143 - RNA, 19 nt, Human
ugaaauaaacccacauaua

SEQ ID NO: 715144 - RNA, 18 nt, Human
ugaccagaaaacaagaca

SEQ ID NO: 715145 - RNA, 19 nt, Human
ugaccagaaaacaagacac

SEQ ID NO: 715146 - RNA, 21 nt, Human
ugaccagaaaacaagacacac

SEQ ID NO: 715147 - RNA, 25 nt, Human
ugaccucugggguucaagugauccu

SEQ ID NO: 715148 - RNA, 24 nt, Human
ugagacaagagaaucacuugaacc

SEQ ID NO: 715149 - RNA, 21 nt, Human
ugagacagucucuacaaaaca

SEQ ID NO: 715150 - RNA, 22 nt, Human
ugagcucaagugauccacccau

SEQ ID NO: 715151 - RNA, 18 nt, Human
ugaggucaggaguuugaa

SEQ ID NO: 715152 - RNA, 23 nt, Human
ugaggucaggaguuugaaaccag

SEQ ID NO: 715153 - RNA, 24 nt, Human
ugauccacccaucuaggccuccca

SEQ ID NO: 715154 - RNA, 22 nt, Human
ugcaacacccaaagcauaaaag

SEQ ID NO: 715155 - RNA, 24 nt, Human
ugccuguaaucccagcuacuuggg

SEQ ID NO: 715156 - RNA, 18 nt, Human
ugcuugaggccaggaguu

SEQ ID NO: 715157 - RNA, 23 nt, Human
uggaaaugugcaaaauccaugug

SEQ ID NO: 715158 - RNA, 19 nt, Human
uggaguacaguggugugau

SEQ ID NO: 715159 - RNA, 19 nt, Human
uggaguacaguggugugau

SEQ ID NO: 715160 - RNA, 28 nt, Human
uggaguacaguggugugauggcucuagc

SEQ ID NO: 715161 - RNA, 24 nt, Human
uggccaacaugguaaaacucuguc

SEQ ID NO: 715162 - RNA, 24 nt, Human
uggccaacauggugaaaccccauc

SEQ ID NO: 715163 - RNA, 24 nt, Human
uggcggccugugccuguaauccca

SEQ ID NO: 715164 - RNA, 21 nt, Human
uggcucacgccugugaucuca

SEQ ID NO: 715165 - RNA, 24 nt, Human
uggcucacgccugugaucucaaca

SEQ ID NO: 715166 - RNA, 20 nt, Human
ugggaggacugcuugaggcc

SEQ ID NO: 715167 - RNA, 18 nt, Human
ugggaggccaaggugggu

SEQ ID NO: 715168 - RNA, 19 nt, Human
ugggaggccaagguggguc

SEQ ID NO: 715169 - RNA, 19 nt, Human
ugggaggccaagguggguc

SEQ ID NO: 715170 - RNA, 24 nt, Human
ugggaggcugagacaagagaauca

SEQ ID NO: 715171 - RNA, 24 nt, Human
ugggaugggaaaagauuucucgga

SEQ ID NO: 715172 - RNA, 18 nt, Human
ugggcucucggcgccuca

SEQ ID NO: 715173 - RNA, 21 nt, Human
ugggcucucggcgccucacuc

SEQ ID NO: 715174 - RNA, 24 nt, Human
ugggguucaagugauccucccacc

SEQ ID NO: 715175 - RNA, 19 nt, Human
ugggucacuugaggucagg

SEQ ID NO: 715176 - RNA, 24 nt, Human
ugggucacuugaggucaggaguuu

SEQ ID NO: 715177 - RNA, 24 nt, Human
ugguagaccuguacacugaaaacu

SEQ ID NO: 715178 - RNA, 19 nt, Human
ugguauuggcauucaggag

SEQ ID NO: 715179 - RNA, 24 nt, Human
uggugugaucucagcucacugcag

SEQ ID NO: 715180 - RNA, 21 nt, Human
uguaaccauguuuacuuucau

SEQ ID NO: 715181 - RNA, 25 nt, Human
uguaaccauguuuacuuucauuuuu

SEQ ID NO: 715182 - RNA, 23 nt, Human
uguaacugugacuacaggcaugc

SEQ ID NO: 715183 - RNA, 22 nt, Human
uguaggaaugcugugauuacag

SEQ ID NO: 715184 - RNA, 24 nt, Human
uguauugcuuuagcucaggaguuc

SEQ ID NO: 715185 - RNA, 24 nt, Human
uguccuuccuucccaaauagccag

SEQ ID NO: 715186 - RNA, 24 nt, Human
ugugccuguaaucccagcuacuug

SEQ ID NO: 715187 - RNA, 19 nt, Human
uuaaaaaacacacuguaac

SEQ ID NO: 715188 - RNA, 22 nt, Human
uuauauauacugaaaauuucua

SEQ ID NO: 715189 - RNA, 19 nt, Human
uuaucuuaaacaaugucua

SEQ ID NO: 715190 - RNA, 23 nt, Human
uucaagugauccucccaccucag

SEQ ID NO: 715191 - RNA, 26 nt, Human
uucaagugauccucccaccucagccu

SEQ ID NO: 715192 - RNA, 21 nt, Human
uugacaaguugauccuaauuu

SEQ ID NO: 715193 - RNA, 22 nt, Human
uugaggccaggaguuugagacc

SEQ ID NO: 715194 - RNA, 20 nt, Human
uugcagugagccaagaucac

SEQ ID NO: 715195 - RNA, 25 nt, Human
uugggaggcugagacaagagaauca

SEQ ID NO: 715196 - RNA, 21 nt, Human
uugggcaacauagugagacag

SEQ ID NO: 715197 - RNA, 24 nt, Human
uuguagagacggaguuucgccaua

SEQ ID NO: 715198 - RNA, 26 nt, Human
uuuaacaaaaaugcaaaggugauaga

SEQ ID NO: 715199 - RNA, 19 nt, Human
uuuauaggccagaagacuc

SEQ ID NO: 715200 - RNA, 24 nt, Human
uuuguagagacggaguuucgccau

SEQ ID NO: 715201 - RNA, 18 nt, Human
uuugucacccaggcugga

SEQ ID NO: 715202 - RNA, 23 nt, Human
uuuuuuguagagacggaguuucg

SEQ ID NO: 715203 - RNA, 24 nt, Human
uuuuuuguagagacggaguuucgc

SEQ ID NO: 715204 - RNA, 19 nt, Human
acgugucauucacaggcau

SEQ ID NO: 715205 - RNA, 19 nt, Human
agaauccacauaaccacag

SEQ ID NO: 715206 - RNA, 18 nt, Human
agaaugaacccaguccca

SEQ ID NO: 715207 - RNA, 25 nt, Human
aggaaaguaagagaauccacauaac

SEQ ID NO: 715208 - RNA, 21 nt, Human
agucaugagaaugaacccagu

SEQ ID NO: 715209 - RNA, 27 nt, Human
aguggcuauuuaccaauaacaaguaac

SEQ ID NO: 715210 - RNA, 26 nt, Human
auccacauaaccacagcuuacaucac

SEQ ID NO: 715211 - RNA, 20 nt, Human
caaaauaauuaaacugaggc

SEQ ID NO: 715212 - RNA, 22 nt, Human
caggcuucucuguuccuccucc

SEQ ID NO: 715213 - RNA, 24 nt, Human
ccaaaauaauuaaacugaggcagg

SEQ ID NO: 715214 - RNA, 29 nt, Human
ccuccugcaggcacaguuugaguagagac

SEQ ID NO: 715215 - RNA, 23 nt, Human
cgcagauccagggacagucccuc

SEQ ID NO: 715216 - RNA, 19 nt, Human
cuguuccuccuccugcagg

SEQ ID NO: 715217 - RNA, 21 nt, Human
gccccaagucaugagaaugaa

SEQ ID NO: 715218 - RNA, 21 nt, Human
uaagagaauccacauaaccac

SEQ ID NO: 715219 - RNA, 22 nt, Human
uccacauaaccacagcuuacau

SEQ ID NO: 715220 - RNA, 18 nt, Human
ugaacccagucccagcag

SEQ ID NO: 715221 - RNA, 22 nt, Human
uucucuguuccuccuccugcag

SEQ ID NO: 715222 - RNA, 19 nt, Human
uugaaacugucuaccuccg

SEQ ID NO: 715223 - RNA, 22 nt, Human
uuugaaacugucuaccuccgca

SEQ ID NO: 715224 - RNA, 18 nt, Human
aaaaagacacuucagagc

SEQ ID NO: 715225 - RNA, 19 nt, Human
aaacaagacggcuugcccu

SEQ ID NO: 715226 - RNA, 19 nt, Human
aaauaaaauaggcuugaaa

SEQ ID NO: 715227 - RNA, 18 nt, Human
aagggggaguggaguugc

SEQ ID NO: 715228 - RNA, 19 nt, Human
aagugccccucaggccuuc

SEQ ID NO: 715229 - RNA, 21 nt, Human
acacacacacacauauauaua

SEQ ID NO: 715230 - RNA, 23 nt, Human
acacacauacacacacacacaca

SEQ ID NO: 715231 - RNA, 20 nt, Human
acaggguugggggugaaggg

SEQ ID NO: 715232 - RNA, 24 nt, Human
acauacacacacacacacacacag

SEQ ID NO: 715233 - RNA, 18 nt, Human
accacacucugcuuuugc

SEQ ID NO: 715234 - RNA, 23 nt, Human
accugggccuggcucugcuccug

SEQ ID NO: 715235 - RNA, 23 nt, Human
acucugcuuuugcuuggccuggg

SEQ ID NO: 715236 - RNA, 18 nt, Human
acugagggaauccuguug

SEQ ID NO: 715237 - RNA, 25 nt, Human
acugguuucacuggcaucucgagac

SEQ ID NO: 715238 - RNA, 18 nt, Human
agcagguggcugguggca

SEQ ID NO: 715239 - RNA, 22 nt, Human
agccagaagagcagcugccgcg

SEQ ID NO: 715240 - RNA, 23 nt, Human
agccagcguuggccccaaaggca

SEQ ID NO: 715241 - RNA, 25 nt, Human
agcuguggaggcuucaugccaagug

SEQ ID NO: 715242 - RNA, 24 nt, Human
aggagcuuuaggaaaggggacagg

SEQ ID NO: 715243 - RNA, 18 nt, Human
aggcuugaaaauuacagu

SEQ ID NO: 715244 - RNA, 19 nt, Human
agggaugaugacauagacc

SEQ ID NO: 715245 - RNA, 24 nt, Human
aggggaaacgaaccuucuucaaaa

SEQ ID NO: 715246 - RNA, 18 nt, Human
agggggccuggguggugc

SEQ ID NO: 715247 - RNA, 21 nt, Human
aggggugacggugccagccag

SEQ ID NO: 715248 - RNA, 25 nt, Human
auauauacacacauauauaugugug

SEQ ID NO: 715249 - RNA, 19 nt, Human
auauauauauauauauaua

SEQ ID NO: 715250 - RNA, 19 nt, Human
auauauauauauauauaua

SEQ ID NO: 715251 - RNA, 19 nt, Human
auauauauauauauauaua

SEQ ID NO: 715252 - RNA, 19 nt, Human
auauauauauauauauaua

SEQ ID NO: 715253 - RNA, 19 nt, Human
auauauauauauauauaua

SEQ ID NO: 715254 - RNA, 19 nt, Human
auauauauauauauauaua

SEQ ID NO: 715255 - RNA, 19 nt, Human
auauauauauauauauaua

SEQ ID NO: 715256 - RNA, 19 nt, Human
auauauauauauauauaua

SEQ ID NO: 715257 - RNA, 29 nt, Human
auguguauauauauacacacauauauaug

SEQ ID NO: 715258 - RNA, 20 nt, Human
cacacacacacacacacaca

SEQ ID NO: 715259 - RNA, 22 nt, Human
cacacacacacacacacacaua

SEQ ID NO: 715260 - RNA, 26 nt, Human
cacacacacacacacacacauauaua

SEQ ID NO: 715261 - RNA, 20 nt, Human
cacacacacacacacacaua

SEQ ID NO: 715262 - RNA, 22 nt, Human
cacacacacacacacacauaua

SEQ ID NO: 715263 - RNA, 26 nt, Human
cacacacacacacacacauauauaua

SEQ ID NO: 715264 - RNA, 19 nt, Human
cacacacacacacacauau

SEQ ID NO: 715265 - RNA, 25 nt, Human
cacacacacacacacauauauauau

SEQ ID NO: 715266 - RNA, 18 nt, Human
cacacacacauauauaua

SEQ ID NO: 715267 - RNA, 20 nt, Human
cacacacauauauauauaua

SEQ ID NO: 715268 - RNA, 24 nt, Human
cacacacauauauauauauauaua

SEQ ID NO: 715269 - RNA, 20 nt, Human
cacacauacacacacacaca

SEQ ID NO: 715270 - RNA, 26 nt, Human
cacauacacacacacacacacacaca

SEQ ID NO: 715271 - RNA, 22 nt, Human
cacauauauauauauauauaua

SEQ ID NO: 715272 - RNA, 19 nt, Human
cacccugggaccagcccaa

SEQ ID NO: 715273 - RNA, 21 nt, Human
cacuaccauaagcaaaaggga

SEQ ID NO: 715274 - RNA, 25 nt, Human
cagcaaacaagacggcuugcccucu

SEQ ID NO: 715275 - RNA, 22 nt, Human
cagcggcacccagggggcugcc

SEQ ID NO: 715276 - RNA, 23 nt, Human
caggaccagaaccuccuguccaa

SEQ ID NO: 715277 - RNA, 19 nt, Human
cagggggcugcccugcucu

SEQ ID NO: 715278 - RNA, 19 nt, Human
cagguggcugguggcagca

SEQ ID NO: 715279 - RNA, 18 nt, Human
cagugcguggccaaaggc

SEQ ID NO: 715280 - RNA, 26 nt, Human
cagugucagugcguggccaaaggcua

SEQ ID NO: 715281 - RNA, 22 nt, Human
caugcgauucucuucucuuuuc

SEQ ID NO: 715282 - RNA, 19 nt, Human
caugcucuuuuggccucgg

SEQ ID NO: 715283 - RNA, 25 nt, Human
cauucacuccaguccaaaacagugg

SEQ ID NO: 715284 - RNA, 21 nt, Human
cauuucaguuuacucagcaga

SEQ ID NO: 715285 - RNA, 22 nt, Human
ccagaaaaccgugguuuuucuu

SEQ ID NO: 715286 - RNA, 22 nt, Human
ccagaaccuccuguccaaccuc

SEQ ID NO: 715287 - RNA, 20 nt, Human
ccagaagagcagcugccgcg

SEQ ID NO: 715288 - RNA, 18 nt, Human
ccagugggacagaacagg

SEQ ID NO: 715289 - RNA, 21 nt, Human
cccaaaggcaggaccagaacc

SEQ ID NO: 715290 - RNA, 22 nt, Human
cccacuaccauaagcaaaaggg

SEQ ID NO: 715291 - RNA, 23 nt, Human
cccacucuuaacucagccucaua

SEQ ID NO: 715292 - RNA, 22 nt, Human
ccccucgcucccuuggugccca

SEQ ID NO: 715293 - RNA, 25 nt, Human
cccucuaugugcagaggagcuuuag

SEQ ID NO: 715294 - RNA, 19 nt, Human
cccugcgcuccaccccugu

SEQ ID NO: 715295 - RNA, 22 nt, Human
ccuccuguccaaccucaaaagc

SEQ ID NO: 715296 - RNA, 21 nt, Human
ccugacagcggcacccagggg

SEQ ID NO: 715297 - RNA, 19 nt, Human
ccugcaggcggggagcugu

SEQ ID NO: 715298 - RNA, 23 nt, Human
ccugcugcaccuggcucccuacc

SEQ ID NO: 715299 - RNA, 19 nt, Human
ccuuggugcccagggggcc

SEQ ID NO: 715300 - RNA, 20 nt, Human
cgagcgggcaggaggcgagc

SEQ ID NO: 715301 - RNA, 24 nt, Human
cgcuccaccccugugcccauucac

SEQ ID NO: 715302 - RNA, 28 nt, Human
cggcuucuggaggccgcguccaccccuu

SEQ ID NO: 715303 - RNA, 20 nt, Human
cucagcagauagaaaaauaa

SEQ ID NO: 715304 - RNA, 20 nt, Human
cucauuucaguuuacucagc

SEQ ID NO: 715305 - RNA, 24 nt, Human
cuccagcuggcuaagauaggcccu

SEQ ID NO: 715306 - RNA, 20 nt, Human
cucgcucccuuggugcccag

SEQ ID NO: 715307 - RNA, 22 nt, Human
cucucacaucccuaucuaugcc

SEQ ID NO: 715308 - RNA, 20 nt, Human
cucuuaaccacacucugcuu

SEQ ID NO: 715309 - RNA, 20 nt, Human
cugcccugcgcuccaccccu

SEQ ID NO: 715310 - RNA, 22 nt, Human
cuggagccaccugggccuggcc

SEQ ID NO: 715311 - RNA, 21 nt, Human
cugggccuggcucugcuccug

SEQ ID NO: 715312 - RNA, 19 nt, Human
cuggggcugcccugcgcuc

SEQ ID NO: 715313 - RNA, 23 nt, Human
cuuaaccacacucugcuuuugcu

SEQ ID NO: 715314 - RNA, 19 nt, Human
cuugcccucucagucuggc

SEQ ID NO: 715315 - RNA, 21 nt, Human
cuuggccugggcagugucagu

SEQ ID NO: 715316 - RNA, 25 nt, Human
gacccuugucucuuaaccacacucu

SEQ ID NO: 715317 - RNA, 24 nt, Human
gagccagcguuggccccaaaggca

SEQ ID NO: 715318 - RNA, 25 nt, Human
gaggagcuuuaggaaaggggacagg

SEQ ID NO: 715319 - RNA, 23 nt, Human
gaggccgcguccaccccuuuggg

SEQ ID NO: 715320 - RNA, 19 nt, Human
gcccauucacuccagucca

SEQ ID NO: 715321 - RNA, 21 nt, Human
gcggcacccagggggcugccc

SEQ ID NO: 715322 - RNA, 19 nt, Human
gcugcccugcgcuccaccc

SEQ ID NO: 715323 - RNA, 21 nt, Human
ggccuggggucgggcaggggu

SEQ ID NO: 715324 - RNA, 22 nt, Human
ggccuggggucgggcaggggug

SEQ ID NO: 715325 - RNA, 20 nt, Human
ggcuggcccaggggccaggu

SEQ ID NO: 715326 - RNA, 21 nt, Human
gggcaggaggcgagcccagga

SEQ ID NO: 715327 - RNA, 22 nt, Human
ggggccuggggucgggcagggg

SEQ ID NO: 715328 - RNA, 22 nt, Human
gguggucgauaaagugugaaac

SEQ ID NO: 715329 - RNA, 19 nt, Human
guauguguauauauauaca

SEQ ID NO: 715330 - RNA, 19 nt, Human
guccgggacacacgcgggg

SEQ ID NO: 715331 - RNA, 22 nt, Human
guggccaaaggcuacacaggac

SEQ ID NO: 715332 - RNA, 21 nt, Human
guggugguugggacccaucuc

SEQ ID NO: 715333 - RNA, 21 nt, Human
guguaucucuauaaacacaca

SEQ ID NO: 715334 - RNA, 24 nt, Human
guguguguauauauauguaugugu

SEQ ID NO: 715335 - RNA, 18 nt, Human
guugggacccaucucauu

SEQ ID NO: 715336 - RNA, 22 nt, Human
uaaaauaggcuugaaaauuaca

SEQ ID NO: 715337 - RNA, 22 nt, Human
uaaagcaccaguggccuuugaa

SEQ ID NO: 715338 - RNA, 19 nt, Human
uaagauaggcccuuccauc

SEQ ID NO: 715339 - RNA, 20 nt, Human
uacacacacacacacacaca

SEQ ID NO: 715340 - RNA, 24 nt, Human
uacacacacacacacacacacaua

SEQ ID NO: 715341 - RNA, 26 nt, Human
uacacacacacacacacacacauaua

SEQ ID NO: 715342 - RNA, 20 nt, Human
uacacacauauauaugugug

SEQ ID NO: 715343 - RNA, 20 nt, Human
uacacacauauauaugugug

SEQ ID NO: 715344 - RNA, 18 nt, Human
uacacaggaccccauggg

SEQ ID NO: 715345 - RNA, 23 nt, Human
uacaggguugggggugaaggggg

SEQ ID NO: 715346 - RNA, 19 nt, Human
uacaguggugguugggacc

SEQ ID NO: 715347 - RNA, 18 nt, Human
uagaaaaauaaagcacca

SEQ ID NO: 715348 - RNA, 26 nt, Human
uauaaacacacauacacacacacaca

SEQ ID NO: 715349 - RNA, 21 nt, Human
uauacacacauauauaugugu

SEQ ID NO: 715350 - RNA, 22 nt, Human
uauacacacauauauaugugug

SEQ ID NO: 715351 - RNA, 18 nt, Human
uauauacacacauauaua

SEQ ID NO: 715352 - RNA, 18 nt, Human
uauauacacacauauaua

SEQ ID NO: 715353 - RNA, 21 nt, Human
uauauacacacauauauaugu

SEQ ID NO: 715354 - RNA, 21 nt, Human
uauauauacacacauauauau

SEQ ID NO: 715355 - RNA, 21 nt, Human
uauauauacacacauauauau

SEQ ID NO: 715356 - RNA, 22 nt, Human
uauauauauacacacauauaua

SEQ ID NO: 715357 - RNA, 19 nt, Human
uauauauauauauauauau

SEQ ID NO: 715358 - RNA, 19 nt, Human
uauauauauauauauauau

SEQ ID NO: 715359 - RNA, 19 nt, Human
uauauauauauauauauau

SEQ ID NO: 715360 - RNA, 19 nt, Human
uauauauauauauauauau

SEQ ID NO: 715361 - RNA, 22 nt, Human
uauauauauguauguguauaua

SEQ ID NO: 715362 - RNA, 24 nt, Human
uaucuaugccaaaucgucauguca

SEQ ID NO: 715363 - RNA, 31 nt, Human
uaucucuauaaacacacauacacacacacag

SEQ ID NO: 715364 - RNA, 22 nt, Human
uauguauguguauauauauaca

SEQ ID NO: 715365 - RNA, 18 nt, Human
uauguguauauauauaca

SEQ ID NO: 715366 - RNA, 20 nt, Human
uauguguauauauauacaca

SEQ ID NO: 715367 - RNA, 18 nt, Human
uaugugugugucugugca

SEQ ID NO: 715368 - RNA, 22 nt, Human
uaugugugugucugugcaaaug

SEQ ID NO: 715369 - RNA, 23 nt, Human
ucacagagccaauauccagggga

SEQ ID NO: 715370 - RNA, 23 nt, Human
ucaugcgauucucuucucuuuuc

SEQ ID NO: 715371 - RNA, 18 nt, Human
uccagcuggcuaagauag

SEQ ID NO: 715372 - RNA, 18 nt, Human
uccaggggaaacgaaccu

SEQ ID NO: 715373 - RNA, 22 nt, Human
uccaggggaaacgaaccuucuu

SEQ ID NO: 715374 - RNA, 20 nt, Human
uccaucuggcuggcccaggg

SEQ ID NO: 715375 - RNA, 22 nt, Human
uccuguugcuugaagccacuca

SEQ ID NO: 715376 - RNA, 25 nt, Human
ucucacaucccuaucuaugccaaau

SEQ ID NO: 715377 - RNA, 19 nt, Human
ucucaucugaagugccccu

SEQ ID NO: 715378 - RNA, 18 nt, Human
ucucuuuucgggagagua

SEQ ID NO: 715379 - RNA, 21 nt, Human
ucucuuuuucuccccucuaug

SEQ ID NO: 715380 - RNA, 26 nt, Human
ucugaagugccccucaggccuuccag

SEQ ID NO: 715381 - RNA, 19 nt, Human
ucugcuccugacagcggca

SEQ ID NO: 715382 - RNA, 24 nt, Human
ucugcuuuugcuuggccugggcag

SEQ ID NO: 715383 - RNA, 21 nt, Human
ucuuuuggccucggcuucugg

SEQ ID NO: 715384 - RNA, 18 nt, Human
ugaaacccaagucaggga

SEQ ID NO: 715385 - RNA, 21 nt, Human
ugacacagagcgagcgggcag

SEQ ID NO: 715386 - RNA, 21 nt, Human
ugacauagacccuugucucuu

SEQ ID NO: 715387 - RNA, 21 nt, Human
ugacauagacccuugucucuu

SEQ ID NO: 715388 - RNA, 19 nt, Human
ugagaaaggaagguacucc

SEQ ID NO: 715389 - RNA, 27 nt, Human
ugagcaaagauggcuggccagugggac

SEQ ID NO: 715390 - RNA, 24 nt, Human
ugcagaggagcuuuaggaaagggg

SEQ ID NO: 715391 - RNA, 19 nt, Human
ugcccagggggccugggug

SEQ ID NO: 715392 - RNA, 21 nt, Human
ugcccugcgcuccaccccugu

SEQ ID NO: 715393 - RNA, 19 nt, Human
ugcuccugacagcggcacu

SEQ ID NO: 715394 - RNA, 21 nt, Human
ugcuuggccugggcaguguca

SEQ ID NO: 715395 - RNA, 19 nt, Human
uggagccaccugggccugg

SEQ ID NO: 715396 - RNA, 20 nt, Human
uggaggcuucaugccaagug

SEQ ID NO: 715397 - RNA, 20 nt, Human
uggaguugccuaaauucucu

SEQ ID NO: 715398 - RNA, 27 nt, Human
uggccugggcagugucagugcguggcc

SEQ ID NO: 715399 - RNA, 26 nt, Human
ugggacagaacagguuuggcuuaagc

SEQ ID NO: 715400 - RNA, 20 nt, Human
ugggaucacacauugcuguc

SEQ ID NO: 715401 - RNA, 19 nt, Human
uggggucgggcagggguga

SEQ ID NO: 715402 - RNA, 21 nt, Human
uggguggugccacccugggac

SEQ ID NO: 715403 - RNA, 27 nt, Human
uguauauauauacacacauauauaugu

SEQ ID NO: 715404 - RNA, 20 nt, Human
ugugcaaaugcgugugugua

SEQ ID NO: 715405 - RNA, 24 nt, Human
ugugcaaaugcguguguguauaua

SEQ ID NO: 715406 - RNA, 22 nt, Human
uguguauauauauacacacaua

SEQ ID NO: 715407 - RNA, 24 nt, Human
uguguauauauauacacacauaua

SEQ ID NO: 715408 - RNA, 29 nt, Human
uguguauauauauacacacauauauaugg

SEQ ID NO: 715409 - RNA, 19 nt, Human
uguguauauauauguaugu

SEQ ID NO: 715410 - RNA, 26 nt, Human
uguguauauauauguauguguauaua

SEQ ID NO: 715411 - RNA, 19 nt, Human
uguguguauauauauguau

SEQ ID NO: 715412 - RNA, 21 nt, Human
uguguguauauauauguaugu

SEQ ID NO: 715413 - RNA, 24 nt, Human
uguguguauauauauguaugugua

SEQ ID NO: 715414 - RNA, 23 nt, Human
uguguguaucucuauaaacacac

SEQ ID NO: 715415 - RNA, 28 nt, Human
uguguguguaucucuauaaacacacaua

SEQ ID NO: 715416 - RNA, 24 nt, Human
uugccuaaauucucuuuuucuccc

SEQ ID NO: 715417 - RNA, 21 nt, Human
uugcuugaagccacucacaug

SEQ ID NO: 715418 - RNA, 21 nt, Human
uugcuuggccugggcaguguc

SEQ ID NO: 715419 - RNA, 24 nt, Human
uuggccccaaaggcaggaccagaa

SEQ ID NO: 715420 - RNA, 20 nt, Human
uugggggugaagggggagug

SEQ ID NO: 715421 - RNA, 25 nt, Human
uuggugcccagggggccuggguggu

SEQ ID NO: 715422 - RNA, 20 nt, Human
uuuacagguacaaauaaaau

SEQ ID NO: 715423 - RNA, 23 nt, Human
uuucuccccucuaugugcagagg

SEQ ID NO: 715424 - RNA, 18 nt, Human
aaaaucuguuucuuucca

SEQ ID NO: 715425 - RNA, 19 nt, Human
aaacaaaacauaaaauucc

SEQ ID NO: 715426 - RNA, 21 nt, Human
aaacaaaacauaaaauucccu

SEQ ID NO: 715427 - RNA, 22 nt, Human
aacaaaacauaaaauucccuua

SEQ ID NO: 715428 - RNA, 23 nt, Human
aagcaaccaaaguaugaauacag

SEQ ID NO: 715429 - RNA, 25 nt, Human
agaaaaaaaaucugaaucuucaugu

SEQ ID NO: 715430 - RNA, 19 nt, Human
agaucuccaguaguuuaaa

SEQ ID NO: 715431 - RNA, 22 nt, Human
auggaaaagaaaaaaaaucuga

SEQ ID NO: 715432 - RNA, 22 nt, Human
caaguccaguuuaggcaagcaa

SEQ ID NO: 715433 - RNA, 22 nt, Human
caauauacaaguauggaaaaga

SEQ ID NO: 715434 - RNA, 24 nt, Human
ccgccgccgucgccgcugccgccg

SEQ ID NO: 715435 - RNA, 21 nt, Human
ccgccgucgccgcugccgccg

SEQ ID NO: 715436 - RNA, 21 nt, Human
ccgccgucgccgcugccgccg

SEQ ID NO: 715437 - RNA, 18 nt, Human
ccgccuccugcugccgcc

SEQ ID NO: 715438 - RNA, 22 nt, Human
ccgccuccugcugccgccgccg

SEQ ID NO: 715439 - RNA, 22 nt, Human
ccgcugccgccgcuggaggccg

SEQ ID NO: 715440 - RNA, 23 nt, Human
ccuccugcugccgccgccgucgc

SEQ ID NO: 715441 - RNA, 21 nt, Human
cgggacacgacuagcucagga

SEQ ID NO: 715442 - RNA, 21 nt, Human
cucucccuccgccuccugcug

SEQ ID NO: 715443 - RNA, 23 nt, Human
gaacaauauauaaagucugaagc

SEQ ID NO: 715444 - RNA, 22 nt, Human
gccgccgccgucgccgcugccg

SEQ ID NO: 715445 - RNA, 21 nt, Human
gccuccugcugccgccgccgu

SEQ ID NO: 715446 - RNA, 20 nt, Human
gcucaggacuccaccgccau

SEQ ID NO: 715447 - RNA, 20 nt, Human
gcugccgccgccgucgccgc

SEQ ID NO: 715448 - RNA, 23 nt, Human
gucaaaaagauuuauuaacuuaa

SEQ ID NO: 715449 - RNA, 23 nt, Human
uaaaauagaugaaauuuguauca

SEQ ID NO: 715450 - RNA, 19 nt, Human
uaaaauggcagaucuccag

SEQ ID NO: 715451 - RNA, 19 nt, Human
uaaagucugaagcaaccaa

SEQ ID NO: 715452 - RNA, 25 nt, Human
uauacaaguauggaaaagaaaaaaa

SEQ ID NO: 715453 - RNA, 24 nt, Human
uauauaaagucugaagcaaccaaa

SEQ ID NO: 715454 - RNA, 23 nt, Human
ucgccgcugccgccgcuggaggc

SEQ ID NO: 715455 - RNA, 23 nt, Human
ugcgaggcccgcgagcuacaggc

SEQ ID NO: 715456 - RNA, 25 nt, Human
uggcuccugcucucccuccgccucc

SEQ ID NO: 715457 - RNA, 21 nt, Human
uuggugauacuaguaaaaacu

SEQ ID NO: 715458 - RNA, 21 nt, Human
uuugaaaaucuguuucuuucc

SEQ ID NO: 715459 - RNA, 22 nt, Human
uuuuauuuuuuuaccuuuuaaa

SEQ ID NO: 715460 - RNA, 20 nt, Human
aacaaauuaucagcucuccu

SEQ ID NO: 715461 - RNA, 20 nt, Human
aacccaacaaccuauuucca

SEQ ID NO: 715462 - RNA, 21 nt, Human
aacccaacaaccuauuuccag

SEQ ID NO: 715463 - RNA, 21 nt, Human
aaccgaacaacaggcaacggg

SEQ ID NO: 715464 - RNA, 23 nt, Human
aaccucacuuucccccccccuua

SEQ ID NO: 715465 - RNA, 20 nt, Human
aaccucuugcacuucaucuc

SEQ ID NO: 715466 - RNA, 19 nt, Human
aacggcaugugcacaugac

SEQ ID NO: 715467 - RNA, 24 nt, Human
aagaccuuccccaauaaaugacag

SEQ ID NO: 715468 - RNA, 18 nt, Human
aaggagccaggacuggag

SEQ ID NO: 715469 - RNA, 18 nt, Human
aauggccuuggcaggaau

SEQ ID NO: 715470 - RNA, 18 nt, Human
aauguagugacugcuagg

SEQ ID NO: 715471 - RNA, 25 nt, Human
aauuugcuuuucccgccaacucggc

SEQ ID NO: 715472 - RNA, 22 nt, Human
acacacacaagagcccugugug

SEQ ID NO: 715473 - RNA, 23 nt, Human
acagaguuuacaaaacugcugac

SEQ ID NO: 715474 - RNA, 20 nt, Human
accauaagaggggagcuggg

SEQ ID NO: 715475 - RNA, 21 nt, Human
acccaacaaccuauuuccagc

SEQ ID NO: 715476 - RNA, 24 nt, Human
acccaauaguaaaggaaccccaca

SEQ ID NO: 715477 - RNA, 26 nt, Human
acccaguacugaauaacaccuguacc

SEQ ID NO: 715478 - RNA, 21 nt, Human
accccaugcccagugcagcua

SEQ ID NO: 715479 - RNA, 22 nt, Human
accuccuccgucccuccuccac

SEQ ID NO: 715480 - RNA, 24 nt, Human
acuagcugcuguauuuacauacac

SEQ ID NO: 715481 - RNA, 25 nt, Human
agaaauacacaaccucuugcacuuc

SEQ ID NO: 715482 - RNA, 19 nt, Human
agcacguggagggaaggca

SEQ ID NO: 715483 - RNA, 23 nt, Human
agccugcucaaaacccaacaacc

SEQ ID NO: 715484 - RNA, 21 nt, Human
aggacacucuaaauucaccaa

SEQ ID NO: 715485 - RNA, 19 nt, Human
aggagcccaggauguagga

SEQ ID NO: 715486 - RNA, 23 nt, Human
agguggaacacaagguaacaguu

SEQ ID NO: 715487 - RNA, 20 nt, Human
aguaggcgaaggugaaauca

SEQ ID NO: 715488 - RNA, 22 nt, Human
augcuucuauauccaucuauca

SEQ ID NO: 715489 - RNA, 24 nt, Human
auguaacagggcucgguccccuca

SEQ ID NO: 715490 - RNA, 22 nt, Human
caaaacccaacaaccuauuucc

SEQ ID NO: 715491 - RNA, 21 nt, Human
caaaacugcugacuaaaaagc

SEQ ID NO: 715492 - RNA, 24 nt, Human
caacagugaaagcccaggccaaac

SEQ ID NO: 715493 - RNA, 21 nt, Human
caaccgaacaacaggcaacgg

SEQ ID NO: 715494 - RNA, 23 nt, Human
caagcaugcucagcccccacccc

SEQ ID NO: 715495 - RNA, 23 nt, Human
caauaauagcagcuuaaaaucca

SEQ ID NO: 715496 - RNA, 20 nt, Human
caauaguaaaggaaccccac

SEQ ID NO: 715497 - RNA, 21 nt, Human
cacaaccgaacaacaggcaac

SEQ ID NO: 715498 - RNA, 18 nt, Human
cacacaaccgaacaacag

SEQ ID NO: 715499 - RNA, 18 nt, Human
caccaccaccccaugccc

SEQ ID NO: 715500 - RNA, 18 nt, Human
caccuauaguaaauccca

SEQ ID NO: 715501 - RNA, 19 nt, Human
cacugcacaggaaggagac

SEQ ID NO: 715502 - RNA, 22 nt, Human
cagaagacaccuguagagacac

SEQ ID NO: 715503 - RNA, 18 nt, Human
cagcaagggaaccuccuc

SEQ ID NO: 715504 - RNA, 20 nt, Human
cagcaagggaaccuccuccg

SEQ ID NO: 715505 - RNA, 19 nt, Human
caggagcccaggauguagg

SEQ ID NO: 715506 - RNA, 22 nt, Human
cauucaauuacuccuagacuag

SEQ ID NO: 715507 - RNA, 18 nt, Human
cauuuuucaaaagcaaaa

SEQ ID NO: 715508 - RNA, 24 nt, Human
ccaacagugaaagcccaggccaaa

SEQ ID NO: 715509 - RNA, 24 nt, Human
ccaacuggugcucucccacuagcu

SEQ ID NO: 715510 - RNA, 27 nt, Human
ccacauauuaacuuucucauuuuacuc

SEQ ID NO: 715511 - RNA, 26 nt, Human
cccaaugcuaagcccaucuggucuuc

SEQ ID NO: 715512 - RNA, 23 nt, Human
cccacagcuaaggucuaacaggc

SEQ ID NO: 715513 - RNA, 24 nt, Human
cccagaagacaccuguagagacac

SEQ ID NO: 715514 - RNA, 21 nt, Human
cccaggauguaggaaggagcc

SEQ ID NO: 715515 - RNA, 20 nt, Human
cccaugcccagugcagcuac

SEQ ID NO: 715516 - RNA, 18 nt, Human
ccuaaaauuucaaagcac

SEQ ID NO: 715517 - RNA, 23 nt, Human
ccugaugggagcugccacacccc

SEQ ID NO: 715518 - RNA, 21 nt, Human
ccugcagagaaaugcuucuau

SEQ ID NO: 715519 - RNA, 22 nt, Human
ccuggggcggcgggcuccgggc

SEQ ID NO: 715520 - RNA, 27 nt, Human
ccuucagaaaagcaaucccugguccac

SEQ ID NO: 715521 - RNA, 18 nt, Human
ccuuuguuuggcccauag

SEQ ID NO: 715522 - RNA, 19 nt, Human
cggcgggcuccgggcuccg

SEQ ID NO: 715523 - RNA, 18 nt, Human
cgggcuccgggcuccgcu

SEQ ID NO: 715524 - RNA, 22 nt, Human
cuaaaaggacacucuaaauuca

SEQ ID NO: 715525 - RNA, 22 nt, Human
cuaacacauuuaaauucucaca

SEQ ID NO: 715526 - RNA, 24 nt, Human
cuacaggccaccauuauugguugc

SEQ ID NO: 715527 - RNA, 21 nt, Human
cucaugauacagcuucuggga

SEQ ID NO: 715528 - RNA, 23 nt, Human
cucaugauacagcuucugggaag

SEQ ID NO: 715529 - RNA, 23 nt, Human
cucucuugucgucuuucuccacc

SEQ ID NO: 715530 - RNA, 18 nt, Human
cugaaccacccaguacug

SEQ ID NO: 715531 - RNA, 18 nt, Human
cugcucaaaacccaacaa

SEQ ID NO: 715532 - RNA, 19 nt, Human
cugcugaaccacccaguac

SEQ ID NO: 715533 - RNA, 18 nt, Human
cuggcuucagaaaaggag

SEQ ID NO: 715534 - RNA, 22 nt, Human
cugugagauucaagguggaaca

SEQ ID NO: 715535 - RNA, 20 nt, Human
cuuauagaccaccuccagac

SEQ ID NO: 715536 - RNA, 24 nt, Human
cuucaaaagaauuugcuuuucccg

SEQ ID NO: 715537 - RNA, 22 nt, Human
cuuuugccaggcuguaccaugc

SEQ ID NO: 715538 - RNA, 24 nt, Human
gaaaagcaaucccugguccacaaa

SEQ ID NO: 715539 - RNA, 18 nt, Human
gaagcaaaguaauuugcc

SEQ ID NO: 715540 - RNA, 19 nt, Human
gaaggcagcuccugggaca

SEQ ID NO: 715541 - RNA, 22 nt, Human
gaaucuaaauagucaagaguuc

SEQ ID NO: 715542 - RNA, 24 nt, Human
gacuaggacaucacaauuguggug

SEQ ID NO: 715543 - RNA, 26 nt, Human
gagcagcuuucuguaucaucuugcuu

SEQ ID NO: 715544 - RNA, 23 nt, Human
gaggccacggaggguccccuuga

SEQ ID NO: 715545 - RNA, 24 nt, Human
gcaacaaaacaguaacuuggagga

SEQ ID NO: 715546 - RNA, 24 nt, Human
gccccaccuaaaaggacacucuaa

SEQ ID NO: 715547 - RNA, 23 nt, Human
gcgaaggugaaaucacucaguga

SEQ ID NO: 715548 - RNA, 19 nt, Human
gcgcagccacaucagcaga

SEQ ID NO: 715549 - RNA, 20 nt, Human
gcggcgggcuccgggcuccg

SEQ ID NO: 715550 - RNA, 25 nt, Human
gcucaaaacccaacaaccuauuucc

SEQ ID NO: 715551 - RNA, 24 nt, Human
ggaagaagggcacuugggaugggg

SEQ ID NO: 715552 - RNA, 23 nt, Human
ggaagcaaaguaauuugccuggu

SEQ ID NO: 715553 - RNA, 19 nt, Human
ggaguagcugagagcuuga

SEQ ID NO: 715554 - RNA, 19 nt, Human
ggauacauguuacacugca

SEQ ID NO: 715555 - RNA, 22 nt, Human
gggaaagacuaagacuucaaaa

SEQ ID NO: 715556 - RNA, 22 nt, Human
gggaagacagcuucuucaggaa

SEQ ID NO: 715557 - RNA, 19 nt, Human
ggugugaggagugggggga

SEQ ID NO: 715558 - RNA, 19 nt, Human
gucccuuucuuccuuccaa

SEQ ID NO: 715559 - RNA, 19 nt, Human
gugaaagcccaggccaaac

SEQ ID NO: 715560 - RNA, 19 nt, Human
gugaagcucuuagcagcua

SEQ ID NO: 715561 - RNA, 21 nt, Human
guggaacugugccauagggcc

SEQ ID NO: 715562 - RNA, 26 nt, Human
guggaagcagcucugcaguccaccac

SEQ ID NO: 715563 - RNA, 24 nt, Human
uaacagccugcucaaaacccaaca

SEQ ID NO: 715564 - RNA, 24 nt, Human
uaacagggcucgguccccucaaaa

SEQ ID NO: 715565 - RNA, 18 nt, Human
uaagcucccaccaccacc

SEQ ID NO: 715566 - RNA, 25 nt, Human
uaaguggaagcagcucugcagucca

SEQ ID NO: 715567 - RNA, 20 nt, Human
uacaggccaccauuauuggu

SEQ ID NO: 715568 - RNA, 21 nt, Human
uaccaccagaccauccuuagc

SEQ ID NO: 715569 - RNA, 20 nt, Human
uaccuaaaauuucaaagcac

SEQ ID NO: 715570 - RNA, 24 nt, Human
uacgggaagcauaagcuugugcug

SEQ ID NO: 715571 - RNA, 22 nt, Human
uacugccuucagaaaagcaauc

SEQ ID NO: 715572 - RNA, 19 nt, Human
uagccaagacagcucucaa

SEQ ID NO: 715573 - RNA, 21 nt, Human
uaggcccaacuggugcucucc

SEQ ID NO: 715574 - RNA, 18 nt, Human
uaguaaaggaaccccaca

SEQ ID NO: 715575 - RNA, 23 nt, Human
ucaaaagaauuugcuuuucccgc

SEQ ID NO: 715576 - RNA, 26 nt, Human
ucaaacaggagagugguuuguuuugc

SEQ ID NO: 715577 - RNA, 23 nt, Human
ucaaagcaccuccaagaaugaaa

SEQ ID NO: 715578 - RNA, 18 nt, Human
ucacacuggaagaagggc

SEQ ID NO: 715579 - RNA, 22 nt, Human
ucacuucccagauugcugauac

SEQ ID NO: 715580 - RNA, 18 nt, Human
ucagaaaaggaggccaca

SEQ ID NO: 715581 - RNA, 19 nt, Human
ucagaaaaggaggccacau

SEQ ID NO: 715582 - RNA, 25 nt, Human
uccacgugcuuccuuccuaaggccg

SEQ ID NO: 715583 - RNA, 18 nt, Human
uccauggccuuuguuugg

SEQ ID NO: 715584 - RNA, 22 nt, Human
uccauggccuuuguuuggccca

SEQ ID NO: 715585 - RNA, 22 nt, Human
ucccaaugcuaagcccaucugg

SEQ ID NO: 715586 - RNA, 23 nt, Human
ucccaccaccaccccaugcccag

SEQ ID NO: 715587 - RNA, 18 nt, Human
uccgcucugcggugcuga

SEQ ID NO: 715588 - RNA, 20 nt, Human
uccgcucugcggugcugagg

SEQ ID NO: 715589 - RNA, 19 nt, Human
uccuuuucuuucccuccuu

SEQ ID NO: 715590 - RNA, 18 nt, Human
ucugaaaagauacacaaa

SEQ ID NO: 715591 - RNA, 18 nt, Human
ucugcacaagcaugcuca

SEQ ID NO: 715592 - RNA, 23 nt, Human
ucugcacaagcaugcucagcccc

SEQ ID NO: 715593 - RNA, 19 nt, Human
ucugccccccagaagacac

SEQ ID NO: 715594 - RNA, 18 nt, Human
ucuguccuugaauaugag

SEQ ID NO: 715595 - RNA, 19 nt, Human
ucuuccuuuucuuucccuc

SEQ ID NO: 715596 - RNA, 19 nt, Human
ugaaaagccacggcuacgg

SEQ ID NO: 715597 - RNA, 25 nt, Human
ugaaaagccacggcuacgggaagca

SEQ ID NO: 715598 - RNA, 19 nt, Human
ugaaaggaggcuucugugu

SEQ ID NO: 715599 - RNA, 21 nt, Human
ugacaacacacacaagagccc

SEQ ID NO: 715600 - RNA, 20 nt, Human
ugagggaaagacuaagacuu

SEQ ID NO: 715601 - RNA, 26 nt, Human
ugauucacccaauaguaaaggaaccc

SEQ ID NO: 715602 - RNA, 19 nt, Human
ugcggugcugaggcugcgg

SEQ ID NO: 715603 - RNA, 20 nt, Human
ugcggugcugaggcugcggc

SEQ ID NO: 715604 - RNA, 22 nt, Human
ugcugguaauuuaguaaggugg

SEQ ID NO: 715605 - RNA, 18 nt, Human
uggaagaagggcacuugg

SEQ ID NO: 715606 - RNA, 18 nt, Human
uggcaggaaugguggggc

SEQ ID NO: 715607 - RNA, 22 nt, Human
uggcaggaaugguggggccuga

SEQ ID NO: 715608 - RNA, 18 nt, Human
ugggagcugccacacccc

SEQ ID NO: 715609 - RNA, 21 nt, Human
ugggaugacaucagcuaggaa

SEQ ID NO: 715610 - RNA, 19 nt, Human
ugguggggccugaacuggu

SEQ ID NO: 715611 - RNA, 20 nt, Human
ugguggggccugaacuggua

SEQ ID NO: 715612 - RNA, 25 nt, Human
ugugcugcuguguggggagagcugc

SEQ ID NO: 715613 - RNA, 19 nt, Human
uguguccauugccacugaa

SEQ ID NO: 715614 - RNA, 18 nt, Human
uguguggggagagcugcc

SEQ ID NO: 715615 - RNA, 26 nt, Human
uuaacccugucacuucccagauugcu

SEQ ID NO: 715616 - RNA, 18 nt, Human
uuaaccugaaagaaaccg

SEQ ID NO: 715617 - RNA, 21 nt, Human
uuaaccugaaagaaaccgcua

SEQ ID NO: 715618 - RNA, 22 nt, Human
uuaacuuucucauuuuacucaa

SEQ ID NO: 715619 - RNA, 19 nt, Human
uucauguaacaagcauuuu

SEQ ID NO: 715620 - RNA, 21 nt, Human
uucccaaauaccaccagacca

SEQ ID NO: 715621 - RNA, 19 nt, Human
uuccuaaggcugagagcuc

SEQ ID NO: 715622 - RNA, 22 nt, Human
uucuaccuaaaauuucaaagca

SEQ ID NO: 715623 - RNA, 18 nt, Human
uucuuccuuuucuuuccc

SEQ ID NO: 715624 - RNA, 19 nt, Human
uugccaggcuguaccaugc

SEQ ID NO: 715625 - RNA, 21 nt, Human
uugccauuaacucugucagcu

SEQ ID NO: 715626 - RNA, 23 nt, Human
uugcugguaauuuaguaaggugg

SEQ ID NO: 715627 - RNA, 23 nt, Human
uugguaacuagacugggaaucau

SEQ ID NO: 715628 - RNA, 24 nt, Human
uugguagaaaaaaagaauguguuc

SEQ ID NO: 715629 - RNA, 20 nt, Human
uugguucccacgagaaaucu

SEQ ID NO: 715630 - RNA, 19 nt, Human
uuuacauagccacuuggaa

SEQ ID NO: 715631 - RNA, 20 nt, Human
uuuucccaaauaccaccaga

SEQ ID NO: 715632 - RNA, 19 nt, Human
aagccaccuacuccacuca

SEQ ID NO: 715633 - RNA, 18 nt, Human
aaggaaguggaggcgagg

SEQ ID NO: 715634 - RNA, 22 nt, Human
aauguggguacaggaagagcaa

SEQ ID NO: 715635 - RNA, 21 nt, Human
acaccgcaggccccacggaac

SEQ ID NO: 715636 - RNA, 28 nt, Human
acccaggaccuccacccugacccacacc

SEQ ID NO: 715637 - RNA, 21 nt, Human
aggaagagcaagagagaaaug

SEQ ID NO: 715638 - RNA, 22 nt, Human
aggagccccggccccgcggccc

SEQ ID NO: 715639 - RNA, 20 nt, Human
aggccccuagucaagacccu

SEQ ID NO: 715640 - RNA, 19 nt, Human
agggaaaggaggaagggga

SEQ ID NO: 715641 - RNA, 20 nt, Human
agggaaaggaggaaggggau

SEQ ID NO: 715642 - RNA, 23 nt, Human
agguccccuggauagcucugccu

SEQ ID NO: 715643 - RNA, 19 nt, Human
agucccuguacaacagccu

SEQ ID NO: 715644 - RNA, 21 nt, Human
caagccccggggagcucgagg

SEQ ID NO: 715645 - RNA, 22 nt, Human
caagccccggggagcucgagga

SEQ ID NO: 715646 - RNA, 19 nt, Human
cacauggccaauucccagg

SEQ ID NO: 715647 - RNA, 18 nt, Human
cacccaggaccuccaccc

SEQ ID NO: 715648 - RNA, 25 nt, Human
cacccaggaccuccacccugacccc

SEQ ID NO: 715649 - RNA, 27 nt, Human
cacccugacccacaccgcaggccccag

SEQ ID NO: 715650 - RNA, 19 nt, Human
caccgguuuggcggcugca

SEQ ID NO: 715651 - RNA, 22 nt, Human
cacuccugaccccuggaggguu

SEQ ID NO: 715652 - RNA, 20 nt, Human
cagcagcaguggccagggaa

SEQ ID NO: 715653 - RNA, 18 nt, Human
cagcaguggccagggaaa

SEQ ID NO: 715654 - RNA, 22 nt, Human
cagccccucucgcuuccccucc

SEQ ID NO: 715655 - RNA, 18 nt, Human
cagucgugacagcagcaa

SEQ ID NO: 715656 - RNA, 20 nt, Human
cauggccaauucccaggccc

SEQ ID NO: 715657 - RNA, 25 nt, Human
cauuaaacauaccgugucccccaag

SEQ ID NO: 715658 - RNA, 23 nt, Human
ccacaccgcaggccccacggaac

SEQ ID NO: 715659 - RNA, 24 nt, Human
ccacaccgcaggccccacggaacc

SEQ ID NO: 715660 - RNA, 24 nt, Human
ccacccaggccccuagucaaaggc

SEQ ID NO: 715661 - RNA, 18 nt, Human
ccaggccccuagucaaag

SEQ ID NO: 715662 - RNA, 23 nt, Human
ccagucgugacagcagcaacaag

SEQ ID NO: 715663 - RNA, 24 nt, Human
cccaccaugcucagggaauggaag

SEQ ID NO: 715664 - RNA, 23 nt, Human
cccacggaacccaccagcuacga

SEQ ID NO: 715665 - RNA, 25 nt, Human
cccacggaacccaccagcuacgagc

SEQ ID NO: 715666 - RNA, 22 nt, Human
ccccgcccggcgacacacggcg

SEQ ID NO: 715667 - RNA, 23 nt, Human
ccccgcggccccgccccucgggg

SEQ ID NO: 715668 - RNA, 23 nt, Human
cccugacccacaccgcaggcccc

SEQ ID NO: 715669 - RNA, 27 nt, Human
cccugacccacaccgcaggccccacgg

SEQ ID NO: 715670 - RNA, 20 nt, Human
cccugggucccaccaugcuc

SEQ ID NO: 715671 - RNA, 20 nt, Human
ccgcaggccccacggaaccc

SEQ ID NO: 715672 - RNA, 21 nt, Human
ccgcaggccccacggaaccca

SEQ ID NO: 715673 - RNA, 22 nt, Human
ccgcugucggcgagaggcggcu

SEQ ID NO: 715674 - RNA, 21 nt, Human
ccggccccgcggccccgcccg

SEQ ID NO: 715675 - RNA, 19 nt, Human
ccucaaagcuuggggugga

SEQ ID NO: 715676 - RNA, 22 nt, Human
ccuccacccugacccacaccgc

SEQ ID NO: 715677 - RNA, 18 nt, Human
ccuccauuaaacauaccg

SEQ ID NO: 715678 - RNA, 22 nt, Human
ccugacccacaccgcaggcccc

SEQ ID NO: 715679 - RNA, 22 nt, Human
ccugaccccuggaggguugaga

SEQ ID NO: 715680 - RNA, 18 nt, Human
ccugggucccaccaugcu

SEQ ID NO: 715681 - RNA, 21 nt, Human
cgacagccccucucgcuuccc

SEQ ID NO: 715682 - RNA, 21 nt, Human
cgcaggcuccucaccgaugcc

SEQ ID NO: 715683 - RNA, 24 nt, Human
cgcggagucgcgacagccccucuc

SEQ ID NO: 715684 - RNA, 18 nt, Human
cggcugcaccggcaguag

SEQ ID NO: 715685 - RNA, 19 nt, Human
cuccacccugacccacacc

SEQ ID NO: 715686 - RNA, 22 nt, Human
cuuauggcccagucugcuuccc

SEQ ID NO: 715687 - RNA, 20 nt, Human
gagcucgaggaagacggcag

SEQ ID NO: 715688 - RNA, 18 nt, Human
gaggacccugggucccac

SEQ ID NO: 715689 - RNA, 18 nt, Human
gcagcaguggccagggaa

SEQ ID NO: 715690 - RNA, 23 nt, Human
gccuccccuccauuaaacauacc

SEQ ID NO: 715691 - RNA, 23 nt, Human
gcuggcgcacucgcgcuccccgc

SEQ ID NO: 715692 - RNA, 23 nt, Human
ggaaaaaaagccaccuacuccac

SEQ ID NO: 715693 - RNA, 22 nt, Human
ggaagagggagggaaaaaaagc

SEQ ID NO: 715694 - RNA, 23 nt, Human
ggaccuccacccugacccacacc

SEQ ID NO: 715695 - RNA, 18 nt, Human
ggagaaucaagagcccaa

SEQ ID NO: 715696 - RNA, 21 nt, Human
ggccccacggaacccaccagc

SEQ ID NO: 715697 - RNA, 20 nt, Human
ggccggaggagcgugcaagc

SEQ ID NO: 715698 - RNA, 21 nt, Human
ggcugaaaccagggcuccuca

SEQ ID NO: 715699 - RNA, 19 nt, Human
ggucccaggcccagagagg

SEQ ID NO: 715700 - RNA, 24 nt, Human
guccugaagggcaagaauaggagc

SEQ ID NO: 715701 - RNA, 21 nt, Human
gugacagcagcaacaaggaag

SEQ ID NO: 715702 - RNA, 18 nt, Human
guggccagggaaaggagg

SEQ ID NO: 715703 - RNA, 18 nt, Human
uaaacaaaccuugggcac

SEQ ID NO: 715704 - RNA, 19 nt, Human
ucagaggcccuccccacag

SEQ ID NO: 715705 - RNA, 19 nt, Human
ucagggagaaucaagagcc

SEQ ID NO: 715706 - RNA, 23 nt, Human
ucccaggcccagagaggauauug

SEQ ID NO: 715707 - RNA, 20 nt, Human
ucccaggcccuaaacaaacc

SEQ ID NO: 715708 - RNA, 18 nt, Human
ucccggaggcgcuuggcc

SEQ ID NO: 715709 - RNA, 24 nt, Human
ucccuccucagcuucccccaaaug

SEQ ID NO: 715710 - RNA, 18 nt, Human
ucccuguacaacagccug

SEQ ID NO: 715711 - RNA, 24 nt, Human
uccuacugcugcuaggucgucguc

SEQ ID NO: 715712 - RNA, 23 nt, Human
uccucagcuucccccaaaugugg

SEQ ID NO: 715713 - RNA, 29 nt, Human
ucucucggggccagaagagguuuccuggu

SEQ ID NO: 715714 - RNA, 21 nt, Human
ugaagggcaagaauaggagca

SEQ ID NO: 715715 - RNA, 19 nt, Human
ugacagcagcaacaaggaa

SEQ ID NO: 715716 - RNA, 25 nt, Human
ugacagcagcaacaaggaaguggag

SEQ ID NO: 715717 - RNA, 21 nt, Human
ugccucaggcaagggccuuac

SEQ ID NO: 715718 - RNA, 24 nt, Human
uggaagcucuuuggucagucccag

SEQ ID NO: 715719 - RNA, 22 nt, Human
uggaggguugagaacugaggac

SEQ ID NO: 715720 - RNA, 22 nt, Human
uggccagggaaaggaggaaggg

SEQ ID NO: 715721 - RNA, 19 nt, Human
uggcccggcggcuggacga

SEQ ID NO: 715722 - RNA, 25 nt, Human
uggcugacuguuccucccuccucag

SEQ ID NO: 715723 - RNA, 23 nt, Human
uucccaggcccuaaacaaaccuu

SEQ ID NO: 715724 - RNA, 21 nt, Human
uuucccucagccuccccucca

SEQ ID NO: 715725 - RNA, 27 nt, Human
agacagaaaaaaugcaguuguaugagg

SEQ ID NO: 715726 - RNA, 19 nt, Human
auaauagacagaaaaaaug

SEQ ID NO: 715727 - RNA, 22 nt, Human
auugaagaaguaggaaaaacag

SEQ ID NO: 715728 - RNA, 24 nt, Human
uaaggacaauccuuccauugaaga

SEQ ID NO: 715729 - RNA, 19 nt, Human
uagacagaaaaaaugcagu

SEQ ID NO: 715730 - RNA, 26 nt, Human
uagacagaaaaaaugcaguuguauga

SEQ ID NO: 715731 - RNA, 18 nt, Human
uauuuuacugaaaaucug

SEQ ID NO: 715732 - RNA, 20 nt, Human
uauuuuacugaaaaucugga

SEQ ID NO: 715733 - RNA, 20 nt, Human
ugaagaaguaggaaaaacag

SEQ ID NO: 715734 - RNA, 18 nt, Human
ugagauauaucuuacuca

SEQ ID NO: 715735 - RNA, 20 nt, Human
uucccauaauagacagaaaa

SEQ ID NO: 715736 - RNA, 19 nt, Human
uuuagaacauaaaacuaaa

SEQ ID NO: 715737 - RNA, 18 nt, Human
aaccauggucuccaguuc

SEQ ID NO: 715738 - RNA, 19 nt, Human
aagcacaggcgugcacacg

SEQ ID NO: 715739 - RNA, 22 nt, Human
aagcagacuuuuuuuuuuuuuu

SEQ ID NO: 715740 - RNA, 20 nt, Human
acaauccuuauugaagcuuu

SEQ ID NO: 715741 - RNA, 21 nt, Human
acagagucuacccuaaacucg

SEQ ID NO: 715742 - RNA, 23 nt, Human
agcacaggcgugcacacgcccuu

SEQ ID NO: 715743 - RNA, 21 nt, Human
agccgccccugcccccgcccg

SEQ ID NO: 715744 - RNA, 27 nt, Human
agcgacagggaccagccggcugcggga

SEQ ID NO: 715745 - RNA, 22 nt, Human
agcgcaggggcagcgacaggga

SEQ ID NO: 715746 - RNA, 20 nt, Human
aggcaaaauuaugcaaugug

SEQ ID NO: 715747 - RNA, 21 nt, Human
caaagcagacuuuuuuuuuuu

SEQ ID NO: 715748 - RNA, 21 nt, Human
caagccccuuacggagccaug

SEQ ID NO: 715749 - RNA, 24 nt, Human
cacaaagcagacuuuuuuuuuuuu

SEQ ID NO: 715750 - RNA, 23 nt, Human
cacacaauccuuauugaagcuuu

SEQ ID NO: 715751 - RNA, 24 nt, Human
cacacgcccuugcacaugcaccac

SEQ ID NO: 715752 - RNA, 20 nt, Human
cacaugcaccacagugaggu

SEQ ID NO: 715753 - RNA, 20 nt, Human
caccagacucccacuucuaa

SEQ ID NO: 715754 - RNA, 21 nt, Human
ccacaaguaaaagacuucaca

SEQ ID NO: 715755 - RNA, 23 nt, Human
ccaccagacucccacuucuaaag

SEQ ID NO: 715756 - RNA, 23 nt, Human
ccccauguguuggagcugcugcc

SEQ ID NO: 715757 - RNA, 26 nt, Human
ccccuuacggagccauggauaggaau

SEQ ID NO: 715758 - RNA, 19 nt, Human
ccgcuggacuucuugacua

SEQ ID NO: 715759 - RNA, 18 nt, Human
ccuaaacucguuugugcc

SEQ ID NO: 715760 - RNA, 19 nt, Human
cuccgcccgggcggcugcg

SEQ ID NO: 715761 - RNA, 23 nt, Human
gaccauauugaucuggcacuuaa

SEQ ID NO: 715762 - RNA, 19 nt, Human
gacugcacugggaccucua

SEQ ID NO: 715763 - RNA, 20 nt, Human
gacuuuuuuuuuuuuuugga

SEQ ID NO: 715764 - RNA, 22 nt, Human
gagcgcagccggagccccgccg

SEQ ID NO: 715765 - RNA, 23 nt, Human
gagcugcugaggauggagcuggc

SEQ ID NO: 715766 - RNA, 28 nt, Human
gauggcaaagcacaggcgucacagaggu

SEQ ID NO: 715767 - RNA, 18 nt, Human
gcacaggcgugcacacgc

SEQ ID NO: 715768 - RNA, 22 nt, Human
gcacaggcgugcacacgcccuu

SEQ ID NO: 715769 - RNA, 21 nt, Human
gcacuauuauggugaguuucu

SEQ ID NO: 715770 - RNA, 21 nt, Human
gccucaagccccuuacggagc

SEQ ID NO: 715771 - RNA, 19 nt, Human
gcggcugcggcugaaugga

SEQ ID NO: 715772 - RNA, 21 nt, Human
gcgugcacacgcccuugcaca

SEQ ID NO: 715773 - RNA, 25 nt, Human
gcgugcacacgcccuugcacaugca

SEQ ID NO: 715774 - RNA, 22 nt, Human
ggagccgccccugcccccgccc

SEQ ID NO: 715775 - RNA, 23 nt, Human
gucauccuuaaggauaugauucu

SEQ ID NO: 715776 - RNA, 21 nt, Human
uaaaaaaauaucauacauuag

SEQ ID NO: 715777 - RNA, 21 nt, Human
uacaaguaacuuuucugcuac

SEQ ID NO: 715778 - RNA, 24 nt, Human
uauagugaguaaggagguguuuac

SEQ ID NO: 715779 - RNA, 20 nt, Human
ucacaaagcagacuuuuuuu

SEQ ID NO: 715780 - RNA, 23 nt, Human
uccacaaguaaaagacuucacaa

SEQ ID NO: 715781 - RNA, 20 nt, Human
uccccuuggcggcggcggcg

SEQ ID NO: 715782 - RNA, 22 nt, Human
ucccggaguggaagcucagcuu

SEQ ID NO: 715783 - RNA, 18 nt, Human
uccgcaccgggcgggugg

SEQ ID NO: 715784 - RNA, 20 nt, Human
ucuauauugggacgccgcug

SEQ ID NO: 715785 - RNA, 20 nt, Human
ucuggacagacugcacuggg

SEQ ID NO: 715786 - RNA, 22 nt, Human
ucuggacagacugcacugggac

SEQ ID NO: 715787 - RNA, 19 nt, Human
ugaauggauccaauauggc

SEQ ID NO: 715788 - RNA, 21 nt, Human
ugaauggauccaauauggcca

SEQ ID NO: 715789 - RNA, 20 nt, Human
uggaacagcuguuuacaaca

SEQ ID NO: 715790 - RNA, 18 nt, Human
uggcggcggcggcgggag

SEQ ID NO: 715791 - RNA, 20 nt, Human
ugggcugggacgagcgcagg

SEQ ID NO: 715792 - RNA, 18 nt, Human
ugguccugagcuggcccc

SEQ ID NO: 715793 - RNA, 19 nt, Human
uuccaccagacucccacuu

SEQ ID NO: 715794 - RNA, 19 nt, Human
uuugauguucccugaugga

SEQ ID NO: 715795 - RNA, 23 nt, Human
uuuuuuuuuuuuuuggucccgga

SEQ ID NO: 715796 - RNA, 24 nt, Human
aaaaaaaaaagaaaaaagaaaaag

SEQ ID NO: 715797 - RNA, 21 nt, Human
aaaaaaagaacaaagaaaaca

SEQ ID NO: 715798 - RNA, 21 nt, Human
aaaaaacacucagacaaaucc

SEQ ID NO: 715799 - RNA, 19 nt, Human
aaaaaauagaaccagcuau

SEQ ID NO: 715800 - RNA, 22 nt, Human
aaaaagaaaaaagaaaaagcaa

SEQ ID NO: 715801 - RNA, 23 nt, Human
aaaagaaaaagcaacuggaagag

SEQ ID NO: 715802 - RNA, 18 nt, Human
aaacaaaagagagagaac

SEQ ID NO: 715803 - RNA, 18 nt, Human
aaacacacagagacaaga

SEQ ID NO: 715804 - RNA, 19 nt, Human
aaacaucgcaacaaauuuc

SEQ ID NO: 715805 - RNA, 19 nt, Human
aaaggucaacaagcugaag

SEQ ID NO: 715806 - RNA, 20 nt, Human
aaauacacaucuauuuacaa

SEQ ID NO: 715807 - RNA, 19 nt, Human
aacauggugaaaccccauc

SEQ ID NO: 715808 - RNA, 20 nt, Human
aacauggugaaaccccaucu

SEQ ID NO: 715809 - RNA, 21 nt, Human
aacauggugaaaccccaucuc

SEQ ID NO: 715810 - RNA, 21 nt, Human
aacauggugaaaccccaucuc

SEQ ID NO: 715811 - RNA, 21 nt, Human
aaccaaugacugcuccagaga

SEQ ID NO: 715812 - RNA, 20 nt, Human
aaccaguacccaaaccaaac

SEQ ID NO: 715813 - RNA, 23 nt, Human
aaccaguacccaaaccaaacaca

SEQ ID NO: 715814 - RNA, 19 nt, Human
aaccauuuuuauccauccu

SEQ ID NO: 715815 - RNA, 23 nt, Human
aacuccuaaauaaaaguaauuuu

SEQ ID NO: 715816 - RNA, 21 nt, Human
aacuccuacggugaccuugac

SEQ ID NO: 715817 - RNA, 21 nt, Human
aacuggaggccgggcguggug

SEQ ID NO: 715818 - RNA, 19 nt, Human
aagagauuggggggagccu

SEQ ID NO: 715819 - RNA, 23 nt, Human
aagagggaugaauauaacuuucu

SEQ ID NO: 715820 - RNA, 18 nt, Human
aagcaacuggaagagauu

SEQ ID NO: 715821 - RNA, 21 nt, Human
aagccgaggugggcagaucac

SEQ ID NO: 715822 - RNA, 18 nt, Human
aaggaaaagcacgagugu

SEQ ID NO: 715823 - RNA, 18 nt, Human
aagggcccggccgcguuc

SEQ ID NO: 715824 - RNA, 20 nt, Human
aagggguccaguggacacug

SEQ ID NO: 715825 - RNA, 22 nt, Human
aagggguccaguggacacugcu

SEQ ID NO: 715826 - RNA, 20 nt, Human
aauaaagcaccaaccaauga

SEQ ID NO: 715827 - RNA, 24 nt, Human
aaucgcucgaacccgggaggcaga

SEQ ID NO: 715828 - RNA, 18 nt, Human
aauuagccaagcaugaug

SEQ ID NO: 715829 - RNA, 19 nt, Human
acagaagcaucauuaagcc

SEQ ID NO: 715830 - RNA, 24 nt, Human
accccaucucuacuaaaaauacaa

SEQ ID NO: 715831 - RNA, 19 nt, Human
acccucagcuuauucccag

SEQ ID NO: 715832 - RNA, 24 nt, Human
accugaggucaggaguucgaggcc

SEQ ID NO: 715833 - RNA, 20 nt, Human
accugcuggcuuggucacuu

SEQ ID NO: 715834 - RNA, 19 nt, Human
acugcacuacagccugggu

SEQ ID NO: 715835 - RNA, 24 nt, Human
acugcacuacagccugggugacag

SEQ ID NO: 715836 - RNA, 26 nt, Human
acugcacuacagccugggugacagag

SEQ ID NO: 715837 - RNA, 24 nt, Human
agacaaauccacaagaagugggca

SEQ ID NO: 715838 - RNA, 22 nt, Human
agacuggaguuuguuacugcaa

SEQ ID NO: 715839 - RNA, 24 nt, Human
agacuggaguuuguuacugcaaac

SEQ ID NO: 715840 - RNA, 18 nt, Human
agagacugcagugagcug

SEQ ID NO: 715841 - RNA, 24 nt, Human
agagacugcagugagcugagauua

SEQ ID NO: 715842 - RNA, 23 nt, Human
agagcaaaaaaacauaacaaacc

SEQ ID NO: 715843 - RNA, 28 nt, Human
agauaacacaaagaaaggucaacaagcu

SEQ ID NO: 715844 - RNA, 23 nt, Human
agauagaucugaacucauagcua

SEQ ID NO: 715845 - RNA, 23 nt, Human
agaucaccugaggucaggaguuc

SEQ ID NO: 715846 - RNA, 21 nt, Human
agcaaaaaaacauaacaaacc

SEQ ID NO: 715847 - RNA, 20 nt, Human
agcaacuucucccccagaug

SEQ ID NO: 715848 - RNA, 24 nt, Human
agcacuuuaggaagccgagguggg

SEQ ID NO: 715849 - RNA, 22 nt, Human
agccuggccaacauggugaaac

SEQ ID NO: 715850 - RNA, 24 nt, Human
agccuggccaacauggugaaaccc

SEQ ID NO: 715851 - RNA, 22 nt, Human
agccugggugacagaguaagac

SEQ ID NO: 715852 - RNA, 24 nt, Human
agccugggugacagaguaagaccu

SEQ ID NO: 715853 - RNA, 18 nt, Human
agcuaggaccgugcaugc

SEQ ID NO: 715854 - RNA, 22 nt, Human
aggaagccgaggugggcagauc

SEQ ID NO: 715855 - RNA, 25 nt, Human
aggcaaauaaacacacagagacaag

SEQ ID NO: 715856 - RNA, 26 nt, Human
aggcaaauaaacacacagagacaaga

SEQ ID NO: 715857 - RNA, 20 nt, Human
aggcagagacugcagugagc

SEQ ID NO: 715858 - RNA, 24 nt, Human
aggcagagacugcagugagcugag

SEQ ID NO: 715859 - RNA, 18 nt, Human
aggcaggagaaucgcucg

SEQ ID NO: 715860 - RNA, 24 nt, Human
aggcaggagaaucgcucgaacccg

SEQ ID NO: 715861 - RNA, 21 nt, Human
aggcagucuagccaagaccaa

SEQ ID NO: 715862 - RNA, 19 nt, Human
aggcaucacgucagggugg

SEQ ID NO: 715863 - RNA, 20 nt, Human
aggcugaggcaggagaaucg

SEQ ID NO: 715864 - RNA, 20 nt, Human
aggcugaggcaggagaaucg

SEQ ID NO: 715865 - RNA, 22 nt, Human
aggugggcagaucaccugaggu

SEQ ID NO: 715866 - RNA, 26 nt, Human
aggugggcagaucaccugaggucagg

SEQ ID NO: 715867 - RNA, 23 nt, Human
aucauuuauuaccagauuaucua

SEQ ID NO: 715868 - RNA, 18 nt, Human
augacugcuccagagaau

SEQ ID NO: 715869 - RNA, 24 nt, Human
auuaugccacugcacuacagccug

SEQ ID NO: 715870 - RNA, 23 nt, Human
auuuugcagaaaaacccauauuu

SEQ ID NO: 715871 - RNA, 22 nt, Human
caaaaaacacucagacaaaucc

SEQ ID NO: 715872 - RNA, 24 nt, Human
caaaaacccuacucaucucacuga

SEQ ID NO: 715873 - RNA, 26 nt, Human
caaaaucaucccaaaugcauucauaa

SEQ ID NO: 715874 - RNA, 22 nt, Human
caaagaaugaagacgcuucuua

SEQ ID NO: 715875 - RNA, 19 nt, Human
caaauaaacacacagagac

SEQ ID NO: 715876 - RNA, 24 nt, Human
caacauggugaaaccccaucucua

SEQ ID NO: 715877 - RNA, 22 nt, Human
caaccaaugacugcuccagaga

SEQ ID NO: 715878 - RNA, 20 nt, Human
caaccaguacccaaaccaaa

SEQ ID NO: 715879 - RNA, 22 nt, Human
caagaagugggcaacaugagcc

SEQ ID NO: 715880 - RNA, 18 nt, Human
caagacagcaacacuaga

SEQ ID NO: 715881 - RNA, 23 nt, Human
caccugaggucaggaguucgagg

SEQ ID NO: 715882 - RNA, 19 nt, Human
cacgccugcaaucccagca

SEQ ID NO: 715883 - RNA, 23 nt, Human
cacuacagccugggugacagagu

SEQ ID NO: 715884 - RNA, 23 nt, Human
cacugcacuacagccugggugac

SEQ ID NO: 715885 - RNA, 24 nt, Human
cacugcacuacagccugggugaca

SEQ ID NO: 715886 - RNA, 19 nt, Human
cacugcagagcaaaaaaac

SEQ ID NO: 715887 - RNA, 23 nt, Human
cacugcagagcaaaaaaacauaa

SEQ ID NO: 715888 - RNA, 22 nt, Human
cacugcuuuucccccacagaga

SEQ ID NO: 715889 - RNA, 19 nt, Human
cagaagagucuuuaaggaa

SEQ ID NO: 715890 - RNA, 24 nt, Human
cagaucaccugaggucaggaguuc

SEQ ID NO: 715891 - RNA, 27 nt, Human
cagaucaccugaggucaggaguucgag

SEQ ID NO: 715892 - RNA, 18 nt, Human
cagcaaccuuuuuuuguu

SEQ ID NO: 715893 - RNA, 24 nt, Human
cagcacuuuaggaagccgaggugg

SEQ ID NO: 715894 - RNA, 21 nt, Human
cagcaucaggaaaaugaaaac

SEQ ID NO: 715895 - RNA, 24 nt, Human
cagcuacucgggaggcugaggcag

SEQ ID NO: 715896 - RNA, 19 nt, Human
cauaaaccagauccacgug

SEQ ID NO: 715897 - RNA, 19 nt, Human
caucacgucaggguggugu

SEQ ID NO: 715898 - RNA, 18 nt, Human
caucauuaagcuucuauu

SEQ ID NO: 715899 - RNA, 22 nt, Human
caucccaaaugcauucauaaac

SEQ ID NO: 715900 - RNA, 20 nt, Human
cauuucacuacucauuaaca

SEQ ID NO: 715901 - RNA, 20 nt, Human
ccacugcacuacagccuggg

SEQ ID NO: 715902 - RNA, 20 nt, Human
ccacugcacuacagccuggg

SEQ ID NO: 715903 - RNA, 21 nt, Human
ccacugcacuacagccugggu

SEQ ID NO: 715904 - RNA, 23 nt, Human
ccacugcacuacagccuggguga

SEQ ID NO: 715905 - RNA, 24 nt, Human
ccacugcacuacagccugggugac

SEQ ID NO: 715906 - RNA, 22 nt, Human
cccgaucauaaaauaaguuacu

SEQ ID NO: 715907 - RNA, 23 nt, Human
ccuggccaacauggugaaacccc

SEQ ID NO: 715908 - RNA, 24 nt, Human
ccuggccaacauggugaaacccca

SEQ ID NO: 715909 - RNA, 20 nt, Human
ccugggugacagaguaagac

SEQ ID NO: 715910 - RNA, 21 nt, Human
ccuguagucccagcuacucgg

SEQ ID NO: 715911 - RNA, 22 nt, Human
ccuguagucccagcuacucggg

SEQ ID NO: 715912 - RNA, 23 nt, Human
ccuuccccaacaguucagcaccc

SEQ ID NO: 715913 - RNA, 19 nt, Human
ccuuucccacauaacuggg

SEQ ID NO: 715914 - RNA, 21 nt, Human
cgagaaccucacacacugcua

SEQ ID NO: 715915 - RNA, 24 nt, Human
cgaggccagccuggccaacauggu

SEQ ID NO: 715916 - RNA, 20 nt, Human
cgaggugggcagaucaccug

SEQ ID NO: 715917 - RNA, 24 nt, Human
cgaggugggcagaucaccugaggu

SEQ ID NO: 715918 - RNA, 22 nt, Human
cgcaacaaauuucuaaaaaaug

SEQ ID NO: 715919 - RNA, 23 nt, Human
cggaagaaggcgguggcggggcc

SEQ ID NO: 715920 - RNA, 24 nt, Human
cggcggcgccgagacucggucccc

SEQ ID NO: 715921 - RNA, 18 nt, Human
cggcggcggggccggcgg

SEQ ID NO: 715922 - RNA, 20 nt, Human
cucacacacugcuaugcucc

SEQ ID NO: 715923 - RNA, 22 nt, Human
cucacgccugcaaucccagcac

SEQ ID NO: 715924 - RNA, 24 nt, Human
cucacgccugcaaucccagcacuu

SEQ ID NO: 715925 - RNA, 22 nt, Human
cucagcuuauucccagggucca

SEQ ID NO: 715926 - RNA, 22 nt, Human
cugagcugcaauagaggcauca

SEQ ID NO: 715927 - RNA, 20 nt, Human
cugcagugagcugagauuau

SEQ ID NO: 715928 - RNA, 21 nt, Human
cugcagugagcugagauuaug

SEQ ID NO: 715929 - RNA, 23 nt, Human
cuggccaacauggugaaacccca

SEQ ID NO: 715930 - RNA, 23 nt, Human
cuuacaaucccaaacaaaaaccc

SEQ ID NO: 715931 - RNA, 20 nt, Human
cuuuggagcacagugauggc

SEQ ID NO: 715932 - RNA, 21 nt, Human
gaacacacucauaaugguaac

SEQ ID NO: 715933 - RNA, 21 nt, Human
gacagugagcaacuucucccc

SEQ ID NO: 715934 - RNA, 19 nt, Human
gacuggaccugccuguggc

SEQ ID NO: 715935 - RNA, 23 nt, Human
gagcacagugauggcaaaagugg

SEQ ID NO: 715936 - RNA, 24 nt, Human
gagcacagugauggcaaaaguggc

SEQ ID NO: 715937 - RNA, 23 nt, Human
gaggugggcagaucaccugaggu

SEQ ID NO: 715938 - RNA, 24 nt, Human
gaucaccugaggucaggaguucga

SEQ ID NO: 715939 - RNA, 19 nt, Human
gaucugguuaccaaaauca

SEQ ID NO: 715940 - RNA, 20 nt, Human
gcacugcagagcaaaaaaac

SEQ ID NO: 715941 - RNA, 23 nt, Human
gcagagcaaaaaaacauaacaaa

SEQ ID NO: 715942 - RNA, 24 nt, Human
gccaacauggugaaaccccaucuc

SEQ ID NO: 715943 - RNA, 24 nt, Human
gccacugcacuacagccuggguga

SEQ ID NO: 715944 - RNA, 23 nt, Human
gccgagacucgguccccaagggc

SEQ ID NO: 715945 - RNA, 24 nt, Human
gcucacaucacaguaaacuaccac

SEQ ID NO: 715946 - RNA, 18 nt, Human
ggagagcacuggcaggca

SEQ ID NO: 715947 - RNA, 20 nt, Human
ggaggcagagacugcaguga

SEQ ID NO: 715948 - RNA, 25 nt, Human
ggcagaucaccugaggucaggaguu

SEQ ID NO: 715949 - RNA, 20 nt, Human
ggcccggccgcguucgcccg

SEQ ID NO: 715950 - RNA, 24 nt, Human
ggcgcggcccgcgcccguuccccg

SEQ ID NO: 715951 - RNA, 21 nt, Human
ggcucacgccugcaaucccag

SEQ ID NO: 715952 - RNA, 21 nt, Human
gggcaggauggcgcuggagag

SEQ ID NO: 715953 - RNA, 23 nt, Human
gggcgugguggcucacgccugca

SEQ ID NO: 715954 - RNA, 24 nt, Human
gggcgugguggcucacgccugcaa

SEQ ID NO: 715955 - RNA, 20 nt, Human
gggcuuugggagucagagga

SEQ ID NO: 715956 - RNA, 18 nt, Human
ggggagccuuaugugcug

SEQ ID NO: 715957 - RNA, 18 nt, Human
gguccuaggggugccaca

SEQ ID NO: 715958 - RNA, 24 nt, Human
gguggcucacgccugcaaucccag

SEQ ID NO: 715959 - RNA, 22 nt, Human
ggugguguccagggcaggaugg

SEQ ID NO: 715960 - RNA, 20 nt, Human
guagaacacauaaugaaaug

SEQ ID NO: 715961 - RNA, 19 nt, Human
guauguaaacacaauguug

SEQ ID NO: 715962 - RNA, 25 nt, Human
gugcaagcaggagaacuccaguucu

SEQ ID NO: 715963 - RNA, 18 nt, Human
gugccuguagucccagcu

SEQ ID NO: 715964 - RNA, 18 nt, Human
guggcggggcccugcccc

SEQ ID NO: 715965 - RNA, 24 nt, Human
guggcuacagucacccuuccccaa

SEQ ID NO: 715966 - RNA, 21 nt, Human
uaaaaauacaaaaauuagcca

SEQ ID NO: 715967 - RNA, 22 nt, Human
uaaaaauagaaaacagcaaccu

SEQ ID NO: 715968 - RNA, 19 nt, Human
uaaacacacagagacaaga

SEQ ID NO: 715969 - RNA, 19 nt, Human
uaaacuagccuauuucccc

SEQ ID NO: 715970 - RNA, 21 nt, Human
uaaagaacacauccaguacca

SEQ ID NO: 715971 - RNA, 21 nt, Human
uaaagcaccaaccaaugacug

SEQ ID NO: 715972 - RNA, 21 nt, Human
uaaauuguacaaacaucgcaa

SEQ ID NO: 715973 - RNA, 19 nt, Human
uaaccauccccaaaugcau

SEQ ID NO: 715974 - RNA, 21 nt, Human
uaagcuucuauugggcuuucu

SEQ ID NO: 715975 - RNA, 18 nt, Human
uacaaucccaaacaaaaa

SEQ ID NO: 715976 - RNA, 22 nt, Human
uaccagauuaucuacccagaaa

SEQ ID NO: 715977 - RNA, 20 nt, Human
uaccagcacuuuuggagaag

SEQ ID NO: 715978 - RNA, 22 nt, Human
uacccuguggcuugcuguagca

SEQ ID NO: 715979 - RNA, 23 nt, Human
uaccuucucuagugcaagcagga

SEQ ID NO: 715980 - RNA, 18 nt, Human
uacugcaacagacuggag

SEQ ID NO: 715981 - RNA, 18 nt, Human
uacugcaacagacuggag

SEQ ID NO: 715982 - RNA, 21 nt, Human
uacuuugcaacuagaauacac

SEQ ID NO: 715983 - RNA, 24 nt, Human
uaggaagccgaggugggcagauca

SEQ ID NO: 715984 - RNA, 20 nt, Human
ucaccugaggucaggaguuc

SEQ ID NO: 715985 - RNA, 21 nt, Human
ucagauggaaauuuugcagaa

SEQ ID NO: 715986 - RNA, 21 nt, Human
ucagcuuauucccagggucca

SEQ ID NO: 715987 - RNA, 22 nt, Human
uccagggcaggauggcgcugga

SEQ ID NO: 715988 - RNA, 20 nt, Human
ucccaaacaaaaacccuacu

SEQ ID NO: 715989 - RNA, 24 nt, Human
uccccuuaaacugaucauuuaaau

SEQ ID NO: 715990 - RNA, 21 nt, Human
ucccuagaaaaaaaaugucug

SEQ ID NO: 715991 - RNA, 19 nt, Human
uccugcuauccacugcugc

SEQ ID NO: 715992 - RNA, 24 nt, Human
ucgggaggcugaggcaggagaauc

SEQ ID NO: 715993 - RNA, 24 nt, Human
ucuauuggcauuugucacccugga

SEQ ID NO: 715994 - RNA, 23 nt, Human
ucucuacuaaaaauacaaaaauu

SEQ ID NO: 715995 - RNA, 21 nt, Human
ugaaaaugacaccguacuuga

SEQ ID NO: 715996 - RNA, 19 nt, Human
ugaaaccccaucucuacua

SEQ ID NO: 715997 - RNA, 24 nt, Human
ugaauccaagacagcaacacuaga

SEQ ID NO: 715998 - RNA, 27 nt, Human
ugaauuuguuugcuugcccaaaauauu

SEQ ID NO: 715999 - RNA, 25 nt, Human
ugacaggggcagcuccuuggguccc

SEQ ID NO: 716000 - RNA, 22 nt, Human
ugaccagcccuuuacaaaaauu

SEQ ID NO: 716001 - RNA, 18 nt, Human
ugacuggaccugccugug

SEQ ID NO: 716002 - RNA, 21 nt, Human
ugagaacaaugccaauacugc

SEQ ID NO: 716003 - RNA, 23 nt, Human
ugagaacaaugccaauacugcca

SEQ ID NO: 716004 - RNA, 18 nt, Human
ugagaagucagauaagga

SEQ ID NO: 716005 - RNA, 24 nt, Human
ugagauuaugccacugcacuacag

SEQ ID NO: 716006 - RNA, 22 nt, Human
ugagcugagauuaugccacugc

SEQ ID NO: 716007 - RNA, 20 nt, Human
ugaggcaggagaaucgcucg

SEQ ID NO: 716008 - RNA, 24 nt, Human
ugaggcaggagaaucgcucgaacc

SEQ ID NO: 716009 - RNA, 25 nt, Human
ugaggcaggagaaucgcucgaaccc

SEQ ID NO: 716010 - RNA, 19 nt, Human
ugagguauuucaguuaaug

SEQ ID NO: 716011 - RNA, 21 nt, Human
ugaguugguggaaaugugggc

SEQ ID NO: 716012 - RNA, 21 nt, Human
ugaguugguggaaaugugggc

SEQ ID NO: 716013 - RNA, 24 nt, Human
ugaguugguggaaaugugggcguu

SEQ ID NO: 716014 - RNA, 19 nt, Human
ugaugcaguaccagcacuu

SEQ ID NO: 716015 - RNA, 24 nt, Human
ugauggugggugccuguaguccca

SEQ ID NO: 716016 - RNA, 21 nt, Human
ugauucucucuuuaccuucuc

SEQ ID NO: 716017 - RNA, 22 nt, Human
ugcauucauaaaccagauccac

SEQ ID NO: 716018 - RNA, 23 nt, Human
ugccuguagucccagcuacucgg

SEQ ID NO: 716019 - RNA, 24 nt, Human
ugccuguagucccagcuacucggg

SEQ ID NO: 716020 - RNA, 20 nt, Human
ugcuccagagaaugcccagc

SEQ ID NO: 716021 - RNA, 22 nt, Human
ugcugugggcuuuuauuuggug

SEQ ID NO: 716022 - RNA, 20 nt, Human
ugcuucuuuugguguucaca

SEQ ID NO: 716023 - RNA, 21 nt, Human
uggaaaaaauaaagccucuga

SEQ ID NO: 716024 - RNA, 23 nt, Human
uggaagagauuggggggagccuu

SEQ ID NO: 716025 - RNA, 19 nt, Human
uggagaagggugugguucu

SEQ ID NO: 716026 - RNA, 23 nt, Human
uggaggccgggcgugguggcuca

SEQ ID NO: 716027 - RNA, 24 nt, Human
uggccaacauggugaaaccccauc

SEQ ID NO: 716028 - RNA, 24 nt, Human
uggcucacgccugcaaucccagca

SEQ ID NO: 716029 - RNA, 24 nt, Human
ugggagucagaggagccggaagaa

SEQ ID NO: 716030 - RNA, 24 nt, Human
ugguggcucacgccugcaauccca

SEQ ID NO: 716031 - RNA, 21 nt, Human
uggugggugccuguaguccca

SEQ ID NO: 716032 - RNA, 20 nt, Human
uguuacugcaacagacugga

SEQ ID NO: 716033 - RNA, 20 nt, Human
uguuacugcaacagacugga

SEQ ID NO: 716034 - RNA, 25 nt, Human
uuaaaauauauuagcaggucauuaa

SEQ ID NO: 716035 - RNA, 18 nt, Human
uuaaccagguccaacuag

SEQ ID NO: 716036 - RNA, 24 nt, Human
uuaauagucuuacaaucccaaaca

SEQ ID NO: 716037 - RNA, 25 nt, Human
uuacaauaaagcaccaaccaaugac

SEQ ID NO: 716038 - RNA, 22 nt, Human
uucagcacccucagcuuauucc

SEQ ID NO: 716039 - RNA, 21 nt, Human
uuccauguggcuacagucacc

SEQ ID NO: 716040 - RNA, 22 nt, Human
uuccccaacaguucagcacccu

SEQ ID NO: 716041 - RNA, 21 nt, Human
uucucgggcuggccgggcccc

SEQ ID NO: 716042 - RNA, 23 nt, Human
uuggucccaaacauauuagucuc

SEQ ID NO: 716043 - RNA, 24 nt, Human
uuuaccuuucccacauaacugggg

SEQ ID NO: 716044 - RNA, 21 nt, Human
uuugcagugacuggaccugcc

SEQ ID NO: 716045 - RNA, 20 nt, Human
uuuggaauucucagugaauu

SEQ ID NO: 716046 - RNA, 20 nt, Human
aaaaaaaagguaggccgagc

SEQ ID NO: 716047 - RNA, 23 nt, Human
aaaaaaaucuaacacuauaucac

SEQ ID NO: 716048 - RNA, 24 nt, Human
aaaaaaccugaauccaguuagaac

SEQ ID NO: 716049 - RNA, 25 nt, Human
aaaccagagaaaccugacuagaaaa

SEQ ID NO: 716050 - RNA, 23 nt, Human
aaagaaaaaaauuaaaaguacaa

SEQ ID NO: 716051 - RNA, 21 nt, Human
aaagguuaggauaacaaacac

SEQ ID NO: 716052 - RNA, 19 nt, Human
aaaguaacuacagauuuuc

SEQ ID NO: 716053 - RNA, 27 nt, Human
aaauacuagaggucagcaggugacacu

SEQ ID NO: 716054 - RNA, 23 nt, Human
aacauggugaaacuccuccgucu

SEQ ID NO: 716055 - RNA, 24 nt, Human
aacauggugaaacuccuccgucuc

SEQ ID NO: 716056 - RNA, 19 nt, Human
aaccaauuagaacccucuc

SEQ ID NO: 716057 - RNA, 18 nt, Human
aacccagucaaucccuaa

SEQ ID NO: 716058 - RNA, 19 nt, Human
aacuauuucugcuccuucu

SEQ ID NO: 716059 - RNA, 20 nt, Human
aagcaaaacgaaacugcaaa

SEQ ID NO: 716060 - RNA, 21 nt, Human
aagcacaggauggagaggacc

SEQ ID NO: 716061 - RNA, 23 nt, Human
aaggugcugacugacaaggggga

SEQ ID NO: 716062 - RNA, 18 nt, Human
aaucgcuugaaucuggga

SEQ ID NO: 716063 - RNA, 24 nt, Human
aaucgcuugaaucugggaggcgga

SEQ ID NO: 716064 - RNA, 20 nt, Human
aauggaaaauucacagacca

SEQ ID NO: 716065 - RNA, 20 nt, Human
acacuaaaucuacuacgcau

SEQ ID NO: 716066 - RNA, 19 nt, Human
acagaccaggugaugcagu

SEQ ID NO: 716067 - RNA, 24 nt, Human
acagagcgagaguccgucucaaaa

SEQ ID NO: 716068 - RNA, 22 nt, Human
acagaggaaaagugauucuaaa

SEQ ID NO: 716069 - RNA, 22 nt, Human
accacugcacuccagccugggc

SEQ ID NO: 716070 - RNA, 23 nt, Human
accacugcacuccagccugggcg

SEQ ID NO: 716071 - RNA, 25 nt, Human
accacugcacuccagccugggcgac

SEQ ID NO: 716072 - RNA, 22 nt, Human
accaugaaggccuccacugccc

SEQ ID NO: 716073 - RNA, 24 nt, Human
accccgucucuacuaaaaauacaa

SEQ ID NO: 716074 - RNA, 24 nt, Human
acucagagaccaggauuuuuuucg

SEQ ID NO: 716075 - RNA, 19 nt, Human
acuccagccuggacaagag

SEQ ID NO: 716076 - RNA, 24 nt, Human
acugcacuccagccugggcgacag

SEQ ID NO: 716077 - RNA, 26 nt, Human
acugcacuccagccugggcgacagag

SEQ ID NO: 716078 - RNA, 25 nt, Human
acugcacuccagccugggcgacagg

SEQ ID NO: 716079 - RNA, 24 nt, Human
acugucugaaagauguuuauccca

SEQ ID NO: 716080 - RNA, 21 nt, Human
agaaagcccugucugcaugug

SEQ ID NO: 716081 - RNA, 25 nt, Human
agaaagugaccaauggcaacccugc

SEQ ID NO: 716082 - RNA, 18 nt, Human
agaaauccugcauccucu

SEQ ID NO: 716083 - RNA, 21 nt, Human
agaaguacaaccucugcucag

SEQ ID NO: 716084 - RNA, 21 nt, Human
agagccagaagccagggagcu

SEQ ID NO: 716085 - RNA, 24 nt, Human
agagguggcagugagccgagaucg

SEQ ID NO: 716086 - RNA, 18 nt, Human
agcacaggauggagagga

SEQ ID NO: 716087 - RNA, 23 nt, Human
agcacaguggcucacaccuguaa

SEQ ID NO: 716088 - RNA, 24 nt, Human
agcacuuugggaggcugaggcagg

SEQ ID NO: 716089 - RNA, 20 nt, Human
agccagaagccagggagcua

SEQ ID NO: 716090 - RNA, 20 nt, Human
agccagcggagagccuuauu

SEQ ID NO: 716091 - RNA, 23 nt, Human
agccgggcauggcggugggcgcc

SEQ ID NO: 716092 - RNA, 22 nt, Human
agccuggccaacauggugaaac

SEQ ID NO: 716093 - RNA, 24 nt, Human
agccuggccaacauggugaaacuc

SEQ ID NO: 716094 - RNA, 19 nt, Human
agccuggccaauauaguga

SEQ ID NO: 716095 - RNA, 22 nt, Human
agccuggccaauauagugaaac

SEQ ID NO: 716096 - RNA, 24 nt, Human
agccuggccaauauagugaaaccc

SEQ ID NO: 716097 - RNA, 19 nt, Human
aggaaaagcauccuuucca

SEQ ID NO: 716098 - RNA, 20 nt, Human
aggcaggagaaucgcuugaa

SEQ ID NO: 716099 - RNA, 24 nt, Human
aggcaggagaaucgcuugaaucug

SEQ ID NO: 716100 - RNA, 21 nt, Human
aggcaggcggauuacuugagg

SEQ ID NO: 716101 - RNA, 22 nt, Human
aggcaggcggauuacuugaggg

SEQ ID NO: 716102 - RNA, 22 nt, Human
aggcaggcggauuacuugaggu

SEQ ID NO: 716103 - RNA, 22 nt, Human
aggccgagcacaguggcucaca

SEQ ID NO: 716104 - RNA, 24 nt, Human
aggcggagauugcggugagcugag

SEQ ID NO: 716105 - RNA, 24 nt, Human
aggcggugagcuugcugggggccg

SEQ ID NO: 716106 - RNA, 21 nt, Human
aggcugagacagauuuccaca

SEQ ID NO: 716107 - RNA, 24 nt, Human
aggcugaggcaggagaaguguuug

SEQ ID NO: 716108 - RNA, 20 nt, Human
aggcugaggcaggagaaucg

SEQ ID NO: 716109 - RNA, 24 nt, Human
aggcugaggcaggagaaucgcuug

SEQ ID NO: 716110 - RNA, 21 nt, Human
aggcugaggcaggcggauuac

SEQ ID NO: 716111 - RNA, 24 nt, Human
aggcugaggcaggcggauuacuug

SEQ ID NO: 716112 - RNA, 24 nt, Human
agggagagguggcagugagccgag

SEQ ID NO: 716113 - RNA, 20 nt, Human
agguuaggauaacaaacacu

SEQ ID NO: 716114 - RNA, 24 nt, Human
aguggcucacaccuguaauuccag

SEQ ID NO: 716115 - RNA, 21 nt, Human
auaauccuggcuaccugggag

SEQ ID NO: 716116 - RNA, 22 nt, Human
auacuccagccuggacaagagc

SEQ ID NO: 716117 - RNA, 22 nt, Human
auagaagauacgaaaauaacua

SEQ ID NO: 716118 - RNA, 21 nt, Human
aucacgucuguaaucccagca

SEQ ID NO: 716119 - RNA, 23 nt, Human
aucacuugaggucaggaggucga

SEQ ID NO: 716120 - RNA, 24 nt, Human
aucgcaccauuauacuccagccug

SEQ ID NO: 716121 - RNA, 26 nt, Human
augcauucuuuaauacaucaaaaaaa

SEQ ID NO: 716122 - RNA, 22 nt, Human
auuauacuccagccuggacaag

SEQ ID NO: 716123 - RNA, 24 nt, Human
caaaaaacaaaaaaaaaagguagg

SEQ ID NO: 716124 - RNA, 21 nt, Human
caacaguguccggcacucagu

SEQ ID NO: 716125 - RNA, 27 nt, Human
caacauggugaaacuccuccgucucua

SEQ ID NO: 716126 - RNA, 24 nt, Human
caagcccaggcaggaaauaaagga

SEQ ID NO: 716127 - RNA, 20 nt, Human
caaggaggcggugagcuugc

SEQ ID NO: 716128 - RNA, 23 nt, Human
caagucuuucaccuaacagcaca

SEQ ID NO: 716129 - RNA, 24 nt, Human
caauauagugaaaccccgucucua

SEQ ID NO: 716130 - RNA, 25 nt, Human
caauggcaacccugcacaguugcaa

SEQ ID NO: 716131 - RNA, 24 nt, Human
cacaccuguaauuccagcaccuug

SEQ ID NO: 716132 - RNA, 24 nt, Human
cacaucacuugaggucaggagguc

SEQ ID NO: 716133 - RNA, 24 nt, Human
caccauuauacuccagccuggaca

SEQ ID NO: 716134 - RNA, 22 nt, Human
cacccacuguacgacucucaau

SEQ ID NO: 716135 - RNA, 21 nt, Human
caccuguaauuccagcaccuu

SEQ ID NO: 716136 - RNA, 23 nt, Human
caccuguaauuccagcaccuugg

SEQ ID NO: 716137 - RNA, 24 nt, Human
caccuguaauuccagcaccuuggg

SEQ ID NO: 716138 - RNA, 24 nt, Human
cacgucuguaaucccagcacuuug

SEQ ID NO: 716139 - RNA, 24 nt, Human
cacuccagccugggcgacagagcg

SEQ ID NO: 716140 - RNA, 19 nt, Human
cacugcacuccagccuggg

SEQ ID NO: 716141 - RNA, 20 nt, Human
cacugcacuccagccugggc

SEQ ID NO: 716142 - RNA, 22 nt, Human
cacugcacuccagccugggcga

SEQ ID NO: 716143 - RNA, 23 nt, Human
cacugcacuccagccugggcgac

SEQ ID NO: 716144 - RNA, 24 nt, Human
cacugcacuccagccugggcgaca

SEQ ID NO: 716145 - RNA, 25 nt, Human
cacugcacuccagccugggcgacaa

SEQ ID NO: 716146 - RNA, 20 nt, Human
cacugcacuccagccugggg

SEQ ID NO: 716147 - RNA, 21 nt, Human
cacuguaacuaauaaaauugc

SEQ ID NO: 716148 - RNA, 23 nt, Human
cagaaaagauuacaagcacugag

SEQ ID NO: 716149 - RNA, 22 nt, Human
cagaaccaauuagaacccucuc

SEQ ID NO: 716150 - RNA, 24 nt, Human
cagcaccuugggaggccgagaugg

SEQ ID NO: 716151 - RNA, 24 nt, Human
cagcacuuugggaggcugaggcag

SEQ ID NO: 716152 - RNA, 26 nt, Human
cagcacuuugggaggcugaggcaggc

SEQ ID NO: 716153 - RNA, 24 nt, Human
cagcaggugacacuggcccugcug

SEQ ID NO: 716154 - RNA, 24 nt, Human
caggccaggcgcggccugguguga

SEQ ID NO: 716155 - RNA, 18 nt, Human
caucacuugaggucagga

SEQ ID NO: 716156 - RNA, 24 nt, Human
caucacuugaggucaggaggucga

SEQ ID NO: 716157 - RNA, 23 nt, Human
caugacucuagcucuagggcaaa

SEQ ID NO: 716158 - RNA, 20 nt, Human
cauguggaauguucucuagg

SEQ ID NO: 716159 - RNA, 19 nt, Human
cauuauacuccagccugga

SEQ ID NO: 716160 - RNA, 24 nt, Human
cauuauacuccagccuggacaaga

SEQ ID NO: 716161 - RNA, 22 nt, Human
ccaaauaaaaagucagaaaccc

SEQ ID NO: 716162 - RNA, 24 nt, Human
ccaaugacgcauagcugagcaagg

SEQ ID NO: 716163 - RNA, 22 nt, Human
ccaaugccaaaugcaugccggg

SEQ ID NO: 716164 - RNA, 20 nt, Human
ccacugcacuccagccuggg

SEQ ID NO: 716165 - RNA, 20 nt, Human
ccacugcacuccagccuggg

SEQ ID NO: 716166 - RNA, 21 nt, Human
ccacugcacuccagccugggc

SEQ ID NO: 716167 - RNA, 23 nt, Human
ccacugcacuccagccugggcga

SEQ ID NO: 716168 - RNA, 23 nt, Human
ccacugcacuccagccugggcga

SEQ ID NO: 716169 - RNA, 19 nt, Human
ccacugcccggcugccucg

SEQ ID NO: 716170 - RNA, 21 nt, Human
ccagagaaaccugacuagaaa

SEQ ID NO: 716171 - RNA, 21 nt, Human
ccagucaaucccuaaaccuaa

SEQ ID NO: 716172 - RNA, 23 nt, Human
ccagucaaucccuaaaccuaaag

SEQ ID NO: 716173 - RNA, 21 nt, Human
ccaugagggagagguggcagu

SEQ ID NO: 716174 - RNA, 21 nt, Human
ccauuauacuccagccuggac

SEQ ID NO: 716175 - RNA, 24 nt, Human
ccauuauacuccagccuggacaag

SEQ ID NO: 716176 - RNA, 19 nt, Human
cccaaugcaggaauaaagu

SEQ ID NO: 716177 - RNA, 23 nt, Human
cccaggcaggaaauaaaggaaua

SEQ ID NO: 716178 - RNA, 20 nt, Human
cccuggcauggcugcucucc

SEQ ID NO: 716179 - RNA, 23 nt, Human
cccuggcauggcugcucucccug

SEQ ID NO: 716180 - RNA, 20 nt, Human
cccuguggggcaggacuggg

SEQ ID NO: 716181 - RNA, 19 nt, Human
ccggcaguggggcccagga

SEQ ID NO: 716182 - RNA, 18 nt, Human
ccuccgucucuacuaaaa

SEQ ID NO: 716183 - RNA, 19 nt, Human
ccucugaggacaggcucaa

SEQ ID NO: 716184 - RNA, 22 nt, Human
ccucugccauccucacccacuc

SEQ ID NO: 716185 - RNA, 18 nt, Human
ccuggccaacauggugaa

SEQ ID NO: 716186 - RNA, 23 nt, Human
ccuggccaacauggugaaacucc

SEQ ID NO: 716187 - RNA, 23 nt, Human
ccuggccaacauggugaaacucc

SEQ ID NO: 716188 - RNA, 23 nt, Human
ccuggccaauauagugaaacccc

SEQ ID NO: 716189 - RNA, 24 nt, Human
ccuggccaauauagugaaaccccg

SEQ ID NO: 716190 - RNA, 21 nt, Human
ccuggcuaccugggaggcuga

SEQ ID NO: 716191 - RNA, 19 nt, Human
ccuguaaucccagcuccug

SEQ ID NO: 716192 - RNA, 23 nt, Human
ccuuggggccacugaaggguggc

SEQ ID NO: 716193 - RNA, 24 nt, Human
cgagaccagccuggccaauauagu

SEQ ID NO: 716194 - RNA, 24 nt, Human
cgagauggacacaucacuugaggu

SEQ ID NO: 716195 - RNA, 26 nt, Human
cgagauggacacaucacuugagguca

SEQ ID NO: 716196 - RNA, 24 nt, Human
cgauaccagccuggccaacauggu

SEQ ID NO: 716197 - RNA, 22 nt, Human
cgccuguaaucccagcuccuga

SEQ ID NO: 716198 - RNA, 19 nt, Human
cgcuucagaaguacuguca

SEQ ID NO: 716199 - RNA, 24 nt, Human
cggauuacuugaggucagcaguuc

SEQ ID NO: 716200 - RNA, 24 nt, Human
cgggguuguccuucuuacuuuuuc

SEQ ID NO: 716201 - RNA, 23 nt, Human
cgucuguaaucccagcacuuugg

SEQ ID NO: 716202 - RNA, 24 nt, Human
cgucuguaaucccagcacuuuggg

SEQ ID NO: 716203 - RNA, 21 nt, Human
cuaacucagagcaagagucgg

SEQ ID NO: 716204 - RNA, 24 nt, Human
cucacaccuguaauuccagcaccu

SEQ ID NO: 716205 - RNA, 20 nt, Human
cucagucuggccuuggggcc

SEQ ID NO: 716206 - RNA, 18 nt, Human
cucugugcccaucauggu

SEQ ID NO: 716207 - RNA, 23 nt, Human
cugaaaacacugacaccuuccca

SEQ ID NO: 716208 - RNA, 22 nt, Human
cugcaguaccuacacuugacuu

SEQ ID NO: 716209 - RNA, 20 nt, Human
cuggaccaaugccaaaugca

SEQ ID NO: 716210 - RNA, 24 nt, Human
cugggggccacagaagcacaggau

SEQ ID NO: 716211 - RNA, 25 nt, Human
cuguaucguccucauuggccaaaua

SEQ ID NO: 716212 - RNA, 24 nt, Human
cuuagaacugaaaacacugacacc

SEQ ID NO: 716213 - RNA, 21 nt, Human
cuuagcuggggagaaggggac

SEQ ID NO: 716214 - RNA, 19 nt, Human
cuugaaucugggaggcgga

SEQ ID NO: 716215 - RNA, 22 nt, Human
cuuuuacauuuaacagugacua

SEQ ID NO: 716216 - RNA, 21 nt, Human
gaaaagcauccuuuccaggga

SEQ ID NO: 716217 - RNA, 21 nt, Human
gaaaccugacuagaaaacuga

SEQ ID NO: 716218 - RNA, 19 nt, Human
gaagaauuuaaaaaaacac

SEQ ID NO: 716219 - RNA, 18 nt, Human
gacaccuucccaagguga

SEQ ID NO: 716220 - RNA, 19 nt, Human
gacccggucccggcagugg

SEQ ID NO: 716221 - RNA, 23 nt, Human
gagaaucgcuugaaucugggagg

SEQ ID NO: 716222 - RNA, 23 nt, Human
gagauugcggugagcugagaucg

SEQ ID NO: 716223 - RNA, 19 nt, Human
gagccagaagccagggagc

SEQ ID NO: 716224 - RNA, 19 nt, Human
gaguaugagccugugggaa

SEQ ID NO: 716225 - RNA, 24 nt, Human
gauuacuugaggucagcaguucga

SEQ ID NO: 716226 - RNA, 24 nt, Human
gcacuccagccugggcgacagagc

SEQ ID NO: 716227 - RNA, 19 nt, Human
gcaggccaggcgcggccug

SEQ ID NO: 716228 - RNA, 24 nt, Human
gcaggugggaaaucaugucauuau

SEQ ID NO: 716229 - RNA, 24 nt, Human
gccaauauagugaaaccccgucuc

SEQ ID NO: 716230 - RNA, 27 nt, Human
gccacugcaccacugcacuccagccug

SEQ ID NO: 716231 - RNA, 20 nt, Human
gcccugcugcccagggaugg

SEQ ID NO: 716232 - RNA, 18 nt, Human
gccgggaaggaagcagug

SEQ ID NO: 716233 - RNA, 18 nt, Human
gccuauauguugauaaaa

SEQ ID NO: 716234 - RNA, 23 nt, Human
gcggugggcgccuguaaucccag

SEQ ID NO: 716235 - RNA, 23 nt, Human
gcucuagggcaaaggaaauacua

SEQ ID NO: 716236 - RNA, 21 nt, Human
gcugccucgccauccucugag

SEQ ID NO: 716237 - RNA, 21 nt, Human
gcugccucgccauccucugag

SEQ ID NO: 716238 - RNA, 20 nt, Human
gcugggggccacagaagcac

SEQ ID NO: 716239 - RNA, 22 nt, Human
ggagauugcggugagcugagau

SEQ ID NO: 716240 - RNA, 24 nt, Human
ggagauugcggugagcugagaucg

SEQ ID NO: 716241 - RNA, 22 nt, Human
ggagcacauauucuuuaauagc

SEQ ID NO: 716242 - RNA, 20 nt, Human
ggauggagaggaccgagaga

SEQ ID NO: 716243 - RNA, 23 nt, Human
ggauuacuugaggucagcaguuc

SEQ ID NO: 716244 - RNA, 23 nt, Human
ggcauggcggugggcgccuguaa

SEQ ID NO: 716245 - RNA, 23 nt, Human
ggcgccuguaaucccagcuccug

SEQ ID NO: 716246 - RNA, 20 nt, Human
ggcgggcggcuauaauccug

SEQ ID NO: 716247 - RNA, 24 nt, Human
ggcggugggcgccuguaaucccag

SEQ ID NO: 716248 - RNA, 27 nt, Human
gggcaaaggaaauacuagaggucagcc

SEQ ID NO: 716249 - RNA, 22 nt, Human
gggcgccuguaaucccagcucc

SEQ ID NO: 716250 - RNA, 22 nt, Human
ggguggggauuagguaagggcc

SEQ ID NO: 716251 - RNA, 24 nt, Human
gguggaucacgucuguaaucccag

SEQ ID NO: 716252 - RNA, 20 nt, Human
guacaaccucugcucaguca

SEQ ID NO: 716253 - RNA, 20 nt, Human
gucucaaaaaaaaaaaaaag

SEQ ID NO: 716254 - RNA, 19 nt, Human
guggaggacaagcccaggc

SEQ ID NO: 716255 - RNA, 23 nt, Human
guggaucacgucuguaaucccag

SEQ ID NO: 716256 - RNA, 18 nt, Human
guggcaaaccuaagccuc

SEQ ID NO: 716257 - RNA, 18 nt, Human
uaaaacuggcuuacagua

SEQ ID NO: 716258 - RNA, 20 nt, Human
uaaaaugaaagcaggccagg

SEQ ID NO: 716259 - RNA, 22 nt, Human
uaaaaugaaagcaggccaggcg

SEQ ID NO: 716260 - RNA, 23 nt, Human
uaaaggaauaaaaaacuuucaga

SEQ ID NO: 716261 - RNA, 24 nt, Human
uaaaucuacuacgcauacauguag

SEQ ID NO: 716262 - RNA, 19 nt, Human
uaacucagcucuaacucag

SEQ ID NO: 716263 - RNA, 21 nt, Human
uaacugauggaggugccacac

SEQ ID NO: 716264 - RNA, 25 nt, Human
uaagccucugugcuuuguggccaua

SEQ ID NO: 716265 - RNA, 19 nt, Human
uacacuugacuuccaagaa

SEQ ID NO: 716266 - RNA, 18 nt, Human
uaccaugaaggccuccac

SEQ ID NO: 716267 - RNA, 20 nt, Human
uaccuuaaggccaaugaggg

SEQ ID NO: 716268 - RNA, 24 nt, Human
uacuaaaaaagaacauacaaaaua

SEQ ID NO: 716269 - RNA, 23 nt, Human
uacuagaggucagcaggugacac

SEQ ID NO: 716270 - RNA, 21 nt, Human
uacuccagccuggacaagagc

SEQ ID NO: 716271 - RNA, 22 nt, Human
uacuccagccuggacaagagcg

SEQ ID NO: 716272 - RNA, 25 nt, Human
uagaaaaaaccugaauccaguuaga

SEQ ID NO: 716273 - RNA, 18 nt, Human
uagaaauccugcauccuc

SEQ ID NO: 716274 - RNA, 22 nt, Human
uagaacacccacuguacgacuc

SEQ ID NO: 716275 - RNA, 28 nt, Human
uaggauaacaaacacuaaaaggucaucc

SEQ ID NO: 716276 - RNA, 22 nt, Human
uagggcaaaggaaauacuagag

SEQ ID NO: 716277 - RNA, 25 nt, Human
uaggguggaggacaagcccaggcag

SEQ ID NO: 716278 - RNA, 20 nt, Human
uauacagcucugaaaccaga

SEQ ID NO: 716279 - RNA, 22 nt, Human
uaugacugcuaccuuaaggcca

SEQ ID NO: 716280 - RNA, 21 nt, Human
uaugucucucuccuccaagga

SEQ ID NO: 716281 - RNA, 18 nt, Human
ucaaaaaaaaaaaaaagu

SEQ ID NO: 716282 - RNA, 26 nt, Human
ucaaaaaaaaaaaaaagucaaguucc

SEQ ID NO: 716283 - RNA, 18 nt, Human
ucacagcugagcacaggc

SEQ ID NO: 716284 - RNA, 23 nt, Human
ucacgucuguaaucccagcacuu

SEQ ID NO: 716285 - RNA, 20 nt, Human
ucagacccggucccggcagu

SEQ ID NO: 716286 - RNA, 20 nt, Human
ucagcuaucaugacucuagc

SEQ ID NO: 716287 - RNA, 20 nt, Human
ucauuggccaaauaaaaagu

SEQ ID NO: 716288 - RNA, 22 nt, Human
uccaaacuuuuaucuugauacu

SEQ ID NO: 716289 - RNA, 18 nt, Human
uccacuggaugagccuca

SEQ ID NO: 716290 - RNA, 22 nt, Human
uccacuggaugagccucagucu

SEQ ID NO: 716291 - RNA, 23 nt, Human
uccagccugggcgacagagcgag

SEQ ID NO: 716292 - RNA, 24 nt, Human
uccagccugggcgacagagcgaga

SEQ ID NO: 716293 - RNA, 20 nt, Human
uccaguuagaacacccacug

SEQ ID NO: 716294 - RNA, 21 nt, Human
ucccaaggugagaaagugacc

SEQ ID NO: 716295 - RNA, 20 nt, Human
ucccggcaguggggcccagg

SEQ ID NO: 716296 - RNA, 19 nt, Human
uccguaaagcacuuacaac

SEQ ID NO: 716297 - RNA, 23 nt, Human
uccgucucaaaaaaaaaaaaaag

SEQ ID NO: 716298 - RNA, 22 nt, Human
uccugcgcaggcaaaggagagg

SEQ ID NO: 716299 - RNA, 20 nt, Human
uccugguggaucacgucugu

SEQ ID NO: 716300 - RNA, 18 nt, Human
ucgcuugaaucugggagg

SEQ ID NO: 716301 - RNA, 20 nt, Human
ucgggagugguggcgggcgg

SEQ ID NO: 716302 - RNA, 18 nt, Human
ucucaaaaaaaaaaaaaa

SEQ ID NO: 716303 - RNA, 21 nt, Human
ucucuaaucugugcucagccc

SEQ ID NO: 716304 - RNA, 23 nt, Human
ucucuacuaaaaauacaaaaauu

SEQ ID NO: 716305 - RNA, 20 nt, Human
ucugucccagagcccuggug

SEQ ID NO: 716306 - RNA, 22 nt, Human
ucugugguccuuuccagucugu

SEQ ID NO: 716307 - RNA, 20 nt, Human
ucuuagcuggggagaagggg

SEQ ID NO: 716308 - RNA, 22 nt, Human
ucuuagcuggggagaaggggac

SEQ ID NO: 716309 - RNA, 20 nt, Human
ucuuuaaggagagaaacagc

SEQ ID NO: 716310 - RNA, 22 nt, Human
ugaaguuaugugugacauuucu

SEQ ID NO: 716311 - RNA, 18 nt, Human
ugacacuggcccugcugc

SEQ ID NO: 716312 - RNA, 18 nt, Human
ugaccaaugcuucauuuu

SEQ ID NO: 716313 - RNA, 22 nt, Human
ugacuugagagugagucaccau

SEQ ID NO: 716314 - RNA, 18 nt, Human
ugagcacaggcccugcag

SEQ ID NO: 716315 - RNA, 22 nt, Human
ugagccgagaucgagccacugc

SEQ ID NO: 716316 - RNA, 18 nt, Human
ugagcugagaucgcacca

SEQ ID NO: 716317 - RNA, 22 nt, Human
ugagcuuucauuuguuaccaug

SEQ ID NO: 716318 - RNA, 25 nt, Human
ugaggcaggagaaguguuugaaacc

SEQ ID NO: 716319 - RNA, 20 nt, Human
ugaggcaggagaaucgcuug

SEQ ID NO: 716320 - RNA, 22 nt, Human
ugaggcaggagaaucgcuugaa

SEQ ID NO: 716321 - RNA, 23 nt, Human
ugaggcaggagaaucgcuugaau

SEQ ID NO: 716322 - RNA, 25 nt, Human
ugaggcaggagaaucgcuugaaucu

SEQ ID NO: 716323 - RNA, 20 nt, Human
ugaggcaggcggauuacuuc

SEQ ID NO: 716324 - RNA, 24 nt, Human
ugaggcaggcggauuacuugaggu

SEQ ID NO: 716325 - RNA, 26 nt, Human
ugaggcaggcggauuacuugagguca

SEQ ID NO: 716326 - RNA, 22 nt, Human
ugaggucagcaguucgagacca

SEQ ID NO: 716327 - RNA, 21 nt, Human
ugagucaccauuuucuuggag

SEQ ID NO: 716328 - RNA, 18 nt, Human
ugcaaauuucaguaucuc

SEQ ID NO: 716329 - RNA, 18 nt, Human
ugcaaggucacucgcugu

SEQ ID NO: 716330 - RNA, 21 nt, Human
ugcaccacugcacuccagccu

SEQ ID NO: 716331 - RNA, 18 nt, Human
ugcccagggauggccagg

SEQ ID NO: 716332 - RNA, 19 nt, Human
ugcucagcccaggaaggca

SEQ ID NO: 716333 - RNA, 21 nt, Human
ugcugcccagggauggccagg

SEQ ID NO: 716334 - RNA, 19 nt, Human
uggaauccacuaguucugg

SEQ ID NO: 716335 - RNA, 19 nt, Human
uggaaugaaaauuauaaaa

SEQ ID NO: 716336 - RNA, 22 nt, Human
uggaggcgagacaggcacugug

SEQ ID NO: 716337 - RNA, 22 nt, Human
uggaucacgucuguaaucccag

SEQ ID NO: 716338 - RNA, 24 nt, Human
uggaucacgucuguaaucccagca

SEQ ID NO: 716339 - RNA, 22 nt, Human
uggcagcagcuuacucagaggu

SEQ ID NO: 716340 - RNA, 18 nt, Human
uggcagugagccgagauc

SEQ ID NO: 716341 - RNA, 25 nt, Human
uggcagugagccgagaucgagccac

SEQ ID NO: 716342 - RNA, 25 nt, Human
uggcauggcugcucucccugauggg

SEQ ID NO: 716343 - RNA, 23 nt, Human
uggccaacauggugaaacuccuc

SEQ ID NO: 716344 - RNA, 24 nt, Human
uggcggugggcgccuguaauccca

SEQ ID NO: 716345 - RNA, 24 nt, Human
uggcuaccugggaggcugaggcag

SEQ ID NO: 716346 - RNA, 18 nt, Human
uggcuagaucccuguggg

SEQ ID NO: 716347 - RNA, 24 nt, Human
uggcuaugaaagauucuaaaaggu

SEQ ID NO: 716348 - RNA, 21 nt, Human
uggcucacaccuguaauucca

SEQ ID NO: 716349 - RNA, 24 nt, Human
uggcucacaccuguaauuccagca

SEQ ID NO: 716350 - RNA, 25 nt, Human
uggcuuacaguaaucuuguuuucug

SEQ ID NO: 716351 - RNA, 19 nt, Human
ugggaggccgagauggaca

SEQ ID NO: 716352 - RNA, 24 nt, Human
ugggaggccgagauggacacauca

SEQ ID NO: 716353 - RNA, 24 nt, Human
ugggaggcggagauugcggugagc

SEQ ID NO: 716354 - RNA, 18 nt, Human
ugggaggcugaggcagga

SEQ ID NO: 716355 - RNA, 19 nt, Human
ugggaggcugaggcaggag

SEQ ID NO: 716356 - RNA, 18 nt, Human
ugggaggcugaggcaggc

SEQ ID NO: 716357 - RNA, 20 nt, Human
ugggaggcugaggcaggcgg

SEQ ID NO: 716358 - RNA, 22 nt, Human
ugggaggcugaggcaggcggau

SEQ ID NO: 716359 - RNA, 22 nt, Human
uggggagaaggggacagaggaa

SEQ ID NO: 716360 - RNA, 18 nt, Human
uggggcaggacugggcac

SEQ ID NO: 716361 - RNA, 20 nt, Human
uggggcccaggauacggggu

SEQ ID NO: 716362 - RNA, 24 nt, Human
ugguggaucacgucuguaauccca

SEQ ID NO: 716363 - RNA, 21 nt, Human
ugucccagagcccugguggga

SEQ ID NO: 716364 - RNA, 25 nt, Human
uguccuuguaugucucucuccucca

SEQ ID NO: 716365 - RNA, 22 nt, Human
uuaugugugacauuucuaaacu

SEQ ID NO: 716366 - RNA, 21 nt, Human
uuauuggcauggugggugccu

SEQ ID NO: 716367 - RNA, 25 nt, Human
uucaaaaaaacaaaaaacaaaaaaa

SEQ ID NO: 716368 - RNA, 20 nt, Human
uucccccagcccuggaaucc

SEQ ID NO: 716369 - RNA, 24 nt, Human
uugaaucugggaggcggagauugc

SEQ ID NO: 716370 - RNA, 18 nt, Human
uuggagggcaggugggaa

SEQ ID NO: 716371 - RNA, 24 nt, Human
uuggcauguggaauguucucuagg

SEQ ID NO: 716372 - RNA, 22 nt, Human
uuuaagaagguucuccacugga

SEQ ID NO: 716373 - RNA, 19 nt, Human
uuucaaaaaaacaaaaaac

SEQ ID NO: 716374 - RNA, 27 nt, Human
uuucaaaaaaacaaaaaacaaaaaaaa

SEQ ID NO: 716375 - RNA, 21 nt, Human
uuucccccagcccuggaaucc

SEQ ID NO: 716376 - RNA, 24 nt, Human
uuucuuggagggcaggugggaaau

SEQ ID NO: 716377 - RNA, 24 nt, Human
uuuucuggcuaugaaagauucuaa

SEQ ID NO: 716378 - RNA, 22 nt, Human
uuuucuguaucguccucauugg

SEQ ID NO: 716379 - RNA, 22 nt, Human
aagaagcagcgaaaagccauaa

SEQ ID NO: 716380 - RNA, 25 nt, Human
aagaagcagcgaaaagccauaaaua

SEQ ID NO: 716381 - RNA, 26 nt, Human
aagcagcgaaaagccauaaauaacag

SEQ ID NO: 716382 - RNA, 19 nt, Human
aagggcccucgccaaacca

SEQ ID NO: 716383 - RNA, 22 nt, Human
acgagagcaguacaaauauucc

SEQ ID NO: 716384 - RNA, 19 nt, Human
agaaucagagaagacaggg

SEQ ID NO: 716385 - RNA, 22 nt, Human
agacaagagauggggcaccaag

SEQ ID NO: 716386 - RNA, 23 nt, Human
agacaagagauggggcaccaaga

SEQ ID NO: 716387 - RNA, 18 nt, Human
agacacuucggcaccacc

SEQ ID NO: 716388 - RNA, 21 nt, Human
agacagggaggaggggcaagg

SEQ ID NO: 716389 - RNA, 22 nt, Human
agacagggaggaggggcaaggu

SEQ ID NO: 716390 - RNA, 23 nt, Human
agacagggaggaggggcaaggug

SEQ ID NO: 716391 - RNA, 19 nt, Human
agagaagacagggaggagg

SEQ ID NO: 716392 - RNA, 22 nt, Human
agaguccaaacaccaccuggcg

SEQ ID NO: 716393 - RNA, 21 nt, Human
aggcacauggucuagagucca

SEQ ID NO: 716394 - RNA, 26 nt, Human
aggcagcaagcgggaaccucccagaa

SEQ ID NO: 716395 - RNA, 18 nt, Human
aggcaggaaggagagcug

SEQ ID NO: 716396 - RNA, 20 nt, Human
aggcaggaaggagagcuggu

SEQ ID NO: 716397 - RNA, 22 nt, Human
aggggcuggccugccucccccg

SEQ ID NO: 716398 - RNA, 21 nt, Human
augcacacugcaaagucuccg

SEQ ID NO: 716399 - RNA, 24 nt, Human
auggggcaccaagaagcagcgaaa

SEQ ID NO: 716400 - RNA, 21 nt, Human
caaaacaaggguguggcgagc

SEQ ID NO: 716401 - RNA, 23 nt, Human
caagaagcagcgaaaagccauaa

SEQ ID NO: 716402 - RNA, 27 nt, Human
cacauggucuagaguccaaacaccacc

SEQ ID NO: 716403 - RNA, 24 nt, Human
caccccucauuucccuccuucuca

SEQ ID NO: 716404 - RNA, 21 nt, Human
cacugggggcagagccuuuua

SEQ ID NO: 716405 - RNA, 18 nt, Human
cagagaagacagggagga

SEQ ID NO: 716406 - RNA, 22 nt, Human
cagcagccucucaaauggcacg

SEQ ID NO: 716407 - RNA, 20 nt, Human
ccagagggacugugucagca

SEQ ID NO: 716408 - RNA, 20 nt, Human
ccccucauuucccuccuucu

SEQ ID NO: 716409 - RNA, 24 nt, Human
cccuggcugaaggcagcaagcggg

SEQ ID NO: 716410 - RNA, 18 nt, Human
ccgcagggcagguggaag

SEQ ID NO: 716411 - RNA, 21 nt, Human
ccgcccgaggcgggcugcgcg

SEQ ID NO: 716412 - RNA, 18 nt, Human
ccgcugugggguucaagc

SEQ ID NO: 716413 - RNA, 19 nt, Human
ccggcccaggacggugcgg

SEQ ID NO: 716414 - RNA, 23 nt, Human
ccggccucccgccucccgccucc

SEQ ID NO: 716415 - RNA, 24 nt, Human
ccguggcagguagggaccuccucu

SEQ ID NO: 716416 - RNA, 19 nt, Human
ccucauuucccuccuucuc

SEQ ID NO: 716417 - RNA, 18 nt, Human
ccucccgcccgaggcggg

SEQ ID NO: 716418 - RNA, 25 nt, Human
ccuccuucucaggaucuaaaggcag

SEQ ID NO: 716419 - RNA, 20 nt, Human
ccucugucuccguacggggg

SEQ ID NO: 716420 - RNA, 18 nt, Human
ccugggcaccggcccagg

SEQ ID NO: 716421 - RNA, 20 nt, Human
ccuucugucuucucccuucc

SEQ ID NO: 716422 - RNA, 18 nt, Human
cggccugggcccggccuc

SEQ ID NO: 716423 - RNA, 25 nt, Human
cggggcugcggcuccgggggcgacg

SEQ ID NO: 716424 - RNA, 22 nt, Human
cuccguacgggggagcgucuuc

SEQ ID NO: 716425 - RNA, 24 nt, Human
cucugaggagcgcccuggcugaag

SEQ ID NO: 716426 - RNA, 22 nt, Human
cugggcccggccucccgccucc

SEQ ID NO: 716427 - RNA, 24 nt, Human
cuugccuauuaaacucuccgcucc

SEQ ID NO: 716428 - RNA, 19 nt, Human
gaaccucccagaagagcac

SEQ ID NO: 716429 - RNA, 19 nt, Human
gacagcagugggguugggc

SEQ ID NO: 716430 - RNA, 24 nt, Human
gacagcagugggguugggccacau

SEQ ID NO: 716431 - RNA, 23 nt, Human
gagcagagcugcggagaaaggaa

SEQ ID NO: 716432 - RNA, 21 nt, Human
gagccggccuggcggcgggac

SEQ ID NO: 716433 - RNA, 24 nt, Human
gcaccaagaagcagcgaaaagcca

SEQ ID NO: 716434 - RNA, 18 nt, Human
gccauaaauaacagaagc

SEQ ID NO: 716435 - RNA, 21 nt, Human
gccauaaauaacagaagcaaa

SEQ ID NO: 716436 - RNA, 20 nt, Human
gcggagcgggggcgggagcc

SEQ ID NO: 716437 - RNA, 21 nt, Human
gcggcggcggcggcgacugca

SEQ ID NO: 716438 - RNA, 20 nt, Human
gcgggagccacaacauggcg

SEQ ID NO: 716439 - RNA, 20 nt, Human
gcugcggcuccgggggcgga

SEQ ID NO: 716440 - RNA, 19 nt, Human
gcuggggcugccgcggcgg

SEQ ID NO: 716441 - RNA, 23 nt, Human
ggaaaauagagcucugaggagcg

SEQ ID NO: 716442 - RNA, 24 nt, Human
ggaaggagagcuggugucugcagg

SEQ ID NO: 716443 - RNA, 18 nt, Human
ggagcagagcugcggaga

SEQ ID NO: 716444 - RNA, 23 nt, Human
ggcggcggcggcgacugcaggcc

SEQ ID NO: 716445 - RNA, 22 nt, Human
ggcggcgggaccuggcuggggc

SEQ ID NO: 716446 - RNA, 18 nt, Human
ggcgggagccggccuggc

SEQ ID NO: 716447 - RNA, 23 nt, Human
ggcgggggauuggcggggggggc

SEQ ID NO: 716448 - RNA, 19 nt, Human
gggcaaggugaucaagggc

SEQ ID NO: 716449 - RNA, 22 nt, Human
ggggcggagcgggggcgggagc

SEQ ID NO: 716450 - RNA, 22 nt, Human
ggggcuggccugccuggggcag

SEQ ID NO: 716451 - RNA, 19 nt, Human
uaccuaggcacauggucua

SEQ ID NO: 716452 - RNA, 22 nt, Human
uagggaccuccucuuucggcuu

SEQ ID NO: 716453 - RNA, 21 nt, Human
uaggggcuggccugccugggg

SEQ ID NO: 716454 - RNA, 22 nt, Human
ucccagagggacugugucagca

SEQ ID NO: 716455 - RNA, 21 nt, Human
uccuucugucuucucccuucc

SEQ ID NO: 716456 - RNA, 20 nt, Human
ucucaggaucuaaaggcagg

SEQ ID NO: 716457 - RNA, 28 nt, Human
ucucccagagggacugugucagcacccc

SEQ ID NO: 716458 - RNA, 20 nt, Human
ucugucuucucccuuccuuc

SEQ ID NO: 716459 - RNA, 21 nt, Human
ugacaauuaguucucaggacu

SEQ ID NO: 716460 - RNA, 22 nt, Human
ugagggaaaagaaucagagaag

SEQ ID NO: 716461 - RNA, 23 nt, Human
ugcaggccagagucucggccgcg

SEQ ID NO: 716462 - RNA, 19 nt, Human
uggcaagggcugacuggua

SEQ ID NO: 716463 - RNA, 22 nt, Human
uggcacgagagcaguacaaaua

SEQ ID NO: 716464 - RNA, 23 nt, Human
uggcacgagagcaguacaaauau

SEQ ID NO: 716465 - RNA, 19 nt, Human
uggcagguagggaccuccu

SEQ ID NO: 716466 - RNA, 18 nt, Human
uggcugaaggcagcaagc

SEQ ID NO: 716467 - RNA, 22 nt, Human
uggcuggggcugccgcggcggg

SEQ ID NO: 716468 - RNA, 24 nt, Human
uggggcaccaagaagcagcgaaaa

SEQ ID NO: 716469 - RNA, 18 nt, Human
uggggcugccgcggcggg

SEQ ID NO: 716470 - RNA, 25 nt, Human
uggggcugggggauacccagcacug

SEQ ID NO: 716471 - RNA, 19 nt, Human
ugggguuggaaggacacag

SEQ ID NO: 716472 - RNA, 20 nt, Human
uucagagcugugaggguccu

SEQ ID NO: 716473 - RNA, 19 nt, Human
uucucccuuccuucuugcc

SEQ ID NO: 716474 - RNA, 20 nt, Human
aaaaaaaaaaaaaaaaacaa

SEQ ID NO: 716475 - RNA, 24 nt, Human
aaaaaaaaaaaaaaaaacaaguaa

SEQ ID NO: 716476 - RNA, 21 nt, Human
aaaaagaaaucuuuuaauaaa

SEQ ID NO: 716477 - RNA, 20 nt, Human
aaaaauauuauuccucugcc

SEQ ID NO: 716478 - RNA, 23 nt, Human
aaaacagaacucuaacccaaaua

SEQ ID NO: 716479 - RNA, 22 nt, Human
aaacaaaacagaacucuaaccc

SEQ ID NO: 716480 - RNA, 24 nt, Human
aaacaaaacagaacucuaacccaa

SEQ ID NO: 716481 - RNA, 23 nt, Human
aaacagaaacaaaacagaacucu

SEQ ID NO: 716482 - RNA, 19 nt, Human
aaacaugaaaaacuggaug

SEQ ID NO: 716483 - RNA, 22 nt, Human
aaagaaccuucuggcauccagc

SEQ ID NO: 716484 - RNA, 23 nt, Human
aacaaaacagaacucuaacccaa

SEQ ID NO: 716485 - RNA, 21 nt, Human
aacaaguaaccuuugaaacug

SEQ ID NO: 716486 - RNA, 18 nt, Human
aacagaauaaugcuucug

SEQ ID NO: 716487 - RNA, 20 nt, Human
aaccagacguggugaggugu

SEQ ID NO: 716488 - RNA, 23 nt, Human
aacugcaaaagcccugcaggaua

SEQ ID NO: 716489 - RNA, 19 nt, Human
aagaaaauaauaacaaaaa

SEQ ID NO: 716490 - RNA, 20 nt, Human
aagcaauuuccaucccccuu

SEQ ID NO: 716491 - RNA, 21 nt, Human
aagcugguuuuucacaauggc

SEQ ID NO: 716492 - RNA, 21 nt, Human
aauaaauuuuaaagagcaaga

SEQ ID NO: 716493 - RNA, 25 nt, Human
acaaaaagaucccuuuuaauuuaaa

SEQ ID NO: 716494 - RNA, 21 nt, Human
acaaaccacugacuacauagc

SEQ ID NO: 716495 - RNA, 24 nt, Human
acacaauccaaagaggagggaacc

SEQ ID NO: 716496 - RNA, 24 nt, Human
acagaaaacagaaacaaaacagaa

SEQ ID NO: 716497 - RNA, 23 nt, Human
acauagcaauacuccaguauagc

SEQ ID NO: 716498 - RNA, 24 nt, Human
acauccagugccccaaaccaaaac

SEQ ID NO: 716499 - RNA, 20 nt, Human
acaugcuuacuuuuacagga

SEQ ID NO: 716500 - RNA, 24 nt, Human
accagguacuucuacagacgcucc

SEQ ID NO: 716501 - RNA, 19 nt, Human
accauccaaaagaugucag

SEQ ID NO: 716502 - RNA, 21 nt, Human
acuugaggcaaacaugaaaaa

SEQ ID NO: 716503 - RNA, 21 nt, Human
agaaaggccccuggugcccuc

SEQ ID NO: 716504 - RNA, 22 nt, Human
agaacagaagaaacugcaaaag

SEQ ID NO: 716505 - RNA, 19 nt, Human
agaagaaacugcaaaagcc

SEQ ID NO: 716506 - RNA, 22 nt, Human
agaagaaacugcaaaagcccug

SEQ ID NO: 716507 - RNA, 24 nt, Human
agacaaaaaaaauuuaucaaagag

SEQ ID NO: 716508 - RNA, 21 nt, Human
agacacagaaaacagaaacaa

SEQ ID NO: 716509 - RNA, 19 nt, Human
agacguggugagguguugc

SEQ ID NO: 716510 - RNA, 23 nt, Human
aggaagaggguauagaaucaggg

SEQ ID NO: 716511 - RNA, 18 nt, Human
aggcagaaggaucacuug

SEQ ID NO: 716512 - RNA, 23 nt, Human
aggcagaaggaucacuugagccc

SEQ ID NO: 716513 - RNA, 18 nt, Human
aggcugaggcagaaggau

SEQ ID NO: 716514 - RNA, 24 nt, Human
aggcugaggcagaaggaucacuug

SEQ ID NO: 716515 - RNA, 22 nt, Human
agggcccagcccgucccaccuc

SEQ ID NO: 716516 - RNA, 19 nt, Human
aggggaaaggggaggagga

SEQ ID NO: 716517 - RNA, 21 nt, Human
agguaacccugucccaaaaaa

SEQ ID NO: 716518 - RNA, 24 nt, Human
agguacaguggugcucaccuguaa

SEQ ID NO: 716519 - RNA, 21 nt, Human
agucccaccuguuugcccaga

SEQ ID NO: 716520 - RNA, 24 nt, Human
aguggugcucaccuguaaucccag

SEQ ID NO: 716521 - RNA, 21 nt, Human
auaaaacacguuuccugacag

SEQ ID NO: 716522 - RNA, 23 nt, Human
auaaggcagcuuucuacaacagu

SEQ ID NO: 716523 - RNA, 20 nt, Human
auacauuucuuauuuacaga

SEQ ID NO: 716524 - RNA, 18 nt, Human
auccagugccccaaacca

SEQ ID NO: 716525 - RNA, 20 nt, Human
auccuuagaggugggaaaac

SEQ ID NO: 716526 - RNA, 19 nt, Human
auggagagcuagcaaaccc

SEQ ID NO: 716527 - RNA, 18 nt, Human
caaaaugcaaaauaccau

SEQ ID NO: 716528 - RNA, 24 nt, Human
caaaccaaaaccaauauaaggcac

SEQ ID NO: 716529 - RNA, 20 nt, Human
caaggauuaaccagacgugg

SEQ ID NO: 716530 - RNA, 23 nt, Human
caauccaaagaugccccaucuau

SEQ ID NO: 716531 - RNA, 22 nt, Human
cacagaaaacagaaacaaaacc

SEQ ID NO: 716532 - RNA, 20 nt, Human
cacagaacagaagaaacugc

SEQ ID NO: 716533 - RNA, 21 nt, Human
caccauguggcuaaacaggcc

SEQ ID NO: 716534 - RNA, 21 nt, Human
caccauguggcuaaacaggcc

SEQ ID NO: 716535 - RNA, 22 nt, Human
caccugcagcauuguguaguuu

SEQ ID NO: 716536 - RNA, 23 nt, Human
caccuguaaucccagcuacucgg

SEQ ID NO: 716537 - RNA, 24 nt, Human
caccuguaaucccagcuacucggg

SEQ ID NO: 716538 - RNA, 21 nt, Human
caccuguuugcccagagacaa

SEQ ID NO: 716539 - RNA, 23 nt, Human
cacuagacacagaaaacagaaac

SEQ ID NO: 716540 - RNA, 27 nt, Human
cacuagacacagaaaacagaaacaaaa

SEQ ID NO: 716541 - RNA, 22 nt, Human
cagaaaacagaaacaaaacaga

SEQ ID NO: 716542 - RNA, 21 nt, Human
cagaacacagaacagaagaaa

SEQ ID NO: 716543 - RNA, 19 nt, Human
cagagcgggagaggagggg

SEQ ID NO: 716544 - RNA, 21 nt, Human
cagauugcacaacugcacuga

SEQ ID NO: 716545 - RNA, 24 nt, Human
cagcuacucgggaggcugaggcag

SEQ ID NO: 716546 - RNA, 23 nt, Human
caggcaggaagaacucaccuccu

SEQ ID NO: 716547 - RNA, 19 nt, Human
cagggcauuuuauugaaca

SEQ ID NO: 716548 - RNA, 21 nt, Human
caguaaacugaacuacgaaau

SEQ ID NO: 716549 - RNA, 19 nt, Human
cagugccccaaaccaaaac

SEQ ID NO: 716550 - RNA, 18 nt, Human
caugcaugcaugugugug

SEQ ID NO: 716551 - RNA, 18 nt, Human
ccagcaaagugaagagac

SEQ ID NO: 716552 - RNA, 19 nt, Human
ccagccccacaaaccacug

SEQ ID NO: 716553 - RNA, 24 nt, Human
ccauaacacuuaaaauuuucaaga

SEQ ID NO: 716554 - RNA, 18 nt, Human
cccaaaaaaauaucaaga

SEQ ID NO: 716555 - RNA, 22 nt, Human
cccaccacugccgccacagaag

SEQ ID NO: 716556 - RNA, 19 nt, Human
cccacugguauuaauucca

SEQ ID NO: 716557 - RNA, 21 nt, Human
cccagcccgucccaccuccuc

SEQ ID NO: 716558 - RNA, 23 nt, Human
cccagguaacccugucccaaaaa

SEQ ID NO: 716559 - RNA, 29 nt, Human
cccucagucucacccacugguauuaauuc

SEQ ID NO: 716560 - RNA, 18 nt, Human
cccugaggauucaguuac

SEQ ID NO: 716561 - RNA, 23 nt, Human
ccugagcccugugaaaccuggga

SEQ ID NO: 716562 - RNA, 21 nt, Human
ccuguaaucccagcuacucgg

SEQ ID NO: 716563 - RNA, 21 nt, Human
ccuugcagaaagaaggaagag

SEQ ID NO: 716564 - RNA, 24 nt, Human
ccuuucuuaugcaaaauaaauaaa

SEQ ID NO: 716565 - RNA, 24 nt, Human
cgggaggcugaggcagaaggauca

SEQ ID NO: 716566 - RNA, 18 nt, Human
cgugcuaugugaggcugg

SEQ ID NO: 716567 - RNA, 23 nt, Human
cuaccuuuucaccagcacuacau

SEQ ID NO: 716568 - RNA, 18 nt, Human
cucaauccucuaacaaag

SEQ ID NO: 716569 - RNA, 19 nt, Human
cucaccuguaaucccagcu

SEQ ID NO: 716570 - RNA, 24 nt, Human
cuccuccucagccauucucuaccc

SEQ ID NO: 716571 - RNA, 23 nt, Human
cugaaaauacucuuuucaaaaau

SEQ ID NO: 716572 - RNA, 19 nt, Human
cugcucagccacccugugg

SEQ ID NO: 716573 - RNA, 18 nt, Human
cuggaacuaugggaguuc

SEQ ID NO: 716574 - RNA, 24 nt, Human
cuggacuuuggcauggucuggguu

SEQ ID NO: 716575 - RNA, 21 nt, Human
cuguaaucccagcuacucggg

SEQ ID NO: 716576 - RNA, 23 nt, Human
gaaaagauguacaugaaauccuu

SEQ ID NO: 716577 - RNA, 28 nt, Human
gaaacaaaacagaacucuaacccaaauu

SEQ ID NO: 716578 - RNA, 18 nt, Human
gaaagaaggaagagggua

SEQ ID NO: 716579 - RNA, 19 nt, Human
gaagaaacugcaaaagccc

SEQ ID NO: 716580 - RNA, 18 nt, Human
gacacagaaaacagaaac

SEQ ID NO: 716581 - RNA, 20 nt, Human
gacacuguuaauaaacagaa

SEQ ID NO: 716582 - RNA, 21 nt, Human
gaccccaauuaucuaacaaca

SEQ ID NO: 716583 - RNA, 19 nt, Human
gagguguugcacagaaauu

SEQ ID NO: 716584 - RNA, 21 nt, Human
gcacuagaauaggagcuggau

SEQ ID NO: 716585 - RNA, 23 nt, Human
gcagcuuucuacaacaguucugc

SEQ ID NO: 716586 - RNA, 19 nt, Human
gcaugcaugcaugugugug

SEQ ID NO: 716587 - RNA, 18 nt, Human
gccaagcaauuuccaucc

SEQ ID NO: 716588 - RNA, 24 nt, Human
gccaagcaauuuccaucccccuuu

SEQ ID NO: 716589 - RNA, 26 nt, Human
gccagguacaguggugcuccccaugg

SEQ ID NO: 716590 - RNA, 21 nt, Human
ggaaaacagugacaggugaga

SEQ ID NO: 716591 - RNA, 21 nt, Human
ggcaggaagaacucaccuccu

SEQ ID NO: 716592 - RNA, 18 nt, Human
ggcucagagccgccgcaa

SEQ ID NO: 716593 - RNA, 23 nt, Human
gggaggcugaggcagaaggauca

SEQ ID NO: 716594 - RNA, 19 nt, Human
ggggaaaggggaggaggaa

SEQ ID NO: 716595 - RNA, 19 nt, Human
ggucugguucaagaugagg

SEQ ID NO: 716596 - RNA, 24 nt, Human
guaaccuuugaaacuggcucaaag

SEQ ID NO: 716597 - RNA, 27 nt, Human
uaaaaagauuuaccuuucuuaugcaaa

SEQ ID NO: 716598 - RNA, 18 nt, Human
uaaaaggcaccugauucu

SEQ ID NO: 716599 - RNA, 24 nt, Human
uaaagcgcgggggccuccccgccg

SEQ ID NO: 716600 - RNA, 23 nt, Human
uaaauacauagaaaauuauuuaa

SEQ ID NO: 716601 - RNA, 24 nt, Human
uaaauacauagaaaauuauuuaag

SEQ ID NO: 716602 - RNA, 19 nt, Human
uacaggugguaaucauuca

SEQ ID NO: 716603 - RNA, 20 nt, Human
uacccaggauuucagaacac

SEQ ID NO: 716604 - RNA, 24 nt, Human
uagacacagaaaacagaaacaaaa

SEQ ID NO: 716605 - RNA, 26 nt, Human
uagacacagaaaacagaaacaaaaca

SEQ ID NO: 716606 - RNA, 19 nt, Human
uagacacuagcuacacgug

SEQ ID NO: 716607 - RNA, 18 nt, Human
uagcacaacuuccuccuu

SEQ ID NO: 716608 - RNA, 23 nt, Human
uaggagcuggaugcugggaaugg

SEQ ID NO: 716609 - RNA, 22 nt, Human
uauucaaaaugcaaaauaccau

SEQ ID NO: 716610 - RNA, 19 nt, Human
ucacaggcaggaagaacuc

SEQ ID NO: 716611 - RNA, 18 nt, Human
ucagcccugcugcacugu

SEQ ID NO: 716612 - RNA, 19 nt, Human
ucagggaguuccacaggua

SEQ ID NO: 716613 - RNA, 22 nt, Human
uccaaagaggaauuacaggugg

SEQ ID NO: 716614 - RNA, 27 nt, Human
uccagaaagcagaaaggaaugucucau

SEQ ID NO: 716615 - RNA, 19 nt, Human
ucccaccuguuugcccaga

SEQ ID NO: 716616 - RNA, 21 nt, Human
ucccuaaaaggcaccugauuc

SEQ ID NO: 716617 - RNA, 21 nt, Human
ucccuauuccaggagcaugag

SEQ ID NO: 716618 - RNA, 29 nt, Human
uccucgauuucccaaggggucccuggccc

SEQ ID NO: 716619 - RNA, 23 nt, Human
uccugacagccuguggccccugg

SEQ ID NO: 716620 - RNA, 25 nt, Human
ucgggaggcugaggcagaaggauca

SEQ ID NO: 716621 - RNA, 18 nt, Human
ucuaaaacaagaaaagcc

SEQ ID NO: 716622 - RNA, 19 nt, Human
ucuaaaacaagaaaagccc

SEQ ID NO: 716623 - RNA, 18 nt, Human
ucuacacaauccaaagag

SEQ ID NO: 716624 - RNA, 18 nt, Human
ugaaacuggcucaaagaa

SEQ ID NO: 716625 - RNA, 18 nt, Human
ugaaaggcaaagacuggc

SEQ ID NO: 716626 - RNA, 18 nt, Human
ugacuuaaaaaaaaaaaa

SEQ ID NO: 716627 - RNA, 20 nt, Human
ugaggcagaaggaucacuug

SEQ ID NO: 716628 - RNA, 24 nt, Human
ugaggcagaaggaucacuugagcc

SEQ ID NO: 716629 - RNA, 25 nt, Human
ugaggcagaaggaucacuugagccc

SEQ ID NO: 716630 - RNA, 19 nt, Human
ugaucuaaaacaagaaaag

SEQ ID NO: 716631 - RNA, 19 nt, Human
ugauucuggaacuauggga

SEQ ID NO: 716632 - RNA, 21 nt, Human
ugcacaacugcacugaccaaa

SEQ ID NO: 716633 - RNA, 21 nt, Human
ugccccaucuauugugcuuau

SEQ ID NO: 716634 - RNA, 22 nt, Human
uggacgggguagucuggaagcu

SEQ ID NO: 716635 - RNA, 21 nt, Human
uggggagaaggggaaagggga

SEQ ID NO: 716636 - RNA, 23 nt, Human
ugguggggagaaggggaaagggg

SEQ ID NO: 716637 - RNA, 20 nt, Human
ugugaaaccugggacacagg

SEQ ID NO: 716638 - RNA, 21 nt, Human
ugugcaugcaugcaugugugu

SEQ ID NO: 716639 - RNA, 23 nt, Human
uguguaauuaacauuuucaauga

SEQ ID NO: 716640 - RNA, 24 nt, Human
ugugugcaugcaugcaugugugug

SEQ ID NO: 716641 - RNA, 26 nt, Human
uuaaaaaaaaaaaaaaaaaaacaagu

SEQ ID NO: 716642 - RNA, 24 nt, Human
uuaacauuuucaaugagucaguga

SEQ ID NO: 716643 - RNA, 18 nt, Human
uuagacagugcuuauuuc

SEQ ID NO: 716644 - RNA, 21 nt, Human
uuccugacagccuguggcccc

SEQ ID NO: 716645 - RNA, 20 nt, Human
uugaauacagaagcugguuu

SEQ ID NO: 716646 - RNA, 19 nt, Human
uuggacgggguagucugga

SEQ ID NO: 716647 - RNA, 23 nt, Human
uuggacgggguagucuggaagcu

SEQ ID NO: 716648 - RNA, 21 nt, Human
uuuaaaaaaaugaaggaaaga

SEQ ID NO: 716649 - RNA, 20 nt, Human
uuuacuagaaugcguuucca

SEQ ID NO: 716650 - RNA, 21 nt, Human
uuucagacuggacuuuggcau

SEQ ID NO: 716651 - RNA, 19 nt, Human
uuuuuuguaaaaagauuua

SEQ ID NO: 716652 - RNA, 24 nt, Human
aaaaaggugacauuugaaaaagga

SEQ ID NO: 716653 - RNA, 24 nt, Human
aaaaugaaaaaaauuaacaaagaa

SEQ ID NO: 716654 - RNA, 21 nt, Human
aaccaaccucuggacaaccug

SEQ ID NO: 716655 - RNA, 18 nt, Human
aagaaaagagagcugaga

SEQ ID NO: 716656 - RNA, 19 nt, Human
aagaagaaaagagagcuga

SEQ ID NO: 716657 - RNA, 21 nt, Human
aagaagaaaagagagcugaga

SEQ ID NO: 716658 - RNA, 18 nt, Human
aauaucuacuccagagaa

SEQ ID NO: 716659 - RNA, 21 nt, Human
acaaaagaaauauuuugaaga

SEQ ID NO: 716660 - RNA, 19 nt, Human
acauauacuugucaaugug

SEQ ID NO: 716661 - RNA, 22 nt, Human
accaaccucuggacaaccugca

SEQ ID NO: 716662 - RNA, 21 nt, Human
accuacuacaacugggcuguu

SEQ ID NO: 716663 - RNA, 22 nt, Human
acuacaacugggcuguuucacc

SEQ ID NO: 716664 - RNA, 21 nt, Human
acuccagagaacucaaagaaa

SEQ ID NO: 716665 - RNA, 24 nt, Human
agaaagcaaaaagcaaaggaaccc

SEQ ID NO: 716666 - RNA, 18 nt, Human
agaaauuaaucaaggcug

SEQ ID NO: 716667 - RNA, 19 nt, Human
agaagaaagagaauauuaa

SEQ ID NO: 716668 - RNA, 23 nt, Human
aggcacaaaagaaauauuuugaa

SEQ ID NO: 716669 - RNA, 23 nt, Human
aggcgguugggcggcggcggcgg

SEQ ID NO: 716670 - RNA, 18 nt, Human
aggcuccuucauuuaccu

SEQ ID NO: 716671 - RNA, 27 nt, Human
agguauacaaaaacugucagccaaacu

SEQ ID NO: 716672 - RNA, 22 nt, Human
auaggggaaauucucuuccuca

SEQ ID NO: 716673 - RNA, 23 nt, Human
auggggcaaaggcaaagguuggg

SEQ ID NO: 716674 - RNA, 18 nt, Human
auguagccaaaagagagg

SEQ ID NO: 716675 - RNA, 21 nt, Human
auuaccaugaagguaucaaau

SEQ ID NO: 716676 - RNA, 22 nt, Human
caaaauacaggacaccuaccac

SEQ ID NO: 716677 - RNA, 23 nt, Human
caaaauguagcaaauacauuuug

SEQ ID NO: 716678 - RNA, 18 nt, Human
caacacaaaaacccugac

SEQ ID NO: 716679 - RNA, 19 nt, Human
caagaacacaacuggggga

SEQ ID NO: 716680 - RNA, 25 nt, Human
caagacaauuuacuauggaaaaaug

SEQ ID NO: 716681 - RNA, 21 nt, Human
cacuuugggaaaggcucugga

SEQ ID NO: 716682 - RNA, 26 nt, Human
cagaaaaggagaaagcaaaaagcaaa

SEQ ID NO: 716683 - RNA, 22 nt, Human
cagaaaccuagugcauaaauag

SEQ ID NO: 716684 - RNA, 24 nt, Human
cagacauguuuuuauccacccccc

SEQ ID NO: 716685 - RNA, 19 nt, Human
cagcucccgcccucggccc

SEQ ID NO: 716686 - RNA, 22 nt, Human
cauuuucaaaaacugcaagaca

SEQ ID NO: 716687 - RNA, 18 nt, Human
ccaaaauauuuacugagc

SEQ ID NO: 716688 - RNA, 24 nt, Human
ccaaacaaaauacaggacaccuac

SEQ ID NO: 716689 - RNA, 19 nt, Human
ccagagaacucaaagaaaa

SEQ ID NO: 716690 - RNA, 26 nt, Human
cccaaacaaaauacaggacaccuacc

SEQ ID NO: 716691 - RNA, 22 nt, Human
ccccccgccggggccgcccccc

SEQ ID NO: 716692 - RNA, 20 nt, Human
cccccgcgccucagcucccg

SEQ ID NO: 716693 - RNA, 21 nt, Human
cccccgcgccucagcucccgc

SEQ ID NO: 716694 - RNA, 23 nt, Human
cccccuaaccgcucgcuuucuuc

SEQ ID NO: 716695 - RNA, 18 nt, Human
cccgccccccgccggggc

SEQ ID NO: 716696 - RNA, 23 nt, Human
cccggcccgucaggccucagccg

SEQ ID NO: 716697 - RNA, 20 nt, Human
cccugggcccagcuguuccc

SEQ ID NO: 716698 - RNA, 20 nt, Human
ccgcgccucagcucccgccc

SEQ ID NO: 716699 - RNA, 19 nt, Human
ccucgcccccgccccccgc

SEQ ID NO: 716700 - RNA, 22 nt, Human
ccucugacaaaccaaccucugg

SEQ ID NO: 716701 - RNA, 22 nt, Human
ccugccccuuaauccccuccuc

SEQ ID NO: 716702 - RNA, 24 nt, Human
cggcggcugaggcggcgcggagca

SEQ ID NO: 716703 - RNA, 19 nt, Human
cggcugaggcggcgcggag

SEQ ID NO: 716704 - RNA, 21 nt, Human
cggucggagugguaaccgccc

SEQ ID NO: 716705 - RNA, 18 nt, Human
cucacuuugggaaaggcu

SEQ ID NO: 716706 - RNA, 20 nt, Human
cuccacgccgcggcccggcc

SEQ ID NO: 716707 - RNA, 18 nt, Human
cucccgcccucggcccuc

SEQ ID NO: 716708 - RNA, 19 nt, Human
cuccucgcccccgcccccc

SEQ ID NO: 716709 - RNA, 21 nt, Human
cucgcaccugccccuuaaucc

SEQ ID NO: 716710 - RNA, 18 nt, Human
cucuggggagucacaugc

SEQ ID NO: 716711 - RNA, 19 nt, Human
cucuggggagucacaugcu

SEQ ID NO: 716712 - RNA, 27 nt, Human
cugaagcacuguuuugauguuugcuuu

SEQ ID NO: 716713 - RNA, 19 nt, Human
gaaaacaacacaaaaaccc

SEQ ID NO: 716714 - RNA, 19 nt, Human
gaagauguagccaaaagag

SEQ ID NO: 716715 - RNA, 21 nt, Human
gagcauuuuccuuggaaguag

SEQ ID NO: 716716 - RNA, 24 nt, Human
gcaccugccccuuaauccccuccu

SEQ ID NO: 716717 - RNA, 23 nt, Human
gccaaaagagaggcaaaacacau

SEQ ID NO: 716718 - RNA, 20 nt, Human
gcccagcuguucccaauagc

SEQ ID NO: 716719 - RNA, 22 nt, Human
gcccggcccgucaggccucagc

SEQ ID NO: 716720 - RNA, 26 nt, Human
gcccucggcccucguccgcccggccc

SEQ ID NO: 716721 - RNA, 19 nt, Human
gcggcggcggcggcugagg

SEQ ID NO: 716722 - RNA, 22 nt, Human
gcggcggcggcggcugaggcgg

SEQ ID NO: 716723 - RNA, 23 nt, Human
gcggcggcggcggcugaggcggc

SEQ ID NO: 716724 - RNA, 21 nt, Human
gcgguugggcggcggcggcga

SEQ ID NO: 716725 - RNA, 20 nt, Human
gcuaagaagaaaagagagcu

SEQ ID NO: 716726 - RNA, 18 nt, Human
ggaauccuucacaaaugc

SEQ ID NO: 716727 - RNA, 19 nt, Human
ggaauccuucacaaaugcc

SEQ ID NO: 716728 - RNA, 18 nt, Human
ggcggcggcggcggcuga

SEQ ID NO: 716729 - RNA, 21 nt, Human
gggcggcggcggcggcugagg

SEQ ID NO: 716730 - RNA, 24 nt, Human
gggcggcggcggcggcugaggcgg

SEQ ID NO: 716731 - RNA, 18 nt, Human
uaaaaauggaaaauggcc

SEQ ID NO: 716732 - RNA, 21 nt, Human
uaaaaauggaaaauggccucu

SEQ ID NO: 716733 - RNA, 20 nt, Human
uaaagcagguauacaaaaac

SEQ ID NO: 716734 - RNA, 24 nt, Human
uaacaacguuacaagaacacaacu

SEQ ID NO: 716735 - RNA, 22 nt, Human
uagccucugacaaaccaaccuc

SEQ ID NO: 716736 - RNA, 22 nt, Human
uaggcacaaaagaaauauuuug

SEQ ID NO: 716737 - RNA, 20 nt, Human
uauaacacagcuccaucaua

SEQ ID NO: 716738 - RNA, 25 nt, Human
uauggcauguuuacacauguacaua

SEQ ID NO: 716739 - RNA, 26 nt, Human
uauggguuuuccccaauauauggggc

SEQ ID NO: 716740 - RNA, 19 nt, Human
uauuacaacuauauuuccc

SEQ ID NO: 716741 - RNA, 18 nt, Human
ucagaaaaggagaaagca

SEQ ID NO: 716742 - RNA, 23 nt, Human
ucagucaggugaaauaguuauga

SEQ ID NO: 716743 - RNA, 20 nt, Human
uccacgccgcggcccggcaa

SEQ ID NO: 716744 - RNA, 24 nt, Human
uccagagaacucaaagaaaaagca

SEQ ID NO: 716745 - RNA, 25 nt, Human
ucccacuacacuuuccaaaacuaga

SEQ ID NO: 716746 - RNA, 18 nt, Human
uccggucggagugguaac

SEQ ID NO: 716747 - RNA, 22 nt, Human
uccuucacaaaugccuaaacag

SEQ ID NO: 716748 - RNA, 21 nt, Human
ucgcggcuccugcccggcucc

SEQ ID NO: 716749 - RNA, 22 nt, Human
ucggagugguaaccgccccccu

SEQ ID NO: 716750 - RNA, 19 nt, Human
ugaaaacaacacaaaaacc

SEQ ID NO: 716751 - RNA, 18 nt, Human
ugacaguaucuaagaugg

SEQ ID NO: 716752 - RNA, 21 nt, Human
ugccuaaacagagaaucagag

SEQ ID NO: 716753 - RNA, 22 nt, Human
ugccuaaacagagaaucagagc

SEQ ID NO: 716754 - RNA, 20 nt, Human
ugcuaaaauccuuuuggugu

SEQ ID NO: 716755 - RNA, 19 nt, Human
uggaaaacuggacuauaua

SEQ ID NO: 716756 - RNA, 19 nt, Human
uggcauguuuacacaugua

SEQ ID NO: 716757 - RNA, 22 nt, Human
ugggcggcggcggcggcugagg

SEQ ID NO: 716758 - RNA, 22 nt, Human
uuaaagcagguauacaaaaacu

SEQ ID NO: 716759 - RNA, 22 nt, Human
uugaaaacaacacaaaaacccu

SEQ ID NO: 716760 - RNA, 21 nt, Human
uugaaauuuacaacugaaggc

SEQ ID NO: 716761 - RNA, 24 nt, Human
uugggcggcggcggcggcugaggc

SEQ ID NO: 716762 - RNA, 23 nt, Human
uuugacaguaucuaagauggugg

SEQ ID NO: 716763 - RNA, 18 nt, Human
uuuguaaacacuauccac

SEQ ID NO: 716764 - RNA, 19 nt, Human
uuuguaaacacuauccaca

SEQ ID NO: 716765 - RNA, 23 nt, Human
uuuuauccaccccccccccccgc

SEQ ID NO: 716766 - RNA, 23 nt, Human
aaaaaaaaaaaaaaaaagcagag

SEQ ID NO: 716767 - RNA, 20 nt, Human
aaaacaacaucaugguacaa

SEQ ID NO: 716768 - RNA, 21 nt, Human
aaaacaacaucaugguacaac

SEQ ID NO: 716769 - RNA, 20 nt, Human
aaaaugccauuugucacugc

SEQ ID NO: 716770 - RNA, 21 nt, Human
aaaaugccauuugucacuggu

SEQ ID NO: 716771 - RNA, 22 nt, Human
aaagaaaaauuugaggcauuuu

SEQ ID NO: 716772 - RNA, 19 nt, Human
aaccacaaacaccauucuc

SEQ ID NO: 716773 - RNA, 19 nt, Human
aagaaaaccaacuugagga

SEQ ID NO: 716774 - RNA, 22 nt, Human
aagagaaaaaagaaaaucucaa

SEQ ID NO: 716775 - RNA, 26 nt, Human
aagcagaacaaaaacgaaacccucga

SEQ ID NO: 716776 - RNA, 24 nt, Human
aagcugguuacuugcuugcagugc

SEQ ID NO: 716777 - RNA, 19 nt, Human
aaggacucacuggcggacg

SEQ ID NO: 716778 - RNA, 21 nt, Human
aaugacacaaaaggaaacuua

SEQ ID NO: 716779 - RNA, 24 nt, Human
aauucccuuuugcagcaaagaggc

SEQ ID NO: 716780 - RNA, 19 nt, Human
acagcacaguuggcaugga

SEQ ID NO: 716781 - RNA, 18 nt, Human
acuacagcucgccagcgg

SEQ ID NO: 716782 - RNA, 21 nt, Human
acuggagugagaagcugguua

SEQ ID NO: 716783 - RNA, 22 nt, Human
agaacaaaaacgaaacccucga

SEQ ID NO: 716784 - RNA, 21 nt, Human
agacacucacucucagagaac

SEQ ID NO: 716785 - RNA, 18 nt, Human
agacaggcaugcaccacc

SEQ ID NO: 716786 - RNA, 23 nt, Human
agcacagcucccacaucagcacu

SEQ ID NO: 716787 - RNA, 24 nt, Human
agcacagcucccacaucagcacug

SEQ ID NO: 716788 - RNA, 25 nt, Human
agcagaacaaaaacgaaacccucga

SEQ ID NO: 716789 - RNA, 19 nt, Human
aggaaacuuaaauuaccaa

SEQ ID NO: 716790 - RNA, 21 nt, Human
aggcaugcaccaccacuaccc

SEQ ID NO: 716791 - RNA, 23 nt, Human
aggcauuuuaaaacaaaauaauu

SEQ ID NO: 716792 - RNA, 19 nt, Human
agugcagcacuucuggaag

SEQ ID NO: 716793 - RNA, 18 nt, Human
auaagcaucaucacacga

SEQ ID NO: 716794 - RNA, 22 nt, Human
auauagcaaucuguauuucacc

SEQ ID NO: 716795 - RNA, 19 nt, Human
aucagguuuuuucagacau

SEQ ID NO: 716796 - RNA, 22 nt, Human
augaagcagaacaaaaacgaaa

SEQ ID NO: 716797 - RNA, 26 nt, Human
augaagcagaacaaaaacgaaacccu

SEQ ID NO: 716798 - RNA, 20 nt, Human
augacaggagggccugggug

SEQ ID NO: 716799 - RNA, 20 nt, Human
augccacaguccccuaccaa

SEQ ID NO: 716800 - RNA, 24 nt, Human
auggaggcuuaauaaaaaauacca

SEQ ID NO: 716801 - RNA, 20 nt, Human
caaacaccauucucucacga

SEQ ID NO: 716802 - RNA, 23 nt, Human
caacuacaaaaaaaaauccccau

SEQ ID NO: 716803 - RNA, 19 nt, Human
caacucacagaagaaaacc

SEQ ID NO: 716804 - RNA, 21 nt, Human
caacucacagaagaaaaccaa

SEQ ID NO: 716805 - RNA, 20 nt, Human
caacuucugguaacauguca

SEQ ID NO: 716806 - RNA, 23 nt, Human
cacaaaaggaaacuuaaauuacc

SEQ ID NO: 716807 - RNA, 23 nt, Human
cacacagacaggcaugcaccacc

SEQ ID NO: 716808 - RNA, 21 nt, Human
cacagacaggcaugcaccacc

SEQ ID NO: 716809 - RNA, 21 nt, Human
cacagacaggcaugcaccacc

SEQ ID NO: 716810 - RNA, 22 nt, Human
caccaccacuacccgucgcccg

SEQ ID NO: 716811 - RNA, 21 nt, Human
cacgcaagccgcaacuacagc

SEQ ID NO: 716812 - RNA, 22 nt, Human
cacugcaagcuccuaaccagcg

SEQ ID NO: 716813 - RNA, 22 nt, Human
cacugccucuacgaggccacac

SEQ ID NO: 716814 - RNA, 23 nt, Human
cacugcgcugcaaugcucacacc

SEQ ID NO: 716815 - RNA, 22 nt, Human
cagaagacugcugcuggcuagg

SEQ ID NO: 716816 - RNA, 23 nt, Human
cagacacugcaagcuccuaacca

SEQ ID NO: 716817 - RNA, 19 nt, Human
cagagugcuggggaacacg

SEQ ID NO: 716818 - RNA, 19 nt, Human
cagcucccacaucagcacu

SEQ ID NO: 716819 - RNA, 24 nt, Human
caucagaaccaagguuucuggggu

SEQ ID NO: 716820 - RNA, 20 nt, Human
ccacaccugccucugccaag

SEQ ID NO: 716821 - RNA, 21 nt, Human
ccacccgccagugacagccgg

SEQ ID NO: 716822 - RNA, 19 nt, Human
ccagcggggcacacagaca

SEQ ID NO: 716823 - RNA, 22 nt, Human
ccagcuuucugaguauugagag

SEQ ID NO: 716824 - RNA, 27 nt, Human
ccaguuacuuaaaaaaaaaaaaaaaaa

SEQ ID NO: 716825 - RNA, 22 nt, Human
ccauuugucacugcugcaucuc

SEQ ID NO: 716826 - RNA, 26 nt, Human
cccacaggccucagacacugcaagcu

SEQ ID NO: 716827 - RNA, 23 nt, Human
ccccgcgcugugagcugcuggcg

SEQ ID NO: 716828 - RNA, 20 nt, Human
cccuuaauuuagaaaaacuc

SEQ ID NO: 716829 - RNA, 22 nt, Human
ccuccgagcaacguuucaguuc

SEQ ID NO: 716830 - RNA, 19 nt, Human
ccuguagugggccgcgagg

SEQ ID NO: 716831 - RNA, 23 nt, Human
cgcaguaacugaguaacucugac

SEQ ID NO: 716832 - RNA, 19 nt, Human
cgcugcaaugcucacaccu

SEQ ID NO: 716833 - RNA, 20 nt, Human
cggcuuagguggaagcacag

SEQ ID NO: 716834 - RNA, 20 nt, Human
cuacaaaaaaaaauccccau

SEQ ID NO: 716835 - RNA, 20 nt, Human
cuauucacaaugugcuuuga

SEQ ID NO: 716836 - RNA, 18 nt, Human
cucacagaagaaaaccaa

SEQ ID NO: 716837 - RNA, 23 nt, Human
cugacaacuacaaaaaaaaaucc

SEQ ID NO: 716838 - RNA, 20 nt, Human
cuggggguaaaggagggugu

SEQ ID NO: 716839 - RNA, 18 nt, Human
cugggguggccccugcag

SEQ ID NO: 716840 - RNA, 27 nt, Human
cuuaaaaaaaaaaaaaaaaagcagagu

SEQ ID NO: 716841 - RNA, 20 nt, Human
cuuaaaaaaaaaaaaaguau

SEQ ID NO: 716842 - RNA, 24 nt, Human
cuuacgauccugccaguuuuugcu

SEQ ID NO: 716843 - RNA, 21 nt, Human
gacaacuacaaaaaaaaaucc

SEQ ID NO: 716844 - RNA, 18 nt, Human
gacuuuccaauucccuuu

SEQ ID NO: 716845 - RNA, 21 nt, Human
gagugagaagcugguuacuug

SEQ ID NO: 716846 - RNA, 22 nt, Human
gcagaacaaaaacgaaacccuc

SEQ ID NO: 716847 - RNA, 20 nt, Human
gcagcaaagaggcagaauca

SEQ ID NO: 716848 - RNA, 19 nt, Human
gccaacccagggccgggcu

SEQ ID NO: 716849 - RNA, 18 nt, Human
gccagcgcccucgccucg

SEQ ID NO: 716850 - RNA, 19 nt, Human
gcccuggcccuuccguagc

SEQ ID NO: 716851 - RNA, 19 nt, Human
gcugcccuccucaugcagc

SEQ ID NO: 716852 - RNA, 22 nt, Human
ggaaaggacuucucauuauuaa

SEQ ID NO: 716853 - RNA, 19 nt, Human
gggaaaaaccacaaacacc

SEQ ID NO: 716854 - RNA, 22 nt, Human
gggagagugucucguuuguggu

SEQ ID NO: 716855 - RNA, 24 nt, Human
gguguuaacuuaaaaaaaaaaaaa

SEQ ID NO: 716856 - RNA, 20 nt, Human
guaaaagagcaggaacuuua

SEQ ID NO: 716857 - RNA, 19 nt, Human
guacagggagauguccaca

SEQ ID NO: 716858 - RNA, 20 nt, Human
gugagcugcuggcggccagc

SEQ ID NO: 716859 - RNA, 18 nt, Human
uaaauaaaauucaagucu

SEQ ID NO: 716860 - RNA, 22 nt, Human
uaaauccaugugcugaugcaga

SEQ ID NO: 716861 - RNA, 22 nt, Human
uaacacagcgcucugcgacccc

SEQ ID NO: 716862 - RNA, 19 nt, Human
uaacauuuuguggaauaaa

SEQ ID NO: 716863 - RNA, 21 nt, Human
uaagcaccaaccuaaaauaag

SEQ ID NO: 716864 - RNA, 22 nt, Human
uacaaaaguuaaggcaaaguca

SEQ ID NO: 716865 - RNA, 23 nt, Human
uacauaacucuuaaauccaugug

SEQ ID NO: 716866 - RNA, 18 nt, Human
uaugaaagccacucucau

SEQ ID NO: 716867 - RNA, 22 nt, Human
uauuaaaaaccaaggacucacu

SEQ ID NO: 716868 - RNA, 20 nt, Human
uauuuacaacuguacaagcg

SEQ ID NO: 716869 - RNA, 19 nt, Human
ucacagaucaauuauuucu

SEQ ID NO: 716870 - RNA, 24 nt, Human
ucagugggcaacaaaguguauguu

SEQ ID NO: 716871 - RNA, 22 nt, Human
ucccacaggccucagacacugc

SEQ ID NO: 716872 - RNA, 25 nt, Human
ucuacaucccgcucaacagcaacau

SEQ ID NO: 716873 - RNA, 20 nt, Human
ucuauaaccugagauacugc

SEQ ID NO: 716874 - RNA, 22 nt, Human
ucuccaaccagagugcugggga

SEQ ID NO: 716875 - RNA, 21 nt, Human
ucugcagcccuguagugggcc

SEQ ID NO: 716876 - RNA, 23 nt, Human
ucuuguuaaauaacauuuugugg

SEQ ID NO: 716877 - RNA, 24 nt, Human
ugaaaaaagaucaacuguugaaga

SEQ ID NO: 716878 - RNA, 22 nt, Human
ugaaacuggagugagaagcugg

SEQ ID NO: 716879 - RNA, 19 nt, Human
ugaagcagaacaaaaacga

SEQ ID NO: 716880 - RNA, 23 nt, Human
ugaagcagaacaaaaacgaaacc

SEQ ID NO: 716881 - RNA, 20 nt, Human
ugaaugacacaaaaggaaac

SEQ ID NO: 716882 - RNA, 20 nt, Human
ugacacaaaaggaaacuuaa

SEQ ID NO: 716883 - RNA, 21 nt, Human
ugagaagcugguuacuugcuu

SEQ ID NO: 716884 - RNA, 19 nt, Human
ugaggcccucgucuuggag

SEQ ID NO: 716885 - RNA, 22 nt, Human
ugaugacaggagggccugggug

SEQ ID NO: 716886 - RNA, 18 nt, Human
ugaugcagaagacugcug

SEQ ID NO: 716887 - RNA, 22 nt, Human
ugaugcagaagacugcugcugg

SEQ ID NO: 716888 - RNA, 18 nt, Human
ugaugugaugacaggagg

SEQ ID NO: 716889 - RNA, 19 nt, Human
ugcaccaccacuacccguc

SEQ ID NO: 716890 - RNA, 20 nt, Human
ugcaccaccacuacccgucg

SEQ ID NO: 716891 - RNA, 20 nt, Human
ugcuaacuuuagugcauccu

SEQ ID NO: 716892 - RNA, 20 nt, Human
ugcuggggguaaaggagggu

SEQ ID NO: 716893 - RNA, 18 nt, Human
uggaagugaaucaaugag

SEQ ID NO: 716894 - RNA, 19 nt, Human
uggcgcggccagcacugcc

SEQ ID NO: 716895 - RNA, 18 nt, Human
uggcggccagcgcccucg

SEQ ID NO: 716896 - RNA, 19 nt, Human
uggcuaaugcacgcgcugc

SEQ ID NO: 716897 - RNA, 21 nt, Human
uggcuauuucucuguauuuga

SEQ ID NO: 716898 - RNA, 19 nt, Human
uggcugauggcgcccuggc

SEQ ID NO: 716899 - RNA, 21 nt, Human
uggcugauggcgcccuggccc

SEQ ID NO: 716900 - RNA, 20 nt, Human
ugggguggccccugcagguu

SEQ ID NO: 716901 - RNA, 22 nt, Human
ugggguggccccugcagguuca

SEQ ID NO: 716902 - RNA, 23 nt, Human
uguacuacaguaugcuuacucag

SEQ ID NO: 716903 - RNA, 19 nt, Human
uguggcuauuucucuguau

SEQ ID NO: 716904 - RNA, 22 nt, Human
uguguuuugggaauggcugaug

SEQ ID NO: 716905 - RNA, 23 nt, Human
uguuaaauaacauuuuguggaau

SEQ ID NO: 716906 - RNA, 26 nt, Human
uuaaaaaaaaaaaaaaaaagcagagu

SEQ ID NO: 716907 - RNA, 19 nt, Human
uucaagagggggagaaucc

SEQ ID NO: 716908 - RNA, 20 nt, Human
uugaaacuggagugagaagc

SEQ ID NO: 716909 - RNA, 18 nt, Human
uuuauccuccaccagcca

SEQ ID NO: 716910 - RNA, 21 nt, Human
aaaagcugaaucaaaaacaau

SEQ ID NO: 716911 - RNA, 26 nt, Human
aaacucacuguacccucauaucgcac

SEQ ID NO: 716912 - RNA, 21 nt, Human
aaaugcgccuuccaaaaacac

SEQ ID NO: 716913 - RNA, 23 nt, Human
aacagaauuuggacugccaaacu

SEQ ID NO: 716914 - RNA, 18 nt, Human
aacauggcugagcugccc

SEQ ID NO: 716915 - RNA, 23 nt, Human
aaccguguuggagaagucaaagc

SEQ ID NO: 716916 - RNA, 21 nt, Human
aacgugcuucugagaucagga

SEQ ID NO: 716917 - RNA, 28 nt, Human
aacucacuguacccucauaucgcacucu

SEQ ID NO: 716918 - RNA, 18 nt, Human
aagcccacaacgugcuuc

SEQ ID NO: 716919 - RNA, 21 nt, Human
aagcccacaacgugcuucuga

SEQ ID NO: 716920 - RNA, 20 nt, Human
aagccucuucccggaguccc

SEQ ID NO: 716921 - RNA, 18 nt, Human
aagcugaagccuuaugac

SEQ ID NO: 716922 - RNA, 21 nt, Human
aaguaccuccuuugggguccc

SEQ ID NO: 716923 - RNA, 19 nt, Human
acacacccacaugugcuua

SEQ ID NO: 716924 - RNA, 24 nt, Human
acacaggagaggcaaagccaaggg

SEQ ID NO: 716925 - RNA, 22 nt, Human
acagacaacauaacagcacagc

SEQ ID NO: 716926 - RNA, 22 nt, Human
acaggacacaggagaggcaaag

SEQ ID NO: 716927 - RNA, 21 nt, Human
acaggcaguccccauaccccu

SEQ ID NO: 716928 - RNA, 26 nt, Human
acagugaaaacaauuagccauccaaa

SEQ ID NO: 716929 - RNA, 25 nt, Human
acccagaagcugaagccuuaugacc

SEQ ID NO: 716930 - RNA, 24 nt, Human
accccacccaccacccagaagcug

SEQ ID NO: 716931 - RNA, 21 nt, Human
accucacugcagaucagggug

SEQ ID NO: 716932 - RNA, 18 nt, Human
accucucaaccugggcgg

SEQ ID NO: 716933 - RNA, 20 nt, Human
accuuuacaaggcaccagca

SEQ ID NO: 716934 - RNA, 18 nt, Human
acuucggagaugccuaag

SEQ ID NO: 716935 - RNA, 18 nt, Human
agaaaaagauggccaaag

SEQ ID NO: 716936 - RNA, 19 nt, Human
agaaaaagauggccaaaga

SEQ ID NO: 716937 - RNA, 19 nt, Human
agaaagacaggacacagga

SEQ ID NO: 716938 - RNA, 27 nt, Human
agaaagacaggacacaggagaggcaaa

SEQ ID NO: 716939 - RNA, 20 nt, Human
agacaggacacaggagaggc

SEQ ID NO: 716940 - RNA, 22 nt, Human
agagcagagcucaggacuugag

SEQ ID NO: 716941 - RNA, 20 nt, Human
agccagccuguguucuguca

SEQ ID NO: 716942 - RNA, 23 nt, Human
agccauccaaaaagcugaaucaa

SEQ ID NO: 716943 - RNA, 21 nt, Human
agcucaggacuugagaugacu

SEQ ID NO: 716944 - RNA, 18 nt, Human
aggaagccuucacuuugc

SEQ ID NO: 716945 - RNA, 24 nt, Human
aggagaugguugugcugcaguuca

SEQ ID NO: 716946 - RNA, 21 nt, Human
aggaggaaguaccuccuuugg

SEQ ID NO: 716947 - RNA, 19 nt, Human
aggcucaaaugcgccuucc

SEQ ID NO: 716948 - RNA, 18 nt, Human
agguaguuuccgccgcaa

SEQ ID NO: 716949 - RNA, 21 nt, Human
agguuucagagaugccaaacc

SEQ ID NO: 716950 - RNA, 18 nt, Human
aguuauccagggaaggga

SEQ ID NO: 716951 - RNA, 21 nt, Human
aucgcacucuuucuucuuugc

SEQ ID NO: 716952 - RNA, 22 nt, Human
augagugcuccucugcaccccc

SEQ ID NO: 716953 - RNA, 23 nt, Human
caaaaagcugaaucaaaaacaau

SEQ ID NO: 716954 - RNA, 20 nt, Human
caaagcgcuucagaagacca

SEQ ID NO: 716955 - RNA, 23 nt, Human
caaugagugcuccucugcacccc

SEQ ID NO: 716956 - RNA, 24 nt, Human
cacaacgugcuucugagaucagga

SEQ ID NO: 716957 - RNA, 21 nt, Human
cacacccacaugugcuuagac

SEQ ID NO: 716958 - RNA, 19 nt, Human
cacagggcugguugguuuc

SEQ ID NO: 716959 - RNA, 22 nt, Human
cacauccucgaccugagacaca

SEQ ID NO: 716960 - RNA, 19 nt, Human
caccacccagaagcugaag

SEQ ID NO: 716961 - RNA, 21 nt, Human
caccacccagaagcugaagcc

SEQ ID NO: 716962 - RNA, 19 nt, Human
caccagcaggcggcagagc

SEQ ID NO: 716963 - RNA, 24 nt, Human
cacccacacagcagcccugagggc

SEQ ID NO: 716964 - RNA, 23 nt, Human
cacccccccauaucaauggcagu

SEQ ID NO: 716965 - RNA, 20 nt, Human
caccuuucccucuucuuucc

SEQ ID NO: 716966 - RNA, 19 nt, Human
cacuuugcccagcgcuacu

SEQ ID NO: 716967 - RNA, 20 nt, Human
cagaauuuggacugccaaac

SEQ ID NO: 716968 - RNA, 20 nt, Human
cagacgagggacuccaggug

SEQ ID NO: 716969 - RNA, 18 nt, Human
cagcacagacaacauaac

SEQ ID NO: 716970 - RNA, 23 nt, Human
cagcagcccugagggcaucagug

SEQ ID NO: 716971 - RNA, 23 nt, Human
cagcagcccugagggcaucagug

SEQ ID NO: 716972 - RNA, 21 nt, Human
cagcuuaacacacccacacag

SEQ ID NO: 716973 - RNA, 20 nt, Human
caggaaaucagguccccccc

SEQ ID NO: 716974 - RNA, 18 nt, Human
caggcugcagagaacaga

SEQ ID NO: 716975 - RNA, 18 nt, Human
cagggccagacccgggcg

SEQ ID NO: 716976 - RNA, 21 nt, Human
cagggcuugcuggagaggaga

SEQ ID NO: 716977 - RNA, 25 nt, Human
cauaacagcacagcuaauccgugaa

SEQ ID NO: 716978 - RNA, 21 nt, Human
cauuuuagcucacaaggcuca

SEQ ID NO: 716979 - RNA, 22 nt, Human
ccacccaccacccagaagcuga

SEQ ID NO: 716980 - RNA, 18 nt, Human
ccacccagaagcugaagc

SEQ ID NO: 716981 - RNA, 25 nt, Human
ccagauaggaaauauuaaauccauu

SEQ ID NO: 716982 - RNA, 25 nt, Human
ccauaccccucauuccaugcccacc

SEQ ID NO: 716983 - RNA, 22 nt, Human
cccacacagcagcccugagggc

SEQ ID NO: 716984 - RNA, 23 nt, Human
cccacagcacagugaaaacaauu

SEQ ID NO: 716985 - RNA, 20 nt, Human
cccaccacccagaagcugaa

SEQ ID NO: 716986 - RNA, 18 nt, Human
cccaccccaccccaccca

SEQ ID NO: 716987 - RNA, 18 nt, Human
cccaccccaccccaccca

SEQ ID NO: 716988 - RNA, 19 nt, Human
cccaccccaccccacccac

SEQ ID NO: 716989 - RNA, 22 nt, Human
cccaccccaccccacccaccac

SEQ ID NO: 716990 - RNA, 30 nt, Human
cccaccccaccccacccaccacccagaagg

SEQ ID NO: 716991 - RNA, 18 nt, Human
ccccaagaaagccucuuc

SEQ ID NO: 716992 - RNA, 18 nt, Human
ccccacccaccacccaga

SEQ ID NO: 716993 - RNA, 26 nt, Human
ccccacccaccacccagaagcugaaa

SEQ ID NO: 716994 - RNA, 31 nt, Human
ccccaccccacccaccacccagaagcugaaa

SEQ ID NO: 716995 - RNA, 18 nt, Human
ccccagucuguccuggau

SEQ ID NO: 716996 - RNA, 23 nt, Human
ccccauaccccucauuccaugcc

SEQ ID NO: 716997 - RNA, 23 nt, Human
ccccggggccgggcgcuuagccc

SEQ ID NO: 716998 - RNA, 19 nt, Human
cccuggaccauuagaaccu

SEQ ID NO: 716999 - RNA, 22 nt, Human
cccuggaccauuagaaccucua

SEQ ID NO: 717000 - RNA, 22 nt, Human
ccgccugccccagcccuacagc

SEQ ID NO: 717001 - RNA, 18 nt, Human
ccgccuggcccggccucc

SEQ ID NO: 717002 - RNA, 18 nt, Human
ccguaggccagggccaga

SEQ ID NO: 717003 - RNA, 24 nt, Human
ccguguuggagaagucaaagcgau

SEQ ID NO: 717004 - RNA, 26 nt, Human
ccugccccagcccuacagccgguucc

SEQ ID NO: 717005 - RNA, 21 nt, Human
ccuggagcauuuuggcuggga

SEQ ID NO: 717006 - RNA, 18 nt, Human
ccugguuuucuguguucc

SEQ ID NO: 717007 - RNA, 22 nt, Human
ccuguguucugucaggcugcug

SEQ ID NO: 717008 - RNA, 20 nt, Human
cggggccgggcgcuuagccc

SEQ ID NO: 717009 - RNA, 21 nt, Human
cucacuguacccucauaucgc

SEQ ID NO: 717010 - RNA, 24 nt, Human
cuccucugcacccccccauaucaa

SEQ ID NO: 717011 - RNA, 24 nt, Human
cugaaguccuucugccugugccga

SEQ ID NO: 717012 - RNA, 20 nt, Human
cugaaucaaaaacaaugcca

SEQ ID NO: 717013 - RNA, 19 nt, Human
cugcacccccccauaucaa

SEQ ID NO: 717014 - RNA, 22 nt, Human
cuggagcauuuuggcugggagg

SEQ ID NO: 717015 - RNA, 20 nt, Human
cugguugguuucaccugcag

SEQ ID NO: 717016 - RNA, 27 nt, Human
cuuaacacacccacacagcagcccuga

SEQ ID NO: 717017 - RNA, 18 nt, Human
cuucagggcuugcuggag

SEQ ID NO: 717018 - RNA, 20 nt, Human
cuuccggggcuacgaagcgc

SEQ ID NO: 717019 - RNA, 24 nt, Human
gaagucuguuuuuagaaccgagaa

SEQ ID NO: 717020 - RNA, 22 nt, Human
gacggacagugaaucaaggcug

SEQ ID NO: 717021 - RNA, 21 nt, Human
gacuccaggugaucuauccac

SEQ ID NO: 717022 - RNA, 24 nt, Human
gacuccaggugaucuauccaccuc

SEQ ID NO: 717023 - RNA, 20 nt, Human
gcaaagccaagggggcaccc

SEQ ID NO: 717024 - RNA, 22 nt, Human
gcaccuuucccucuucuuucca

SEQ ID NO: 717025 - RNA, 20 nt, Human
gcagaaagacaggacacagg

SEQ ID NO: 717026 - RNA, 22 nt, Human
gccagccuguguucugucaggc

SEQ ID NO: 717027 - RNA, 20 nt, Human
gcccaccccaccccacccac

SEQ ID NO: 717028 - RNA, 22 nt, Human
gcccagcgcuacuucggagaug

SEQ ID NO: 717029 - RNA, 18 nt, Human
gccccggggccgggcgcu

SEQ ID NO: 717030 - RNA, 20 nt, Human
gcccguaggccagggccaga

SEQ ID NO: 717031 - RNA, 19 nt, Human
gccggauccgcggccccgg

SEQ ID NO: 717032 - RNA, 21 nt, Human
gcugagcugcccagcagagcu

SEQ ID NO: 717033 - RNA, 20 nt, Human
ggagaggagaugguugugcu

SEQ ID NO: 717034 - RNA, 23 nt, Human
ggcaaaaguaaaacaaaaggagg

SEQ ID NO: 717035 - RNA, 27 nt, Human
guaaaacaaaaggaggcuggcagcccc

SEQ ID NO: 717036 - RNA, 25 nt, Human
gugaggaggaaguaccuccuuuggg

SEQ ID NO: 717037 - RNA, 22 nt, Human
gugagguuucacugugcaacag

SEQ ID NO: 717038 - RNA, 24 nt, Human
uaaaggcugccguagguuuccaag

SEQ ID NO: 717039 - RNA, 18 nt, Human
uaacacacccacacagca

SEQ ID NO: 717040 - RNA, 23 nt, Human
uaacagcacagcuaauccgugaa

SEQ ID NO: 717041 - RNA, 23 nt, Human
uaacgaguauaccuuuacaaggc

SEQ ID NO: 717042 - RNA, 24 nt, Human
uacacacccacaugugcuuagaca

SEQ ID NO: 717043 - RNA, 18 nt, Human
uacagccccgccuggccc

SEQ ID NO: 717044 - RNA, 22 nt, Human
uacccuggagcauuuuggcugg

SEQ ID NO: 717045 - RNA, 18 nt, Human
uagaaccgagaaccagga

SEQ ID NO: 717046 - RNA, 22 nt, Human
uagaaccucuagggccuguaac

SEQ ID NO: 717047 - RNA, 24 nt, Human
ucaaaugcgccuuccaaaaacacc

SEQ ID NO: 717048 - RNA, 23 nt, Human
ucacugcagaucagggugaagga

SEQ ID NO: 717049 - RNA, 23 nt, Human
uccaaaauugacuaaaggcugcc

SEQ ID NO: 717050 - RNA, 20 nt, Human
uccacacauggcugccggau

SEQ ID NO: 717051 - RNA, 18 nt, Human
uccaccucacugcagauc

SEQ ID NO: 717052 - RNA, 19 nt, Human
uccaugcccaccccacccc

SEQ ID NO: 717053 - RNA, 24 nt, Human
uccaugcccaccccaccccaccca

SEQ ID NO: 717054 - RNA, 19 nt, Human
ucccagugcuauuacaggc

SEQ ID NO: 717055 - RNA, 21 nt, Human
uccccauaccccucauuccau

SEQ ID NO: 717056 - RNA, 21 nt, Human
ucccucuucuuuccacugccc

SEQ ID NO: 717057 - RNA, 18 nt, Human
uccgccgcaaacugaacc

SEQ ID NO: 717058 - RNA, 22 nt, Human
ucggcagucccccaagucuucc

SEQ ID NO: 717059 - RNA, 30 nt, Human
ucuaaacacauccucgaccugagacacagg

SEQ ID NO: 717060 - RNA, 22 nt, Human
ucucuaaacacauccucgaccu

SEQ ID NO: 717061 - RNA, 22 nt, Human
ugaaaacaauuagccauccaaa

SEQ ID NO: 717062 - RNA, 24 nt, Human
ugaaacaaaguacagucuccucuc

SEQ ID NO: 717063 - RNA, 18 nt, Human
ugaaggagaggcucucac

SEQ ID NO: 717064 - RNA, 22 nt, Human
ugaaucaaaaacaaugccaauc

SEQ ID NO: 717065 - RNA, 25 nt, Human
ugacaccagaacagugacagucaaa

SEQ ID NO: 717066 - RNA, 18 nt, Human
ugacucaguugcucaaaa

SEQ ID NO: 717067 - RNA, 19 nt, Human
ugagaucaggaagccuuca

SEQ ID NO: 717068 - RNA, 20 nt, Human
ugagggcaucagugaggagg

SEQ ID NO: 717069 - RNA, 24 nt, Human
ugcaagaaaauaaaccuccgagau

SEQ ID NO: 717070 - RNA, 18 nt, Human
ugcugcaguucacuuggu

SEQ ID NO: 717071 - RNA, 22 nt, Human
ugcuggagaggagaugguugug

SEQ ID NO: 717072 - RNA, 24 nt, Human
ugcuggagaggagaugguugugcc

SEQ ID NO: 717073 - RNA, 23 nt, Human
uggaucuccaucauggacaauga

SEQ ID NO: 717074 - RNA, 22 nt, Human
uggcacaggcuuggagacuucc

SEQ ID NO: 717075 - RNA, 18 nt, Human
uggccaaagaggggaaaa

SEQ ID NO: 717076 - RNA, 18 nt, Human
uggcugagcugcccagca

SEQ ID NO: 717077 - RNA, 22 nt, Human
uggcugccggauccgcggcccc

SEQ ID NO: 717078 - RNA, 19 nt, Human
uucacugguugcaagaaaa

SEQ ID NO: 717079 - RNA, 18 nt, Human
uuccccaagaaagccucu

SEQ ID NO: 717080 - RNA, 21 nt, Human
uuccuuggcagguggauggca

SEQ ID NO: 717081 - RNA, 19 nt, Human
uugacaccagaacagugac

SEQ ID NO: 717082 - RNA, 22 nt, Human
uugaucaguuugcaauauaaag

SEQ ID NO: 717083 - RNA, 22 nt, Human
uuggcugggaggcaaaauccca

SEQ ID NO: 717084 - RNA, 23 nt, Human
uuggcugggaggcaaaaucccag

SEQ ID NO: 717085 - RNA, 25 nt, Human
uuuccgccgcaaacugaaccuuauc

SEQ ID NO: 717086 - RNA, 18 nt, Human
uuugaaacaaaguacagu

SEQ ID NO: 717087 - RNA, 21 nt, Human
uuugcagacaccaggccugcu

SEQ ID NO: 717088 - RNA, 22 nt, Human
cauuucugucauaauuaguggg

SEQ ID NO: 717089 - RNA, 21 nt, Human
gccgcaacucuugcgcacguu

SEQ ID NO: 717090 - RNA, 22 nt, Human
uauacaguucugugccugaaac

SEQ ID NO: 717091 - RNA, 21 nt, Human
uccucugcccgccgccgcaac

SEQ ID NO: 717092 - RNA, 23 nt, Human
ugguaguccucugcccgccgccg

SEQ ID NO: 717093 - RNA, 21 nt, Human
uuggauauacaguucugugcc

SEQ ID NO: 717094 - RNA, 24 nt, Human
aaacaaaagccagaaaaugcagaa

SEQ ID NO: 717095 - RNA, 18 nt, Human
aaacaagaagccugcuuu

SEQ ID NO: 717096 - RNA, 25 nt, Human
aaacauuacuaauaacaauaacaau

SEQ ID NO: 717097 - RNA, 20 nt, Human
aaccucaaauccaccacguc

SEQ ID NO: 717098 - RNA, 22 nt, Human
aagagccaaaagacgugccugc

SEQ ID NO: 717099 - RNA, 18 nt, Human
aagccgucccccacccaa

SEQ ID NO: 717100 - RNA, 24 nt, Human
aaguguugcaaaguaaccugaacc

SEQ ID NO: 717101 - RNA, 19 nt, Human
aauaugggacuauggacga

SEQ ID NO: 717102 - RNA, 19 nt, Human
aauggugggaagaauggaa

SEQ ID NO: 717103 - RNA, 25 nt, Human
acacggccccagggaggagggaacc

SEQ ID NO: 717104 - RNA, 20 nt, Human
accugaaccgucaaguaauu

SEQ ID NO: 717105 - RNA, 20 nt, Human
acuugcugggguggcucagg

SEQ ID NO: 717106 - RNA, 20 nt, Human
acuuuugauaaugcauaaaa

SEQ ID NO: 717107 - RNA, 18 nt, Human
agaagcccacugucuaca

SEQ ID NO: 717108 - RNA, 22 nt, Human
agaagcccacugucuacaaaaa

SEQ ID NO: 717109 - RNA, 21 nt, Human
agacagaugccuugugccccu

SEQ ID NO: 717110 - RNA, 21 nt, Human
agccaagaaaacaaaagccag

SEQ ID NO: 717111 - RNA, 23 nt, Human
agccagcaccugggcuuuccugg

SEQ ID NO: 717112 - RNA, 29 nt, Human
aggcaaagaguggggacagaagggacccc

SEQ ID NO: 717113 - RNA, 20 nt, Human
aggcgccagagcucagcacc

SEQ ID NO: 717114 - RNA, 18 nt, Human
aggggcggggaggcaaag

SEQ ID NO: 717115 - RNA, 18 nt, Human
aguaaaaaaaaaaaaaaa

SEQ ID NO: 717116 - RNA, 22 nt, Human
aguaacaaguagaauccagaac

SEQ ID NO: 717117 - RNA, 18 nt, Human
agucuucugauuucuuag

SEQ ID NO: 717118 - RNA, 19 nt, Human
auauauauauauauauaua

SEQ ID NO: 717119 - RNA, 19 nt, Human
auauauauauauauauaua

SEQ ID NO: 717120 - RNA, 19 nt, Human
auauauauauauauauaua

SEQ ID NO: 717121 - RNA, 19 nt, Human
auauauauauauauauaua

SEQ ID NO: 717122 - RNA, 19 nt, Human
auauauauauauauauaua

SEQ ID NO: 717123 - RNA, 19 nt, Human
auauauauauauauauaua

SEQ ID NO: 717124 - RNA, 19 nt, Human
auauauauauauauauaua

SEQ ID NO: 717125 - RNA, 19 nt, Human
auauauauauauauauaua

SEQ ID NO: 717126 - RNA, 19 nt, Human
auauauauauauauauaua

SEQ ID NO: 717127 - RNA, 19 nt, Human
auauauauauauauauaua

SEQ ID NO: 717128 - RNA, 19 nt, Human
auauauauauauauauaua

SEQ ID NO: 717129 - RNA, 19 nt, Human
auauauauauauauauaua

SEQ ID NO: 717130 - RNA, 21 nt, Human
auggaacaggcacacggcccc

SEQ ID NO: 717131 - RNA, 19 nt, Human
caaaagacgugccugcucc

SEQ ID NO: 717132 - RNA, 21 nt, Human
caagaaaacaaaagccagaaa

SEQ ID NO: 717133 - RNA, 22 nt, Human
caaguaauuuaaacucaguaac

SEQ ID NO: 717134 - RNA, 24 nt, Human
caaguagaauccagaaccaaacau

SEQ ID NO: 717135 - RNA, 27 nt, Human
cacacacaacaaguaucuuuuuuucca

SEQ ID NO: 717136 - RNA, 21 nt, Human
cacaggugggaggcugcuggg

SEQ ID NO: 717137 - RNA, 19 nt, Human
caccuccuuccucucucuu

SEQ ID NO: 717138 - RNA, 19 nt, Human
caccuccuuccucucucuu

SEQ ID NO: 717139 - RNA, 18 nt, Human
cacguaaaugcguauaua

SEQ ID NO: 717140 - RNA, 24 nt, Human
cagaggaaugugucuccgcaacuu

SEQ ID NO: 717141 - RNA, 23 nt, Human
cagauucuuggcagggaggcggc

SEQ ID NO: 717142 - RNA, 20 nt, Human
cagcacccuagucaucuagg

SEQ ID NO: 717143 - RNA, 18 nt, Human
cagcaccugggcuuuccu

SEQ ID NO: 717144 - RNA, 19 nt, Human
cagggaccguccuaucucu

SEQ ID NO: 717145 - RNA, 24 nt, Human
caguaacaaguagaauccagaacc

SEQ ID NO: 717146 - RNA, 20 nt, Human
cagucaccauucacuuucag

SEQ ID NO: 717147 - RNA, 21 nt, Human
cauaaaucaacagaagagucu

SEQ ID NO: 717148 - RNA, 24 nt, Human
caucuagggcaccugaaccugcuc

SEQ ID NO: 717149 - RNA, 18 nt, Human
cauuacugaggaagaggu

SEQ ID NO: 717150 - RNA, 19 nt, Human
cauuccuaacagucaccau

SEQ ID NO: 717151 - RNA, 23 nt, Human
ccaaaagacgugccugcucccag

SEQ ID NO: 717152 - RNA, 22 nt, Human
cccaaaauaacuuuacagaaca

SEQ ID NO: 717153 - RNA, 20 nt, Human
cccacagcaccugaacguca

SEQ ID NO: 717154 - RNA, 21 nt, Human
cccacugucuacaaaaacugc

SEQ ID NO: 717155 - RNA, 18 nt, Human
ccccggcuguucuuccau

SEQ ID NO: 717156 - RNA, 22 nt, Human
ccccugugacagugcucagccu

SEQ ID NO: 717157 - RNA, 31 nt, Human
ccccugugacagugcucagccucgccacucu

SEQ ID NO: 717158 - RNA, 21 nt, Human
cccuccgccaagccugcuucc

SEQ ID NO: 717159 - RNA, 24 nt, Human
ccggugguggcggcacagcuuucu

SEQ ID NO: 717160 - RNA, 20 nt, Human
cgaaggacggacgcggccgg

SEQ ID NO: 717161 - RNA, 18 nt, Human
cggccaggucacaggugg

SEQ ID NO: 717162 - RNA, 20 nt, Human
cggccucucucagauucuug

SEQ ID NO: 717163 - RNA, 21 nt, Human
cggggaggcaaagagugggga

SEQ ID NO: 717164 - RNA, 18 nt, Human
cgugccugcucccaggag

SEQ ID NO: 717165 - RNA, 20 nt, Human
cucagaaauauuaccaucac

SEQ ID NO: 717166 - RNA, 19 nt, Human
cucagauucuuggcaggga

SEQ ID NO: 717167 - RNA, 22 nt, Human
cucaucaucauaccccuccgcc

SEQ ID NO: 717168 - RNA, 24 nt, Human
cugcauggacauuccuaauuacac

SEQ ID NO: 717169 - RNA, 20 nt, Human
cugguguaagaauaucagaa

SEQ ID NO: 717170 - RNA, 26 nt, Human
cuucuacauggggggcgcagcagcug

SEQ ID NO: 717171 - RNA, 23 nt, Human
cuuugcccaaaauaacuuuacag

SEQ ID NO: 717172 - RNA, 22 nt, Human
gaaaacaaaagccagaaaaugc

SEQ ID NO: 717173 - RNA, 18 nt, Human
gaacaggcacacggcccc

SEQ ID NO: 717174 - RNA, 20 nt, Human
gaauguagcccuguuacaaa

SEQ ID NO: 717175 - RNA, 23 nt, Human
gaguuccccggcuguucuuccau

SEQ ID NO: 717176 - RNA, 23 nt, Human
gaucaaccucaaauccaccacgu

SEQ ID NO: 717177 - RNA, 20 nt, Human
gcagcagcuggcagccagca

SEQ ID NO: 717178 - RNA, 19 nt, Human
gccggugguggcggcacag

SEQ ID NO: 717179 - RNA, 21 nt, Human
gcucccaggaggugcaccuuc

SEQ ID NO: 717180 - RNA, 24 nt, Human
gcucgggaugugaggugucugcuc

SEQ ID NO: 717181 - RNA, 24 nt, Human
ggaaaagaaaauauuuauaucugu

SEQ ID NO: 717182 - RNA, 27 nt, Human
ggcaaugggaaaagaaaagggagggcc

SEQ ID NO: 717183 - RNA, 19 nt, Human
ggccaggucacagguggga

SEQ ID NO: 717184 - RNA, 18 nt, Human
ggcgcagcagcuggcagc

SEQ ID NO: 717185 - RNA, 22 nt, Human
ggcggggaggcaaagagugggg

SEQ ID NO: 717186 - RNA, 20 nt, Human
ggcuggugauccccacccuu

SEQ ID NO: 717187 - RNA, 22 nt, Human
gggaaacuacugaaaugauuaa

SEQ ID NO: 717188 - RNA, 22 nt, Human
gggacagaaggcgccagagcuc

SEQ ID NO: 717189 - RNA, 24 nt, Human
gggaccuggggugcgucggaaaca

SEQ ID NO: 717190 - RNA, 22 nt, Human
gggagaaaagacacccacuugc

SEQ ID NO: 717191 - RNA, 19 nt, Human
gggcgcagcagcuggcagc

SEQ ID NO: 717192 - RNA, 24 nt, Human
gggcgcagcagcuggcagccagca

SEQ ID NO: 717193 - RNA, 22 nt, Human
gggcggggaggcaaagaguggg

SEQ ID NO: 717194 - RNA, 19 nt, Human
gguggcucagggaaggggc

SEQ ID NO: 717195 - RNA, 22 nt, Human
gguguaagaauaucagaaaaaa

SEQ ID NO: 717196 - RNA, 18 nt, Human
guccuaucucuccauggu

SEQ ID NO: 717197 - RNA, 21 nt, Human
gucuucugauuucuuaggugg

SEQ ID NO: 717198 - RNA, 23 nt, Human
gugucacggcaaugggaaaagaa

SEQ ID NO: 717199 - RNA, 31 nt, Human
guguguguguguguuuguguguguguguguu

SEQ ID NO: 717200 - RNA, 18 nt, Human
guuacauugcaucguuug

SEQ ID NO: 717201 - RNA, 18 nt, Human
uaaaacacagagaaacag

SEQ ID NO: 717202 - RNA, 21 nt, Human
uaaacaagacuuuguaucaga

SEQ ID NO: 717203 - RNA, 19 nt, Human
uaaauacccacuaagacaa

SEQ ID NO: 717204 - RNA, 18 nt, Human
uaacaaguagaauccaga

SEQ ID NO: 717205 - RNA, 22 nt, Human
uaacuaaaacacagagaaacag

SEQ ID NO: 717206 - RNA, 21 nt, Human
uaagaaaauaugggacuaugg

SEQ ID NO: 717207 - RNA, 19 nt, Human
uaagacagaugccuugugc

SEQ ID NO: 717208 - RNA, 23 nt, Human
uaaugcauaaaaucauaugugca

SEQ ID NO: 717209 - RNA, 19 nt, Human
uaccaucacacauaguguc

SEQ ID NO: 717210 - RNA, 31 nt, Human
uaggguguguguguguguuugugugugugug

SEQ ID NO: 717211 - RNA, 22 nt, Human
uauaagcuagccaguuacauug

SEQ ID NO: 717212 - RNA, 24 nt, Human
uauauaagcuagccaguuacauug

SEQ ID NO: 717213 - RNA, 19 nt, Human
uauauauauauauauauau

SEQ ID NO: 717214 - RNA, 19 nt, Human
uauauauauauauauauau

SEQ ID NO: 717215 - RNA, 19 nt, Human
uauauauauauauauauau

SEQ ID NO: 717216 - RNA, 19 nt, Human
uauauauauauauauauau

SEQ ID NO: 717217 - RNA, 19 nt, Human
uauauauauauauauauau

SEQ ID NO: 717218 - RNA, 19 nt, Human
uauauauauauauauauau

SEQ ID NO: 717219 - RNA, 19 nt, Human
ucaaggcagcaguaacuuu

SEQ ID NO: 717220 - RNA, 20 nt, Human
ucaccuccuuccucucucuu

SEQ ID NO: 717221 - RNA, 21 nt, Human
ucacuagucccugacauuccu

SEQ ID NO: 717222 - RNA, 23 nt, Human
ucauccccacagucccucuuaac

SEQ ID NO: 717223 - RNA, 18 nt, Human
uccagugucucaaacuug

SEQ ID NO: 717224 - RNA, 20 nt, Human
uccagugucucaaacuuguc

SEQ ID NO: 717225 - RNA, 25 nt, Human
uccauggucagaagagccaaaagac

SEQ ID NO: 717226 - RNA, 19 nt, Human
ucccacagacgugucuccu

SEQ ID NO: 717227 - RNA, 19 nt, Human
ucccacagacgugucuccu

SEQ ID NO: 717228 - RNA, 18 nt, Human
uccgcaacuuugcccaaa

SEQ ID NO: 717229 - RNA, 20 nt, Human
uccgccaagccugcuuccca

SEQ ID NO: 717230 - RNA, 20 nt, Human
uccugggaauguggaaaugc

SEQ ID NO: 717231 - RNA, 18 nt, Human
uccuuccucucucuuauu

SEQ ID NO: 717232 - RNA, 19 nt, Human
ucuacaaaaacugcacuag

SEQ ID NO: 717233 - RNA, 21 nt, Human
ucuagaauauagcaucuucau

SEQ ID NO: 717234 - RNA, 21 nt, Human
ucuuggcagggaggcggcggg

SEQ ID NO: 717235 - RNA, 23 nt, Human
ugcauggacauuccuaauuacac

SEQ ID NO: 717236 - RNA, 18 nt, Human
ugcguacacugcaugguu

SEQ ID NO: 717237 - RNA, 21 nt, Human
ugcucccaggaggugcaccuu

SEQ ID NO: 717238 - RNA, 20 nt, Human
uggaauaccauuucaauugc

SEQ ID NO: 717239 - RNA, 20 nt, Human
uggagccagugaacaaugag

SEQ ID NO: 717240 - RNA, 18 nt, Human
uggaggucaccaggccca

SEQ ID NO: 717241 - RNA, 19 nt, Human
uggcucagggaaggggcgg

SEQ ID NO: 717242 - RNA, 18 nt, Human
uggggacagaaggcgcca

SEQ ID NO: 717243 - RNA, 19 nt, Human
ugugccugccaguacuacu

SEQ ID NO: 717244 - RNA, 20 nt, Human
ugugugugugugugucugug

SEQ ID NO: 717245 - RNA, 21 nt, Human
uguguguguguguuugugugu

SEQ ID NO: 717246 - RNA, 28 nt, Human
uguguguguguguuugugugugugugug

SEQ ID NO: 717247 - RNA, 21 nt, Human
uguguguguguuugugugugu

SEQ ID NO: 717248 - RNA, 21 nt, Human
uguguguguuugugugugugu

SEQ ID NO: 717249 - RNA, 23 nt, Human
uguguguguuugugugugugugu

SEQ ID NO: 717250 - RNA, 24 nt, Human
uguugcgcuagcucucuuccgagg

SEQ ID NO: 717251 - RNA, 22 nt, Human
uuaaacucaguaacaaguagaa

SEQ ID NO: 717252 - RNA, 19 nt, Human
uuaacaaggagaggcaucu

SEQ ID NO: 717253 - RNA, 19 nt, Human
uuacaccaacaggacagau

SEQ ID NO: 717254 - RNA, 21 nt, Human
uuacugaggaagagguauaug

SEQ ID NO: 717255 - RNA, 19 nt, Human
uucacaauuaaaaaaaaac

SEQ ID NO: 717256 - RNA, 21 nt, Human
uucacagaacauuuucauuca

SEQ ID NO: 717257 - RNA, 22 nt, Human
uucagccaagaaaacaaaagcc

SEQ ID NO: 717258 - RNA, 18 nt, Human
uugugccccuacugugcc

SEQ ID NO: 717259 - RNA, 21 nt, Human
uuuaaacucaguaacaaguag

SEQ ID NO: 717260 - RNA, 23 nt, Human
uuugugugugugugugucugugu

SEQ ID NO: 717261 - RNA, 22 nt, Human
aaaaaaaaaaaaaaaaaaagaa

SEQ ID NO: 717262 - RNA, 22 nt, Human
aaaaagccagguuaacuaaaac

SEQ ID NO: 717263 - RNA, 20 nt, Human
aaaaagccagguuaacuagu

SEQ ID NO: 717264 - RNA, 19 nt, Human
aaaacagacgcacgaucua

SEQ ID NO: 717265 - RNA, 21 nt, Human
aaacccuccaccgucgucuuc

SEQ ID NO: 717266 - RNA, 19 nt, Human
aaagaacacuaucaccugc

SEQ ID NO: 717267 - RNA, 18 nt, Human
aaagcucuaaauccuugg

SEQ ID NO: 717268 - RNA, 24 nt, Human
aaagugcugggauuacagguguga

SEQ ID NO: 717269 - RNA, 21 nt, Human
aaauauuucaaacaggaacuc

SEQ ID NO: 717270 - RNA, 20 nt, Human
aacagauaaacauuaccagg

SEQ ID NO: 717271 - RNA, 23 nt, Human
aacaggcaggacaagacggcaca

SEQ ID NO: 717272 - RNA, 19 nt, Human
aagaagccccagguggggc

SEQ ID NO: 717273 - RNA, 18 nt, Human
aagcaacuaugagaagac

SEQ ID NO: 717274 - RNA, 24 nt, Human
aagcuccagaacugaaacaaagga

SEQ ID NO: 717275 - RNA, 22 nt, Human
aagcugcaucaacuuaaggaac

SEQ ID NO: 717276 - RNA, 21 nt, Human
aaggcuacaggugagccuggc

SEQ ID NO: 717277 - RNA, 24 nt, Human
aaguagcugggauuacaggcgugu

SEQ ID NO: 717278 - RNA, 25 nt, Human
aaguagcugggauuacaggcgugug

SEQ ID NO: 717279 - RNA, 18 nt, Human
aagugcugggauuacagg

SEQ ID NO: 717280 - RNA, 19 nt, Human
aagugcugggauuacaggu

SEQ ID NO: 717281 - RNA, 20 nt, Human
acaaacacacacauggcccc

SEQ ID NO: 717282 - RNA, 21 nt, Human
acacagacgucagacaaguca

SEQ ID NO: 717283 - RNA, 20 nt, Human
acaggguuucaccacauugg

SEQ ID NO: 717284 - RNA, 24 nt, Human
acaggguuucaccacauuggccag

SEQ ID NO: 717285 - RNA, 27 nt, Human
acaucacaaacacacacauggccccac

SEQ ID NO: 717286 - RNA, 20 nt, Human
accaaaacuggaaguagagc

SEQ ID NO: 717287 - RNA, 19 nt, Human
acccaggcuggagugcggu

SEQ ID NO: 717288 - RNA, 22 nt, Human
accucaugauccgcccgcacug

SEQ ID NO: 717289 - RNA, 18 nt, Human
acucugucacccaggcug

SEQ ID NO: 717290 - RNA, 25 nt, Human
acucugucacccaggcuggagugcg

SEQ ID NO: 717291 - RNA, 20 nt, Human
acugcacacagacgucagac

SEQ ID NO: 717292 - RNA, 20 nt, Human
agaacugaaacaaaggaaaa

SEQ ID NO: 717293 - RNA, 18 nt, Human
agacggcacaucuguccu

SEQ ID NO: 717294 - RNA, 20 nt, Human
agagaccuuaacaccaagag

SEQ ID NO: 717295 - RNA, 18 nt, Human
agagcucauuuuuauaaa

SEQ ID NO: 717296 - RNA, 24 nt, Human
agagguuagaagcugcaucaacuu

SEQ ID NO: 717297 - RNA, 21 nt, Human
agcacaacgaccaucuaacag

SEQ ID NO: 717298 - RNA, 23 nt, Human
agcagcaggagaggugguugaga

SEQ ID NO: 717299 - RNA, 27 nt, Human
agcauugucauccuuugauccuauggc

SEQ ID NO: 717300 - RNA, 24 nt, Human
agcgauucuccugccucagccucc

SEQ ID NO: 717301 - RNA, 22 nt, Human
aggauuguucuguggcccccaa

SEQ ID NO: 717302 - RNA, 24 nt, Human
aggcagaggaaucaagggcagggg

SEQ ID NO: 717303 - RNA, 24 nt, Human
aggcgugugccaccacgcccagcu

SEQ ID NO: 717304 - RNA, 27 nt, Human
aggcuacaggugagccuggccugagca

SEQ ID NO: 717305 - RNA, 21 nt, Human
agggaaggacccagcucugcu

SEQ ID NO: 717306 - RNA, 23 nt, Human
aggugugagccacugugccuggc

SEQ ID NO: 717307 - RNA, 20 nt, Human
agugcgguggcgcaaucucg

SEQ ID NO: 717308 - RNA, 24 nt, Human
agugcgguggcgcaaucucggcuc

SEQ ID NO: 717309 - RNA, 20 nt, Human
agugcugggauuacaggugu

SEQ ID NO: 717310 - RNA, 24 nt, Human
aguggcucaguucugcaacaggug

SEQ ID NO: 717311 - RNA, 31 nt, Human
augaugauaauuaaaaaaaaaaaaaaaaaaa

SEQ ID NO: 717312 - RNA, 19 nt, Human
auuacaggcgugugccacc

SEQ ID NO: 717313 - RNA, 19 nt, Human
caaaacaucccauccucua

SEQ ID NO: 717314 - RNA, 22 nt, Human
caaaacaucccauccucuaccc

SEQ ID NO: 717315 - RNA, 26 nt, Human
caaagaucacaccugcaccaaaaagc

SEQ ID NO: 717316 - RNA, 24 nt, Human
caaagugcugggauuacaggugug

SEQ ID NO: 717317 - RNA, 25 nt, Human
caaagugcugggauuacagguguga

SEQ ID NO: 717318 - RNA, 19 nt, Human
caaauaaguggacgaaaug

SEQ ID NO: 717319 - RNA, 22 nt, Human
caagcgauucuccugccucagc

SEQ ID NO: 717320 - RNA, 27 nt, Human
caagcgauucuccugccucagccuccc

SEQ ID NO: 717321 - RNA, 19 nt, Human
cacagcugccucugagguc

SEQ ID NO: 717322 - RNA, 18 nt, Human
cacauuaacggggggagg

SEQ ID NO: 717323 - RNA, 26 nt, Human
cacauuaacgggggggaagggggagg

SEQ ID NO: 717324 - RNA, 24 nt, Human
cacauuggccaggcuggucucaaa

SEQ ID NO: 717325 - RNA, 23 nt, Human
caccaaaaagccagguuaacuaa

SEQ ID NO: 717326 - RNA, 21 nt, Human
caccacauuggccaggcuggu

SEQ ID NO: 717327 - RNA, 24 nt, Human
caccacauuggccaggcuggucuc

SEQ ID NO: 717328 - RNA, 27 nt, Human
caccacauuggccaggcuggucucaaa

SEQ ID NO: 717329 - RNA, 24 nt, Human
caccacgcccagcuaauuuuugua

SEQ ID NO: 717330 - RNA, 18 nt, Human
caccagggaaggacccag

SEQ ID NO: 717331 - RNA, 24 nt, Human
cacccaggcuggagugcgguggcg

SEQ ID NO: 717332 - RNA, 23 nt, Human
cacucugucacccaggcuggagu

SEQ ID NO: 717333 - RNA, 24 nt, Human
cacucugucacccaggcuggagug

SEQ ID NO: 717334 - RNA, 18 nt, Human
cacugcaaccucugccuc

SEQ ID NO: 717335 - RNA, 21 nt, Human
cacugcaaccucugccuccca

SEQ ID NO: 717336 - RNA, 21 nt, Human
cagaaagaacacuaucaccug

SEQ ID NO: 717337 - RNA, 21 nt, Human
cagaacugaaacaaaggaaaa

SEQ ID NO: 717338 - RNA, 19 nt, Human
cagaagcacaacgaccauc

SEQ ID NO: 717339 - RNA, 20 nt, Human
cagcacccacgcccauuucu

SEQ ID NO: 717340 - RNA, 19 nt, Human
cagcagcaggagagguggu

SEQ ID NO: 717341 - RNA, 23 nt, Human
cagcagguggaaacgcaguucag

SEQ ID NO: 717342 - RNA, 23 nt, Human
cagcugccucugaggucucugag

SEQ ID NO: 717343 - RNA, 20 nt, Human
cagcuuccagggcagcaccc

SEQ ID NO: 717344 - RNA, 22 nt, Human
cagggcagcacccacgcccauu

SEQ ID NO: 717345 - RNA, 24 nt, Human
caggguuucaccacauuggccagg

SEQ ID NO: 717346 - RNA, 19 nt, Human
caguaaaaaaaaaaaaaaa

SEQ ID NO: 717347 - RNA, 19 nt, Human
caguucagagcacgggcgg

SEQ ID NO: 717348 - RNA, 26 nt, Human
ccaaacccuccaccgucgucuucaaa

SEQ ID NO: 717349 - RNA, 21 nt, Human
ccaaagugcugggauuacagg

SEQ ID NO: 717350 - RNA, 21 nt, Human
ccaaagugcugggauuacagg

SEQ ID NO: 717351 - RNA, 24 nt, Human
ccaaagugcugggauuacaggugu

SEQ ID NO: 717352 - RNA, 22 nt, Human
ccaagguagaugaagaaaguca

SEQ ID NO: 717353 - RNA, 22 nt, Human
ccaaguagcugggauuacaggc

SEQ ID NO: 717354 - RNA, 24 nt, Human
ccaaguagcugggauuacaggcgu

SEQ ID NO: 717355 - RNA, 20 nt, Human
ccaccacgcccagcuaauuu

SEQ ID NO: 717356 - RNA, 19 nt, Human
ccacccaaggacuucacuu

SEQ ID NO: 717357 - RNA, 24 nt, Human
ccaccgucgucuucaaauuaccca

SEQ ID NO: 717358 - RNA, 20 nt, Human
ccacugugccuggccuggau

SEQ ID NO: 717359 - RNA, 24 nt, Human
ccagcaacugccagugcucccucc

SEQ ID NO: 717360 - RNA, 19 nt, Human
ccagggcagcacccacgcc

SEQ ID NO: 717361 - RNA, 21 nt, Human
ccagggcagcacccacgccca

SEQ ID NO: 717362 - RNA, 24 nt, Human
cccaaauaaguggacgaaaugccc

SEQ ID NO: 717363 - RNA, 23 nt, Human
cccaaguagcugggauuacaggc

SEQ ID NO: 717364 - RNA, 23 nt, Human
cccaaguagcugggauuacaggc

SEQ ID NO: 717365 - RNA, 20 nt, Human
cccagguucaagcgauucuc

SEQ ID NO: 717366 - RNA, 23 nt, Human
cccagguucaagcgauucuccug

SEQ ID NO: 717367 - RNA, 24 nt, Human
ccucccagguucaagcgauucucc

SEQ ID NO: 717368 - RNA, 21 nt, Human
ccucucccacuucccugggag

SEQ ID NO: 717369 - RNA, 21 nt, Human
ccugccgacggcugacugcac

SEQ ID NO: 717370 - RNA, 20 nt, Human
ccuucagcgacagagcuggc

SEQ ID NO: 717371 - RNA, 22 nt, Human
cgcugguggagccucagcccug

SEQ ID NO: 717372 - RNA, 18 nt, Human
cggcguaaggcuacaggu

SEQ ID NO: 717373 - RNA, 21 nt, Human
cgugugccaccacgcccagcu

SEQ ID NO: 717374 - RNA, 24 nt, Human
cucacucugucacccaggcuggag

SEQ ID NO: 717375 - RNA, 24 nt, Human
cucacugcaaccucugccucccag

SEQ ID NO: 717376 - RNA, 24 nt, Human
cucacugcaaccucugccucccag

SEQ ID NO: 717377 - RNA, 23 nt, Human
cucagccucccaaguagcuggga

SEQ ID NO: 717378 - RNA, 22 nt, Human
cucaucagcuuccaccaaccac

SEQ ID NO: 717379 - RNA, 24 nt, Human
cuccugaccucaugauccgcccgc

SEQ ID NO: 717380 - RNA, 25 nt, Human
cuccugccucagccucccaaguagc

SEQ ID NO: 717381 - RNA, 23 nt, Human
cugcaaccucugccucccagguu

SEQ ID NO: 717382 - RNA, 24 nt, Human
cugcaaccucugccucccagguuc

SEQ ID NO: 717383 - RNA, 23 nt, Human
cugccucagccucccaaguagcu

SEQ ID NO: 717384 - RNA, 21 nt, Human
cuggacccaucaaccugccga

SEQ ID NO: 717385 - RNA, 19 nt, Human
cugucacccaggcuggagu

SEQ ID NO: 717386 - RNA, 22 nt, Human
cuuaaagcucccugaaggaccu

SEQ ID NO: 717387 - RNA, 28 nt, Human
cuucaagaucaccaagguagaugaagaa

SEQ ID NO: 717388 - RNA, 18 nt, Human
cuuccacucuucugcuau

SEQ ID NO: 717389 - RNA, 25 nt, Human
cuuugaggcagaggaaucaagggca

SEQ ID NO: 717390 - RNA, 18 nt, Human
gacuuggcuuuuugaguc

SEQ ID NO: 717391 - RNA, 18 nt, Human
gagacuguugaguucggc

SEQ ID NO: 717392 - RNA, 22 nt, Human
gaggagccuaugagacuguuga

SEQ ID NO: 717393 - RNA, 22 nt, Human
gaggcagaggaaucaagggcag

SEQ ID NO: 717394 - RNA, 21 nt, Human
gaucaccaagguagaugaaga

SEQ ID NO: 717395 - RNA, 18 nt, Human
gauuacaggcgugugcca

SEQ ID NO: 717396 - RNA, 18 nt, Human
gauuacaggugugagcca

SEQ ID NO: 717397 - RNA, 21 nt, Human
gauuacaggugugagccacug

SEQ ID NO: 717398 - RNA, 24 nt, Human
gauuacaggugugagccacugugc

SEQ ID NO: 717399 - RNA, 22 nt, Human
gcaaccucugccucccagguuc

SEQ ID NO: 717400 - RNA, 20 nt, Human
gcagcaggagaggugguuga

SEQ ID NO: 717401 - RNA, 19 nt, Human
gccacugugccuggccugg

SEQ ID NO: 717402 - RNA, 22 nt, Human
gcccagcuaauuuuuguauuuu

SEQ ID NO: 717403 - RNA, 20 nt, Human
gcccgcacuggccucccaaa

SEQ ID NO: 717404 - RNA, 20 nt, Human
gccucagccucccaaguagc

SEQ ID NO: 717405 - RNA, 24 nt, Human
gcgauucuccugccucagccuccc

SEQ ID NO: 717406 - RNA, 21 nt, Human
gcuccuucagcgacagagcug

SEQ ID NO: 717407 - RNA, 18 nt, Human
gcugcaggaaggggagag

SEQ ID NO: 717408 - RNA, 23 nt, Human
gcuggucucaaacuccugaccuc

SEQ ID NO: 717409 - RNA, 19 nt, Human
ggaaggggagagaacggag

SEQ ID NO: 717410 - RNA, 21 nt, Human
ggaaucaagggcaggggccag

SEQ ID NO: 717411 - RNA, 24 nt, Human
ggaaucaagggcaggggccaguuc

SEQ ID NO: 717412 - RNA, 20 nt, Human
ggacagagucaucagggaca

SEQ ID NO: 717413 - RNA, 19 nt, Human
ggccaccagggaaggaccc

SEQ ID NO: 717414 - RNA, 19 nt, Human
ggcccggagggagggcugc

SEQ ID NO: 717415 - RNA, 24 nt, Human
ggcuggucucaaacuccugaccuc

SEQ ID NO: 717416 - RNA, 18 nt, Human
gggcagcacccacgccca

SEQ ID NO: 717417 - RNA, 21 nt, Human
ggggggaggggggcagcacac

SEQ ID NO: 717418 - RNA, 20 nt, Human
gggugcgguugagggagcua

SEQ ID NO: 717419 - RNA, 18 nt, Human
guagcugggauuacaggc

SEQ ID NO: 717420 - RNA, 18 nt, Human
gugugccaccacgcccag

SEQ ID NO: 717421 - RNA, 22 nt, Human
uaaacauuaccaggcuacacag

SEQ ID NO: 717422 - RNA, 19 nt, Human
uaaagcucccugaaggacc

SEQ ID NO: 717423 - RNA, 20 nt, Human
uaagaagauggugggugagg

SEQ ID NO: 717424 - RNA, 20 nt, Human
uaaggaacaucacaaacaca

SEQ ID NO: 717425 - RNA, 22 nt, Human
uaaggcaagagagacucggcca

SEQ ID NO: 717426 - RNA, 24 nt, Human
uaauuuuuguauuuuuggaagaga

SEQ ID NO: 717427 - RNA, 22 nt, Human
uacacagaguuaagugcauaau

SEQ ID NO: 717428 - RNA, 24 nt, Human
uacaggcgugugccaccacgccca

SEQ ID NO: 717429 - RNA, 22 nt, Human
uacaggugugagccacugugcc

SEQ ID NO: 717430 - RNA, 23 nt, Human
uacaggugugagccacugugccu

SEQ ID NO: 717431 - RNA, 26 nt, Human
uaccagcaagcaacuaugagaagaca

SEQ ID NO: 717432 - RNA, 21 nt, Human
uacuuagaccagacguugggg

SEQ ID NO: 717433 - RNA, 23 nt, Human
uaggauggcaucagggaccugcc

SEQ ID NO: 717434 - RNA, 21 nt, Human
uauguuaguucaacgaaagcu

SEQ ID NO: 717435 - RNA, 23 nt, Human
ucaaaaggacuucaccaucaaca

SEQ ID NO: 717436 - RNA, 24 nt, Human
ucaaagaucacaccugcaccaaaa

SEQ ID NO: 717437 - RNA, 23 nt, Human
ucaaauauuucaaacaggaacuc

SEQ ID NO: 717438 - RNA, 21 nt, Human
ucaaucccagaacaaaaauga

SEQ ID NO: 717439 - RNA, 21 nt, Human
ucacaaacacacacauggccc

SEQ ID NO: 717440 - RNA, 19 nt, Human
ucacagagguuagaagcuu

SEQ ID NO: 717441 - RNA, 22 nt, Human
ucaccacagacucuggacccau

SEQ ID NO: 717442 - RNA, 22 nt, Human
ucacccaggcuggagugcggug

SEQ ID NO: 717443 - RNA, 19 nt, Human
ucacugcaaccucugccuc

SEQ ID NO: 717444 - RNA, 24 nt, Human
ucacugcaaccucugccucccagg

SEQ ID NO: 717445 - RNA, 25 nt, Human
ucacugcaaccucugccucccaggu

SEQ ID NO: 717446 - RNA, 19 nt, Human
ucagaagcacaacgaccau

SEQ ID NO: 717447 - RNA, 26 nt, Human
ucagcauuaucaaaugaacagauaaa

SEQ ID NO: 717448 - RNA, 20 nt, Human
ucagccucccaaguagcugg

SEQ ID NO: 717449 - RNA, 24 nt, Human
ucagggucuucuagcccuacaugg

SEQ ID NO: 717450 - RNA, 22 nt, Human
ucaguaaaaaaaaaaaaaaaga

SEQ ID NO: 717451 - RNA, 23 nt, Human
ucaguucugauggaaacaccugg

SEQ ID NO: 717452 - RNA, 25 nt, Human
ucaguucugauggaaacaccuggug

SEQ ID NO: 717453 - RNA, 23 nt, Human
ucauucuuaaagcucccugaagg

SEQ ID NO: 717454 - RNA, 23 nt, Human
ucccaaagugcugggauuacagg

SEQ ID NO: 717455 - RNA, 24 nt, Human
ucccaaguagcugggauuacaggc

SEQ ID NO: 717456 - RNA, 21 nt, Human
ucccagguucaagcgauucuc

SEQ ID NO: 717457 - RNA, 24 nt, Human
ucccagguucaagcgauucuccug

SEQ ID NO: 717458 - RNA, 26 nt, Human
ucccucucacgcugguggagccucag

SEQ ID NO: 717459 - RNA, 18 nt, Human
ucuagucacagcccuuca

SEQ ID NO: 717460 - RNA, 23 nt, Human
ucucacucugucacccaggcugg

SEQ ID NO: 717461 - RNA, 24 nt, Human
ucucacucugucacccaggcugga

SEQ ID NO: 717462 - RNA, 22 nt, Human
ucugaccccaguccaggacagg

SEQ ID NO: 717463 - RNA, 24 nt, Human
ucugucacccaggcuggagugcgg

SEQ ID NO: 717464 - RNA, 19 nt, Human
ugaaacaaaggaaaauugg

SEQ ID NO: 717465 - RNA, 26 nt, Human
ugaacagaagggagaacagccucagg

SEQ ID NO: 717466 - RNA, 19 nt, Human
ugaauaaauaacuggguau

SEQ ID NO: 717467 - RNA, 18 nt, Human
ugacaugcaggugaaacc

SEQ ID NO: 717468 - RNA, 23 nt, Human
ugacaugcaggugaaaccuagag

SEQ ID NO: 717469 - RNA, 21 nt, Human
ugaccaaagaagcuaaggcaa

SEQ ID NO: 717470 - RNA, 22 nt, Human
ugaccaaagaagcuaaggcaag

SEQ ID NO: 717471 - RNA, 20 nt, Human
ugaccuggagaaagagcugg

SEQ ID NO: 717472 - RNA, 22 nt, Human
ugagacggagucucacucuguc

SEQ ID NO: 717473 - RNA, 22 nt, Human
ugaggcagaggaaucaagggca

SEQ ID NO: 717474 - RNA, 21 nt, Human
ugauaccaaacccuccaccgu

SEQ ID NO: 717475 - RNA, 23 nt, Human
ugcaaagccgcuccaagccacca

SEQ ID NO: 717476 - RNA, 24 nt, Human
ugcaaagugcuuccaaaacauccc

SEQ ID NO: 717477 - RNA, 24 nt, Human
ugccucagccucccaaguagcugg

SEQ ID NO: 717478 - RNA, 22 nt, Human
ugcgguggcgcaaucucggcuc

SEQ ID NO: 717479 - RNA, 23 nt, Human
ugcgguggcgcaaucucggcuca

SEQ ID NO: 717480 - RNA, 24 nt, Human
ugcugggauuacaggugugagcca

SEQ ID NO: 717481 - RNA, 24 nt, Human
uggagugcgguggcgcaaucucgg

SEQ ID NO: 717482 - RNA, 24 nt, Human
uggccaggcuggucucaaacuccu

SEQ ID NO: 717483 - RNA, 21 nt, Human
uggccugagcaucaguucugu

SEQ ID NO: 717484 - RNA, 19 nt, Human
uggcucaguucugcaacag

SEQ ID NO: 717485 - RNA, 21 nt, Human
uggcuuucagaucccaacuuu

SEQ ID NO: 717486 - RNA, 18 nt, Human
ugggauuacaggcgugug

SEQ ID NO: 717487 - RNA, 19 nt, Human
ugggauuacaggcgugugc

SEQ ID NO: 717488 - RNA, 21 nt, Human
ugggauuacaggcgugugcca

SEQ ID NO: 717489 - RNA, 22 nt, Human
ugggauuacaggcgugugccac

SEQ ID NO: 717490 - RNA, 24 nt, Human
ugggauuacaggcgugugccacca

SEQ ID NO: 717491 - RNA, 21 nt, Human
ugggauuacaggugugagcca

SEQ ID NO: 717492 - RNA, 22 nt, Human
ugggauuacaggugugagccac

SEQ ID NO: 717493 - RNA, 22 nt, Human
ugggauuacaggugugagccac

SEQ ID NO: 717494 - RNA, 22 nt, Human
ugggauuacaggugugagccac

SEQ ID NO: 717495 - RNA, 24 nt, Human
ugggauuacaggugugagccacug

SEQ ID NO: 717496 - RNA, 21 nt, Human
uggggucauucuuaaagcucc

SEQ ID NO: 717497 - RNA, 22 nt, Human
ugguggagccucagcccuggcc

SEQ ID NO: 717498 - RNA, 20 nt, Human
ugugucaccuuuuuguuuuu

SEQ ID NO: 717499 - RNA, 19 nt, Human
uuacucagaagcacaacga

SEQ ID NO: 717500 - RNA, 21 nt, Human
uucaagcgauucuccugccuc

SEQ ID NO: 717501 - RNA, 23 nt, Human
uucaagcgauucuccugccucag

SEQ ID NO: 717502 - RNA, 24 nt, Human
uucaagcgauucuccugccucagc

SEQ ID NO: 717503 - RNA, 18 nt, Human
uucacagagguuagaagc

SEQ ID NO: 717504 - RNA, 23 nt, Human
uucuagcccuacauggcuuucag

SEQ ID NO: 717505 - RNA, 19 nt, Human
uucuguggggucauucuua

SEQ ID NO: 717506 - RNA, 20 nt, Human
uugaggcagaggaaucaagg

SEQ ID NO: 717507 - RNA, 24 nt, Human
uugaggcagaggaaucaagggcag

SEQ ID NO: 717508 - RNA, 24 nt, Human
uuuuuggaagagacaggguuucac

SEQ ID NO: 717509 - RNA, 20 nt, Human
uuuuuguauuuuuggaagag

SEQ ID NO: 717510 - RNA, 23 nt, Human
uuuuuguauuuuuggaagagaca

SEQ ID NO: 717511 - RNA, 24 nt, Human
uuuuuguuuuuugagacggagucu

SEQ ID NO: 717512 - RNA, 21 nt, Human
aaacaaaaaguguccaauaug

SEQ ID NO: 717513 - RNA, 22 nt, Human
aaagagcuggggugcaacagga

SEQ ID NO: 717514 - RNA, 22 nt, Human
aaaguccaggcaggggaugaca

SEQ ID NO: 717515 - RNA, 23 nt, Human
aagaaugucaguugcaacacuau

SEQ ID NO: 717516 - RNA, 23 nt, Human
aagcacaaaggcuguagccacca

SEQ ID NO: 717517 - RNA, 22 nt, Human
aagcaccauaaacaaaauuuga

SEQ ID NO: 717518 - RNA, 19 nt, Human
aagcagaugaccuggacgc

SEQ ID NO: 717519 - RNA, 22 nt, Human
aagcauauuugcagcauuucuu

SEQ ID NO: 717520 - RNA, 19 nt, Human
aaggauccagcccaugggc

SEQ ID NO: 717521 - RNA, 23 nt, Human
aaggauccagcccaugggcugug

SEQ ID NO: 717522 - RNA, 18 nt, Human
acauaggucagcagugac

SEQ ID NO: 717523 - RNA, 21 nt, Human
accugucccaaaccuuggccc

SEQ ID NO: 717524 - RNA, 23 nt, Human
acuauuaucccagcuaccaaauu

SEQ ID NO: 717525 - RNA, 24 nt, Human
acuccaguguacacauugacaguc

SEQ ID NO: 717526 - RNA, 22 nt, Human
acucuuaaaagcacaaaggcug

SEQ ID NO: 717527 - RNA, 20 nt, Human
acugggaggagacaaagagc

SEQ ID NO: 717528 - RNA, 23 nt, Human
agcaaaaaacaaaaaguguccaa

SEQ ID NO: 717529 - RNA, 22 nt, Human
agcaccauaaacaaaauuugaa

SEQ ID NO: 717530 - RNA, 21 nt, Human
agccacaacagcaucccagcc

SEQ ID NO: 717531 - RNA, 18 nt, Human
agccccugggcagucucc

SEQ ID NO: 717532 - RNA, 23 nt, Human
agcuaugccacuaaaggccaugc

SEQ ID NO: 717533 - RNA, 22 nt, Human
aggagccagaagaaguggggag

SEQ ID NO: 717534 - RNA, 22 nt, Human
aggauccagcccaugggcugug

SEQ ID NO: 717535 - RNA, 23 nt, Human
aggcaggggaugacagugcaggu

SEQ ID NO: 717536 - RNA, 25 nt, Human
aggcuguagccaccauugucugcca

SEQ ID NO: 717537 - RNA, 22 nt, Human
aggcuugggaaugggggugggg

SEQ ID NO: 717538 - RNA, 22 nt, Human
auaaacaaaauuugaaagcaaa

SEQ ID NO: 717539 - RNA, 22 nt, Human
auacacagacauaacuauugga

SEQ ID NO: 717540 - RNA, 20 nt, Human
auccuaacaaaccaucugcc

SEQ ID NO: 717541 - RNA, 24 nt, Human
augggcugugugccugcugccugu

SEQ ID NO: 717542 - RNA, 22 nt, Human
augucaaaaagcaccauaaaca

SEQ ID NO: 717543 - RNA, 22 nt, Human
augugcaaaauuuagcuacaag

SEQ ID NO: 717544 - RNA, 21 nt, Human
caaacaucaaccaauacccca

SEQ ID NO: 717545 - RNA, 21 nt, Human
caaagaccaagggaagacccu

SEQ ID NO: 717546 - RNA, 18 nt, Human
caagccaagacaacgagu

SEQ ID NO: 717547 - RNA, 19 nt, Human
caagccccugggcagucuc

SEQ ID NO: 717548 - RNA, 19 nt, Human
cacacucauguaaacaaga

SEQ ID NO: 717549 - RNA, 24 nt, Human
cacaguucuuguuuuggggaggga

SEQ ID NO: 717550 - RNA, 24 nt, Human
cagaagcacuggccaaagucaaag

SEQ ID NO: 717551 - RNA, 18 nt, Human
cagaauccaggacggggc

SEQ ID NO: 717552 - RNA, 20 nt, Human
caggacggggcucucugccg

SEQ ID NO: 717553 - RNA, 19 nt, Human
caggcgugggcgcagcucu

SEQ ID NO: 717554 - RNA, 20 nt, Human
caguucaauccccuagccua

SEQ ID NO: 717555 - RNA, 23 nt, Human
cauagcauaacgagcacagacau

SEQ ID NO: 717556 - RNA, 21 nt, Human
cauguaaacaagaccucucuc

SEQ ID NO: 717557 - RNA, 24 nt, Human
cauucuccccgcugcugccagagg

SEQ ID NO: 717558 - RNA, 20 nt, Human
ccaaacaagcagaugaccug

SEQ ID NO: 717559 - RNA, 22 nt, Human
ccagcccaugagacuccucucc

SEQ ID NO: 717560 - RNA, 20 nt, Human
ccagcccugccccagcacac

SEQ ID NO: 717561 - RNA, 22 nt, Human
ccagccgccgccgccgccgccu

SEQ ID NO: 717562 - RNA, 21 nt, Human
ccauucuccccgcugcugcca

SEQ ID NO: 717563 - RNA, 18 nt, Human
cccaugagacuccucucc

SEQ ID NO: 717564 - RNA, 19 nt, Human
cccaugagacuccucucca

SEQ ID NO: 717565 - RNA, 18 nt, Human
cccccgccucccggcucc

SEQ ID NO: 717566 - RNA, 19 nt, Human
cccgccgccgccgccgccg

SEQ ID NO: 717567 - RNA, 18 nt, Human
cccgcucccgcccuccuc

SEQ ID NO: 717568 - RNA, 18 nt, Human
cccggcuccgcgccgccc

SEQ ID NO: 717569 - RNA, 19 nt, Human
cccuccucccuccgcaacc

SEQ ID NO: 717570 - RNA, 18 nt, Human
ccgccgccccggcgccug

SEQ ID NO: 717571 - RNA, 18 nt, Human
ccgccgccgccgccgccg

SEQ ID NO: 717572 - RNA, 18 nt, Human
ccgccgccgccgccgccg

SEQ ID NO: 717573 - RNA, 19 nt, Human
ccgccgccgccgccgccuc

SEQ ID NO: 717574 - RNA, 21 nt, Human
ccgccgccgccgccgccucgg

SEQ ID NO: 717575 - RNA, 18 nt, Human
ccgccgccgccgccgcgc

SEQ ID NO: 717576 - RNA, 26 nt, Human
ccgccgccgccgccgcgccuucccgg

SEQ ID NO: 717577 - RNA, 18 nt, Human
ccgccgccgccgccucgg

SEQ ID NO: 717578 - RNA, 24 nt, Human
ccgccgccgccgccucggacgccg

SEQ ID NO: 717579 - RNA, 19 nt, Human
ccgccgccgccucggacgc

SEQ ID NO: 717580 - RNA, 20 nt, Human
ccggccccucccccgccucc

SEQ ID NO: 717581 - RNA, 20 nt, Human
ccgggacuagcgcugcgggg

SEQ ID NO: 717582 - RNA, 19 nt, Human
ccucccggcuccgcgccgc

SEQ ID NO: 717583 - RNA, 21 nt, Human
ccucccggcuccgcgccgccc

SEQ ID NO: 717584 - RNA, 23 nt, Human
cgcacaaagaccaagggaagacc

SEQ ID NO: 717585 - RNA, 20 nt, Human
cgcaggcuucguggcggccg

SEQ ID NO: 717586 - RNA, 19 nt, Human
cgcgaagaaucaaagaaag

SEQ ID NO: 717587 - RNA, 21 nt, Human
cgugguggggcaucugcuuac

SEQ ID NO: 717588 - RNA, 18 nt, Human
cuaacaaaccaucugcca

SEQ ID NO: 717589 - RNA, 20 nt, Human
cuaaguauagcauagauacu

SEQ ID NO: 717590 - RNA, 20 nt, Human
cucccccgccucccggcucc

SEQ ID NO: 717591 - RNA, 22 nt, Human
cuccgcgccgcccgcucccgcc

SEQ ID NO: 717592 - RNA, 18 nt, Human
cucuuuccccuggccauc

SEQ ID NO: 717593 - RNA, 22 nt, Human
cugacaucaugaacacuuuuca

SEQ ID NO: 717594 - RNA, 22 nt, Human
cuggccaaagucaaagccacaa

SEQ ID NO: 717595 - RNA, 21 nt, Human
cuggggugcaacaggaggaaa

SEQ ID NO: 717596 - RNA, 23 nt, Human
cugguuuuugaucuuucuacaug

SEQ ID NO: 717597 - RNA, 20 nt, Human
cuguagcccccguugaaagc

SEQ ID NO: 717598 - RNA, 21 nt, Human
cuguugagaaaguuugauaug

SEQ ID NO: 717599 - RNA, 25 nt, Human
cuuccauuuccuugaagacugagac

SEQ ID NO: 717600 - RNA, 23 nt, Human
cuuccuguagcccccguugaaag

SEQ ID NO: 717601 - RNA, 18 nt, Human
cuucguggcggccgugac

SEQ ID NO: 717602 - RNA, 19 nt, Human
cuuggcccacuucauccug

SEQ ID NO: 717603 - RNA, 19 nt, Human
cuuucccaaugcuggggau

SEQ ID NO: 717604 - RNA, 22 nt, Human
gaacaguaucccagaguaacug

SEQ ID NO: 717605 - RNA, 20 nt, Human
gaaggauccagcccaugggc

SEQ ID NO: 717606 - RNA, 18 nt, Human
gacaaagccaagccccug

SEQ ID NO: 717607 - RNA, 20 nt, Human
gagcaaaaaacaaaaagugu

SEQ ID NO: 717608 - RNA, 23 nt, Human
gagcacagacaucaggagacuag

SEQ ID NO: 717609 - RNA, 21 nt, Human
gaggcuugggaaugggggugg

SEQ ID NO: 717610 - RNA, 22 nt, Human
gaguccgggggaaugguaugug

SEQ ID NO: 717611 - RNA, 18 nt, Human
gaugcaaaauaaauuaga

SEQ ID NO: 717612 - RNA, 22 nt, Human
gccacaacagcaucccagccca

SEQ ID NO: 717613 - RNA, 18 nt, Human
gcccacuucauccugccc

SEQ ID NO: 717614 - RNA, 22 nt, Human
gccugcugccugugggauggua

SEQ ID NO: 717615 - RNA, 22 nt, Human
gcuccagccgccgccgccgccg

SEQ ID NO: 717616 - RNA, 21 nt, Human
gcuucaccagcgcuucucugu

SEQ ID NO: 717617 - RNA, 18 nt, Human
gcuucaguggcaugugaa

SEQ ID NO: 717618 - RNA, 24 nt, Human
ggaaagacagcauaauauaguagg

SEQ ID NO: 717619 - RNA, 20 nt, Human
ggaaggaggcaggggcuaag

SEQ ID NO: 717620 - RNA, 25 nt, Human
ggaaggaguaaaagugagggagugg

SEQ ID NO: 717621 - RNA, 18 nt, Human
ggaaugguaugugugguc

SEQ ID NO: 717622 - RNA, 24 nt, Human
ggacaaaugcacagaaaauucagc

SEQ ID NO: 717623 - RNA, 25 nt, Human
ggacaaaugcacagaaaauucagcc

SEQ ID NO: 717624 - RNA, 23 nt, Human
ggacagaauccaggacggggcuc

SEQ ID NO: 717625 - RNA, 25 nt, Human
ggagaggaugucuccauugucuggg

SEQ ID NO: 717626 - RNA, 19 nt, Human
ggaguccuuccugacgcac

SEQ ID NO: 717627 - RNA, 21 nt, Human
ggaugacagugcaggucagau

SEQ ID NO: 717628 - RNA, 25 nt, Human
ggccccucccccgccucccggcucc

SEQ ID NO: 717629 - RNA, 20 nt, Human
gggaaugggggugggggugg

SEQ ID NO: 717630 - RNA, 22 nt, Human
gggaugccuggaaguccccggu

SEQ ID NO: 717631 - RNA, 20 nt, Human
ggugggggguggggguggga

SEQ ID NO: 717632 - RNA, 24 nt, Human
gguuuugugcucuaaagccuuugu

SEQ ID NO: 717633 - RNA, 24 nt, Human
gucuugggugguaagcuuauggau

SEQ ID NO: 717634 - RNA, 23 nt, Human
uaaaaaaauccacaacugugugu

SEQ ID NO: 717635 - RNA, 25 nt, Human
uaaaaaaauccacaacugugugugc

SEQ ID NO: 717636 - RNA, 23 nt, Human
uaaaacuucuacaauacacacau

SEQ ID NO: 717637 - RNA, 22 nt, Human
uaaaagcacaaaggcuguagcc

SEQ ID NO: 717638 - RNA, 23 nt, Human
uaaaagcacaaaggcuguagcca

SEQ ID NO: 717639 - RNA, 26 nt, Human
uaaaagcacaaaggcuguagccacca

SEQ ID NO: 717640 - RNA, 22 nt, Human
uaaacauaccaauaucaaauaa

SEQ ID NO: 717641 - RNA, 22 nt, Human
uaaaucacaguucuuguuuugg

SEQ ID NO: 717642 - RNA, 22 nt, Human
uaacaguugccucgagaugcuc

SEQ ID NO: 717643 - RNA, 21 nt, Human
uaaggcaggagagccagucug

SEQ ID NO: 717644 - RNA, 25 nt, Human
uaauggcaggccccucaauauuucu

SEQ ID NO: 717645 - RNA, 24 nt, Human
uacaccaaaaagaacuaaaaggua

SEQ ID NO: 717646 - RNA, 18 nt, Human
uacaugggauggcuacaa

SEQ ID NO: 717647 - RNA, 21 nt, Human
uagaaugagcaauacacagac

SEQ ID NO: 717648 - RNA, 20 nt, Human
uaggaugcaaaauaaauuag

SEQ ID NO: 717649 - RNA, 20 nt, Human
uaguuuuucccccaaagagu

SEQ ID NO: 717650 - RNA, 24 nt, Human
uaucaaaauucuuaaaaauagcca

SEQ ID NO: 717651 - RNA, 18 nt, Human
uauucaguguauccaguu

SEQ ID NO: 717652 - RNA, 19 nt, Human
ucacaaagaaagaaguaca

SEQ ID NO: 717653 - RNA, 21 nt, Human
ucagcccuaucaccccaaaca

SEQ ID NO: 717654 - RNA, 23 nt, Human
ucagcccuaucaccccaaacauc

SEQ ID NO: 717655 - RNA, 24 nt, Human
ucaggccccucucagucgcugacc

SEQ ID NO: 717656 - RNA, 23 nt, Human
ucaguaaguagaaugagcaauac

SEQ ID NO: 717657 - RNA, 24 nt, Human
ucaguaaguguuucuuguuugacu

SEQ ID NO: 717658 - RNA, 24 nt, Human
uccacaaucccagcccacucuuaa

SEQ ID NO: 717659 - RNA, 23 nt, Human
ucccagcagaagucaggccccuc

SEQ ID NO: 717660 - RNA, 22 nt, Human
ucccgcccuccucccuccgcaa

SEQ ID NO: 717661 - RNA, 21 nt, Human
ucccggguuuaaaagccgcgg

SEQ ID NO: 717662 - RNA, 22 nt, Human
ucuagcaccuuccuguagcccc

SEQ ID NO: 717663 - RNA, 19 nt, Human
ucuaugugcuagauguuga

SEQ ID NO: 717664 - RNA, 20 nt, Human
ucuccagagagugagcucua

SEQ ID NO: 717665 - RNA, 20 nt, Human
ucuccaggugaccucuaccc

SEQ ID NO: 717666 - RNA, 27 nt, Human
ucucuucauccuucagauccuaacaaa

SEQ ID NO: 717667 - RNA, 21 nt, Human
ucugcccgccgccgccgccgc

SEQ ID NO: 717668 - RNA, 20 nt, Human
ucuggcgccccgcacuccca

SEQ ID NO: 717669 - RNA, 21 nt, Human
ucuugggugguaagcuuaugg

SEQ ID NO: 717670 - RNA, 19 nt, Human
ugaaagcaaagcacuugga

SEQ ID NO: 717671 - RNA, 21 nt, Human
ugaaggaacagaaggagcaaa

SEQ ID NO: 717672 - RNA, 19 nt, Human
ugaccucuacccuucucuu

SEQ ID NO: 717673 - RNA, 19 nt, Human
ugacugaagcaacauggca

SEQ ID NO: 717674 - RNA, 23 nt, Human
ugaguaaauacauaaggaggcca

SEQ ID NO: 717675 - RNA, 24 nt, Human
ugcaacacuauuuacaaugaagau

SEQ ID NO: 717676 - RNA, 21 nt, Human
ugcacagaaaauucagcccua

SEQ ID NO: 717677 - RNA, 20 nt, Human
ugccaaaucacaaacguucu

SEQ ID NO: 717678 - RNA, 21 nt, Human
ugccaaaucacaaacguucua

SEQ ID NO: 717679 - RNA, 25 nt, Human
ugccccagcacacucauguaaacaa

SEQ ID NO: 717680 - RNA, 22 nt, Human
ugccugcugggugggaguccgg

SEQ ID NO: 717681 - RNA, 24 nt, Human
ugccuggaaguccccggucaggcc

SEQ ID NO: 717682 - RNA, 23 nt, Human
ugccuggcuguaaguagcucuga

SEQ ID NO: 717683 - RNA, 21 nt, Human
ugccugugggaugguacacuc

SEQ ID NO: 717684 - RNA, 23 nt, Human
ugcggggggaccguggccccgag

SEQ ID NO: 717685 - RNA, 22 nt, Human
ugcuuuggggaaagccccaucc

SEQ ID NO: 717686 - RNA, 29 nt, Human
uggaggcuugggaaugggggugggggugg

SEQ ID NO: 717687 - RNA, 20 nt, Human
uggauccugccguggugggg

SEQ ID NO: 717688 - RNA, 19 nt, Human
uggauuggauuuuguccuu

SEQ ID NO: 717689 - RNA, 20 nt, Human
uggauuggauuuuguccuuu

SEQ ID NO: 717690 - RNA, 21 nt, Human
uggccaaagucaaagccacaa

SEQ ID NO: 717691 - RNA, 23 nt, Human
uggcccacuucauccugcccuuc

SEQ ID NO: 717692 - RNA, 18 nt, Human
ugggcaaacaauaugccc

SEQ ID NO: 717693 - RNA, 20 nt, Human
uggggagggaugaggagaag

SEQ ID NO: 717694 - RNA, 18 nt, Human
uggggguggggguggggg

SEQ ID NO: 717695 - RNA, 23 nt, Human
ugggggugggggugggggucggg

SEQ ID NO: 717696 - RNA, 21 nt, Human
ugggugaugaaugcuagguga

SEQ ID NO: 717697 - RNA, 22 nt, Human
ugucaggaaaguguggaaggau

SEQ ID NO: 717698 - RNA, 25 nt, Human
ugucaggaaaguguggaaggaucca

SEQ ID NO: 717699 - RNA, 19 nt, Human
ugucugggcgaccuaccag

SEQ ID NO: 717700 - RNA, 22 nt, Human
ugugaauauaacuuacgcugcu

SEQ ID NO: 717701 - RNA, 18 nt, Human
ugugccugcugccugugg

SEQ ID NO: 717702 - RNA, 18 nt, Human
uguggaaggauccagccc

SEQ ID NO: 717703 - RNA, 19 nt, Human
uguggaaggauccagccca

SEQ ID NO: 717704 - RNA, 22 nt, Human
ugugugugcguguguacauuua

SEQ ID NO: 717705 - RNA, 24 nt, Human
uuacauaauuaacccauauuuaac

SEQ ID NO: 717706 - RNA, 20 nt, Human
uucaaauccuagcuaugcca

SEQ ID NO: 717707 - RNA, 20 nt, Human
uuccccuggccaucaucuuu

SEQ ID NO: 717708 - RNA, 25 nt, Human
uuccuuuuccucuucuccagagagu

SEQ ID NO: 717709 - RNA, 22 nt, Human
uuggauuuuguccuuuuuuucc

SEQ ID NO: 717710 - RNA, 23 nt, Human
uugggaauggggguggggguggg

SEQ ID NO: 717711 - RNA, 23 nt, Human
uuguccuuuuuuuccuaaaacuu

SEQ ID NO: 717712 - RNA, 23 nt, Human
uuucuuaacccuuccauuuccuu

SEQ ID NO: 717713 - RNA, 23 nt, Human
uuugguacaaacuuucuggaggg

SEQ ID NO: 717714 - RNA, 23 nt, Human
aaaacaaagcgagcagcaggaaa

SEQ ID NO: 717715 - RNA, 23 nt, Human
aaaaccaaagcuggaagcccaga

SEQ ID NO: 717716 - RNA, 18 nt, Human
aaaauacagagacaaaga

SEQ ID NO: 717717 - RNA, 22 nt, Human
aaacaaaagggaaagucauuca

SEQ ID NO: 717718 - RNA, 19 nt, Human
aaacaccuauggaugaucu

SEQ ID NO: 717719 - RNA, 23 nt, Human
aaaccaaagcuggaagcccagaa

SEQ ID NO: 717720 - RNA, 27 nt, Human
aaaccaaucucuaaacagaacccagag

SEQ ID NO: 717721 - RNA, 18 nt, Human
aacaaagcgagcagcagg

SEQ ID NO: 717722 - RNA, 21 nt, Human
aacaaagcugcuuuuccuauu

SEQ ID NO: 717723 - RNA, 18 nt, Human
aaccaaagcuggaagccc

SEQ ID NO: 717724 - RNA, 21 nt, Human
aaccccagaaauggaccggaa

SEQ ID NO: 717725 - RNA, 21 nt, Human
aacuuugccucucaaauccac

SEQ ID NO: 717726 - RNA, 24 nt, Human
aagaggccagggagaggccuggcg

SEQ ID NO: 717727 - RNA, 18 nt, Human
aagcagaagaaacaccua

SEQ ID NO: 717728 - RNA, 21 nt, Human
aagccggggccgagaacugua

SEQ ID NO: 717729 - RNA, 21 nt, Human
aagucacuucuugacccucug

SEQ ID NO: 717730 - RNA, 18 nt, Human
aaguguaaccgucaaacc

SEQ ID NO: 717731 - RNA, 20 nt, Human
aauccacagcaguuuccccu

SEQ ID NO: 717732 - RNA, 21 nt, Human
aauucagucuguucuaaguug

SEQ ID NO: 717733 - RNA, 21 nt, Human
accuaccgccccgcccccgac

SEQ ID NO: 717734 - RNA, 20 nt, Human
accuuagcugaccccacucc

SEQ ID NO: 717735 - RNA, 20 nt, Human
acgagaagccugugucuagc

SEQ ID NO: 717736 - RNA, 22 nt, Human
acugaggucagucuauguuguu

SEQ ID NO: 717737 - RNA, 19 nt, Human
acugcagcucugccugcuc

SEQ ID NO: 717738 - RNA, 21 nt, Human
agaaacccacaaggccuggcc

SEQ ID NO: 717739 - RNA, 18 nt, Human
agaagaaaagaaagaaag

SEQ ID NO: 717740 - RNA, 24 nt, Human
agaggaguguugcugaagccugga

SEQ ID NO: 717741 - RNA, 20 nt, Human
agcagcuggugggcagggga

SEQ ID NO: 717742 - RNA, 20 nt, Human
agcauuaaugccccaaacaa

SEQ ID NO: 717743 - RNA, 22 nt, Human
agccagucagagacacagcccc

SEQ ID NO: 717744 - RNA, 20 nt, Human
agcccagggcagugcuccga

SEQ ID NO: 717745 - RNA, 21 nt, Human
agccugccccaaaggccacgc

SEQ ID NO: 717746 - RNA, 19 nt, Human
agcugcuuucugcuggccu

SEQ ID NO: 717747 - RNA, 19 nt, Human
aggaaagggagacuaccca

SEQ ID NO: 717748 - RNA, 26 nt, Human
aggcccaggccaaguggccaagagga

SEQ ID NO: 717749 - RNA, 24 nt, Human
aggcgcaccgggaugccagccugc

SEQ ID NO: 717750 - RNA, 21 nt, Human
aggcggaggugaggccugggu

SEQ ID NO: 717751 - RNA, 25 nt, Human
agucagagacacagccccacuucug

SEQ ID NO: 717752 - RNA, 23 nt, Human
augccccaaacaaagcugcuuuu

SEQ ID NO: 717753 - RNA, 20 nt, Human
caaaauacagagacaaagau

SEQ ID NO: 717754 - RNA, 19 nt, Human
caagcagaagaaacaccua

SEQ ID NO: 717755 - RNA, 21 nt, Human
caaggcagggcucguucugca

SEQ ID NO: 717756 - RNA, 20 nt, Human
caaguagcaaccuuagcuga

SEQ ID NO: 717757 - RNA, 24 nt, Human
caccgggggccagggaugggccca

SEQ ID NO: 717758 - RNA, 20 nt, Human
cagcacagugugguuccuca

SEQ ID NO: 717759 - RNA, 20 nt, Human
cagcacuagaaacugcacac

SEQ ID NO: 717760 - RNA, 20 nt, Human
cagcagcugauaugguuggg

SEQ ID NO: 717761 - RNA, 22 nt, Human
cagcuccccuguccucugcccc

SEQ ID NO: 717762 - RNA, 22 nt, Human
cagcuccccuguccucugcccc

SEQ ID NO: 717763 - RNA, 19 nt, Human
cagcugagccaacuuugcc

SEQ ID NO: 717764 - RNA, 20 nt, Human
caguucauaaagagcagcag

SEQ ID NO: 717765 - RNA, 25 nt, Human
cauaaagagcagcagcugauauggu

SEQ ID NO: 717766 - RNA, 19 nt, Human
caucgggaaccccagaaau

SEQ ID NO: 717767 - RNA, 22 nt, Human
ccaaagcuggaagcccagaaau

SEQ ID NO: 717768 - RNA, 20 nt, Human
ccacccgaaugggcuccuuc

SEQ ID NO: 717769 - RNA, 21 nt, Human
ccagcagccaaguguaaccgu

SEQ ID NO: 717770 - RNA, 18 nt, Human
ccagcccagggcagugcu

SEQ ID NO: 717771 - RNA, 28 nt, Human
cccagagcuagagcagacuagccaaggc

SEQ ID NO: 717772 - RNA, 21 nt, Human
ccccugaaagggacaggaagu

SEQ ID NO: 717773 - RNA, 18 nt, Human
cccgcccccgacagaggc

SEQ ID NO: 717774 - RNA, 20 nt, Human
cccugaaaggggcaggaaau

SEQ ID NO: 717775 - RNA, 19 nt, Human
ccgacccacugagcugcac

SEQ ID NO: 717776 - RNA, 19 nt, Human
ccgccuucucuuccgaccc

SEQ ID NO: 717777 - RNA, 18 nt, Human
ccuaugccaggaaagcuc

SEQ ID NO: 717778 - RNA, 21 nt, Human
ccucugaaccaaccucagcuc

SEQ ID NO: 717779 - RNA, 22 nt, Human
ccuggauuauucauccugggac

SEQ ID NO: 717780 - RNA, 25 nt, Human
ccuguggcugggacagguacugagc

SEQ ID NO: 717781 - RNA, 18 nt, Human
cguggugguggcaggccc

SEQ ID NO: 717782 - RNA, 24 nt, Human
cucaaauccacagcaguuuccccu

SEQ ID NO: 717783 - RNA, 20 nt, Human
cuccacagccaaggcagggc

SEQ ID NO: 717784 - RNA, 20 nt, Human
cucccugcucaaacccgagc

SEQ ID NO: 717785 - RNA, 24 nt, Human
cugaggacagaggcuaugcaggcu

SEQ ID NO: 717786 - RNA, 23 nt, Human
cuggccucugaaccaaccucagc

SEQ ID NO: 717787 - RNA, 22 nt, Human
cuucucauuuauuaauucaguc

SEQ ID NO: 717788 - RNA, 18 nt, Human
gaaaauaacaaaaccaaa

SEQ ID NO: 717789 - RNA, 23 nt, Human
gaaaauaacaaaaccaaagcugg

SEQ ID NO: 717790 - RNA, 19 nt, Human
gaacccagagcuagagcag

SEQ ID NO: 717791 - RNA, 21 nt, Human
gagaagaaaagaaagaaaggc

SEQ ID NO: 717792 - RNA, 22 nt, Human
gagcagcagcugauaugguugg

SEQ ID NO: 717793 - RNA, 19 nt, Human
gagcagcuggugggcaggg

SEQ ID NO: 717794 - RNA, 19 nt, Human
gcacacgcagagccugucg

SEQ ID NO: 717795 - RNA, 24 nt, Human
gcacccaaguuccguccugaggac

SEQ ID NO: 717796 - RNA, 24 nt, Human
gcccaucugaagucucccacccga

SEQ ID NO: 717797 - RNA, 23 nt, Human
gccccgcccccgacagaggccca

SEQ ID NO: 717798 - RNA, 24 nt, Human
gcgagcagcaggaaagcuuaagaa

SEQ ID NO: 717799 - RNA, 27 nt, Human
gcuuuaggguuccuggucaacucuuuc

SEQ ID NO: 717800 - RNA, 21 nt, Human
ggaaagcucggagccugcuaa

SEQ ID NO: 717801 - RNA, 22 nt, Human
ggaaagcucggagccugcuaaa

SEQ ID NO: 717802 - RNA, 20 nt, Human
ggaaagcuuaagaagcagag

SEQ ID NO: 717803 - RNA, 20 nt, Human
ggaaagcuuaagaagcagag

SEQ ID NO: 717804 - RNA, 19 nt, Human
ggccaagaggagguccugc

SEQ ID NO: 717805 - RNA, 20 nt, Human
ggccccuuaggaggaagacg

SEQ ID NO: 717806 - RNA, 27 nt, Human
gggcaggaaaugaaguaaaagggaccc

SEQ ID NO: 717807 - RNA, 18 nt, Human
ggugguggcagugggagc

SEQ ID NO: 717808 - RNA, 19 nt, Human
ggugguggcagugggagcc

SEQ ID NO: 717809 - RNA, 18 nt, Human
gucgggaaggucuuaugc

SEQ ID NO: 717810 - RNA, 20 nt, Human
gugaggcgauggcgguggug

SEQ ID NO: 717811 - RNA, 19 nt, Human
gugguggcaggcccaggcc

SEQ ID NO: 717812 - RNA, 20 nt, Human
uaaaacaaaagggaaaguca

SEQ ID NO: 717813 - RNA, 18 nt, Human
uaaagugcccacaggagg

SEQ ID NO: 717814 - RNA, 23 nt, Human
uaacaaaaccaaagcuggaagcc

SEQ ID NO: 717815 - RNA, 19 nt, Human
uaagcacaaaagacagcuu

SEQ ID NO: 717816 - RNA, 23 nt, Human
uaccaacaaagaauucaaauuca

SEQ ID NO: 717817 - RNA, 24 nt, Human
uaccaagaaguggaggagggccug

SEQ ID NO: 717818 - RNA, 21 nt, Human
uacgagaagccugugucuagc

SEQ ID NO: 717819 - RNA, 24 nt, Human
uauagcagcuucaagcagaagaaa

SEQ ID NO: 717820 - RNA, 23 nt, Human
ucaaagacagacccaauucagac

SEQ ID NO: 717821 - RNA, 18 nt, Human
ucaguccauugccacacc

SEQ ID NO: 717822 - RNA, 19 nt, Human
uccacaccgggggccaggg

SEQ ID NO: 717823 - RNA, 25 nt, Human
uccacagcaguuuccccugcauuuc

SEQ ID NO: 717824 - RNA, 18 nt, Human
uccccugcauuucuacuc

SEQ ID NO: 717825 - RNA, 25 nt, Human
ucuaaggcuguguucuuacgagaag

SEQ ID NO: 717826 - RNA, 22 nt, Human
ucuagccccugaaagggacagg

SEQ ID NO: 717827 - RNA, 20 nt, Human
ucugcaggacgugguggugg

SEQ ID NO: 717828 - RNA, 19 nt, Human
ugaaaauaacaaaaccaaa

SEQ ID NO: 717829 - RNA, 21 nt, Human
ugaaaauaacaaaaccaaagc

SEQ ID NO: 717830 - RNA, 22 nt, Human
ugaaaauaacaaaaccaaagcu

SEQ ID NO: 717831 - RNA, 23 nt, Human
ugaaaauaacaaaaccaaagcug

SEQ ID NO: 717832 - RNA, 22 nt, Human
ugaaaggggcaggaaaugaagu

SEQ ID NO: 717833 - RNA, 18 nt, Human
ugaccccacuccaagcau

SEQ ID NO: 717834 - RNA, 18 nt, Human
ugagccccaaucacacag

SEQ ID NO: 717835 - RNA, 21 nt, Human
ugagccugcuccguuccccuc

SEQ ID NO: 717836 - RNA, 23 nt, Human
ugaggacagaggcuaugcaggcu

SEQ ID NO: 717837 - RNA, 24 nt, Human
ugaggacagaggcuaugcaggcug

SEQ ID NO: 717838 - RNA, 20 nt, Human
ugagucccaggccccaaccu

SEQ ID NO: 717839 - RNA, 20 nt, Human
ugauuagacaaaucacaaau

SEQ ID NO: 717840 - RNA, 18 nt, Human
ugcacacuuaucuucauu

SEQ ID NO: 717841 - RNA, 23 nt, Human
ugcacugucaccuuauuuagccu

SEQ ID NO: 717842 - RNA, 20 nt, Human
ugcaggacguggugguggca

SEQ ID NO: 717843 - RNA, 23 nt, Human
ugcaggugaggcgauggcggugg

SEQ ID NO: 717844 - RNA, 19 nt, Human
ugccagccugccccaaagg

SEQ ID NO: 717845 - RNA, 25 nt, Human
ugccagccugccccaaaggccacgc

SEQ ID NO: 717846 - RNA, 20 nt, Human
ugccugagccugcuccguuc

SEQ ID NO: 717847 - RNA, 21 nt, Human
ugcucaggugccucuaaggcu

SEQ ID NO: 717848 - RNA, 19 nt, Human
ugcuccguuccccucaccc

SEQ ID NO: 717849 - RNA, 20 nt, Human
uggaagcccagaaauauuua

SEQ ID NO: 717850 - RNA, 20 nt, Human
uggcaaguagcaaccuuagc

SEQ ID NO: 717851 - RNA, 18 nt, Human
uggccucugaaccaaccu

SEQ ID NO: 717852 - RNA, 18 nt, Human
uggccucugaaccaaccu

SEQ ID NO: 717853 - RNA, 20 nt, Human
uggccugggcaucucaaaga

SEQ ID NO: 717854 - RNA, 21 nt, Human
uggccugggcaucucaaagac

SEQ ID NO: 717855 - RNA, 22 nt, Human
uggcggugguggcagugggagc

SEQ ID NO: 717856 - RNA, 22 nt, Human
ugggaaagaggaguguugcuga

SEQ ID NO: 717857 - RNA, 22 nt, Human
ugggacagguacugagcccauc

SEQ ID NO: 717858 - RNA, 22 nt, Human
uggguuaagaaugugccuaaca

SEQ ID NO: 717859 - RNA, 23 nt, Human
uggucaacucuuggaagaaagcc

SEQ ID NO: 717860 - RNA, 19 nt, Human
uggugguggcaggcccagg

SEQ ID NO: 717861 - RNA, 21 nt, Human
uggugguggcaggcccaggcc

SEQ ID NO: 717862 - RNA, 19 nt, Human
uguacaguuaugaaaauaa

SEQ ID NO: 717863 - RNA, 21 nt, Human
uuagcagauagaaacccacaa

SEQ ID NO: 717864 - RNA, 23 nt, Human
uuagcugaccccacuccaagcau

SEQ ID NO: 717865 - RNA, 23 nt, Human
uucagagaaucaaaaugagcccc

SEQ ID NO: 717866 - RNA, 18 nt, Human
uucccaucgggaacccca

SEQ ID NO: 717867 - RNA, 18 nt, Human
uuuggccacugaaccuuc

SEQ ID NO: 717868 - RNA, 19 nt, Human
aaacaaacaaaaaaaaauc

SEQ ID NO: 717869 - RNA, 21 nt, Human
aaauagccaagaauuuaacag

SEQ ID NO: 717870 - RNA, 19 nt, Human
aaaugaccuccaucuagaa

SEQ ID NO: 717871 - RNA, 26 nt, Human
aacuccacaagaaaacaaacaaaaaa

SEQ ID NO: 717872 - RNA, 24 nt, Human
aagaaaaaggcaacaaaacccaaa

SEQ ID NO: 717873 - RNA, 25 nt, Human
aagaaugaaaaauacauaaaaacgu

SEQ ID NO: 717874 - RNA, 20 nt, Human
aagacaagcacaugcacacc

SEQ ID NO: 717875 - RNA, 22 nt, Human
aagcaagaagagaaagagggac

SEQ ID NO: 717876 - RNA, 19 nt, Human
aagcauuuucugcaguuga

SEQ ID NO: 717877 - RNA, 19 nt, Human
aagccuaaaugcuccaaag

SEQ ID NO: 717878 - RNA, 22 nt, Human
acaaaacccaaauguucaaagc

SEQ ID NO: 717879 - RNA, 18 nt, Human
acaaaacuaaaaagccac

SEQ ID NO: 717880 - RNA, 20 nt, Human
acaaaacuaaaaagccacac

SEQ ID NO: 717881 - RNA, 20 nt, Human
acaagaugcgccggcucccc

SEQ ID NO: 717882 - RNA, 20 nt, Human
accaaggagaaacgggagcc

SEQ ID NO: 717883 - RNA, 22 nt, Human
accacgggaaaaacaaucucag

SEQ ID NO: 717884 - RNA, 18 nt, Human
accccacaccccaaaucc

SEQ ID NO: 717885 - RNA, 19 nt, Human
accgcugagucacccaggc

SEQ ID NO: 717886 - RNA, 19 nt, Human
acuccacaagaaaacaaac

SEQ ID NO: 717887 - RNA, 21 nt, Human
acugcaguuaagaugcaaaaa

SEQ ID NO: 717888 - RNA, 22 nt, Human
agaacaaguauaguacacucuu

SEQ ID NO: 717889 - RNA, 21 nt, Human
agaguccaccgcgcccuaccu

SEQ ID NO: 717890 - RNA, 21 nt, Human
agcaaaaccaccacacaggga

SEQ ID NO: 717891 - RNA, 20 nt, Human
agcaggccacaccacuuucu

SEQ ID NO: 717892 - RNA, 19 nt, Human
agccaaagauuucucuggg

SEQ ID NO: 717893 - RNA, 22 nt, Human
agcccuuuccuaauaaacagca

SEQ ID NO: 717894 - RNA, 18 nt, Human
agcugcagcagccaaaga

SEQ ID NO: 717895 - RNA, 19 nt, Human
aggaagcuggaguucuuua

SEQ ID NO: 717896 - RNA, 28 nt, Human
aggcaacaaaacccaaauguucaaagca

SEQ ID NO: 717897 - RNA, 21 nt, Human
aggcugccgggcggcgcggcg

SEQ ID NO: 717898 - RNA, 22 nt, Human
aggggaaaagaaauccuaagag

SEQ ID NO: 717899 - RNA, 25 nt, Human
aggggcugcgggcggcugccgagcg

SEQ ID NO: 717900 - RNA, 24 nt, Human
agguaguagucccugcgugugcug

SEQ ID NO: 717901 - RNA, 19 nt, Human
agucccugcgugugcuggg

SEQ ID NO: 717902 - RNA, 19 nt, Human
agugugcaccuuugccacc

SEQ ID NO: 717903 - RNA, 20 nt, Human
auaaacagcagcuguccaaa

SEQ ID NO: 717904 - RNA, 23 nt, Human
caaaacccaaauguucaaagcaa

SEQ ID NO: 717905 - RNA, 21 nt, Human
caaacacaaaaugagaucgaa

SEQ ID NO: 717906 - RNA, 25 nt, Human
caacaaaacccaaauguucaaagcc

SEQ ID NO: 717907 - RNA, 18 nt, Human
caaccacgggaaaaacaa

SEQ ID NO: 717908 - RNA, 22 nt, Human
caauacaaccacgggaaaaaca

SEQ ID NO: 717909 - RNA, 19 nt, Human
cacaaaacuaaaaagccac

SEQ ID NO: 717910 - RNA, 23 nt, Human
cacaagaaaacaaacaaaaaaaa

SEQ ID NO: 717911 - RNA, 27 nt, Human
cacacagacccucaaugacuccacagu

SEQ ID NO: 717912 - RNA, 25 nt, Human
cacacccacccaccuuaaaguguca

SEQ ID NO: 717913 - RNA, 24 nt, Human
cacgggaaaaacaaucucagccca

SEQ ID NO: 717914 - RNA, 20 nt, Human
cacugaagaguaauuuucca

SEQ ID NO: 717915 - RNA, 23 nt, Human
cagaaaguaacaaucugcaacua

SEQ ID NO: 717916 - RNA, 19 nt, Human
cagcaaaaccaccacacag

SEQ ID NO: 717917 - RNA, 21 nt, Human
cagcagccaaagauuucucug

SEQ ID NO: 717918 - RNA, 20 nt, Human
cagccaccuaaaacagacuu

SEQ ID NO: 717919 - RNA, 22 nt, Human
caggccacaccacuuucuuccc

SEQ ID NO: 717920 - RNA, 22 nt, Human
caggggcagaguccaccgcgcc

SEQ ID NO: 717921 - RNA, 19 nt, Human
cagucccacggagcgacag

SEQ ID NO: 717922 - RNA, 24 nt, Human
cauauuaacauauaaagauuuaau

SEQ ID NO: 717923 - RNA, 26 nt, Human
cauucucaacgcauucuccggaacgg

SEQ ID NO: 717924 - RNA, 23 nt, Human
ccacaagaaaacaaacaaaaaaa

SEQ ID NO: 717925 - RNA, 23 nt, Human
ccacacacagaacuugcccagag

SEQ ID NO: 717926 - RNA, 19 nt, Human
ccagaaaguaacaaucugc

SEQ ID NO: 717927 - RNA, 21 nt, Human
ccagaacauucucucaaacac

SEQ ID NO: 717928 - RNA, 21 nt, Human
cccacaccccaaauccuuggc

SEQ ID NO: 717929 - RNA, 21 nt, Human
ccccagaagaaaacaaaaaga

SEQ ID NO: 717930 - RNA, 20 nt, Human
ccggcgggggcgccucuccu

SEQ ID NO: 717931 - RNA, 27 nt, Human
ccuaaaacagacuuucccucuucaggc

SEQ ID NO: 717932 - RNA, 24 nt, Human
ccucugagcuucagcuacuuaacu

SEQ ID NO: 717933 - RNA, 20 nt, Human
ccuggccucugccuguggcc

SEQ ID NO: 717934 - RNA, 22 nt, Human
ccuguggcacaaugccaugaga

SEQ ID NO: 717935 - RNA, 20 nt, Human
cgcacacacacacacacaca

SEQ ID NO: 717936 - RNA, 23 nt, Human
cgccccaacccaccacacacaga

SEQ ID NO: 717937 - RNA, 25 nt, Human
cgcgcacacacacacacacacaccc

SEQ ID NO: 717938 - RNA, 20 nt, Human
cggcgggggcgccucuccuc

SEQ ID NO: 717939 - RNA, 18 nt, Human
cggcuccccgggcucacc

SEQ ID NO: 717940 - RNA, 18 nt, Human
cggugaggacacacagac

SEQ ID NO: 717941 - RNA, 21 nt, Human
cgugaaaucagaacaauacaa

SEQ ID NO: 717942 - RNA, 19 nt, Human
cuaaaugaccuccaucuag

SEQ ID NO: 717943 - RNA, 22 nt, Human
cuaauaaacagcagcuguccaa

SEQ ID NO: 717944 - RNA, 20 nt, Human
cuaaugaaucaacauccuga

SEQ ID NO: 717945 - RNA, 20 nt, Human
cucaaacacaaaaugagauc

SEQ ID NO: 717946 - RNA, 20 nt, Human
cucuacccgccccaacccuc

SEQ ID NO: 717947 - RNA, 19 nt, Human
cucugggugaugagguggc

SEQ ID NO: 717948 - RNA, 23 nt, Human
cugaugcuccaggcaugcuacgc

SEQ ID NO: 717949 - RNA, 22 nt, Human
cugcagcagccaaagauuucuc

SEQ ID NO: 717950 - RNA, 24 nt, Human
cugcagcagccaaagauuucucuc

SEQ ID NO: 717951 - RNA, 22 nt, Human
cugcaguuaagaugcaaaaagc

SEQ ID NO: 717952 - RNA, 28 nt, Human
cugugcucaagguugugucccggguccg

SEQ ID NO: 717953 - RNA, 25 nt, Human
gaaaaaggcaacaaaacccaaaugu

SEQ ID NO: 717954 - RNA, 23 nt, Human
gaaaacaaacaaaaaaaaaucag

SEQ ID NO: 717955 - RNA, 21 nt, Human
gaacaaauguaaccugggcac

SEQ ID NO: 717956 - RNA, 21 nt, Human
gaacaaguauaguacacucuu

SEQ ID NO: 717957 - RNA, 21 nt, Human
gaagacaucugaguaaaaacc

SEQ ID NO: 717958 - RNA, 21 nt, Human
gaagcauuuucugcaguugau

SEQ ID NO: 717959 - RNA, 20 nt, Human
gagaaacgggagccaguccc

SEQ ID NO: 717960 - RNA, 20 nt, Human
gagaaauaaaaacaacaaac

SEQ ID NO: 717961 - RNA, 18 nt, Human
gagagcuaaaugaccucc

SEQ ID NO: 717962 - RNA, 19 nt, Human
gagcgacagucagcaaaag

SEQ ID NO: 717963 - RNA, 20 nt, Human
gaguaaaaggaagcuggagu

SEQ ID NO: 717964 - RNA, 23 nt, Human
gcauacgaccccacaccccaaau

SEQ ID NO: 717965 - RNA, 20 nt, Human
gccccaacccaccacacaca

SEQ ID NO: 717966 - RNA, 21 nt, Human
gccccaacccaccacacacag

SEQ ID NO: 717967 - RNA, 19 nt, Human
gcggcgcggcggccggcgg

SEQ ID NO: 717968 - RNA, 19 nt, Human
gcggcgcggcggccggcgg

SEQ ID NO: 717969 - RNA, 18 nt, Human
gcuaugagaaauaaaaac

SEQ ID NO: 717970 - RNA, 19 nt, Human
gcugcacaauguuuucagc

SEQ ID NO: 717971 - RNA, 22 nt, Human
ggaaaaacaaucucagcccagg

SEQ ID NO: 717972 - RNA, 23 nt, Human
ggaguucuuuacaaaagaagcuu

SEQ ID NO: 717973 - RNA, 24 nt, Human
gggaaaaaaaaucuuuaacaggau

SEQ ID NO: 717974 - RNA, 26 nt, Human
gggaaaagaaauccuaagagagaaaa

SEQ ID NO: 717975 - RNA, 18 nt, Human
gggcggcgcggcggccgg

SEQ ID NO: 717976 - RNA, 20 nt, Human
gguagucagccaccuaaaac

SEQ ID NO: 717977 - RNA, 23 nt, Human
ggugcugcaucuucucaccugug

SEQ ID NO: 717978 - RNA, 21 nt, Human
guaaauaaauaacagcaacau

SEQ ID NO: 717979 - RNA, 18 nt, Human
guagagaugcuugacaug

SEQ ID NO: 717980 - RNA, 22 nt, Human
uaaaaaccuauuucugauguua

SEQ ID NO: 717981 - RNA, 22 nt, Human
uaaauaacagcaacauaaaacc

SEQ ID NO: 717982 - RNA, 21 nt, Human
uaaaugaccuccaucuagaac

SEQ ID NO: 717983 - RNA, 23 nt, Human
uaacuccacaagaaaacaaacaa

SEQ ID NO: 717984 - RNA, 24 nt, Human
uaacuccacaagaaaacaaacaaa

SEQ ID NO: 717985 - RNA, 20 nt, Human
uaacugcaguaugagagcag

SEQ ID NO: 717986 - RNA, 21 nt, Human
uaagaaaaaggcaacaaaacc

SEQ ID NO: 717987 - RNA, 21 nt, Human
uaagacaagcacaugcacacc

SEQ ID NO: 717988 - RNA, 22 nt, Human
uaagacaagcacaugcacaccc

SEQ ID NO: 717989 - RNA, 24 nt, Human
uaagacaagcacaugcacacccau

SEQ ID NO: 717990 - RNA, 20 nt, Human
uaagaugcaaaaagcaguga

SEQ ID NO: 717991 - RNA, 23 nt, Human
uaaugaaucaacauccugauagc

SEQ ID NO: 717992 - RNA, 22 nt, Human
uagaacaaauguaaccugggca

SEQ ID NO: 717993 - RNA, 19 nt, Human
uagcaagaaagucacgaac

SEQ ID NO: 717994 - RNA, 23 nt, Human
uauggaacacucaccacaaagaa

SEQ ID NO: 717995 - RNA, 27 nt, Human
ucaaagcaaaucauagauuucacagcc

SEQ ID NO: 717996 - RNA, 18 nt, Human
ucaaauguucacaauuuc

SEQ ID NO: 717997 - RNA, 20 nt, Human
ucagauacugaauaaacaac

SEQ ID NO: 717998 - RNA, 19 nt, Human
ucagcaggccacaccacuu

SEQ ID NO: 717999 - RNA, 22 nt, Human
ucagcccaggaauggaaacugg

SEQ ID NO: 718000 - RNA, 19 nt, Human
ucaguuaauugaagaggaa

SEQ ID NO: 718001 - RNA, 21 nt, Human
uccacaagaaaacaaacaaaa

SEQ ID NO: 718002 - RNA, 20 nt, Human
uccccagaagaaaacaaaaa

SEQ ID NO: 718003 - RNA, 18 nt, Human
uccuacuggaaauguaca

SEQ ID NO: 718004 - RNA, 19 nt, Human
ucgcauacgaccccacacc

SEQ ID NO: 718005 - RNA, 21 nt, Human
ucuacccgccccaacccacca

SEQ ID NO: 718006 - RNA, 23 nt, Human
ucucagcccaggaauggaaacug

SEQ ID NO: 718007 - RNA, 21 nt, Human
ucucgcauacgaccccacacc

SEQ ID NO: 718008 - RNA, 20 nt, Human
ucucugggugaugagguggc

SEQ ID NO: 718009 - RNA, 20 nt, Human
ucugcaguugauauucuguu

SEQ ID NO: 718010 - RNA, 21 nt, Human
ugaaaaauacauaaaaacgua

SEQ ID NO: 718011 - RNA, 18 nt, Human
ugagaaauaaaaacaaca

SEQ ID NO: 718012 - RNA, 21 nt, Human
ugagagcagguaagggguggg

SEQ ID NO: 718013 - RNA, 18 nt, Human
ugagauggggaggagccg

SEQ ID NO: 718014 - RNA, 20 nt, Human
ugagauggggaggagccgcu

SEQ ID NO: 718015 - RNA, 22 nt, Human
ugagauggggaggagccgcuga

SEQ ID NO: 718016 - RNA, 21 nt, Human
ugaggacacacagacccucaa

SEQ ID NO: 718017 - RNA, 19 nt, Human
ugaguugguuaaaaaagaa

SEQ ID NO: 718018 - RNA, 22 nt, Human
ugaguugguuaaaaaagaaaaa

SEQ ID NO: 718019 - RNA, 24 nt, Human
ugaguugguuaaaaaagaaaaaaa

SEQ ID NO: 718020 - RNA, 23 nt, Human
ugauacuucuaagacaagcacau

SEQ ID NO: 718021 - RNA, 20 nt, Human
ugaugcuccaggcaugcuac

SEQ ID NO: 718022 - RNA, 24 nt, Human
ugcaaaaagcagugauacuucuaa

SEQ ID NO: 718023 - RNA, 20 nt, Human
ugcacagauguuaccagugu

SEQ ID NO: 718024 - RNA, 21 nt, Human
ugcccaaaugaguggugaagc

SEQ ID NO: 718025 - RNA, 22 nt, Human
ugcccagaacauucucucaaac

SEQ ID NO: 718026 - RNA, 22 nt, Human
uggaaacugguacuucagugcu

SEQ ID NO: 718027 - RNA, 24 nt, Human
uggaacacucaccacaaagaaccc

SEQ ID NO: 718028 - RNA, 25 nt, Human
uggaacacucaccacaaagaacccc

SEQ ID NO: 718029 - RNA, 26 nt, Human
uggagaacaaagccuaaaugcuccaa

SEQ ID NO: 718030 - RNA, 23 nt, Human
ugguuaaaaaagaaaaacaaugu

SEQ ID NO: 718031 - RNA, 27 nt, Human
uguacaugagauuuugcugaauggaga

SEQ ID NO: 718032 - RNA, 19 nt, Human
ugugaagcauuuucugcag

SEQ ID NO: 718033 - RNA, 21 nt, Human
ugugaagcauuuucugcaguu

SEQ ID NO: 718034 - RNA, 23 nt, Human
ugugcaccuuugccaccuggagc

SEQ ID NO: 718035 - RNA, 18 nt, Human
uguguaugcauucauaua

SEQ ID NO: 718036 - RNA, 21 nt, Human
uguuaccaguguaugucucag

SEQ ID NO: 718037 - RNA, 25 nt, Human
uuaggggaaaagaaauccuaagaga

SEQ ID NO: 718038 - RNA, 26 nt, Human
uucacaaaacuaaaaagccacacuuu

SEQ ID NO: 718039 - RNA, 22 nt, Human
uucauaccacagugcguuucag

SEQ ID NO: 718040 - RNA, 22 nt, Human
uucucugggugaugagguggcc

SEQ ID NO: 718041 - RNA, 22 nt, Human
uucuucaguuagcaagaaaguc

SEQ ID NO: 718042 - RNA, 19 nt, Human
uugcugaaagccucugagc

SEQ ID NO: 718043 - RNA, 25 nt, Human
uuucucugggugaugagguggccuu

SEQ ID NO: 718044 - RNA, 18 nt, Human
uuuuccaucacauaucau

SEQ ID NO: 718045 - RNA, 18 nt, Human
caucacagcuggcggccu

SEQ ID NO: 718046 - RNA, 20 nt, Human
ccagcaggccggcuccuucc

SEQ ID NO: 718047 - RNA, 21 nt, Human
ccccuuguggccacgcugccc

SEQ ID NO: 718048 - RNA, 18 nt, Human
ccuucucugacagcagca

SEQ ID NO: 718049 - RNA, 21 nt, Human
cuccuucccucucgggcgcca

SEQ ID NO: 718050 - RNA, 18 nt, Human
cuuguggccacgcugccc

SEQ ID NO: 718051 - RNA, 19 nt, Human
gacggcagcgccacgcagg

SEQ ID NO: 718052 - RNA, 24 nt, Human
gccacgcugcccagcaggccggcu

SEQ ID NO: 718053 - RNA, 23 nt, Human
ggcaguggcucccccggccugag

SEQ ID NO: 718054 - RNA, 21 nt, Human
uacaguacacgugggggacgg

SEQ ID NO: 718055 - RNA, 20 nt, Human
ucccccggccugaggagugc

SEQ ID NO: 718056 - RNA, 21 nt, Human
ugccgccccuuguggccacgc

SEQ ID NO: 718057 - RNA, 24 nt, Human
uguauaaauaaaacauuuuuuaau

SEQ ID NO: 718058 - RNA, 21 nt, Human
aaaagaauccuuucccagcca

SEQ ID NO: 718059 - RNA, 19 nt, Human
aaacuguacagaacagccu

SEQ ID NO: 718060 - RNA, 19 nt, Human
aaagacacgaagacuaugu

SEQ ID NO: 718061 - RNA, 21 nt, Human
aaagacccagccucaucugcu

SEQ ID NO: 718062 - RNA, 19 nt, Human
aaagagacguggagacauu

SEQ ID NO: 718063 - RNA, 23 nt, Human
aacaacccuaucaucccaaaggu

SEQ ID NO: 718064 - RNA, 22 nt, Human
aacaacucagccucagcccucc

SEQ ID NO: 718065 - RNA, 23 nt, Human
aacacugcuggacaaccuucugg

SEQ ID NO: 718066 - RNA, 20 nt, Human
aacagcagaugcucccccac

SEQ ID NO: 718067 - RNA, 22 nt, Human
aacagcccuacccacagaaccu

SEQ ID NO: 718068 - RNA, 18 nt, Human
aacguaggcuaagauugu

SEQ ID NO: 718069 - RNA, 31 nt, Human
aacguggucacguacacacacacacacagug

SEQ ID NO: 718070 - RNA, 20 nt, Human
aacuccuugggaggcccaag

SEQ ID NO: 718071 - RNA, 22 nt, Human
aagaacacacaggcucugcccc

SEQ ID NO: 718072 - RNA, 18 nt, Human
aagaagcagcauuuuaaa

SEQ ID NO: 718073 - RNA, 18 nt, Human
aagaaggaggagguucca

SEQ ID NO: 718074 - RNA, 23 nt, Human
aagaauccuuucccagccagacc

SEQ ID NO: 718075 - RNA, 21 nt, Human
aagacaagacagaaaacaaag

SEQ ID NO: 718076 - RNA, 20 nt, Human
aagacagaaaacaaagcaga

SEQ ID NO: 718077 - RNA, 21 nt, Human
aagacagaaaacaaagcagag

SEQ ID NO: 718078 - RNA, 19 nt, Human
aagacccagccucaucugc

SEQ ID NO: 718079 - RNA, 21 nt, Human
aagcagaaaugaggaaagacc

SEQ ID NO: 718080 - RNA, 24 nt, Human
aagcagaaaugaggaaagacccag

SEQ ID NO: 718081 - RNA, 20 nt, Human
aagcagagaccaccaggagc

SEQ ID NO: 718082 - RNA, 25 nt, Human
aagcagaggcaggugggaggucgac

SEQ ID NO: 718083 - RNA, 19 nt, Human
aagcagcugccccaccuuc

SEQ ID NO: 718084 - RNA, 19 nt, Human
aagcuccaaccagacaugg

SEQ ID NO: 718085 - RNA, 19 nt, Human
aaggaaaccagcccacgga

SEQ ID NO: 718086 - RNA, 22 nt, Human
aaggaaaccagcccacggagac

SEQ ID NO: 718087 - RNA, 21 nt, Human
aagugcagccacacugcauca

SEQ ID NO: 718088 - RNA, 21 nt, Human
aaguucccucucuccucccau

SEQ ID NO: 718089 - RNA, 22 nt, Human
aaugcacaaaaacuggagcccc

SEQ ID NO: 718090 - RNA, 22 nt, Human
acaaaagaggagcaucacuaaa

SEQ ID NO: 718091 - RNA, 23 nt, Human
acaaagcagagaccaccaggagc

SEQ ID NO: 718092 - RNA, 21 nt, Human
acaagacagaaaacaaagcag

SEQ ID NO: 718093 - RNA, 19 nt, Human
acacacacgcacgcacaca

SEQ ID NO: 718094 - RNA, 23 nt, Human
acacacacgcacgcacacacgca

SEQ ID NO: 718095 - RNA, 24 nt, Human
acacacacgcacgcacacacgcac

SEQ ID NO: 718096 - RNA, 19 nt, Human
acacaggcucugccccagg

SEQ ID NO: 718097 - RNA, 26 nt, Human
acagaaaacaaagcagagaccaccag

SEQ ID NO: 718098 - RNA, 21 nt, Human
acagacgugucagccucacac

SEQ ID NO: 718099 - RNA, 18 nt, Human
acagagcagaaauacaaa

SEQ ID NO: 718100 - RNA, 26 nt, Human
acagugcuagaggcaaccagagagac

SEQ ID NO: 718101 - RNA, 19 nt, Human
acaucagaccccuccucca

SEQ ID NO: 718102 - RNA, 23 nt, Human
acccuaucaucccaaagguguag

SEQ ID NO: 718103 - RNA, 20 nt, Human
acgaagagaggaaagcagag

SEQ ID NO: 718104 - RNA, 19 nt, Human
acgcggggcggggaggggc

SEQ ID NO: 718105 - RNA, 19 nt, Human
acucagugaaagacagucc

SEQ ID NO: 718106 - RNA, 19 nt, Human
acucugaggaguggaagag

SEQ ID NO: 718107 - RNA, 19 nt, Human
agaaaacaaagcagagacc

SEQ ID NO: 718108 - RNA, 21 nt, Human
agaaaacaaagcagagaccac

SEQ ID NO: 718109 - RNA, 18 nt, Human
agaaacagacccuuaagu

SEQ ID NO: 718110 - RNA, 18 nt, Human
agaaagcaagcagaggca

SEQ ID NO: 718111 - RNA, 19 nt, Human
agaaagcaagcagaggcag

SEQ ID NO: 718112 - RNA, 24 nt, Human
agaaccuccuuaccgagucaugcc

SEQ ID NO: 718113 - RNA, 21 nt, Human
agaauguuguacgaaacagcc

SEQ ID NO: 718114 - RNA, 25 nt, Human
agacacaaaagaggagcaucacuaa

SEQ ID NO: 718115 - RNA, 20 nt, Human
agacagaaaacaaagcagag

SEQ ID NO: 718116 - RNA, 23 nt, Human
agacagaaaacaaagcagagacc

SEQ ID NO: 718117 - RNA, 29 nt, Human
agacaggagaugaagaacaaagggacccc

SEQ ID NO: 718118 - RNA, 23 nt, Human
agacagggagggggccuccacag

SEQ ID NO: 718119 - RNA, 19 nt, Human
agagaacaaggucccacca

SEQ ID NO: 718120 - RNA, 24 nt, Human
agagaggaaagcagagucuguuag

SEQ ID NO: 718121 - RNA, 19 nt, Human
agagcagaaauacaaagac

SEQ ID NO: 718122 - RNA, 19 nt, Human
agagcauuuccgccuaaag

SEQ ID NO: 718123 - RNA, 20 nt, Human
agagcugaggagggacaggg

SEQ ID NO: 718124 - RNA, 23 nt, Human
agaggagguggaaugacaaagag

SEQ ID NO: 718125 - RNA, 23 nt, Human
agagggcagcaguggggcacagg

SEQ ID NO: 718126 - RNA, 20 nt, Human
agcaaacagcccuacccaca

SEQ ID NO: 718127 - RNA, 21 nt, Human
agcaauuucuugcagaguuug

SEQ ID NO: 718128 - RNA, 22 nt, Human
agccaacaggcaugcagcagga

SEQ ID NO: 718129 - RNA, 24 nt, Human
agccaagcugacuggaacccaggc

SEQ ID NO: 718130 - RNA, 19 nt, Human
agccaugcugggcccacac

SEQ ID NO: 718131 - RNA, 20 nt, Human
agccgggagagucaagagug

SEQ ID NO: 718132 - RNA, 19 nt, Human
agcguaccccugccucagg

SEQ ID NO: 718133 - RNA, 22 nt, Human
agcucagcaacuccugggcagc

SEQ ID NO: 718134 - RNA, 18 nt, Human
agcuccuggguucugccu

SEQ ID NO: 718135 - RNA, 19 nt, Human
agcugacuggaacccaggc

SEQ ID NO: 718136 - RNA, 19 nt, Human
aggaagauggggaauauga

SEQ ID NO: 718137 - RNA, 20 nt, Human
aggaaugagcccugaggggg

SEQ ID NO: 718138 - RNA, 22 nt, Human
aggaggaggcagggaagcaggg

SEQ ID NO: 718139 - RNA, 22 nt, Human
aggaggcccuuugggcugagau

SEQ ID NO: 718140 - RNA, 20 nt, Human
aggaguggucuuaagaagcc

SEQ ID NO: 718141 - RNA, 27 nt, Human
aggcacgcggggcggggaggggcggcg

SEQ ID NO: 718142 - RNA, 21 nt, Human
aggcgcggcccggccccaggc

SEQ ID NO: 718143 - RNA, 21 nt, Human
aggcucugccccaggccagga

SEQ ID NO: 718144 - RNA, 18 nt, Human
aggcuugaagagacagga

SEQ ID NO: 718145 - RNA, 23 nt, Human
agggcaacucaucuacaacauca

SEQ ID NO: 718146 - RNA, 20 nt, Human
agguaggaggaggcagggaa

SEQ ID NO: 718147 - RNA, 21 nt, Human
agguugagggagaaggcgggg

SEQ ID NO: 718148 - RNA, 20 nt, Human
aguaggcgcggcccggcccc

SEQ ID NO: 718149 - RNA, 21 nt, Human
aucccaaagguguagaguauu

SEQ ID NO: 718150 - RNA, 21 nt, Human
auugcucugagaugcucaggc

SEQ ID NO: 718151 - RNA, 24 nt, Human
auuuggggaggaaauuaccuucuu

SEQ ID NO: 718152 - RNA, 20 nt, Human
caaagaaguacccuuggagg

SEQ ID NO: 718153 - RNA, 22 nt, Human
caaagcagagaccaccaggagc

SEQ ID NO: 718154 - RNA, 23 nt, Human
caaagcagagaccaccaggagca

SEQ ID NO: 718155 - RNA, 19 nt, Human
caaaggcagcaauuucuug

SEQ ID NO: 718156 - RNA, 24 nt, Human
caaaggcagcaauuucuugcagag

SEQ ID NO: 718157 - RNA, 23 nt, Human
caacaagacacaaagagacgugg

SEQ ID NO: 718158 - RNA, 28 nt, Human
caacaagacacaaagagacguggagaca

SEQ ID NO: 718159 - RNA, 19 nt, Human
caacaagcaccugccccaa

SEQ ID NO: 718160 - RNA, 21 nt, Human
caacaagcaccugccccaagc

SEQ ID NO: 718161 - RNA, 22 nt, Human
caacaucaagcaaaggcagcaa

SEQ ID NO: 718162 - RNA, 21 nt, Human
caagaaaugaggugaaggcaa

SEQ ID NO: 718163 - RNA, 19 nt, Human
caagacacaaagagacggu

SEQ ID NO: 718164 - RNA, 20 nt, Human
caagaccucgugcuucacug

SEQ ID NO: 718165 - RNA, 22 nt, Human
caaggcccuguccuuacuggcc

SEQ ID NO: 718166 - RNA, 23 nt, Human
caauugacuucugccaaaacacc

SEQ ID NO: 718167 - RNA, 18 nt, Human
cacaacccaacaucacug

SEQ ID NO: 718168 - RNA, 25 nt, Human
cacacacacacacacgcacgcacac

SEQ ID NO: 718169 - RNA, 21 nt, Human
cacaccuccacuguccugcug

SEQ ID NO: 718170 - RNA, 21 nt, Human
caccacggccuggaacccccg

SEQ ID NO: 718171 - RNA, 23 nt, Human
cacccagccugggcaucaggggc

SEQ ID NO: 718172 - RNA, 20 nt, Human
caccccccguccucaaacag

SEQ ID NO: 718173 - RNA, 19 nt, Human
cacgguggaguggggaggc

SEQ ID NO: 718174 - RNA, 26 nt, Human
cacguacacacacacacacacgcacg

SEQ ID NO: 718175 - RNA, 22 nt, Human
cacuaacaacccuaucauccca

SEQ ID NO: 718176 - RNA, 22 nt, Human
cacuccugucucugccauaugc

SEQ ID NO: 718177 - RNA, 20 nt, Human
cacugccuccaugccccuac

SEQ ID NO: 718178 - RNA, 20 nt, Human
cacuggcuaaugggguggau

SEQ ID NO: 718179 - RNA, 21 nt, Human
cagaaaacaaagcagagacca

SEQ ID NO: 718180 - RNA, 23 nt, Human
cagagaccaccaggagcaggcac

SEQ ID NO: 718181 - RNA, 18 nt, Human
cagagauaggagccuggg

SEQ ID NO: 718182 - RNA, 19 nt, Human
cagaggaaugaggguaugg

SEQ ID NO: 718183 - RNA, 23 nt, Human
cagaggcaggugggugccuggag

SEQ ID NO: 718184 - RNA, 18 nt, Human
cagcaaacagcccuaccc

SEQ ID NO: 718185 - RNA, 20 nt, Human
cagcagaugcucccccaccc

SEQ ID NO: 718186 - RNA, 21 nt, Human
cagcaggacaagggguccaga

SEQ ID NO: 718187 - RNA, 19 nt, Human
cagcaucugggcauggacc

SEQ ID NO: 718188 - RNA, 23 nt, Human
cagcccacggagacaggaaccag

SEQ ID NO: 718189 - RNA, 21 nt, Human
cagcuaagucugagcucccag

SEQ ID NO: 718190 - RNA, 21 nt, Human
caggaccaggcagcaccgacu

SEQ ID NO: 718191 - RNA, 22 nt, Human
caggcugcuggagcccagcuaa

SEQ ID NO: 718192 - RNA, 24 nt, Human
caggcugcuggagcccagcuaagu

SEQ ID NO: 718193 - RNA, 18 nt, Human
caggggcugaaggaaacc

SEQ ID NO: 718194 - RNA, 21 nt, Human
caggguuucaucugggcaagg

SEQ ID NO: 718195 - RNA, 22 nt, Human
caguaaagaagagaucaggcau

SEQ ID NO: 718196 - RNA, 23 nt, Human
caguaaagaagagaucaggcaug

SEQ ID NO: 718197 - RNA, 20 nt, Human
cagugauuccacagaggaug

SEQ ID NO: 718198 - RNA, 18 nt, Human
cagugcuacauccacaaa

SEQ ID NO: 718199 - RNA, 20 nt, Human
caguuuuggcagccagggac

SEQ ID NO: 718200 - RNA, 28 nt, Human
cauaccaaaaacccauugcagggaaaag

SEQ ID NO: 718201 - RNA, 18 nt, Human
caucaagcaaaggcagca

SEQ ID NO: 718202 - RNA, 18 nt, Human
caucaagcaaaggcagca

SEQ ID NO: 718203 - RNA, 18 nt, Human
caucacagggggcugccu

SEQ ID NO: 718204 - RNA, 20 nt, Human
caugccccuacaacuuuggu

SEQ ID NO: 718205 - RNA, 23 nt, Human
cauuuggaaagucuaaaaaaagg

SEQ ID NO: 718206 - RNA, 19 nt, Human
ccaaagcagaaacacucau

SEQ ID NO: 718207 - RNA, 26 nt, Human
ccaaaugaacaacuucaugcagugaa

SEQ ID NO: 718208 - RNA, 19 nt, Human
ccacacaccuccacugucc

SEQ ID NO: 718209 - RNA, 19 nt, Human
ccacacugcaucacacaga

SEQ ID NO: 718210 - RNA, 18 nt, Human
ccaccccagcaaacaacc

SEQ ID NO: 718211 - RNA, 20 nt, Human
ccagaggaggcgaugugaua

SEQ ID NO: 718212 - RNA, 22 nt, Human
ccagcccacggagacaggaacc

SEQ ID NO: 718213 - RNA, 24 nt, Human
ccagcccacggagacaggaaccag

SEQ ID NO: 718214 - RNA, 23 nt, Human
ccagccugggcaucaggggcuga

SEQ ID NO: 718215 - RNA, 23 nt, Human
ccagcuagaaccuccccugugcu

SEQ ID NO: 718216 - RNA, 23 nt, Human
ccagggugggagacuucuggagg

SEQ ID NO: 718217 - RNA, 24 nt, Human
ccaggugcaccaggcucgcaaccc

SEQ ID NO: 718218 - RNA, 19 nt, Human
ccaguagccaacaggcaug

SEQ ID NO: 718219 - RNA, 23 nt, Human
ccaguggccuccuccccaucucu

SEQ ID NO: 718220 - RNA, 25 nt, Human
cccaacaucacugcagggccacucc

SEQ ID NO: 718221 - RNA, 23 nt, Human
cccacaacccaacaucacugcag

SEQ ID NO: 718222 - RNA, 22 nt, Human
cccacacaagcccaagcucagg

SEQ ID NO: 718223 - RNA, 21 nt, Human
cccacagaaccuccuuaccga

SEQ ID NO: 718224 - RNA, 19 nt, Human
cccagaaaagugaggagcc

SEQ ID NO: 718225 - RNA, 19 nt, Human
cccaggcucagggacccuu

SEQ ID NO: 718226 - RNA, 18 nt, Human
cccaguugucaaaucaag

SEQ ID NO: 718227 - RNA, 20 nt, Human
ccccagaggcaagggucacc

SEQ ID NO: 718228 - RNA, 22 nt, Human
ccccagggcccuggccagggag

SEQ ID NO: 718229 - RNA, 19 nt, Human
ccccaguggcaggccucuc

SEQ ID NO: 718230 - RNA, 18 nt, Human
ccccaucucuaugcaccc

SEQ ID NO: 718231 - RNA, 22 nt, Human
ccccgggaccccgccccgcgaa

SEQ ID NO: 718232 - RNA, 25 nt, Human
ccccgggaccccgccccgcgaaccc

SEQ ID NO: 718233 - RNA, 21 nt, Human
ccccuccccacaccaccaucc

SEQ ID NO: 718234 - RNA, 27 nt, Human
ccccugccucaggugcuggggccacag

SEQ ID NO: 718235 - RNA, 18 nt, Human
cccgccccgcgaacccgg

SEQ ID NO: 718236 - RNA, 22 nt, Human
cccgcgaacccggcaguaggcg

SEQ ID NO: 718237 - RNA, 19 nt, Human
cccucacaggcacagccau

SEQ ID NO: 718238 - RNA, 19 nt, Human
cccuccuccagcuagaacc

SEQ ID NO: 718239 - RNA, 23 nt, Human
cccuggccagggagcuagguggg

SEQ ID NO: 718240 - RNA, 20 nt, Human
cccugugcuaacccuucccc

SEQ ID NO: 718241 - RNA, 18 nt, Human
ccgagucaugcccaccag

SEQ ID NO: 718242 - RNA, 21 nt, Human
ccgagucaugcccaccaggaa

SEQ ID NO: 718243 - RNA, 21 nt, Human
ccggagcggcuccaguggggu

SEQ ID NO: 718244 - RNA, 23 nt, Human
ccggcagucccucccagcugugc

SEQ ID NO: 718245 - RNA, 18 nt, Human
ccuagagcugaggaggga

SEQ ID NO: 718246 - RNA, 19 nt, Human
ccucaggaggacuguuugc

SEQ ID NO: 718247 - RNA, 19 nt, Human
ccucucgccuuucacccua

SEQ ID NO: 718248 - RNA, 20 nt, Human
ccugcagccacugcagaaac

SEQ ID NO: 718249 - RNA, 20 nt, Human
ccugcauccaugaugcugag

SEQ ID NO: 718250 - RNA, 21 nt, Human
ccugccacccgggaaccacaa

SEQ ID NO: 718251 - RNA, 21 nt, Human
ccuggaacccccaguggcagg

SEQ ID NO: 718252 - RNA, 18 nt, Human
ccugggacuugcugcauc

SEQ ID NO: 718253 - RNA, 24 nt, Human
ccuuccuuccccaccccccguccu

SEQ ID NO: 718254 - RNA, 20 nt, Human
ccuucugaaaugaugucugg

SEQ ID NO: 718255 - RNA, 19 nt, Human
ccuuucuacugcuacccca

SEQ ID NO: 718256 - RNA, 19 nt, Human
ccuuugggcugagaugacc

SEQ ID NO: 718257 - RNA, 26 nt, Human
cgcacacacgcacacacuacagucuc

SEQ ID NO: 718258 - RNA, 20 nt, Human
cgcacacacuacagucucca

SEQ ID NO: 718259 - RNA, 25 nt, Human
cgcacgcacacacgcacacacuaca

SEQ ID NO: 718260 - RNA, 22 nt, Human
cgccacugccuccaugccccua

SEQ ID NO: 718261 - RNA, 18 nt, Human
cggagccaggcugcugga

SEQ ID NO: 718262 - RNA, 25 nt, Human
cguaacacagaaccaugccagccaa

SEQ ID NO: 718263 - RNA, 25 nt, Human
cguacacacacacacacacgcacgc

SEQ ID NO: 718264 - RNA, 33 nt, Human
cguggucacguacacacacacacacacgcagug

SEQ ID NO: 718265 - RNA, 22 nt, Human
cuaacccuuccccagaggcaag

SEQ ID NO: 718266 - RNA, 22 nt, Human
cucacaggcacagccaugcugg

SEQ ID NO: 718267 - RNA, 18 nt, Human
cucagaucuucaacucuc

SEQ ID NO: 718268 - RNA, 22 nt, Human
cucagccucagcccuccuuauu

SEQ ID NO: 718269 - RNA, 24 nt, Human
cucagccucagcccuccuuauucc

SEQ ID NO: 718270 - RNA, 24 nt, Human
cucaguugccccuggaauucccaa

SEQ ID NO: 718271 - RNA, 23 nt, Human
cucaucuacaacaucaagcaaag

SEQ ID NO: 718272 - RNA, 25 nt, Human
cuccaugccccuacaacuuugguua

SEQ ID NO: 718273 - RNA, 21 nt, Human
cuccccaucucuaugcaccca

SEQ ID NO: 718274 - RNA, 20 nt, Human
cuccuccagcuagaaccucc

SEQ ID NO: 718275 - RNA, 22 nt, Human
cuccuuauuccagcaaacagcc

SEQ ID NO: 718276 - RNA, 19 nt, Human
cugcagggccacuccuguc

SEQ ID NO: 718277 - RNA, 22 nt, Human
cugccccaggccaggaccaggc

SEQ ID NO: 718278 - RNA, 22 nt, Human
cugccccgggaccccgccccgc

SEQ ID NO: 718279 - RNA, 18 nt, Human
cugccggagcggcuccag

SEQ ID NO: 718280 - RNA, 18 nt, Human
cugcugagcaguuuuggc

SEQ ID NO: 718281 - RNA, 20 nt, Human
cugcuuucuccccuaccaga

SEQ ID NO: 718282 - RNA, 18 nt, Human
cugggcccacacaagccc

SEQ ID NO: 718283 - RNA, 18 nt, Human
cugggcccacacaagccc

SEQ ID NO: 718284 - RNA, 19 nt, Human
cugggcccacacaagccca

SEQ ID NO: 718285 - RNA, 23 nt, Human
cuggguacccucugccuccccag

SEQ ID NO: 718286 - RNA, 24 nt, Human
cuggguacccucugccuccccagg

SEQ ID NO: 718287 - RNA, 22 nt, Human
cuucaaucaugcuuguuuuguu

SEQ ID NO: 718288 - RNA, 19 nt, Human
cuuccacacaccuccacug

SEQ ID NO: 718289 - RNA, 24 nt, Human
cuuccccaccccccguccucaaac

SEQ ID NO: 718290 - RNA, 21 nt, Human
cuuucccagccagaccaggcc

SEQ ID NO: 718291 - RNA, 24 nt, Human
cuuucuacugcuaccccagguagc

SEQ ID NO: 718292 - RNA, 22 nt, Human
gaacccccaguggcaggccucu

SEQ ID NO: 718293 - RNA, 19 nt, Human
gaagaaggaggagguucca

SEQ ID NO: 718294 - RNA, 20 nt, Human
gaagcuccaaccagacaugg

SEQ ID NO: 718295 - RNA, 18 nt, Human
gaauauaucauaaacagg

SEQ ID NO: 718296 - RNA, 19 nt, Human
gacaggagaugaagaacaa

SEQ ID NO: 718297 - RNA, 23 nt, Human
gacaggcuagguccagaguggcu

SEQ ID NO: 718298 - RNA, 18 nt, Human
gacagugacugcucuaga

SEQ ID NO: 718299 - RNA, 18 nt, Human
gacauugcucugagaugc

SEQ ID NO: 718300 - RNA, 20 nt, Human
gagaagaaaacucugaggag

SEQ ID NO: 718301 - RNA, 20 nt, Human
gagaagcuccaaccagacau

SEQ ID NO: 718302 - RNA, 22 nt, Human
gagcaguuuuggcagccaggga

SEQ ID NO: 718303 - RNA, 23 nt, Human
gaggacagagcccuuuguccauu

SEQ ID NO: 718304 - RNA, 21 nt, Human
gaggcaaccagagagacacaa

SEQ ID NO: 718305 - RNA, 21 nt, Human
gaggcuucugcucuccucaag

SEQ ID NO: 718306 - RNA, 21 nt, Human
gagggcagcaguggggcacag

SEQ ID NO: 718307 - RNA, 23 nt, Human
gagugccuuccacacaccuccac

SEQ ID NO: 718308 - RNA, 20 nt, Human
gcaacucaucuacaacauca

SEQ ID NO: 718309 - RNA, 18 nt, Human
gcaacuccugggcagcag

SEQ ID NO: 718310 - RNA, 24 nt, Human
gcaagggucaccacggccuggaac

SEQ ID NO: 718311 - RNA, 22 nt, Human
gcaaugggccuggggagagcau

SEQ ID NO: 718312 - RNA, 23 nt, Human
gcacagccaugcugggcccacac

SEQ ID NO: 718313 - RNA, 26 nt, Human
gcagaaauacaaagacagacgcucug

SEQ ID NO: 718314 - RNA, 20 nt, Human
gcagcaguggggcacaggaa

SEQ ID NO: 718315 - RNA, 18 nt, Human
gcagggcucuucuuuucc

SEQ ID NO: 718316 - RNA, 22 nt, Human
gccacagccauuucagcaccug

SEQ ID NO: 718317 - RNA, 18 nt, Human
gccaugugaagaauuuuc

SEQ ID NO: 718318 - RNA, 23 nt, Human
gcccaggcccacuggcagagcuc

SEQ ID NO: 718319 - RNA, 22 nt, Human
gccccaagccaaucuaggcccc

SEQ ID NO: 718320 - RNA, 19 nt, Human
gccccgggaccccgccccg

SEQ ID NO: 718321 - RNA, 20 nt, Human
gccgggguccagacagggag

SEQ ID NO: 718322 - RNA, 21 nt, Human
gccucaggaggacuguuugcu

SEQ ID NO: 718323 - RNA, 19 nt, Human
gcggggggauguguccaca

SEQ ID NO: 718324 - RNA, 18 nt, Human
gcucccagaggaggcgau

SEQ ID NO: 718325 - RNA, 20 nt, Human
gcucccccaccccagcaaac

SEQ ID NO: 718326 - RNA, 19 nt, Human
gcucugccccaggccagga

SEQ ID NO: 718327 - RNA, 18 nt, Human
gcuucaauugacuucugc

SEQ ID NO: 718328 - RNA, 20 nt, Human
ggaaagcagggaagcccgga

SEQ ID NO: 718329 - RNA, 21 nt, Human
ggaaccccaggggaagaggag

SEQ ID NO: 718330 - RNA, 20 nt, Human
ggacccugguugcaugucag

SEQ ID NO: 718331 - RNA, 20 nt, Human
ggaggcuucugcucuccuca

SEQ ID NO: 718332 - RNA, 23 nt, Human
ggagggaaucauggggagagcag

SEQ ID NO: 718333 - RNA, 19 nt, Human
ggaggggagggagggaaag

SEQ ID NO: 718334 - RNA, 20 nt, Human
ggaguggggaggcuugaaga

SEQ ID NO: 718335 - RNA, 24 nt, Human
ggcacgcggggcggggaggggcgg

SEQ ID NO: 718336 - RNA, 22 nt, Human
ggcagugauuccacagaggaug

SEQ ID NO: 718337 - RNA, 22 nt, Human
ggcauggaagagggacccuggu

SEQ ID NO: 718338 - RNA, 18 nt, Human
ggccccaggcuggcgcgg

SEQ ID NO: 718339 - RNA, 19 nt, Human
ggccuggggagagcauuuc

SEQ ID NO: 718340 - RNA, 25 nt, Human
ggcggggaggggcggcgagggaggc

SEQ ID NO: 718341 - RNA, 18 nt, Human
gggaagcccggaggggua

SEQ ID NO: 718342 - RNA, 20 nt, Human
gggacagggacaggucuggg

SEQ ID NO: 718343 - RNA, 19 nt, Human
gggagggaaucauggggag

SEQ ID NO: 718344 - RNA, 21 nt, Human
gggagucauuuuggagaugau

SEQ ID NO: 718345 - RNA, 18 nt, Human
gggcauggaagagggacc

SEQ ID NO: 718346 - RNA, 20 nt, Human
gggcauuccugagucagacu

SEQ ID NO: 718347 - RNA, 19 nt, Human
gggcucaccugauugugug

SEQ ID NO: 718348 - RNA, 23 nt, Human
gggcucuucuuuuccaucucccu

SEQ ID NO: 718349 - RNA, 19 nt, Human
gggcugaaggaaaccagcc

SEQ ID NO: 718350 - RNA, 20 nt, Human
ggggaacaacucagccucag

SEQ ID NO: 718351 - RNA, 22 nt, Human
ggggcaggugcugccccgggac

SEQ ID NO: 718352 - RNA, 24 nt, Human
ggggcggggaggggcggcgaggga

SEQ ID NO: 718353 - RNA, 28 nt, Human
ggggggaggggagggagggaaaguuccg

SEQ ID NO: 718354 - RNA, 18 nt, Human
gggguucccagagggccc

SEQ ID NO: 718355 - RNA, 21 nt, Human
gggugccuggagcagauggcu

SEQ ID NO: 718356 - RNA, 21 nt, Human
gggugggagacuucuggaggg

SEQ ID NO: 718357 - RNA, 21 nt, Human
ggucagggccacccucagggc

SEQ ID NO: 718358 - RNA, 18 nt, Human
ggugcuggggccacagcc

SEQ ID NO: 718359 - RNA, 23 nt, Human
guccugcugcuuucuccccuacc

SEQ ID NO: 718360 - RNA, 25 nt, Human
gugcaccugccacccgggaaccaca

SEQ ID NO: 718361 - RNA, 23 nt, Human
gugcagccacacugcaucacaca

SEQ ID NO: 718362 - RNA, 23 nt, Human
guggaacaaaagacaagacagaa

SEQ ID NO: 718363 - RNA, 21 nt, Human
guggagggcaacucaucuaca

SEQ ID NO: 718364 - RNA, 19 nt, Human
gugggacagaaugaacaga

SEQ ID NO: 718365 - RNA, 23 nt, Human
guggggcacaggaaagcagggaa

SEQ ID NO: 718366 - RNA, 24 nt, Human
uaaaagaauaauuccccaagguca

SEQ ID NO: 718367 - RNA, 18 nt, Human
uaaaaggguccggaggug

SEQ ID NO: 718368 - RNA, 22 nt, Human
uaaacagugugcuugucagucc

SEQ ID NO: 718369 - RNA, 22 nt, Human
uaacacagaaccaugccagcca

SEQ ID NO: 718370 - RNA, 19 nt, Human
uaauauaagaauagaggcu

SEQ ID NO: 718371 - RNA, 26 nt, Human
uacacacacacacacacgcacgcaca

SEQ ID NO: 718372 - RNA, 18 nt, Human
uaccaaaaacccauugca

SEQ ID NO: 718373 - RNA, 20 nt, Human
uacccaaggucacaguuucu

SEQ ID NO: 718374 - RNA, 20 nt, Human
uacccacagaaccuccuuac

SEQ ID NO: 718375 - RNA, 18 nt, Human
uacuggagaagaaaacuc

SEQ ID NO: 718376 - RNA, 22 nt, Human
uacuggagccuuuuucauacca

SEQ ID NO: 718377 - RNA, 19 nt, Human
uacuuugaagggaaauaag

SEQ ID NO: 718378 - RNA, 23 nt, Human
uagaagaaaccagauggggaguc

SEQ ID NO: 718379 - RNA, 26 nt, Human
uagaauucucagaucuucaacucucc

SEQ ID NO: 718380 - RNA, 21 nt, Human
uagcagauaacaugcccucuu

SEQ ID NO: 718381 - RNA, 19 nt, Human
uagggcauuugcacaaggc

SEQ ID NO: 718382 - RNA, 23 nt, Human
uaucucucucuuugcaggaugca

SEQ ID NO: 718383 - RNA, 20 nt, Human
ucacaggcacagccaugcca

SEQ ID NO: 718384 - RNA, 18 nt, Human
ucacagggggcugccucc

SEQ ID NO: 718385 - RNA, 20 nt, Human
ucacugauguggcuucccuc

SEQ ID NO: 718386 - RNA, 19 nt, Human
ucacuggaagaaggaggag

SEQ ID NO: 718387 - RNA, 24 nt, Human
ucagacaagccccugcauccauga

SEQ ID NO: 718388 - RNA, 18 nt, Human
ucagcccauaucaucacc

SEQ ID NO: 718389 - RNA, 22 nt, Human
ucagcccccaugaaaugcuggc

SEQ ID NO: 718390 - RNA, 22 nt, Human
ucagccucacacaacuuuaccc

SEQ ID NO: 718391 - RNA, 18 nt, Human
ucaggcagagauaggagc

SEQ ID NO: 718392 - RNA, 21 nt, Human
ucaugcuuuucaacaagcacc

SEQ ID NO: 718393 - RNA, 20 nt, Human
uccaaagaaguacccuugga

SEQ ID NO: 718394 - RNA, 22 nt, Human
uccaagaacuugacgaacggua

SEQ ID NO: 718395 - RNA, 20 nt, Human
uccacacaccuccacugucc

SEQ ID NO: 718396 - RNA, 20 nt, Human
uccagaucagagacuuuuaa

SEQ ID NO: 718397 - RNA, 20 nt, Human
uccagcaaacagcccuaccc

SEQ ID NO: 718398 - RNA, 22 nt, Human
uccagcaaacagcccuacccac

SEQ ID NO: 718399 - RNA, 22 nt, Human
uccauaaggcgccacugccucc

SEQ ID NO: 718400 - RNA, 26 nt, Human
ucccaagccccauucuguuagccaag

SEQ ID NO: 718401 - RNA, 19 nt, Human
ucccagccagaccaggcca

SEQ ID NO: 718402 - RNA, 19 nt, Human
ucccccaccccagcaaaca

SEQ ID NO: 718403 - RNA, 19 nt, Human
uccccgggguggcagggcc

SEQ ID NO: 718404 - RNA, 19 nt, Human
ucccugcagccacugcaga

SEQ ID NO: 718405 - RNA, 20 nt, Human
ucccuguagccagcuguccc

SEQ ID NO: 718406 - RNA, 21 nt, Human
ucccuguagccagcugucccu

SEQ ID NO: 718407 - RNA, 19 nt, Human
uccgcccgccugcgcugcc

SEQ ID NO: 718408 - RNA, 21 nt, Human
uccugagucagacuucaggau

SEQ ID NO: 718409 - RNA, 21 nt, Human
uccuggggugacugcuggucu

SEQ ID NO: 718410 - RNA, 25 nt, Human
uccuuuggguuucuuuucaacaagg

SEQ ID NO: 718411 - RNA, 23 nt, Human
ucgcaacacccugacagugacug

SEQ ID NO: 718412 - RNA, 23 nt, Human
ucuccacugccagcugggaugag

SEQ ID NO: 718413 - RNA, 23 nt, Human
ucucuccagccagguggagggca

SEQ ID NO: 718414 - RNA, 22 nt, Human
ucucugcaggcagcuccccacc

SEQ ID NO: 718415 - RNA, 21 nt, Human
ucugcaggcagcuccccaccg

SEQ ID NO: 718416 - RNA, 23 nt, Human
ucuugcagaguuugcacagugcu

SEQ ID NO: 718417 - RNA, 22 nt, Human
ucuuuuccaucucccugcagcc

SEQ ID NO: 718418 - RNA, 18 nt, Human
ugaaaugcuggcauugcc

SEQ ID NO: 718419 - RNA, 25 nt, Human
ugaacagagcagaaauacaaagaca

SEQ ID NO: 718420 - RNA, 21 nt, Human
ugaacagauagaacgugguca

SEQ ID NO: 718421 - RNA, 21 nt, Human
ugaauggaggccccaagucau

SEQ ID NO: 718422 - RNA, 19 nt, Human
ugagaaagcaagcagaggc

SEQ ID NO: 718423 - RNA, 27 nt, Human
ugagcaguuuuggcagccagggacugu

SEQ ID NO: 718424 - RNA, 19 nt, Human
ugaggaaagacccagccuc

SEQ ID NO: 718425 - RNA, 26 nt, Human
ugaggaaagacccagccucaucugcu

SEQ ID NO: 718426 - RNA, 19 nt, Human
ugaggaagauggggaauau

SEQ ID NO: 718427 - RNA, 23 nt, Human
ugaggaagauggggaauaugagg

SEQ ID NO: 718428 - RNA, 25 nt, Human
ugaggaguggaagagaaagguagga

SEQ ID NO: 718429 - RNA, 19 nt, Human
ugaggugaaggcaaucagg

SEQ ID NO: 718430 - RNA, 21 nt, Human
ugaggugaaggcaaucagggc

SEQ ID NO: 718431 - RNA, 18 nt, Human
ugagucauguccacacaa

SEQ ID NO: 718432 - RNA, 21 nt, Human
ugauuccacagaggaugagcu

SEQ ID NO: 718433 - RNA, 20 nt, Human
ugauugugugggcuuccccu

SEQ ID NO: 718434 - RNA, 20 nt, Human
ugccccaaccucuucugagg

SEQ ID NO: 718435 - RNA, 21 nt, Human
ugccccaggccaggaccaggc

SEQ ID NO: 718436 - RNA, 22 nt, Human
ugccccaggccaggaccaggca

SEQ ID NO: 718437 - RNA, 23 nt, Human
ugccccgggaccccgccccgcga

SEQ ID NO: 718438 - RNA, 25 nt, Human
ugccucagcccccaugaaaugcugg

SEQ ID NO: 718439 - RNA, 18 nt, Human
ugccucccaacagcacac

SEQ ID NO: 718440 - RNA, 18 nt, Human
ugccugcccaggcccacu

SEQ ID NO: 718441 - RNA, 18 nt, Human
ugccugggacuugcugca

SEQ ID NO: 718442 - RNA, 28 nt, Human
ugccugggacuugcugcaucccaagagc

SEQ ID NO: 718443 - RNA, 19 nt, Human
ugcuacauccacaaacauc

SEQ ID NO: 718444 - RNA, 21 nt, Human
ugcuacauuucucagaaaaca

SEQ ID NO: 718445 - RNA, 23 nt, Human
ugcuacauuucucagaaaacagu

SEQ ID NO: 718446 - RNA, 19 nt, Human
uggaaagagugccuuccac

SEQ ID NO: 718447 - RNA, 18 nt, Human
uggaacaaaagacaagac

SEQ ID NO: 718448 - RNA, 24 nt, Human
uggaacaaaagacaagacagaaaa

SEQ ID NO: 718449 - RNA, 30 nt, Human
uggaacaaaagacaagacagaaaacagugg

SEQ ID NO: 718450 - RNA, 19 nt, Human
uggaacccaggcucaggga

SEQ ID NO: 718451 - RNA, 22 nt, Human
uggaagaaggaggagguuccag

SEQ ID NO: 718452 - RNA, 22 nt, Human
uggaagagaaagguaggaggag

SEQ ID NO: 718453 - RNA, 23 nt, Human
uggaagagggacccugguugcau

SEQ ID NO: 718454 - RNA, 19 nt, Human
uggacaaccuucuggcccu

SEQ ID NO: 718455 - RNA, 23 nt, Human
uggaccagaugagagccugcacc

SEQ ID NO: 718456 - RNA, 24 nt, Human
uggagaagaaaacucugaggagug

SEQ ID NO: 718457 - RNA, 26 nt, Human
uggaggccccaagucauucagacccc

SEQ ID NO: 718458 - RNA, 23 nt, Human
uggcagccagggacuguagguag

SEQ ID NO: 718459 - RNA, 22 nt, Human
uggcagggccucaggcagcucg

SEQ ID NO: 718460 - RNA, 20 nt, Human
uggcagugaguuggccccag

SEQ ID NO: 718461 - RNA, 21 nt, Human
uggcaucauugugaacuccuu

SEQ ID NO: 718462 - RNA, 23 nt, Human
uggcaugaccaugggaggacugg

SEQ ID NO: 718463 - RNA, 22 nt, Human
uggcauugccugggacuugcug

SEQ ID NO: 718464 - RNA, 20 nt, Human
uggccaggaacccuggaacc

SEQ ID NO: 718465 - RNA, 22 nt, Human
uggcugccugcccaggcccacu

SEQ ID NO: 718466 - RNA, 19 nt, Human
ugggaggacuggcuugacc

SEQ ID NO: 718467 - RNA, 21 nt, Human
ugggaggcccaaggcccuguc

SEQ ID NO: 718468 - RNA, 21 nt, Human
ugggcaggccaggugggguuc

SEQ ID NO: 718469 - RNA, 18 nt, Human
uggggagagcauuuccgc

SEQ ID NO: 718470 - RNA, 19 nt, Human
uggggagagcauuuccgcc

SEQ ID NO: 718471 - RNA, 25 nt, Human
uggggagagcauuuccgccuaaaga

SEQ ID NO: 718472 - RNA, 24 nt, Human
uggggaugaguaacuuauuuggug

SEQ ID NO: 718473 - RNA, 20 nt, Human
uggguggcaugaccauggga

SEQ ID NO: 718474 - RNA, 20 nt, Human
uggguggcaugaccauggga

SEQ ID NO: 718475 - RNA, 21 nt, Human
ugguagaagaaaccagauggg

SEQ ID NO: 718476 - RNA, 22 nt, Human
ugguuaugaauggaggccccaa

SEQ ID NO: 718477 - RNA, 19 nt, Human
uguccugugggucacuaac

SEQ ID NO: 718478 - RNA, 20 nt, Human
uguuaggauucccagaguuc

SEQ ID NO: 718479 - RNA, 21 nt, Human
uuaaaaauggaggcuucugcu

SEQ ID NO: 718480 - RNA, 19 nt, Human
uuaaaagaauccuuuccca

SEQ ID NO: 718481 - RNA, 20 nt, Human
uuauuccagcaaacagcccu

SEQ ID NO: 718482 - RNA, 22 nt, Human
uucaacucucccacugauguca

SEQ ID NO: 718483 - RNA, 18 nt, Human
uucaucugggcaaggggg

SEQ ID NO: 718484 - RNA, 22 nt, Human
uuccagccucauagagaaaguc

SEQ ID NO: 718485 - RNA, 22 nt, Human
uucccagaguucuugucugagg

SEQ ID NO: 718486 - RNA, 23 nt, Human
uuccccaccccccguccucaaac

SEQ ID NO: 718487 - RNA, 20 nt, Human
uuccuggcaucauugugaac

SEQ ID NO: 718488 - RNA, 21 nt, Human
uugagcuaucaggcccacucu

SEQ ID NO: 718489 - RNA, 22 nt, Human
uuuauugucuuuaaaaauggag

SEQ ID NO: 718490 - RNA, 18 nt, Human
uuucccagccagaccagg

SEQ ID NO: 718491 - RNA, 21 nt, Human
aaccacgacggaguggcagcc

SEQ ID NO: 718492 - RNA, 23 nt, Human
aaccacgacggaguggcagccuc

SEQ ID NO: 718493 - RNA, 19 nt, Human
aggccccgccuucacuuuc

SEQ ID NO: 718494 - RNA, 21 nt, Human
aggugccaucgauggggaaug

SEQ ID NO: 718495 - RNA, 21 nt, Human
cagcagagacuggaaauggca

SEQ ID NO: 718496 - RNA, 21 nt, Human
caggccccgccuucacuuucu

SEQ ID NO: 718497 - RNA, 22 nt, Human
ccccaggacugagucaggcccc

SEQ ID NO: 718498 - RNA, 21 nt, Human
ccccgccuucacuuucucuuu

SEQ ID NO: 718499 - RNA, 21 nt, Human
ccccgccuucacuuucucuuu

SEQ ID NO: 718500 - RNA, 21 nt, Human
cccuuggagcccucgcagccc

SEQ ID NO: 718501 - RNA, 23 nt, Human
cucucucuauauuaaaaauaaaa

SEQ ID NO: 718502 - RNA, 20 nt, Human
cuucuugcccuuugcucucc

SEQ ID NO: 718503 - RNA, 18 nt, Human
gagcccucgcagcccuuc

SEQ ID NO: 718504 - RNA, 20 nt, Human
gccuucacuuucucuuucuu

SEQ ID NO: 718505 - RNA, 19 nt, Human
ggaaugagguggacaggcc

SEQ ID NO: 718506 - RNA, 25 nt, Human
ggacacucagcagagacuggaaaug

SEQ ID NO: 718507 - RNA, 28 nt, Human
ggaccagggcagggccugggacagggaa

SEQ ID NO: 718508 - RNA, 19 nt, Human
ggccugguuaccgcucuug

SEQ ID NO: 718509 - RNA, 20 nt, Human
gggcagggccugggacaggg

SEQ ID NO: 718510 - RNA, 22 nt, Human
gucuccuacucugugcagcugg

SEQ ID NO: 718511 - RNA, 19 nt, Human
gugccaucgauggggaaug

SEQ ID NO: 718512 - RNA, 21 nt, Human
uaccgcucuugagccucaguc

SEQ ID NO: 718513 - RNA, 22 nt, Human
uaccgcucuugagccucagucu

SEQ ID NO: 718514 - RNA, 20 nt, Human
ucacuuucucuuucuucuca

SEQ ID NO: 718515 - RNA, 19 nt, Human
ucagcagagacuggaaaug

SEQ ID NO: 718516 - RNA, 27 nt, Human
ugacugggcugaggccuugugggggga

SEQ ID NO: 718517 - RNA, 27 nt, Human
ugacugggcugaggccuugugggggga

SEQ ID NO: 718518 - RNA, 18 nt, Human
uggcagccucgagggucu

SEQ ID NO: 718519 - RNA, 20 nt, Human
uggcagccucgagggucugg

SEQ ID NO: 718520 - RNA, 18 nt, Human
uggggggaccagggcagg

SEQ ID NO: 718521 - RNA, 19 nt, Human
uguggggggaccagggcag

SEQ ID NO: 718522 - RNA, 24 nt, Human
uucucugcugugaucugcaccgac

SEQ ID NO: 718523 - RNA, 23 nt, Human
uuggagcccucgcagcccuuccu

SEQ ID NO: 718524 - RNA, 24 nt, Human
aaaaacccaaaacuaaauuugcag

SEQ ID NO: 718525 - RNA, 24 nt, Human
aaaaaugaccucuggauccgagca

SEQ ID NO: 718526 - RNA, 21 nt, Human
aaaacaaauaaacaaaaugcc

SEQ ID NO: 718527 - RNA, 21 nt, Human
aaaaugccuauaagcacuuuc

SEQ ID NO: 718528 - RNA, 20 nt, Human
aaacaaauaaacaaaaugcc

SEQ ID NO: 718529 - RNA, 21 nt, Human
aaacaaauaaacaaaaugccu

SEQ ID NO: 718530 - RNA, 21 nt, Human
aaacagaaaccaugacagggc

SEQ ID NO: 718531 - RNA, 18 nt, Human
aaagaacaggauugagau

SEQ ID NO: 718532 - RNA, 20 nt, Human
aacaaaaaugaccucuggau

SEQ ID NO: 718533 - RNA, 18 nt, Human
aagaagcauaaacaaggc

SEQ ID NO: 718534 - RNA, 22 nt, Human
aagaagcauaaacaaggccaga

SEQ ID NO: 718535 - RNA, 22 nt, Human
aagcaaauaaagcccacaccac

SEQ ID NO: 718536 - RNA, 18 nt, Human
aaguguuagggcuuaaaa

SEQ ID NO: 718537 - RNA, 24 nt, Human
acaaacaaaaacauacauuauaug

SEQ ID NO: 718538 - RNA, 18 nt, Human
acaacaaaacacacacaa

SEQ ID NO: 718539 - RNA, 24 nt, Human
acaauaacaacaaaacacacacaa

SEQ ID NO: 718540 - RNA, 20 nt, Human
acacugacagcgagugacgc

SEQ ID NO: 718541 - RNA, 21 nt, Human
acaugcgucaccccuauaggc

SEQ ID NO: 718542 - RNA, 23 nt, Human
acccaaacagaaaguaccaacug

SEQ ID NO: 718543 - RNA, 22 nt, Human
acuacccaaacagaaaguacca

SEQ ID NO: 718544 - RNA, 22 nt, Human
agaaaaaaaaaaaaaaaaagaa

SEQ ID NO: 718545 - RNA, 23 nt, Human
agaaaagccuaugaaaucaugga

SEQ ID NO: 718546 - RNA, 27 nt, Human
agacaagaagcauaaacaaggccagag

SEQ ID NO: 718547 - RNA, 21 nt, Human
agacaaguguuagggcuuaaa

SEQ ID NO: 718548 - RNA, 20 nt, Human
agaggugacaaauguacaug

SEQ ID NO: 718549 - RNA, 20 nt, Human
agaucaagcaggcuggagac

SEQ ID NO: 718550 - RNA, 20 nt, Human
aggauugggacagcagggca

SEQ ID NO: 718551 - RNA, 22 nt, Human
agggcugcgggucccuggcaac

SEQ ID NO: 718552 - RNA, 18 nt, Human
auuggcuggggcaugugg

SEQ ID NO: 718553 - RNA, 19 nt, Human
auuugcaguaauuaaugua

SEQ ID NO: 718554 - RNA, 21 nt, Human
caaaacuaaauuugcagaugc

SEQ ID NO: 718555 - RNA, 20 nt, Human
caaaauccagcaacaaacaa

SEQ ID NO: 718556 - RNA, 22 nt, Human
caaacgaugcuccaacaggcac

SEQ ID NO: 718557 - RNA, 23 nt, Human
caaacuguuggcuugaaccuaua

SEQ ID NO: 718558 - RNA, 19 nt, Human
caaaugacuuaugauuguc

SEQ ID NO: 718559 - RNA, 22 nt, Human
caacaaaacacacacaaaaaaa

SEQ ID NO: 718560 - RNA, 24 nt, Human
caacuggcgacaccaacuuaucua

SEQ ID NO: 718561 - RNA, 20 nt, Human
caaggccagagucuccuuaa

SEQ ID NO: 718562 - RNA, 23 nt, Human
caauuuguauuggcuggggcagu

SEQ ID NO: 718563 - RNA, 18 nt, Human
cacaggccaaacagaaac

SEQ ID NO: 718564 - RNA, 19 nt, Human
cacuguauugcuugcaaac

SEQ ID NO: 718565 - RNA, 21 nt, Human
cagaaaaaaaaaaaaaaaaaa

SEQ ID NO: 718566 - RNA, 24 nt, Human
cagaaaaucaaaugcuuaauaaca

SEQ ID NO: 718567 - RNA, 22 nt, Human
cagccagcaauuuacugcucaa

SEQ ID NO: 718568 - RNA, 18 nt, Human
caggauagggaagaaaga

SEQ ID NO: 718569 - RNA, 21 nt, Human
caggccaaacagaaaccauga

SEQ ID NO: 718570 - RNA, 22 nt, Human
cauggaguuuagggcagggugu

SEQ ID NO: 718571 - RNA, 19 nt, Human
ccaaacagaaaccaugaca

SEQ ID NO: 718572 - RNA, 30 nt, Human
ccacaacagaaaaaaaaaaaaaaaaagaaa

SEQ ID NO: 718573 - RNA, 20 nt, Human
ccaugcucacuaauaugaac

SEQ ID NO: 718574 - RNA, 18 nt, Human
ccauuuccauuugcuuuu

SEQ ID NO: 718575 - RNA, 18 nt, Human
cccaagggaagaaaagcc

SEQ ID NO: 718576 - RNA, 21 nt, Human
ccccaagggaagaaaagccua

SEQ ID NO: 718577 - RNA, 24 nt, Human
ccuaggacuacccaaacagaaagu

SEQ ID NO: 718578 - RNA, 22 nt, Human
ccucaacaauaacaacaaaaca

SEQ ID NO: 718579 - RNA, 20 nt, Human
ccuccagagccagggagaua

SEQ ID NO: 718580 - RNA, 20 nt, Human
ccucuguacacugugccucu

SEQ ID NO: 718581 - RNA, 25 nt, Human
ccucuugcaaggauuucugaagaau

SEQ ID NO: 718582 - RNA, 24 nt, Human
ccuguaaucacgacaaguauugcu

SEQ ID NO: 718583 - RNA, 21 nt, Human
cgaaugaaccugaacaacuga

SEQ ID NO: 718584 - RNA, 24 nt, Human
cgggguggggucucggggcggggu

SEQ ID NO: 718585 - RNA, 23 nt, Human
cuacuaaauccuucagagcuaaa

SEQ ID NO: 718586 - RNA, 22 nt, Human
cucaacaauaacaacaaaacac

SEQ ID NO: 718587 - RNA, 20 nt, Human
cucacuagcagcccacauga

SEQ ID NO: 718588 - RNA, 21 nt, Human
cucgggguggggucucggggc

SEQ ID NO: 718589 - RNA, 22 nt, Human
cucuggauccgagcagcucaga

SEQ ID NO: 718590 - RNA, 27 nt, Human
cuguaacuaagaacagaaccggggucc

SEQ ID NO: 718591 - RNA, 19 nt, Human
cuguguuuucuaauuagaa

SEQ ID NO: 718592 - RNA, 21 nt, Human
gaaagagaggugacaaaugua

SEQ ID NO: 718593 - RNA, 20 nt, Human
gcaaauaaagcccacaccac

SEQ ID NO: 718594 - RNA, 20 nt, Human
gcaggcuggagacaggagac

SEQ ID NO: 718595 - RNA, 30 nt, Human
gcuacuggcuuuuccaccagggcugcgggg

SEQ ID NO: 718596 - RNA, 21 nt, Human
gcugcaccuccagagccaggg

SEQ ID NO: 718597 - RNA, 19 nt, Human
gcugcuguaacuaagaaca

SEQ ID NO: 718598 - RNA, 18 nt, Human
ggcuggggcauguggcug

SEQ ID NO: 718599 - RNA, 23 nt, Human
gggaaucccaugucucagaucuu

SEQ ID NO: 718600 - RNA, 23 nt, Human
gggagaagagugcauaaaaauac

SEQ ID NO: 718601 - RNA, 24 nt, Human
gggccagauuuuccaauuuguauu

SEQ ID NO: 718602 - RNA, 24 nt, Human
ggggccuaucagacugcuuucugc

SEQ ID NO: 718603 - RNA, 19 nt, Human
ggguagggggaggacugcu

SEQ ID NO: 718604 - RNA, 21 nt, Human
gucccuggcagcacagccagc

SEQ ID NO: 718605 - RNA, 25 nt, Human
uaaaaaaacccaaaacuaaauuugc

SEQ ID NO: 718606 - RNA, 22 nt, Human
uaaaaaguaaacuuacauacaa

SEQ ID NO: 718607 - RNA, 27 nt, Human
uaaacaaagaacaggauugagauuaga

SEQ ID NO: 718608 - RNA, 21 nt, Human
uaacugguuuccauuuuccuu

SEQ ID NO: 718609 - RNA, 24 nt, Human
uaauaauaaaaaaacccaaaacua

SEQ ID NO: 718610 - RNA, 21 nt, Human
uaauaugaacacaggccaaac

SEQ ID NO: 718611 - RNA, 24 nt, Human
uacauacaaugacacaaaaauuua

SEQ ID NO: 718612 - RNA, 18 nt, Human
uacaugaagcuuaucuug

SEQ ID NO: 718613 - RNA, 19 nt, Human
uacaugcacguguguguau

SEQ ID NO: 718614 - RNA, 21 nt, Human
uacccuaggacuacccaaaca

SEQ ID NO: 718615 - RNA, 22 nt, Human
uauaugcuuuuacauauauaca

SEQ ID NO: 718616 - RNA, 27 nt, Human
uauuauaacccucauggcucuaucccg

SEQ ID NO: 718617 - RNA, 24 nt, Human
uauugcucuuaaacaaagaacagg

SEQ ID NO: 718618 - RNA, 19 nt, Human
ucaaaauuuuaccaagggc

SEQ ID NO: 718619 - RNA, 22 nt, Human
ucaaagauggcugagggggaag

SEQ ID NO: 718620 - RNA, 19 nt, Human
ucaaaugcuuaauaacaaa

SEQ ID NO: 718621 - RNA, 22 nt, Human
ucaagcaggcuggagacaggag

SEQ ID NO: 718622 - RNA, 19 nt, Human
ucagugauauuggccucuu

SEQ ID NO: 718623 - RNA, 19 nt, Human
ucaguggugggcuagcugg

SEQ ID NO: 718624 - RNA, 21 nt, Human
ucaguggugggcuagcugguc

SEQ ID NO: 718625 - RNA, 22 nt, Human
uccaacaggcacaugcgucacc

SEQ ID NO: 718626 - RNA, 21 nt, Human
uccagggauaaaguucugcaa

SEQ ID NO: 718627 - RNA, 18 nt, Human
ucccuaggugaaauucaa

SEQ ID NO: 718628 - RNA, 19 nt, Human
uccgggguggggucucggg

SEQ ID NO: 718629 - RNA, 22 nt, Human
ucgggguggggucucggggcgg

SEQ ID NO: 718630 - RNA, 18 nt, Human
ucuucuguugcuguguuu

SEQ ID NO: 718631 - RNA, 20 nt, Human
ugaaacaaaauccagcaaca

SEQ ID NO: 718632 - RNA, 18 nt, Human
ugaaagugcuuuugaugc

SEQ ID NO: 718633 - RNA, 22 nt, Human
ugaaauucaacauagauaugcc

SEQ ID NO: 718634 - RNA, 22 nt, Human
ugaacacaggccaaacagaaac

SEQ ID NO: 718635 - RNA, 22 nt, Human
ugaaccaucaauagggaagccc

SEQ ID NO: 718636 - RNA, 18 nt, Human
ugaagaaggaugaagcug

SEQ ID NO: 718637 - RNA, 19 nt, Human
ugacaagaaauaaaaauaa

SEQ ID NO: 718638 - RNA, 24 nt, Human
ugacaagaaauaaaaauaaauaaa

SEQ ID NO: 718639 - RNA, 25 nt, Human
ugacaagaaauaaaaauaaauaaag

SEQ ID NO: 718640 - RNA, 19 nt, Human
ugagauuagaaagaauaac

SEQ ID NO: 718641 - RNA, 19 nt, Human
ugaugaagaaggaugaagc

SEQ ID NO: 718642 - RNA, 22 nt, Human
ugcagaugcagugggauauucu

SEQ ID NO: 718643 - RNA, 21 nt, Human
ugcagugggauauucuuuaaa

SEQ ID NO: 718644 - RNA, 20 nt, Human
uggcauccaaauaugccucu

SEQ ID NO: 718645 - RNA, 23 nt, Human
uggcugcaccuccagagccaggg

SEQ ID NO: 718646 - RNA, 23 nt, Human
uggcuggggcauguggcugggga

SEQ ID NO: 718647 - RNA, 18 nt, Human
ugggcuagcugguuaccu

SEQ ID NO: 718648 - RNA, 18 nt, Human
ugguaaauuaggcucucc

SEQ ID NO: 718649 - RNA, 23 nt, Human
ugguauauagaaaagcuaggauu

SEQ ID NO: 718650 - RNA, 19 nt, Human
uguagugggacacaggggc

SEQ ID NO: 718651 - RNA, 25 nt, Human
ugugcacacacuguaacaaaaauga

SEQ ID NO: 718652 - RNA, 19 nt, Human
uguguguagugggacacag

SEQ ID NO: 718653 - RNA, 24 nt, Human
uuacaguguuuuuaaaaaacaaaa

SEQ ID NO: 718654 - RNA, 20 nt, Human
uucaggaaguacuuaaggac

SEQ ID NO: 718655 - RNA, 20 nt, Human
uugcuccggaagcaucagaa

SEQ ID NO: 718656 - RNA, 24 nt, Human
uugggacagcagggcaggauaggg

SEQ ID NO: 718657 - RNA, 27 nt, Human
uuuguaaucuccaacuaaacauuuccu

SEQ ID NO: 718658 - RNA, 21 nt, Human
uuuguauuggcuggggcaugu

SEQ ID NO: 718659 - RNA, 23 nt, Human
uuuuuaaaaaacaaaacaaauaa

SEQ ID NO: 718660 - RNA, 21 nt, Human
aaaaaaaaaaaaaaaaacaaa

SEQ ID NO: 718661 - RNA, 26 nt, Human
aaaaaaaaaaaaaaaaacaaacacca

SEQ ID NO: 718662 - RNA, 23 nt, Human
aaaaaaacaaacaccaacaacaa

SEQ ID NO: 718663 - RNA, 19 nt, Human
aaaaaaacccaaaaacucu

SEQ ID NO: 718664 - RNA, 25 nt, Human
aaaaagacaaggccaggaaggcccc

SEQ ID NO: 718665 - RNA, 20 nt, Human
aaaauccagaagaauccuaa

SEQ ID NO: 718666 - RNA, 24 nt, Human
aaacaaaaaaaagacaaggccagg

SEQ ID NO: 718667 - RNA, 19 nt, Human
aaacaaaaaaacccaaaaa

SEQ ID NO: 718668 - RNA, 21 nt, Human
aaacaaacaaaaaaacccaaa

SEQ ID NO: 718669 - RNA, 23 nt, Human
aaacaaacaccaacaacaaacaa

SEQ ID NO: 718670 - RNA, 18 nt, Human
aaacccagaaaggggcaa

SEQ ID NO: 718671 - RNA, 19 nt, Human
aaaggggcaaccugcccag

SEQ ID NO: 718672 - RNA, 23 nt, Human
aaauuucagaaaaaagcaaaaca

SEQ ID NO: 718673 - RNA, 20 nt, Human
aacaaaaaaaagacaaggcc

SEQ ID NO: 718674 - RNA, 24 nt, Human
aacaaacucauaaaguggccagga

SEQ ID NO: 718675 - RNA, 27 nt, Human
aagaagccagggcaggguguggggacu

SEQ ID NO: 718676 - RNA, 18 nt, Human
aagaauccuaaagucggc

SEQ ID NO: 718677 - RNA, 22 nt, Human
aagcaaaacaaacauuccuuac

SEQ ID NO: 718678 - RNA, 19 nt, Human
aagcaaaauauucuccaag

SEQ ID NO: 718679 - RNA, 19 nt, Human
aagcaaacccaaacugauu

SEQ ID NO: 718680 - RNA, 20 nt, Human
aagcuggucaucuaugcagc

SEQ ID NO: 718681 - RNA, 19 nt, Human
aaggcgacuggggccauua

SEQ ID NO: 718682 - RNA, 18 nt, Human
aaguaggaaaagcagcag

SEQ ID NO: 718683 - RNA, 21 nt, Human
aauaaaauaaagcaaacccaa

SEQ ID NO: 718684 - RNA, 22 nt, Human
acaaaaccccagaguaacaaga

SEQ ID NO: 718685 - RNA, 26 nt, Human
acaaaaccccagaguaaccgggacgu

SEQ ID NO: 718686 - RNA, 18 nt, Human
acaaacaaaaaaacccaa

SEQ ID NO: 718687 - RNA, 28 nt, Human
acaaacaaacaaaaaaacccaaaaacuc

SEQ ID NO: 718688 - RNA, 21 nt, Human
acaaacaccaacaacaaacaa

SEQ ID NO: 718689 - RNA, 23 nt, Human
acaacaaacaaacaaaaaaaccc

SEQ ID NO: 718690 - RNA, 22 nt, Human
acacauggcuaugggagagcgc

SEQ ID NO: 718691 - RNA, 19 nt, Human
acaccaacaacaaacaaac

SEQ ID NO: 718692 - RNA, 22 nt, Human
acaggacagacccaggcccggc

SEQ ID NO: 718693 - RNA, 23 nt, Human
accagcucccuaccuaacuaugc

SEQ ID NO: 718694 - RNA, 19 nt, Human
accuucuccaaccagcucc

SEQ ID NO: 718695 - RNA, 21 nt, Human
acucaacagggccaggagcuu

SEQ ID NO: 718696 - RNA, 21 nt, Human
acucucaacucaacagggcca

SEQ ID NO: 718697 - RNA, 23 nt, Human
acucucaccccaauuagagccac

SEQ ID NO: 718698 - RNA, 18 nt, Human
agacaagggcacugcugu

SEQ ID NO: 718699 - RNA, 20 nt, Human
agacaugcagcacagggucc

SEQ ID NO: 718700 - RNA, 19 nt, Human
agcagacaugcagcacagg

SEQ ID NO: 718701 - RNA, 18 nt, Human
agccugggcuugugcucc

SEQ ID NO: 718702 - RNA, 21 nt, Human
agcugaauaaaccccaaacaa

SEQ ID NO: 718703 - RNA, 20 nt, Human
aggaaggccgaugcuggaag

SEQ ID NO: 718704 - RNA, 20 nt, Human
aggagcuggugggggcugcc

SEQ ID NO: 718705 - RNA, 23 nt, Human
aggaggggaggagacgagagggg

SEQ ID NO: 718706 - RNA, 22 nt, Human
aggcacaaguaaacacagcagc

SEQ ID NO: 718707 - RNA, 24 nt, Human
aggcagauggcgagaaucuuccuu

SEQ ID NO: 718708 - RNA, 18 nt, Human
aggcaggaggcaagaggg

SEQ ID NO: 718709 - RNA, 24 nt, Human
aggcccacaggagcuggugggggc

SEQ ID NO: 718710 - RNA, 24 nt, Human
aggcccaggagccucugggaagug

SEQ ID NO: 718711 - RNA, 19 nt, Human
aggcucaggggaggagcag

SEQ ID NO: 718712 - RNA, 19 nt, Human
agggagagggaggaagggc

SEQ ID NO: 718713 - RNA, 23 nt, Human
agggagagggaggaagggcugag

SEQ ID NO: 718714 - RNA, 21 nt, Human
auaaaaccaaacaaacucaua

SEQ ID NO: 718715 - RNA, 21 nt, Human
augacagggaaacuggacagg

SEQ ID NO: 718716 - RNA, 23 nt, Human
augcgagggguggcagggaaggg

SEQ ID NO: 718717 - RNA, 20 nt, Human
auuucaccagggaucaagcu

SEQ ID NO: 718718 - RNA, 18 nt, Human
auuucauucucuacgcaa

SEQ ID NO: 718719 - RNA, 18 nt, Human
caaaaaaacccaaaaacu

SEQ ID NO: 718720 - RNA, 22 nt, Human
caaaacaaacauuccuuacugc

SEQ ID NO: 718721 - RNA, 23 nt, Human
caaacaaacaaaaaaacccaaaa

SEQ ID NO: 718722 - RNA, 24 nt, Human
caaacaaacaaaaaaacccaaaaa

SEQ ID NO: 718723 - RNA, 25 nt, Human
caaacaaacaaaaaaacccaaaaac

SEQ ID NO: 718724 - RNA, 26 nt, Human
caaacaaacucauaaaguggccagga

SEQ ID NO: 718725 - RNA, 26 nt, Human
caacaaacaaacaaaaaaacccaaaa

SEQ ID NO: 718726 - RNA, 22 nt, Human
cacagcacauaaaauacagaaa

SEQ ID NO: 718727 - RNA, 21 nt, Human
cacagcccacguacaucucuc

SEQ ID NO: 718728 - RNA, 19 nt, Human
caccaacaacaaacaaaca

SEQ ID NO: 718729 - RNA, 21 nt, Human
caccaacaacaaacaaacaaa

SEQ ID NO: 718730 - RNA, 22 nt, Human
caccaacaacaaacaaacaaaa

SEQ ID NO: 718731 - RNA, 27 nt, Human
caccaacaacaaacaaacaaaaaaacc

SEQ ID NO: 718732 - RNA, 24 nt, Human
caccacaaacccagaaaggggcaa

SEQ ID NO: 718733 - RNA, 18 nt, Human
caccagggucaacccagg

SEQ ID NO: 718734 - RNA, 21 nt, Human
caccccucccccuuuugucac

SEQ ID NO: 718735 - RNA, 18 nt, Human
caccccucugcccaccuc

SEQ ID NO: 718736 - RNA, 26 nt, Human
cagaagcccuagaaauagcagcacau

SEQ ID NO: 718737 - RNA, 23 nt, Human
cagcaacuacaccauucagacca

SEQ ID NO: 718738 - RNA, 22 nt, Human
cagcacagcaagcagcaggcca

SEQ ID NO: 718739 - RNA, 22 nt, Human
cagcagcacagcaagcagcagg

SEQ ID NO: 718740 - RNA, 21 nt, Human
cagcagugcagccacuaaggc

SEQ ID NO: 718741 - RNA, 18 nt, Human
cagccauuuuccuucucu

SEQ ID NO: 718742 - RNA, 24 nt, Human
cagcccacguacaucucuccuccu

SEQ ID NO: 718743 - RNA, 18 nt, Human
cagcugggacugggaggg

SEQ ID NO: 718744 - RNA, 18 nt, Human
caggagcuugugccuuug

SEQ ID NO: 718745 - RNA, 25 nt, Human
cagggccaggagcuugugccuuugg

SEQ ID NO: 718746 - RNA, 18 nt, Human
cagggugggggaaaggca

SEQ ID NO: 718747 - RNA, 21 nt, Human
cagggugggggaaaggcacaa

SEQ ID NO: 718748 - RNA, 20 nt, Human
cagguaagguggcuggagag

SEQ ID NO: 718749 - RNA, 21 nt, Human
cagugcagccacuaaggcuug

SEQ ID NO: 718750 - RNA, 18 nt, Human
caucuaugcagcugaaua

SEQ ID NO: 718751 - RNA, 18 nt, Human
cauggacaugauucucca

SEQ ID NO: 718752 - RNA, 23 nt, Human
cauuaagguuggggugcacaugg

SEQ ID NO: 718753 - RNA, 23 nt, Human
ccaauuagagccacuucugccac

SEQ ID NO: 718754 - RNA, 21 nt, Human
ccaccugcugcuacccuuguc

SEQ ID NO: 718755 - RNA, 19 nt, Human
ccacucuugacucaagagc

SEQ ID NO: 718756 - RNA, 21 nt, Human
ccagcaggcccaagagaagcu

SEQ ID NO: 718757 - RNA, 23 nt, Human
ccaggagcuugugccuuugggcc

SEQ ID NO: 718758 - RNA, 21 nt, Human
ccaggauauuaaaccugcacu

SEQ ID NO: 718759 - RNA, 21 nt, Human
ccaggcccggcccccugugug

SEQ ID NO: 718760 - RNA, 23 nt, Human
ccagggaaacaaaaaaaagacaa

SEQ ID NO: 718761 - RNA, 22 nt, Human
ccagugacaagaaggaggggag

SEQ ID NO: 718762 - RNA, 19 nt, Human
cccacaggagcuggugggg

SEQ ID NO: 718763 - RNA, 26 nt, Human
cccagaagcccuagaaauagcagcac

SEQ ID NO: 718764 - RNA, 21 nt, Human
cccagcaaagcugggccugcc

SEQ ID NO: 718765 - RNA, 22 nt, Human
cccagccacagugcuucagaaa

SEQ ID NO: 718766 - RNA, 19 nt, Human
ccccaagcagacaggcuca

SEQ ID NO: 718767 - RNA, 22 nt, Human
ccccaggccccugugggcagca

SEQ ID NO: 718768 - RNA, 21 nt, Human
ccccagggcccuguacuccag

SEQ ID NO: 718769 - RNA, 21 nt, Human
ccccuccgucaccacaaaccc

SEQ ID NO: 718770 - RNA, 23 nt, Human
cccgugccaccacccaugaagcu

SEQ ID NO: 718771 - RNA, 18 nt, Human
ccuagaaauagcagcacu

SEQ ID NO: 718772 - RNA, 22 nt, Human
ccuauagggcccucagagauac

SEQ ID NO: 718773 - RNA, 18 nt, Human
ccuccccuccgucaccac

SEQ ID NO: 718774 - RNA, 21 nt, Human
ccuccgucaccacaaacccag

SEQ ID NO: 718775 - RNA, 22 nt, Human
ccugcacucacaggcccaggag

SEQ ID NO: 718776 - RNA, 19 nt, Human
ccugggcacaguuacuaag

SEQ ID NO: 718777 - RNA, 18 nt, Human
ccuucuaguucuagcacc

SEQ ID NO: 718778 - RNA, 24 nt, Human
ccuucuaguucuagcaccuucucc

SEQ ID NO: 718779 - RNA, 23 nt, Human
ccuuuggugcuggccauucuccu

SEQ ID NO: 718780 - RNA, 20 nt, Human
cgugccaccacccaugaagc

SEQ ID NO: 718781 - RNA, 23 nt, Human
cuccacaccccucugcccaccuc

SEQ ID NO: 718782 - RNA, 24 nt, Human
cuccaggcugcuccacaccccucu

SEQ ID NO: 718783 - RNA, 21 nt, Human
cucuacgcaaggauguuccuc

SEQ ID NO: 718784 - RNA, 24 nt, Human
cucucaguaagggacaaagcccag

SEQ ID NO: 718785 - RNA, 20 nt, Human
cucugggaagugggccucau

SEQ ID NO: 718786 - RNA, 19 nt, Human
cugaauaaaccccaaacaa

SEQ ID NO: 718787 - RNA, 19 nt, Human
cugagggcucagcugggac

SEQ ID NO: 718788 - RNA, 24 nt, Human
cugcaauguacaggauaccaaaaa

SEQ ID NO: 718789 - RNA, 21 nt, Human
cugcugugggugagguaaggc

SEQ ID NO: 718790 - RNA, 24 nt, Human
cugcugugggugagguaaggcgac

SEQ ID NO: 718791 - RNA, 18 nt, Human
cugcuucccugcuaggcc

SEQ ID NO: 718792 - RNA, 19 nt, Human
cugcuucccugcuaggccu

SEQ ID NO: 718793 - RNA, 21 nt, Human
cuucuaagaugacagcaguug

SEQ ID NO: 718794 - RNA, 23 nt, Human
cuuuucauuucaccagggaucaa

SEQ ID NO: 718795 - RNA, 20 nt, Human
cuuuuuuuuuucuuuggggg

SEQ ID NO: 718796 - RNA, 25 nt, Human
gaagcaaguggucugagggcucagc

SEQ ID NO: 718797 - RNA, 21 nt, Human
gaaggcuuuucauuucaccag

SEQ ID NO: 718798 - RNA, 21 nt, Human
gacauaacuggaggaagaagc

SEQ ID NO: 718799 - RNA, 18 nt, Human
gacccagaggcuuaggaa

SEQ ID NO: 718800 - RNA, 18 nt, Human
gaggagacgagaggggag

SEQ ID NO: 718801 - RNA, 20 nt, Human
gaggagggggagggcaagau

SEQ ID NO: 718802 - RNA, 19 nt, Human
gaggaguaaggaugcagaa

SEQ ID NO: 718803 - RNA, 22 nt, Human
gcaaaauauucuccaaguccca

SEQ ID NO: 718804 - RNA, 27 nt, Human
gcaaaauauucuccaagucccaccuug

SEQ ID NO: 718805 - RNA, 20 nt, Human
gcaaagagccagcuccucca

SEQ ID NO: 718806 - RNA, 24 nt, Human
gcaacccucaaaggaaacaggaca

SEQ ID NO: 718807 - RNA, 26 nt, Human
gcaagaugaaugggaaagaaaauauu

SEQ ID NO: 718808 - RNA, 22 nt, Human
gcagcagcacagcaagcagcag

SEQ ID NO: 718809 - RNA, 23 nt, Human
gccaggagcuugugccuuugggc

SEQ ID NO: 718810 - RNA, 24 nt, Human
gccaggcaaagagccagcuccucc

SEQ ID NO: 718811 - RNA, 23 nt, Human
gccccaggccccugugggcagca

SEQ ID NO: 718812 - RNA, 21 nt, Human
gcgagggguggcagggaaggg

SEQ ID NO: 718813 - RNA, 21 nt, Human
gcucacagcuuccacgccgcc

SEQ ID NO: 718814 - RNA, 18 nt, Human
gcuccucccccagggccc

SEQ ID NO: 718815 - RNA, 22 nt, Human
gcuggccauucuccugcaucag

SEQ ID NO: 718816 - RNA, 24 nt, Human
ggaaacucucaacucaacagggcc

SEQ ID NO: 718817 - RNA, 22 nt, Human
ggaagaaagacauaacuggagg

SEQ ID NO: 718818 - RNA, 23 nt, Human
ggaagugggccucaucaaagcca

SEQ ID NO: 718819 - RNA, 21 nt, Human
ggacugggagggaaagggcua

SEQ ID NO: 718820 - RNA, 18 nt, Human
ggaggagggggagggcaa

SEQ ID NO: 718821 - RNA, 26 nt, Human
ggaggagggggagggcaagaugaagu

SEQ ID NO: 718822 - RNA, 21 nt, Human
ggaggggaggagacgagaggg

SEQ ID NO: 718823 - RNA, 18 nt, Human
ggccaggagcuugugccu

SEQ ID NO: 718824 - RNA, 18 nt, Human
ggccaggagcuugugccu

SEQ ID NO: 718825 - RNA, 19 nt, Human
ggcgggagggagggaggag

SEQ ID NO: 718826 - RNA, 22 nt, Human
ggcuccucccccagggcccugu

SEQ ID NO: 718827 - RNA, 19 nt, Human
ggcuggaggggacccagag

SEQ ID NO: 718828 - RNA, 23 nt, Human
gggaacacagcacauaaaauaca

SEQ ID NO: 718829 - RNA, 18 nt, Human
gggagggaaagggcuaag

SEQ ID NO: 718830 - RNA, 19 nt, Human
gggagggaaagggcuaagg

SEQ ID NO: 718831 - RNA, 21 nt, Human
gggagggagggaggagguggg

SEQ ID NO: 718832 - RNA, 20 nt, Human
gggaugggggcgcucacagc

SEQ ID NO: 718833 - RNA, 18 nt, Human
gggcacaguuacuaaggc

SEQ ID NO: 718834 - RNA, 19 nt, Human
gggcaggguguggggacug

SEQ ID NO: 718835 - RNA, 20 nt, Human
gggccaggcaaagagccagc

SEQ ID NO: 718836 - RNA, 21 nt, Human
ggggaagugugggaguggcca

SEQ ID NO: 718837 - RNA, 21 nt, Human
ggggacaaaaccccagaguaa

SEQ ID NO: 718838 - RNA, 20 nt, Human
ggggccaggcaaagagccag

SEQ ID NO: 718839 - RNA, 19 nt, Human
gucaacccagggcaagccc

SEQ ID NO: 718840 - RNA, 22 nt, Human
gugggcagcaagaaagccagag

SEQ ID NO: 718841 - RNA, 20 nt, Human
guguuguuuuaaaccauuau

SEQ ID NO: 718842 - RNA, 21 nt, Human
guuuuuuuaaaaagaaaaaau

SEQ ID NO: 718843 - RNA, 29 nt, Human
uaaaauaaagcaaacccaaacugauugaa

SEQ ID NO: 718844 - RNA, 20 nt, Human
uaaaauacagaaauggcaaa

SEQ ID NO: 718845 - RNA, 19 nt, Human
uaacagccugccaccugcu

SEQ ID NO: 718846 - RNA, 22 nt, Human
uaaggcgacuggggccauuagg

SEQ ID NO: 718847 - RNA, 21 nt, Human
uaagggacaaagcccagaagc

SEQ ID NO: 718848 - RNA, 21 nt, Human
uaagguacugaaaauaaacug

SEQ ID NO: 718849 - RNA, 22 nt, Human
uacacagauacacagguggcag

SEQ ID NO: 718850 - RNA, 30 nt, Human
uaccaaaaaauauauauauaaaauaaagaa

SEQ ID NO: 718851 - RNA, 18 nt, Human
uagaauguacauugaaau

SEQ ID NO: 718852 - RNA, 19 nt, Human
uagcagcacauggcugaug

SEQ ID NO: 718853 - RNA, 18 nt, Human
ucaaaggaaacaggacag

SEQ ID NO: 718854 - RNA, 18 nt, Human
ucacccgggagccggcgg

SEQ ID NO: 718855 - RNA, 18 nt, Human
ucagaccaaacauaugcc

SEQ ID NO: 718856 - RNA, 18 nt, Human
ucagaccaaacauaugcc

SEQ ID NO: 718857 - RNA, 22 nt, Human
ucagcccuucccccagggggcc

SEQ ID NO: 718858 - RNA, 20 nt, Human
ucagcucaagugugccaaaa

SEQ ID NO: 718859 - RNA, 20 nt, Human
ucaggccauuaagguugggg

SEQ ID NO: 718860 - RNA, 18 nt, Human
uccacgccgccgcuugcg

SEQ ID NO: 718861 - RNA, 19 nt, Human
uccccuccgucaccacaaa

SEQ ID NO: 718862 - RNA, 20 nt, Human
uccgucaccacaaacccaga

SEQ ID NO: 718863 - RNA, 22 nt, Human
uccgucaccacaaacccagaaa

SEQ ID NO: 718864 - RNA, 18 nt, Human
uccugcacucacaggccc

SEQ ID NO: 718865 - RNA, 24 nt, Human
uccugccccaggccccugugggca

SEQ ID NO: 718866 - RNA, 21 nt, Human
ucuccaaccagcucccuaccu

SEQ ID NO: 718867 - RNA, 18 nt, Human
ucucuccuccuugcuugg

SEQ ID NO: 718868 - RNA, 18 nt, Human
ucugacagaugggaaggc

SEQ ID NO: 718869 - RNA, 21 nt, Human
ucugccacucuugacucaaga

SEQ ID NO: 718870 - RNA, 18 nt, Human
ucugcccaccucaggcca

SEQ ID NO: 718871 - RNA, 18 nt, Human
ucuguuuuggaggaagac

SEQ ID NO: 718872 - RNA, 22 nt, Human
ugaaacagugaaaaauaaaagc

SEQ ID NO: 718873 - RNA, 21 nt, Human
ugaaacgggaacacagcacau

SEQ ID NO: 718874 - RNA, 25 nt, Human
ugaauaaaccccaaacaaaaagugc

SEQ ID NO: 718875 - RNA, 23 nt, Human
ugaaugggaaagaaaauauuagc

SEQ ID NO: 718876 - RNA, 18 nt, Human
ugacaagaaggaggggag

SEQ ID NO: 718877 - RNA, 20 nt, Human
ugacaagaaggaggggagga

SEQ ID NO: 718878 - RNA, 20 nt, Human
ugacucaagagcucucacac

SEQ ID NO: 718879 - RNA, 21 nt, Human
ugaggaggauccucaggaccg

SEQ ID NO: 718880 - RNA, 24 nt, Human
ugaguaccauucugcaaaggauuc

SEQ ID NO: 718881 - RNA, 19 nt, Human
ugagucagcucaagugugc

SEQ ID NO: 718882 - RNA, 19 nt, Human
ugcaaagggcaguaggggc

SEQ ID NO: 718883 - RNA, 22 nt, Human
ugcaauguacaggauaccaaaa

SEQ ID NO: 718884 - RNA, 23 nt, Human
ugccccaggccccugugggcagc

SEQ ID NO: 718885 - RNA, 22 nt, Human
ugcuccacaccccucugcccac

SEQ ID NO: 718886 - RNA, 24 nt, Human
ugcuuugccccugcauccccuucu

SEQ ID NO: 718887 - RNA, 19 nt, Human
uggaggaagaagcugucac

SEQ ID NO: 718888 - RNA, 18 nt, Human
uggcagggaagggcagaa

SEQ ID NO: 718889 - RNA, 18 nt, Human
uggcagggaagggcagaa

SEQ ID NO: 718890 - RNA, 24 nt, Human
uggcuggaggggacccagaggcuu

SEQ ID NO: 718891 - RNA, 22 nt, Human
ugggaagugggccucaucaaag

SEQ ID NO: 718892 - RNA, 18 nt, Human
ugggacugggagggaaag

SEQ ID NO: 718893 - RNA, 18 nt, Human
ugggagggaaagggcuaa

SEQ ID NO: 718894 - RNA, 21 nt, Human
ugggagggaaagggcuaaggg

SEQ ID NO: 718895 - RNA, 18 nt, Human
ugggcagaggaagcgggc

SEQ ID NO: 718896 - RNA, 25 nt, Human
ugggggaggggaagugugggagugg

SEQ ID NO: 718897 - RNA, 18 nt, Human
ugucacugcuuucuguuu

SEQ ID NO: 718898 - RNA, 18 nt, Human
ugucucucagccaggccc

SEQ ID NO: 718899 - RNA, 22 nt, Human
uguggccgguuucuuccaccug

SEQ ID NO: 718900 - RNA, 22 nt, Human
ugugggcagaggaagcgggcgg

SEQ ID NO: 718901 - RNA, 23 nt, Human
uguuuuggaggaagacaagggca

SEQ ID NO: 718902 - RNA, 21 nt, Human
uuaagcugugaagccugcaug

SEQ ID NO: 718903 - RNA, 19 nt, Human
uuaauuauuuagaaaugca

SEQ ID NO: 718904 - RNA, 24 nt, Human
uuccuugaguuuccagcaaggugg

SEQ ID NO: 718905 - RNA, 18 nt, Human
uucuaggccacccacgcc

SEQ ID NO: 718906 - RNA, 18 nt, Human
uuucauucucuacgcaag

SEQ ID NO: 718907 - RNA, 22 nt, Human
uuugccccugcauccccuucua

SEQ ID NO: 718908 - RNA, 21 nt, Human
uuugggggugaggaguaagga

SEQ ID NO: 718909 - RNA, 19 nt, Human
uuuuucuuugggggugagg

SEQ ID NO: 718910 - RNA, 19 nt, Human
aaaaaaacaaaaggcaaac

SEQ ID NO: 718911 - RNA, 25 nt, Human
aaaaaaacaaaaggcaaacacaaau

SEQ ID NO: 718912 - RNA, 22 nt, Human
aaaaggcaaacacaaaucuaaa

SEQ ID NO: 718913 - RNA, 24 nt, Human
aaacaaaaggcaaacacaaaucua

SEQ ID NO: 718914 - RNA, 25 nt, Human
aaacaaaauguaguucuugccaaag

SEQ ID NO: 718915 - RNA, 21 nt, Human
aaaccagaaaucaaaaaaaaa

SEQ ID NO: 718916 - RNA, 18 nt, Human
aaagacauggauaaagcc

SEQ ID NO: 718917 - RNA, 22 nt, Human
aaagacauggauaaagcccaag

SEQ ID NO: 718918 - RNA, 19 nt, Human
aaagcccaagagagcccag

SEQ ID NO: 718919 - RNA, 24 nt, Human
aaagugcugggauuacaggcguga

SEQ ID NO: 718920 - RNA, 18 nt, Human
aacacuucuccaaaucca

SEQ ID NO: 718921 - RNA, 25 nt, Human
aaccagaaaucaaaaaaaaaagucc

SEQ ID NO: 718922 - RNA, 19 nt, Human
aacugguuuugaaaccccu

SEQ ID NO: 718923 - RNA, 23 nt, Human
aagacauggauaaagcccaagag

SEQ ID NO: 718924 - RNA, 22 nt, Human
aagaugaagagaggaaagagga

SEQ ID NO: 718925 - RNA, 19 nt, Human
aagugcugggauuacaggc

SEQ ID NO: 718926 - RNA, 19 nt, Human
aagugcugggauuacaggc

SEQ ID NO: 718927 - RNA, 26 nt, Human
aagugcugggauuacaggcgugagcu

SEQ ID NO: 718928 - RNA, 27 nt, Human
aauguccacucaucgucacugucagac

SEQ ID NO: 718929 - RNA, 22 nt, Human
acaaaucuaaagacauggauaa

SEQ ID NO: 718930 - RNA, 24 nt, Human
accauauauauguauacacacaca

SEQ ID NO: 718931 - RNA, 22 nt, Human
accgccacugccgccgccgccg

SEQ ID NO: 718932 - RNA, 24 nt, Human
accguguuagucagauuggucuug

SEQ ID NO: 718933 - RNA, 20 nt, Human
acgcggccuuuccgcuucuu

SEQ ID NO: 718934 - RNA, 18 nt, Human
acucugucacccagacug

SEQ ID NO: 718935 - RNA, 25 nt, Human
acucugucacccagacuggagugca

SEQ ID NO: 718936 - RNA, 25 nt, Human
acugccgccgccgccgccgcugcuc

SEQ ID NO: 718937 - RNA, 19 nt, Human
acuggagugcaguggcacg

SEQ ID NO: 718938 - RNA, 19 nt, Human
agagaugggguuucaccgu

SEQ ID NO: 718939 - RNA, 22 nt, Human
agaggaaagaggaucgcaggug

SEQ ID NO: 718940 - RNA, 19 nt, Human
agcugaaaaaaaucugaaa

SEQ ID NO: 718941 - RNA, 19 nt, Human
aggaaguacaaagcagagc

SEQ ID NO: 718942 - RNA, 20 nt, Human
aggcacgcaccaccaugccc

SEQ ID NO: 718943 - RNA, 21 nt, Human
agggauucuccugucucagcc

SEQ ID NO: 718944 - RNA, 19 nt, Human
agggggcuaaacuggggag

SEQ ID NO: 718945 - RNA, 24 nt, Human
aggugauccacccgccuaggccuc

SEQ ID NO: 718946 - RNA, 18 nt, Human
aguagcugggauuacagg

SEQ ID NO: 718947 - RNA, 23 nt, Human
aguagcugggauuacaggcacgc

SEQ ID NO: 718948 - RNA, 20 nt, Human
agugcaguggcacgaucuug

SEQ ID NO: 718949 - RNA, 23 nt, Human
agugcaguggcacgaucuuggcu

SEQ ID NO: 718950 - RNA, 24 nt, Human
agugcaguggcacgaucuuggcuc

SEQ ID NO: 718951 - RNA, 18 nt, Human
agugcugggauuacaggc

SEQ ID NO: 718952 - RNA, 24 nt, Human
aguuuuguaguuuuaguagagaug

SEQ ID NO: 718953 - RNA, 21 nt, Human
auggggcaugcagggucagaa

SEQ ID NO: 718954 - RNA, 20 nt, Human
augggguuucaccguguuag

SEQ ID NO: 718955 - RNA, 24 nt, Human
augggguuucaccguguuagucag

SEQ ID NO: 718956 - RNA, 26 nt, Human
augggguuucaccguguuagucagau

SEQ ID NO: 718957 - RNA, 20 nt, Human
auuuuucuggcuuuuccuuu

SEQ ID NO: 718958 - RNA, 21 nt, Human
caaagcagcaaaacagaauca

SEQ ID NO: 718959 - RNA, 24 nt, Human
caaagugcugggauuacaggcgug

SEQ ID NO: 718960 - RNA, 19 nt, Human
caacacuucuccaaaucca

SEQ ID NO: 718961 - RNA, 21 nt, Human
caacacuucuccaaauccaaa

SEQ ID NO: 718962 - RNA, 21 nt, Human
caagcagucaguuuaucucuu

SEQ ID NO: 718963 - RNA, 22 nt, Human
caagggauucuccugucucagc

SEQ ID NO: 718964 - RNA, 26 nt, Human
cacacaaaggcgaccgcgcaugcgcg

SEQ ID NO: 718965 - RNA, 20 nt, Human
cacacacacaaaacugcacc

SEQ ID NO: 718966 - RNA, 24 nt, Human
cacagcuaccacaaagcuguguua

SEQ ID NO: 718967 - RNA, 21 nt, Human
caccacaaccuccgccuccca

SEQ ID NO: 718968 - RNA, 22 nt, Human
caccacaaccuccgccucccag

SEQ ID NO: 718969 - RNA, 23 nt, Human
caccacuccuuugcccaagugaa

SEQ ID NO: 718970 - RNA, 23 nt, Human
cacccgccuaggccucccaaagu

SEQ ID NO: 718971 - RNA, 24 nt, Human
caccguguuagucagauuggucuu

SEQ ID NO: 718972 - RNA, 22 nt, Human
cacucugucacccagacuggag

SEQ ID NO: 718973 - RNA, 23 nt, Human
cacucugucacccagacuggagu

SEQ ID NO: 718974 - RNA, 18 nt, Human
cacuggguggggcccugg

SEQ ID NO: 718975 - RNA, 23 nt, Human
cacuuggagcuuuacaccugaga

SEQ ID NO: 718976 - RNA, 19 nt, Human
cagcagucaggccuguuua

SEQ ID NO: 718977 - RNA, 22 nt, Human
cagcccaaagaggcuaaaucaa

SEQ ID NO: 718978 - RNA, 19 nt, Human
caggugcccaauccccgcu

SEQ ID NO: 718979 - RNA, 19 nt, Human
cagguucaagggauucucc

SEQ ID NO: 718980 - RNA, 19 nt, Human
caguggcacgaucuuggcu

SEQ ID NO: 718981 - RNA, 21 nt, Human
caucaccacuccuuugcccaa

SEQ ID NO: 718982 - RNA, 22 nt, Human
ccaaagcagcaaaacagaauca

SEQ ID NO: 718983 - RNA, 20 nt, Human
ccaaagugcugggauuacag

SEQ ID NO: 718984 - RNA, 22 nt, Human
ccaaagugcugggauuacaggc

SEQ ID NO: 718985 - RNA, 22 nt, Human
ccaaagugcugggauuacaggc

SEQ ID NO: 718986 - RNA, 24 nt, Human
ccaaagugcugggauuacaggcgu

SEQ ID NO: 718987 - RNA, 21 nt, Human
ccaaauccaaaugauacuaaa

SEQ ID NO: 718988 - RNA, 19 nt, Human
ccaagagagcccaggccca

SEQ ID NO: 718989 - RNA, 23 nt, Human
ccacaaccuccgccucccagguu

SEQ ID NO: 718990 - RNA, 24 nt, Human
ccacaaccuccgccucccagguuc

SEQ ID NO: 718991 - RNA, 19 nt, Human
ccacacacuuacacacaca

SEQ ID NO: 718992 - RNA, 23 nt, Human
ccacugccgccgccgccgccgcu

SEQ ID NO: 718993 - RNA, 24 nt, Human
ccacugccgccgccgccgccgcug

SEQ ID NO: 718994 - RNA, 22 nt, Human
ccagcuccaugguaauacugaa

SEQ ID NO: 718995 - RNA, 22 nt, Human
ccaggcccacacuggguggggc

SEQ ID NO: 718996 - RNA, 24 nt, Human
ccagggacaagagcuccugaucca

SEQ ID NO: 718997 - RNA, 23 nt, Human
ccaugggaagagcaagacauuca

SEQ ID NO: 718998 - RNA, 19 nt, Human
cccaauccccgcuccccca

SEQ ID NO: 718999 - RNA, 19 nt, Human
cccacacaaaggcgaccgc

SEQ ID NO: 719000 - RNA, 20 nt, Human
cccagcagcuccaggacucu

SEQ ID NO: 719001 - RNA, 24 nt, Human
ccccgaguagcugggauuacaggc

SEQ ID NO: 719002 - RNA, 22 nt, Human
ccccgcuccccccacaagguca

SEQ ID NO: 719003 - RNA, 23 nt, Human
cccgaguagcugggauuacaggc

SEQ ID NO: 719004 - RNA, 24 nt, Human
cccgaguagcugggauuacaggca

SEQ ID NO: 719005 - RNA, 19 nt, Human
cccggacuccccucuugcc

SEQ ID NO: 719006 - RNA, 23 nt, Human
ccgaguagcugggauuacaggca

SEQ ID NO: 719007 - RNA, 23 nt, Human
ccgccgccgccgccgcugcucga

SEQ ID NO: 719008 - RNA, 20 nt, Human
ccgcgcaugcgcgcuccgcu

SEQ ID NO: 719009 - RNA, 24 nt, Human
ccucccagguucaagggauucucc

SEQ ID NO: 719010 - RNA, 18 nt, Human
ccucccugguaccuggcc

SEQ ID NO: 719011 - RNA, 22 nt, Human
ccugaccucaggugauccaccc

SEQ ID NO: 719012 - RNA, 23 nt, Human
ccugaccucaggugauccacccg

SEQ ID NO: 719013 - RNA, 22 nt, Human
cgcccggacuccccucuugccc

SEQ ID NO: 719014 - RNA, 21 nt, Human
cgccgccgccgccgcugcucg

SEQ ID NO: 719015 - RNA, 25 nt, Human
cgcgguuaaaaaaacaaaaggcaaa

SEQ ID NO: 719016 - RNA, 18 nt, Human
cuaaacccagaaguuacc

SEQ ID NO: 719017 - RNA, 25 nt, Human
cuacagcagucaggccuguuuagua

SEQ ID NO: 719018 - RNA, 21 nt, Human
cuaggccucccaaagugcugg

SEQ ID NO: 719019 - RNA, 24 nt, Human
cucaccacaaccuccgccucccag

SEQ ID NO: 719020 - RNA, 24 nt, Human
cucagccccccgaguagcugggau

SEQ ID NO: 719021 - RNA, 22 nt, Human
cuccaaaguugggaaaggaugg

SEQ ID NO: 719022 - RNA, 23 nt, Human
cuccagcccaaagaggcuaaauc

SEQ ID NO: 719023 - RNA, 22 nt, Human
cuccugucucagccccccgagu

SEQ ID NO: 719024 - RNA, 22 nt, Human
cucgucgcugccgcuguccucu

SEQ ID NO: 719025 - RNA, 23 nt, Human
cugaaaaaaaucugaaacagcua

SEQ ID NO: 719026 - RNA, 23 nt, Human
cugcacaauauauaugcugacca

SEQ ID NO: 719027 - RNA, 19 nt, Human
cugccaggacacagccugc

SEQ ID NO: 719028 - RNA, 24 nt, Human
cugcuggcuucgcccuagcugcac

SEQ ID NO: 719029 - RNA, 20 nt, Human
cugguuuugaaaccccuucu

SEQ ID NO: 719030 - RNA, 19 nt, Human
cuguacccaugggaagagc

SEQ ID NO: 719031 - RNA, 20 nt, Human
cuguagaggagaccgccugg

SEQ ID NO: 719032 - RNA, 24 nt, Human
cuguccucuguguccgagucgauc

SEQ ID NO: 719033 - RNA, 23 nt, Human
cugucucagccccccgaguagcu

SEQ ID NO: 719034 - RNA, 26 nt, Human
cuuacacacacacacauacacacucu

SEQ ID NO: 719035 - RNA, 24 nt, Human
cuucuuauuuuuauugcucccaaa

SEQ ID NO: 719036 - RNA, 23 nt, Human
cuugcccgccugccagugggacc

SEQ ID NO: 719037 - RNA, 22 nt, Human
cuuggagcuuuacaccugagag

SEQ ID NO: 719038 - RNA, 18 nt, Human
gaaaggaugggaagagua

SEQ ID NO: 719039 - RNA, 22 nt, Human
gaccucaggugauccacccgcc

SEQ ID NO: 719040 - RNA, 21 nt, Human
gagaaagaugaagagaggaaa

SEQ ID NO: 719041 - RNA, 24 nt, Human
gagaugggguuucaccguguuagu

SEQ ID NO: 719042 - RNA, 24 nt, Human
gauuacaggcacgcaccaccaugc

SEQ ID NO: 719043 - RNA, 18 nt, Human
gauuacaggcgugagcua

SEQ ID NO: 719044 - RNA, 19 nt, Human
gauuacaggcgugagcuac

SEQ ID NO: 719045 - RNA, 23 nt, Human
gauuacaggcgugagcuacugca

SEQ ID NO: 719046 - RNA, 25 nt, Human
gauucccagcuccaugguaauacug

SEQ ID NO: 719047 - RNA, 24 nt, Human
gauuggucuugaacuccugaccuc

SEQ ID NO: 719048 - RNA, 18 nt, Human
gcaaaacagaaucaccag

SEQ ID NO: 719049 - RNA, 20 nt, Human
gcaccaccaugcccggcuaa

SEQ ID NO: 719050 - RNA, 21 nt, Human
gccagggacaagagcuccuga

SEQ ID NO: 719051 - RNA, 22 nt, Human
gcccugggggaggggaggcugg

SEQ ID NO: 719052 - RNA, 20 nt, Human
gccgccgccgccgccgcugc

SEQ ID NO: 719053 - RNA, 27 nt, Human
gcucucaaauuagacccccccccccca

SEQ ID NO: 719054 - RNA, 24 nt, Human
ggauaaagcccaagagagcccagg

SEQ ID NO: 719055 - RNA, 23 nt, Human
gggccaaggcagucuguagagga

SEQ ID NO: 719056 - RNA, 21 nt, Human
gggcccugggggaggggaggc

SEQ ID NO: 719057 - RNA, 19 nt, Human
ggggaggggaggcuggugg

SEQ ID NO: 719058 - RNA, 22 nt, Human
gggguuucaccguguuagucag

SEQ ID NO: 719059 - RNA, 18 nt, Human
ggguggggcccuggggga

SEQ ID NO: 719060 - RNA, 22 nt, Human
ggguggggcccugggggagggg

SEQ ID NO: 719061 - RNA, 19 nt, Human
ggucuugaacuccugaccu

SEQ ID NO: 719062 - RNA, 18 nt, Human
gguggucccccggcuccc

SEQ ID NO: 719063 - RNA, 21 nt, Human
guacccaugggaagagcaaga

SEQ ID NO: 719064 - RNA, 18 nt, Human
guagcugggauuacaggc

SEQ ID NO: 719065 - RNA, 24 nt, Human
gugauccacccgccuaggccuccc

SEQ ID NO: 719066 - RNA, 20 nt, Human
guucucgucgcugccgcugu

SEQ ID NO: 719067 - RNA, 26 nt, Human
guucucgucgcugccgcuguccucug

SEQ ID NO: 719068 - RNA, 23 nt, Human
uaaaaaaaugauaaaaaaaucca

SEQ ID NO: 719069 - RNA, 20 nt, Human
uaaaaccagaaaucaaaaaa

SEQ ID NO: 719070 - RNA, 24 nt, Human
uaaguuuuguaguuuuaguagaga

SEQ ID NO: 719071 - RNA, 18 nt, Human
uacaaucauaauacuccu

SEQ ID NO: 719072 - RNA, 22 nt, Human
uacacacacacacauacacagg

SEQ ID NO: 719073 - RNA, 22 nt, Human
uacacagccauaauguaaucaa

SEQ ID NO: 719074 - RNA, 20 nt, Human
uacacagcuacagcagucag

SEQ ID NO: 719075 - RNA, 19 nt, Human
uacaggcgugagcuacugc

SEQ ID NO: 719076 - RNA, 18 nt, Human
uagaccccccccccccac

SEQ ID NO: 719077 - RNA, 19 nt, Human
uagaccccccccccccaca

SEQ ID NO: 719078 - RNA, 21 nt, Human
uaguagagaugggguuucacc

SEQ ID NO: 719079 - RNA, 24 nt, Human
uaguagagaugggguuucaccgug

SEQ ID NO: 719080 - RNA, 26 nt, Human
uaguagagaugggguuucaccguguu

SEQ ID NO: 719081 - RNA, 18 nt, Human
uagucagauuggucuuga

SEQ ID NO: 719082 - RNA, 24 nt, Human
uagucagauuggucuugaacuccu

SEQ ID NO: 719083 - RNA, 31 nt, Human
uauguauacacacacacaaaacugcacaugg

SEQ ID NO: 719084 - RNA, 27 nt, Human
uauuacacagccauaauguaaucaaca

SEQ ID NO: 719085 - RNA, 24 nt, Human
ucacauuuaaugaguuucuuucuu

SEQ ID NO: 719086 - RNA, 24 nt, Human
ucaccacaaccuccgccucccagg

SEQ ID NO: 719087 - RNA, 25 nt, Human
ucaccacaaccuccgccucccaggu

SEQ ID NO: 719088 - RNA, 27 nt, Human
ucaccacaaccuccgccucccagguuc

SEQ ID NO: 719089 - RNA, 24 nt, Human
ucaccguguuagucagauuggucu

SEQ ID NO: 719090 - RNA, 20 nt, Human
ucacugcgcuuucgcuuugc

SEQ ID NO: 719091 - RNA, 22 nt, Human
uccacacacuuacacacacaca

SEQ ID NO: 719092 - RNA, 24 nt, Human
uccacacacuuacacacacacaca

SEQ ID NO: 719093 - RNA, 24 nt, Human
ucccaaagugcugggauuacaggc

SEQ ID NO: 719094 - RNA, 21 nt, Human
ucccagguucaagggauucuc

SEQ ID NO: 719095 - RNA, 24 nt, Human
ucccagguucaagggauucuccug

SEQ ID NO: 719096 - RNA, 22 nt, Human
uccccgcuccccccacaagguc

SEQ ID NO: 719097 - RNA, 25 nt, Human
ucccugguaccuggccaugggcuuc

SEQ ID NO: 719098 - RNA, 20 nt, Human
uccuuguacgaaagcagggu

SEQ ID NO: 719099 - RNA, 22 nt, Human
ucgaucacgacgcggccuuucc

SEQ ID NO: 719100 - RNA, 21 nt, Human
ucgcaggugcccaauccccgc

SEQ ID NO: 719101 - RNA, 22 nt, Human
ucgcuuugccagggacaagagc

SEQ ID NO: 719102 - RNA, 22 nt, Human
ucuaaagacauggauaaagccc

SEQ ID NO: 719103 - RNA, 24 nt, Human
ucucacucugucacccagacugga

SEQ ID NO: 719104 - RNA, 26 nt, Human
ucucacucugucacccagacuggagu

SEQ ID NO: 719105 - RNA, 27 nt, Human
ucucacucugucacccagacuggagug

SEQ ID NO: 719106 - RNA, 19 nt, Human
ucuccacauucauauucag

SEQ ID NO: 719107 - RNA, 21 nt, Human
ucuccgagucugacgaggcug

SEQ ID NO: 719108 - RNA, 24 nt, Human
ucugucacccagacuggagugcag

SEQ ID NO: 719109 - RNA, 23 nt, Human
ucuugaacuccugaccucaggug

SEQ ID NO: 719110 - RNA, 20 nt, Human
ucuugguauauauagucagc

SEQ ID NO: 719111 - RNA, 22 nt, Human
ugaaaaaaaucugaaacagcua

SEQ ID NO: 719112 - RNA, 23 nt, Human
ugaaagauuuguuaaaugccacu

SEQ ID NO: 719113 - RNA, 21 nt, Human
ugaccucaggugauccacccg

SEQ ID NO: 719114 - RNA, 24 nt, Human
ugaccucaggugauccacccgccu

SEQ ID NO: 719115 - RNA, 27 nt, Human
ugacucacaggcggcuccuucuccucu

SEQ ID NO: 719116 - RNA, 25 nt, Human
ugacuccagcgaauuaucuggauuc

SEQ ID NO: 719117 - RNA, 22 nt, Human
ugaggcggagucucacucuguc

SEQ ID NO: 719118 - RNA, 20 nt, Human
ugauaaaaaaauccacacac

SEQ ID NO: 719119 - RNA, 24 nt, Human
ugcaggucagggggcuaaacuggg

SEQ ID NO: 719120 - RNA, 22 nt, Human
ugcaguggcacgaucuuggcuc

SEQ ID NO: 719121 - RNA, 19 nt, Human
ugccaggacacagccugca

SEQ ID NO: 719122 - RNA, 18 nt, Human
ugccccaggggcuccagc

SEQ ID NO: 719123 - RNA, 21 nt, Human
ugccgaauguucaaugggugg

SEQ ID NO: 719124 - RNA, 22 nt, Human
ugcucaaguacagcugaaaaaa

SEQ ID NO: 719125 - RNA, 24 nt, Human
ugcugaccauauauauguauacac

SEQ ID NO: 719126 - RNA, 22 nt, Human
ugcuggcuucgcccuagcugca

SEQ ID NO: 719127 - RNA, 23 nt, Human
ugcuggcuucgcccuagcugcac

SEQ ID NO: 719128 - RNA, 20 nt, Human
ugcugggauuacaggcguga

SEQ ID NO: 719129 - RNA, 23 nt, Human
uggagugcaguggcacgaucuug

SEQ ID NO: 719130 - RNA, 24 nt, Human
uggagugcaguggcacgaucuugg

SEQ ID NO: 719131 - RNA, 21 nt, Human
uggauaaagcccaagagagcc

SEQ ID NO: 719132 - RNA, 24 nt, Human
uggcacgaucuuggcucaccacaa

SEQ ID NO: 719133 - RNA, 24 nt, Human
ugggaagagcaagacauucacugc

SEQ ID NO: 719134 - RNA, 25 nt, Human
ugggaagagcaagacauucacugcc

SEQ ID NO: 719135 - RNA, 22 nt, Human
ugggaauggggaaguuacacag

SEQ ID NO: 719136 - RNA, 21 nt, Human
ugggauuacaggcacgcacca

SEQ ID NO: 719137 - RNA, 24 nt, Human
ugggauuacaggcacgcaccacca

SEQ ID NO: 719138 - RNA, 18 nt, Human
ugggauuacaggcgugag

SEQ ID NO: 719139 - RNA, 19 nt, Human
ugggauuacaggcgugagc

SEQ ID NO: 719140 - RNA, 22 nt, Human
ugggauuacaggcgugagcuac

SEQ ID NO: 719141 - RNA, 22 nt, Human
ugggauuacaggcgugagcuac

SEQ ID NO: 719142 - RNA, 24 nt, Human
ugggauuacaggcgugagcuacug

SEQ ID NO: 719143 - RNA, 24 nt, Human
ugggauuacaggcgugagcuacug

SEQ ID NO: 719144 - RNA, 25 nt, Human
ugggauuacaggcgugagcuacugc

SEQ ID NO: 719145 - RNA, 21 nt, Human
uggggcccugggggaggggag

SEQ ID NO: 719146 - RNA, 20 nt, Human
ugggggaggggaggcuggug

SEQ ID NO: 719147 - RNA, 19 nt, Human
ugggguuucaccguguuag

SEQ ID NO: 719148 - RNA, 18 nt, Human
ugguaccuggccaugggc

SEQ ID NO: 719149 - RNA, 20 nt, Human
uggugggagauggugugcag

SEQ ID NO: 719150 - RNA, 20 nt, Human
uguagaggagaccgccuggu

SEQ ID NO: 719151 - RNA, 27 nt, Human
uguauacacacacacaaaacugcacag

SEQ ID NO: 719152 - RNA, 24 nt, Human
ugucucagccccccgaguagcugg

SEQ ID NO: 719153 - RNA, 21 nt, Human
uguuugcucuccacauucaua

SEQ ID NO: 719154 - RNA, 20 nt, Human
uuaaaaaaacaaaaggcaaa

SEQ ID NO: 719155 - RNA, 22 nt, Human
uuaaaaccagaaaucaaaaaaa

SEQ ID NO: 719156 - RNA, 24 nt, Human
uuaaauacaacuuacaaguccaug

SEQ ID NO: 719157 - RNA, 21 nt, Human
uuacacuuggagcuuuacacc

SEQ ID NO: 719158 - RNA, 21 nt, Human
uuaccaaguucauuuuuaugu

SEQ ID NO: 719159 - RNA, 18 nt, Human
uuaguagagaugggguuu

SEQ ID NO: 719160 - RNA, 22 nt, Human
uuaguagagaugggguuucacc

SEQ ID NO: 719161 - RNA, 24 nt, Human
uuaguagagaugggguuucaccgu

SEQ ID NO: 719162 - RNA, 21 nt, Human
uuuagauuagucucucgugga

SEQ ID NO: 719163 - RNA, 23 nt, Human
uuuuaguagagaugggguuucac

SEQ ID NO: 719164 - RNA, 18 nt, Human
uuuuguaguuuuaguaga

SEQ ID NO: 719165 - RNA, 19 nt, Human
uuuuguaguuuuaguagag

SEQ ID NO: 719166 - RNA, 24 nt, Human
aaacaggaucuacucaccagcaac

SEQ ID NO: 719167 - RNA, 19 nt, Human
aacagagcccuccaacucg

SEQ ID NO: 719168 - RNA, 22 nt, Human
aacaggcgagugugaagccaaa

SEQ ID NO: 719169 - RNA, 24 nt, Human
aaccgcgcgcccacacucagcccc

SEQ ID NO: 719170 - RNA, 18 nt, Human
aacuccaagaccuuccuc

SEQ ID NO: 719171 - RNA, 24 nt, Human
aacucgccccuuccagcugaggug

SEQ ID NO: 719172 - RNA, 22 nt, Human
aagaacacagcaucccugccuc

SEQ ID NO: 719173 - RNA, 19 nt, Human
aaggccucuucggggccuc

SEQ ID NO: 719174 - RNA, 18 nt, Human
aaguguagccucccaggc

SEQ ID NO: 719175 - RNA, 18 nt, Human
acacagguggcuaaguac

SEQ ID NO: 719176 - RNA, 22 nt, Human
acaccuaagccucccgaauaca

SEQ ID NO: 719177 - RNA, 22 nt, Human
acacugccccaggcggaaggcc

SEQ ID NO: 719178 - RNA, 24 nt, Human
acaggaucuacucaccagcaacaa

SEQ ID NO: 719179 - RNA, 23 nt, Human
acaggcgagugugaagccaaagg

SEQ ID NO: 719180 - RNA, 23 nt, Human
accuaagccucccgaauacauca

SEQ ID NO: 719181 - RNA, 18 nt, Human
acuagauuagacccagga

SEQ ID NO: 719182 - RNA, 22 nt, Human
acucaucgcgguccucuccggg

SEQ ID NO: 719183 - RNA, 22 nt, Human
agaauugcacaccuaagccucc

SEQ ID NO: 719184 - RNA, 21 nt, Human
agagcccuccaacucgcccuu

SEQ ID NO: 719185 - RNA, 22 nt, Human
agcaaacaauaaaaccuuccug

SEQ ID NO: 719186 - RNA, 19 nt, Human
aggaucuacucaccagcaa

SEQ ID NO: 719187 - RNA, 22 nt, Human
aggcugaauaugcagcuuguca

SEQ ID NO: 719188 - RNA, 21 nt, Human
aggggggcaugaacugugucu

SEQ ID NO: 719189 - RNA, 21 nt, Human
agggucaaaaauucaaaaacu

SEQ ID NO: 719190 - RNA, 21 nt, Human
auaaaacaaggcugucccccu

SEQ ID NO: 719191 - RNA, 23 nt, Human
auauacagcacuucccugugacu

SEQ ID NO: 719192 - RNA, 18 nt, Human
caaagcaacacagguggc

SEQ ID NO: 719193 - RNA, 23 nt, Human
caaagccaauaaauaaaaugggu

SEQ ID NO: 719194 - RNA, 24 nt, Human
caaagccaauaaauaaaaugggug

SEQ ID NO: 719195 - RNA, 23 nt, Human
caagcagccucaugacaucuucc

SEQ ID NO: 719196 - RNA, 22 nt, Human
caaucccaacaucacaaaagga

SEQ ID NO: 719197 - RNA, 18 nt, Human
cacacucagccccgaccu

SEQ ID NO: 719198 - RNA, 19 nt, Human
cacaguuuuuuuccuguuc

SEQ ID NO: 719199 - RNA, 23 nt, Human
caccccauugccuucucaucagu

SEQ ID NO: 719200 - RNA, 24 nt, Human
caccccauugccuucucaucaguc

SEQ ID NO: 719201 - RNA, 19 nt, Human
cacugaaggagcuuaaugg

SEQ ID NO: 719202 - RNA, 22 nt, Human
cagaaagaacacagcaucccug

SEQ ID NO: 719203 - RNA, 22 nt, Human
cagagcccuccaacucgccccu

SEQ ID NO: 719204 - RNA, 24 nt, Human
cagcaacacaugagcaagaaguuc

SEQ ID NO: 719205 - RNA, 20 nt, Human
caggauucuggcaaacaauc

SEQ ID NO: 719206 - RNA, 23 nt, Human
caugcaacugggacacacagacc

SEQ ID NO: 719207 - RNA, 18 nt, Human
ccaggcaagcagccucau

SEQ ID NO: 719208 - RNA, 21 nt, Human
cccaacaucacaaaaggaaca

SEQ ID NO: 719209 - RNA, 23 nt, Human
cccacacucagccccgaccugaa

SEQ ID NO: 719210 - RNA, 24 nt, Human
ccccauugccuucucaucagucua

SEQ ID NO: 719211 - RNA, 19 nt, Human
cccucaaaguccuacaggc

SEQ ID NO: 719212 - RNA, 20 nt, Human
cccuccuucuucuucuggaa

SEQ ID NO: 719213 - RNA, 23 nt, Human
ccgccguaaaccugggcgacugc

SEQ ID NO: 719214 - RNA, 18 nt, Human
ccgcgcgcccacacucag

SEQ ID NO: 719215 - RNA, 21 nt, Human
ccuuccagcugagguguggcu

SEQ ID NO: 719216 - RNA, 22 nt, Human
ccuugaaaaauuuucuucccuc

SEQ ID NO: 719217 - RNA, 22 nt, Human
cgagaauaggaucuuagcccuc

SEQ ID NO: 719218 - RNA, 21 nt, Human
cggacacuuacacacgcagcg

SEQ ID NO: 719219 - RNA, 20 nt, Human
cuagagcuugugugcuggug

SEQ ID NO: 719220 - RNA, 21 nt, Human
cuccagcaauucccaguugcc

SEQ ID NO: 719221 - RNA, 21 nt, Human
cuccgcagccgggccugugug

SEQ ID NO: 719222 - RNA, 24 nt, Human
cuccuuggaaaaacugaggcugaa

SEQ ID NO: 719223 - RNA, 25 nt, Human
cucuagggcaggggguugggagccc

SEQ ID NO: 719224 - RNA, 21 nt, Human
cugcuacaaauggagcagaag

SEQ ID NO: 719225 - RNA, 19 nt, Human
cuuccugacuggucucugg

SEQ ID NO: 719226 - RNA, 23 nt, Human
cuucggggccucggggcgggcgc

SEQ ID NO: 719227 - RNA, 24 nt, Human
cuugaaaaauuuucuucccuccuu

SEQ ID NO: 719228 - RNA, 21 nt, Human
gaaccugcuagccaaacuugg

SEQ ID NO: 719229 - RNA, 21 nt, Human
gagcccuccaacucgccccuu

SEQ ID NO: 719230 - RNA, 19 nt, Human
gagcuugugugcuggugga

SEQ ID NO: 719231 - RNA, 22 nt, Human
gcaacaaucccaacaucacaaa

SEQ ID NO: 719232 - RNA, 22 nt, Human
gcagcagauucaaagcaacaca

SEQ ID NO: 719233 - RNA, 24 nt, Human
gcagcagauucaaagcaacacagg

SEQ ID NO: 719234 - RNA, 18 nt, Human
gcagcggccggcgaagac

SEQ ID NO: 719235 - RNA, 20 nt, Human
gcccacacucagccccgacc

SEQ ID NO: 719236 - RNA, 20 nt, Human
gcccuggggcccacggacac

SEQ ID NO: 719237 - RNA, 18 nt, Human
gccgccguaaaccugggc

SEQ ID NO: 719238 - RNA, 24 nt, Human
gccguaaaccugggcgaccggcgc

SEQ ID NO: 719239 - RNA, 21 nt, Human
gccguaaaccugggcgacugc

SEQ ID NO: 719240 - RNA, 19 nt, Human
gcugagguguggcuuugga

SEQ ID NO: 719241 - RNA, 20 nt, Human
ggaauuuauuuuccauuuag

SEQ ID NO: 719242 - RNA, 20 nt, Human
ggaggauggcaaaaggagaa

SEQ ID NO: 719243 - RNA, 19 nt, Human
ggcaggggguugggagcaa

SEQ ID NO: 719244 - RNA, 21 nt, Human
gggcaggggguugggagcaaa

SEQ ID NO: 719245 - RNA, 24 nt, Human
guagucuuauuucaaauaucaaaa

SEQ ID NO: 719246 - RNA, 21 nt, Human
guccucuccgggagccucggc

SEQ ID NO: 719247 - RNA, 21 nt, Human
gugcacagggccaggauucug

SEQ ID NO: 719248 - RNA, 20 nt, Human
guggcuaaguacacaugagg

SEQ ID NO: 719249 - RNA, 19 nt, Human
uaacuccaagaccuuccuc

SEQ ID NO: 719250 - RNA, 23 nt, Human
uaagcacaugugugcacagggcc

SEQ ID NO: 719251 - RNA, 23 nt, Human
uagccucccaggcaagcagccuc

SEQ ID NO: 719252 - RNA, 25 nt, Human
uaguaagaaaagggaaaguagucuu

SEQ ID NO: 719253 - RNA, 24 nt, Human
uaugugaugaaaaaguauagcuuu

SEQ ID NO: 719254 - RNA, 19 nt, Human
ucaaagcaacacagguggc

SEQ ID NO: 719255 - RNA, 20 nt, Human
ucaaagucuagggcuggaga

SEQ ID NO: 719256 - RNA, 19 nt, Human
ucagcacaggcccaauucu

SEQ ID NO: 719257 - RNA, 18 nt, Human
uccaggcccucaaagucc

SEQ ID NO: 719258 - RNA, 22 nt, Human
uccauucuccuuggaaaaacug

SEQ ID NO: 719259 - RNA, 18 nt, Human
ucuaauacauuggcugga

SEQ ID NO: 719260 - RNA, 21 nt, Human
ucuccagcaauucccaguugc

SEQ ID NO: 719261 - RNA, 23 nt, Human
ucuuccacaaaccacuuuaauug

SEQ ID NO: 719262 - RNA, 23 nt, Human
ucuucccugccuuuuaucacccu

SEQ ID NO: 719263 - RNA, 22 nt, Human
ugaagccaaagggcucccagug

SEQ ID NO: 719264 - RNA, 18 nt, Human
ugagaagguuguuuucuc

SEQ ID NO: 719265 - RNA, 18 nt, Human
ugaggggaagguaugggg

SEQ ID NO: 719266 - RNA, 21 nt, Human
ugcagucugacaaaagaccuu

SEQ ID NO: 719267 - RNA, 22 nt, Human
ugccuuugggcaagaauugcac

SEQ ID NO: 719268 - RNA, 21 nt, Human
ugcuaguccuacucuuugugc

SEQ ID NO: 719269 - RNA, 20 nt, Human
ugcucaucgagaauaggauc

SEQ ID NO: 719270 - RNA, 20 nt, Human
ugcuucaagaacuuuggagc

SEQ ID NO: 719271 - RNA, 19 nt, Human
uggagccauaaagucacug

SEQ ID NO: 719272 - RNA, 23 nt, Human
uggcaauauccauuauuucccuc

SEQ ID NO: 719273 - RNA, 24 nt, Human
uggcauaaaacaaggcuguccccc

SEQ ID NO: 719274 - RNA, 22 nt, Human
uggcuggacuccugcagguacu

SEQ ID NO: 719275 - RNA, 27 nt, Human
uggcuuuggaggaaaacucuguggccc

SEQ ID NO: 719276 - RNA, 23 nt, Human
ugggaaacuagauuagacccagg

SEQ ID NO: 719277 - RNA, 28 nt, Human
ugggaguaucuuuuccagcuaccugugg

SEQ ID NO: 719278 - RNA, 23 nt, Human
uggggagagaaaaguggcauaaa

SEQ ID NO: 719279 - RNA, 23 nt, Human
ugggugcuguucagggaaccggg

SEQ ID NO: 719280 - RNA, 23 nt, Human
ugucugauguacugauuuuguga

SEQ ID NO: 719281 - RNA, 19 nt, Human
uguugggaaacagcaacac

SEQ ID NO: 719282 - RNA, 24 nt, Human
uuaaaggacugauuauaaccguaa

SEQ ID NO: 719283 - RNA, 21 nt, Human
uucuggcaaacaaucucaggg

SEQ ID NO: 719284 - RNA, 21 nt, Human
uucuuccacaaaccacuuuaa

SEQ ID NO: 719285 - RNA, 24 nt, Human
uugaaaaauuuucuucccuccuuc

SEQ ID NO: 719286 - RNA, 21 nt, Human
uuggcagucagcuuugaaguc

SEQ ID NO: 719287 - RNA, 26 nt, Human
uuuggcagucagcuuugaagucuucu

SEQ ID NO: 719288 - RNA, 21 nt, Human
uuuuaucacccugucagcugg

SEQ ID NO: 719289 - RNA, 21 nt, Human
uuuugugccacauuugagcca

SEQ ID NO: 719290 - RNA, 23 nt, Human
aaaaaaaaaauccaagauuugaa

SEQ ID NO: 719291 - RNA, 24 nt, Human
aaaaaaaauccaaaccagaaauac

SEQ ID NO: 719292 - RNA, 24 nt, Human
aaaaauccaaaccagaaauacacc

SEQ ID NO: 719293 - RNA, 26 nt, Human
aaacaaagaaggaaaaaaaaauccaa

SEQ ID NO: 719294 - RNA, 21 nt, Human
aaagagaaucucuuagggaaa

SEQ ID NO: 719295 - RNA, 21 nt, Human
aacccacaaaaaaacucaucc

SEQ ID NO: 719296 - RNA, 22 nt, Human
aacccacaaaaaaacucauccc

SEQ ID NO: 719297 - RNA, 19 nt, Human
aaccucacugaagcucugg

SEQ ID NO: 719298 - RNA, 21 nt, Human
aagaaaaagcaacccacaaaa

SEQ ID NO: 719299 - RNA, 22 nt, Human
aagcaacccacaaaaaaacuca

SEQ ID NO: 719300 - RNA, 23 nt, Human
acaaaaaaacucaucccccacag

SEQ ID NO: 719301 - RNA, 21 nt, Human
acaauccgaccaaaaaaaggc

SEQ ID NO: 719302 - RNA, 24 nt, Human
acagacaaguggaugcuuggcuug

SEQ ID NO: 719303 - RNA, 21 nt, Human
acaggcccucccgccccccac

SEQ ID NO: 719304 - RNA, 20 nt, Human
acaguucacugcaagucucc

SEQ ID NO: 719305 - RNA, 19 nt, Human
acccuagcggccuuggcca

SEQ ID NO: 719306 - RNA, 21 nt, Human
acgcagccccaggauccagga

SEQ ID NO: 719307 - RNA, 21 nt, Human
acugcaagucucuucucuucu

SEQ ID NO: 719308 - RNA, 24 nt, Human
agaagagggaaagagaggucuggc

SEQ ID NO: 719309 - RNA, 18 nt, Human
agaccaaaaguagaaugg

SEQ ID NO: 719310 - RNA, 20 nt, Human
agagggcagggagagaaugc

SEQ ID NO: 719311 - RNA, 22 nt, Human
agagggcagggagagaaugccu

SEQ ID NO: 719312 - RNA, 18 nt, Human
agcaguaaagaccacggc

SEQ ID NO: 719313 - RNA, 18 nt, Human
agcggccuuggccauccc

SEQ ID NO: 719314 - RNA, 24 nt, Human
aggaaaaaaaaauccaaaccagaa

SEQ ID NO: 719315 - RNA, 21 nt, Human
aggaggcuggggagaagaggg

SEQ ID NO: 719316 - RNA, 18 nt, Human
aggauccaggaacacugu

SEQ ID NO: 719317 - RNA, 23 nt, Human
aggcauuuuuuuaauuaaaaaua

SEQ ID NO: 719318 - RNA, 24 nt, Human
aggcucggaaaccucacugaagcu

SEQ ID NO: 719319 - RNA, 24 nt, Human
aggggcagggccagggagguggau

SEQ ID NO: 719320 - RNA, 20 nt, Human
agugcaggggcagggccagg

SEQ ID NO: 719321 - RNA, 24 nt, Human
aguguuuuggguguccccaaaagg

SEQ ID NO: 719322 - RNA, 20 nt, Human
auccugagggguaaggaccc

SEQ ID NO: 719323 - RNA, 18 nt, Human
auggggcuggcuaaagaa

SEQ ID NO: 719324 - RNA, 18 nt, Human
caaaagacuccaauaucg

SEQ ID NO: 719325 - RNA, 20 nt, Human
caacagcccugaggaacuga

SEQ ID NO: 719326 - RNA, 23 nt, Human
caacccacaaaaaaacucauccc

SEQ ID NO: 719327 - RNA, 24 nt, Human
cacaagccugagugcaggggcagg

SEQ ID NO: 719328 - RNA, 26 nt, Human
cacgcagccccaggauccaggaacac

SEQ ID NO: 719329 - RNA, 20 nt, Human
cacugaagaaaaagcaaccc

SEQ ID NO: 719330 - RNA, 23 nt, Human
cacugcaagucucuucucuucuu

SEQ ID NO: 719331 - RNA, 20 nt, Human
cagcccuggaggaggcuggg

SEQ ID NO: 719332 - RNA, 21 nt, Human
cagcccuggaggaggcugggg

SEQ ID NO: 719333 - RNA, 24 nt, Human
cauucccccuaaaaagagaaucuc

SEQ ID NO: 719334 - RNA, 22 nt, Human
ccacaaaaaaacucauccccca

SEQ ID NO: 719335 - RNA, 22 nt, Human
ccacaaaaaaacucauccccca

SEQ ID NO: 719336 - RNA, 23 nt, Human
ccagaaauacaccugaauaaaca

SEQ ID NO: 719337 - RNA, 24 nt, Human
ccagcaaacuccggcugcucugaa

SEQ ID NO: 719338 - RNA, 23 nt, Human
ccauucccccuaaaaagagaauc

SEQ ID NO: 719339 - RNA, 21 nt, Human
cccccaguacuuccaggggau

SEQ ID NO: 719340 - RNA, 22 nt, Human
cccuuuucuccaacuugaugcu

SEQ ID NO: 719341 - RNA, 18 nt, Human
ccgagcuggagcugugcu

SEQ ID NO: 719342 - RNA, 26 nt, Human
ccgccccccacgcagccccaggaucc

SEQ ID NO: 719343 - RNA, 24 nt, Human
ccucccgccccccacgcagcccca

SEQ ID NO: 719344 - RNA, 18 nt, Human
ccuccgaaacggcgccuc

SEQ ID NO: 719345 - RNA, 18 nt, Human
ccuuccaucuuccuucuc

SEQ ID NO: 719346 - RNA, 20 nt, Human
cgaccaaaaaaaggcauaca

SEQ ID NO: 719347 - RNA, 21 nt, Human
cgcaagauuaucuacaggccc

SEQ ID NO: 719348 - RNA, 22 nt, Human
cgguggauuuauccauccugga

SEQ ID NO: 719349 - RNA, 20 nt, Human
cuccgaaacggcgccucccc

SEQ ID NO: 719350 - RNA, 19 nt, Human
cucuuagggaaaaaaaaaa

SEQ ID NO: 719351 - RNA, 20 nt, Human
cugaagaaaaagcaacccac

SEQ ID NO: 719352 - RNA, 18 nt, Human
cugaagcucuggcguguc

SEQ ID NO: 719353 - RNA, 19 nt, Human
cugcaagucucuucucuuc

SEQ ID NO: 719354 - RNA, 19 nt, Human
cuggcagaggcuggcuggc

SEQ ID NO: 719355 - RNA, 18 nt, Human
cuggcccccaguacuucc

SEQ ID NO: 719356 - RNA, 21 nt, Human
cuguccgagcuggagcugugc

SEQ ID NO: 719357 - RNA, 21 nt, Human
cuucuuguccauuccugggga

SEQ ID NO: 719358 - RNA, 22 nt, Human
gaaaaacgcaagauuaucuaca

SEQ ID NO: 719359 - RNA, 22 nt, Human
gaaaagcaguaaagaccacggc

SEQ ID NO: 719360 - RNA, 18 nt, Human
gaacaaaagacuccaaua

SEQ ID NO: 719361 - RNA, 23 nt, Human
gaacgacagaacuuaccuuccau

SEQ ID NO: 719362 - RNA, 22 nt, Human
gaagaaaaagcaacccacaaaa

SEQ ID NO: 719363 - RNA, 21 nt, Human
gaccaaaaaaaggcauacagg

SEQ ID NO: 719364 - RNA, 24 nt, Human
gaccaaaaaaaggcauacaggcau

SEQ ID NO: 719365 - RNA, 20 nt, Human
gacccuagcggccuuggcca

SEQ ID NO: 719366 - RNA, 22 nt, Human
gagagcgguaccuccugaggaa

SEQ ID NO: 719367 - RNA, 18 nt, Human
gaguaugaccccagaggc

SEQ ID NO: 719368 - RNA, 23 nt, Human
gaugcuugguggaugccgcuugg

SEQ ID NO: 719369 - RNA, 21 nt, Human
gcacaaaaacaguucacugca

SEQ ID NO: 719370 - RNA, 18 nt, Human
gcagcagccgaggucuuc

SEQ ID NO: 719371 - RNA, 19 nt, Human
gccccagguccaggguuuc

SEQ ID NO: 719372 - RNA, 22 nt, Human
gcccccaguacuuccaggggau

SEQ ID NO: 719373 - RNA, 23 nt, Human
gccugagugcaggggcagggcca

SEQ ID NO: 719374 - RNA, 20 nt, Human
gcucccggagucuccuucac

SEQ ID NO: 719375 - RNA, 19 nt, Human
gcuuugucguggccucagu

SEQ ID NO: 719376 - RNA, 19 nt, Human
ggagaggcucggaaaccuc

SEQ ID NO: 719377 - RNA, 21 nt, Human
ggaggagccaggccagccacg

SEQ ID NO: 719378 - RNA, 23 nt, Human
ggaggaggcuggggagaagaggg

SEQ ID NO: 719379 - RNA, 18 nt, Human
ggauuuauccauccugga

SEQ ID NO: 719380 - RNA, 19 nt, Human
ggcagcagccgaggucuuc

SEQ ID NO: 719381 - RNA, 20 nt, Human
ggcgaaggcagcagccgagg

SEQ ID NO: 719382 - RNA, 21 nt, Human
gggaaagagaggucuggcaga

SEQ ID NO: 719383 - RNA, 20 nt, Human
gggagguggauuucggggaa

SEQ ID NO: 719384 - RNA, 19 nt, Human
gggcagggagaggcucgga

SEQ ID NO: 719385 - RNA, 18 nt, Human
gggccccgcuccagcucc

SEQ ID NO: 719386 - RNA, 21 nt, Human
gggcggagaccaaaaguagaa

SEQ ID NO: 719387 - RNA, 19 nt, Human
gggguggaggggauggggc

SEQ ID NO: 719388 - RNA, 24 nt, Human
uaaaaagagaaucucuuagggaaa

SEQ ID NO: 719389 - RNA, 19 nt, Human
uaagaugacgaaaaacgca

SEQ ID NO: 719390 - RNA, 18 nt, Human
uaaucucugggccucccu

SEQ ID NO: 719391 - RNA, 20 nt, Human
uacaggcccucccgcccccc

SEQ ID NO: 719392 - RNA, 28 nt, Human
uaugaccccagaggccagagagggcagg

SEQ ID NO: 719393 - RNA, 20 nt, Human
ucaccagcauccugagcuuu

SEQ ID NO: 719394 - RNA, 21 nt, Human
uccaagauuugaaugaacaaa

SEQ ID NO: 719395 - RNA, 18 nt, Human
ucccccacagaacuggaa

SEQ ID NO: 719396 - RNA, 19 nt, Human
uccgaccaaaaaaaggcau

SEQ ID NO: 719397 - RNA, 22 nt, Human
uccugagcuuugucuuguguug

SEQ ID NO: 719398 - RNA, 23 nt, Human
uccugagggguaaggacccuagc

SEQ ID NO: 719399 - RNA, 24 nt, Human
ucggaaaccucacugaagcucugg

SEQ ID NO: 719400 - RNA, 21 nt, Human
ucuacaggcccucccgccccc

SEQ ID NO: 719401 - RNA, 22 nt, Human
ucuacaggcccucccgcccccc

SEQ ID NO: 719402 - RNA, 21 nt, Human
ucuguaaucucugggccuccc

SEQ ID NO: 719403 - RNA, 20 nt, Human
ucuuguagcaacuaagacuu

SEQ ID NO: 719404 - RNA, 22 nt, Human
ugaagaaaaagcaacccacaaa

SEQ ID NO: 719405 - RNA, 27 nt, Human
ugaccaaaacccuuaucucgguggauu

SEQ ID NO: 719406 - RNA, 20 nt, Human
ugagucaggggucccggagg

SEQ ID NO: 719407 - RNA, 23 nt, Human
ugagugcaggggcagggccaggg

SEQ ID NO: 719408 - RNA, 21 nt, Human
ugauuuaaaaagucagaaaaa

SEQ ID NO: 719409 - RNA, 19 nt, Human
ugcaaggguuagcagcugc

SEQ ID NO: 719410 - RNA, 18 nt, Human
ugccgcuuggcgcugcag

SEQ ID NO: 719411 - RNA, 23 nt, Human
ugcuccuggugaaaagaugaccc

SEQ ID NO: 719412 - RNA, 22 nt, Human
ugcuuugucguggccucagugg

SEQ ID NO: 719413 - RNA, 19 nt, Human
uggaagauccugggauacc

SEQ ID NO: 719414 - RNA, 19 nt, Human
uggaagauccugggauacc

SEQ ID NO: 719415 - RNA, 18 nt, Human
uggaggaggcuggggaga

SEQ ID NO: 719416 - RNA, 18 nt, Human
uggaggggauggggcugg

SEQ ID NO: 719417 - RNA, 22 nt, Human
uggauguggucucuuguaacuu

SEQ ID NO: 719418 - RNA, 24 nt, Human
uggcacaaaaacaguucacugcaa

SEQ ID NO: 719419 - RNA, 20 nt, Human
uggcagaggcuggcuggcac

SEQ ID NO: 719420 - RNA, 18 nt, Human
uggcucagggccaggcau

SEQ ID NO: 719421 - RNA, 21 nt, Human
uggcucagggccaggcauggg

SEQ ID NO: 719422 - RNA, 21 nt, Human
uggcuggaaacccugccuugg

SEQ ID NO: 719423 - RNA, 28 nt, Human
ugggaaauacuuggccccagguccaggg

SEQ ID NO: 719424 - RNA, 22 nt, Human
uggggagugauccugaggggua

SEQ ID NO: 719425 - RNA, 22 nt, Human
uggggcagugaggggagggaca

SEQ ID NO: 719426 - RNA, 19 nt, Human
ugggguggaggggaugggg

SEQ ID NO: 719427 - RNA, 22 nt, Human
ugggguggaggggauggggcug

SEQ ID NO: 719428 - RNA, 19 nt, Human
uguccgagcuggagcugug

SEQ ID NO: 719429 - RNA, 22 nt, Human
uguugggagucccacaagggcu

SEQ ID NO: 719430 - RNA, 24 nt, Human
uuaaaacaaagaaggaaaaaaaaa

SEQ ID NO: 719431 - RNA, 21 nt, Human
uuauccauccuggauccauuu

SEQ ID NO: 719432 - RNA, 21 nt, Human
uucacucaccaucgccgucgc

SEQ ID NO: 719433 - RNA, 25 nt, Human
uucacucaccaucgccgucgccauu

SEQ ID NO: 719434 - RNA, 19 nt, Human
uuccaucuuccuucucaca

SEQ ID NO: 719435 - RNA, 23 nt, Human
uucuuggcacaaaaacaguucac

SEQ ID NO: 719436 - RNA, 20 nt, Human
uugagaaauucacugguuug

SEQ ID NO: 719437 - RNA, 20 nt, Human
uugaugcuugguggaugccg

SEQ ID NO: 719438 - RNA, 18 nt, Human
uugggcagcccuggagga

SEQ ID NO: 719439 - RNA, 18 nt, Human
uuucuuggcacaaaaaca

SEQ ID NO: 719440 - RNA, 21 nt, Human
uuugcuccuggugaaaagaug

SEQ ID NO: 719441 - RNA, 18 nt, Human
uuuugcgugccugcaguc

SEQ ID NO: 719442 - RNA, 23 nt, Human
aaaaacaaccuccagucaaagcc

SEQ ID NO: 719443 - RNA, 25 nt, Human
aaaaacuucucaauguauaacacac

SEQ ID NO: 719444 - RNA, 23 nt, Human
aaaaucccuucauguuauaacuc

SEQ ID NO: 719445 - RNA, 18 nt, Human
aaaaugguaacauuuccu

SEQ ID NO: 719446 - RNA, 20 nt, Human
aaagagccaaccaugcccac

SEQ ID NO: 719447 - RNA, 22 nt, Human
aaagccaguaaaaacuucucaa

SEQ ID NO: 719448 - RNA, 22 nt, Human
aaaguaacaauguguuaagauu

SEQ ID NO: 719449 - RNA, 21 nt, Human
aaauccauaucucaaaucaag

SEQ ID NO: 719450 - RNA, 24 nt, Human
aagcaaacagcagcuuuacaaaca

SEQ ID NO: 719451 - RNA, 20 nt, Human
aagcaaauaugagacagaac

SEQ ID NO: 719452 - RNA, 20 nt, Human
aagcagguauacaaacuccu

SEQ ID NO: 719453 - RNA, 18 nt, Human
aagcugaaacagaucuga

SEQ ID NO: 719454 - RNA, 21 nt, Human
aaguuccuuuccuugaccucc

SEQ ID NO: 719455 - RNA, 18 nt, Human
aauucccaccccucccuc

SEQ ID NO: 719456 - RNA, 19 nt, Human
acaaaccuacugaagcaga

SEQ ID NO: 719457 - RNA, 21 nt, Human
acagcaaacaaaccuacugaa

SEQ ID NO: 719458 - RNA, 21 nt, Human
acgccacuggccgaggaggcg

SEQ ID NO: 719459 - RNA, 19 nt, Human
acggaugugugcaugugug

SEQ ID NO: 719460 - RNA, 25 nt, Human
acucaaucaaauccauaucucaaau

SEQ ID NO: 719461 - RNA, 19 nt, Human
agagacaguaagaucugcc

SEQ ID NO: 719462 - RNA, 18 nt, Human
agcacaauaauaaaguug

SEQ ID NO: 719463 - RNA, 22 nt, Human
aggggggugggggggacaguug

SEQ ID NO: 719464 - RNA, 19 nt, Human
agguaaguaagaagcaaau

SEQ ID NO: 719465 - RNA, 26 nt, Human
auacagcaaaagaugaaaaucccuuc

SEQ ID NO: 719466 - RNA, 24 nt, Human
auaccccuuccuucucaguuuugu

SEQ ID NO: 719467 - RNA, 23 nt, Human
auagacagcaucuaucacuuucc

SEQ ID NO: 719468 - RNA, 18 nt, Human
augaaccaacccuuacuc

SEQ ID NO: 719469 - RNA, 19 nt, Human
auggaggaggcgguggcag

SEQ ID NO: 719470 - RNA, 20 nt, Human
auuaagcuaauaugaacauc

SEQ ID NO: 719471 - RNA, 22 nt, Human
caaaaacaaccuccagucaaag

SEQ ID NO: 719472 - RNA, 22 nt, Human
caaaauguugagaugaagcaua

SEQ ID NO: 719473 - RNA, 23 nt, Human
caaaccuacugaagcagaaaucu

SEQ ID NO: 719474 - RNA, 26 nt, Human
caaagagccaaccaugcccaccacgg

SEQ ID NO: 719475 - RNA, 19 nt, Human
caaaucaagaguccugaac

SEQ ID NO: 719476 - RNA, 21 nt, Human
caaauccauaucucaaaucaa

SEQ ID NO: 719477 - RNA, 25 nt, Human
caaaugaggcuagcuagcuauaauc

SEQ ID NO: 719478 - RNA, 21 nt, Human
caagaguccugaaccagaagc

SEQ ID NO: 719479 - RNA, 22 nt, Human
cacacacacguacggaugugug

SEQ ID NO: 719480 - RNA, 20 nt, Human
caccccucccuccuccccca

SEQ ID NO: 719481 - RNA, 25 nt, Human
caccccucccuccucccccagcuua

SEQ ID NO: 719482 - RNA, 20 nt, Human
caccugucaacaugugccuu

SEQ ID NO: 719483 - RNA, 22 nt, Human
cagugacuucugacuaaacauu

SEQ ID NO: 719484 - RNA, 23 nt, Human
ccaaccaugcccacuucaaaaaa

SEQ ID NO: 719485 - RNA, 20 nt, Human
ccaccccucccuccuccccc

SEQ ID NO: 719486 - RNA, 24 nt, Human
ccaguaaaaccaccucuacacauu

SEQ ID NO: 719487 - RNA, 25 nt, Human
cccaacacuaauuaauuacaauaau

SEQ ID NO: 719488 - RNA, 20 nt, Human
ccccccgcucggguccagac

SEQ ID NO: 719489 - RNA, 21 nt, Human
ccuccaaagccuguaauucaa

SEQ ID NO: 719490 - RNA, 24 nt, Human
ccuccagucaaagccaguaaaaac

SEQ ID NO: 719491 - RNA, 22 nt, Human
ccucccccagcuuauuuagaaa

SEQ ID NO: 719492 - RNA, 18 nt, Human
ccugcagccgcaacgggc

SEQ ID NO: 719493 - RNA, 18 nt, Human
cgcaacgggcccgcgcua

SEQ ID NO: 719494 - RNA, 20 nt, Human
cgcucggguccagacugggu

SEQ ID NO: 719495 - RNA, 22 nt, Human
cuaaaucaucaaccaagaaucc

SEQ ID NO: 719496 - RNA, 20 nt, Human
cuauccuuagaaccuuguuc

SEQ ID NO: 719497 - RNA, 22 nt, Human
cucaaggcuaggugcaaaauag

SEQ ID NO: 719498 - RNA, 21 nt, Human
cucaauguauaacacacauua

SEQ ID NO: 719499 - RNA, 22 nt, Human
cucuaucauuucuuuaaaccaa

SEQ ID NO: 719500 - RNA, 23 nt, Human
cuuaccugcuguguuccuuuaaa

SEQ ID NO: 719501 - RNA, 24 nt, Human
gaagcaugcaagagaacacaccag

SEQ ID NO: 719502 - RNA, 22 nt, Human
gcaaacagcagcuuuacaaaca

SEQ ID NO: 719503 - RNA, 18 nt, Human
gcaaagcccugccccaga

SEQ ID NO: 719504 - RNA, 21 nt, Human
gcaaagcccugccccagauaa

SEQ ID NO: 719505 - RNA, 22 nt, Human
gcaaaggaaauuuacaccauaa

SEQ ID NO: 719506 - RNA, 19 nt, Human
ggaggaggcgguggcagcu

SEQ ID NO: 719507 - RNA, 18 nt, Human
ggaugugugcaugugugu

SEQ ID NO: 719508 - RNA, 21 nt, Human
gggacaguugggggugguggg

SEQ ID NO: 719509 - RNA, 24 nt, Human
gggggugggggggacaguuggggg

SEQ ID NO: 719510 - RNA, 21 nt, Human
ggggugggggggacaguuggg

SEQ ID NO: 719511 - RNA, 23 nt, Human
ggugugaugugccaacaaaauuu

SEQ ID NO: 719512 - RNA, 20 nt, Human
gucauugcuauguggaaggu

SEQ ID NO: 719513 - RNA, 21 nt, Human
gugugagggggguggggggga

SEQ ID NO: 719514 - RNA, 19 nt, Human
uaaaacaucaaaacuagca

SEQ ID NO: 719515 - RNA, 20 nt, Human
uaaaacuuccuccucuaagc

SEQ ID NO: 719516 - RNA, 19 nt, Human
uaaaauaccaucucugcaa

SEQ ID NO: 719517 - RNA, 22 nt, Human
uaaaauaccaucucugcaaaaa

SEQ ID NO: 719518 - RNA, 23 nt, Human
uaagaagcaaauaugagacagaa

SEQ ID NO: 719519 - RNA, 19 nt, Human
uaagaugguggcuccacug

SEQ ID NO: 719520 - RNA, 22 nt, Human
uaagcaaacagcagcuuuacaa

SEQ ID NO: 719521 - RNA, 22 nt, Human
uaaguaagaagcaaauaugaga

SEQ ID NO: 719522 - RNA, 21 nt, Human
uacaaaauaagcugaaacaga

SEQ ID NO: 719523 - RNA, 27 nt, Human
uacaaacuccuagagaagggcagagau

SEQ ID NO: 719524 - RNA, 22 nt, Human
uacacagcuccugaacuuucac

SEQ ID NO: 719525 - RNA, 20 nt, Human
uacaucauuuacaaacauau

SEQ ID NO: 719526 - RNA, 21 nt, Human
uacuauuucagaggcuucauu

SEQ ID NO: 719527 - RNA, 19 nt, Human
uagaggagguggaguccug

SEQ ID NO: 719528 - RNA, 20 nt, Human
uagcacaauaauaaaguuga

SEQ ID NO: 719529 - RNA, 24 nt, Human
uaguacagaagaauccccacuagu

SEQ ID NO: 719530 - RNA, 21 nt, Human
uaguuugucauucuuccacca

SEQ ID NO: 719531 - RNA, 18 nt, Human
uauaaaacaucaaaacua

SEQ ID NO: 719532 - RNA, 25 nt, Human
uauaaaauaauacaaauacuuucaa

SEQ ID NO: 719533 - RNA, 20 nt, Human
uauaagacucuguuucugaa

SEQ ID NO: 719534 - RNA, 25 nt, Human
ucaaaaaauauauaaaaacuuuccu

SEQ ID NO: 719535 - RNA, 18 nt, Human
ucacugaaguccaggugg

SEQ ID NO: 719536 - RNA, 19 nt, Human
ucagggcagggauaauacc

SEQ ID NO: 719537 - RNA, 22 nt, Human
uccacagcuggagauagagagc

SEQ ID NO: 719538 - RNA, 24 nt, Human
ucccaccccucccuccucccccag

SEQ ID NO: 719539 - RNA, 19 nt, Human
uccugaacuuucacaauuc

SEQ ID NO: 719540 - RNA, 18 nt, Human
uccuucauacagcaaaag

SEQ ID NO: 719541 - RNA, 23 nt, Human
uccuugaccuccugacaguaacu

SEQ ID NO: 719542 - RNA, 21 nt, Human
ucgggccgcuuucuccauggc

SEQ ID NO: 719543 - RNA, 19 nt, Human
ucucaguuuugugccugcu

SEQ ID NO: 719544 - RNA, 22 nt, Human
ucuccugccucugugaggcaaa

SEQ ID NO: 719545 - RNA, 26 nt, Human
ucugugaggcaaagcccugccccaga

SEQ ID NO: 719546 - RNA, 23 nt, Human
ugaaccaacccuuacucuuccca

SEQ ID NO: 719547 - RNA, 19 nt, Human
ugaagcaaacacugauaac

SEQ ID NO: 719548 - RNA, 20 nt, Human
ugacuccacccccaguucuu

SEQ ID NO: 719549 - RNA, 18 nt, Human
ugauugacuaacauuuuc

SEQ ID NO: 719550 - RNA, 21 nt, Human
ugcaaaauagguauuuuuuaa

SEQ ID NO: 719551 - RNA, 22 nt, Human
ugcaugugugugaggggggugg

SEQ ID NO: 719552 - RNA, 19 nt, Human
ugcucaaggcuaggugcaa

SEQ ID NO: 719553 - RNA, 21 nt, Human
uggaaaacacacacacguacc

SEQ ID NO: 719554 - RNA, 20 nt, Human
uggaggaggcgguggcagcu

SEQ ID NO: 719555 - RNA, 24 nt, Human
uggaguccugaagcaaacacugau

SEQ ID NO: 719556 - RNA, 21 nt, Human
uggccgaggaggcggcuccag

SEQ ID NO: 719557 - RNA, 22 nt, Human
uggguuccggaccuccgccccu

SEQ ID NO: 719558 - RNA, 19 nt, Human
uggguuguccucuagaggu

SEQ ID NO: 719559 - RNA, 21 nt, Human
ugugcaugugugugagggggg

SEQ ID NO: 719560 - RNA, 19 nt, Human
ugugccuagcuuuuuguaa

SEQ ID NO: 719561 - RNA, 21 nt, Human
uguggaaggugcucaaggcua

SEQ ID NO: 719562 - RNA, 20 nt, Human
ugugguauauuuagaaauua

SEQ ID NO: 719563 - RNA, 21 nt, Human
uuauccuucauacagcaaaag

SEQ ID NO: 719564 - RNA, 24 nt, Human
uucaaaaugucuuuuaaguaagca

SEQ ID NO: 719565 - RNA, 23 nt, Human
uucacaauucacaaauacuaaau

SEQ ID NO: 719566 - RNA, 23 nt, Human
uucuccauggccccccgcucggg

SEQ ID NO: 719567 - RNA, 20 nt, Human
uugauuacaaaauaagcuga

SEQ ID NO: 719568 - RNA, 24 nt, Human
uuguggaccacauaaaaguugcau

SEQ ID NO: 719569 - RNA, 19 nt, Human
uuucuugugaugaugaacc

SEQ ID NO: 719570 - RNA, 27 nt, Human
uuuuuuuuuuuaagcaaacagcagcuu

SEQ ID NO: 719571 - RNA, 22 nt, Human
aaaguacaacacaaaguuguau

SEQ ID NO: 719572 - RNA, 21 nt, Human
aagaaagaucugaaagaagcg

SEQ ID NO: 719573 - RNA, 19 nt, Human
aagcacaacagcaaaucuc

SEQ ID NO: 719574 - RNA, 19 nt, Human
agaagcgaguggucugagc

SEQ ID NO: 719575 - RNA, 21 nt, Human
agacagguggugaaaacgcag

SEQ ID NO: 719576 - RNA, 19 nt, Human
agaggaggguggggagggg

SEQ ID NO: 719577 - RNA, 22 nt, Human
agaggaggguggggaggggagc

SEQ ID NO: 719578 - RNA, 18 nt, Human
aggaggguggggagggga

SEQ ID NO: 719579 - RNA, 21 nt, Human
aggaggguggggaggggagcu

SEQ ID NO: 719580 - RNA, 18 nt, Human
aggguggggaggggagcu

SEQ ID NO: 719581 - RNA, 21 nt, Human
aggguggggaggggagcugca

SEQ ID NO: 719582 - RNA, 23 nt, Human
caaacagcacagaaaaugcauau

SEQ ID NO: 719583 - RNA, 20 nt, Human
caaacagcacagaaaaugcu

SEQ ID NO: 719584 - RNA, 20 nt, Human
cagcacagaaaaugcauaug

SEQ ID NO: 719585 - RNA, 23 nt, Human
cuaaaagcacaacagcaaaucuc

SEQ ID NO: 719586 - RNA, 18 nt, Human
gaagacagguggugaaaa

SEQ ID NO: 719587 - RNA, 23 nt, Human
gaggguggggaggggagcugcag

SEQ ID NO: 719588 - RNA, 20 nt, Human
gggaggggagcugcaguaag

SEQ ID NO: 719589 - RNA, 20 nt, Human
ggguggggaggggagcugca

SEQ ID NO: 719590 - RNA, 24 nt, Human
gucucagaaacuggcacaucauga

SEQ ID NO: 719591 - RNA, 19 nt, Human
uaaguugacuuacauuucu

SEQ ID NO: 719592 - RNA, 21 nt, Human
uaccucaaguacaaacagcac

SEQ ID NO: 719593 - RNA, 18 nt, Human
uaucucaagacuuggcua

SEQ ID NO: 719594 - RNA, 18 nt, Human
ucugaaagaagcgagugg

SEQ ID NO: 719595 - RNA, 27 nt, Human
ugcaaagaagaggaggguggggagggg

SEQ ID NO: 719596 - RNA, 23 nt, Human
ugcuugggucuguuuugcaaaga

SEQ ID NO: 719597 - RNA, 20 nt, Human
uggcugaguccagacuuuuc

SEQ ID NO: 719598 - RNA, 24 nt, Human
uggucugagccugcccugcuuggg

SEQ ID NO: 719599 - RNA, 21 nt, Human
ugucacaugccaggauuucug

SEQ ID NO: 719600 - RNA, 22 nt, Human
uucucagauguacaggucuuau

SEQ ID NO: 719601 - RNA, 22 nt, Human
uuucugaaucaacucaaauuau

SEQ ID NO: 719602 - RNA, 19 nt, Human
aaagcccgacucucacugu

SEQ ID NO: 719603 - RNA, 23 nt, Human
aacaccccuguuccuggggcucc

SEQ ID NO: 719604 - RNA, 18 nt, Human
aaccugccaguucuccuu

SEQ ID NO: 719605 - RNA, 19 nt, Human
aagaagggucugagagggc

SEQ ID NO: 719606 - RNA, 23 nt, Human
aagagcacugcacgcauuauccc

SEQ ID NO: 719607 - RNA, 20 nt, Human
aagagcagaagguggcccag

SEQ ID NO: 719608 - RNA, 18 nt, Human
aaggugcagaggucuaug

SEQ ID NO: 719609 - RNA, 21 nt, Human
aauggauccaaauccaaguga

SEQ ID NO: 719610 - RNA, 24 nt, Human
aauggcccuaaggaugcucugggc

SEQ ID NO: 719611 - RNA, 21 nt, Human
aaugggacugaaaacguagaa

SEQ ID NO: 719612 - RNA, 19 nt, Human
acaaagcaggaggugggcg

SEQ ID NO: 719613 - RNA, 19 nt, Human
acccacaccucugcaccgc

SEQ ID NO: 719614 - RNA, 24 nt, Human
acccacaccucugcaccgcccccc

SEQ ID NO: 719615 - RNA, 19 nt, Human
accccuggugguggcagug

SEQ ID NO: 719616 - RNA, 21 nt, Human
accccuguuccuggggcuccu

SEQ ID NO: 719617 - RNA, 19 nt, Human
acccuauugcagcuccugg

SEQ ID NO: 719618 - RNA, 21 nt, Human
accuggagagaaaauacuccu

SEQ ID NO: 719619 - RNA, 19 nt, Human
acugugagagagggaacau

SEQ ID NO: 719620 - RNA, 24 nt, Human
agacccuccccaccaucucugagg

SEQ ID NO: 719621 - RNA, 21 nt, Human
agaccucuuguuuucaugccc

SEQ ID NO: 719622 - RNA, 22 nt, Human
agagagggaacaugugggcagg

SEQ ID NO: 719623 - RNA, 20 nt, Human
agagauggcuagcaggagag

SEQ ID NO: 719624 - RNA, 18 nt, Human
agagcagagggcagggag

SEQ ID NO: 719625 - RNA, 20 nt, Human
agagggcacagggaggaugg

SEQ ID NO: 719626 - RNA, 18 nt, Human
agcagaagguggcccagg

SEQ ID NO: 719627 - RNA, 19 nt, Human
agcugugaaacaggaaaga

SEQ ID NO: 719628 - RNA, 24 nt, Human
aggaaccugccaguucuccuuggu

SEQ ID NO: 719629 - RNA, 24 nt, Human
aggcaggaaccugccaguucuccu

SEQ ID NO: 719630 - RNA, 19 nt, Human
agggaaaccacuagcagcu

SEQ ID NO: 719631 - RNA, 19 nt, Human
aggugauaagcaauggaca

SEQ ID NO: 719632 - RNA, 23 nt, Human
aguaauccaagacgcagacaacc

SEQ ID NO: 719633 - RNA, 19 nt, Human
agucaagaccagaguagcu

SEQ ID NO: 719634 - RNA, 21 nt, Human
auaaucccaaaauguaaccaa

SEQ ID NO: 719635 - RNA, 20 nt, Human
aucccacaucugcuguaugu

SEQ ID NO: 719636 - RNA, 19 nt, Human
augggucuuugaagugugg

SEQ ID NO: 719637 - RNA, 20 nt, Human
caaaauacccaggcuuccuc

SEQ ID NO: 719638 - RNA, 21 nt, Human
caagaagggucugagagggcu

SEQ ID NO: 719639 - RNA, 21 nt, Human
cacaccucugcaccgcccccc

SEQ ID NO: 719640 - RNA, 18 nt, Human
caccccaaucaauccggc

SEQ ID NO: 719641 - RNA, 18 nt, Human
cacccccuccccagcagg

SEQ ID NO: 719642 - RNA, 22 nt, Human
caccccuaggccucaucugccc

SEQ ID NO: 719643 - RNA, 18 nt, Human
cacccuguguuggucucc

SEQ ID NO: 719644 - RNA, 22 nt, Human
caccgcgcccccaggacccagc

SEQ ID NO: 719645 - RNA, 21 nt, Human
caccugggggcccucgccccu

SEQ ID NO: 719646 - RNA, 22 nt, Human
cacuuuauaaacauccccagcc

SEQ ID NO: 719647 - RNA, 20 nt, Human
cagaguagcugagcagaggc

SEQ ID NO: 719648 - RNA, 18 nt, Human
cagcccagagagcaggcc

SEQ ID NO: 719649 - RNA, 19 nt, Human
cagcccagccucuagcuuu

SEQ ID NO: 719650 - RNA, 23 nt, Human
cagccgaccucagagcacccugc

SEQ ID NO: 719651 - RNA, 22 nt, Human
caggagacagccauccccaaua

SEQ ID NO: 719652 - RNA, 18 nt, Human
caggauguccccuggacc

SEQ ID NO: 719653 - RNA, 23 nt, Human
cauaacucccccuacuccuaaaa

SEQ ID NO: 719654 - RNA, 19 nt, Human
cauucugcaucuccaucca

SEQ ID NO: 719655 - RNA, 23 nt, Human
ccaaauaaaugccaaagagacua

SEQ ID NO: 719656 - RNA, 23 nt, Human
ccaagugagaaaaagcaggagac

SEQ ID NO: 719657 - RNA, 25 nt, Human
ccacaccgcagccgaccucagagca

SEQ ID NO: 719658 - RNA, 22 nt, Human
ccagaccagaagagccucugcc

SEQ ID NO: 719659 - RNA, 19 nt, Human
ccagcccagagagcaggcc

SEQ ID NO: 719660 - RNA, 20 nt, Human
ccagcccagagagcaggccc

SEQ ID NO: 719661 - RNA, 21 nt, Human
ccagccucuagcuuuccagaa

SEQ ID NO: 719662 - RNA, 23 nt, Human
ccauccugggcuccuccagaacc

SEQ ID NO: 719663 - RNA, 18 nt, Human
ccauucugcaucuccauc

SEQ ID NO: 719664 - RNA, 18 nt, Human
cccaggggaucccucccc

SEQ ID NO: 719665 - RNA, 19 nt, Human
ccccagguggaaaaagugg

SEQ ID NO: 719666 - RNA, 20 nt, Human
cccccaggacccagcgggcc

SEQ ID NO: 719667 - RNA, 26 nt, Human
cccccuacuccuaaaaccuacccuuc

SEQ ID NO: 719668 - RNA, 21 nt, Human
ccccgcugcuaucccccucca

SEQ ID NO: 719669 - RNA, 18 nt, Human
ccccuaggccucaucugc

SEQ ID NO: 719670 - RNA, 22 nt, Human
cccgcagcuccccucucccucc

SEQ ID NO: 719671 - RNA, 21 nt, Human
cccgccccucagggaccuggc

SEQ ID NO: 719672 - RNA, 18 nt, Human
cccgguuucccccucggg

SEQ ID NO: 719673 - RNA, 19 nt, Human
cccuaggccucaucugccc

SEQ ID NO: 719674 - RNA, 26 nt, Human
cccuaggccucaucugcccgccccuc

SEQ ID NO: 719675 - RNA, 18 nt, Human
cccuauaugccuaccuca

SEQ ID NO: 719676 - RNA, 19 nt, Human
cccuccauggccaccuccc

SEQ ID NO: 719677 - RNA, 22 nt, Human
cccuccucccuccucagguccc

SEQ ID NO: 719678 - RNA, 19 nt, Human
cccucgggggccccuccuu

SEQ ID NO: 719679 - RNA, 20 nt, Human
cccuggggucugcucucggc

SEQ ID NO: 719680 - RNA, 20 nt, Human
cccuguguuggucucccucc

SEQ ID NO: 719681 - RNA, 19 nt, Human
cccuguuccuggggcuccu

SEQ ID NO: 719682 - RNA, 18 nt, Human
ccgccccucagggaccug

SEQ ID NO: 719683 - RNA, 18 nt, Human
ccgccugagcuccuccuc

SEQ ID NO: 719684 - RNA, 19 nt, Human
ccgggguuggggugggggg

SEQ ID NO: 719685 - RNA, 23 nt, Human
ccucaccacucacccccucccca

SEQ ID NO: 719686 - RNA, 18 nt, Human
ccucagagcacccugccu

SEQ ID NO: 719687 - RNA, 19 nt, Human
ccucaucugcccgccccuc

SEQ ID NO: 719688 - RNA, 26 nt, Human
ccuccgggaccugcgcgccagccacc

SEQ ID NO: 719689 - RNA, 24 nt, Human
ccuccgguccaggcagggauccca

SEQ ID NO: 719690 - RNA, 23 nt, Human
ccuccugccuccuugcuggggaa

SEQ ID NO: 719691 - RNA, 21 nt, Human
ccuccuugcuggggaagugcc

SEQ ID NO: 719692 - RNA, 19 nt, Human
ccucgccccuccugccucc

SEQ ID NO: 719693 - RNA, 21 nt, Human
ccucgugcuagacaggccuuc

SEQ ID NO: 719694 - RNA, 19 nt, Human
ccucugugaaccuggagug

SEQ ID NO: 719695 - RNA, 19 nt, Human
ccugggcuccuccagaacc

SEQ ID NO: 719696 - RNA, 18 nt, Human
ccuguguuggucucccuc

SEQ ID NO: 719697 - RNA, 20 nt, Human
cgacaccacgacagaagccc

SEQ ID NO: 719698 - RNA, 21 nt, Human
cgcagacaaccuugcuuuuaa

SEQ ID NO: 719699 - RNA, 19 nt, Human
cgcauuaucucaguaaucc

SEQ ID NO: 719700 - RNA, 19 nt, Human
cggaaucagaucucgcaua

SEQ ID NO: 719701 - RNA, 18 nt, Human
cgggagcacaaagcagga

SEQ ID NO: 719702 - RNA, 24 nt, Human
cguagaaaaaccaaauaaaugcca

SEQ ID NO: 719703 - RNA, 22 nt, Human
cuagaacaugggucuuugaagu

SEQ ID NO: 719704 - RNA, 22 nt, Human
cucaaacuagacauucagaagu

SEQ ID NO: 719705 - RNA, 22 nt, Human
cucaccacucacccccucccca

SEQ ID NO: 719706 - RNA, 20 nt, Human
cuccagacccuccggggcuc

SEQ ID NO: 719707 - RNA, 21 nt, Human
cuccagcccagagagcaggcc

SEQ ID NO: 719708 - RNA, 24 nt, Human
cucccccuacuccuaaaaccuacc

SEQ ID NO: 719709 - RNA, 25 nt, Human
cuccccgcugcuaucccccuccauc

SEQ ID NO: 719710 - RNA, 22 nt, Human
cuccuaaaaccuacccuucacc

SEQ ID NO: 719711 - RNA, 19 nt, Human
cugaauccaagaagacugu

SEQ ID NO: 719712 - RNA, 22 nt, Human
cugcugccacuuccagggaaac

SEQ ID NO: 719713 - RNA, 23 nt, Human
cuguuaggaagcgggagcacaaa

SEQ ID NO: 719714 - RNA, 21 nt, Human
cuucaugcgccccagcucccc

SEQ ID NO: 719715 - RNA, 21 nt, Human
cuugguuccccaggucccagc

SEQ ID NO: 719716 - RNA, 19 nt, Human
gacagguaggguggucccc

SEQ ID NO: 719717 - RNA, 24 nt, Human
gacaucuuguccuaggguagaggc

SEQ ID NO: 719718 - RNA, 18 nt, Human
gaccaccugggggcccuc

SEQ ID NO: 719719 - RNA, 20 nt, Human
gagcacccugccucaacugu

SEQ ID NO: 719720 - RNA, 22 nt, Human
gagcagcagagagggcacaggg

SEQ ID NO: 719721 - RNA, 26 nt, Human
gagcaggcccaggccgugccucccac

SEQ ID NO: 719722 - RNA, 21 nt, Human
gagggaacaugugggcaggga

SEQ ID NO: 719723 - RNA, 24 nt, Human
gcacaggauuaaccauccccagga

SEQ ID NO: 719724 - RNA, 18 nt, Human
gcagcagagagggcacag

SEQ ID NO: 719725 - RNA, 19 nt, Human
gcagcuccccucucccucc

SEQ ID NO: 719726 - RNA, 18 nt, Human
gcauuaucucaguaaucc

SEQ ID NO: 719727 - RNA, 20 nt, Human
gccaccugcccgacucccgg

SEQ ID NO: 719728 - RNA, 18 nt, Human
gccagcggccgggguugg

SEQ ID NO: 719729 - RNA, 22 nt, Human
gccagcggccgggguuggggug

SEQ ID NO: 719730 - RNA, 20 nt, Human
gcccguagcgacaccacgac

SEQ ID NO: 719731 - RNA, 21 nt, Human
gccgggguugggguggggggg

SEQ ID NO: 719732 - RNA, 20 nt, Human
gccucuagcuuuccagaagc

SEQ ID NO: 719733 - RNA, 19 nt, Human
gcgccagccaccgcgcccc

SEQ ID NO: 719734 - RNA, 20 nt, Human
gcguuaggaauggaggagca

SEQ ID NO: 719735 - RNA, 19 nt, Human
gcucuagcuugcaagagca

SEQ ID NO: 719736 - RNA, 20 nt, Human
ggaaaagagacccuccccac

SEQ ID NO: 719737 - RNA, 19 nt, Human
ggaaugcucucacuuccuc

SEQ ID NO: 719738 - RNA, 21 nt, Human
ggaaugcucucacuuccucuc

SEQ ID NO: 719739 - RNA, 26 nt, Human
ggacagaccugaugccugggguuugg

SEQ ID NO: 719740 - RNA, 21 nt, Human
ggagcagcagagagggcacag

SEQ ID NO: 719741 - RNA, 23 nt, Human
ggaggugggcggcaggcgaguga

SEQ ID NO: 719742 - RNA, 20 nt, Human
ggcagggagauagugugaga

SEQ ID NO: 719743 - RNA, 19 nt, Human
ggcgagugagcauuaccgc

SEQ ID NO: 719744 - RNA, 21 nt, Human
gggaaacucagaggaugccaa

SEQ ID NO: 719745 - RNA, 18 nt, Human
gggagguugggguggacc

SEQ ID NO: 719746 - RNA, 21 nt, Human
gggagguugggguggaccugg

SEQ ID NO: 719747 - RNA, 25 nt, Human
gggauccuaggaggcugggggauca

SEQ ID NO: 719748 - RNA, 24 nt, Human
gggccacugaaaggggcucugugg

SEQ ID NO: 719749 - RNA, 19 nt, Human
gggcggcaggcgagugagc

SEQ ID NO: 719750 - RNA, 20 nt, Human
ggggaagaaggcuuauuugg

SEQ ID NO: 719751 - RNA, 24 nt, Human
ggggcuccugcuccccacuccagc

SEQ ID NO: 719752 - RNA, 22 nt, Human
ggggcucuggcccgcagcuccc

SEQ ID NO: 719753 - RNA, 20 nt, Human
gggucggcugugacucacca

SEQ ID NO: 719754 - RNA, 18 nt, Human
gguuggggugggggggcc

SEQ ID NO: 719755 - RNA, 21 nt, Human
guagugcgcgccagccgcccc

SEQ ID NO: 719756 - RNA, 21 nt, Human
guccacgacauuggaccccag

SEQ ID NO: 719757 - RNA, 23 nt, Human
gucuguggccuguuaggaagcgg

SEQ ID NO: 719758 - RNA, 18 nt, Human
gugaaccuggagugauuc

SEQ ID NO: 719759 - RNA, 20 nt, Human
gugacauggauuaggggucu

SEQ ID NO: 719760 - RNA, 21 nt, Human
gugcagaggucuaugccagga

SEQ ID NO: 719761 - RNA, 19 nt, Human
guggcagugggggagaaag

SEQ ID NO: 719762 - RNA, 18 nt, Human
guggccuguuaggaagcg

SEQ ID NO: 719763 - RNA, 23 nt, Human
gugggcggcaggcgagugagcau

SEQ ID NO: 719764 - RNA, 20 nt, Human
guggucccccuugaaaaguc

SEQ ID NO: 719765 - RNA, 20 nt, Human
guuacgccaccugcccgacu

SEQ ID NO: 719766 - RNA, 19 nt, Human
uaaaugacuauaaaaaugu

SEQ ID NO: 719767 - RNA, 19 nt, Human
uaauccaagacgcagacaa

SEQ ID NO: 719768 - RNA, 18 nt, Human
uacccaggcuuccuccag

SEQ ID NO: 719769 - RNA, 18 nt, Human
uagccccaaucacagcaa

SEQ ID NO: 719770 - RNA, 18 nt, Human
uagcgacaccacgacaga

SEQ ID NO: 719771 - RNA, 20 nt, Human
uagcuguaucugaugcacua

SEQ ID NO: 719772 - RNA, 22 nt, Human
uaggaggcugggggaucaucug

SEQ ID NO: 719773 - RNA, 24 nt, Human
uaggaggcugggggaucaucugcc

SEQ ID NO: 719774 - RNA, 18 nt, Human
ucacuccauuauauaugg

SEQ ID NO: 719775 - RNA, 20 nt, Human
uccaaauccaagugagaaaa

SEQ ID NO: 719776 - RNA, 21 nt, Human
uccacgacauuggaccccagg

SEQ ID NO: 719777 - RNA, 23 nt, Human
uccacugguggaaaaauuguuuu

SEQ ID NO: 719778 - RNA, 19 nt, Human
ucccaggggaucccucccc

SEQ ID NO: 719779 - RNA, 22 nt, Human
uccccacuggcgaucccuuccc

SEQ ID NO: 719780 - RNA, 21 nt, Human
uccccaggaaaugccucccuc

SEQ ID NO: 719781 - RNA, 21 nt, Human
ucccccuugaaaagucagcca

SEQ ID NO: 719782 - RNA, 24 nt, Human
ucccgugucaaaauacccaggcuu

SEQ ID NO: 719783 - RNA, 23 nt, Human
ucccugguaccaaaaagguuggg

SEQ ID NO: 719784 - RNA, 20 nt, Human
uccgcacacgcaccaauccc

SEQ ID NO: 719785 - RNA, 19 nt, Human
uccuguuggcgugggcugc

SEQ ID NO: 719786 - RNA, 20 nt, Human
uccuuggaaaaggacagcaa

SEQ ID NO: 719787 - RNA, 23 nt, Human
ucgacccacaccucugcaccgcc

SEQ ID NO: 719788 - RNA, 20 nt, Human
ucggcaccccuaggccucau

SEQ ID NO: 719789 - RNA, 21 nt, Human
ucucugggaaaggcggcagag

SEQ ID NO: 719790 - RNA, 21 nt, Human
ucugacccucggcugcccugc

SEQ ID NO: 719791 - RNA, 24 nt, Human
ucugaugcacuagguggcagggag

SEQ ID NO: 719792 - RNA, 23 nt, Human
ucuggacagaccugaugccuggg

SEQ ID NO: 719793 - RNA, 20 nt, Human
ucuggggaccaccugggggc

SEQ ID NO: 719794 - RNA, 22 nt, Human
ugaauggcagacaguaauccaa

SEQ ID NO: 719795 - RNA, 18 nt, Human
ugacugagggaugaccag

SEQ ID NO: 719796 - RNA, 18 nt, Human
ugagaaaaagcaggagac

SEQ ID NO: 719797 - RNA, 19 nt, Human
ugagaaaaagcaggagacu

SEQ ID NO: 719798 - RNA, 21 nt, Human
ugaggaaaagagacccucccc

SEQ ID NO: 719799 - RNA, 19 nt, Human
ugaggaaacaggcucagag

SEQ ID NO: 719800 - RNA, 20 nt, Human
ugaggaaacaggcucagaga

SEQ ID NO: 719801 - RNA, 21 nt, Human
ugaggaaacaggcucagagag

SEQ ID NO: 719802 - RNA, 23 nt, Human
ugaggaaacaggcucagagaggu

SEQ ID NO: 719803 - RNA, 22 nt, Human
ugaggggaaauauuuuacccug

SEQ ID NO: 719804 - RNA, 20 nt, Human
ugaguuggcauuacuauccc

SEQ ID NO: 719805 - RNA, 23 nt, Human
ugaugaucugagaugaaacaguu

SEQ ID NO: 719806 - RNA, 18 nt, Human
ugcagcuccuggguuugg

SEQ ID NO: 719807 - RNA, 25 nt, Human
ugccaaaugauaaauuccuaaaaac

SEQ ID NO: 719808 - RNA, 18 nt, Human
ugccaguucuccuuggug

SEQ ID NO: 719809 - RNA, 19 nt, Human
ugccaguucuccuuggugc

SEQ ID NO: 719810 - RNA, 18 nt, Human
ugcccgccccucagggac

SEQ ID NO: 719811 - RNA, 21 nt, Human
ugccucagagcuuuagcccca

SEQ ID NO: 719812 - RNA, 22 nt, Human
ugccuccuugcuggggaagugc

SEQ ID NO: 719813 - RNA, 18 nt, Human
ugcuccagcccagagagc

SEQ ID NO: 719814 - RNA, 20 nt, Human
ugcucugggcuggacaggcc

SEQ ID NO: 719815 - RNA, 19 nt, Human
ugcuuccuucucuccaggu

SEQ ID NO: 719816 - RNA, 19 nt, Human
uggaaaaagugggucccau

SEQ ID NO: 719817 - RNA, 25 nt, Human
uggaaugcuuccuucucuccagguc

SEQ ID NO: 719818 - RNA, 20 nt, Human
uggacaggccaaggggaucc

SEQ ID NO: 719819 - RNA, 23 nt, Human
uggcagggagugagucuuggagu

SEQ ID NO: 719820 - RNA, 23 nt, Human
uggccagagagaaugacucugau

SEQ ID NO: 719821 - RNA, 18 nt, Human
uggcuccuccagacccuc

SEQ ID NO: 719822 - RNA, 21 nt, Human
ugggcuggcucuagcuugcaa

SEQ ID NO: 719823 - RNA, 23 nt, Human
uggggaagugcccaguccagugc

SEQ ID NO: 719824 - RNA, 18 nt, Human
ugugaaagauaaggcuuc

SEQ ID NO: 719825 - RNA, 20 nt, Human
ugugcagaucagugccaaau

SEQ ID NO: 719826 - RNA, 21 nt, Human
ugugggcagggauaaaggcag

SEQ ID NO: 719827 - RNA, 19 nt, Human
uguuaggaagcgggagcac

SEQ ID NO: 719828 - RNA, 20 nt, Human
uuacugucuccaccccagac

SEQ ID NO: 719829 - RNA, 19 nt, Human
uuccccuauccuugguucc

SEQ ID NO: 719830 - RNA, 19 nt, Human
uuccuggggcuccugcucc

SEQ ID NO: 719831 - RNA, 18 nt, Human
uuuggcaaaggcugaaug

SEQ ID NO: 719832 - RNA, 22 nt, Human
uuuuccacaaaaccggucccug

SEQ ID NO: 719833 - RNA, 25 nt, Human
uuuucuuggcaauccucugaaacgg

SEQ ID NO: 719834 - RNA, 20 nt, Human
aaaaaagcaaaagcaaauga

SEQ ID NO: 719835 - RNA, 21 nt, Human
aaaacaaaacaaaacaaaaaa

SEQ ID NO: 719836 - RNA, 19 nt, Human
aaaaguacucuacuguucu

SEQ ID NO: 719837 - RNA, 19 nt, Human
aaaauauacuauuaauccc

SEQ ID NO: 719838 - RNA, 19 nt, Human
aaacaaaacaaaacaaaaa

SEQ ID NO: 719839 - RNA, 23 nt, Human
aaagcaaaagcaaaugagccuga

SEQ ID NO: 719840 - RNA, 20 nt, Human
aaagucuaaauggguaaaaa

SEQ ID NO: 719841 - RNA, 23 nt, Human
aaauaaaaauaggauuggauuca

SEQ ID NO: 719842 - RNA, 25 nt, Human
aaaucaauuuucaaaugauuaccag

SEQ ID NO: 719843 - RNA, 24 nt, Human
aacaaaaaagcaaaagcaaaugag

SEQ ID NO: 719844 - RNA, 23 nt, Human
aacaaucugcauuaucaaaaaua

SEQ ID NO: 719845 - RNA, 24 nt, Human
aaccaaaaaauucacaaaauuauu

SEQ ID NO: 719846 - RNA, 21 nt, Human
aagcaaaagcaaaugagccug

SEQ ID NO: 719847 - RNA, 18 nt, Human
aagucagccucaaguacc

SEQ ID NO: 719848 - RNA, 22 nt, Human
aaucauucaacaaaaaagcaaa

SEQ ID NO: 719849 - RNA, 22 nt, Human
aaucugaaugaaaaaagggucu

SEQ ID NO: 719850 - RNA, 24 nt, Human
acaaaacaaaacaaaaaacuguua

SEQ ID NO: 719851 - RNA, 25 nt, Human
acaaaacaaaacaaaaaacuguuaa

SEQ ID NO: 719852 - RNA, 24 nt, Human
acauacacagcaguugcacuaaca

SEQ ID NO: 719853 - RNA, 19 nt, Human
acuauuuugccuccuccuu

SEQ ID NO: 719854 - RNA, 25 nt, Human
agaaggaagaaaacaauuugccugg

SEQ ID NO: 719855 - RNA, 20 nt, Human
agaaggcagccacugcauuu

SEQ ID NO: 719856 - RNA, 20 nt, Human
agacaauagaaggcagccac

SEQ ID NO: 719857 - RNA, 20 nt, Human
agcuaugacacauuauggua

SEQ ID NO: 719858 - RNA, 26 nt, Human
aggaaaaaaaaaaguauaaccagugg

SEQ ID NO: 719859 - RNA, 21 nt, Human
aggcuuugcgcuuaugcaauu

SEQ ID NO: 719860 - RNA, 23 nt, Human
agguggccuuaaaaauccaaaca

SEQ ID NO: 719861 - RNA, 21 nt, Human
aguauaaccaguggugugaau

SEQ ID NO: 719862 - RNA, 20 nt, Human
aguugcacuaacagcagcac

SEQ ID NO: 719863 - RNA, 21 nt, Human
auaaagcaagaaaacaagggg

SEQ ID NO: 719864 - RNA, 23 nt, Human
auaaagcaagaaaacaaggggag

SEQ ID NO: 719865 - RNA, 18 nt, Human
auagaaggcagccacugc

SEQ ID NO: 719866 - RNA, 24 nt, Human
aucccguguaucuuuggauuccau

SEQ ID NO: 719867 - RNA, 19 nt, Human
auggguagggguuggggug

SEQ ID NO: 719868 - RNA, 23 nt, Human
caaaacaaaaaacuguuaaacac

SEQ ID NO: 719869 - RNA, 19 nt, Human
caacaaaaaagcaaaagca

SEQ ID NO: 719870 - RNA, 18 nt, Human
caccaaaaaucugucccu

SEQ ID NO: 719871 - RNA, 23 nt, Human
caccaaaaaucugucccuuuccc

SEQ ID NO: 719872 - RNA, 20 nt, Human
caccaccuccccccaccaaa

SEQ ID NO: 719873 - RNA, 22 nt, Human
caccuccccccaccaaaaucug

SEQ ID NO: 719874 - RNA, 20 nt, Human
cagauuucccaacaaucugc

SEQ ID NO: 719875 - RNA, 26 nt, Human
ccaaucaauaaaaaaggaaaaaaaaa

SEQ ID NO: 719876 - RNA, 20 nt, Human
cccagaauaaagcaagaaaa

SEQ ID NO: 719877 - RNA, 19 nt, Human
ccccaccaccuccccccac

SEQ ID NO: 719878 - RNA, 20 nt, Human
ccccaccaccuccccccacc

SEQ ID NO: 719879 - RNA, 22 nt, Human
ccccaccaccuccccccaccaa

SEQ ID NO: 719880 - RNA, 19 nt, Human
cccccaccaccucccccca

SEQ ID NO: 719881 - RNA, 20 nt, Human
cccggcccccaccuccuucc

SEQ ID NO: 719882 - RNA, 19 nt, Human
cccuucaaacuugcccaga

SEQ ID NO: 719883 - RNA, 21 nt, Human
ccuaaaaugcagaguucucug

SEQ ID NO: 719884 - RNA, 20 nt, Human
cgaagaaaucagguggccuu

SEQ ID NO: 719885 - RNA, 22 nt, Human
cgaaugcaugacgaagaaauca

SEQ ID NO: 719886 - RNA, 22 nt, Human
cuggaaucaguuacuuccuuac

SEQ ID NO: 719887 - RNA, 20 nt, Human
cuuuuccccucauuuuugau

SEQ ID NO: 719888 - RNA, 23 nt, Human
gacaauagaaggcagccacugca

SEQ ID NO: 719889 - RNA, 25 nt, Human
gagcaccugaagcaaagguaaagca

SEQ ID NO: 719890 - RNA, 18 nt, Human
gauacugaugaauguucu

SEQ ID NO: 719891 - RNA, 18 nt, Human
ggaauuguuaacagccug

SEQ ID NO: 719892 - RNA, 18 nt, Human
ggacuucuuucaugacuu

SEQ ID NO: 719893 - RNA, 24 nt, Human
ggugauggguagggguuggggugg

SEQ ID NO: 719894 - RNA, 22 nt, Human
guauaaccaguggugugaauaa

SEQ ID NO: 719895 - RNA, 19 nt, Human
gugugaauaauacaagaaa

SEQ ID NO: 719896 - RNA, 23 nt, Human
uaaaaacacacaaaugcacugca

SEQ ID NO: 719897 - RNA, 18 nt, Human
uaaaaauccaaacacgaa

SEQ ID NO: 719898 - RNA, 21 nt, Human
uaaaaguauuaaugaaaaaga

SEQ ID NO: 719899 - RNA, 19 nt, Human
uaaguguaaacuacccugg

SEQ ID NO: 719900 - RNA, 21 nt, Human
uaauuuuaaauauagacagua

SEQ ID NO: 719901 - RNA, 19 nt, Human
uacaaaaacccaaagacau

SEQ ID NO: 719902 - RNA, 18 nt, Human
uacaaauccaaugaagaa

SEQ ID NO: 719903 - RNA, 20 nt, Human
uacacagcaguugcacuaag

SEQ ID NO: 719904 - RNA, 25 nt, Human
uacccuaaaaugcagaguucucuga

SEQ ID NO: 719905 - RNA, 27 nt, Human
uacgaacaaagaaucugaaugaaaaaa

SEQ ID NO: 719906 - RNA, 18 nt, Human
uacucagggcaaauacaa

SEQ ID NO: 719907 - RNA, 22 nt, Human
uaguuaagucagccucaaguac

SEQ ID NO: 719908 - RNA, 18 nt, Human
uaguucagggaacaacaa

SEQ ID NO: 719909 - RNA, 21 nt, Human
uaucaaaaauaggaagacaau

SEQ ID NO: 719910 - RNA, 22 nt, Human
uaucaaaaauaggaagacaaua

SEQ ID NO: 719911 - RNA, 24 nt, Human
uaucaaaaauaggaagacaauaga

SEQ ID NO: 719912 - RNA, 22 nt, Human
uaucucccccaccaccuccccc

SEQ ID NO: 719913 - RNA, 19 nt, Human
uauuuugcuaagcuagcuu

SEQ ID NO: 719914 - RNA, 21 nt, Human
ucaaauaacugcucuacgaac

SEQ ID NO: 719915 - RNA, 20 nt, Human
ucaacaaaaaagcaaaagca

SEQ ID NO: 719916 - RNA, 18 nt, Human
ucagggaacaacaaccaa

SEQ ID NO: 719917 - RNA, 22 nt, Human
ucagggcaaauacaaucucaau

SEQ ID NO: 719918 - RNA, 22 nt, Human
ucagguucaccaaaaaucuguc

SEQ ID NO: 719919 - RNA, 25 nt, Human
uccaaugaagaaacaugauguaacu

SEQ ID NO: 719920 - RNA, 19 nt, Human
uccauaacuguuuuucaaa

SEQ ID NO: 719921 - RNA, 19 nt, Human
ucccuaaauccaaugauua

SEQ ID NO: 719922 - RNA, 19 nt, Human
ucucaaacuguuguuuuuc

SEQ ID NO: 719923 - RNA, 22 nt, Human
ucucccccaccaccucccccca

SEQ ID NO: 719924 - RNA, 22 nt, Human
ucugccacaagucagguucacc

SEQ ID NO: 719925 - RNA, 18 nt, Human
ugaagaaacaugauguaa

SEQ ID NO: 719926 - RNA, 21 nt, Human
ugagccugaaaaaggaacuaa

SEQ ID NO: 719927 - RNA, 21 nt, Human
ugauacaagagccccgauuug

SEQ ID NO: 719928 - RNA, 19 nt, Human
ugauggguagggguugggg

SEQ ID NO: 719929 - RNA, 20 nt, Human
ugauggguagggguuggggu

SEQ ID NO: 719930 - RNA, 23 nt, Human
ugcccagaauaaagcaagaaaac

SEQ ID NO: 719931 - RNA, 25 nt, Human
uggaaacaggaauuccacauuggug

SEQ ID NO: 719932 - RNA, 19 nt, Human
ugggguggguagaaggaag

SEQ ID NO: 719933 - RNA, 20 nt, Human
uggguagggguugggguggg

SEQ ID NO: 719934 - RNA, 21 nt, Human
uuaaaaauccaaacacgaaug

SEQ ID NO: 719935 - RNA, 20 nt, Human
uuacuuccuuacagauuucc

SEQ ID NO: 719936 - RNA, 24 nt, Human
uuauuuacaaaaacccaaagacau

SEQ ID NO: 719937 - RNA, 18 nt, Human
uucaaauaacugcucuac

SEQ ID NO: 719938 - RNA, 23 nt, Human
aaaacaaaucaaacaaaccagaa

SEQ ID NO: 719939 - RNA, 22 nt, Human
aaacaaaucaaacaaaccagaa

SEQ ID NO: 719940 - RNA, 24 nt, Human
aaacaucuguaagaccacaaaaaa

SEQ ID NO: 719941 - RNA, 19 nt, Human
aaacaugagagaguacaaa

SEQ ID NO: 719942 - RNA, 23 nt, Human
aaagagauauuuaaaaccauuaa

SEQ ID NO: 719943 - RNA, 21 nt, Human
aaagauguguuccaacucucc

SEQ ID NO: 719944 - RNA, 18 nt, Human
aaagcagacggaaaagaa

SEQ ID NO: 719945 - RNA, 22 nt, Human
aaauccacacauaagcuaaaga

SEQ ID NO: 719946 - RNA, 19 nt, Human
aacaagauggcaagcacug

SEQ ID NO: 719947 - RNA, 19 nt, Human
aaccugcaagauucccaag

SEQ ID NO: 719948 - RNA, 20 nt, Human
aacuacuuuuguagcacaac

SEQ ID NO: 719949 - RNA, 20 nt, Human
aacucuaaccacugcuggca

SEQ ID NO: 719950 - RNA, 20 nt, Human
aagacacuuuagaccaagga

SEQ ID NO: 719951 - RNA, 20 nt, Human
aagaccacaaaaaaaaaaug

SEQ ID NO: 719952 - RNA, 21 nt, Human
aagcaaagaaggaagcacgug

SEQ ID NO: 719953 - RNA, 19 nt, Human
aagcagcaggcauaaacuu

SEQ ID NO: 719954 - RNA, 18 nt, Human
aagccuaccucaggcccu

SEQ ID NO: 719955 - RNA, 22 nt, Human
aagucaaagagauauuuaaaac

SEQ ID NO: 719956 - RNA, 23 nt, Human
aagucuuuugacaaaccaacucu

SEQ ID NO: 719957 - RNA, 18 nt, Human
acagcccgaguggaagcc

SEQ ID NO: 719958 - RNA, 21 nt, Human
acaggacuguaguaagacggc

SEQ ID NO: 719959 - RNA, 21 nt, Human
accgaaacgccugaugacccc

SEQ ID NO: 719960 - RNA, 26 nt, Human
agaaaaauaaaaaauaauacaaaaaa

SEQ ID NO: 719961 - RNA, 23 nt, Human
agaacauguacacaugugugguu

SEQ ID NO: 719962 - RNA, 23 nt, Human
agaaggaagagggaguaugugag

SEQ ID NO: 719963 - RNA, 20 nt, Human
agaguacaaagaugacaggg

SEQ ID NO: 719964 - RNA, 19 nt, Human
agcuaggugaaaaaagagg

SEQ ID NO: 719965 - RNA, 21 nt, Human
aggaaaagcaaguauuuguca

SEQ ID NO: 719966 - RNA, 22 nt, Human
aggaagcacgugggaaagugag

SEQ ID NO: 719967 - RNA, 19 nt, Human
aggaauuccgagugcuggu

SEQ ID NO: 719968 - RNA, 19 nt, Human
aggaggaacagaagcaaag

SEQ ID NO: 719969 - RNA, 18 nt, Human
aggauagucuucauuauc

SEQ ID NO: 719970 - RNA, 22 nt, Human
aggauagucuucauuaucaggc

SEQ ID NO: 719971 - RNA, 18 nt, Human
aggaugcagguuuucucu

SEQ ID NO: 719972 - RNA, 21 nt, Human
aggugcuuacaggaaaggaua

SEQ ID NO: 719973 - RNA, 21 nt, Human
auaaauccaggucaaaaaucc

SEQ ID NO: 719974 - RNA, 19 nt, Human
auagguauaccgaaacgcc

SEQ ID NO: 719975 - RNA, 24 nt, Human
aucaaguaaacagugucaggaauu

SEQ ID NO: 719976 - RNA, 18 nt, Human
auccagaacauguacaca

SEQ ID NO: 719977 - RNA, 20 nt, Human
augaaucuauuguuugguag

SEQ ID NO: 719978 - RNA, 24 nt, Human
caaaaugauaccuccagaguuccc

SEQ ID NO: 719979 - RNA, 26 nt, Human
caaauuaaaaacaugaaaauuacacc

SEQ ID NO: 719980 - RNA, 22 nt, Human
caacaaaauguaagacaugcaa

SEQ ID NO: 719981 - RNA, 20 nt, Human
caacaacaaagagcacgacc

SEQ ID NO: 719982 - RNA, 22 nt, Human
caacaacaaagagcacgaccac

SEQ ID NO: 719983 - RNA, 22 nt, Human
caacaagcuaagggaaaaauca

SEQ ID NO: 719984 - RNA, 21 nt, Human
caaccuuuccuacaugccaag

SEQ ID NO: 719985 - RNA, 21 nt, Human
caagaugauagccaaagacca

SEQ ID NO: 719986 - RNA, 22 nt, Human
caaggcauuuggggaaccaaag

SEQ ID NO: 719987 - RNA, 18 nt, Human
caaguaaacagugucagg

SEQ ID NO: 719988 - RNA, 18 nt, Human
caaguaaacagugucagg

SEQ ID NO: 719989 - RNA, 19 nt, Human
caaguaaacagugucagga

SEQ ID NO: 719990 - RNA, 23 nt, Human
caaguauggauggaaccagacca

SEQ ID NO: 719991 - RNA, 22 nt, Human
caauuuacagaaaggcaucuga

SEQ ID NO: 719992 - RNA, 21 nt, Human
cacacacaaaaugaaugcuac

SEQ ID NO: 719993 - RNA, 21 nt, Human
cacuuccccaagaugcaaaaa

SEQ ID NO: 719994 - RNA, 18 nt, Human
cagaauacgaagaccaac

SEQ ID NO: 719995 - RNA, 19 nt, Human
cagcaccuugaguacaccu

SEQ ID NO: 719996 - RNA, 21 nt, Human
cagcccugggcggccgacaug

SEQ ID NO: 719997 - RNA, 20 nt, Human
cagcggagccuccuuccugu

SEQ ID NO: 719998 - RNA, 19 nt, Human
caggaggaacagaagcaaa

SEQ ID NO: 719999 - RNA, 21 nt, Human
caguaaccugugccacuuucu

SEQ ID NO: 720000 - RNA, 22 nt, Human
caguuuauaguuuuuccaggau

SEQ ID NO: 720001 - RNA, 19 nt, Human
ccaaggcauuuggggaacc

SEQ ID NO: 720002 - RNA, 24 nt, Human
ccagaccacaucucucuucagcuc

SEQ ID NO: 720003 - RNA, 22 nt, Human
ccagaguucccugaagagagga

SEQ ID NO: 720004 - RNA, 24 nt, Human
cccacugucccagcccugggcggc

SEQ ID NO: 720005 - RNA, 22 nt, Human
cccccgcugcccccacuguccc

SEQ ID NO: 720006 - RNA, 20 nt, Human
ccccgcugcccccacugucc

SEQ ID NO: 720007 - RNA, 18 nt, Human
cccggucccgucagcgcc

SEQ ID NO: 720008 - RNA, 22 nt, Human
cccucauccacccuagagcuca

SEQ ID NO: 720009 - RNA, 22 nt, Human
cccugggcggccgacaugaccc

SEQ ID NO: 720010 - RNA, 18 nt, Human
ccgagugcugguuauagg

SEQ ID NO: 720011 - RNA, 22 nt, Human
ccucauccacccuagagcucaa

SEQ ID NO: 720012 - RNA, 23 nt, Human
ccuggagcucagggcaggagaug

SEQ ID NO: 720013 - RNA, 21 nt, Human
cgugcugguggaggucugugg

SEQ ID NO: 720014 - RNA, 22 nt, Human
cucacuucuauccuaaggacca

SEQ ID NO: 720015 - RNA, 24 nt, Human
cucccaugcgagucuccugcugug

SEQ ID NO: 720016 - RNA, 23 nt, Human
cuccggcaacaaaauguaagaca

SEQ ID NO: 720017 - RNA, 18 nt, Human
cugcugccaucagaccca

SEQ ID NO: 720018 - RNA, 20 nt, Human
cugcugccaucagacccagc

SEQ ID NO: 720019 - RNA, 20 nt, Human
cuguaagaccacaaaaaaaa

SEQ ID NO: 720020 - RNA, 22 nt, Human
cugugucgcacacagcuuuucc

SEQ ID NO: 720021 - RNA, 22 nt, Human
cuuguucaauuuagaauauauu

SEQ ID NO: 720022 - RNA, 19 nt, Human
gaaaaaagaggcacuuaaa

SEQ ID NO: 720023 - RNA, 24 nt, Human
gaaaggauagggaggaaaaagaaa

SEQ ID NO: 720024 - RNA, 18 nt, Human
gacaugacccgcuaacga

SEQ ID NO: 720025 - RNA, 18 nt, Human
gaccauaaacccucaucc

SEQ ID NO: 720026 - RNA, 19 nt, Human
gaccaugaaagucuaagca

SEQ ID NO: 720027 - RNA, 21 nt, Human
gagcacgaccacgacacacac

SEQ ID NO: 720028 - RNA, 27 nt, Human
gagcauucagucuuuggucccugacuu

SEQ ID NO: 720029 - RNA, 26 nt, Human
gaggauagucuucauuaucaggccaa

SEQ ID NO: 720030 - RNA, 20 nt, Human
gccccgggaggaccagcgcu

SEQ ID NO: 720031 - RNA, 19 nt, Human
gccuaccucaggcccugcg

SEQ ID NO: 720032 - RNA, 20 nt, Human
gcugaagucaugcagcaaag

SEQ ID NO: 720033 - RNA, 21 nt, Human
ggaaaaacaggugcuuacagg

SEQ ID NO: 720034 - RNA, 21 nt, Human
ggaggucuguggccuggccag

SEQ ID NO: 720035 - RNA, 22 nt, Human
uaaaacacacaggucuucgaug

SEQ ID NO: 720036 - RNA, 21 nt, Human
uaaaauucuuggcauaauuug

SEQ ID NO: 720037 - RNA, 22 nt, Human
uaaaguaaugagcucacuuccc

SEQ ID NO: 720038 - RNA, 21 nt, Human
uaaaugaagaaagcaucauuu

SEQ ID NO: 720039 - RNA, 20 nt, Human
uaaaugauacuugguucucc

SEQ ID NO: 720040 - RNA, 21 nt, Human
uaacguaucuuuugcuuaaaa

SEQ ID NO: 720041 - RNA, 21 nt, Human
uaagaaaacauggacuugaaa

SEQ ID NO: 720042 - RNA, 19 nt, Human
uaagagcaacaacaaagag

SEQ ID NO: 720043 - RNA, 22 nt, Human
uacagaaaggcaucugauguau

SEQ ID NO: 720044 - RNA, 23 nt, Human
uacccccaagaccuuguauccaa

SEQ ID NO: 720045 - RNA, 19 nt, Human
uaccuccagaguucccuga

SEQ ID NO: 720046 - RNA, 20 nt, Human
uagaauauuguaugacaugg

SEQ ID NO: 720047 - RNA, 18 nt, Human
uaggugaaaaaagaggca

SEQ ID NO: 720048 - RNA, 23 nt, Human
uaguuuuuaaaugauacuugguu

SEQ ID NO: 720049 - RNA, 20 nt, Human
uaguuuuuccaggaugugga

SEQ ID NO: 720050 - RNA, 23 nt, Human
uaugacauggaacuauucagaau

SEQ ID NO: 720051 - RNA, 21 nt, Human
uauuccuuuuccuuuucuacc

SEQ ID NO: 720052 - RNA, 31 nt, Human
ucaacucuaacaaaccuaaggaacaaugagg

SEQ ID NO: 720053 - RNA, 23 nt, Human
ucaagagccaaagaaauguguuc

SEQ ID NO: 720054 - RNA, 18 nt, Human
ucagcuaacagugaccag

SEQ ID NO: 720055 - RNA, 19 nt, Human
ucaggcccucccgauucau

SEQ ID NO: 720056 - RNA, 19 nt, Human
ucagugcuggucauaccau

SEQ ID NO: 720057 - RNA, 19 nt, Human
ucccccgacccccgcugcc

SEQ ID NO: 720058 - RNA, 19 nt, Human
uccccuagcagccagaugg

SEQ ID NO: 720059 - RNA, 18 nt, Human
ucccugaagagaggauag

SEQ ID NO: 720060 - RNA, 19 nt, Human
uccgagugcugguuauagg

SEQ ID NO: 720061 - RNA, 21 nt, Human
uccgagugcugguuauaggua

SEQ ID NO: 720062 - RNA, 23 nt, Human
uccuacaugccaagcugugugau

SEQ ID NO: 720063 - RNA, 21 nt, Human
ucuaccucaaagaagacugcc

SEQ ID NO: 720064 - RNA, 24 nt, Human
ucuccugcugugaguuggccccgg

SEQ ID NO: 720065 - RNA, 23 nt, Human
ucuucaggaaggaugaccugugg

SEQ ID NO: 720066 - RNA, 22 nt, Human
ugaaaacacuaaguuaaacauc

SEQ ID NO: 720067 - RNA, 23 nt, Human
ugaagaagucaaagagauauuua

SEQ ID NO: 720068 - RNA, 18 nt, Human
ugaagucaugcagcaaag

SEQ ID NO: 720069 - RNA, 20 nt, Human
ugacccagcggaaccagcgg

SEQ ID NO: 720070 - RNA, 21 nt, Human
ugacuugcucugggagagaac

SEQ ID NO: 720071 - RNA, 18 nt, Human
ugagaaaauggcagguac

SEQ ID NO: 720072 - RNA, 22 nt, Human
ugagaaaauggcagguaccugg

SEQ ID NO: 720073 - RNA, 21 nt, Human
ugagauguccauaaacugaaa

SEQ ID NO: 720074 - RNA, 20 nt, Human
ugagccucuugcucagcucc

SEQ ID NO: 720075 - RNA, 20 nt, Human
ugcagguuuucucugccugg

SEQ ID NO: 720076 - RNA, 20 nt, Human
ugcauguaaugggucaggag

SEQ ID NO: 720077 - RNA, 18 nt, Human
ugccaucagacccagcua

SEQ ID NO: 720078 - RNA, 24 nt, Human
ugccaucagacccagcuacuacuc

SEQ ID NO: 720079 - RNA, 22 nt, Human
ugccugagaaaauggcagguac

SEQ ID NO: 720080 - RNA, 23 nt, Human
ugcucagcuccccuagcagccag

SEQ ID NO: 720081 - RNA, 23 nt, Human
ugcugugaguuggccccgggagg

SEQ ID NO: 720082 - RNA, 18 nt, Human
uggacuaauggagcugcu

SEQ ID NO: 720083 - RNA, 22 nt, Human
ugggccccuagaggagcugcuc

SEQ ID NO: 720084 - RNA, 20 nt, Human
uggugccauacuccuguagc

SEQ ID NO: 720085 - RNA, 23 nt, Human
ugguggcaggagguuaagugcua

SEQ ID NO: 720086 - RNA, 20 nt, Human
uguacacaugugugguucua

SEQ ID NO: 720087 - RNA, 19 nt, Human
uguauaaauccaggucaaa

SEQ ID NO: 720088 - RNA, 22 nt, Human
ugucaggaauuccgagugcugg

SEQ ID NO: 720089 - RNA, 19 nt, Human
ugucccagcccugggcggc

SEQ ID NO: 720090 - RNA, 20 nt, Human
ugucccagcccugggcggcc

SEQ ID NO: 720091 - RNA, 22 nt, Human
ugugcauguaaugggucaggag

SEQ ID NO: 720092 - RNA, 24 nt, Human
uuaaagcagacggaaaagaaggca

SEQ ID NO: 720093 - RNA, 24 nt, Human
uuaagauuucaaccuauucugugu

SEQ ID NO: 720094 - RNA, 24 nt, Human
uuagacacaucuugaaaacacuaa

SEQ ID NO: 720095 - RNA, 25 nt, Human
uuagccuucucagcuuccccuaaau

SEQ ID NO: 720096 - RNA, 26 nt, Human
uucaacucuaauuguucagccugacu

SEQ ID NO: 720097 - RNA, 20 nt, Human
uugccacccuggacagccug

SEQ ID NO: 720098 - RNA, 20 nt, Human
uuggccaccacaaguuuuuc

SEQ ID NO: 720099 - RNA, 18 nt, Human
uuuaggaaacuccuuaca

SEQ ID NO: 720100 - RNA, 22 nt, Human
uuucucuuucccagaacugaac

SEQ ID NO: 720101 - RNA, 20 nt, Human
uuugugguuguugcuguugc

SEQ ID NO: 720102 - RNA, 24 nt, Human
aaagugcugggauuacagguguga

SEQ ID NO: 720103 - RNA, 24 nt, Human
aaagugcugggauuacagguguga

SEQ ID NO: 720104 - RNA, 21 nt, Human
aaauaauuauuacacaaaacc

SEQ ID NO: 720105 - RNA, 27 nt, Human
aagcaauucuccugccucagucuccca

SEQ ID NO: 720106 - RNA, 18 nt, Human
aaggcaccacacuggaaa

SEQ ID NO: 720107 - RNA, 22 nt, Human
aaguagcugggauuacaggugc

SEQ ID NO: 720108 - RNA, 18 nt, Human
aagugcugggauuacagg

SEQ ID NO: 720109 - RNA, 18 nt, Human
aagugcugggauuacagg

SEQ ID NO: 720110 - RNA, 19 nt, Human
aagugcugggauuacaggu

SEQ ID NO: 720111 - RNA, 19 nt, Human
aagugcugggauuacaggu

SEQ ID NO: 720112 - RNA, 21 nt, Human
aaugucacuucaaauuccuga

SEQ ID NO: 720113 - RNA, 23 nt, Human
acaaaaccuauguaacacacacu

SEQ ID NO: 720114 - RNA, 18 nt, Human
acaaugagagacccacac

SEQ ID NO: 720115 - RNA, 18 nt, Human
acaauuuucaccaguacc

SEQ ID NO: 720116 - RNA, 19 nt, Human
acagacaggguuucaccau

SEQ ID NO: 720117 - RNA, 22 nt, Human
acagacgcuagcggacaaacca

SEQ ID NO: 720118 - RNA, 19 nt, Human
acaggguuucaccauguug

SEQ ID NO: 720119 - RNA, 20 nt, Human
acaggguuucaccauguugu

SEQ ID NO: 720120 - RNA, 24 nt, Human
acaggguuucaccauguuguucag

SEQ ID NO: 720121 - RNA, 23 nt, Human
accacuuugacacuuuucaugcu

SEQ ID NO: 720122 - RNA, 23 nt, Human
accauguuguucaggcuggucuc

SEQ ID NO: 720123 - RNA, 25 nt, Human
acccaucucggccucccaaagugcu

SEQ ID NO: 720124 - RNA, 27 nt, Human
agaaaaacagccugagguucucuugaa

SEQ ID NO: 720125 - RNA, 20 nt, Human
agaauuuaaauguacuagaa

SEQ ID NO: 720126 - RNA, 23 nt, Human
agaugaagaaucugagacucaga

SEQ ID NO: 720127 - RNA, 24 nt, Human
agcgcucuuucaaaaugccaccuu

SEQ ID NO: 720128 - RNA, 21 nt, Human
aggaaaucauuagguauauuc

SEQ ID NO: 720129 - RNA, 25 nt, Human
aggguuccuuucacuccaauuucuu

SEQ ID NO: 720130 - RNA, 22 nt, Human
aggugccugccaccaggcccag

SEQ ID NO: 720131 - RNA, 24 nt, Human
agucagaauauccagguuauaauc

SEQ ID NO: 720132 - RNA, 20 nt, Human
agugcaguggcacaaucuug

SEQ ID NO: 720133 - RNA, 24 nt, Human
agugcaguggcacaaucuuggcuc

SEQ ID NO: 720134 - RNA, 23 nt, Human
auaaaggagcagcuuuaguguca

SEQ ID NO: 720135 - RNA, 19 nt, Human
auaaagugcaaaagcuaua

SEQ ID NO: 720136 - RNA, 21 nt, Human
auaguacacaacuguaaauaa

SEQ ID NO: 720137 - RNA, 24 nt, Human
augauccacccaucucggccuccc

SEQ ID NO: 720138 - RNA, 24 nt, Human
augauccacccaucucggccuccc

SEQ ID NO: 720139 - RNA, 24 nt, Human
augugaggcauauaaaaggcacca

SEQ ID NO: 720140 - RNA, 19 nt, Human
auuacaggugccugccacc

SEQ ID NO: 720141 - RNA, 19 nt, Human
caaaacagcaggcuuggac

SEQ ID NO: 720142 - RNA, 24 nt, Human
caaagugcugggauuacaggugug

SEQ ID NO: 720143 - RNA, 24 nt, Human
caaagugcugggauuacaggugug

SEQ ID NO: 720144 - RNA, 19 nt, Human
caacuccaaucccaaaaga

SEQ ID NO: 720145 - RNA, 21 nt, Human
caagcaauucuccugccucag

SEQ ID NO: 720146 - RNA, 20 nt, Human
cacacuggaaagaauccaag

SEQ ID NO: 720147 - RNA, 20 nt, Human
cacacuuuauaguacacaac

SEQ ID NO: 720148 - RNA, 21 nt, Human
caccaggcccagcuaauuuuu

SEQ ID NO: 720149 - RNA, 24 nt, Human
caccauguuguucaggcuggucuc

SEQ ID NO: 720150 - RNA, 22 nt, Human
cacccaucucggccucccaaag

SEQ ID NO: 720151 - RNA, 22 nt, Human
cacccaucucggccucccaaag

SEQ ID NO: 720152 - RNA, 23 nt, Human
cacccaucucggccucccaaagu

SEQ ID NO: 720153 - RNA, 23 nt, Human
cacccaucucggccucccaaagu

SEQ ID NO: 720154 - RNA, 21 nt, Human
caccgcacccagcacuuuggc

SEQ ID NO: 720155 - RNA, 24 nt, Human
cagaaaaacagccugagguucucu

SEQ ID NO: 720156 - RNA, 19 nt, Human
cagaacauccugugacuga

SEQ ID NO: 720157 - RNA, 20 nt, Human
cagaacauccugugacugac

SEQ ID NO: 720158 - RNA, 20 nt, Human
cagacagacgcuagcggaca

SEQ ID NO: 720159 - RNA, 22 nt, Human
cagccagaaagccaguuauauc

SEQ ID NO: 720160 - RNA, 23 nt, Human
cagccucucucauguauaccaag

SEQ ID NO: 720161 - RNA, 24 nt, Human
caggguuucaccauguuguucagg

SEQ ID NO: 720162 - RNA, 19 nt, Human
caggugccugccaccaggc

SEQ ID NO: 720163 - RNA, 23 nt, Human
cauguuguucaggcuggucucaa

SEQ ID NO: 720164 - RNA, 20 nt, Human
ccaaagugcugggauuacag

SEQ ID NO: 720165 - RNA, 20 nt, Human
ccaaagugcugggauuacag

SEQ ID NO: 720166 - RNA, 21 nt, Human
ccaaagugcugggauuacagg

SEQ ID NO: 720167 - RNA, 21 nt, Human
ccaaagugcugggauuacagg

SEQ ID NO: 720168 - RNA, 21 nt, Human
ccaaagugcugggauuacagg

SEQ ID NO: 720169 - RNA, 21 nt, Human
ccaaagugcugggauuacagg

SEQ ID NO: 720170 - RNA, 24 nt, Human
ccaaagugcugggauuacaggugu

SEQ ID NO: 720171 - RNA, 24 nt, Human
ccaaagugcugggauuacaggugu

SEQ ID NO: 720172 - RNA, 21 nt, Human
ccaaguagcugggauuacagg

SEQ ID NO: 720173 - RNA, 19 nt, Human
ccaguuucaagcaauucuc

SEQ ID NO: 720174 - RNA, 23 nt, Human
ccauacacuccacaacuccaauc

SEQ ID NO: 720175 - RNA, 22 nt, Human
cccaaguagcugggauuacagg

SEQ ID NO: 720176 - RNA, 22 nt, Human
cccaaguagcugggauuacagg

SEQ ID NO: 720177 - RNA, 24 nt, Human
cccaaguagcugggauuacaggug

SEQ ID NO: 720178 - RNA, 19 nt, Human
cccuaaguucaucaucuuu

SEQ ID NO: 720179 - RNA, 20 nt, Human
ccuaguaacuaacaaucuac

SEQ ID NO: 720180 - RNA, 24 nt, Human
ccuguagcagaguaaaaccggggc

SEQ ID NO: 720181 - RNA, 24 nt, Human
ccuuccaguuucaagcaauucucc

SEQ ID NO: 720182 - RNA, 19 nt, Human
cuaccacccuacacacacc

SEQ ID NO: 720183 - RNA, 20 nt, Human
cuauguaacacacacuuuau

SEQ ID NO: 720184 - RNA, 23 nt, Human
cucaaaaaugacaucugagagga

SEQ ID NO: 720185 - RNA, 24 nt, Human
cucacugcaaccucugccuuccag

SEQ ID NO: 720186 - RNA, 24 nt, Human
cucagucucccaaguagcugggau

SEQ ID NO: 720187 - RNA, 20 nt, Human
cugcaaccucugccuuccag

SEQ ID NO: 720188 - RNA, 23 nt, Human
cugcaaccucugccuuccaguuu

SEQ ID NO: 720189 - RNA, 24 nt, Human
cugcaaccucugccuuccaguuuc

SEQ ID NO: 720190 - RNA, 28 nt, Human
cugccauacacuccacaacuccaauccc

SEQ ID NO: 720191 - RNA, 23 nt, Human
cugccucagucucccaaguagcu

SEQ ID NO: 720192 - RNA, 18 nt, Human
cuuaaauaacuuuuccac

SEQ ID NO: 720193 - RNA, 18 nt, Human
cuuccuugacuacauccu

SEQ ID NO: 720194 - RNA, 22 nt, Human
cuucuuauucagcaauuuagca

SEQ ID NO: 720195 - RNA, 19 nt, Human
gaacacgauuaaacaaguc

SEQ ID NO: 720196 - RNA, 21 nt, Human
gaacauccugugacugacccu

SEQ ID NO: 720197 - RNA, 20 nt, Human
gaagguguuuaaccaguuua

SEQ ID NO: 720198 - RNA, 21 nt, Human
gacagcauaaacaaaaacaau

SEQ ID NO: 720199 - RNA, 23 nt, Human
gacaggguuucaccauguuguuc

SEQ ID NO: 720200 - RNA, 23 nt, Human
gaccacucaaaaaugacaucuga

SEQ ID NO: 720201 - RNA, 22 nt, Human
gaccucaugauccacccaucuc

SEQ ID NO: 720202 - RNA, 24 nt, Human
gaccucaugauccacccaucucgg

SEQ ID NO: 720203 - RNA, 24 nt, Human
gaccucaugauccacccaucucgg

SEQ ID NO: 720204 - RNA, 19 nt, Human
gauguaucuguauaucaua

SEQ ID NO: 720205 - RNA, 18 nt, Human
gauuacaggugccugcca

SEQ ID NO: 720206 - RNA, 18 nt, Human
gauuacaggugugagaca

SEQ ID NO: 720207 - RNA, 18 nt, Human
gauuacaggugugagaca

SEQ ID NO: 720208 - RNA, 22 nt, Human
gauuacaggugugagacaccgc

SEQ ID NO: 720209 - RNA, 22 nt, Human
gauuacaggugugagacaccgc

SEQ ID NO: 720210 - RNA, 22 nt, Human
gccauacacuccacaacuccaa

SEQ ID NO: 720211 - RNA, 24 nt, Human
gcccagcuaauuuuuuuguauuuu

SEQ ID NO: 720212 - RNA, 24 nt, Human
gccuaguaacuaacaaucuacaga

SEQ ID NO: 720213 - RNA, 24 nt, Human
gccucagucucccaaguagcuggg

SEQ ID NO: 720214 - RNA, 19 nt, Human
gcuagagugcaguggcaca

SEQ ID NO: 720215 - RNA, 19 nt, Human
gcuagcggacaaaccacuu

SEQ ID NO: 720216 - RNA, 20 nt, Human
gcucacugcaaccucugccu

SEQ ID NO: 720217 - RNA, 23 nt, Human
gcugcuuuuugaucugaugacag

SEQ ID NO: 720218 - RNA, 19 nt, Human
gcuggcagcaccuuggccu

SEQ ID NO: 720219 - RNA, 19 nt, Human
gcuuauugcccaggcuaga

SEQ ID NO: 720220 - RNA, 18 nt, Human
ggaaaggauugcuggcag

SEQ ID NO: 720221 - RNA, 22 nt, Human
ggaguuuugcuuauugcccagg

SEQ ID NO: 720222 - RNA, 19 nt, Human
ggccccugacugucacuuc

SEQ ID NO: 720223 - RNA, 20 nt, Human
ggcuggucucaacugcugac

SEQ ID NO: 720224 - RNA, 20 nt, Human
ggcuggucucaacugcugac

SEQ ID NO: 720225 - RNA, 19 nt, Human
gugugucagaacauccugu

SEQ ID NO: 720226 - RNA, 23 nt, Human
guucugcagacagacgcuagcgg

SEQ ID NO: 720227 - RNA, 21 nt, Human
uaaauaacuuuuccacagaug

SEQ ID NO: 720228 - RNA, 18 nt, Human
uaaauacaaaucuaaaua

SEQ ID NO: 720229 - RNA, 20 nt, Human
uaaaucaugucuaaauacaa

SEQ ID NO: 720230 - RNA, 25 nt, Human
uaagaaaaagcacugggccaggagu

SEQ ID NO: 720231 - RNA, 24 nt, Human
uaauagauacccuguggauguauc

SEQ ID NO: 720232 - RNA, 18 nt, Human
uaaucuguaggguuccuu

SEQ ID NO: 720233 - RNA, 22 nt, Human
uacacuccacaacuccaauccc

SEQ ID NO: 720234 - RNA, 22 nt, Human
uacagacaggguuucaccaugu

SEQ ID NO: 720235 - RNA, 24 nt, Human
uaccaagaauggaagccgaaggcu

SEQ ID NO: 720236 - RNA, 23 nt, Human
uagagugcaguggcacaaucuug

SEQ ID NO: 720237 - RNA, 24 nt, Human
uagagugcaguggcacaaucuugg

SEQ ID NO: 720238 - RNA, 21 nt, Human
uagcagaguaaaacuggacca

SEQ ID NO: 720239 - RNA, 22 nt, Human
uaggaaugucacuucaaauucc

SEQ ID NO: 720240 - RNA, 24 nt, Human
uaguacacaacuguaaauaagaau

SEQ ID NO: 720241 - RNA, 24 nt, Human
uaguacagacaggguuucaccaug

SEQ ID NO: 720242 - RNA, 18 nt, Human
uaguaugugauguuaccu

SEQ ID NO: 720243 - RNA, 19 nt, Human
uauagccauaucugcucac

SEQ ID NO: 720244 - RNA, 22 nt, Human
uaucaucacugucagaaaaaca

SEQ ID NO: 720245 - RNA, 19 nt, Human
uauguaacacacacuuuau

SEQ ID NO: 720246 - RNA, 25 nt, Human
uauguaacacacacuuuauaguaca

SEQ ID NO: 720247 - RNA, 22 nt, Human
uauugcccaggcuagagugcag

SEQ ID NO: 720248 - RNA, 18 nt, Human
ucaaaaggucagaaguuu

SEQ ID NO: 720249 - RNA, 24 nt, Human
ucaacacuuccuuuuauucuaaaa

SEQ ID NO: 720250 - RNA, 27 nt, Human
ucaacugcugaccucaugauccaccca

SEQ ID NO: 720251 - RNA, 27 nt, Human
ucaacugcugaccucaugauccaccca

SEQ ID NO: 720252 - RNA, 21 nt, Human
ucaccauguuguucaggcugg

SEQ ID NO: 720253 - RNA, 18 nt, Human
ucacugcaaccucugccu

SEQ ID NO: 720254 - RNA, 19 nt, Human
ucacugcaaccucugccuu

SEQ ID NO: 720255 - RNA, 23 nt, Human
ucacugcaaccucugccuuccag

SEQ ID NO: 720256 - RNA, 19 nt, Human
ucagaaagauaaaggagca

SEQ ID NO: 720257 - RNA, 20 nt, Human
ucagaacauccugugacuga

SEQ ID NO: 720258 - RNA, 27 nt, Human
ucauccauuuucuuuucaacacuuccu

SEQ ID NO: 720259 - RNA, 23 nt, Human
uccaagagaaugaaaaaucacuu

SEQ ID NO: 720260 - RNA, 24 nt, Human
uccaagagaaugaaaaaucacuuc

SEQ ID NO: 720261 - RNA, 19 nt, Human
uccacaacuccaaucccaa

SEQ ID NO: 720262 - RNA, 20 nt, Human
uccagauuacagaugaagaa

SEQ ID NO: 720263 - RNA, 23 nt, Human
ucccaaagugcugggauuacagg

SEQ ID NO: 720264 - RNA, 23 nt, Human
ucccaaagugcugggauuacagg

SEQ ID NO: 720265 - RNA, 23 nt, Human
ucccaaguagcugggauuacagg

SEQ ID NO: 720266 - RNA, 20 nt, Human
uccuaaauccucagacagcc

SEQ ID NO: 720267 - RNA, 20 nt, Human
ucucagccagaaagccaguu

SEQ ID NO: 720268 - RNA, 20 nt, Human
ucucggccucccaaagugcu

SEQ ID NO: 720269 - RNA, 20 nt, Human
ucucggccucccaaagugcu

SEQ ID NO: 720270 - RNA, 27 nt, Human
ucucucauguauaccaagaauggaagc

SEQ ID NO: 720271 - RNA, 19 nt, Human
ucuugaacuccuaaauccu

SEQ ID NO: 720272 - RNA, 20 nt, Human
ugaaacagcuuugugacacu

SEQ ID NO: 720273 - RNA, 24 nt, Human
ugaaacagcuuugugacacugaag

SEQ ID NO: 720274 - RNA, 22 nt, Human
ugaacuagaaaggauugauuau

SEQ ID NO: 720275 - RNA, 20 nt, Human
ugacacugaaggaaucuacu

SEQ ID NO: 720276 - RNA, 18 nt, Human
ugacagcauaaacaaaaa

SEQ ID NO: 720277 - RNA, 21 nt, Human
ugacagcauaaacaaaaacaa

SEQ ID NO: 720278 - RNA, 23 nt, Human
ugaccucaugauccacccaucuc

SEQ ID NO: 720279 - RNA, 18 nt, Human
ugacuuccaggcugagau

SEQ ID NO: 720280 - RNA, 21 nt, Human
ugagaacacgauuaaacaagu

SEQ ID NO: 720281 - RNA, 22 nt, Human
ugagaacacgauuaaacaaguc

SEQ ID NO: 720282 - RNA, 22 nt, Human
ugagaacacgauuaaacaaguc

SEQ ID NO: 720283 - RNA, 24 nt, Human
ugauccacccaucucggccuccca

SEQ ID NO: 720284 - RNA, 24 nt, Human
ugauccacccaucucggccuccca

SEQ ID NO: 720285 - RNA, 22 nt, Human
ugaugacagauggcuuggagau

SEQ ID NO: 720286 - RNA, 20 nt, Human
ugcaaccucugccuuccagu

SEQ ID NO: 720287 - RNA, 22 nt, Human
ugcaguggcacaaucuuggcuc

SEQ ID NO: 720288 - RNA, 27 nt, Human
ugccauacacuccacaacuccaauccc

SEQ ID NO: 720289 - RNA, 24 nt, Human
ugcccaggcuagagugcaguggca

SEQ ID NO: 720290 - RNA, 23 nt, Human
ugccucagucucccaaguagcug

SEQ ID NO: 720291 - RNA, 24 nt, Human
ugccucagucucccaaguagcugg

SEQ ID NO: 720292 - RNA, 24 nt, Human
ugcugggauuacaggugugagaca

SEQ ID NO: 720293 - RNA, 24 nt, Human
ugcugggauuacaggugugagaca

SEQ ID NO: 720294 - RNA, 21 nt, Human
ugcuugcccagcgcucuuuca

SEQ ID NO: 720295 - RNA, 19 nt, Human
uggaaaggauugcuggcag

SEQ ID NO: 720296 - RNA, 23 nt, Human
uggaaucagggccccugacuguc

SEQ ID NO: 720297 - RNA, 25 nt, Human
uggaccacucaaaaaugacaucuga

SEQ ID NO: 720298 - RNA, 23 nt, Human
uggaguuuugcuuauugcccagg

SEQ ID NO: 720299 - RNA, 24 nt, Human
uggcacaaucuuggcucacugcaa

SEQ ID NO: 720300 - RNA, 19 nt, Human
uggcagcaccuuggccucu

SEQ ID NO: 720301 - RNA, 21 nt, Human
ugggauuacaggugccugcca

SEQ ID NO: 720302 - RNA, 22 nt, Human
ugggauuacaggugccugccac

SEQ ID NO: 720303 - RNA, 24 nt, Human
ugggauuacaggugccugccacca

SEQ ID NO: 720304 - RNA, 18 nt, Human
ugggauuacaggugugag

SEQ ID NO: 720305 - RNA, 18 nt, Human
ugggauuacaggugugag

SEQ ID NO: 720306 - RNA, 18 nt, Human
ugggauuacaggugugag

SEQ ID NO: 720307 - RNA, 18 nt, Human
ugggauuacaggugugag

SEQ ID NO: 720308 - RNA, 21 nt, Human
ugggauuacaggugugagaca

SEQ ID NO: 720309 - RNA, 21 nt, Human
ugggauuacaggugugagaca

SEQ ID NO: 720310 - RNA, 22 nt, Human
ugggauuacaggugugagacac

SEQ ID NO: 720311 - RNA, 22 nt, Human
ugggauuacaggugugagacac

SEQ ID NO: 720312 - RNA, 23 nt, Human
ugggauuacaggugugagacacc

SEQ ID NO: 720313 - RNA, 23 nt, Human
ugggauuacaggugugagacacc

SEQ ID NO: 720314 - RNA, 24 nt, Human
ugggauuacaggugugagacaccg

SEQ ID NO: 720315 - RNA, 24 nt, Human
ugggauuacaggugugagacaccg

SEQ ID NO: 720316 - RNA, 19 nt, Human
uggguucaaaacagcaggc

SEQ ID NO: 720317 - RNA, 25 nt, Human
ugucaagcuuugggccccccgaauu

SEQ ID NO: 720318 - RNA, 18 nt, Human
ugugcugagccaguuuug

SEQ ID NO: 720319 - RNA, 23 nt, Human
uguuacgacaaccuccaaugagg

SEQ ID NO: 720320 - RNA, 20 nt, Human
uguucaggcuggucucaacu

SEQ ID NO: 720321 - RNA, 21 nt, Human
uuaaggaaaucauuagguaua

SEQ ID NO: 720322 - RNA, 19 nt, Human
uuaauggucauccauuuuc

SEQ ID NO: 720323 - RNA, 20 nt, Human
uuacagaugcacgagcacuu

SEQ ID NO: 720324 - RNA, 24 nt, Human
uuaguacagacaggguuucaccau

SEQ ID NO: 720325 - RNA, 23 nt, Human
uuauucuaaaaggaaauuuuguc

SEQ ID NO: 720326 - RNA, 20 nt, Human
uucaaaaugccaccuugcca

SEQ ID NO: 720327 - RNA, 20 nt, Human
uucaaaaugccaccuugcca

SEQ ID NO: 720328 - RNA, 21 nt, Human
uucaagcaauucuccugccuc

SEQ ID NO: 720329 - RNA, 24 nt, Human
uucaagcaauucuccugccucagu

SEQ ID NO: 720330 - RNA, 25 nt, Human
uuccacagaugauaggaaugucacu

SEQ ID NO: 720331 - RNA, 24 nt, Human
uuccagaaaacuuuuucuuccuug

SEQ ID NO: 720332 - RNA, 24 nt, Human
uuccaguuucaagcaauucuccug

SEQ ID NO: 720333 - RNA, 20 nt, Human
uuccuugacuacauccucag

SEQ ID NO: 720334 - RNA, 20 nt, Human
uuccuuuuauucuaaaagga

SEQ ID NO: 720335 - RNA, 21 nt, Human
uuccuuuuuuucuuuuuugag

SEQ ID NO: 720336 - RNA, 19 nt, Human
uucugauuuggagucucuu

SEQ ID NO: 720337 - RNA, 18 nt, Human
uugcccaggcuagagugc

SEQ ID NO: 720338 - RNA, 19 nt, Human
uuuauagccauaucugcuu

SEQ ID NO: 720339 - RNA, 24 nt, Human
uuucaccauguuguucaggcuggu

SEQ ID NO: 720340 - RNA, 24 nt, Human
uuucuuuuuccuuuuuuucuuuuu

SEQ ID NO: 720341 - RNA, 22 nt, Human
uuucuuuuuuuaaaaaaugugg

SEQ ID NO: 720342 - RNA, 22 nt, Human
uuugccccuuaacacaaagaug

SEQ ID NO: 720343 - RNA, 19 nt, Human
uuuuaaggaaaucauuagg

SEQ ID NO: 720344 - RNA, 21 nt, Human
uuuuacagauauggcauuacu

SEQ ID NO: 720345 - RNA, 23 nt, Human
uuuugcuuauugcccaggcuaga

SEQ ID NO: 720346 - RNA, 22 nt, Human
uuuuguauuuuuaguacagaca

SEQ ID NO: 720347 - RNA, 24 nt, Human
uuuuuaguacagacaggguuucac

SEQ ID NO: 720348 - RNA, 21 nt, Human
aaaaaacgcuuauaaacacca

SEQ ID NO: 720349 - RNA, 22 nt, Human
aaaaaacgcuuauaaacaccau

SEQ ID NO: 720350 - RNA, 23 nt, Human
aaacaauggaacaucaggucaaa

SEQ ID NO: 720351 - RNA, 24 nt, Human
aaacaauggaacaucaggucaaac

SEQ ID NO: 720352 - RNA, 18 nt, Human
aaagguccuuaucuuucu

SEQ ID NO: 720353 - RNA, 27 nt, Human
aaauagacaaugaggaucguaaagaaa

SEQ ID NO: 720354 - RNA, 21 nt, Human
aacuucucagagaagcuacac

SEQ ID NO: 720355 - RNA, 21 nt, Human
aagcaguuauggacuggcuca

SEQ ID NO: 720356 - RNA, 24 nt, Human
aauuuacuuuccaaugaaaaaaau

SEQ ID NO: 720357 - RNA, 23 nt, Human
acaacagugacaagacauacacu

SEQ ID NO: 720358 - RNA, 19 nt, Human
acacuuucuuuccaaugaa

SEQ ID NO: 720359 - RNA, 22 nt, Human
acagaguugucuucuuucaaag

SEQ ID NO: 720360 - RNA, 20 nt, Human
acucccuaugccaucugcau

SEQ ID NO: 720361 - RNA, 23 nt, Human
agaccugaauauaacgagaaaau

SEQ ID NO: 720362 - RNA, 23 nt, Human
agccaccaucuucaguucuggga

SEQ ID NO: 720363 - RNA, 19 nt, Human
aggacgcucuagcuuaaaa

SEQ ID NO: 720364 - RNA, 26 nt, Human
aggggaaaaauacucuaauauuuuga

SEQ ID NO: 720365 - RNA, 21 nt, Human
aguggcaaggaaugggaaaga

SEQ ID NO: 720366 - RNA, 24 nt, Human
aucagccuuuuaugauuuuaguuu

SEQ ID NO: 720367 - RNA, 18 nt, Human
caagugggaaauaaacuu

SEQ ID NO: 720368 - RNA, 24 nt, Human
cacuggaaucuuuacagcuuacca

SEQ ID NO: 720369 - RNA, 20 nt, Human
cagaauauaccacaucccac

SEQ ID NO: 720370 - RNA, 21 nt, Human
cagaguugucuucuuucaaag

SEQ ID NO: 720371 - RNA, 23 nt, Human
cauaaucuacacuuaaaugacau

SEQ ID NO: 720372 - RNA, 25 nt, Human
caucauaggacuucaaagaauggaa

SEQ ID NO: 720373 - RNA, 27 nt, Human
caucuucaguucugggagccugaguuu

SEQ ID NO: 720374 - RNA, 20 nt, Human
caugugaaugcuauacaagu

SEQ ID NO: 720375 - RNA, 20 nt, Human
cauuuugcaauuacauaugc

SEQ ID NO: 720376 - RNA, 18 nt, Human
ccauuucccccuaaaaca

SEQ ID NO: 720377 - RNA, 22 nt, Human
cccuugguugcugaccuagggc

SEQ ID NO: 720378 - RNA, 25 nt, Human
ccuaaaacugcucugucagggacuu

SEQ ID NO: 720379 - RNA, 21 nt, Human
cgcuuauaaacaccauugcuc

SEQ ID NO: 720380 - RNA, 18 nt, Human
cuaugcucuucuguggag

SEQ ID NO: 720381 - RNA, 18 nt, Human
cuuagaaacguuguagag

SEQ ID NO: 720382 - RNA, 21 nt, Human
gacaaugaggaucguaaagaa

SEQ ID NO: 720383 - RNA, 22 nt, Human
ggugacggaggagcagccggaa

SEQ ID NO: 720384 - RNA, 23 nt, Human
guugugcacccuuuuucuacagg

SEQ ID NO: 720385 - RNA, 22 nt, Human
uaaaaaaacgcuuauaaacacc

SEQ ID NO: 720386 - RNA, 23 nt, Human
uaaacucacucucagaaaaccau

SEQ ID NO: 720387 - RNA, 20 nt, Human
uaaauaaaaacaccaacguu

SEQ ID NO: 720388 - RNA, 23 nt, Human
uaaauaucacaacagugacaaga

SEQ ID NO: 720389 - RNA, 23 nt, Human
uaacuacaacaacuauggcagaa

SEQ ID NO: 720390 - RNA, 19 nt, Human
uaaucaccaaaaaaggcuu

SEQ ID NO: 720391 - RNA, 21 nt, Human
uaaucuacacuuaaaugacau

SEQ ID NO: 720392 - RNA, 21 nt, Human
uacucccuaugccaucugcau

SEQ ID NO: 720393 - RNA, 22 nt, Human
uagagauggaaaagugauuugg

SEQ ID NO: 720394 - RNA, 20 nt, Human
uagcaacuaaauccagacac

SEQ ID NO: 720395 - RNA, 19 nt, Human
uauuacuguaauuaaaaug

SEQ ID NO: 720396 - RNA, 18 nt, Human
ucaaacaacucuugcuac

SEQ ID NO: 720397 - RNA, 21 nt, Human
ucacauugaagcuuuugcucc

SEQ ID NO: 720398 - RNA, 25 nt, Human
ucacucucagaaaaccauucucaaa

SEQ ID NO: 720399 - RNA, 18 nt, Human
ucaggcugaauauugcug

SEQ ID NO: 720400 - RNA, 20 nt, Human
uccccaaauggcacaagccu

SEQ ID NO: 720401 - RNA, 20 nt, Human
ucucagagaagcuacacugg

SEQ ID NO: 720402 - RNA, 18 nt, Human
ucuguggaguuuuccucu

SEQ ID NO: 720403 - RNA, 24 nt, Human
ucuucaguucugggagccugaguu

SEQ ID NO: 720404 - RNA, 27 nt, Human
ugaaaaaaaucagccauuggcgauaua

SEQ ID NO: 720405 - RNA, 19 nt, Human
ugaauuguuuggcucaaaa

SEQ ID NO: 720406 - RNA, 25 nt, Human
ugccaucugcauauuggcacccugc

SEQ ID NO: 720407 - RNA, 22 nt, Human
ugcuacauuagcuaaaacacag

SEQ ID NO: 720408 - RNA, 20 nt, Human
uggaaaagugauuuggcuga

SEQ ID NO: 720409 - RNA, 18 nt, Human
uggcagaaaugcuuucag

SEQ ID NO: 720410 - RNA, 21 nt, Human
uggcgauauaacuacaacaac

SEQ ID NO: 720411 - RNA, 21 nt, Human
uggcuaaaaguggccuaugcu

SEQ ID NO: 720412 - RNA, 18 nt, Human
uggcucaaaaaugcacac

SEQ ID NO: 720413 - RNA, 23 nt, Human
ugggguuugcugcagaaauggug

SEQ ID NO: 720414 - RNA, 18 nt, Human
uguauuugugacuuaauc

SEQ ID NO: 720415 - RNA, 23 nt, Human
ugugaaugcuauacaagugggaa

SEQ ID NO: 720416 - RNA, 18 nt, Human
uuaaaauaaacuuuugga

SEQ ID NO: 720417 - RNA, 21 nt, Human
uuaaauaucacaacagugaca

SEQ ID NO: 720418 - RNA, 19 nt, Human
uuaguucuaacaacaaacc

SEQ ID NO: 720419 - RNA, 25 nt, Human
uucaaagaauggaagaauauagccc

SEQ ID NO: 720420 - RNA, 26 nt, Human
uucaaagaauggaagaauauagcccc

SEQ ID NO: 720421 - RNA, 18 nt, Human
uucagagggauaaucauc

SEQ ID NO: 720422 - RNA, 22 nt, Human
uucccccuaaaacagaacugau

SEQ ID NO: 720423 - RNA, 22 nt, Human
uucuucagagggauaaucaucc

SEQ ID NO: 720424 - RNA, 18 nt, Human
uugaagccaaugaaaucc

SEQ ID NO: 720425 - RNA, 21 nt, Human
uugucuucuuucaaagguccu

SEQ ID NO: 720426 - RNA, 18 nt, Human
uuuaaaauaaacuuuugg

SEQ ID NO: 720427 - RNA, 21 nt, Human
uuugcuccuuuuuacaaggua

SEQ ID NO: 720428 - RNA, 24 nt, Human
aaguuaccuuuugaagaugagaca

SEQ ID NO: 720429 - RNA, 25 nt, Human
acaacagggcacgagccuccggacc

SEQ ID NO: 720430 - RNA, 27 nt, Human
cagccaggaacaacacccauuaggcac

SEQ ID NO: 720431 - RNA, 23 nt, Human
caggagacucggcgagaaaaccc

SEQ ID NO: 720432 - RNA, 22 nt, Human
cccaggagacucggcgagaaaa

SEQ ID NO: 720433 - RNA, 21 nt, Human
ccccacaacagggcacgagcc

SEQ ID NO: 720434 - RNA, 19 nt, Human
cgagaaaaccccucaggcc

SEQ ID NO: 720435 - RNA, 19 nt, Human
cucaggcccuggacaucaa

SEQ ID NO: 720436 - RNA, 18 nt, Human
gagccuccggaccgcccc

SEQ ID NO: 720437 - RNA, 18 nt, Human
gagccuccggaccgcccc

SEQ ID NO: 720438 - RNA, 19 nt, Human
ggcccuggacaucaagucc

SEQ ID NO: 720439 - RNA, 23 nt, Human
ugacagaaaaggagaaaggcuuc

SEQ ID NO: 720440 - RNA, 21 nt, Human
ugagacaagacagguucuaag

SEQ ID NO: 720441 - RNA, 22 nt, Human
ugagacaagacagguucuaagc

SEQ ID NO: 720442 - RNA, 21 nt, Human
uucuaagcuaaucagacgugu

SEQ ID NO: 720443 - RNA, 25 nt, Human
uucuaagcuaaucagacguguccac

SEQ ID NO: 720444 - RNA, 18 nt, Human
aaacaaaagaaaugcaca

SEQ ID NO: 720445 - RNA, 23 nt, Human
aaacaaacaaaagaaaugcacag

SEQ ID NO: 720446 - RNA, 22 nt, Human
aaacagcaacaaacaaacaaaa

SEQ ID NO: 720447 - RNA, 23 nt, Human
aaagcuccuccaggcucugcagc

SEQ ID NO: 720448 - RNA, 24 nt, Human
aacaaaaggaaagaaaacagcuac

SEQ ID NO: 720449 - RNA, 20 nt, Human
aacagggggcagucaagaug

SEQ ID NO: 720450 - RNA, 19 nt, Human
aacuguguaaccaccaccc

SEQ ID NO: 720451 - RNA, 22 nt, Human
aacuguguaaccaccacccagu

SEQ ID NO: 720452 - RNA, 24 nt, Human
aagaaaccguucuuugaacacaug

SEQ ID NO: 720453 - RNA, 19 nt, Human
aagaugccgccacccacca

SEQ ID NO: 720454 - RNA, 18 nt, Human
aagcaggagggagaaggg

SEQ ID NO: 720455 - RNA, 20 nt, Human
aagcaggugaagcucaugga

SEQ ID NO: 720456 - RNA, 20 nt, Human
aaggaagcccugggggcuga

SEQ ID NO: 720457 - RNA, 23 nt, Human
aaggucacaaaucaaggagcuga

SEQ ID NO: 720458 - RNA, 24 nt, Human
aaguugccugcugcugcucagagc

SEQ ID NO: 720459 - RNA, 21 nt, Human
acacacacacacauacacaca

SEQ ID NO: 720460 - RNA, 19 nt, Human
acacacaugcaugcacaca

SEQ ID NO: 720461 - RNA, 23 nt, Human
accaacaacaaaaggaaagaaaa

SEQ ID NO: 720462 - RNA, 19 nt, Human
accacaucggcccaguuuu

SEQ ID NO: 720463 - RNA, 25 nt, Human
accacccaguguccccaagagagca

SEQ ID NO: 720464 - RNA, 25 nt, Human
accugggccaccugggacagaccuc

SEQ ID NO: 720465 - RNA, 21 nt, Human
acugccagguugggagccuca

SEQ ID NO: 720466 - RNA, 21 nt, Human
agaagggcagacaggggucgg

SEQ ID NO: 720467 - RNA, 18 nt, Human
agacagagagagcacgug

SEQ ID NO: 720468 - RNA, 25 nt, Human
agacagcuuggcgaggcacccuguc

SEQ ID NO: 720469 - RNA, 19 nt, Human
agacaggggucgguugagc

SEQ ID NO: 720470 - RNA, 25 nt, Human
agacggaaauccaagcacuugaaca

SEQ ID NO: 720471 - RNA, 19 nt, Human
agagagcagcccagaucau

SEQ ID NO: 720472 - RNA, 19 nt, Human
agaggcgcggcugccucag

SEQ ID NO: 720473 - RNA, 20 nt, Human
agaggcuaguucagucccuu

SEQ ID NO: 720474 - RNA, 24 nt, Human
agagggagagagaaucagagaggc

SEQ ID NO: 720475 - RNA, 23 nt, Human
agauguugauuccagggcagagu

SEQ ID NO: 720476 - RNA, 18 nt, Human
agcagcccagaucauggc

SEQ ID NO: 720477 - RNA, 23 nt, Human
agcauccuuaacaacccccaccc

SEQ ID NO: 720478 - RNA, 23 nt, Human
aggagcaguguggaucaaggaca

SEQ ID NO: 720479 - RNA, 25 nt, Human
aggagcgaggcaucgaggagagggc

SEQ ID NO: 720480 - RNA, 18 nt, Human
aggagggagaagggcaga

SEQ ID NO: 720481 - RNA, 19 nt, Human
aggcaggaguugcaccaag

SEQ ID NO: 720482 - RNA, 18 nt, Human
aggcaggguccccaagug

SEQ ID NO: 720483 - RNA, 21 nt, Human
aggccccuuggucaagacccu

SEQ ID NO: 720484 - RNA, 20 nt, Human
aggcgggcuggagugaaggg

SEQ ID NO: 720485 - RNA, 21 nt, Human
aggcugaaggcaggcgggcug

SEQ ID NO: 720486 - RNA, 22 nt, Human
aggcugcagcuuucggcagcug

SEQ ID NO: 720487 - RNA, 19 nt, Human
aggggucagggcugggcug

SEQ ID NO: 720488 - RNA, 21 nt, Human
augccaacggaccccaccccc

SEQ ID NO: 720489 - RNA, 19 nt, Human
auggcccuaauuccccuac

SEQ ID NO: 720490 - RNA, 28 nt, Human
caaagcucagccauuuguucuccccagg

SEQ ID NO: 720491 - RNA, 19 nt, Human
caacaaacaaacaaaagaa

SEQ ID NO: 720492 - RNA, 19 nt, Human
caacccccacccccacccc

SEQ ID NO: 720493 - RNA, 20 nt, Human
caacccccacccccaccccg

SEQ ID NO: 720494 - RNA, 20 nt, Human
caagagagcagcccagaucu

SEQ ID NO: 720495 - RNA, 21 nt, Human
caagaugccgccacccaccac

SEQ ID NO: 720496 - RNA, 20 nt, Human
cacacacgcugcacucacca

SEQ ID NO: 720497 - RNA, 22 nt, Human
cacacacgcugcacucaccacg

SEQ ID NO: 720498 - RNA, 20 nt, Human
caccaccccucccuuccaag

SEQ ID NO: 720499 - RNA, 23 nt, Human
caccaccugggccaccugggaca

SEQ ID NO: 720500 - RNA, 18 nt, Human
caccacgcacugaagggc

SEQ ID NO: 720501 - RNA, 19 nt, Human
caccaggauggcccccagg

SEQ ID NO: 720502 - RNA, 18 nt, Human
cacccaccacucacccag

SEQ ID NO: 720503 - RNA, 23 nt, Human
caccccucccuuccaagcuccca

SEQ ID NO: 720504 - RNA, 22 nt, Human
cacccuguucuaccugcaccac

SEQ ID NO: 720505 - RNA, 24 nt, Human
caccucccccagcacccaugggcc

SEQ ID NO: 720506 - RNA, 20 nt, Human
cacugcauugaccccacacc

SEQ ID NO: 720507 - RNA, 21 nt, Human
cagaugcugggaggcugggga

SEQ ID NO: 720508 - RNA, 19 nt, Human
cagcacuggacgcggagag

SEQ ID NO: 720509 - RNA, 23 nt, Human
cagcaggggcuguaacuguagca

SEQ ID NO: 720510 - RNA, 26 nt, Human
cagcaguuaaaucuacagacggaaau

SEQ ID NO: 720511 - RNA, 21 nt, Human
cagccagaagacccagagaca

SEQ ID NO: 720512 - RNA, 24 nt, Human
cagcccagaucauggcuccaccac

SEQ ID NO: 720513 - RNA, 19 nt, Human
cagcuacaaggaggccgaa

SEQ ID NO: 720514 - RNA, 26 nt, Human
cagcucuccucccgcggucugccucc

SEQ ID NO: 720515 - RNA, 19 nt, Human
cagggcugggcuggaggac

SEQ ID NO: 720516 - RNA, 22 nt, Human
caucucaacaccuaaaagcucc

SEQ ID NO: 720517 - RNA, 18 nt, Human
cauggucucagagugcgg

SEQ ID NO: 720518 - RNA, 20 nt, Human
ccaacggaccccacccccuc

SEQ ID NO: 720519 - RNA, 21 nt, Human
ccaauccuagcaagagcagaa

SEQ ID NO: 720520 - RNA, 21 nt, Human
ccacacacacacacacauaca

SEQ ID NO: 720521 - RNA, 18 nt, Human
ccacacccaccacucacc

SEQ ID NO: 720522 - RNA, 23 nt, Human
ccaccaggauggcccccagguuc

SEQ ID NO: 720523 - RNA, 26 nt, Human
ccacccaccaccccucccuuccaagc

SEQ ID NO: 720524 - RNA, 20 nt, Human
ccagggucuaggauucagag

SEQ ID NO: 720525 - RNA, 18 nt, Human
ccauuuguucuccccagg

SEQ ID NO: 720526 - RNA, 18 nt, Human
cccacacccaccacucac

SEQ ID NO: 720527 - RNA, 21 nt, Human
cccacacccaccacucaccca

SEQ ID NO: 720528 - RNA, 21 nt, Human
cccaccaccccucccuuccaa

SEQ ID NO: 720529 - RNA, 19 nt, Human
cccacccccaccccgagga

SEQ ID NO: 720530 - RNA, 25 nt, Human
cccaggccaugcuuccuucuccauc

SEQ ID NO: 720531 - RNA, 20 nt, Human
ccccagcauccuuaacaacc

SEQ ID NO: 720532 - RNA, 21 nt, Human
cccccagcauccuuaacaacc

SEQ ID NO: 720533 - RNA, 22 nt, Human
cccccucuccucacccuguucu

SEQ ID NO: 720534 - RNA, 23 nt, Human
cccccucuccucacccuguucua

SEQ ID NO: 720535 - RNA, 23 nt, Human
cccccucuccucacccuguucuc

SEQ ID NO: 720536 - RNA, 23 nt, Human
ccccugcaauccuaccagaggcu

SEQ ID NO: 720537 - RNA, 22 nt, Human
ccccugggacugccgccagccc

SEQ ID NO: 720538 - RNA, 20 nt, Human
cccugccccucccuccccuu

SEQ ID NO: 720539 - RNA, 20 nt, Human
cccugccccucccuccccuu

SEQ ID NO: 720540 - RNA, 24 nt, Human
cccuuccucugaacuccuuccuuc

SEQ ID NO: 720541 - RNA, 19 nt, Human
ccgccacccaccaccccuc

SEQ ID NO: 720542 - RNA, 22 nt, Human
ccucagagcccggcugcaccug

SEQ ID NO: 720543 - RNA, 22 nt, Human
ccucccuuccaagcucccaggc

SEQ ID NO: 720544 - RNA, 19 nt, Human
ccugaacugagccggggcu

SEQ ID NO: 720545 - RNA, 19 nt, Human
ccugucccuggccucucag

SEQ ID NO: 720546 - RNA, 20 nt, Human
cgacacgaggcagggucccc

SEQ ID NO: 720547 - RNA, 22 nt, Human
cgaggcacccugucccuggccu

SEQ ID NO: 720548 - RNA, 24 nt, Human
cgcacacacgcugcacucaccacg

SEQ ID NO: 720549 - RNA, 18 nt, Human
cggcuguccucagcucuc

SEQ ID NO: 720550 - RNA, 23 nt, Human
cucccaguccccccagguggagc

SEQ ID NO: 720551 - RNA, 20 nt, Human
cuccccuggcaggaggaaga

SEQ ID NO: 720552 - RNA, 18 nt, Human
cuccuucuguggugucuc

SEQ ID NO: 720553 - RNA, 19 nt, Human
cucucagcugcugcccucc

SEQ ID NO: 720554 - RNA, 18 nt, Human
cugagccggggccggggc

SEQ ID NO: 720555 - RNA, 20 nt, Human
cugcagccacagccuccucc

SEQ ID NO: 720556 - RNA, 21 nt, Human
cugcagcuuucggcagcugcu

SEQ ID NO: 720557 - RNA, 18 nt, Human
cugcugcaaccuaccaga

SEQ ID NO: 720558 - RNA, 20 nt, Human
cugcugcuccuggcccucag

SEQ ID NO: 720559 - RNA, 20 nt, Human
cuggguggcaggccccuugg

SEQ ID NO: 720560 - RNA, 19 nt, Human
cuguagcaucagcaucacg

SEQ ID NO: 720561 - RNA, 23 nt, Human
cugucacccgucccagccaucug

SEQ ID NO: 720562 - RNA, 24 nt, Human
cuuaacaacccccacccccacccc

SEQ ID NO: 720563 - RNA, 22 nt, Human
cuuccaagcucccaggccaugc

SEQ ID NO: 720564 - RNA, 19 nt, Human
cuugagugcccaucaacgc

SEQ ID NO: 720565 - RNA, 21 nt, Human
cuugcuguggcugggcguccu

SEQ ID NO: 720566 - RNA, 20 nt, Human
gaaaacagcuacaaggaggc

SEQ ID NO: 720567 - RNA, 19 nt, Human
gacagagagaggacaggag

SEQ ID NO: 720568 - RNA, 19 nt, Human
gacaucaagaggacagggg

SEQ ID NO: 720569 - RNA, 18 nt, Human
gacccccucuccucaccc

SEQ ID NO: 720570 - RNA, 19 nt, Human
gagaggacaggagaaagag

SEQ ID NO: 720571 - RNA, 22 nt, Human
gagaggacaggagaaagagggg

SEQ ID NO: 720572 - RNA, 20 nt, Human
gagagggagagagaaucaga

SEQ ID NO: 720573 - RNA, 18 nt, Human
gagccgacccccucuccu

SEQ ID NO: 720574 - RNA, 18 nt, Human
gaggacacggcuggggga

SEQ ID NO: 720575 - RNA, 21 nt, Human
gaggaugggggcgcaggggaa

SEQ ID NO: 720576 - RNA, 20 nt, Human
gaggcuggggacugccaggu

SEQ ID NO: 720577 - RNA, 24 nt, Human
gagggagaagggcagacagggguc

SEQ ID NO: 720578 - RNA, 19 nt, Human
gaggggacugggggaccug

SEQ ID NO: 720579 - RNA, 22 nt, Human
gagggugacaucaagaggacag

SEQ ID NO: 720580 - RNA, 21 nt, Human
gaguguuaagggucagggagg

SEQ ID NO: 720581 - RNA, 21 nt, Human
gaucugacauccaccuccccc

SEQ ID NO: 720582 - RNA, 18 nt, Human
gcagggcuggaugacuca

SEQ ID NO: 720583 - RNA, 19 nt, Human
gcgggcuggagugaagggg

SEQ ID NO: 720584 - RNA, 25 nt, Human
gcugcaaccuaccagaucugacauc

SEQ ID NO: 720585 - RNA, 19 nt, Human
gcugcccuccuccucugcc

SEQ ID NO: 720586 - RNA, 23 nt, Human
gcuggagugaaggggggugacca

SEQ ID NO: 720587 - RNA, 21 nt, Human
gcuugcuguggcugggcgucc

SEQ ID NO: 720588 - RNA, 18 nt, Human
ggaagccccucugcgggg

SEQ ID NO: 720589 - RNA, 20 nt, Human
ggacacccuuccucugaacu

SEQ ID NO: 720590 - RNA, 19 nt, Human
ggacaggagaaagagggga

SEQ ID NO: 720591 - RNA, 24 nt, Human
ggaccagucucaguggggcgaaag

SEQ ID NO: 720592 - RNA, 20 nt, Human
ggaccuggaacgacgcgaca

SEQ ID NO: 720593 - RNA, 20 nt, Human
ggagagggagagagaaucag

SEQ ID NO: 720594 - RNA, 24 nt, Human
ggagagggcacuggaggggcuggg

SEQ ID NO: 720595 - RNA, 22 nt, Human
ggccuggggcagccaaggggag

SEQ ID NO: 720596 - RNA, 20 nt, Human
ggcugaaggcaggcgggcug

SEQ ID NO: 720597 - RNA, 18 nt, Human
ggcugggcuggaggacac

SEQ ID NO: 720598 - RNA, 22 nt, Human
gggaggugaaggacagagagag

SEQ ID NO: 720599 - RNA, 20 nt, Human
gggcacacacccccuuagcc

SEQ ID NO: 720600 - RNA, 21 nt, Human
gggcuggagugaaggggggug

SEQ ID NO: 720601 - RNA, 18 nt, Human
ggggagugggggcaggaa

SEQ ID NO: 720602 - RNA, 23 nt, Human
ggggauguuggggaacagcgagg

SEQ ID NO: 720603 - RNA, 20 nt, Human
ggggucagggcugggcugga

SEQ ID NO: 720604 - RNA, 20 nt, Human
ggguagaaaccaagggguca

SEQ ID NO: 720605 - RNA, 18 nt, Human
ggugaccaccccccacgu

SEQ ID NO: 720606 - RNA, 18 nt, Human
guggagcaggguccuucu

SEQ ID NO: 720607 - RNA, 19 nt, Human
guggaguguacuuguuucc

SEQ ID NO: 720608 - RNA, 23 nt, Human
uaaaacauauuuacaaggacaca

SEQ ID NO: 720609 - RNA, 26 nt, Human
uaaaacauauuuacaaggacacacaa

SEQ ID NO: 720610 - RNA, 27 nt, Human
uaaaaccaacaacaaaaggaaagaaaa

SEQ ID NO: 720611 - RNA, 22 nt, Human
uaacaacccccacccccacccc

SEQ ID NO: 720612 - RNA, 21 nt, Human
uaaccaccacccagugucccc

SEQ ID NO: 720613 - RNA, 20 nt, Human
uacuuguuuccuuaggcuga

SEQ ID NO: 720614 - RNA, 19 nt, Human
uagacagcucccugccccu

SEQ ID NO: 720615 - RNA, 28 nt, Human
uaggagaugcacuugucugaaaaagccc

SEQ ID NO: 720616 - RNA, 21 nt, Human
uaggauucagagcugccccau

SEQ ID NO: 720617 - RNA, 21 nt, Human
uauggaacagcauuucccuga

SEQ ID NO: 720618 - RNA, 22 nt, Human
uauggaguuaaguggggcucug

SEQ ID NO: 720619 - RNA, 24 nt, Human
ucaacaccuaaaagcuccuccagg

SEQ ID NO: 720620 - RNA, 24 nt, Human
ucaacgcacacgcacacagucuaa

SEQ ID NO: 720621 - RNA, 22 nt, Human
ucaacuguguaaccaccaccca

SEQ ID NO: 720622 - RNA, 20 nt, Human
ucaaggucacaaaucaagga

SEQ ID NO: 720623 - RNA, 18 nt, Human
ucacacugucacccgucc

SEQ ID NO: 720624 - RNA, 18 nt, Human
ucacagccccaagucugg

SEQ ID NO: 720625 - RNA, 20 nt, Human
ucagaacugggcugcggaau

SEQ ID NO: 720626 - RNA, 19 nt, Human
ucagagcucugcuguugag

SEQ ID NO: 720627 - RNA, 18 nt, Human
ucaucugaggcugguggg

SEQ ID NO: 720628 - RNA, 22 nt, Human
uccaucacccuuggacccucuc

SEQ ID NO: 720629 - RNA, 18 nt, Human
ucccaccccgcugcuggc

SEQ ID NO: 720630 - RNA, 22 nt, Human
ucccaggccaccaggauggccc

SEQ ID NO: 720631 - RNA, 23 nt, Human
ucccaggccaccaggauggcccc

SEQ ID NO: 720632 - RNA, 19 nt, Human
ucccaggccaugcuuccuu

SEQ ID NO: 720633 - RNA, 22 nt, Human
uccccaaguggaggcagggcgg

SEQ ID NO: 720634 - RNA, 18 nt, Human
ucccccagcacccauggg

SEQ ID NO: 720635 - RNA, 19 nt, Human
ucccugccccucccucccc

SEQ ID NO: 720636 - RNA, 18 nt, Human
uccucagcucuccucccg

SEQ ID NO: 720637 - RNA, 20 nt, Human
uccucagcucuccucccgcg

SEQ ID NO: 720638 - RNA, 20 nt, Human
ucggaagauguugauuccag

SEQ ID NO: 720639 - RNA, 18 nt, Human
ucggcagcugcuucucuc

SEQ ID NO: 720640 - RNA, 23 nt, Human
ucucugaguggucucucaaggca

SEQ ID NO: 720641 - RNA, 19 nt, Human
ucucugcugcaaccuacca

SEQ ID NO: 720642 - RNA, 18 nt, Human
ucugccgccaccaccuuc

SEQ ID NO: 720643 - RNA, 21 nt, Human
ucugcugggaacuuccucggg

SEQ ID NO: 720644 - RNA, 20 nt, Human
ucugugccacacacaugcca

SEQ ID NO: 720645 - RNA, 22 nt, Human
ucugugccacacacaugccaug

SEQ ID NO: 720646 - RNA, 24 nt, Human
ugaaaaagcccagcacuggacgcg

SEQ ID NO: 720647 - RNA, 19 nt, Human
ugagaggaugggggcgcag

SEQ ID NO: 720648 - RNA, 23 nt, Human
ugagccgacccccucuccucacc

SEQ ID NO: 720649 - RNA, 18 nt, Human
ugagggaaguggggcugg

SEQ ID NO: 720650 - RNA, 18 nt, Human
ugagggaaguggggcugg

SEQ ID NO: 720651 - RNA, 21 nt, Human
ugagggaaguggggcuggaca

SEQ ID NO: 720652 - RNA, 20 nt, Human
ugcaccaccugggccaccug

SEQ ID NO: 720653 - RNA, 19 nt, Human
ugcacucacacugucaccc

SEQ ID NO: 720654 - RNA, 20 nt, Human
ugcagcuuucggcagcugcu

SEQ ID NO: 720655 - RNA, 21 nt, Human
ugccacacacacacacacaua

SEQ ID NO: 720656 - RNA, 20 nt, Human
ugccgccaccaccuucauuc

SEQ ID NO: 720657 - RNA, 19 nt, Human
ugcggaaugggaagcaguu

SEQ ID NO: 720658 - RNA, 21 nt, Human
uggaaagcaguuugcucuggc

SEQ ID NO: 720659 - RNA, 23 nt, Human
uggaggggcuggguggcaggccc

SEQ ID NO: 720660 - RNA, 23 nt, Human
uggaguuaaguggggcucugcua

SEQ ID NO: 720661 - RNA, 20 nt, Human
uggcaggaggaagaucaugg

SEQ ID NO: 720662 - RNA, 20 nt, Human
uggcccccagguucacacac

SEQ ID NO: 720663 - RNA, 24 nt, Human
uggccucucagcugcugcccuccu

SEQ ID NO: 720664 - RNA, 26 nt, Human
ugggagccucacccagagagccucac

SEQ ID NO: 720665 - RNA, 22 nt, Human
ugggaggcuggggacugccagg

SEQ ID NO: 720666 - RNA, 22 nt, Human
ugggaggcuggggacugccagg

SEQ ID NO: 720667 - RNA, 19 nt, Human
ugggcuggaggacacggcu

SEQ ID NO: 720668 - RNA, 25 nt, Human
uggggaggugaaggacagagagagg

SEQ ID NO: 720669 - RNA, 22 nt, Human
uggggcagccaaggggaguucc

SEQ ID NO: 720670 - RNA, 23 nt, Human
ugggggaucucauuucauggauu

SEQ ID NO: 720671 - RNA, 25 nt, Human
uggguggcaggccccuuggucaagg

SEQ ID NO: 720672 - RNA, 24 nt, Human
uggucuggguucgaccuggggggu

SEQ ID NO: 720673 - RNA, 22 nt, Human
ugguuaggagaugcacuugucu

SEQ ID NO: 720674 - RNA, 24 nt, Human
uguacuuguuuccuuaggcugagu

SEQ ID NO: 720675 - RNA, 19 nt, Human
uguccucagcucuccuccc

SEQ ID NO: 720676 - RNA, 21 nt, Human
ugugaauguauuuuaaaacca

SEQ ID NO: 720677 - RNA, 21 nt, Human
uguggccucagagcccggcug

SEQ ID NO: 720678 - RNA, 20 nt, Human
uguggcugggcguccuggcc

SEQ ID NO: 720679 - RNA, 20 nt, Human
ugugggacaacagggggcag

SEQ ID NO: 720680 - RNA, 23 nt, Human
ugugugaauguauuuuaaaacca

SEQ ID NO: 720681 - RNA, 26 nt, Human
uguguggaguguacuuguuuccuuag

SEQ ID NO: 720682 - RNA, 21 nt, Human
uguugagucccccccggcagc

SEQ ID NO: 720683 - RNA, 23 nt, Human
uuaaaaauaacauuugauuuccu

SEQ ID NO: 720684 - RNA, 22 nt, Human
uuaaggaauuugcuuugcugag

SEQ ID NO: 720685 - RNA, 18 nt, Human
uucagagcugccccaucu

SEQ ID NO: 720686 - RNA, 18 nt, Human
uuccccaggccccccagc

SEQ ID NO: 720687 - RNA, 19 nt, Human
uucuuccagcauggcccua

SEQ ID NO: 720688 - RNA, 23 nt, Human
uugaccccacacccaccacucac

SEQ ID NO: 720689 - RNA, 23 nt, Human
uugaggccgcccuucagcuccac

SEQ ID NO: 720690 - RNA, 21 nt, Human
uugauuccagggcagagugag

SEQ ID NO: 720691 - RNA, 19 nt, Human
uuuccauuuucuuaaaaau

SEQ ID NO: 720692 - RNA, 23 nt, Human
uuuuaauguccuuccucccaccc

SEQ ID NO: 720693 - RNA, 27 nt, Human
aaaaaaaaaaaaaaaaaagacauaaaa

SEQ ID NO: 720694 - RNA, 24 nt, Human
aaaaaaaaagacauaaaauacaaa

SEQ ID NO: 720695 - RNA, 23 nt, Human
aaaaaaagagaacaaacaaacaa

SEQ ID NO: 720696 - RNA, 27 nt, Human
aaaaaaagagaacaaacaaacaaaaaa

SEQ ID NO: 720697 - RNA, 21 nt, Human
aaaaaaagggacuagaaaugc

SEQ ID NO: 720698 - RNA, 25 nt, Human
aaaauaaauccauugugaaaccaga

SEQ ID NO: 720699 - RNA, 26 nt, Human
aaaauaaauccauugugaaaccagaa

SEQ ID NO: 720700 - RNA, 27 nt, Human
aaacagccagcaaaaccaugagguuuu

SEQ ID NO: 720701 - RNA, 22 nt, Human
aaacauaauucagaguucaugc

SEQ ID NO: 720702 - RNA, 22 nt, Human
aaauaaauauauaaaaucaaga

SEQ ID NO: 720703 - RNA, 19 nt, Human
aacaaggaaaacaaaacag

SEQ ID NO: 720704 - RNA, 19 nt, Human
aacuguaacaucucccucc

SEQ ID NO: 720705 - RNA, 21 nt, Human
aacuguaugaccuguugccuu

SEQ ID NO: 720706 - RNA, 21 nt, Human
aagggaaacagugcaagagaa

SEQ ID NO: 720707 - RNA, 21 nt, Human
aauaacccaaaccuuuuucca

SEQ ID NO: 720708 - RNA, 23 nt, Human
aauagcaaacaccaacauguccc

SEQ ID NO: 720709 - RNA, 20 nt, Human
aaugucauugaaaccuaaaa

SEQ ID NO: 720710 - RNA, 20 nt, Human
acaauagaaaaagagaaagg

SEQ ID NO: 720711 - RNA, 18 nt, Human
acagugcaagagaagcag

SEQ ID NO: 720712 - RNA, 21 nt, Human
accagcucacugcaccucggc

SEQ ID NO: 720713 - RNA, 20 nt, Human
accauucuguuuauucuugu

SEQ ID NO: 720714 - RNA, 20 nt, Human
accccuuuuucuccccuuag

SEQ ID NO: 720715 - RNA, 27 nt, Human
agaaaauaaauccauugugaaaccaga

SEQ ID NO: 720716 - RNA, 22 nt, Human
agagagaaaauaaauccauugu

SEQ ID NO: 720717 - RNA, 21 nt, Human
agcaaacaccaacaugucccu

SEQ ID NO: 720718 - RNA, 21 nt, Human
agcuggccaauucaauagcaa

SEQ ID NO: 720719 - RNA, 26 nt, Human
aggaaaaaaagagaacaaacaaacaa

SEQ ID NO: 720720 - RNA, 21 nt, Human
aggcaguuuaaagauuauuug

SEQ ID NO: 720721 - RNA, 20 nt, Human
agguacuaaagaaaacccag

SEQ ID NO: 720722 - RNA, 23 nt, Human
auaugaaaaugugaacacuguuu

SEQ ID NO: 720723 - RNA, 24 nt, Human
auucuguuuauucuuguuuccuca

SEQ ID NO: 720724 - RNA, 22 nt, Human
caaaaaaagggacuagaaaugc

SEQ ID NO: 720725 - RNA, 23 nt, Human
caaacaaacaaggaaaacaaaac

SEQ ID NO: 720726 - RNA, 20 nt, Human
caaacugcaaagcagccuuc

SEQ ID NO: 720727 - RNA, 24 nt, Human
caaacugcaaagcagccuuccaag

SEQ ID NO: 720728 - RNA, 21 nt, Human
caaagcagccuuccaagagaa

SEQ ID NO: 720729 - RNA, 22 nt, Human
caaauaaggagugguuaaguau

SEQ ID NO: 720730 - RNA, 21 nt, Human
caacccacguuuuggucucau

SEQ ID NO: 720731 - RNA, 20 nt, Human
caagaauggcaaaaaaaaaa

SEQ ID NO: 720732 - RNA, 23 nt, Human
caaugccacacagcaagcagagc

SEQ ID NO: 720733 - RNA, 22 nt, Human
caccucggcucgaagcugagga

SEQ ID NO: 720734 - RNA, 18 nt, Human
cacuggcuagaagaaugc

SEQ ID NO: 720735 - RNA, 21 nt, Human
cacuguauauacauacaaaau

SEQ ID NO: 720736 - RNA, 21 nt, Human
caggaaaagccuagcaugaaa

SEQ ID NO: 720737 - RNA, 18 nt, Human
cauaugccucuaaaaagu

SEQ ID NO: 720738 - RNA, 21 nt, Human
caucucccuccuguaacaauc

SEQ ID NO: 720739 - RNA, 23 nt, Human
caugaaacaaacaaacaaggaaa

SEQ ID NO: 720740 - RNA, 24 nt, Human
caugcgcuuugauacaaacagcaa

SEQ ID NO: 720741 - RNA, 23 nt, Human
ccaauucaauagcaaacaccaac

SEQ ID NO: 720742 - RNA, 19 nt, Human
ccaguaaauaagugcuuga

SEQ ID NO: 720743 - RNA, 24 nt, Human
ccagucaccacugcaaaacaaaug

SEQ ID NO: 720744 - RNA, 22 nt, Human
ccggcucgccgcccaggcuccc

SEQ ID NO: 720745 - RNA, 23 nt, Human
ccggcucgccgcccaggcucccg

SEQ ID NO: 720746 - RNA, 19 nt, Human
ccucaagaauggcaaaaaa

SEQ ID NO: 720747 - RNA, 23 nt, Human
cgccucgcgguccccccaccagc

SEQ ID NO: 720748 - RNA, 20 nt, Human
cgcuuugauacaaacagcaa

SEQ ID NO: 720749 - RNA, 19 nt, Human
cucgccucgcggucccccc

SEQ ID NO: 720750 - RNA, 19 nt, Human
cugaaaccaaacacaaaua

SEQ ID NO: 720751 - RNA, 22 nt, Human
cugcaaaacaaaugcauccauc

SEQ ID NO: 720752 - RNA, 19 nt, Human
cugcaccucggcucgaagc

SEQ ID NO: 720753 - RNA, 19 nt, Human
cuguacaaauaacucaggu

SEQ ID NO: 720754 - RNA, 24 nt, Human
cuugccauuaacauuuccuguucu

SEQ ID NO: 720755 - RNA, 23 nt, Human
gaaaagccuagcaugaaacaaac

SEQ ID NO: 720756 - RNA, 23 nt, Human
gaaacaaacaaacaaggaaaaca

SEQ ID NO: 720757 - RNA, 21 nt, Human
gagaacaaugccacacagcaa

SEQ ID NO: 720758 - RNA, 22 nt, Human
gccaauucaauagcaaacacca

SEQ ID NO: 720759 - RNA, 20 nt, Human
guuggggugaaaacauguca

SEQ ID NO: 720760 - RNA, 24 nt, Human
uaaauaaagcuacaguugaucaga

SEQ ID NO: 720761 - RNA, 20 nt, Human
uaacaguauuucaguuaagc

SEQ ID NO: 720762 - RNA, 19 nt, Human
uacaaaauuuaaacagcaa

SEQ ID NO: 720763 - RNA, 22 nt, Human
uaccuccuuccagaaguuggcc

SEQ ID NO: 720764 - RNA, 23 nt, Human
uagaaaugccacaaaauuauuuu

SEQ ID NO: 720765 - RNA, 21 nt, Human
uagaagaaugcaaaaggaaaa

SEQ ID NO: 720766 - RNA, 21 nt, Human
uagcaaacaccaacauguccc

SEQ ID NO: 720767 - RNA, 20 nt, Human
uagcaccagauaguuggggu

SEQ ID NO: 720768 - RNA, 22 nt, Human
uagguacuaaagaaaacccaga

SEQ ID NO: 720769 - RNA, 19 nt, Human
uaguguaaauacaaacugc

SEQ ID NO: 720770 - RNA, 27 nt, Human
uauacacauauacaaaauuuaaacagc

SEQ ID NO: 720771 - RNA, 23 nt, Human
uauauaaaaucaagacaaucaag

SEQ ID NO: 720772 - RNA, 18 nt, Human
uauauacauacaaaauuu

SEQ ID NO: 720773 - RNA, 19 nt, Human
uaugcuuguuuucucaaaa

SEQ ID NO: 720774 - RNA, 20 nt, Human
uauuauacaacauaugaaag

SEQ ID NO: 720775 - RNA, 25 nt, Human
uauucuuguuuccucauccacaaaa

SEQ ID NO: 720776 - RNA, 21 nt, Human
uauuuggcauaugccucuaaa

SEQ ID NO: 720777 - RNA, 20 nt, Human
ucuauauuuccucaagaaug

SEQ ID NO: 720778 - RNA, 20 nt, Human
ucugaccuacuucagcagua

SEQ ID NO: 720779 - RNA, 21 nt, Human
ucugucugaccccuuuuucuc

SEQ ID NO: 720780 - RNA, 21 nt, Human
ugaaaaguggccccucuagga

SEQ ID NO: 720781 - RNA, 25 nt, Human
ugaaaaguggccccucuaggacagg

SEQ ID NO: 720782 - RNA, 19 nt, Human
ugaaacaaacaaacaagga

SEQ ID NO: 720783 - RNA, 21 nt, Human
ugaaacaaacaaacaaggaaa

SEQ ID NO: 720784 - RNA, 23 nt, Human
ugaaaccuaaaaccaguuugcug

SEQ ID NO: 720785 - RNA, 25 nt, Human
ugaaaccuaaaaccaguuugcugua

SEQ ID NO: 720786 - RNA, 21 nt, Human
ugaaaugcuacauaggagacc

SEQ ID NO: 720787 - RNA, 19 nt, Human
ugaacacuguuugcaaaga

SEQ ID NO: 720788 - RNA, 21 nt, Human
ugacaacagaguauugcaaug

SEQ ID NO: 720789 - RNA, 23 nt, Human
ugcaaaaggaaaaaaagagaaca

SEQ ID NO: 720790 - RNA, 21 nt, Human
ugcaagauuaucccuuuggaa

SEQ ID NO: 720791 - RNA, 20 nt, Human
ugccacacagcaagcagagc

SEQ ID NO: 720792 - RNA, 19 nt, Human
ugguaaaauaguggucaag

SEQ ID NO: 720793 - RNA, 24 nt, Human
ugguuaaguaugcuuaaucacuac

SEQ ID NO: 720794 - RNA, 19 nt, Human
uguauacacacacacugua

SEQ ID NO: 720795 - RNA, 21 nt, Human
uguauacacacacacuguaua

SEQ ID NO: 720796 - RNA, 21 nt, Human
uguauuccaugacaacagagu

SEQ ID NO: 720797 - RNA, 23 nt, Human
uuaacugaaaauucaagccacag

SEQ ID NO: 720798 - RNA, 22 nt, Human
uuauaaacagccagcaaaacca

SEQ ID NO: 720799 - RNA, 25 nt, Human
uucagauauugguuuaugcaaacug

SEQ ID NO: 720800 - RNA, 20 nt, Human
uucuguauaaacuucaaaag

SEQ ID NO: 720801 - RNA, 20 nt, Human
aaaaacccaaaagaauccaa

SEQ ID NO: 720802 - RNA, 23 nt, Human
aaaaagugaauuaacacuggaaa

SEQ ID NO: 720803 - RNA, 21 nt, Human
aaaacaaccagaacacucccc

SEQ ID NO: 720804 - RNA, 18 nt, Human
aaaagcaagcccagggac

SEQ ID NO: 720805 - RNA, 21 nt, Human
aaaagcagcuuuuacaaaaac

SEQ ID NO: 720806 - RNA, 20 nt, Human
aaaagcauggccucuccuuu

SEQ ID NO: 720807 - RNA, 19 nt, Human
aaacaaaacaaaaacccaa

SEQ ID NO: 720808 - RNA, 23 nt, Human
aaacaacaaaacaaaaccagauu

SEQ ID NO: 720809 - RNA, 21 nt, Human
aaagagcagaaacaggagccc

SEQ ID NO: 720810 - RNA, 21 nt, Human
aacgcucucuucacagggaug

SEQ ID NO: 720811 - RNA, 19 nt, Human
aagaaaagggagagaaaug

SEQ ID NO: 720812 - RNA, 23 nt, Human
aagaaucacuuccaagcugugug

SEQ ID NO: 720813 - RNA, 21 nt, Human
aagaauccaaaacaacaaaac

SEQ ID NO: 720814 - RNA, 22 nt, Human
aagcagaugccuuuaagucagg

SEQ ID NO: 720815 - RNA, 19 nt, Human
aagcagcgggggccgcaca

SEQ ID NO: 720816 - RNA, 21 nt, Human
aagcccuccaaagaaggaccc

SEQ ID NO: 720817 - RNA, 18 nt, Human
aaggacaaaaucaccuuu

SEQ ID NO: 720818 - RNA, 23 nt, Human
aaggaugcucagagucugguucu

SEQ ID NO: 720819 - RNA, 18 nt, Human
aagggcaaaagaaaaggg

SEQ ID NO: 720820 - RNA, 20 nt, Human
aaggggugcuggaccugggc

SEQ ID NO: 720821 - RNA, 21 nt, Human
aaggugcccacuagguaggaa

SEQ ID NO: 720822 - RNA, 23 nt, Human
aauuucuguuccugccauccgcc

SEQ ID NO: 720823 - RNA, 25 nt, Human
acaaaaacccaaaagaauccaaaac

SEQ ID NO: 720824 - RNA, 23 nt, Human
acacagggcauccggccuuccaa

SEQ ID NO: 720825 - RNA, 22 nt, Human
acagcucagaggcugaagucug

SEQ ID NO: 720826 - RNA, 21 nt, Human
acagcuucugagcuccuucca

SEQ ID NO: 720827 - RNA, 19 nt, Human
acaggcaaggccauggggc

SEQ ID NO: 720828 - RNA, 19 nt, Human
accacccugcagccgcuug

SEQ ID NO: 720829 - RNA, 18 nt, Human
accauaguuacaaauucu

SEQ ID NO: 720830 - RNA, 22 nt, Human
accggagccuccuccucagcga

SEQ ID NO: 720831 - RNA, 20 nt, Human
acgagacagcagacagccug

SEQ ID NO: 720832 - RNA, 19 nt, Human
acuggagagacugagggac

SEQ ID NO: 720833 - RNA, 20 nt, Human
acugugcccauccuaccaga

SEQ ID NO: 720834 - RNA, 20 nt, Human
acuucuugaccccaggccag

SEQ ID NO: 720835 - RNA, 19 nt, Human
agaaaaaacaaccagaaca

SEQ ID NO: 720836 - RNA, 24 nt, Human
agaacaaagcaagcccuccaaaga

SEQ ID NO: 720837 - RNA, 25 nt, Human
agaacaaagcaagcccuccaaagaa

SEQ ID NO: 720838 - RNA, 23 nt, Human
agacaaaguucacagggcccaga

SEQ ID NO: 720839 - RNA, 21 nt, Human
agagaccauuccagacucacc

SEQ ID NO: 720840 - RNA, 20 nt, Human
agcagaaacaggagcccaga

SEQ ID NO: 720841 - RNA, 23 nt, Human
agcagcugcaggcgaaaacggcg

SEQ ID NO: 720842 - RNA, 23 nt, Human
agcaugcaccacagaagauaucc

SEQ ID NO: 720843 - RNA, 22 nt, Human
agcccgacggguggggggaggg

SEQ ID NO: 720844 - RNA, 20 nt, Human
agcucccagacucaaacuuc

SEQ ID NO: 720845 - RNA, 20 nt, Human
agcuggaagggcaggggcuc

SEQ ID NO: 720846 - RNA, 21 nt, Human
aggaaggcugcauuuaaugcu

SEQ ID NO: 720847 - RNA, 18 nt, Human
aggaaggggauagagcug

SEQ ID NO: 720848 - RNA, 18 nt, Human
aggaggaaggggauagag

SEQ ID NO: 720849 - RNA, 22 nt, Human
aggaggaaggggauagagcugg

SEQ ID NO: 720850 - RNA, 24 nt, Human
aggcaaggccauggggcuuuccaa

SEQ ID NO: 720851 - RNA, 27 nt, Human
aggcaggagauuagaaaaaggggaccc

SEQ ID NO: 720852 - RNA, 19 nt, Human
aggcaguggcaugaggagg

SEQ ID NO: 720853 - RNA, 19 nt, Human
aggcgaaaacggcggcggc

SEQ ID NO: 720854 - RNA, 24 nt, Human
aggcgaaaacggcggcggcggcgg

SEQ ID NO: 720855 - RNA, 23 nt, Human
agggagagaaaugcccuagguuc

SEQ ID NO: 720856 - RNA, 24 nt, Human
agggguuugcauccuggggccagu

SEQ ID NO: 720857 - RNA, 20 nt, Human
aggguuuccugauuuuuccc

SEQ ID NO: 720858 - RNA, 20 nt, Human
agguaagaaagaacagcaac

SEQ ID NO: 720859 - RNA, 20 nt, Human
agguaggaggaaggggauag

SEQ ID NO: 720860 - RNA, 18 nt, Human
auaaaauguucgugcccc

SEQ ID NO: 720861 - RNA, 19 nt, Human
caaaaacccaaaagaaucc

SEQ ID NO: 720862 - RNA, 19 nt, Human
caaaacaaaacaaaaaccc

SEQ ID NO: 720863 - RNA, 22 nt, Human
caaaacaaaacaaaaacccaaa

SEQ ID NO: 720864 - RNA, 19 nt, Human
caaaacaacaaaacaaaac

SEQ ID NO: 720865 - RNA, 27 nt, Human
caaaagaauccaaaacaacaaaacaaa

SEQ ID NO: 720866 - RNA, 19 nt, Human
caaagaaggacccccagau

SEQ ID NO: 720867 - RNA, 19 nt, Human
caagcccuccaaagaagga

SEQ ID NO: 720868 - RNA, 21 nt, Human
cacagcaaggauauccaggga

SEQ ID NO: 720869 - RNA, 23 nt, Human
caccauagauccagacuaucugg

SEQ ID NO: 720870 - RNA, 19 nt, Human
cacccaccuuuacaaaacc

SEQ ID NO: 720871 - RNA, 19 nt, Human
cacccccucugggcacaga

SEQ ID NO: 720872 - RNA, 18 nt, Human
caccuggaaugugguucc

SEQ ID NO: 720873 - RNA, 24 nt, Human
cacuccggacuguguuuugaaaac

SEQ ID NO: 720874 - RNA, 22 nt, Human
cacuggaucuggacagugggca

SEQ ID NO: 720875 - RNA, 21 nt, Human
cacuugacuuuuccaagccuu

SEQ ID NO: 720876 - RNA, 20 nt, Human
cagaaacaggagcccagaga

SEQ ID NO: 720877 - RNA, 19 nt, Human
cagaacagauaauuuagaa

SEQ ID NO: 720878 - RNA, 19 nt, Human
cagaauggggcccaccccc

SEQ ID NO: 720879 - RNA, 23 nt, Human
cagaauuuccaaaugcuauuucu

SEQ ID NO: 720880 - RNA, 21 nt, Human
cagaugucuucacagaauuuc

SEQ ID NO: 720881 - RNA, 18 nt, Human
cagcagaaagagcagagg

SEQ ID NO: 720882 - RNA, 21 nt, Human
cagcaggguucugggaagccu

SEQ ID NO: 720883 - RNA, 18 nt, Human
cagcccccuuggcaugcc

SEQ ID NO: 720884 - RNA, 18 nt, Human
cagcccccuuggcaugcc

SEQ ID NO: 720885 - RNA, 23 nt, Human
cagccuucagaugaaccacugca

SEQ ID NO: 720886 - RNA, 20 nt, Human
cagcucugaguuccuacccu

SEQ ID NO: 720887 - RNA, 22 nt, Human
cagcuucugagcuccuuccaac

SEQ ID NO: 720888 - RNA, 18 nt, Human
cagcuuuuacaaaaacca

SEQ ID NO: 720889 - RNA, 24 nt, Human
caggagcccagagaccauuccaga

SEQ ID NO: 720890 - RNA, 21 nt, Human
caggcccaaagcugaucucac

SEQ ID NO: 720891 - RNA, 24 nt, Human
cagggacaggacacuuagggaaga

SEQ ID NO: 720892 - RNA, 20 nt, Human
cagggccagaugcuuuggcc

SEQ ID NO: 720893 - RNA, 18 nt, Human
cagguucucagccugggg

SEQ ID NO: 720894 - RNA, 19 nt, Human
caguaaauaccauaguuac

SEQ ID NO: 720895 - RNA, 21 nt, Human
cauaguaggugcuaagauagg

SEQ ID NO: 720896 - RNA, 22 nt, Human
cauauacaacgcucucuucaca

SEQ ID NO: 720897 - RNA, 22 nt, Human
cauccuaccagaggcacaugac

SEQ ID NO: 720898 - RNA, 22 nt, Human
caugaggcaagcaccgcuccuc

SEQ ID NO: 720899 - RNA, 22 nt, Human
cauggggcuuuccaaucuuuac

SEQ ID NO: 720900 - RNA, 20 nt, Human
cauuccagacucaccaggua

SEQ ID NO: 720901 - RNA, 23 nt, Human
ccaaagccaugaggcaagcaccc

SEQ ID NO: 720902 - RNA, 20 nt, Human
ccaagcuuggcaagcagcgg

SEQ ID NO: 720903 - RNA, 20 nt, Human
ccacaaugcccucccucccc

SEQ ID NO: 720904 - RNA, 21 nt, Human
ccacccugcagccgcuuggca

SEQ ID NO: 720905 - RNA, 22 nt, Human
ccacuagguaggaaggcugcau

SEQ ID NO: 720906 - RNA, 24 nt, Human
cccacaaugcccucccucccccca

SEQ ID NO: 720907 - RNA, 21 nt, Human
cccacauggaggcagcagggu

SEQ ID NO: 720908 - RNA, 21 nt, Human
cccacccucccccaaauucua

SEQ ID NO: 720909 - RNA, 20 nt, Human
cccagccaagcgcugggugc

SEQ ID NO: 720910 - RNA, 21 nt, Human
cccagccaagcgcugggugcc

SEQ ID NO: 720911 - RNA, 21 nt, Human
ccccacaaugcccucccuccc

SEQ ID NO: 720912 - RNA, 19 nt, Human
ccccagaggggcugcuggc

SEQ ID NO: 720913 - RNA, 19 nt, Human
ccccagggcucauuacagg

SEQ ID NO: 720914 - RNA, 18 nt, Human
cccccacccucccccaaa

SEQ ID NO: 720915 - RNA, 19 nt, Human
cccccagaggggcugcugg

SEQ ID NO: 720916 - RNA, 23 nt, Human
cccccagaucucugggaacgggg

SEQ ID NO: 720917 - RNA, 22 nt, Human
ccccucucuggauucccaagcu

SEQ ID NO: 720918 - RNA, 22 nt, Human
cccucccuccaugcuugccaag

SEQ ID NO: 720919 - RNA, 24 nt, Human
cccugcuaucaguggcuggaaugg

SEQ ID NO: 720920 - RNA, 20 nt, Human
cccuucuucccucuccuucc

SEQ ID NO: 720921 - RNA, 22 nt, Human
cccuucuucccucuccuucccc

SEQ ID NO: 720922 - RNA, 21 nt, Human
ccggagccuccuccucagcga

SEQ ID NO: 720923 - RNA, 24 nt, Human
ccucccuccccccacccuccccca

SEQ ID NO: 720924 - RNA, 20 nt, Human
ccucccuucuucccucuccu

SEQ ID NO: 720925 - RNA, 23 nt, Human
ccucccuucuucccucuccuucc

SEQ ID NO: 720926 - RNA, 20 nt, Human
ccuccucuuccucuccucuc

SEQ ID NO: 720927 - RNA, 28 nt, Human
ccucuaccacagcaaggauauccaggga

SEQ ID NO: 720928 - RNA, 24 nt, Human
ccucuucuuccuuucuccucucug

SEQ ID NO: 720929 - RNA, 22 nt, Human
ccugaggagaaaggcugggguc

SEQ ID NO: 720930 - RNA, 21 nt, Human
ccuggccuuacccccccuggg

SEQ ID NO: 720931 - RNA, 19 nt, Human
ccuuggaagcccaggaagg

SEQ ID NO: 720932 - RNA, 25 nt, Human
cggaggcugcugcugggcaauccag

SEQ ID NO: 720933 - RNA, 21 nt, Human
cggcggcggcggcggcugagg

SEQ ID NO: 720934 - RNA, 19 nt, Human
cgugccccacccccagagg

SEQ ID NO: 720935 - RNA, 23 nt, Human
cuaccacagcaaggauauccagg

SEQ ID NO: 720936 - RNA, 18 nt, Human
cuagaacaaccuucaccc

SEQ ID NO: 720937 - RNA, 18 nt, Human
cucaagccuccugagccu

SEQ ID NO: 720938 - RNA, 22 nt, Human
cucaucagcacccagaacagau

SEQ ID NO: 720939 - RNA, 18 nt, Human
cuccaaagaaggaccccc

SEQ ID NO: 720940 - RNA, 25 nt, Human
cuccaaguagcuagaggccuggccu

SEQ ID NO: 720941 - RNA, 25 nt, Human
cuccccccacccucccccaaauucu

SEQ ID NO: 720942 - RNA, 20 nt, Human
cuccuggcucuaggccaagg

SEQ ID NO: 720943 - RNA, 23 nt, Human
cuccuggcucuaggccaaggagg

SEQ ID NO: 720944 - RNA, 19 nt, Human
cuccuuccccacaaugccc

SEQ ID NO: 720945 - RNA, 19 nt, Human
cuccuuccccacaaugccc

SEQ ID NO: 720946 - RNA, 21 nt, Human
cucuaggccaaggaggcugau

SEQ ID NO: 720947 - RNA, 21 nt, Human
cucuccuuccccacaaugccc

SEQ ID NO: 720948 - RNA, 23 nt, Human
cucugggucccuccccagggcuc

SEQ ID NO: 720949 - RNA, 19 nt, Human
cugaggccggcugaacugg

SEQ ID NO: 720950 - RNA, 28 nt, Human
cugaggcggcgaugcccuugucuucucc

SEQ ID NO: 720951 - RNA, 19 nt, Human
cugaucuucaaaacaaaac

SEQ ID NO: 720952 - RNA, 22 nt, Human
cugaucuucaaaacaaaacaaa

SEQ ID NO: 720953 - RNA, 19 nt, Human
cugccccucucuggauucc

SEQ ID NO: 720954 - RNA, 23 nt, Human
cugggccucaguuuccucaucug

SEQ ID NO: 720955 - RNA, 21 nt, Human
cugggucccuccccagggcuc

SEQ ID NO: 720956 - RNA, 19 nt, Human
cugugcccauccuaccaga

SEQ ID NO: 720957 - RNA, 20 nt, Human
cuguuuugucccuuucuagc

SEQ ID NO: 720958 - RNA, 20 nt, Human
cuucagagcugccagcaccc

SEQ ID NO: 720959 - RNA, 21 nt, Human
cuucauuugcaauuucuguuc

SEQ ID NO: 720960 - RNA, 18 nt, Human
cuuccuccucuuccucuc

SEQ ID NO: 720961 - RNA, 19 nt, Human
cuugcuggggucaggccca

SEQ ID NO: 720962 - RNA, 20 nt, Human
cuuggggccccccuuugcuc

SEQ ID NO: 720963 - RNA, 18 nt, Human
gaagggcaaaagaaaagg

SEQ ID NO: 720964 - RNA, 19 nt, Human
gaaguccuuuccgcuucuc

SEQ ID NO: 720965 - RNA, 26 nt, Human
gacuguguuuugaaaacaccuauaaa

SEQ ID NO: 720966 - RNA, 22 nt, Human
gagauuagaaaaagcagcuuuu

SEQ ID NO: 720967 - RNA, 24 nt, Human
gagcagcugcaggcgaaaacggcc

SEQ ID NO: 720968 - RNA, 19 nt, Human
gagcugccagcacccaccu

SEQ ID NO: 720969 - RNA, 23 nt, Human
gaggagcuugagucacaccauag

SEQ ID NO: 720970 - RNA, 19 nt, Human
gagggggacaguuggggag

SEQ ID NO: 720971 - RNA, 21 nt, Human
gauaugaaacagggaagcaga

SEQ ID NO: 720972 - RNA, 21 nt, Human
gaugaaccacugcaauaaacc

SEQ ID NO: 720973 - RNA, 20 nt, Human
gaugacacagggcauccggc

SEQ ID NO: 720974 - RNA, 21 nt, Human
gaugagccugucuccugggcc

SEQ ID NO: 720975 - RNA, 22 nt, Human
gccagguaagaaagaacagcaa

SEQ ID NO: 720976 - RNA, 23 nt, Human
gcccacucuacuacugccccucu

SEQ ID NO: 720977 - RNA, 18 nt, Human
gccuguguggggaucaga

SEQ ID NO: 720978 - RNA, 21 nt, Human
gccuuuggguuggacucaaca

SEQ ID NO: 720979 - RNA, 19 nt, Human
gcggcggcggcggcugagg

SEQ ID NO: 720980 - RNA, 22 nt, Human
gcggcggcggcggcugaggcgg

SEQ ID NO: 720981 - RNA, 24 nt, Human
gcggcggcggcggcugaggcggcg

SEQ ID NO: 720982 - RNA, 23 nt, Human
gcugcaggcgaaaacggcggcgg

SEQ ID NO: 720983 - RNA, 21 nt, Human
gcuuagucagugccucgcugg

SEQ ID NO: 720984 - RNA, 19 nt, Human
ggaaaagcaagcccaggga

SEQ ID NO: 720985 - RNA, 21 nt, Human
ggacagugggcaggcucucag

SEQ ID NO: 720986 - RNA, 20 nt, Human
ggagaaggucucugggacag

SEQ ID NO: 720987 - RNA, 23 nt, Human
ggccagaugcuuuggccagagac

SEQ ID NO: 720988 - RNA, 19 nt, Human
ggccagugaggagaggggg

SEQ ID NO: 720989 - RNA, 23 nt, Human
ggccaugaauggcacagguaacc

SEQ ID NO: 720990 - RNA, 22 nt, Human
gggaagggcaaaagaaaaggga

SEQ ID NO: 720991 - RNA, 22 nt, Human
gggaccggagccuccuccucag

SEQ ID NO: 720992 - RNA, 21 nt, Human
ggggccagugcuguagcucac

SEQ ID NO: 720993 - RNA, 20 nt, Human
ggguggggggaggggacgcu

SEQ ID NO: 720994 - RNA, 20 nt, Human
gguaaccaagagcuuggccu

SEQ ID NO: 720995 - RNA, 18 nt, Human
guaaaggacaaacccugc

SEQ ID NO: 720996 - RNA, 18 nt, Human
guaaccaagagcuuggcc

SEQ ID NO: 720997 - RNA, 23 nt, Human
gucuccucuucuuccuuucuccu

SEQ ID NO: 720998 - RNA, 22 nt, Human
gugcugccaguuagaugugccu

SEQ ID NO: 720999 - RNA, 18 nt, Human
guggcagcagaaagagca

SEQ ID NO: 721000 - RNA, 23 nt, Human
gugugccucgguuggccuuuggg

SEQ ID NO: 721001 - RNA, 27 nt, Human
uaaaaugaauuaaaaaauacaaaauca

SEQ ID NO: 721002 - RNA, 20 nt, Human
uaaaauggaggacuuuggca

SEQ ID NO: 721003 - RNA, 19 nt, Human
uaaaauguucgugccccac

SEQ ID NO: 721004 - RNA, 21 nt, Human
uaaagugaaaccucaucagca

SEQ ID NO: 721005 - RNA, 20 nt, Human
uaaaugaaagcaguuuuuua

SEQ ID NO: 721006 - RNA, 22 nt, Human
uaagaaaaaacaaccagaacac

SEQ ID NO: 721007 - RNA, 20 nt, Human
uacacacaggcaaggccaug

SEQ ID NO: 721008 - RNA, 20 nt, Human
uacagcuuacaguaaauacc

SEQ ID NO: 721009 - RNA, 23 nt, Human
uacaggauggaaaagcagacuuc

SEQ ID NO: 721010 - RNA, 18 nt, Human
uaccuaugguaccuccca

SEQ ID NO: 721011 - RNA, 24 nt, Human
uacugccccucucuggauucccaa

SEQ ID NO: 721012 - RNA, 19 nt, Human
uagaggccuggccuuaccc

SEQ ID NO: 721013 - RNA, 21 nt, Human
uagauuaaaaugaauuaaaaa

SEQ ID NO: 721014 - RNA, 18 nt, Human
uagccccucccuccaugc

SEQ ID NO: 721015 - RNA, 18 nt, Human
uagccgccgaggagcccg

SEQ ID NO: 721016 - RNA, 24 nt, Human
uaggccugaggagaaaggcugggg

SEQ ID NO: 721017 - RNA, 22 nt, Human
uauaaaguacaguuagccccuc

SEQ ID NO: 721018 - RNA, 28 nt, Human
uaugaaacagggaagcagaugccuuuaa

SEQ ID NO: 721019 - RNA, 24 nt, Human
uauugcuauugcuuuuccuucacu

SEQ ID NO: 721020 - RNA, 21 nt, Human
ucaaaacaaaacaaaaaccca

SEQ ID NO: 721021 - RNA, 22 nt, Human
ucaacagcaugcaccacagaag

SEQ ID NO: 721022 - RNA, 22 nt, Human
ucaagauuauuacagacaacuc

SEQ ID NO: 721023 - RNA, 25 nt, Human
ucacagggcccagaauggggcccac

SEQ ID NO: 721024 - RNA, 23 nt, Human
ucagagcugccagcacccaccug

SEQ ID NO: 721025 - RNA, 19 nt, Human
ucagguagaaguagaagaa

SEQ ID NO: 721026 - RNA, 19 nt, Human
ucagguaggaggaagggga

SEQ ID NO: 721027 - RNA, 19 nt, Human
ucagugccucgcugggaac

SEQ ID NO: 721028 - RNA, 25 nt, Human
uccaaaacaacaaaacaaaaccaga

SEQ ID NO: 721029 - RNA, 18 nt, Human
uccagauuuggaugggcu

SEQ ID NO: 721030 - RNA, 21 nt, Human
uccauaaccuguuuccucauu

SEQ ID NO: 721031 - RNA, 20 nt, Human
ucccaggggucccucuucuc

SEQ ID NO: 721032 - RNA, 24 nt, Human
uccccacaaugcccucccuccccc

SEQ ID NO: 721033 - RNA, 25 nt, Human
uccccacaaugcccucccucccccc

SEQ ID NO: 721034 - RNA, 22 nt, Human
uccccagguucucagccugggg

SEQ ID NO: 721035 - RNA, 24 nt, Human
ucccugacucucuuaggccugagg

SEQ ID NO: 721036 - RNA, 18 nt, Human
ucccuuguccucucuugc

SEQ ID NO: 721037 - RNA, 21 nt, Human
uccgcuucucugggccucagu

SEQ ID NO: 721038 - RNA, 19 nt, Human
uccgguguggaaucccauc

SEQ ID NO: 721039 - RNA, 19 nt, Human
uccuaaaguuccuuggaag

SEQ ID NO: 721040 - RNA, 19 nt, Human
uccuaccacccugcagccg

SEQ ID NO: 721041 - RNA, 21 nt, Human
uccuaccacccugcagccgcu

SEQ ID NO: 721042 - RNA, 19 nt, Human
uccuggaaccauauaaugc

SEQ ID NO: 721043 - RNA, 19 nt, Human
uccuggagguggagucagg

SEQ ID NO: 721044 - RNA, 23 nt, Human
uccuggcugagacuagcagggac

SEQ ID NO: 721045 - RNA, 22 nt, Human
uccugggcauugugaccccaaa

SEQ ID NO: 721046 - RNA, 19 nt, Human
ucucaagccuccugagccu

SEQ ID NO: 721047 - RNA, 21 nt, Human
ucucagggauuaggaagccag

SEQ ID NO: 721048 - RNA, 18 nt, Human
ucucaugaggaagaaauu

SEQ ID NO: 721049 - RNA, 23 nt, Human
ucuccuggagguggagucaggua

SEQ ID NO: 721050 - RNA, 23 nt, Human
ucucugcuugccucuagacuggg

SEQ ID NO: 721051 - RNA, 21 nt, Human
ucucugggaacgggguaccuc

SEQ ID NO: 721052 - RNA, 18 nt, Human
ucucuuucccugacucuc

SEQ ID NO: 721053 - RNA, 22 nt, Human
ucuggagaugcuggucuugcug

SEQ ID NO: 721054 - RNA, 20 nt, Human
ucuuccuccucuuccucucc

SEQ ID NO: 721055 - RNA, 23 nt, Human
ucuugcuggggucaggcccaaag

SEQ ID NO: 721056 - RNA, 22 nt, Human
ugaaagcaguuuuuuaaagucc

SEQ ID NO: 721057 - RNA, 19 nt, Human
ugaaggccaucagaacaaa

SEQ ID NO: 721058 - RNA, 19 nt, Human
ugaaggcuggguccuggaa

SEQ ID NO: 721059 - RNA, 24 nt, Human
ugaagugcuuugaccucugugaug

SEQ ID NO: 721060 - RNA, 20 nt, Human
ugacagcucagaggcugaag

SEQ ID NO: 721061 - RNA, 19 nt, Human
ugaccucugugaugcaccu

SEQ ID NO: 721062 - RNA, 20 nt, Human
ugacucccacugucuuccuc

SEQ ID NO: 721063 - RNA, 18 nt, Human
ugagacuagcagggaccu

SEQ ID NO: 721064 - RNA, 20 nt, Human
ugaggaagugccaggucagu

SEQ ID NO: 721065 - RNA, 19 nt, Human
ugaggagagggggucaggu

SEQ ID NO: 721066 - RNA, 20 nt, Human
ugaggagccaaaacuuggug

SEQ ID NO: 721067 - RNA, 18 nt, Human
ugagguccagcuguuagu

SEQ ID NO: 721068 - RNA, 25 nt, Human
ugccaagagacccagcagguggcag

SEQ ID NO: 721069 - RNA, 24 nt, Human
ugcccauccuaccagaggcacaug

SEQ ID NO: 721070 - RNA, 18 nt, Human
ugccuaauuucagaaacg

SEQ ID NO: 721071 - RNA, 19 nt, Human
ugccucugggucccucccc

SEQ ID NO: 721072 - RNA, 18 nt, Human
ugccugugcgcucagagg

SEQ ID NO: 721073 - RNA, 20 nt, Human
ugcucagagucugguucugg

SEQ ID NO: 721074 - RNA, 18 nt, Human
ugcuggcccagccaagcg

SEQ ID NO: 721075 - RNA, 20 nt, Human
uggaagacacuggucaaagg

SEQ ID NO: 721076 - RNA, 21 nt, Human
uggaauguugaagcuggccug

SEQ ID NO: 721077 - RNA, 21 nt, Human
uggagguggagucagguacag

SEQ ID NO: 721078 - RNA, 18 nt, Human
uggcacagguaaccaaga

SEQ ID NO: 721079 - RNA, 19 nt, Human
uggcagcagaaagagcaga

SEQ ID NO: 721080 - RNA, 19 nt, Human
uggcaugaggaggagagag

SEQ ID NO: 721081 - RNA, 21 nt, Human
uggcaugaggaggagagaggg

SEQ ID NO: 721082 - RNA, 25 nt, Human
uggcaugaggaggagagagggguuu

SEQ ID NO: 721083 - RNA, 18 nt, Human
uggccuggucagguagga

SEQ ID NO: 721084 - RNA, 20 nt, Human
ugggaaaagcaagcccaggg

SEQ ID NO: 721085 - RNA, 18 nt, Human
ugggaacgggguaccuca

SEQ ID NO: 721086 - RNA, 18 nt, Human
ugggagaauacaggaugg

SEQ ID NO: 721087 - RNA, 20 nt, Human
ugggagaauacaggauggaa

SEQ ID NO: 721088 - RNA, 23 nt, Human
ugggauccccagggacaggacac

SEQ ID NO: 721089 - RNA, 23 nt, Human
ugggauccuaccacccugcagcc

SEQ ID NO: 721090 - RNA, 19 nt, Human
uggggucaggcccaaagcu

SEQ ID NO: 721091 - RNA, 22 nt, Human
uguaccccugauccuggccaua

SEQ ID NO: 721092 - RNA, 20 nt, Human
ugucuccugggccucauccu

SEQ ID NO: 721093 - RNA, 24 nt, Human
ugugauaugaaacagggaagcaga

SEQ ID NO: 721094 - RNA, 19 nt, Human
uguuuccucauuugucaau

SEQ ID NO: 721095 - RNA, 23 nt, Human
uguuuugucccuuucuagcuuug

SEQ ID NO: 721096 - RNA, 20 nt, Human
uuaaagucccaaauguuguc

SEQ ID NO: 721097 - RNA, 25 nt, Human
uuacugguguugaaagaacaaaagu

SEQ ID NO: 721098 - RNA, 21 nt, Human
uuagcaagucucaagccuccu

SEQ ID NO: 721099 - RNA, 20 nt, Human
uuagccccucccuccaugcu

SEQ ID NO: 721100 - RNA, 26 nt, Human
uuagccccucccuccaugcuugccaa

SEQ ID NO: 721101 - RNA, 24 nt, Human
uucaaaccaaagccaugaggcaag

SEQ ID NO: 721102 - RNA, 24 nt, Human
uucagaaacgaggaguuuucuagg

SEQ ID NO: 721103 - RNA, 24 nt, Human
uucagcucugcgggugggucccaa

SEQ ID NO: 721104 - RNA, 21 nt, Human
uucaguacgugagccugugug

SEQ ID NO: 721105 - RNA, 22 nt, Human
uucaugugauuccuuucugaag

SEQ ID NO: 721106 - RNA, 20 nt, Human
uuccaaggccucgggaugcu

SEQ ID NO: 721107 - RNA, 20 nt, Human
uuccccagguucucagccug

SEQ ID NO: 721108 - RNA, 18 nt, Human
uuccuccucuuccucucc

SEQ ID NO: 721109 - RNA, 21 nt, Human
uugcaaagcuguuacaucugu

SEQ ID NO: 721110 - RNA, 25 nt, Human
uugcagugacuccccaagcuuggcc

SEQ ID NO: 721111 - RNA, 21 nt, Human
uugugaccccaaaguguuuug

SEQ ID NO: 721112 - RNA, 21 nt, Human
uuuggcauuuuucaaacacgu

SEQ ID NO: 721113 - RNA, 18 nt, Human
uuugucccuuucuagcuu

SEQ ID NO: 721114 - RNA, 21 nt, Human
aaacaacaguuccugggcccg

SEQ ID NO: 721115 - RNA, 19 nt, Human
aaccaccugcggccaggca

SEQ ID NO: 721116 - RNA, 21 nt, Human
aagccccugguccauacccag

SEQ ID NO: 721117 - RNA, 18 nt, Human
aagcccggcaaacaagga

SEQ ID NO: 721118 - RNA, 26 nt, Human
aagcuaaagacaaaaauaagggaccc

SEQ ID NO: 721119 - RNA, 20 nt, Human
aaggagccguggaugaagcg

SEQ ID NO: 721120 - RNA, 21 nt, Human
aaggagcucaguguggggagg

SEQ ID NO: 721121 - RNA, 21 nt, Human
acacacaccacccgcuuccag

SEQ ID NO: 721122 - RNA, 18 nt, Human
acacccccacguccaccc

SEQ ID NO: 721123 - RNA, 21 nt, Human
acacccccacguccaccccca

SEQ ID NO: 721124 - RNA, 19 nt, Human
acagggcagccccaagcuc

SEQ ID NO: 721125 - RNA, 19 nt, Human
accagggggggacaccugc

SEQ ID NO: 721126 - RNA, 18 nt, Human
acccaggaggccuccaca

SEQ ID NO: 721127 - RNA, 19 nt, Human
acccccacguccaccccca

SEQ ID NO: 721128 - RNA, 20 nt, Human
acccguacacccaaccccag

SEQ ID NO: 721129 - RNA, 24 nt, Human
acggcagaggcaccaagcucugcu

SEQ ID NO: 721130 - RNA, 21 nt, Human
acucuuuccuuuaaagcuaaa

SEQ ID NO: 721131 - RNA, 21 nt, Human
agaacccguacacccaacccc

SEQ ID NO: 721132 - RNA, 23 nt, Human
agcaccuccuccauacagacagc

SEQ ID NO: 721133 - RNA, 20 nt, Human
agcccggcaaacaaggacca

SEQ ID NO: 721134 - RNA, 21 nt, Human
agcugaaagaauccugagaaa

SEQ ID NO: 721135 - RNA, 18 nt, Human
agcugggcccagaggccu

SEQ ID NO: 721136 - RNA, 18 nt, Human
aggagcugggcccagagg

SEQ ID NO: 721137 - RNA, 23 nt, Human
aggaggccuccacagggcagccc

SEQ ID NO: 721138 - RNA, 19 nt, Human
aggcaggcgggugugcggc

SEQ ID NO: 721139 - RNA, 19 nt, Human
aggcagggguggggguggc

SEQ ID NO: 721140 - RNA, 22 nt, Human
aggcggggugggcaacuggggc

SEQ ID NO: 721141 - RNA, 21 nt, Human
agggaggcuggccuggccagg

SEQ ID NO: 721142 - RNA, 21 nt, Human
agggggcaagggcgugggagg

SEQ ID NO: 721143 - RNA, 20 nt, Human
agggggcgaggcaggggugg

SEQ ID NO: 721144 - RNA, 20 nt, Human
aggggugggcagcagcccgg

SEQ ID NO: 721145 - RNA, 18 nt, Human
agggguggggguggccau

SEQ ID NO: 721146 - RNA, 23 nt, Human
agggguggggguggccauggggc

SEQ ID NO: 721147 - RNA, 24 nt, Human
agggguggggguggccauggggcu

SEQ ID NO: 721148 - RNA, 23 nt, Human
agggugcuggcugggagcugacg

SEQ ID NO: 721149 - RNA, 20 nt, Human
agugaacccuccgagaagcc

SEQ ID NO: 721150 - RNA, 22 nt, Human
agugaacccuccgagaagcccg

SEQ ID NO: 721151 - RNA, 18 nt, Human
auggcagguuagugccug

SEQ ID NO: 721152 - RNA, 18 nt, Human
auggguuuggcaacugug

SEQ ID NO: 721153 - RNA, 19 nt, Human
caaccccagcucagcuaaa

SEQ ID NO: 721154 - RNA, 28 nt, Human
caagugcccugccaucucagacaguccc

SEQ ID NO: 721155 - RNA, 18 nt, Human
cacacguaaacaucaggu

SEQ ID NO: 721156 - RNA, 22 nt, Human
cacacguaaacaucaggugggc

SEQ ID NO: 721157 - RNA, 27 nt, Human
caccaaaugaccccacagucgaccucu

SEQ ID NO: 721158 - RNA, 18 nt, Human
caccacccgcuuccagcc

SEQ ID NO: 721159 - RNA, 22 nt, Human
caccagaggcuggaagcagugg

SEQ ID NO: 721160 - RNA, 20 nt, Human
cacccaggaccuuggaagcc

SEQ ID NO: 721161 - RNA, 23 nt, Human
cacccaggaccuuggaagcccac

SEQ ID NO: 721162 - RNA, 23 nt, Human
cacccccaccaaccacggccaac

SEQ ID NO: 721163 - RNA, 19 nt, Human
cacccccacguccaccccc

SEQ ID NO: 721164 - RNA, 26 nt, Human
cacccccgcccccccucacacacaca

SEQ ID NO: 721165 - RNA, 19 nt, Human
caccugcggccaggcaggc

SEQ ID NO: 721166 - RNA, 21 nt, Human
cagaacccguacacccaaccc

SEQ ID NO: 721167 - RNA, 28 nt, Human
cagaacccguacacccaaccccagcuca

SEQ ID NO: 721168 - RNA, 18 nt, Human
cagaggccuguagggggc

SEQ ID NO: 721169 - RNA, 21 nt, Human
cagcaggcucuuggggcgggg

SEQ ID NO: 721170 - RNA, 28 nt, Human
cagccuccaguccccagugccgcucccu

SEQ ID NO: 721171 - RNA, 22 nt, Human
caggcucagaggaacagaaccc

SEQ ID NO: 721172 - RNA, 21 nt, Human
cagggguggggguggccaugg

SEQ ID NO: 721173 - RNA, 19 nt, Human
caguuccugggcccguccc

SEQ ID NO: 721174 - RNA, 20 nt, Human
cauugccaggcagggugugg

SEQ ID NO: 721175 - RNA, 20 nt, Human
ccaaaugaccccacagucga

SEQ ID NO: 721176 - RNA, 20 nt, Human
ccacaagaccaccugagaac

SEQ ID NO: 721177 - RNA, 25 nt, Human
ccacccccgcccccccucacacaca

SEQ ID NO: 721178 - RNA, 23 nt, Human
ccacggcagaggcaccaagcucu

SEQ ID NO: 721179 - RNA, 24 nt, Human
ccaggcaggguguggagcucaccc

SEQ ID NO: 721180 - RNA, 20 nt, Human
cccacguccacccccaccaa

SEQ ID NO: 721181 - RNA, 22 nt, Human
cccacguccacccccaccaacc

SEQ ID NO: 721182 - RNA, 19 nt, Human
cccauugaggcugcccagg

SEQ ID NO: 721183 - RNA, 23 nt, Human
ccccacguccacccccaccaacc

SEQ ID NO: 721184 - RNA, 18 nt, Human
ccccagugccgcuccccc

SEQ ID NO: 721185 - RNA, 19 nt, Human
cccccaccaaccacggcca

SEQ ID NO: 721186 - RNA, 21 nt, Human
cccccgcccccccucacacac

SEQ ID NO: 721187 - RNA, 23 nt, Human
ccccgcccccccucacacacaca

SEQ ID NO: 721188 - RNA, 19 nt, Human
ccccugguccauacccagg

SEQ ID NO: 721189 - RNA, 19 nt, Human
cccugguccauacccagga

SEQ ID NO: 721190 - RNA, 26 nt, Human
ccguacacccaaccccagcucagcua

SEQ ID NO: 721191 - RNA, 21 nt, Human
ccuacagaggcccauagcccc

SEQ ID NO: 721192 - RNA, 21 nt, Human
ccuccauacagacagcaggcu

SEQ ID NO: 721193 - RNA, 23 nt, Human
ccugcggccaggcaggccggggc

SEQ ID NO: 721194 - RNA, 22 nt, Human
ccuguagggggcgaggcagggg

SEQ ID NO: 721195 - RNA, 21 nt, Human
cgaaagacagccacaagacca

SEQ ID NO: 721196 - RNA, 23 nt, Human
cgagaagcccggcaaacaaggac

SEQ ID NO: 721197 - RNA, 21 nt, Human
cgagggggcaagggcguggga

SEQ ID NO: 721198 - RNA, 18 nt, Human
cggcagaggcaccaagcu

SEQ ID NO: 721199 - RNA, 22 nt, Human
cuaaaaguaaacaggggacaca

SEQ ID NO: 721200 - RNA, 18 nt, Human
cuccuccauacagacagc

SEQ ID NO: 721201 - RNA, 23 nt, Human
cuugaccuuggcagcagccuggc

SEQ ID NO: 721202 - RNA, 22 nt, Human
cuuuaaagcuaaagacaaaaau

SEQ ID NO: 721203 - RNA, 22 nt, Human
gaacaaauuccaugacaaauca

SEQ ID NO: 721204 - RNA, 23 nt, Human
gaacgaauguacagugaacccuc

SEQ ID NO: 721205 - RNA, 20 nt, Human
gaagaggaggcgggguaaug

SEQ ID NO: 721206 - RNA, 23 nt, Human
gaagcccggcaaacaaggaccag

SEQ ID NO: 721207 - RNA, 23 nt, Human
gaccaguucccaggcaaaggcug

SEQ ID NO: 721208 - RNA, 19 nt, Human
gagcucaguguggggagga

SEQ ID NO: 721209 - RNA, 19 nt, Human
gcacccaggaccuuggaag

SEQ ID NO: 721210 - RNA, 18 nt, Human
gccaugcacccggcugca

SEQ ID NO: 721211 - RNA, 27 nt, Human
gccuggacuagccgugugcaugggagg

SEQ ID NO: 721212 - RNA, 21 nt, Human
ggacagggugaguagggugcu

SEQ ID NO: 721213 - RNA, 20 nt, Human
ggcaacuguguuggcaccag

SEQ ID NO: 721214 - RNA, 18 nt, Human
ggcaagugcccugccauc

SEQ ID NO: 721215 - RNA, 20 nt, Human
ggcaugcaggggugggcagc

SEQ ID NO: 721216 - RNA, 25 nt, Human
ggcuggaagcaguggggcuccugcc

SEQ ID NO: 721217 - RNA, 18 nt, Human
ggcuuagaggcuccggca

SEQ ID NO: 721218 - RNA, 20 nt, Human
gggcugccccagcaggggcc

SEQ ID NO: 721219 - RNA, 21 nt, Human
gggguggggguggccaugggg

SEQ ID NO: 721220 - RNA, 24 nt, Human
gggguggggguggccauggggcug

SEQ ID NO: 721221 - RNA, 19 nt, Human
gggugaguagggugcuggc

SEQ ID NO: 721222 - RNA, 19 nt, Human
ggguggggguggccauggg

SEQ ID NO: 721223 - RNA, 21 nt, Human
ggguggggguggccauggggc

SEQ ID NO: 721224 - RNA, 20 nt, Human
gguggggguggccauggggc

SEQ ID NO: 721225 - RNA, 20 nt, Human
gugggaggcacccgcccaca

SEQ ID NO: 721226 - RNA, 18 nt, Human
guggugcaggccaagcug

SEQ ID NO: 721227 - RNA, 23 nt, Human
guucccagcugaaagaauccuga

SEQ ID NO: 721228 - RNA, 23 nt, Human
uaaaauaaccauuuuccgaaaga

SEQ ID NO: 721229 - RNA, 22 nt, Human
uaaugcccuugagggcuugacc

SEQ ID NO: 721230 - RNA, 18 nt, Human
uacacccaaccccagcuc

SEQ ID NO: 721231 - RNA, 21 nt, Human
uacccaggaggccuccacagg

SEQ ID NO: 721232 - RNA, 18 nt, Human
uagaacaaauuccaugac

SEQ ID NO: 721233 - RNA, 19 nt, Human
ucagacagucccaggaaca

SEQ ID NO: 721234 - RNA, 23 nt, Human
ucaggccuggagggggcaccugc

SEQ ID NO: 721235 - RNA, 18 nt, Human
uccacccccaccaaccac

SEQ ID NO: 721236 - RNA, 22 nt, Human
uccacccccaccaaccacggcc

SEQ ID NO: 721237 - RNA, 23 nt, Human
uccacccccaccaaccacggcca

SEQ ID NO: 721238 - RNA, 19 nt, Human
ucccaggaacaggugagcc

SEQ ID NO: 721239 - RNA, 23 nt, Human
ucccccagcagcuggcccuguca

SEQ ID NO: 721240 - RNA, 21 nt, Human
uccgacucucauaccauugcc

SEQ ID NO: 721241 - RNA, 20 nt, Human
uccugggcccgucccugccc

SEQ ID NO: 721242 - RNA, 19 nt, Human
ucgugcgcucacccccgcc

SEQ ID NO: 721243 - RNA, 21 nt, Human
ugaacccuccgagaagcccuu

SEQ ID NO: 721244 - RNA, 23 nt, Human
ugaagccaaaaggggagggcgug

SEQ ID NO: 721245 - RNA, 25 nt, Human
ugacaaaucauauaaaaaggguuuc

SEQ ID NO: 721246 - RNA, 18 nt, Human
ugagaaaacaacaguucc

SEQ ID NO: 721247 - RNA, 21 nt, Human
ugagaaaacaacaguuccugg

SEQ ID NO: 721248 - RNA, 24 nt, Human
ugagccugcccaccuccauguuug

SEQ ID NO: 721249 - RNA, 18 nt, Human
ugauggcgugaagccaaa

SEQ ID NO: 721250 - RNA, 19 nt, Human
ugccaggcaggguguggag

SEQ ID NO: 721251 - RNA, 18 nt, Human
ugccaucucagacagucc

SEQ ID NO: 721252 - RNA, 26 nt, Human
ugcccugccaucucagacagucccaa

SEQ ID NO: 721253 - RNA, 19 nt, Human
ugcgcucacccccgccaga

SEQ ID NO: 721254 - RNA, 23 nt, Human
ugcucaccugccauguucccagc

SEQ ID NO: 721255 - RNA, 19 nt, Human
uggcagguuagugccuggc

SEQ ID NO: 721256 - RNA, 20 nt, Human
uggccaggagcugggcccag

SEQ ID NO: 721257 - RNA, 18 nt, Human
uggccuggccaggucugg

SEQ ID NO: 721258 - RNA, 18 nt, Human
uggcucagcucucaacaa

SEQ ID NO: 721259 - RNA, 21 nt, Human
uggcucagcucucaacaagcc

SEQ ID NO: 721260 - RNA, 18 nt, Human
uggcugggagcugacgag

SEQ ID NO: 721261 - RNA, 19 nt, Human
ugggcagcagcccggugga

SEQ ID NO: 721262 - RNA, 19 nt, Human
uggggcuggacagggugag

SEQ ID NO: 721263 - RNA, 22 nt, Human
uggggucaggugggagccacca

SEQ ID NO: 721264 - RNA, 19 nt, Human
ugucugcaccugugugcau

SEQ ID NO: 721265 - RNA, 19 nt, Human
ugugaacuuaaaacauugc

SEQ ID NO: 721266 - RNA, 25 nt, Human
uucacaaacgucccauugaggcugc

SEQ ID NO: 721267 - RNA, 24 nt, Human
uuccagccuccaguccccagugcc

SEQ ID NO: 721268 - RNA, 20 nt, Human
uugagggcuugaccuuggca

SEQ ID NO: 721269 - RNA, 21 nt, Human
uuggcaccaaaugaccccaca

SEQ ID NO: 721270 - RNA, 23 nt, Human
uuuccuuuaaagcuaaagacaaa

SEQ ID NO: 721271 - RNA, 24 nt, Human
aaaaaucuauacccuccauucuuc

SEQ ID NO: 721272 - RNA, 22 nt, Human
aaaccugcacuuguccccccaa

SEQ ID NO: 721273 - RNA, 20 nt, Human
aaccucauuauccgggcccc

SEQ ID NO: 721274 - RNA, 31 nt, Human
aagacuucccccucccaguuucuucugaggg

SEQ ID NO: 721275 - RNA, 18 nt, Human
aaggagcagccuguucca

SEQ ID NO: 721276 - RNA, 25 nt, Human
aagggaagaagggucagcugaagag

SEQ ID NO: 721277 - RNA, 24 nt, Human
aagggggagggagggaugaggagc

SEQ ID NO: 721278 - RNA, 23 nt, Human
aaguauccuuccaaccggccccc

SEQ ID NO: 721279 - RNA, 19 nt, Human
aauaaagggggagggaggg

SEQ ID NO: 721280 - RNA, 21 nt, Human
acaaaaaacgguaauaaaggg

SEQ ID NO: 721281 - RNA, 20 nt, Human
acacuggugcuggucugagu

SEQ ID NO: 721282 - RNA, 23 nt, Human
acauccuagaaggagcagccugu

SEQ ID NO: 721283 - RNA, 24 nt, Human
acauccuagaaggagcagccuguu

SEQ ID NO: 721284 - RNA, 22 nt, Human
acccaaccucauuauccgggcc

SEQ ID NO: 721285 - RNA, 19 nt, Human
acccugagauauagguagu

SEQ ID NO: 721286 - RNA, 18 nt, Human
acuccgcucagggaccag

SEQ ID NO: 721287 - RNA, 21 nt, Human
acuuugugauccuugaggcug

SEQ ID NO: 721288 - RNA, 25 nt, Human
agaaaagagaauaaauaagggaaga

SEQ ID NO: 721289 - RNA, 21 nt, Human
agaaaccugcacuuguccccc

SEQ ID NO: 721290 - RNA, 19 nt, Human
agagagggcaucuagcggu

SEQ ID NO: 721291 - RNA, 27 nt, Human
agagcccuccucauagugaagcugccc

SEQ ID NO: 721292 - RNA, 24 nt, Human
agagggcuuuccuggcccaggcac

SEQ ID NO: 721293 - RNA, 21 nt, Human
agccaugaugauugaaguucc

SEQ ID NO: 721294 - RNA, 23 nt, Human
aggaagggguauggaaggggagg

SEQ ID NO: 721295 - RNA, 21 nt, Human
aggagaaguugccugcucaag

SEQ ID NO: 721296 - RNA, 24 nt, Human
aggaggggaggcaggaaggugggg

SEQ ID NO: 721297 - RNA, 24 nt, Human
aggaggggaggcaggaaggugggg

SEQ ID NO: 721298 - RNA, 23 nt, Human
aggcacuuagagguuacauaacu

SEQ ID NO: 721299 - RNA, 24 nt, Human
aggcaguguggccuggccuaggag

SEQ ID NO: 721300 - RNA, 20 nt, Human
aggugggaggagggugaggg

SEQ ID NO: 721301 - RNA, 23 nt, Human
augaaaggugagaaggugggagg

SEQ ID NO: 721302 - RNA, 18 nt, Human
augaggagcaggagggga

SEQ ID NO: 721303 - RNA, 23 nt, Human
caaguauccuuccaaccggcccc

SEQ ID NO: 721304 - RNA, 18 nt, Human
cacacagcaauggacauc

SEQ ID NO: 721305 - RNA, 19 nt, Human
cacacuaaaaaaagcccag

SEQ ID NO: 721306 - RNA, 26 nt, Human
cacacuaaaaaaagcccagacuucac

SEQ ID NO: 721307 - RNA, 19 nt, Human
cagagccucggagacugcc

SEQ ID NO: 721308 - RNA, 23 nt, Human
cagcaggaggcaaaugcuucugg

SEQ ID NO: 721309 - RNA, 27 nt, Human
caggcucccggcucccuccuucccaca

SEQ ID NO: 721310 - RNA, 20 nt, Human
caggggugggagagagaaga

SEQ ID NO: 721311 - RNA, 20 nt, Human
ccaaccggccccauggccca

SEQ ID NO: 721312 - RNA, 22 nt, Human
ccacacauauaaauagaaaaga

SEQ ID NO: 721313 - RNA, 22 nt, Human
ccacagcugcugcuccucagca

SEQ ID NO: 721314 - RNA, 20 nt, Human
ccaggcucccggcucccucc

SEQ ID NO: 721315 - RNA, 21 nt, Human
cccacacaugccggacagggc

SEQ ID NO: 721316 - RNA, 21 nt, Human
cccacaccauccaugucacaa

SEQ ID NO: 721317 - RNA, 20 nt, Human
cccacagagccacugcucac

SEQ ID NO: 721318 - RNA, 24 nt, Human
cccacaggcaguguggccuggccu

SEQ ID NO: 721319 - RNA, 21 nt, Human
cccagguuccggggagagccc

SEQ ID NO: 721320 - RNA, 24 nt, Human
cccauggcccaggguggacggggc

SEQ ID NO: 721321 - RNA, 19 nt, Human
ccccaucccgggccggccc

SEQ ID NO: 721322 - RNA, 22 nt, Human
ccccccaaauauauaaaacuaa

SEQ ID NO: 721323 - RNA, 18 nt, Human
cccccucccaguuucuuc

SEQ ID NO: 721324 - RNA, 25 nt, Human
ccccuguguccucccaccuacccca

SEQ ID NO: 721325 - RNA, 22 nt, Human
cccggaacccagagggcuuucc

SEQ ID NO: 721326 - RNA, 19 nt, Human
cccggcucccuccuuccca

SEQ ID NO: 721327 - RNA, 18 nt, Human
ccucccagccaccagucc

SEQ ID NO: 721328 - RNA, 19 nt, Human
ccucccagccaccaguccc

SEQ ID NO: 721329 - RNA, 21 nt, Human
ccucggagacugcccaucccc

SEQ ID NO: 721330 - RNA, 18 nt, Human
ccugagggagguguggga

SEQ ID NO: 721331 - RNA, 22 nt, Human
ccugcacuuguccccccaaaua

SEQ ID NO: 721332 - RNA, 22 nt, Human
ccugucucuuccauccuuucuc

SEQ ID NO: 721333 - RNA, 23 nt, Human
ccuugaggcugcgggucuccagg

SEQ ID NO: 721334 - RNA, 20 nt, Human
ccuuggguuuggauuugaag

SEQ ID NO: 721335 - RNA, 19 nt, Human
cuaauugaaaaaaaaaauc

SEQ ID NO: 721336 - RNA, 21 nt, Human
cucaaacccaggcaggcaguc

SEQ ID NO: 721337 - RNA, 20 nt, Human
cucagagcugggggcugggg

SEQ ID NO: 721338 - RNA, 19 nt, Human
cucagcacuucauuuacuu

SEQ ID NO: 721339 - RNA, 19 nt, Human
cuccagagccuccugucuc

SEQ ID NO: 721340 - RNA, 20 nt, Human
cuccucagcacuuugagggu

SEQ ID NO: 721341 - RNA, 18 nt, Human
cuccucucccucccagcc

SEQ ID NO: 721342 - RNA, 21 nt, Human
cugcugcuccucagcacuuug

SEQ ID NO: 721343 - RNA, 22 nt, Human
cuggcccuggggugagugggca

SEQ ID NO: 721344 - RNA, 18 nt, Human
cuucccacagagccacug

SEQ ID NO: 721345 - RNA, 21 nt, Human
cuucccccucccaguuucuuc

SEQ ID NO: 721346 - RNA, 25 nt, Human
gaacccagagggcuuuccuggccca

SEQ ID NO: 721347 - RNA, 23 nt, Human
gacagaaaagaagggucaccugg

SEQ ID NO: 721348 - RNA, 20 nt, Human
gacauauagaguggaauaaa

SEQ ID NO: 721349 - RNA, 24 nt, Human
gagacaguggucuggagggggagc

SEQ ID NO: 721350 - RNA, 19 nt, Human
gaggaggugggaguaccca

SEQ ID NO: 721351 - RNA, 23 nt, Human
gcacaacugucuucgagacagug

SEQ ID NO: 721352 - RNA, 22 nt, Human
gcucaggccagcuuccuucugc

SEQ ID NO: 721353 - RNA, 24 nt, Human
ggaaacucacuuugugauccuuga

SEQ ID NO: 721354 - RNA, 23 nt, Human
ggaggaggugggaguacccaggu

SEQ ID NO: 721355 - RNA, 20 nt, Human
ggaguggaggaggugggagu

SEQ ID NO: 721356 - RNA, 24 nt, Human
ggcgagaaaagcugccggccuucu

SEQ ID NO: 721357 - RNA, 26 nt, Human
ggcgaugcgcacacuaaaaaaagccc

SEQ ID NO: 721358 - RNA, 19 nt, Human
gggaauacccacacaugcc

SEQ ID NO: 721359 - RNA, 18 nt, Human
gggcccuccucucccucc

SEQ ID NO: 721360 - RNA, 18 nt, Human
gggcguggaguggaggag

SEQ ID NO: 721361 - RNA, 24 nt, Human
ggggagggagggaugaggagcagg

SEQ ID NO: 721362 - RNA, 28 nt, Human
ggggcugggguuaccauuggccuugggu

SEQ ID NO: 721363 - RNA, 24 nt, Human
gggggagggagggaugaggagcag

SEQ ID NO: 721364 - RNA, 23 nt, Human
gggugcccaccucucaugugcuu

SEQ ID NO: 721365 - RNA, 18 nt, Human
ggugggaggagggugagg

SEQ ID NO: 721366 - RNA, 18 nt, Human
guccauguccucggcacc

SEQ ID NO: 721367 - RNA, 22 nt, Human
gucugaguggggaccugaggga

SEQ ID NO: 721368 - RNA, 22 nt, Human
guggcugcuggucccagggcuu

SEQ ID NO: 721369 - RNA, 20 nt, Human
uaaaaaaagcccagacuuca

SEQ ID NO: 721370 - RNA, 21 nt, Human
uaacacucagcacuucauuua

SEQ ID NO: 721371 - RNA, 23 nt, Human
uaagaucucaagcacgggaacca

SEQ ID NO: 721372 - RNA, 23 nt, Human
uacccaaaggcaugugcccuaaa

SEQ ID NO: 721373 - RNA, 24 nt, Human
uacccaaaggcaugugcccuaaac

SEQ ID NO: 721374 - RNA, 20 nt, Human
uagaaggagcagccuguucc

SEQ ID NO: 721375 - RNA, 18 nt, Human
uaggaguucggugucucc

SEQ ID NO: 721376 - RNA, 18 nt, Human
ucacuugguuugucugug

SEQ ID NO: 721377 - RNA, 25 nt, Human
ucagagcuggguccucagagcuggg

SEQ ID NO: 721378 - RNA, 18 nt, Human
ucaggccagcuuccuucu

SEQ ID NO: 721379 - RNA, 21 nt, Human
ucaucuguucacggagggucc

SEQ ID NO: 721380 - RNA, 24 nt, Human
uccacaaugugugucaucuaccca

SEQ ID NO: 721381 - RNA, 23 nt, Human
uccacaugcuaucuacccaaagg

SEQ ID NO: 721382 - RNA, 21 nt, Human
uccacugccaugguggcugcu

SEQ ID NO: 721383 - RNA, 18 nt, Human
ucccacagagccacugcu

SEQ ID NO: 721384 - RNA, 21 nt, Human
ucccaccuaccccagggguca

SEQ ID NO: 721385 - RNA, 22 nt, Human
ucccagccaccagucccucguc

SEQ ID NO: 721386 - RNA, 18 nt, Human
ucccggaacccagagggc

SEQ ID NO: 721387 - RNA, 18 nt, Human
ucccggcucccuccuucc

SEQ ID NO: 721388 - RNA, 20 nt, Human
ucccgggccggcccugcucu

SEQ ID NO: 721389 - RNA, 21 nt, Human
ucccgggccggcccugcucuc

SEQ ID NO: 721390 - RNA, 20 nt, Human
uccggggagagcccuccuca

SEQ ID NO: 721391 - RNA, 18 nt, Human
uccucccaccuaccccag

SEQ ID NO: 721392 - RNA, 21 nt, Human
uccuucugccuaggccuccgg

SEQ ID NO: 721393 - RNA, 22 nt, Human
uccuugaggcugcgggucucca

SEQ ID NO: 721394 - RNA, 19 nt, Human
ucucagaggcagacacugg

SEQ ID NO: 721395 - RNA, 24 nt, Human
ucucagaggcagacacuggugcug

SEQ ID NO: 721396 - RNA, 22 nt, Human
ucucuggggaaggcuucccacc

SEQ ID NO: 721397 - RNA, 20 nt, Human
ucuugguaggugugaugcug

SEQ ID NO: 721398 - RNA, 20 nt, Human
ugaaaggugagaagguggga

SEQ ID NO: 721399 - RNA, 25 nt, Human
ugaaaggugagaaggugggaggagg

SEQ ID NO: 721400 - RNA, 26 nt, Human
ugaaggaaaagcgcuugauaaggcgg

SEQ ID NO: 721401 - RNA, 19 nt, Human
ugaaguucccauuuuacag

SEQ ID NO: 721402 - RNA, 18 nt, Human
ugagaaaacugaggcacu

SEQ ID NO: 721403 - RNA, 18 nt, Human
ugagaaggugggaggagg

SEQ ID NO: 721404 - RNA, 21 nt, Human
ugagaaggugggaggagggug

SEQ ID NO: 721405 - RNA, 19 nt, Human
ugaggaaacugaggucccc

SEQ ID NO: 721406 - RNA, 23 nt, Human
ugaggaaacugagguccccaaag

SEQ ID NO: 721407 - RNA, 23 nt, Human
ugaggcugcgggucuccagggca

SEQ ID NO: 721408 - RNA, 19 nt, Human
ugagggaggugaagagggg

SEQ ID NO: 721409 - RNA, 18 nt, Human
ugagggaggugugggagc

SEQ ID NO: 721410 - RNA, 21 nt, Human
ugagggaggugugggagcccc

SEQ ID NO: 721411 - RNA, 19 nt, Human
ugcaauauaugcauguaag

SEQ ID NO: 721412 - RNA, 21 nt, Human
ugcaugcaauauaugcaugua

SEQ ID NO: 721413 - RNA, 22 nt, Human
ugccaugguggcugcugguccc

SEQ ID NO: 721414 - RNA, 23 nt, Human
ugccaugguggcugcugguccca

SEQ ID NO: 721415 - RNA, 19 nt, Human
ugcuggggcguggagugga

SEQ ID NO: 721416 - RNA, 18 nt, Human
uggagacauggcuggugg

SEQ ID NO: 721417 - RNA, 26 nt, Human
ugggacagaaaagaagggucaccugg

SEQ ID NO: 721418 - RNA, 20 nt, Human
ugggagagagaagagacaga

SEQ ID NO: 721419 - RNA, 21 nt, Human
ugggaggagggugaggguuga

SEQ ID NO: 721420 - RNA, 18 nt, Human
ugggcacaacugucuucg

SEQ ID NO: 721421 - RNA, 20 nt, Human
uggggaccugagggaggugu

SEQ ID NO: 721422 - RNA, 18 nt, Human
uggguccucagagcuggg

SEQ ID NO: 721423 - RNA, 20 nt, Human
ugguaggugugaugcugggg

SEQ ID NO: 721424 - RNA, 18 nt, Human
ugguggcugcugguccca

SEQ ID NO: 721425 - RNA, 23 nt, Human
uguauaagaucucaagcacggga

SEQ ID NO: 721426 - RNA, 18 nt, Human
ugucaucuacccaaccuc

SEQ ID NO: 721427 - RNA, 21 nt, Human
ugugucaucuacccaaccuca

SEQ ID NO: 721428 - RNA, 21 nt, Human
uucaaaggauaaccaguuguc

SEQ ID NO: 721429 - RNA, 20 nt, Human
uuccacaugcuaucuaccca

SEQ ID NO: 721430 - RNA, 19 nt, Human
uucuaagacuucccccucc

SEQ ID NO: 721431 - RNA, 18 nt, Human
uucucagaggcagacacu

SEQ ID NO: 721432 - RNA, 21 nt, Human
uucuucugaggcaacaguuaa

SEQ ID NO: 721433 - RNA, 20 nt, Human
uugaguuuuuugcuacaauu

SEQ ID NO: 721434 - RNA, 18 nt, Human
uuucaaaggauaaccagu

SEQ ID NO: 721435 - RNA, 18 nt, Human
uuucaaaggauaaccagu

SEQ ID NO: 721436 - RNA, 26 nt, Human
uuugcccacauuucagaaugagagag

SEQ ID NO: 721437 - RNA, 20 nt, Human
aaaaagaaacaaaagguuua

SEQ ID NO: 721438 - RNA, 23 nt, Human
aaaauaagacccauggcaaagag

SEQ ID NO: 721439 - RNA, 19 nt, Human
aaacauucaugaacauuua

SEQ ID NO: 721440 - RNA, 24 nt, Human
aaacauucaugaacauuuaaauaa

SEQ ID NO: 721441 - RNA, 23 nt, Human
aaagaaccaaguaaaugacagac

SEQ ID NO: 721442 - RNA, 23 nt, Human
aaauauguaggggccuagggggu

SEQ ID NO: 721443 - RNA, 21 nt, Human
aaauuguguaucaagaaacua

SEQ ID NO: 721444 - RNA, 23 nt, Human
aacacgguggaaaaaaaacuggu

SEQ ID NO: 721445 - RNA, 20 nt, Human
aaggaagaaugggaagagaa

SEQ ID NO: 721446 - RNA, 23 nt, Human
aaggacacacagcacaccagagc

SEQ ID NO: 721447 - RNA, 21 nt, Human
aagucugcaauggagcuaggc

SEQ ID NO: 721448 - RNA, 18 nt, Human
aauugcacaacacaugca

SEQ ID NO: 721449 - RNA, 21 nt, Human
aauuucuacccuaucuaucuc

SEQ ID NO: 721450 - RNA, 18 nt, Human
acaacacaugcaacaugg

SEQ ID NO: 721451 - RNA, 19 nt, Human
acacagcacaccagagcag

SEQ ID NO: 721452 - RNA, 21 nt, Human
acauaguuucaaggcuuaaaa

SEQ ID NO: 721453 - RNA, 18 nt, Human
accaaggcaccaagccag

SEQ ID NO: 721454 - RNA, 23 nt, Human
acuaaaucaaagcuuaaaacaac

SEQ ID NO: 721455 - RNA, 22 nt, Human
acugaaaucacaagagcuauaa

SEQ ID NO: 721456 - RNA, 25 nt, Human
acugaaaucacaagagcuauaacug

SEQ ID NO: 721457 - RNA, 18 nt, Human
acuugcugguucuggaac

SEQ ID NO: 721458 - RNA, 18 nt, Human
agaagagccuacaggcau

SEQ ID NO: 721459 - RNA, 21 nt, Human
agaaugccaugcuagcugugg

SEQ ID NO: 721460 - RNA, 24 nt, Human
agacuuuuccaggguauaagggug

SEQ ID NO: 721461 - RNA, 24 nt, Human
agcaacucucaggcugccgucuca

SEQ ID NO: 721462 - RNA, 20 nt, Human
agcaaucuccggaacacaga

SEQ ID NO: 721463 - RNA, 23 nt, Human
agcccaguacaucucaccugcag

SEQ ID NO: 721464 - RNA, 24 nt, Human
aggaauggacagagcauguagaca

SEQ ID NO: 721465 - RNA, 18 nt, Human
aggcagcauacaucucag

SEQ ID NO: 721466 - RNA, 22 nt, Human
aggcaugaagauaaccuggagc

SEQ ID NO: 721467 - RNA, 19 nt, Human
aggcucuggaaaacacugg

SEQ ID NO: 721468 - RNA, 19 nt, Human
agguaauuacagacuuuuc

SEQ ID NO: 721469 - RNA, 24 nt, Human
auauaauaaaaagcccaguacauc

SEQ ID NO: 721470 - RNA, 26 nt, Human
aucucacucuguuucaaaggguugaa

SEQ ID NO: 721471 - RNA, 18 nt, Human
aucugccacuaaagcuac

SEQ ID NO: 721472 - RNA, 22 nt, Human
augaagauaaccuggagccuau

SEQ ID NO: 721473 - RNA, 22 nt, Human
augggaagagaagaauacaaau

SEQ ID NO: 721474 - RNA, 20 nt, Human
auguuuuuuaaaagacauuc

SEQ ID NO: 721475 - RNA, 21 nt, Human
auuagaaacuauaccaaaaac

SEQ ID NO: 721476 - RNA, 24 nt, Human
auucuuggcauuucaauauagguu

SEQ ID NO: 721477 - RNA, 25 nt, Human
auuuccuuuccuccuccuuccuuuc

SEQ ID NO: 721478 - RNA, 22 nt, Human
caaaauuaccacgcuaaauggc

SEQ ID NO: 721479 - RNA, 20 nt, Human
caaagagccaucccugauaa

SEQ ID NO: 721480 - RNA, 19 nt, Human
caaagcuuaaaacaacagc

SEQ ID NO: 721481 - RNA, 21 nt, Human
caaagcuuaaaacaacagcuc

SEQ ID NO: 721482 - RNA, 19 nt, Human
caaaggguugaaagcaauu

SEQ ID NO: 721483 - RNA, 20 nt, Human
caacaaaaagacuaaggaca

SEQ ID NO: 721484 - RNA, 19 nt, Human
caagagcuauaacugccag

SEQ ID NO: 721485 - RNA, 20 nt, Human
caccagagcagcaccguccu

SEQ ID NO: 721486 - RNA, 21 nt, Human
caccagagcagcaccguccuu

SEQ ID NO: 721487 - RNA, 20 nt, Human
caccucaagucuaaacacgg

SEQ ID NO: 721488 - RNA, 21 nt, Human
cagaggugauuucaccauuuu

SEQ ID NO: 721489 - RNA, 19 nt, Human
cagcugccucuuguauucc

SEQ ID NO: 721490 - RNA, 21 nt, Human
caggucuccaacuaccagaua

SEQ ID NO: 721491 - RNA, 20 nt, Human
cauccaauuucucuggaaac

SEQ ID NO: 721492 - RNA, 24 nt, Human
cauccaauuucucuggaaacauaa

SEQ ID NO: 721493 - RNA, 20 nt, Human
cauggaccaaggcaccaagc

SEQ ID NO: 721494 - RNA, 24 nt, Human
cauuaaugcucuacauaauuuggu

SEQ ID NO: 721495 - RNA, 21 nt, Human
cauucacuacuuuauccacuc

SEQ ID NO: 721496 - RNA, 18 nt, Human
ccacaggcaggcagggca

SEQ ID NO: 721497 - RNA, 18 nt, Human
ccagccagugacagaaau

SEQ ID NO: 721498 - RNA, 19 nt, Human
ccagcuuaccucauaguua

SEQ ID NO: 721499 - RNA, 22 nt, Human
cccacaggcuaaaacuugccag

SEQ ID NO: 721500 - RNA, 23 nt, Human
cccacauuuugggagucugugac

SEQ ID NO: 721501 - RNA, 19 nt, Human
cccauagcaucugcccaaa

SEQ ID NO: 721502 - RNA, 22 nt, Human
ccccuaaaaaaauaaaaaaaaa

SEQ ID NO: 721503 - RNA, 23 nt, Human
cccuagaauggaaucuauuagca

SEQ ID NO: 721504 - RNA, 25 nt, Human
cccuaucuaucucacucuguuucaa

SEQ ID NO: 721505 - RNA, 22 nt, Human
ccuccuuccuuucacuacucaa

SEQ ID NO: 721506 - RNA, 22 nt, Human
cuaaaacaacaaaaagacuaag

SEQ ID NO: 721507 - RNA, 21 nt, Human
cucauaguuaucccuucaauc

SEQ ID NO: 721508 - RNA, 22 nt, Human
cucuccuuccucagggauccca

SEQ ID NO: 721509 - RNA, 22 nt, Human
cugaaugagcacccagaggcau

SEQ ID NO: 721510 - RNA, 18 nt, Human
cugacccuuuggaagucu

SEQ ID NO: 721511 - RNA, 19 nt, Human
cugagcccaucuuguuuuu

SEQ ID NO: 721512 - RNA, 31 nt, Human
cuuucauucaccaaaauucuauuauacaugg

SEQ ID NO: 721513 - RNA, 19 nt, Human
cuuuccuccuccuuccuuu

SEQ ID NO: 721514 - RNA, 24 nt, Human
ggaaaacacugguggaaauaauca

SEQ ID NO: 721515 - RNA, 22 nt, Human
ggacccaaagagcuaucagcaa

SEQ ID NO: 721516 - RNA, 21 nt, Human
ggcaugaagauaaccuggagc

SEQ ID NO: 721517 - RNA, 19 nt, Human
gguggugagaaaaggcuga

SEQ ID NO: 721518 - RNA, 24 nt, Human
guaauuacagacuuuuccagggua

SEQ ID NO: 721519 - RNA, 24 nt, Human
guccacguaaagauaacugaccac

SEQ ID NO: 721520 - RNA, 18 nt, Human
gugaaaauaagacccaug

SEQ ID NO: 721521 - RNA, 18 nt, Human
guggaaauaaucaacugc

SEQ ID NO: 721522 - RNA, 24 nt, Human
uaaaaaacaaaacaauaaaaaucu

SEQ ID NO: 721523 - RNA, 19 nt, Human
uaaaaaaucaucugccuuu

SEQ ID NO: 721524 - RNA, 21 nt, Human
uaaaaaucuauuuuccuccca

SEQ ID NO: 721525 - RNA, 23 nt, Human
uaaaacaacaaaaagacuaagga

SEQ ID NO: 721526 - RNA, 24 nt, Human
uaaaacaacaaaaagacuaaggac

SEQ ID NO: 721527 - RNA, 21 nt, Human
uaaaacaacagcuccuggggc

SEQ ID NO: 721528 - RNA, 22 nt, Human
uaaaauggaacagugggacccc

SEQ ID NO: 721529 - RNA, 20 nt, Human
uaaacagagaaagaggagaa

SEQ ID NO: 721530 - RNA, 23 nt, Human
uaaagucacugaaauaaaagcug

SEQ ID NO: 721531 - RNA, 20 nt, Human
uaaaguuccuuuuacccuuc

SEQ ID NO: 721532 - RNA, 22 nt, Human
uaacagacguaaaaaucaugaa

SEQ ID NO: 721533 - RNA, 19 nt, Human
uaacccauagcaucugccc

SEQ ID NO: 721534 - RNA, 24 nt, Human
uaacugccagagaaaaauuaaaug

SEQ ID NO: 721535 - RNA, 24 nt, Human
uaagguauuacccacaggcuaaaa

SEQ ID NO: 721536 - RNA, 21 nt, Human
uaaguaggggaggcaccaaaa

SEQ ID NO: 721537 - RNA, 20 nt, Human
uacugaaaucacaagagcua

SEQ ID NO: 721538 - RNA, 24 nt, Human
uaguaaccaucuagaaucaacuca

SEQ ID NO: 721539 - RNA, 18 nt, Human
uaguucacagguaaggga

SEQ ID NO: 721540 - RNA, 19 nt, Human
ucaacuguaacccauagca

SEQ ID NO: 721541 - RNA, 20 nt, Human
ucacucuggagcacuugcug

SEQ ID NO: 721542 - RNA, 19 nt, Human
ucauaugucagacuugagu

SEQ ID NO: 721543 - RNA, 19 nt, Human
uccagagcccuggagccca

SEQ ID NO: 721544 - RNA, 18 nt, Human
uccaucugagcccaucuu

SEQ ID NO: 721545 - RNA, 19 nt, Human
uccaucugagcccaucuug

SEQ ID NO: 721546 - RNA, 19 nt, Human
ucccuaaguaggggaggca

SEQ ID NO: 721547 - RNA, 22 nt, Human
ucccuguguucuguuggucucu

SEQ ID NO: 721548 - RNA, 19 nt, Human
ucucacucuguuucaaagg

SEQ ID NO: 721549 - RNA, 23 nt, Human
ucuccagagaauccugagaccac

SEQ ID NO: 721550 - RNA, 21 nt, Human
ucucucuggaaguugcagccu

SEQ ID NO: 721551 - RNA, 23 nt, Human
ucuucaaguagugacugagccag

SEQ ID NO: 721552 - RNA, 26 nt, Human
ugaaaggaauggacagagcauguaga

SEQ ID NO: 721553 - RNA, 21 nt, Human
ugaaagggcaaaggcagggua

SEQ ID NO: 721554 - RNA, 18 nt, Human
ugaaauaaagacaugauc

SEQ ID NO: 721555 - RNA, 20 nt, Human
ugaaaucacaagagcuauaa

SEQ ID NO: 721556 - RNA, 23 nt, Human
ugaaaucacaagagcuauaacug

SEQ ID NO: 721557 - RNA, 26 nt, Human
ugaagaccacaaagaaaaagaaccaa

SEQ ID NO: 721558 - RNA, 20 nt, Human
ugaagcaaucugagugggaa

SEQ ID NO: 721559 - RNA, 19 nt, Human
ugaaugagcacccagaggc

SEQ ID NO: 721560 - RNA, 22 nt, Human
ugagcacccagaggcaugaaga

SEQ ID NO: 721561 - RNA, 21 nt, Human
ugagguaguugucacuuagga

SEQ ID NO: 721562 - RNA, 23 nt, Human
ugccaugaccaucuaucuuccug

SEQ ID NO: 721563 - RNA, 22 nt, Human
uggaaaaaaaacuggucuagag

SEQ ID NO: 721564 - RNA, 18 nt, Human
uggaaaauuaugguaacu

SEQ ID NO: 721565 - RNA, 18 nt, Human
uggaaacuugacagcuga

SEQ ID NO: 721566 - RNA, 18 nt, Human
uggaacaugaguuuguua

SEQ ID NO: 721567 - RNA, 22 nt, Human
uggaauuagaaacuauaccaaa

SEQ ID NO: 721568 - RNA, 26 nt, Human
uggagaacguauaaaaagcauccaaa

SEQ ID NO: 721569 - RNA, 22 nt, Human
uggcaaaagaaucugaaacuaa

SEQ ID NO: 721570 - RNA, 20 nt, Human
uggcuggucuaaaggaguca

SEQ ID NO: 721571 - RNA, 22 nt, Human
uggcuggucuaaaggagucauu

SEQ ID NO: 721572 - RNA, 25 nt, Human
ugguaacugcaggcuguaacaguuu

SEQ ID NO: 721573 - RNA, 22 nt, Human
uggucugagagaugagacugua

SEQ ID NO: 721574 - RNA, 18 nt, Human
ugguguggaaauccaaag

SEQ ID NO: 721575 - RNA, 24 nt, Human
uguaacccauagcaucugcccaaa

SEQ ID NO: 721576 - RNA, 19 nt, Human
uguagagagagaacauuuu

SEQ ID NO: 721577 - RNA, 20 nt, Human
ugugucacucuggagcacuu

SEQ ID NO: 721578 - RNA, 21 nt, Human
uguuccuaaaggcaaauagga

SEQ ID NO: 721579 - RNA, 23 nt, Human
uguuuuaugccagcugccucuug

SEQ ID NO: 721580 - RNA, 18 nt, Human
uuaaaaaaucaucugccu

SEQ ID NO: 721581 - RNA, 19 nt, Human
uuaaaacaacagcuccugg

SEQ ID NO: 721582 - RNA, 23 nt, Human
uuaaaauuggaauuagaaacuau

SEQ ID NO: 721583 - RNA, 23 nt, Human
uuauaggcaagcuaucaccuccc

SEQ ID NO: 721584 - RNA, 21 nt, Human
uucaaacauucaugaacauuu

SEQ ID NO: 721585 - RNA, 18 nt, Human
uucaccaaaauucuauua

SEQ ID NO: 721586 - RNA, 24 nt, Human
uuccucacagaugacauugcuggu

SEQ ID NO: 721587 - RNA, 22 nt, Human
uugaguccagagaauacuagaa

SEQ ID NO: 721588 - RNA, 22 nt, Human
uugaucccuguguucuguuggu

SEQ ID NO: 721589 - RNA, 24 nt, Human
uugguuucaguuaauauguaauau

SEQ ID NO: 721590 - RNA, 24 nt, Human
uuuaauuuccuuuccuccuccuuc

SEQ ID NO: 721591 - RNA, 21 nt, Human
uuucccaauguaaaguuccuu

SEQ ID NO: 721592 - RNA, 22 nt, Human
uuuccuccuccuuccuuucacu

SEQ ID NO: 721593 - RNA, 23 nt, Human
uuuccuuuccuccuccuuccuuu

SEQ ID NO: 721594 - RNA, 24 nt, Human
uuuuaccauguacauaauucacaa

SEQ ID NO: 721595 - RNA, 20 nt, Human
agcuccgugccucaguuucc

SEQ ID NO: 721596 - RNA, 24 nt, Human
aggcuggggugggaggccccaggg

SEQ ID NO: 721597 - RNA, 22 nt, Human
augggccucagggaggcugggg

SEQ ID NO: 721598 - RNA, 20 nt, Human
caccagggcgcaguguagag

SEQ ID NO: 721599 - RNA, 18 nt, Human
cagccaggcugggcaugg

SEQ ID NO: 721600 - RNA, 21 nt, Human
cagccaggcugggcauggggc

SEQ ID NO: 721601 - RNA, 21 nt, Human
ccccaggguccggcaggaggg

SEQ ID NO: 721602 - RNA, 19 nt, Human
ccugucugacggggcaggc

SEQ ID NO: 721603 - RNA, 20 nt, Human
gaguaugggccucagggagg

SEQ ID NO: 721604 - RNA, 22 nt, Human
gccucagggaggcugggguggg

SEQ ID NO: 721605 - RNA, 22 nt, Human
ggccucagggaggcuggggugg

SEQ ID NO: 721606 - RNA, 19 nt, Human
gggcagcagcauuugcggg

SEQ ID NO: 721607 - RNA, 20 nt, Human
ggguagcgagugggaugggg

SEQ ID NO: 721608 - RNA, 23 nt, Human
ggguggucagccagcaccagggc

SEQ ID NO: 721609 - RNA, 18 nt, Human
uaaaaggccgggaccugu

SEQ ID NO: 721610 - RNA, 22 nt, Human
uccgugccucaguuuccccauc

SEQ ID NO: 721611 - RNA, 19 nt, Human
ucuccguggaguaugggcc

SEQ ID NO: 721612 - RNA, 18 nt, Human
ucucgggcucagccaggc

SEQ ID NO: 721613 - RNA, 24 nt, Human
ucuguggagaccccugcaggcccc

SEQ ID NO: 721614 - RNA, 23 nt, Human
ugcaggccccguccagugccugg

SEQ ID NO: 721615 - RNA, 19 nt, Human
uggcaugagggggaggagc

SEQ ID NO: 721616 - RNA, 22 nt, Human
ugggaggccccaggguccggca

SEQ ID NO: 721617 - RNA, 19 nt, Human
uggggcagcagcauuugcg

SEQ ID NO: 721618 - RNA, 19 nt, Human
uggggccccugucugacgg

SEQ ID NO: 721619 - RNA, 20 nt, Human
uggggugggaggccccaggg

SEQ ID NO: 721620 - RNA, 23 nt, Human
uggggugggaggccccagggucc

SEQ ID NO: 721621 - RNA, 22 nt, Human
uggugucugagucacuguccag

SEQ ID NO: 721622 - RNA, 19 nt, Human
uguagagcuggggcagcag

SEQ ID NO: 721623 - RNA, 21 nt, Human
uguagagcuggggcagcagca

SEQ ID NO: 721624 - RNA, 20 nt, Human
ugugugggguuggcaugagg

SEQ ID NO: 721625 - RNA, 25 nt, Human
uucaaagaacauuaaaaggccggga

SEQ ID NO: 721626 - RNA, 28 nt, Human
aaaaaggaaacguaauaaaaacaaggga

SEQ ID NO: 721627 - RNA, 18 nt, Human
aaaaggaaacguaauaaa

SEQ ID NO: 721628 - RNA, 20 nt, Human
aaaaugcuagcuacaucuuu

SEQ ID NO: 721629 - RNA, 21 nt, Human
aacacuucuugccuauagaug

SEQ ID NO: 721630 - RNA, 19 nt, Human
aaccuccaucggccaucuc

SEQ ID NO: 721631 - RNA, 22 nt, Human
aacuucaguguauacuucgcaa

SEQ ID NO: 721632 - RNA, 18 nt, Human
aagcuucaguggucaugg

SEQ ID NO: 721633 - RNA, 27 nt, Human
acgacacaacuucaguguauacuucgc

SEQ ID NO: 721634 - RNA, 18 nt, Human
agaaaccaugccaaagac

SEQ ID NO: 721635 - RNA, 20 nt, Human
agaaggaagguaguuaccag

SEQ ID NO: 721636 - RNA, 22 nt, Human
agaaggaagguaguuaccaggg

SEQ ID NO: 721637 - RNA, 19 nt, Human
agacgcuggaggaaggguu

SEQ ID NO: 721638 - RNA, 21 nt, Human
agaggggaagaugguggccac

SEQ ID NO: 721639 - RNA, 22 nt, Human
agaguucugcauggacuuggag

SEQ ID NO: 721640 - RNA, 18 nt, Human
aggaggauagauuuggag

SEQ ID NO: 721641 - RNA, 21 nt, Human
aggauccuuuauuaaaauauc

SEQ ID NO: 721642 - RNA, 22 nt, Human
aggggaagaugguggccacagu

SEQ ID NO: 721643 - RNA, 23 nt, Human
aggguggugguggcuaaaagaug

SEQ ID NO: 721644 - RNA, 21 nt, Human
auagaacuaggauuacaacaa

SEQ ID NO: 721645 - RNA, 20 nt, Human
auccgggcuggacucccccc

SEQ ID NO: 721646 - RNA, 21 nt, Human
augccuuccagaaacagcacc

SEQ ID NO: 721647 - RNA, 24 nt, Human
auggcgagaaggggagcugggguc

SEQ ID NO: 721648 - RNA, 23 nt, Human
caaaaaacguaaacggcauaaca

SEQ ID NO: 721649 - RNA, 22 nt, Human
caaacgccacucuccaagcacc

SEQ ID NO: 721650 - RNA, 19 nt, Human
caaaucccgucacacuaaa

SEQ ID NO: 721651 - RNA, 18 nt, Human
caaguggggaaacuuccu

SEQ ID NO: 721652 - RNA, 22 nt, Human
cagaccaccagaaugaaacacu

SEQ ID NO: 721653 - RNA, 25 nt, Human
ccaagaggggaagaugguggccaca

SEQ ID NO: 721654 - RNA, 20 nt, Human
ccaagcaccugccccaugcc

SEQ ID NO: 721655 - RNA, 24 nt, Human
ccaagcaccugccccaugcccacc

SEQ ID NO: 721656 - RNA, 20 nt, Human
ccagaaugaaacacauccuc

SEQ ID NO: 721657 - RNA, 22 nt, Human
cccaugcccaccuuuccaaagg

SEQ ID NO: 721658 - RNA, 18 nt, Human
ccccggggccgccgccgg

SEQ ID NO: 721659 - RNA, 20 nt, Human
ccccggggccgccgccggcc

SEQ ID NO: 721660 - RNA, 24 nt, Human
cccucccuuaccccauccuguuga

SEQ ID NO: 721661 - RNA, 18 nt, Human
cccugagcgccgcggccc

SEQ ID NO: 721662 - RNA, 19 nt, Human
ccgcccgggcccugagcgc

SEQ ID NO: 721663 - RNA, 23 nt, Human
ccuagaaaccaugccaaagacgc

SEQ ID NO: 721664 - RNA, 23 nt, Human
ccuccauggcccacagguuucua

SEQ ID NO: 721665 - RNA, 22 nt, Human
cuauagauggacaagauggaug

SEQ ID NO: 721666 - RNA, 21 nt, Human
cucaauauccgggcuggacuc

SEQ ID NO: 721667 - RNA, 22 nt, Human
cuccaagcaccugccccaugcc

SEQ ID NO: 721668 - RNA, 19 nt, Human
cuccccaacaggucaugcg

SEQ ID NO: 721669 - RNA, 22 nt, Human
cugaaaauggucacuguuuccu

SEQ ID NO: 721670 - RNA, 20 nt, Human
cuguugaggagaguaagugc

SEQ ID NO: 721671 - RNA, 19 nt, Human
cuucucaucuucauucugg

SEQ ID NO: 721672 - RNA, 23 nt, Human
gaaaacaccaagaggggaagaug

SEQ ID NO: 721673 - RNA, 22 nt, Human
gaacuaggauuacaacaaaaaa

SEQ ID NO: 721674 - RNA, 18 nt, Human
gaaggguuccucugaguu

SEQ ID NO: 721675 - RNA, 18 nt, Human
gaggaaggguuccucuga

SEQ ID NO: 721676 - RNA, 22 nt, Human
gaggagcaggggggugcagaaa

SEQ ID NO: 721677 - RNA, 18 nt, Human
gcccacaucucuacaaca

SEQ ID NO: 721678 - RNA, 23 nt, Human
gcccgggcccugagcgccgcggc

SEQ ID NO: 721679 - RNA, 21 nt, Human
gcccggggccccucgggcgcc

SEQ ID NO: 721680 - RNA, 22 nt, Human
gcccggggccccucgggcgccc

SEQ ID NO: 721681 - RNA, 19 nt, Human
gccugggcugggugugaga

SEQ ID NO: 721682 - RNA, 19 nt, Human
ggacuuggaguugcagaug

SEQ ID NO: 721683 - RNA, 22 nt, Human
ggagucacucaauucagccuuc

SEQ ID NO: 721684 - RNA, 22 nt, Human
ggcccggggccccucgggcgcc

SEQ ID NO: 721685 - RNA, 18 nt, Human
ggcgagaaggggagcugg

SEQ ID NO: 721686 - RNA, 19 nt, Human
ggggagcuggggucucuag

SEQ ID NO: 721687 - RNA, 20 nt, Human
gguggugguggcuaaaagau

SEQ ID NO: 721688 - RNA, 19 nt, Human
gguuuguguaugugugugu

SEQ ID NO: 721689 - RNA, 23 nt, Human
gguuuguguuuuguugacuguuu

SEQ ID NO: 721690 - RNA, 21 nt, Human
guaauaaaaacaagggagaga

SEQ ID NO: 721691 - RNA, 20 nt, Human
gucccuugcccccucacccu

SEQ ID NO: 721692 - RNA, 21 nt, Human
gucuuauaguguuuugugaug

SEQ ID NO: 721693 - RNA, 20 nt, Human
guggagacugcagccugggc

SEQ ID NO: 721694 - RNA, 18 nt, Human
guggggaaacuuccuggg

SEQ ID NO: 721695 - RNA, 19 nt, Human
guugaguuccucccucccu

SEQ ID NO: 721696 - RNA, 24 nt, Human
uaaagccaaauuuaguucucuagg

SEQ ID NO: 721697 - RNA, 18 nt, Human
uacaacaggauuuccgug

SEQ ID NO: 721698 - RNA, 22 nt, Human
uacagaacguguuccuuuuuuu

SEQ ID NO: 721699 - RNA, 18 nt, Human
uacuucgcaacaguugug

SEQ ID NO: 721700 - RNA, 19 nt, Human
uagaaaccaugccaaagac

SEQ ID NO: 721701 - RNA, 18 nt, Human
uagaacuaggauuacaac

SEQ ID NO: 721702 - RNA, 18 nt, Human
uagauggacaagauggau

SEQ ID NO: 721703 - RNA, 20 nt, Human
uaguggcaaaaacgacacaa

SEQ ID NO: 721704 - RNA, 19 nt, Human
uauacaauucuguauuuag

SEQ ID NO: 721705 - RNA, 22 nt, Human
uauauucaccuucucaucuuca

SEQ ID NO: 721706 - RNA, 25 nt, Human
ucaaaagacuauacuaagugcuuaa

SEQ ID NO: 721707 - RNA, 18 nt, Human
ucacagacagauguggaa

SEQ ID NO: 721708 - RNA, 18 nt, Human
uccagauuugauuacucu

SEQ ID NO: 721709 - RNA, 21 nt, Human
ucccuugcccccucacccugc

SEQ ID NO: 721710 - RNA, 24 nt, Human
ucguuuacagaacguguuccuuuu

SEQ ID NO: 721711 - RNA, 20 nt, Human
ucuggggagucacucaauuc

SEQ ID NO: 721712 - RNA, 20 nt, Human
ucuuauaguguuuugugaug

SEQ ID NO: 721713 - RNA, 21 nt, Human
ucuuuuuagcacaguuucugg

SEQ ID NO: 721714 - RNA, 23 nt, Human
ugaaaauggucacuguuuccuau

SEQ ID NO: 721715 - RNA, 18 nt, Human
ugaagaggagcagggggg

SEQ ID NO: 721716 - RNA, 24 nt, Human
ugaauauguggugccauuuugcuu

SEQ ID NO: 721717 - RNA, 26 nt, Human
ugacagcauccugauuuuauaacugg

SEQ ID NO: 721718 - RNA, 21 nt, Human
ugacccaccugcucacacagc

SEQ ID NO: 721719 - RNA, 23 nt, Human
ugagaaagaagauggcgagaagg

SEQ ID NO: 721720 - RNA, 19 nt, Human
ugcaaaacagaccaccaga

SEQ ID NO: 721721 - RNA, 23 nt, Human
ugcaaaacagaccaccagaauga

SEQ ID NO: 721722 - RNA, 22 nt, Human
ugcagaaaaguggaggcaaugg

SEQ ID NO: 721723 - RNA, 22 nt, Human
ugcucuggaauacccacacucc

SEQ ID NO: 721724 - RNA, 18 nt, Human
uggacuccccccagcccc

SEQ ID NO: 721725 - RNA, 18 nt, Human
uggaggcugggauauggu

SEQ ID NO: 721726 - RNA, 24 nt, Human
uggauaaaaauguauacaguggaa

SEQ ID NO: 721727 - RNA, 19 nt, Human
uggcgagaaggggagcugg

SEQ ID NO: 721728 - RNA, 20 nt, Human
uggcgagaaggggagcuggg

SEQ ID NO: 721729 - RNA, 20 nt, Human
uggcgagaaggggagcuggg

SEQ ID NO: 721730 - RNA, 21 nt, Human
uggcuaaaagauguuucauuu

SEQ ID NO: 721731 - RNA, 21 nt, Human
ugggauaaauuccaaaggauc

SEQ ID NO: 721732 - RNA, 20 nt, Human
ugggaugaccaacacuguca

SEQ ID NO: 721733 - RNA, 22 nt, Human
uguggagacugcagccugggcu

SEQ ID NO: 721734 - RNA, 18 nt, Human
uguguaugugugugugug

SEQ ID NO: 721735 - RNA, 24 nt, Human
uguguguguguuuuuuaaccguuu

SEQ ID NO: 721736 - RNA, 21 nt, Human
uuacaauggcacggacauucu

SEQ ID NO: 721737 - RNA, 22 nt, Human
uuaucuguccccuucugguugc

SEQ ID NO: 721738 - RNA, 22 nt, Human
uucacacgggaaauggggucgc

SEQ ID NO: 721739 - RNA, 19 nt, Human
uuccagaaacagcaccacg

SEQ ID NO: 721740 - RNA, 30 nt, Human
uucugccuccugcagaggggucagggugaa

SEQ ID NO: 721741 - RNA, 18 nt, Human
uugcccccucacccugcc

SEQ ID NO: 721742 - RNA, 20 nt, Human
uugcuguccacauuuugaug

SEQ ID NO: 721743 - RNA, 21 nt, Human
uugcuguccacauuuugaugg

SEQ ID NO: 721744 - RNA, 19 nt, Human
uuuacagaacguguuccuu

SEQ ID NO: 721745 - RNA, 18 nt, Human
uuugugauggcuuugaau

SEQ ID NO: 721746 - RNA, 21 nt, Human
uuuguguaugugugugugugu

SEQ ID NO: 721747 - RNA, 18 nt, Human
aaaaaggaaaagaaaaac

SEQ ID NO: 721748 - RNA, 22 nt, Human
aaaacgaggaggcagaaaccua

SEQ ID NO: 721749 - RNA, 23 nt, Human
aaacaaaauauguguuaccaaga

SEQ ID NO: 721750 - RNA, 23 nt, Human
aaacaaacaacaaaggcccagaa

SEQ ID NO: 721751 - RNA, 24 nt, Human
aaacgaggaggcagaaaccuaggg

SEQ ID NO: 721752 - RNA, 22 nt, Human
aaacggcaccuucagcaccucc

SEQ ID NO: 721753 - RNA, 21 nt, Human
aaagauaggaggggagaacag

SEQ ID NO: 721754 - RNA, 19 nt, Human
aacagagcaacgccaaugg

SEQ ID NO: 721755 - RNA, 22 nt, Human
aacagagcaacgccaauggaac

SEQ ID NO: 721756 - RNA, 19 nt, Human
aaccccugcccccugccuc

SEQ ID NO: 721757 - RNA, 18 nt, Human
aacuagcugcccaguugc

SEQ ID NO: 721758 - RNA, 21 nt, Human
aacuagcugcccaguugcauc

SEQ ID NO: 721759 - RNA, 23 nt, Human
aagaggaaguagagagaagggac

SEQ ID NO: 721760 - RNA, 19 nt, Human
aagcggccaaacaaugguu

SEQ ID NO: 721761 - RNA, 20 nt, Human
aagcggccaaacaaugguuu

SEQ ID NO: 721762 - RNA, 20 nt, Human
aagcuaccaaaucauccuca

SEQ ID NO: 721763 - RNA, 20 nt, Human
aaguucguccucuguguuuc

SEQ ID NO: 721764 - RNA, 21 nt, Human
aauuauguagaaaacaacccc

SEQ ID NO: 721765 - RNA, 21 nt, Human
acaaacaacaaaggcccagaa

SEQ ID NO: 721766 - RNA, 20 nt, Human
acaaggcaggaaaaggggau

SEQ ID NO: 721767 - RNA, 18 nt, Human
acaaugguuugguugggu

SEQ ID NO: 721768 - RNA, 19 nt, Human
acagaguaugcugcaggcc

SEQ ID NO: 721769 - RNA, 20 nt, Human
acugagcuauauaaaaucau

SEQ ID NO: 721770 - RNA, 23 nt, Human
acuggauucaacagcuugccauc

SEQ ID NO: 721771 - RNA, 18 nt, Human
agaaaacaacccccaauu

SEQ ID NO: 721772 - RNA, 19 nt, Human
agaaauaaccagcagcccu

SEQ ID NO: 721773 - RNA, 18 nt, Human
agacuuggauaugaggau

SEQ ID NO: 721774 - RNA, 20 nt, Human
agagacucaagaaaucacca

SEQ ID NO: 721775 - RNA, 23 nt, Human
agagcaguggcuucucugggcug

SEQ ID NO: 721776 - RNA, 20 nt, Human
agagcugagggagaacagga

SEQ ID NO: 721777 - RNA, 18 nt, Human
agaggaaaagagaaagcg

SEQ ID NO: 721778 - RNA, 19 nt, Human
agaggaaguagagagaaag

SEQ ID NO: 721779 - RNA, 21 nt, Human
agaugcagaaucuggugaugg

SEQ ID NO: 721780 - RNA, 23 nt, Human
agcagaaggcagacggaaugaug

SEQ ID NO: 721781 - RNA, 21 nt, Human
agcccugugcugguguuggaa

SEQ ID NO: 721782 - RNA, 18 nt, Human
agcgggugggcuggggca

SEQ ID NO: 721783 - RNA, 26 nt, Human
agcgggugggcuggggcaggaggggc

SEQ ID NO: 721784 - RNA, 20 nt, Human
aggacuuaguggggacgcag

SEQ ID NO: 721785 - RNA, 19 nt, Human
aggcagcucagcagcaaac

SEQ ID NO: 721786 - RNA, 20 nt, Human
aggcaggaaaaggggaugaa

SEQ ID NO: 721787 - RNA, 18 nt, Human
agggccugggcaggggug

SEQ ID NO: 721788 - RNA, 21 nt, Human
aggggcuugaucccaggaggg

SEQ ID NO: 721789 - RNA, 22 nt, Human
agggguuuguuuuuccgcuuau

SEQ ID NO: 721790 - RNA, 20 nt, Human
aggguuacaaggcagguagu

SEQ ID NO: 721791 - RNA, 19 nt, Human
aggugaagagaggggaggc

SEQ ID NO: 721792 - RNA, 24 nt, Human
aguacaguuuguauauauauauau

SEQ ID NO: 721793 - RNA, 20 nt, Human
auggagcagggccaggaaga

SEQ ID NO: 721794 - RNA, 28 nt, Human
caaaacacacaacaauauuuaaaaacaa

SEQ ID NO: 721795 - RNA, 22 nt, Human
caaacaggaacagagagggaac

SEQ ID NO: 721796 - RNA, 18 nt, Human
caaauaaccucccauggc

SEQ ID NO: 721797 - RNA, 19 nt, Human
cacacucccuuuuccagcc

SEQ ID NO: 721798 - RNA, 21 nt, Human
cacauuugaagaccuuguuuu

SEQ ID NO: 721799 - RNA, 21 nt, Human
cagaaaaggguuacaaggcag

SEQ ID NO: 721800 - RNA, 20 nt, Human
cagaguaaagcuccugggcu

SEQ ID NO: 721801 - RNA, 18 nt, Human
cagaguagacaaggggau

SEQ ID NO: 721802 - RNA, 21 nt, Human
cagcaacacugccccuccagc

SEQ ID NO: 721803 - RNA, 22 nt, Human
cagcaccagcuugcucccagug

SEQ ID NO: 721804 - RNA, 18 nt, Human
cagcaggacuuagugggg

SEQ ID NO: 721805 - RNA, 21 nt, Human
cagcucagcagcaaacuccag

SEQ ID NO: 721806 - RNA, 22 nt, Human
cagcucuccaagccuugccugg

SEQ ID NO: 721807 - RNA, 20 nt, Human
caggaagaucaggagagcug

SEQ ID NO: 721808 - RNA, 21 nt, Human
caggacuuaguggggacgcag

SEQ ID NO: 721809 - RNA, 20 nt, Human
caggaugaucaacaccauuu

SEQ ID NO: 721810 - RNA, 23 nt, Human
caggccagugccacagauacaaa

SEQ ID NO: 721811 - RNA, 24 nt, Human
caguggaaaagaagaggcaagacc

SEQ ID NO: 721812 - RNA, 19 nt, Human
cagugucccuggggagccc

SEQ ID NO: 721813 - RNA, 19 nt, Human
caucagaguagacaagggg

SEQ ID NO: 721814 - RNA, 19 nt, Human
ccaagaggucuaaaacaau

SEQ ID NO: 721815 - RNA, 20 nt, Human
ccaagcaguggaaaagaaga

SEQ ID NO: 721816 - RNA, 20 nt, Human
ccaauaaagcuaccaaauca

SEQ ID NO: 721817 - RNA, 19 nt, Human
ccaccucacaggagcccca

SEQ ID NO: 721818 - RNA, 20 nt, Human
ccagcaccagcuugcuccca

SEQ ID NO: 721819 - RNA, 18 nt, Human
ccagcccgggccuccagc

SEQ ID NO: 721820 - RNA, 19 nt, Human
ccagccuuuguuugugggg

SEQ ID NO: 721821 - RNA, 18 nt, Human
ccaggagaaauaaccagc

SEQ ID NO: 721822 - RNA, 18 nt, Human
ccagggaaagugaagcug

SEQ ID NO: 721823 - RNA, 26 nt, Human
ccagugccacagauacaaaacacagu

SEQ ID NO: 721824 - RNA, 22 nt, Human
cccagugucccuggggagcccu

SEQ ID NO: 721825 - RNA, 24 nt, Human
ccccaauaaagcuaccaaccauug

SEQ ID NO: 721826 - RNA, 27 nt, Human
cccccugccucacaggccggguccuuc

SEQ ID NO: 721827 - RNA, 20 nt, Human
ccccugcugagcaucucauc

SEQ ID NO: 721828 - RNA, 19 nt, Human
cccugcccccugccucaca

SEQ ID NO: 721829 - RNA, 24 nt, Human
cccuggggagcccugugcuggugu

SEQ ID NO: 721830 - RNA, 18 nt, Human
ccuccagcccgggccucc

SEQ ID NO: 721831 - RNA, 22 nt, Human
ccugggaggggcuugaucccag

SEQ ID NO: 721832 - RNA, 20 nt, Human
ccuuuguuugugggguggga

SEQ ID NO: 721833 - RNA, 20 nt, Human
cgccccaaccugcucccaau

SEQ ID NO: 721834 - RNA, 20 nt, Human
cgggccuccagcucgcccca

SEQ ID NO: 721835 - RNA, 20 nt, Human
cuaguuuaucugccugaggc

SEQ ID NO: 721836 - RNA, 23 nt, Human
cuccaagaacugcugggugcucc

SEQ ID NO: 721837 - RNA, 20 nt, Human
cuccugaggaagagguaggg

SEQ ID NO: 721838 - RNA, 22 nt, Human
cucgcaacucuaaguccugcca

SEQ ID NO: 721839 - RNA, 20 nt, Human
cugagcagcuccuacucuuc

SEQ ID NO: 721840 - RNA, 30 nt, Human
cuugguuggggugacucagguggggugggg

SEQ ID NO: 721841 - RNA, 19 nt, Human
gaacaggaaaauugggagg

SEQ ID NO: 721842 - RNA, 18 nt, Human
gaacccaaggcugcccag

SEQ ID NO: 721843 - RNA, 20 nt, Human
gaaggaagaggcagcucagc

SEQ ID NO: 721844 - RNA, 22 nt, Human
gagagaaagggaaaaaaguggg

SEQ ID NO: 721845 - RNA, 24 nt, Human
gagagggaaccuuggcuccaccuc

SEQ ID NO: 721846 - RNA, 23 nt, Human
gagaucacuggaaagcuuccugg

SEQ ID NO: 721847 - RNA, 25 nt, Human
gagcaacgccaauggaacaaaaucu

SEQ ID NO: 721848 - RNA, 21 nt, Human
gagcagcuccuacucuucagg

SEQ ID NO: 721849 - RNA, 19 nt, Human
gaggaaagggaggucacug

SEQ ID NO: 721850 - RNA, 18 nt, Human
gaggaagauaucagaugg

SEQ ID NO: 721851 - RNA, 22 nt, Human
gaggaaguagagagaaagggaa

SEQ ID NO: 721852 - RNA, 21 nt, Human
gaggaggcagaaaccuaggga

SEQ ID NO: 721853 - RNA, 18 nt, Human
gaggaugcauauggagca

SEQ ID NO: 721854 - RNA, 21 nt, Human
gaggcuguuuuggggcccugc

SEQ ID NO: 721855 - RNA, 24 nt, Human
gagggcagcagaaggcagacggaa

SEQ ID NO: 721856 - RNA, 24 nt, Human
gaucacuggaaagcuuccugggau

SEQ ID NO: 721857 - RNA, 20 nt, Human
gauggugagaggguauacgg

SEQ ID NO: 721858 - RNA, 24 nt, Human
gauggugagggguauggcugcugu

SEQ ID NO: 721859 - RNA, 25 nt, Human
gcaaacuccaggagaaagggaacgc

SEQ ID NO: 721860 - RNA, 21 nt, Human
gcaaagcacuagggagaugca

SEQ ID NO: 721861 - RNA, 18 nt, Human
gcagcagaaggcagacgg

SEQ ID NO: 721862 - RNA, 21 nt, Human
gccagggccuccaggaaacag

SEQ ID NO: 721863 - RNA, 23 nt, Human
gcccucugcagucuuaacucgca

SEQ ID NO: 721864 - RNA, 26 nt, Human
gccuucaucuccacagaggccacuac

SEQ ID NO: 721865 - RNA, 23 nt, Human
gcugcaggccagugccacagaua

SEQ ID NO: 721866 - RNA, 24 nt, Human
gcugggcagaaaaggguuacaagg

SEQ ID NO: 721867 - RNA, 19 nt, Human
ggaaaaggggaugaaggga

SEQ ID NO: 721868 - RNA, 19 nt, Human
ggacagggccugggagggg

SEQ ID NO: 721869 - RNA, 20 nt, Human
ggaggacucagaacccaacu

SEQ ID NO: 721870 - RNA, 19 nt, Human
ggauaggauggggaccccu

SEQ ID NO: 721871 - RNA, 20 nt, Human
ggaugacggugucugcacua

SEQ ID NO: 721872 - RNA, 27 nt, Human
ggccaaacaaugguuugguugggcugu

SEQ ID NO: 721873 - RNA, 19 nt, Human
ggccugggaggggcuugau

SEQ ID NO: 721874 - RNA, 18 nt, Human
ggcugaaauucagucacc

SEQ ID NO: 721875 - RNA, 22 nt, Human
gggaagccccgugagcaauguc

SEQ ID NO: 721876 - RNA, 18 nt, Human
gggcaaggaguuggggaa

SEQ ID NO: 721877 - RNA, 21 nt, Human
gggcagcagaaggcagacgga

SEQ ID NO: 721878 - RNA, 18 nt, Human
gggcaggaaugcagggcc

SEQ ID NO: 721879 - RNA, 20 nt, Human
gggcaggaggggcuggggac

SEQ ID NO: 721880 - RNA, 21 nt, Human
gggcaucagaguagacaaggg

SEQ ID NO: 721881 - RNA, 19 nt, Human
gggccaacuagcugcccag

SEQ ID NO: 721882 - RNA, 21 nt, Human
gggcuggggacagggccuggg

SEQ ID NO: 721883 - RNA, 19 nt, Human
gggcuggggcaggaggggc

SEQ ID NO: 721884 - RNA, 23 nt, Human
ggggauggugagaggguauacgg

SEQ ID NO: 721885 - RNA, 22 nt, Human
ggggcagaugccuuggucuucc

SEQ ID NO: 721886 - RNA, 18 nt, Human
ggggcugccuucugggcc

SEQ ID NO: 721887 - RNA, 21 nt, Human
gggggggcugguacugcucca

SEQ ID NO: 721888 - RNA, 19 nt, Human
ggguauggcugcugugcug

SEQ ID NO: 721889 - RNA, 19 nt, Human
gguuggggugacucaggug

SEQ ID NO: 721890 - RNA, 20 nt, Human
gguuggggugacucaggugg

SEQ ID NO: 721891 - RNA, 22 nt, Human
guauauauauauauuuauauau

SEQ ID NO: 721892 - RNA, 19 nt, Human
gucacuuuuggcacucugg

SEQ ID NO: 721893 - RNA, 23 nt, Human
gugucccuggggagcccugugcu

SEQ ID NO: 721894 - RNA, 19 nt, Human
guguggggaucccccuggg

SEQ ID NO: 721895 - RNA, 21 nt, Human
uaaaacaaacaacaaaggccc

SEQ ID NO: 721896 - RNA, 24 nt, Human
uaaagagcagcucuccaagccuug

SEQ ID NO: 721897 - RNA, 21 nt, Human
uaacugaugucuaaacggcac

SEQ ID NO: 721898 - RNA, 18 nt, Human
uaagcuccccacaccuug

SEQ ID NO: 721899 - RNA, 19 nt, Human
uacagaagggaagaaucag

SEQ ID NO: 721900 - RNA, 19 nt, Human
uacaguuuguauauauaua

SEQ ID NO: 721901 - RNA, 18 nt, Human
uacauguacaaggcagga

SEQ ID NO: 721902 - RNA, 24 nt, Human
uacauguacauguacaaggcagga

SEQ ID NO: 721903 - RNA, 20 nt, Human
uacccagugcuugggggugg

SEQ ID NO: 721904 - RNA, 21 nt, Human
uagaaaacaacccccaauuuc

SEQ ID NO: 721905 - RNA, 23 nt, Human
uagccacaggaguccaccagcug

SEQ ID NO: 721906 - RNA, 25 nt, Human
uaggauggggaccccugcugagcau

SEQ ID NO: 721907 - RNA, 22 nt, Human
uauauauauuuauauauauaua

SEQ ID NO: 721908 - RNA, 20 nt, Human
uauauauuuauauauauaua

SEQ ID NO: 721909 - RNA, 21 nt, Human
uaugagggaggcuguuuuggg

SEQ ID NO: 721910 - RNA, 24 nt, Human
uauuucccauuuuccaaacugagu

SEQ ID NO: 721911 - RNA, 24 nt, Human
ucaaagcacagcuccacugaguac

SEQ ID NO: 721912 - RNA, 22 nt, Human
ucaacaccauuuaacugauguc

SEQ ID NO: 721913 - RNA, 21 nt, Human
ucacaggagccccaggagggc

SEQ ID NO: 721914 - RNA, 20 nt, Human
ucacaggcagcucaaggccc

SEQ ID NO: 721915 - RNA, 22 nt, Human
ucagaacccaacuugaacaaaa

SEQ ID NO: 721916 - RNA, 21 nt, Human
ucagagcauucuagaggcugg

SEQ ID NO: 721917 - RNA, 18 nt, Human
uccaagguuccccaagcg

SEQ ID NO: 721918 - RNA, 25 nt, Human
uccagccuuuguuugugggguggga

SEQ ID NO: 721919 - RNA, 24 nt, Human
uccaggaaacaggucccagaguac

SEQ ID NO: 721920 - RNA, 22 nt, Human
ucccaaugggagggcugagcac

SEQ ID NO: 721921 - RNA, 18 nt, Human
ucccaggggcugccuucu

SEQ ID NO: 721922 - RNA, 21 nt, Human
uccccugguugcuucccguga

SEQ ID NO: 721923 - RNA, 19 nt, Human
ucccuggggagcccugugc

SEQ ID NO: 721924 - RNA, 24 nt, Human
ucuaaggaacaaauaaccucccau

SEQ ID NO: 721925 - RNA, 21 nt, Human
ucuccaagccuugccugaucu

SEQ ID NO: 721926 - RNA, 23 nt, Human
ucugcagucuuaacucgcaacuc

SEQ ID NO: 721927 - RNA, 24 nt, Human
ucugcagucuuaacucgcaacucu

SEQ ID NO: 721928 - RNA, 18 nt, Human
ucugccugaggcuuaaga

SEQ ID NO: 721929 - RNA, 19 nt, Human
ucuggagaacccaaggcug

SEQ ID NO: 721930 - RNA, 18 nt, Human
ucugggcugaggccaugu

SEQ ID NO: 721931 - RNA, 18 nt, Human
ucugucagucuuuaucuc

SEQ ID NO: 721932 - RNA, 22 nt, Human
ucuuuagcuucuccucuauggg

SEQ ID NO: 721933 - RNA, 20 nt, Human
ugacauggguggccucaaag

SEQ ID NO: 721934 - RNA, 23 nt, Human
ugacccauaaacccuuagcccuu

SEQ ID NO: 721935 - RNA, 24 nt, Human
ugaccuggcagacuccaagguucc

SEQ ID NO: 721936 - RNA, 20 nt, Human
ugagagaauaaauauuuuug

SEQ ID NO: 721937 - RNA, 21 nt, Human
ugaggaagagguagggucagg

SEQ ID NO: 721938 - RNA, 22 nt, Human
ugaggaagagguagggucaggu

SEQ ID NO: 721939 - RNA, 23 nt, Human
ugaggaagguagaggaaaagaga

SEQ ID NO: 721940 - RNA, 19 nt, Human
ugaggaugcauauggagca

SEQ ID NO: 721941 - RNA, 21 nt, Human
ugaggcuuaagagccaagcag

SEQ ID NO: 721942 - RNA, 23 nt, Human
ugagggaggcuguuuuggggccc

SEQ ID NO: 721943 - RNA, 23 nt, Human
ugaguacauucugagacucuaau

SEQ ID NO: 721944 - RNA, 22 nt, Human
ugaugucuaaacggcaccuuca

SEQ ID NO: 721945 - RNA, 19 nt, Human
ugcaggccagugccacaga

SEQ ID NO: 721946 - RNA, 20 nt, Human
ugccaagaggucuaaaacaa

SEQ ID NO: 721947 - RNA, 21 nt, Human
ugccacagauacaaaacacac

SEQ ID NO: 721948 - RNA, 23 nt, Human
ugccacagauacaaaacacacaa

SEQ ID NO: 721949 - RNA, 25 nt, Human
ugccacagauacaaaacacacaaca

SEQ ID NO: 721950 - RNA, 23 nt, Human
ugccacagguagcucccaccugu

SEQ ID NO: 721951 - RNA, 28 nt, Human
ugccaugguggcuuucaccugcucuucu

SEQ ID NO: 721952 - RNA, 20 nt, Human
ugccuucugggccuugcccu

SEQ ID NO: 721953 - RNA, 18 nt, Human
ugcucagagcacugccca

SEQ ID NO: 721954 - RNA, 19 nt, Human
ugcuccagcaccagcuugc

SEQ ID NO: 721955 - RNA, 18 nt, Human
ugcugcaggccagugcca

SEQ ID NO: 721956 - RNA, 22 nt, Human
uggaacaaaaucuaugaacagc

SEQ ID NO: 721957 - RNA, 19 nt, Human
uggagcagggccaggaaga

SEQ ID NO: 721958 - RNA, 22 nt, Human
uggccaagccagaaaacaaugc

SEQ ID NO: 721959 - RNA, 18 nt, Human
uggcugcugugcugucuu

SEQ ID NO: 721960 - RNA, 20 nt, Human
ugggaggaaggaagaggcag

SEQ ID NO: 721961 - RNA, 18 nt, Human
ugggagggcugagcacca

SEQ ID NO: 721962 - RNA, 22 nt, Human
ugggaugcccaaguaauuaaaa

SEQ ID NO: 721963 - RNA, 22 nt, Human
ugggcuggggcaggaggggcug

SEQ ID NO: 721964 - RNA, 24 nt, Human
ugggcuggggcaggaggggcuggg

SEQ ID NO: 721965 - RNA, 19 nt, Human
uggggccaacuagcugccc

SEQ ID NO: 721966 - RNA, 18 nt, Human
uggggugggauaggaugg

SEQ ID NO: 721967 - RNA, 19 nt, Human
uggggugggaugacggugu

SEQ ID NO: 721968 - RNA, 19 nt, Human
ugggugcucccaggggcug

SEQ ID NO: 721969 - RNA, 18 nt, Human
uggugagaggguauacgg

SEQ ID NO: 721970 - RNA, 23 nt, Human
ugguggaaacggcaaacaggaug

SEQ ID NO: 721971 - RNA, 23 nt, Human
ugguggcuuucaccugcucuucu

SEQ ID NO: 721972 - RNA, 18 nt, Human
ugguggucuuggcccuug

SEQ ID NO: 721973 - RNA, 24 nt, Human
ugguugggcuguguuucagaguau

SEQ ID NO: 721974 - RNA, 22 nt, Human
uguacaaaggcaaaaagaguac

SEQ ID NO: 721975 - RNA, 19 nt, Human
uguaggguuccaggguccu

SEQ ID NO: 721976 - RNA, 22 nt, Human
uguauauauauauauuuauaua

SEQ ID NO: 721977 - RNA, 20 nt, Human
ugugagggccugggcagggg

SEQ ID NO: 721978 - RNA, 18 nt, Human
uuaagaagaggaaguaga

SEQ ID NO: 721979 - RNA, 22 nt, Human
uuccacggaggaaagggagguc

SEQ ID NO: 721980 - RNA, 24 nt, Human
uuccacggaggaaagggaggucac

SEQ ID NO: 721981 - RNA, 21 nt, Human
uucuaaggagagcagagaaau

SEQ ID NO: 721982 - RNA, 19 nt, Human
uugcucccagugucccugg

SEQ ID NO: 721983 - RNA, 19 nt, Human
uuggucugguggucuuggc

SEQ ID NO: 721984 - RNA, 21 nt, Human
uuguuuucacaauuauguaga

SEQ ID NO: 721985 - RNA, 24 nt, Human
uuuacaauauauacagaguaugcu

SEQ ID NO: 721986 - RNA, 19 nt, Human
uuucccaguacaaagagua

SEQ ID NO: 721987 - RNA, 21 nt, Human
uuugaagaccuuguuuucaca

SEQ ID NO: 721988 - RNA, 22 nt, Human
uuugcuaaguaccagcucucca

SEQ ID NO: 721989 - RNA, 20 nt, Human
uuuguauauauauauauuua

SEQ ID NO: 721990 - RNA, 24 nt, Human
uuuuagggguaguuuuccggucaa

SEQ ID NO: 721991 - RNA, 18 nt, Human
aaacuggcuccucccuca

SEQ ID NO: 721992 - RNA, 24 nt, Human
aaauauaggagcuccccuaggcuu

SEQ ID NO: 721993 - RNA, 18 nt, Human
aacuucgccucuuggcuc

SEQ ID NO: 721994 - RNA, 19 nt, Human
aagcuucccaaauauagga

SEQ ID NO: 721995 - RNA, 25 nt, Human
aagggcccaccaucucagggccacc

SEQ ID NO: 721996 - RNA, 18 nt, Human
aaguucaccugaggucac

SEQ ID NO: 721997 - RNA, 24 nt, Human
acacagcagccaggggguacccag

SEQ ID NO: 721998 - RNA, 23 nt, Human
accaguuuccguggccaagucaa

SEQ ID NO: 721999 - RNA, 22 nt, Human
accccauagccaagcccccacc

SEQ ID NO: 722000 - RNA, 19 nt, Human
acuucugaucacagaccug

SEQ ID NO: 722001 - RNA, 19 nt, Human
agaaggagcagacacgugg

SEQ ID NO: 722002 - RNA, 26 nt, Human
agagaugggagcaacacugacaggga

SEQ ID NO: 722003 - RNA, 20 nt, Human
agagggacagggaguagggu

SEQ ID NO: 722004 - RNA, 21 nt, Human
agagguuccccaagcauccau

SEQ ID NO: 722005 - RNA, 21 nt, Human
agccaagcccccacccaccuc

SEQ ID NO: 722006 - RNA, 19 nt, Human
aggacagggacgcgaggaa

SEQ ID NO: 722007 - RNA, 18 nt, Human
aggaguggggucgugggg

SEQ ID NO: 722008 - RNA, 23 nt, Human
aggaguggggucguggggguggg

SEQ ID NO: 722009 - RNA, 20 nt, Human
aggggcagaccccgcacagc

SEQ ID NO: 722010 - RNA, 21 nt, Human
agucauuacuuuacuggcuga

SEQ ID NO: 722011 - RNA, 21 nt, Human
auagccaagcccccacccacc

SEQ ID NO: 722012 - RNA, 22 nt, Human
auuacuguccuuuaagaacagu

SEQ ID NO: 722013 - RNA, 24 nt, Human
caacacugacagggaaggaccaga

SEQ ID NO: 722014 - RNA, 19 nt, Human
caaccagugaaccaguuuc

SEQ ID NO: 722015 - RNA, 22 nt, Human
caacuuucccaccgguggggcu

SEQ ID NO: 722016 - RNA, 20 nt, Human
cacccacccucgguggccac

SEQ ID NO: 722017 - RNA, 19 nt, Human
caccccauagccaagcccc

SEQ ID NO: 722018 - RNA, 21 nt, Human
caccccauagccaagccccca

SEQ ID NO: 722019 - RNA, 23 nt, Human
caccccauagccaagcccccacc

SEQ ID NO: 722020 - RNA, 23 nt, Human
cacccugcuauuuguuauaccuu

SEQ ID NO: 722021 - RNA, 21 nt, Human
cagaaggagcagacacguggc

SEQ ID NO: 722022 - RNA, 22 nt, Human
cagaaggagcagacacguggca

SEQ ID NO: 722023 - RNA, 22 nt, Human
cagaccccgcacagcguguacc

SEQ ID NO: 722024 - RNA, 19 nt, Human
cagcagagggaaaaggggc

SEQ ID NO: 722025 - RNA, 19 nt, Human
cagcaguuuuccuuuuuuu

SEQ ID NO: 722026 - RNA, 18 nt, Human
caggaaagaauggaaccu

SEQ ID NO: 722027 - RNA, 20 nt, Human
caggccacuggggugaagga

SEQ ID NO: 722028 - RNA, 20 nt, Human
cagggccacccacccucggu

SEQ ID NO: 722029 - RNA, 23 nt, Human
cagggccacccacccucgguggc

SEQ ID NO: 722030 - RNA, 24 nt, Human
cauagccaagcccccacccaccuc

SEQ ID NO: 722031 - RNA, 24 nt, Human
caucccuacagguauagcuaagga

SEQ ID NO: 722032 - RNA, 24 nt, Human
cauuccuucagcuuucaggugacu

SEQ ID NO: 722033 - RNA, 21 nt, Human
ccaauggcuuccucuuuuucu

SEQ ID NO: 722034 - RNA, 22 nt, Human
ccacuggggcuccuggggggag

SEQ ID NO: 722035 - RNA, 20 nt, Human
ccagcagugcuggguggagg

SEQ ID NO: 722036 - RNA, 21 nt, Human
ccaggaguggggucguggggg

SEQ ID NO: 722037 - RNA, 19 nt, Human
cccaaggaccuaauuucua

SEQ ID NO: 722038 - RNA, 21 nt, Human
cccagcccuggcaaacuggcc

SEQ ID NO: 722039 - RNA, 24 nt, Human
cccauagccaagcccccacccacc

SEQ ID NO: 722040 - RNA, 21 nt, Human
ccccaagcauccaugcccaag

SEQ ID NO: 722041 - RNA, 19 nt, Human
cccccacgugcugcccaac

SEQ ID NO: 722042 - RNA, 20 nt, Human
cccccacgugcugcccaacc

SEQ ID NO: 722043 - RNA, 21 nt, Human
ccccgcacagcguguaccccc

SEQ ID NO: 722044 - RNA, 19 nt, Human
ccccugccccuggccccgg

SEQ ID NO: 722045 - RNA, 23 nt, Human
cccugcacgcgcucccuccccca

SEQ ID NO: 722046 - RNA, 20 nt, Human
ccggccgccccacucccugg

SEQ ID NO: 722047 - RNA, 19 nt, Human
ccuagaccaaaccaauggc

SEQ ID NO: 722048 - RNA, 19 nt, Human
ccucccccagauucugauc

SEQ ID NO: 722049 - RNA, 19 nt, Human
ccucgguggccacuagaug

SEQ ID NO: 722050 - RNA, 21 nt, Human
ccugccccuggccccggaggc

SEQ ID NO: 722051 - RNA, 20 nt, Human
ccugcccucugcucugacaa

SEQ ID NO: 722052 - RNA, 21 nt, Human
ccugcccucugcucugacaag

SEQ ID NO: 722053 - RNA, 22 nt, Human
ccuggccccggaggcccagaug

SEQ ID NO: 722054 - RNA, 21 nt, Human
ccuggggggagagagagagga

SEQ ID NO: 722055 - RNA, 19 nt, Human
ccuugggaaagaagccaga

SEQ ID NO: 722056 - RNA, 19 nt, Human
cgaggaacaccccaccccc

SEQ ID NO: 722057 - RNA, 21 nt, Human
cgaggaacaccccacccccuc

SEQ ID NO: 722058 - RNA, 23 nt, Human
cgccccacucccuggcagccgcg

SEQ ID NO: 722059 - RNA, 18 nt, Human
cguggagcccaugcccca

SEQ ID NO: 722060 - RNA, 24 nt, Human
cguggagcccaugccccaucccuu

SEQ ID NO: 722061 - RNA, 23 nt, Human
cguuggcagcagagggaaaaggg

SEQ ID NO: 722062 - RNA, 24 nt, Human
cuacuagauccaaucugcaggcac

SEQ ID NO: 722063 - RNA, 24 nt, Human
cucaccccauagccaagcccccac

SEQ ID NO: 722064 - RNA, 24 nt, Human
cucccuggcagccgcggcuuccag

SEQ ID NO: 722065 - RNA, 20 nt, Human
cugcacgcgcucccuccccc

SEQ ID NO: 722066 - RNA, 24 nt, Human
cugcacgcgcucccucccccagau

SEQ ID NO: 722067 - RNA, 23 nt, Human
cugcuccaggaaagaauggaacc

SEQ ID NO: 722068 - RNA, 19 nt, Human
cugugcacaagcuucccaa

SEQ ID NO: 722069 - RNA, 23 nt, Human
cuguuguugcugcagcugggccu

SEQ ID NO: 722070 - RNA, 23 nt, Human
gaaaaggggcugaauaaagguua

SEQ ID NO: 722071 - RNA, 20 nt, Human
gaaccuagaccaaaccaaug

SEQ ID NO: 722072 - RNA, 19 nt, Human
gaauggaaccuagaccaaa

SEQ ID NO: 722073 - RNA, 18 nt, Human
gaccuguuauguucuuca

SEQ ID NO: 722074 - RNA, 18 nt, Human
gagaggagaagauauggg

SEQ ID NO: 722075 - RNA, 19 nt, Human
gagaggagaagauaugggg

SEQ ID NO: 722076 - RNA, 23 nt, Human
gagcagcagagacaaggcgcagg

SEQ ID NO: 722077 - RNA, 20 nt, Human
gagguggagaggccagccca

SEQ ID NO: 722078 - RNA, 22 nt, Human
gaguggggucgugggggugggu

SEQ ID NO: 722079 - RNA, 19 nt, Human
gcagcagagggaaaagggg

SEQ ID NO: 722080 - RNA, 24 nt, Human
gcagcagagggaaaaggggcugaa

SEQ ID NO: 722081 - RNA, 19 nt, Human
gccacuggggcuccugggg

SEQ ID NO: 722082 - RNA, 22 nt, Human
gcguguacccccucccagcccu

SEQ ID NO: 722083 - RNA, 18 nt, Human
gcuccuggggggagagag

SEQ ID NO: 722084 - RNA, 18 nt, Human
ggaaagaauggaaccuag

SEQ ID NO: 722085 - RNA, 20 nt, Human
ggaaccuagaccaaaccaag

SEQ ID NO: 722086 - RNA, 25 nt, Human
ggagaggccagcccagguccugcug

SEQ ID NO: 722087 - RNA, 20 nt, Human
ggcagcaguuuuccuuuuuu

SEQ ID NO: 722088 - RNA, 21 nt, Human
gggacgcgaggaacaccccac

SEQ ID NO: 722089 - RNA, 18 nt, Human
gggagaagcugaggucug

SEQ ID NO: 722090 - RNA, 19 nt, Human
gggagguggagaggccagc

SEQ ID NO: 722091 - RNA, 18 nt, Human
gggccaaggccuaggaag

SEQ ID NO: 722092 - RNA, 21 nt, Human
ggggagaggagaagauauggg

SEQ ID NO: 722093 - RNA, 20 nt, Human
gggggagagagagaggaggu

SEQ ID NO: 722094 - RNA, 21 nt, Human
ggggguggguggagggggcaa

SEQ ID NO: 722095 - RNA, 23 nt, Human
ggguggcgcugagaagagcacgg

SEQ ID NO: 722096 - RNA, 18 nt, Human
ggugaugaggcuggggga

SEQ ID NO: 722097 - RNA, 22 nt, Human
ggugaugaggcugggggaagga

SEQ ID NO: 722098 - RNA, 21 nt, Human
gugaccuuccccugaacagaa

SEQ ID NO: 722099 - RNA, 19 nt, Human
guggccaagucagcaggga

SEQ ID NO: 722100 - RNA, 20 nt, Human
guguaauggaggagcccagg

SEQ ID NO: 722101 - RNA, 23 nt, Human
guugcaaucuggcugcugagggu

SEQ ID NO: 722102 - RNA, 20 nt, Human
uaagaacaguaggaaucugc

SEQ ID NO: 722103 - RNA, 24 nt, Human
uacccccucccagcccugcaggcc

SEQ ID NO: 722104 - RNA, 23 nt, Human
uaccugacuugcgggugcucagc

SEQ ID NO: 722105 - RNA, 23 nt, Human
uagcagaaaccuggagguucaga

SEQ ID NO: 722106 - RNA, 23 nt, Human
uagcagccucggccugaccacgc

SEQ ID NO: 722107 - RNA, 18 nt, Human
uaggagcuccccuaggcu

SEQ ID NO: 722108 - RNA, 19 nt, Human
uagggugccaaccagugaa

SEQ ID NO: 722109 - RNA, 23 nt, Human
ucacugagagguuccccaagcau

SEQ ID NO: 722110 - RNA, 24 nt, Human
ucagggccacccacccucgguggc

SEQ ID NO: 722111 - RNA, 20 nt, Human
uccacaggcaacuuucccac

SEQ ID NO: 722112 - RNA, 23 nt, Human
uccacaggcaacuuucccaccgg

SEQ ID NO: 722113 - RNA, 18 nt, Human
uccaggaguggggucgug

SEQ ID NO: 722114 - RNA, 18 nt, Human
uccaugcccaaggaccua

SEQ ID NO: 722115 - RNA, 24 nt, Human
uccccaagcauccaugcccaagga

SEQ ID NO: 722116 - RNA, 26 nt, Human
uccccaagcauccaugcccaaggacc

SEQ ID NO: 722117 - RNA, 23 nt, Human
ucccugcacgcgcucccuccccc

SEQ ID NO: 722118 - RNA, 22 nt, Human
ucccuggcagccgcggcuucca

SEQ ID NO: 722119 - RNA, 19 nt, Human
ucccuuguucccuggcacc

SEQ ID NO: 722120 - RNA, 23 nt, Human
uccguggccaagucagcagggaa

SEQ ID NO: 722121 - RNA, 20 nt, Human
uccucaagcuacuucucuca

SEQ ID NO: 722122 - RNA, 18 nt, Human
ucugcauccaccucuccc

SEQ ID NO: 722123 - RNA, 24 nt, Human
ucuggcuacaguguaauggaggag

SEQ ID NO: 722124 - RNA, 21 nt, Human
ucugguggaggggccaaggcc

SEQ ID NO: 722125 - RNA, 23 nt, Human
ugacagggaaggaccagaggucu

SEQ ID NO: 722126 - RNA, 20 nt, Human
ugaccacgcccccacgugcu

SEQ ID NO: 722127 - RNA, 24 nt, Human
ugacucaggaggguuuccagacac

SEQ ID NO: 722128 - RNA, 18 nt, Human
ugacucccaccugcccuc

SEQ ID NO: 722129 - RNA, 19 nt, Human
ugagaagagcacggugaug

SEQ ID NO: 722130 - RNA, 21 nt, Human
ugaugaggcugggggaaggag

SEQ ID NO: 722131 - RNA, 18 nt, Human
ugccacuggggcuccugg

SEQ ID NO: 722132 - RNA, 21 nt, Human
ugccccuggccccggaggccc

SEQ ID NO: 722133 - RNA, 25 nt, Human
ugcugaggguggcgcugagaagagc

SEQ ID NO: 722134 - RNA, 21 nt, Human
uggaagucauuacuuuacuga

SEQ ID NO: 722135 - RNA, 20 nt, Human
uggaauggguccgccucuac

SEQ ID NO: 722136 - RNA, 19 nt, Human
uggaggagcccagguagca

SEQ ID NO: 722137 - RNA, 20 nt, Human
uggagggggcaauggcaagu

SEQ ID NO: 722138 - RNA, 19 nt, Human
uggcaaguccccucugccc

SEQ ID NO: 722139 - RNA, 22 nt, Human
uggcacccggccugcuccagga

SEQ ID NO: 722140 - RNA, 20 nt, Human
uggcagcaccuuccucuggu

SEQ ID NO: 722141 - RNA, 22 nt, Human
uggccaagucagcagggaagcc

SEQ ID NO: 722142 - RNA, 18 nt, Human
uggcugcugaggguggcg

SEQ ID NO: 722143 - RNA, 20 nt, Human
ugggagcaacacugacaggg

SEQ ID NO: 722144 - RNA, 19 nt, Human
uggggucgugggggugggu

SEQ ID NO: 722145 - RNA, 20 nt, Human
ugguggaggggccaaggccu

SEQ ID NO: 722146 - RNA, 19 nt, Human
ugugacucaguccuccagu

SEQ ID NO: 722147 - RNA, 19 nt, Human
ugugcagaggguggcaggg

SEQ ID NO: 722148 - RNA, 21 nt, Human
ugugcagaggguggcagggug

SEQ ID NO: 722149 - RNA, 24 nt, Human
uguuauguucuucagaccagacuc

SEQ ID NO: 722150 - RNA, 21 nt, Human
uucagaccagacucaaaaggc

SEQ ID NO: 722151 - RNA, 27 nt, Human
uucaggugacucccaccugcccucugc

SEQ ID NO: 722152 - RNA, 22 nt, Human
uuccagacacagcagccagggg

SEQ ID NO: 722153 - RNA, 22 nt, Human
uuccccaagcauccaugcccaa

SEQ ID NO: 722154 - RNA, 19 nt, Human
uuccccugccccuggcccc

SEQ ID NO: 722155 - RNA, 19 nt, Human
uuggcucuacgagcaacaa

SEQ ID NO: 722156 - RNA, 21 nt, Human
uuucaggugacucccaccugc

SEQ ID NO: 722157 - RNA, 23 nt, Human
uuucuuuuuuuggggggcagcag

SEQ ID NO: 722158 - RNA, 22 nt, Human
uuugguuggauccuaaaaaggc

SEQ ID NO: 722159 - RNA, 21 nt, Human
aaaaaacagcaggagcccaag

SEQ ID NO: 722160 - RNA, 25 nt, Human
aaaaacaaaacaaaaccaugauuca

SEQ ID NO: 722161 - RNA, 24 nt, Human
aaaacaaaaccaugauucaaaaca

SEQ ID NO: 722162 - RNA, 22 nt, Human
aaacaaaaccaugauucaaaac

SEQ ID NO: 722163 - RNA, 21 nt, Human
aaacaaauacccugaaaaccg

SEQ ID NO: 722164 - RNA, 20 nt, Human
aaacaagaacauccuugaac

SEQ ID NO: 722165 - RNA, 18 nt, Human
aaacagcacagaaguccu

SEQ ID NO: 722166 - RNA, 19 nt, Human
aaacagcacagaaguccuc

SEQ ID NO: 722167 - RNA, 18 nt, Human
aacaaaaagggcugccag

SEQ ID NO: 722168 - RNA, 23 nt, Human
aacaaaacaaaaccaugauucaa

SEQ ID NO: 722169 - RNA, 21 nt, Human
aacaaaguucacaggauggug

SEQ ID NO: 722170 - RNA, 24 nt, Human
aacaagaacauccuugaacuucau

SEQ ID NO: 722171 - RNA, 21 nt, Human
aacacuuccaggcagcggcca

SEQ ID NO: 722172 - RNA, 19 nt, Human
aacagcugccagagugccc

SEQ ID NO: 722173 - RNA, 25 nt, Human
aaccucucucccuucuuuuacccac

SEQ ID NO: 722174 - RNA, 21 nt, Human
aagacucacuucugaucuuug

SEQ ID NO: 722175 - RNA, 21 nt, Human
aagcaaaggcaaacagugaca

SEQ ID NO: 722176 - RNA, 22 nt, Human
aagcagaacucacgauccauac

SEQ ID NO: 722177 - RNA, 22 nt, Human
aagcaggaggagaggcccagag

SEQ ID NO: 722178 - RNA, 22 nt, Human
aagccagcgagaggcaggugug

SEQ ID NO: 722179 - RNA, 18 nt, Human
aagcugggagccucacuc

SEQ ID NO: 722180 - RNA, 23 nt, Human
acaagaacauccuugaacuucau

SEQ ID NO: 722181 - RNA, 20 nt, Human
acaauaccagcuucucacac

SEQ ID NO: 722182 - RNA, 19 nt, Human
acaccaaguacaacaaagu

SEQ ID NO: 722183 - RNA, 22 nt, Human
acagagggcgggcucugaagug

SEQ ID NO: 722184 - RNA, 19 nt, Human
acagucuuuggcugugcug

SEQ ID NO: 722185 - RNA, 24 nt, Human
accauccacacucugaagaggaua

SEQ ID NO: 722186 - RNA, 19 nt, Human
acucucuccacccauggaa

SEQ ID NO: 722187 - RNA, 21 nt, Human
acuggcgccaguggagguuuc

SEQ ID NO: 722188 - RNA, 20 nt, Human
agaaaaaaauucaccaagga

SEQ ID NO: 722189 - RNA, 21 nt, Human
agaacucacgauccauaccuc

SEQ ID NO: 722190 - RNA, 20 nt, Human
agacagccuggaggcgggcu

SEQ ID NO: 722191 - RNA, 19 nt, Human
agacaggacaagcaaaggc

SEQ ID NO: 722192 - RNA, 18 nt, Human
agacccccucuggcccag

SEQ ID NO: 722193 - RNA, 25 nt, Human
agaggcagguguguaaagggagccu

SEQ ID NO: 722194 - RNA, 18 nt, Human
agaugcaaauggcaaaga

SEQ ID NO: 722195 - RNA, 21 nt, Human
agcacagaaguccucauucuc

SEQ ID NO: 722196 - RNA, 21 nt, Human
agcacaguaacucuccgccau

SEQ ID NO: 722197 - RNA, 20 nt, Human
agcccaggaggaguucagau

SEQ ID NO: 722198 - RNA, 18 nt, Human
agccucucagcaugcagg

SEQ ID NO: 722199 - RNA, 19 nt, Human
agccucugcaaccucggag

SEQ ID NO: 722200 - RNA, 23 nt, Human
agccuggaggcgggcuggucaga

SEQ ID NO: 722201 - RNA, 18 nt, Human
agcugagcaaggcuggca

SEQ ID NO: 722202 - RNA, 21 nt, Human
aggcugguuauagcaggcauu

SEQ ID NO: 722203 - RNA, 22 nt, Human
agggaggccacgggaagcccug

SEQ ID NO: 722204 - RNA, 25 nt, Human
aggguauggccacugacaagcacca

SEQ ID NO: 722205 - RNA, 19 nt, Human
agguuuucccgagccuaac

SEQ ID NO: 722206 - RNA, 18 nt, Human
agucuguguucuucagga

SEQ ID NO: 722207 - RNA, 21 nt, Human
augggacaacagcugccagag

SEQ ID NO: 722208 - RNA, 24 nt, Human
auggucaccaaaggacacuggcuu

SEQ ID NO: 722209 - RNA, 21 nt, Human
auggugggaaugugggcugca

SEQ ID NO: 722210 - RNA, 20 nt, Human
augucacaccauccacagcu

SEQ ID NO: 722211 - RNA, 24 nt, Human
auuacuaagacccccucuggccca

SEQ ID NO: 722212 - RNA, 21 nt, Human
auuacugaaaucuucucugua

SEQ ID NO: 722213 - RNA, 18 nt, Human
auucacaagcagaacuca

SEQ ID NO: 722214 - RNA, 24 nt, Human
caaaacaaaaccaugauucaaaac

SEQ ID NO: 722215 - RNA, 19 nt, Human
caaaacaaauacccugaaa

SEQ ID NO: 722216 - RNA, 21 nt, Human
caaaacaaauacccugaaaac

SEQ ID NO: 722217 - RNA, 25 nt, Human
caaauaggcacaaauugagaccuau

SEQ ID NO: 722218 - RNA, 21 nt, Human
caacacucaccaguugcccaa

SEQ ID NO: 722219 - RNA, 19 nt, Human
caaguacaacaaaguucac

SEQ ID NO: 722220 - RNA, 23 nt, Human
cacagcagccaccuaugucaaca

SEQ ID NO: 722221 - RNA, 24 nt, Human
cacagcagccaccuaugucaacau

SEQ ID NO: 722222 - RNA, 20 nt, Human
cacaguauucacaagcagag

SEQ ID NO: 722223 - RNA, 24 nt, Human
caccuuagacaaacuucccccagg

SEQ ID NO: 722224 - RNA, 21 nt, Human
cacuacacaguucaacaagac

SEQ ID NO: 722225 - RNA, 21 nt, Human
cagacaggacaagcaaaggca

SEQ ID NO: 722226 - RNA, 22 nt, Human
cagcagcugucucacaguauuu

SEQ ID NO: 722227 - RNA, 21 nt, Human
cagccucgagcuccuguuccc

SEQ ID NO: 722228 - RNA, 19 nt, Human
caggaagcucccauccuga

SEQ ID NO: 722229 - RNA, 19 nt, Human
caggagaugugcccuccac

SEQ ID NO: 722230 - RNA, 19 nt, Human
cauccacucucacuagaca

SEQ ID NO: 722231 - RNA, 24 nt, Human
caugcaaaaacaaaacaaaaccau

SEQ ID NO: 722232 - RNA, 18 nt, Human
cauggcuccugagcccug

SEQ ID NO: 722233 - RNA, 24 nt, Human
cauuacuaagacccccucuggccc

SEQ ID NO: 722234 - RNA, 24 nt, Human
cauuuuaaaaaacagcaggagccc

SEQ ID NO: 722235 - RNA, 21 nt, Human
ccaaauaggcacaaauugaga

SEQ ID NO: 722236 - RNA, 20 nt, Human
ccaagauaucccuccaugcc

SEQ ID NO: 722237 - RNA, 20 nt, Human
ccacccagcucagucaagaa

SEQ ID NO: 722238 - RNA, 25 nt, Human
ccacccagcucagucaagaauguug

SEQ ID NO: 722239 - RNA, 23 nt, Human
ccaccuuagacaaacuuccccca

SEQ ID NO: 722240 - RNA, 21 nt, Human
ccacgggaagcccuggggagu

SEQ ID NO: 722241 - RNA, 20 nt, Human
ccagaaaaguguuggcuuuu

SEQ ID NO: 722242 - RNA, 21 nt, Human
ccagaaaaguguuggcuuuuu

SEQ ID NO: 722243 - RNA, 19 nt, Human
ccagacaggacaagcaaag

SEQ ID NO: 722244 - RNA, 22 nt, Human
ccagacaggacaagcaaaggca

SEQ ID NO: 722245 - RNA, 22 nt, Human
ccaguauccucacaaacacccu

SEQ ID NO: 722246 - RNA, 20 nt, Human
cccaaacuagaaaacgggau

SEQ ID NO: 722247 - RNA, 22 nt, Human
cccagaguaaguagcacagagg

SEQ ID NO: 722248 - RNA, 22 nt, Human
cccccuguccaccuuagacaaa

SEQ ID NO: 722249 - RNA, 18 nt, Human
cccgagccuaaccaggug

SEQ ID NO: 722250 - RNA, 19 nt, Human
cccuggacacuaaaagguu

SEQ ID NO: 722251 - RNA, 19 nt, Human
cccuguuggucccugaggc

SEQ ID NO: 722252 - RNA, 19 nt, Human
ccuccaguauccucacaaa

SEQ ID NO: 722253 - RNA, 18 nt, Human
ccuccugccuuggcuggg

SEQ ID NO: 722254 - RNA, 23 nt, Human
ccucuagaagccuccacuagucu

SEQ ID NO: 722255 - RNA, 21 nt, Human
ccucucucccuucuuuuaccc

SEQ ID NO: 722256 - RNA, 22 nt, Human
ccugaaauuagccaugcaauga

SEQ ID NO: 722257 - RNA, 21 nt, Human
ccugagcccuggacacuaaaa

SEQ ID NO: 722258 - RNA, 21 nt, Human
ccuggguggccucagacaguc

SEQ ID NO: 722259 - RNA, 22 nt, Human
cggcacugaaggaggguguggg

SEQ ID NO: 722260 - RNA, 19 nt, Human
cuacaaacaagaacauccu

SEQ ID NO: 722261 - RNA, 21 nt, Human
cuaggucuaaaggaaaagcca

SEQ ID NO: 722262 - RNA, 22 nt, Human
cucacaguauucacaagcagaa

SEQ ID NO: 722263 - RNA, 19 nt, Human
cucacagucguacuccauc

SEQ ID NO: 722264 - RNA, 21 nt, Human
cucacagucguacuccaucuc

SEQ ID NO: 722265 - RNA, 21 nt, Human
cucacuagacaccuccucgga

SEQ ID NO: 722266 - RNA, 22 nt, Human
cuccaguauccucacaaacacc

SEQ ID NO: 722267 - RNA, 26 nt, Human
cucguucacacccaggacaggagaug

SEQ ID NO: 722268 - RNA, 23 nt, Human
cucuauuggggcuggggggcccu

SEQ ID NO: 722269 - RNA, 20 nt, Human
cucucacuagacaccuccuc

SEQ ID NO: 722270 - RNA, 24 nt, Human
cugcccagccaaagaagugacagu

SEQ ID NO: 722271 - RNA, 19 nt, Human
cugucacaacacucaccag

SEQ ID NO: 722272 - RNA, 20 nt, Human
cuucaggagaugugcccucc

SEQ ID NO: 722273 - RNA, 23 nt, Human
gaacacaggcaucucuccugagg

SEQ ID NO: 722274 - RNA, 20 nt, Human
gaacucacgauccauaccuc

SEQ ID NO: 722275 - RNA, 23 nt, Human
gaacucacgauccauaccucuga

SEQ ID NO: 722276 - RNA, 20 nt, Human
gaccagaccccaaaccagaa

SEQ ID NO: 722277 - RNA, 21 nt, Human
gagcaauaccaucaacucaac

SEQ ID NO: 722278 - RNA, 22 nt, Human
gagucugaguccuccugccuug

SEQ ID NO: 722279 - RNA, 21 nt, Human
gagugagcugguuguggguua

SEQ ID NO: 722280 - RNA, 25 nt, Human
gauaucccuccaugcccccggcacu

SEQ ID NO: 722281 - RNA, 18 nt, Human
gcaggagagguggaacac

SEQ ID NO: 722282 - RNA, 18 nt, Human
gcagguguguaaagggag

SEQ ID NO: 722283 - RNA, 23 nt, Human
gcaugcaaaaacaaaacaaaacc

SEQ ID NO: 722284 - RNA, 18 nt, Human
gcgggcucugaaguggac

SEQ ID NO: 722285 - RNA, 19 nt, Human
ggagaugugcccuccacuu

SEQ ID NO: 722286 - RNA, 23 nt, Human
ggcagguucucacccuaaagaag

SEQ ID NO: 722287 - RNA, 25 nt, Human
gggccagggggcugacagguucaug

SEQ ID NO: 722288 - RNA, 18 nt, Human
gggcugggucaggcugcg

SEQ ID NO: 722289 - RNA, 22 nt, Human
ggggccuggguggccucagaca

SEQ ID NO: 722290 - RNA, 24 nt, Human
ggggccuggguggccucagacagu

SEQ ID NO: 722291 - RNA, 21 nt, Human
gggucaggcugcggcacaagg

SEQ ID NO: 722292 - RNA, 19 nt, Human
gguagagaaggaaaugagc

SEQ ID NO: 722293 - RNA, 27 nt, Human
guagaucuccuucaaccagcccucaaa

SEQ ID NO: 722294 - RNA, 28 nt, Human
guagaucuccuucaaccagcccucaaag

SEQ ID NO: 722295 - RNA, 24 nt, Human
guagaugcaaauggcaaagaagag

SEQ ID NO: 722296 - RNA, 20 nt, Human
guggauguacuacggcuccc

SEQ ID NO: 722297 - RNA, 20 nt, Human
guggguuacucucuccaccc

SEQ ID NO: 722298 - RNA, 18 nt, Human
gugguauagugagcuggg

SEQ ID NO: 722299 - RNA, 18 nt, Human
guucauggaagggcaggc

SEQ ID NO: 722300 - RNA, 18 nt, Human
uaaaaaacagcaggagcc

SEQ ID NO: 722301 - RNA, 23 nt, Human
uaaaaaacagcaggagcccaaga

SEQ ID NO: 722302 - RNA, 23 nt, Human
uaaaaaacagcaggagcccaaga

SEQ ID NO: 722303 - RNA, 21 nt, Human
uaaagugaagaugaucucuca

SEQ ID NO: 722304 - RNA, 21 nt, Human
uaagugaaaucugaaccagaa

SEQ ID NO: 722305 - RNA, 21 nt, Human
uaauaaauaccuuccucuuuc

SEQ ID NO: 722306 - RNA, 19 nt, Human
uaccccaaacuagaaaacg

SEQ ID NO: 722307 - RNA, 19 nt, Human
uagacaaacuucccccagg

SEQ ID NO: 722308 - RNA, 24 nt, Human
uagacaccuccucggagucugagu

SEQ ID NO: 722309 - RNA, 22 nt, Human
uagcaaaggcccuacaaacaag

SEQ ID NO: 722310 - RNA, 20 nt, Human
uagcacagagggcgggcucu

SEQ ID NO: 722311 - RNA, 21 nt, Human
uagcccagaguaaguagcaca

SEQ ID NO: 722312 - RNA, 22 nt, Human
uaggaacacaaugcagaaaaaa

SEQ ID NO: 722313 - RNA, 21 nt, Human
uaggaaggcagguucucaccc

SEQ ID NO: 722314 - RNA, 18 nt, Human
uauccagacaggacaagc

SEQ ID NO: 722315 - RNA, 18 nt, Human
uauuggggcuggggggcc

SEQ ID NO: 722316 - RNA, 22 nt, Human
uauuggggcuggggggcccuuc

SEQ ID NO: 722317 - RNA, 19 nt, Human
ucaagacucaguuacccca

SEQ ID NO: 722318 - RNA, 21 nt, Human
ucacacccaggacaggagaug

SEQ ID NO: 722319 - RNA, 24 nt, Human
ucacagcagccaccuaugucaaca

SEQ ID NO: 722320 - RNA, 19 nt, Human
ucagucaagaaugucacac

SEQ ID NO: 722321 - RNA, 18 nt, Human
ucagugccacacucgaug

SEQ ID NO: 722322 - RNA, 23 nt, Human
uccacagcauuuucacagcagcc

SEQ ID NO: 722323 - RNA, 18 nt, Human
uccagaaugcuucucucu

SEQ ID NO: 722324 - RNA, 27 nt, Human
ucccaaauaaaugcuguagaugcaaau

SEQ ID NO: 722325 - RNA, 19 nt, Human
ucccaggcagaaaaaaauu

SEQ ID NO: 722326 - RNA, 19 nt, Human
ucccauggcuuccagaaug

SEQ ID NO: 722327 - RNA, 20 nt, Human
ucccccaacaauaugagcaa

SEQ ID NO: 722328 - RNA, 24 nt, Human
ucccgagccuaaccaggugugguc

SEQ ID NO: 722329 - RNA, 18 nt, Human
uccgugagcccaggaggc

SEQ ID NO: 722330 - RNA, 24 nt, Human
uccuucucaaccaagcccuugcuu

SEQ ID NO: 722331 - RNA, 23 nt, Human
ucuagaagccuccacuagucugc

SEQ ID NO: 722332 - RNA, 19 nt, Human
ucuaggaaggcagguucuc

SEQ ID NO: 722333 - RNA, 18 nt, Human
ucuauuggggcugggggg

SEQ ID NO: 722334 - RNA, 19 nt, Human
ucuccacagccacccagcu

SEQ ID NO: 722335 - RNA, 22 nt, Human
ucucuaaccuccaacaaaaagg

SEQ ID NO: 722336 - RNA, 23 nt, Human
ucucuagcacauuacuaagaccc

SEQ ID NO: 722337 - RNA, 25 nt, Human
ucugagguugcuucauggucgggac

SEQ ID NO: 722338 - RNA, 26 nt, Human
ucugagguugcuucauggucgggacc

SEQ ID NO: 722339 - RNA, 24 nt, Human
ucuguaguggauguacuacggcuc

SEQ ID NO: 722340 - RNA, 24 nt, Human
ucuguguucuucaggagaugugcc

SEQ ID NO: 722341 - RNA, 21 nt, Human
ucuuaugcucacuauugaagg

SEQ ID NO: 722342 - RNA, 22 nt, Human
ugaaagggaaaugaccagaccc

SEQ ID NO: 722343 - RNA, 20 nt, Human
ugaagcagacagcagcuguc

SEQ ID NO: 722344 - RNA, 18 nt, Human
ugacagguucauggaagg

SEQ ID NO: 722345 - RNA, 21 nt, Human
ugacagucuuuggcugugcug

SEQ ID NO: 722346 - RNA, 19 nt, Human
ugaccacuggcgccagugg

SEQ ID NO: 722347 - RNA, 25 nt, Human
ugaccagaccccaaaccagaaaguc

SEQ ID NO: 722348 - RNA, 24 nt, Human
ugaccuccaguauccucacaaaca

SEQ ID NO: 722349 - RNA, 22 nt, Human
ugacuaugcaaaacaaauaccc

SEQ ID NO: 722350 - RNA, 21 nt, Human
ugagagaugcuguuggccagg

SEQ ID NO: 722351 - RNA, 22 nt, Human
ugagcaauggguuccuucucaa

SEQ ID NO: 722352 - RNA, 22 nt, Human
ugagcccaggaggaguucagau

SEQ ID NO: 722353 - RNA, 20 nt, Human
ugagcccaggaggccacacc

SEQ ID NO: 722354 - RNA, 21 nt, Human
ugagcccaggaggccacaccc

SEQ ID NO: 722355 - RNA, 23 nt, Human
ugaggcaaacagcacagaagucc

SEQ ID NO: 722356 - RNA, 19 nt, Human
ugaguccuccugccuuggc

SEQ ID NO: 722357 - RNA, 22 nt, Human
ugauugacagguccaugggccu

SEQ ID NO: 722358 - RNA, 22 nt, Human
ugcaaaaacaaaacaaaaccuu

SEQ ID NO: 722359 - RNA, 20 nt, Human
ugcacaaaggaaagaugacc

SEQ ID NO: 722360 - RNA, 18 nt, Human
ugcagccucgagcuccug

SEQ ID NO: 722361 - RNA, 19 nt, Human
ugccucuugauuuuucccc

SEQ ID NO: 722362 - RNA, 19 nt, Human
ugcugcagagcuguagacg

SEQ ID NO: 722363 - RNA, 24 nt, Human
ugcuuaggccaggagaugcccgca

SEQ ID NO: 722364 - RNA, 21 nt, Human
uggaccugaagcagacagcag

SEQ ID NO: 722365 - RNA, 23 nt, Human
uggcaaagaagagcacuacacag

SEQ ID NO: 722366 - RNA, 20 nt, Human
uggcaagccaaggggcaugg

SEQ ID NO: 722367 - RNA, 21 nt, Human
uggcuaggucuaaaggaaaag

SEQ ID NO: 722368 - RNA, 23 nt, Human
uggcuccugagcccuggacacuu

SEQ ID NO: 722369 - RNA, 20 nt, Human
uggcugaccuuaauggacau

SEQ ID NO: 722370 - RNA, 22 nt, Human
ugggaagcugagcaaggcugac

SEQ ID NO: 722371 - RNA, 19 nt, Human
ugggacaacagcugccaga

SEQ ID NO: 722372 - RNA, 23 nt, Human
ugggagguagccugaccuccagu

SEQ ID NO: 722373 - RNA, 22 nt, Human
ugguuugcuuuaaagugaagau

SEQ ID NO: 722374 - RNA, 22 nt, Human
uuaaaaaacagcaggagcccaa

SEQ ID NO: 722375 - RNA, 18 nt, Human
uuaauuggcuccuccagu

SEQ ID NO: 722376 - RNA, 22 nt, Human
uuacuaagacccccucuggccc

SEQ ID NO: 722377 - RNA, 22 nt, Human
uuagcacaguuccagaacauga

SEQ ID NO: 722378 - RNA, 19 nt, Human
uuauugcagcacaaggaca

SEQ ID NO: 722379 - RNA, 20 nt, Human
uucacaagcagaacucacga

SEQ ID NO: 722380 - RNA, 21 nt, Human
uucacacccaggacaggagau

SEQ ID NO: 722381 - RNA, 26 nt, Human
uucccaggcagaaaaaaauucaccaa

SEQ ID NO: 722382 - RNA, 23 nt, Human
uucuaagucauguucugguuuuu

SEQ ID NO: 722383 - RNA, 24 nt, Human
uugcuucauggucaccaaaggaca

SEQ ID NO: 722384 - RNA, 20 nt, Human
uuggcuccuccaguucugag

SEQ ID NO: 722385 - RNA, 21 nt, Human
uuggcuccuccaguucugagg

SEQ ID NO: 722386 - RNA, 20 nt, Human
uuggcuccugggguucgagg

SEQ ID NO: 722387 - RNA, 24 nt, Human
uuggggcuggggggcccuucuugg

SEQ ID NO: 722388 - RNA, 22 nt, Human
uuucuccggguagaucuccuuc

SEQ ID NO: 722389 - RNA, 23 nt, Human
uuuucccccuguccaccuuagaa

SEQ ID NO: 722390 - RNA, 18 nt, Human
aagccuguucccacuccu

SEQ ID NO: 722391 - RNA, 22 nt, Human
aagggauccuuauugaguccca

SEQ ID NO: 722392 - RNA, 21 nt, Human
aaugauguaccugggaauguc

SEQ ID NO: 722393 - RNA, 23 nt, Human
acacagccuccucucaaaggucc

SEQ ID NO: 722394 - RNA, 21 nt, Human
acauauccauuucuuucucuc

SEQ ID NO: 722395 - RNA, 24 nt, Human
agacaaggccaaaaauaaaaaaaa

SEQ ID NO: 722396 - RNA, 23 nt, Human
agccaacgaccagcggcguccag

SEQ ID NO: 722397 - RNA, 21 nt, Human
aggaagaaagacaaggccaaa

SEQ ID NO: 722398 - RNA, 23 nt, Human
aggcaaugcuggugacugcccag

SEQ ID NO: 722399 - RNA, 27 nt, Human
aggccaaaaauaaaaaaaaagggaccc

SEQ ID NO: 722400 - RNA, 22 nt, Human
aucaaauucccaggcacucuaa

SEQ ID NO: 722401 - RNA, 18 nt, Human
aucuacucacucccucca

SEQ ID NO: 722402 - RNA, 18 nt, Human
augaggcuccgagcucug

SEQ ID NO: 722403 - RNA, 18 nt, Human
caacgaccagcggcgucc

SEQ ID NO: 722404 - RNA, 21 nt, Human
caaggccauaugacuaaaaug

SEQ ID NO: 722405 - RNA, 18 nt, Human
cacagcaggcgggagaac

SEQ ID NO: 722406 - RNA, 23 nt, Human
ccagcggcguccaucaguccucc

SEQ ID NO: 722407 - RNA, 19 nt, Human
cccaauuaucuacucacuc

SEQ ID NO: 722408 - RNA, 22 nt, Human
cccauagccagaggaagggaga

SEQ ID NO: 722409 - RNA, 26 nt, Human
ccgucccguccuagccuuuaauuaac

SEQ ID NO: 722410 - RNA, 20 nt, Human
ccuccgugcaaaugaaaaau

SEQ ID NO: 722411 - RNA, 21 nt, Human
ccuguucccacuccucaaaug

SEQ ID NO: 722412 - RNA, 19 nt, Human
cuggaagaagguccccucu

SEQ ID NO: 722413 - RNA, 22 nt, Human
cuuauugagucccaguuggcua

SEQ ID NO: 722414 - RNA, 18 nt, Human
gcguguuccugcaucugu

SEQ ID NO: 722415 - RNA, 19 nt, Human
ggacauucccacacagugc

SEQ ID NO: 722416 - RNA, 21 nt, Human
ggagaacguccagggcucaga

SEQ ID NO: 722417 - RNA, 25 nt, Human
ggagagaagccaacgaccagcggcg

SEQ ID NO: 722418 - RNA, 21 nt, Human
ggcccuggugggauuuaucca

SEQ ID NO: 722419 - RNA, 22 nt, Human
gugguacagaaauguuuugaua

SEQ ID NO: 722420 - RNA, 22 nt, Human
uaaaaaaaaggaagaaagacaa

SEQ ID NO: 722421 - RNA, 21 nt, Human
uacccuguccuucuuuggcau

SEQ ID NO: 722422 - RNA, 23 nt, Human
uagcaacuuaucuaauuugugcu

SEQ ID NO: 722423 - RNA, 22 nt, Human
ucaaagguccgggaaacugauu

SEQ ID NO: 722424 - RNA, 18 nt, Human
ucaggacgggucuccaca

SEQ ID NO: 722425 - RNA, 23 nt, Human
uccagagaaaaugugaugggaac

SEQ ID NO: 722426 - RNA, 23 nt, Human
ucucuucaauucacuguggguuc

SEQ ID NO: 722427 - RNA, 19 nt, Human
ucuuccaucugagcuguag

SEQ ID NO: 722428 - RNA, 21 nt, Human
ugaaagguagucaagacacag

SEQ ID NO: 722429 - RNA, 19 nt, Human
ugagagcacaguccaaaaa

SEQ ID NO: 722430 - RNA, 20 nt, Human
ugagccuccuguagcaacuu

SEQ ID NO: 722431 - RNA, 22 nt, Human
ugagcuguagccuuugggaacc

SEQ ID NO: 722432 - RNA, 21 nt, Human
ugaggcacugggggagaaauu

SEQ ID NO: 722433 - RNA, 23 nt, Human
ugaggugaugaggcccugguggg

SEQ ID NO: 722434 - RNA, 25 nt, Human
ugaugcaacuucuccugggaggaac

SEQ ID NO: 722435 - RNA, 18 nt, Human
ugccccugggcccucccc

SEQ ID NO: 722436 - RNA, 21 nt, Human
ugcugguuuugaaagguaguc

SEQ ID NO: 722437 - RNA, 19 nt, Human
uggaagaagguccccucuu

SEQ ID NO: 722438 - RNA, 20 nt, Human
uggcauggccuucugcugcu

SEQ ID NO: 722439 - RNA, 23 nt, Human
uggcauggccuucugcugcuucc

SEQ ID NO: 722440 - RNA, 18 nt, Human
uggucgaggcaaugcugg

SEQ ID NO: 722441 - RNA, 20 nt, Human
uucaggacgggucuccacag

SEQ ID NO: 722442 - RNA, 20 nt, Human
uucgccgaagccuguuccca

SEQ ID NO: 722443 - RNA, 20 nt, Human
uugagucccaguuggcuaau

SEQ ID NO: 722444 - RNA, 23 nt, Human
uugguugguaugguaacugaugc

SEQ ID NO: 722445 - RNA, 21 nt, Human
uuuggcauggccuucugcugc

SEQ ID NO: 722446 - RNA, 25 nt, Human
uuugucuuucucucuccccuguugc

SEQ ID NO: 722447 - RNA, 24 nt, Human
aaaaccgugaacuaaugccgaagg

SEQ ID NO: 722448 - RNA, 23 nt, Human
aaacaauucugagucaaagauuc

SEQ ID NO: 722449 - RNA, 24 nt, Human
aaacaccaaacaguuuguauuccu

SEQ ID NO: 722450 - RNA, 20 nt, Human
aaacauccuggguggucugg

SEQ ID NO: 722451 - RNA, 24 nt, Human
aaaugaucaagugaaacagaaagc

SEQ ID NO: 722452 - RNA, 20 nt, Human
aaaugguuuuaccccaacua

SEQ ID NO: 722453 - RNA, 21 nt, Human
aacagucagagaagccuuaaa

SEQ ID NO: 722454 - RNA, 18 nt, Human
aagauacucuccccaagu

SEQ ID NO: 722455 - RNA, 24 nt, Human
aaugaaugaacauucuuaaaugac

SEQ ID NO: 722456 - RNA, 20 nt, Human
acacgagcugaccgagggac

SEQ ID NO: 722457 - RNA, 19 nt, Human
agguuucggggggcucggg

SEQ ID NO: 722458 - RNA, 24 nt, Human
caaaaaccgugaacuaaugccggu

SEQ ID NO: 722459 - RNA, 23 nt, Human
caaccucugaaccaacguccccc

SEQ ID NO: 722460 - RNA, 24 nt, Human
caaggacaaauggauccagcggga

SEQ ID NO: 722461 - RNA, 19 nt, Human
cacaaaaucacccaugguc

SEQ ID NO: 722462 - RNA, 19 nt, Human
cacccucucuuugcuccca

SEQ ID NO: 722463 - RNA, 18 nt, Human
cagaaaguaaagugaggc

SEQ ID NO: 722464 - RNA, 20 nt, Human
cagaaaguaaagugaggcug

SEQ ID NO: 722465 - RNA, 19 nt, Human
cagcgcccuccacucauuc

SEQ ID NO: 722466 - RNA, 19 nt, Human
caggagcuacucaaagucu

SEQ ID NO: 722467 - RNA, 22 nt, Human
cagugugcgaccagcucugagu

SEQ ID NO: 722468 - RNA, 23 nt, Human
cauucuacaauuucuacacuuaa

SEQ ID NO: 722469 - RNA, 21 nt, Human
cauuuuggaaaacauccuggg

SEQ ID NO: 722470 - RNA, 21 nt, Human
ccaaccucugaaccaacgucc

SEQ ID NO: 722471 - RNA, 19 nt, Human
ccaggaaggaucugugcua

SEQ ID NO: 722472 - RNA, 19 nt, Human
ccuccuacgggagaagaau

SEQ ID NO: 722473 - RNA, 20 nt, Human
ccucucucaaaaaccgugaa

SEQ ID NO: 722474 - RNA, 23 nt, Human
ccuguggcagagacagcuccggc

SEQ ID NO: 722475 - RNA, 24 nt, Human
cgaccauguggcucuccuguggca

SEQ ID NO: 722476 - RNA, 19 nt, Human
cgggcagagccgaccggaa

SEQ ID NO: 722477 - RNA, 20 nt, Human
cggggggcucgggguugagg

SEQ ID NO: 722478 - RNA, 27 nt, Human
cuaccaaccucugaaccaacguccccc

SEQ ID NO: 722479 - RNA, 22 nt, Human
cuccuucccagugacugggcca

SEQ ID NO: 722480 - RNA, 21 nt, Human
cugcugugucucccugggggc

SEQ ID NO: 722481 - RNA, 21 nt, Human
cuuaaagcuuugcaucaguga

SEQ ID NO: 722482 - RNA, 21 nt, Human
cuuuucggcaaacaauucuga

SEQ ID NO: 722483 - RNA, 19 nt, Human
gaaaacauccugggugguc

SEQ ID NO: 722484 - RNA, 20 nt, Human
gaaacagaaagccaggaagg

SEQ ID NO: 722485 - RNA, 21 nt, Human
gaaaugaagcccaaaucaaac

SEQ ID NO: 722486 - RNA, 18 nt, Human
gaaucugaaaggauggug

SEQ ID NO: 722487 - RNA, 18 nt, Human
gaaugaacauucuuaaau

SEQ ID NO: 722488 - RNA, 20 nt, Human
gaccacccugagccaucaug

SEQ ID NO: 722489 - RNA, 22 nt, Human
gaggaggcccgucucugaguuc

SEQ ID NO: 722490 - RNA, 19 nt, Human
gaggcgcugauugagaaca

SEQ ID NO: 722491 - RNA, 25 nt, Human
gcagaaccuacagaaauuaucuacu

SEQ ID NO: 722492 - RNA, 21 nt, Human
gcagagacagcuccggcuuca

SEQ ID NO: 722493 - RNA, 18 nt, Human
gcagagcagggguugggg

SEQ ID NO: 722494 - RNA, 20 nt, Human
ggagcuacucaaagucucag

SEQ ID NO: 722495 - RNA, 24 nt, Human
ggaugaccacccugagccaucaug

SEQ ID NO: 722496 - RNA, 19 nt, Human
gggaagcaucgggcagggc

SEQ ID NO: 722497 - RNA, 20 nt, Human
gggcagagccgaccggaaga

SEQ ID NO: 722498 - RNA, 24 nt, Human
gggcuccuucccagugacugggcc

SEQ ID NO: 722499 - RNA, 18 nt, Human
gggguuggggucugccuc

SEQ ID NO: 722500 - RNA, 20 nt, Human
ggugcagagcagggguuggg

SEQ ID NO: 722501 - RNA, 22 nt, Human
gugcagagcagggguugggguc

SEQ ID NO: 722502 - RNA, 18 nt, Human
guggcugcuccagguugc

SEQ ID NO: 722503 - RNA, 23 nt, Human
uaaauuuaaaacaccaaacaguu

SEQ ID NO: 722504 - RNA, 23 nt, Human
uaacuaaggccucucucaaaaac

SEQ ID NO: 722505 - RNA, 23 nt, Human
uaagauacucuccccaagugcua

SEQ ID NO: 722506 - RNA, 18 nt, Human
uacacacgaaaugaagcc

SEQ ID NO: 722507 - RNA, 21 nt, Human
uacgggagaagaaucgauuug

SEQ ID NO: 722508 - RNA, 23 nt, Human
ucaaaugguuuuaccccaacuaa

SEQ ID NO: 722509 - RNA, 24 nt, Human
ucaaaugguuuuaccccaacuaaa

SEQ ID NO: 722510 - RNA, 23 nt, Human
ucaagugaaacagaaagccagga

SEQ ID NO: 722511 - RNA, 20 nt, Human
ucacaucauucuuuucggca

SEQ ID NO: 722512 - RNA, 24 nt, Human
ucacaucauucuuuucggcaaaca

SEQ ID NO: 722513 - RNA, 18 nt, Human
ucacugggcagugacuca

SEQ ID NO: 722514 - RNA, 23 nt, Human
ucagccagguucaaacacggcga

SEQ ID NO: 722515 - RNA, 23 nt, Human
ucagucacccucucuuugcuccc

SEQ ID NO: 722516 - RNA, 20 nt, Human
uccccaagugcuaccaaccu

SEQ ID NO: 722517 - RNA, 20 nt, Human
uccuacacacgaaaugaagc

SEQ ID NO: 722518 - RNA, 18 nt, Human
ucgaccccagaacagcgg

SEQ ID NO: 722519 - RNA, 20 nt, Human
ucgaccccagaacagcgggc

SEQ ID NO: 722520 - RNA, 20 nt, Human
ucggggcagaaauacuaagu

SEQ ID NO: 722521 - RNA, 21 nt, Human
ucucuggggcuccuucccagu

SEQ ID NO: 722522 - RNA, 19 nt, Human
ugaaacagaaagccaggaa

SEQ ID NO: 722523 - RNA, 25 nt, Human
ugacaagaauacgaagaguuucaga

SEQ ID NO: 722524 - RNA, 19 nt, Human
ugacucacagcugggcuug

SEQ ID NO: 722525 - RNA, 20 nt, Human
ugagaacacagcgcccuccc

SEQ ID NO: 722526 - RNA, 21 nt, Human
ugagauuuuaccgguucgaaa

SEQ ID NO: 722527 - RNA, 20 nt, Human
ugcaucagugagaggaggcc

SEQ ID NO: 722528 - RNA, 24 nt, Human
ugccucagucacccucucuuugcu

SEQ ID NO: 722529 - RNA, 31 nt, Human
ugcuaauuccacauucuacaauuucuacacc

SEQ ID NO: 722530 - RNA, 23 nt, Human
ugcuaccaaccucugaaccaacg

SEQ ID NO: 722531 - RNA, 21 nt, Human
ugcucacggaaagugcagccu

SEQ ID NO: 722532 - RNA, 23 nt, Human
uggaugaccacccugagccauca

SEQ ID NO: 722533 - RNA, 18 nt, Human
uggcagagacagcuccgg

SEQ ID NO: 722534 - RNA, 20 nt, Human
uggcagagacagcuccggcu

SEQ ID NO: 722535 - RNA, 21 nt, Human
uggcagagacagcuccggcuu

SEQ ID NO: 722536 - RNA, 24 nt, Human
uggcagucgaccccagaacagcgg

SEQ ID NO: 722537 - RNA, 21 nt, Human
uggcggacacaggucucccuu

SEQ ID NO: 722538 - RNA, 23 nt, Human
uggucugggcuaaaugaucaagu

SEQ ID NO: 722539 - RNA, 23 nt, Human
uguggcucuccuguggcagagac

SEQ ID NO: 722540 - RNA, 21 nt, Human
uuaaagcuuugcaucagugag

SEQ ID NO: 722541 - RNA, 20 nt, Human
uuaaaggaagcgcgggacuc

SEQ ID NO: 722542 - RNA, 22 nt, Human
uuggaaaacauccugggugguc

SEQ ID NO: 722543 - RNA, 21 nt, Human
uuugcacuugucugaaauauu

SEQ ID NO: 722544 - RNA, 18 nt, Human
aaaagccucuugagagaa

SEQ ID NO: 722545 - RNA, 18 nt, Human
aacuauuuacucauggcu

SEQ ID NO: 722546 - RNA, 22 nt, Human
aagaaaggagacaucuguucau

SEQ ID NO: 722547 - RNA, 22 nt, Human
aauaacaaaauauacagagaga

SEQ ID NO: 722548 - RNA, 21 nt, Human
agacaaauguaauuuaugacc

SEQ ID NO: 722549 - RNA, 21 nt, Human
agagcagcucauuggcaucau

SEQ ID NO: 722550 - RNA, 20 nt, Human
agccccaguagcaaaaaccc

SEQ ID NO: 722551 - RNA, 20 nt, Human
agcuuccuccccagggggag

SEQ ID NO: 722552 - RNA, 19 nt, Human
auacagagagaagaaagga

SEQ ID NO: 722553 - RNA, 23 nt, Human
auauaaaauaacaaaauauacag

SEQ ID NO: 722554 - RNA, 19 nt, Human
augagccacuggggaccuu

SEQ ID NO: 722555 - RNA, 19 nt, Human
auugcauaugugcucuccu

SEQ ID NO: 722556 - RNA, 19 nt, Human
caauagcugaagggucccc

SEQ ID NO: 722557 - RNA, 22 nt, Human
caauccgggcaucaaaagccag

SEQ ID NO: 722558 - RNA, 22 nt, Human
cacaguagaauccauccccacc

SEQ ID NO: 722559 - RNA, 18 nt, Human
cagguugcugaaguccaa

SEQ ID NO: 722560 - RNA, 23 nt, Human
caucgaucuucccuacaauuucc

SEQ ID NO: 722561 - RNA, 21 nt, Human
cauguauggcuuugcaaaggu

SEQ ID NO: 722562 - RNA, 24 nt, Human
ccccucuccucuucuuccucacca

SEQ ID NO: 722563 - RNA, 24 nt, Human
ccuccucgucucuccuucccaggc

SEQ ID NO: 722564 - RNA, 20 nt, Human
ccucucagauccgguggccg

SEQ ID NO: 722565 - RNA, 22 nt, Human
ccugaggcuccccccucucaga

SEQ ID NO: 722566 - RNA, 24 nt, Human
ccuuuugugaaaccuccccucaga

SEQ ID NO: 722567 - RNA, 20 nt, Human
cgccgagaguccaacauuag

SEQ ID NO: 722568 - RNA, 18 nt, Human
cguguauauauauguaua

SEQ ID NO: 722569 - RNA, 24 nt, Human
cucauuggcaucauuuugggcugc

SEQ ID NO: 722570 - RNA, 23 nt, Human
cuccaaaucgacagauccggaga

SEQ ID NO: 722571 - RNA, 19 nt, Human
cucccgggaucagcuugcc

SEQ ID NO: 722572 - RNA, 22 nt, Human
cucccgggaucagcuugccuuc

SEQ ID NO: 722573 - RNA, 22 nt, Human
cugcugcuaugucucagagccu

SEQ ID NO: 722574 - RNA, 19 nt, Human
cuuugagucuuuaugagcc

SEQ ID NO: 722575 - RNA, 19 nt, Human
gacacaguagaauccaucc

SEQ ID NO: 722576 - RNA, 20 nt, Human
gaggcaagagaccuggacgg

SEQ ID NO: 722577 - RNA, 23 nt, Human
gaucagcuucaggauguugagac

SEQ ID NO: 722578 - RNA, 21 nt, Human
gccucuccccucuccucuucu

SEQ ID NO: 722579 - RNA, 19 nt, Human
gcugaaguccaagucaucu

SEQ ID NO: 722580 - RNA, 20 nt, Human
gucuggacucaauggauaac

SEQ ID NO: 722581 - RNA, 24 nt, Human
uaaaauaacaaaauauacagagag

SEQ ID NO: 722582 - RNA, 24 nt, Human
uaaauguccuaucacucuaaaggg

SEQ ID NO: 722583 - RNA, 18 nt, Human
uaaugagauauucuauaa

SEQ ID NO: 722584 - RNA, 22 nt, Human
uacacacaaaguaaauaaaagu

SEQ ID NO: 722585 - RNA, 30 nt, Human
uacacacaaaguaaauaaaaguucauguag

SEQ ID NO: 722586 - RNA, 25 nt, Human
uaccuggaguuuuaacuauaugaaa

SEQ ID NO: 722587 - RNA, 20 nt, Human
uacguguauauauauguaua

SEQ ID NO: 722588 - RNA, 20 nt, Human
uacguguauauauauguaua

SEQ ID NO: 722589 - RNA, 22 nt, Human
uacguguauauauauguauaau

SEQ ID NO: 722590 - RNA, 23 nt, Human
uacuaaauguccuaucacucuaa

SEQ ID NO: 722591 - RNA, 24 nt, Human
uagaggcaagagaccuggacggug

SEQ ID NO: 722592 - RNA, 23 nt, Human
uagcaggaugggaucagcuucag

SEQ ID NO: 722593 - RNA, 22 nt, Human
uagccaaaugucaucacuuucu

SEQ ID NO: 722594 - RNA, 23 nt, Human
uaggcaacagagcacuugaaagc

SEQ ID NO: 722595 - RNA, 28 nt, Human
uauacagcuuugagucuuuaugagccac

SEQ ID NO: 722596 - RNA, 18 nt, Human
uauuacagauauauucuc

SEQ ID NO: 722597 - RNA, 21 nt, Human
ucagaacuggccuccugugcu

SEQ ID NO: 722598 - RNA, 19 nt, Human
ucagccaauccagauuaag

SEQ ID NO: 722599 - RNA, 20 nt, Human
ucaggcauugcauaugugcu

SEQ ID NO: 722600 - RNA, 25 nt, Human
ucaucgaucuucccuacaauuuccu

SEQ ID NO: 722601 - RNA, 21 nt, Human
ucauuaaauguuccuuuuuuu

SEQ ID NO: 722602 - RNA, 19 nt, Human
ucccaugauuacaguagcc

SEQ ID NO: 722603 - RNA, 18 nt, Human
ucgcgccgagaguccaac

SEQ ID NO: 722604 - RNA, 18 nt, Human
ucuccuucccaggcucug

SEQ ID NO: 722605 - RNA, 24 nt, Human
ucuuuuacguguauauauauguau

SEQ ID NO: 722606 - RNA, 18 nt, Human
ugaagagcauuugugcug

SEQ ID NO: 722607 - RNA, 25 nt, Human
ugaauguuugaugguagcaggaugg

SEQ ID NO: 722608 - RNA, 18 nt, Human
ugacuccucccucuucuc

SEQ ID NO: 722609 - RNA, 18 nt, Human
ugacuccucccucuucuc

SEQ ID NO: 722610 - RNA, 20 nt, Human
ugacuccucccucuucuccu

SEQ ID NO: 722611 - RNA, 20 nt, Human
ugauaugguuuccaaguagc

SEQ ID NO: 722612 - RNA, 21 nt, Human
ugaugcaugaagcccuaugcu

SEQ ID NO: 722613 - RNA, 19 nt, Human
ugauuuggaauuggcaccu

SEQ ID NO: 722614 - RNA, 24 nt, Human
ugcaaauacuuuacuaaauguccu

SEQ ID NO: 722615 - RNA, 22 nt, Human
ugcaugaagcccuaugcugaga

SEQ ID NO: 722616 - RNA, 23 nt, Human
ugcccagaccuucagcacugacc

SEQ ID NO: 722617 - RNA, 18 nt, Human
ugcugcccuccagcuucc

SEQ ID NO: 722618 - RNA, 19 nt, Human
ugcuucggcagcuuucagu

SEQ ID NO: 722619 - RNA, 23 nt, Human
uggacgguggccucuccccucuc

SEQ ID NO: 722620 - RNA, 18 nt, Human
uggcagccuuagccucug

SEQ ID NO: 722621 - RNA, 20 nt, Human
uggcagccuuagccucuguu

SEQ ID NO: 722622 - RNA, 18 nt, Human
uggcugcuucggcagcuu

SEQ ID NO: 722623 - RNA, 21 nt, Human
uggcugggagguguccugagg

SEQ ID NO: 722624 - RNA, 19 nt, Human
ugggcugcaaggaacccau

SEQ ID NO: 722625 - RNA, 20 nt, Human
ugguagcaggaugggaucag

SEQ ID NO: 722626 - RNA, 23 nt, Human
uguccugaggcuccccccucuca

SEQ ID NO: 722627 - RNA, 24 nt, Human
ugucucagagccuucuggcuggga

SEQ ID NO: 722628 - RNA, 23 nt, Human
uucuccccgggaaguuuuuuaaa

SEQ ID NO: 722629 - RNA, 23 nt, Human
uucucucucggaaggucuccaaa

SEQ ID NO: 722630 - RNA, 24 nt, Human
uucugaguucacgacuuuaacuaa

SEQ ID NO: 722631 - RNA, 18 nt, Human
uugaguugggaugagggg

SEQ ID NO: 722632 - RNA, 19 nt, Human
uugauuccgagugaauguu

SEQ ID NO: 722633 - RNA, 18 nt, Human
uugcuugggagaaaucau

SEQ ID NO: 722634 - RNA, 18 nt, Human
uuuaacuaaucgcaugca

SEQ ID NO: 722635 - RNA, 20 nt, Human
uuuggugagcuuccucccca

SEQ ID NO: 722636 - RNA, 23 nt, Human
uuugugaaaccuccccucagagc

SEQ ID NO: 722637 - RNA, 28 nt, Human
aaaaaaaaaacaaaacaguaaaagaaaa

SEQ ID NO: 722638 - RNA, 29 nt, Human
aaaaacagcagaaccaguccacgugcccu

SEQ ID NO: 722639 - RNA, 22 nt, Human
aaaaacgccacaaggucaacag

SEQ ID NO: 722640 - RNA, 18 nt, Human
aaaccccuuucugggccc

SEQ ID NO: 722641 - RNA, 18 nt, Human
aaagagggugucuccaag

SEQ ID NO: 722642 - RNA, 18 nt, Human
aaagcgacugccaaaaac

SEQ ID NO: 722643 - RNA, 18 nt, Human
aaaggcccaagagagcaa

SEQ ID NO: 722644 - RNA, 20 nt, Human
aacauuugggcaagcagcag

SEQ ID NO: 722645 - RNA, 20 nt, Human
aaccaguccacgugccccca

SEQ ID NO: 722646 - RNA, 19 nt, Human
aagaaacacuaauagaaaa

SEQ ID NO: 722647 - RNA, 26 nt, Human
aagaaacacuaauagaaaauugccca

SEQ ID NO: 722648 - RNA, 22 nt, Human
aagcaucaguagucuccaagcc

SEQ ID NO: 722649 - RNA, 18 nt, Human
aagcuccagagagcaugg

SEQ ID NO: 722650 - RNA, 21 nt, Human
aaggacucaaguaccagucug

SEQ ID NO: 722651 - RNA, 19 nt, Human
aaguaccugggucacaagg

SEQ ID NO: 722652 - RNA, 18 nt, Human
aagugcuuuuuccaguuc

SEQ ID NO: 722653 - RNA, 18 nt, Human
acacaggggagcaugcgg

SEQ ID NO: 722654 - RNA, 23 nt, Human
acagccgaggaucacagcugcag

SEQ ID NO: 722655 - RNA, 24 nt, Human
acaguaaugaaaaaggauguuguc

SEQ ID NO: 722656 - RNA, 25 nt, Human
acauaucaccuccauguucaucccu

SEQ ID NO: 722657 - RNA, 19 nt, Human
accauguggcauggaggau

SEQ ID NO: 722658 - RNA, 21 nt, Human
accuugucuuccaacuuccac

SEQ ID NO: 722659 - RNA, 18 nt, Human
acucuggaggcuacagcu

SEQ ID NO: 722660 - RNA, 22 nt, Human
acugccaaaggacgccccagga

SEQ ID NO: 722661 - RNA, 25 nt, Human
agaaaaaaaaaacaaaacaguaaaa

SEQ ID NO: 722662 - RNA, 22 nt, Human
agaaaagcgacugccaaaaaca

SEQ ID NO: 722663 - RNA, 19 nt, Human
agaaaugcccgaagggaaa

SEQ ID NO: 722664 - RNA, 23 nt, Human
agaagacgggcuccccacucucc

SEQ ID NO: 722665 - RNA, 23 nt, Human
agccauaugccuaggcaugcccc

SEQ ID NO: 722666 - RNA, 19 nt, Human
aggcaggaacuguagcagc

SEQ ID NO: 722667 - RNA, 24 nt, Human
aguaaaagaaaaggcccaagagag

SEQ ID NO: 722668 - RNA, 25 nt, Human
aguaugaaagcaggauuagaaaaaa

SEQ ID NO: 722669 - RNA, 18 nt, Human
aucaguagucuccaagcc

SEQ ID NO: 722670 - RNA, 21 nt, Human
auucaagaaaaagcuuacaga

SEQ ID NO: 722671 - RNA, 30 nt, Human
caaaaacagcagaaccaguccacgugcccu

SEQ ID NO: 722672 - RNA, 25 nt, Human
caacagugaaccuaauaagcuuccu

SEQ ID NO: 722673 - RNA, 19 nt, Human
caaggcauugccaaagucc

SEQ ID NO: 722674 - RNA, 18 nt, Human
cacagggaugcagcuucc

SEQ ID NO: 722675 - RNA, 20 nt, Human
caccaguuucccaacagggc

SEQ ID NO: 722676 - RNA, 19 nt, Human
cacucuggaggcuacagcu

SEQ ID NO: 722677 - RNA, 18 nt, Human
cagaaagggucuauccau

SEQ ID NO: 722678 - RNA, 18 nt, Human
cagcaaagccuucuuaaa

SEQ ID NO: 722679 - RNA, 19 nt, Human
caggacucuguguacuugc

SEQ ID NO: 722680 - RNA, 25 nt, Human
caggauuagaaaaaaaaaacaaaac

SEQ ID NO: 722681 - RNA, 18 nt, Human
cagggguuggcagguguu

SEQ ID NO: 722682 - RNA, 22 nt, Human
cagguaacuuuuggccccuuuc

SEQ ID NO: 722683 - RNA, 19 nt, Human
caucaguagucuccaagcc

SEQ ID NO: 722684 - RNA, 23 nt, Human
cauuuauuuaucuacuguacaaa

SEQ ID NO: 722685 - RNA, 22 nt, Human
ccaaaaacagcagaaccagucc

SEQ ID NO: 722686 - RNA, 22 nt, Human
ccaagaaaggacaaaugaugac

SEQ ID NO: 722687 - RNA, 21 nt, Human
ccaaggaccugugauaagcac

SEQ ID NO: 722688 - RNA, 21 nt, Human
ccaguccacgugcccccagcu

SEQ ID NO: 722689 - RNA, 23 nt, Human
cccaagaaauaacacucucucau

SEQ ID NO: 722690 - RNA, 19 nt, Human
ccccacucucccaccaaga

SEQ ID NO: 722691 - RNA, 19 nt, Human
ccccucucuccuggcuccu

SEQ ID NO: 722692 - RNA, 19 nt, Human
cccgagccggggguugcag

SEQ ID NO: 722693 - RNA, 23 nt, Human
cccgucaaugccaacagacagcc

SEQ ID NO: 722694 - RNA, 25 nt, Human
cccuaguguccugacgccaaggacc

SEQ ID NO: 722695 - RNA, 24 nt, Human
cccugaugcuggaucccggacccc

SEQ ID NO: 722696 - RNA, 20 nt, Human
cccugcgaacaggagggcuc

SEQ ID NO: 722697 - RNA, 23 nt, Human
ccugaugagaagaggcaaucacc

SEQ ID NO: 722698 - RNA, 20 nt, Human
ccuuguuucaggacucugug

SEQ ID NO: 722699 - RNA, 19 nt, Human
cgacugccaaaaacagcag

SEQ ID NO: 722700 - RNA, 21 nt, Human
cgacugccaaaaacagcagaa

SEQ ID NO: 722701 - RNA, 21 nt, Human
cgcccagaagcuccagagagc

SEQ ID NO: 722702 - RNA, 20 nt, Human
cgugugccaucucccucagc

SEQ ID NO: 722703 - RNA, 23 nt, Human
cuacugagaucuucaaaggacca

SEQ ID NO: 722704 - RNA, 22 nt, Human
cucagacaugcuuccaggaggc

SEQ ID NO: 722705 - RNA, 28 nt, Human
cucccaccaagagaccccagaguugguc

SEQ ID NO: 722706 - RNA, 18 nt, Human
cugcuccuaugggccacc

SEQ ID NO: 722707 - RNA, 20 nt, Human
cuguagcagcucaggagggc

SEQ ID NO: 722708 - RNA, 25 nt, Human
cuuuuagcagacuacauaaugggga

SEQ ID NO: 722709 - RNA, 22 nt, Human
gaaaccccuuucugggcccaag

SEQ ID NO: 722710 - RNA, 21 nt, Human
gaaagugcuuuuuccaguucu

SEQ ID NO: 722711 - RNA, 21 nt, Human
gaaccaguccacgugccccca

SEQ ID NO: 722712 - RNA, 19 nt, Human
gaagcuccagagagcaugg

SEQ ID NO: 722713 - RNA, 22 nt, Human
gaaggggcggcagcacucagca

SEQ ID NO: 722714 - RNA, 20 nt, Human
gaccauguggcauggaggau

SEQ ID NO: 722715 - RNA, 22 nt, Human
gacuucucucuagugcagggug

SEQ ID NO: 722716 - RNA, 20 nt, Human
gagccaacuggaugacagga

SEQ ID NO: 722717 - RNA, 19 nt, Human
gagccccgugugccaucuc

SEQ ID NO: 722718 - RNA, 18 nt, Human
gaggauccugggguauag

SEQ ID NO: 722719 - RNA, 24 nt, Human
gcaaagccuucuuaaaaacacaaa

SEQ ID NO: 722720 - RNA, 21 nt, Human
gccccacucuggaggcuacag

SEQ ID NO: 722721 - RNA, 18 nt, Human
ggaacuguagcagcucag

SEQ ID NO: 722722 - RNA, 22 nt, Human
ggagccaacuggaugacaggag

SEQ ID NO: 722723 - RNA, 21 nt, Human
gggccaaagagggugucucca

SEQ ID NO: 722724 - RNA, 21 nt, Human
gggcggcagcacucagcagaa

SEQ ID NO: 722725 - RNA, 20 nt, Human
gggcuccccacucucccacc

SEQ ID NO: 722726 - RNA, 21 nt, Human
gggcuuggucucugccaauuu

SEQ ID NO: 722727 - RNA, 25 nt, Human
ggucacaaggacauaaauaaaagaa

SEQ ID NO: 722728 - RNA, 19 nt, Human
guaccuuuuccccacacug

SEQ ID NO: 722729 - RNA, 19 nt, Human
guagagcacuccuauucac

SEQ ID NO: 722730 - RNA, 24 nt, Human
guagagcacuccuauucaccaaag

SEQ ID NO: 722731 - RNA, 19 nt, Human
gugugccaucucccucagc

SEQ ID NO: 722732 - RNA, 23 nt, Human
uaaaaacacaaauuugggaaguc

SEQ ID NO: 722733 - RNA, 18 nt, Human
uaaaagaaaaggcccaag

SEQ ID NO: 722734 - RNA, 18 nt, Human
uaaauaaaagaacuggcc

SEQ ID NO: 722735 - RNA, 23 nt, Human
uaagaugcucugaaaaagugcua

SEQ ID NO: 722736 - RNA, 20 nt, Human
uagaaugcuaaaggaucccc

SEQ ID NO: 722737 - RNA, 23 nt, Human
uagcagcaugguccucuucucau

SEQ ID NO: 722738 - RNA, 21 nt, Human
uagccaagacaaucaacucaa

SEQ ID NO: 722739 - RNA, 18 nt, Human
uagcuggccccccaagua

SEQ ID NO: 722740 - RNA, 25 nt, Human
uagugagggccaaagagggugucuc

SEQ ID NO: 722741 - RNA, 19 nt, Human
uagugccaaaggguuuugu

SEQ ID NO: 722742 - RNA, 21 nt, Human
ucaacagugaaccuaauaagc

SEQ ID NO: 722743 - RNA, 22 nt, Human
ucagaaaagcgacugccaaaaa

SEQ ID NO: 722744 - RNA, 18 nt, Human
ucagcacccaugugccaa

SEQ ID NO: 722745 - RNA, 18 nt, Human
ucaggcaggaacuguagc

SEQ ID NO: 722746 - RNA, 21 nt, Human
ucagucuaucugcuuuucuca

SEQ ID NO: 722747 - RNA, 19 nt, Human
ucauauucuucagucuauc

SEQ ID NO: 722748 - RNA, 23 nt, Human
ucaucuuccaagauacagcagca

SEQ ID NO: 722749 - RNA, 28 nt, Human
uccaggguagagaaauacagcccaagaa

SEQ ID NO: 722750 - RNA, 19 nt, Human
uccaucagacuuugucaca

SEQ ID NO: 722751 - RNA, 20 nt, Human
ucccaggguggugauaaacc

SEQ ID NO: 722752 - RNA, 22 nt, Human
ucccaggguggugauaaaccuu

SEQ ID NO: 722753 - RNA, 23 nt, Human
ucccaggguggugauaaaccuuc

SEQ ID NO: 722754 - RNA, 23 nt, Human
ucuccaagccagccauaugccuu

SEQ ID NO: 722755 - RNA, 21 nt, Human
ucuguaacuugcgcccagaag

SEQ ID NO: 722756 - RNA, 21 nt, Human
ucuucagucuaucugcuuuuc

SEQ ID NO: 722757 - RNA, 24 nt, Human
ugaaagaaaaacgccacaagguca

SEQ ID NO: 722758 - RNA, 20 nt, Human
ugaaagcaggauuagaaaaa

SEQ ID NO: 722759 - RNA, 23 nt, Human
ugacaggucuagccaagacaauc

SEQ ID NO: 722760 - RNA, 19 nt, Human
ugagaaggacucaaguacc

SEQ ID NO: 722761 - RNA, 20 nt, Human
ugauagcagcaugguccucu

SEQ ID NO: 722762 - RNA, 23 nt, Human
ugaugcuggaucccggaccccaa

SEQ ID NO: 722763 - RNA, 24 nt, Human
ugcaaucaacugccaaaggacgcc

SEQ ID NO: 722764 - RNA, 18 nt, Human
ugccaaaaacagcagaac

SEQ ID NO: 722765 - RNA, 24 nt, Human
ugcccccagcuggaaaccccuuuc

SEQ ID NO: 722766 - RNA, 25 nt, Human
ugcuacaaaauuuucuucaguagaa

SEQ ID NO: 722767 - RNA, 23 nt, Human
uggagcaaaggggaguacagggg

SEQ ID NO: 722768 - RNA, 24 nt, Human
uggagcacaguguggauuuaaggg

SEQ ID NO: 722769 - RNA, 25 nt, Human
uggccaaaauaagaaacacuaauag

SEQ ID NO: 722770 - RNA, 24 nt, Human
ugggaaggggcggcagcacucagc

SEQ ID NO: 722771 - RNA, 22 nt, Human
ugggaugaacuggaugaacucc

SEQ ID NO: 722772 - RNA, 24 nt, Human
ugggaugaacuggaugaacuccag

SEQ ID NO: 722773 - RNA, 22 nt, Human
uggggaagucaguggcccaagc

SEQ ID NO: 722774 - RNA, 21 nt, Human
ugugauuaauaaucauuucca

SEQ ID NO: 722775 - RNA, 20 nt, Human
uucaccaaagcagguaacuu

SEQ ID NO: 722776 - RNA, 24 nt, Human
uucacucaugucuggucuccuuca

SEQ ID NO: 722777 - RNA, 19 nt, Human
uuuccaguucugacaccac

SEQ ID NO: 722778 - RNA, 18 nt, Human
uuucccaggguggugaua

SEQ ID NO: 722779 - RNA, 21 nt, Human
uuucugggcccaaggggcagc

SEQ ID NO: 722780 - RNA, 23 nt, Human
uuuuggcaauaaagauggcuugu

SEQ ID NO: 722781 - RNA, 23 nt, Human
aaaguaacagaaaaccauaugcc

SEQ ID NO: 722782 - RNA, 18 nt, Human
aaccgcuccucuuuguuc

SEQ ID NO: 722783 - RNA, 20 nt, Human
aagacguccccucccaccuc

SEQ ID NO: 722784 - RNA, 21 nt, Human
aagaguaaaaacaauuuacaa

SEQ ID NO: 722785 - RNA, 24 nt, Human
aagcagccccuuuuucuuuuucga

SEQ ID NO: 722786 - RNA, 23 nt, Human
aagcauuuugagaagggagaaag

SEQ ID NO: 722787 - RNA, 21 nt, Human
aagguuggaguacuggugcuu

SEQ ID NO: 722788 - RNA, 18 nt, Human
aagucuaccacacuggcc

SEQ ID NO: 722789 - RNA, 20 nt, Human
aaguuacuuucucuccuuuu

SEQ ID NO: 722790 - RNA, 21 nt, Human
acaaaagaaaggcagucugaa

SEQ ID NO: 722791 - RNA, 23 nt, Human
acaacgaaaguaacagaaaacca

SEQ ID NO: 722792 - RNA, 19 nt, Human
acacacccacacagagcuu

SEQ ID NO: 722793 - RNA, 22 nt, Human
acacauggauuuccuuuaauaa

SEQ ID NO: 722794 - RNA, 20 nt, Human
acacccacacagagcuuaac

SEQ ID NO: 722795 - RNA, 21 nt, Human
acagguagggagggagcuaca

SEQ ID NO: 722796 - RNA, 20 nt, Human
accucgcuucccuuuacagc

SEQ ID NO: 722797 - RNA, 23 nt, Human
accucgcuucccuuuacagcuaa

SEQ ID NO: 722798 - RNA, 19 nt, Human
acgccagagagaggcccca

SEQ ID NO: 722799 - RNA, 20 nt, Human
agaccagagucaaagugaaa

SEQ ID NO: 722800 - RNA, 28 nt, Human
agacugccagcggugacagagagcaacc

SEQ ID NO: 722801 - RNA, 25 nt, Human
agacuggaauuacagguagggaggg

SEQ ID NO: 722802 - RNA, 19 nt, Human
agcagccccuuuuucuuuu

SEQ ID NO: 722803 - RNA, 21 nt, Human
agcauuccucuggcccuaccu

SEQ ID NO: 722804 - RNA, 18 nt, Human
aggagcauagcucucucg

SEQ ID NO: 722805 - RNA, 23 nt, Human
agggcaggggagacaugaucuga

SEQ ID NO: 722806 - RNA, 18 nt, Human
agucaugaaagcccuagu

SEQ ID NO: 722807 - RNA, 24 nt, Human
augaagccuuaagucuaccacacu

SEQ ID NO: 722808 - RNA, 18 nt, Human
augcugccgggcccuugu

SEQ ID NO: 722809 - RNA, 21 nt, Human
caaagacuggaauuacaggua

SEQ ID NO: 722810 - RNA, 26 nt, Human
caacaacaaacgcguguugcagcaac

SEQ ID NO: 722811 - RNA, 20 nt, Human
cacacuggcccgguuaaggu

SEQ ID NO: 722812 - RNA, 21 nt, Human
caccugcaggcuucaggugug

SEQ ID NO: 722813 - RNA, 20 nt, Human
cacugcacccagcuuuuuca

SEQ ID NO: 722814 - RNA, 22 nt, Human
cacugcacccagcuuuuucagc

SEQ ID NO: 722815 - RNA, 18 nt, Human
cagagagcaaccgcuccu

SEQ ID NO: 722816 - RNA, 18 nt, Human
cagcacgccagagagagg

SEQ ID NO: 722817 - RNA, 25 nt, Human
cagcaggcaaaugcuguaagccaag

SEQ ID NO: 722818 - RNA, 18 nt, Human
cagcggucucccaaagcu

SEQ ID NO: 722819 - RNA, 20 nt, Human
cauaaaugaagacuaagggc

SEQ ID NO: 722820 - RNA, 19 nt, Human
ccacacagagcuuaaccac

SEQ ID NO: 722821 - RNA, 20 nt, Human
ccaccucccaaaucagagcu

SEQ ID NO: 722822 - RNA, 19 nt, Human
ccagcggucucccaaagcu

SEQ ID NO: 722823 - RNA, 22 nt, Human
cccacacagagcuuaaccacac

SEQ ID NO: 722824 - RNA, 20 nt, Human
ccgggcccuugugggaaggc

SEQ ID NO: 722825 - RNA, 21 nt, Human
ccucagcaccugcaggcuuca

SEQ ID NO: 722826 - RNA, 22 nt, Human
ccuuggguuaaguuucuaaagu

SEQ ID NO: 722827 - RNA, 18 nt, Human
cggccaaaucgcgcucuc

SEQ ID NO: 722828 - RNA, 21 nt, Human
cguccccucccaccucccaaa

SEQ ID NO: 722829 - RNA, 20 nt, Human
cucccaggacuaccagaacc

SEQ ID NO: 722830 - RNA, 21 nt, Human
cucccaggacuaccagaaccc

SEQ ID NO: 722831 - RNA, 19 nt, Human
cucucccacagcacgccag

SEQ ID NO: 722832 - RNA, 21 nt, Human
cucucuggucacgagggugag

SEQ ID NO: 722833 - RNA, 20 nt, Human
cucugucucgagggagugcg

SEQ ID NO: 722834 - RNA, 19 nt, Human
cugaaugcacgacacauac

SEQ ID NO: 722835 - RNA, 21 nt, Human
cugcaggcuucagguguggcg

SEQ ID NO: 722836 - RNA, 22 nt, Human
cugccgggcccuugugggaagg

SEQ ID NO: 722837 - RNA, 23 nt, Human
cuuaaaaagcgaaaguucauaaa

SEQ ID NO: 722838 - RNA, 20 nt, Human
cuucacggccaaaucgcgcu

SEQ ID NO: 722839 - RNA, 22 nt, Human
cuuccuauaguaaacauguuug

SEQ ID NO: 722840 - RNA, 19 nt, Human
gaaccuaguagguacagug

SEQ ID NO: 722841 - RNA, 20 nt, Human
gaagauaccaucuauuccau

SEQ ID NO: 722842 - RNA, 23 nt, Human
gaagauggguauggacucauuug

SEQ ID NO: 722843 - RNA, 21 nt, Human
gacgacuucaccucgcuuccc

SEQ ID NO: 722844 - RNA, 23 nt, Human
gacguccccucccaccucccaaa

SEQ ID NO: 722845 - RNA, 20 nt, Human
gacuucaccucgcuucccuu

SEQ ID NO: 722846 - RNA, 18 nt, Human
gaugauugugcuuugagg

SEQ ID NO: 722847 - RNA, 21 nt, Human
gcaggggagacaugaucugaa

SEQ ID NO: 722848 - RNA, 19 nt, Human
ggagauggacuguggggga

SEQ ID NO: 722849 - RNA, 18 nt, Human
gggaaggccugcaugaug

SEQ ID NO: 722850 - RNA, 23 nt, Human
guagggagggagcuacaggugau

SEQ ID NO: 722851 - RNA, 26 nt, Human
guuaaagugcauuccuggggugguug

SEQ ID NO: 722852 - RNA, 19 nt, Human
uaaaaugcacagccuguac

SEQ ID NO: 722853 - RNA, 24 nt, Human
uaaacuaggaauuucaagaccaga

SEQ ID NO: 722854 - RNA, 27 nt, Human
uaaagcaucccaaaguacaccugaaga

SEQ ID NO: 722855 - RNA, 20 nt, Human
uaaccccacaaugaagccuc

SEQ ID NO: 722856 - RNA, 22 nt, Human
uaaggcagaacaucaaggcgaa

SEQ ID NO: 722857 - RNA, 24 nt, Human
uaaucaaagaaagcuuaaaggccc

SEQ ID NO: 722858 - RNA, 26 nt, Human
uaauucacuucauaaaugaagacuaa

SEQ ID NO: 722859 - RNA, 20 nt, Human
uacaaaagaaaggcagucug

SEQ ID NO: 722860 - RNA, 22 nt, Human
uaccugaacccucaggaggaac

SEQ ID NO: 722861 - RNA, 18 nt, Human
uaggaaaugauuauuaaa

SEQ ID NO: 722862 - RNA, 18 nt, Human
uagguucuccagcuuggc

SEQ ID NO: 722863 - RNA, 23 nt, Human
uauuacaauuuauaauagcguuu

SEQ ID NO: 722864 - RNA, 18 nt, Human
ucaagcuugcuuggauuu

SEQ ID NO: 722865 - RNA, 23 nt, Human
ucacugcacccagcuuuuucagc

SEQ ID NO: 722866 - RNA, 21 nt, Human
ucagcaccugcaggcuucagg

SEQ ID NO: 722867 - RNA, 21 nt, Human
uccccagcggucucccaaagc

SEQ ID NO: 722868 - RNA, 21 nt, Human
ucccuggguggcauccuucag

SEQ ID NO: 722869 - RNA, 24 nt, Human
ucccuggguggcauccuucaguuc

SEQ ID NO: 722870 - RNA, 21 nt, Human
uccucuggcccuaccucucca

SEQ ID NO: 722871 - RNA, 22 nt, Human
uccucuggcccuaccucuccag

SEQ ID NO: 722872 - RNA, 21 nt, Human
ucucaggagauacucucccug

SEQ ID NO: 722873 - RNA, 21 nt, Human
ucugcugaguuccuggucuca

SEQ ID NO: 722874 - RNA, 18 nt, Human
ucuuccucaguagauagg

SEQ ID NO: 722875 - RNA, 20 nt, Human
ugaaacuaguaucuuaaaau

SEQ ID NO: 722876 - RNA, 18 nt, Human
ugaacccucaggaggaac

SEQ ID NO: 722877 - RNA, 19 nt, Human
ugaaugcacgacacauaca

SEQ ID NO: 722878 - RNA, 23 nt, Human
ugacaaaugcacaaagacuggaa

SEQ ID NO: 722879 - RNA, 18 nt, Human
ugagagcagacugccagc

SEQ ID NO: 722880 - RNA, 20 nt, Human
ugagagcagacugccagcgg

SEQ ID NO: 722881 - RNA, 19 nt, Human
ugagcugcgugcuucauca

SEQ ID NO: 722882 - RNA, 24 nt, Human
ugauagcuaugcgcccccguuugu

SEQ ID NO: 722883 - RNA, 23 nt, Human
ugaucgaauguggccucagcacc

SEQ ID NO: 722884 - RNA, 20 nt, Human
ugcacacacccacacagagc

SEQ ID NO: 722885 - RNA, 23 nt, Human
ugcauuaugaggcaagcauuuug

SEQ ID NO: 722886 - RNA, 27 nt, Human
ugccacagaauagaacauuaaaagcaa

SEQ ID NO: 722887 - RNA, 25 nt, Human
ugcuguaccugaacccucaggagga

SEQ ID NO: 722888 - RNA, 21 nt, Human
ugcuuugaggaggagcauagc

SEQ ID NO: 722889 - RNA, 19 nt, Human
uggacugugggggauggag

SEQ ID NO: 722890 - RNA, 28 nt, Human
uggagauggcacacugguuccgaccacg

SEQ ID NO: 722891 - RNA, 19 nt, Human
uggcacacugguugaaaga

SEQ ID NO: 722892 - RNA, 21 nt, Human
uggcauccuucaguucauuuu

SEQ ID NO: 722893 - RNA, 19 nt, Human
ugggaaggccugcaugaug

SEQ ID NO: 722894 - RNA, 21 nt, Human
uggugcuuuaccaaacaaagu

SEQ ID NO: 722895 - RNA, 25 nt, Human
uggugucaggggagaagauuggguu

SEQ ID NO: 722896 - RNA, 19 nt, Human
ugguugaaagaaaaaaaaa

SEQ ID NO: 722897 - RNA, 24 nt, Human
ugguugguuuaaagugguugguag

SEQ ID NO: 722898 - RNA, 21 nt, Human
ugugggggauggagcucuccu

SEQ ID NO: 722899 - RNA, 22 nt, Human
ugugucaggaugaagaccacug

SEQ ID NO: 722900 - RNA, 28 nt, Human
uucaccuugucaugcugccgggcccuug

SEQ ID NO: 722901 - RNA, 20 nt, Human
uucagcaguuucuugccuuu

SEQ ID NO: 722902 - RNA, 25 nt, Human
uucaucaacuuaguauugcauuggu

SEQ ID NO: 722903 - RNA, 21 nt, Human
uucuagguucuccagcuuggc

SEQ ID NO: 722904 - RNA, 20 nt, Human
uugagacauauuucuuugua

SEQ ID NO: 722905 - RNA, 23 nt, Human
uuuauaaaccguccauaaauuac

SEQ ID NO: 722906 - RNA, 21 nt, Human
uuucaguuguugaaguaugcc

SEQ ID NO: 722907 - RNA, 21 nt, Human
uuuccccagcggucucccaaa

SEQ ID NO: 722908 - RNA, 23 nt, Human
uuucucugucucgagggagugcg

SEQ ID NO: 722909 - RNA, 22 nt, Human
uuuggaguguucagagccaaca

SEQ ID NO: 722910 - RNA, 23 nt, Human
uuuggaguguucagagccaacac

SEQ ID NO: 722911 - RNA, 20 nt, Human
uuuuccacaaaguuucucug

SEQ ID NO: 722912 - RNA, 24 nt, Human
aaacgcacagccuacagaacauaa

SEQ ID NO: 722913 - RNA, 19 nt, Human
aaaguaccugucggggacc

SEQ ID NO: 722914 - RNA, 22 nt, Human
aaauuucccccuaaaaauaagc

SEQ ID NO: 722915 - RNA, 19 nt, Human
aacaggauauuguuuaggu

SEQ ID NO: 722916 - RNA, 19 nt, Human
aagcagaacucuacaguuu

SEQ ID NO: 722917 - RNA, 19 nt, Human
aaggacagaaaaggaggag

SEQ ID NO: 722918 - RNA, 21 nt, Human
aagggcaccaccaaggccacc

SEQ ID NO: 722919 - RNA, 19 nt, Human
aaugacacacuuuuuaguu

SEQ ID NO: 722920 - RNA, 25 nt, Human
acacaaaaaacaaugguagucacuc

SEQ ID NO: 722921 - RNA, 25 nt, Human
acacacacacacacagacacacaca

SEQ ID NO: 722922 - RNA, 33 nt, Human
acacacacacacacagacacacacacacacagu

SEQ ID NO: 722923 - RNA, 20 nt, Human
acacacacacacacguucac

SEQ ID NO: 722924 - RNA, 31 nt, Human; identical to SEQ ID NO: 639497

SEQ ID NO: 722925 - RNA, 18 nt, Human
acacagccaucugacugc

SEQ ID NO: 722926 - RNA, 18 nt, Human
acacaucuaacccacugg

SEQ ID NO: 722927 - RNA, 21 nt, Human
acacuuuuuaguucugccuuu

SEQ ID NO: 722928 - RNA, 18 nt, Human
acagaacauaauaaaugc

SEQ ID NO: 722929 - RNA, 22 nt, Human
acaugcaagacuccguaccucc

SEQ ID NO: 722930 - RNA, 21 nt, Human
acccugaagcauaaagaaaac

SEQ ID NO: 722931 - RNA, 19 nt, Human
accuuggcucucuggaucc

SEQ ID NO: 722932 - RNA, 20 nt, Human
accuuggcucucuggaucca

SEQ ID NO: 722933 - RNA, 22 nt, Human
acugaagcucgccccaugcguu

SEQ ID NO: 722934 - RNA, 20 nt, Human
acugcuaaacaacaccgaga

SEQ ID NO: 722935 - RNA, 22 nt, Human
acugguucuaucucucauucua

SEQ ID NO: 722936 - RNA, 23 nt, Human
agaaagaaaagauaauguuacaa

SEQ ID NO: 722937 - RNA, 25 nt, Human
agaaaucaucccuuuuuaaaacccu

SEQ ID NO: 722938 - RNA, 23 nt, Human
agaguuuggugcaagcuuccuuu

SEQ ID NO: 722939 - RNA, 21 nt, Human
agcauaaagaaaacaaauuuc

SEQ ID NO: 722940 - RNA, 18 nt, Human
agccaggcccgccgaggg

SEQ ID NO: 722941 - RNA, 24 nt, Human
agcugaauuuuuuuuaagaaccca

SEQ ID NO: 722942 - RNA, 24 nt, Human
agguggcaucacuggcuuguugag

SEQ ID NO: 722943 - RNA, 25 nt, Human
agugguacauuuucuuaccuugcug

SEQ ID NO: 722944 - RNA, 24 nt, Human
auagaacuuucagguggcccaaaa

SEQ ID NO: 722945 - RNA, 20 nt, Human
auauacacaauugcugaguc

SEQ ID NO: 722946 - RNA, 24 nt, Human
auauuagaaauaccuugucaacaa

SEQ ID NO: 722947 - RNA, 23 nt, Human
augaauccuccuucauugaaugu

SEQ ID NO: 722948 - RNA, 21 nt, Human
auuucuauuaacaagcaucuc

SEQ ID NO: 722949 - RNA, 23 nt, Human
auuuuccuucuaacacuauagac

SEQ ID NO: 722950 - RNA, 18 nt, Human
caaaaaaugccaagggca

SEQ ID NO: 722951 - RNA, 22 nt, Human
caaaaaaugccaagggcaccac

SEQ ID NO: 722952 - RNA, 18 nt, Human
caaaagcaccuaaaagcu

SEQ ID NO: 722953 - RNA, 19 nt, Human
caaaagcaccuaaaagcug

SEQ ID NO: 722954 - RNA, 18 nt, Human
caaaauccucgcuuccuc

SEQ ID NO: 722955 - RNA, 18 nt, Human
caaacgcacagccuacag

SEQ ID NO: 722956 - RNA, 19 nt, Human
caacacugguucuaucucu

SEQ ID NO: 722957 - RNA, 25 nt, Human
caacauaagaaugauaguaucuccu

SEQ ID NO: 722958 - RNA, 21 nt, Human
caagcccaagacaggcugaag

SEQ ID NO: 722959 - RNA, 22 nt, Human
caagcccaagacaggcugaagc

SEQ ID NO: 722960 - RNA, 18 nt, Human
caaggcaggaguucuuug

SEQ ID NO: 722961 - RNA, 23 nt, Human
caaugauaagcaguccaccauga

SEQ ID NO: 722962 - RNA, 25 nt, Human
cacacacacacacacguucacaccc

SEQ ID NO: 722963 - RNA, 22 nt, Human
cacacacacagacacacacaca

SEQ ID NO: 722964 - RNA, 21 nt, Human
caccaaggccaccagccucag

SEQ ID NO: 722965 - RNA, 24 nt, Human
cacguucacacccucgcgcgcgca

SEQ ID NO: 722966 - RNA, 22 nt, Human
cacucuccuccccgcgcacaaa

SEQ ID NO: 722967 - RNA, 21 nt, Human
cacugcuggcgacacugaagc

SEQ ID NO: 722968 - RNA, 23 nt, Human
cagaacauaauaaaugcuuaaug

SEQ ID NO: 722969 - RNA, 28 nt, Human
cagacacacacacacacacacguucaca

SEQ ID NO: 722970 - RNA, 19 nt, Human
cagcacagguggagcaagg

SEQ ID NO: 722971 - RNA, 24 nt, Human
cagccaggcccgccgagggcagca

SEQ ID NO: 722972 - RNA, 19 nt, Human
cagccccaccccagcaaaa

SEQ ID NO: 722973 - RNA, 18 nt, Human
cagugggugauggcaggc

SEQ ID NO: 722974 - RNA, 22 nt, Human
cagugggugauggcaggcuucc

SEQ ID NO: 722975 - RNA, 31 nt, Human
caucgcaggucuuacacacacacacacagug

SEQ ID NO: 722976 - RNA, 21 nt, Human
ccacaaaaaaugccaagggca

SEQ ID NO: 722977 - RNA, 21 nt, Human
ccagcaaaauccucgcuuccu

SEQ ID NO: 722978 - RNA, 18 nt, Human
ccagcuacaaaaacucaa

SEQ ID NO: 722979 - RNA, 19 nt, Human
cccccgggggauccccgcc

SEQ ID NO: 722980 - RNA, 22 nt, Human
ccccuuucuauugccucagucc

SEQ ID NO: 722981 - RNA, 18 nt, Human
cccgaugacuuuacauuu

SEQ ID NO: 722982 - RNA, 26 nt, Human
cccuaaaaauaagcauuacagaaaaa

SEQ ID NO: 722983 - RNA, 19 nt, Human
cccuccauccaucaaggca

SEQ ID NO: 722984 - RNA, 21 nt, Human
cccuucuuccucauuacgccc

SEQ ID NO: 722985 - RNA, 21 nt, Human
ccgcccaccgcccgcggcagc

SEQ ID NO: 722986 - RNA, 19 nt, Human
ccgccgagggcagcacagg

SEQ ID NO: 722987 - RNA, 18 nt, Human
ccuagagggagggguggc

SEQ ID NO: 722988 - RNA, 20 nt, Human
ccuaugagcccuacaaacac

SEQ ID NO: 722989 - RNA, 22 nt, Human
ccucugggaaguuacuuaaccu

SEQ ID NO: 722990 - RNA, 21 nt, Human
ccuuagaguuuuacccagccu

SEQ ID NO: 722991 - RNA, 20 nt, Human
cgccgagggcagcacaggug

SEQ ID NO: 722992 - RNA, 24 nt, Human
cgggaguacugcuuuguggguggg

SEQ ID NO: 722993 - RNA, 19 nt, Human
cgugcacacacaggcugca

SEQ ID NO: 722994 - RNA, 19 nt, Human
cuacccugaaccagucaac

SEQ ID NO: 722995 - RNA, 23 nt, Human
cuauacugcuaaacaacaccgag

SEQ ID NO: 722996 - RNA, 18 nt, Human
cuauucuaaaagaguggg

SEQ ID NO: 722997 - RNA, 25 nt, Human
cuccccuuucuauugccucaguccu

SEQ ID NO: 722998 - RNA, 22 nt, Human
cuccguaccuccacagauggcc

SEQ ID NO: 722999 - RNA, 22 nt, Human
cucuccuccccgcgcacaaaag

SEQ ID NO: 723000 - RNA, 18 nt, Human
cucugcgcggggccagcc

SEQ ID NO: 723001 - RNA, 24 nt, Human
cucuuccccgggacguagccccag

SEQ ID NO: 723002 - RNA, 19 nt, Human
cugaaugucauauaguuca

SEQ ID NO: 723003 - RNA, 21 nt, Human
cugcuggcccugagcaucacu

SEQ ID NO: 723004 - RNA, 19 nt, Human
cuggucaccugauaaggca

SEQ ID NO: 723005 - RNA, 19 nt, Human
cuguccagagcucuuagcg

SEQ ID NO: 723006 - RNA, 21 nt, Human
cuucuuggccaugaccucugg

SEQ ID NO: 723007 - RNA, 24 nt, Human
gaagaaguccacuguaaaccuaga

SEQ ID NO: 723008 - RNA, 21 nt, Human
gaauauauacacaauugcuga

SEQ ID NO: 723009 - RNA, 22 nt, Human
gacagaaaaggaggaggggcag

SEQ ID NO: 723010 - RNA, 21 nt, Human
gcaaacaaccauaacccuggu

SEQ ID NO: 723011 - RNA, 20 nt, Human
gcaagcuuccuuugauguuu

SEQ ID NO: 723012 - RNA, 20 nt, Human
gccucaggaccaagggugga

SEQ ID NO: 723013 - RNA, 24 nt, Human
gcgacacugaagcucgccccaugc

SEQ ID NO: 723014 - RNA, 21 nt, Human
gcucacacuugguaccacaac

SEQ ID NO: 723015 - RNA, 20 nt, Human
guggaaagcagaacucuaca

SEQ ID NO: 723016 - RNA, 18 nt, Human
guuggucauuccaucucg

SEQ ID NO: 723017 - RNA, 21 nt, Human
guuuuucucuguccagagcuc

SEQ ID NO: 723018 - RNA, 23 nt, Human
uaaaagagcaaaguuuuuguuuu

SEQ ID NO: 723019 - RNA, 19 nt, Human
uaagacagaaaucaucccu

SEQ ID NO: 723020 - RNA, 22 nt, Human
uaagauggucccaugaggauga

SEQ ID NO: 723021 - RNA, 18 nt, Human
uacaagagaaaccguguu

SEQ ID NO: 723022 - RNA, 18 nt, Human
uacaguuuaaaaaauuug

SEQ ID NO: 723023 - RNA, 20 nt, Human
uacccugaagcauaaagaaa

SEQ ID NO: 723024 - RNA, 19 nt, Human
uaccuugcuucuucaucag

SEQ ID NO: 723025 - RNA, 19 nt, Human
uagaaauaccuugucaacu

SEQ ID NO: 723026 - RNA, 19 nt, Human
uagcacagaauuaaaaacc

SEQ ID NO: 723027 - RNA, 23 nt, Human
uaugccagaaauucacauuugca

SEQ ID NO: 723028 - RNA, 22 nt, Human
uauuucagaguuuuggaauaua

SEQ ID NO: 723029 - RNA, 18 nt, Human
uauuuuggaaaguaccug

SEQ ID NO: 723030 - RNA, 23 nt, Human
ucacacuugguaccacaacacug

SEQ ID NO: 723031 - RNA, 18 nt, Human
ucacagcggcuaagacag

SEQ ID NO: 723032 - RNA, 23 nt, Human
ucacauuugcaugcaaacaacca

SEQ ID NO: 723033 - RNA, 18 nt, Human
ucaguuaaaagagcaaag

SEQ ID NO: 723034 - RNA, 23 nt, Human
ucaguucuuggagccacuacuuc

SEQ ID NO: 723035 - RNA, 21 nt, Human
uccaaacgcacagccuacaga

SEQ ID NO: 723036 - RNA, 21 nt, Human
uccgggagaugacaaaagcac

SEQ ID NO: 723037 - RNA, 24 nt, Human
uccuccucgucgucaucgcagguc

SEQ ID NO: 723038 - RNA, 19 nt, Human
ucgcgcgcgcaccugcugu

SEQ ID NO: 723039 - RNA, 19 nt, Human
ucuaaucuucccacaaaaa

SEQ ID NO: 723040 - RNA, 28 nt, Human
ucucugggccuucagagggccgacuuuc

SEQ ID NO: 723041 - RNA, 23 nt, Human
ugaaaacauaagacccacuuuuc

SEQ ID NO: 723042 - RNA, 21 nt, Human
ugaagagaguuuggugcaagc

SEQ ID NO: 723043 - RNA, 22 nt, Human
ugaagugaauacaucuauguca

SEQ ID NO: 723044 - RNA, 20 nt, Human
ugacaaaagcaccuaaaagc

SEQ ID NO: 723045 - RNA, 23 nt, Human
ugacaaaagcaccuaaaagcuga

SEQ ID NO: 723046 - RNA, 23 nt, Human
ugacaagacaggacucacuuucu

SEQ ID NO: 723047 - RNA, 20 nt, Human
ugagauugugccagcuacaa

SEQ ID NO: 723048 - RNA, 23 nt, Human
ugcaacaggauauuguuuaggug

SEQ ID NO: 723049 - RNA, 21 nt, Human
ugcaugcaaacaaccauaacc

SEQ ID NO: 723050 - RNA, 24 nt, Human
ugccaagggcaccaccaaggccac

SEQ ID NO: 723051 - RNA, 20 nt, Human
uggaaggaucagagaggcca

SEQ ID NO: 723052 - RNA, 19 nt, Human
uggggcgugcacacacagg

SEQ ID NO: 723053 - RNA, 19 nt, Human
ugggugauggcaggcuucu

SEQ ID NO: 723054 - RNA, 19 nt, Human
uguaaaccagcaacuaaag

SEQ ID NO: 723055 - RNA, 19 nt, Human
uguaaugccauggguauga

SEQ ID NO: 723056 - RNA, 19 nt, Human
uguuucauucaccuucucu

SEQ ID NO: 723057 - RNA, 19 nt, Human
uuaauugucuuucauguuu

SEQ ID NO: 723058 - RNA, 22 nt, Human
uuagagaaagaaaagauaaugu

SEQ ID NO: 723059 - RNA, 19 nt, Human
uucacauuugcaugcaaac

SEQ ID NO: 723060 - RNA, 22 nt, Human
uucaucagcaaugcauuccuag

SEQ ID NO: 723061 - RNA, 20 nt, Human
uuccccgggacguagcccca

SEQ ID NO: 723062 - RNA, 22 nt, Human
uuccuccucgucgucaucgcua

SEQ ID NO: 723063 - RNA, 18 nt, Human
uucuagggccuguuuuuc

SEQ ID NO: 723064 - RNA, 22 nt, Human
uucucuggcacuccugcccugg

SEQ ID NO: 723065 - RNA, 25 nt, Human
uucuuaccuugcugcauguuuuuca

SEQ ID NO: 723066 - RNA, 21 nt, Human
uuguucaucuuuaauaugaga

SEQ ID NO: 723067 - RNA, 24 nt, Human
uuguuccuccucgucgucaucgca

SEQ ID NO: 723068 - RNA, 22 nt, Human
uuuaaguauauaccuuagaguu

SEQ ID NO: 723069 - RNA, 19 nt, Human
uuucuuaccuugcugcaug

SEQ ID NO: 723070 - RNA, 18 nt, Human
aaaaaaggcagacucaga

SEQ ID NO: 723071 - RNA, 18 nt, Human
aaaaaucuugguucagag

SEQ ID NO: 723072 - RNA, 20 nt, Human
aaaaggaagcagcuuccuaa

SEQ ID NO: 723073 - RNA, 24 nt, Human
aaagaacuggccaucuccagacaa

SEQ ID NO: 723074 - RNA, 26 nt, Human
aaagaacuggccaucuccagacaaac

SEQ ID NO: 723075 - RNA, 20 nt, Human
aaagaagcgcacucccuucc

SEQ ID NO: 723076 - RNA, 22 nt, Human
aaaggccaaggcagaggaggug

SEQ ID NO: 723077 - RNA, 18 nt, Human
aacaggacaacccggguc

SEQ ID NO: 723078 - RNA, 23 nt, Human
aacuugucucucaaacaggagau

SEQ ID NO: 723079 - RNA, 23 nt, Human
aaggcagacucagaagggcaagc

SEQ ID NO: 723080 - RNA, 22 nt, Human
aagggugcugcaguaacugaag

SEQ ID NO: 723081 - RNA, 25 nt, Human
aagggugcugcaguaacugaagaag

SEQ ID NO: 723082 - RNA, 22 nt, Human
acacaacagcuccucaaggucu

SEQ ID NO: 723083 - RNA, 23 nt, Human
acagguagcacuugccccaaagc

SEQ ID NO: 723084 - RNA, 21 nt, Human
acauaagcagauaauugagac

SEQ ID NO: 723085 - RNA, 23 nt, Human
accacagagauucacugccagac

SEQ ID NO: 723086 - RNA, 23 nt, Human
accaccccccaccgccuccccug

SEQ ID NO: 723087 - RNA, 19 nt, Human
accccgccuuucaaggcua

SEQ ID NO: 723088 - RNA, 23 nt, Human
acccgcuccccccaccacccccc

SEQ ID NO: 723089 - RNA, 30 nt, Human
acccgcuccccccaccaccccccaccgccc

SEQ ID NO: 723090 - RNA, 23 nt, Human
acuuuaguccuucuuggacagcc

SEQ ID NO: 723091 - RNA, 23 nt, Human
agaaagacuggcccaaccacaga

SEQ ID NO: 723092 - RNA, 21 nt, Human
agacaaacacacauagauucc

SEQ ID NO: 723093 - RNA, 19 nt, Human
agacucagaagggcaagca

SEQ ID NO: 723094 - RNA, 21 nt, Human
agaggaggugagggcugggag

SEQ ID NO: 723095 - RNA, 18 nt, Human
agaugccugcaccugaaa

SEQ ID NO: 723096 - RNA, 19 nt, Human
agcaaggggcucacagcag

SEQ ID NO: 723097 - RNA, 18 nt, Human
agcacagcucaggacugc

SEQ ID NO: 723098 - RNA, 18 nt, Human
agcacccgcuccccccac

SEQ ID NO: 723099 - RNA, 19 nt, Human
agcuacuaaagcacgucca

SEQ ID NO: 723100 - RNA, 21 nt, Human
agcucuguugcagcagaacaa

SEQ ID NO: 723101 - RNA, 20 nt, Human
aggagcgcaaacaggacugc

SEQ ID NO: 723102 - RNA, 21 nt, Human
aggcaaguaggguccaaucca

SEQ ID NO: 723103 - RNA, 18 nt, Human
aggcagaggaggugaggg

SEQ ID NO: 723104 - RNA, 19 nt, Human
aggcagaggaggugagggc

SEQ ID NO: 723105 - RNA, 19 nt, Human
aggcagccaggaggaaggc

SEQ ID NO: 723106 - RNA, 25 nt, Human
aggcugagauucucuugggccagaa

SEQ ID NO: 723107 - RNA, 21 nt, Human
agggaaauccacaggguuucu

SEQ ID NO: 723108 - RNA, 24 nt, Human
agggugcugcaguaacugaagaag

SEQ ID NO: 723109 - RNA, 24 nt, Human
aggucugcuggcuuugccgggaug

SEQ ID NO: 723110 - RNA, 20 nt, Human
agugagcugaagggcccggg

SEQ ID NO: 723111 - RNA, 21 nt, Human
agugccucuuuuaaauggaga

SEQ ID NO: 723112 - RNA, 21 nt, Human
aucccaaauuaagggcugcaa

SEQ ID NO: 723113 - RNA, 22 nt, Human
auggaugggaccaauaggcuga

SEQ ID NO: 723114 - RNA, 25 nt, Human
caaaaaaggcagacucagaagggca

SEQ ID NO: 723115 - RNA, 19 nt, Human
caaacccagaaucuucuga

SEQ ID NO: 723116 - RNA, 19 nt, Human
caacaggcagcucugugcu

SEQ ID NO: 723117 - RNA, 19 nt, Human
caacccgggucaagaacca

SEQ ID NO: 723118 - RNA, 20 nt, Human
caacuggaaaaccucgaaug

SEQ ID NO: 723119 - RNA, 22 nt, Human
caagcagacgccagagaaggac

SEQ ID NO: 723120 - RNA, 21 nt, Human
caaggggcucacagcagcagc

SEQ ID NO: 723121 - RNA, 19 nt, Human
caaguaggguccaauccaa

SEQ ID NO: 723122 - RNA, 23 nt, Human
cacaaacuguagggccagccgac

SEQ ID NO: 723123 - RNA, 18 nt, Human
cacaccuuuucucaaaca

SEQ ID NO: 723124 - RNA, 19 nt, Human
cacagagauucacugccag

SEQ ID NO: 723125 - RNA, 23 nt, Human
cacagcucaggacugcauccuuu

SEQ ID NO: 723126 - RNA, 22 nt, Human
caccagagacacugacuucagc

SEQ ID NO: 723127 - RNA, 22 nt, Human
cacccgcuccccccaccacccc

SEQ ID NO: 723128 - RNA, 25 nt, Human
cacccgcuccccccaccacccccca

SEQ ID NO: 723129 - RNA, 21 nt, Human
caccugcagcuccgccagcuu

SEQ ID NO: 723130 - RNA, 18 nt, Human
caccuuuucucuccccag

SEQ ID NO: 723131 - RNA, 18 nt, Human
cacuucagugagcugaag

SEQ ID NO: 723132 - RNA, 24 nt, Human
cagacaaacacacauagauuccaa

SEQ ID NO: 723133 - RNA, 21 nt, Human
cagagaaaagaagcgcacucc

SEQ ID NO: 723134 - RNA, 20 nt, Human
cagagcugcagagcuuucuu

SEQ ID NO: 723135 - RNA, 23 nt, Human
cagagcuuucuuuaggccccaca

SEQ ID NO: 723136 - RNA, 20 nt, Human
cagcagaacaaagggauuuc

SEQ ID NO: 723137 - RNA, 33 nt, Human
cagcgcacaggaacaugcacacgugugugcagu

SEQ ID NO: 723138 - RNA, 21 nt, Human
cagcgugguguucaaaggcuu

SEQ ID NO: 723139 - RNA, 23 nt, Human
caggaccaaaacuucucaucuga

SEQ ID NO: 723140 - RNA, 19 nt, Human
ccaaccuagggcagagcca

SEQ ID NO: 723141 - RNA, 21 nt, Human
ccacagagauucacugccaga

SEQ ID NO: 723142 - RNA, 21 nt, Human
ccaccaccccccaccgccucc

SEQ ID NO: 723143 - RNA, 23 nt, Human
ccaccaccccccaccgccucccc

SEQ ID NO: 723144 - RNA, 23 nt, Human
ccaccgccuccccuguaucccug

SEQ ID NO: 723145 - RNA, 19 nt, Human
ccaucuccagacaaacaca

SEQ ID NO: 723146 - RNA, 19 nt, Human
cccacaugucugcauaucc

SEQ ID NO: 723147 - RNA, 23 nt, Human
cccaccgccuccccuguaucccc

SEQ ID NO: 723148 - RNA, 23 nt, Human
cccaccgccuccccuguaucccu

SEQ ID NO: 723149 - RNA, 21 nt, Human
ccccacaugucugcauaucca

SEQ ID NO: 723150 - RNA, 27 nt, Human
ccccaccaccccccaccgccuccccug

SEQ ID NO: 723151 - RNA, 24 nt, Human
ccccaccgccuccccuguaucccu

SEQ ID NO: 723152 - RNA, 22 nt, Human
cccccaccaccccccaccgccu

SEQ ID NO: 723153 - RNA, 24 nt, Human
cccccaccaccccccaccgccucc

SEQ ID NO: 723154 - RNA, 20 nt, Human
ccccccaccaccccccaccg

SEQ ID NO: 723155 - RNA, 23 nt, Human
ccccccaccgccuccccuguauc

SEQ ID NO: 723156 - RNA, 19 nt, Human
cccugcugcaaagacccuc

SEQ ID NO: 723157 - RNA, 20 nt, Human
ccgcuccccccaccaccccc

SEQ ID NO: 723158 - RNA, 20 nt, Human
ccucaacacaacagcuccuc

SEQ ID NO: 723159 - RNA, 18 nt, Human
ccuccucccuuuucuucc

SEQ ID NO: 723160 - RNA, 19 nt, Human
ccucggggaagcccccagg

SEQ ID NO: 723161 - RNA, 18 nt, Human
ccugcagcuccgccagcu

SEQ ID NO: 723162 - RNA, 23 nt, Human
ccuggccaccuuuucucucccca

SEQ ID NO: 723163 - RNA, 19 nt, Human
ccuggccccacugcccaag

SEQ ID NO: 723164 - RNA, 20 nt, Human
ccuggccccacugcccaagg

SEQ ID NO: 723165 - RNA, 22 nt, Human
cgacuucucagagaugcauccu

SEQ ID NO: 723166 - RNA, 20 nt, Human
cgggaugagcaaagagcaag

SEQ ID NO: 723167 - RNA, 23 nt, Human
cgggaugagcaaagagcaagggg

SEQ ID NO: 723168 - RNA, 23 nt, Human
cuaggauccuggccaccuuuucu

SEQ ID NO: 723169 - RNA, 21 nt, Human
cucaaggaaggaaaagccaaa

SEQ ID NO: 723170 - RNA, 22 nt, Human
cucaaggaaggaaaagccaaac

SEQ ID NO: 723171 - RNA, 23 nt, Human
cucacagcagcagcugacgauga

SEQ ID NO: 723172 - RNA, 18 nt, Human
cuccccccaccacccccc

SEQ ID NO: 723173 - RNA, 21 nt, Human
cuccccccaccaccccccacc

SEQ ID NO: 723174 - RNA, 23 nt, Human
cuccccccaccaccccccaccgc

SEQ ID NO: 723175 - RNA, 25 nt, Human
cuccccccaccaccccccaccgccu

SEQ ID NO: 723176 - RNA, 24 nt, Human
cucggggaagcccccaggcaggcc

SEQ ID NO: 723177 - RNA, 20 nt, Human
cucucaggccacguguuccu

SEQ ID NO: 723178 - RNA, 22 nt, Human
cucugauuugguuugacuggcu

SEQ ID NO: 723179 - RNA, 21 nt, Human
cucugcagccagaggcaccuc

SEQ ID NO: 723180 - RNA, 22 nt, Human
cucuggcagcucuagugccucu

SEQ ID NO: 723181 - RNA, 28 nt, Human
cucugugcuugugagcacccgcuccccc

SEQ ID NO: 723182 - RNA, 24 nt, Human
cucuugcccguguuagccucacag

SEQ ID NO: 723183 - RNA, 22 nt, Human
cugaagagacugaagggaagca

SEQ ID NO: 723184 - RNA, 23 nt, Human
cugcauauccauccugugguccu

SEQ ID NO: 723185 - RNA, 21 nt, Human
cugccccugcugcaaagaccc

SEQ ID NO: 723186 - RNA, 21 nt, Human
cugccccugcugcaaagaccc

SEQ ID NO: 723187 - RNA, 19 nt, Human
cuggagcuuucugggcugc

SEQ ID NO: 723188 - RNA, 22 nt, Human
cuggagcuuucugggcugccug

SEQ ID NO: 723189 - RNA, 19 nt, Human
cuggcagcucuagugccuc

SEQ ID NO: 723190 - RNA, 18 nt, Human
cuggccaccaaggauucc

SEQ ID NO: 723191 - RNA, 23 nt, Human
cuguccacaaacuguagggccag

SEQ ID NO: 723192 - RNA, 19 nt, Human
gacaguggaggaguccugg

SEQ ID NO: 723193 - RNA, 24 nt, Human
gacuaccuuccaaagacuccagga

SEQ ID NO: 723194 - RNA, 21 nt, Human
gacuauacaaacaggacaacu

SEQ ID NO: 723195 - RNA, 22 nt, Human
gacuuaagaaaggccaaggcag

SEQ ID NO: 723196 - RNA, 21 nt, Human
gagaacgguagaaagacuggc

SEQ ID NO: 723197 - RNA, 18 nt, Human
gagacugaagggaagcag

SEQ ID NO: 723198 - RNA, 24 nt, Human
gagagggugguguggcuggcaaca

SEQ ID NO: 723199 - RNA, 20 nt, Human
gagauucucuugggccagaa

SEQ ID NO: 723200 - RNA, 21 nt, Human
gagcaaggggcucacagcagc

SEQ ID NO: 723201 - RNA, 22 nt, Human
gagcugcagagcuuucuuuagg

SEQ ID NO: 723202 - RNA, 20 nt, Human
gcagagcuuucuuuaggccc

SEQ ID NO: 723203 - RNA, 22 nt, Human
gcagagcuuucuuuaggcccca

SEQ ID NO: 723204 - RNA, 24 nt, Human
gcagagcuuucuuuaggccccaca

SEQ ID NO: 723205 - RNA, 24 nt, Human
gcaucgccaucacugcuguugccc

SEQ ID NO: 723206 - RNA, 24 nt, Human
gccaccuuuucucuccccagacuc

SEQ ID NO: 723207 - RNA, 23 nt, Human
gcccguacacuucagugagcuga

SEQ ID NO: 723208 - RNA, 20 nt, Human
gccucuggagcuuucugggc

SEQ ID NO: 723209 - RNA, 19 nt, Human
gcuccccccaccacccccc

SEQ ID NO: 723210 - RNA, 21 nt, Human
gcuccccccaccaccccccac

SEQ ID NO: 723211 - RNA, 20 nt, Human
gcugcaguaacugaagaagg

SEQ ID NO: 723212 - RNA, 23 nt, Human
gcuugggagaagagacaccugga

SEQ ID NO: 723213 - RNA, 23 nt, Human
ggaaaacagguuuauuccacagg

SEQ ID NO: 723214 - RNA, 24 nt, Human
ggaaaagccaaacuuuagcccaaa

SEQ ID NO: 723215 - RNA, 23 nt, Human
ggaaacagguauugccaaccuuc

SEQ ID NO: 723216 - RNA, 20 nt, Human
ggaaauccacaggguuucug

SEQ ID NO: 723217 - RNA, 21 nt, Human
ggaaggccucaaacagaggga

SEQ ID NO: 723218 - RNA, 19 nt, Human
ggagcucgguguagaaagu

SEQ ID NO: 723219 - RNA, 19 nt, Human
ggaggaguccugggcucug

SEQ ID NO: 723220 - RNA, 18 nt, Human
ggaugagcaaagagcaag

SEQ ID NO: 723221 - RNA, 22 nt, Human
ggcagacucagaagggcaagca

SEQ ID NO: 723222 - RNA, 25 nt, Human
ggcaucgccaucacugcuguugccc

SEQ ID NO: 723223 - RNA, 23 nt, Human
ggcucccaggcagccaggaggaa

SEQ ID NO: 723224 - RNA, 18 nt, Human
gggaaggaaggaaaagag

SEQ ID NO: 723225 - RNA, 20 nt, Human
gggccagaagggcugccagu

SEQ ID NO: 723226 - RNA, 22 nt, Human
gggcuuucuuuccaauguaggg

SEQ ID NO: 723227 - RNA, 19 nt, Human
gguuagccuuucuuucccu

SEQ ID NO: 723228 - RNA, 20 nt, Human
gugguccugaagagacugaa

SEQ ID NO: 723229 - RNA, 24 nt, Human
guuuuggugguguuuuucuguugg

SEQ ID NO: 723230 - RNA, 19 nt, Human
uaaaguaaagugccucuuu

SEQ ID NO: 723231 - RNA, 19 nt, Human
uaagaaaggccaaggcaga

SEQ ID NO: 723232 - RNA, 19 nt, Human
uaagacagagaaaagaagc

SEQ ID NO: 723233 - RNA, 20 nt, Human
uaagaggagcuacuaaagca

SEQ ID NO: 723234 - RNA, 18 nt, Human
uacagucuuucuccucuc

SEQ ID NO: 723235 - RNA, 19 nt, Human
uagaaagugggaggucauc

SEQ ID NO: 723236 - RNA, 21 nt, Human
uagagaaacauggcacuugcg

SEQ ID NO: 723237 - RNA, 25 nt, Human
uagggcagagccagagaagucccac

SEQ ID NO: 723238 - RNA, 19 nt, Human
uagggccagccgacuucuc

SEQ ID NO: 723239 - RNA, 22 nt, Human
uauacacauacccacagcuuuc

SEQ ID NO: 723240 - RNA, 18 nt, Human
uauuguggcuuguuugua

SEQ ID NO: 723241 - RNA, 22 nt, Human
ucaaauagguaaaaucgaguca

SEQ ID NO: 723242 - RNA, 23 nt, Human
ucacugcuguugcccagcucuca

SEQ ID NO: 723243 - RNA, 23 nt, Human
ucagaugccugcaccugaaaacc

SEQ ID NO: 723244 - RNA, 24 nt, Human
uccaaccuagggcagagccagaga

SEQ ID NO: 723245 - RNA, 24 nt, Human
uccacagguagcacuugccccaaa

SEQ ID NO: 723246 - RNA, 20 nt, Human
uccaccaaccagaugugacu

SEQ ID NO: 723247 - RNA, 18 nt, Human
uccagacaaacacacaua

SEQ ID NO: 723248 - RNA, 23 nt, Human
uccagaggcccaauuccaaagcc

SEQ ID NO: 723249 - RNA, 21 nt, Human
uccauccugugguccugaaga

SEQ ID NO: 723250 - RNA, 18 nt, Human
uccaucugccugcugccu

SEQ ID NO: 723251 - RNA, 18 nt, Human
ucccauucucucacccac

SEQ ID NO: 723252 - RNA, 18 nt, Human
uccccccaccacccccca

SEQ ID NO: 723253 - RNA, 21 nt, Human
uccccccaccaccccccaccg

SEQ ID NO: 723254 - RNA, 19 nt, Human
uccugggcucuggcagcuc

SEQ ID NO: 723255 - RNA, 20 nt, Human
uccuuccaugacaagcuggg

SEQ ID NO: 723256 - RNA, 23 nt, Human
ucgccaucacugcuguugcccag

SEQ ID NO: 723257 - RNA, 19 nt, Human
ucuauccgucgaccccgcc

SEQ ID NO: 723258 - RNA, 25 nt, Human
ucuccagacaaacacacauagauuc

SEQ ID NO: 723259 - RNA, 21 nt, Human
ucucugauuugguuugacugg

SEQ ID NO: 723260 - RNA, 23 nt, Human
ucucuggccaccaaggauuccuc

SEQ ID NO: 723261 - RNA, 18 nt, Human
ucucugggggaacuuguc

SEQ ID NO: 723262 - RNA, 19 nt, Human
ucuguaaaagcccucuagg

SEQ ID NO: 723263 - RNA, 21 nt, Human
ucuguugcagcagaacaaagg

SEQ ID NO: 723264 - RNA, 18 nt, Human
ugaagggaagcaggaggg

SEQ ID NO: 723265 - RNA, 24 nt, Human
ugaagggaagcaggagggaaaagg

SEQ ID NO: 723266 - RNA, 19 nt, Human
ugaccccacaugucugcau

SEQ ID NO: 723267 - RNA, 22 nt, Human
ugaccuauucauuauucccuca

SEQ ID NO: 723268 - RNA, 24 nt, Human
ugaccuuuaaccucggggaagccc

SEQ ID NO: 723269 - RNA, 18 nt, Human
ugacucaaggaaggaaaa

SEQ ID NO: 723270 - RNA, 21 nt, Human
ugacucccuuuucuaagacag

SEQ ID NO: 723271 - RNA, 20 nt, Human
ugagcgugacuuaagaaagg

SEQ ID NO: 723272 - RNA, 24 nt, Human
ugagggcugggagugaugaguccc

SEQ ID NO: 723273 - RNA, 21 nt, Human
ugagguagaaagaacuggcca

SEQ ID NO: 723274 - RNA, 24 nt, Human
ugauggggucuguuugcccagguu

SEQ ID NO: 723275 - RNA, 21 nt, Human
ugcaguaggccagaaucucca

SEQ ID NO: 723276 - RNA, 23 nt, Human
ugccugauggggucuguuugccc

SEQ ID NO: 723277 - RNA, 23 nt, Human
ugccugcaccugaaaacccuucu

SEQ ID NO: 723278 - RNA, 22 nt, Human
ugcgugaaagguccuauccuug

SEQ ID NO: 723279 - RNA, 24 nt, Human
ugcucaaaucguccacaucucgcc

SEQ ID NO: 723280 - RNA, 21 nt, Human
uggaaaacagguuuauuccac

SEQ ID NO: 723281 - RNA, 19 nt, Human
uggaaugggaaggaaggaa

SEQ ID NO: 723282 - RNA, 18 nt, Human
ugggaagagcucuguugc

SEQ ID NO: 723283 - RNA, 22 nt, Human
ugggaagagcucuguugcagca

SEQ ID NO: 723284 - RNA, 25 nt, Human
ugggaagagcucuguugcagcagaa

SEQ ID NO: 723285 - RNA, 21 nt, Human
ugggagagggugguguggcug

SEQ ID NO: 723286 - RNA, 22 nt, Human
ugggagagggugguguggcugg

SEQ ID NO: 723287 - RNA, 21 nt, Human
ugggagagggugguguggcuu

SEQ ID NO: 723288 - RNA, 20 nt, Human
ugggagugaugagucccuug

SEQ ID NO: 723289 - RNA, 24 nt, Human
uggggaggaguagggcuuucuuuc

SEQ ID NO: 723290 - RNA, 21 nt, Human
ugguguggcuggcaacacagu

SEQ ID NO: 723291 - RNA, 22 nt, Human
ugguguuuuucuguuggagacu

SEQ ID NO: 723292 - RNA, 21 nt, Human
ugucuauaagaaugccacagc

SEQ ID NO: 723293 - RNA, 18 nt, Human
ugugguccugaagagacu

SEQ ID NO: 723294 - RNA, 21 nt, Human
uguucagaaaugcuugggcgu

SEQ ID NO: 723295 - RNA, 24 nt, Human
uguuccagaaggcgcucacacucc

SEQ ID NO: 723296 - RNA, 24 nt, Human
uuaguccuucuuggacagccgugu

SEQ ID NO: 723297 - RNA, 19 nt, Human
uucacugccagacucugcc

SEQ ID NO: 723298 - RNA, 23 nt, Human
uugaagucacugaguaugacaca

SEQ ID NO: 723299 - RNA, 23 nt, Human
uugcagcagaacaaagggauuuc

SEQ ID NO: 723300 - RNA, 18 nt, Human
uugccccaaagccaucuc

SEQ ID NO: 723301 - RNA, 21 nt, Human
uugcccgggaaggcaaguagg

SEQ ID NO: 723302 - RNA, 22 nt, Human
aaaagaaacuggauauuuauuu

SEQ ID NO: 723303 - RNA, 25 nt, Human
aaaaggaaaaaaaaaugugaaaaaa

SEQ ID NO: 723304 - RNA, 19 nt, Human
aaacuucucuugaguugag

SEQ ID NO: 723305 - RNA, 18 nt, Human
aaaggaacuugaacucca

SEQ ID NO: 723306 - RNA, 23 nt, Human
aaaggggaucaucccaggaaggg

SEQ ID NO: 723307 - RNA, 19 nt, Human
aacaaaagucauggcuuua

SEQ ID NO: 723308 - RNA, 19 nt, Human
aacaagcaccaucacucuc

SEQ ID NO: 723309 - RNA, 21 nt, Human
aaccaagguaauauguccuuc

SEQ ID NO: 723310 - RNA, 28 nt, Human
aagcaaacaaaagucauggcuuuaacaa

SEQ ID NO: 723311 - RNA, 24 nt, Human
aaggaaaaaaaaaugugaaaaaaa

SEQ ID NO: 723312 - RNA, 19 nt, Human
aagggaaagggaaaagggg

SEQ ID NO: 723313 - RNA, 21 nt, Human
acaaaacagaacaguacagaa

SEQ ID NO: 723314 - RNA, 24 nt, Human
acaaaacagaacaguacagaacuc

SEQ ID NO: 723315 - RNA, 20 nt, Human
acacauuuuuuuuuccuuug

SEQ ID NO: 723316 - RNA, 20 nt, Human
acagaggagagaagccugaa

SEQ ID NO: 723317 - RNA, 22 nt, Human
acaugugaaucaugaguugaau

SEQ ID NO: 723318 - RNA, 26 nt, Human
acccuggcgaccgcccgcucucgcug

SEQ ID NO: 723319 - RNA, 18 nt, Human
agaacaguacagaacucg

SEQ ID NO: 723320 - RNA, 22 nt, Human
agaucaugcuccugucagcgcg

SEQ ID NO: 723321 - RNA, 22 nt, Human
agauggagaggaaaacaaagag

SEQ ID NO: 723322 - RNA, 24 nt, Human
agccucauccuucaugcuaccuca

SEQ ID NO: 723323 - RNA, 23 nt, Human
aggaaaaaaaaaugugaaaaaaa

SEQ ID NO: 723324 - RNA, 21 nt, Human
aggaaaaggaaaaaaaaaugu

SEQ ID NO: 723325 - RNA, 19 nt, Human
aggaaaaugucaggcgagg

SEQ ID NO: 723326 - RNA, 21 nt, Human
aguacuauguugcccuugauc

SEQ ID NO: 723327 - RNA, 21 nt, Human
auaagacaaugggggcugaag

SEQ ID NO: 723328 - RNA, 24 nt, Human
auacacagaccuugagacagcugu

SEQ ID NO: 723329 - RNA, 18 nt, Human
auagaaauggaaguaaac

SEQ ID NO: 723330 - RNA, 25 nt, Human
auauguccuucuucccuuucuccag

SEQ ID NO: 723331 - RNA, 24 nt, Human
auauguuuucacugaaugcuaaaa

SEQ ID NO: 723332 - RNA, 19 nt, Human
aucgcuuuauccucccgcu

SEQ ID NO: 723333 - RNA, 18 nt, Human
aucuuggcagcccuggcc

SEQ ID NO: 723334 - RNA, 21 nt, Human
auugaaaacagaggagagaag

SEQ ID NO: 723335 - RNA, 24 nt, Human
caaguguagcuuaacuugcauuca

SEQ ID NO: 723336 - RNA, 19 nt, Human
cacugucacggcggagggg

SEQ ID NO: 723337 - RNA, 19 nt, Human
cagcagguguuuucuugcu

SEQ ID NO: 723338 - RNA, 22 nt, Human
cagcagguguuuucuugcuguu

SEQ ID NO: 723339 - RNA, 21 nt, Human
cagcgcgcagauuagagcugg

SEQ ID NO: 723340 - RNA, 21 nt, Human
cagcuccuaguucuggaguug

SEQ ID NO: 723341 - RNA, 24 nt, Human
cagcuuccuaguguggucccgaug

SEQ ID NO: 723342 - RNA, 27 nt, Human
cauugcauugcaucagcagcagguguu

SEQ ID NO: 723343 - RNA, 19 nt, Human
ccacaugugaaucaugagu

SEQ ID NO: 723344 - RNA, 21 nt, Human
ccaggaaaaugucaggcgagg

SEQ ID NO: 723345 - RNA, 18 nt, Human
cccuccuaaacuucucuu

SEQ ID NO: 723346 - RNA, 18 nt, Human
cccuggccugggcacaga

SEQ ID NO: 723347 - RNA, 18 nt, Human
ccuggagugcuuaaugcu

SEQ ID NO: 723348 - RNA, 18 nt, Human
cgaggagggggccgguuc

SEQ ID NO: 723349 - RNA, 20 nt, Human
cgaggagggggccgguucgg

SEQ ID NO: 723350 - RNA, 19 nt, Human
cgcuuuauccucccgcuug

SEQ ID NO: 723351 - RNA, 22 nt, Human
cuaacaagcaccaucacucucu

SEQ ID NO: 723352 - RNA, 19 nt, Human
cucgcugcgcucuggcugc

SEQ ID NO: 723353 - RNA, 22 nt, Human
cugaaugcuaaaagaaacugga

SEQ ID NO: 723354 - RNA, 18 nt, Human
cugcagcuuccuagugug

SEQ ID NO: 723355 - RNA, 20 nt, Human
cugcgcucuggcugccgggu

SEQ ID NO: 723356 - RNA, 21 nt, Human
cuggcuggggaggggacccug

SEQ ID NO: 723357 - RNA, 18 nt, Human
cuugaacuccaugauuaa

SEQ ID NO: 723358 - RNA, 27 nt, Human
gaaaacagaggagagaagccgguaccc

SEQ ID NO: 723359 - RNA, 20 nt, Human
gacccuggcgaccgcccgcu

SEQ ID NO: 723360 - RNA, 22 nt, Human
gagccugcagcuguuuuucuga

SEQ ID NO: 723361 - RNA, 19 nt, Human
gaucuggccaccugcuuug

SEQ ID NO: 723362 - RNA, 19 nt, Human
gcuccuaguucuggaguug

SEQ ID NO: 723363 - RNA, 19 nt, Human
gcuuccuaguguggucccg

SEQ ID NO: 723364 - RNA, 24 nt, Human
ggacaugugcacaaguuuguccuu

SEQ ID NO: 723365 - RNA, 22 nt, Human
gggaaaaggggaucaucccagg

SEQ ID NO: 723366 - RNA, 18 nt, Human
gggaaagggaaaagggga

SEQ ID NO: 723367 - RNA, 22 nt, Human
ggugccccgagagagcggaggc

SEQ ID NO: 723368 - RNA, 18 nt, Human
gguuuauuucaaauguag

SEQ ID NO: 723369 - RNA, 22 nt, Human
guagauggagaggaaaacaaag

SEQ ID NO: 723370 - RNA, 21 nt, Human
uaacaagcaccaucacucucu

SEQ ID NO: 723371 - RNA, 18 nt, Human
uaacgcagcacacuucau

SEQ ID NO: 723372 - RNA, 21 nt, Human
uaagacaaugggggcugaagc

SEQ ID NO: 723373 - RNA, 19 nt, Human
uacacauuuuuuuuuccuu

SEQ ID NO: 723374 - RNA, 19 nt, Human
uaccaaaaucaaaggagag

SEQ ID NO: 723375 - RNA, 23 nt, Human
uagaucuuagaagaaggcaguuc

SEQ ID NO: 723376 - RNA, 24 nt, Human
uagggaugcucccccuccuaaacu

SEQ ID NO: 723377 - RNA, 20 nt, Human
uauuucaaauguaguugaga

SEQ ID NO: 723378 - RNA, 21 nt, Human
uauuucaaauguaguugagag

SEQ ID NO: 723379 - RNA, 20 nt, Human
ucagagucgcacgguguucc

SEQ ID NO: 723380 - RNA, 24 nt, Human
ucaugcacagcuuuugucaauccu

SEQ ID NO: 723381 - RNA, 22 nt, Human
ucccuaacaagcaccaucacuc

SEQ ID NO: 723382 - RNA, 25 nt, Human
ucccuucaaugauagaaauggaagu

SEQ ID NO: 723383 - RNA, 19 nt, Human
uccguaauagccacagccg

SEQ ID NO: 723384 - RNA, 18 nt, Human
uccucccgcuugcauccc

SEQ ID NO: 723385 - RNA, 22 nt, Human
ucgcuuuauccucccgcuugca

SEQ ID NO: 723386 - RNA, 20 nt, Human
ucggcgagugugugcgcgag

SEQ ID NO: 723387 - RNA, 19 nt, Human
ucucuugaguugagcccac

SEQ ID NO: 723388 - RNA, 26 nt, Human
ugaaaaaaaaauaucaaaguuuuaaa

SEQ ID NO: 723389 - RNA, 22 nt, Human
ugagacagcuguuuuuuaauau

SEQ ID NO: 723390 - RNA, 22 nt, Human
ugagcccacaauccccacaacc

SEQ ID NO: 723391 - RNA, 19 nt, Human
ugaguugagcccacaaucc

SEQ ID NO: 723392 - RNA, 24 nt, Human
ugcaaaggaacuugaacuccauga

SEQ ID NO: 723393 - RNA, 21 nt, Human
uggaaguaaacauuuauuacc

SEQ ID NO: 723394 - RNA, 19 nt, Human
uggcagcccuggccugggc

SEQ ID NO: 723395 - RNA, 20 nt, Human
uggcagcccuggccugggca

SEQ ID NO: 723396 - RNA, 18 nt, Human
ugucacuggccaggaaaa

SEQ ID NO: 723397 - RNA, 22 nt, Human
uguggcuagacuaaacaaaaca

SEQ ID NO: 723398 - RNA, 22 nt, Human
uguuaaucguuagaagugucau

SEQ ID NO: 723399 - RNA, 23 nt, Human
uuggguuuauuucaaauguaguu

SEQ ID NO: 723400 - RNA, 18 nt, Human
uuugcaccguaugucuag

SEQ ID NO: 723401 - RNA, 19 nt, Human
uuugcaccguaugucuagg

SEQ ID NO: 723402 - RNA, 22 nt, Human
uuuuaauauugcauacaggcua

SEQ ID NO: 723403 - RNA, 22 nt, Human
aaaagaacuugucacaaguuug

SEQ ID NO: 723404 - RNA, 19 nt, Human
aaacaggcauagcugagac

SEQ ID NO: 723405 - RNA, 23 nt, Human
aaacaggcauagcugagaccaga

SEQ ID NO: 723406 - RNA, 19 nt, Human
aaagaacuugucacaaguu

SEQ ID NO: 723407 - RNA, 20 nt, Human
aacacaccugcccccagccu

SEQ ID NO: 723408 - RNA, 21 nt, Human
aaccaggaggagcagugggcu

SEQ ID NO: 723409 - RNA, 19 nt, Human
aaccagggcccuuagcaca

SEQ ID NO: 723410 - RNA, 25 nt, Human
aaccucguaaccaaaugggaagcug

SEQ ID NO: 723411 - RNA, 18 nt, Human
aagaaguauaaacaaccc

SEQ ID NO: 723412 - RNA, 18 nt, Human
aagucucccucugccuuc

SEQ ID NO: 723413 - RNA, 19 nt, Human
aaucauugucaccucuuug

SEQ ID NO: 723414 - RNA, 20 nt, Human
acaccugagacuugguccaa

SEQ ID NO: 723415 - RNA, 19 nt, Human
accagacacaguuccccca

SEQ ID NO: 723416 - RNA, 19 nt, Human
accagccucaaagguggau

SEQ ID NO: 723417 - RNA, 19 nt, Human
accaggaggagcagugggc

SEQ ID NO: 723418 - RNA, 23 nt, Human
accggcagcuuacuaccagccca

SEQ ID NO: 723419 - RNA, 24 nt, Human
accucguaaccaaaugggaagcug

SEQ ID NO: 723420 - RNA, 19 nt, Human
accuugggugcugcccugg

SEQ ID NO: 723421 - RNA, 19 nt, Human
accuugggugcugcccugg

SEQ ID NO: 723422 - RNA, 22 nt, Human
acuacagagagccaggcaggac

SEQ ID NO: 723423 - RNA, 21 nt, Human
acugcucacuucuguuacaga

SEQ ID NO: 723424 - RNA, 22 nt, Human
acuggcuaccaguauuccuucc

SEQ ID NO: 723425 - RNA, 26 nt, Human
agaaaccaaucaagaaguauaaacaa

SEQ ID NO: 723426 - RNA, 23 nt, Human
agaagccaagucucccucugccu

SEQ ID NO: 723427 - RNA, 24 nt, Human
agaagccaagucucccucugccuu

SEQ ID NO: 723428 - RNA, 22 nt, Human
agacuugguccaagcaccuuuc

SEQ ID NO: 723429 - RNA, 18 nt, Human
agagaaaauguuaggguc

SEQ ID NO: 723430 - RNA, 24 nt, Human
agaggaagagguaaggcccaggug

SEQ ID NO: 723431 - RNA, 19 nt, Human
agauaguaaauucccuggc

SEQ ID NO: 723432 - RNA, 23 nt, Human
agcagccagggagaggaacagcu

SEQ ID NO: 723433 - RNA, 24 nt, Human
agcagccagggagaggaacagcuu

SEQ ID NO: 723434 - RNA, 19 nt, Human
agcagugggcuccuucaag

SEQ ID NO: 723435 - RNA, 19 nt, Human
agccucuaaguuuagcccu

SEQ ID NO: 723436 - RNA, 20 nt, Human
agccugggucaguaugguac

SEQ ID NO: 723437 - RNA, 23 nt, Human
agccugggucaguaugguacagu

SEQ ID NO: 723438 - RNA, 21 nt, Human
aggcaauaaaaauaaauuguc

SEQ ID NO: 723439 - RNA, 22 nt, Human
aggcagaaguaaagcccaagca

SEQ ID NO: 723440 - RNA, 22 nt, Human
agggcccuuagcacaaaagggc

SEQ ID NO: 723441 - RNA, 20 nt, Human
agggguugugcugggccgug

SEQ ID NO: 723442 - RNA, 18 nt, Human
agguaaggcccaggugua

SEQ ID NO: 723443 - RNA, 22 nt, Human
aggucguggcaagggccugagg

SEQ ID NO: 723444 - RNA, 24 nt, Human
agguuaugauaaagauagacacua

SEQ ID NO: 723445 - RNA, 24 nt, Human
agucagggccuggaaaagaucuuc

SEQ ID NO: 723446 - RNA, 22 nt, Human
auaaauugucucacuaaccuug

SEQ ID NO: 723447 - RNA, 23 nt, Human
auaaauugucucacuaaccuugg

SEQ ID NO: 723448 - RNA, 22 nt, Human
aucauuacacucgccaugcagu

SEQ ID NO: 723449 - RNA, 20 nt, Human
auccagagcagcagccaggg

SEQ ID NO: 723450 - RNA, 20 nt, Human
auccuggagacaaaggaccc

SEQ ID NO: 723451 - RNA, 23 nt, Human
aucuaaccagggauuugccaaca

SEQ ID NO: 723452 - RNA, 22 nt, Human
caaagcaccaacucagggugcc

SEQ ID NO: 723453 - RNA, 19 nt, Human
caaccagaguuccuccagg

SEQ ID NO: 723454 - RNA, 25 nt, Human
caacucugguucuuucauuuuccag

SEQ ID NO: 723455 - RNA, 24 nt, Human
caauaaaaauaaauugucucacua

SEQ ID NO: 723456 - RNA, 22 nt, Human
cacacauaaagcagaagugugc

SEQ ID NO: 723457 - RNA, 22 nt, Human
cacaccugagacuugguccaag

SEQ ID NO: 723458 - RNA, 30 nt, Human
cacccuagaugauucuuccccaaagacggg

SEQ ID NO: 723459 - RNA, 18 nt, Human
cacccugcccuccacccu

SEQ ID NO: 723460 - RNA, 20 nt, Human
caccggcagcuuacuaccag

SEQ ID NO: 723461 - RNA, 18 nt, Human
caccguuucccuucuugg

SEQ ID NO: 723462 - RNA, 19 nt, Human
cagcagagggacucucaca

SEQ ID NO: 723463 - RNA, 22 nt, Human
cagcagccagggagaggaacag

SEQ ID NO: 723464 - RNA, 24 nt, Human
cagccaccaguucaggccauacua

SEQ ID NO: 723465 - RNA, 19 nt, Human
cagccagggagaggaacag

SEQ ID NO: 723466 - RNA, 20 nt, Human
cagcccaggaggggacuuug

SEQ ID NO: 723467 - RNA, 19 nt, Human
cagcgugccaucaugcugc

SEQ ID NO: 723468 - RNA, 24 nt, Human
cagcgugccaucaugcugcuggag

SEQ ID NO: 723469 - RNA, 18 nt, Human
caggcugcagcagaacaa

SEQ ID NO: 723470 - RNA, 19 nt, Human
caguccucuuucccauugu

SEQ ID NO: 723471 - RNA, 19 nt, Human
cauagcugagaccagaagc

SEQ ID NO: 723472 - RNA, 19 nt, Human
caugcccuugaagcaaacc

SEQ ID NO: 723473 - RNA, 20 nt, Human
cauuauagggcacguuauag

SEQ ID NO: 723474 - RNA, 19 nt, Human
ccaaaagaacuugucacaa

SEQ ID NO: 723475 - RNA, 20 nt, Human
ccacuacacucuagcagccu

SEQ ID NO: 723476 - RNA, 18 nt, Human
ccacucagagggaggcag

SEQ ID NO: 723477 - RNA, 21 nt, Human
ccacucccuacagaaacccug

SEQ ID NO: 723478 - RNA, 19 nt, Human
ccaguccacauaacacugu

SEQ ID NO: 723479 - RNA, 22 nt, Human
ccaguccacauaacacugugcc

SEQ ID NO: 723480 - RNA, 19 nt, Human
ccaugcccuugaagcaaac

SEQ ID NO: 723481 - RNA, 20 nt, Human
cccaaagacgggguuuugaa

SEQ ID NO: 723482 - RNA, 22 nt, Human
cccacacagaacagaacccagg

SEQ ID NO: 723483 - RNA, 24 nt, Human
cccagggcaaaugauuguguucca

SEQ ID NO: 723484 - RNA, 19 nt, Human
ccccacaggcccacacaga

SEQ ID NO: 723485 - RNA, 21 nt, Human
cccccacucccuacagaaacc

SEQ ID NO: 723486 - RNA, 25 nt, Human
cccuccccaucaucauuacacucgc

SEQ ID NO: 723487 - RNA, 21 nt, Human
cccuguaccuucccucuuucc

SEQ ID NO: 723488 - RNA, 21 nt, Human
ccuacagaaacccugugcuaa

SEQ ID NO: 723489 - RNA, 26 nt, Human
ccuacuguguaaauguagauuuugga

SEQ ID NO: 723490 - RNA, 19 nt, Human
ccuagcaucuccuuccacg

SEQ ID NO: 723491 - RNA, 23 nt, Human
ccucaaagguggauguaacagaa

SEQ ID NO: 723492 - RNA, 19 nt, Human
ccucucaucugacuggggc

SEQ ID NO: 723493 - RNA, 22 nt, Human
ccucucccaguccucuuuccca

SEQ ID NO: 723494 - RNA, 19 nt, Human
ccugauccaaagcaccaac

SEQ ID NO: 723495 - RNA, 19 nt, Human
ccugcagcugccccacuuc

SEQ ID NO: 723496 - RNA, 23 nt, Human
ccugcccacccugcccuccaccc

SEQ ID NO: 723497 - RNA, 21 nt, Human
ccuggcacaggaggacuucaa

SEQ ID NO: 723498 - RNA, 23 nt, Human
ccugugcuaaggcaaaguugaga

SEQ ID NO: 723499 - RNA, 24 nt, Human
ccuugggugcugcccugggccgcc

SEQ ID NO: 723500 - RNA, 20 nt, Human
cggggaccuggcaggaaucc

SEQ ID NO: 723501 - RNA, 18 nt, Human
cguggcaagggccugagg

SEQ ID NO: 723502 - RNA, 22 nt, Human
cguguucaucucaacaccagga

SEQ ID NO: 723503 - RNA, 19 nt, Human
cuacugcacacccaccauc

SEQ ID NO: 723504 - RNA, 18 nt, Human
cuagcagcccccacuccc

SEQ ID NO: 723505 - RNA, 21 nt, Human
cucacuucuguuacagagcca

SEQ ID NO: 723506 - RNA, 24 nt, Human
cucagggaccgcuggguuaucucu

SEQ ID NO: 723507 - RNA, 23 nt, Human
cuccaacacaccugcccccagcc

SEQ ID NO: 723508 - RNA, 22 nt, Human
cuccccacaggcccacacagaa

SEQ ID NO: 723509 - RNA, 23 nt, Human
cuccuuccacgcucccaggagcu

SEQ ID NO: 723510 - RNA, 20 nt, Human
cugagacuugguccaagcac

SEQ ID NO: 723511 - RNA, 22 nt, Human
cugaggccuguuccucacaggc

SEQ ID NO: 723512 - RNA, 21 nt, Human
cugcugcccuuucgccugggc

SEQ ID NO: 723513 - RNA, 18 nt, Human
cuggaggcggcuggagcu

SEQ ID NO: 723514 - RNA, 20 nt, Human
cuggccauccagagcagcag

SEQ ID NO: 723515 - RNA, 24 nt, Human
cuggcuaccaguauuccuucccag

SEQ ID NO: 723516 - RNA, 19 nt, Human
cugggccuggggggcccca

SEQ ID NO: 723517 - RNA, 20 nt, Human
cuuccagguuaggcacugug

SEQ ID NO: 723518 - RNA, 22 nt, Human
cuuccugcccacccugcccucc

SEQ ID NO: 723519 - RNA, 22 nt, Human
cuugguccuucaguugccaaaa

SEQ ID NO: 723520 - RNA, 19 nt, Human
cuugucuagagacucccca

SEQ ID NO: 723521 - RNA, 21 nt, Human
cuuuaugcaacauacgucuuc

SEQ ID NO: 723522 - RNA, 19 nt, Human
gaagccaucugguucuuag

SEQ ID NO: 723523 - RNA, 20 nt, Human
gaauaggcucagcuccucua

SEQ ID NO: 723524 - RNA, 20 nt, Human
gacuccccacaggcccacac

SEQ ID NO: 723525 - RNA, 19 nt, Human
gagcugaagccaucugguu

SEQ ID NO: 723526 - RNA, 27 nt, Human
gaguuugcccagaccuugggugcugcc

SEQ ID NO: 723527 - RNA, 18 nt, Human
gcagcuuacuaccagccc

SEQ ID NO: 723528 - RNA, 23 nt, Human
gcaggaccaaggacacccagggc

SEQ ID NO: 723529 - RNA, 19 nt, Human
gcccagguguaggauagcc

SEQ ID NO: 723530 - RNA, 18 nt, Human
gcccugggccgccgagcc

SEQ ID NO: 723531 - RNA, 21 nt, Human
gcugggccguggggguggugc

SEQ ID NO: 723532 - RNA, 18 nt, Human
ggagagcugagauuacaa

SEQ ID NO: 723533 - RNA, 23 nt, Human
ggagguugcucaaaagggaugca

SEQ ID NO: 723534 - RNA, 20 nt, Human
ggcgacagcgugccaucaug

SEQ ID NO: 723535 - RNA, 18 nt, Human
gggaaacagaaaccagga

SEQ ID NO: 723536 - RNA, 22 nt, Human
gggaagcugcagccaggcuucc

SEQ ID NO: 723537 - RNA, 21 nt, Human
gggcgacagcgugccaucaug

SEQ ID NO: 723538 - RNA, 20 nt, Human
ggggcaccuguccuacuucu

SEQ ID NO: 723539 - RNA, 18 nt, Human
guaccuucccucuuuccu

SEQ ID NO: 723540 - RNA, 23 nt, Human
gucuacugcacacccaccaucac

SEQ ID NO: 723541 - RNA, 19 nt, Human
guggauccuggagacaaag

SEQ ID NO: 723542 - RNA, 20 nt, Human
guguuaaaaucuagggugug

SEQ ID NO: 723543 - RNA, 21 nt, Human
guguucaucucaacaccagga

SEQ ID NO: 723544 - RNA, 18 nt, Human
uaaagacagccauacugc

SEQ ID NO: 723545 - RNA, 21 nt, Human
uaaagcagaagugugccuugc

SEQ ID NO: 723546 - RNA, 21 nt, Human
uaaaguaaggaguacugauua

SEQ ID NO: 723547 - RNA, 21 nt, Human
uaaguccucccauccccauac

SEQ ID NO: 723548 - RNA, 18 nt, Human
uagaggaagagguaaggc

SEQ ID NO: 723549 - RNA, 23 nt, Human
uagcacaaaagggcagaagacac

SEQ ID NO: 723550 - RNA, 20 nt, Human
uagcagccucuaaguuuagc

SEQ ID NO: 723551 - RNA, 18 nt, Human
uagccaaccugcagauga

SEQ ID NO: 723552 - RNA, 18 nt, Human
uagccuaaguaggucgug

SEQ ID NO: 723553 - RNA, 19 nt, Human
uaggaugccaguagaggaa

SEQ ID NO: 723554 - RNA, 21 nt, Human
uagggguugugcugggccgug

SEQ ID NO: 723555 - RNA, 19 nt, Human
uauguucucauuucuccuc

SEQ ID NO: 723556 - RNA, 20 nt, Human
ucaaagguggauguaacaga

SEQ ID NO: 723557 - RNA, 21 nt, Human
ucacuuccugcccacccugcc

SEQ ID NO: 723558 - RNA, 19 nt, Human
ucagcuccucuagagagcu

SEQ ID NO: 723559 - RNA, 22 nt, Human
ucagggugccucuggaucagag

SEQ ID NO: 723560 - RNA, 19 nt, Human
ucaucccucuccccagcgc

SEQ ID NO: 723561 - RNA, 20 nt, Human
ucauuuuccagauaauuggu

SEQ ID NO: 723562 - RNA, 22 nt, Human
uccaagcaccuuuccuccaaga

SEQ ID NO: 723563 - RNA, 23 nt, Human
ucccaaaguggcuucccugaucc

SEQ ID NO: 723564 - RNA, 21 nt, Human
ucccucuuuccugcucuaggg

SEQ ID NO: 723565 - RNA, 21 nt, Human
ucccugucuauaagaagcuua

SEQ ID NO: 723566 - RNA, 21 nt, Human
uccggaacuaauccccucuag

SEQ ID NO: 723567 - RNA, 22 nt, Human
uccuggagauucuacacgccag

SEQ ID NO: 723568 - RNA, 20 nt, Human
uccuucccagagcuaggggc

SEQ ID NO: 723569 - RNA, 18 nt, Human
ucucccaguccucuuucc

SEQ ID NO: 723570 - RNA, 20 nt, Human
ucugccuucuucacuagcuc

SEQ ID NO: 723571 - RNA, 18 nt, Human
ucuuccccaaagacgggg

SEQ ID NO: 723572 - RNA, 24 nt, Human
ugaaaauggcaagaaaccaaucaa

SEQ ID NO: 723573 - RNA, 26 nt, Human
ugaagcaaaccacgugcacggggucc

SEQ ID NO: 723574 - RNA, 22 nt, Human
ugaccagacacaguucccccag

SEQ ID NO: 723575 - RNA, 25 nt, Human
ugaccagacacaguucccccagcca

SEQ ID NO: 723576 - RNA, 22 nt, Human
ugacccaugcccuugaagcaaa

SEQ ID NO: 723577 - RNA, 21 nt, Human
ugaggaaggggaaacagaaac

SEQ ID NO: 723578 - RNA, 22 nt, Human
ugcagccaggcuuccuggagau

SEQ ID NO: 723579 - RNA, 20 nt, Human
ugccaaaagaacuugucaca

SEQ ID NO: 723580 - RNA, 26 nt, Human
ugccaacacauuuguuagucuguaaa

SEQ ID NO: 723581 - RNA, 20 nt, Human
ugccagggccuagcaucucc

SEQ ID NO: 723582 - RNA, 25 nt, Human
ugccagggccuagcaucuccuucca

SEQ ID NO: 723583 - RNA, 24 nt, Human
ugcucuagggguugugcugggccg

SEQ ID NO: 723584 - RNA, 20 nt, Human
ugcuuauuaucauuuauucc

SEQ ID NO: 723585 - RNA, 18 nt, Human
uggagccaacagucucag

SEQ ID NO: 723586 - RNA, 18 nt, Human
uggaggcggcuggagcug

SEQ ID NO: 723587 - RNA, 20 nt, Human
uggaucagagugagcagcag

SEQ ID NO: 723588 - RNA, 18 nt, Human
uggcaagaaaccaaucaa

SEQ ID NO: 723589 - RNA, 19 nt, Human
uggcaagggccugaggccu

SEQ ID NO: 723590 - RNA, 23 nt, Human
uggcacaggaggacuucaagcag

SEQ ID NO: 723591 - RNA, 22 nt, Human
ugggaagcugcagccaggcuuc

SEQ ID NO: 723592 - RNA, 20 nt, Human
uggggaagugaugggauuag

SEQ ID NO: 723593 - RNA, 20 nt, Human
uggggagagugaggaagggg

SEQ ID NO: 723594 - RNA, 20 nt, Human
ugguguaaaucaccaaaaag

SEQ ID NO: 723595 - RNA, 21 nt, Human
uguagagaaugcucugcaguu

SEQ ID NO: 723596 - RNA, 18 nt, Human
ugucauugcagagcaugg

SEQ ID NO: 723597 - RNA, 20 nt, Human
uguuacagagccaagucaac

SEQ ID NO: 723598 - RNA, 21 nt, Human
uuauagugagaaugcaguguu

SEQ ID NO: 723599 - RNA, 30 nt, Human
uuauuaucauuuauuccuuacaacaacccc

SEQ ID NO: 723600 - RNA, 25 nt, Human
uucccaguuugguuucucuacaugu

SEQ ID NO: 723601 - RNA, 22 nt, Human
uucccuucuugguccuucaguu

SEQ ID NO: 723602 - RNA, 21 nt, Human
uugguccuucaguugccaaaa

SEQ ID NO: 723603 - RNA, 22 nt, Human
uuucucuacauguccugcagcu

SEQ ID NO: 723604 - RNA, 20 nt, Human
uuugccaacacauuuguuaa

SEQ ID NO: 723605 - RNA, 20 nt, Human
aaacacacaaugcaucuaac

SEQ ID NO: 723606 - RNA, 20 nt, Human
aaaggagcuuggggaggugg

SEQ ID NO: 723607 - RNA, 20 nt, Human
aacugcccccugcuuccccc

SEQ ID NO: 723608 - RNA, 20 nt, Human
aagcaagaaggggccuggag

SEQ ID NO: 723609 - RNA, 22 nt, Human
aagcacuuccuuucugacccag

SEQ ID NO: 723610 - RNA, 21 nt, Human
aagcucuccccucugcuuucc

SEQ ID NO: 723611 - RNA, 24 nt, Human
aagcugcuccccaggccucuucug

SEQ ID NO: 723612 - RNA, 21 nt, Human
aaggagcuuggggaggugggc

SEQ ID NO: 723613 - RNA, 22 nt, Human
aaggggccuggaguuagcuggg

SEQ ID NO: 723614 - RNA, 23 nt, Human
aaggggccuggaguuagcugggu

SEQ ID NO: 723615 - RNA, 19 nt, Human
aauuuguuuuuucuucccc

SEQ ID NO: 723616 - RNA, 18 nt, Human
acagaaacugcccccugc

SEQ ID NO: 723617 - RNA, 18 nt, Human
acaggcagcaccccccuc

SEQ ID NO: 723618 - RNA, 20 nt, Human
acccacaggcagcacccccc

SEQ ID NO: 723619 - RNA, 18 nt, Human
acucaaaaauggggccuc

SEQ ID NO: 723620 - RNA, 21 nt, Human
acugcccccugcuucccccua

SEQ ID NO: 723621 - RNA, 23 nt, Human
agaaacugcccccugcuuccccc

SEQ ID NO: 723622 - RNA, 22 nt, Human
agaaagggugguccugccuggu

SEQ ID NO: 723623 - RNA, 18 nt, Human
agaccugagaauguggug

SEQ ID NO: 723624 - RNA, 22 nt, Human
agagccaagccccuuagcccuc

SEQ ID NO: 723625 - RNA, 23 nt, Human
agcaacucuagccacugccaccu

SEQ ID NO: 723626 - RNA, 19 nt, Human
agcaguuuccccaccuugg

SEQ ID NO: 723627 - RNA, 18 nt, Human
agccaagccccuuagccc

SEQ ID NO: 723628 - RNA, 18 nt, Human
aggcagcaccccccucag

SEQ ID NO: 723629 - RNA, 21 nt, Human
aggggccuggaguuagcuggg

SEQ ID NO: 723630 - RNA, 20 nt, Human
aggguuucucaucacugaug

SEQ ID NO: 723631 - RNA, 20 nt, Human
agguaccagggugaagaggg

SEQ ID NO: 723632 - RNA, 18 nt, Human
aguccucuccuuuugaag

SEQ ID NO: 723633 - RNA, 20 nt, Human
agugcagugagugggaccuu

SEQ ID NO: 723634 - RNA, 19 nt, Human
aucuguugggcuccucccu

SEQ ID NO: 723635 - RNA, 21 nt, Human
auuguccucaaaccccaagga

SEQ ID NO: 723636 - RNA, 22 nt, Human
caacuaagcaacaugaccacca

SEQ ID NO: 723637 - RNA, 18 nt, Human
caagaaggggccuggagu

SEQ ID NO: 723638 - RNA, 19 nt, Human
cacaauccugaggccugcc

SEQ ID NO: 723639 - RNA, 19 nt, Human
cacaccacucccccagcug

SEQ ID NO: 723640 - RNA, 21 nt, Human
cacacugccugccucccccca

SEQ ID NO: 723641 - RNA, 23 nt, Human
cacacugccugccuccccccaga

SEQ ID NO: 723642 - RNA, 18 nt, Human
caccagggaggagggcug

SEQ ID NO: 723643 - RNA, 18 nt, Human
cacccaguucccacacca

SEQ ID NO: 723644 - RNA, 19 nt, Human
cacccaguucccacaccac

SEQ ID NO: 723645 - RNA, 20 nt, Human
cacgcaggcccuaagucucc

SEQ ID NO: 723646 - RNA, 26 nt, Human
cagcaccccccucaguagugcuuccc

SEQ ID NO: 723647 - RNA, 19 nt, Human
caggaaaaaccuccugaag

SEQ ID NO: 723648 - RNA, 24 nt, Human
cagggaccuguggcucagucugug

SEQ ID NO: 723649 - RNA, 23 nt, Human
cagucacacugccugccuccccc

SEQ ID NO: 723650 - RNA, 24 nt, Human
cauaggccucuuucccuaaaacac

SEQ ID NO: 723651 - RNA, 18 nt, Human
ccaacaaagaugaauagc

SEQ ID NO: 723652 - RNA, 18 nt, Human
ccacugccaccucccugc

SEQ ID NO: 723653 - RNA, 21 nt, Human
ccagcaggccuggcguuuucc

SEQ ID NO: 723654 - RNA, 22 nt, Human
cccacaggcagcaccccccuca

SEQ ID NO: 723655 - RNA, 25 nt, Human
cccagcgcugagcagaguccucucc

SEQ ID NO: 723656 - RNA, 19 nt, Human
cccauccaucucaaggcug

SEQ ID NO: 723657 - RNA, 18 nt, Human
ccccaaaagcugcucccc

SEQ ID NO: 723658 - RNA, 23 nt, Human
ccccaaaagcugcuccccaggcc

SEQ ID NO: 723659 - RNA, 26 nt, Human
ccccaaaagcugcuccccaggccucu

SEQ ID NO: 723660 - RNA, 20 nt, Human
ccccacugacucccugaccc

SEQ ID NO: 723661 - RNA, 23 nt, Human
ccccagagguaucgaacccugcc

SEQ ID NO: 723662 - RNA, 23 nt, Human
ccccagccacauaugcccaggcc

SEQ ID NO: 723663 - RNA, 18 nt, Human
ccccaggggacuuaaccc

SEQ ID NO: 723664 - RNA, 23 nt, Human
ccccagugcagugagugggaccc

SEQ ID NO: 723665 - RNA, 23 nt, Human
cccccagacuggccucugagccc

SEQ ID NO: 723666 - RNA, 24 nt, Human
cccccagacuggccucugagcccc

SEQ ID NO: 723667 - RNA, 18 nt, Human
ccccccagacuggccucu

SEQ ID NO: 723668 - RNA, 21 nt, Human
cccccugcuucccccuaauuu

SEQ ID NO: 723669 - RNA, 21 nt, Human
ccccugcuucccccuaauuuu

SEQ ID NO: 723670 - RNA, 21 nt, Human
ccuacaacaugugagcauccu

SEQ ID NO: 723671 - RNA, 24 nt, Human
ccuacaauuaauagggccgggguc

SEQ ID NO: 723672 - RNA, 24 nt, Human
ccuauuuucuuccuuuucaguucc

SEQ ID NO: 723673 - RNA, 23 nt, Human
ccucagggcaggucauggaaccc

SEQ ID NO: 723674 - RNA, 21 nt, Human
ccuccacuccacuaccaucug

SEQ ID NO: 723675 - RNA, 22 nt, Human
ccuccauguccauagcaguuuc

SEQ ID NO: 723676 - RNA, 23 nt, Human
ccucugagccccaaaagcugcuc

SEQ ID NO: 723677 - RNA, 20 nt, Human
ccugaaggugagaccugaga

SEQ ID NO: 723678 - RNA, 19 nt, Human
ccugccuucucccucuccc

SEQ ID NO: 723679 - RNA, 21 nt, Human
ccugccuucucccucucccca

SEQ ID NO: 723680 - RNA, 22 nt, Human
ccugccuucucccucuccccag

SEQ ID NO: 723681 - RNA, 24 nt, Human
ccugcggggcagccuucugucggg

SEQ ID NO: 723682 - RNA, 21 nt, Human
ccugcuucaauccucccaaga

SEQ ID NO: 723683 - RNA, 21 nt, Human
ccugguuaaaggagcuugggg

SEQ ID NO: 723684 - RNA, 19 nt, Human
ccuucagucacacugccug

SEQ ID NO: 723685 - RNA, 23 nt, Human
cgccgaggacucugggguccuuc

SEQ ID NO: 723686 - RNA, 19 nt, Human
cgccugacccuacgaacug

SEQ ID NO: 723687 - RNA, 23 nt, Human
cguacaagagccaagccccuuag

SEQ ID NO: 723688 - RNA, 24 nt, Human
cucacaacccuggagggcuccagg

SEQ ID NO: 723689 - RNA, 19 nt, Human
cuccccagcaggccuggcc

SEQ ID NO: 723690 - RNA, 23 nt, Human
cucccgggucagugccauugcgg

SEQ ID NO: 723691 - RNA, 20 nt, Human
cuccgcacaauccugaggcc

SEQ ID NO: 723692 - RNA, 20 nt, Human
cuccgcacaauccugaggcc

SEQ ID NO: 723693 - RNA, 18 nt, Human
cuccuauuuucuuccuuu

SEQ ID NO: 723694 - RNA, 24 nt, Human
cuccucugggggcuccagagcucc

SEQ ID NO: 723695 - RNA, 20 nt, Human
cucugucuuaucuccucugg

SEQ ID NO: 723696 - RNA, 22 nt, Human
cugcaguguuccagggaccggc

SEQ ID NO: 723697 - RNA, 21 nt, Human
cugcuccccaggccucuucug

SEQ ID NO: 723698 - RNA, 23 nt, Human
cuggccucugagccccaaaagcu

SEQ ID NO: 723699 - RNA, 18 nt, Human
cuggggucugggaaaagc

SEQ ID NO: 723700 - RNA, 29 nt, Human
gaaggggccuggaguuagcuggguuccgg

SEQ ID NO: 723701 - RNA, 23 nt, Human
gacccacaggcagcaccccccuc

SEQ ID NO: 723702 - RNA, 19 nt, Human
gacccuacgaacugugcgc

SEQ ID NO: 723703 - RNA, 21 nt, Human
gaccuguggcucagucugugg

SEQ ID NO: 723704 - RNA, 20 nt, Human
gacuagcagcgguucucccu

SEQ ID NO: 723705 - RNA, 25 nt, Human
gacuggccucugagccccaaaagcc

SEQ ID NO: 723706 - RNA, 19 nt, Human
gagaccugagaauguggug

SEQ ID NO: 723707 - RNA, 19 nt, Human
gagggcugccuuauccugc

SEQ ID NO: 723708 - RNA, 21 nt, Human
gaggguuuggcugcacagugc

SEQ ID NO: 723709 - RNA, 23 nt, Human
gagucugggagcugcugaccuca

SEQ ID NO: 723710 - RNA, 21 nt, Human
gccaccucccugcuucaaucc

SEQ ID NO: 723711 - RNA, 22 nt, Human
gcccccugcuucccccuaauuu

SEQ ID NO: 723712 - RNA, 23 nt, Human
gcccugaugacuuggagaaggcu

SEQ ID NO: 723713 - RNA, 23 nt, Human
gccugccuccccccagacuggcc

SEQ ID NO: 723714 - RNA, 26 nt, Human
gcggggcagccuugcuaccaacaaag

SEQ ID NO: 723715 - RNA, 23 nt, Human
gcucuccccucugcuuuccccac

SEQ ID NO: 723716 - RNA, 20 nt, Human
gcugagcagaguccucuccu

SEQ ID NO: 723717 - RNA, 22 nt, Human
ggaauuagaggucucuuccaca

SEQ ID NO: 723718 - RNA, 22 nt, Human
ggagcugcugaccucagggcag

SEQ ID NO: 723719 - RNA, 20 nt, Human
ggaggagggcugccuuaucc

SEQ ID NO: 723720 - RNA, 23 nt, Human
ggaggcccacacgcaggcccuaa

SEQ ID NO: 723721 - RNA, 20 nt, Human
ggcuccucccuccaccaggg

SEQ ID NO: 723722 - RNA, 23 nt, Human
gggagggaagcuccugguuaaag

SEQ ID NO: 723723 - RNA, 19 nt, Human
ggggccuggggccugcaug

SEQ ID NO: 723724 - RNA, 20 nt, Human
ggguucuuucuccuccacuc

SEQ ID NO: 723725 - RNA, 19 nt, Human
gguguggggagaacccuug

SEQ ID NO: 723726 - RNA, 22 nt, Human
gugaagagggugauacggccuc

SEQ ID NO: 723727 - RNA, 21 nt, Human
gugagggagagguguuuucug

SEQ ID NO: 723728 - RNA, 23 nt, Human
guuccacccaguucccacaccac

SEQ ID NO: 723729 - RNA, 19 nt, Human
guucuccgcacaauccuga

SEQ ID NO: 723730 - RNA, 21 nt, Human
uaaaagcacuauuuuuuccca

SEQ ID NO: 723731 - RNA, 19 nt, Human
uaagaaauucuguggcccu

SEQ ID NO: 723732 - RNA, 21 nt, Human
uaagaaauucuguggcccuga

SEQ ID NO: 723733 - RNA, 22 nt, Human
uacagacuuaaagggcuuuuuu

SEQ ID NO: 723734 - RNA, 19 nt, Human
uacugaccauguuucugca

SEQ ID NO: 723735 - RNA, 19 nt, Human
uagcucacucugggaggga

SEQ ID NO: 723736 - RNA, 21 nt, Human
uaggcuggggcguuaugcaga

SEQ ID NO: 723737 - RNA, 22 nt, Human
uauuuuuucccaggguucuuuc

SEQ ID NO: 723738 - RNA, 19 nt, Human
uccacccaguucccacacc

SEQ ID NO: 723739 - RNA, 25 nt, Human
uccaggacagcgcauuacugggguu

SEQ ID NO: 723740 - RNA, 21 nt, Human
uccauagcaguuucaaguuuc

SEQ ID NO: 723741 - RNA, 19 nt, Human
ucccaggguucuuucuccu

SEQ ID NO: 723742 - RNA, 24 nt, Human
uccccacugacucccugacccuau

SEQ ID NO: 723743 - RNA, 20 nt, Human
uccccaggccucuucuggga

SEQ ID NO: 723744 - RNA, 22 nt, Human
uccccaggccucuucugggaac

SEQ ID NO: 723745 - RNA, 18 nt, Human
ucccgggucagugccauu

SEQ ID NO: 723746 - RNA, 24 nt, Human
ucccguacaagagccaagccccuu

SEQ ID NO: 723747 - RNA, 18 nt, Human
ucccuggcugggcaggga

SEQ ID NO: 723748 - RNA, 25 nt, Human
uccggaagcaagaaggggccuggag

SEQ ID NO: 723749 - RNA, 25 nt, Human
uccuauuuucuuccuuuucaguucc

SEQ ID NO: 723750 - RNA, 20 nt, Human
uccucaaaccccaaggaccc

SEQ ID NO: 723751 - RNA, 22 nt, Human
uccugaaggugagaccugagaa

SEQ ID NO: 723752 - RNA, 21 nt, Human
ucuccccagccacauaugccc

SEQ ID NO: 723753 - RNA, 19 nt, Human
ucucccucuccccagcagg

SEQ ID NO: 723754 - RNA, 18 nt, Human
ucucuacugccuuauaag

SEQ ID NO: 723755 - RNA, 18 nt, Human
ucugcuacagacuuaaag

SEQ ID NO: 723756 - RNA, 22 nt, Human
ucugggucaccccucucuugag

SEQ ID NO: 723757 - RNA, 21 nt, Human
ucuguugggcuccucccucca

SEQ ID NO: 723758 - RNA, 23 nt, Human
ugaauagcugaaguuuaaaauca

SEQ ID NO: 723759 - RNA, 20 nt, Human
ugaccauguuucugcacccc

SEQ ID NO: 723760 - RNA, 18 nt, Human
ugacccagcgcugagcag

SEQ ID NO: 723761 - RNA, 18 nt, Human
ugacuccugacgggcccc

SEQ ID NO: 723762 - RNA, 20 nt, Human
ugagaccugagaauguggug

SEQ ID NO: 723763 - RNA, 25 nt, Human
ugagagcaucugcuucuggcuuugc

SEQ ID NO: 723764 - RNA, 20 nt, Human
ugagcugccacuggcggcag

SEQ ID NO: 723765 - RNA, 18 nt, Human
ugaggacagaauuugagg

SEQ ID NO: 723766 - RNA, 19 nt, Human
ugagggcaaaggagucugg

SEQ ID NO: 723767 - RNA, 20 nt, Human
ugagggcaaaggagucuggg

SEQ ID NO: 723768 - RNA, 24 nt, Human
ugagggcaaaggagucugggagcu

SEQ ID NO: 723769 - RNA, 24 nt, Human
ugaggggccuggggccugcaugug

SEQ ID NO: 723770 - RNA, 21 nt, Human
ugauuggacaagaggguuugg

SEQ ID NO: 723771 - RNA, 26 nt, Human
ugcaaaaaucugggucaccccucucu

SEQ ID NO: 723772 - RNA, 19 nt, Human
ugccuccccccagacuggc

SEQ ID NO: 723773 - RNA, 21 nt, Human
ugccugguguggggagaaccc

SEQ ID NO: 723774 - RNA, 23 nt, Human
ugccugguguggggagaacccuu

SEQ ID NO: 723775 - RNA, 24 nt, Human
ugccugguguggggagaacccuug

SEQ ID NO: 723776 - RNA, 19 nt, Human
ugcgguacuuccccgaccc

SEQ ID NO: 723777 - RNA, 19 nt, Human
ugcugggagagaacauugu

SEQ ID NO: 723778 - RNA, 30 nt, Human
uggccucugagccccaaaagcugcucccuc

SEQ ID NO: 723779 - RNA, 18 nt, Human
uggcugcacagugccuuc

SEQ ID NO: 723780 - RNA, 19 nt, Human
uggcugggcagggagaaag

SEQ ID NO: 723781 - RNA, 21 nt, Human
uggcugggcagggagaaaggg

SEQ ID NO: 723782 - RNA, 19 nt, Human
ugggaaaagccggaaggcg

SEQ ID NO: 723783 - RNA, 19 nt, Human
ugggaaaagccggaaggcg

SEQ ID NO: 723784 - RNA, 21 nt, Human
ugggagcugcugaccucagga

SEQ ID NO: 723785 - RNA, 19 nt, Human
uggggaggugggcaagaga

SEQ ID NO: 723786 - RNA, 22 nt, Human
uggggugucuggauccccacca

SEQ ID NO: 723787 - RNA, 23 nt, Human
uggggugucuggauccccaccag

SEQ ID NO: 723788 - RNA, 19 nt, Human
ugguccugccugguguggg

SEQ ID NO: 723789 - RNA, 23 nt, Human
uggugugggaggugagaugggcc

SEQ ID NO: 723790 - RNA, 18 nt, Human
ugucuggauccccaccag

SEQ ID NO: 723791 - RNA, 19 nt, Human
ugugagcaguuuccccacc

SEQ ID NO: 723792 - RNA, 18 nt, Human
uguggcucagucuguggg

SEQ ID NO: 723793 - RNA, 19 nt, Human
uguggggagaacccuugca

SEQ ID NO: 723794 - RNA, 19 nt, Human
uuacucccgggucagugcc

SEQ ID NO: 723795 - RNA, 20 nt, Human
uuacugggguuggcaagcac

SEQ ID NO: 723796 - RNA, 18 nt, Human
uuaggucauggaauuaga

SEQ ID NO: 723797 - RNA, 23 nt, Human
uucaacuaagcaacaugaccacc

SEQ ID NO: 723798 - RNA, 19 nt, Human
uucaggaaaaaccuccuga

SEQ ID NO: 723799 - RNA, 20 nt, Human
uucaguuucugcuaccaucu

SEQ ID NO: 723800 - RNA, 18 nt, Human
uucaucugagccgaucug

SEQ ID NO: 723801 - RNA, 22 nt, Human
uucccaucugaccuccaugucc

SEQ ID NO: 723802 - RNA, 21 nt, Human
uuccccauuuugggguuuuga

SEQ ID NO: 723803 - RNA, 19 nt, Human
uucgcaagcuuccggaagc

SEQ ID NO: 723804 - RNA, 19 nt, Human
uuggcguucuguuaggaag

SEQ ID NO: 723805 - RNA, 22 nt, Human
uugggaccucuuccuacaauua

SEQ ID NO: 723806 - RNA, 23 nt, Human
uuucccuaaaacacacaaugcau

SEQ ID NO: 723807 - RNA, 22 nt, Human
uuuucaguuccacccaguuccc

SEQ ID NO: 723808 - RNA, 19 nt, Human
uuuugggggaaaaaaucca

SEQ ID NO: 723809 - RNA, 22 nt, Human
aaaaccagaaagaaaacuguac

SEQ ID NO: 723810 - RNA, 22 nt, Human
aaaccaacauagaugaaaguaa

SEQ ID NO: 723811 - RNA, 23 nt, Human
aaagguucuagaaaagggaagug

SEQ ID NO: 723812 - RNA, 18 nt, Human
aaaguaagugugcggguc

SEQ ID NO: 723813 - RNA, 22 nt, Human
aaccagaaagaaaacuguacaa

SEQ ID NO: 723814 - RNA, 24 nt, Human
aacccgggaaggaacaaagggcuu

SEQ ID NO: 723815 - RNA, 25 nt, Human
aagcacaacuaaaaauuaaaaccag

SEQ ID NO: 723816 - RNA, 22 nt, Human
acagugcaggcucaggacaaac

SEQ ID NO: 723817 - RNA, 22 nt, Human
accucauuuggacauggaaaac

SEQ ID NO: 723818 - RNA, 19 nt, Human
acucccaccaacaaaagcu

SEQ ID NO: 723819 - RNA, 24 nt, Human
acucccaccaacaaaagcuggagc

SEQ ID NO: 723820 - RNA, 22 nt, Human
agaaagaaaacuguacaaagca

SEQ ID NO: 723821 - RNA, 22 nt, Human
agcccggccucagcuuccuggc

SEQ ID NO: 723822 - RNA, 18 nt, Human
aggacagugcaggcucag

SEQ ID NO: 723823 - RNA, 22 nt, Human
aggcagcgcguccaccagggag

SEQ ID NO: 723824 - RNA, 21 nt, Human
aggccuccggagaccacuccc

SEQ ID NO: 723825 - RNA, 18 nt, Human
agggaagugugaagucag

SEQ ID NO: 723826 - RNA, 23 nt, Human
agucagaucugggauuucggcau

SEQ ID NO: 723827 - RNA, 20 nt, Human
agugcggugugggguguggu

SEQ ID NO: 723828 - RNA, 23 nt, Human
auggacuccgggccgcgggggcu

SEQ ID NO: 723829 - RNA, 21 nt, Human
auugcacuacagucccauggg

SEQ ID NO: 723830 - RNA, 19 nt, Human
caaacccgggaaggaacaa

SEQ ID NO: 723831 - RNA, 19 nt, Human
caaacccgggaaggaacaa

SEQ ID NO: 723832 - RNA, 28 nt, Human
caaagcacaacuaaaaauuaaaaccaga

SEQ ID NO: 723833 - RNA, 20 nt, Human
caacauagaugaaaguaagu

SEQ ID NO: 723834 - RNA, 26 nt, Human
caaggcacaacagacacagagagaug

SEQ ID NO: 723835 - RNA, 22 nt, Human
cacaacagacacagagagaugc

SEQ ID NO: 723836 - RNA, 22 nt, Human
cacagcagccguccauagaggc

SEQ ID NO: 723837 - RNA, 18 nt, Human
caccaacaaaagcuggag

SEQ ID NO: 723838 - RNA, 23 nt, Human
caccaacaaaagcuggagcuauc

SEQ ID NO: 723839 - RNA, 24 nt, Human
caccaaggacugggccugggccag

SEQ ID NO: 723840 - RNA, 21 nt, Human
caccuagacgcggguuuaauu

SEQ ID NO: 723841 - RNA, 22 nt, Human
cacgcaggaaaaggaauguuua

SEQ ID NO: 723842 - RNA, 19 nt, Human
cacggguggaggcuguggg

SEQ ID NO: 723843 - RNA, 19 nt, Human
cacucccaccaacaaaagc

SEQ ID NO: 723844 - RNA, 18 nt, Human
cagcaccgaagagcagca

SEQ ID NO: 723845 - RNA, 19 nt, Human
cagcaccgaagagcagcag

SEQ ID NO: 723846 - RNA, 21 nt, Human
cagcagcuggcuccgccgggg

SEQ ID NO: 723847 - RNA, 24 nt, Human
cagcucccccacgccccaugcacc

SEQ ID NO: 723848 - RNA, 18 nt, Human
cagcugaagagcgcucuc

SEQ ID NO: 723849 - RNA, 19 nt, Human
caggaggcgggcagccugc

SEQ ID NO: 723850 - RNA, 20 nt, Human
caggcuaaaaaaagcagcca

SEQ ID NO: 723851 - RNA, 21 nt, Human
cauccagguuccauuugcacc

SEQ ID NO: 723852 - RNA, 22 nt, Human
ccccacgccccaugcacccucc

SEQ ID NO: 723853 - RNA, 25 nt, Human
ccccuccggacucgucggccccgcc

SEQ ID NO: 723854 - RNA, 18 nt, Human
ccccugugcccgccacag

SEQ ID NO: 723855 - RNA, 25 nt, Human
ccccugugcccgccacagacgccgg

SEQ ID NO: 723856 - RNA, 21 nt, Human
cccuccggacucgucggcccc

SEQ ID NO: 723857 - RNA, 18 nt, Human
cccugcagaaggcauggg

SEQ ID NO: 723858 - RNA, 22 nt, Human
cccugggccaaaccagcugccc

SEQ ID NO: 723859 - RNA, 21 nt, Human
ccgaagccccugugcccgcca

SEQ ID NO: 723860 - RNA, 21 nt, Human
ccgcaggucccgugaccgccc

SEQ ID NO: 723861 - RNA, 19 nt, Human
ccgcgugacucggccaggg

SEQ ID NO: 723862 - RNA, 25 nt, Human
ccuaccugggacacacgugcacaca

SEQ ID NO: 723863 - RNA, 24 nt, Human
ccuaugaugggacaaagccggggc

SEQ ID NO: 723864 - RNA, 26 nt, Human
ccuccggacucgucggccccgccggg

SEQ ID NO: 723865 - RNA, 22 nt, Human
ccucugaggaugcaucugguuu

SEQ ID NO: 723866 - RNA, 23 nt, Human
ccugugccgucccuaccugggac

SEQ ID NO: 723867 - RNA, 21 nt, Human
ccuguucccugggcaacgggg

SEQ ID NO: 723868 - RNA, 22 nt, Human
cggagccagcccgcaggucccc

SEQ ID NO: 723869 - RNA, 21 nt, Human
cggcaucuugaccucauuugg

SEQ ID NO: 723870 - RNA, 24 nt, Human
cgggagggggcgggauguguggca

SEQ ID NO: 723871 - RNA, 18 nt, Human
cggggccggcaccggggc

SEQ ID NO: 723872 - RNA, 18 nt, Human
cuccaggaggcgggcagc

SEQ ID NO: 723873 - RNA, 22 nt, Human
cuccgcgugacucggccagggc

SEQ ID NO: 723874 - RNA, 19 nt, Human
cucucaagcccggccucag

SEQ ID NO: 723875 - RNA, 23 nt, Human
cugcugcagcaaucacgccagcc

SEQ ID NO: 723876 - RNA, 19 nt, Human
cugugccgucccuaccugg

SEQ ID NO: 723877 - RNA, 21 nt, Human
cuuccuggccagagcgucugg

SEQ ID NO: 723878 - RNA, 23 nt, Human
gaacauauuuuaucacccuccac

SEQ ID NO: 723879 - RNA, 18 nt, Human
gacucaaagcacaacuaa

SEQ ID NO: 723880 - RNA, 24 nt, Human
gagaccaggacggcagcaguggga

SEQ ID NO: 723881 - RNA, 23 nt, Human
gagcagcagcuggcuccgccggg

SEQ ID NO: 723882 - RNA, 22 nt, Human
gcaccggggccagcaccgaaga

SEQ ID NO: 723883 - RNA, 19 nt, Human
gcccgcaggucccgugacc

SEQ ID NO: 723884 - RNA, 20 nt, Human
gcgggcagccugcgccgugu

SEQ ID NO: 723885 - RNA, 23 nt, Human
gcuccaucuggcccuggggcuac

SEQ ID NO: 723886 - RNA, 20 nt, Human
ggacugggccugggccaggg

SEQ ID NO: 723887 - RNA, 21 nt, Human
ggacugggccugggccagggg

SEQ ID NO: 723888 - RNA, 19 nt, Human
ggcccugggccaaaccagc

SEQ ID NO: 723889 - RNA, 18 nt, Human
ggccucagcuuccuggcc

SEQ ID NO: 723890 - RNA, 18 nt, Human
ggccuggggcugccucug

SEQ ID NO: 723891 - RNA, 20 nt, Human
ggcugccacucggagccagc

SEQ ID NO: 723892 - RNA, 22 nt, Human
gggcagugaggugugguguggu

SEQ ID NO: 723893 - RNA, 19 nt, Human
gggcggggugggcacugcc

SEQ ID NO: 723894 - RNA, 26 nt, Human
gggcugccgggagccuguucccuggg

SEQ ID NO: 723895 - RNA, 18 nt, Human
gggggcucccgcggcagc

SEQ ID NO: 723896 - RNA, 19 nt, Human
ggugugggguguggugugu

SEQ ID NO: 723897 - RNA, 18 nt, Human
guccaccagggagucacu

SEQ ID NO: 723898 - RNA, 23 nt, Human
gugaggagagcuuugccauccgu

SEQ ID NO: 723899 - RNA, 26 nt, Human
gugcggguccaaccuggccagaggug

SEQ ID NO: 723900 - RNA, 25 nt, Human
gugcgguguggggugugguguguug

SEQ ID NO: 723901 - RNA, 22 nt, Human
gugcucugcagcuuugucucug

SEQ ID NO: 723902 - RNA, 21 nt, Human
gugugguguggugaggugugc

SEQ ID NO: 723903 - RNA, 24 nt, Human
guguguuguguguuguggugugca

SEQ ID NO: 723904 - RNA, 18 nt, Human
uaaaaccagaaagaaaac

SEQ ID NO: 723905 - RNA, 21 nt, Human
uaaaaccagaaagaaaacugu

SEQ ID NO: 723906 - RNA, 18 nt, Human
uagaggcacugguuucaa

SEQ ID NO: 723907 - RNA, 21 nt, Human
uaucacccuccaccugcggcc

SEQ ID NO: 723908 - RNA, 19 nt, Human
ucaagugucaacccauacc

SEQ ID NO: 723909 - RNA, 24 nt, Human
ucaccuagacgcggguuuaauugc

SEQ ID NO: 723910 - RNA, 23 nt, Human
uccaccugcggccugggggcucc

SEQ ID NO: 723911 - RNA, 20 nt, Human
ucccaugggugaggagagcu

SEQ ID NO: 723912 - RNA, 23 nt, Human
ucccugggcaacggggccggcac

SEQ ID NO: 723913 - RNA, 20 nt, Human
uccgaagccccugugcccgc

SEQ ID NO: 723914 - RNA, 22 nt, Human
uccgggccgcgggggcugccgg

SEQ ID NO: 723915 - RNA, 22 nt, Human
ucggaaaacauaucucucuucu

SEQ ID NO: 723916 - RNA, 23 nt, Human
ucucuggggggacaccccccuau

SEQ ID NO: 723917 - RNA, 21 nt, Human
ucugggaggccuccggagacc

SEQ ID NO: 723918 - RNA, 23 nt, Human
ugaccuuuggcuccaucuggccc

SEQ ID NO: 723919 - RNA, 18 nt, Human
ugacucaaagcacaacua

SEQ ID NO: 723920 - RNA, 20 nt, Human
ugagaccaggacggcagcac

SEQ ID NO: 723921 - RNA, 26 nt, Human
ugagcgacccuugcucagcuccccca

SEQ ID NO: 723922 - RNA, 25 nt, Human
ugcagccgggcagucgccacugucc

SEQ ID NO: 723923 - RNA, 18 nt, Human
ugccugccccucugaggc

SEQ ID NO: 723924 - RNA, 23 nt, Human
ugcggugugguguggugaggugu

SEQ ID NO: 723925 - RNA, 21 nt, Human
uggaacgagacagaaaccaac

SEQ ID NO: 723926 - RNA, 23 nt, Human
uggaaugugcucugcagcuuugu

SEQ ID NO: 723927 - RNA, 20 nt, Human
uggccagagcgucuggcaug

SEQ ID NO: 723928 - RNA, 22 nt, Human
uggccagagcgucuggcaugga

SEQ ID NO: 723929 - RNA, 22 nt, Human
uggcccuggggcuacuaaugug

SEQ ID NO: 723930 - RNA, 23 nt, Human
uggugugcaugugcguggguucu

SEQ ID NO: 723931 - RNA, 20 nt, Human
ugucuggacaaguguugagg

SEQ ID NO: 723932 - RNA, 24 nt, Human
uguguuguggugugcaugugcgug

SEQ ID NO: 723933 - RNA, 23 nt, Human
uguuuauuugucaucuagggaaa

SEQ ID NO: 723934 - RNA, 21 nt, Human
uucccugggcaacggggccgg

SEQ ID NO: 723935 - RNA, 18 nt, Human
uugaccucauuuggacau

SEQ ID NO: 723936 - RNA, 19 nt, Human
uuuacaaaagguucuagaa

SEQ ID NO: 723937 - RNA, 20 nt, Human
uuuacaaaagguucuagaaa

SEQ ID NO: 723938 - RNA, 19 nt, Human
aaaaacagaccguucaggc

SEQ ID NO: 723939 - RNA, 18 nt, Human
aaacaaacaaaaaacccc

SEQ ID NO: 723940 - RNA, 22 nt, Human
aaacaaacaaaaaaccccagga

SEQ ID NO: 723941 - RNA, 24 nt, Human
aaacuucacagaauauauauucua

SEQ ID NO: 723942 - RNA, 25 nt, Human
aaagaaaaaaaccuuauuuguaaac

SEQ ID NO: 723943 - RNA, 19 nt, Human
aaagaaaaaauucagagac

SEQ ID NO: 723944 - RNA, 23 nt, Human
aaagauuuuuuuaaaaagcaagc

SEQ ID NO: 723945 - RNA, 18 nt, Human
aaauagccacaaugaaag

SEQ ID NO: 723946 - RNA, 18 nt, Human
aacaguagugugaaacuc

SEQ ID NO: 723947 - RNA, 19 nt, Human
aacguuaaagaaaaaauuc

SEQ ID NO: 723948 - RNA, 21 nt, Human
aagaaacaugaauaauaagcu

SEQ ID NO: 723949 - RNA, 22 nt, Human
aagagaaacuuaucaaaagcaa

SEQ ID NO: 723950 - RNA, 22 nt, Human
aagaggaaaugaaaagagggac

SEQ ID NO: 723951 - RNA, 21 nt, Human
aagauggaaugccaaaaucac

SEQ ID NO: 723952 - RNA, 19 nt, Human
aagcaaaugguuagcaaac

SEQ ID NO: 723953 - RNA, 18 nt, Human
aagcacccaaaacugacc

SEQ ID NO: 723954 - RNA, 20 nt, Human
aagcacccaaaacugaccua

SEQ ID NO: 723955 - RNA, 23 nt, Human
aagcacccaaaacugaccuaaaa

SEQ ID NO: 723956 - RNA, 23 nt, Human
aaguuuuauuucuuccucauacc

SEQ ID NO: 723957 - RNA, 21 nt, Human
acaaacaaacaaaaaacccca

SEQ ID NO: 723958 - RNA, 22 nt, Human
acacaugcauacacaaacaaac

SEQ ID NO: 723959 - RNA, 23 nt, Human
acgccaugccauaucuaccuagu

SEQ ID NO: 723960 - RNA, 19 nt, Human
acugcuaaacuccaaugua

SEQ ID NO: 723961 - RNA, 20 nt, Human
agaaaccagugcaagaugga

SEQ ID NO: 723962 - RNA, 19 nt, Human
agaaauaagcaucccuugc

SEQ ID NO: 723963 - RNA, 23 nt, Human
agagaaauaagcaucccuugcaa

SEQ ID NO: 723964 - RNA, 23 nt, Human
agaggacaguaaguguccacaga

SEQ ID NO: 723965 - RNA, 18 nt, Human
agcaaaccaccaaauagg

SEQ ID NO: 723966 - RNA, 18 nt, Human
aggcucacggaacagcag

SEQ ID NO: 723967 - RNA, 20 nt, Human
aguugcucagaacauggguu

SEQ ID NO: 723968 - RNA, 19 nt, Human
auaacuaaacccaagucuc

SEQ ID NO: 723969 - RNA, 19 nt, Human
aucacaacacuuccccugg

SEQ ID NO: 723970 - RNA, 25 nt, Human
aucauauugcuucugugaaaaaaau

SEQ ID NO: 723971 - RNA, 18 nt, Human
auggaacaaggcucacgg

SEQ ID NO: 723972 - RNA, 20 nt, Human
auuacaaauaagcacccaaa

SEQ ID NO: 723973 - RNA, 20 nt, Human
auucuaucaggccuaagaaa

SEQ ID NO: 723974 - RNA, 25 nt, Human
caaaaucaccaccaacucgacacga

SEQ ID NO: 723975 - RNA, 23 nt, Human
caaacaaaaaaccccaggaaugc

SEQ ID NO: 723976 - RNA, 21 nt, Human
caaaccaccaaauaggagucu

SEQ ID NO: 723977 - RNA, 22 nt, Human
caacuggaagaccaugcuuaug

SEQ ID NO: 723978 - RNA, 21 nt, Human
caagauggaaugccaaaauca

SEQ ID NO: 723979 - RNA, 24 nt, Human
caagauucacaaauaauaguguca

SEQ ID NO: 723980 - RNA, 22 nt, Human
caagcuaaaucaaaauaaucca

SEQ ID NO: 723981 - RNA, 21 nt, Human
caaguugaaaagauuuuuuua

SEQ ID NO: 723982 - RNA, 24 nt, Human
caccaaauaggagucucagguccc

SEQ ID NO: 723983 - RNA, 23 nt, Human
cacccacccaaccaaaagaaagu

SEQ ID NO: 723984 - RNA, 20 nt, Human
cacuguguggucaucagaac

SEQ ID NO: 723985 - RNA, 20 nt, Human
cagaacauggguuggaugua

SEQ ID NO: 723986 - RNA, 20 nt, Human
caguuucacccacuguaaga

SEQ ID NO: 723987 - RNA, 25 nt, Human
cauaaauaagcaaguauucccucca

SEQ ID NO: 723988 - RNA, 21 nt, Human
cauuaaguaaaacagugauug

SEQ ID NO: 723989 - RNA, 21 nt, Human
ccacccaaccaaaagaaaguc

SEQ ID NO: 723990 - RNA, 21 nt, Human
ccagaaaaaaagaacugcuaa

SEQ ID NO: 723991 - RNA, 19 nt, Human
ccaguguuugaaagauagc

SEQ ID NO: 723992 - RNA, 27 nt, Human
cccaaccaaaagaaagucaguuucacc

SEQ ID NO: 723993 - RNA, 20 nt, Human
cccuguguauaaacauuaag

SEQ ID NO: 723994 - RNA, 22 nt, Human
ccuaaaauuuucuacucaaucc

SEQ ID NO: 723995 - RNA, 20 nt, Human
ccugcaacuggaagaccauu

SEQ ID NO: 723996 - RNA, 20 nt, Human
cggcggcagcagcacgggcg

SEQ ID NO: 723997 - RNA, 22 nt, Human
cggcggcagcagcacgggcgag

SEQ ID NO: 723998 - RNA, 18 nt, Human
cguuaaagaaaaaauuca

SEQ ID NO: 723999 - RNA, 19 nt, Human
cuaagccuauacuagaaac

SEQ ID NO: 724000 - RNA, 24 nt, Human
cuacaaucuacaaaacuauacaaa

SEQ ID NO: 724001 - RNA, 18 nt, Human
cuacagaagagaggggag

SEQ ID NO: 724002 - RNA, 18 nt, Human
cuacuugaacacuggggc

SEQ ID NO: 724003 - RNA, 22 nt, Human
cuagcaucacaacacuuccccu

SEQ ID NO: 724004 - RNA, 18 nt, Human
cucacggaacagcagcac

SEQ ID NO: 724005 - RNA, 21 nt, Human
cugaugccaguguuugaaaga

SEQ ID NO: 724006 - RNA, 19 nt, Human
cugcaauaaagaaaaaucc

SEQ ID NO: 724007 - RNA, 20 nt, Human
gaaaaaaaaauccaauacaa

SEQ ID NO: 724008 - RNA, 24 nt, Human
gaauaguuuucuacuuucucuuuu

SEQ ID NO: 724009 - RNA, 20 nt, Human
gcaucagguauaagaagcac

SEQ ID NO: 724010 - RNA, 22 nt, Human
gccaggcauuccacuaacaaaa

SEQ ID NO: 724011 - RNA, 21 nt, Human
ggaaaacaacaaagaaaaaaa

SEQ ID NO: 724012 - RNA, 24 nt, Human
ggaaauaaccuaucuaauaauacc

SEQ ID NO: 724013 - RNA, 25 nt, Human
ggaacucuccaaaccaugggugcac

SEQ ID NO: 724014 - RNA, 21 nt, Human
ggaagaccaugcuuaugaaca

SEQ ID NO: 724015 - RNA, 22 nt, Human
ggcaagauuaaguaaaacaagu

SEQ ID NO: 724016 - RNA, 23 nt, Human
guagaggacaguaaguguccaca

SEQ ID NO: 724017 - RNA, 26 nt, Human
uaaaaagcaagcuaaaucaaaauaau

SEQ ID NO: 724018 - RNA, 23 nt, Human
uaacaaaacgccaugccauaucu

SEQ ID NO: 724019 - RNA, 20 nt, Human
uaaccuaucuaauaauacca

SEQ ID NO: 724020 - RNA, 21 nt, Human
uaacguuaaagaaaaaauuca

SEQ ID NO: 724021 - RNA, 21 nt, Human
uaagaaacagaucaagacuua

SEQ ID NO: 724022 - RNA, 21 nt, Human
uaagauaaaccaugacacuug

SEQ ID NO: 724023 - RNA, 22 nt, Human
uaagcaaguauucccuccaaga

SEQ ID NO: 724024 - RNA, 21 nt, Human
uaagccuauacuagaaaccag

SEQ ID NO: 724025 - RNA, 25 nt, Human
uaaggaaauaacuuucaagcaauau

SEQ ID NO: 724026 - RNA, 25 nt, Human
uaauauguacauuaacaaacuucac

SEQ ID NO: 724027 - RNA, 22 nt, Human
uacaaauaagcacccaaaacug

SEQ ID NO: 724028 - RNA, 21 nt, Human
uacacaaacaaacaaaaaacc

SEQ ID NO: 724029 - RNA, 25 nt, Human
uacacaauauaaaacaaugacagau

SEQ ID NO: 724030 - RNA, 23 nt, Human
uacauaaaaaacugaaaucaaga

SEQ ID NO: 724031 - RNA, 23 nt, Human
uacauuaacaaacuucacagaau

SEQ ID NO: 724032 - RNA, 21 nt, Human
uacccaagagaaacuuaucaa

SEQ ID NO: 724033 - RNA, 23 nt, Human
uagaagaggaaaacaacaaagaa

SEQ ID NO: 724034 - RNA, 20 nt, Human
uagaagaggaaaugaaaaga

SEQ ID NO: 724035 - RNA, 21 nt, Human
uagcagaaaagccaaaaacau

SEQ ID NO: 724036 - RNA, 21 nt, Human
uagcaguauuaugaccaacau

SEQ ID NO: 724037 - RNA, 23 nt, Human
uaggaacucuccaaaccaugggu

SEQ ID NO: 724038 - RNA, 22 nt, Human
uaggagucucaggucccuuaau

SEQ ID NO: 724039 - RNA, 22 nt, Human
uaguaucugcacaauuuucugu

SEQ ID NO: 724040 - RNA, 23 nt, Human
uauguacauuaacaaacuucaca

SEQ ID NO: 724041 - RNA, 18 nt, Human
ucacagaauauauauucu

SEQ ID NO: 724042 - RNA, 20 nt, Human
ucaccgguggggcaaaaaaa

SEQ ID NO: 724043 - RNA, 24 nt, Human
ucaggcacaaaacaaaucgcauuu

SEQ ID NO: 724044 - RNA, 24 nt, Human
uccaauacaaucuaauauguacau

SEQ ID NO: 724045 - RNA, 24 nt, Human
uccauuagaacaauaaaaauuuca

SEQ ID NO: 724046 - RNA, 19 nt, Human
ucuguaacuugaguguccu

SEQ ID NO: 724047 - RNA, 26 nt, Human
ucuguaauuaggcuuuucacuaaaac

SEQ ID NO: 724048 - RNA, 24 nt, Human
ucuguucagauuuuauuugaaauc

SEQ ID NO: 724049 - RNA, 24 nt, Human
ugaaagauagccuacagaagauua

SEQ ID NO: 724050 - RNA, 19 nt, Human
ugaauaaacacugaggcau

SEQ ID NO: 724051 - RNA, 23 nt, Human
ugaauuaaacacucccuaaaauc

SEQ ID NO: 724052 - RNA, 19 nt, Human
ugcaucagguauaagaagc

SEQ ID NO: 724053 - RNA, 18 nt, Human
ugccaaaaucaccaccaa

SEQ ID NO: 724054 - RNA, 24 nt, Human
ugccaaaaucaccaccaacucgac

SEQ ID NO: 724055 - RNA, 18 nt, Human
ugccccuccuucggcggc

SEQ ID NO: 724056 - RNA, 22 nt, Human
ugcuuaugaacauucuagucaa

SEQ ID NO: 724057 - RNA, 20 nt, Human
uggaacaaggcucacggaac

SEQ ID NO: 724058 - RNA, 23 nt, Human
uggccaaaccuuguuagaaaauu

SEQ ID NO: 724059 - RNA, 21 nt, Human
ugggaguggggggggaccaac

SEQ ID NO: 724060 - RNA, 19 nt, Human
uuaaaguuuggggggaaau

SEQ ID NO: 724061 - RNA, 21 nt, Human
uuacauugaagcuccaugagg

SEQ ID NO: 724062 - RNA, 23 nt, Human
uuagaauaguuuucuacuuucuc

SEQ ID NO: 724063 - RNA, 18 nt, Human
uucaagaaaaaaaaaucc

SEQ ID NO: 724064 - RNA, 20 nt, Human
uucagaacuuacgccaccau

SEQ ID NO: 724065 - RNA, 20 nt, Human
uuccccugggauuuguacuu

SEQ ID NO: 724066 - RNA, 23 nt, Human
uugcaauucaagaaaaaaaaauc

SEQ ID NO: 724067 - RNA, 22 nt, Human
uuguuagaauaguuuucuacuu

SEQ ID NO: 724068 - RNA, 22 nt, Human
uuugaagagaaauaagcauccc

SEQ ID NO: 724069 - RNA, 21 nt, Human
aaacaaaaucuacaucugaaa

SEQ ID NO: 724070 - RNA, 20 nt, Human
aaacugcacaaaacaguaca

SEQ ID NO: 724071 - RNA, 23 nt, Human
aaaguucugauggaaucuuuuga

SEQ ID NO: 724072 - RNA, 22 nt, Human
aaccaagaagaaaaaaauggcc

SEQ ID NO: 724073 - RNA, 20 nt, Human
aagaaaguagacaaacugca

SEQ ID NO: 724074 - RNA, 20 nt, Human
aagaagcccugaaguuuuca

SEQ ID NO: 724075 - RNA, 22 nt, Human
aagagagggaauggggguguca

SEQ ID NO: 724076 - RNA, 22 nt, Human
aagcucuaguuccagcucugcu

SEQ ID NO: 724077 - RNA, 20 nt, Human
aaguagacaaacugcacaaa

SEQ ID NO: 724078 - RNA, 24 nt, Human
aauaugaucuugcuucaaaauacu

SEQ ID NO: 724079 - RNA, 23 nt, Human
accaaacuuucaaugagacaaag

SEQ ID NO: 724080 - RNA, 19 nt, Human
agaaaagccacucccuugg

SEQ ID NO: 724081 - RNA, 22 nt, Human
agaaaguagacaaacugcacaa

SEQ ID NO: 724082 - RNA, 24 nt, Human
agaaaguagacaaacugcacaaaa

SEQ ID NO: 724083 - RNA, 25 nt, Human
agacaaacugcacaaaaccggaccc

SEQ ID NO: 724084 - RNA, 18 nt, Human
agacaaagaguuuaaauu

SEQ ID NO: 724085 - RNA, 23 nt, Human
agcagcuaacagaaaugcuuugu

SEQ ID NO: 724086 - RNA, 22 nt, Human
agccauuacccucuacuaagaa

SEQ ID NO: 724087 - RNA, 24 nt, Human
aggacaaacaugagauaagcauag

SEQ ID NO: 724088 - RNA, 23 nt, Human
aggaugauucaaaacuacaacug

SEQ ID NO: 724089 - RNA, 18 nt, Human
agggaugggaaccaagaa

SEQ ID NO: 724090 - RNA, 20 nt, Human
auacagaaaagaagcccuga

SEQ ID NO: 724091 - RNA, 22 nt, Human
auacucuaccacaaaaccaaca

SEQ ID NO: 724092 - RNA, 18 nt, Human
caaaaaauacuucacuaa

SEQ ID NO: 724093 - RNA, 25 nt, Human
caaagaaccagcaaaauuggagacc

SEQ ID NO: 724094 - RNA, 22 nt, Human
caaccucugugucucaguuccu

SEQ ID NO: 724095 - RNA, 24 nt, Human
caagaaaagccacucccuuggaag

SEQ ID NO: 724096 - RNA, 19 nt, Human
caagaagaaaaaaauggcc

SEQ ID NO: 724097 - RNA, 18 nt, Human
caaggagccuaauauccu

SEQ ID NO: 724098 - RNA, 26 nt, Human
cacacugagaagcagcuaacagaaau

SEQ ID NO: 724099 - RNA, 19 nt, Human
cacuaaagaacuaaagugg

SEQ ID NO: 724100 - RNA, 20 nt, Human
ccaucuacugcaacauuuga

SEQ ID NO: 724101 - RNA, 24 nt, Human
cgaguagcuuccauuaaaugucuc

SEQ ID NO: 724102 - RNA, 23 nt, Human
cuugaagcugcccaucuacugca

SEQ ID NO: 724103 - RNA, 22 nt, Human
cuuuuugacaaugaaaccuuaa

SEQ ID NO: 724104 - RNA, 20 nt, Human
gaacuaaacugaaagaaaau

SEQ ID NO: 724105 - RNA, 22 nt, Human
gaacuaaacugaaagaaaauaa

SEQ ID NO: 724106 - RNA, 18 nt, Human
gaagaagagagggaaugg

SEQ ID NO: 724107 - RNA, 19 nt, Human
gaagaagagagggaauggg

SEQ ID NO: 724108 - RNA, 19 nt, Human
gagguguaacuguagugag

SEQ ID NO: 724109 - RNA, 21 nt, Human
gagguucuugguaacuauccc

SEQ ID NO: 724110 - RNA, 19 nt, Human
gcaauguugcuuuucuucu

SEQ ID NO: 724111 - RNA, 20 nt, Human
gcccaugaccagcccaagua

SEQ ID NO: 724112 - RNA, 22 nt, Human
ggaagaagagagggaauggggg

SEQ ID NO: 724113 - RNA, 19 nt, Human
ggagaguguucccaaucuc

SEQ ID NO: 724114 - RNA, 21 nt, Human
ggaggacaaacaugagauaag

SEQ ID NO: 724115 - RNA, 18 nt, Human
gucacuaaagaacuaaag

SEQ ID NO: 724116 - RNA, 20 nt, Human
uaaacaccauguacauuauu

SEQ ID NO: 724117 - RNA, 24 nt, Human
uaaagugggaaaauuguuuuauca

SEQ ID NO: 724118 - RNA, 21 nt, Human
uaaaugucucugcccaugacc

SEQ ID NO: 724119 - RNA, 20 nt, Human
uaacaauguaacaaaaaauc

SEQ ID NO: 724120 - RNA, 23 nt, Human
uaacccuaacuucccgagaacac

SEQ ID NO: 724121 - RNA, 23 nt, Human
uaacuucccgagaacacguuuaa

SEQ ID NO: 724122 - RNA, 24 nt, Human
uaagaaaguagacaaacugcacaa

SEQ ID NO: 724123 - RNA, 27 nt, Human
uacaaaaaauacuucacuaagaaagua

SEQ ID NO: 724124 - RNA, 24 nt, Human
uacagaaaagaagcccugaaguuu

SEQ ID NO: 724125 - RNA, 25 nt, Human
uacauacaacuuuuacucuuccaca

SEQ ID NO: 724126 - RNA, 22 nt, Human
uaccucaaaaacaaaaucuaca

SEQ ID NO: 724127 - RNA, 19 nt, Human
uagacaaacugcacaaaac

SEQ ID NO: 724128 - RNA, 22 nt, Human
uagcacaaaucuuucuuucaca

SEQ ID NO: 724129 - RNA, 23 nt, Human
uaggcucaauuuaagaaacacaa

SEQ ID NO: 724130 - RNA, 24 nt, Human
uaguuucuuucaaaacuuuugagu

SEQ ID NO: 724131 - RNA, 19 nt, Human
ucaaaauuuucuuuaaccc

SEQ ID NO: 724132 - RNA, 29 nt, Human
ucaacuucucuggaccucaguuuccucaa

SEQ ID NO: 724133 - RNA, 18 nt, Human
ucauuaacacuuguaaca

SEQ ID NO: 724134 - RNA, 20 nt, Human
uccaaagaaccagcaaaauu

SEQ ID NO: 724135 - RNA, 18 nt, Human
ucuaacaagugacagagu

SEQ ID NO: 724136 - RNA, 20 nt, Human
ucugcauuaugguaacugaa

SEQ ID NO: 724137 - RNA, 18 nt, Human
ucuuuuuuucugaaaacu

SEQ ID NO: 724138 - RNA, 21 nt, Human
ugaaaauguucauuacagaaa

SEQ ID NO: 724139 - RNA, 20 nt, Human
ugaaagagcucuccaucucc

SEQ ID NO: 724140 - RNA, 21 nt, Human
ugaaauaaaaaccaagaaaau

SEQ ID NO: 724141 - RNA, 21 nt, Human
ugacaaugaaaccuuaaguac

SEQ ID NO: 724142 - RNA, 20 nt, Human
ugagaaacuccuucaguucu

SEQ ID NO: 724143 - RNA, 18 nt, Human
ugccaaaaacucuucaag

SEQ ID NO: 724144 - RNA, 26 nt, Human
uggaaaaaaaauuuacuugccaaaaa

SEQ ID NO: 724145 - RNA, 22 nt, Human
uggaagaagagagggaaugggg

SEQ ID NO: 724146 - RNA, 18 nt, Human
ugguggaagaagagaggg

SEQ ID NO: 724147 - RNA, 20 nt, Human
uguacagacuuaauuuguua

SEQ ID NO: 724148 - RNA, 21 nt, Human
ugucauuaacacuuguaacaa

SEQ ID NO: 724149 - RNA, 21 nt, Human
ugugaccuugggaaaacuuca

SEQ ID NO: 724150 - RNA, 21 nt, Human
uguuaacacaagaacuccauu

SEQ ID NO: 724151 - RNA, 24 nt, Human
uguuuauggaggacaaacaugaga

SEQ ID NO: 724152 - RNA, 22 nt, Human
uguuucacggacaucuucaggu

SEQ ID NO: 724153 - RNA, 26 nt, Human
uuaacccuaacuucccgagaacacgu

SEQ ID NO: 724154 - RNA, 21 nt, Human
uuaugcacugccucugggucc

SEQ ID NO: 724155 - RNA, 19 nt, Human
uucacagaacuaacagguu

SEQ ID NO: 724156 - RNA, 23 nt, Human
uugaaagccuaggucugcuaaau

SEQ ID NO: 724157 - RNA, 22 nt, Human
uugccaaaaacucuucaagcau

SEQ ID NO: 724158 - RNA, 23 nt, Human
uugccaaaaacucuucaagcauu

SEQ ID NO: 724159 - RNA, 18 nt, Human
uuguccuaauuuggacau

SEQ ID NO: 724160 - RNA, 20 nt, Human
uuuacaguuucuguuucuag

SEQ ID NO: 724161 - RNA, 24 nt, Human
uuuacauaaaagguacaaaaauau

SEQ ID NO: 724162 - RNA, 28 nt, Human
uuuagaacuaaaagggaaaagccgcaaa

SEQ ID NO: 724163 - RNA, 23 nt, Human
aaaaauuucucaacaauuuauaa

SEQ ID NO: 724164 - RNA, 21 nt, Human
aaaaggucuaaagucaaagag

SEQ ID NO: 724165 - RNA, 18 nt, Human
aaacacugaaagcaccac

SEQ ID NO: 724166 - RNA, 19 nt, Human
aaacacugaaagcaccacu

SEQ ID NO: 724167 - RNA, 19 nt, Human
aagagccuggaaagacacc

SEQ ID NO: 724168 - RNA, 24 nt, Human
accaaagugcaaagccaguucucc

SEQ ID NO: 724169 - RNA, 21 nt, Human
acuuccucucauugcagaaac

SEQ ID NO: 724170 - RNA, 27 nt, Human
agaaaccaugaaagaauaccgguaccc

SEQ ID NO: 724171 - RNA, 24 nt, Human
agacaccaugaaaucaccucaacu

SEQ ID NO: 724172 - RNA, 22 nt, Human
agagacaaggucucgcucuguu

SEQ ID NO: 724173 - RNA, 18 nt, Human
agagagcauacuguguga

SEQ ID NO: 724174 - RNA, 21 nt, Human
agcaauucuccagccucagcc

SEQ ID NO: 724175 - RNA, 19 nt, Human
agcuggugaagccacccca

SEQ ID NO: 724176 - RNA, 25 nt, Human
aggugucaaaggcaaguaacacuuc

SEQ ID NO: 724177 - RNA, 22 nt, Human
agucacuguugugauagguuuu

SEQ ID NO: 724178 - RNA, 18 nt, Human
augcagaggugucaaagg

SEQ ID NO: 724179 - RNA, 25 nt, Human
auuacaaauuauccaauuuuugauu

SEQ ID NO: 724180 - RNA, 19 nt, Human
auuuuccuuuuucagagaa

SEQ ID NO: 724181 - RNA, 21 nt, Human
caaaaacacugaaagcaccac

SEQ ID NO: 724182 - RNA, 21 nt, Human
caaaaacacugaaagcaccac

SEQ ID NO: 724183 - RNA, 23 nt, Human
caaacucaacauaucagcagcaa

SEQ ID NO: 724184 - RNA, 22 nt, Human
caaagugcaaagccaguucucc

SEQ ID NO: 724185 - RNA, 18 nt, Human
caagagccuggaaagaca

SEQ ID NO: 724186 - RNA, 25 nt, Human
cacaccuggccuugaaacauuauuu

SEQ ID NO: 724187 - RNA, 18 nt, Human
cacuuuuaccaacaaagc

SEQ ID NO: 724188 - RNA, 18 nt, Human
cagaagaagagcauccag

SEQ ID NO: 724189 - RNA, 19 nt, Human
cagaagaagagcauccaga

SEQ ID NO: 724190 - RNA, 20 nt, Human
cagaagaagagcauccagac

SEQ ID NO: 724191 - RNA, 20 nt, Human
cauauagauguacaaauaua

SEQ ID NO: 724192 - RNA, 20 nt, Human
cauauagauguacaaauaua

SEQ ID NO: 724193 - RNA, 23 nt, Human
ccaaaaacacugaaagcaccagu

SEQ ID NO: 724194 - RNA, 20 nt, Human
ccagaagaagagcauccaga

SEQ ID NO: 724195 - RNA, 21 nt, Human
ccagggguagcuggugaagcc

SEQ ID NO: 724196 - RNA, 21 nt, Human
cccgccgccggcccgcaacca

SEQ ID NO: 724197 - RNA, 19 nt, Human
ccugagguuccagagaagu

SEQ ID NO: 724198 - RNA, 26 nt, Human
ccuucaguaacagguuuuuggcggac

SEQ ID NO: 724199 - RNA, 21 nt, Human
cgccggcccgcaaccagccgc

SEQ ID NO: 724200 - RNA, 21 nt, Human
cuagccucaagcaauucucca

SEQ ID NO: 724201 - RNA, 23 nt, Human
cuccagccucagccucccaaagu

SEQ ID NO: 724202 - RNA, 21 nt, Human
cucugcuuuuuccagaagaag

SEQ ID NO: 724203 - RNA, 25 nt, Human
cuucauagccccuuaacaugucacu

SEQ ID NO: 724204 - RNA, 22 nt, Human
cuuuuugacaaaagaauugugg

SEQ ID NO: 724205 - RNA, 21 nt, Human
gaacacuaucugccaaaaaca

SEQ ID NO: 724206 - RNA, 25 nt, Human
gagaaagugaaauauauuuaaauau

SEQ ID NO: 724207 - RNA, 22 nt, Human
gagugcagugggagucacagcu

SEQ ID NO: 724208 - RNA, 22 nt, Human
gcagaaaccaugaaagaauacg

SEQ ID NO: 724209 - RNA, 18 nt, Human
gcaugggaaaucacauga

SEQ ID NO: 724210 - RNA, 23 nt, Human
gccucaagcaauucuccagccuc

SEQ ID NO: 724211 - RNA, 20 nt, Human
gccucagccucccaaaguag

SEQ ID NO: 724212 - RNA, 19 nt, Human
ggaaaauggagaggauucu

SEQ ID NO: 724213 - RNA, 22 nt, Human
ggaacacuaucugccaaaaaca

SEQ ID NO: 724214 - RNA, 21 nt, Human
ggagaggauucucaaaacaga

SEQ ID NO: 724215 - RNA, 21 nt, Human
ggaucuagucauuaaaacaua

SEQ ID NO: 724216 - RNA, 19 nt, Human
guucuucaauuucuuucuc

SEQ ID NO: 724217 - RNA, 26 nt, Human
uaaaaaaacuaaacucuucaugucag

SEQ ID NO: 724218 - RNA, 25 nt, Human
uaaacuguauuuuaacuuagcacaa

SEQ ID NO: 724219 - RNA, 19 nt, Human
uaaauuaagaguauaaacu

SEQ ID NO: 724220 - RNA, 18 nt, Human
uaacaaucuguaacucug

SEQ ID NO: 724221 - RNA, 24 nt, Human
uacucauagucaguguuacacuag

SEQ ID NO: 724222 - RNA, 21 nt, Human
uacugccgagaaaugggcggg

SEQ ID NO: 724223 - RNA, 22 nt, Human
uagagacaaggucucgcucugu

SEQ ID NO: 724224 - RNA, 20 nt, Human
uagaugcaaacauauauaca

SEQ ID NO: 724225 - RNA, 25 nt, Human
uagccucaagcaauucuccagccuc

SEQ ID NO: 724226 - RNA, 24 nt, Human
uauguagaugcaaacauauauaca

SEQ ID NO: 724227 - RNA, 26 nt, Human
uauguagaugcaaacauauauacaca

SEQ ID NO: 724228 - RNA, 18 nt, Human
ucaugucagcucugaaau

SEQ ID NO: 724229 - RNA, 21 nt, Human
uccagaagaagagcauccaga

SEQ ID NO: 724230 - RNA, 25 nt, Human
ucggaggaacugugacgauguagca

SEQ ID NO: 724231 - RNA, 19 nt, Human
ucuaaagucaaagagaaag

SEQ ID NO: 724232 - RNA, 23 nt, Human
ucuaagacaggaggaaagaugag

SEQ ID NO: 724233 - RNA, 19 nt, Human
ucuccagccucagccuccc

SEQ ID NO: 724234 - RNA, 20 nt, Human
ucuccgccagcccgccgccg

SEQ ID NO: 724235 - RNA, 24 nt, Human
ucucgcucuguuccccgagcugga

SEQ ID NO: 724236 - RNA, 20 nt, Human
ucuguguaaccaaagugcaa

SEQ ID NO: 724237 - RNA, 22 nt, Human
ugaaaucaccucaacucaagug

SEQ ID NO: 724238 - RNA, 23 nt, Human
uggaacacuaucugccaaaaaca

SEQ ID NO: 724239 - RNA, 24 nt, Human
uggaacacuaucugccaaaaacac

SEQ ID NO: 724240 - RNA, 18 nt, Human
uggagugcagugggaguc

SEQ ID NO: 724241 - RNA, 24 nt, Human
ugggauuucaggcaugaaucacca

SEQ ID NO: 724242 - RNA, 20 nt, Human
ugggcggguccugagguucc

SEQ ID NO: 724243 - RNA, 22 nt, Human
uguaaccaaagugcaaagccag

SEQ ID NO: 724244 - RNA, 23 nt, Human
ugucaaaggcaaguaacacuacc

SEQ ID NO: 724245 - RNA, 23 nt, Human
uuaaaauaaucauuacacuuccu

SEQ ID NO: 724246 - RNA, 20 nt, Human
uuagauccaaugcugaguga

SEQ ID NO: 724247 - RNA, 20 nt, Human
uucaauuucuuucuccaauu

SEQ ID NO: 724248 - RNA, 18 nt, Human
uuccccgagcuggagugc

SEQ ID NO: 724249 - RNA, 22 nt, Human
uucuaagacaggaggaaagaug

SEQ ID NO: 724250 - RNA, 22 nt, Human
uuggaucuagucauuaaaacau

SEQ ID NO: 724251 - RNA, 25 nt, Human
aaaaccaaaaccaaacagaacaaaa

SEQ ID NO: 724252 - RNA, 19 nt, Human
aaaacccuccaaauauugc

SEQ ID NO: 724253 - RNA, 20 nt, Human
aaacaaaaccaaaaccaaac

SEQ ID NO: 724254 - RNA, 21 nt, Human
aaacaaaccccaucugaaacc

SEQ ID NO: 724255 - RNA, 21 nt, Human
aaacagaacaaaacaaacccc

SEQ ID NO: 724256 - RNA, 19 nt, Human
aaacauaaucuaagaccgc

SEQ ID NO: 724257 - RNA, 22 nt, Human
aaaccaaacagaacaaaacaaa

SEQ ID NO: 724258 - RNA, 20 nt, Human
aaagcccuguccaaggcccc

SEQ ID NO: 724259 - RNA, 23 nt, Human
aaaggcaccaccaacaaacuggg

SEQ ID NO: 724260 - RNA, 19 nt, Human
aacaaaacaaaccccaucu

SEQ ID NO: 724261 - RNA, 18 nt, Human
aaccacuaaaggcaccac

SEQ ID NO: 724262 - RNA, 23 nt, Human
aagcagggccaaggacugggggc

SEQ ID NO: 724263 - RNA, 19 nt, Human
aagcgagggggcugagggu

SEQ ID NO: 724264 - RNA, 18 nt, Human
acaaaccccaucugaaac

SEQ ID NO: 724265 - RNA, 18 nt, Human
acagaacaaaacaaaccc

SEQ ID NO: 724266 - RNA, 22 nt, Human
acaugcagugugcguacgugug

SEQ ID NO: 724267 - RNA, 21 nt, Human
accaccaacaaacugggaaau

SEQ ID NO: 724268 - RNA, 22 nt, Human
accacuaaaggcaccaccaaca

SEQ ID NO: 724269 - RNA, 18 nt, Human
acccagcugugucuuugg

SEQ ID NO: 724270 - RNA, 23 nt, Human
acccuccaaauauugcacauggc

SEQ ID NO: 724271 - RNA, 19 nt, Human
agaaagcccuguccaaggc

SEQ ID NO: 724272 - RNA, 19 nt, Human
agaacaaaacaaaccccau

SEQ ID NO: 724273 - RNA, 24 nt, Human
agaccgcaaugacccacccacccc

SEQ ID NO: 724274 - RNA, 20 nt, Human
agagggucgggagaagccau

SEQ ID NO: 724275 - RNA, 21 nt, Human
agcaagagaaacauaaucuaa

SEQ ID NO: 724276 - RNA, 25 nt, Human
aggcagagcccacgcaggcacaugg

SEQ ID NO: 724277 - RNA, 18 nt, Human
aggcaggugggcgggcga

SEQ ID NO: 724278 - RNA, 21 nt, Human
aggcaggugggcgggcgaguc

SEQ ID NO: 724279 - RNA, 22 nt, Human
aggcaggugggcgggcgagucc

SEQ ID NO: 724280 - RNA, 20 nt, Human
aggcuggggcccuggaaagu

SEQ ID NO: 724281 - RNA, 23 nt, Human
agggaaccacuaaaggcaccacc

SEQ ID NO: 724282 - RNA, 21 nt, Human
aggggcuucccuuggcagaag

SEQ ID NO: 724283 - RNA, 22 nt, Human
agggucagagguccuggucagc

SEQ ID NO: 724284 - RNA, 20 nt, Human
agguagaggcugcucucaag

SEQ ID NO: 724285 - RNA, 24 nt, Human
agucugcgugugggcuagggagag

SEQ ID NO: 724286 - RNA, 23 nt, Human
aguggcucucugugguccagggg

SEQ ID NO: 724287 - RNA, 21 nt, Human
aucacccccaccccaggugac

SEQ ID NO: 724288 - RNA, 22 nt, Human
aucacugcccccuaauagucag

SEQ ID NO: 724289 - RNA, 20 nt, Human
augacuggaagcaccggggc

SEQ ID NO: 724290 - RNA, 18 nt, Human
augcuuccgcgaagacaa

SEQ ID NO: 724291 - RNA, 22 nt, Human
caaaacaaaccccaucugaaac

SEQ ID NO: 724292 - RNA, 25 nt, Human
caaaaccaaaaccaaacagaaccga

SEQ ID NO: 724293 - RNA, 27 nt, Human
caaaaccaaacagaacaaaacaaaccc

SEQ ID NO: 724294 - RNA, 23 nt, Human
caaacagaacaaaacaaacccca

SEQ ID NO: 724295 - RNA, 24 nt, Human
caaacagaacaaaacaaaccccau

SEQ ID NO: 724296 - RNA, 22 nt, Human
caaagccugacagguccccaga

SEQ ID NO: 724297 - RNA, 20 nt, Human
caaauauugcacauggcccu

SEQ ID NO: 724298 - RNA, 19 nt, Human
cacccaccccaaacaaaac

SEQ ID NO: 724299 - RNA, 23 nt, Human
cacccaccccaaacaaaaccaaa

SEQ ID NO: 724300 - RNA, 21 nt, Human
caccccaggugaccaggucac

SEQ ID NO: 724301 - RNA, 22 nt, Human
cacgcaggcacaugugugcccc

SEQ ID NO: 724302 - RNA, 23 nt, Human
cacugcccccuaauagucagcau

SEQ ID NO: 724303 - RNA, 19 nt, Human
cagccccucagcuuugggg

SEQ ID NO: 724304 - RNA, 20 nt, Human
cagccuuccugcugcccucc

SEQ ID NO: 724305 - RNA, 22 nt, Human
cagggugguccccagggcagga

SEQ ID NO: 724306 - RNA, 20 nt, Human
cagugcaugagacacaggga

SEQ ID NO: 724307 - RNA, 18 nt, Human
caguggguguuccaucag

SEQ ID NO: 724308 - RNA, 24 nt, Human
caucuugaucuagaggacugaggg

SEQ ID NO: 724309 - RNA, 23 nt, Human
ccaaaaccaaacagaacaaaaca

SEQ ID NO: 724310 - RNA, 28 nt, Human
ccaaaaccaaacagaacaaaacaaaccc

SEQ ID NO: 724311 - RNA, 22 nt, Human
ccaaacaaaaccaaaaccaaac

SEQ ID NO: 724312 - RNA, 26 nt, Human
ccaaacaaaaccaaaaccaaacagaa

SEQ ID NO: 724313 - RNA, 24 nt, Human
ccaaacagaacaaaacaaacccca

SEQ ID NO: 724314 - RNA, 24 nt, Human
ccagggcaggaauagguuucuuuu

SEQ ID NO: 724315 - RNA, 23 nt, Human
cccacccaccccaaacaaaacca

SEQ ID NO: 724316 - RNA, 21 nt, Human
cccaccccaaacaaaaccaaa

SEQ ID NO: 724317 - RNA, 24 nt, Human
ccccaccccaggugaccaggucac

SEQ ID NO: 724318 - RNA, 21 nt, Human
ccccacccgaucaugacugga

SEQ ID NO: 724319 - RNA, 18 nt, Human
ccccagccccgugggguc

SEQ ID NO: 724320 - RNA, 20 nt, Human
ccccaucaggcuggggcccu

SEQ ID NO: 724321 - RNA, 23 nt, Human
cccccaccccaggugaccagguc

SEQ ID NO: 724322 - RNA, 21 nt, Human
ccccucagcuuuggggggucc

SEQ ID NO: 724323 - RNA, 18 nt, Human
cccgugggguccagaccc

SEQ ID NO: 724324 - RNA, 23 nt, Human
ccuccaaggugaccauaugugcc

SEQ ID NO: 724325 - RNA, 21 nt, Human
ccuccagaaaacccuccaaau

SEQ ID NO: 724326 - RNA, 21 nt, Human
ccugggccacggcagacaggg

SEQ ID NO: 724327 - RNA, 22 nt, Human
ccuuccugcugcccuccagaaa

SEQ ID NO: 724328 - RNA, 24 nt, Human
cgaagacaaggcagagcccacgca

SEQ ID NO: 724329 - RNA, 21 nt, Human
cuccuaccugagagaaagccc

SEQ ID NO: 724330 - RNA, 18 nt, Human
cuuccugcugcccuccag

SEQ ID NO: 724331 - RNA, 22 nt, Human
gcaaugacccacccaccccaaa

SEQ ID NO: 724332 - RNA, 21 nt, Human
gcaggcugaaggcaggugggc

SEQ ID NO: 724333 - RNA, 22 nt, Human
gccugacagguccccagauggc

SEQ ID NO: 724334 - RNA, 19 nt, Human
gcgggcgaguccugggcca

SEQ ID NO: 724335 - RNA, 23 nt, Human
gcuggccaguggguguuccauca

SEQ ID NO: 724336 - RNA, 23 nt, Human
ggacugagggcagccccaucagg

SEQ ID NO: 724337 - RNA, 18 nt, Human
ggacugggggcgacugug

SEQ ID NO: 724338 - RNA, 18 nt, Human
ggcucaggggcgcauggg

SEQ ID NO: 724339 - RNA, 18 nt, Human
ggcuccuaggucugcccu

SEQ ID NO: 724340 - RNA, 20 nt, Human
gggaaccacuaaaggcacca

SEQ ID NO: 724341 - RNA, 20 nt, Human
gggaagcagggccaaggacu

SEQ ID NO: 724342 - RNA, 20 nt, Human
gggcaggaauagguuucuuu

SEQ ID NO: 724343 - RNA, 20 nt, Human
gggcgggcgaguccugggcc

SEQ ID NO: 724344 - RNA, 22 nt, Human
gggucagaguggcucucugugg

SEQ ID NO: 724345 - RNA, 18 nt, Human
gguccuggucagcccaca

SEQ ID NO: 724346 - RNA, 22 nt, Human
guccaaggccccaucaguguuc

SEQ ID NO: 724347 - RNA, 23 nt, Human
guuuagggccuuggacaugcagu

SEQ ID NO: 724348 - RNA, 20 nt, Human
uaaaaagaaacauaaauacu

SEQ ID NO: 724349 - RNA, 22 nt, Human
uaaaggcaccaccaacaaacug

SEQ ID NO: 724350 - RNA, 28 nt, Human
uaaaggcaccaccaacaaacuggagacc

SEQ ID NO: 724351 - RNA, 22 nt, Human
uaaauaagugcuugggaaggua

SEQ ID NO: 724352 - RNA, 23 nt, Human
uacuccuggucaaagucugcgug

SEQ ID NO: 724353 - RNA, 20 nt, Human
uagagucccagggugguccc

SEQ ID NO: 724354 - RNA, 21 nt, Human
uagcugaagaagcgagggggc

SEQ ID NO: 724355 - RNA, 24 nt, Human
uagggaaccacuaaaggcaccacc

SEQ ID NO: 724356 - RNA, 21 nt, Human
ucagcccacaugucccccacc

SEQ ID NO: 724357 - RNA, 21 nt, Human
uccaaagagaguuaauacaug

SEQ ID NO: 724358 - RNA, 19 nt, Human
uccaggaaggcuugguuag

SEQ ID NO: 724359 - RNA, 25 nt, Human
uccccagauggcaaucacugcccuu

SEQ ID NO: 724360 - RNA, 21 nt, Human
uccccagccuuccugcugccc

SEQ ID NO: 724361 - RNA, 22 nt, Human
ucccuccaggaaggcuugguua

SEQ ID NO: 724362 - RNA, 20 nt, Human
uccucaaaucacccccaccc

SEQ ID NO: 724363 - RNA, 19 nt, Human
uccugaaggggcuucccuu

SEQ ID NO: 724364 - RNA, 19 nt, Human
ugacuggaagcaccggggc

SEQ ID NO: 724365 - RNA, 25 nt, Human
ugagagaaagcccuguccaaggcug

SEQ ID NO: 724366 - RNA, 18 nt, Human
ugaggagaucaugggccc

SEQ ID NO: 724367 - RNA, 23 nt, Human
ugcccuccagaaaacccuccaaa

SEQ ID NO: 724368 - RNA, 22 nt, Human
ugcguacgugugugucuguaug

SEQ ID NO: 724369 - RNA, 21 nt, Human
uggaguuuuagcugaagaagc

SEQ ID NO: 724370 - RNA, 21 nt, Human
uggaguuuuagcugaagaagc

SEQ ID NO: 724371 - RNA, 23 nt, Human
uggccuggcuggccagugggugu

SEQ ID NO: 724372 - RNA, 22 nt, Human
ugggcgggcgaguccugggcca

SEQ ID NO: 724373 - RNA, 20 nt, Human
ugugugccccuggcuggaua

SEQ ID NO: 724374 - RNA, 18 nt, Human
uucaucauccaaagagag

SEQ ID NO: 724375 - RNA, 22 nt, Human
uuuuuuuuuugcagucaucugg

SEQ ID NO: 724376 - RNA, 18 nt, Human
uuuuuuuuuuuuuuuuug

SEQ ID NO: 724377 - RNA, 22 nt, Human
uuuuuuuuuuuuuuuuugcagu

SEQ ID NO: 724378 - RNA, 24 nt, Human
aaaaacaaucaggggguggugggc

SEQ ID NO: 724379 - RNA, 23 nt, Human
aagcugccuccagggacugaggc

SEQ ID NO: 724380 - RNA, 20 nt, Human
aagggugacccucagggucu

SEQ ID NO: 724381 - RNA, 23 nt, Human
acaaagcaagaggacuguguagc

SEQ ID NO: 724382 - RNA, 26 nt, Human
acaaagcaagaggacuguguagcccc

SEQ ID NO: 724383 - RNA, 22 nt, Human
acccaccccgccauccuggccu

SEQ ID NO: 724384 - RNA, 22 nt, Human
acccauccugccccaccucagu

SEQ ID NO: 724385 - RNA, 23 nt, Human
accucaguuuagggagccccggc

SEQ ID NO: 724386 - RNA, 25 nt, Human
acugggggugcagagcccccccagg

SEQ ID NO: 724387 - RNA, 26 nt, Human
acuguguagccccccaggacagaauu

SEQ ID NO: 724388 - RNA, 21 nt, Human
agaaaaacaaucagggggugg

SEQ ID NO: 724389 - RNA, 18 nt, Human
aggcagaagcugccucca

SEQ ID NO: 724390 - RNA, 21 nt, Human
aggcagaagcugccuccaggg

SEQ ID NO: 724391 - RNA, 22 nt, Human
aggcgcggggcgguggcggcgg

SEQ ID NO: 724392 - RNA, 19 nt, Human
agggacugaggcucccucg

SEQ ID NO: 724393 - RNA, 24 nt, Human
auaaauaggggugugggcacccau

SEQ ID NO: 724394 - RNA, 21 nt, Human
caaacagaccccacucgugga

SEQ ID NO: 724395 - RNA, 19 nt, Human
cacugcguggcucguaggc

SEQ ID NO: 724396 - RNA, 19 nt, Human
cagcagcaauggguuccau

SEQ ID NO: 724397 - RNA, 19 nt, Human
cagcagcaauggguuccau

SEQ ID NO: 724398 - RNA, 21 nt, Human
cagccaccaccaccucggggg

SEQ ID NO: 724399 - RNA, 21 nt, Human
cagcuucuucuccgcaaagaa

SEQ ID NO: 724400 - RNA, 21 nt, Human
caggaacagaugaggcagggu

SEQ ID NO: 724401 - RNA, 24 nt, Human
caggacagaaucuguacaggccgg

SEQ ID NO: 724402 - RNA, 25 nt, Human
cauccuggccuggcugagccgggga

SEQ ID NO: 724403 - RNA, 21 nt, Human
cauccuggggccgccgcuugc

SEQ ID NO: 724404 - RNA, 21 nt, Human
ccacccggaacagguagcugc

SEQ ID NO: 724405 - RNA, 24 nt, Human
ccagcccagcaaaagggacccacc

SEQ ID NO: 724406 - RNA, 19 nt, Human
cccacgcuuggagaugggg

SEQ ID NO: 724407 - RNA, 23 nt, Human
cccacucguggauccggcuccgg

SEQ ID NO: 724408 - RNA, 22 nt, Human
cccaggacugggggugcagagc

SEQ ID NO: 724409 - RNA, 21 nt, Human
cccauccugccccaccucagu

SEQ ID NO: 724410 - RNA, 19 nt, Human
ccccagggggagaacaugg

SEQ ID NO: 724411 - RNA, 18 nt, Human
cccccaggacagaaucug

SEQ ID NO: 724412 - RNA, 21 nt, Human
cccccucuuccucccccuccu

SEQ ID NO: 724413 - RNA, 19 nt, Human
ccccugaguguccacgccc

SEQ ID NO: 724414 - RNA, 19 nt, Human
cccgccauccuggccuggc

SEQ ID NO: 724415 - RNA, 18 nt, Human
cccggggcccauccuggg

SEQ ID NO: 724416 - RNA, 19 nt, Human
ccggcaccccagguuucca

SEQ ID NO: 724417 - RNA, 22 nt, Human
ccggcaccccagguuuccacag

SEQ ID NO: 724418 - RNA, 21 nt, Human
ccuccucuuccucccccucuu

SEQ ID NO: 724419 - RNA, 25 nt, Human
cgcucagcagccgccgcugucggac

SEQ ID NO: 724420 - RNA, 23 nt, Human
cgggaucuuguugucuuccagug

SEQ ID NO: 724421 - RNA, 18 nt, Human
cucagccaccaccaccuc

SEQ ID NO: 724422 - RNA, 20 nt, Human
cuccagggacugaggcuccc

SEQ ID NO: 724423 - RNA, 26 nt, Human
cuccccaucgcugcugcugcugcugu

SEQ ID NO: 724424 - RNA, 19 nt, Human
cucccccuccucuucgccc

SEQ ID NO: 724425 - RNA, 25 nt, Human
cucccccucuuccucccccuccucc

SEQ ID NO: 724426 - RNA, 19 nt, Human
cuccucccgcugcugcugc

SEQ ID NO: 724427 - RNA, 23 nt, Human
cuccucccgcugcugcugcaguu

SEQ ID NO: 724428 - RNA, 22 nt, Human
cucgcugggcuuggggccccca

SEQ ID NO: 724429 - RNA, 18 nt, Human
cugagcccacuaaggcug

SEQ ID NO: 724430 - RNA, 24 nt, Human
cugaggcucccucgcugggcuugg

SEQ ID NO: 724431 - RNA, 19 nt, Human
cugcacguagcgcuucucc

SEQ ID NO: 724432 - RNA, 20 nt, Human
cugcacguagcgcuucuccc

SEQ ID NO: 724433 - RNA, 21 nt, Human
cugcagcagccgcucguacgu

SEQ ID NO: 724434 - RNA, 23 nt, Human
gaacagguagcugcugccaaugc

SEQ ID NO: 724435 - RNA, 18 nt, Human
gaacauggccacugcccc

SEQ ID NO: 724436 - RNA, 18 nt, Human
gagaugggggcauguggg

SEQ ID NO: 724437 - RNA, 18 nt, Human
gcagaagcugccuccagg

SEQ ID NO: 724438 - RNA, 21 nt, Human
gcagagcccccccagggggag

SEQ ID NO: 724439 - RNA, 22 nt, Human
gccggcaccccagguuuccaca

SEQ ID NO: 724440 - RNA, 22 nt, Human
gcgcggggcgguggcggcgggg

SEQ ID NO: 724441 - RNA, 18 nt, Human
gcgcucagcagccgccgc

SEQ ID NO: 724442 - RNA, 21 nt, Human
gcguggcucguaggcgcgggg

SEQ ID NO: 724443 - RNA, 20 nt, Human
gcugcagcagccgcucguac

SEQ ID NO: 724444 - RNA, 20 nt, Human
gcugcaguugcugcggcuug

SEQ ID NO: 724445 - RNA, 20 nt, Human
ggaacagaugaggcaggguu

SEQ ID NO: 724446 - RNA, 21 nt, Human
ggagaacauggccacugcccc

SEQ ID NO: 724447 - RNA, 19 nt, Human
ggagaugggggcauguggg

SEQ ID NO: 724448 - RNA, 20 nt, Human
ggagggcggcggcgccgggc

SEQ ID NO: 724449 - RNA, 19 nt, Human
ggaucuuguugucuuccag

SEQ ID NO: 724450 - RNA, 18 nt, Human
ggcggcgggggugggggc

SEQ ID NO: 724451 - RNA, 23 nt, Human
gggaauaaauaggggugugggca

SEQ ID NO: 724452 - RNA, 18 nt, Human
gggcaggggugacaggag

SEQ ID NO: 724453 - RNA, 21 nt, Human
gggcaggggugacaggagagg

SEQ ID NO: 724454 - RNA, 21 nt, Human
ggggcgguggcggcgggggug

SEQ ID NO: 724455 - RNA, 22 nt, Human
ggggcgguggcggcgggggugg

SEQ ID NO: 724456 - RNA, 19 nt, Human
gggggugggggcggagggc

SEQ ID NO: 724457 - RNA, 18 nt, Human
ggggugggggcggagggc

SEQ ID NO: 724458 - RNA, 18 nt, Human
ggggugggggcggagggc

SEQ ID NO: 724459 - RNA, 23 nt, Human
gggguggugggcaggggugacag

SEQ ID NO: 724460 - RNA, 24 nt, Human
gugcagcagugguugaugaaucug

SEQ ID NO: 724461 - RNA, 20 nt, Human
guggcggcgggggugggggc

SEQ ID NO: 724462 - RNA, 22 nt, Human
gugggggcggagggcggcggcg

SEQ ID NO: 724463 - RNA, 22 nt, Human
guggugggcaggggugacagga

SEQ ID NO: 724464 - RNA, 22 nt, Human
guuccaggcacggaguccccag

SEQ ID NO: 724465 - RNA, 19 nt, Human
uaagccgcagguaacucau

SEQ ID NO: 724466 - RNA, 23 nt, Human
uagcugcugccaaugcccuccug

SEQ ID NO: 724467 - RNA, 23 nt, Human
uauaaaaauguggcgucggguuu

SEQ ID NO: 724468 - RNA, 18 nt, Human
ucagcaggucacugucca

SEQ ID NO: 724469 - RNA, 19 nt, Human
ucagggucuggcaggaaca

SEQ ID NO: 724470 - RNA, 21 nt, Human
ucccgcugcugcugcaguugc

SEQ ID NO: 724471 - RNA, 18 nt, Human
ucccggggcccauccugg

SEQ ID NO: 724472 - RNA, 19 nt, Human
ucccucgcugggcuugggg

SEQ ID NO: 724473 - RNA, 19 nt, Human
uccucuucgcccuccuccc

SEQ ID NO: 724474 - RNA, 23 nt, Human
uccucuucgcccuccucccgcug

SEQ ID NO: 724475 - RNA, 21 nt, Human
ucgcugggcuuggggccccca

SEQ ID NO: 724476 - RNA, 21 nt, Human
ucugcugcagcagccgcucuu

SEQ ID NO: 724477 - RNA, 24 nt, Human
ucugugccacacagacacgggauc

SEQ ID NO: 724478 - RNA, 21 nt, Human
ucugugccacacagacacggu

SEQ ID NO: 724479 - RNA, 25 nt, Human
ugacccacguauucgaugaccaucu

SEQ ID NO: 724480 - RNA, 18 nt, Human
ugagccagucagccccgc

SEQ ID NO: 724481 - RNA, 26 nt, Human
ugaggcaggguuccaggcacggaguc

SEQ ID NO: 724482 - RNA, 26 nt, Human
ugcagcagugguugaugaaucuggcc

SEQ ID NO: 724483 - RNA, 18 nt, Human
ugccacacagacacggga

SEQ ID NO: 724484 - RNA, 19 nt, Human
ugccgggccgagacugggc

SEQ ID NO: 724485 - RNA, 21 nt, Human
ugcguuuugggguggucaggu

SEQ ID NO: 724486 - RNA, 21 nt, Human
ugcuacaaaacauuuacagcu

SEQ ID NO: 724487 - RNA, 18 nt, Human
ugcugcugcaguugcugc

SEQ ID NO: 724488 - RNA, 21 nt, Human
ugcugcugcaguugcugcggc

SEQ ID NO: 724489 - RNA, 20 nt, Human
ugcugcugucagaggacucc

SEQ ID NO: 724490 - RNA, 19 nt, Human
ugcuuggaguagaucacga

SEQ ID NO: 724491 - RNA, 19 nt, Human
uggccacugccccagagac

SEQ ID NO: 724492 - RNA, 20 nt, Human
uggcucguaggcgcggggcg

SEQ ID NO: 724493 - RNA, 21 nt, Human
uggcugagccggggagugacc

SEQ ID NO: 724494 - RNA, 22 nt, Human
uggugggcaggggugacaggag

SEQ ID NO: 724495 - RNA, 23 nt, Human
uguacaggccggcaccccagguu

SEQ ID NO: 724496 - RNA, 21 nt, Human
ugucauacaggauggucaucu

SEQ ID NO: 724497 - RNA, 20 nt, Human
uguccucugaguccaggccc

SEQ ID NO: 724498 - RNA, 25 nt, Human
uuccacaggaaacagcugcuggcug

SEQ ID NO: 724499 - RNA, 20 nt, Human
uugcugcggcuugggcuccu

SEQ ID NO: 724500 - RNA, 19 nt, Human
aaaaaaaaacaccuggaau

SEQ ID NO: 724501 - RNA, 25 nt, Human
aaaaaaugugauaauacagcaagau

SEQ ID NO: 724502 - RNA, 21 nt, Human
aaaaacagaagaagggaaggc

SEQ ID NO: 724503 - RNA, 25 nt, Human
aaaaugcuaauucacauucuuuuug

SEQ ID NO: 724504 - RNA, 20 nt, Human
aaaauuggaaacaagcauuu

SEQ ID NO: 724505 - RNA, 27 nt, Human
aaacaccuggaauaaaaauuagaaaca

SEQ ID NO: 724506 - RNA, 25 nt, Human
aaaccaaugucagcuuuaaucucua

SEQ ID NO: 724507 - RNA, 23 nt, Human
aaacuaauacugccagacucuac

SEQ ID NO: 724508 - RNA, 24 nt, Human
aacuggccucuccuggcucuccug

SEQ ID NO: 724509 - RNA, 19 nt, Human
aacuugccagggagaacca

SEQ ID NO: 724510 - RNA, 20 nt, Human
aagcauuucaaggaaacaau

SEQ ID NO: 724511 - RNA, 22 nt, Human
aaggcagaaaagucgccacaga

SEQ ID NO: 724512 - RNA, 23 nt, Human
aaguaagaaaaaaaaacaccugg

SEQ ID NO: 724513 - RNA, 20 nt, Human
acagaagaagcuacacuaca

SEQ ID NO: 724514 - RNA, 24 nt, Human
agaacaaucaaagaccaagggagc

SEQ ID NO: 724515 - RNA, 18 nt, Human
agaagaagggaaggcaga

SEQ ID NO: 724516 - RNA, 21 nt, Human
agagauuuccuggcccagagc

SEQ ID NO: 724517 - RNA, 19 nt, Human
agcaagcagagacucauca

SEQ ID NO: 724518 - RNA, 21 nt, Human
aggaagcuaaaaccaauguca

SEQ ID NO: 724519 - RNA, 21 nt, Human
agggaaggcagaaaagucgcc

SEQ ID NO: 724520 - RNA, 18 nt, Human
agggugggcaguaaccau

SEQ ID NO: 724521 - RNA, 21 nt, Human
auucuaagucagaauggaaug

SEQ ID NO: 724522 - RNA, 19 nt, Human
auucuugacuacauucuga

SEQ ID NO: 724523 - RNA, 23 nt, Human
auugcuguccuggacauuggggu

SEQ ID NO: 724524 - RNA, 25 nt, Human
caaaagcagcagcaacauuggagac

SEQ ID NO: 724525 - RNA, 24 nt, Human
caacaagcagcaugagcagcaaaa

SEQ ID NO: 724526 - RNA, 18 nt, Human
cacaaaaaacagaagaag

SEQ ID NO: 724527 - RNA, 25 nt, Human
cacaaaaaacagaagaagggaaggc

SEQ ID NO: 724528 - RNA, 18 nt, Human
caccaucccacagugaug

SEQ ID NO: 724529 - RNA, 23 nt, Human
caccuggaauaaaaauuagaaac

SEQ ID NO: 724530 - RNA, 23 nt, Human
cagaagaagcuacacuacaagug

SEQ ID NO: 724531 - RNA, 18 nt, Human
cagaaugcguccugggcu

SEQ ID NO: 724532 - RNA, 24 nt, Human
cagagcagcagcaacugaggugag

SEQ ID NO: 724533 - RNA, 25 nt, Human
cagauggcugaggaagcuaaaacca

SEQ ID NO: 724534 - RNA, 23 nt, Human
cagcaacauggggggaaagcugg

SEQ ID NO: 724535 - RNA, 19 nt, Human
cagcaugagcagcaaaagc

SEQ ID NO: 724536 - RNA, 18 nt, Human
cagccaaguggcagugac

SEQ ID NO: 724537 - RNA, 24 nt, Human
cagugaggagucccaacauucccu

SEQ ID NO: 724538 - RNA, 22 nt, Human
ccaaaacagauccaacagaugg

SEQ ID NO: 724539 - RNA, 19 nt, Human
ccagggagaaccaagaaaa

SEQ ID NO: 724540 - RNA, 21 nt, Human
ccagggagaaccaagaaaacu

SEQ ID NO: 724541 - RNA, 24 nt, Human
ccauagccaaggcagaguuaggac

SEQ ID NO: 724542 - RNA, 18 nt, Human
cccagcgcucagaauucu

SEQ ID NO: 724543 - RNA, 23 nt, Human
cccagcgcucagaauucuaaguc

SEQ ID NO: 724544 - RNA, 20 nt, Human
ccccugggcacauacagcuc

SEQ ID NO: 724545 - RNA, 22 nt, Human
ccuccugcaaacgggcccagau

SEQ ID NO: 724546 - RNA, 21 nt, Human
ccuggcccagagcagcagcaa

SEQ ID NO: 724547 - RNA, 24 nt, Human
ccuugcuuuccauaccaggcugag

SEQ ID NO: 724548 - RNA, 19 nt, Human
cucauagcacacuugaugc

SEQ ID NO: 724549 - RNA, 22 nt, Human
cugccagacucuacuuggaaac

SEQ ID NO: 724550 - RNA, 23 nt, Human
gaaaacaacaagcagcaugagca

SEQ ID NO: 724551 - RNA, 19 nt, Human
gaggaggcugcagcugugu

SEQ ID NO: 724552 - RNA, 24 nt, Human
gaucacaaaaaacagaagaaggga

SEQ ID NO: 724553 - RNA, 22 nt, Human
gaugagggaauccauagagaga

SEQ ID NO: 724554 - RNA, 25 nt, Human
gcaaacgggcccagauccgcccucu

SEQ ID NO: 724555 - RNA, 21 nt, Human
gcaccauagccaaggcagagu

SEQ ID NO: 724556 - RNA, 25 nt, Human
gcagcaaaagcagcagcaacauggg

SEQ ID NO: 724557 - RNA, 22 nt, Human
gccacagagagaaaaggcuaac

SEQ ID NO: 724558 - RNA, 21 nt, Human
gcccaccccugggcacauaca

SEQ ID NO: 724559 - RNA, 18 nt, Human
gcucacuguggggagagg

SEQ ID NO: 724560 - RNA, 25 nt, Human
gcucccagcaacauuccccagccuu

SEQ ID NO: 724561 - RNA, 18 nt, Human
gcugcuggcucacugugg

SEQ ID NO: 724562 - RNA, 22 nt, Human
ggagaaccaagaaaacuagaug

SEQ ID NO: 724563 - RNA, 21 nt, Human
gggaaggcagaaaagucgcca

SEQ ID NO: 724564 - RNA, 21 nt, Human
gggugggguaagggugggcag

SEQ ID NO: 724565 - RNA, 18 nt, Human
gugacaacuggccucucc

SEQ ID NO: 724566 - RNA, 22 nt, Human
guuggaccaaaacagauccaac

SEQ ID NO: 724567 - RNA, 24 nt, Human
uaacuuuauaaaaaaugugauaau

SEQ ID NO: 724568 - RNA, 25 nt, Human
uaagaaaaaaaaacaccuggaauaa

SEQ ID NO: 724569 - RNA, 22 nt, Human
uagcacacuugaugcugcagca

SEQ ID NO: 724570 - RNA, 22 nt, Human
ucaccaucccacagugaugagc

SEQ ID NO: 724571 - RNA, 18 nt, Human
uccgcccucuuauaaggc

SEQ ID NO: 724572 - RNA, 18 nt, Human
ucuaacagaagaagcuac

SEQ ID NO: 724573 - RNA, 21 nt, Human
ugaaagagaaguaaugagaau

SEQ ID NO: 724574 - RNA, 22 nt, Human
ugaaagagaaguaaugagaaua

SEQ ID NO: 724575 - RNA, 19 nt, Human
ugaccagaaugcguccugg

SEQ ID NO: 724576 - RNA, 19 nt, Human
ugagagaaauagcacgggg

SEQ ID NO: 724577 - RNA, 25 nt, Human
ugagcagcaaaagcagcagcaacau

SEQ ID NO: 724578 - RNA, 22 nt, Human
ugagccagacaccccagggacc

SEQ ID NO: 724579 - RNA, 20 nt, Human
ugagcucagcaagcagagac

SEQ ID NO: 724580 - RNA, 18 nt, Human
ugagcugagggguggggu

SEQ ID NO: 724581 - RNA, 20 nt, Human
ugagcugaggggugggguaa

SEQ ID NO: 724582 - RNA, 20 nt, Human
ugaggaagcuaaaaccaaug

SEQ ID NO: 724583 - RNA, 18 nt, Human
ugaggggugggguaaggg

SEQ ID NO: 724584 - RNA, 18 nt, Human
ugaggggugggguaaggg

SEQ ID NO: 724585 - RNA, 21 nt, Human
ugccagacucuacuuggaaac

SEQ ID NO: 724586 - RNA, 21 nt, Human
ugcuccaaucugcagcucugc

SEQ ID NO: 724587 - RNA, 23 nt, Human
uggaaacaagcauuucaaggaaa

SEQ ID NO: 724588 - RNA, 19 nt, Human
uggcacagguagcuaagaa

SEQ ID NO: 724589 - RNA, 20 nt, Human
uggcucacuguggggagagg

SEQ ID NO: 724590 - RNA, 18 nt, Human
uggcugcuggcucacugu

SEQ ID NO: 724591 - RNA, 24 nt, Human
uggcuuagcuggcucccuccucug

SEQ ID NO: 724592 - RNA, 20 nt, Human
ugggcucgggguggccagug

SEQ ID NO: 724593 - RNA, 20 nt, Human
ugggguuuucuuuuuuucug

SEQ ID NO: 724594 - RNA, 21 nt, Human
ugggugaauucuugacuacau

SEQ ID NO: 724595 - RNA, 21 nt, Human
ugucaaguaagaaaaaaaaac

SEQ ID NO: 724596 - RNA, 20 nt, Human
ugucuucugccccagcgcuc

SEQ ID NO: 724597 - RNA, 21 nt, Human
uguggcaggagaugagggaau

SEQ ID NO: 724598 - RNA, 21 nt, Human
uucccauugcuguccuggaca

SEQ ID NO: 724599 - RNA, 22 nt, Human
uuccgaaggaugaggaggcugc

SEQ ID NO: 724600 - RNA, 24 nt, Human
uuggagaggcagcugggaaugcuc

SEQ ID NO: 724601 - RNA, 21 nt, Human
acccgugucuccgccucagua

SEQ ID NO: 724602 - RNA, 23 nt, Human
agccagauggaguuuggugugcc

SEQ ID NO: 724603 - RNA, 18 nt, Human
aggcaggcgggcggggcg

SEQ ID NO: 724604 - RNA, 25 nt, Human
aggcaggcgggcggggcguccggcc

SEQ ID NO: 724605 - RNA, 23 nt, Human
agugcccgcuacccccagauggc

SEQ ID NO: 724606 - RNA, 21 nt, Human
aguggguggggugggcagugc

SEQ ID NO: 724607 - RNA, 20 nt, Human
cagcaguggccccaggagcc

SEQ ID NO: 724608 - RNA, 19 nt, Human
caggcaggcgggcggggcg

SEQ ID NO: 724609 - RNA, 22 nt, Human
caggcaugugcugguggccccg

SEQ ID NO: 724610 - RNA, 25 nt, Human
cccaggagcccuggagauugggcac

SEQ ID NO: 724611 - RNA, 22 nt, Human
ccccagaaagccaaucaucacc

SEQ ID NO: 724612 - RNA, 20 nt, Human
ccccagauggcugccucagu

SEQ ID NO: 724613 - RNA, 20 nt, Human
cccccagauggcugccucag

SEQ ID NO: 724614 - RNA, 23 nt, Human
cccccagauggcugccucagucc

SEQ ID NO: 724615 - RNA, 22 nt, Human
cccccugccccagcucucuggg

SEQ ID NO: 724616 - RNA, 18 nt, Human
cccugccccagcucucug

SEQ ID NO: 724617 - RNA, 19 nt, Human
cuaaaaaaaaaaaaaaagu

SEQ ID NO: 724618 - RNA, 25 nt, Human
cuccccagaaagccaaucaucaccc

SEQ ID NO: 724619 - RNA, 24 nt, Human
cucugauaagagugcccgcuaccc

SEQ ID NO: 724620 - RNA, 21 nt, Human
cugggacgaugguccggcucc

SEQ ID NO: 724621 - RNA, 24 nt, Human
gcccccugccccagcucucuggga

SEQ ID NO: 724622 - RNA, 30 nt, Human
gcgcgggcaggcaggcgggcggggcguccc

SEQ ID NO: 724623 - RNA, 18 nt, Human
gcuaaaaaaaaaaaaaaa

SEQ ID NO: 724624 - RNA, 20 nt, Human
gcugguggccccgcggcgcc

SEQ ID NO: 724625 - RNA, 18 nt, Human
ggcaggcaggcgggcggg

SEQ ID NO: 724626 - RNA, 20 nt, Human
ggcaggcaggcgggcggggc

SEQ ID NO: 724627 - RNA, 26 nt, Human
ggguacaacagaccacaguggguggg

SEQ ID NO: 724628 - RNA, 21 nt, Human
ggugggcagugcuacggggcu

SEQ ID NO: 724629 - RNA, 21 nt, Human
guacaacagaccacagugggu

SEQ ID NO: 724630 - RNA, 20 nt, Human
gugugcccugucucauugga

SEQ ID NO: 724631 - RNA, 24 nt, Human
uauuugcuaaaaaaaaaaaaaaag

SEQ ID NO: 724632 - RNA, 18 nt, Human
uccccagaaagccaauca

SEQ ID NO: 724633 - RNA, 21 nt, Human
uccuuucacagccaauuccgg

SEQ ID NO: 724634 - RNA, 18 nt, Human
ucucugggacgauggucc

SEQ ID NO: 724635 - RNA, 24 nt, Human
ucucugggacgaugguccggcucu

SEQ ID NO: 724636 - RNA, 25 nt, Human
ucugggacgaugguccggcuccagc

SEQ ID NO: 724637 - RNA, 21 nt, Human
ugaggggagcugccaaugggg

SEQ ID NO: 724638 - RNA, 20 nt, Human
ugccucaguccuuucacagc

SEQ ID NO: 724639 - RNA, 23 nt, Human
ugccucaguccuuucacagccaa

SEQ ID NO: 724640 - RNA, 26 nt, Human
ugcgcgggcaggcaggcgggcggggc

SEQ ID NO: 724641 - RNA, 19 nt, Human
ugcuaaaaaaaaaaaaaaa

SEQ ID NO: 724642 - RNA, 22 nt, Human
ugcuaaaaaaaaaaaaaaaguu

SEQ ID NO: 724643 - RNA, 18 nt, Human
ugggguggaagggcuggg

SEQ ID NO: 724644 - RNA, 19 nt, Human
ugggguggaagggcugggc

SEQ ID NO: 724645 - RNA, 18 nt, Human
uggggugggcagugcuac

SEQ ID NO: 724646 - RNA, 21 nt, Human
uggggugggcagugcuacggg

SEQ ID NO: 724647 - RNA, 24 nt, Human
uggggugggcagugcuacggggcu

SEQ ID NO: 724648 - RNA, 22 nt, Human
uggugugcccugucucauugga

SEQ ID NO: 724649 - RNA, 19 nt, Human
aaaaaaaccucuaacagcc

SEQ ID NO: 724650 - RNA, 20 nt, Human
aaaaaaauccaagagccucu

SEQ ID NO: 724651 - RNA, 18 nt, Human
aaaaaccagccagcacac

SEQ ID NO: 724652 - RNA, 20 nt, Human
aaaaagccugggugccagac

SEQ ID NO: 724653 - RNA, 19 nt, Human
aaaaaggcaucaaacccuu

SEQ ID NO: 724654 - RNA, 24 nt, Human
aaaagaaaaaaaaaaaaccucuaa

SEQ ID NO: 724655 - RNA, 23 nt, Human
aaaauaaauaucacuuaugccaa

SEQ ID NO: 724656 - RNA, 22 nt, Human
aaacuuuuuacauaugauacau

SEQ ID NO: 724657 - RNA, 21 nt, Human
aaauucagcagaacuucuuuc

SEQ ID NO: 724658 - RNA, 22 nt, Human
aacauaugaaaaaaagccaaaa

SEQ ID NO: 724659 - RNA, 22 nt, Human
aagugaguuuucucaaagccaa

SEQ ID NO: 724660 - RNA, 23 nt, Human
aaguggcucuuguucuaggaagg

SEQ ID NO: 724661 - RNA, 23 nt, Human
acagaggccaaaauaaauaucac

SEQ ID NO: 724662 - RNA, 23 nt, Human
acaugcggaacaaaucauaaaac

SEQ ID NO: 724663 - RNA, 19 nt, Human
accacagcccaaacaaccg

SEQ ID NO: 724664 - RNA, 21 nt, Human
accuacagcccaaacaaccag

SEQ ID NO: 724665 - RNA, 22 nt, Human
agaaauaacaagagaauaucac

SEQ ID NO: 724666 - RNA, 20 nt, Human
agaaccagaaacuauaaaac

SEQ ID NO: 724667 - RNA, 19 nt, Human
agaauaucacugucugaaa

SEQ ID NO: 724668 - RNA, 22 nt, Human
agaaugaaauccagagacaacc

SEQ ID NO: 724669 - RNA, 21 nt, Human
agcagcuugucuguuccagga

SEQ ID NO: 724670 - RNA, 24 nt, Human
agccccaccuuagacaggcucaga

SEQ ID NO: 724671 - RNA, 18 nt, Human
aggaacuucugccucagc

SEQ ID NO: 724672 - RNA, 21 nt, Human
agggggagagagguggacuca

SEQ ID NO: 724673 - RNA, 21 nt, Human
agucagcuucggacccacggu

SEQ ID NO: 724674 - RNA, 20 nt, Human
agugcaagaaaaucugcuga

SEQ ID NO: 724675 - RNA, 23 nt, Human
augaauuaugccaccuacagccc

SEQ ID NO: 724676 - RNA, 22 nt, Human
auuuucuuucuauugguccucc

SEQ ID NO: 724677 - RNA, 24 nt, Human
caaaaagaauaaaaagccugggug

SEQ ID NO: 724678 - RNA, 26 nt, Human
caaaagaagcuuaccuuaaaagcuaa

SEQ ID NO: 724679 - RNA, 22 nt, Human
caaccacagcccaaacaaccag

SEQ ID NO: 724680 - RNA, 25 nt, Human
caacuagcuuaacaccagaaaauaa

SEQ ID NO: 724681 - RNA, 22 nt, Human
cacaccaggaauccaccuucuc

SEQ ID NO: 724682 - RNA, 27 nt, Human
cacaccaggaauccaccuucuccccaa

SEQ ID NO: 724683 - RNA, 18 nt, Human
cacagcccaaacaaccag

SEQ ID NO: 724684 - RNA, 25 nt, Human
caccaacccagucccaguguugggc

SEQ ID NO: 724685 - RNA, 21 nt, Human
caccaggaauccaccuucucc

SEQ ID NO: 724686 - RNA, 19 nt, Human
caccuuagacaggcucaga

SEQ ID NO: 724687 - RNA, 20 nt, Human
cacuucuuuuagcuucaguu

SEQ ID NO: 724688 - RNA, 18 nt, Human
cagaaacuauaaaacugg

SEQ ID NO: 724689 - RNA, 24 nt, Human
cagaaccagaaacuauaaaacugg

SEQ ID NO: 724690 - RNA, 21 nt, Human
cagacccccacaaaggggcug

SEQ ID NO: 724691 - RNA, 23 nt, Human
cagacccccacaaaggggcuggg

SEQ ID NO: 724692 - RNA, 20 nt, Human
cagcccugaaaaaccagcca

SEQ ID NO: 724693 - RNA, 24 nt, Human
cagcucaucugaccauucaguugg

SEQ ID NO: 724694 - RNA, 24 nt, Human
cagcugggugagucagucccacgg

SEQ ID NO: 724695 - RNA, 18 nt, Human
caggaaaugcuggcuggg

SEQ ID NO: 724696 - RNA, 20 nt, Human
caucugaaaaaaagccaaaa

SEQ ID NO: 724697 - RNA, 23 nt, Human
ccaaaauaaacaugaauuaugcc

SEQ ID NO: 724698 - RNA, 20 nt, Human
ccacagcccaaacaaccaga

SEQ ID NO: 724699 - RNA, 21 nt, Human
ccacucaguggaaccaggaag

SEQ ID NO: 724700 - RNA, 24 nt, Human
ccauaaaaaaaaaaagaaaaaaaa

SEQ ID NO: 724701 - RNA, 23 nt, Human
cccaccuuagacaggcucagaau

SEQ ID NO: 724702 - RNA, 18 nt, Human
ccuacagcccaaacaacc

SEQ ID NO: 724703 - RNA, 22 nt, Human
cggaacaaaucauaaaacuaac

SEQ ID NO: 724704 - RNA, 21 nt, Human
cucaucugaccauucaguugg

SEQ ID NO: 724705 - RNA, 21 nt, Human
cucuaagugaguuuucucaaa

SEQ ID NO: 724706 - RNA, 20 nt, Human
cugcaugugugucccccaac

SEQ ID NO: 724707 - RNA, 23 nt, Human
cugcaugugugucccccaacucu

SEQ ID NO: 724708 - RNA, 22 nt, Human
cuuagccccaccuuagacaggc

SEQ ID NO: 724709 - RNA, 18 nt, Human
cuugcucgaucuuaaaac

SEQ ID NO: 724710 - RNA, 20 nt, Human
gacccaacagaccacagaga

SEQ ID NO: 724711 - RNA, 25 nt, Human
gaccuucuuccugugauacugugga

SEQ ID NO: 724712 - RNA, 21 nt, Human
gagucagcuucggacccacgg

SEQ ID NO: 724713 - RNA, 24 nt, Human
gaguuuucucaaagccaaaagucu

SEQ ID NO: 724714 - RNA, 24 nt, Human
gcagaacuucuuucuuucuuaaaa

SEQ ID NO: 724715 - RNA, 22 nt, Human
gccauaaaaaaaaaaagaaaaa

SEQ ID NO: 724716 - RNA, 21 nt, Human
ggaaagcuggaguauuguuau

SEQ ID NO: 724717 - RNA, 22 nt, Human
ggaaccaggaaguaugacccaa

SEQ ID NO: 724718 - RNA, 19 nt, Human
ggacaccaacccaguccca

SEQ ID NO: 724719 - RNA, 18 nt, Human
gguucucaccuucuucag

SEQ ID NO: 724720 - RNA, 24 nt, Human
gucagcagaggggacaccaaccca

SEQ ID NO: 724721 - RNA, 22 nt, Human
guucucaccuucuucaguguuc

SEQ ID NO: 724722 - RNA, 23 nt, Human
uaaacauaaaacaugcggaacaa

SEQ ID NO: 724723 - RNA, 23 nt, Human
uaaauuuuagcuuggugaacaua

SEQ ID NO: 724724 - RNA, 18 nt, Human
uaauggcugggacuaugc

SEQ ID NO: 724725 - RNA, 25 nt, Human
uagaugauauacucugccccugaag

SEQ ID NO: 724726 - RNA, 22 nt, Human
uagcugaguggaacaaaacuug

SEQ ID NO: 724727 - RNA, 21 nt, Human
uauucucagagaaugaaaucc

SEQ ID NO: 724728 - RNA, 22 nt, Human
uauugguccuccucucagcugg

SEQ ID NO: 724729 - RNA, 23 nt, Human
ucaaaaucaaccacuuugcuccu

SEQ ID NO: 724730 - RNA, 21 nt, Human
ucaaagaaaacugauugaaag

SEQ ID NO: 724731 - RNA, 20 nt, Human
ucagaauuuauuccucuacu

SEQ ID NO: 724732 - RNA, 19 nt, Human
ucaguccucagaaccagaa

SEQ ID NO: 724733 - RNA, 21 nt, Human
uccuaaguuuuuggaaagccc

SEQ ID NO: 724734 - RNA, 19 nt, Human
ucuacuaagucuucaguca

SEQ ID NO: 724735 - RNA, 23 nt, Human
ucuaggaagagaagcuccuugcu

SEQ ID NO: 724736 - RNA, 23 nt, Human
ucucccaggcucugugauauucu

SEQ ID NO: 724737 - RNA, 18 nt, Human
ucucucauagucaaugga

SEQ ID NO: 724738 - RNA, 19 nt, Human
ucuuucacacacuaccuug

SEQ ID NO: 724739 - RNA, 23 nt, Human
ugaaaaaccagccagcacaccag

SEQ ID NO: 724740 - RNA, 18 nt, Human
ugacccaacagaccacag

SEQ ID NO: 724741 - RNA, 21 nt, Human
ugacccaacagaccacagaga

SEQ ID NO: 724742 - RNA, 23 nt, Human
ugcaagaaaaucugcugauggaa

SEQ ID NO: 724743 - RNA, 20 nt, Human
uggaaccaggaaguaugacu

SEQ ID NO: 724744 - RNA, 20 nt, Human
uggaagaugauuuucaucag

SEQ ID NO: 724745 - RNA, 18 nt, Human
uggacucaaaugugaauu

SEQ ID NO: 724746 - RNA, 19 nt, Human
uggcgacggucauccuccu

SEQ ID NO: 724747 - RNA, 18 nt, Human
uggcugggugggaguggg

SEQ ID NO: 724748 - RNA, 19 nt, Human
uggcuucuacauccucacu

SEQ ID NO: 724749 - RNA, 23 nt, Human
uggcuucuacauccucacuucuu

SEQ ID NO: 724750 - RNA, 24 nt, Human
ugggccacucaguggaaccaggaa

SEQ ID NO: 724751 - RNA, 25 nt, Human
uggugaacauaugaaaaaaagccaa

SEQ ID NO: 724752 - RNA, 25 nt, Human
uggugaacaucugaaaaaaagccaa

SEQ ID NO: 724753 - RNA, 25 nt, Human
ugugucccccaacucuccccuaggg

SEQ ID NO: 724754 - RNA, 18 nt, Human
uguguuuuuugguggugc

SEQ ID NO: 724755 - RNA, 18 nt, Human
uuagaaauaacaagagaa

SEQ ID NO: 724756 - RNA, 19 nt, Human
uucaucuucucccaggcuc

SEQ ID NO: 724757 - RNA, 22 nt, Human
uucuuuuagcuucaguuccaga

SEQ ID NO: 724758 - RNA, 21 nt, Human
uuggugaacaucugaaaaaaa

SEQ ID NO: 724759 - RNA, 24 nt, Human
aaaggagauguuuaucuaagucug

SEQ ID NO: 724760 - RNA, 19 nt, Human
aaauaaauggaaaaagcca

SEQ ID NO: 724761 - RNA, 22 nt, Human
aagcggaaauaaauauccaaag

SEQ ID NO: 724762 - RNA, 22 nt, Human
aaggaacaucuugggggcugug

SEQ ID NO: 724763 - RNA, 21 nt, Human
aauggaaaaagccacacuaag

SEQ ID NO: 724764 - RNA, 19 nt, Human
acacacacaaagggaggcc

SEQ ID NO: 724765 - RNA, 22 nt, Human
acagacagagucauuucaaaac

SEQ ID NO: 724766 - RNA, 22 nt, Human
acagucgagggcaggugacgua

SEQ ID NO: 724767 - RNA, 18 nt, Human
acagugaccugguccaau

SEQ ID NO: 724768 - RNA, 22 nt, Human
accugggugaggugggguccuu

SEQ ID NO: 724769 - RNA, 21 nt, Human
acgagcacaccuccacaacaa

SEQ ID NO: 724770 - RNA, 24 nt, Human
acgagcacaccuccacaacaauau

SEQ ID NO: 724771 - RNA, 19 nt, Human
acuaagaacucugaaacaa

SEQ ID NO: 724772 - RNA, 21 nt, Human
agaaaaccauucagcccucuc

SEQ ID NO: 724773 - RNA, 24 nt, Human
agaaaaccauucagcccucucagc

SEQ ID NO: 724774 - RNA, 18 nt, Human
agacagagaccauguucu

SEQ ID NO: 724775 - RNA, 24 nt, Human
agacagagucauuucaaaaccaga

SEQ ID NO: 724776 - RNA, 21 nt, Human
agagggagagugacagacuca

SEQ ID NO: 724777 - RNA, 22 nt, Human
agcgcggcucccgagacuaccc

SEQ ID NO: 724778 - RNA, 18 nt, Human
agcuggaggggaacuggc

SEQ ID NO: 724779 - RNA, 19 nt, Human
agcuggaggggaacuggcu

SEQ ID NO: 724780 - RNA, 23 nt, Human
aggaaauccucaccccacacacc

SEQ ID NO: 724781 - RNA, 19 nt, Human
aggccccuccucccaaucc

SEQ ID NO: 724782 - RNA, 19 nt, Human
aggggaacuggcucugggc

SEQ ID NO: 724783 - RNA, 23 nt, Human
aggugcuggaagcugucucuguu

SEQ ID NO: 724784 - RNA, 19 nt, Human
agugaaaaaggaauucaag

SEQ ID NO: 724785 - RNA, 24 nt, Human
agugaguaacaaagaaucacuuaa

SEQ ID NO: 724786 - RNA, 21 nt, Human
caacaauauucaaagccaagg

SEQ ID NO: 724787 - RNA, 24 nt, Human
caagaccaguuggagcccagagac

SEQ ID NO: 724788 - RNA, 21 nt, Human
caaguugccagccccagcuga

SEQ ID NO: 724789 - RNA, 28 nt, Human
cacaccuccacaacaauauucaaagcca

SEQ ID NO: 724790 - RNA, 19 nt, Human
caccagugaccagagaggu

SEQ ID NO: 724791 - RNA, 21 nt, Human
caccuccacaacaauauucaa

SEQ ID NO: 724792 - RNA, 24 nt, Human
cagaaagggacgagcacaccucca

SEQ ID NO: 724793 - RNA, 21 nt, Human
cagcagagcggcccagcgccc

SEQ ID NO: 724794 - RNA, 18 nt, Human
cagcccagcacugacauu

SEQ ID NO: 724795 - RNA, 23 nt, Human
cagcuacccagagggcuucuaag

SEQ ID NO: 724796 - RNA, 23 nt, Human
cagcuugauccucucuaccccuc

SEQ ID NO: 724797 - RNA, 18 nt, Human
cagugaccugguccaauu

SEQ ID NO: 724798 - RNA, 18 nt, Human
caucuagacaagaagauc

SEQ ID NO: 724799 - RNA, 18 nt, Human
caugagguugaaaacugc

SEQ ID NO: 724800 - RNA, 20 nt, Human
ccacacacacaaagggaggc

SEQ ID NO: 724801 - RNA, 21 nt, Human
ccacucccccuccuuggcagg

SEQ ID NO: 724802 - RNA, 22 nt, Human
ccagcacugacauucagccgga

SEQ ID NO: 724803 - RNA, 22 nt, Human
cccacacaccuggagguguccc

SEQ ID NO: 724804 - RNA, 26 nt, Human
cccacagacagagucauuucaaaacc

SEQ ID NO: 724805 - RNA, 24 nt, Human
cccagagacuucugacagcaggcu

SEQ ID NO: 724806 - RNA, 20 nt, Human
ccccaugggcgccacucccc

SEQ ID NO: 724807 - RNA, 19 nt, Human
ccccccgcuccacccugcc

SEQ ID NO: 724808 - RNA, 22 nt, Human
cccccgcuccacccugccuucc

SEQ ID NO: 724809 - RNA, 23 nt, Human
cccggcccacagcccagcacuga

SEQ ID NO: 724810 - RNA, 24 nt, Human
cccggcccacagcccagcacugac

SEQ ID NO: 724811 - RNA, 20 nt, Human
cccucggcaggccuugccgg

SEQ ID NO: 724812 - RNA, 21 nt, Human
cccucggcaggccuugccggg

SEQ ID NO: 724813 - RNA, 23 nt, Human
cccugguggacuuggggagggug

SEQ ID NO: 724814 - RNA, 21 nt, Human
cccuugcagcuggaggggaac

SEQ ID NO: 724815 - RNA, 21 nt, Human
ccgagacuacccuauggccag

SEQ ID NO: 724816 - RNA, 20 nt, Human
ccgcuggucccagccugcac

SEQ ID NO: 724817 - RNA, 19 nt, Human
ccucaccccacacaccugg

SEQ ID NO: 724818 - RNA, 22 nt, Human
ccucccagucaccuuuaauccu

SEQ ID NO: 724819 - RNA, 23 nt, Human
ccucccgggcaugcuguccagcc

SEQ ID NO: 724820 - RNA, 26 nt, Human
ccucucuaccccucuugcucuuaaaa

SEQ ID NO: 724821 - RNA, 21 nt, Human
ccucugcugguccucccgggc

SEQ ID NO: 724822 - RNA, 20 nt, Human
ccucuggaugccaggggccc

SEQ ID NO: 724823 - RNA, 21 nt, Human
ccugacuuggcaaacccagcc

SEQ ID NO: 724824 - RNA, 22 nt, Human
ccugcaagcccacauggggacu

SEQ ID NO: 724825 - RNA, 18 nt, Human
ccugguccaauucuucug

SEQ ID NO: 724826 - RNA, 21 nt, Human
ccugucugggagcgccccagc

SEQ ID NO: 724827 - RNA, 20 nt, Human
ccuugggguggggcagccac

SEQ ID NO: 724828 - RNA, 19 nt, Human
cgcagggauaggugguuga

SEQ ID NO: 724829 - RNA, 21 nt, Human
cgccuugggguggggcagcca

SEQ ID NO: 724830 - RNA, 20 nt, Human
cggcccagcgcccgcggcgg

SEQ ID NO: 724831 - RNA, 21 nt, Human
cggcggccccgacccgucucu

SEQ ID NO: 724832 - RNA, 19 nt, Human
cggcggcggaggcggugga

SEQ ID NO: 724833 - RNA, 19 nt, Human
cggcgguagcacaagcgga

SEQ ID NO: 724834 - RNA, 22 nt, Human
cgugguuuguccuuccuuuggg

SEQ ID NO: 724835 - RNA, 20 nt, Human
cuacauuccuccuuuuccug

SEQ ID NO: 724836 - RNA, 21 nt, Human
cucacggaggccccuccuccc

SEQ ID NO: 724837 - RNA, 18 nt, Human
cuccccggcccacagccc

SEQ ID NO: 724838 - RNA, 22 nt, Human
cucccgagacuacccuauggcc

SEQ ID NO: 724839 - RNA, 20 nt, Human
cucccgagcuggccgaguag

SEQ ID NO: 724840 - RNA, 20 nt, Human
cugaagacauagcugugccc

SEQ ID NO: 724841 - RNA, 23 nt, Human
cugcaagcccacauggggacugc

SEQ ID NO: 724842 - RNA, 23 nt, Human
cuggaagcugucucuguuugguu

SEQ ID NO: 724843 - RNA, 22 nt, Human
cuggccccaucugaccugcugg

SEQ ID NO: 724844 - RNA, 19 nt, Human
cuggcccuuccugccuggg

SEQ ID NO: 724845 - RNA, 18 nt, Human
cuggguguggcguguccc

SEQ ID NO: 724846 - RNA, 18 nt, Human
cugugguccuucucucca

SEQ ID NO: 724847 - RNA, 21 nt, Human
cuuaguguugauguuuuugga

SEQ ID NO: 724848 - RNA, 21 nt, Human
cuuccccccgcuccacccugc

SEQ ID NO: 724849 - RNA, 21 nt, Human
gaagcaugagucaugcuggcg

SEQ ID NO: 724850 - RNA, 22 nt, Human
gaccucugaggcuaugaccuga

SEQ ID NO: 724851 - RNA, 25 nt, Human
gagcagugucuuuuauccuccgcug

SEQ ID NO: 724852 - RNA, 21 nt, Human
gagcccagagacuucugacag

SEQ ID NO: 724853 - RNA, 18 nt, Human
gaggguggaucacggccu

SEQ ID NO: 724854 - RNA, 18 nt, Human
gaggugccgguggguccg

SEQ ID NO: 724855 - RNA, 23 nt, Human
gaggugccgguggguccugccac

SEQ ID NO: 724856 - RNA, 24 nt, Human
gaguuccugcggccagcccugcuc

SEQ ID NO: 724857 - RNA, 20 nt, Human
gaugcggcggcggaggcggu

SEQ ID NO: 724858 - RNA, 19 nt, Human
gcagagcggcccagcgccc

SEQ ID NO: 724859 - RNA, 24 nt, Human
gccacacuaagaacucugaaacag

SEQ ID NO: 724860 - RNA, 22 nt, Human
gcccacagcccagcacugacau

SEQ ID NO: 724861 - RNA, 18 nt, Human
gcccauguggcccccuuu

SEQ ID NO: 724862 - RNA, 18 nt, Human
gccccaucugaccugcug

SEQ ID NO: 724863 - RNA, 25 nt, Human
gcccugguggacuuggggagggugg

SEQ ID NO: 724864 - RNA, 18 nt, Human
gcccuuuucuuggccagg

SEQ ID NO: 724865 - RNA, 22 nt, Human
gccuucccacacuccuggcucu

SEQ ID NO: 724866 - RNA, 20 nt, Human
gcuccgggagagggacuggg

SEQ ID NO: 724867 - RNA, 20 nt, Human
gcugccugcuggguguggcg

SEQ ID NO: 724868 - RNA, 20 nt, Human
gcuggcccuuccugccuggg

SEQ ID NO: 724869 - RNA, 24 nt, Human
gcugucucuguuugguuuugguga

SEQ ID NO: 724870 - RNA, 20 nt, Human
gcuucuucccauucaaggga

SEQ ID NO: 724871 - RNA, 19 nt, Human
ggacagcggcagaggaggg

SEQ ID NO: 724872 - RNA, 27 nt, Human
ggagaaaucuuuccaugaugggagaag

SEQ ID NO: 724873 - RNA, 25 nt, Human
ggaguuccugcggccagcccugcuc

SEQ ID NO: 724874 - RNA, 19 nt, Human
ggccccugagagugacccu

SEQ ID NO: 724875 - RNA, 19 nt, Human
ggccgaggagacagagacc

SEQ ID NO: 724876 - RNA, 18 nt, Human
ggcucccgagacuacccu

SEQ ID NO: 724877 - RNA, 18 nt, Human
ggcuggugacagaggagc

SEQ ID NO: 724878 - RNA, 20 nt, Human
gggacagcggcagaggaggg

SEQ ID NO: 724879 - RNA, 19 nt, Human
gggacugggcugggacagc

SEQ ID NO: 724880 - RNA, 22 nt, Human
gggacugggcugggacagcggc

SEQ ID NO: 724881 - RNA, 20 nt, Human
gggagagugacagacucaga

SEQ ID NO: 724882 - RNA, 24 nt, Human
gggagcuccugaagacauagcugu

SEQ ID NO: 724883 - RNA, 19 nt, Human
ggggaacuggcucugggcc

SEQ ID NO: 724884 - RNA, 24 nt, Human
gggggcugugucugaugcaucugg

SEQ ID NO: 724885 - RNA, 23 nt, Human
ggucccgaggcucagaggcaucg

SEQ ID NO: 724886 - RNA, 20 nt, Human
gguccuuguaccugcagcca

SEQ ID NO: 724887 - RNA, 22 nt, Human
ggucgugguuuguccuuccuuu

SEQ ID NO: 724888 - RNA, 25 nt, Human
ggucgugguuuguccuuccuuuggg

SEQ ID NO: 724889 - RNA, 22 nt, Human
guccagaaagggacgagcacac

SEQ ID NO: 724890 - RNA, 18 nt, Human
guccgaauggggaaggga

SEQ ID NO: 724891 - RNA, 20 nt, Human
gucgugguuuguccuuccuu

SEQ ID NO: 724892 - RNA, 20 nt, Human
gugggcacaucugcuggcag

SEQ ID NO: 724893 - RNA, 21 nt, Human
guucucacugggacaaaaauu

SEQ ID NO: 724894 - RNA, 23 nt, Human
uaaaaaauaauccaaacuuucca

SEQ ID NO: 724895 - RNA, 21 nt, Human
uacacuuuucacaugacauca

SEQ ID NO: 724896 - RNA, 21 nt, Human
uagagaugguaacacugaaga

SEQ ID NO: 724897 - RNA, 21 nt, Human
uagagggugucuuccuuugau

SEQ ID NO: 724898 - RNA, 24 nt, Human
uauggccaggcuccggcggauacc

SEQ ID NO: 724899 - RNA, 20 nt, Human
ucaaaaucaguucaccccac

SEQ ID NO: 724900 - RNA, 21 nt, Human
ucacggaggccccuccuccca

SEQ ID NO: 724901 - RNA, 20 nt, Human
ucacugggacaaaaauuauu

SEQ ID NO: 724902 - RNA, 21 nt, Human
ucagagcucuggggacaccau

SEQ ID NO: 724903 - RNA, 21 nt, Human
ucaguacccacgaagcaugag

SEQ ID NO: 724904 - RNA, 20 nt, Human
ucaugccggaccagcagagc

SEQ ID NO: 724905 - RNA, 23 nt, Human
uccaaacuuuccaggaagguacu

SEQ ID NO: 724906 - RNA, 20 nt, Human
ucccacacuccuggcucuuc

SEQ ID NO: 724907 - RNA, 23 nt, Human
ucccagucaccuuuaauccucug

SEQ ID NO: 724908 - RNA, 23 nt, Human
ucccgggcaugcuguccagcccu

SEQ ID NO: 724909 - RNA, 24 nt, Human
ucccgucuccugaugcuguggucc

SEQ ID NO: 724910 - RNA, 19 nt, Human
ucccugaguggccggugca

SEQ ID NO: 724911 - RNA, 20 nt, Human
uccuccccggcccacagccc

SEQ ID NO: 724912 - RNA, 25 nt, Human
uccuuuggguuucugcccauguggg

SEQ ID NO: 724913 - RNA, 22 nt, Human
ucuacaaauuucuacguacagu

SEQ ID NO: 724914 - RNA, 22 nt, Human
ucucuguuugguuuuggugaag

SEQ ID NO: 724915 - RNA, 20 nt, Human
ucugaccugcugggacaggu

SEQ ID NO: 724916 - RNA, 19 nt, Human
ucugcagauggccacggug

SEQ ID NO: 724917 - RNA, 21 nt, Human
ucugcagauggccacgguggu

SEQ ID NO: 724918 - RNA, 21 nt, Human
ugacagaggagccauaugaca

SEQ ID NO: 724919 - RNA, 19 nt, Human
ugaccagagaggugagggg

SEQ ID NO: 724920 - RNA, 23 nt, Human
ugacgggagcuccugaagacaua

SEQ ID NO: 724921 - RNA, 19 nt, Human
ugagauggcugcugggggc

SEQ ID NO: 724922 - RNA, 19 nt, Human
ugagugucagaagccacag

SEQ ID NO: 724923 - RNA, 20 nt, Human
ugcaggcuguuccuccuggu

SEQ ID NO: 724924 - RNA, 22 nt, Human
ugccaggggcccagcguguccu

SEQ ID NO: 724925 - RNA, 24 nt, Human
ugccggaccagcagagcggcccag

SEQ ID NO: 724926 - RNA, 18 nt, Human
ugccgggacagcuggcug

SEQ ID NO: 724927 - RNA, 23 nt, Human
ugccgggacagcuggcugggccg

SEQ ID NO: 724928 - RNA, 18 nt, Human
ugccugggggagcgccuc

SEQ ID NO: 724929 - RNA, 21 nt, Human
ugcucacggaggccccuccuc

SEQ ID NO: 724930 - RNA, 19 nt, Human
ugcugccccacagacagag

SEQ ID NO: 724931 - RNA, 20 nt, Human
ugcuucagauuuauuuauug

SEQ ID NO: 724932 - RNA, 23 nt, Human
uggaagcaaagguccuuguaccu

SEQ ID NO: 724933 - RNA, 25 nt, Human
uggaggugucccccagacgcaaguu

SEQ ID NO: 724934 - RNA, 19 nt, Human
uggcaggucuggaggaaag

SEQ ID NO: 724935 - RNA, 23 nt, Human
uggccuccaaugggcuggcuccc

SEQ ID NO: 724936 - RNA, 18 nt, Human
uggcucccgagcuggccu

SEQ ID NO: 724937 - RNA, 20 nt, Human
uggcugggccgaggagacag

SEQ ID NO: 724938 - RNA, 24 nt, Human
uggcugggccgaggagacagagac

SEQ ID NO: 724939 - RNA, 18 nt, Human
ugggacagcggcagagga

SEQ ID NO: 724940 - RNA, 19 nt, Human
ugggccgaggagacagaga

SEQ ID NO: 724941 - RNA, 19 nt, Human
ugggcugugagugcugugu

SEQ ID NO: 724942 - RNA, 19 nt, Human
uggggaagggaaccauggg

SEQ ID NO: 724943 - RNA, 24 nt, Human
uggggagcuggcuacauuccuccu

SEQ ID NO: 724944 - RNA, 21 nt, Human
uggggcuggugacagaggagc

SEQ ID NO: 724945 - RNA, 20 nt, Human
ugggguggggcagccacuug

SEQ ID NO: 724946 - RNA, 23 nt, Human
ugguaacacugaagaaggugcug

SEQ ID NO: 724947 - RNA, 19 nt, Human
ugguccaauucuucugugc

SEQ ID NO: 724948 - RNA, 18 nt, Human
uggucuuccccccgcucc

SEQ ID NO: 724949 - RNA, 19 nt, Human
uggugaagagaaaugagga

SEQ ID NO: 724950 - RNA, 20 nt, Human
ugguggacuuggggagggug

SEQ ID NO: 724951 - RNA, 21 nt, Human
ugguuuguccuuccuuugggu

SEQ ID NO: 724952 - RNA, 21 nt, Human
ugucagaagccacagccccca

SEQ ID NO: 724953 - RNA, 25 nt, Human
ugucuggacuggccugucugggagc

SEQ ID NO: 724954 - RNA, 20 nt, Human
ugugguccuucucuccauga

SEQ ID NO: 724955 - RNA, 20 nt, Human
uucaaagccaagguuuggga

SEQ ID NO: 724956 - RNA, 19 nt, Human
uuccuccuggucacgccuu

SEQ ID NO: 724957 - RNA, 23 nt, Human
uugauccucucuaccccucuugc

SEQ ID NO: 724958 - RNA, 25 nt, Human
uugccagccccagcugaaagaggcc

SEQ ID NO: 724959 - RNA, 18 nt, Human
uugccgggacagcuggcu

SEQ ID NO: 724960 - RNA, 24 nt, Human
uugcucuuaaaaaauuaagcaaca

SEQ ID NO: 724961 - RNA, 24 nt, Human
uugggggcugugucugaugcaucu

SEQ ID NO: 724962 - RNA, 25 nt, Human
uuuacauauuuuuagcucaaggaaa

SEQ ID NO: 724963 - RNA, 25 nt, Human
uuuauugcaucuagacaagaagauc

SEQ ID NO: 724964 - RNA, 23 nt, Human
uuuucauuuccacccucguguuc

SEQ ID NO: 724965 - RNA, 22 nt, Human
aaaaccuaucaguaaacuaaaa

SEQ ID NO: 724966 - RNA, 20 nt, Human
aaacacaacacagaacagaa

SEQ ID NO: 724967 - RNA, 19 nt, Human
aaacagaugacuauaucaa

SEQ ID NO: 724968 - RNA, 24 nt, Human
aaacagcccgggguguugcugaau

SEQ ID NO: 724969 - RNA, 20 nt, Human
aaacagguacucacagauca

SEQ ID NO: 724970 - RNA, 23 nt, Human
aaaccacacuuugugcugaacaa

SEQ ID NO: 724971 - RNA, 21 nt, Human
aaaccucccuuuaccuccucu

SEQ ID NO: 724972 - RNA, 18 nt, Human
aaagagucccagaugggu

SEQ ID NO: 724973 - RNA, 20 nt, Human
aaagccccuuagaaaaccaa

SEQ ID NO: 724974 - RNA, 24 nt, Human
aaaucaaaugaacagaaagucaaa

SEQ ID NO: 724975 - RNA, 22 nt, Human
aaauccuguuucuuuggaaaug

SEQ ID NO: 724976 - RNA, 20 nt, Human
aagacaggaggcuuccaaac

SEQ ID NO: 724977 - RNA, 22 nt, Human
aaguuaagcagucuugggcuug

SEQ ID NO: 724978 - RNA, 21 nt, Human
acacauuuccuucuuaaauuc

SEQ ID NO: 724979 - RNA, 28 nt, Human
acaccacgggccaaacacuucuggacca

SEQ ID NO: 724980 - RNA, 20 nt, Human
acagcaauagauaguaaacc

SEQ ID NO: 724981 - RNA, 23 nt, Human
acagcccgggguguugcugaauc

SEQ ID NO: 724982 - RNA, 22 nt, Human
acagucagaacgcacacccugc

SEQ ID NO: 724983 - RNA, 20 nt, Human
accaccaccuugaaauuuuu

SEQ ID NO: 724984 - RNA, 23 nt, Human
accccugguucuccacaucucuc

SEQ ID NO: 724985 - RNA, 19 nt, Human
acccugaucaaucugauca

SEQ ID NO: 724986 - RNA, 21 nt, Human
acuggagugccaggauacuag

SEQ ID NO: 724987 - RNA, 23 nt, Human
agaacagaauuccuaccaaggca

SEQ ID NO: 724988 - RNA, 19 nt, Human
agacaugacuuuggugggg

SEQ ID NO: 724989 - RNA, 18 nt, Human
agaccaccccauagagcc

SEQ ID NO: 724990 - RNA, 18 nt, Human
agagacaaucuggagaag

SEQ ID NO: 724991 - RNA, 20 nt, Human
agcaacaaaaucaaaugaac

SEQ ID NO: 724992 - RNA, 26 nt, Human
agcaauagauaguaaacacuuaaaua

SEQ ID NO: 724993 - RNA, 24 nt, Human
agcugacaaagcuccggcacuguu

SEQ ID NO: 724994 - RNA, 18 nt, Human
agcugguccugaguacau

SEQ ID NO: 724995 - RNA, 21 nt, Human
aggcaaaauuauaacuucagc

SEQ ID NO: 724996 - RNA, 22 nt, Human
aggccagggacucccagagcuc

SEQ ID NO: 724997 - RNA, 23 nt, Human
aggcuggggaagggggucuagug

SEQ ID NO: 724998 - RNA, 23 nt, Human
aucuacaccacgggccaaacacu

SEQ ID NO: 724999 - RNA, 21 nt, Human
augagcuacugauccuaugac

SEQ ID NO: 725000 - RNA, 19 nt, Human
auggagccucugcuguuua

SEQ ID NO: 725001 - RNA, 20 nt, Human
auggagucagcucaucuaca

SEQ ID NO: 725002 - RNA, 19 nt, Human
caaaaccagccucaaaaga

SEQ ID NO: 725003 - RNA, 24 nt, Human
caaaaucaaaugaacagaaaguca

SEQ ID NO: 725004 - RNA, 21 nt, Human
caaagccccuuagaaaaccaa

SEQ ID NO: 725005 - RNA, 19 nt, Human
caaaguaaacagguuaccc

SEQ ID NO: 725006 - RNA, 24 nt, Human
caacaaaucucaugagcuacugau

SEQ ID NO: 725007 - RNA, 19 nt, Human
caacaacaguaacagcuua

SEQ ID NO: 725008 - RNA, 20 nt, Human
caacacagaacagaauuccu

SEQ ID NO: 725009 - RNA, 23 nt, Human
caacaguaacagcuuaugugcua

SEQ ID NO: 725010 - RNA, 22 nt, Human
cacaacacagaacagaauuccu

SEQ ID NO: 725011 - RNA, 18 nt, Human
cacacucugcagccaccc

SEQ ID NO: 725012 - RNA, 20 nt, Human
cacaguuucagguuaaguac

SEQ ID NO: 725013 - RNA, 21 nt, Human
caccaagacacucauggccaa

SEQ ID NO: 725014 - RNA, 23 nt, Human
caccacgggccaaacacuucugg

SEQ ID NO: 725015 - RNA, 19 nt, Human
caccaggggcagugccagg

SEQ ID NO: 725016 - RNA, 23 nt, Human
caccaggggcagugccagggcug

SEQ ID NO: 725017 - RNA, 22 nt, Human
caccccauagagcccacuccca

SEQ ID NO: 725018 - RNA, 20 nt, Human
cacccugccuccugacucau

SEQ ID NO: 725019 - RNA, 21 nt, Human
cacuucauggagucagcucau

SEQ ID NO: 725020 - RNA, 20 nt, Human
cagaacagaauuccuaccaa

SEQ ID NO: 725021 - RNA, 23 nt, Human
cagaaguggccaaaacagaugac

SEQ ID NO: 725022 - RNA, 21 nt, Human
cagagcuuccuagcgggugcu

SEQ ID NO: 725023 - RNA, 23 nt, Human
cagaggaagcagacaugacuuug

SEQ ID NO: 725024 - RNA, 23 nt, Human
cagcagagcuuccuagcgggugc

SEQ ID NO: 725025 - RNA, 24 nt, Human
cagccucaaaagaaugaaaaacau

SEQ ID NO: 725026 - RNA, 23 nt, Human
cagcuccuaugaaauuaccuccu

SEQ ID NO: 725027 - RNA, 25 nt, Human
caguaacacccacagugaaaaccuc

SEQ ID NO: 725028 - RNA, 23 nt, Human
caguuaauccggcucugcggcgc

SEQ ID NO: 725029 - RNA, 24 nt, Human
caugucacuuguuccccucaaccc

SEQ ID NO: 725030 - RNA, 24 nt, Human
cauugcuggucaucccaguuggag

SEQ ID NO: 725031 - RNA, 24 nt, Human
ccaaaacagaugacuauaucaaag

SEQ ID NO: 725032 - RNA, 21 nt, Human
ccaccucuccaccaagacacu

SEQ ID NO: 725033 - RNA, 22 nt, Human
ccaccucuccaccaagacacuc

SEQ ID NO: 725034 - RNA, 24 nt, Human
ccaccucuccaccaagacacucau

SEQ ID NO: 725035 - RNA, 19 nt, Human
ccagagagccaggcacucc

SEQ ID NO: 725036 - RNA, 18 nt, Human
ccaguuacucaggucccu

SEQ ID NO: 725037 - RNA, 24 nt, Human
ccaguuggaggccugcaguaacac

SEQ ID NO: 725038 - RNA, 24 nt, Human
cccaaaaccagccucaaaagaaug

SEQ ID NO: 725039 - RNA, 27 nt, Human
cccaaagcuuucugaccuaaauagaaa

SEQ ID NO: 725040 - RNA, 20 nt, Human
cccacagaaggccggacguc

SEQ ID NO: 725041 - RNA, 18 nt, Human
cccauagagcccacuccc

SEQ ID NO: 725042 - RNA, 20 nt, Human
ccccaccucuccaccaagac

SEQ ID NO: 725043 - RNA, 19 nt, Human
ccggcacacucugcagcca

SEQ ID NO: 725044 - RNA, 24 nt, Human
ccucacaaguaugcaagaucgagg

SEQ ID NO: 725045 - RNA, 21 nt, Human
ccucuccuguccauccaggcu

SEQ ID NO: 725046 - RNA, 21 nt, Human
ccuggaauuuaacugucccga

SEQ ID NO: 725047 - RNA, 27 nt, Human
cggcacuguuagcacaaaguaaacaac

SEQ ID NO: 725048 - RNA, 19 nt, Human
cgggugcuguggcaucagu

SEQ ID NO: 725049 - RNA, 24 nt, Human
cgucaacaacucuucucuguuuca

SEQ ID NO: 725050 - RNA, 22 nt, Human
cucaaaagaaugaaaaacauag

SEQ ID NO: 725051 - RNA, 23 nt, Human
cucaaaagaaugaaaaacauagc

SEQ ID NO: 725052 - RNA, 20 nt, Human
cucacagaucagaaaagcag

SEQ ID NO: 725053 - RNA, 24 nt, Human
cucucucacaccagcauuucaaaa

SEQ ID NO: 725054 - RNA, 23 nt, Human
cugaaccagcugccauccaauag

SEQ ID NO: 725055 - RNA, 22 nt, Human
cugcaggacaccccuucuggcu

SEQ ID NO: 725056 - RNA, 23 nt, Human
cuggagacaaacagguacucaca

SEQ ID NO: 725057 - RNA, 19 nt, Human
gaaaacaaguugggaaugg

SEQ ID NO: 725058 - RNA, 23 nt, Human
gaagaggauguucaaggcuuaaa

SEQ ID NO: 725059 - RNA, 20 nt, Human
gagcuccccguggcucugcc

SEQ ID NO: 725060 - RNA, 23 nt, Human
gagcuuccuagcgggugcugugg

SEQ ID NO: 725061 - RNA, 19 nt, Human
gcucucagccacucggcug

SEQ ID NO: 725062 - RNA, 21 nt, Human
gcugacaaagcuccggcacug

SEQ ID NO: 725063 - RNA, 18 nt, Human
gcugaggccagggacucc

SEQ ID NO: 725064 - RNA, 20 nt, Human
gcuguggcaucagugaguca

SEQ ID NO: 725065 - RNA, 22 nt, Human
gcuguugcuucucaacaacagu

SEQ ID NO: 725066 - RNA, 21 nt, Human
ggaaggaguuagacgucaaca

SEQ ID NO: 725067 - RNA, 22 nt, Human
ggagaagccagucagcaaugaa

SEQ ID NO: 725068 - RNA, 19 nt, Human
ggagcuccccguggcucug

SEQ ID NO: 725069 - RNA, 18 nt, Human
gggaaacgggaaguucag

SEQ ID NO: 725070 - RNA, 27 nt, Human
gggaaggguuuuaaagaaacaucaaaa

SEQ ID NO: 725071 - RNA, 20 nt, Human
gggcuggggacaagcagcag

SEQ ID NO: 725072 - RNA, 23 nt, Human
ggggucaccaacagggagagggu

SEQ ID NO: 725073 - RNA, 21 nt, Human
gggguggggggaaacgggaag

SEQ ID NO: 725074 - RNA, 21 nt, Human
ggugggguggggggaaacggg

SEQ ID NO: 725075 - RNA, 21 nt, Human
gucagcucaucuacaccacgg

SEQ ID NO: 725076 - RNA, 18 nt, Human
gugcagaccaccccauag

SEQ ID NO: 725077 - RNA, 22 nt, Human
gugccagggcugaggccaggga

SEQ ID NO: 725078 - RNA, 23 nt, Human
uaaaaccuaucaguaaacuaaaa

SEQ ID NO: 725079 - RNA, 23 nt, Human
uaaacuaaaacuagagaggcugg

SEQ ID NO: 725080 - RNA, 21 nt, Human
uaaagucucuuauacaaaaga

SEQ ID NO: 725081 - RNA, 20 nt, Human
uaacacccacagugaaaacc

SEQ ID NO: 725082 - RNA, 20 nt, Human
uaagcagacaccaacauccc

SEQ ID NO: 725083 - RNA, 26 nt, Human
uacacagaccacccagcauccaugau

SEQ ID NO: 725084 - RNA, 22 nt, Human
uacagcaauagauaguaaacac

SEQ ID NO: 725085 - RNA, 19 nt, Human
uacagugucuaucuagaau

SEQ ID NO: 725086 - RNA, 23 nt, Human
uaccagguaucccagggugcccu

SEQ ID NO: 725087 - RNA, 25 nt, Human
uagaucccaaaaccagccucaaaag

SEQ ID NO: 725088 - RNA, 24 nt, Human
uagcaaaaaccugucuaggaaaaa

SEQ ID NO: 725089 - RNA, 21 nt, Human
uaggacagacagucagaacgc

SEQ ID NO: 725090 - RNA, 23 nt, Human
uauaaaaaaaaacuuuuacccau

SEQ ID NO: 725091 - RNA, 20 nt, Human
uauacaaaaacaaaaauaaa

SEQ ID NO: 725092 - RNA, 22 nt, Human
ucaaaugaacagaaagucaaaa

SEQ ID NO: 725093 - RNA, 22 nt, Human
ucaacaacucuucucuguuuca

SEQ ID NO: 725094 - RNA, 19 nt, Human
ucacuguucaaucagcaga

SEQ ID NO: 725095 - RNA, 23 nt, Human
ucaguaaacuaaaacuagagagg

SEQ ID NO: 725096 - RNA, 18 nt, Human
ucccaaaaccagccucaa

SEQ ID NO: 725097 - RNA, 19 nt, Human
uccccucaacccugucccc

SEQ ID NO: 725098 - RNA, 21 nt, Human
ucccugcugagggcuggaacc

SEQ ID NO: 725099 - RNA, 21 nt, Human
uccuggcugcugcuugggagc

SEQ ID NO: 725100 - RNA, 21 nt, Human
ucucacaccagcauuucaaaa

SEQ ID NO: 725101 - RNA, 23 nt, Human
ucucugccccacagaaggccgga

SEQ ID NO: 725102 - RNA, 18 nt, Human
ucugacugggaccaacug

SEQ ID NO: 725103 - RNA, 22 nt, Human
ucugcagccacccacggagggc

SEQ ID NO: 725104 - RNA, 19 nt, Human
ugaaaaacauagcccugca

SEQ ID NO: 725105 - RNA, 21 nt, Human
ugaaaaccucccuuuaccucc

SEQ ID NO: 725106 - RNA, 22 nt, Human
ugaccaccaccuugaaauuuuu

SEQ ID NO: 725107 - RNA, 18 nt, Human
ugacccuuaucccaccuc

SEQ ID NO: 725108 - RNA, 22 nt, Human
ugacuauaucaaagugguuccc

SEQ ID NO: 725109 - RNA, 21 nt, Human
ugagcuggaggcagaggaagc

SEQ ID NO: 725110 - RNA, 18 nt, Human
ugaggccagggacuccca

SEQ ID NO: 725111 - RNA, 22 nt, Human
ugaggggacugcccugcugacc

SEQ ID NO: 725112 - RNA, 19 nt, Human
ugccaggauacuaaucucu

SEQ ID NO: 725113 - RNA, 18 nt, Human
ugcccugcugaccugucu

SEQ ID NO: 725114 - RNA, 22 nt, Human
ugcugcugucagauacaucccc

SEQ ID NO: 725115 - RNA, 22 nt, Human
uggaaggaguuagacgucaaca

SEQ ID NO: 725116 - RNA, 22 nt, Human
uggagacaaacagguacucaca

SEQ ID NO: 725117 - RNA, 21 nt, Human
uggagucagcucaucuacacc

SEQ ID NO: 725118 - RNA, 21 nt, Human
uggcaaaaagggaaaacuuca

SEQ ID NO: 725119 - RNA, 28 nt, Human
uggcaaaaagggaaaacuucacaguuuc

SEQ ID NO: 725120 - RNA, 18 nt, Human
uggcacugcaggacaccc

SEQ ID NO: 725121 - RNA, 18 nt, Human
uggccuggagacaaacag

SEQ ID NO: 725122 - RNA, 20 nt, Human
ugggagaagaggauguucaa

SEQ ID NO: 725123 - RNA, 21 nt, Human
ugggagaagaggauguucaag

SEQ ID NO: 725124 - RNA, 22 nt, Human
ugggagaagaggauguucaagg

SEQ ID NO: 725125 - RNA, 24 nt, Human
ugggcaaagccccuuagaaaacca

SEQ ID NO: 725126 - RNA, 19 nt, Human
ugggcuuggggaaaggggc

SEQ ID NO: 725127 - RNA, 24 nt, Human
uggggaaaggggcacagaaggagg

SEQ ID NO: 725128 - RNA, 22 nt, Human
ugggggcggcgaguggauugga

SEQ ID NO: 725129 - RNA, 21 nt, Human
uggguuuagauggucaaaggu

SEQ ID NO: 725130 - RNA, 20 nt, Human
ugucuugucccugcugaggg

SEQ ID NO: 725131 - RNA, 25 nt, Human
uguuccccucaacccuguccccaau

SEQ ID NO: 725132 - RNA, 20 nt, Human
uuaaaaaugcaaaauaaaau

SEQ ID NO: 725133 - RNA, 23 nt, Human
uuaaauauuaggaggucaguacu

SEQ ID NO: 725134 - RNA, 21 nt, Human
uuagauaucagcauccuggcu

SEQ ID NO: 725135 - RNA, 21 nt, Human
uuauucuaaauaaaaaccaca

SEQ ID NO: 725136 - RNA, 21 nt, Human
uucagaagagggugagcugga

SEQ ID NO: 725137 - RNA, 20 nt, Human
uucccuggguuuauuaugcu

SEQ ID NO: 725138 - RNA, 21 nt, Human
uucuuugggcaaagccccuua

SEQ ID NO: 725139 - RNA, 22 nt, Human
uuuaaacuggccacuguacaag

SEQ ID NO: 725140 - RNA, 24 nt, Human
uuuggugggguggggggaaacggg

SEQ ID NO: 725141 - RNA, 20 nt, Human
aaauuuuuaaaugugccacu

SEQ ID NO: 725142 - RNA, 21 nt, Human
aacaacuuuaaacauuuggua

SEQ ID NO: 725143 - RNA, 21 nt, Human
aagagccacugggcagcugga

SEQ ID NO: 725144 - RNA, 18 nt, Human
aagcaaaguccacuuaug

SEQ ID NO: 725145 - RNA, 20 nt, Human
aaggacacuggcccacaagc

SEQ ID NO: 725146 - RNA, 22 nt, Human
aagguuaaucucacaagacacu

SEQ ID NO: 725147 - RNA, 21 nt, Human
aaguacacacuccauuuacaa

SEQ ID NO: 725148 - RNA, 23 nt, Human
aaguuguaaccagcauagcacca

SEQ ID NO: 725149 - RNA, 26 nt, Human
acaaagacaaacacaagucuuuucug

SEQ ID NO: 725150 - RNA, 21 nt, Human
acaaggacacuggcccacaag

SEQ ID NO: 725151 - RNA, 22 nt, Human
accaaaucaccacugguuacac

SEQ ID NO: 725152 - RNA, 20 nt, Human
acccaaaaccaguuauaauc

SEQ ID NO: 725153 - RNA, 20 nt, Human
acccgccccccucccacccc

SEQ ID NO: 725154 - RNA, 18 nt, Human
acgggacuuccucccccu

SEQ ID NO: 725155 - RNA, 19 nt, Human
acugacauggaugccuuga

SEQ ID NO: 725156 - RNA, 19 nt, Human
acuggccucagcguugucu

SEQ ID NO: 725157 - RNA, 20 nt, Human
agaaaaaacuguuaaaacau

SEQ ID NO: 725158 - RNA, 19 nt, Human
agagauuccagguuccauc

SEQ ID NO: 725159 - RNA, 24 nt, Human
agagguaagcgggcaggcuccugg

SEQ ID NO: 725160 - RNA, 19 nt, Human
agauaagccccaaaagcaa

SEQ ID NO: 725161 - RNA, 22 nt, Human
agaugccaagcgccccuggaac

SEQ ID NO: 725162 - RNA, 26 nt, Human
agcagaacaaagacaaacacaagucu

SEQ ID NO: 725163 - RNA, 19 nt, Human
agcauguaucagagauaag

SEQ ID NO: 725164 - RNA, 22 nt, Human
agccacugggcagcuggaagcc

SEQ ID NO: 725165 - RNA, 20 nt, Human
agccuagaaaauauuuaccc

SEQ ID NO: 725166 - RNA, 20 nt, Human
aggcagggcuccagcaugua

SEQ ID NO: 725167 - RNA, 19 nt, Human
agggaaggagggcugcacc

SEQ ID NO: 725168 - RNA, 19 nt, Human
agggcugcaccgcucugcc

SEQ ID NO: 725169 - RNA, 21 nt, Human
agggucuguacuguuaaaagu

SEQ ID NO: 725170 - RNA, 19 nt, Human
auacugcucaaacagcaca

SEQ ID NO: 725171 - RNA, 20 nt, Human
augccaagcgccccuggaac

SEQ ID NO: 725172 - RNA, 23 nt, Human
auggagaacaggcuuguccucgg

SEQ ID NO: 725173 - RNA, 21 nt, Human
auucagguacccaaaaccagu

SEQ ID NO: 725174 - RNA, 20 nt, Human
auuuacccaugaacacuacc

SEQ ID NO: 725175 - RNA, 22 nt, Human
caaaacaugacuccacaucagc

SEQ ID NO: 725176 - RNA, 22 nt, Human
caagguuaaucucacaagacac

SEQ ID NO: 725177 - RNA, 21 nt, Human
cacacguagaaacugacagac

SEQ ID NO: 725178 - RNA, 23 nt, Human
caccagaaaagauucuacaugau

SEQ ID NO: 725179 - RNA, 18 nt, Human
caccccgccucuaguccc

SEQ ID NO: 725180 - RNA, 22 nt, Human
cagaacaaagacaaacacaagu

SEQ ID NO: 725181 - RNA, 19 nt, Human
cagcaaggugaggcugggg

SEQ ID NO: 725182 - RNA, 19 nt, Human
cagcagaacaaagacaaac

SEQ ID NO: 725183 - RNA, 22 nt, Human
cagcagaacaaagacaaacaca

SEQ ID NO: 725184 - RNA, 18 nt, Human
cauguaaaggguggaugg

SEQ ID NO: 725185 - RNA, 21 nt, Human
cauuuugcaucacuauacagg

SEQ ID NO: 725186 - RNA, 27 nt, Human
ccaaaaccaguuauaauccagguagaa

SEQ ID NO: 725187 - RNA, 19 nt, Human
ccaaauggaagggaaggag

SEQ ID NO: 725188 - RNA, 23 nt, Human
ccacaaaacaugacuccacauca

SEQ ID NO: 725189 - RNA, 19 nt, Human
ccacugggcagcuggaagc

SEQ ID NO: 725190 - RNA, 20 nt, Human
ccacugggcagcuggaagcc

SEQ ID NO: 725191 - RNA, 21 nt, Human
ccagaaaaaacuguuaaaaca

SEQ ID NO: 725192 - RNA, 20 nt, Human
ccaggcagggccucucauuu

SEQ ID NO: 725193 - RNA, 23 nt, Human
cccacugugucccaagguuaauc

SEQ ID NO: 725194 - RNA, 24 nt, Human
cccaugaacacuaccauguuugga

SEQ ID NO: 725195 - RNA, 19 nt, Human
ccccaaaagcaaaguccac

SEQ ID NO: 725196 - RNA, 20 nt, Human
ccccaaaagcaaaguccacu

SEQ ID NO: 725197 - RNA, 21 nt, Human
ccccaaggaagcaccugguuu

SEQ ID NO: 725198 - RNA, 23 nt, Human
ccccaaggaagcaccugguuuca

SEQ ID NO: 725199 - RNA, 22 nt, Human
ccccccucccaccccgccucua

SEQ ID NO: 725200 - RNA, 22 nt, Human
ccccuggacgcacacuuggccu

SEQ ID NO: 725201 - RNA, 21 nt, Human
ccccuggacgcacacuugguc

SEQ ID NO: 725202 - RNA, 19 nt, Human
ccccuuccacccgcccccc

SEQ ID NO: 725203 - RNA, 18 nt, Human
ccguuacgggacuuccuc

SEQ ID NO: 725204 - RNA, 21 nt, Human
ccuaacauggaacuguaacau

SEQ ID NO: 725205 - RNA, 21 nt, Human
ccuagugccuccaacagucuc

SEQ ID NO: 725206 - RNA, 20 nt, Human
ccucccaccccgccucuagu

SEQ ID NO: 725207 - RNA, 21 nt, Human
ccugguuucagggauugcauc

SEQ ID NO: 725208 - RNA, 26 nt, Human
cuaacagcccugauggcagugucaga

SEQ ID NO: 725209 - RNA, 21 nt, Human
cucacacguagaaacugacag

SEQ ID NO: 725210 - RNA, 22 nt, Human
cucccuggguccaggcagggcc

SEQ ID NO: 725211 - RNA, 24 nt, Human
cugaaggaggcggugaccccucuc

SEQ ID NO: 725212 - RNA, 18 nt, Human
cugacugcauuacucaac

SEQ ID NO: 725213 - RNA, 22 nt, Human
cuggacccagugucagcaccaa

SEQ ID NO: 725214 - RNA, 24 nt, Human
cuuccacccgccccccucccaccc

SEQ ID NO: 725215 - RNA, 20 nt, Human
gaaggaggcggugaccccuc

SEQ ID NO: 725216 - RNA, 20 nt, Human
gacuuccucccccuuccacc

SEQ ID NO: 725217 - RNA, 19 nt, Human
gaggcuggggaagugaggc

SEQ ID NO: 725218 - RNA, 24 nt, Human
gaguugcuauauggggaggggaga

SEQ ID NO: 725219 - RNA, 23 nt, Human
gcccuagugccuccaacagucuc

SEQ ID NO: 725220 - RNA, 30 nt, Human
gcuacagcauguacaaggacacuggcccag

SEQ ID NO: 725221 - RNA, 18 nt, Human
gcuccucucccugggucc

SEQ ID NO: 725222 - RNA, 21 nt, Human
gcuccuggcaccaccuccucc

SEQ ID NO: 725223 - RNA, 19 nt, Human
ggaggggagagugaagaaa

SEQ ID NO: 725224 - RNA, 18 nt, Human
ggcaccaccuccuccaaa

SEQ ID NO: 725225 - RNA, 18 nt, Human
ggcuccuggcaccaccuc

SEQ ID NO: 725226 - RNA, 18 nt, Human
gguguguccucaaaggcc

SEQ ID NO: 725227 - RNA, 19 nt, Human
guccucggguaggaugugu

SEQ ID NO: 725228 - RNA, 24 nt, Human
guuacgggacuuccucccccuucc

SEQ ID NO: 725229 - RNA, 19 nt, Human
guuuuccagggaacccugg

SEQ ID NO: 725230 - RNA, 25 nt, Human
uaaaaauaaaaaauacaguacuuug

SEQ ID NO: 725231 - RNA, 25 nt, Human
uaaaccagaaaaaacuguuaaaaca

SEQ ID NO: 725232 - RNA, 23 nt, Human
uaaagcauuuguggcagacaggu

SEQ ID NO: 725233 - RNA, 26 nt, Human
uaaccaaucaaaauucagguacccaa

SEQ ID NO: 725234 - RNA, 19 nt, Human
uaaccugugcuguuccccu

SEQ ID NO: 725235 - RNA, 18 nt, Human
uaagacaggcaccaaauc

SEQ ID NO: 725236 - RNA, 20 nt, Human
uaagagccacugggcagcug

SEQ ID NO: 725237 - RNA, 18 nt, Human
uaagagguagaugagaga

SEQ ID NO: 725238 - RNA, 22 nt, Human
uaagccccaaaagcaaagucca

SEQ ID NO: 725239 - RNA, 18 nt, Human
uaaggcuaaccaaucaaa

SEQ ID NO: 725240 - RNA, 22 nt, Human
uacagaucauaggaacccuggg

SEQ ID NO: 725241 - RNA, 21 nt, Human
uacaucauguaaaggguggau

SEQ ID NO: 725242 - RNA, 18 nt, Human
uaggaacccugggacugg

SEQ ID NO: 725243 - RNA, 20 nt, Human
uaguccccuagcuccuccag

SEQ ID NO: 725244 - RNA, 19 nt, Human
ucacucagaaaugcagcag

SEQ ID NO: 725245 - RNA, 19 nt, Human
ucagcagagguaagcgggc

SEQ ID NO: 725246 - RNA, 19 nt, Human
ucaguccaugggagaugcc

SEQ ID NO: 725247 - RNA, 22 nt, Human
uccagcuacacauacuuagcuu

SEQ ID NO: 725248 - RNA, 23 nt, Human
ucccaccccgccucuaguccccu

SEQ ID NO: 725249 - RNA, 22 nt, Human
ucccuggguccaggcagggccu

SEQ ID NO: 725250 - RNA, 18 nt, Human
uccuggcaccaccuccuc

SEQ ID NO: 725251 - RNA, 19 nt, Human
ucuagauuaacaggagaga

SEQ ID NO: 725252 - RNA, 20 nt, Human
ucucagaugcuacuugauua

SEQ ID NO: 725253 - RNA, 21 nt, Human
ucuccaggcuaacccacugug

SEQ ID NO: 725254 - RNA, 22 nt, Human
ucuccaggcuaacccacugugu

SEQ ID NO: 725255 - RNA, 19 nt, Human
ugccaagcgccccuggaac

SEQ ID NO: 725256 - RNA, 18 nt, Human
ugcuaaacuguuuaagag

SEQ ID NO: 725257 - RNA, 22 nt, Human
uggaagccucgaacccaaaggc

SEQ ID NO: 725258 - RNA, 18 nt, Human
uggcaccaccuccuccaa

SEQ ID NO: 725259 - RNA, 18 nt, Human
uggcagugucagaggaca

SEQ ID NO: 725260 - RNA, 21 nt, Human
ugguuaaaauacugcucaaac

SEQ ID NO: 725261 - RNA, 24 nt, Human
ugucuaagaaagcuauauaaaaca

SEQ ID NO: 725262 - RNA, 18 nt, Human
uuaaaacaucuauccaac

SEQ ID NO: 725263 - RNA, 25 nt, Human
uuaacugcuuaccaaaagaaauuca

SEQ ID NO: 725264 - RNA, 27 nt, Human
uuacgggacuuccucccccuuccaccc

SEQ ID NO: 725265 - RNA, 23 nt, Human
uucacaggaccucauauccucca

SEQ ID NO: 725266 - RNA, 20 nt, Human
uucuccaggcuaacccacug

SEQ ID NO: 725267 - RNA, 25 nt, Human
uuggauuucaaacaacuuuaaacau

SEQ ID NO: 725268 - RNA, 25 nt, Human
uuucagggauugcaucccuuuccca

SEQ ID NO: 725269 - RNA, 22 nt, Human
aaaaagcuauaaaauacaguga

SEQ ID NO: 725270 - RNA, 24 nt, Human
aaaagacaacaccugaggccuggg

SEQ ID NO: 725271 - RNA, 22 nt, Human
aaacccagaagcugaucaacag

SEQ ID NO: 725272 - RNA, 24 nt, Human
aaagugcugggauuacaggcguga

SEQ ID NO: 725273 - RNA, 19 nt, Human
aaauucuccaaauuuccuc

SEQ ID NO: 725274 - RNA, 21 nt, Human
aacauggugaggugaaugcuc

SEQ ID NO: 725275 - RNA, 19 nt, Human
aaccacccuuguccccaag

SEQ ID NO: 725276 - RNA, 19 nt, Human
aagagccacgcaggguugg

SEQ ID NO: 725277 - RNA, 18 nt, Human
aagcacgugccugaaaau

SEQ ID NO: 725278 - RNA, 25 nt, Human
aagcaguaaagaauuacuucacaca

SEQ ID NO: 725279 - RNA, 19 nt, Human
aagugcugggauuacaggc

SEQ ID NO: 725280 - RNA, 19 nt, Human
aagugcugggauuacaggc

SEQ ID NO: 725281 - RNA, 26 nt, Human
aagugcugggauuacaggcgugagcc

SEQ ID NO: 725282 - RNA, 21 nt, Human
acacaauguccugcugaugcc

SEQ ID NO: 725283 - RNA, 25 nt, Human
acagcaccuacauggagaccacaca

SEQ ID NO: 725284 - RNA, 18 nt, Human
acagcaggacuaaaaacc

SEQ ID NO: 725285 - RNA, 19 nt, Human
acagcaggacuaaaaaccc

SEQ ID NO: 725286 - RNA, 22 nt, Human
accacacaaacggcuucacaca

SEQ ID NO: 725287 - RNA, 24 nt, Human
accauauuggccaggcuggucucg

SEQ ID NO: 725288 - RNA, 19 nt, Human
acccaggcuggagugcagu

SEQ ID NO: 725289 - RNA, 20 nt, Human
accccaggugacugcuucca

SEQ ID NO: 725290 - RNA, 25 nt, Human
acucugucacccaggcuggagugca

SEQ ID NO: 725291 - RNA, 18 nt, Human
agaaaaacgagaacauaa

SEQ ID NO: 725292 - RNA, 26 nt, Human
agaauuacuucacacaaaguccuuuc

SEQ ID NO: 725293 - RNA, 21 nt, Human
agacaacaccugaggccuggg

SEQ ID NO: 725294 - RNA, 19 nt, Human
agagaaaaacaaacuggaa

SEQ ID NO: 725295 - RNA, 20 nt, Human
agaguuccaguuuggaagcc

SEQ ID NO: 725296 - RNA, 19 nt, Human
agccugacaacacaguacu

SEQ ID NO: 725297 - RNA, 24 nt, Human
agcgauucuucugcuucagccucc

SEQ ID NO: 725298 - RNA, 18 nt, Human
aggcaggcaggcaggcag

SEQ ID NO: 725299 - RNA, 20 nt, Human
aggcaggcaggcaggcuggc

SEQ ID NO: 725300 - RNA, 21 nt, Human
aggcaggcaggcuggcuggcc

SEQ ID NO: 725301 - RNA, 21 nt, Human
aggcaggcuggcuggccuggg

SEQ ID NO: 725302 - RNA, 23 nt, Human
aggccagacgccugugucuccag

SEQ ID NO: 725303 - RNA, 19 nt, Human
aggcggugccgggaacaca

SEQ ID NO: 725304 - RNA, 25 nt, Human
aggcuggagugcaguggcacaaucu

SEQ ID NO: 725305 - RNA, 20 nt, Human
aggcuucuaaguccuuuccu

SEQ ID NO: 725306 - RNA, 23 nt, Human
agggugcugcuggguggcgagga

SEQ ID NO: 725307 - RNA, 23 nt, Human
aggguuuccaaaaaauggucagu

SEQ ID NO: 725308 - RNA, 24 nt, Human
aggugauccaccugccucggccuc

SEQ ID NO: 725309 - RNA, 21 nt, Human
agguggcugggcucagacacc

SEQ ID NO: 725310 - RNA, 19 nt, Human
agguuuaaaggcuuggagc

SEQ ID NO: 725311 - RNA, 21 nt, Human
aguacuaaaaacucagguggc

SEQ ID NO: 725312 - RNA, 18 nt, Human
aguagcugggacuacagg

SEQ ID NO: 725313 - RNA, 21 nt, Human
agugcaguggcacaaucucag

SEQ ID NO: 725314 - RNA, 18 nt, Human
agugcugggauuacaggc

SEQ ID NO: 725315 - RNA, 24 nt, Human
auacaggguacuguggacacauua

SEQ ID NO: 725316 - RNA, 18 nt, Human
aucucacucugucaccca

SEQ ID NO: 725317 - RNA, 18 nt, Human
augggguuucaccauauu

SEQ ID NO: 725318 - RNA, 20 nt, Human
augggguuucaccauauugg

SEQ ID NO: 725319 - RNA, 24 nt, Human
augggguuucaccauauuggccag

SEQ ID NO: 725320 - RNA, 24 nt, Human
auuuuuguauuuuuaguagagaug

SEQ ID NO: 725321 - RNA, 22 nt, Human
caaaaacccagaagcugaucaa

SEQ ID NO: 725322 - RNA, 23 nt, Human
caaaaacccagaagcugaucaac

SEQ ID NO: 725323 - RNA, 18 nt, Human
caaaggacacacacguuc

SEQ ID NO: 725324 - RNA, 24 nt, Human
caaagugcugggauuacaggcgug

SEQ ID NO: 725325 - RNA, 23 nt, Human
caacacacagcaggacuaaaaac

SEQ ID NO: 725326 - RNA, 21 nt, Human
caacacaguacuaaaaacuca

SEQ ID NO: 725327 - RNA, 23 nt, Human
caacagcaauuuaaaagcaguaa

SEQ ID NO: 725328 - RNA, 20 nt, Human
caagagccacgcaggguugg

SEQ ID NO: 725329 - RNA, 22 nt, Human
caagcgauucuucugcuucagc

SEQ ID NO: 725330 - RNA, 20 nt, Human
caaggcacccacgcccaacc

SEQ ID NO: 725331 - RNA, 23 nt, Human
cacacaauguccugcugaugccc

SEQ ID NO: 725332 - RNA, 24 nt, Human
cacagcaggacuaaaaacccaaga

SEQ ID NO: 725333 - RNA, 18 nt, Human
cacagcucugggcgggca

SEQ ID NO: 725334 - RNA, 24 nt, Human
caccacacccggcuaauuuuugua

SEQ ID NO: 725335 - RNA, 21 nt, Human
caccacgcccagccucuuuuu

SEQ ID NO: 725336 - RNA, 21 nt, Human
caccauauuggccaggcuggu

SEQ ID NO: 725337 - RNA, 24 nt, Human
caccauauuggccaggcuggucuc

SEQ ID NO: 725338 - RNA, 27 nt, Human
caccauauuggccaggcuggucucgaa

SEQ ID NO: 725339 - RNA, 19 nt, Human
cacccuuguccccaaggaa

SEQ ID NO: 725340 - RNA, 23 nt, Human
caccugccucggccucccaaagu

SEQ ID NO: 725341 - RNA, 23 nt, Human
cacucaagguguggaggagggag

SEQ ID NO: 725342 - RNA, 23 nt, Human
cacucugucacccaggcuggagu

SEQ ID NO: 725343 - RNA, 24 nt, Human
cacucugucacccaggcuggagug

SEQ ID NO: 725344 - RNA, 21 nt, Human
cacuguaaccuccgccucccg

SEQ ID NO: 725345 - RNA, 23 nt, Human
cacuguaaccuccgccucccggg

SEQ ID NO: 725346 - RNA, 24 nt, Human
cagaaccacggcaaaagaucauaa

SEQ ID NO: 725347 - RNA, 18 nt, Human
cagcaaugcauccccaca

SEQ ID NO: 725348 - RNA, 24 nt, Human
cagcaaugcauccccacacagcac

SEQ ID NO: 725349 - RNA, 20 nt, Human
cagcaccuggaauuaccagu

SEQ ID NO: 725350 - RNA, 20 nt, Human
cagcaggugcagccuugcuc

SEQ ID NO: 725351 - RNA, 18 nt, Human
cagcaguguaccuccggc

SEQ ID NO: 725352 - RNA, 24 nt, Human
cauauuggccaggcuggucucgaa

SEQ ID NO: 725353 - RNA, 19 nt, Human
caugugauccaauguagag

SEQ ID NO: 725354 - RNA, 25 nt, Human
cauuccacucucuuacuaaaaggau

SEQ ID NO: 725355 - RNA, 22 nt, Human
ccaaaaaaguuagaacccaaaa

SEQ ID NO: 725356 - RNA, 23 nt, Human
ccaaaaaaguuagaacccaaaaa

SEQ ID NO: 725357 - RNA, 26 nt, Human
ccaaaaaaguuagaacccaaaaaccc

SEQ ID NO: 725358 - RNA, 22 nt, Human
ccaaagugcugggauuacaggc

SEQ ID NO: 725359 - RNA, 22 nt, Human
ccaaagugcugggauuacaggc

SEQ ID NO: 725360 - RNA, 24 nt, Human
ccaaagugcugggauuacaggcgu

SEQ ID NO: 725361 - RNA, 23 nt, Human
ccaaauuuccucuaauguuuccu

SEQ ID NO: 725362 - RNA, 20 nt, Human
ccaaccacccuuguccccaa

SEQ ID NO: 725363 - RNA, 25 nt, Human
ccaaccaugcaaaggacacacacgu

SEQ ID NO: 725364 - RNA, 18 nt, Human
ccacacagcacaaaagaa

SEQ ID NO: 725365 - RNA, 22 nt, Human
ccacccccagaaaccccaggug

SEQ ID NO: 725366 - RNA, 23 nt, Human
ccacggcaaaagaucauaaauac

SEQ ID NO: 725367 - RNA, 20 nt, Human
ccagaaaccccaggugacug

SEQ ID NO: 725368 - RNA, 22 nt, Human
ccaucguuucagaagccagguu

SEQ ID NO: 725369 - RNA, 26 nt, Human
cccagaaaccccaggugacugcuucc

SEQ ID NO: 725370 - RNA, 22 nt, Human
cccagcgcaccgccuuggaccg

SEQ ID NO: 725371 - RNA, 18 nt, Human
ccccaaggaacccucccu

SEQ ID NO: 725372 - RNA, 27 nt, Human
ccccacacagcacaaaagacaacaccc

SEQ ID NO: 725373 - RNA, 19 nt, Human
ccccacagcucugggcggg

SEQ ID NO: 725374 - RNA, 30 nt, Human
ccccagaaaccccaggugacugcuuccaag

SEQ ID NO: 725375 - RNA, 20 nt, Human
ccccaggugacugcuuccaa

SEQ ID NO: 725376 - RNA, 20 nt, Human
ccccugaaggccagacgccu

SEQ ID NO: 725377 - RNA, 23 nt, Human
cccgaguagcugggacuacaggc

SEQ ID NO: 725378 - RNA, 24 nt, Human
cccgaguagcugggacuacaggcg

SEQ ID NO: 725379 - RNA, 23 nt, Human
cccggguucaagcgauucuucug

SEQ ID NO: 725380 - RNA, 23 nt, Human
cccuaaauccacaggauguuauc

SEQ ID NO: 725381 - RNA, 18 nt, Human
cccuagcaagccccugaa

SEQ ID NO: 725382 - RNA, 20 nt, Human
ccgcagucccagggugcugc

SEQ ID NO: 725383 - RNA, 24 nt, Human
ccgcagucccagggugcugcuggg

SEQ ID NO: 725384 - RNA, 24 nt, Human
ccgccucccggguucaagcgauuc

SEQ ID NO: 725385 - RNA, 24 nt, Human
ccucccggguucaagcgauucuuc

SEQ ID NO: 725386 - RNA, 21 nt, Human
ccugaccuuaggugauccacc

SEQ ID NO: 725387 - RNA, 23 nt, Human
ccugaccuuaggugauccaccug

SEQ ID NO: 725388 - RNA, 21 nt, Human
ccugugcuggagcaucaagga

SEQ ID NO: 725389 - RNA, 26 nt, Human
cgagaacauaaauguguuauuacaau

SEQ ID NO: 725390 - RNA, 24 nt, Human
cgaggaacuguccacccccagaaa

SEQ ID NO: 725391 - RNA, 22 nt, Human
cgcccaaccaugcaaaggacac

SEQ ID NO: 725392 - RNA, 23 nt, Human
cuaauuuuuguauuuuuaguaga

SEQ ID NO: 725393 - RNA, 22 nt, Human
cucaagguguggaggagggagg

SEQ ID NO: 725394 - RNA, 18 nt, Human
cucacaaugucaaugcaa

SEQ ID NO: 725395 - RNA, 24 nt, Human
cucacucugucacccaggcuggag

SEQ ID NO: 725396 - RNA, 24 nt, Human
cucacuguaaccuccgccucccgg

SEQ ID NO: 725397 - RNA, 23 nt, Human
cugccucggccucccaaagugcu

SEQ ID NO: 725398 - RNA, 23 nt, Human
cugcuucagccucccgaguagcu

SEQ ID NO: 725399 - RNA, 24 nt, Human
cuggaaaagcuuauauggaguuag

SEQ ID NO: 725400 - RNA, 19 nt, Human
cuguccacccccagaaacc

SEQ ID NO: 725401 - RNA, 24 nt, Human
cugugucuucaauauacccaaaaa

SEQ ID NO: 725402 - RNA, 23 nt, Human
cuucagcaguguaccuccggcac

SEQ ID NO: 725403 - RNA, 24 nt, Human
gaaaauaucccuaaauccacagga

SEQ ID NO: 725404 - RNA, 19 nt, Human
gaacucgaaauacagggua

SEQ ID NO: 725405 - RNA, 21 nt, Human
gaaggaucgaagggcagcagg

SEQ ID NO: 725406 - RNA, 31 nt, Human
gacacacacguucacacaugcacacacaugg

SEQ ID NO: 725407 - RNA, 19 nt, Human
gacagcagcuggcuggucc

SEQ ID NO: 725408 - RNA, 24 nt, Human
gaccuuaggugauccaccugccuc

SEQ ID NO: 725409 - RNA, 23 nt, Human
gagaugggguuucaccauauugg

SEQ ID NO: 725410 - RNA, 24 nt, Human
gagaugggguuucaccauauuggc

SEQ ID NO: 725411 - RNA, 22 nt, Human
gaggagggaggagaggguuucc

SEQ ID NO: 725412 - RNA, 24 nt, Human
gaggagggaggagaggguuuccaa

SEQ ID NO: 725413 - RNA, 24 nt, Human
gagggaggagaggguuuccaaaaa

SEQ ID NO: 725414 - RNA, 20 nt, Human
gaguagcugggacuacaggc

SEQ ID NO: 725415 - RNA, 26 nt, Human
gaguagcugggacuacaggcgcacgc

SEQ ID NO: 725416 - RNA, 18 nt, Human
gauaguguuaaacaaacc

SEQ ID NO: 725417 - RNA, 18 nt, Human
gauuacaggcgugagcca

SEQ ID NO: 725418 - RNA, 21 nt, Human
gauuacaggcgugagccacca

SEQ ID NO: 725419 - RNA, 22 nt, Human
gauuacaggcgugagccaccac

SEQ ID NO: 725420 - RNA, 23 nt, Human
gcacauggacagcagcuggcugg

SEQ ID NO: 725421 - RNA, 24 nt, Human
gcgauucuucugcuucagccuccc

SEQ ID NO: 725422 - RNA, 24 nt, Human
gcucugcacauggacagcagcugg

SEQ ID NO: 725423 - RNA, 26 nt, Human
gcuggagcaucaaggauugaccucug

SEQ ID NO: 725424 - RNA, 19 nt, Human
gcuggagugcaguggcaca

SEQ ID NO: 725425 - RNA, 21 nt, Human
gcuuggagcugccaaccaccc

SEQ ID NO: 725426 - RNA, 18 nt, Human
ggaacuguccacccccag

SEQ ID NO: 725427 - RNA, 21 nt, Human
ggaagaucaaacuucugcaga

SEQ ID NO: 725428 - RNA, 22 nt, Human
ggagaggcacuauuaaaacaug

SEQ ID NO: 725429 - RNA, 18 nt, Human
ggaggagggaggagaggg

SEQ ID NO: 725430 - RNA, 19 nt, Human
ggauuacaggcgugagcca

SEQ ID NO: 725431 - RNA, 20 nt, Human
ggcaggcaggcaggcaggca

SEQ ID NO: 725432 - RNA, 24 nt, Human
ggcuggucucgaacuccugaccuu

SEQ ID NO: 725433 - RNA, 24 nt, Human
gggcagcaggugcagccuugcucu

SEQ ID NO: 725434 - RNA, 22 nt, Human
gggguuucaccauauuggccag

SEQ ID NO: 725435 - RNA, 22 nt, Human
ggguuucaccauauuggccagg

SEQ ID NO: 725436 - RNA, 21 nt, Human
gguagcgguuuccuuguaaca

SEQ ID NO: 725437 - RNA, 19 nt, Human
ggucucgaacuccugaccu

SEQ ID NO: 725438 - RNA, 18 nt, Human
guaaagucugaagcaaga

SEQ ID NO: 725439 - RNA, 24 nt, Human
gugagccaccacgcccagccucuu

SEQ ID NO: 725440 - RNA, 19 nt, Human
gugauccaccugccucggc

SEQ ID NO: 725441 - RNA, 24 nt, Human
gugauccaccugccucggccuccc

SEQ ID NO: 725442 - RNA, 19 nt, Human
guggaggagggaggagagg

SEQ ID NO: 725443 - RNA, 24 nt, Human
guuuguuguaagucuccuccucca

SEQ ID NO: 725444 - RNA, 25 nt, Human
uaaaaaaaauauuaauacugucaaa

SEQ ID NO: 725445 - RNA, 18 nt, Human
uaaaaacccaagagcugu

SEQ ID NO: 725446 - RNA, 19 nt, Human
uaaaagcaguaaagaauua

SEQ ID NO: 725447 - RNA, 19 nt, Human
uaaaauacagugauuggug

SEQ ID NO: 725448 - RNA, 22 nt, Human
uaaagaacuuucuguaaccuca

SEQ ID NO: 725449 - RNA, 18 nt, Human
uaaauacaggcagcaaug

SEQ ID NO: 725450 - RNA, 18 nt, Human
uaacauauauuaaaaugg

SEQ ID NO: 725451 - RNA, 22 nt, Human
uaacauuaauaagagaugcuuc

SEQ ID NO: 725452 - RNA, 24 nt, Human
uaauuuuuguauuuuuaguagaga

SEQ ID NO: 725453 - RNA, 23 nt, Human
uacaaaacaguucuuuguaaaca

SEQ ID NO: 725454 - RNA, 23 nt, Human
uacaggcgcacgccaccacaccc

SEQ ID NO: 725455 - RNA, 24 nt, Human
uacaggcgugagccaccacgccca

SEQ ID NO: 725456 - RNA, 25 nt, Human
uacauacauacauacauacauauag

SEQ ID NO: 725457 - RNA, 24 nt, Human
uacauacauacauacauauauaua

SEQ ID NO: 725458 - RNA, 25 nt, Human
uacauacauacauacauauauauau

SEQ ID NO: 725459 - RNA, 20 nt, Human
uacaugaaaaaaaaagcuau

SEQ ID NO: 725460 - RNA, 25 nt, Human
uagaaaacuaucuuacaaguagaac

SEQ ID NO: 725461 - RNA, 25 nt, Human
uagaacccaaaaacccagaagcuga

SEQ ID NO: 725462 - RNA, 21 nt, Human
uagagaaaaacaaacuggaaa

SEQ ID NO: 725463 - RNA, 19 nt, Human
uaguagagaugggguuuca

SEQ ID NO: 725464 - RNA, 23 nt, Human
uaguagagaugggguuucaccau

SEQ ID NO: 725465 - RNA, 26 nt, Human
uaguagagaugggguuucaccauauu

SEQ ID NO: 725466 - RNA, 18 nt, Human
uauucuauauuuugccca

SEQ ID NO: 725467 - RNA, 24 nt, Human
ucacccaggcuggagugcaguggc

SEQ ID NO: 725468 - RNA, 24 nt, Human
ucacucugucacccaggcuggagu

SEQ ID NO: 725469 - RNA, 23 nt, Human
ucacuguaaccuccgccucccgg

SEQ ID NO: 725470 - RNA, 24 nt, Human
ucacuguaaccuccgccucccggg

SEQ ID NO: 725471 - RNA, 25 nt, Human
ucacuguaaccuccgccucccgggu

SEQ ID NO: 725472 - RNA, 22 nt, Human
ucagaaccacggcaaaagauca

SEQ ID NO: 725473 - RNA, 23 nt, Human
ucagccucccgaguagcugggac

SEQ ID NO: 725474 - RNA, 22 nt, Human
ucagguggcugggcucagacac

SEQ ID NO: 725475 - RNA, 24 nt, Human
ucccaaagugcugggauuacaggc

SEQ ID NO: 725476 - RNA, 24 nt, Human
ucccgaguagcugggacuacaggc

SEQ ID NO: 725477 - RNA, 20 nt, Human
ucccggguucaagcgauucu

SEQ ID NO: 725478 - RNA, 24 nt, Human
ucccggguucaagcgauucuucug

SEQ ID NO: 725479 - RNA, 25 nt, Human
ucccugggauggggcgcacuggucc

SEQ ID NO: 725480 - RNA, 18 nt, Human
ucggccucccaaagugcu

SEQ ID NO: 725481 - RNA, 23 nt, Human
ucucacucugucacccaggcugg

SEQ ID NO: 725482 - RNA, 24 nt, Human
ucucacucugucacccaggcugga

SEQ ID NO: 725483 - RNA, 26 nt, Human
ucucacucugucacccaggcuggagu

SEQ ID NO: 725484 - RNA, 27 nt, Human
ucucacucugucacccaggcuggagug

SEQ ID NO: 725485 - RNA, 27 nt, Human
ucugacaaaaaauaaaagauguccaaa

SEQ ID NO: 725486 - RNA, 18 nt, Human
ucugcagaauuuugacag

SEQ ID NO: 725487 - RNA, 24 nt, Human
ucugucacccaggcuggagugcag

SEQ ID NO: 725488 - RNA, 21 nt, Human
ucuuacuaaaaggauaugcuu

SEQ ID NO: 725489 - RNA, 19 nt, Human
ucuucuggauccauucugg

SEQ ID NO: 725490 - RNA, 24 nt, Human
ucuucuggauccauucuggcugga

SEQ ID NO: 725491 - RNA, 18 nt, Human
ucuuuuuuuuuuuucuug

SEQ ID NO: 725492 - RNA, 23 nt, Human
ugaaaaaaaaagcuauaaaauac

SEQ ID NO: 725493 - RNA, 23 nt, Human
ugaaaaugucuauauacaaaaca

SEQ ID NO: 725494 - RNA, 22 nt, Human
ugaagcaagaaugcacagaugu

SEQ ID NO: 725495 - RNA, 24 nt, Human
ugacaaaaaauaaaagauguccaa

SEQ ID NO: 725496 - RNA, 24 nt, Human
ugacaaaaaauaaaagauguccaa

SEQ ID NO: 725497 - RNA, 25 nt, Human
ugacaaaaaauaaaagauguccaaa

SEQ ID NO: 725498 - RNA, 26 nt, Human
ugacaaaaaauaaaagauguccaaaa

SEQ ID NO: 725499 - RNA, 18 nt, Human
ugacagcuaacacagaca

SEQ ID NO: 725500 - RNA, 24 nt, Human
ugaccuuaggugauccaccugccu

SEQ ID NO: 725501 - RNA, 22 nt, Human
ugagacggaaucucacucuguc

SEQ ID NO: 725502 - RNA, 22 nt, Human
ugcacacacaugcgcuuuggcg

SEQ ID NO: 725503 - RNA, 22 nt, Human
ugcaguggcacaaucucagcuc

SEQ ID NO: 725504 - RNA, 21 nt, Human
ugccucggccucccaaagugc

SEQ ID NO: 725505 - RNA, 24 nt, Human
ugccucggccucccaaagugcugg

SEQ ID NO: 725506 - RNA, 23 nt, Human
ugcucagaaccacggcaaaagau

SEQ ID NO: 725507 - RNA, 18 nt, Human
ugcucugcacauggacag

SEQ ID NO: 725508 - RNA, 24 nt, Human
ugcugggauuacaggcgugagcca

SEQ ID NO: 725509 - RNA, 24 nt, Human
ugcuucagccucccgaguagcugg

SEQ ID NO: 725510 - RNA, 18 nt, Human
uggaggagggaggagagg

SEQ ID NO: 725511 - RNA, 18 nt, Human
uggagugcaguggcacaa

SEQ ID NO: 725512 - RNA, 23 nt, Human
uggagugcaguggcacaaucuca

SEQ ID NO: 725513 - RNA, 24 nt, Human
uggagugcaguggcacaaucucag

SEQ ID NO: 725514 - RNA, 20 nt, Human
uggcacaaucucagcucacu

SEQ ID NO: 725515 - RNA, 24 nt, Human
uggccaggcuggucucgaacuccu

SEQ ID NO: 725516 - RNA, 19 nt, Human
uggcccugggguggggaca

SEQ ID NO: 725517 - RNA, 18 nt, Human
uggcgagaccccucugcc

SEQ ID NO: 725518 - RNA, 21 nt, Human
ugggaagagccugacaacaca

SEQ ID NO: 725519 - RNA, 20 nt, Human
ugggaagagccugacaacca

SEQ ID NO: 725520 - RNA, 22 nt, Human
ugggacuacaggcgcacgccac

SEQ ID NO: 725521 - RNA, 24 nt, Human
ugggacuacaggcgcacgccacca

SEQ ID NO: 725522 - RNA, 18 nt, Human
ugggauggggcgcacugg

SEQ ID NO: 725523 - RNA, 18 nt, Human
ugggauuacaggcgugag

SEQ ID NO: 725524 - RNA, 19 nt, Human
ugggauuacaggcgugagc

SEQ ID NO: 725525 - RNA, 22 nt, Human
ugggauuacaggcgugagccac

SEQ ID NO: 725526 - RNA, 23 nt, Human
ugggauuacaggcgugagccacc

SEQ ID NO: 725527 - RNA, 24 nt, Human
ugggauuacaggcgugagccacca

SEQ ID NO: 725528 - RNA, 21 nt, Human
ugggcgggcaggcaggcaggc

SEQ ID NO: 725529 - RNA, 27 nt, Human
ugggcgggcaggcaggcaggcaggccc

SEQ ID NO: 725530 - RNA, 24 nt, Human
ugggguuucaccauauuggccagg

SEQ ID NO: 725531 - RNA, 24 nt, Human
uguccccaaggaacccucccuggg

SEQ ID NO: 725532 - RNA, 19 nt, Human
uguccuggccaugugugga

SEQ ID NO: 725533 - RNA, 24 nt, Human
uguggcaguguccuggccaugugu

SEQ ID NO: 725534 - RNA, 24 nt, Human
uguguguuuacauacauacauaca

SEQ ID NO: 725535 - RNA, 26 nt, Human
uguguuuacauacauacauacauaca

SEQ ID NO: 725536 - RNA, 20 nt, Human
uuaauagagaaaaacaaacu

SEQ ID NO: 725537 - RNA, 21 nt, Human
uuaggugauccaccugccucg

SEQ ID NO: 725538 - RNA, 18 nt, Human
uuaguagagaugggguuu

SEQ ID NO: 725539 - RNA, 22 nt, Human
uuaguagagaugggguuucacc

SEQ ID NO: 725540 - RNA, 24 nt, Human
uuaguagagaugggguuucaccau

SEQ ID NO: 725541 - RNA, 23 nt, Human
uucaagcgauucuucugcuucag

SEQ ID NO: 725542 - RNA, 24 nt, Human
uucaagcgauucuucugcuucagc

SEQ ID NO: 725543 - RNA, 27 nt, Human
uucacacaugcacacacaugcgcuuug

SEQ ID NO: 725544 - RNA, 24 nt, Human
uucagccucccgaguagcugggac

SEQ ID NO: 725545 - RNA, 18 nt, Human
uuccaaaaaauggucagu

SEQ ID NO: 725546 - RNA, 19 nt, Human
uucccuagcaagccccuga

SEQ ID NO: 725547 - RNA, 21 nt, Human
uucugcuucaauaaagcuggg

SEQ ID NO: 725548 - RNA, 23 nt, Human
uugcuggaaaagcuuauauggag

SEQ ID NO: 725549 - RNA, 24 nt, Human
uuggagaggcacuauuaaaacaug

SEQ ID NO: 725550 - RNA, 23 nt, Human
uuguauuuuuaguagagaugggg

SEQ ID NO: 725551 - RNA, 24 nt, Human
uuucaccauauuggccaggcuggu

SEQ ID NO: 725552 - RNA, 19 nt, Human
uuuccaaaaaauggucagu

SEQ ID NO: 725553 - RNA, 20 nt, Human
uuugcugagguagcgguuuc

SEQ ID NO: 725554 - RNA, 24 nt, Human
uuugcugagguagcgguuuccuug

SEQ ID NO: 725555 - RNA, 21 nt, Human
uuuggcgagaccccucugcca

SEQ ID NO: 725556 - RNA, 20 nt, Human
uuuguaaacauggugaggug

SEQ ID NO: 725557 - RNA, 18 nt, Human
uuuguaaggcuucuaagu

SEQ ID NO: 725558 - RNA, 19 nt, Human
uuuguaaggcuucuaaguc

SEQ ID NO: 725559 - RNA, 24 nt, Human
uuuuuaguagagaugggguuucac

SEQ ID NO: 725560 - RNA, 21 nt, Human
uuuuucucagacuuuuucaaa

SEQ ID NO: 725561 - RNA, 22 nt, Human
uuuuucuuuuuuuuuuaaaugg

SEQ ID NO: 725562 - RNA, 20 nt, Human
uuuuuguauuuuuaguagag

SEQ ID NO: 725563 - RNA, 25 nt, Human
aaaacaauuccagacucccacccca

SEQ ID NO: 725564 - RNA, 18 nt, Human
aaacaauuccagacuccc

SEQ ID NO: 725565 - RNA, 21 nt, Human
aaacccagccgggauggcuga

SEQ ID NO: 725566 - RNA, 26 nt, Human
aaaugcuccccaaguccccuuuccac

SEQ ID NO: 725567 - RNA, 25 nt, Human
aaccugcugccuccgagggcaccuu

SEQ ID NO: 725568 - RNA, 23 nt, Human
aagcccuccccaggccaggcucc

SEQ ID NO: 725569 - RNA, 18 nt, Human
acccaggagggcucaaag

SEQ ID NO: 725570 - RNA, 21 nt, Human
acgcccugcacagcuuaggac

SEQ ID NO: 725571 - RNA, 22 nt, Human
acucccaccccagccccaaggc

SEQ ID NO: 725572 - RNA, 21 nt, Human
agacucccaccccagccccaa

SEQ ID NO: 725573 - RNA, 20 nt, Human
agaggaaccggggucgccag

SEQ ID NO: 725574 - RNA, 19 nt, Human
agagggguggggggagggc

SEQ ID NO: 725575 - RNA, 22 nt, Human
agcaucuggugguggccacgcc

SEQ ID NO: 725576 - RNA, 19 nt, Human
agcugugacacggugagua

SEQ ID NO: 725577 - RNA, 20 nt, Human
aggagaggugggggaaggcg

SEQ ID NO: 725578 - RNA, 22 nt, Human
aggcagagagugugaccccggg

SEQ ID NO: 725579 - RNA, 24 nt, Human
aggcgacagagagaccagcaaacc

SEQ ID NO: 725580 - RNA, 23 nt, Human
aggcgccgggacgcuggugagcc

SEQ ID NO: 725581 - RNA, 23 nt, Human
caagacggcgacccuccauaaac

SEQ ID NO: 725582 - RNA, 23 nt, Human
caauuccagacucccaccccagc

SEQ ID NO: 725583 - RNA, 25 nt, Human
cacagcuuaggaccaggucacuucu

SEQ ID NO: 725584 - RNA, 23 nt, Human
cacagugcagggcguggcugccu

SEQ ID NO: 725585 - RNA, 28 nt, Human
caccccagccccaaggccccuucaaagg

SEQ ID NO: 725586 - RNA, 20 nt, Human
cacccccggcuuucagagcu

SEQ ID NO: 725587 - RNA, 19 nt, Human
caccuuaaaaaacuagacc

SEQ ID NO: 725588 - RNA, 21 nt, Human
cacuuugaaaacaauuccaga

SEQ ID NO: 725589 - RNA, 19 nt, Human
cagcagcuaaucgccccca

SEQ ID NO: 725590 - RNA, 18 nt, Human
cagcaguggccugcccac

SEQ ID NO: 725591 - RNA, 23 nt, Human
cagccgggauggcugagccacag

SEQ ID NO: 725592 - RNA, 23 nt, Human
cagcuucuggggaacgggccccc

SEQ ID NO: 725593 - RNA, 23 nt, Human
caggcuagagaagagcuaggggc

SEQ ID NO: 725594 - RNA, 24 nt, Human
cagggccagagcccugcucacuag

SEQ ID NO: 725595 - RNA, 19 nt, Human
cagggccucaaaccugcug

SEQ ID NO: 725596 - RNA, 20 nt, Human
caggggucagucaggcagag

SEQ ID NO: 725597 - RNA, 20 nt, Human
caguucccccgcacgcccug

SEQ ID NO: 725598 - RNA, 18 nt, Human
cauaacccagcuccuggc

SEQ ID NO: 725599 - RNA, 19 nt, Human
caugacaccaagcggagcg

SEQ ID NO: 725600 - RNA, 20 nt, Human
caugacaccaagcggagcga

SEQ ID NO: 725601 - RNA, 23 nt, Human
ccaagcugagcgcagguaagaca

SEQ ID NO: 725602 - RNA, 21 nt, Human
ccaccccagccccaaggcccc

SEQ ID NO: 725603 - RNA, 20 nt, Human
ccaccugaggccugacucca

SEQ ID NO: 725604 - RNA, 19 nt, Human
ccacgccuccugcagcaga

SEQ ID NO: 725605 - RNA, 18 nt, Human
ccacggggacuuccuggg

SEQ ID NO: 725606 - RNA, 24 nt, Human
ccagccccaaggccccuucaaagg

SEQ ID NO: 725607 - RNA, 19 nt, Human
ccaggagaggugggggaag

SEQ ID NO: 725608 - RNA, 18 nt, Human
ccaggucacuucuccaca

SEQ ID NO: 725609 - RNA, 21 nt, Human
cccaccagccacccgcuaccu

SEQ ID NO: 725610 - RNA, 22 nt, Human
cccaggccaggcuccugcccac

SEQ ID NO: 725611 - RNA, 21 nt, Human
cccccagggccucaaaccugc

SEQ ID NO: 725612 - RNA, 18 nt, Human
cccccggcuuucagagcg

SEQ ID NO: 725613 - RNA, 19 nt, Human
ccccucagccuccgagccg

SEQ ID NO: 725614 - RNA, 21 nt, Human
ccccuuuccacaguguuuggg

SEQ ID NO: 725615 - RNA, 23 nt, Human
cccucagagaaucacaugacacc

SEQ ID NO: 725616 - RNA, 24 nt, Human
ccucacaggcccaagcccucccca

SEQ ID NO: 725617 - RNA, 23 nt, Human
ccuccgagccgacgaugcggucu

SEQ ID NO: 725618 - RNA, 18 nt, Human
ccucucugggguccugcc

SEQ ID NO: 725619 - RNA, 18 nt, Human
ccugcagcagaggggugg

SEQ ID NO: 725620 - RNA, 22 nt, Human
ccugcagcagaggggugggggg

SEQ ID NO: 725621 - RNA, 20 nt, Human
ccuggcuuaggaggcauugg

SEQ ID NO: 725622 - RNA, 22 nt, Human
ccuggcuuaggaggcauuggcg

SEQ ID NO: 725623 - RNA, 19 nt, Human
ccugggcugauggcaaacc

SEQ ID NO: 725624 - RNA, 24 nt, Human
cgacagagagaccagcaaacccac

SEQ ID NO: 725625 - RNA, 18 nt, Human
cggccgcggcagccccuc

SEQ ID NO: 725626 - RNA, 22 nt, Human
cgggcacccaccaaggugggcc

SEQ ID NO: 725627 - RNA, 19 nt, Human
cuaccucuaagccaggccu

SEQ ID NO: 725628 - RNA, 19 nt, Human
cuagagaagagcuaggggc

SEQ ID NO: 725629 - RNA, 23 nt, Human
cucacaggcccaagcccucccca

SEQ ID NO: 725630 - RNA, 22 nt, Human
cucccaccccagccccaaggcc

SEQ ID NO: 725631 - RNA, 23 nt, Human
cucccaccccagccccaaggccc

SEQ ID NO: 725632 - RNA, 20 nt, Human
cuccccaggccaggcuccug

SEQ ID NO: 725633 - RNA, 26 nt, Human
cucuaagccaggccugaguggcuccc

SEQ ID NO: 725634 - RNA, 19 nt, Human
cugacuccaagcugagcgc

SEQ ID NO: 725635 - RNA, 19 nt, Human
cugagccacacucaccccc

SEQ ID NO: 725636 - RNA, 20 nt, Human
cugcacagcuuaggaccagg

SEQ ID NO: 725637 - RNA, 19 nt, Human
cugcagcagaggggugggg

SEQ ID NO: 725638 - RNA, 21 nt, Human
cugcagcagaggggugggggg

SEQ ID NO: 725639 - RNA, 18 nt, Human
cugcagcagcgccccugu

SEQ ID NO: 725640 - RNA, 24 nt, Human
cugccugcccucucugggguccug

SEQ ID NO: 725641 - RNA, 18 nt, Human
cugcugcacaggcaucca

SEQ ID NO: 725642 - RNA, 23 nt, Human
cuggccacaucugagggucuucc

SEQ ID NO: 725643 - RNA, 19 nt, Human
cugggcacaggugugugcc

SEQ ID NO: 725644 - RNA, 23 nt, Human
cuucuggggaacgggccccccag

SEQ ID NO: 725645 - RNA, 21 nt, Human
gaaaaugcuccccaagucccc

SEQ ID NO: 725646 - RNA, 18 nt, Human
gaagcugugcgcagccuc

SEQ ID NO: 725647 - RNA, 18 nt, Human
gacacagaggaaccgggg

SEQ ID NO: 725648 - RNA, 19 nt, Human
gagggcaccuucggggaga

SEQ ID NO: 725649 - RNA, 19 nt, Human
gcaaagacuccucagggcc

SEQ ID NO: 725650 - RNA, 22 nt, Human
gcacugggugggcccauagacc

SEQ ID NO: 725651 - RNA, 19 nt, Human
gcagcuucuggggaacggg

SEQ ID NO: 725652 - RNA, 28 nt, Human
gccccaaggccccuucaaaggcaguccu

SEQ ID NO: 725653 - RNA, 19 nt, Human
gcggagcgaggagcgaggc

SEQ ID NO: 725654 - RNA, 18 nt, Human
gcugccugcccucucugg

SEQ ID NO: 725655 - RNA, 22 nt, Human
ggagaauccucacaggcccaag

SEQ ID NO: 725656 - RNA, 19 nt, Human
ggaggggaggcgggaagag

SEQ ID NO: 725657 - RNA, 22 nt, Human
ggaguaaagaggacacagagga

SEQ ID NO: 725658 - RNA, 20 nt, Human
ggcacccaccaaggugggcc

SEQ ID NO: 725659 - RNA, 23 nt, Human
ggcacugggugggcccauagacc

SEQ ID NO: 725660 - RNA, 20 nt, Human
ggcagccccucagccuccga

SEQ ID NO: 725661 - RNA, 24 nt, Human
ggcauccagcuccaaggcugggug

SEQ ID NO: 725662 - RNA, 20 nt, Human
ggccccuucaaaggcagucc

SEQ ID NO: 725663 - RNA, 18 nt, Human
ggccgcggcagccccuca

SEQ ID NO: 725664 - RNA, 22 nt, Human
ggccgcggcagccccucagccu

SEQ ID NO: 725665 - RNA, 19 nt, Human
gggaaggcgacagagagac

SEQ ID NO: 725666 - RNA, 21 nt, Human
gggcaagacggcgacccucca

SEQ ID NO: 725667 - RNA, 19 nt, Human
gggcucaaagugcugacag

SEQ ID NO: 725668 - RNA, 21 nt, Human
gggguggggaguaaagaggac

SEQ ID NO: 725669 - RNA, 22 nt, Human
gguggcugcauccacagggcag

SEQ ID NO: 725670 - RNA, 23 nt, Human
uaaaaaacuagaccuuuuaauca

SEQ ID NO: 725671 - RNA, 19 nt, Human
uaaacggcccugccugccc

SEQ ID NO: 725672 - RNA, 19 nt, Human
uaggaccaggucacuucuc

SEQ ID NO: 725673 - RNA, 21 nt, Human
uaugaaugggaaaaacccacc

SEQ ID NO: 725674 - RNA, 18 nt, Human
ucaauacauugcaaagac

SEQ ID NO: 725675 - RNA, 24 nt, Human
ucagagcggggucagcagaugggc

SEQ ID NO: 725676 - RNA, 22 nt, Human
ucagggauggggcaaugagggc

SEQ ID NO: 725677 - RNA, 21 nt, Human
uccacagggcaguucccccgc

SEQ ID NO: 725678 - RNA, 19 nt, Human
uccacaguguuugggcagc

SEQ ID NO: 725679 - RNA, 26 nt, Human
uccacaguguuugggcagcccuaacg

SEQ ID NO: 725680 - RNA, 21 nt, Human
uccauaaacccaggagggcuc

SEQ ID NO: 725681 - RNA, 18 nt, Human
uccccaggccaggcuccu

SEQ ID NO: 725682 - RNA, 21 nt, Human
uccccaggccaggcuccugcc

SEQ ID NO: 725683 - RNA, 19 nt, Human
ucccggcugggcaaguuca

SEQ ID NO: 725684 - RNA, 19 nt, Human
uccugggcuuucucuggga

SEQ ID NO: 725685 - RNA, 24 nt, Human
ucuccacagugcagggcguggcug

SEQ ID NO: 725686 - RNA, 28 nt, Human
ugaaagcacuggcagcuucuggggaacg

SEQ ID NO: 725687 - RNA, 19 nt, Human
ugacaaggggacacagcug

SEQ ID NO: 725688 - RNA, 20 nt, Human
ugacagugcugguuuccagu

SEQ ID NO: 725689 - RNA, 24 nt, Human
ugaccaucacuuugaaaacaauuc

SEQ ID NO: 725690 - RNA, 22 nt, Human
ugacuaggcugggcuuguggug

SEQ ID NO: 725691 - RNA, 18 nt, Human
ugagggaggggaggcggg

SEQ ID NO: 725692 - RNA, 19 nt, Human
ugagggaggggaggcggga

SEQ ID NO: 725693 - RNA, 18 nt, Human
ugaggggcgguuuggcac

SEQ ID NO: 725694 - RNA, 19 nt, Human
ugaguggcuccugugcauc

SEQ ID NO: 725695 - RNA, 18 nt, Human
ugcaaagacuccucaggg

SEQ ID NO: 725696 - RNA, 20 nt, Human
ugcagcagaggggugggggg

SEQ ID NO: 725697 - RNA, 21 nt, Human
ugcagcagcgccccugucugu

SEQ ID NO: 725698 - RNA, 19 nt, Human
ugccuaucugugcccuggc

SEQ ID NO: 725699 - RNA, 23 nt, Human
ugccugcccucucugggguccug

SEQ ID NO: 725700 - RNA, 20 nt, Human
ugcggcucuccaccugaggc

SEQ ID NO: 725701 - RNA, 20 nt, Human
ugcuagguccaggagaggug

SEQ ID NO: 725702 - RNA, 21 nt, Human
ugcuccggggaacuucuucag

SEQ ID NO: 725703 - RNA, 22 nt, Human
ugcuccggggaacuucuucagu

SEQ ID NO: 725704 - RNA, 20 nt, Human
ugcugcacaggcauccagcu

SEQ ID NO: 725705 - RNA, 23 nt, Human
ugcuuugggaauucauggcuuug

SEQ ID NO: 725706 - RNA, 21 nt, Human
uggcagugagggccaaggaaa

SEQ ID NO: 725707 - RNA, 22 nt, Human
uggcagugagggccaaggaaag

SEQ ID NO: 725708 - RNA, 21 nt, Human
uggcugccugcccucucuggg

SEQ ID NO: 725709 - RNA, 22 nt, Human
ugggaaaaacccaccuuaaaaa

SEQ ID NO: 725710 - RNA, 27 nt, Human
ugggaaaaacccaccuuaaaaaacuag

SEQ ID NO: 725711 - RNA, 24 nt, Human
ugggcaaguucagugaugcuuugg

SEQ ID NO: 725712 - RNA, 22 nt, Human
ugggggaaggcgacagagagac

SEQ ID NO: 725713 - RNA, 18 nt, Human
uggggggagggccagggg

SEQ ID NO: 725714 - RNA, 23 nt, Human
ugguggccacgccuccugcagca

SEQ ID NO: 725715 - RNA, 19 nt, Human
ugguggcugcauccacagg

SEQ ID NO: 725716 - RNA, 23 nt, Human
ugucccagcaguggccugcccac

SEQ ID NO: 725717 - RNA, 27 nt, Human
ugucccggcugggcaaguucagugaug

SEQ ID NO: 725718 - RNA, 23 nt, Human
uguggaauugaaaaugcucccca

SEQ ID NO: 725719 - RNA, 20 nt, Human
uugggcagcccuaacggagg

SEQ ID NO: 725720 - RNA, 22 nt, Human
uugugguggagcguuaaugugg

SEQ ID NO: 725721 - RNA, 20 nt, Human
cagguggcugggcccugggg

SEQ ID NO: 725722 - RNA, 20 nt, Human
cccugcaucccagcuggcuc

SEQ ID NO: 725723 - RNA, 21 nt, Human
ccuggggucagagcacagggc

SEQ ID NO: 725724 - RNA, 18 nt, Human
ggaaggcguaggauggcu

SEQ ID NO: 725725 - RNA, 18 nt, Human
ggcaggaacgugagggcc

SEQ ID NO: 725726 - RNA, 22 nt, Human
ggcaggaacgugagggccaggu

SEQ ID NO: 725727 - RNA, 20 nt, Human
ggcuggggccgggcacccgg

SEQ ID NO: 725728 - RNA, 24 nt, Human
gggcacccggcuugcugggcagga

SEQ ID NO: 725729 - RNA, 21 nt, Human
gggucagagcacagggcuccc

SEQ ID NO: 725730 - RNA, 21 nt, Human
ggguccgcccaggccgagggu

SEQ ID NO: 725731 - RNA, 19 nt, Human
uccccuggguccgcccagg

SEQ ID NO: 725732 - RNA, 18 nt, Human
ugagggccagguggcugg

SEQ ID NO: 725733 - RNA, 21 nt, Human
ugggcaggaacgugagggcca

SEQ ID NO: 725734 - RNA, 20 nt, Human
uugggccgcccuccccuggg

SEQ ID NO: 725735 - RNA, 19 nt, Human
aaaaaacagaaacaaaaga

SEQ ID NO: 725736 - RNA, 27 nt, Human
aaagcacccagaguggcgagagagcac

SEQ ID NO: 725737 - RNA, 26 nt, Human
aaagcacccagaguggcggcgaaguc

SEQ ID NO: 725738 - RNA, 18 nt, Human
aacaaggaguacucaccc

SEQ ID NO: 725739 - RNA, 22 nt, Human
aagaaagggaaaaucaagacgc

SEQ ID NO: 725740 - RNA, 22 nt, Human
aaggagcccuguaaacaccugc

SEQ ID NO: 725741 - RNA, 20 nt, Human
acaaacaguccaugagaugc

SEQ ID NO: 725742 - RNA, 23 nt, Human
acaagccagagacaguaaagcac

SEQ ID NO: 725743 - RNA, 19 nt, Human
acaucugcaucauccucug

SEQ ID NO: 725744 - RNA, 19 nt, Human
accugagcccagggccugg

SEQ ID NO: 725745 - RNA, 23 nt, Human
acggaaacuacacagaaauacca

SEQ ID NO: 725746 - RNA, 19 nt, Human
agggggugcccagagggcc

SEQ ID NO: 725747 - RNA, 28 nt, Human
agugauggaaacaagccagagacaguaa

SEQ ID NO: 725748 - RNA, 18 nt, Human
aucuuaaaaaacagaaac

SEQ ID NO: 725749 - RNA, 20 nt, Human
caaauguggccaaaaugacc

SEQ ID NO: 725750 - RNA, 19 nt, Human
caagccagagacaguaaag

SEQ ID NO: 725751 - RNA, 21 nt, Human
caagccagagacaguaaagca

SEQ ID NO: 725752 - RNA, 25 nt, Human
caagccagagacaguaaagcaccca

SEQ ID NO: 725753 - RNA, 19 nt, Human
cacccaacccuuccccuuc

SEQ ID NO: 725754 - RNA, 22 nt, Human
cagaaacaaaagaaaacuucca

SEQ ID NO: 725755 - RNA, 22 nt, Human
cagagacaguaaagcacccaga

SEQ ID NO: 725756 - RNA, 21 nt, Human
cagcaggaacuaagcucagua

SEQ ID NO: 725757 - RNA, 26 nt, Human
caucaaagaaagggaaaaucaagacg

SEQ ID NO: 725758 - RNA, 31 nt, Human
caucaaagaaagggaaaaucaagacgcgacu

SEQ ID NO: 725759 - RNA, 18 nt, Human
cccaacccuuccccuucc

SEQ ID NO: 725760 - RNA, 22 nt, Human
cccuggcuggcccggcuauggg

SEQ ID NO: 725761 - RNA, 20 nt, Human
ccucucgggggugacccugg

SEQ ID NO: 725762 - RNA, 23 nt, Human
ccuguaaacaccugcacauguaa

SEQ ID NO: 725763 - RNA, 18 nt, Human
cucacaguagaaacaagg

SEQ ID NO: 725764 - RNA, 20 nt, Human
cuccugcccgucagcaccca

SEQ ID NO: 725765 - RNA, 25 nt, Human
cugcaucauccucugucggaacaca

SEQ ID NO: 725766 - RNA, 19 nt, Human
cuggcuggcccggcuaugg

SEQ ID NO: 725767 - RNA, 23 nt, Human
gaaaacuuccauuuuguaacauc

SEQ ID NO: 725768 - RNA, 19 nt, Human
gaaaggagcccuguaaaca

SEQ ID NO: 725769 - RNA, 22 nt, Human
gacugcccuuaagagaucuuga

SEQ ID NO: 725770 - RNA, 22 nt, Human
gagucucugggaggccaagccu

SEQ ID NO: 725771 - RNA, 19 nt, Human
gaucuuaaaaaacagaaac

SEQ ID NO: 725772 - RNA, 21 nt, Human
gcuuuugagggggugcccaga

SEQ ID NO: 725773 - RNA, 19 nt, Human
gggggugcccagagggccc

SEQ ID NO: 725774 - RNA, 23 nt, Human
gugcaccugagcccagggccugg

SEQ ID NO: 725775 - RNA, 22 nt, Human
uaaaaaacagaaacaaaagaaa

SEQ ID NO: 725776 - RNA, 23 nt, Human
uaaagcacccagaguggcgagag

SEQ ID NO: 725777 - RNA, 28 nt, Human
uaacaacauucacaacuucuuagaucuu

SEQ ID NO: 725778 - RNA, 21 nt, Human
uacacagaaauaccacuuagc

SEQ ID NO: 725779 - RNA, 26 nt, Human
uagaaacaaggaguacucacccucga

SEQ ID NO: 725780 - RNA, 23 nt, Human
uagggagugaaaaagagagucag

SEQ ID NO: 725781 - RNA, 21 nt, Human
uaucaaggaccaaaaacacua

SEQ ID NO: 725782 - RNA, 24 nt, Human
uaucaaggaccaaaaacacuacaa

SEQ ID NO: 725783 - RNA, 24 nt, Human
ucagcacccaacccuuccccuucc

SEQ ID NO: 725784 - RNA, 23 nt, Human
ucuacaccaggacagaaaggagc

SEQ ID NO: 725785 - RNA, 19 nt, Human
ucucugggaggccaagccu

SEQ ID NO: 725786 - RNA, 21 nt, Human
ugaaaaagagagucaguugug

SEQ ID NO: 725787 - RNA, 19 nt, Human
ugaccagggccaacaagcu

SEQ ID NO: 725788 - RNA, 20 nt, Human
ugagacaucaaagaaaggga

SEQ ID NO: 725789 - RNA, 28 nt, Human
ugagaugcagguguuugggacacacacu

SEQ ID NO: 725790 - RNA, 25 nt, Human
ugauuaacaacauucacaacuucuu

SEQ ID NO: 725791 - RNA, 24 nt, Human
ugcccagagggcccugguuaccuc

SEQ ID NO: 725792 - RNA, 18 nt, Human
uggaaacaagccagagac

SEQ ID NO: 725793 - RNA, 23 nt, Human
ugggaaagcaguuccagacggaa

SEQ ID NO: 725794 - RNA, 21 nt, Human
ugggaggccaagccuaggggc

SEQ ID NO: 725795 - RNA, 23 nt, Human
ugggcacaaacaguccaugagau

SEQ ID NO: 725796 - RNA, 20 nt, Human
uguaaacaccugcacaugua

SEQ ID NO: 725797 - RNA, 19 nt, Human
ugucuguacaucugcauca

SEQ ID NO: 725798 - RNA, 24 nt, Human
ugucuucuuugugcuccugcccgu

SEQ ID NO: 725799 - RNA, 25 nt, Human
uuccagugauggaaacaagguaccc

SEQ ID NO: 725800 - RNA, 20 nt, Human
uucuuugugcuccugcccgu

SEQ ID NO: 725801 - RNA, 20 nt, Human
uuugagggggugcccagagg

SEQ ID NO: 725802 - RNA, 20 nt, Human
aaaaggaaauccagcuaauu

SEQ ID NO: 725803 - RNA, 21 nt, Human
aaaauuuuuccaacccaaaau

SEQ ID NO: 725804 - RNA, 18 nt, Human
aaacgaagucuaacagac

SEQ ID NO: 725805 - RNA, 20 nt, Human
aacaagagcccucuaugaac

SEQ ID NO: 725806 - RNA, 25 nt, Human
aacaaguuuguguggcuguguuuca

SEQ ID NO: 725807 - RNA, 20 nt, Human
aagaaugguucccagaguga

SEQ ID NO: 725808 - RNA, 20 nt, Human
accccaccucacuagaggcc

SEQ ID NO: 725809 - RNA, 21 nt, Human
agacuugaaaucuuguuggca

SEQ ID NO: 725810 - RNA, 25 nt, Human
agcaaagcaucaggaaccaaggcag

SEQ ID NO: 725811 - RNA, 20 nt, Human
agcugaguuuauggccugaa

SEQ ID NO: 725812 - RNA, 21 nt, Human
aggagaaaugcaaagcaguuc

SEQ ID NO: 725813 - RNA, 24 nt, Human
aggauucucuguggauaaaugugg

SEQ ID NO: 725814 - RNA, 19 nt, Human
aggauuuucuuccacacug

SEQ ID NO: 725815 - RNA, 20 nt, Human
aggugggcugugggaggggg

SEQ ID NO: 725816 - RNA, 23 nt, Human
aguaggccaccuugcacuugagu

SEQ ID NO: 725817 - RNA, 21 nt, Human
augauguuaaaagaccaauuu

SEQ ID NO: 725818 - RNA, 22 nt, Human
augguuuuacaccuuguguggu

SEQ ID NO: 725819 - RNA, 24 nt, Human
caaagcaucaggaaccaaggcagg

SEQ ID NO: 725820 - RNA, 21 nt, Human
caaggagcuuugagaaacaau

SEQ ID NO: 725821 - RNA, 20 nt, Human
caccaugagacuagggugga

SEQ ID NO: 725822 - RNA, 22 nt, Human
cagaagucagaaccaaagcaag

SEQ ID NO: 725823 - RNA, 25 nt, Human
cagagagcuaccaaacaugcaacac

SEQ ID NO: 725824 - RNA, 20 nt, Human
cagcaaacuuuuucuguaaa

SEQ ID NO: 725825 - RNA, 18 nt, Human
caucgcugaaacuguggu

SEQ ID NO: 725826 - RNA, 20 nt, Human
caugaaauauucaaaaaaaa

SEQ ID NO: 725827 - RNA, 22 nt, Human
cauuuuggcaauugcaaccuaa

SEQ ID NO: 725828 - RNA, 21 nt, Human
ccaaugaccccuugguucccu

SEQ ID NO: 725829 - RNA, 19 nt, Human
ccaaugcaugauagaaaaa

SEQ ID NO: 725830 - RNA, 21 nt, Human
cccucaaacaaacuuucucac

SEQ ID NO: 725831 - RNA, 21 nt, Human
cugaaacuguggucaaaggca

SEQ ID NO: 725832 - RNA, 20 nt, Human
cugcugaacugcucagcucu

SEQ ID NO: 725833 - RNA, 18 nt, Human
cugucuguggaugucaaa

SEQ ID NO: 725834 - RNA, 21 nt, Human
cuuucuauuuuuccccuuaga

SEQ ID NO: 725835 - RNA, 19 nt, Human
gaaccaugaaccagaaaag

SEQ ID NO: 725836 - RNA, 20 nt, Human
gaagucagaaccaaagcaag

SEQ ID NO: 725837 - RNA, 18 nt, Human
gacaguacaaaaacaagu

SEQ ID NO: 725838 - RNA, 22 nt, Human
gacuauaaaggaaauauuuugu

SEQ ID NO: 725839 - RNA, 24 nt, Human
gagcaggggucagcaaacuuuuuc

SEQ ID NO: 725840 - RNA, 19 nt, Human
gaggugggcugugggaggg

SEQ ID NO: 725841 - RNA, 21 nt, Human
gcaaagcaucaggaaccaagg

SEQ ID NO: 725842 - RNA, 23 nt, Human
gcaaagcaucaggaaccaaggca

SEQ ID NO: 725843 - RNA, 19 nt, Human
gccaccuugcacuugaguu

SEQ ID NO: 725844 - RNA, 23 nt, Human
gcccauaauuuucauguaggaag

SEQ ID NO: 725845 - RNA, 24 nt, Human
gcggcuguagugugaaaguagcug

SEQ ID NO: 725846 - RNA, 24 nt, Human
ggaaaaagguaacaucagcccugu

SEQ ID NO: 725847 - RNA, 21 nt, Human
ggaaggacgggaggagacaga

SEQ ID NO: 725848 - RNA, 21 nt, Human
ggacgggaggagacagaggug

SEQ ID NO: 725849 - RNA, 19 nt, Human
ggaggugggcugugggagg

SEQ ID NO: 725850 - RNA, 20 nt, Human
guaaccucuggagcugaguu

SEQ ID NO: 725851 - RNA, 20 nt, Human
gucaaaggcagcuucgcuua

SEQ ID NO: 725852 - RNA, 19 nt, Human
uaaaagguaaccucuggag

SEQ ID NO: 725853 - RNA, 26 nt, Human
uaaaauagcagauaccuaaagggagc

SEQ ID NO: 725854 - RNA, 18 nt, Human
uaaaaucuuugaggcaca

SEQ ID NO: 725855 - RNA, 22 nt, Human
uaaacaagaacaaaacgggcac

SEQ ID NO: 725856 - RNA, 23 nt, Human
uaaaguaguuacaagcuccuucu

SEQ ID NO: 725857 - RNA, 19 nt, Human
uaacaucagcccugucucu

SEQ ID NO: 725858 - RNA, 21 nt, Human
uacaaaaugggaugcuacuga

SEQ ID NO: 725859 - RNA, 24 nt, Human
uacaagcuccuucuacccaggacu

SEQ ID NO: 725860 - RNA, 18 nt, Human
uacacugaacacuggauu

SEQ ID NO: 725861 - RNA, 18 nt, Human
uacagaacagcugaaaca

SEQ ID NO: 725862 - RNA, 24 nt, Human
uacagaacagcugaaacaaaauca

SEQ ID NO: 725863 - RNA, 21 nt, Human
uagaggccuacagacuugaaa

SEQ ID NO: 725864 - RNA, 24 nt, Human
uagcugugguuugccaccccaccu

SEQ ID NO: 725865 - RNA, 25 nt, Human
uaggguggaaccgcucucaccccuu

SEQ ID NO: 725866 - RNA, 23 nt, Human
uauuuacuuggggugaauguaca

SEQ ID NO: 725867 - RNA, 21 nt, Human
ucaauuuuuauuucugaauua

SEQ ID NO: 725868 - RNA, 23 nt, Human
ucacuacaccguguuaaugaagu

SEQ ID NO: 725869 - RNA, 23 nt, Human
ucagagugcaagagcuagagagc

SEQ ID NO: 725870 - RNA, 19 nt, Human
ucaugaaauauucaaaaaa

SEQ ID NO: 725871 - RNA, 22 nt, Human
uccacacugagcuacugcccuc

SEQ ID NO: 725872 - RNA, 18 nt, Human
uccagacaagugucugag

SEQ ID NO: 725873 - RNA, 22 nt, Human
ucccagaagucagaaccaaagc

SEQ ID NO: 725874 - RNA, 20 nt, Human
uccuacuuucuugcuaaggc

SEQ ID NO: 725875 - RNA, 18 nt, Human
uccuggacagcucucccc

SEQ ID NO: 725876 - RNA, 21 nt, Human
uccuucuacccaggacuccaa

SEQ ID NO: 725877 - RNA, 22 nt, Human
ucuaagggaacaaacuacugag

SEQ ID NO: 725878 - RNA, 23 nt, Human
ucuaggauucuauuuacuugggg

SEQ ID NO: 725879 - RNA, 19 nt, Human
ucuuagagaguaaccccau

SEQ ID NO: 725880 - RNA, 20 nt, Human
ucuuccacacugagcuacug

SEQ ID NO: 725881 - RNA, 20 nt, Human
ugaaaguagcuguagacagu

SEQ ID NO: 725882 - RNA, 23 nt, Human
ugaacaaacaggaauauugggua

SEQ ID NO: 725883 - RNA, 20 nt, Human
ugaacagcucuaugcccuca

SEQ ID NO: 725884 - RNA, 19 nt, Human
ugacuuccucacacaccuc

SEQ ID NO: 725885 - RNA, 18 nt, Human
ugaguaggccaccuugca

SEQ ID NO: 725886 - RNA, 20 nt, Human
ugaguucuuggcacuuaaaa

SEQ ID NO: 725887 - RNA, 26 nt, Human
ugcuaaggcucaacuaaaaucuuuga

SEQ ID NO: 725888 - RNA, 20 nt, Human
ugggagggggugggcuguag

SEQ ID NO: 725889 - RNA, 21 nt, Human
ugggagggggugggcuguagg

SEQ ID NO: 725890 - RNA, 20 nt, Human
ugggaugcuacugagugaaa

SEQ ID NO: 725891 - RNA, 18 nt, Human
ugggcugugggagggggu

SEQ ID NO: 725892 - RNA, 27 nt, Human
ugguaaacaagaacaaaacgggcacuu

SEQ ID NO: 725893 - RNA, 18 nt, Human
ugguucccuuaacuacag

SEQ ID NO: 725894 - RNA, 23 nt, Human
uguggaucaccaucaaacaaagc

SEQ ID NO: 725895 - RNA, 19 nt, Human
ugugggagggggugggcug

SEQ ID NO: 725896 - RNA, 20 nt, Human
uuaaagacuuuuauauuauu

SEQ ID NO: 725897 - RNA, 25 nt, Human
uucauaaaauaucuuaagaguaaac

SEQ ID NO: 725898 - RNA, 24 nt, Human
uuccccuuagaaauuuagaauggc

SEQ ID NO: 725899 - RNA, 20 nt, Human
uuuaaaccuaaugcaaucac

SEQ ID NO: 725900 - RNA, 21 nt, Human
uuuauggccugaaacucagag

SEQ ID NO: 725901 - RNA, 25 nt, Human
uuuccaccaugagacuaggguggaa

SEQ ID NO: 725902 - RNA, 21 nt, Human
uuuucauuacuuccugugaca

SEQ ID NO: 725903 - RNA, 21 nt, Human
aaaaaguuugaaauacauugg

SEQ ID NO: 725904 - RNA, 23 nt, Human
aaacauggaguuuccacgaaaaa

SEQ ID NO: 725905 - RNA, 20 nt, Human
aaccaccccucaaacaucca

SEQ ID NO: 725906 - RNA, 24 nt, Human
aagaacaccaccacuucaaccccc

SEQ ID NO: 725907 - RNA, 18 nt, Human
aagcucuguuugcuuuuc

SEQ ID NO: 725908 - RNA, 22 nt, Human
aauaaagcuaauaaggaacaaa

SEQ ID NO: 725909 - RNA, 20 nt, Human
aauaauaaacauggaguuuc

SEQ ID NO: 725910 - RNA, 24 nt, Human
aaucaaccaccuaaacacaugaca

SEQ ID NO: 725911 - RNA, 23 nt, Human
acaaccaccccucaaacauccaa

SEQ ID NO: 725912 - RNA, 20 nt, Human
acacagauagaaugugugau

SEQ ID NO: 725913 - RNA, 22 nt, Human
acugacucuguccucuccaucu

SEQ ID NO: 725914 - RNA, 19 nt, Human
agggucaguuuaguucugg

SEQ ID NO: 725915 - RNA, 19 nt, Human
agucugcgauuuuguuucu

SEQ ID NO: 725916 - RNA, 23 nt, Human
aguucuggcacaaagacugcugu

SEQ ID NO: 725917 - RNA, 20 nt, Human
auagggccccuuccugaaau

SEQ ID NO: 725918 - RNA, 20 nt, Human
augaacauggcacuuguuug

SEQ ID NO: 725919 - RNA, 24 nt, Human
caaagaacaccaccacuucaaccc

SEQ ID NO: 725920 - RNA, 24 nt, Human
caaaucaaccaccuaaacacauga

SEQ ID NO: 725921 - RNA, 23 nt, Human
caacagaaggaaggaggaaaacc

SEQ ID NO: 725922 - RNA, 26 nt, Human
caaccaccuaaacacaugacaagaca

SEQ ID NO: 725923 - RNA, 18 nt, Human
cacagcuuccuauuucuu

SEQ ID NO: 725924 - RNA, 22 nt, Human
caccaccacuucaacccccaau

SEQ ID NO: 725925 - RNA, 24 nt, Human
cauccaagguuccauuaagcucac

SEQ ID NO: 725926 - RNA, 28 nt, Human
ccacuucaacccccaaugaagggcccuc

SEQ ID NO: 725927 - RNA, 21 nt, Human
ccagcuugcucugcaacucug

SEQ ID NO: 725928 - RNA, 22 nt, Human
ccgaaggagacugacucugucc

SEQ ID NO: 725929 - RNA, 20 nt, Human
ccucugagaugacacagcuu

SEQ ID NO: 725930 - RNA, 19 nt, Human
cucaguuuaccaucaacac

SEQ ID NO: 725931 - RNA, 18 nt, Human
cugacucuguccucucca

SEQ ID NO: 725932 - RNA, 21 nt, Human
cugcugugugccacccuaaac

SEQ ID NO: 725933 - RNA, 23 nt, Human
cuugcagucaaaaaaguuugaaa

SEQ ID NO: 725934 - RNA, 18 nt, Human
cuugcucugcaacucugu

SEQ ID NO: 725935 - RNA, 22 nt, Human
cuuuacaaccaccccucaaaca

SEQ ID NO: 725936 - RNA, 19 nt, Human
cuuuuuauuucagccaagg

SEQ ID NO: 725937 - RNA, 21 nt, Human
gauggcaggauuauuccaguc

SEQ ID NO: 725938 - RNA, 19 nt, Human
gggccagacauuaaacacc

SEQ ID NO: 725939 - RNA, 23 nt, Human
guuaacgucaauaaggaugagua

SEQ ID NO: 725940 - RNA, 21 nt, Human
uaacuauuucugccaguuucc

SEQ ID NO: 725941 - RNA, 24 nt, Human
uacaaccaccccucaaacauccaa

SEQ ID NO: 725942 - RNA, 24 nt, Human
uaccaucaacacuaagguuuuacu

SEQ ID NO: 725943 - RNA, 20 nt, Human
uaccucaucuuggaaguuuc

SEQ ID NO: 725944 - RNA, 18 nt, Human
uccaccuguaaaaggaag

SEQ ID NO: 725945 - RNA, 20 nt, Human
ucuaaaccacggcagucugc

SEQ ID NO: 725946 - RNA, 21 nt, Human
ucuaaaccacggcagucugcg

SEQ ID NO: 725947 - RNA, 24 nt, Human
ugacauuauaaauggucuaaacca

SEQ ID NO: 725948 - RNA, 23 nt, Human
ugagaaaaggcauuuuuuaaaag

SEQ ID NO: 725949 - RNA, 27 nt, Human
uggaauccaagguaagcuacagaguuc

SEQ ID NO: 725950 - RNA, 23 nt, Human
uguaaagaugcuaaacaaucauu

SEQ ID NO: 725951 - RNA, 25 nt, Human
uuauuaaugauggcaggauuauucc

SEQ ID NO: 725952 - RNA, 20 nt, Human
uuccagucaauuaagcucug

SEQ ID NO: 725953 - RNA, 22 nt, Human
uuccuuuacaaccaccccucaa

SEQ ID NO: 725954 - RNA, 21 nt, Human
uucucaguuuaccaucaacac

SEQ ID NO: 725955 - RNA, 22 nt, Human
uucuucagguguaagagggagg

SEQ ID NO: 725956 - RNA, 22 nt, Human
uugcagucaaaaaaguuugaaa

SEQ ID NO: 725957 - RNA, 19 nt, Human
aaaacaacaaaaacgugag

SEQ ID NO: 725958 - RNA, 21 nt, Human
aaucuccaggcuccuauuugc

SEQ ID NO: 725959 - RNA, 22 nt, Human
aaugaugagaaaacaacaaaaa

SEQ ID NO: 725960 - RNA, 23 nt, Human
acaacaaaaacgugagucuuugc

SEQ ID NO: 725961 - RNA, 20 nt, Human
agccacgugcgccuggucug

SEQ ID NO: 725962 - RNA, 27 nt, Human
agucauuccuagugcuggagagaaagu

SEQ ID NO: 725963 - RNA, 25 nt, Human
cagaggcaggcagcguugcuugcgg

SEQ ID NO: 725964 - RNA, 25 nt, Human
cagcagcagaaguccguguccccag

SEQ ID NO: 725965 - RNA, 22 nt, Human
cagcucugcugggcagcggcaa

SEQ ID NO: 725966 - RNA, 20 nt, Human
ccccaugagccacgugcgcc

SEQ ID NO: 725967 - RNA, 18 nt, Human
ccgccugcuccaacgccc

SEQ ID NO: 725968 - RNA, 24 nt, Human
cggcaagauguggaggagcggcag

SEQ ID NO: 725969 - RNA, 24 nt, Human
gcaaaucucugacaaagagcagag

SEQ ID NO: 725970 - RNA, 25 nt, Human
gcaauucugccccaugagccacguu

SEQ ID NO: 725971 - RNA, 23 nt, Human
gccccaugagccacgugcgccug

SEQ ID NO: 725972 - RNA, 18 nt, Human
gggagaagccaaggagug

SEQ ID NO: 725973 - RNA, 21 nt, Human
gggcagcggcaagauguggag

SEQ ID NO: 725974 - RNA, 21 nt, Human
gggcagcggcaagauguggag

SEQ ID NO: 725975 - RNA, 20 nt, Human
guggaagguagggcuggcgc

SEQ ID NO: 725976 - RNA, 19 nt, Human
guggacccagaagccagcu

SEQ ID NO: 725977 - RNA, 18 nt, Human
uacauagucauuccuagu

SEQ ID NO: 725978 - RNA, 18 nt, Human
uccuuggcuggaauggug

SEQ ID NO: 725979 - RNA, 21 nt, Human
ucucugacaaagagcagagau

SEQ ID NO: 725980 - RNA, 19 nt, Human
ucugugguggaagguaggg

SEQ ID NO: 725981 - RNA, 20 nt, Human
ugacaaagagcagagaucuc

SEQ ID NO: 725982 - RNA, 23 nt, Human
ugacaaagagcagagaucucaag

SEQ ID NO: 725983 - RNA, 20 nt, Human
ugcggugggagaagccaagg

SEQ ID NO: 725984 - RNA, 23 nt, Human
ugcggugggagaagccaaggagu

SEQ ID NO: 725985 - RNA, 22 nt, Human
uggaagguagggcuggcgcagg

SEQ ID NO: 725986 - RNA, 22 nt, Human
uggaauggugagaagguggcac

SEQ ID NO: 725987 - RNA, 23 nt, Human
uggcgcagguggcagcagcagaa

SEQ ID NO: 725988 - RNA, 20 nt, Human
uggcuggaauggugagaagg

SEQ ID NO: 725989 - RNA, 19 nt, Human
ugggagaagccaaggagug

SEQ ID NO: 725990 - RNA, 19 nt, Human
ugggagaagccaaggagug

SEQ ID NO: 725991 - RNA, 19 nt, Human
uugcggugggagaagccaa

SEQ ID NO: 725992 - RNA, 18 nt, Human
aaacgccgaggcugcaau

SEQ ID NO: 725993 - RNA, 20 nt, Human
aacaaauuucaaugcugauu

SEQ ID NO: 725994 - RNA, 20 nt, Human
aagcaaccaaggcaauaaug

SEQ ID NO: 725995 - RNA, 18 nt, Human
accaugcaagaugcagaa

SEQ ID NO: 725996 - RNA, 24 nt, Human
auuacauagaaaauggcuauuaag

SEQ ID NO: 725997 - RNA, 20 nt, Human
auuuuuguuuuauuucagaa

SEQ ID NO: 725998 - RNA, 19 nt, Human
caagaugcagaaaauaaug

SEQ ID NO: 725999 - RNA, 23 nt, Human
cagcauuauuuuccauuaauguu

SEQ ID NO: 726000 - RNA, 22 nt, Human
cauauuacauagaaaauggcua

SEQ ID NO: 726001 - RNA, 22 nt, Human
cgcaugcgccuuucccaggacu

SEQ ID NO: 726002 - RNA, 20 nt, Human
gccgaggcugcaaugagagc

SEQ ID NO: 726003 - RNA, 23 nt, Human
gugcauugugcuaaucuacuuuu

SEQ ID NO: 726004 - RNA, 26 nt, Human
uaaugguuuuccuuucauucugguuu

SEQ ID NO: 726005 - RNA, 26 nt, Human
uauuacauagaaaauggcuauuaagg

SEQ ID NO: 726006 - RNA, 25 nt, Human
uauuuggauuuuaugaugaauuggu

SEQ ID NO: 726007 - RNA, 19 nt, Human
ucacacaccugaguguuug

SEQ ID NO: 726008 - RNA, 20 nt, Human
ucuacaaacgccgaggcugc

SEQ ID NO: 726009 - RNA, 21 nt, Human
ugauuguuccuuacccauuuu

SEQ ID NO: 726010 - RNA, 24 nt, Human
ugcauauuacauagaaaauggcua

SEQ ID NO: 726011 - RNA, 23 nt, Human
uguugcuuuggguagaagucuug

SEQ ID NO: 726012 - RNA, 20 nt, Human
uuaaaaaaaacccugcagac

SEQ ID NO: 726013 - RNA, 22 nt, Human
uuggguagaagucuugauucau

SEQ ID NO: 726014 - RNA, 24 nt, Human
uuuccuuucauucugguuuuccca

SEQ ID NO: 726015 - RNA, 23 nt, Human
uuugcaaaucuugauuggaguag

SEQ ID NO: 726016 - RNA, 19 nt, Human
uuuucaacagaauuggaga

SEQ ID NO: 726017 - RNA, 22 nt, Human
aacaagaaaacuuuuuguacac

SEQ ID NO: 726018 - RNA, 20 nt, Human
accaaaaugaaauguccaaa

SEQ ID NO: 726019 - RNA, 18 nt, Human
acuauucuaucuuacccu

SEQ ID NO: 726020 - RNA, 19 nt, Human
agaaaaguacaauaaagaa

SEQ ID NO: 726021 - RNA, 19 nt, Human
aggaaguaaaaaaacuuac

SEQ ID NO: 726022 - RNA, 22 nt, Human
agggaaacagggguagaugaga

SEQ ID NO: 726023 - RNA, 20 nt, Human
auaaaacucuaacaaaagua

SEQ ID NO: 726024 - RNA, 21 nt, Human
auaaagguacaagguagugag

SEQ ID NO: 726025 - RNA, 19 nt, Human
caaaaauaagacaugaaca

SEQ ID NO: 726026 - RNA, 21 nt, Human
cauguaagaaaaacaugcauu

SEQ ID NO: 726027 - RNA, 18 nt, Human
cugaguuaugcugguguc

SEQ ID NO: 726028 - RNA, 24 nt, Human
cuuaugaucggaaaacaacuugcc

SEQ ID NO: 726029 - RNA, 19 nt, Human
gcagguagaagaggaagaa

SEQ ID NO: 726030 - RNA, 21 nt, Human
gguacaagguagugagaagga

SEQ ID NO: 726031 - RNA, 20 nt, Human
gucauuguaaaauaaaacuc

SEQ ID NO: 726032 - RNA, 22 nt, Human
uaagaaaaacaugcauuaacau

SEQ ID NO: 726033 - RNA, 19 nt, Human
uagaagaggaagaaaacua

SEQ ID NO: 726034 - RNA, 23 nt, Human
uagugagaaggaaauacuacagu

SEQ ID NO: 726035 - RNA, 26 nt, Human
uaucuuacccuuaagauucaguuuca

SEQ ID NO: 726036 - RNA, 25 nt, Human
uauuaaagaauuucuugaugcucag

SEQ ID NO: 726037 - RNA, 24 nt, Human
ucaacaccaaaaugaaauguccaa

SEQ ID NO: 726038 - RNA, 22 nt, Human
ucuauuaucaacaccaaaauga

SEQ ID NO: 726039 - RNA, 21 nt, Human
uggauggcuuuucuaaauuuc

SEQ ID NO: 726040 - RNA, 19 nt, Human
ugguauaaggaauaaucaa

SEQ ID NO: 726041 - RNA, 26 nt, Human
uguaaaauaaaacucaauuaauuuga

SEQ ID NO: 726042 - RNA, 21 nt, Human
ugucauuguaaaauaaaacuc

SEQ ID NO: 726043 - RNA, 23 nt, Human
uuaaagaauuucuugaugcucag

SEQ ID NO: 726044 - RNA, 23 nt, Human
uuacccuuaagauucaguuucac

SEQ ID NO: 726045 - RNA, 21 nt, Human
uuacuugguucaugguucuac

SEQ ID NO: 726046 - RNA, 23 nt, Human
uuccuauguaaauaaagauacac

SEQ ID NO: 726047 - RNA, 24 nt, Human
uucuauuauaguucucuguaauaa

SEQ ID NO: 726048 - RNA, 21 nt, Human
uuucuuggcucuucaauuguu

SEQ ID NO: 726049 - RNA, 22 nt, Human
acccuguagauggcuuucuggg

SEQ ID NO: 726050 - RNA, 21 nt, Human
agacacugucccuggagccca

SEQ ID NO: 726051 - RNA, 22 nt, Human
agacacugucccuggagcccag

SEQ ID NO: 726052 - RNA, 20 nt, Human
agcugagacacuguuccacg

SEQ ID NO: 726053 - RNA, 22 nt, Human
agcuggaccccugaugcgucug

SEQ ID NO: 726054 - RNA, 22 nt, Human
aggugccagcacagggauacgu

SEQ ID NO: 726055 - RNA, 19 nt, Human
caacagcaccagacacugu

SEQ ID NO: 726056 - RNA, 22 nt, Human
cauaaacagacgccugggcucc

SEQ ID NO: 726057 - RNA, 27 nt, Human
cauccucaucuccaccuggccuaggga

SEQ ID NO: 726058 - RNA, 22 nt, Human
ccagugcugugucccaucccuc

SEQ ID NO: 726059 - RNA, 19 nt, Human
ccugggcuccuccucccuc

SEQ ID NO: 726060 - RNA, 24 nt, Human
cgaccaagcucuaccgcgacaguu

SEQ ID NO: 726061 - RNA, 22 nt, Human
cuggccccaauacuguuaccca

SEQ ID NO: 726062 - RNA, 19 nt, Human
cugggccacccgccuccag

SEQ ID NO: 726063 - RNA, 24 nt, Human
cugucccuggagcccaguggggca

SEQ ID NO: 726064 - RNA, 21 nt, Human
gaccaggcacuggccacagcc

SEQ ID NO: 726065 - RNA, 21 nt, Human
gcugugucccaucccucuccu

SEQ ID NO: 726066 - RNA, 19 nt, Human
ggauacguggccccagcuc

SEQ ID NO: 726067 - RNA, 19 nt, Human
ggauacguggccccagcuc

SEQ ID NO: 726068 - RNA, 24 nt, Human
gggaagggcucucgggcucugagu

SEQ ID NO: 726069 - RNA, 20 nt, Human
gucugucccuuuugcacucc

SEQ ID NO: 726070 - RNA, 19 nt, Human
guuccagcugagacacugu

SEQ ID NO: 726071 - RNA, 19 nt, Human
ucccucuccuggguggagg

SEQ ID NO: 726072 - RNA, 24 nt, Human
ucuccaccuggccuagggaacccu

SEQ ID NO: 726073 - RNA, 21 nt, Human
ucuggacaaggucacugggac

SEQ ID NO: 726074 - RNA, 21 nt, Human
ucugggccacccgccuccagg

SEQ ID NO: 726075 - RNA, 23 nt, Human
ucugggccacccgccuccagggg

SEQ ID NO: 726076 - RNA, 21 nt, Human
ugagucuggggguuaugaggg

SEQ ID NO: 726077 - RNA, 22 nt, Human
ugcgucugucccuuuugcacuc

SEQ ID NO: 726078 - RNA, 20 nt, Human
ugggcuccuccucccucuuc

SEQ ID NO: 726079 - RNA, 24 nt, Human
uucaucaggagagcuuggcaccuc

SEQ ID NO: 726080 - RNA, 21 nt, Human
uucugggccacccgccuccag

SEQ ID NO: 726081 - RNA, 19 nt, Human
aaacagcauggacccagca

SEQ ID NO: 726082 - RNA, 23 nt, Human
aaacaguaauucucacaugaaca

SEQ ID NO: 726083 - RNA, 22 nt, Human
aaaccaugaccagacagcugga

SEQ ID NO: 726084 - RNA, 19 nt, Human
aaaggcaaugcuucuggaa

SEQ ID NO: 726085 - RNA, 27 nt, Human
aaauaaauaaaccaaaccaugaccaga

SEQ ID NO: 726086 - RNA, 19 nt, Human
aacacaacucagacagggg

SEQ ID NO: 726087 - RNA, 24 nt, Human
aacaugcuccuccaaacuaggacg

SEQ ID NO: 726088 - RNA, 20 nt, Human
aagaguuaaggcacuuucuu

SEQ ID NO: 726089 - RNA, 21 nt, Human
aagcccuccccgugcccaccc

SEQ ID NO: 726090 - RNA, 18 nt, Human
aaguggcuucuuggagac

SEQ ID NO: 726091 - RNA, 22 nt, Human
acagcaacaaaaacacaacuca

SEQ ID NO: 726092 - RNA, 21 nt, Human
accaaaccaugaccagacagc

SEQ ID NO: 726093 - RNA, 19 nt, Human
accccuacccccccauccc

SEQ ID NO: 726094 - RNA, 21 nt, Human
acuccagcagccaccggccug

SEQ ID NO: 726095 - RNA, 20 nt, Human
agacagggggcgggacgggg

SEQ ID NO: 726096 - RNA, 18 nt, Human
agagaaauagaaacgcga

SEQ ID NO: 726097 - RNA, 21 nt, Human
agaggaacagcaacaaaaaca

SEQ ID NO: 726098 - RNA, 24 nt, Human
agcuguugaguucuggccugagag

SEQ ID NO: 726099 - RNA, 21 nt, Human
aggcugacaucugggcagggc

SEQ ID NO: 726100 - RNA, 21 nt, Human
agggggcauggacccaguacc

SEQ ID NO: 726101 - RNA, 20 nt, Human
agugcagcagcagcacccca

SEQ ID NO: 726102 - RNA, 18 nt, Human
aguggcucaugccaacag

SEQ ID NO: 726103 - RNA, 19 nt, Human
augcauuuacaagcaaauu

SEQ ID NO: 726104 - RNA, 22 nt, Human
caaaacagccccugaaggacaa

SEQ ID NO: 726105 - RNA, 27 nt, Human
caaaauaaauaaaccaaaccaugacca

SEQ ID NO: 726106 - RNA, 18 nt, Human
caacagaggaacagcaac

SEQ ID NO: 726107 - RNA, 25 nt, Human
caacagaggaacagcaacaaaaaca

SEQ ID NO: 726108 - RNA, 22 nt, Human
caacagcagagcuggccaucaa

SEQ ID NO: 726109 - RNA, 19 nt, Human
caacucagacagggggcgg

SEQ ID NO: 726110 - RNA, 21 nt, Human
caagaacacgcgcugcaccgc

SEQ ID NO: 726111 - RNA, 22 nt, Human
caagcccuccccgugcccaccc

SEQ ID NO: 726112 - RNA, 19 nt, Human
caccaaagggcauccagcc

SEQ ID NO: 726113 - RNA, 20 nt, Human
caccagcaccggaacccacc

SEQ ID NO: 726114 - RNA, 22 nt, Human
caccagcaccggaacccacccc

SEQ ID NO: 726115 - RNA, 19 nt, Human
caccgcaucgcucccucgc

SEQ ID NO: 726116 - RNA, 21 nt, Human
caccgcaucgcucccucgcaa

SEQ ID NO: 726117 - RNA, 25 nt, Human
caccggaacccaccccagccaauag

SEQ ID NO: 726118 - RNA, 18 nt, Human
caccuggggagggugggc

SEQ ID NO: 726119 - RNA, 23 nt, Human
cacgcuguggggcagcccagagu

SEQ ID NO: 726120 - RNA, 24 nt, Human
cagaacaggagcgaccuuuuccag

SEQ ID NO: 726121 - RNA, 22 nt, Human
cagcaacaaaaacacaacucag

SEQ ID NO: 726122 - RNA, 21 nt, Human
cagcaccggaacccaccccag

SEQ ID NO: 726123 - RNA, 18 nt, Human
cagcggcagcagccugag

SEQ ID NO: 726124 - RNA, 22 nt, Human
cagcugacccacgucuguggug

SEQ ID NO: 726125 - RNA, 23 nt, Human
caggggaagcccccucauucuua

SEQ ID NO: 726126 - RNA, 21 nt, Human
cauccauggccaccuuccucc

SEQ ID NO: 726127 - RNA, 19 nt, Human
cauuccuaaagcccacagu

SEQ ID NO: 726128 - RNA, 18 nt, Human
cauugcauccagucugug

SEQ ID NO: 726129 - RNA, 19 nt, Human
ccaagcccuccccgugccc

SEQ ID NO: 726130 - RNA, 22 nt, Human
ccacugguggcuggucuuccuc

SEQ ID NO: 726131 - RNA, 19 nt, Human
ccagccagcggcagcagcc

SEQ ID NO: 726132 - RNA, 22 nt, Human
ccaggcuggaagacaggucgcu

SEQ ID NO: 726133 - RNA, 18 nt, Human
ccauccauccauggccac

SEQ ID NO: 726134 - RNA, 18 nt, Human
ccaucuggugaccaggug

SEQ ID NO: 726135 - RNA, 24 nt, Human
cccacaguguccuaaggauccuau

SEQ ID NO: 726136 - RNA, 24 nt, Human
cccacaguguccuaaggauccuau

SEQ ID NO: 726137 - RNA, 24 nt, Human
cccaccccagccaauagucaggaa

SEQ ID NO: 726138 - RNA, 21 nt, Human
ccccaagaacacgcgcugcac

SEQ ID NO: 726139 - RNA, 24 nt, Human
ccccagcccuggcgugcccgcacc

SEQ ID NO: 726140 - RNA, 22 nt, Human
cccucuuucccuguugcugacc

SEQ ID NO: 726141 - RNA, 24 nt, Human
cccucuuucccuguugcugaccuc

SEQ ID NO: 726142 - RNA, 19 nt, Human
ccgcagaagccugggaucg

SEQ ID NO: 726143 - RNA, 18 nt, Human
ccgcaucgcucccucgca

SEQ ID NO: 726144 - RNA, 22 nt, Human
ccgccagaaagcccagccgcgu

SEQ ID NO: 726145 - RNA, 21 nt, Human
ccuccugugagccccucauug

SEQ ID NO: 726146 - RNA, 22 nt, Human
ccucuagauacucuccuagcuc

SEQ ID NO: 726147 - RNA, 26 nt, Human
ccugaugcuggacccaugagacuccc

SEQ ID NO: 726148 - RNA, 21 nt, Human
ccuggggaccccuaccccccc

SEQ ID NO: 726149 - RNA, 21 nt, Human
cgcaucgcucccucgcaaucu

SEQ ID NO: 726150 - RNA, 25 nt, Human
cgcaucgcucccucgcaaucuccug

SEQ ID NO: 726151 - RNA, 20 nt, Human
cgcccucuagauacucuccu

SEQ ID NO: 726152 - RNA, 18 nt, Human
cggaacccaccccagcca

SEQ ID NO: 726153 - RNA, 27 nt, Human
cggcugaguucuuccaauacggaagcc

SEQ ID NO: 726154 - RNA, 19 nt, Human
cgggacggggccaggaguc

SEQ ID NO: 726155 - RNA, 23 nt, Human
cuaaagccagagcugggacucca

SEQ ID NO: 726156 - RNA, 22 nt, Human
cuaguguaguucaauauucucu

SEQ ID NO: 726157 - RNA, 21 nt, Human
cucacacgcuguggggcagcc

SEQ ID NO: 726158 - RNA, 19 nt, Human
cuccagcagccaccggccu

SEQ ID NO: 726159 - RNA, 23 nt, Human
cucccuugcagcucugcacgcaa

SEQ ID NO: 726160 - RNA, 23 nt, Human
cucgcaaucuccugguuugggcu

SEQ ID NO: 726161 - RNA, 21 nt, Human
cucugcacgcaaaccuucccc

SEQ ID NO: 726162 - RNA, 20 nt, Human
cugaaaacaggcauuucacc

SEQ ID NO: 726163 - RNA, 24 nt, Human
cugaaaacaggcauuucaccaaag

SEQ ID NO: 726164 - RNA, 22 nt, Human
cugaguucuuccaauacggaag

SEQ ID NO: 726165 - RNA, 21 nt, Human
cugaugcuggacccaugagac

SEQ ID NO: 726166 - RNA, 23 nt, Human
cugcacgcaaaccuuccccaagg

SEQ ID NO: 726167 - RNA, 21 nt, Human
cuggacccaugagacucccag

SEQ ID NO: 726168 - RNA, 21 nt, Human
cuucuggaacccucucccuug

SEQ ID NO: 726169 - RNA, 23 nt, Human
gaagauccuggggaccccuaccc

SEQ ID NO: 726170 - RNA, 21 nt, Human
gaauggacgggucauguggga

SEQ ID NO: 726171 - RNA, 18 nt, Human
gacagguggaguggccuc

SEQ ID NO: 726172 - RNA, 20 nt, Human
gaccccuacccccccauccc

SEQ ID NO: 726173 - RNA, 22 nt, Human
gaccccucagcccacaaucggg

SEQ ID NO: 726174 - RNA, 19 nt, Human
gagacaacucaaccacuga

SEQ ID NO: 726175 - RNA, 19 nt, Human
gaucccuauucccaaaaau

SEQ ID NO: 726176 - RNA, 23 nt, Human
gcaaaacagccccugaaggacaa

SEQ ID NO: 726177 - RNA, 21 nt, Human
gcaacaaaaacacaacucaga

SEQ ID NO: 726178 - RNA, 20 nt, Human
gcacagggggcauggaccca

SEQ ID NO: 726179 - RNA, 22 nt, Human
gcaccggaacccaccccagcca

SEQ ID NO: 726180 - RNA, 21 nt, Human
gcagcaccccagcccuggcgu

SEQ ID NO: 726181 - RNA, 22 nt, Human
gcagcagcaccccagcccuggc

SEQ ID NO: 726182 - RNA, 20 nt, Human
gcagcagccugagcucccag

SEQ ID NO: 726183 - RNA, 20 nt, Human
gcaucgcucccucgcaaucu

SEQ ID NO: 726184 - RNA, 21 nt, Human
gccaucaacagaggaacagcc

SEQ ID NO: 726185 - RNA, 23 nt, Human
gcccucacaagaagaguuaaggc

SEQ ID NO: 726186 - RNA, 18 nt, Human
gcccuggcgugcccgcac

SEQ ID NO: 726187 - RNA, 21 nt, Human
gcggccgagccuucaucaacc

SEQ ID NO: 726188 - RNA, 23 nt, Human
gcucccaggcugacaucugggca

SEQ ID NO: 726189 - RNA, 20 nt, Human
gcugaccucaggccugaugc

SEQ ID NO: 726190 - RNA, 23 nt, Human
gcugcacccacaugcacagcccc

SEQ ID NO: 726191 - RNA, 20 nt, Human
gcuggucuuccucauggugc

SEQ ID NO: 726192 - RNA, 20 nt, Human
ggaggggcccuggugggagc

SEQ ID NO: 726193 - RNA, 24 nt, Human
ggaguggccucugugaaggcaaau

SEQ ID NO: 726194 - RNA, 18 nt, Human
ggcuggaagacaggucgc

SEQ ID NO: 726195 - RNA, 20 nt, Human
gggcauggugguaggagaca

SEQ ID NO: 726196 - RNA, 25 nt, Human
gggcgcugggaacugccaggcgcug

SEQ ID NO: 726197 - RNA, 21 nt, Human
gggcgggacggggccaggagu

SEQ ID NO: 726198 - RNA, 21 nt, Human
gguacaggucuugucuggaca

SEQ ID NO: 726199 - RNA, 19 nt, Human
guaggagacaacucaacca

SEQ ID NO: 726200 - RNA, 18 nt, Human
gucggccgggacagcccc

SEQ ID NO: 726201 - RNA, 20 nt, Human
gugccagaugccacaggacu

SEQ ID NO: 726202 - RNA, 19 nt, Human
gugcccuggagcacuagug

SEQ ID NO: 726203 - RNA, 22 nt, Human
guggcuucuuggagacuucgug

SEQ ID NO: 726204 - RNA, 21 nt, Human
guguggggcagcugacccacg

SEQ ID NO: 726205 - RNA, 21 nt, Human
uaaagcccacaguguccuaag

SEQ ID NO: 726206 - RNA, 19 nt, Human
uaaaguagccccaucggac

SEQ ID NO: 726207 - RNA, 20 nt, Human
uaaaugacacugccugggcu

SEQ ID NO: 726208 - RNA, 22 nt, Human
uaaaugacacugccugggcucc

SEQ ID NO: 726209 - RNA, 25 nt, Human
uaacaaaacaaaaauguuaacuaga

SEQ ID NO: 726210 - RNA, 21 nt, Human
uaacagaacaggagcgaccuu

SEQ ID NO: 726211 - RNA, 25 nt, Human
uaacuagaaaaacuccuuaugauga

SEQ ID NO: 726212 - RNA, 23 nt, Human
uaaggcacuuucuuuaacucugg

SEQ ID NO: 726213 - RNA, 22 nt, Human
uagaaaaacuccuuaugaugaa

SEQ ID NO: 726214 - RNA, 19 nt, Human
uagaaacgcgacuggcccu

SEQ ID NO: 726215 - RNA, 19 nt, Human
uaggagacaacucaaccac

SEQ ID NO: 726216 - RNA, 22 nt, Human
uaggagacaacucaaccacuga

SEQ ID NO: 726217 - RNA, 24 nt, Human
uauuuccugcuuuauuccuugcuc

SEQ ID NO: 726218 - RNA, 21 nt, Human
ucaagaauauuuacuagaaca

SEQ ID NO: 726219 - RNA, 24 nt, Human
ucagaaggaaaacuccagcagcca

SEQ ID NO: 726220 - RNA, 23 nt, Human
ucaggccugaugcuggacccaug

SEQ ID NO: 726221 - RNA, 24 nt, Human
ucagugaguuuaaaugacacugcc

SEQ ID NO: 726222 - RNA, 19 nt, Human
uccagaagauccuggggac

SEQ ID NO: 726223 - RNA, 21 nt, Human
uccauccauggccaccuuccu

SEQ ID NO: 726224 - RNA, 21 nt, Human
ucccacagaacugaaucccuu

SEQ ID NO: 726225 - RNA, 19 nt, Human
uccccaagaacacgcgcug

SEQ ID NO: 726226 - RNA, 20 nt, Human
uccugguuugggcugggcgg

SEQ ID NO: 726227 - RNA, 19 nt, Human
ucuaaagccagagcuggga

SEQ ID NO: 726228 - RNA, 24 nt, Human
ucuagauaggcggggccaagcccu

SEQ ID NO: 726229 - RNA, 20 nt, Human
ucuauagucauuccuaaagc

SEQ ID NO: 726230 - RNA, 24 nt, Human
ucuccagugaccaccuuucccaag

SEQ ID NO: 726231 - RNA, 23 nt, Human
ucuguggggcagugaccccgcuu

SEQ ID NO: 726232 - RNA, 23 nt, Human
ucuuggagacuucgugccagaug

SEQ ID NO: 726233 - RNA, 23 nt, Human
ugaacacgccuggauugugucgg

SEQ ID NO: 726234 - RNA, 18 nt, Human
ugaaggcaaaugagagca

SEQ ID NO: 726235 - RNA, 23 nt, Human
ugaaggcaaaugagagcaaaagu

SEQ ID NO: 726236 - RNA, 19 nt, Human
ugaagggcccagggcgcug

SEQ ID NO: 726237 - RNA, 22 nt, Human
ugaauggacgggucauguggga

SEQ ID NO: 726238 - RNA, 23 nt, Human
ugaauggacgggucaugugggag

SEQ ID NO: 726239 - RNA, 19 nt, Human
ugaccagacagcuggaucc

SEQ ID NO: 726240 - RNA, 25 nt, Human
ugagagcaaaagugggaacugagga

SEQ ID NO: 726241 - RNA, 21 nt, Human
ugagccccucauugcauccag

SEQ ID NO: 726242 - RNA, 23 nt, Human
ugaggacaccuaaguggagagac

SEQ ID NO: 726243 - RNA, 20 nt, Human
ugauggaagaggugccacug

SEQ ID NO: 726244 - RNA, 26 nt, Human
ugcaccgcaucgcucccucgcaaucu

SEQ ID NO: 726245 - RNA, 21 nt, Human
ugccaaacacaguuauauucu

SEQ ID NO: 726246 - RNA, 19 nt, Human
ugccgccagcugcacccac

SEQ ID NO: 726247 - RNA, 19 nt, Human
ugcuggacccaugagacuc

SEQ ID NO: 726248 - RNA, 20 nt, Human
ugcuugccuggccucuccuu

SEQ ID NO: 726249 - RNA, 19 nt, Human
ugcuuuauuccuugcucuc

SEQ ID NO: 726250 - RNA, 21 nt, Human
uggaagaggugccacuggaaa

SEQ ID NO: 726251 - RNA, 19 nt, Human
uggacccagcaccugggga

SEQ ID NO: 726252 - RNA, 24 nt, Human
uggacgggucaugugggaggggcc

SEQ ID NO: 726253 - RNA, 24 nt, Human
uggccaucaacagaggaacagcaa

SEQ ID NO: 726254 - RNA, 19 nt, Human
uggcucaugccaacagcag

SEQ ID NO: 726255 - RNA, 21 nt, Human
uggggagggugggcacagggg

SEQ ID NO: 726256 - RNA, 18 nt, Human
uggggcggcuccucccgg

SEQ ID NO: 726257 - RNA, 22 nt, Human
ugguaggagacaacucaaccac

SEQ ID NO: 726258 - RNA, 22 nt, Human
ugugagcaucuauagucauucc

SEQ ID NO: 726259 - RNA, 19 nt, Human
ugugggaggggcccuggug

SEQ ID NO: 726260 - RNA, 18 nt, Human
ugugugcugagcccacau

SEQ ID NO: 726261 - RNA, 20 nt, Human
uuagcugaaaacaggcauuu

SEQ ID NO: 726262 - RNA, 21 nt, Human
uucaccaaagggcauccagcc

SEQ ID NO: 726263 - RNA, 18 nt, Human
uucccgccagaaagccca

SEQ ID NO: 726264 - RNA, 21 nt, Human
uuccucauggugcuaugcagg

SEQ ID NO: 726265 - RNA, 20 nt, Human
uuggggcggcuccucccggc

SEQ ID NO: 726266 - RNA, 21 nt, Human
uuggugcccuggagcacuagu

SEQ ID NO: 726267 - RNA, 19 nt, Human
uugguucaaacagcaugga

SEQ ID NO: 726268 - RNA, 21 nt, Human
aaacagccccaccacagagga

SEQ ID NO: 726269 - RNA, 22 nt, Human
aaacagccccaccacagaggag

SEQ ID NO: 726270 - RNA, 23 nt, Human
aaacuggcuccuccucaaccaca

SEQ ID NO: 726271 - RNA, 19 nt, Human
aacacccacucaucccgcu

SEQ ID NO: 726272 - RNA, 28 nt, Human
aacacccacucaucccgcuaaugccggc

SEQ ID NO: 726273 - RNA, 21 nt, Human
aagacaagaguccccugaaug

SEQ ID NO: 726274 - RNA, 23 nt, Human
aagccaaacagccccaccacaga

SEQ ID NO: 726275 - RNA, 27 nt, Human
aauaccuacuuuucccuagagcuauug

SEQ ID NO: 726276 - RNA, 22 nt, Human
aaugaccgcauuaccccuccua

SEQ ID NO: 726277 - RNA, 23 nt, Human
acagccccaccacagaggaggcc

SEQ ID NO: 726278 - RNA, 19 nt, Human
accccuccuacccacuccc

SEQ ID NO: 726279 - RNA, 20 nt, Human
accccuccuacccacuccca

SEQ ID NO: 726280 - RNA, 20 nt, Human
acccuagaguccccucuuuu

SEQ ID NO: 726281 - RNA, 21 nt, Human
aggcagaaggggcacuugggg

SEQ ID NO: 726282 - RNA, 19 nt, Human
auaaauauauauauauaua

SEQ ID NO: 726283 - RNA, 22 nt, Human
auucccaucccuggaucuuugg

SEQ ID NO: 726284 - RNA, 24 nt, Human
caccacagaggaggcccacuuuca

SEQ ID NO: 726285 - RNA, 23 nt, Human
cagaggaacaggacugaggcaga

SEQ ID NO: 726286 - RNA, 19 nt, Human
cagcaaaugggaaaggcag

SEQ ID NO: 726287 - RNA, 24 nt, Human
cagccccaccacagaggaggccca

SEQ ID NO: 726288 - RNA, 19 nt, Human
cauauggucuaagcguacc

SEQ ID NO: 726289 - RNA, 23 nt, Human
caucuccuaagccaaacagcccc

SEQ ID NO: 726290 - RNA, 18 nt, Human
caugggcuagagacuggc

SEQ ID NO: 726291 - RNA, 20 nt, Human
ccaaacagccccaccacaga

SEQ ID NO: 726292 - RNA, 26 nt, Human
ccaaacagccccaccacagaggaggc

SEQ ID NO: 726293 - RNA, 21 nt, Human
ccaacagaaaagguugcuggc

SEQ ID NO: 726294 - RNA, 24 nt, Human
ccaaugaccgcauuaccccuccua

SEQ ID NO: 726295 - RNA, 19 nt, Human
ccccagaaaagugaagacc

SEQ ID NO: 726296 - RNA, 23 nt, Human
ccccagacaccgcuggugagagc

SEQ ID NO: 726297 - RNA, 22 nt, Human
ccccugaaugcacauauggucu

SEQ ID NO: 726298 - RNA, 19 nt, Human
cccugccggaacacccacu

SEQ ID NO: 726299 - RNA, 18 nt, Human
ccgcauuaccccuccuac

SEQ ID NO: 726300 - RNA, 19 nt, Human
ccuaggaugcucagagaag

SEQ ID NO: 726301 - RNA, 19 nt, Human
cggaacacccacucauccc

SEQ ID NO: 726302 - RNA, 24 nt, Human
cucauaauguuccagcccccgacu

SEQ ID NO: 726303 - RNA, 24 nt, Human
cuccaaugaccgcauuaccccucc

SEQ ID NO: 726304 - RNA, 25 nt, Human
cugcaguguuuggucuuuggccagu

SEQ ID NO: 726305 - RNA, 19 nt, Human
cugccggaacacccacuca

SEQ ID NO: 726306 - RNA, 24 nt, Human
cuuaaaauagaaccugauuaucuc

SEQ ID NO: 726307 - RNA, 20 nt, Human
gaggagccaauggcuucuuc

SEQ ID NO: 726308 - RNA, 24 nt, Human
gaggaggcccacuuucacagacuc

SEQ ID NO: 726309 - RNA, 28 nt, Human
gcacaacuacagaaauaaagggaacgcc

SEQ ID NO: 726310 - RNA, 20 nt, Human
gcagugaagcggcauuuccu

SEQ ID NO: 726311 - RNA, 21 nt, Human
gccggaacacccacucauccc

SEQ ID NO: 726312 - RNA, 18 nt, Human
gcuucauacaaagagaac

SEQ ID NO: 726313 - RNA, 19 nt, Human
ggcacuuggggaugauaug

SEQ ID NO: 726314 - RNA, 22 nt, Human
gggugagugcuggucaugggcu

SEQ ID NO: 726315 - RNA, 21 nt, Human
uaauaccuacuuuucccuaga

SEQ ID NO: 726316 - RNA, 25 nt, Human
uacaaagagaacuacuuccccagac

SEQ ID NO: 726317 - RNA, 22 nt, Human
uacccacucccauucccauccc

SEQ ID NO: 726318 - RNA, 23 nt, Human
uacuacagcaucuccuaagccaa

SEQ ID NO: 726319 - RNA, 18 nt, Human
uagagacuggcucugagg

SEQ ID NO: 726320 - RNA, 23 nt, Human
uaggaugcucagagaaggcuggg

SEQ ID NO: 726321 - RNA, 19 nt, Human
uagugugauaccacuaaug

SEQ ID NO: 726322 - RNA, 19 nt, Human
uccuaagccaaacagcccc

SEQ ID NO: 726323 - RNA, 26 nt, Human
ugcccagaggaacaggacugaggcag

SEQ ID NO: 726324 - RNA, 23 nt, Human
ugcugauugcuuaaaauagaacc

SEQ ID NO: 726325 - RNA, 18 nt, Human
ugcuggcaaagacaagag

SEQ ID NO: 726326 - RNA, 18 nt, Human
uguugcugguggaagggg

SEQ ID NO: 726327 - RNA, 18 nt, Human
uuaccccuccuacccacu

SEQ ID NO: 726328 - RNA, 19 nt, Human
uuaccccuccuacccacuc

SEQ ID NO: 726329 - RNA, 21 nt, Human
uuaccccuccuacccacuccc

SEQ ID NO: 726330 - RNA, 20 nt, Human
uucuuggggacccugcagug

SEQ ID NO: 726331 - RNA, 19 nt, Human
uuggggaugauauggaagg

SEQ ID NO: 726332 - RNA, 20 nt, Human
uuuccccagaaaagugaaga

SEQ ID NO: 726333 - RNA, 23 nt, Human
uuuggaaaaagcuucauaaucau

SEQ ID NO: 726334 - RNA, 21 nt, Human
aaacagccuguaaaagagaag

SEQ ID NO: 726335 - RNA, 19 nt, Human
aagccaaauuaaccccaaa

SEQ ID NO: 726336 - RNA, 24 nt, Human
aagcuucagcacacuuuacagcuu

SEQ ID NO: 726337 - RNA, 23 nt, Human
aagguggaaagaucacccuugua

SEQ ID NO: 726338 - RNA, 24 nt, Human
aaguaguucuagagcagaagcugg

SEQ ID NO: 726339 - RNA, 23 nt, Human
acauacaagguguaaccauaaag

SEQ ID NO: 726340 - RNA, 26 nt, Human
accaaagcuucagcacacuuuacagc

SEQ ID NO: 726341 - RNA, 21 nt, Human
agaagacauggcagaaugugc

SEQ ID NO: 726342 - RNA, 21 nt, Human
agaaugcuucaaaaguaccug

SEQ ID NO: 726343 - RNA, 19 nt, Human
agacuggaugaaccucagg

SEQ ID NO: 726344 - RNA, 23 nt, Human
agagguuagagacuggaugaacc

SEQ ID NO: 726345 - RNA, 18 nt, Human
agccaaauuaaccccaaa

SEQ ID NO: 726346 - RNA, 19 nt, Human
auuauaauacacaucagau

SEQ ID NO: 726347 - RNA, 19 nt, Human
caaaaguaccugaacugcu

SEQ ID NO: 726348 - RNA, 21 nt, Human
caaagugccuuuuuccugaaa

SEQ ID NO: 726349 - RNA, 28 nt, Human
caacuccaucuaaggaagaccuuucuaa

SEQ ID NO: 726350 - RNA, 19 nt, Human
caaugauuucugcaucucc

SEQ ID NO: 726351 - RNA, 23 nt, Human
cagaaugcuucaaaaguaccuga

SEQ ID NO: 726352 - RNA, 23 nt, Human
cagacccaggcccaaagacagaa

SEQ ID NO: 726353 - RNA, 28 nt, Human
caggcccaaagacagaaguuaccgggag

SEQ ID NO: 726354 - RNA, 23 nt, Human
caugauguaaugcaguccucccu

SEQ ID NO: 726355 - RNA, 27 nt, Human
ccaggcccaaagacagaaguuacccuc

SEQ ID NO: 726356 - RNA, 23 nt, Human
ccauuucacccaaaguaguucua

SEQ ID NO: 726357 - RNA, 19 nt, Human
cccaaagacagaaguuacc

SEQ ID NO: 726358 - RNA, 24 nt, Human
ccugaacugcuuccucacuacaag

SEQ ID NO: 726359 - RNA, 18 nt, Human
cugaacugcuuccucacu

SEQ ID NO: 726360 - RNA, 20 nt, Human
cuguaaaagagaagacaugg

SEQ ID NO: 726361 - RNA, 19 nt, Human
gaagagaauuccuuuaaaa

SEQ ID NO: 726362 - RNA, 25 nt, Human
gaagugguuaagcuggggggcagac

SEQ ID NO: 726363 - RNA, 21 nt, Human
gacagaaguuaccgggaggga

SEQ ID NO: 726364 - RNA, 18 nt, Human
gagaacucccuccuccuc

SEQ ID NO: 726365 - RNA, 23 nt, Human
gagaacucccuccuccucagccc

SEQ ID NO: 726366 - RNA, 24 nt, Human
gaggacagacccaggcccaaagac

SEQ ID NO: 726367 - RNA, 22 nt, Human
gcagaaugugcgagauucaucc

SEQ ID NO: 726368 - RNA, 23 nt, Human
gcucacugugggaucuuuccucu

SEQ ID NO: 726369 - RNA, 18 nt, Human
gcugucuuuggcauuaac

SEQ ID NO: 726370 - RNA, 22 nt, Human
ggaagugguuaagcuggggggc

SEQ ID NO: 726371 - RNA, 25 nt, Human
uaaauuaaaaacagcuugucacuuu

SEQ ID NO: 726372 - RNA, 19 nt, Human
uaaccccaaaauuuacagc

SEQ ID NO: 726373 - RNA, 22 nt, Human
uaagaaacacuacagaacaggg

SEQ ID NO: 726374 - RNA, 23 nt, Human
uaagaaacacuacagaacagggc

SEQ ID NO: 726375 - RNA, 28 nt, Human
uaauuaauguacuuauuccccugaaagg

SEQ ID NO: 726376 - RNA, 24 nt, Human
uacauuacucagaagagguaccaa

SEQ ID NO: 726377 - RNA, 24 nt, Human
uacgugaauaucaaagugccuuuu

SEQ ID NO: 726378 - RNA, 20 nt, Human
uagagcugcucaacaacuga

SEQ ID NO: 726379 - RNA, 22 nt, Human
uauaagccaaauuaaccccaaa

SEQ ID NO: 726380 - RNA, 20 nt, Human
uauuccaacaauacuggcgu

SEQ ID NO: 726381 - RNA, 21 nt, Human
ucacugugggaucuuuccucu

SEQ ID NO: 726382 - RNA, 23 nt, Human
ucauuugcuauuaccaccauuuc

SEQ ID NO: 726383 - RNA, 22 nt, Human
ucgagcauuaacaucugcagaa

SEQ ID NO: 726384 - RNA, 22 nt, Human
ucuacggugcuguguucaggga

SEQ ID NO: 726385 - RNA, 19 nt, Human
ugagacaguacuuuggggu

SEQ ID NO: 726386 - RNA, 22 nt, Human
ugagguagagucacuuggaagu

SEQ ID NO: 726387 - RNA, 22 nt, Human
ugcuauuaccaccauuucaccc

SEQ ID NO: 726388 - RNA, 23 nt, Human
uggaaagaucacccuuguagaag

SEQ ID NO: 726389 - RNA, 30 nt, Human
ugguauuauaauacacaucagauauuucaa

SEQ ID NO: 726390 - RNA, 21 nt, Human
ugucuuuggcauuaacucuag

SEQ ID NO: 726391 - RNA, 23 nt, Human
ugugaggauaagaaacacuacag

SEQ ID NO: 726392 - RNA, 19 nt, Human
uuggugagguagagucacu

SEQ ID NO: 726393 - RNA, 22 nt, Human
aaccauuuucacuuuucaagac

SEQ ID NO: 726394 - RNA, 19 nt, Human
aaggugcuauucacugaaa

SEQ ID NO: 726395 - RNA, 25 nt, Human
acaaucagacacaagcaguaauacc

SEQ ID NO: 726396 - RNA, 24 nt, Human
agauaaccaccgaggaccacgaac

SEQ ID NO: 726397 - RNA, 18 nt, Human
agcaguugucacucagga

SEQ ID NO: 726398 - RNA, 22 nt, Human
aggauuuaugacuuugagggag

SEQ ID NO: 726399 - RNA, 19 nt, Human
auuagcaauaccaagauaa

SEQ ID NO: 726400 - RNA, 23 nt, Human
caaaauacaggacaaucagacac

SEQ ID NO: 726401 - RNA, 21 nt, Human
caagcaguaauacccacgaga

SEQ ID NO: 726402 - RNA, 21 nt, Human
caagcugcagauaaccaccga

SEQ ID NO: 726403 - RNA, 19 nt, Human
cacaagcaguaauacccac

SEQ ID NO: 726404 - RNA, 19 nt, Human
cagauaaccaccgaggacc

SEQ ID NO: 726405 - RNA, 22 nt, Human
caggacccaccucuacaugcuc

SEQ ID NO: 726406 - RNA, 18 nt, Human
cauuccauucauaaauga

SEQ ID NO: 726407 - RNA, 26 nt, Human
ccaaagcacacgaucaccccguacaa

SEQ ID NO: 726408 - RNA, 18 nt, Human
ccaggaacaccuuaauau

SEQ ID NO: 726409 - RNA, 27 nt, Human
ccccccacccccagccagguuguccac

SEQ ID NO: 726410 - RNA, 23 nt, Human
cccuugagaacagggaaaaugga

SEQ ID NO: 726411 - RNA, 30 nt, Human
ccuaugaugacaacguggaaacucucuucu

SEQ ID NO: 726412 - RNA, 23 nt, Human
ccugacacaauauuaaacuagca

SEQ ID NO: 726413 - RNA, 21 nt, Human
gaaagcuacaauuauuauaac

SEQ ID NO: 726414 - RNA, 26 nt, Human
gacaaucagacacaagcaguaauacc

SEQ ID NO: 726415 - RNA, 18 nt, Human
gauuggugcaccgugugu

SEQ ID NO: 726416 - RNA, 20 nt, Human
guauacacauaccuaugcca

SEQ ID NO: 726417 - RNA, 20 nt, Human
gugcaccguguguauacaca

SEQ ID NO: 726418 - RNA, 25 nt, Human
uaauuauucaacacacauaugugua

SEQ ID NO: 726419 - RNA, 19 nt, Human
uacuucaacaauacucugu

SEQ ID NO: 726420 - RNA, 18 nt, Human
uagccucugauucucugc

SEQ ID NO: 726421 - RNA, 20 nt, Human
uaggacgaccugacacaaua

SEQ ID NO: 726422 - RNA, 22 nt, Human
uauuauaacuuacaugccuuca

SEQ ID NO: 726423 - RNA, 21 nt, Human
ucaagacaaacuucaucaggu

SEQ ID NO: 726424 - RNA, 22 nt, Human
ucaagacaaacuucaucaggua

SEQ ID NO: 726425 - RNA, 21 nt, Human
ucagacacaagcaguaauacc

SEQ ID NO: 726426 - RNA, 22 nt, Human
ucauuaccaggaacaccuuaau

SEQ ID NO: 726427 - RNA, 22 nt, Human
uccaagcaagguuuuggucacu

SEQ ID NO: 726428 - RNA, 18 nt, Human
uccaugacuaauacugga

SEQ ID NO: 726429 - RNA, 19 nt, Human
uccaugacuaauacuggaa

SEQ ID NO: 726430 - RNA, 18 nt, Human
ugcucaggugagcuggug

SEQ ID NO: 726431 - RNA, 22 nt, Human
uguaacucagcauacagcacac

SEQ ID NO: 726432 - RNA, 20 nt, Human
uguguauacacauaccuaug

SEQ ID NO: 726433 - RNA, 20 nt, Human
uguguauacauucuucucuu

SEQ ID NO: 726434 - RNA, 21 nt, Human
uuacugcacuuuucuguauuc

SEQ ID NO: 726435 - RNA, 18 nt, Human
uugcuucaaucaccauuu

SEQ ID NO: 726436 - RNA, 22 nt, Human
uuuauuagcaauaccaagauaa

SEQ ID NO: 726437 - RNA, 19 nt, Human
aaaagcacuauuagucacc

SEQ ID NO: 726438 - RNA, 20 nt, Human
aaaagcacuauuagucaccc

SEQ ID NO: 726439 - RNA, 22 nt, Human
aaacaaacaccagcucaagagc

SEQ ID NO: 726440 - RNA, 20 nt, Human
aaacuguaagcuggcuagug

SEQ ID NO: 726441 - RNA, 22 nt, Human
aaagagguacaccccuguuccu

SEQ ID NO: 726442 - RNA, 24 nt, Human
aaagagguacaccccuguuccuuc

SEQ ID NO: 726443 - RNA, 19 nt, Human
aaagugcuggaacuguagg

SEQ ID NO: 726444 - RNA, 23 nt, Human
aaagugcuggaacuguaggugug

SEQ ID NO: 726445 - RNA, 24 nt, Human
aaagugcuggaacuguaggugugg

SEQ ID NO: 726446 - RNA, 25 nt, Human
aaagugcuggaauuaacagguauga

SEQ ID NO: 726447 - RNA, 19 nt, Human
aaaguucucucaaguucuc

SEQ ID NO: 726448 - RNA, 20 nt, Human
aaaugaucagaacacaaaug

SEQ ID NO: 726449 - RNA, 20 nt, Human
aacauggugaaaacccgucu

SEQ ID NO: 726450 - RNA, 21 nt, Human
aacauggugaaaacccgucuc

SEQ ID NO: 726451 - RNA, 21 nt, Human
aacgucgcaagccgcaaacca

SEQ ID NO: 726452 - RNA, 21 nt, Human
aagaagauaaaacguccccuc

SEQ ID NO: 726453 - RNA, 23 nt, Human
aagaaguuuagcucacugaaagc

SEQ ID NO: 726454 - RNA, 24 nt, Human
aagcaauucucccauuuggccucc

SEQ ID NO: 726455 - RNA, 18 nt, Human
aagccgcaaaccagggga

SEQ ID NO: 726456 - RNA, 26 nt, Human
aagugauccucccaccucagcccucu

SEQ ID NO: 726457 - RNA, 24 nt, Human
aagugauccuccugucuuggccuc

SEQ ID NO: 726458 - RNA, 23 nt, Human
aaguucucucauaucccuuuccu

SEQ ID NO: 726459 - RNA, 20 nt, Human
aauugcuugaacccaggagg

SEQ ID NO: 726460 - RNA, 24 nt, Human
aauugcuugaacccaggaggcaga

SEQ ID NO: 726461 - RNA, 24 nt, Human
aauuuggaaaagagauuauagaau

SEQ ID NO: 726462 - RNA, 21 nt, Human
acaacucaaagcggcacucag

SEQ ID NO: 726463 - RNA, 24 nt, Human
acaaugguuccccacuccuggaca

SEQ ID NO: 726464 - RNA, 18 nt, Human
acagguaugagccaccac

SEQ ID NO: 726465 - RNA, 24 nt, Human
acccaggcuagagugaguugagac

SEQ ID NO: 726466 - RNA, 20 nt, Human
accucagcccucugaguagc

SEQ ID NO: 726467 - RNA, 23 nt, Human
accucagcccucugaguagcugg

SEQ ID NO: 726468 - RNA, 25 nt, Human
acucugucaccuaggcuggagugca

SEQ ID NO: 726469 - RNA, 18 nt, Human
acugaauuuauuagagcu

SEQ ID NO: 726470 - RNA, 19 nt, Human
agaaagaguauuugggaau

SEQ ID NO: 726471 - RNA, 19 nt, Human
agaacacaaaugggcagcc

SEQ ID NO: 726472 - RNA, 25 nt, Human
agaaguagcaaaaaauggauaccaa

SEQ ID NO: 726473 - RNA, 18 nt, Human
agacagggucuugcuaug

SEQ ID NO: 726474 - RNA, 23 nt, Human
agacagggucuugcuauguugcc

SEQ ID NO: 726475 - RNA, 22 nt, Human
agacccaacagagcccugagaa

SEQ ID NO: 726476 - RNA, 18 nt, Human
agacuaugccagaaaugg

SEQ ID NO: 726477 - RNA, 18 nt, Human
agacugaauuuauuagaa

SEQ ID NO: 726478 - RNA, 19 nt, Human
agagaauaaacucagccuu

SEQ ID NO: 726479 - RNA, 21 nt, Human
agagacagggucuugcuaugu

SEQ ID NO: 726480 - RNA, 25 nt, Human
agaggcaugagaauugcuugaaccc

SEQ ID NO: 726481 - RNA, 24 nt, Human
agagguugcagugaacugagauca

SEQ ID NO: 726482 - RNA, 22 nt, Human
agaucaagacucugucucaaaa

SEQ ID NO: 726483 - RNA, 24 nt, Human
agauggauugauucugcuauuggu

SEQ ID NO: 726484 - RNA, 18 nt, Human
agauguugaaaaaacccc

SEQ ID NO: 726485 - RNA, 25 nt, Human
agcaagaaggcaggugaguuuucuc

SEQ ID NO: 726486 - RNA, 24 nt, Human
agcacuuugggaggcugaggcggg

SEQ ID NO: 726487 - RNA, 18 nt, Human
agcucaagagccucugau

SEQ ID NO: 726488 - RNA, 18 nt, Human
agcuuuugcaguaucuuu

SEQ ID NO: 726489 - RNA, 20 nt, Human
aggcagagguugcagugaac

SEQ ID NO: 726490 - RNA, 24 nt, Human
aggcagagguugcagugaacugag

SEQ ID NO: 726491 - RNA, 18 nt, Human
aggcaugagaauugcuug

SEQ ID NO: 726492 - RNA, 22 nt, Human
aggcggguggaucaccugaggu

SEQ ID NO: 726493 - RNA, 26 nt, Human
aggcggguggaucaccugaggucagg

SEQ ID NO: 726494 - RNA, 21 nt, Human
aggcugaggcggguggaucac

SEQ ID NO: 726495 - RNA, 24 nt, Human
aggcugaggcggguggaucaccug

SEQ ID NO: 726496 - RNA, 21 nt, Human
aggcuggucuccaacuccugg

SEQ ID NO: 726497 - RNA, 22 nt, Human
aggcuggucuccaacuccuggc

SEQ ID NO: 726498 - RNA, 23 nt, Human
aguagcugggaccacaggcaugu

SEQ ID NO: 726499 - RNA, 22 nt, Human
agugagagagauguugaaaaaa

SEQ ID NO: 726500 - RNA, 24 nt, Human
agugaggcugggcacuguggcuca

SEQ ID NO: 726501 - RNA, 22 nt, Human
auaagcagacugaauuuauuag

SEQ ID NO: 726502 - RNA, 25 nt, Human
aucaauauaagaaacuuuccaucac

SEQ ID NO: 726503 - RNA, 19 nt, Human
augagguagacccaacaga

SEQ ID NO: 726504 - RNA, 22 nt, Human
auggcgcaugccuguaauucca

SEQ ID NO: 726505 - RNA, 23 nt, Human
auggcgcaugccuguaauuccag

SEQ ID NO: 726506 - RNA, 18 nt, Human
auggugaaaacccgucuc

SEQ ID NO: 726507 - RNA, 18 nt, Human
auugcacuccagccuaga

SEQ ID NO: 726508 - RNA, 23 nt, Human
auuuggaaaagagauuauagaau

SEQ ID NO: 726509 - RNA, 21 nt, Human
caaaagcacuauuagucaccc

SEQ ID NO: 726510 - RNA, 21 nt, Human
caaacaccagcucaagagccu

SEQ ID NO: 726511 - RNA, 23 nt, Human
caaacuugauuaaguggaaaaaa

SEQ ID NO: 726512 - RNA, 24 nt, Human
caaagugcuggaacuguaggugug

SEQ ID NO: 726513 - RNA, 25 nt, Human
caaagugcuggaauuaacagguaug

SEQ ID NO: 726514 - RNA, 22 nt, Human
caacauggugaaaacccgucuc

SEQ ID NO: 726515 - RNA, 24 nt, Human
caacauggugaaaacccgucucua

SEQ ID NO: 726516 - RNA, 24 nt, Human
cacaccuguaaucccagcacuuug

SEQ ID NO: 726517 - RNA, 24 nt, Human
cacaggcaugugcuaccaugccca

SEQ ID NO: 726518 - RNA, 23 nt, Human
caccugaggucaggaguuugaga

SEQ ID NO: 726519 - RNA, 23 nt, Human
caccuguaaucccagcacuuugg

SEQ ID NO: 726520 - RNA, 24 nt, Human
caccuguaaucccagcacuuuggg

SEQ ID NO: 726521 - RNA, 22 nt, Human
cacucugucaccuaggcuggag

SEQ ID NO: 726522 - RNA, 23 nt, Human
cacucugucaccuaggcuggagu

SEQ ID NO: 726523 - RNA, 19 nt, Human
cagaacacaaaugggcagc

SEQ ID NO: 726524 - RNA, 22 nt, Human
cagagaaugagacuaugccaga

SEQ ID NO: 726525 - RNA, 20 nt, Human
cagaggcaaugcccuaaaca

SEQ ID NO: 726526 - RNA, 22 nt, Human
cagcacuuugggaggcugaggc

SEQ ID NO: 726527 - RNA, 24 nt, Human
cagcacuuugggaggcugaggcgg

SEQ ID NO: 726528 - RNA, 24 nt, Human
cagcucacugcagccuugaccucu

SEQ ID NO: 726529 - RNA, 24 nt, Human
cagggucuugcuauguugcccagg

SEQ ID NO: 726530 - RNA, 22 nt, Human
caucauagucuagagaagugag

SEQ ID NO: 726531 - RNA, 23 nt, Human
cauucaacaacucaaagcggcac

SEQ ID NO: 726532 - RNA, 18 nt, Human
cauugcacuccagccuag

SEQ ID NO: 726533 - RNA, 20 nt, Human
cauugcacuccagccuagau

SEQ ID NO: 726534 - RNA, 21 nt, Human
cauugcacuccagccuagaug

SEQ ID NO: 726535 - RNA, 22 nt, Human
cauugcacuccagccuagauga

SEQ ID NO: 726536 - RNA, 23 nt, Human
cauugcacuccagccuagaugaa

SEQ ID NO: 726537 - RNA, 24 nt, Human
cauugcacuccagccuagaugaaa

SEQ ID NO: 726538 - RNA, 23 nt, Human
ccaaaagcacuauuagucaccca

SEQ ID NO: 726539 - RNA, 29 nt, Human
ccaaacacaaacuuagcauagagguaagg

SEQ ID NO: 726540 - RNA, 21 nt, Human
ccaaagugcuggaacuguagg

SEQ ID NO: 726541 - RNA, 24 nt, Human
ccaaagugcuggaacuguaggugu

SEQ ID NO: 726542 - RNA, 22 nt, Human
ccaaagugcuggaauuaacagg

SEQ ID NO: 726543 - RNA, 22 nt, Human
ccaaagugcuggaauuaacagg

SEQ ID NO: 726544 - RNA, 25 nt, Human
ccaaagugcuggaauuaacagguau

SEQ ID NO: 726545 - RNA, 24 nt, Human
ccaacucuugauaagccuccaaaa

SEQ ID NO: 726546 - RNA, 24 nt, Human
ccaauguuuuccuggagagcucuu

SEQ ID NO: 726547 - RNA, 18 nt, Human
ccaccaugcccugacucc

SEQ ID NO: 726548 - RNA, 22 nt, Human
ccaggaggcagagguugcagug

SEQ ID NO: 726549 - RNA, 19 nt, Human
ccauugcacuccagccuag

SEQ ID NO: 726550 - RNA, 21 nt, Human
ccauugcacuccagccuagau

SEQ ID NO: 726551 - RNA, 25 nt, Human
cccacuccuggacaagggacagaug

SEQ ID NO: 726552 - RNA, 23 nt, Human
cccaggcuagagugaguugagac

SEQ ID NO: 726553 - RNA, 21 nt, Human
cccccucuucuccaauccaaa

SEQ ID NO: 726554 - RNA, 21 nt, Human
ccccucuucuccaauccaaau

SEQ ID NO: 726555 - RNA, 19 nt, Human
cccuaaacaaacaccagcu

SEQ ID NO: 726556 - RNA, 20 nt, Human
cccuaaacaaacaccagcuc

SEQ ID NO: 726557 - RNA, 23 nt, Human
ccuaaacaaacaccagcucaaga

SEQ ID NO: 726558 - RNA, 21 nt, Human
ccuaggcuggucuccaacucc

SEQ ID NO: 726559 - RNA, 24 nt, Human
ccucccaccucagcccucugagua

SEQ ID NO: 726560 - RNA, 26 nt, Human
ccuccugucuuggccucccaaagugc

SEQ ID NO: 726561 - RNA, 24 nt, Human
ccucugaguagcugggaccacagg

SEQ ID NO: 726562 - RNA, 21 nt, Human
ccugacuccucccccaucucu

SEQ ID NO: 726563 - RNA, 23 nt, Human
ccugaggucaggaguuugagagc

SEQ ID NO: 726564 - RNA, 21 nt, Human
ccugcacuccucaaggucacc

SEQ ID NO: 726565 - RNA, 20 nt, Human
ccuggcuucaagcaauucuc

SEQ ID NO: 726566 - RNA, 22 nt, Human
ccugucuuggccucccaaagug

SEQ ID NO: 726567 - RNA, 18 nt, Human
ccuguguugccuaggcug

SEQ ID NO: 726568 - RNA, 23 nt, Human
ccuguguugccuaggcuggucuc

SEQ ID NO: 726569 - RNA, 22 nt, Human
cgcaaaccaggggacagagcag

SEQ ID NO: 726570 - RNA, 24 nt, Human
cgcucugucacccaggcuagagug

SEQ ID NO: 726571 - RNA, 24 nt, Human
cggguggaucaccugaggucagga

SEQ ID NO: 726572 - RNA, 23 nt, Human
cgucgcaagccgcaaaccagggg

SEQ ID NO: 726573 - RNA, 19 nt, Human
cucaagcagaaguuagggu

SEQ ID NO: 726574 - RNA, 24 nt, Human
cucaagucugcaauuccagcacuu

SEQ ID NO: 726575 - RNA, 24 nt, Human
cucaagugauccucccaccucagc

SEQ ID NO: 726576 - RNA, 22 nt, Human
cucacaccuguaaucccagcac

SEQ ID NO: 726577 - RNA, 24 nt, Human
cucacaccuguaaucccagcacuu

SEQ ID NO: 726578 - RNA, 24 nt, Human
cucacucugucaccuaggcuggag

SEQ ID NO: 726579 - RNA, 23 nt, Human
cucacugcagccuugaccucugg

SEQ ID NO: 726580 - RNA, 24 nt, Human
cucagcccucugaguagcugggac

SEQ ID NO: 726581 - RNA, 19 nt, Human
cucaucuccaaaauggacu

SEQ ID NO: 726582 - RNA, 19 nt, Human
cucccaccucagcccucug

SEQ ID NO: 726583 - RNA, 24 nt, Human
cucccaccucagcccucugaguag

SEQ ID NO: 726584 - RNA, 23 nt, Human
cucugucacccaggcuagaguga

SEQ ID NO: 726585 - RNA, 23 nt, Human
cucugucaccuaggcuggagugc

SEQ ID NO: 726586 - RNA, 19 nt, Human
cucugucucaaaaaaaaaa

SEQ ID NO: 726587 - RNA, 24 nt, Human
cugacuccucccccaucucuaugu

SEQ ID NO: 726588 - RNA, 19 nt, Human
cugcaauuccagcacuuug

SEQ ID NO: 726589 - RNA, 21 nt, Human
cugcugagccauucaggauac

SEQ ID NO: 726590 - RNA, 18 nt, Human
cuggaauuaacagguaug

SEQ ID NO: 726591 - RNA, 22 nt, Human
cuggcccaguaggagaaaugca

SEQ ID NO: 726592 - RNA, 23 nt, Human
cugucuuggccucccaaagugcu

SEQ ID NO: 726593 - RNA, 23 nt, Human
cuugcauauugaauacaguaugu

SEQ ID NO: 726594 - RNA, 24 nt, Human
gaacuguaggugugggccaccaug

SEQ ID NO: 726595 - RNA, 21 nt, Human
gacagaggcaaugcccuaaac

SEQ ID NO: 726596 - RNA, 21 nt, Human
gacucacaccuguaaucccag

SEQ ID NO: 726597 - RNA, 20 nt, Human
gagacuaugccagaaauggg

SEQ ID NO: 726598 - RNA, 25 nt, Human
gaguagcugggaccacaggcaugug

SEQ ID NO: 726599 - RNA, 24 nt, Human
gagugcaguagcaugaucacagcu

SEQ ID NO: 726600 - RNA, 19 nt, Human
gaucaagacucugucucaa

SEQ ID NO: 726601 - RNA, 21 nt, Human
gaucaccugaggucaggaguu

SEQ ID NO: 726602 - RNA, 24 nt, Human
gaucaccugaggucaggaguuuga

SEQ ID NO: 726603 - RNA, 23 nt, Human
gaugaaauuaauaguguucacaa

SEQ ID NO: 726604 - RNA, 19 nt, Human
gcaagccgcaaaccagggg

SEQ ID NO: 726605 - RNA, 20 nt, Human
gcaugugcuaccaugcccag

SEQ ID NO: 726606 - RNA, 19 nt, Human
gccagaaaugggaggaggc

SEQ ID NO: 726607 - RNA, 23 nt, Human
gccuaggcuggucuccaacuccu

SEQ ID NO: 726608 - RNA, 18 nt, Human
gcggggugacucacaccu

SEQ ID NO: 726609 - RNA, 22 nt, Human
gcucaagugauccucccaccuc

SEQ ID NO: 726610 - RNA, 20 nt, Human
gcugaaaucaagggcuaaua

SEQ ID NO: 726611 - RNA, 19 nt, Human
ggcuggucuccaacuccug

SEQ ID NO: 726612 - RNA, 20 nt, Human
gggccuaaagugauccuccu

SEQ ID NO: 726613 - RNA, 24 nt, Human
gggccuaaagugauccuccugucu

SEQ ID NO: 726614 - RNA, 21 nt, Human
gggcucaagugauccucccac

SEQ ID NO: 726615 - RNA, 21 nt, Human
gguggaucaccugaggucagg

SEQ ID NO: 726616 - RNA, 24 nt, Human
gucuugcuauguugcccagguugg

SEQ ID NO: 726617 - RNA, 20 nt, Human
gugcaguagcaugaucacag

SEQ ID NO: 726618 - RNA, 18 nt, Human
gugcuggaacuguaggug

SEQ ID NO: 726619 - RNA, 18 nt, Human
uaaaagcaagaaggcagg

SEQ ID NO: 726620 - RNA, 21 nt, Human
uaaaagcugguccuauuuccu

SEQ ID NO: 726621 - RNA, 24 nt, Human
uaaaauguaauuucucuaccacaa

SEQ ID NO: 726622 - RNA, 21 nt, Human
uaaacaaacaccagcucaaga

SEQ ID NO: 726623 - RNA, 19 nt, Human
uaaagugauccuccugucu

SEQ ID NO: 726624 - RNA, 23 nt, Human
uaaagugauccuccugucuuggc

SEQ ID NO: 726625 - RNA, 20 nt, Human
uaacagguaugagccaccac

SEQ ID NO: 726626 - RNA, 20 nt, Human
uaacauacagagaaugagac

SEQ ID NO: 726627 - RNA, 18 nt, Human
uaagugcauacuugagaa

SEQ ID NO: 726628 - RNA, 20 nt, Human
uaaguggaaaaaaauuggca

SEQ ID NO: 726629 - RNA, 24 nt, Human
uaauagaauccuuuuaucuucagg

SEQ ID NO: 726630 - RNA, 20 nt, Human
uaauuucuauggcuuccccu

SEQ ID NO: 726631 - RNA, 22 nt, Human
uacccaaacacaaacuuagcau

SEQ ID NO: 726632 - RNA, 20 nt, Human
uacguaaagaaagaacuauc

SEQ ID NO: 726633 - RNA, 19 nt, Human
uacugcugagccauucagg

SEQ ID NO: 726634 - RNA, 21 nt, Human
uagagaagugaggcugggcaa

SEQ ID NO: 726635 - RNA, 21 nt, Human
uagcaaaaaauggauaccaaa

SEQ ID NO: 726636 - RNA, 22 nt, Human
uagcaaaaaauggauaccaaaa

SEQ ID NO: 726637 - RNA, 24 nt, Human
uagcaugaucacagcucacugcag

SEQ ID NO: 726638 - RNA, 24 nt, Human
uauaaauucagaaugcaaggggga

SEQ ID NO: 726639 - RNA, 20 nt, Human
uauccaauguuuuccuggag

SEQ ID NO: 726640 - RNA, 21 nt, Human
uaugaaaagauauaucucauu

SEQ ID NO: 726641 - RNA, 19 nt, Human
uauguugcccagguugguc

SEQ ID NO: 726642 - RNA, 24 nt, Human
uauguugcccagguuggucuccaa

SEQ ID NO: 726643 - RNA, 22 nt, Human
ucaaaugaucagaacacaaaug

SEQ ID NO: 726644 - RNA, 22 nt, Human
ucaagagccucugaugccaacc

SEQ ID NO: 726645 - RNA, 22 nt, Human
ucaagucugcaauuccagcacu

SEQ ID NO: 726646 - RNA, 22 nt, Human
ucaaugcuguuaauagaauccu

SEQ ID NO: 726647 - RNA, 22 nt, Human
ucaccuaggcuggagugcagua

SEQ ID NO: 726648 - RNA, 19 nt, Human
ucaccugaggucaggaguu

SEQ ID NO: 726649 - RNA, 24 nt, Human
ucacucugucaccuaggcuggagu

SEQ ID NO: 726650 - RNA, 23 nt, Human
ucacugcagccuugaccucuggg

SEQ ID NO: 726651 - RNA, 18 nt, Human
ucagcccucugaguagcu

SEQ ID NO: 726652 - RNA, 24 nt, Human
ucaggcugugcggggugacucaca

SEQ ID NO: 726653 - RNA, 24 nt, Human
uccagcacuuuguuuuguuuugaa

SEQ ID NO: 726654 - RNA, 21 nt, Human
uccaggagcuugcuugacagg

SEQ ID NO: 726655 - RNA, 23 nt, Human
ucccaaagugcuggaacuguagg

SEQ ID NO: 726656 - RNA, 24 nt, Human
ucccaaagugcuggaauuaacagg

SEQ ID NO: 726657 - RNA, 20 nt, Human
ucccuguguugccuaggcug

SEQ ID NO: 726658 - RNA, 19 nt, Human
uccuggcuucaagcaauuc

SEQ ID NO: 726659 - RNA, 21 nt, Human
uccuuacagacaaaucaaggu

SEQ ID NO: 726660 - RNA, 23 nt, Human
uccuuggauuuuccuaaauuguu

SEQ ID NO: 726661 - RNA, 20 nt, Human
ucggccuccuccucuaucuc

SEQ ID NO: 726662 - RNA, 18 nt, Human
ucucaagcagaaguuagg

SEQ ID NO: 726663 - RNA, 23 nt, Human
ucucacucugucaccuaggcugg

SEQ ID NO: 726664 - RNA, 24 nt, Human
ucucacucugucaccuaggcugga

SEQ ID NO: 726665 - RNA, 22 nt, Human
ucuccaacucuugauaagccuc

SEQ ID NO: 726666 - RNA, 19 nt, Human
ucucccuguguugccuagg

SEQ ID NO: 726667 - RNA, 23 nt, Human
ucucccuguguugccuaggcugg

SEQ ID NO: 726668 - RNA, 24 nt, Human
ucucccuguguugccuaggcuggu

SEQ ID NO: 726669 - RNA, 19 nt, Human
ucucgcucugucacccagg

SEQ ID NO: 726670 - RNA, 23 nt, Human
ucucgcucugucacccaggcuag

SEQ ID NO: 726671 - RNA, 25 nt, Human
ucucgcucugucacccaggcuagag

SEQ ID NO: 726672 - RNA, 26 nt, Human
ucucgcucugucacccaggcuagagu

SEQ ID NO: 726673 - RNA, 21 nt, Human
ucucuacuaaaaaugcaaaaa

SEQ ID NO: 726674 - RNA, 23 nt, Human
ucugaguagcugggaccacaggc

SEQ ID NO: 726675 - RNA, 24 nt, Human
ucugaguagcugggaccacaggca

SEQ ID NO: 726676 - RNA, 22 nt, Human
ucugucacccaggcuagaguga

SEQ ID NO: 726677 - RNA, 24 nt, Human
ucugucaccuaggcuggagugcag

SEQ ID NO: 726678 - RNA, 19 nt, Human
ucugucucaaaaaaaaaaa

SEQ ID NO: 726679 - RNA, 19 nt, Human
ucuugcuauguugcccagg

SEQ ID NO: 726680 - RNA, 23 nt, Human
ucuugcuauguugcccagguugg

SEQ ID NO: 726681 - RNA, 24 nt, Human
ucuugcuauguugcccagguuggu

SEQ ID NO: 726682 - RNA, 20 nt, Human
ucuuggccucccaaagugcu

SEQ ID NO: 726683 - RNA, 24 nt, Human
ugaaaaaaccccucuucuauggca

SEQ ID NO: 726684 - RNA, 24 nt, Human
ugaaaaaaccccucuucuauggca

SEQ ID NO: 726685 - RNA, 18 nt, Human
ugaaaagauauaucucau

SEQ ID NO: 726686 - RNA, 25 nt, Human
ugaccucuggggcucaagugauccu

SEQ ID NO: 726687 - RNA, 22 nt, Human
ugacucacaccuguaaucccag

SEQ ID NO: 726688 - RNA, 24 nt, Human
ugacucacaccuguaaucccagca

SEQ ID NO: 726689 - RNA, 20 nt, Human
ugagaacagcaggaggaaaa

SEQ ID NO: 726690 - RNA, 20 nt, Human
ugagacagggucucacucug

SEQ ID NO: 726691 - RNA, 22 nt, Human
ugagaucaaaccauugcacucc

SEQ ID NO: 726692 - RNA, 24 nt, Human
ugagaucaaaccauugcacuccag

SEQ ID NO: 726693 - RNA, 20 nt, Human
ugaggcggguggaucaccug

SEQ ID NO: 726694 - RNA, 22 nt, Human
ugaggcggguggaucaccugag

SEQ ID NO: 726695 - RNA, 24 nt, Human
ugaggcggguggaucaccugaggu

SEQ ID NO: 726696 - RNA, 26 nt, Human
ugaggcggguggaucaccugagguca

SEQ ID NO: 726697 - RNA, 19 nt, Human
ugagguauauugucauaaa

SEQ ID NO: 726698 - RNA, 18 nt, Human
ugaggucaggaguuugag

SEQ ID NO: 726699 - RNA, 21 nt, Human
ugauaaguaauuaaaaacugc

SEQ ID NO: 726700 - RNA, 22 nt, Human
ugaucagaacacaaaugggcag

SEQ ID NO: 726701 - RNA, 22 nt, Human
ugcaagggggaagcacaaaguc

SEQ ID NO: 726702 - RNA, 27 nt, Human
ugcccagguuggucuccaacucugggc

SEQ ID NO: 726703 - RNA, 23 nt, Human
ugccuguaauuccagcugcccga

SEQ ID NO: 726704 - RNA, 22 nt, Human
ugcuauguugcccagguugguc

SEQ ID NO: 726705 - RNA, 21 nt, Human
uggaacuguaggugugggcca

SEQ ID NO: 726706 - RNA, 25 nt, Human
uggaauuaacagguaugagccacca

SEQ ID NO: 726707 - RNA, 19 nt, Human
uggagugcaguagcaugau

SEQ ID NO: 726708 - RNA, 19 nt, Human
uggagugcaguagcaugau

SEQ ID NO: 726709 - RNA, 21 nt, Human
uggagugcaguagcaugauca

SEQ ID NO: 726710 - RNA, 23 nt, Human
uggaucaccugaggucaggaguu

SEQ ID NO: 726711 - RNA, 24 nt, Human
uggaucaccugaggucaggaguuu

SEQ ID NO: 726712 - RNA, 18 nt, Human
uggccucccaaagugcug

SEQ ID NO: 726713 - RNA, 21 nt, Human
uggcgcaugccuguaauucca

SEQ ID NO: 726714 - RNA, 20 nt, Human
uggcuucaagcaauucuccc

SEQ ID NO: 726715 - RNA, 21 nt, Human
uggcuucaagcaauucuccca

SEQ ID NO: 726716 - RNA, 20 nt, Human
ugggaauuagaagagcuggg

SEQ ID NO: 726717 - RNA, 20 nt, Human
ugggaccacaggcaugugcu

SEQ ID NO: 726718 - RNA, 24 nt, Human
ugggaccacaggcaugugcuacca

SEQ ID NO: 726719 - RNA, 20 nt, Human
ugggaggcugaggcgggugg

SEQ ID NO: 726720 - RNA, 23 nt, Human
ugggaggcugaggcggguggauc

SEQ ID NO: 726721 - RNA, 24 nt, Human
ugggaggcugaggcggguggauca

SEQ ID NO: 726722 - RNA, 24 nt, Human
uggggcucaagugauccucccacc

SEQ ID NO: 726723 - RNA, 18 nt, Human
ugggucugagaacagcag

SEQ ID NO: 726724 - RNA, 20 nt, Human
ugguaggccuggaaggcaag

SEQ ID NO: 726725 - RNA, 25 nt, Human
ugucauaaauguaaauauaucaauu

SEQ ID NO: 726726 - RNA, 19 nt, Human
uguguugccuaggcugguc

SEQ ID NO: 726727 - RNA, 20 nt, Human
uguuccucaucuccaaaaug

SEQ ID NO: 726728 - RNA, 22 nt, Human
uguuccuucuucucauucuuac

SEQ ID NO: 726729 - RNA, 20 nt, Human
uuaaaauauaaucacuuugu

SEQ ID NO: 726730 - RNA, 18 nt, Human
uuacuuugagguauauug

SEQ ID NO: 726731 - RNA, 26 nt, Human
uucaggauacuugggcccuuaaaaga

SEQ ID NO: 726732 - RNA, 20 nt, Human
uuccaaaaaaaauaagaaaa

SEQ ID NO: 726733 - RNA, 21 nt, Human
uuccccucuguagagcucuaa

SEQ ID NO: 726734 - RNA, 22 nt, Human
uugagacagggucucacucugu

SEQ ID NO: 726735 - RNA, 19 nt, Human
uugcagugaacugagauca

SEQ ID NO: 726736 - RNA, 25 nt, Human
uugcagugaacugagaucaaaccau

SEQ ID NO: 726737 - RNA, 24 nt, Human
uugcuugaacccaggaggcagagg

SEQ ID NO: 726738 - RNA, 25 nt, Human
uugggaggcugaggcggguggauca

SEQ ID NO: 726739 - RNA, 21 nt, Human
uuggugugcaguaauguugca

SEQ ID NO: 726740 - RNA, 19 nt, Human
uuuggccucccaaagugcu

SEQ ID NO: 726741 - RNA, 22 nt, Human
uuugucgacacgggucucccug

SEQ ID NO: 726742 - RNA, 18 nt, Human
aacaaggauggacaaugg

SEQ ID NO: 726743 - RNA, 26 nt, Human
aagcagcaugccuaggccugggggca

SEQ ID NO: 726744 - RNA, 24 nt, Human
aaggacucacggacaacaaggaug

SEQ ID NO: 726745 - RNA, 21 nt, Human
aaggcaggcacacaauggcca

SEQ ID NO: 726746 - RNA, 19 nt, Human
aaggccuagccugcaugug

SEQ ID NO: 726747 - RNA, 18 nt, Human
aagggugggguggcagga

SEQ ID NO: 726748 - RNA, 24 nt, Human
aagggugggguggcaggagcgagg

SEQ ID NO: 726749 - RNA, 20 nt, Human
aaugcagaacgcaagggugg

SEQ ID NO: 726750 - RNA, 24 nt, Human
acaaaaccacggagucacuaaggc

SEQ ID NO: 726751 - RNA, 20 nt, Human
acccugggauuccucagagc

SEQ ID NO: 726752 - RNA, 18 nt, Human
accucagguggccaaagg

SEQ ID NO: 726753 - RNA, 18 nt, Human
agacaggcugugcagugc

SEQ ID NO: 726754 - RNA, 19 nt, Human
agacaggcugugcagugcc

SEQ ID NO: 726755 - RNA, 20 nt, Human
agagguacacuguacaaggc

SEQ ID NO: 726756 - RNA, 21 nt, Human
agagguggggucgguuggugg

SEQ ID NO: 726757 - RNA, 19 nt, Human
aggaggaaguggggauggc

SEQ ID NO: 726758 - RNA, 21 nt, Human
aggcagagcuagccuugcuuc

SEQ ID NO: 726759 - RNA, 18 nt, Human
aggcaguggcagugcugc

SEQ ID NO: 726760 - RNA, 19 nt, Human
aggccugggggcaggagcu

SEQ ID NO: 726761 - RNA, 18 nt, Human
agggccuccauguuccag

SEQ ID NO: 726762 - RNA, 23 nt, Human
aguaggugugucccccaaggcag

SEQ ID NO: 726763 - RNA, 23 nt, Human
caagcagcaugccuaggccuggg

SEQ ID NO: 726764 - RNA, 18 nt, Human
caaggauggacaaugggg

SEQ ID NO: 726765 - RNA, 21 nt, Human
caaggauggacaauggggugg

SEQ ID NO: 726766 - RNA, 22 nt, Human
caaggcggagcccccgcccgcc

SEQ ID NO: 726767 - RNA, 18 nt, Human
caauauacugggacugca

SEQ ID NO: 726768 - RNA, 20 nt, Human
caaugggguggucuggcccc

SEQ ID NO: 726769 - RNA, 28 nt, Human
cacaaaaccacggagucacuaaggcagg

SEQ ID NO: 726770 - RNA, 22 nt, Human
caccagggacagauggggacac

SEQ ID NO: 726771 - RNA, 30 nt, Human
cacccagggcccacaucuuccgacugcccc

SEQ ID NO: 726772 - RNA, 22 nt, Human
caccucucccugccggagccca

SEQ ID NO: 726773 - RNA, 23 nt, Human
cacgugcuugguggaggccaagg

SEQ ID NO: 726774 - RNA, 23 nt, Human
cacuguacaaggccggggaggcc

SEQ ID NO: 726775 - RNA, 19 nt, Human
cagaacgcaaggguggggu

SEQ ID NO: 726776 - RNA, 19 nt, Human
cagcaguccaggcugcggc

SEQ ID NO: 726777 - RNA, 21 nt, Human
caggcacacaauggccacacc

SEQ ID NO: 726778 - RNA, 23 nt, Human
caggcacacaauggccacacgug

SEQ ID NO: 726779 - RNA, 22 nt, Human
cagguucacucgugggcagcag

SEQ ID NO: 726780 - RNA, 20 nt, Human
caguggggcuacucccagau

SEQ ID NO: 726781 - RNA, 26 nt, Human
cauacacacucugcuccucacaaaac

SEQ ID NO: 726782 - RNA, 22 nt, Human
caucccggcccugauccgaggg

SEQ ID NO: 726783 - RNA, 19 nt, Human
cauggcagaugucugcgac

SEQ ID NO: 726784 - RNA, 24 nt, Human
ccacaucuuccgacugccccagaa

SEQ ID NO: 726785 - RNA, 24 nt, Human
ccacugcccggugcucggcuccgc

SEQ ID NO: 726786 - RNA, 18 nt, Human
ccagccccgggcagggcc

SEQ ID NO: 726787 - RNA, 20 nt, Human
ccaggcugcggcugcaggug

SEQ ID NO: 726788 - RNA, 20 nt, Human
cccccgcauacacagcuccu

SEQ ID NO: 726789 - RNA, 20 nt, Human
cccccgcgcccucgccgccu

SEQ ID NO: 726790 - RNA, 22 nt, Human
cccccgcgcccucgccgccucc

SEQ ID NO: 726791 - RNA, 18 nt, Human
ccccgcauacacagcucc

SEQ ID NO: 726792 - RNA, 20 nt, Human
ccccgcccgccgcgcucccc

SEQ ID NO: 726793 - RNA, 22 nt, Human
ccccgcgcccucgccgccuccg

SEQ ID NO: 726794 - RNA, 24 nt, Human
ccccucccaucccggcccugaucc

SEQ ID NO: 726795 - RNA, 20 nt, Human
ccccugcaccucucccugcc

SEQ ID NO: 726796 - RNA, 23 nt, Human
cccgcacccgugacgugugccua

SEQ ID NO: 726797 - RNA, 19 nt, Human
cccgccgccgccgccgccg

SEQ ID NO: 726798 - RNA, 24 nt, Human
cccgccgccgccgccgccgccgca

SEQ ID NO: 726799 - RNA, 23 nt, Human
cccucgccgccuccgcgccucuc

SEQ ID NO: 726800 - RNA, 27 nt, Human
ccgcauacacagcuccuccaagggggu

SEQ ID NO: 726801 - RNA, 30 nt, Human
ccgccgccgccgccgcagccacugcccggg

SEQ ID NO: 726802 - RNA, 18 nt, Human
ccgccgccgccgccgccg

SEQ ID NO: 726803 - RNA, 18 nt, Human
ccgccgccgccgccgccg

SEQ ID NO: 726804 - RNA, 19 nt, Human
ccgccgccgccgccgccgc

SEQ ID NO: 726805 - RNA, 22 nt, Human
ccgccgccgccgccgccgccgg

SEQ ID NO: 726806 - RNA, 18 nt, Human
ccggagcccaggcucugc

SEQ ID NO: 726807 - RNA, 21 nt, Human
ccucccaucccggcccugauc

SEQ ID NO: 726808 - RNA, 18 nt, Human
ccugagaagcauguggaa

SEQ ID NO: 726809 - RNA, 23 nt, Human
cgagcaagcagcaugccuaggcc

SEQ ID NO: 726810 - RNA, 24 nt, Human
cgccgagcgguccucagagccccc

SEQ ID NO: 726811 - RNA, 21 nt, Human
cgccuccgcgccucucggcuc

SEQ ID NO: 726812 - RNA, 19 nt, Human
cgggggcagggcugggcug

SEQ ID NO: 726813 - RNA, 22 nt, Human
cgggggcagggcugggcugggc

SEQ ID NO: 726814 - RNA, 19 nt, Human
cgugggcagcaguccaggc

SEQ ID NO: 726815 - RNA, 24 nt, Human
cuaggccccagccccgggcagggc

SEQ ID NO: 726816 - RNA, 20 nt, Human
cucugcacggcugcugccuc

SEQ ID NO: 726817 - RNA, 18 nt, Human
cucugcuccucacaaaac

SEQ ID NO: 726818 - RNA, 22 nt, Human
cugauccgagggcauccuggcc

SEQ ID NO: 726819 - RNA, 21 nt, Human
cugcuccucacaaaaccacgg

SEQ ID NO: 726820 - RNA, 20 nt, Human
cugcugccuccuggccccag

SEQ ID NO: 726821 - RNA, 18 nt, Human
cuguacaaggccggggag

SEQ ID NO: 726822 - RNA, 24 nt, Human
gacaaugggguggucuggcccccc

SEQ ID NO: 726823 - RNA, 19 nt, Human
gacuccccugcaccucucc

SEQ ID NO: 726824 - RNA, 18 nt, Human
gagcggccugaaggcggc

SEQ ID NO: 726825 - RNA, 19 nt, Human
gagcgguccucagagcccc

SEQ ID NO: 726826 - RNA, 25 nt, Human
gcacagagccucucgcccucugcca

SEQ ID NO: 726827 - RNA, 20 nt, Human
gcaggcugugcugggugcag

SEQ ID NO: 726828 - RNA, 20 nt, Human
gcccaggccgcuauagcccc

SEQ ID NO: 726829 - RNA, 20 nt, Human
gcccgggggcagggcugggc

SEQ ID NO: 726830 - RNA, 23 nt, Human
gcccgggggcagggcugggcugg

SEQ ID NO: 726831 - RNA, 20 nt, Human
gcccuuugucauguuucuca

SEQ ID NO: 726832 - RNA, 22 nt, Human
gcgguccucagagcccccgcgc

SEQ ID NO: 726833 - RNA, 21 nt, Human
gcucugcacggcugcugccuc

SEQ ID NO: 726834 - RNA, 19 nt, Human
gcugcccucgaacugaggc

SEQ ID NO: 726835 - RNA, 18 nt, Human
gcugggugcagaagggcu

SEQ ID NO: 726836 - RNA, 23 nt, Human
ggacacccaugcauccccugccu

SEQ ID NO: 726837 - RNA, 21 nt, Human
ggacucacggacaacaaggau

SEQ ID NO: 726838 - RNA, 20 nt, Human
ggcaaggccuagccugcaug

SEQ ID NO: 726839 - RNA, 23 nt, Human
ggcaggagcuaugcccuuccugg

SEQ ID NO: 726840 - RNA, 18 nt, Human
ggcagggcugggcugggc

SEQ ID NO: 726841 - RNA, 19 nt, Human
ggccugaaggcggcccggg

SEQ ID NO: 726842 - RNA, 23 nt, Human
ggccugggggucaccucaggugg

SEQ ID NO: 726843 - RNA, 24 nt, Human
ggcuacucccagaugugugagagg

SEQ ID NO: 726844 - RNA, 21 nt, Human
ggcugggcaggcugugcuggg

SEQ ID NO: 726845 - RNA, 24 nt, Human
ggcugggcaggcugugcugggugc

SEQ ID NO: 726846 - RNA, 24 nt, Human
gggaggcugugaccggauucuucc

SEQ ID NO: 726847 - RNA, 19 nt, Human
gggcaaggccuagccugca

SEQ ID NO: 726848 - RNA, 23 nt, Human
gggcaaggccuagccugcaugug

SEQ ID NO: 726849 - RNA, 18 nt, Human
gggggcagggcugggcug

SEQ ID NO: 726850 - RNA, 21 nt, Human
gggggcagggcugggcugggc

SEQ ID NO: 726851 - RNA, 19 nt, Human
ggugcagaagggcugcggg

SEQ ID NO: 726852 - RNA, 24 nt, Human
gugcccgggggcagggcugggcug

SEQ ID NO: 726853 - RNA, 20 nt, Human
gugcugcugaagugggcugc

SEQ ID NO: 726854 - RNA, 23 nt, Human
guggucuggcccccagacaggcu

SEQ ID NO: 726855 - RNA, 22 nt, Human
uaaggcaggcacacaauggcca

SEQ ID NO: 726856 - RNA, 23 nt, Human
uaaggcaggcacacaauggcccc

SEQ ID NO: 726857 - RNA, 21 nt, Human
uaauccuguggggccccaggu

SEQ ID NO: 726858 - RNA, 20 nt, Human
uaggccccagccccgggcag

SEQ ID NO: 726859 - RNA, 22 nt, Human
uaggccccagccccgggcaggg

SEQ ID NO: 726860 - RNA, 19 nt, Human
ucauccacuggcaaaagca

SEQ ID NO: 726861 - RNA, 24 nt, Human
uccaaggggguuucuggguuccua

SEQ ID NO: 726862 - RNA, 19 nt, Human
uccccugcaccucucccug

SEQ ID NO: 726863 - RNA, 26 nt, Human
ucccggcccgccgccgccgccgccgg

SEQ ID NO: 726864 - RNA, 19 nt, Human
ucgugggcagcaguccagg

SEQ ID NO: 726865 - RNA, 23 nt, Human
ucugccagacuuugguggcugcu

SEQ ID NO: 726866 - RNA, 18 nt, Human
ucuggguuccuaggccuc

SEQ ID NO: 726867 - RNA, 21 nt, Human
ugaccccucccaucccggccc

SEQ ID NO: 726868 - RNA, 22 nt, Human
ugacuccccugcaccucucccu

SEQ ID NO: 726869 - RNA, 22 nt, Human
ugcagaaagucugccagacuuu

SEQ ID NO: 726870 - RNA, 20 nt, Human
ugcggcugcagguggcagug

SEQ ID NO: 726871 - RNA, 19 nt, Human
ugcugcugaagugggcugc

SEQ ID NO: 726872 - RNA, 23 nt, Human
ugcugcugaagugggcugcuccc

SEQ ID NO: 726873 - RNA, 23 nt, Human
uggccccugacuugcccugcagg

SEQ ID NO: 726874 - RNA, 24 nt, Human
uggcugcuggacuaggccccagcc

SEQ ID NO: 726875 - RNA, 18 nt, Human
uggcuggggaggucuggg

SEQ ID NO: 726876 - RNA, 23 nt, Human
ugggcaggcugugcugggugcag

SEQ ID NO: 726877 - RNA, 18 nt, Human
ugggcugcucccacccag

SEQ ID NO: 726878 - RNA, 19 nt, Human
ugggguggcaggagcgagg

SEQ ID NO: 726879 - RNA, 20 nt, Human
ugggugcagaagggcugcgg

SEQ ID NO: 726880 - RNA, 18 nt, Human
uguggcaggaggcggcgc

SEQ ID NO: 726881 - RNA, 24 nt, Human
uguugggguagaggaggaaguggg

SEQ ID NO: 726882 - RNA, 22 nt, Human
uuccccgacagagucacccugg

SEQ ID NO: 726883 - RNA, 21 nt, Human
uuccuaggccucuuggcaucc

SEQ ID NO: 726884 - RNA, 24 nt, Human
uuucuggguuccuaggccucuugg

SEQ ID NO: 726885 - RNA, 25 nt, Human
uuucuggguuccuaggccucuuggc

SEQ ID NO: 726886 - RNA, 23 nt, Human
aagcagcuggaacucggugaugc

SEQ ID NO: 726887 - RNA, 19 nt, Human
agacaggugucauaauccc

SEQ ID NO: 726888 - RNA, 24 nt, Human
agaucagcaccacagccuuccagg

SEQ ID NO: 726889 - RNA, 18 nt, Human
aggcagggagcaaggacc

SEQ ID NO: 726890 - RNA, 19 nt, Human
caacagggaauacagaagc

SEQ ID NO: 726891 - RNA, 21 nt, Human
cuaaaggagugugcacagggc

SEQ ID NO: 726892 - RNA, 24 nt, Human
gcaccacagccuuccaggugucca

SEQ ID NO: 726893 - RNA, 18 nt, Human
guaagugucucgaauuuc

SEQ ID NO: 726894 - RNA, 24 nt, Human
uaaauccuuuaacugcuuugacca

SEQ ID NO: 726895 - RNA, 20 nt, Human
uaaggcagggagcaaggacc

SEQ ID NO: 726896 - RNA, 19 nt, Human
uaagugucucgaauuucuu

SEQ ID NO: 726897 - RNA, 21 nt, Human
ucagaaguuccaacaggaaaa

SEQ ID NO: 726898 - RNA, 20 nt, Human
ugaccaaaaacagaacaagu

SEQ ID NO: 726899 - RNA, 23 nt, Human
ugauaguaagugucucgaauuuc

SEQ ID NO: 726900 - RNA, 19 nt, Human
ugugcacagggcagaagca

SEQ ID NO: 726901 - RNA, 21 nt, Human
uuuaacugcuuugaccaaaaa

SEQ ID NO: 726902 - RNA, 18 nt, Human
uuuaggcuacuaaauccu

SEQ ID NO: 726903 - RNA, 19 nt, Human
aaggccccaaggcagggag

SEQ ID NO: 726904 - RNA, 26 nt, Human
acacggauaucauccccuccuccccc

SEQ ID NO: 726905 - RNA, 22 nt, Human
aggaaaagugcagagccagggc

SEQ ID NO: 726906 - RNA, 18 nt, Human
auccccuccuccccccag

SEQ ID NO: 726907 - RNA, 18 nt, Human
cacccucugggugccggg

SEQ ID NO: 726908 - RNA, 23 nt, Human
cacuuggcugagugggauggggu

SEQ ID NO: 726909 - RNA, 18 nt, Human
cagcacccucugggugcc

SEQ ID NO: 726910 - RNA, 21 nt, Human
cagcucuugggaggcucagga

SEQ ID NO: 726911 - RNA, 20 nt, Human
cagggcuaaggccccaaggc

SEQ ID NO: 726912 - RNA, 19 nt, Human
caggucgggggaggggcag

SEQ ID NO: 726913 - RNA, 22 nt, Human
ccaaggcagggaggccccccuc

SEQ ID NO: 726914 - RNA, 18 nt, Human
cccaggucgggggagggg

SEQ ID NO: 726915 - RNA, 21 nt, Human
ccccuccuccccccagacaca

SEQ ID NO: 726916 - RNA, 19 nt, Human
ccucucacagcagauuggc

SEQ ID NO: 726917 - RNA, 23 nt, Human
cugcagcucuugggaggcucagg

SEQ ID NO: 726918 - RNA, 20 nt, Human
cuucaugcagacacugaccc

SEQ ID NO: 726919 - RNA, 21 nt, Human
gagugggaugggguccgaggg

SEQ ID NO: 726920 - RNA, 22 nt, Human
gagugggaugggguccgagggu

SEQ ID NO: 726921 - RNA, 24 nt, Human
gauaucauccccuccuccccccag

SEQ ID NO: 726922 - RNA, 20 nt, Human
gccccaaggcagggaggccc

SEQ ID NO: 726923 - RNA, 22 nt, Human
gcccgugggcugcagcucuugg

SEQ ID NO: 726924 - RNA, 20 nt, Human
gugggcugcagcucuuggga

SEQ ID NO: 726925 - RNA, 24 nt, Human
uaaggccccaaggcagggaggccc

SEQ ID NO: 726926 - RNA, 19 nt, Human
uccccccagacacagaaag

SEQ ID NO: 726927 - RNA, 20 nt, Human
uccugggagaaggcagcagu

SEQ ID NO: 726928 - RNA, 22 nt, Human
ugggaaggcguccuucacagug

SEQ ID NO: 726929 - RNA, 20 nt, Human
ugggaugggguccgaggguc

SEQ ID NO: 726930 - RNA, 20 nt, Human
uggugggcagcacccucugg

SEQ ID NO: 726931 - RNA, 24 nt, Human
acucuagccucggugacagaguga

SEQ ID NO: 726932 - RNA, 23 nt, Human
agggagcuggggcuauagagaug

SEQ ID NO: 726933 - RNA, 22 nt, Human
agguugaggcugcaaugagcug

SEQ ID NO: 726934 - RNA, 20 nt, Human
ccacuguacucuagccucgg

SEQ ID NO: 726935 - RNA, 23 nt, Human
ccacuguacucuagccucgguga

SEQ ID NO: 726936 - RNA, 24 nt, Human
ccacuguacucuagccucggugac

SEQ ID NO: 726937 - RNA, 22 nt, Human
ccgcugccaccgccuauggccg

SEQ ID NO: 726938 - RNA, 23 nt, Human
ccgcugccaccgccuauggccgg

SEQ ID NO: 726939 - RNA, 22 nt, Human
cugaccucuugugugugugugu

SEQ ID NO: 726940 - RNA, 30 nt, Human
cugaccucuuguguguguguguguguggug

SEQ ID NO: 726941 - RNA, 19 nt, Human
cugcaggcuagguguggug

SEQ ID NO: 726942 - RNA, 19 nt, Human
cugggagguugaggcugca

SEQ ID NO: 726943 - RNA, 21 nt, Human
gacaacacaagguaugaaaca

SEQ ID NO: 726944 - RNA, 23 nt, Human
gagccaccagacaaugucacuug

SEQ ID NO: 726945 - RNA, 20 nt, Human
gagcuggggcuauagagaug

SEQ ID NO: 726946 - RNA, 24 nt, Human
gauugagccugggagguugaggcu

SEQ ID NO: 726947 - RNA, 24 nt, Human
gccacuguacucuagccucgguga

SEQ ID NO: 726948 - RNA, 24 nt, Human
gccugggagguugaggcugcaaug

SEQ ID NO: 726949 - RNA, 21 nt, Human
gcuaggugugguggugugcac

SEQ ID NO: 726950 - RNA, 18 nt, Human
gcuauagagaugguaggc

SEQ ID NO: 726951 - RNA, 19 nt, Human
gcugcaaugagcugugauu

SEQ ID NO: 726952 - RNA, 22 nt, Human
ggccgggguggggucagcccag

SEQ ID NO: 726953 - RNA, 18 nt, Human
gggaggcucaguuggaag

SEQ ID NO: 726954 - RNA, 24 nt, Human
guacucuagccucggugacagagu

SEQ ID NO: 726955 - RNA, 19 nt, Human
guguguguguguguguggc

SEQ ID NO: 726956 - RNA, 22 nt, Human
uacucuagccucggugacagag

SEQ ID NO: 726957 - RNA, 24 nt, Human
uacucuagccucggugacagagug

SEQ ID NO: 726958 - RNA, 20 nt, Human
ucucugcugccgcugccacc

SEQ ID NO: 726959 - RNA, 20 nt, Human
ucugcugccgcugccaccgc

SEQ ID NO: 726960 - RNA, 21 nt, Human
ucuuuauuuccguuuguuucc

SEQ ID NO: 726961 - RNA, 24 nt, Human
ugagccugggagguugaggcugca

SEQ ID NO: 726962 - RNA, 22 nt, Human
ugagcugugauugugccacugu

SEQ ID NO: 726963 - RNA, 22 nt, Human
ugcaaugagcugugauugugcc

SEQ ID NO: 726964 - RNA, 21 nt, Human
uggaggggaacugaccucuug

SEQ ID NO: 726965 - RNA, 21 nt, Human
uggcaguaggggagggaucgg

SEQ ID NO: 726966 - RNA, 19 nt, Human
uggcuggcaguaggggagg

SEQ ID NO: 726967 - RNA, 21 nt, Human
uggggucagcccagcuucugg

SEQ ID NO: 726968 - RNA, 20 nt, Human
uguguguguguguguggccu

SEQ ID NO: 726969 - RNA, 21 nt, Human
uguguguguguguguggccug

SEQ ID NO: 726970 - RNA, 18 nt, Human
ugugugugugugugugug

SEQ ID NO: 726971 - RNA, 18 nt, Human
uucucugcugccgcugcc

SEQ ID NO: 726972 - RNA, 18 nt, Human
uucucugcugccgcugcc

SEQ ID NO: 726973 - RNA, 25 nt, Human
uucucugcugccgcugccaccgccu

SEQ ID NO: 726974 - RNA, 21 nt, Human
aaaacaaaacaaaauuaaaac

SEQ ID NO: 726975 - RNA, 21 nt, Human
aaaacaaauaugacaauaccc

SEQ ID NO: 726976 - RNA, 26 nt, Human
aaaacaucaaaaacuauuuucaagga

SEQ ID NO: 726977 - RNA, 20 nt, Human
aaaacuaaugaggauggcau

SEQ ID NO: 726978 - RNA, 18 nt, Human
aaaagagacugucagaug

SEQ ID NO: 726979 - RNA, 25 nt, Human
aaacaaauaugacaauacccuaugu

SEQ ID NO: 726980 - RNA, 20 nt, Human
aaacaagaauaucaauggua

SEQ ID NO: 726981 - RNA, 22 nt, Human
aaacacauggccaugcacauaa

SEQ ID NO: 726982 - RNA, 18 nt, Human
aaacacugaagacugaug

SEQ ID NO: 726983 - RNA, 23 nt, Human
aaaccgcuuugaguucucuuugc

SEQ ID NO: 726984 - RNA, 26 nt, Human
aaagauuagaaaaaggaaaaaaauaa

SEQ ID NO: 726985 - RNA, 24 nt, Human
aaagugcugggauuacaggcaaga

SEQ ID NO: 726986 - RNA, 23 nt, Human
aaaucacucuagaccuuuaauuc

SEQ ID NO: 726987 - RNA, 21 nt, Human
aaccaggauugucuccaucuc

SEQ ID NO: 726988 - RNA, 18 nt, Human
aaccugguaaaaucaccu

SEQ ID NO: 726989 - RNA, 20 nt, Human
aacuauaauuuuagucaaca

SEQ ID NO: 726990 - RNA, 19 nt, Human
aagaagacuuuuaucagac

SEQ ID NO: 726991 - RNA, 21 nt, Human
aagcagaaacucuuaaguccc

SEQ ID NO: 726992 - RNA, 21 nt, Human
aaguauguaugacuucauguu

SEQ ID NO: 726993 - RNA, 18 nt, Human
aagugcugggauuacagg

SEQ ID NO: 726994 - RNA, 19 nt, Human
aagugcugggauuacaggc

SEQ ID NO: 726995 - RNA, 23 nt, Human
aaucuagcaaugauagcauaaua

SEQ ID NO: 726996 - RNA, 21 nt, Human
aaugcuuacaagucccuuuaa

SEQ ID NO: 726997 - RNA, 18 nt, Human
aaugucacuguuuucaaa

SEQ ID NO: 726998 - RNA, 25 nt, Human
acaaaacaucaaaaacuauuuucaa

SEQ ID NO: 726999 - RNA, 24 nt, Human
acaaaauuagaaugaccugaauca

SEQ ID NO: 727000 - RNA, 23 nt, Human
acacacacacacacacacacaca

SEQ ID NO: 727001 - RNA, 19 nt, Human
acccaggcuggagugcagu

SEQ ID NO: 727002 - RNA, 22 nt, Human
acccuaugugauauaauagaac

SEQ ID NO: 727003 - RNA, 18 nt, Human
accucgugauccccccac

SEQ ID NO: 727004 - RNA, 25 nt, Human
acucugucacccaggcuggagugca

SEQ ID NO: 727005 - RNA, 18 nt, Human
acugcaagcucugccucc

SEQ ID NO: 727006 - RNA, 21 nt, Human
acuucaaaagagacugucaga

SEQ ID NO: 727007 - RNA, 22 nt, Human
agaaauauuauuccugaucuuc

SEQ ID NO: 727008 - RNA, 24 nt, Human
agagaacagguccgccuguaaaca

SEQ ID NO: 727009 - RNA, 21 nt, Human
agagugaacuguguacauaua

SEQ ID NO: 727010 - RNA, 18 nt, Human
aggaagaaaagugaccac

SEQ ID NO: 727011 - RNA, 25 nt, Human
aggcuggagugcaguggcgcgaucu

SEQ ID NO: 727012 - RNA, 26 nt, Human
aggggguuucaccgugaugaaaccag

SEQ ID NO: 727013 - RNA, 24 nt, Human
aggguuccucuuuccugguguuuu

SEQ ID NO: 727014 - RNA, 21 nt, Human
agugcaguggcgcgaucucug

SEQ ID NO: 727015 - RNA, 24 nt, Human
agugcaguggcgcgaucucugcuc

SEQ ID NO: 727016 - RNA, 18 nt, Human
agugcugggauuacaggc

SEQ ID NO: 727017 - RNA, 23 nt, Human
auggaguuuuggguggccaggag

SEQ ID NO: 727018 - RNA, 18 nt, Human
augucaagguuuaguuua

SEQ ID NO: 727019 - RNA, 24 nt, Human
auucuaucacuuucucuggaaugg

SEQ ID NO: 727020 - RNA, 18 nt, Human
auuggaaaacuaaugagg

SEQ ID NO: 727021 - RNA, 20 nt, Human
auuuccauuuaccuaauagg

SEQ ID NO: 727022 - RNA, 27 nt, Human
caaaacaucaaaaacuauuuucaagga

SEQ ID NO: 727023 - RNA, 27 nt, Human
caaagugcugggauuacaggcaagagc

SEQ ID NO: 727024 - RNA, 24 nt, Human
caauauggagaacuuaugugacag

SEQ ID NO: 727025 - RNA, 24 nt, Human
cacacaaacucaaguacuccucuc

SEQ ID NO: 727026 - RNA, 20 nt, Human
cacacacacacacacacaca

SEQ ID NO: 727027 - RNA, 20 nt, Human
cacacacacacacacacaca

SEQ ID NO: 727028 - RNA, 20 nt, Human
cacacacacacacacacaca

SEQ ID NO: 727029 - RNA, 22 nt, Human
cacacacacacacacacacaca

SEQ ID NO: 727030 - RNA, 24 nt, Human
cacccaggcuggagugcaguggcg

SEQ ID NO: 727031 - RNA, 18 nt, Human
caccgcgcccaccaguuc

SEQ ID NO: 727032 - RNA, 24 nt, Human
cacucagaaugcucuguuugacua

SEQ ID NO: 727033 - RNA, 22 nt, Human
cacucugucacccaggcuggag

SEQ ID NO: 727034 - RNA, 23 nt, Human
cacucugucacccaggcuggagu

SEQ ID NO: 727035 - RNA, 22 nt, Human
cacugacacaaacacacacaca

SEQ ID NO: 727036 - RNA, 23 nt, Human
cacugcaagcucugccucccggg

SEQ ID NO: 727037 - RNA, 25 nt, Human
cacuguaugcaaacuguagccaaaa

SEQ ID NO: 727038 - RNA, 20 nt, Human
cagaaacacugucacaaaau

SEQ ID NO: 727039 - RNA, 23 nt, Human
cagaacauucaaauaaccuuagu

SEQ ID NO: 727040 - RNA, 20 nt, Human
cagauuaaaacaaauaugac

SEQ ID NO: 727041 - RNA, 18 nt, Human
cagcugggacuacaggug

SEQ ID NO: 727042 - RNA, 20 nt, Human
cagguccgccuguaaacacu

SEQ ID NO: 727043 - RNA, 19 nt, Human
caguguacgagaagccaua

SEQ ID NO: 727044 - RNA, 21 nt, Human
cauaauaaagggcauauucua

SEQ ID NO: 727045 - RNA, 24 nt, Human
caugauacugucucugaggaucaa

SEQ ID NO: 727046 - RNA, 22 nt, Human
caugcaccuacaaacacauggc

SEQ ID NO: 727047 - RNA, 19 nt, Human
ccaaagugcugggauuaca

SEQ ID NO: 727048 - RNA, 23 nt, Human
ccaaagugcugggauuacaggca

SEQ ID NO: 727049 - RNA, 20 nt, Human
ccacaucugcaaaaugaaau

SEQ ID NO: 727050 - RNA, 24 nt, Human
cccaaagugcugggauuacaggca

SEQ ID NO: 727051 - RNA, 19 nt, Human
cccaggguuccucuuuccu

SEQ ID NO: 727052 - RNA, 26 nt, Human
ccccccaccuuggccucccaaagugc

SEQ ID NO: 727053 - RNA, 24 nt, Human
cccgagcagcugggacuacaggug

SEQ ID NO: 727054 - RNA, 20 nt, Human
ccuaauucacuuugcuaaua

SEQ ID NO: 727055 - RNA, 19 nt, Human
cggcaaagcuguaagaaaa

SEQ ID NO: 727056 - RNA, 21 nt, Human
cuaaaagcuuaccacaacuua

SEQ ID NO: 727057 - RNA, 20 nt, Human
cucaaguacuccucucugcc

SEQ ID NO: 727058 - RNA, 24 nt, Human
cucacucugucacccaggcuggag

SEQ ID NO: 727059 - RNA, 24 nt, Human
cucacugcaagcucugccucccgg

SEQ ID NO: 727060 - RNA, 20 nt, Human
cucagaaugcucuguuugac

SEQ ID NO: 727061 - RNA, 21 nt, Human
cucccggguucaugccauucu

SEQ ID NO: 727062 - RNA, 18 nt, Human
cuccugaccucgugaucc

SEQ ID NO: 727063 - RNA, 22 nt, Human
cucucugccucauccuuauucc

SEQ ID NO: 727064 - RNA, 25 nt, Human
cuguaauaaaaaaaaucugauuuuc

SEQ ID NO: 727065 - RNA, 23 nt, Human
cuuaccacaacuuaaagaaaaac

SEQ ID NO: 727066 - RNA, 21 nt, Human
gaacauuuuaugcuugcuuua

SEQ ID NO: 727067 - RNA, 24 nt, Human
gaccucgugauccccccaccuugg

SEQ ID NO: 727068 - RNA, 19 nt, Human
gagauccucaauauucuaa

SEQ ID NO: 727069 - RNA, 20 nt, Human
gagcagcugggacuacaggu

SEQ ID NO: 727070 - RNA, 25 nt, Human
gagcagcugggacuacaggugacca

SEQ ID NO: 727071 - RNA, 18 nt, Human
gauuacaggcaagagcca

SEQ ID NO: 727072 - RNA, 20 nt, Human
gauuacuucuuuaugagauu

SEQ ID NO: 727073 - RNA, 21 nt, Human
gcaagagccaccgcgcccacc

SEQ ID NO: 727074 - RNA, 25 nt, Human
gccucccggguucaugccauucucc

SEQ ID NO: 727075 - RNA, 23 nt, Human
gccuggcuaauuuuuuguauuuu

SEQ ID NO: 727076 - RNA, 20 nt, Human
gcuacuguggaugucaaggu

SEQ ID NO: 727077 - RNA, 26 nt, Human
gcuggagugcaguggcgcgaucucug

SEQ ID NO: 727078 - RNA, 18 nt, Human
ggaaagaaaaauguucuc

SEQ ID NO: 727079 - RNA, 18 nt, Human
ggaaagaaauggcuuucu

SEQ ID NO: 727080 - RNA, 23 nt, Human
ggagcaggaagucaggcagguuu

SEQ ID NO: 727081 - RNA, 22 nt, Human
ggauuacaggcaagagccaccg

SEQ ID NO: 727082 - RNA, 26 nt, Human
ggggguuucaccgugaugaaaccagg

SEQ ID NO: 727083 - RNA, 24 nt, Human
gggguuucaccgugaugaaaccag

SEQ ID NO: 727084 - RNA, 24 nt, Human
guagaauccagauuacuucuuuau

SEQ ID NO: 727085 - RNA, 23 nt, Human
guagggaagcagaaacucuuaag

SEQ ID NO: 727086 - RNA, 18 nt, Human
gugagaucagaaauuuca

SEQ ID NO: 727087 - RNA, 18 nt, Human
uaaaaaaucucaaaguga

SEQ ID NO: 727088 - RNA, 24 nt, Human
uaaaaacacugaagacugauggaa

SEQ ID NO: 727089 - RNA, 23 nt, Human
uaaacacaaagaauauauaggua

SEQ ID NO: 727090 - RNA, 24 nt, Human
uaaacagucacuugucagucaaaa

SEQ ID NO: 727091 - RNA, 20 nt, Human
uaaacuaaaagcuuaccaca

SEQ ID NO: 727092 - RNA, 21 nt, Human
uaaagcagcuaaacuaaaagc

SEQ ID NO: 727093 - RNA, 22 nt, Human
uaaauaaacacaaagaauauau

SEQ ID NO: 727094 - RNA, 23 nt, Human
uaaccuuaguuuuucaguuuuac

SEQ ID NO: 727095 - RNA, 21 nt, Human
uaauauggggugagaucagaa

SEQ ID NO: 727096 - RNA, 24 nt, Human
uaauuuuuuguauuuuuagcagag

SEQ ID NO: 727097 - RNA, 25 nt, Human
uaauuuuuuguauuuuuagcagaga

SEQ ID NO: 727098 - RNA, 23 nt, Human
uacaaaauauaaacaguacugca

SEQ ID NO: 727099 - RNA, 25 nt, Human
uacaaaauauaaacaguacugcaua

SEQ ID NO: 727100 - RNA, 24 nt, Human
uacaggcaagagccaccgcgccca

SEQ ID NO: 727101 - RNA, 21 nt, Human
uacuguggaugucaagguuua

SEQ ID NO: 727102 - RNA, 18 nt, Human
uacuuguacacuaacauu

SEQ ID NO: 727103 - RNA, 20 nt, Human
uagaaaaaaguggcuuaaaa

SEQ ID NO: 727104 - RNA, 23 nt, Human
uagaacuucuguaauauagcaau

SEQ ID NO: 727105 - RNA, 18 nt, Human
uagaauuccaagccccuc

SEQ ID NO: 727106 - RNA, 23 nt, Human
uagaauuccaagccccucgacau

SEQ ID NO: 727107 - RNA, 18 nt, Human
uagcacguucauugauau

SEQ ID NO: 727108 - RNA, 24 nt, Human
uagcagagaggggguuucaccgug

SEQ ID NO: 727109 - RNA, 27 nt, Human
uaggaaauguuuguugcugaggcugac

SEQ ID NO: 727110 - RNA, 19 nt, Human
uaggaagaaaagugaccac

SEQ ID NO: 727111 - RNA, 21 nt, Human
uagugacaguagagagcaaag

SEQ ID NO: 727112 - RNA, 23 nt, Human
uauaaaacauuuaugaacauuuu

SEQ ID NO: 727113 - RNA, 20 nt, Human
uaugacccaggguuccucuu

SEQ ID NO: 727114 - RNA, 22 nt, Human
uauugauuuuccuccaaagcuu

SEQ ID NO: 727115 - RNA, 21 nt, Human
uauuucaacacaugcaccuac

SEQ ID NO: 727116 - RNA, 19 nt, Human
ucaaaagagacugucagau

SEQ ID NO: 727117 - RNA, 23 nt, Human
ucaaaucugccugaucaucaaua

SEQ ID NO: 727118 - RNA, 25 nt, Human
ucaauuacuggccauauuauauaau

SEQ ID NO: 727119 - RNA, 22 nt, Human
ucacccaggcuggagugcagug

SEQ ID NO: 727120 - RNA, 24 nt, Human
ucacucugucacccaggcuggagu

SEQ ID NO: 727121 - RNA, 18 nt, Human
ucacugcaagcucugccu

SEQ ID NO: 727122 - RNA, 18 nt, Human
ucacugcaagcucugccu

SEQ ID NO: 727123 - RNA, 24 nt, Human
ucacugcaagcucugccucccggg

SEQ ID NO: 727124 - RNA, 24 nt, Human
ucacugcagaaaaugagggaaaga

SEQ ID NO: 727125 - RNA, 26 nt, Human
ucacuuucucuggaauggucuucuca

SEQ ID NO: 727126 - RNA, 26 nt, Human
ucauccagauuaaaacaaauaugaca

SEQ ID NO: 727127 - RNA, 21 nt, Human
ucauugauauugauuuuccuc

SEQ ID NO: 727128 - RNA, 18 nt, Human
ucauuuuaugacccaggg

SEQ ID NO: 727129 - RNA, 19 nt, Human
uccagaaaugcuuacaagu

SEQ ID NO: 727130 - RNA, 20 nt, Human
uccagaaaugcuuacaaguc

SEQ ID NO: 727131 - RNA, 25 nt, Human
uccagauuaaaacaaauaugacaaa

SEQ ID NO: 727132 - RNA, 21 nt, Human
uccauugucacacaacagcau

SEQ ID NO: 727133 - RNA, 24 nt, Human
ucccaaagugcugggauuacaggc

SEQ ID NO: 727134 - RNA, 19 nt, Human
uccccccaccuuggccucc

SEQ ID NO: 727135 - RNA, 23 nt, Human
ucccgagcagcugggacuacagg

SEQ ID NO: 727136 - RNA, 21 nt, Human
ucccggguucaugccauucuc

SEQ ID NO: 727137 - RNA, 24 nt, Human
ucccggguucaugccauucuccug

SEQ ID NO: 727138 - RNA, 23 nt, Human
uccuaggaagaaaagugaccacc

SEQ ID NO: 727139 - RNA, 24 nt, Human
ucuaaaaucuuccauuuagaauuc

SEQ ID NO: 727140 - RNA, 25 nt, Human
ucuaaaaucuuccauuuagaauucc

SEQ ID NO: 727141 - RNA, 22 nt, Human
ucuaucacuuucucuggaaugg

SEQ ID NO: 727142 - RNA, 23 nt, Human
ucucacucugucacccaggcugg

SEQ ID NO: 727143 - RNA, 24 nt, Human
ucucacucugucacccaggcugga

SEQ ID NO: 727144 - RNA, 26 nt, Human
ucucacucugucacccaggcuggagu

SEQ ID NO: 727145 - RNA, 27 nt, Human
ucucacucugucacccaggcuggagug

SEQ ID NO: 727146 - RNA, 20 nt, Human
ucugccucauccuuauuccu

SEQ ID NO: 727147 - RNA, 23 nt, Human
ucuggagucccagucccuacccc

SEQ ID NO: 727148 - RNA, 24 nt, Human
ucugucacccaggcuggagugcag

SEQ ID NO: 727149 - RNA, 21 nt, Human
ucuuuguagggaagcagaaac

SEQ ID NO: 727150 - RNA, 19 nt, Human
ugaaaccaggauugucucc

SEQ ID NO: 727151 - RNA, 19 nt, Human
ugacaauacccuaugugau

SEQ ID NO: 727152 - RNA, 20 nt, Human
ugacaauacccuaugugaua

SEQ ID NO: 727153 - RNA, 22 nt, Human
ugacacaaacacacacacacac

SEQ ID NO: 727154 - RNA, 22 nt, Human
ugacaguagagagcaaaguucc

SEQ ID NO: 727155 - RNA, 18 nt, Human
ugaccucgugaucccccc

SEQ ID NO: 727156 - RNA, 20 nt, Human
ugaccugaaucaauuacugg

SEQ ID NO: 727157 - RNA, 20 nt, Human
ugagaucagcccauaauauc

SEQ ID NO: 727158 - RNA, 22 nt, Human
ugagccuuucaaggaagucugc

SEQ ID NO: 727159 - RNA, 22 nt, Human
ugaucaucuauuagucuguauu

SEQ ID NO: 727160 - RNA, 19 nt, Human
ugcagaaaaugagggaaag

SEQ ID NO: 727161 - RNA, 24 nt, Human
ugccucacccucccgagcagcugg

SEQ ID NO: 727162 - RNA, 19 nt, Human
ugccucccggguucaugcc

SEQ ID NO: 727163 - RNA, 21 nt, Human
ugcugggauuacaggcaagag

SEQ ID NO: 727164 - RNA, 18 nt, Human
ugcuugacaaucucagau

SEQ ID NO: 727165 - RNA, 22 nt, Human
uggagugcaguggcgcgaucuc

SEQ ID NO: 727166 - RNA, 24 nt, Human
uggagugcaguggcgcgaucucug

SEQ ID NO: 727167 - RNA, 18 nt, Human
uggaguucacugcagaaa

SEQ ID NO: 727168 - RNA, 18 nt, Human
uggcuucaguuguacuac

SEQ ID NO: 727169 - RNA, 21 nt, Human
ugggacuacaggugaccacca

SEQ ID NO: 727170 - RNA, 22 nt, Human
ugggauuacaggcaagagccac

SEQ ID NO: 727171 - RNA, 23 nt, Human
ugggauuacaggcaagagccacc

SEQ ID NO: 727172 - RNA, 24 nt, Human
ugggauuacaggcaagagccaccg

SEQ ID NO: 727173 - RNA, 20 nt, Human
uggggugagaucagaaauuu

SEQ ID NO: 727174 - RNA, 19 nt, Human
uggguagagagaggauguc

SEQ ID NO: 727175 - RNA, 20 nt, Human
uguauagaccuuaguuacca

SEQ ID NO: 727176 - RNA, 22 nt, Human
ugucacaaaauuagaaugaccu

SEQ ID NO: 727177 - RNA, 22 nt, Human
uguuaguaaaaaaguaacuuag

SEQ ID NO: 727178 - RNA, 20 nt, Human
uguuuuguuuuguuuuauua

SEQ ID NO: 727179 - RNA, 22 nt, Human
uuaagguagaauccagauuacu

SEQ ID NO: 727180 - RNA, 20 nt, Human
uuaaguggauaccuauuaaa

SEQ ID NO: 727181 - RNA, 22 nt, Human
uuagaauuccaagccccucgac

SEQ ID NO: 727182 - RNA, 22 nt, Human
uuagcagagaggggguuucacc

SEQ ID NO: 727183 - RNA, 24 nt, Human
uuagcagagaggggguuucaccgu

SEQ ID NO: 727184 - RNA, 21 nt, Human
uucaguuucuuuuugcauccc

SEQ ID NO: 727185 - RNA, 19 nt, Human
uucaugccauucuccugcc

SEQ ID NO: 727186 - RNA, 18 nt, Human
uucauuuuuuaaagagau

SEQ ID NO: 727187 - RNA, 23 nt, Human
uuccugaugcuacuguggauguc

SEQ ID NO: 727188 - RNA, 22 nt, Human
uucuccccucuagcuggaaagc

SEQ ID NO: 727189 - RNA, 19 nt, Human
uucugaauagaggaaagaa

SEQ ID NO: 727190 - RNA, 18 nt, Human
uuggccucccaaagugcu

SEQ ID NO: 727191 - RNA, 23 nt, Human
uuguauuuuuagcagagaggggg

SEQ ID NO: 727192 - RNA, 19 nt, Human
uuuaaggaaaagauuagaa

SEQ ID NO: 727193 - RNA, 18 nt, Human
uuuagaauuccaagcccc

SEQ ID NO: 727194 - RNA, 22 nt, Human
uuuauuuucuuuucucagacca

SEQ ID NO: 727195 - RNA, 21 nt, Human
uuuccagaaaugcuuacaagu

SEQ ID NO: 727196 - RNA, 18 nt, Human
uuuguuuuguuuuguuuu

SEQ ID NO: 727197 - RNA, 24 nt, Human
uuuuuagcagagaggggguuucac

SEQ ID NO: 727198 - RNA, 19 nt, Human
uuuuugguagcaaacugug

SEQ ID NO: 727199 - RNA, 21 nt, Human
uuuuuguauuuuuagcagaga

SEQ ID NO: 727200 - RNA, 18 nt, Human
uuuuuuguauuuuuagca

SEQ ID NO: 727201 - RNA, 20 nt, Human
ccacgugcacagcgcuccuc

SEQ ID NO: 727202 - RNA, 21 nt, Human
ccagagguuuuaucacacuuu

SEQ ID NO: 727203 - RNA, 22 nt, Human
ccaggaaccaggucuuggcuca

SEQ ID NO: 727204 - RNA, 23 nt, Human
ccucaggguccaccaggaaccag

SEQ ID NO: 727205 - RNA, 26 nt, Human
ccucuggaagucggagcgcucagccu

SEQ ID NO: 727206 - RNA, 22 nt, Human
ccuggaguuugagaucugccuc

SEQ ID NO: 727207 - RNA, 24 nt, Human
ccuggaguuugagaucugccuccc

SEQ ID NO: 727208 - RNA, 19 nt, Human
cgggagggcagggucgccg

SEQ ID NO: 727209 - RNA, 21 nt, Human
guagagcaagucugagccaga

SEQ ID NO: 727210 - RNA, 23 nt, Human
uccucaggguccaccaggaacca

SEQ ID NO: 727211 - RNA, 19 nt, Human
ucuuggcucacagccaggc

SEQ ID NO: 727212 - RNA, 23 nt, Human
ucuuggcucacagccaggcugga

SEQ ID NO: 727213 - RNA, 19 nt, Human
ugcacagcgcuccucugga

SEQ ID NO: 727214 - RNA, 19 nt, Human
uucacaguucugagccugg

SEQ ID NO: 727215 - RNA, 23 nt, Human
uuuucucacaauaaacucuuuau

SEQ ID NO: 727216 - RNA, 23 nt, Human
uuuuuuuuuuuuuuucucacaau

SEQ ID NO: 727217 - RNA, 20 nt, Human
aaaacccuucugauaacuca

SEQ ID NO: 727218 - RNA, 27 nt, Human
aaacaaaaggagaaagaaaagggaccc

SEQ ID NO: 727219 - RNA, 22 nt, Human
aaacaauaaaugguacagucau

SEQ ID NO: 727220 - RNA, 20 nt, Human
aaacacaauagcaaaacuca

SEQ ID NO: 727221 - RNA, 23 nt, Human
aaacacacacacacacacaaacc

SEQ ID NO: 727222 - RNA, 19 nt, Human
aaacacauguccaguucuu

SEQ ID NO: 727223 - RNA, 19 nt, Human
aaagaacacuuaaccaaau

SEQ ID NO: 727224 - RNA, 26 nt, Human
aaagcaaaucaauuacacaguaacau

SEQ ID NO: 727225 - RNA, 24 nt, Human
aacaaaacgucuuggcucuccuua

SEQ ID NO: 727226 - RNA, 21 nt, Human
aaccaagaaauaaaacaaucu

SEQ ID NO: 727227 - RNA, 21 nt, Human
aaccuaaaaugcguuuucccc

SEQ ID NO: 727228 - RNA, 18 nt, Human
aagaagaaauaucaaucc

SEQ ID NO: 727229 - RNA, 19 nt, Human
aagcauacuucauccugaa

SEQ ID NO: 727230 - RNA, 22 nt, Human
aauuagaaguguaacuaaacca

SEQ ID NO: 727231 - RNA, 21 nt, Human
acaaaaccacaagaaacuaag

SEQ ID NO: 727232 - RNA, 23 nt, Human
acaaaaucacaaaaccacaagaa

SEQ ID NO: 727233 - RNA, 23 nt, Human
acacaaauucugaaggcaacauc

SEQ ID NO: 727234 - RNA, 22 nt, Human
acacuacaccuuaaauguccaa

SEQ ID NO: 727235 - RNA, 23 nt, Human
acccuaaagaauaaugcacacca

SEQ ID NO: 727236 - RNA, 25 nt, Human
agaagccaccuucagaaggcagcag

SEQ ID NO: 727237 - RNA, 19 nt, Human
agcagaauacaaaaaucua

SEQ ID NO: 727238 - RNA, 24 nt, Human
agcagcuaagucacauaagaaagu

SEQ ID NO: 727239 - RNA, 21 nt, Human
aggaauuccuaacaaaacguc

SEQ ID NO: 727240 - RNA, 18 nt, Human
aggaggcuugggaagcac

SEQ ID NO: 727241 - RNA, 23 nt, Human
aggaggcuugggaagcacuuaua

SEQ ID NO: 727242 - RNA, 21 nt, Human
aggcaacaucauuuauaaaac

SEQ ID NO: 727243 - RNA, 20 nt, Human
aggcgaaaugggucugggac

SEQ ID NO: 727244 - RNA, 23 nt, Human
agucauccuuuucccucuuguua

SEQ ID NO: 727245 - RNA, 22 nt, Human
auaaaacacuguagaaugacca

SEQ ID NO: 727246 - RNA, 19 nt, Human
auauuuuuaguuuuguacc

SEQ ID NO: 727247 - RNA, 24 nt, Human
augugcaauccacaucucaaaaca

SEQ ID NO: 727248 - RNA, 22 nt, Human
auuuugacugggaaggccuggg

SEQ ID NO: 727249 - RNA, 18 nt, Human
caaaacacaauagcaaaa

SEQ ID NO: 727250 - RNA, 22 nt, Human
caaaacacaauagcaaaacuca

SEQ ID NO: 727251 - RNA, 23 nt, Human
caaaacacaauagcaaaacucaa

SEQ ID NO: 727252 - RNA, 24 nt, Human
caaaacccuucugauaacucaaau

SEQ ID NO: 727253 - RNA, 21 nt, Human
caaaaucacaaaaccacaaga

SEQ ID NO: 727254 - RNA, 24 nt, Human
caaaguauuagcauauauuacacu

SEQ ID NO: 727255 - RNA, 21 nt, Human
cacaaacccuugacaggagau

SEQ ID NO: 727256 - RNA, 21 nt, Human
cacacaucuccauauguccac

SEQ ID NO: 727257 - RNA, 19 nt, Human
cacagguuaauaggaggca

SEQ ID NO: 727258 - RNA, 21 nt, Human
cacaucauggugacaugacua

SEQ ID NO: 727259 - RNA, 24 nt, Human
cacuacaccuuaaauguccaaacc

SEQ ID NO: 727260 - RNA, 21 nt, Human
cagaauacaaaaaucuaaaaa

SEQ ID NO: 727261 - RNA, 23 nt, Human
cagaauauaaucaagaacucaua

SEQ ID NO: 727262 - RNA, 18 nt, Human
cagccuucagaacaaaua

SEQ ID NO: 727263 - RNA, 23 nt, Human
cauauguccacaagcucaaaaug

SEQ ID NO: 727264 - RNA, 21 nt, Human
ccaacuuguucacaaaaagug

SEQ ID NO: 727265 - RNA, 21 nt, Human
ccagacagugcucgugcgagc

SEQ ID NO: 727266 - RNA, 28 nt, Human
ccagccagcuagagagcuaccagacagu

SEQ ID NO: 727267 - RNA, 19 nt, Human
ccagccccaacggcggcga

SEQ ID NO: 727268 - RNA, 18 nt, Human
cccuccauaacuuaacaa

SEQ ID NO: 727269 - RNA, 25 nt, Human
ccgaggcgggccgggcagcaucucu

SEQ ID NO: 727270 - RNA, 19 nt, Human
ccugcucuugcuguucugu

SEQ ID NO: 727271 - RNA, 19 nt, Human
cgccucaaagccgaggcgg

SEQ ID NO: 727272 - RNA, 23 nt, Human
cgucuuggcucuccuuaaaacag

SEQ ID NO: 727273 - RNA, 24 nt, Human
cuaacccagaaaacaaacaauaac

SEQ ID NO: 727274 - RNA, 23 nt, Human
cuaaucaucaauauucagaauau

SEQ ID NO: 727275 - RNA, 22 nt, Human
cuacaccuuaaauguccaaacc

SEQ ID NO: 727276 - RNA, 22 nt, Human
cuacauuacaccacuuaucacc

SEQ ID NO: 727277 - RNA, 18 nt, Human
cugagaaagauacagaag

SEQ ID NO: 727278 - RNA, 22 nt, Human
cugccaucugaugagaaagccc

SEQ ID NO: 727279 - RNA, 22 nt, Human
cuuaagcucugcuacauuacac

SEQ ID NO: 727280 - RNA, 21 nt, Human
cuucaguauugucuuuuucaa

SEQ ID NO: 727281 - RNA, 20 nt, Human
gaacauuuacaaaggcaccg

SEQ ID NO: 727282 - RNA, 22 nt, Human
gaccaaauaaaacacuguagaa

SEQ ID NO: 727283 - RNA, 21 nt, Human
gagaaugcuucccuaguauag

SEQ ID NO: 727284 - RNA, 22 nt, Human
gagaccuuuagagaaacaaaag

SEQ ID NO: 727285 - RNA, 22 nt, Human
gagaccuuuagagaaacaaaag

SEQ ID NO: 727286 - RNA, 20 nt, Human
gagcaaaaggcuccucaaga

SEQ ID NO: 727287 - RNA, 30 nt, Human
gccugcuggauuuucaauucucugcagccc

SEQ ID NO: 727288 - RNA, 21 nt, Human
gcuuuuuguuguguguggguc

SEQ ID NO: 727289 - RNA, 22 nt, Human
ggcagcaucucucucgcccggc

SEQ ID NO: 727290 - RNA, 18 nt, Human
ggguacuuuguaaucacu

SEQ ID NO: 727291 - RNA, 21 nt, Human
ggguacuuuguaaucacuaug

SEQ ID NO: 727292 - RNA, 18 nt, Human
guagugauauauaccaau

SEQ ID NO: 727293 - RNA, 21 nt, Human
guaguguaaaauuauaaagca

SEQ ID NO: 727294 - RNA, 18 nt, Human
gucaagcuucaaaccuga

SEQ ID NO: 727295 - RNA, 21 nt, Human
gucacagacaaaauuaaagcc

SEQ ID NO: 727296 - RNA, 19 nt, Human
guuauuaaauacaacaaaa

SEQ ID NO: 727297 - RNA, 20 nt, Human
guucuauucuuaagcucugc

SEQ ID NO: 727298 - RNA, 22 nt, Human
guuuguagugauauauaccaau

SEQ ID NO: 727299 - RNA, 22 nt, Human
uaaaacacuguagaaugaccac

SEQ ID NO: 727300 - RNA, 21 nt, Human
uaaaaugcguuuuccccaguu

SEQ ID NO: 727301 - RNA, 25 nt, Human
uaaaaugcguuuuccccaguuugaa

SEQ ID NO: 727302 - RNA, 24 nt, Human
uaaauacaacaaaaucacaaaacc

SEQ ID NO: 727303 - RNA, 23 nt, Human
uaacaaaaaacauaaaaaacaca

SEQ ID NO: 727304 - RNA, 19 nt, Human
uaacccagaaaacaaacaa

SEQ ID NO: 727305 - RNA, 24 nt, Human
uaacucaaaucuuguauagaucaa

SEQ ID NO: 727306 - RNA, 22 nt, Human
uaagauaacuauuaaccuccga

SEQ ID NO: 727307 - RNA, 22 nt, Human
uaaguagauucacaauauucaa

SEQ ID NO: 727308 - RNA, 21 nt, Human
uacagucaugauuucagaauc

SEQ ID NO: 727309 - RNA, 24 nt, Human
uacuauaggaaaaagaaaccaagc

SEQ ID NO: 727310 - RNA, 18 nt, Human
uacucagaagcagaacga

SEQ ID NO: 727311 - RNA, 21 nt, Human
uagcauauauuacacucuggc

SEQ ID NO: 727312 - RNA, 20 nt, Human
uagcauuacagcaaauaaca

SEQ ID NO: 727313 - RNA, 21 nt, Human
uaguuucacuauuagaaagca

SEQ ID NO: 727314 - RNA, 22 nt, Human
uauauaacugacauuucucaag

SEQ ID NO: 727315 - RNA, 21 nt, Human
uauggcaagucaauucuguca

SEQ ID NO: 727316 - RNA, 19 nt, Human
ucaaaggaaucaaucccau

SEQ ID NO: 727317 - RNA, 24 nt, Human
ucaaucccagauacauugcuaaaa

SEQ ID NO: 727318 - RNA, 23 nt, Human
ucacagacaaaauuaaagccuau

SEQ ID NO: 727319 - RNA, 20 nt, Human
ucacuguuguuuagcuucuc

SEQ ID NO: 727320 - RNA, 18 nt, Human
ucagauacaugauauuuu

SEQ ID NO: 727321 - RNA, 23 nt, Human
uccaaugagagguucuuauuucc

SEQ ID NO: 727322 - RNA, 22 nt, Human
uccaguuugagaucacuuugag

SEQ ID NO: 727323 - RNA, 24 nt, Human
ucccuccauaacuuaacaacgcaa

SEQ ID NO: 727324 - RNA, 21 nt, Human
uccugcucuugcuguucuguu

SEQ ID NO: 727325 - RNA, 24 nt, Human
ucuaaagggcauuuauagcauuac

SEQ ID NO: 727326 - RNA, 21 nt, Human
ucuacccucaucuagaugguc

SEQ ID NO: 727327 - RNA, 18 nt, Human
ucuauucuuaagcucugc

SEQ ID NO: 727328 - RNA, 19 nt, Human
ucuucaaaauuugguuuag

SEQ ID NO: 727329 - RNA, 20 nt, Human
ugacauuucucaaguucuau

SEQ ID NO: 727330 - RNA, 21 nt, Human
ugacuggccaaagugaaaucu

SEQ ID NO: 727331 - RNA, 22 nt, Human
ugacugggaaggccugggagac

SEQ ID NO: 727332 - RNA, 20 nt, Human
ugcacaccacagcccucagc

SEQ ID NO: 727333 - RNA, 25 nt, Human
ugcuacauuacaccacuuaucaccu

SEQ ID NO: 727334 - RNA, 18 nt, Human
ugcucacacaaauggaag

SEQ ID NO: 727335 - RNA, 22 nt, Human
uggaacucucagaaagacacau

SEQ ID NO: 727336 - RNA, 18 nt, Human
uggcaagaauagcaucaa

SEQ ID NO: 727337 - RNA, 22 nt, Human
ugguuauuucuaagucacauuu

SEQ ID NO: 727338 - RNA, 21 nt, Human
ugucaaguucugccaacaugg

SEQ ID NO: 727339 - RNA, 18 nt, Human
ugucacagguuaauagga

SEQ ID NO: 727340 - RNA, 19 nt, Human
uguuaagagcgacagaaca

SEQ ID NO: 727341 - RNA, 25 nt, Human
uuaaacacacacacacacacaaacc

SEQ ID NO: 727342 - RNA, 22 nt, Human
uuaaauacaacaaaaucacaaa

SEQ ID NO: 727343 - RNA, 24 nt, Human
uuaaauacaacaaaaucacaaaac

SEQ ID NO: 727344 - RNA, 19 nt, Human
uuaaauguccaaaccuaca

SEQ ID NO: 727345 - RNA, 25 nt, Human
uuaacacuacaccuuaaauguccaa

SEQ ID NO: 727346 - RNA, 21 nt, Human
uucaaaccugacaaaagggau

SEQ ID NO: 727347 - RNA, 24 nt, Human
uugaaugcaaucuaaauauguauu

SEQ ID NO: 727348 - RNA, 23 nt, Human
uuuccaugucaccaauuauuuuc

SEQ ID NO: 727349 - RNA, 19 nt, Human
uuuccugcucuugcuguuc

SEQ ID NO: 727350 - RNA, 23 nt, Human
uuuccugcucuugcuguucuguu

SEQ ID NO: 727351 - RNA, 21 nt, Human
uuugagaucacuuugagaaua

SEQ ID NO: 727352 - RNA, 23 nt, Human
uuuucaggaggcuugggaagcac

SEQ ID NO: 727353 - RNA, 19 nt, Human
aaacaaagcaucccggugu

SEQ ID NO: 727354 - RNA, 18 nt, Human
aaacacagugcugccgac

SEQ ID NO: 727355 - RNA, 22 nt, Human
aaacccgggaagcgucugagug

SEQ ID NO: 727356 - RNA, 18 nt, Human
aaagaggagaccgggggc

SEQ ID NO: 727357 - RNA, 22 nt, Human
aagaggagaccgggggcggagc

SEQ ID NO: 727358 - RNA, 19 nt, Human
aagcccagagggugagcag

SEQ ID NO: 727359 - RNA, 22 nt, Human
acaaacaaagcaucccggugug

SEQ ID NO: 727360 - RNA, 19 nt, Human
acaaaugaccugguuucug

SEQ ID NO: 727361 - RNA, 19 nt, Human
acaagcgcaccacccagag

SEQ ID NO: 727362 - RNA, 22 nt, Human
acaaggugcugauugguguguu

SEQ ID NO: 727363 - RNA, 19 nt, Human
acagacccagcagccucca

SEQ ID NO: 727364 - RNA, 28 nt, Human
acagacccagcagccuccacccgaccca

SEQ ID NO: 727365 - RNA, 24 nt, Human
accacccagagcggugaccacacc

SEQ ID NO: 727366 - RNA, 20 nt, Human
acccagagcggugaccacac

SEQ ID NO: 727367 - RNA, 24 nt, Human
acccaguggauccugcacaggggc

SEQ ID NO: 727368 - RNA, 24 nt, Human
accccgcgguucggcucgggcauc

SEQ ID NO: 727369 - RNA, 19 nt, Human
acccgaguggguugucacu

SEQ ID NO: 727370 - RNA, 21 nt, Human
accuccccuucgcgcgaaucc

SEQ ID NO: 727371 - RNA, 19 nt, Human
accuggcggugaggacccc

SEQ ID NO: 727372 - RNA, 20 nt, Human
accugggggggacaccuggg

SEQ ID NO: 727373 - RNA, 24 nt, Human
acgaaccucggaaacuccaggagg

SEQ ID NO: 727374 - RNA, 22 nt, Human
acucgccgauggcccacaccac

SEQ ID NO: 727375 - RNA, 24 nt, Human
agaaggcuggcaccagcgcuggcc

SEQ ID NO: 727376 - RNA, 21 nt, Human
agagcaaaagaggagaccggg

SEQ ID NO: 727377 - RNA, 19 nt, Human
agcaagcuggcugcccagg

SEQ ID NO: 727378 - RNA, 20 nt, Human
agcacacugcccagaaagcc

SEQ ID NO: 727379 - RNA, 20 nt, Human
agcagcaguggcacgccggg

SEQ ID NO: 727380 - RNA, 21 nt, Human
agcagcaguggcacgccgggc

SEQ ID NO: 727381 - RNA, 25 nt, Human
agccugggggcggggcgugaggcuc

SEQ ID NO: 727382 - RNA, 24 nt, Human
agcgcaccacccagagcggugacc

SEQ ID NO: 727383 - RNA, 23 nt, Human
agcggugaccacacccgggaacu

SEQ ID NO: 727384 - RNA, 23 nt, Human
agcuccacucagguggcucccug

SEQ ID NO: 727385 - RNA, 22 nt, Human
agcuggccugggcgguggcccc

SEQ ID NO: 727386 - RNA, 22 nt, Human
aggaacccacggaggggagggg

SEQ ID NO: 727387 - RNA, 25 nt, Human
aggaacccacggaggggagggggga

SEQ ID NO: 727388 - RNA, 18 nt, Human
aggacucccgcgcccucc

SEQ ID NO: 727389 - RNA, 20 nt, Human
aggccgcgggggacaccagc

SEQ ID NO: 727390 - RNA, 22 nt, Human
aggccggccucccucuccacca

SEQ ID NO: 727391 - RNA, 19 nt, Human
aggcugcggacuuagcacc

SEQ ID NO: 727392 - RNA, 22 nt, Human
aggcugcggacuuagcaccagc

SEQ ID NO: 727393 - RNA, 24 nt, Human
aggcugucacuucucacuuucacu

SEQ ID NO: 727394 - RNA, 22 nt, Human
agggcugugaggacugccagca

SEQ ID NO: 727395 - RNA, 19 nt, Human
aggggaggugggcggggcc

SEQ ID NO: 727396 - RNA, 19 nt, Human
aggggcucccacagugcag

SEQ ID NO: 727397 - RNA, 27 nt, Human
aggggcucccacagugcaguggcgggg

SEQ ID NO: 727398 - RNA, 21 nt, Human
agguccccagcccugccccgc

SEQ ID NO: 727399 - RNA, 20 nt, Human
agguggcggggcuggggccc

SEQ ID NO: 727400 - RNA, 25 nt, Human
agugcaguggcgggcugaagggcuc

SEQ ID NO: 727401 - RNA, 21 nt, Human
auacagaguguugacaaaaag

SEQ ID NO: 727402 - RNA, 21 nt, Human
auagaggaacacagaagacug

SEQ ID NO: 727403 - RNA, 20 nt, Human
aucagaucuuggcuccggga

SEQ ID NO: 727404 - RNA, 19 nt, Human
aucccgagacccgcgcacu

SEQ ID NO: 727405 - RNA, 20 nt, Human
aucgcaggccgcgggggaca

SEQ ID NO: 727406 - RNA, 19 nt, Human
aucuuggcuccgggaggcc

SEQ ID NO: 727407 - RNA, 24 nt, Human
augaggccggccucccucuccacc

SEQ ID NO: 727408 - RNA, 22 nt, Human
caaaaacaaaagacuaggaaac

SEQ ID NO: 727409 - RNA, 22 nt, Human
caagggcaucaaaaggggcauu

SEQ ID NO: 727410 - RNA, 20 nt, Human
cacaaaugaccugguuucug

SEQ ID NO: 727411 - RNA, 25 nt, Human
cacagagcccacgcccacccggaac

SEQ ID NO: 727412 - RNA, 21 nt, Human
caccagacucaggagcccagc

SEQ ID NO: 727413 - RNA, 23 nt, Human
caccagcgcuggccucaggcccc

SEQ ID NO: 727414 - RNA, 23 nt, Human
caccgcgccucucccuccacacc

SEQ ID NO: 727415 - RNA, 19 nt, Human
caccgugggccuugccucc

SEQ ID NO: 727416 - RNA, 18 nt, Human
caccuccccuucgcgcga

SEQ ID NO: 727417 - RNA, 20 nt, Human
caccugaagguugcuccucc

SEQ ID NO: 727418 - RNA, 24 nt, Human
cacgcacgccuugguaugcacagu

SEQ ID NO: 727419 - RNA, 21 nt, Human
cacucgcccccuccauagucc

SEQ ID NO: 727420 - RNA, 20 nt, Human
cacugggaagugaucccgag

SEQ ID NO: 727421 - RNA, 19 nt, Human
cacuggggagaaggcuggc

SEQ ID NO: 727422 - RNA, 19 nt, Human
cagagcggugaccacaccc

SEQ ID NO: 727423 - RNA, 22 nt, Human
cagagcuaugggggauuggggg

SEQ ID NO: 727424 - RNA, 19 nt, Human
cagaggaggcgccaagagc

SEQ ID NO: 727425 - RNA, 19 nt, Human
cagaguggggagggggaag

SEQ ID NO: 727426 - RNA, 21 nt, Human
cagcacacugcccagaaagcc

SEQ ID NO: 727427 - RNA, 22 nt, Human
cagcagcugcugguccaggugc

SEQ ID NO: 727428 - RNA, 23 nt, Human
cagcuaaggcccagugagaaauc

SEQ ID NO: 727429 - RNA, 19 nt, Human
cagcuccaccaccagggag

SEQ ID NO: 727430 - RNA, 23 nt, Human
caggaacugagaacucagcacac

SEQ ID NO: 727431 - RNA, 19 nt, Human
cagggcaggaggggagcug

SEQ ID NO: 727432 - RNA, 21 nt, Human
caguggcgggcugaagggcuc

SEQ ID NO: 727433 - RNA, 19 nt, Human
caguuguacacgugcgcug

SEQ ID NO: 727434 - RNA, 18 nt, Human
caucgcaggccgcggggg

SEQ ID NO: 727435 - RNA, 19 nt, Human
caucgcggugauagcgggg

SEQ ID NO: 727436 - RNA, 22 nt, Human
cauguccccaccagauuaacua

SEQ ID NO: 727437 - RNA, 24 nt, Human
ccaaaaacaaaagacuaggaaaca

SEQ ID NO: 727438 - RNA, 19 nt, Human
ccacacccacugcugcagg

SEQ ID NO: 727439 - RNA, 18 nt, Human
ccacccgacccagccaca

SEQ ID NO: 727440 - RNA, 19 nt, Human
ccacccgacccagccacag

SEQ ID NO: 727441 - RNA, 22 nt, Human
ccaccgugggccuugccuccuc

SEQ ID NO: 727442 - RNA, 23 nt, Human
ccagccuuuccugcggccccggc

SEQ ID NO: 727443 - RNA, 18 nt, Human
ccaggacacccccgacgc

SEQ ID NO: 727444 - RNA, 23 nt, Human
ccaggggcagggccguguuggca

SEQ ID NO: 727445 - RNA, 23 nt, Human
cccacaccacgcuggugacgagg

SEQ ID NO: 727446 - RNA, 22 nt, Human
cccacacccacugcugcaggcg

SEQ ID NO: 727447 - RNA, 19 nt, Human
cccacagagcccacgccca

SEQ ID NO: 727448 - RNA, 21 nt, Human
cccacagagcccacgcccacc

SEQ ID NO: 727449 - RNA, 21 nt, Human
cccaccgcgccucucccucca

SEQ ID NO: 727450 - RNA, 24 nt, Human
cccagcccugccccgcaggaaggc

SEQ ID NO: 727451 - RNA, 20 nt, Human
cccaggaagguggcggggcu

SEQ ID NO: 727452 - RNA, 23 nt, Human
cccaggcagaggaggcgccaaga

SEQ ID NO: 727453 - RNA, 20 nt, Human
cccccacacccacugcugca

SEQ ID NO: 727454 - RNA, 21 nt, Human
ccccggcucagcggcccuggg

SEQ ID NO: 727455 - RNA, 19 nt, Human
cccgugcccugcuccaaag

SEQ ID NO: 727456 - RNA, 18 nt, Human
cccuccacaccuccccgc

SEQ ID NO: 727457 - RNA, 23 nt, Human
cccuccacaccuccccgcaagcu

SEQ ID NO: 727458 - RNA, 22 nt, Human
cccugcuccaaaggcacuccuc

SEQ ID NO: 727459 - RNA, 23 nt, Human
cccugggcuggggucaugcccuc

SEQ ID NO: 727460 - RNA, 23 nt, Human
cccuuuucccagcugccuccugg

SEQ ID NO: 727461 - RNA, 19 nt, Human
ccgauggcccacaccacgc

SEQ ID NO: 727462 - RNA, 21 nt, Human
ccgccaccagacgcgcacgaa

SEQ ID NO: 727463 - RNA, 22 nt, Human
ccggcucagcggcccugggcug

SEQ ID NO: 727464 - RNA, 18 nt, Human
ccggcuccggccuuggcc

SEQ ID NO: 727465 - RNA, 18 nt, Human
ccguguuggcaucgcggu

SEQ ID NO: 727466 - RNA, 22 nt, Human
ccuaugaccccauccccaucca

SEQ ID NO: 727467 - RNA, 21 nt, Human
ccuccacaccuccccgcaagc

SEQ ID NO: 727468 - RNA, 26 nt, Human
ccuccaggacuggcagcagcugccag

SEQ ID NO: 727469 - RNA, 22 nt, Human
ccuccagggcuucgaagaacuu

SEQ ID NO: 727470 - RNA, 20 nt, Human
ccuccucucccaggacuccc

SEQ ID NO: 727471 - RNA, 23 nt, Human
ccucggaaacuccaggagcugca

SEQ ID NO: 727472 - RNA, 18 nt, Human
ccucucccuccacaccuc

SEQ ID NO: 727473 - RNA, 21 nt, Human
ccucucccuccacaccucccc

SEQ ID NO: 727474 - RNA, 19 nt, Human
ccugcauaggccauggcgc

SEQ ID NO: 727475 - RNA, 18 nt, Human
ccugccccgcaggaaggc

SEQ ID NO: 727476 - RNA, 20 nt, Human
cgacccagccacagggccuc

SEQ ID NO: 727477 - RNA, 19 nt, Human
cgcaagcaccgcgugcagc

SEQ ID NO: 727478 - RNA, 22 nt, Human
cgcaccacccagagcggugacc

SEQ ID NO: 727479 - RNA, 20 nt, Human
cgcugcccaggaacuccagc

SEQ ID NO: 727480 - RNA, 22 nt, Human
cgcugcugcacaggcugcggac

SEQ ID NO: 727481 - RNA, 21 nt, Human
cggcugaccgugcgcagggcc

SEQ ID NO: 727482 - RNA, 24 nt, Human
cggggcgugaggcucucggggcgg

SEQ ID NO: 727483 - RNA, 19 nt, Human
cguggagcugguggcugga

SEQ ID NO: 727484 - RNA, 26 nt, Human
cuaggaaacagacccagcagccucca

SEQ ID NO: 727485 - RNA, 18 nt, Human
cuccaggagcugcagccc

SEQ ID NO: 727486 - RNA, 19 nt, Human
cucccacagugcaguggcg

SEQ ID NO: 727487 - RNA, 19 nt, Human
cucccgcgcccuccugagc

SEQ ID NO: 727488 - RNA, 18 nt, Human
cucccugggcugggguca

SEQ ID NO: 727489 - RNA, 23 nt, Human
cucccuggggccuucccuccgaa

SEQ ID NO: 727490 - RNA, 22 nt, Human
cucugugcagaccuaugacccc

SEQ ID NO: 727491 - RNA, 20 nt, Human
cugcccaggaacuccagcag

SEQ ID NO: 727492 - RNA, 19 nt, Human
cugggggggacaccugggc

SEQ ID NO: 727493 - RNA, 24 nt, Human
cuguggggcaggcgagcgcuuccu

SEQ ID NO: 727494 - RNA, 18 nt, Human
gaaccucggaaacuccag

SEQ ID NO: 727495 - RNA, 21 nt, Human
gaagguugcuccucccugggc

SEQ ID NO: 727496 - RNA, 24 nt, Human
gacacaaagguucuccaugucccc

SEQ ID NO: 727497 - RNA, 21 nt, Human
gagcaaaaggcucggagacaa

SEQ ID NO: 727498 - RNA, 20 nt, Human
gagccagaguggggaggggg

SEQ ID NO: 727499 - RNA, 21 nt, Human
gagccugggggcggggcguga

SEQ ID NO: 727500 - RNA, 24 nt, Human
gagcuggugagcuuugcccuuuuc

SEQ ID NO: 727501 - RNA, 20 nt, Human
gagggggaagaguuugagcc

SEQ ID NO: 727502 - RNA, 20 nt, Human
gaguggggagggggaagagu

SEQ ID NO: 727503 - RNA, 25 nt, Human
gcagccccacgcucucugagcuucg

SEQ ID NO: 727504 - RNA, 25 nt, Human
gccagcgccagccuuuccugcggcc

SEQ ID NO: 727505 - RNA, 18 nt, Human
gccagggguucccauccc

SEQ ID NO: 727506 - RNA, 18 nt, Human
gcccagacaccuccccuu

SEQ ID NO: 727507 - RNA, 21 nt, Human
gcccagacaccuccccuucgc

SEQ ID NO: 727508 - RNA, 21 nt, Human
gccggaggggaggugggcggg

SEQ ID NO: 727509 - RNA, 19 nt, Human
gccucagagaaacuguucu

SEQ ID NO: 727510 - RNA, 19 nt, Human
gccucccucuccaccagcc

SEQ ID NO: 727511 - RNA, 18 nt, Human
gcgggcugcaggucccca

SEQ ID NO: 727512 - RNA, 21 nt, Human
gcuagacacaaagguucucca

SEQ ID NO: 727513 - RNA, 19 nt, Human
gcuagauacagagugucua

SEQ ID NO: 727514 - RNA, 22 nt, Human
gcugguggcuggacugugagcc

SEQ ID NO: 727515 - RNA, 22 nt, Human
ggaaacagacccagcagccucc

SEQ ID NO: 727516 - RNA, 23 nt, Human
ggaaacuccaggagcugcagccc

SEQ ID NO: 727517 - RNA, 22 nt, Human
ggaacgcgacccaaggcccagg

SEQ ID NO: 727518 - RNA, 19 nt, Human
ggaggggaggugggcgggg

SEQ ID NO: 727519 - RNA, 18 nt, Human
ggcaggaggggagcugcg

SEQ ID NO: 727520 - RNA, 18 nt, Human
ggcagggcagcagagggg

SEQ ID NO: 727521 - RNA, 19 nt, Human
ggccagcccugaaaggggc

SEQ ID NO: 727522 - RNA, 18 nt, Human
ggccauggcgcuugcaac

SEQ ID NO: 727523 - RNA, 20 nt, Human
ggccauggcgcuugcaaccc

SEQ ID NO: 727524 - RNA, 19 nt, Human
ggccccacccacauccugc

SEQ ID NO: 727525 - RNA, 25 nt, Human
ggccggaggggaggugggcggggcc

SEQ ID NO: 727526 - RNA, 18 nt, Human
ggcggcggcgcccccugg

SEQ ID NO: 727527 - RNA, 21 nt, Human
ggcucccacagugcaguggcg

SEQ ID NO: 727528 - RNA, 21 nt, Human
ggcucggagacaaagcccaga

SEQ ID NO: 727529 - RNA, 25 nt, Human
gggaacucgcgccgcugccuuccgg

SEQ ID NO: 727530 - RNA, 19 nt, Human
gggaagaguuugagccugg

SEQ ID NO: 727531 - RNA, 20 nt, Human
gggaggccagcuucgucagc

SEQ ID NO: 727532 - RNA, 18 nt, Human
gggccagccccgcguguc

SEQ ID NO: 727533 - RNA, 20 nt, Human
gggccgaggccggaggggag

SEQ ID NO: 727534 - RNA, 24 nt, Human
gggcggcacugggugaccucgaau

SEQ ID NO: 727535 - RNA, 21 nt, Human
gggcggggccgaggccggagg

SEQ ID NO: 727536 - RNA, 19 nt, Human
ggggauugggggcggggcc

SEQ ID NO: 727537 - RNA, 21 nt, Human
ggggggacaccugggcagggc

SEQ ID NO: 727538 - RNA, 21 nt, Human
ggguucccaucccugguccuc

SEQ ID NO: 727539 - RNA, 18 nt, Human
gguggcggggcuggggcc

SEQ ID NO: 727540 - RNA, 20 nt, Human
gguucccaccgcgccucucc

SEQ ID NO: 727541 - RNA, 19 nt, Human
gucucuugccagcuccacc

SEQ ID NO: 727542 - RNA, 22 nt, Human
gugagcaggggggccagccccg

SEQ ID NO: 727543 - RNA, 23 nt, Human
gugcgacacagcugugccuuggu

SEQ ID NO: 727544 - RNA, 19 nt, Human
uaagccccucacugcccag

SEQ ID NO: 727545 - RNA, 21 nt, Human
uagcaagcuggcugcccaggc

SEQ ID NO: 727546 - RNA, 19 nt, Human
uagcagcaguggcacgccg

SEQ ID NO: 727547 - RNA, 18 nt, Human
uaggcaucuucagcaggg

SEQ ID NO: 727548 - RNA, 21 nt, Human
ucacuggggagaaggcuggca

SEQ ID NO: 727549 - RNA, 18 nt, Human
ucagcagcucuguggccc

SEQ ID NO: 727550 - RNA, 19 nt, Human
ucagguggcucccuggggc

SEQ ID NO: 727551 - RNA, 25 nt, Human
uccaaaaacaaaagacuaggaaaca

SEQ ID NO: 727552 - RNA, 19 nt, Human
uccaaguccccaccagacu

SEQ ID NO: 727553 - RNA, 21 nt, Human
uccccagggugcagggcaggu

SEQ ID NO: 727554 - RNA, 20 nt, Human
ucccgcgcccuccugagcuc

SEQ ID NO: 727555 - RNA, 21 nt, Human
ucccuccacaccuccccgcaa

SEQ ID NO: 727556 - RNA, 20 nt, Human
ucccugggcuggggucaugc

SEQ ID NO: 727557 - RNA, 19 nt, Human
uccgaggcccuguggccau

SEQ ID NO: 727558 - RNA, 22 nt, Human
uccgaggcccuguggccaugag

SEQ ID NO: 727559 - RNA, 20 nt, Human
uccggagggugggaccacag

SEQ ID NO: 727560 - RNA, 23 nt, Human
uccgugcugggugugagcacaaa

SEQ ID NO: 727561 - RNA, 19 nt, Human
ucgagcacagcagcugcug

SEQ ID NO: 727562 - RNA, 18 nt, Human
ucgccgauggcccacacc

SEQ ID NO: 727563 - RNA, 19 nt, Human
ucgcgccgcugccuuccgg

SEQ ID NO: 727564 - RNA, 19 nt, Human
ucuccaaguccccaccaga

SEQ ID NO: 727565 - RNA, 22 nt, Human
ucucccaggacucccgcgcccu

SEQ ID NO: 727566 - RNA, 22 nt, Human
ucucccuccacaccuccccgca

SEQ ID NO: 727567 - RNA, 24 nt, Human
ucugcuccacggugcaccuccgau

SEQ ID NO: 727568 - RNA, 24 nt, Human
ucuggccccacccacauccugcug

SEQ ID NO: 727569 - RNA, 24 nt, Human
ugacaaaaagguuuuccaaguccc

SEQ ID NO: 727570 - RNA, 21 nt, Human
ugaccacacccgggaacucgc

SEQ ID NO: 727571 - RNA, 20 nt, Human
ugaccugguuucuguagcag

SEQ ID NO: 727572 - RNA, 24 nt, Human
ugagaacucagcacacugcccaga

SEQ ID NO: 727573 - RNA, 20 nt, Human
ugagcaggggggccagcccc

SEQ ID NO: 727574 - RNA, 25 nt, Human
ugagcuagacacaaagguucuccaa

SEQ ID NO: 727575 - RNA, 19 nt, Human
ugcaaagagcgaacaaaca

SEQ ID NO: 727576 - RNA, 23 nt, Human
ugcacaaaugaccugguuucugu

SEQ ID NO: 727577 - RNA, 21 nt, Human
ugcaccgaagucccuggccac

SEQ ID NO: 727578 - RNA, 18 nt, Human
ugcaguggcgggcugaag

SEQ ID NO: 727579 - RNA, 22 nt, Human
ugccagcaggcugucacuucuc

SEQ ID NO: 727580 - RNA, 24 nt, Human
ugcccaggaacuccagcaggucuc

SEQ ID NO: 727581 - RNA, 20 nt, Human
ugcccugagcagguggcaac

SEQ ID NO: 727582 - RNA, 18 nt, Human
ugccugggagcaaaaggc

SEQ ID NO: 727583 - RNA, 20 nt, Human
ugccugggagcaaaaggcuc

SEQ ID NO: 727584 - RNA, 22 nt, Human
ugcggggcccacagagcccacg

SEQ ID NO: 727585 - RNA, 25 nt, Human
ugcugcacaggcugcggacuuagca

SEQ ID NO: 727586 - RNA, 30 nt, Human
ugcugccgacggaagcgccugccagcgccc

SEQ ID NO: 727587 - RNA, 25 nt, Human
uggaaacacaaacacagugcugccg

SEQ ID NO: 727588 - RNA, 19 nt, Human
uggaggccaccugaagguu

SEQ ID NO: 727589 - RNA, 22 nt, Human
uggcaacacucguuggggaggc

SEQ ID NO: 727590 - RNA, 18 nt, Human
uggcaccagcgcuggccu

SEQ ID NO: 727591 - RNA, 19 nt, Human
uggcacgccgggcugagcc

SEQ ID NO: 727592 - RNA, 19 nt, Human
uggcccggguacggauggc

SEQ ID NO: 727593 - RNA, 19 nt, Human
uggcggggcuagccggcgg

SEQ ID NO: 727594 - RNA, 23 nt, Human
uggcuggacugugagccaggguc

SEQ ID NO: 727595 - RNA, 18 nt, Human
uggcuuccgcgcccuccu

SEQ ID NO: 727596 - RNA, 21 nt, Human
ugggcagggcagcagaggggc

SEQ ID NO: 727597 - RNA, 19 nt, Human
uggggagaaggcuggcacc

SEQ ID NO: 727598 - RNA, 21 nt, Human
ugggggauugggggcggggcc

SEQ ID NO: 727599 - RNA, 20 nt, Human
uggggucaugcccuccgagg

SEQ ID NO: 727600 - RNA, 23 nt, Human
ugggugaccucgaauagcagagc

SEQ ID NO: 727601 - RNA, 27 nt, Human
ugguagguguaugcugcacccuccucu

SEQ ID NO: 727602 - RNA, 24 nt, Human
uguaaaucugaaaaacuauucuaa

SEQ ID NO: 727603 - RNA, 22 nt, Human
ugucacugcuggcucgggcagc

SEQ ID NO: 727604 - RNA, 18 nt, Human
uguguuuacaaaccuuga

SEQ ID NO: 727605 - RNA, 21 nt, Human
uguguuuacaaaccuugagcu

SEQ ID NO: 727606 - RNA, 21 nt, Human
uucaagggcaucaaaaggggc

SEQ ID NO: 727607 - RNA, 18 nt, Human
uucuugcccaucaacugu

SEQ ID NO: 727608 - RNA, 22 nt, Human
uugcaacccucccccggucccc

SEQ ID NO: 727609 - RNA, 20 nt, Human
uugcuccucccugggcuggg

SEQ ID NO: 727610 - RNA, 20 nt, Human
aaaaauguggcauccuuauc

SEQ ID NO: 727611 - RNA, 23 nt, Human
aaaaccccaucaaaaaacaaaag

SEQ ID NO: 727612 - RNA, 26 nt, Human
aaaagcagaagaaagagguuuaaacc

SEQ ID NO: 727613 - RNA, 23 nt, Human
aaacacaaauggacaaaaaugaa

SEQ ID NO: 727614 - RNA, 19 nt, Human
aaaccccaucaaaaaacaa

SEQ ID NO: 727615 - RNA, 20 nt, Human
aaaugaaagaaaaucuugcc

SEQ ID NO: 727616 - RNA, 21 nt, Human
aacaagagacaaaauacucac

SEQ ID NO: 727617 - RNA, 24 nt, Human
aaccugugcugauucugaaacaca

SEQ ID NO: 727618 - RNA, 20 nt, Human
aagcauugguuucauuuucu

SEQ ID NO: 727619 - RNA, 19 nt, Human
aauaucuacuaacccaggc

SEQ ID NO: 727620 - RNA, 18 nt, Human
accagucuucagcauaca

SEQ ID NO: 727621 - RNA, 23 nt, Human
acucagcuuauuagaauuacauu

SEQ ID NO: 727622 - RNA, 18 nt, Human
agagcuccuggagcagca

SEQ ID NO: 727623 - RNA, 19 nt, Human
agagucagauuucaaaauc

SEQ ID NO: 727624 - RNA, 20 nt, Human
aggaaaaagcagaagaaagg

SEQ ID NO: 727625 - RNA, 23 nt, Human
aggaagugugccuuaagaaaaug

SEQ ID NO: 727626 - RNA, 24 nt, Human
aguaaauaccaaauuaucauacaa

SEQ ID NO: 727627 - RNA, 24 nt, Human
aguggguagugguggugaagagga

SEQ ID NO: 727628 - RNA, 18 nt, Human
agugguggugaagaggau

SEQ ID NO: 727629 - RNA, 18 nt, Human
auaugaaaaguaugcccc

SEQ ID NO: 727630 - RNA, 19 nt, Human
auauuaaagagucacucag

SEQ ID NO: 727631 - RNA, 22 nt, Human
augaaagaaaaucuugccuucu

SEQ ID NO: 727632 - RNA, 18 nt, Human
auuuauagcuuuuucccc

SEQ ID NO: 727633 - RNA, 22 nt, Human
caacugaauugaacugggcuga

SEQ ID NO: 727634 - RNA, 18 nt, Human
caccuuaaaaaagagcac

SEQ ID NO: 727635 - RNA, 25 nt, Human
cacuguguaaccaagauccgcagcu

SEQ ID NO: 727636 - RNA, 20 nt, Human
cacuguguggcugcauaggc

SEQ ID NO: 727637 - RNA, 20 nt, Human
cacuucagaaaaagaacagg

SEQ ID NO: 727638 - RNA, 20 nt, Human
cagaaaaauggaaggcaaaa

SEQ ID NO: 727639 - RNA, 21 nt, Human
cagaagaaagagguuuaaacc

SEQ ID NO: 727640 - RNA, 21 nt, Human
cagcagguccuuucccuguuu

SEQ ID NO: 727641 - RNA, 21 nt, Human
cagugagucuguaaaaggcuc

SEQ ID NO: 727642 - RNA, 22 nt, Human
cauacaugaaauucuacuuccc

SEQ ID NO: 727643 - RNA, 21 nt, Human
cccugaaugaaggauaucaug

SEQ ID NO: 727644 - RNA, 19 nt, Human
ccucuggaaagcauugguu

SEQ ID NO: 727645 - RNA, 23 nt, Human
ccucuucccuuuucagcagcagg

SEQ ID NO: 727646 - RNA, 21 nt, Human
cuaaaugccacaaaaaucaug

SEQ ID NO: 727647 - RNA, 23 nt, Human
cuaaaugccacaaaaaucauguc

SEQ ID NO: 727648 - RNA, 23 nt, Human
cuaacauguaggagccuuugacc

SEQ ID NO: 727649 - RNA, 22 nt, Human
cuagauggguaugguaucauaa

SEQ ID NO: 727650 - RNA, 21 nt, Human
cuccuggagcagcaugagugc

SEQ ID NO: 727651 - RNA, 19 nt, Human
cugaaugaaggauaucaug

SEQ ID NO: 727652 - RNA, 21 nt, Human
cuguccuucagggcugaugga

SEQ ID NO: 727653 - RNA, 19 nt, Human
cuugcaucuaaauuccaaa

SEQ ID NO: 727654 - RNA, 19 nt, Human
cuuucuaaauuguuuucag

SEQ ID NO: 727655 - RNA, 22 nt, Human
gaaaucauaauacaagaaacug

SEQ ID NO: 727656 - RNA, 24 nt, Human
gaacaauguuuauggaaaaguucu

SEQ ID NO: 727657 - RNA, 23 nt, Human
gagugugugugugugugugugug

SEQ ID NO: 727658 - RNA, 19 nt, Human
gauuaauuauuuuucuggu

SEQ ID NO: 727659 - RNA, 18 nt, Human
gcagagaagagcuccugg

SEQ ID NO: 727660 - RNA, 19 nt, Human
gcagcaugagugcauuuac

SEQ ID NO: 727661 - RNA, 19 nt, Human
gccuuaacauguuuucagu

SEQ ID NO: 727662 - RNA, 22 nt, Human
gcuacagaaaugaauauaaacg

SEQ ID NO: 727663 - RNA, 19 nt, Human
gcucuuugagguuugaaga

SEQ ID NO: 727664 - RNA, 20 nt, Human
gcucuuugagguuugaagau

SEQ ID NO: 727665 - RNA, 22 nt, Human
gggaagaaaaaauaugcccuga

SEQ ID NO: 727666 - RNA, 21 nt, Human
gggaaguagggcgcugugcuc

SEQ ID NO: 727667 - RNA, 19 nt, Human
guaaaaauuagauauguau

SEQ ID NO: 727668 - RNA, 24 nt, Human
gugugugugcuuuuaaauuggagg

SEQ ID NO: 727669 - RNA, 18 nt, Human
gugugugugugugugugc

SEQ ID NO: 727670 - RNA, 22 nt, Human
gugugugugugugugugcuuuu

SEQ ID NO: 727671 - RNA, 21 nt, Human
gugugugugugugugugugug

SEQ ID NO: 727672 - RNA, 21 nt, Human
gugugugugugugugugugug

SEQ ID NO: 727673 - RNA, 21 nt, Human
guuagacucaacgcagugagu

SEQ ID NO: 727674 - RNA, 24 nt, Human
uaaaacaguugucuaaaugccaca

SEQ ID NO: 727675 - RNA, 22 nt, Human
uaaaaccccaucaaaaaacaaa

SEQ ID NO: 727676 - RNA, 21 nt, Human
uaaaaucaaguuagugcuaua

SEQ ID NO: 727677 - RNA, 22 nt, Human
uacccaucucuuaguauuaaag

SEQ ID NO: 727678 - RNA, 19 nt, Human
uaggagccuuugaccaguu

SEQ ID NO: 727679 - RNA, 19 nt, Human
uaggauaucccucuggaaa

SEQ ID NO: 727680 - RNA, 23 nt, Human
uaguugugguacaugggauggag

SEQ ID NO: 727681 - RNA, 22 nt, Human
uaucuccaaaauaucuucuaaa

SEQ ID NO: 727682 - RNA, 19 nt, Human
uaugaaaaguaugccccca

SEQ ID NO: 727683 - RNA, 18 nt, Human
uauuaaagagucacucag

SEQ ID NO: 727684 - RNA, 24 nt, Human
ucaaagcuucagucucauuuccgc

SEQ ID NO: 727685 - RNA, 20 nt, Human
ucaauaagauaugaaaagua

SEQ ID NO: 727686 - RNA, 19 nt, Human
ucaggaaaaagcagaagaa

SEQ ID NO: 727687 - RNA, 23 nt, Human
ucagucaauuccauuuauugaau

SEQ ID NO: 727688 - RNA, 21 nt, Human
ucccuaaaucaguuuugaaua

SEQ ID NO: 727689 - RNA, 21 nt, Human
ucccuguuuggugcagauugu

SEQ ID NO: 727690 - RNA, 25 nt, Human
ucccuguuuggugcagauuguguau

SEQ ID NO: 727691 - RNA, 18 nt, Human
uccgcagcguugcuguga

SEQ ID NO: 727692 - RNA, 20 nt, Human
uccgcagcguugcugugaug

SEQ ID NO: 727693 - RNA, 23 nt, Human
ucuaacauguaggagccuuugac

SEQ ID NO: 727694 - RNA, 19 nt, Human
ucucuuggucuuaacuugu

SEQ ID NO: 727695 - RNA, 22 nt, Human
ucugagcacauuggaggcugca

SEQ ID NO: 727696 - RNA, 21 nt, Human
ucugccuuuccuuuuaauccc

SEQ ID NO: 727697 - RNA, 18 nt, Human
ucugugucccaggcuuuc

SEQ ID NO: 727698 - RNA, 21 nt, Human
ugaaugaguagcuugcaucua

SEQ ID NO: 727699 - RNA, 22 nt, Human
ugagaccuuuucacagucacuu

SEQ ID NO: 727700 - RNA, 24 nt, Human
ugagaccuuuucacagucacuugg

SEQ ID NO: 727701 - RNA, 20 nt, Human
ugagauucaucucaguggug

SEQ ID NO: 727702 - RNA, 24 nt, Human
ugagugcauuuacugaaaagcuuu

SEQ ID NO: 727703 - RNA, 23 nt, Human
ugauacagaaauuaacuuaggca

SEQ ID NO: 727704 - RNA, 26 nt, Human
ugcucaggacacaguuguguugugac

SEQ ID NO: 727705 - RNA, 21 nt, Human
uggaaagauggagucuagcuc

SEQ ID NO: 727706 - RNA, 19 nt, Human
uggaaucuugugugcucag

SEQ ID NO: 727707 - RNA, 21 nt, Human
uggggaaaagauaacuugaaa

SEQ ID NO: 727708 - RNA, 22 nt, Human
uguaacuccagcuaaccugaga

SEQ ID NO: 727709 - RNA, 22 nt, Human
uguauaaucauuguuggcugcc

SEQ ID NO: 727710 - RNA, 19 nt, Human
ugucuguggggaaguaggg

SEQ ID NO: 727711 - RNA, 22 nt, Human
ugugaccaagcugucugucacc

SEQ ID NO: 727712 - RNA, 23 nt, Human
ugugugugugugcuuuuaaauug

SEQ ID NO: 727713 - RNA, 18 nt, Human
ugugugugugugugugug

SEQ ID NO: 727714 - RNA, 18 nt, Human
ugugugugugugugugug

SEQ ID NO: 727715 - RNA, 18 nt, Human
ugugugugugugugugug

SEQ ID NO: 727716 - RNA, 18 nt, Human
ugugugugugugugugug

SEQ ID NO: 727717 - RNA, 18 nt, Human
ugugugugugugugugug

SEQ ID NO: 727718 - RNA, 18 nt, Human
ugugugugugugugugug

SEQ ID NO: 727719 - RNA, 18 nt, Human
ugugugugugugugugug

SEQ ID NO: 727720 - RNA, 21 nt, Human
ugugugugugugugugugugu

SEQ ID NO: 727721 - RNA, 21 nt, Human
ugugugugugugugugugugu

SEQ ID NO: 727722 - RNA, 21 nt, Human
ugugugugugugugugugugu

SEQ ID NO: 727723 - RNA, 21 nt, Human
ugugugugugugugugugugu

SEQ ID NO: 727724 - RNA, 21 nt, Human
ugugugugugugugugugugu

SEQ ID NO: 727725 - RNA, 21 nt, Human
ugugugugugugugugugugu

SEQ ID NO: 727726 - RNA, 21 nt, Human
ugugugugugugugugugugu

SEQ ID NO: 727727 - RNA, 21 nt, Human
ugugugugugugugugugugu

SEQ ID NO: 727728 - RNA, 21 nt, Human
ugugugugugugugugugugu

SEQ ID NO: 727729 - RNA, 21 nt, Human
ugugugugugugugugugugu

SEQ ID NO: 727730 - RNA, 21 nt, Human
ugugugugugugugugugugu

SEQ ID NO: 727731 - RNA, 21 nt, Human
ugugugugugugugugugugu

SEQ ID NO: 727732 - RNA, 22 nt, Human
ugugugugugugugugugugug

SEQ ID NO: 727733 - RNA, 22 nt, Human
ugugugugugugugugugugug

SEQ ID NO: 727734 - RNA, 22 nt, Human
ugugugugugugugugugugug

SEQ ID NO: 727735 - RNA, 22 nt, Human
ugugugugugugugugugugug

SEQ ID NO: 727736 - RNA, 18 nt, Human
uguuggggaaaagauaac

SEQ ID NO: 727737 - RNA, 24 nt, Human
uuaaaaauagaaaaaaaauggagu

SEQ ID NO: 727738 - RNA, 23 nt, Human
uuaaauugacucaguuugucuug

SEQ ID NO: 727739 - RNA, 21 nt, Human
uuagacuuuccaacaggagug

SEQ ID NO: 727740 - RNA, 18 nt, Human
uuaguacagauuuuuggc

SEQ ID NO: 727741 - RNA, 19 nt, Human
uuaguggcguugggaaguu

SEQ ID NO: 727742 - RNA, 22 nt, Human
uuaucauacaagagaacuuuac

SEQ ID NO: 727743 - RNA, 22 nt, Human
uucaguagaaaaaaauaguaua

SEQ ID NO: 727744 - RNA, 23 nt, Human
uuccaaauauuuaauagguuuuc

SEQ ID NO: 727745 - RNA, 19 nt, Human
uuccuguuuucuguguccc

SEQ ID NO: 727746 - RNA, 20 nt, Human
uucugugucccaggcuuucc

SEQ ID NO: 727747 - RNA, 18 nt, Human
uugcuuuuugaugcuggc

SEQ ID NO: 727748 - RNA, 22 nt, Human
uuggcugccuuguaacuccagc

SEQ ID NO: 727749 - RNA, 19 nt, Human
uuggugacuagcauuagaa

SEQ ID NO: 727750 - RNA, 19 nt, Human
uugugauuaaaucuuacug

SEQ ID NO: 727751 - RNA, 18 nt, Human
uuuccuguuuucuguguc

SEQ ID NO: 727752 - RNA, 18 nt, Human
uuuccuguuuucuguguc

SEQ ID NO: 727753 - RNA, 24 nt, Human
uuucugugucccaggcuuuccaag

SEQ ID NO: 727754 - RNA, 22 nt, Human
uuuuauuggaaagauggagucu

SEQ ID NO: 727755 - RNA, 21 nt, Human
aaaaaaaacugacuuaauaca

SEQ ID NO: 727756 - RNA, 20 nt, Human
aaaaagaagacauggucaaa

SEQ ID NO: 727757 - RNA, 23 nt, Human
aaaacauucccaguucccacuga

SEQ ID NO: 727758 - RNA, 25 nt, Human
aaaaguaucaucaacaaaaaucaag

SEQ ID NO: 727759 - RNA, 22 nt, Human
aaacaagaccaauggcaaccuc

SEQ ID NO: 727760 - RNA, 23 nt, Human
aaagcgcaucguagaaaccaaga

SEQ ID NO: 727761 - RNA, 18 nt, Human
aaccucauuuucuuaccc

SEQ ID NO: 727762 - RNA, 20 nt, Human
aacggagaucuguucaaagc

SEQ ID NO: 727763 - RNA, 23 nt, Human
aagaagacauggucaaaugaaau

SEQ ID NO: 727764 - RNA, 23 nt, Human
aagacauggucaaaugaaaugug

SEQ ID NO: 727765 - RNA, 21 nt, Human
aagagaacauuagcaaagaca

SEQ ID NO: 727766 - RNA, 19 nt, Human
aaggagcccaaaggggaca

SEQ ID NO: 727767 - RNA, 24 nt, Human
aaggagcccaaaggggacaccugc

SEQ ID NO: 727768 - RNA, 18 nt, Human
aaggagggauggauuugg

SEQ ID NO: 727769 - RNA, 24 nt, Human
aaguuuucaccugcuaagaaugug

SEQ ID NO: 727770 - RNA, 24 nt, Human
aauauucuaacauuauauguacau

SEQ ID NO: 727771 - RNA, 20 nt, Human
aaugcaaggcaggaaaggcu

SEQ ID NO: 727772 - RNA, 21 nt, Human
acaacuggggcugcagcucug

SEQ ID NO: 727773 - RNA, 20 nt, Human
acaguaacaaaaguaucauc

SEQ ID NO: 727774 - RNA, 20 nt, Human
accucauuuucuuacccagg

SEQ ID NO: 727775 - RNA, 19 nt, Human
acuggggaaggagagagug

SEQ ID NO: 727776 - RNA, 24 nt, Human
agaaaagcgcaucguagaaaccaa

SEQ ID NO: 727777 - RNA, 18 nt, Human
agagagacuugaaaaacu

SEQ ID NO: 727778 - RNA, 22 nt, Human
agcauccugaaaacaucacaca

SEQ ID NO: 727779 - RNA, 20 nt, Human
aggcaccucugucuauugcu

SEQ ID NO: 727780 - RNA, 21 nt, Human
aggcuuuacauuagcccaaaa

SEQ ID NO: 727781 - RNA, 18 nt, Human
agggaaggagggauggau

SEQ ID NO: 727782 - RNA, 18 nt, Human
auccaaguugcauuggaa

SEQ ID NO: 727783 - RNA, 22 nt, Human
augaaacauugcauagcacaga

SEQ ID NO: 727784 - RNA, 24 nt, Human
caagagaacauuagcaaagacacc

SEQ ID NO: 727785 - RNA, 19 nt, Human
caccagcuaaaaacauucc

SEQ ID NO: 727786 - RNA, 20 nt, Human
cagaaccagaacguucagcu

SEQ ID NO: 727787 - RNA, 23 nt, Human
cagaccuggacucuaaaagcuaa

SEQ ID NO: 727788 - RNA, 20 nt, Human
cagagugacugcuccgaccc

SEQ ID NO: 727789 - RNA, 19 nt, Human
cagauaaguugaguccaag

SEQ ID NO: 727790 - RNA, 18 nt, Human
cagauaauaugccaggga

SEQ ID NO: 727791 - RNA, 19 nt, Human
cagauaauaugccagggac

SEQ ID NO: 727792 - RNA, 18 nt, Human
cagcgcccgugcccgugc

SEQ ID NO: 727793 - RNA, 23 nt, Human
cagcuuaaucacagcuauacauc

SEQ ID NO: 727794 - RNA, 20 nt, Human
cauuucaccacuuuuguacc

SEQ ID NO: 727795 - RNA, 21 nt, Human
ccaaaaaauuuagaaagacaa

SEQ ID NO: 727796 - RNA, 19 nt, Human
ccaagccagguggagcccc

SEQ ID NO: 727797 - RNA, 24 nt, Human
ccaccagcuaaaaacauucccagu

SEQ ID NO: 727798 - RNA, 20 nt, Human
ccccaaucccauugaccaag

SEQ ID NO: 727799 - RNA, 23 nt, Human
ccccggaccgcgaggggagccuc

SEQ ID NO: 727800 - RNA, 22 nt, Human
cccgugcccgugcgggucucug

SEQ ID NO: 727801 - RNA, 21 nt, Human
cccugauuguucucaucuucc

SEQ ID NO: 727802 - RNA, 19 nt, Human
ccucaguuaaaaagggcuc

SEQ ID NO: 727803 - RNA, 19 nt, Human
ccucauuuucuuacccaga

SEQ ID NO: 727804 - RNA, 22 nt, Human
ccuccagcgcagcgcccgugcc

SEQ ID NO: 727805 - RNA, 19 nt, Human
ccuucuccguggccauuuc

SEQ ID NO: 727806 - RNA, 21 nt, Human
ccuuucaaaauguggaauuaa

SEQ ID NO: 727807 - RNA, 24 nt, Human
cgacccggaaggagaggucaacga

SEQ ID NO: 727808 - RNA, 19 nt, Human
cguagaaaccaagauucug

SEQ ID NO: 727809 - RNA, 19 nt, Human
cucauggaagcccucuucc

SEQ ID NO: 727810 - RNA, 20 nt, Human
cuccugaauguugcagaaaa

SEQ ID NO: 727811 - RNA, 23 nt, Human
cuccugauccaggcgguccacgu

SEQ ID NO: 727812 - RNA, 24 nt, Human
cucuccuacucacaaaagcccuag

SEQ ID NO: 727813 - RNA, 18 nt, Human
cuucuaccaccagcuaaa

SEQ ID NO: 727814 - RNA, 20 nt, Human
gaaggaugugcauggagaag

SEQ ID NO: 727815 - RNA, 20 nt, Human
gagccacaggcccgcuguga

SEQ ID NO: 727816 - RNA, 19 nt, Human
gcuacgguuauucuucccu

SEQ ID NO: 727817 - RNA, 18 nt, Human
gcugggcuuauguaccac

SEQ ID NO: 727818 - RNA, 21 nt, Human
ggaaaagaaauuaacugcaga

SEQ ID NO: 727819 - RNA, 20 nt, Human
ggaaaagacagcuuugaaca

SEQ ID NO: 727820 - RNA, 19 nt, Human
ggccauccaaaaaauuuag

SEQ ID NO: 727821 - RNA, 21 nt, Human
ggcugugagucagauucuuga

SEQ ID NO: 727822 - RNA, 20 nt, Human
gggaaggagagagugaagac

SEQ ID NO: 727823 - RNA, 22 nt, Human
gggacaggcagcggggcgggag

SEQ ID NO: 727824 - RNA, 19 nt, Human
gguagggaaggagggaugg

SEQ ID NO: 727825 - RNA, 18 nt, Human
gguuucuuucuuugaccc

SEQ ID NO: 727826 - RNA, 25 nt, Human
gugaagaucagauaauaugccaggg

SEQ ID NO: 727827 - RNA, 20 nt, Human
uaaaagggccaucuccaagc

SEQ ID NO: 727828 - RNA, 23 nt, Human
uaaaggagcccaaaggggacacc

SEQ ID NO: 727829 - RNA, 25 nt, Human
uaaccagaccuggacucuaaaagcu

SEQ ID NO: 727830 - RNA, 23 nt, Human
uaaggacaguaacaaaaguauca

SEQ ID NO: 727831 - RNA, 18 nt, Human
uagaaagacaagucucag

SEQ ID NO: 727832 - RNA, 21 nt, Human
uagaaagacaagucucagaug

SEQ ID NO: 727833 - RNA, 18 nt, Human
uagggaaagaacagucaa

SEQ ID NO: 727834 - RNA, 26 nt, Human
uagggaaagaacagucaagguugagg

SEQ ID NO: 727835 - RNA, 26 nt, Human
uagugagcacaauuaagaaaccaaac

SEQ ID NO: 727836 - RNA, 18 nt, Human
uauggaaaauuaaggaca

SEQ ID NO: 727837 - RNA, 19 nt, Human
uauuuuagaauacuggucc

SEQ ID NO: 727838 - RNA, 23 nt, Human
ucacagcauauaauuugggauac

SEQ ID NO: 727839 - RNA, 21 nt, Human
uccaaaaaauuuagaaagaca

SEQ ID NO: 727840 - RNA, 19 nt, Human
uccaauuucaguugaacca

SEQ ID NO: 727841 - RNA, 24 nt, Human
uccaggaaccuguucugaacaccg

SEQ ID NO: 727842 - RNA, 24 nt, Human
ucccaaauuucaccaauguauucc

SEQ ID NO: 727843 - RNA, 19 nt, Human
uccccuggcccuuccugug

SEQ ID NO: 727844 - RNA, 19 nt, Human
ucccugaaccuccuugcug

SEQ ID NO: 727845 - RNA, 24 nt, Human
uccuccucuuuccccuccugucug

SEQ ID NO: 727846 - RNA, 23 nt, Human
uccuccugguucaaagaucucau

SEQ ID NO: 727847 - RNA, 24 nt, Human
ucuagaaagacagcaauagggcau

SEQ ID NO: 727848 - RNA, 23 nt, Human
ucuauaaucuggacucagccauc

SEQ ID NO: 727849 - RNA, 21 nt, Human
ucugcuccuuucaauggaauc

SEQ ID NO: 727850 - RNA, 24 nt, Human
ucuguaacuugucuguuacucagc

SEQ ID NO: 727851 - RNA, 24 nt, Human
ucuguucaaagcagcgcaaccacu

SEQ ID NO: 727852 - RNA, 27 nt, Human
ugaaaaaaaacugacuuaauacaucaa

SEQ ID NO: 727853 - RNA, 23 nt, Human
ugaaaacuagcugcuccuccagg

SEQ ID NO: 727854 - RNA, 24 nt, Human
ugaaaacuagcugcuccuccagga

SEQ ID NO: 727855 - RNA, 24 nt, Human
ugaaacauugcauagcacagauuc

SEQ ID NO: 727856 - RNA, 21 nt, Human
ugaaaugcuguuuaaaaucug

SEQ ID NO: 727857 - RNA, 19 nt, Human
ugaagacaagagaguuugc

SEQ ID NO: 727858 - RNA, 21 nt, Human
ugaagaucuccuccugguuca

SEQ ID NO: 727859 - RNA, 18 nt, Human
ugagaccccaguagcuga

SEQ ID NO: 727860 - RNA, 20 nt, Human
ugauaugagaaucuaaaaca

SEQ ID NO: 727861 - RNA, 20 nt, Human
ugauuguucucaucuucccu

SEQ ID NO: 727862 - RNA, 21 nt, Human
ugcaaaaacaguuguaugguu

SEQ ID NO: 727863 - RNA, 24 nt, Human
ugcauagcacagauucucuuccca

SEQ ID NO: 727864 - RNA, 21 nt, Human
ugcauuggaaguucacucauu

SEQ ID NO: 727865 - RNA, 18 nt, Human
ugcuccuuucaauggaau

SEQ ID NO: 727866 - RNA, 19 nt, Human
ugcuguuuaaaaucugcau

SEQ ID NO: 727867 - RNA, 21 nt, Human
uggaaucugugacuguuuggg

SEQ ID NO: 727868 - RNA, 19 nt, Human
uggaccacgcuuugcccuc

SEQ ID NO: 727869 - RNA, 24 nt, Human
uggagccccaaucccauugaccaa

SEQ ID NO: 727870 - RNA, 21 nt, Human
uggcaaccucauuuucuuacc

SEQ ID NO: 727871 - RNA, 19 nt, Human
ugguccauauuucaagcag

SEQ ID NO: 727872 - RNA, 23 nt, Human
uggugaugcaaacaagaccaaug

SEQ ID NO: 727873 - RNA, 20 nt, Human
uuaaaucuagaaagacagca

SEQ ID NO: 727874 - RNA, 22 nt, Human
uuagcccaaaaaagaggggcuu

SEQ ID NO: 727875 - RNA, 21 nt, Human
uuagcccagcagaaaagcugg

SEQ ID NO: 727876 - RNA, 18 nt, Human
uucaagcagaugagaggu

SEQ ID NO: 727877 - RNA, 23 nt, Human
uucaccaauguauuccuuucaaa

SEQ ID NO: 727878 - RNA, 20 nt, Human
uucaguguguuuggacccua

SEQ ID NO: 727879 - RNA, 20 nt, Human
uuccucagucagcuccguuc

SEQ ID NO: 727880 - RNA, 19 nt, Human
uucuaugccuaaaccuuaa

SEQ ID NO: 727881 - RNA, 21 nt, Human
uucuuacccagaauuccuacu

SEQ ID NO: 727882 - RNA, 21 nt, Human
uugcaaaaacaguuguauggu

SEQ ID NO: 727883 - RNA, 18 nt, Human
uugggaaggaugugcaug

SEQ ID NO: 727884 - RNA, 19 nt, Human
uuggggguuucauuuaagg

SEQ ID NO: 727885 - RNA, 19 nt, Human
uuguaugguuccuccucuu

SEQ ID NO: 727886 - RNA, 18 nt, Human
aaacaaaaacaaaagcaa

SEQ ID NO: 727887 - RNA, 21 nt, Human
aaacaaaacaaucucaccaca

SEQ ID NO: 727888 - RNA, 25 nt, Human
aaacaaaagcaaaaucacccgccca

SEQ ID NO: 727889 - RNA, 27 nt, Human
aaacaaacucacaaaacaaaaggaaac

SEQ ID NO: 727890 - RNA, 19 nt, Human
aaaccucucccgaaacaug

SEQ ID NO: 727891 - RNA, 23 nt, Human
aaaggaacugcccgcccagaaau

SEQ ID NO: 727892 - RNA, 22 nt, Human
aaauaauauuaacaugaagaca

SEQ ID NO: 727893 - RNA, 22 nt, Human
aaccccauccacuacccaucuc

SEQ ID NO: 727894 - RNA, 19 nt, Human
aacccggccccuacccagc

SEQ ID NO: 727895 - RNA, 21 nt, Human
aagacacccccaagccugaaa

SEQ ID NO: 727896 - RNA, 21 nt, Human
acaaaacaaaaggaaacaaaa

SEQ ID NO: 727897 - RNA, 22 nt, Human
acaaaacaaaaggaaacaaaac

SEQ ID NO: 727898 - RNA, 18 nt, Human
acaacagaaaccccaucc

SEQ ID NO: 727899 - RNA, 21 nt, Human
acaauugaaaaacacaacccu

SEQ ID NO: 727900 - RNA, 22 nt, Human
acacuaaaccacuaccauuagu

SEQ ID NO: 727901 - RNA, 23 nt, Human
accaaaugaaacgacuuuggcuu

SEQ ID NO: 727902 - RNA, 25 nt, Human
accacuaccauuaguacugcaaucu

SEQ ID NO: 727903 - RNA, 19 nt, Human
acccaaaggugacagagga

SEQ ID NO: 727904 - RNA, 22 nt, Human
acccaggcccccaaacaacccc

SEQ ID NO: 727905 - RNA, 21 nt, Human
accccauccacuacccaucuc

SEQ ID NO: 727906 - RNA, 23 nt, Human
acccccauccccuaccuuccagc

SEQ ID NO: 727907 - RNA, 22 nt, Human
accccccaccccccacccccau

SEQ ID NO: 727908 - RNA, 25 nt, Human
acccucgggaagaccagguuggcuc

SEQ ID NO: 727909 - RNA, 24 nt, Human
acgccacugcaauccagccugagc

SEQ ID NO: 727910 - RNA, 25 nt, Human
acguaaggcuuccagcccugcccag

SEQ ID NO: 727911 - RNA, 18 nt, Human
acugcaauccagccugag

SEQ ID NO: 727912 - RNA, 24 nt, Human
acugcaauccagccugagcaacag

SEQ ID NO: 727913 - RNA, 22 nt, Human
acugcaaucuagcagauuaacu

SEQ ID NO: 727914 - RNA, 24 nt, Human
agaagacacccccaagccugaaag

SEQ ID NO: 727915 - RNA, 19 nt, Human
agaugccagcaaucaaaac

SEQ ID NO: 727916 - RNA, 18 nt, Human
agcaaaggcacaacuggg

SEQ ID NO: 727917 - RNA, 22 nt, Human
agcacaauucacaaauacagcu

SEQ ID NO: 727918 - RNA, 22 nt, Human
aggcagguucuccucacuuccc

SEQ ID NO: 727919 - RNA, 19 nt, Human
aggcccccaaacaaccccu

SEQ ID NO: 727920 - RNA, 21 nt, Human
aggccugggacucccuggucc

SEQ ID NO: 727921 - RNA, 24 nt, Human
aggcugaagugggaggauugcuug

SEQ ID NO: 727922 - RNA, 20 nt, Human
aggcuuccagcccugcccag

SEQ ID NO: 727923 - RNA, 22 nt, Human
agggauccuccaucuucuuggg

SEQ ID NO: 727924 - RNA, 21 nt, Human
aggggguggcuggcgguguug

SEQ ID NO: 727925 - RNA, 19 nt, Human
aggucgaggcugcagugag

SEQ ID NO: 727926 - RNA, 19 nt, Human
auacugcaucuuuaaguaa

SEQ ID NO: 727927 - RNA, 24 nt, Human
aucacgccacugcaauccagccug

SEQ ID NO: 727928 - RNA, 19 nt, Human
auggugcacaggauaucuc

SEQ ID NO: 727929 - RNA, 19 nt, Human
auguaauccauuggugaag

SEQ ID NO: 727930 - RNA, 24 nt, Human
auugcuugagcccagggaggucga

SEQ ID NO: 727931 - RNA, 20 nt, Human
caaaagcaaaaucacccgcc

SEQ ID NO: 727932 - RNA, 23 nt, Human
caaacucacaaaacaaaaggaaa

SEQ ID NO: 727933 - RNA, 22 nt, Human
caacccccaguccagggacccu

SEQ ID NO: 727934 - RNA, 25 nt, Human
caagauacaacagaaaccccaucca

SEQ ID NO: 727935 - RNA, 21 nt, Human
caaggccaagacagugacagu

SEQ ID NO: 727936 - RNA, 23 nt, Human
caauccagccugagcaacagagc

SEQ ID NO: 727937 - RNA, 25 nt, Human
caauuuuaaacaaacucacaaaaca

SEQ ID NO: 727938 - RNA, 22 nt, Human
cacaaaacaaaaggaaacaaaa

SEQ ID NO: 727939 - RNA, 23 nt, Human
cacaaaacaaaaggaaacaaaac

SEQ ID NO: 727940 - RNA, 24 nt, Human
cacaaaacaaaaggaaacaaaaca

SEQ ID NO: 727941 - RNA, 25 nt, Human
cacaaaacaaaaggaaacaaaacaa

SEQ ID NO: 727942 - RNA, 21 nt, Human
cacaaauacagcuuaggacaa

SEQ ID NO: 727943 - RNA, 20 nt, Human
cacaacccaaaggugacaga

SEQ ID NO: 727944 - RNA, 23 nt, Human
cacacaguggaaaccaaaugaaa

SEQ ID NO: 727945 - RNA, 21 nt, Human
cacagggauccuccaucuucu

SEQ ID NO: 727946 - RNA, 20 nt, Human
caccaacccccaguccaggg

SEQ ID NO: 727947 - RNA, 23 nt, Human
caccaacccccaguccagggacc

SEQ ID NO: 727948 - RNA, 19 nt, Human
cacccaggcccccaaacaa

SEQ ID NO: 727949 - RNA, 21 nt, Human
cacccaggcccccaaacaacc

SEQ ID NO: 727950 - RNA, 22 nt, Human
cacccaggcccccaaacaaccc

SEQ ID NO: 727951 - RNA, 21 nt, Human
cacccccaagccugaaagcca

SEQ ID NO: 727952 - RNA, 19 nt, Human
caccccccaccccccaccc

SEQ ID NO: 727953 - RNA, 20 nt, Human
cacugaggcuggaagagccc

SEQ ID NO: 727954 - RNA, 21 nt, Human
cacugcaauccagccugagca

SEQ ID NO: 727955 - RNA, 24 nt, Human
cacugcaauccagccugagcaaca

SEQ ID NO: 727956 - RNA, 26 nt, Human
cagaagaacaguuucucugcuucacc

SEQ ID NO: 727957 - RNA, 25 nt, Human
cagcaaucaaaacugggccaagcag

SEQ ID NO: 727958 - RNA, 18 nt, Human
cagcacaguccacacagu

SEQ ID NO: 727959 - RNA, 24 nt, Human
cagcccagcuggacagccacacug

SEQ ID NO: 727960 - RNA, 22 nt, Human
cagcuuucuuggcucugggucc

SEQ ID NO: 727961 - RNA, 21 nt, Human
caggcccccaaacaaccccua

SEQ ID NO: 727962 - RNA, 22 nt, Human
caggggcuuaggguugcccagg

SEQ ID NO: 727963 - RNA, 18 nt, Human
cagguucuccucacuucc

SEQ ID NO: 727964 - RNA, 23 nt, Human
cagugugggcacccccauccccu

SEQ ID NO: 727965 - RNA, 22 nt, Human
caucuccuucccaugugaggcc

SEQ ID NO: 727966 - RNA, 21 nt, Human
caucuucuugggcaccugugg

SEQ ID NO: 727967 - RNA, 19 nt, Human
caugucugcaaccuggggc

SEQ ID NO: 727968 - RNA, 22 nt, Human
ccacccaggcccccaaacaacc

SEQ ID NO: 727969 - RNA, 22 nt, Human
ccaccccccaccccccaccccc

SEQ ID NO: 727970 - RNA, 19 nt, Human
ccacccucucuguaaacuc

SEQ ID NO: 727971 - RNA, 20 nt, Human
ccacugcaauccagccugag

SEQ ID NO: 727972 - RNA, 21 nt, Human
ccacugcaauccagccugagc

SEQ ID NO: 727973 - RNA, 20 nt, Human
ccagaucuguagcaaaggca

SEQ ID NO: 727974 - RNA, 18 nt, Human
ccaggcccccaaacaacc

SEQ ID NO: 727975 - RNA, 20 nt, Human
ccaugucugcaaccuggggc

SEQ ID NO: 727976 - RNA, 26 nt, Human
cccaaaucaacaaaccucucccgaaa

SEQ ID NO: 727977 - RNA, 26 nt, Human
cccacaagauacaacagaaaccccau

SEQ ID NO: 727978 - RNA, 24 nt, Human
cccagcgcugggagcccgcucucc

SEQ ID NO: 727979 - RNA, 24 nt, Human
cccagggaggucgaggcugcagug

SEQ ID NO: 727980 - RNA, 19 nt, Human
cccauaguggggacaaugg

SEQ ID NO: 727981 - RNA, 26 nt, Human
cccauccacuacccaucuccuuccca

SEQ ID NO: 727982 - RNA, 18 nt, Human
cccauuuuuuccuuuccc

SEQ ID NO: 727983 - RNA, 21 nt, Human
cccauuuuuuccuuucccuuu

SEQ ID NO: 727984 - RNA, 18 nt, Human
ccccaaacaaccccuaaa

SEQ ID NO: 727985 - RNA, 23 nt, Human
ccccauccacuacccaucuccuu

SEQ ID NO: 727986 - RNA, 21 nt, Human
ccccauccccuaccuuccagc

SEQ ID NO: 727987 - RNA, 25 nt, Human
ccccaugaccuugucuuuuccagag

SEQ ID NO: 727988 - RNA, 18 nt, Human
cccccaagccugaaagcc

SEQ ID NO: 727989 - RNA, 25 nt, Human
cccccaccccccacccccauuuuuu

SEQ ID NO: 727990 - RNA, 19 nt, Human
cccccaguccagggacccu

SEQ ID NO: 727991 - RNA, 20 nt, Human
ccccccaccccccaccccca

SEQ ID NO: 727992 - RNA, 20 nt, Human
ccccuaaaauaagacgcaaa

SEQ ID NO: 727993 - RNA, 21 nt, Human
cccuaaaauaagacgcaaacc

SEQ ID NO: 727994 - RNA, 20 nt, Human
ccgaccacccaggcccccaa

SEQ ID NO: 727995 - RNA, 22 nt, Human
ccgaccacccaggcccccaaac

SEQ ID NO: 727996 - RNA, 18 nt, Human
ccggccccuacccagcgc

SEQ ID NO: 727997 - RNA, 19 nt, Human
ccuccaucuucuugggcac

SEQ ID NO: 727998 - RNA, 19 nt, Human
ccugccuggguggggagca

SEQ ID NO: 727999 - RNA, 24 nt, Human
ccugggacucccugguccauuccc

SEQ ID NO: 728000 - RNA, 19 nt, Human
ccuugggggaagccggcug

SEQ ID NO: 728001 - RNA, 24 nt, Human
cgccacugcaauccagccugagca

SEQ ID NO: 728002 - RNA, 20 nt, Human
cgcccagaaauacccaaaau

SEQ ID NO: 728003 - RNA, 18 nt, Human
cgccggaacccggccccu

SEQ ID NO: 728004 - RNA, 26 nt, Human
cggaacccggccccuacccagcgcug

SEQ ID NO: 728005 - RNA, 22 nt, Human
cgguggcuucgcccacccucuc

SEQ ID NO: 728006 - RNA, 20 nt, Human
cguguggaaauccacuccca

SEQ ID NO: 728007 - RNA, 26 nt, Human
cuaaaauaagacgcaaaccaaaggcc

SEQ ID NO: 728008 - RNA, 22 nt, Human
cuauagaaaacaccaaccccca

SEQ ID NO: 728009 - RNA, 20 nt, Human
cucacaaaacaaaaggaaac

SEQ ID NO: 728010 - RNA, 23 nt, Human
cucaccgcucauccagugggcgg

SEQ ID NO: 728011 - RNA, 23 nt, Human
cuccucacuucccaaacugggaa

SEQ ID NO: 728012 - RNA, 20 nt, Human
cuccugaacacccuccuccu

SEQ ID NO: 728013 - RNA, 24 nt, Human
cucugggucccaggccugggacuc

SEQ ID NO: 728014 - RNA, 25 nt, Human
cuggcaccugggaacugcuuuuucu

SEQ ID NO: 728015 - RNA, 18 nt, Human
cuguggucccagccacuc

SEQ ID NO: 728016 - RNA, 18 nt, Human
cuuccagcccugcccagc

SEQ ID NO: 728017 - RNA, 22 nt, Human
cuucuggaggguccccucugaa

SEQ ID NO: 728018 - RNA, 18 nt, Human
gaaaccccauccacuacc

SEQ ID NO: 728019 - RNA, 22 nt, Human
gaacacccuccuccuuccuggg

SEQ ID NO: 728020 - RNA, 28 nt, Human
gaagaaugugaaacaaaaacaaaagcaa

SEQ ID NO: 728021 - RNA, 21 nt, Human
gaagacacccccaagccugaa

SEQ ID NO: 728022 - RNA, 23 nt, Human
gaagacacccccaagccugaaag

SEQ ID NO: 728023 - RNA, 21 nt, Human
gaagggggaguccuuggggga

SEQ ID NO: 728024 - RNA, 24 nt, Human
gaagugggaggauugcuugagccc

SEQ ID NO: 728025 - RNA, 20 nt, Human
gacaguuaugaaagaugguc

SEQ ID NO: 728026 - RNA, 21 nt, Human
gagcccgcucuccccgccacc

SEQ ID NO: 728027 - RNA, 25 nt, Human
gagcccgcucuccccgccaccggag

SEQ ID NO: 728028 - RNA, 23 nt, Human
gcagguucuccucacuucccaaa

SEQ ID NO: 728029 - RNA, 18 nt, Human
gcaugaucacgccacugc

SEQ ID NO: 728030 - RNA, 22 nt, Human
gccacugcaauccagccugagc

SEQ ID NO: 728031 - RNA, 21 nt, Human
gccagagaggcacacugaggc

SEQ ID NO: 728032 - RNA, 18 nt, Human
gccagcaaucaaaacugg

SEQ ID NO: 728033 - RNA, 18 nt, Human
gccccacggagagcgggc

SEQ ID NO: 728034 - RNA, 19 nt, Human
gccuggcccagaagcaggc

SEQ ID NO: 728035 - RNA, 22 nt, Human
gcuccuggcacagggauccucc

SEQ ID NO: 728036 - RNA, 20 nt, Human
gcuucgcccacccucucugu

SEQ ID NO: 728037 - RNA, 24 nt, Human
ggaaauccacucccagcgaagggg

SEQ ID NO: 728038 - RNA, 20 nt, Human
ggaacccggccccuacccag

SEQ ID NO: 728039 - RNA, 19 nt, Human
ggagcagggugagggaggg

SEQ ID NO: 728040 - RNA, 20 nt, Human
ggaggcugaagugggaggau

SEQ ID NO: 728041 - RNA, 22 nt, Human
ggaggcugaagugggaggauug

SEQ ID NO: 728042 - RNA, 21 nt, Human
ggaguccuugggggaagccgg

SEQ ID NO: 728043 - RNA, 19 nt, Human
ggcacccccauccccuacc

SEQ ID NO: 728044 - RNA, 25 nt, Human
ggcagcugaaucgguggcugugagg

SEQ ID NO: 728045 - RNA, 19 nt, Human
ggcaucuuugaggucaccc

SEQ ID NO: 728046 - RNA, 21 nt, Human
ggcgguguuggcuccagucug

SEQ ID NO: 728047 - RNA, 27 nt, Human
ggcugggcuucuggaggguccccucug

SEQ ID NO: 728048 - RNA, 21 nt, Human
ggcuuccagcccugcccagcu

SEQ ID NO: 728049 - RNA, 18 nt, Human
gggauggggugugguggg

SEQ ID NO: 728050 - RNA, 20 nt, Human
ggggaagccggcugggcuuc

SEQ ID NO: 728051 - RNA, 20 nt, Human
ggggguggguuuugaaggca

SEQ ID NO: 728052 - RNA, 19 nt, Human
guaggguaggggugggggu

SEQ ID NO: 728053 - RNA, 18 nt, Human
guccacacaguggaaacc

SEQ ID NO: 728054 - RNA, 24 nt, Human
guccagggacccuggcagcugaau

SEQ ID NO: 728055 - RNA, 18 nt, Human
gugggcacccccaucccc

SEQ ID NO: 728056 - RNA, 18 nt, Human
guuguccaccccccaccc

SEQ ID NO: 728057 - RNA, 22 nt, Human
uaaacaaacucacaaaacaaag

SEQ ID NO: 728058 - RNA, 28 nt, Human
uaaaccacuaccauuaguacugcaaucu

SEQ ID NO: 728059 - RNA, 25 nt, Human
uaaguacaaauaauauuaacaugaa

SEQ ID NO: 728060 - RNA, 18 nt, Human
uaccagggauaccugggg

SEQ ID NO: 728061 - RNA, 18 nt, Human
uacccaucuccuucccau

SEQ ID NO: 728062 - RNA, 24 nt, Human
uagaaaacaccaacccccagucca

SEQ ID NO: 728063 - RNA, 19 nt, Human
uaggguaggggugggggug

SEQ ID NO: 728064 - RNA, 18 nt, Human
uauaagccccaaaucaac

SEQ ID NO: 728065 - RNA, 20 nt, Human
ucaccgcucauccagugggc

SEQ ID NO: 728066 - RNA, 23 nt, Human
ucacgccacugcaauccagccug

SEQ ID NO: 728067 - RNA, 23 nt, Human
ucagaagacacccccaagccuga

SEQ ID NO: 728068 - RNA, 23 nt, Human
ucagcuuucuuggcucugggucc

SEQ ID NO: 728069 - RNA, 21 nt, Human
ucagugugggcacccccaucc

SEQ ID NO: 728070 - RNA, 24 nt, Human
uccacacaguggaaaccaaaugaa

SEQ ID NO: 728071 - RNA, 24 nt, Human
uccaccccccaccccccaccccca

SEQ ID NO: 728072 - RNA, 24 nt, Human
uccagccugagcaacagagcgaga

SEQ ID NO: 728073 - RNA, 25 nt, Human
uccaucuucuugggcaccuguggca

SEQ ID NO: 728074 - RNA, 22 nt, Human
ucccagauggcauguaauccau

SEQ ID NO: 728075 - RNA, 22 nt, Human
uccuccaucuucuugggcaccu

SEQ ID NO: 728076 - RNA, 20 nt, Human
uccuccucuauagaaaacac

SEQ ID NO: 728077 - RNA, 20 nt, Human
ucgacaaagaacacgagcca

SEQ ID NO: 728078 - RNA, 21 nt, Human
ucggcgguggcgucggcaccu

SEQ ID NO: 728079 - RNA, 22 nt, Human
ucuagcagauuaacucaacauc

SEQ ID NO: 728080 - RNA, 22 nt, Human
ucucaccacaggccuucgacaa

SEQ ID NO: 728081 - RNA, 21 nt, Human
ucucuguaaacucugguacug

SEQ ID NO: 728082 - RNA, 23 nt, Human
ucugcccauaguggggacaaugg

SEQ ID NO: 728083 - RNA, 19 nt, Human
ucuggcaggcgccaagcuc

SEQ ID NO: 728084 - RNA, 21 nt, Human
ucugggucccaggccugggac

SEQ ID NO: 728085 - RNA, 27 nt, Human
ucuguagcaaaggcacaaccggggucc

SEQ ID NO: 728086 - RNA, 18 nt, Human
ucuugggcgacucagccc

SEQ ID NO: 728087 - RNA, 19 nt, Human
ugaaaaacacaacccaaag

SEQ ID NO: 728088 - RNA, 18 nt, Human
ugaaacaaaaacaaaagc

SEQ ID NO: 728089 - RNA, 21 nt, Human
ugaaacaaaaacaaaagcaaa

SEQ ID NO: 728090 - RNA, 23 nt, Human
ugaagugggaggauugcuugagc

SEQ ID NO: 728091 - RNA, 24 nt, Human
ugaagugggaggauugcuugagcc

SEQ ID NO: 728092 - RNA, 21 nt, Human
ugaggccgaccacccaggccc

SEQ ID NO: 728093 - RNA, 22 nt, Human
ugagguugugcaggaaccagaa

SEQ ID NO: 728094 - RNA, 19 nt, Human
ugccagcaggccagagggg

SEQ ID NO: 728095 - RNA, 22 nt, Human
ugcccugccuggguggggagca

SEQ ID NO: 728096 - RNA, 21 nt, Human
ugccuggguggggagcagggu

SEQ ID NO: 728097 - RNA, 22 nt, Human
ugccuggguggggagcagggug

SEQ ID NO: 728098 - RNA, 18 nt, Human
ugccuucucuccaaaagu

SEQ ID NO: 728099 - RNA, 18 nt, Human
ugcugcccugccugggug

SEQ ID NO: 728100 - RNA, 18 nt, Human
ugcuggcaccugggaacu

SEQ ID NO: 728101 - RNA, 21 nt, Human
uggaggcugaagugggaggau

SEQ ID NO: 728102 - RNA, 27 nt, Human
uggcaagaugccagcaaucaaaacugg

SEQ ID NO: 728103 - RNA, 18 nt, Human
uggcauugccagcaggcc

SEQ ID NO: 728104 - RNA, 22 nt, Human
uggcuccagucugacccaaggg

SEQ ID NO: 728105 - RNA, 20 nt, Human
uggcuccugaacacccuccu

SEQ ID NO: 728106 - RNA, 21 nt, Human
uggcuccugaacacccuccuc

SEQ ID NO: 728107 - RNA, 20 nt, Human
uggcucugggucccaggccu

SEQ ID NO: 728108 - RNA, 20 nt, Human
uggcugugaggcccaaucug

SEQ ID NO: 728109 - RNA, 18 nt, Human
uggcuucuaauguacccu

SEQ ID NO: 728110 - RNA, 24 nt, Human
ugggaggauugcuugagcccaggg

SEQ ID NO: 728111 - RNA, 22 nt, Human
ugggauggcuuggacagggggc

SEQ ID NO: 728112 - RNA, 23 nt, Human
ugggucccaggccugggacuccc

SEQ ID NO: 728113 - RNA, 21 nt, Human
ugucuucacuggggcacugac

SEQ ID NO: 728114 - RNA, 19 nt, Human
ugugaaacaaaaacaaaag

SEQ ID NO: 728115 - RNA, 21 nt, Human
ugugguaggcguggcaaugcc

SEQ ID NO: 728116 - RNA, 21 nt, Human
uguggugggguaggguagggg

SEQ ID NO: 728117 - RNA, 20 nt, Human
uuaacucaacauccugcucu

SEQ ID NO: 728118 - RNA, 20 nt, Human
uucuugggcaccuguggcau

SEQ ID NO: 728119 - RNA, 20 nt, Human
uugcuugagcccagggaggg

SEQ ID NO: 728120 - RNA, 23 nt, Human
uuggaacugccauagucccuucc

SEQ ID NO: 728121 - RNA, 24 nt, Human
uuggcucugggucccaggccuggg

SEQ ID NO: 728122 - RNA, 18 nt, Human
uuugccccucugagguug

SEQ ID NO: 728123 - RNA, 18 nt, Human
uuugccccucugagguug

SEQ ID NO: 728124 - RNA, 18 nt, Human
uuuggcuuguggaggggg

SEQ ID NO: 728125 - RNA, 22 nt, Human
aaaaacagacuaugaagaacaa

SEQ ID NO: 728126 - RNA, 23 nt, Human
aaaagcacaaagcccuuuuugga

SEQ ID NO: 728127 - RNA, 24 nt, Human
aaaaugcugggaguacagguguga

SEQ ID NO: 728128 - RNA, 25 nt, Human
aaaauggugacccacauuaacuucu

SEQ ID NO: 728129 - RNA, 24 nt, Human
aaauggugacccacauuaacuucu

SEQ ID NO: 728130 - RNA, 20 nt, Human
aaauuaauagugacauucuc

SEQ ID NO: 728131 - RNA, 24 nt, Human
aacauuccacucaaaguaaaaaua

SEQ ID NO: 728132 - RNA, 18 nt, Human
aacuuucuccaaaacuau

SEQ ID NO: 728133 - RNA, 19 nt, Human
aagaagcuaugaacaccaa

SEQ ID NO: 728134 - RNA, 23 nt, Human
aagcaaaaaaaguauauaaauaa

SEQ ID NO: 728135 - RNA, 24 nt, Human
aagcaauucgccugucucagccuc

SEQ ID NO: 728136 - RNA, 24 nt, Human
aaguagcuggaacuacaggcaugc

SEQ ID NO: 728137 - RNA, 21 nt, Human
aaguuaaauuuaaaauggcac

SEQ ID NO: 728138 - RNA, 20 nt, Human
acaggcuuuuaucuuuaaau

SEQ ID NO: 728139 - RNA, 19 nt, Human
acaguacugggguaacaua

SEQ ID NO: 728140 - RNA, 19 nt, Human
acuggagugcaauggcaca

SEQ ID NO: 728141 - RNA, 22 nt, Human
acuuuuuuuuuuuuuuuuuuuu

SEQ ID NO: 728142 - RNA, 27 nt, Human
agaaaaaacagacuaugaagaacaaaa

SEQ ID NO: 728143 - RNA, 19 nt, Human
agaaagaucuuauaaccua

SEQ ID NO: 728144 - RNA, 26 nt, Human
agaacaguaucagcacacagcaggca

SEQ ID NO: 728145 - RNA, 20 nt, Human
agaagcaaaacuagugaaaa

SEQ ID NO: 728146 - RNA, 22 nt, Human
agacaucugggcauauaaaaua

SEQ ID NO: 728147 - RNA, 21 nt, Human
agagcgcagcucgguccgccg

SEQ ID NO: 728148 - RNA, 24 nt, Human
agaugggguuucgccauguuuggu

SEQ ID NO: 728149 - RNA, 21 nt, Human
agcuaugaacaccaaaaaaga

SEQ ID NO: 728150 - RNA, 24 nt, Human
aggugauccacccaccuuggccuc

SEQ ID NO: 728151 - RNA, 20 nt, Human
auccccauuacacagaacag

SEQ ID NO: 728152 - RNA, 21 nt, Human
augggguuucgccauguuugg

SEQ ID NO: 728153 - RNA, 22 nt, Human
augggguuucgccauguuuggu

SEQ ID NO: 728154 - RNA, 25 nt, Human
augggguuucgccauguuuggucag

SEQ ID NO: 728155 - RNA, 20 nt, Human
caaaacuagugaaaauaaaa

SEQ ID NO: 728156 - RNA, 19 nt, Human
caaaagcacaaacaguguc

SEQ ID NO: 728157 - RNA, 23 nt, Human
caaaagcacaaacagugucuggc

SEQ ID NO: 728158 - RNA, 24 nt, Human
caaaaugcugggaguacaggugug

SEQ ID NO: 728159 - RNA, 23 nt, Human
caccaaaauguaagcgccauaag

SEQ ID NO: 728160 - RNA, 19 nt, Human
caccaugccuaauuuuugu

SEQ ID NO: 728161 - RNA, 18 nt, Human
cacugcaaccucugccuc

SEQ ID NO: 728162 - RNA, 21 nt, Human
cacugcaaccucugccuccca

SEQ ID NO: 728163 - RNA, 19 nt, Human
cagcuccucuccccucgcc

SEQ ID NO: 728164 - RNA, 20 nt, Human
cagcucgguccgccgccgcc

SEQ ID NO: 728165 - RNA, 22 nt, Human
caggaauuaccaaacugaccaa

SEQ ID NO: 728166 - RNA, 25 nt, Human
caggcaauauucuuauccccugaag

SEQ ID NO: 728167 - RNA, 18 nt, Human
caguacagaugggguuuc

SEQ ID NO: 728168 - RNA, 24 nt, Human
caguacagaugggguuucgccaug

SEQ ID NO: 728169 - RNA, 22 nt, Human
caugaauaauaauccuuccccc

SEQ ID NO: 728170 - RNA, 21 nt, Human
caugccuaauuuuuguauuuu

SEQ ID NO: 728171 - RNA, 19 nt, Human
ccaaacugaccaaaugauc

SEQ ID NO: 728172 - RNA, 20 nt, Human
ccauguuuggucaggcuggu

SEQ ID NO: 728173 - RNA, 23 nt, Human
ccauguuuggucaggcuggucuc

SEQ ID NO: 728174 - RNA, 21 nt, Human
cccacaaugcuaugaauaagc

SEQ ID NO: 728175 - RNA, 19 nt, Human
cccacagucacacacuauc

SEQ ID NO: 728176 - RNA, 23 nt, Human
cccacggccccuucagcuccucu

SEQ ID NO: 728177 - RNA, 21 nt, Human
cccagguucaagcaauucgcc

SEQ ID NO: 728178 - RNA, 23 nt, Human
cccagguucaagcaauucgccug

SEQ ID NO: 728179 - RNA, 18 nt, Human
ccccuucagcuccucucc

SEQ ID NO: 728180 - RNA, 22 nt, Human
cccgacuggagugcaauggcac

SEQ ID NO: 728181 - RNA, 19 nt, Human
ccgccgccgccuucuccuc

SEQ ID NO: 728182 - RNA, 21 nt, Human
ccuaacauuucugucagacaa

SEQ ID NO: 728183 - RNA, 21 nt, Human
ccucccagguucaagcaauuc

SEQ ID NO: 728184 - RNA, 24 nt, Human
ccugaccucaggugauccacccac

SEQ ID NO: 728185 - RNA, 21 nt, Human
ccuucagcuccucuccccucg

SEQ ID NO: 728186 - RNA, 19 nt, Human
ccuucuccuccuccucccc

SEQ ID NO: 728187 - RNA, 20 nt, Human
cgccacgggccuugucagga

SEQ ID NO: 728188 - RNA, 24 nt, Human
cguuaucuugguaacauuuguugg

SEQ ID NO: 728189 - RNA, 20 nt, Human
cuaauuugcauuacacacac

SEQ ID NO: 728190 - RNA, 18 nt, Human
cucaaguuucucauccuu

SEQ ID NO: 728191 - RNA, 24 nt, Human
cucacugcaaccucugccucccag

SEQ ID NO: 728192 - RNA, 24 nt, Human
cucacugcaaccucugccucccag

SEQ ID NO: 728193 - RNA, 24 nt, Human
cucaggugauccacccaccuuggc

SEQ ID NO: 728194 - RNA, 25 nt, Human
cuccuaaaucaagcaugcuagaaaa

SEQ ID NO: 728195 - RNA, 23 nt, Human
cugcaaccucugccucccagguu

SEQ ID NO: 728196 - RNA, 24 nt, Human
cugcaaccucugccucccagguuc

SEQ ID NO: 728197 - RNA, 23 nt, Human
cugucucagccucccaaguagcu

SEQ ID NO: 728198 - RNA, 18 nt, Human
cuugguaacauuuguugg

SEQ ID NO: 728199 - RNA, 24 nt, Human
cuuuuuuuuuuuuuuuuuuuuggg

SEQ ID NO: 728200 - RNA, 23 nt, Human
gaaaaaacagacuaugaagaaca

SEQ ID NO: 728201 - RNA, 25 nt, Human
gaaaaaacagacuaugaagaacaaa

SEQ ID NO: 728202 - RNA, 20 nt, Human
gaccaaaauggugacccaca

SEQ ID NO: 728203 - RNA, 23 nt, Human
gaccucaggugauccacccaccu

SEQ ID NO: 728204 - RNA, 18 nt, Human
gagaagaagcuaugaaca

SEQ ID NO: 728205 - RNA, 24 nt, Human
gagaagaagcuaugaacaccaaaa

SEQ ID NO: 728206 - RNA, 18 nt, Human
gaguacaggugugagcca

SEQ ID NO: 728207 - RNA, 20 nt, Human
gaguacaggugugagccacc

SEQ ID NO: 728208 - RNA, 20 nt, Human
gaugggguuucgccauguuu

SEQ ID NO: 728209 - RNA, 19 nt, Human
gauuuuugucugucuuccu

SEQ ID NO: 728210 - RNA, 18 nt, Human
gcucgguccgccgccgcc

SEQ ID NO: 728211 - RNA, 18 nt, Human
gcucgguccgccgccgcc

SEQ ID NO: 728212 - RNA, 23 nt, Human
gcuggucucaaacuccugaccuc

SEQ ID NO: 728213 - RNA, 24 nt, Human
ggcuggucucaaacuccugaccuc

SEQ ID NO: 728214 - RNA, 21 nt, Human
guaaaacacaggcuuuuaucu

SEQ ID NO: 728215 - RNA, 22 nt, Human
guacagaugggguuucgccaug

SEQ ID NO: 728216 - RNA, 22 nt, Human
guacaggugugagccacccugc

SEQ ID NO: 728217 - RNA, 22 nt, Human
guaucagcacacagcaggcacu

SEQ ID NO: 728218 - RNA, 22 nt, Human
gugauccacccaccuuggccuc

SEQ ID NO: 728219 - RNA, 21 nt, Human
uaacauacaugaagccuaaca

SEQ ID NO: 728220 - RNA, 30 nt, Human
uaaccaggcaauauucuuauccggaaaucu

SEQ ID NO: 728221 - RNA, 19 nt, Human
uaauagugacauucucccu

SEQ ID NO: 728222 - RNA, 24 nt, Human
uaauuuuuguauuuucaguacaga

SEQ ID NO: 728223 - RNA, 26 nt, Human
uacacagaacaguaucagcacacagc

SEQ ID NO: 728224 - RNA, 22 nt, Human
uacagaugggguuucgccaugu

SEQ ID NO: 728225 - RNA, 22 nt, Human
uacaggcaugcaccaccaugcc

SEQ ID NO: 728226 - RNA, 19 nt, Human
uacaggugugagccacccu

SEQ ID NO: 728227 - RNA, 22 nt, Human
uacaggugugagccacccugcc

SEQ ID NO: 728228 - RNA, 24 nt, Human
uagaaaauauaacugcaugcaaca

SEQ ID NO: 728229 - RNA, 18 nt, Human
uauaaaaugagggaaagg

SEQ ID NO: 728230 - RNA, 19 nt, Human
ucacugcaaccucugccuc

SEQ ID NO: 728231 - RNA, 24 nt, Human
ucacugcaaccucugccucccagg

SEQ ID NO: 728232 - RNA, 25 nt, Human
ucacugcaaccucugccucccaggu

SEQ ID NO: 728233 - RNA, 18 nt, Human
ucagccucccaaguagcu

SEQ ID NO: 728234 - RNA, 20 nt, Human
ucagccucccaaguagcugg

SEQ ID NO: 728235 - RNA, 27 nt, Human
ucagcucacugcaaccucugccuccca

SEQ ID NO: 728236 - RNA, 21 nt, Human
ucaguacagaugggguuuccu

SEQ ID NO: 728237 - RNA, 24 nt, Human
ucaguacagaugggguuucgccau

SEQ ID NO: 728238 - RNA, 20 nt, Human
ucagucuuguucacugaauc

SEQ ID NO: 728239 - RNA, 22 nt, Human
uccacccaccuuggccucacaa

SEQ ID NO: 728240 - RNA, 24 nt, Human
ucccaaguagcuggaacuacaggc

SEQ ID NO: 728241 - RNA, 19 nt, Human
ucccagguucaagcaauuc

SEQ ID NO: 728242 - RNA, 21 nt, Human
ucccagguucaagcaauucgc

SEQ ID NO: 728243 - RNA, 24 nt, Human
ucccagguucaagcaauucgccug

SEQ ID NO: 728244 - RNA, 23 nt, Human
ucgccauguuuggucaggcuggu

SEQ ID NO: 728245 - RNA, 19 nt, Human
ucuccuccuccuccccgcc

SEQ ID NO: 728246 - RNA, 24 nt, Human
ucuugcucuguuaacccgacugga

SEQ ID NO: 728247 - RNA, 24 nt, Human
ugaaaagcacaaagcccuuuuugg

SEQ ID NO: 728248 - RNA, 18 nt, Human
ugaacauuccacucaaag

SEQ ID NO: 728249 - RNA, 20 nt, Human
ugaagaacaaaauauacaga

SEQ ID NO: 728250 - RNA, 19 nt, Human
ugacaggaauguaugcuuc

SEQ ID NO: 728251 - RNA, 23 nt, Human
ugaccaaaauggugacccacauu

SEQ ID NO: 728252 - RNA, 21 nt, Human
ugaccucaggugauccaccca

SEQ ID NO: 728253 - RNA, 24 nt, Human
ugaccucaggugauccacccaccu

SEQ ID NO: 728254 - RNA, 21 nt, Human
ugagaagaagcuaugaacacc

SEQ ID NO: 728255 - RNA, 23 nt, Human
ugagaagaagcuaugaacaccaa

SEQ ID NO: 728256 - RNA, 26 nt, Human
ugagaagaagcuaugaacaccaaaaa

SEQ ID NO: 728257 - RNA, 20 nt, Human
ugagaagaagcuaugaacca

SEQ ID NO: 728258 - RNA, 22 nt, Human
ugagacagugucuugcucuguu

SEQ ID NO: 728259 - RNA, 18 nt, Human
ugagccacccugccuggc

SEQ ID NO: 728260 - RNA, 21 nt, Human
ugauuuuugucugucuuccuc

SEQ ID NO: 728261 - RNA, 26 nt, Human
ugcauuacacacacaaaaagugcaca

SEQ ID NO: 728262 - RNA, 18 nt, Human
ugcuagaaaaaacagacu

SEQ ID NO: 728263 - RNA, 21 nt, Human
uggaacuacaggcaugcacca

SEQ ID NO: 728264 - RNA, 24 nt, Human
uggaacuacaggcaugcaccacca

SEQ ID NO: 728265 - RNA, 23 nt, Human
uggagugcaauggcacagucuca

SEQ ID NO: 728266 - RNA, 24 nt, Human
uggcacagucucagcucacugcaa

SEQ ID NO: 728267 - RNA, 21 nt, Human
uggcucaaaugguacugacag

SEQ ID NO: 728268 - RNA, 18 nt, Human
ugggaguacaggugugag

SEQ ID NO: 728269 - RNA, 22 nt, Human
ugggaguacaggugugagccac

SEQ ID NO: 728270 - RNA, 23 nt, Human
ugggaguacaggugugagccacc

SEQ ID NO: 728271 - RNA, 24 nt, Human
uggucaggcuggucucaaacuccu

SEQ ID NO: 728272 - RNA, 26 nt, Human
uguaaaacacaggcuuuuaucuuuaa

SEQ ID NO: 728273 - RNA, 21 nt, Human
uguaugcuucugaccaaaaug

SEQ ID NO: 728274 - RNA, 24 nt, Human
ugucucagccucccaaguagcugg

SEQ ID NO: 728275 - RNA, 21 nt, Human
ugucuggcaccuguaugagaa

SEQ ID NO: 728276 - RNA, 21 nt, Human
ugugcugucuuccccaaauuu

SEQ ID NO: 728277 - RNA, 23 nt, Human
uuacauuaaugaacauuccacuc

SEQ ID NO: 728278 - RNA, 25 nt, Human
uucccacagucacacacuaucugaa

SEQ ID NO: 728279 - RNA, 21 nt, Human
uugccuauaaauuuuaaaaaa

SEQ ID NO: 728280 - RNA, 23 nt, Human
uugccuauaaauuuuaaaaaauu

SEQ ID NO: 728281 - RNA, 24 nt, Human
uuugucugucuuccuccaccaaaa

SEQ ID NO: 728282 - RNA, 22 nt, Human
uuuucaguacagaugggguuuc

SEQ ID NO: 728283 - RNA, 18 nt, Human
aaagacugccagggcagc

SEQ ID NO: 728284 - RNA, 24 nt, Human
aaaguguugggauuauaggcauga

SEQ ID NO: 728285 - RNA, 23 nt, Human
aacuuagcagaaacccagggcuc

SEQ ID NO: 728286 - RNA, 25 nt, Human
aagaagcccaagccaaggcacuucc

SEQ ID NO: 728287 - RNA, 18 nt, Human
aagacugccagggcagcu

SEQ ID NO: 728288 - RNA, 18 nt, Human
aagcaaggccaggagaca

SEQ ID NO: 728289 - RNA, 25 nt, Human
aagcaauccuucugccucagccucc

SEQ ID NO: 728290 - RNA, 18 nt, Human
aagcagcacccaccuuca

SEQ ID NO: 728291 - RNA, 20 nt, Human
aagcagcacccaccuucagc

SEQ ID NO: 728292 - RNA, 19 nt, Human
aagcagcuucuuucuucuu

SEQ ID NO: 728293 - RNA, 22 nt, Human
aagcagcuucuuucuucuuuuu

SEQ ID NO: 728294 - RNA, 24 nt, Human
aagcaggccagaucaggcuucaag

SEQ ID NO: 728295 - RNA, 23 nt, Human
aaggugugguaugguagacaccu

SEQ ID NO: 728296 - RNA, 21 nt, Human
aaguguugggauuauaggcau

SEQ ID NO: 728297 - RNA, 21 nt, Human
aaugcugcuuguggguugcuu

SEQ ID NO: 728298 - RNA, 22 nt, Human
aauuaaacaguucccuaggaga

SEQ ID NO: 728299 - RNA, 23 nt, Human
acaaagagcagcgccuguaacuc

SEQ ID NO: 728300 - RNA, 19 nt, Human
acacuggaggcgagcgggc

SEQ ID NO: 728301 - RNA, 22 nt, Human
acccagaaaacacaagcagcuu

SEQ ID NO: 728302 - RNA, 19 nt, Human
acccucuccaaucagggau

SEQ ID NO: 728303 - RNA, 24 nt, Human
acuacaaccuauugagguaggcac

SEQ ID NO: 728304 - RNA, 24 nt, Human
acuauguugcccaggcuggucuug

SEQ ID NO: 728305 - RNA, 25 nt, Human
acuauguugcccaggcuggucuuga

SEQ ID NO: 728306 - RNA, 24 nt, Human
agaaacccagggcucucccacccu

SEQ ID NO: 728307 - RNA, 20 nt, Human
agaaugaccacugacauuaa

SEQ ID NO: 728308 - RNA, 18 nt, Human
agacaccccaacuugggc

SEQ ID NO: 728309 - RNA, 23 nt, Human
agacagggucucacuauguugcc

SEQ ID NO: 728310 - RNA, 18 nt, Human
agacuauaggcacgcacc

SEQ ID NO: 728311 - RNA, 21 nt, Human
agaugacacuuucucucuucc

SEQ ID NO: 728312 - RNA, 23 nt, Human
agcagcugagacuauaggcacgc

SEQ ID NO: 728313 - RNA, 23 nt, Human
agcaggugguugguuccagagau

SEQ ID NO: 728314 - RNA, 21 nt, Human
agccaucccuaguacaggacc

SEQ ID NO: 728315 - RNA, 23 nt, Human
agccugaggcggggcccgaucgc

SEQ ID NO: 728316 - RNA, 19 nt, Human
aggaaggugggcaaggcuc

SEQ ID NO: 728317 - RNA, 25 nt, Human
aggcaaaaaagcaacacuaaaagca

SEQ ID NO: 728318 - RNA, 22 nt, Human
aggcaagaagaaugaccuugau

SEQ ID NO: 728319 - RNA, 20 nt, Human
aggcaugagccaccacgccc

SEQ ID NO: 728320 - RNA, 19 nt, Human
aggccccaaggagacccaa

SEQ ID NO: 728321 - RNA, 18 nt, Human
aggcggggcccgaucgcg

SEQ ID NO: 728322 - RNA, 18 nt, Human
agggagggggaauuccag

SEQ ID NO: 728323 - RNA, 20 nt, Human
agggcaaacacagcagccuc

SEQ ID NO: 728324 - RNA, 22 nt, Human
aggggcgggagcgaaaccugcc

SEQ ID NO: 728325 - RNA, 27 nt, Human
auaauucuugacaccuacuuuucucug

SEQ ID NO: 728326 - RNA, 22 nt, Human
aucagaugccaagguaaacacc

SEQ ID NO: 728327 - RNA, 23 nt, Human
aucagccggccucagccucccaa

SEQ ID NO: 728328 - RNA, 21 nt, Human
auccuucugccucagccuccc

SEQ ID NO: 728329 - RNA, 20 nt, Human
augauucuuguggccacaaa

SEQ ID NO: 728330 - RNA, 18 nt, Human
auggagcgcuuucugugu

SEQ ID NO: 728331 - RNA, 22 nt, Human
auguugcccaggcuggucuuga

SEQ ID NO: 728332 - RNA, 20 nt, Human
auugcaaguugcucucagca

SEQ ID NO: 728333 - RNA, 23 nt, Human
auuuuuaaaccauucuaaaggca

SEQ ID NO: 728334 - RNA, 21 nt, Human
caaaaaagcaacacuaaaagc

SEQ ID NO: 728335 - RNA, 18 nt, Human
caacacuaaaagcaggcc

SEQ ID NO: 728336 - RNA, 19 nt, Human
caagaagcccaagccaagg

SEQ ID NO: 728337 - RNA, 19 nt, Human
caagagcccugacaccacc

SEQ ID NO: 728338 - RNA, 22 nt, Human
caagcaauccuucugccucagc

SEQ ID NO: 728339 - RNA, 23 nt, Human
caaggcccaggugcccaaacacc

SEQ ID NO: 728340 - RNA, 19 nt, Human
caaguuggugaccccugac

SEQ ID NO: 728341 - RNA, 20 nt, Human
caauccugcugcggcuucug

SEQ ID NO: 728342 - RNA, 18 nt, Human
cacaugugcacacacacc

SEQ ID NO: 728343 - RNA, 22 nt, Human
caccaccacgccuggcucauuu

SEQ ID NO: 728344 - RNA, 19 nt, Human
caccacgccuggcucauuu

SEQ ID NO: 728345 - RNA, 22 nt, Human
cacgcaccaccacgccuggcuc

SEQ ID NO: 728346 - RNA, 25 nt, Human
cacgcaggucaugaggauguguaau

SEQ ID NO: 728347 - RNA, 19 nt, Human
cacuauguugcccaggcug

SEQ ID NO: 728348 - RNA, 24 nt, Human
cacuauguugcccaggcuggucuu

SEQ ID NO: 728349 - RNA, 22 nt, Human
cacucagaauacacucccucag

SEQ ID NO: 728350 - RNA, 22 nt, Human
cacuuaacugcucaccaagcac

SEQ ID NO: 728351 - RNA, 18 nt, Human
cagaaugaccacugacau

SEQ ID NO: 728352 - RNA, 20 nt, Human
cagagaugagccccaacucu

SEQ ID NO: 728353 - RNA, 22 nt, Human
cagagcaagagguggacagaga

SEQ ID NO: 728354 - RNA, 21 nt, Human
cagccauaucugaagcagcac

SEQ ID NO: 728355 - RNA, 19 nt, Human
caggacccagggaauuugc

SEQ ID NO: 728356 - RNA, 22 nt, Human
caggagacaaggguaccagcca

SEQ ID NO: 728357 - RNA, 20 nt, Human
cagggcucucccacccucuc

SEQ ID NO: 728358 - RNA, 24 nt, Human
cagggucucacuauguugcccagg

SEQ ID NO: 728359 - RNA, 24 nt, Human
cagggucuugcuuugucacccagg

SEQ ID NO: 728360 - RNA, 20 nt, Human
caguccggggccgcgugcag

SEQ ID NO: 728361 - RNA, 21 nt, Human
cauggucccaggcccugcagu

SEQ ID NO: 728362 - RNA, 21 nt, Human
ccaaacaccaacaguaaugcu

SEQ ID NO: 728363 - RNA, 24 nt, Human
ccaaacaccaacaguaaugcugcu

SEQ ID NO: 728364 - RNA, 24 nt, Human
ccaaaguguugggauuauaggcau

SEQ ID NO: 728365 - RNA, 21 nt, Human
ccacauccaggggugcagagg

SEQ ID NO: 728366 - RNA, 21 nt, Human
ccagaucaggcuucaaguugg

SEQ ID NO: 728367 - RNA, 24 nt, Human
ccagcccacauggucccaggcccu

SEQ ID NO: 728368 - RNA, 23 nt, Human
ccagggcaaacacagcagccucc

SEQ ID NO: 728369 - RNA, 19 nt, Human
ccauacuucaaccucuggg

SEQ ID NO: 728370 - RNA, 22 nt, Human
cccaagccaaggcacuuccagc

SEQ ID NO: 728371 - RNA, 22 nt, Human
ccccaguacuccucgaggcacc

SEQ ID NO: 728372 - RNA, 25 nt, Human
ccccauucugcuggugcucccaaaa

SEQ ID NO: 728373 - RNA, 26 nt, Human
ccccauucugcuggugcucccaaaag

SEQ ID NO: 728374 - RNA, 22 nt, Human
cccuccuggacuggccaguucu

SEQ ID NO: 728375 - RNA, 21 nt, Human
ccucaggccccaaggagaccc

SEQ ID NO: 728376 - RNA, 28 nt, Human
ccuccaagcaauccuucugccucagccu

SEQ ID NO: 728377 - RNA, 26 nt, Human
ccugcaggccacaggcugaacaagcu

SEQ ID NO: 728378 - RNA, 27 nt, Human
ccugcggccaggacagcuguggaaggc

SEQ ID NO: 728379 - RNA, 18 nt, Human
ccuggcaacugugauugg

SEQ ID NO: 728380 - RNA, 19 nt, Human
ccuuggguuugggguugag

SEQ ID NO: 728381 - RNA, 18 nt, Human
cgccuugaacacccugcg

SEQ ID NO: 728382 - RNA, 23 nt, Human
cgggcggcccugaaacacugggc

SEQ ID NO: 728383 - RNA, 25 nt, Human
cguagcagaugccaccauggauacc

SEQ ID NO: 728384 - RNA, 20 nt, Human
cuagugaaaggaaggcuggg

SEQ ID NO: 728385 - RNA, 19 nt, Human
cucaaacucuccauacuuc

SEQ ID NO: 728386 - RNA, 23 nt, Human
cucaggccccaaggagacccaag

SEQ ID NO: 728387 - RNA, 18 nt, Human
cuccaagcaauccuucug

SEQ ID NO: 728388 - RNA, 24 nt, Human
cuccagcccacauggucccaggcc

SEQ ID NO: 728389 - RNA, 18 nt, Human
cuccagugggguauacag

SEQ ID NO: 728390 - RNA, 24 nt, Human
cuccagugggguauacagacagcc

SEQ ID NO: 728391 - RNA, 22 nt, Human
cugaagcaagcccuccuggacu

SEQ ID NO: 728392 - RNA, 19 nt, Human
cugccaagggaaauaccac

SEQ ID NO: 728393 - RNA, 23 nt, Human
cugccucagccucccgagcagcu

SEQ ID NO: 728394 - RNA, 18 nt, Human
cuggagcaccaauggagg

SEQ ID NO: 728395 - RNA, 24 nt, Human
cuggagcaccaauggaggucacca

SEQ ID NO: 728396 - RNA, 19 nt, Human
cuggaucacggugauuggu

SEQ ID NO: 728397 - RNA, 19 nt, Human
cuggucuugaacuccugca

SEQ ID NO: 728398 - RNA, 19 nt, Human
cugguuggagcaagugauc

SEQ ID NO: 728399 - RNA, 18 nt, Human
cuuaggccaugcuggccu

SEQ ID NO: 728400 - RNA, 19 nt, Human
cuucagccaucccuaguac

SEQ ID NO: 728401 - RNA, 20 nt, Human
cuuggccuuggcuuggucuu

SEQ ID NO: 728402 - RNA, 21 nt, Human
cuuggccuuggcuuggucuuc

SEQ ID NO: 728403 - RNA, 18 nt, Human
cuuucucucuuccuuggg

SEQ ID NO: 728404 - RNA, 18 nt, Human
gaacaagcuagcucuaaa

SEQ ID NO: 728405 - RNA, 20 nt, Human
gaaggcugggguuugagucc

SEQ ID NO: 728406 - RNA, 20 nt, Human
gacacuggaggcgagcgggc

SEQ ID NO: 728407 - RNA, 22 nt, Human
gacagggucuugcuuugucacc

SEQ ID NO: 728408 - RNA, 24 nt, Human
gaccuccaagcaauccuucugccu

SEQ ID NO: 728409 - RNA, 21 nt, Human
gaccuggcaaucgcucccccu

SEQ ID NO: 728410 - RNA, 20 nt, Human
gagaucauggcucacuccag

SEQ ID NO: 728411 - RNA, 23 nt, Human
gagcaagagguggacagagagga

SEQ ID NO: 728412 - RNA, 20 nt, Human
gaggucaccaggcaggggug

SEQ ID NO: 728413 - RNA, 21 nt, Human
gauuauaggcaugagccacca

SEQ ID NO: 728414 - RNA, 22 nt, Human
gauuauaggcaugagccaccac

SEQ ID NO: 728415 - RNA, 24 nt, Human
gcaacacuaaaagcaggccagauc

SEQ ID NO: 728416 - RNA, 22 nt, Human
gcagagcaagagguggacagag

SEQ ID NO: 728417 - RNA, 23 nt, Human
gcagagcaagagguggacagaga

SEQ ID NO: 728418 - RNA, 18 nt, Human
gcaugugacucgagcugg

SEQ ID NO: 728419 - RNA, 21 nt, Human
gcccacgggaaaccuccagga

SEQ ID NO: 728420 - RNA, 23 nt, Human
gccccgcccacacaagcaguuuc

SEQ ID NO: 728421 - RNA, 23 nt, Human
gccucagccucccaaaguguugg

SEQ ID NO: 728422 - RNA, 24 nt, Human
ggaagugggcuggagccuuuggga

SEQ ID NO: 728423 - RNA, 22 nt, Human
ggagcaccaauggaggucacca

SEQ ID NO: 728424 - RNA, 22 nt, Human
ggaucucuagccuggugugucc

SEQ ID NO: 728425 - RNA, 27 nt, Human
ggaugugcuguuccccacaaagagcag

SEQ ID NO: 728426 - RNA, 19 nt, Human
ggauuauaggcaugagcca

SEQ ID NO: 728427 - RNA, 19 nt, Human
ggcaaacacagcagccucc

SEQ ID NO: 728428 - RNA, 24 nt, Human
ggccaaucagagccuuccaugaga

SEQ ID NO: 728429 - RNA, 22 nt, Human
ggcugggguuugaguccuggcc

SEQ ID NO: 728430 - RNA, 24 nt, Human
ggcuggucuugaacuccugcacuc

SEQ ID NO: 728431 - RNA, 18 nt, Human
gggagcugugcugaaagc

SEQ ID NO: 728432 - RNA, 22 nt, Human
gggcaaacacagcagccuccac

SEQ ID NO: 728433 - RNA, 18 nt, Human
gggcaaggcucucuccca

SEQ ID NO: 728434 - RNA, 22 nt, Human
gggcggcccugaaacacugggc

SEQ ID NO: 728435 - RNA, 22 nt, Human
ggucaggcuuaggccaugcugg

SEQ ID NO: 728436 - RNA, 19 nt, Human
ggucuuccuuacacgaagc

SEQ ID NO: 728437 - RNA, 23 nt, Human
ggugcaguugagaggccugagga

SEQ ID NO: 728438 - RNA, 20 nt, Human
guaaugugggcugggcgcaa

SEQ ID NO: 728439 - RNA, 20 nt, Human
guggguugcuucuguccugg

SEQ ID NO: 728440 - RNA, 19 nt, Human
uaaauuuuacagcagggag

SEQ ID NO: 728441 - RNA, 23 nt, Human
uaagagaaaagcuagaaauucac

SEQ ID NO: 728442 - RNA, 20 nt, Human
uaagcaaggccaggagacaa

SEQ ID NO: 728443 - RNA, 19 nt, Human
uaagcuccuggauccagcc

SEQ ID NO: 728444 - RNA, 23 nt, Human
uaaugcuuccacguggguccccg

SEQ ID NO: 728445 - RNA, 21 nt, Human
uacaggggugagaucauggcu

SEQ ID NO: 728446 - RNA, 19 nt, Human
uacccagaaaacacaagca

SEQ ID NO: 728447 - RNA, 18 nt, Human
uaccugaagcaagcccuc

SEQ ID NO: 728448 - RNA, 24 nt, Human
uagacaccuuggccuuggcuuggu

SEQ ID NO: 728449 - RNA, 22 nt, Human
uagagacagggucucacuaugu

SEQ ID NO: 728450 - RNA, 19 nt, Human
uagagugugaauccugaaa

SEQ ID NO: 728451 - RNA, 21 nt, Human
uagcagacuccccucccccca

SEQ ID NO: 728452 - RNA, 18 nt, Human
uaggagagaaaggcaucu

SEQ ID NO: 728453 - RNA, 19 nt, Human
uaugcaggcaagcugcagg

SEQ ID NO: 728454 - RNA, 18 nt, Human
uaugguagacaccuuggc

SEQ ID NO: 728455 - RNA, 24 nt, Human
uaugguagacaccuuggccuuggc

SEQ ID NO: 728456 - RNA, 24 nt, Human
uauguugcccaggcuggucuugaa

SEQ ID NO: 728457 - RNA, 19 nt, Human
ucacugcaccucacugcaa

SEQ ID NO: 728458 - RNA, 24 nt, Human
uccaagcaauccuucugccucagc

SEQ ID NO: 728459 - RNA, 24 nt, Human
ucccaaaguguugggauuauaggc

SEQ ID NO: 728460 - RNA, 23 nt, Human
ucccacuacaaccuauugaggua

SEQ ID NO: 728461 - RNA, 22 nt, Human
uccguaaaaggcuucugugucc

SEQ ID NO: 728462 - RNA, 18 nt, Human
uccugcugcggcuucugc

SEQ ID NO: 728463 - RNA, 18 nt, Human
ucucacuauguugcccag

SEQ ID NO: 728464 - RNA, 19 nt, Human
ucucacuauguugcccagg

SEQ ID NO: 728465 - RNA, 23 nt, Human
ucucacuauguugcccaggcugg

SEQ ID NO: 728466 - RNA, 24 nt, Human
ucucacuauguugcccaggcuggu

SEQ ID NO: 728467 - RNA, 26 nt, Human
ucucacuauguugcccaggcuggucu

SEQ ID NO: 728468 - RNA, 27 nt, Human
ucucacuauguugcccaggcuggucuu

SEQ ID NO: 728469 - RNA, 20 nt, Human
ucuccagugugccuggcaac

SEQ ID NO: 728470 - RNA, 20 nt, Human
ucucuguggcuuacaaccaa

SEQ ID NO: 728471 - RNA, 21 nt, Human
ucugcuggugcucccaaaugc

SEQ ID NO: 728472 - RNA, 20 nt, Human
ucuggaacaggcaguuccag

SEQ ID NO: 728473 - RNA, 25 nt, Human
ucugggaagugggcuggagccuuuc

SEQ ID NO: 728474 - RNA, 21 nt, Human
ucugugguccagcuucucuug

SEQ ID NO: 728475 - RNA, 24 nt, Human
ucuguguucugggagcugugcuga

SEQ ID NO: 728476 - RNA, 19 nt, Human
ucuugcuuugucacccagg

SEQ ID NO: 728477 - RNA, 20 nt, Human
ucuugcuuugucacccagga

SEQ ID NO: 728478 - RNA, 23 nt, Human
ucuugcuuugucacccaggauga

SEQ ID NO: 728479 - RNA, 24 nt, Human
ucuugcuuugucacccaggaugaa

SEQ ID NO: 728480 - RNA, 21 nt, Human
ucuuuuuuugagacagggucu

SEQ ID NO: 728481 - RNA, 20 nt, Human
ugaaauuauaggcuuggggc

SEQ ID NO: 728482 - RNA, 18 nt, Human
ugacacuuucucucuucc

SEQ ID NO: 728483 - RNA, 22 nt, Human
ugaccccugacuggcugccuuc

SEQ ID NO: 728484 - RNA, 21 nt, Human
ugagacuauaggcacgcacca

SEQ ID NO: 728485 - RNA, 24 nt, Human
ugagacuauaggcacgcaccacca

SEQ ID NO: 728486 - RNA, 22 nt, Human
ugagacuccugccacgcagguc

SEQ ID NO: 728487 - RNA, 21 nt, Human
ugagagcaggugguugguucc

SEQ ID NO: 728488 - RNA, 18 nt, Human
ugaggauguguaaugugg

SEQ ID NO: 728489 - RNA, 19 nt, Human
ugagguaggcacugcuauc

SEQ ID NO: 728490 - RNA, 21 nt, Human
ugauaugggagcaauuaguuu

SEQ ID NO: 728491 - RNA, 23 nt, Human
ugcaaucagaugccaagguaaac

SEQ ID NO: 728492 - RNA, 23 nt, Human
ugcacacaugugcacacacaccu

SEQ ID NO: 728493 - RNA, 19 nt, Human
ugcacagagccugaggcgg

SEQ ID NO: 728494 - RNA, 21 nt, Human
ugcacagagccugaggcgggg

SEQ ID NO: 728495 - RNA, 23 nt, Human
ugcagagucaagaggccugggug

SEQ ID NO: 728496 - RNA, 21 nt, Human
ugcagcagagaugagccccaa

SEQ ID NO: 728497 - RNA, 21 nt, Human
ugccaccauggauaccugcug

SEQ ID NO: 728498 - RNA, 24 nt, Human
ugcccaggcuggucuugaacuccu

SEQ ID NO: 728499 - RNA, 20 nt, Human
ugccccagggcaaacacagc

SEQ ID NO: 728500 - RNA, 23 nt, Human
ugccccagggcaaacacagcagc

SEQ ID NO: 728501 - RNA, 24 nt, Human
ugccucagccucccgagcagcuga

SEQ ID NO: 728502 - RNA, 21 nt, Human
ugcggccaggacagcugugga

SEQ ID NO: 728503 - RNA, 25 nt, Human
ugcuuaagccaguuugggcugguuu

SEQ ID NO: 728504 - RNA, 26 nt, Human
ugcuuaagccaguuugggcugguuuu

SEQ ID NO: 728505 - RNA, 19 nt, Human
ugcuuuguugcuuaagcca

SEQ ID NO: 728506 - RNA, 24 nt, Human
uggaagaaagaaugaggucagcau

SEQ ID NO: 728507 - RNA, 18 nt, Human
uggauaccugcugguucu

SEQ ID NO: 728508 - RNA, 21 nt, Human
uggcaaucccuuccuuggauu

SEQ ID NO: 728509 - RNA, 24 nt, Human
uggcucacuccagccuugaccucc

SEQ ID NO: 728510 - RNA, 20 nt, Human
uggcucaguuacugcagcag

SEQ ID NO: 728511 - RNA, 18 nt, Human
uggcugacgucgcuaagc

SEQ ID NO: 728512 - RNA, 22 nt, Human
ugggaagugggcuggagccuuu

SEQ ID NO: 728513 - RNA, 18 nt, Human
ugggagcugugcugaaag

SEQ ID NO: 728514 - RNA, 18 nt, Human
ugggauuauaggcaugag

SEQ ID NO: 728515 - RNA, 19 nt, Human
ugggauuauaggcaugagc

SEQ ID NO: 728516 - RNA, 22 nt, Human
ugggauuauaggcaugagccac

SEQ ID NO: 728517 - RNA, 23 nt, Human
ugggauuauaggcaugagccacc

SEQ ID NO: 728518 - RNA, 24 nt, Human
ugggauuauaggcaugagccacca

SEQ ID NO: 728519 - RNA, 19 nt, Human
ugggcaaggcucucuccca

SEQ ID NO: 728520 - RNA, 21 nt, Human
ugggcagcaucuaggccuggg

SEQ ID NO: 728521 - RNA, 21 nt, Human
ugggguagggacuggcguggc

SEQ ID NO: 728522 - RNA, 22 nt, Human
ugggguagggacuggcguggcc

SEQ ID NO: 728523 - RNA, 22 nt, Human
ugguagacaccuuggccuuggc

SEQ ID NO: 728524 - RNA, 22 nt, Human
ugguccagauugggcaugaccc

SEQ ID NO: 728525 - RNA, 20 nt, Human
uggugaccccugacuggcug

SEQ ID NO: 728526 - RNA, 24 nt, Human
uguagagacagggucucacuaugu

SEQ ID NO: 728527 - RNA, 18 nt, Human
ugugacucgagcugggcc

SEQ ID NO: 728528 - RNA, 18 nt, Human
uuaacugcucaccaagca

SEQ ID NO: 728529 - RNA, 21 nt, Human
uucaagagcccugacaccacc

SEQ ID NO: 728530 - RNA, 19 nt, Human
uucaugcaacaauagugac

SEQ ID NO: 728531 - RNA, 19 nt, Human
uuccuggcccugcauugcu

SEQ ID NO: 728532 - RNA, 22 nt, Human
uucuguguccuucucuggggcu

SEQ ID NO: 728533 - RNA, 19 nt, Human
uucuguguucugggagcug

SEQ ID NO: 728534 - RNA, 21 nt, Human
uucuguguucugggagcugug

SEQ ID NO: 728535 - RNA, 18 nt, Human
uucuucuuuuuuugagac

SEQ ID NO: 728536 - RNA, 18 nt, Human
uugaagcaccugggcaug

SEQ ID NO: 728537 - RNA, 22 nt, Human
uugagacagggucuugcuuugu

SEQ ID NO: 728538 - RNA, 21 nt, Human
uugggauuauaggcaugagcc

SEQ ID NO: 728539 - RNA, 18 nt, Human
uuugggcugguuuucccu

SEQ ID NO: 728540 - RNA, 18 nt, Human
uuuguagagacagggucu

SEQ ID NO: 728541 - RNA, 24 nt, Human
uuuguagagacagggucucacuau

SEQ ID NO: 728542 - RNA, 22 nt, Human
aaaacauaaagcaauaaaauuu

SEQ ID NO: 728543 - RNA, 23 nt, Human
aaauacauguuuuucacaaauaa

SEQ ID NO: 728544 - RNA, 21 nt, Human
aacacguuuuuuaaacgugca

SEQ ID NO: 728545 - RNA, 21 nt, Human
aagcaaauauaugacauuaac

SEQ ID NO: 728546 - RNA, 24 nt, Human
acagcagcaaaagcaagcuaauac

SEQ ID NO: 728547 - RNA, 20 nt, Human
agaaaugagacauaccagaa

SEQ ID NO: 728548 - RNA, 21 nt, Human
agaaaugagacauaccagaac

SEQ ID NO: 728549 - RNA, 22 nt, Human
agaaaugagacauaccagaaca

SEQ ID NO: 728550 - RNA, 18 nt, Human
agauccucuccaagcccc

SEQ ID NO: 728551 - RNA, 20 nt, Human
aggcagccucuggcaaaaug

SEQ ID NO: 728552 - RNA, 19 nt, Human
aggucaaaacauaaagcaa

SEQ ID NO: 728553 - RNA, 24 nt, Human
aggugguggugguuggaagaaacc

SEQ ID NO: 728554 - RNA, 22 nt, Human
augagcaggacuuuucucaaaa

SEQ ID NO: 728555 - RNA, 21 nt, Human
caaaagaacagcuucagccuu

SEQ ID NO: 728556 - RNA, 19 nt, Human
caaaauggcccccgucuga

SEQ ID NO: 728557 - RNA, 20 nt, Human
caagccccaagcugcagaag

SEQ ID NO: 728558 - RNA, 27 nt, Human
caagccccaagcugcagaagaggcaaa

SEQ ID NO: 728559 - RNA, 19 nt, Human
caagcugcagaagaggcaa

SEQ ID NO: 728560 - RNA, 18 nt, Human
cacagcagcaaaagcaag

SEQ ID NO: 728561 - RNA, 20 nt, Human
cacagcagcaaaagcaagcu

SEQ ID NO: 728562 - RNA, 21 nt, Human
cagaagaggcaaaagaacagc

SEQ ID NO: 728563 - RNA, 18 nt, Human
cagcagcaaaagcaagcu

SEQ ID NO: 728564 - RNA, 20 nt, Human
cagcagcaaaagcaagcuaa

SEQ ID NO: 728565 - RNA, 20 nt, Human
cagcuucagccugccgccag

SEQ ID NO: 728566 - RNA, 23 nt, Human
ccaagccccaagcugcagaagag

SEQ ID NO: 728567 - RNA, 19 nt, Human
ccccacagcugccaccggg

SEQ ID NO: 728568 - RNA, 21 nt, Human
ccccacagcugccaccgggcg

SEQ ID NO: 728569 - RNA, 25 nt, Human
cccccgucugagcccuagaccccac

SEQ ID NO: 728570 - RNA, 22 nt, Human
ccccgucugagcccuagacccc

SEQ ID NO: 728571 - RNA, 20 nt, Human
cccuagaccccacagcugcc

SEQ ID NO: 728572 - RNA, 22 nt, Human
cccuagaccccacagcugccac

SEQ ID NO: 728573 - RNA, 23 nt, Human
ccugccgccaggccgcccccaac

SEQ ID NO: 728574 - RNA, 20 nt, Human
cgccaggccgcccccaacuc

SEQ ID NO: 728575 - RNA, 23 nt, Human
cgcccccaacuccgggaggcagc

SEQ ID NO: 728576 - RNA, 23 nt, Human
cugccgccaggccgcccccaacu

SEQ ID NO: 728577 - RNA, 21 nt, Human
gaaaugagacauaccagaaca

SEQ ID NO: 728578 - RNA, 18 nt, Human
gaacaugauuacauaaua

SEQ ID NO: 728579 - RNA, 20 nt, Human
gacauaccagaacaugauua

SEQ ID NO: 728580 - RNA, 19 nt, Human
gagacauaccagaacauga

SEQ ID NO: 728581 - RNA, 23 nt, Human
gauccucuccaagccccaagcug

SEQ ID NO: 728582 - RNA, 23 nt, Human
gcaggguugucaggugguggugg

SEQ ID NO: 728583 - RNA, 21 nt, Human
gcccccgucugagcccuagac

SEQ ID NO: 728584 - RNA, 20 nt, Human
ggcaaaauggcccccgucug

SEQ ID NO: 728585 - RNA, 23 nt, Human
uaaaauaaggcugagaaaugaga

SEQ ID NO: 728586 - RNA, 23 nt, Human
uaauuuuacauauagggcaacaa

SEQ ID NO: 728587 - RNA, 18 nt, Human
uacaaaacugggcagcag

SEQ ID NO: 728588 - RNA, 23 nt, Human
uacaguacuuguaagcccaugaa

SEQ ID NO: 728589 - RNA, 24 nt, Human
uacauguuuuucacaaauaauaua

SEQ ID NO: 728590 - RNA, 21 nt, Human
uagaaaguuccauuugucauc

SEQ ID NO: 728591 - RNA, 25 nt, Human
ucaucauguaaacacuuuuguucau

SEQ ID NO: 728592 - RNA, 22 nt, Human
uccaagccccaagcugcagaag

SEQ ID NO: 728593 - RNA, 20 nt, Human
uccacguuauaaaauaaggc

SEQ ID NO: 728594 - RNA, 22 nt, Human
ucccaugugacucagauuucau

SEQ ID NO: 728595 - RNA, 19 nt, Human
uccgggaggcagccucugg

SEQ ID NO: 728596 - RNA, 27 nt, Human
ucucaaaaauauuaaaauugaauucau

SEQ ID NO: 728597 - RNA, 19 nt, Human
ucuccaagccccaagcugc

SEQ ID NO: 728598 - RNA, 19 nt, Human
ucugaaaaaagcuauagaa

SEQ ID NO: 728599 - RNA, 18 nt, Human
ugaaaaaagcuauagaag

SEQ ID NO: 728600 - RNA, 21 nt, Human
ugaaaaaagcuauagaagacc

SEQ ID NO: 728601 - RNA, 21 nt, Human
ugacuuaauuugcuggaugug

SEQ ID NO: 728602 - RNA, 21 nt, Human
ugagcccuagaccccacagcu

SEQ ID NO: 728603 - RNA, 23 nt, Human
ugcagaagaggcaaaagaacagc

SEQ ID NO: 728604 - RNA, 18 nt, Human
ugcuggaugugaagugca

SEQ ID NO: 728605 - RNA, 22 nt, Human
uuaaauuucacaauuauguaga

SEQ ID NO: 728606 - RNA, 20 nt, Human
uucaucauacaguauuuuau

SEQ ID NO: 728607 - RNA, 21 nt, Human
uucaucauacaguauuuuauc

SEQ ID NO: 728608 - RNA, 21 nt, Human
uuccagauccucuccaagccc

SEQ ID NO: 728609 - RNA, 20 nt, Human
uuuaauguuuucuaaaacuu

SEQ ID NO: 728610 - RNA, 27 nt, Human
uuucacaauuauguagauaauugaacc

SEQ ID NO: 728611 - RNA, 24 nt, Human
uuuuagguuuuuaugugaugaaua

SEQ ID NO: 728612 - RNA, 23 nt, Human
aaaaaaaacaaaaccccaauccc

SEQ ID NO: 728613 - RNA, 19 nt, Human
aaaaaaacagccgggcaug

SEQ ID NO: 728614 - RNA, 22 nt, Human
aaaacacccaacaaacaaaaaa

SEQ ID NO: 728615 - RNA, 26 nt, Human
aaaaccccaauccccuacaaauaugg

SEQ ID NO: 728616 - RNA, 24 nt, Human
aaaacuuucccacauuccuuaugg

SEQ ID NO: 728617 - RNA, 24 nt, Human
aaaagagauucucuucaucgugga

SEQ ID NO: 728618 - RNA, 25 nt, Human
aaaauacacacuaaucugauguggg

SEQ ID NO: 728619 - RNA, 22 nt, Human
aaacagagauaaucauccagga

SEQ ID NO: 728620 - RNA, 18 nt, Human
aaagaagccaagcuagaa

SEQ ID NO: 728621 - RNA, 21 nt, Human
aaauggaauuugaagcuaaau

SEQ ID NO: 728622 - RNA, 23 nt, Human
aaauguaagaaagcaacacuuug

SEQ ID NO: 728623 - RNA, 24 nt, Human
aacagccgggcaugguggcucaug

SEQ ID NO: 728624 - RNA, 19 nt, Human
aacauggugaaaccccguc

SEQ ID NO: 728625 - RNA, 20 nt, Human
aacauggugaaaccccgucu

SEQ ID NO: 728626 - RNA, 21 nt, Human
aacauggugaaaccccgucuc

SEQ ID NO: 728627 - RNA, 22 nt, Human
aagaagccaagcuagaaaaaua

SEQ ID NO: 728628 - RNA, 18 nt, Human
aagcaagcaucuccacau

SEQ ID NO: 728629 - RNA, 18 nt, Human
aagcugagaaacaaggaa

SEQ ID NO: 728630 - RNA, 24 nt, Human
aaggugggcagaucacaaggucag

SEQ ID NO: 728631 - RNA, 24 nt, Human
aauacaagccuacucagaccaaaa

SEQ ID NO: 728632 - RNA, 24 nt, Human
aaucacuugaaccugggaggcgga

SEQ ID NO: 728633 - RNA, 19 nt, Human
acaaggaauaucaugaaac

SEQ ID NO: 728634 - RNA, 22 nt, Human
acacccaacaaacaaaaaaccc

SEQ ID NO: 728635 - RNA, 20 nt, Human
acagacaauucaaaugucag

SEQ ID NO: 728636 - RNA, 23 nt, Human
acaggagaaucacuugaaccugg

SEQ ID NO: 728637 - RNA, 19 nt, Human
acauuccuuauggugacag

SEQ ID NO: 728638 - RNA, 23 nt, Human
acccaacaaacaaaaaacccaau

SEQ ID NO: 728639 - RNA, 24 nt, Human
accccgucucuacuaaaaauacaa

SEQ ID NO: 728640 - RNA, 19 nt, Human
acugugaauucuccaaugc

SEQ ID NO: 728641 - RNA, 25 nt, Human
agaaaaauauacucucugaagggac

SEQ ID NO: 728642 - RNA, 22 nt, Human
agaaucacuugaaccugggagg

SEQ ID NO: 728643 - RNA, 22 nt, Human
agacaggagaaucacuugaacc

SEQ ID NO: 728644 - RNA, 24 nt, Human
agacaggagaaucacuugaaccug

SEQ ID NO: 728645 - RNA, 20 nt, Human
agaccaaaaagaaaauaaua

SEQ ID NO: 728646 - RNA, 23 nt, Human
agagacaaguuuucuggggagag

SEQ ID NO: 728647 - RNA, 21 nt, Human
agagaugcaacuuauuucaaa

SEQ ID NO: 728648 - RNA, 23 nt, Human
agccgggcaugguggcucaugcc

SEQ ID NO: 728649 - RNA, 22 nt, Human
agccuggccaacauggugaaac

SEQ ID NO: 728650 - RNA, 24 nt, Human
agccuggccaacauggugaaaccc

SEQ ID NO: 728651 - RNA, 25 nt, Human
agccugggcgacaggagcaagacuc

SEQ ID NO: 728652 - RNA, 23 nt, Human
agcugggaaugguggcaagugcc

SEQ ID NO: 728653 - RNA, 23 nt, Human
aggagacagaucacaaauccaga

SEQ ID NO: 728654 - RNA, 23 nt, Human
aggagcaagacuccaucucaaaa

SEQ ID NO: 728655 - RNA, 26 nt, Human
aggcagaaagagacuggaagugcaug

SEQ ID NO: 728656 - RNA, 21 nt, Human
aggccaaggugggcagaucac

SEQ ID NO: 728657 - RNA, 21 nt, Human
aggcggagguugcagugagcc

SEQ ID NO: 728658 - RNA, 24 nt, Human
aggcggagguugcagugagccgag

SEQ ID NO: 728659 - RNA, 22 nt, Human
agggauguacagcagagggaca

SEQ ID NO: 728660 - RNA, 18 nt, Human
aggugggcagaucacaag

SEQ ID NO: 728661 - RNA, 24 nt, Human
aggugggcagaucacaaggucagg

SEQ ID NO: 728662 - RNA, 21 nt, Human
aguaagaucucaccuggaaac

SEQ ID NO: 728663 - RNA, 18 nt, Human
auaaaagaaaucaggaaa

SEQ ID NO: 728664 - RNA, 23 nt, Human
auaaaauccacuuuuaccuaaag

SEQ ID NO: 728665 - RNA, 19 nt, Human
aucacaaggucaggaguuc

SEQ ID NO: 728666 - RNA, 20 nt, Human
aucacaaggucaggaguucc

SEQ ID NO: 728667 - RNA, 21 nt, Human
auccaaagcugagaaacaagg

SEQ ID NO: 728668 - RNA, 24 nt, Human
aucgugccauugcacuccagccug

SEQ ID NO: 728669 - RNA, 24 nt, Human
aucucaaaaaaauaaagaaaauaa

SEQ ID NO: 728670 - RNA, 24 nt, Human
aucuuaaaaaaacagccgggcaug

SEQ ID NO: 728671 - RNA, 19 nt, Human
auucagcaucuccagauuu

SEQ ID NO: 728672 - RNA, 24 nt, Human
auugcacuccagccugggcgacag

SEQ ID NO: 728673 - RNA, 23 nt, Human
auuugggugagaagagacagcua

SEQ ID NO: 728674 - RNA, 18 nt, Human
caaaaaaaacaaaacccc

SEQ ID NO: 728675 - RNA, 24 nt, Human
caaaaaaaacaaaaccccaauccc

SEQ ID NO: 728676 - RNA, 25 nt, Human
caaaaaaauaaagaaaauaaagaag

SEQ ID NO: 728677 - RNA, 24 nt, Human
caaaaugcacagacaauucaaaug

SEQ ID NO: 728678 - RNA, 24 nt, Human
caacauggugaaaccccgucucua

SEQ ID NO: 728679 - RNA, 21 nt, Human
caagacuccaucucaaaaaaa

SEQ ID NO: 728680 - RNA, 25 nt, Human
caagcuagaaaaauauacucucuga

SEQ ID NO: 728681 - RNA, 23 nt, Human
caaggaauaucaugaaaccaaga

SEQ ID NO: 728682 - RNA, 22 nt, Human
cacaaauccagagaugcaacuu

SEQ ID NO: 728683 - RNA, 25 nt, Human
cacuauaaacaaaagccuuucaaaa

SEQ ID NO: 728684 - RNA, 24 nt, Human
cacuccagccugggcgacaggagc

SEQ ID NO: 728685 - RNA, 21 nt, Human
cacugauuuuucccaaguucc

SEQ ID NO: 728686 - RNA, 21 nt, Human
cacuugaaccugggaggcgga

SEQ ID NO: 728687 - RNA, 21 nt, Human
cagcuucacaaguaggggcca

SEQ ID NO: 728688 - RNA, 22 nt, Human
cagcuucuaaacauucuuuccu

SEQ ID NO: 728689 - RNA, 21 nt, Human
cagguuuuagaacugaaaaga

SEQ ID NO: 728690 - RNA, 22 nt, Human
caucuaaaacaaaaugcacaga

SEQ ID NO: 728691 - RNA, 24 nt, Human
caugccuguaaucccugaacuuug

SEQ ID NO: 728692 - RNA, 25 nt, Human
cauuccccccaacaaaauucagcau

SEQ ID NO: 728693 - RNA, 19 nt, Human
cauugcacuccagccuggg

SEQ ID NO: 728694 - RNA, 21 nt, Human
cauugcacuccagccugggcg

SEQ ID NO: 728695 - RNA, 22 nt, Human
cauugcacuccagccugggcga

SEQ ID NO: 728696 - RNA, 24 nt, Human
cauugcacuccagccugggcgaca

SEQ ID NO: 728697 - RNA, 25 nt, Human
cauugcacuccagccugggcgacag

SEQ ID NO: 728698 - RNA, 24 nt, Human
ccaaugcuggcaaaccuucccaag

SEQ ID NO: 728699 - RNA, 22 nt, Human
ccagccugggcgacaggagcaa

SEQ ID NO: 728700 - RNA, 25 nt, Human
ccagggccagaagagaacucccucu

SEQ ID NO: 728701 - RNA, 23 nt, Human
ccagggccuguuccagcaccugc

SEQ ID NO: 728702 - RNA, 26 nt, Human
ccauaucaaaaggcaauaacacugag

SEQ ID NO: 728703 - RNA, 20 nt, Human
ccauugcacuccagccuggg

SEQ ID NO: 728704 - RNA, 21 nt, Human
ccauugcacuccagccugggc

SEQ ID NO: 728705 - RNA, 22 nt, Human
ccauugcacuccagccugggcg

SEQ ID NO: 728706 - RNA, 23 nt, Human
ccauugcacuccagccugggcga

SEQ ID NO: 728707 - RNA, 24 nt, Human
ccauugcacuccagccugggcgac

SEQ ID NO: 728708 - RNA, 19 nt, Human
cccaacaaaauucagcauc

SEQ ID NO: 728709 - RNA, 21 nt, Human
cccaauauagaaagaggaggu

SEQ ID NO: 728710 - RNA, 22 nt, Human
ccccagggccagaagagaacuc

SEQ ID NO: 728711 - RNA, 19 nt, Human
ccccccaacaaaauucagc

SEQ ID NO: 728712 - RNA, 19 nt, Human
ccccccaacaaaauucagc

SEQ ID NO: 728713 - RNA, 20 nt, Human
ccuaaguuaaaacacccaac

SEQ ID NO: 728714 - RNA, 18 nt, Human
ccucuuucucuccagaga

SEQ ID NO: 728715 - RNA, 23 nt, Human
ccuggccaacauggugaaacccc

SEQ ID NO: 728716 - RNA, 24 nt, Human
ccuggccaacauggugaaaccccg

SEQ ID NO: 728717 - RNA, 19 nt, Human
ccugggaggcggagguugc

SEQ ID NO: 728718 - RNA, 23 nt, Human
ccugggcgacaggagcaagacuc

SEQ ID NO: 728719 - RNA, 21 nt, Human
ccuguaaucccagcuacucgg

SEQ ID NO: 728720 - RNA, 22 nt, Human
ccuguaaucccugaacuuuggg

SEQ ID NO: 728721 - RNA, 24 nt, Human
ccuuucacugcauuuacugaaaca

SEQ ID NO: 728722 - RNA, 22 nt, Human
cgaaggcaagaggccucgaacc

SEQ ID NO: 728723 - RNA, 21 nt, Human
cgacaggagcaagacuccauc

SEQ ID NO: 728724 - RNA, 24 nt, Human
cgagaccagccuggccaacauggu

SEQ ID NO: 728725 - RNA, 24 nt, Human
cgggagacugagacaggagaauca

SEQ ID NO: 728726 - RNA, 20 nt, Human
cuaucuccagagaguagcaa

SEQ ID NO: 728727 - RNA, 18 nt, Human
cucagaccaaaaagaaaa

SEQ ID NO: 728728 - RNA, 24 nt, Human
cucaugccuguaaucccugaacuu

SEQ ID NO: 728729 - RNA, 19 nt, Human
cuccacauucuggaugaua

SEQ ID NO: 728730 - RNA, 24 nt, Human
cugaacuuugggaggccaaggugg

SEQ ID NO: 728731 - RNA, 23 nt, Human
cuguaaucccugaacuuugggag

SEQ ID NO: 728732 - RNA, 19 nt, Human
cuuugccagccugauucuu

SEQ ID NO: 728733 - RNA, 26 nt, Human
gaaggcacguggcaggguaggaguug

SEQ ID NO: 728734 - RNA, 23 nt, Human
gagaucgugccauugcacuccag

SEQ ID NO: 728735 - RNA, 23 nt, Human
gagguugcagugagccgagaucg

SEQ ID NO: 728736 - RNA, 22 nt, Human
gaucacaaggucaggaguucga

SEQ ID NO: 728737 - RNA, 24 nt, Human
gaucacaaggucaggaguucgaga

SEQ ID NO: 728738 - RNA, 23 nt, Human
gcaaaaaauuuagggauguacag

SEQ ID NO: 728739 - RNA, 24 nt, Human
gcagaaagagacuggaagugcaug

SEQ ID NO: 728740 - RNA, 19 nt, Human
gcaggguaggaguaggggg

SEQ ID NO: 728741 - RNA, 24 nt, Human
gccaacauggugaaaccccgucuc

SEQ ID NO: 728742 - RNA, 22 nt, Human
gccauugcacuccagccugggc

SEQ ID NO: 728743 - RNA, 24 nt, Human
gccauugcacuccagccugggcga

SEQ ID NO: 728744 - RNA, 23 nt, Human
ggaaugguggcaagugccuguaa

SEQ ID NO: 728745 - RNA, 20 nt, Human
ggacaccuacacggucuugu

SEQ ID NO: 728746 - RNA, 20 nt, Human
ggagguugcagugagccgag

SEQ ID NO: 728747 - RNA, 22 nt, Human
ggagguugcagugagccgagau

SEQ ID NO: 728748 - RNA, 23 nt, Human
ggagguugcagugagccgagauc

SEQ ID NO: 728749 - RNA, 24 nt, Human
ggagguugcagugagccgagaucg

SEQ ID NO: 728750 - RNA, 23 nt, Human
ggcagaucacaaggucaggaguu

SEQ ID NO: 728751 - RNA, 27 nt, Human
gggauaugaucaaaguuaacuugaaaa

SEQ ID NO: 728752 - RNA, 24 nt, Human
gggcaugguggcucaugccuguaa

SEQ ID NO: 728753 - RNA, 24 nt, Human
gggccagggccuguuccagcaccu

SEQ ID NO: 728754 - RNA, 26 nt, Human
ggguaggaguagggggguccaauuug

SEQ ID NO: 728755 - RNA, 22 nt, Human
ggucaaaaaaaacaaaacccca

SEQ ID NO: 728756 - RNA, 24 nt, Human
gguggcaagugccuguaaucccag

SEQ ID NO: 728757 - RNA, 24 nt, Human
gguggcucaugccuguaaucccug

SEQ ID NO: 728758 - RNA, 19 nt, Human
gucaagcuuucccaucggu

SEQ ID NO: 728759 - RNA, 19 nt, Human
guguuggagaauauaaagg

SEQ ID NO: 728760 - RNA, 18 nt, Human
guuuuagaacugaaaaga

SEQ ID NO: 728761 - RNA, 21 nt, Human
uaaaacaaaaugcacagacaa

SEQ ID NO: 728762 - RNA, 21 nt, Human
uaaaacacccaacaaacaaaa

SEQ ID NO: 728763 - RNA, 22 nt, Human
uaaaacacccaacaaacaaaaa

SEQ ID NO: 728764 - RNA, 23 nt, Human
uaaaacacccaacaaacaaaaaa

SEQ ID NO: 728765 - RNA, 26 nt, Human
uaaaaugagcaauuuagacuaccccc

SEQ ID NO: 728766 - RNA, 20 nt, Human
uaaacaaaagccuuucaaaa

SEQ ID NO: 728767 - RNA, 21 nt, Human
uaaagaaaauaaagaagccaa

SEQ ID NO: 728768 - RNA, 21 nt, Human
uaaagauaugagaugagacua

SEQ ID NO: 728769 - RNA, 21 nt, Human
uaacaccaucuaaaacaaaau

SEQ ID NO: 728770 - RNA, 19 nt, Human
uaagucucuaaacaagcau

SEQ ID NO: 728771 - RNA, 22 nt, Human
uaaguuaaaacacccaacaaac

SEQ ID NO: 728772 - RNA, 20 nt, Human
uaaucaaaaaagagaagauc

SEQ ID NO: 728773 - RNA, 20 nt, Human
uagaauucugagauaaucac

SEQ ID NO: 728774 - RNA, 19 nt, Human
uaggguacagugauuaaaa

SEQ ID NO: 728775 - RNA, 18 nt, Human
uagguuugaucugaaacc

SEQ ID NO: 728776 - RNA, 24 nt, Human
uauuacauuuaugcagucucucuc

SEQ ID NO: 728777 - RNA, 20 nt, Human
uauuucaaaaguccugguug

SEQ ID NO: 728778 - RNA, 18 nt, Human
ucacaaggucaggaguuc

SEQ ID NO: 728779 - RNA, 24 nt, Human
ucacaaggucaggaguucgagacc

SEQ ID NO: 728780 - RNA, 24 nt, Human
ucacuugaaccugggaggcggagg

SEQ ID NO: 728781 - RNA, 25 nt, Human
ucacuugaaccugggaggcggaggu

SEQ ID NO: 728782 - RNA, 22 nt, Human
ucagguagauaaugagaaggag

SEQ ID NO: 728783 - RNA, 23 nt, Human
ucagguuugcugcuuucuauccu

SEQ ID NO: 728784 - RNA, 23 nt, Human
ucaguaacaccaucuaaaacaaa

SEQ ID NO: 728785 - RNA, 21 nt, Human
ucaugccuguaaucccugaac

SEQ ID NO: 728786 - RNA, 18 nt, Human
uccacuauaaacaaaagc

SEQ ID NO: 728787 - RNA, 18 nt, Human
uccagccugggcgacagg

SEQ ID NO: 728788 - RNA, 19 nt, Human
uccaucucaaaaaaauaaa

SEQ ID NO: 728789 - RNA, 23 nt, Human
ucccgugaggcucuccucuuucu

SEQ ID NO: 728790 - RNA, 19 nt, Human
ucccucuacggagcgaagg

SEQ ID NO: 728791 - RNA, 23 nt, Human
ucgugccauugcacuccagccug

SEQ ID NO: 728792 - RNA, 21 nt, Human
ucuaaaagcuucccgugaggc

SEQ ID NO: 728793 - RNA, 24 nt, Human
ucuaaaauguaagaaagcaacacu

SEQ ID NO: 728794 - RNA, 19 nt, Human
ucuacagacauucccccca

SEQ ID NO: 728795 - RNA, 21 nt, Human
ucuauaagaaaaaauaucagu

SEQ ID NO: 728796 - RNA, 27 nt, Human
ucuaucuuaaaaaaacagccgggcaug

SEQ ID NO: 728797 - RNA, 27 nt, Human
ucuccacauucaucauguuuauugugc

SEQ ID NO: 728798 - RNA, 22 nt, Human
ucuccagagaugcucucucauc

SEQ ID NO: 728799 - RNA, 19 nt, Human
ucucuaaacaagcaucuca

SEQ ID NO: 728800 - RNA, 21 nt, Human
ucucuacuaaaaauacaaaaa

SEQ ID NO: 728801 - RNA, 19 nt, Human
ucucucucauguggauucu

SEQ ID NO: 728802 - RNA, 20 nt, Human
ugaaaagaauaagcaaguua

SEQ ID NO: 728803 - RNA, 24 nt, Human
ugaaccugggaggcggagguugca

SEQ ID NO: 728804 - RNA, 21 nt, Human
ugaagcuaaaggaguuaagug

SEQ ID NO: 728805 - RNA, 19 nt, Human
ugagaagagacagcuaggc

SEQ ID NO: 728806 - RNA, 24 nt, Human
ugagaaggagaugaguagagacaa

SEQ ID NO: 728807 - RNA, 24 nt, Human
ugagacaggagaaucacuugaacc

SEQ ID NO: 728808 - RNA, 19 nt, Human
ugagaugagacuagagcag

SEQ ID NO: 728809 - RNA, 22 nt, Human
ugagccgagaucgugccauugc

SEQ ID NO: 728810 - RNA, 24 nt, Human
ugaguggaucaguaaacaacggga

SEQ ID NO: 728811 - RNA, 19 nt, Human
ugcagcuucacaaguaggg

SEQ ID NO: 728812 - RNA, 19 nt, Human
ugcaguucuacagacauuc

SEQ ID NO: 728813 - RNA, 23 nt, Human
ugccuguaaucccagcuacucgg

SEQ ID NO: 728814 - RNA, 24 nt, Human
ugccuguaaucccagcuacucggg

SEQ ID NO: 728815 - RNA, 23 nt, Human
ugccuguaaucccugaacuuugg

SEQ ID NO: 728816 - RNA, 23 nt, Human
ugccuguaaucccugaacuuugg

SEQ ID NO: 728817 - RNA, 19 nt, Human
ugcuuucuauccuauuccc

SEQ ID NO: 728818 - RNA, 18 nt, Human
uggaucaguaaacaacgg

SEQ ID NO: 728819 - RNA, 24 nt, Human
uggccaacauggugaaaccccguc

SEQ ID NO: 728820 - RNA, 26 nt, Human
uggcuacuacuauaaaccuacagaau

SEQ ID NO: 728821 - RNA, 20 nt, Human
uggcucaugccuguaauccc

SEQ ID NO: 728822 - RNA, 22 nt, Human
uggcucaugccuguaaucccug

SEQ ID NO: 728823 - RNA, 21 nt, Human
uggcugagauuuccuacuuaa

SEQ ID NO: 728824 - RNA, 21 nt, Human
ugggaaugguggcaagugccu

SEQ ID NO: 728825 - RNA, 20 nt, Human
ugggaggccaaggugggcag

SEQ ID NO: 728826 - RNA, 24 nt, Human
ugggaggccaaggugggcagauca

SEQ ID NO: 728827 - RNA, 29 nt, Human
ugggaggcggagguugcagugacaacggu

SEQ ID NO: 728828 - RNA, 24 nt, Human
ugggaggcggagguugcagugagc

SEQ ID NO: 728829 - RNA, 22 nt, Human
ugggcagaucacaaggucagga

SEQ ID NO: 728830 - RNA, 19 nt, Human
ugggucaaaaaaaacaaaa

SEQ ID NO: 728831 - RNA, 24 nt, Human
ugggucaaaaaaaacaaaacccca

SEQ ID NO: 728832 - RNA, 20 nt, Human
uggucuugggaaauggaauu

SEQ ID NO: 728833 - RNA, 24 nt, Human
ugguggcaagugccuguaauccca

SEQ ID NO: 728834 - RNA, 23 nt, Human
ugguggcucaugccuguaauccc

SEQ ID NO: 728835 - RNA, 24 nt, Human
ugguuuguccuucauuuggaagac

SEQ ID NO: 728836 - RNA, 21 nt, Human
uguguuggagaauauaaaggu

SEQ ID NO: 728837 - RNA, 20 nt, Human
uuaaaaauaaaauccacuuu

SEQ ID NO: 728838 - RNA, 24 nt, Human
uuagcugggaaugguggcaagugc

SEQ ID NO: 728839 - RNA, 21 nt, Human
uuauugugcagauucucuggu

SEQ ID NO: 728840 - RNA, 20 nt, Human
uucaaaaguccugguugcuu

SEQ ID NO: 728841 - RNA, 23 nt, Human
uucaaaauacacacuaaucugau

SEQ ID NO: 728842 - RNA, 20 nt, Human
uucccaaguuccaaccucug

SEQ ID NO: 728843 - RNA, 26 nt, Human
uugaaaauaaugaauuuauuaauaau

SEQ ID NO: 728844 - RNA, 24 nt, Human
uugaaccugggaggcggagguugc

SEQ ID NO: 728845 - RNA, 18 nt, Human
uugcagugagccgagauc

SEQ ID NO: 728846 - RNA, 22 nt, Human
uugcagugagccgagaucgugc

SEQ ID NO: 728847 - RNA, 23 nt, Human
uugcagugagccgagaucgugcc

SEQ ID NO: 728848 - RNA, 22 nt, Human
uugcugaaugaauuaaagauau

SEQ ID NO: 728849 - RNA, 19 nt, Human
uugggaaauggaauuugaa

SEQ ID NO: 728850 - RNA, 19 nt, Human
uuuguuuuguuuuguuuug

SEQ ID NO: 728851 - RNA, 23 nt, Human
aaaacagacugggacuuggcuuc

SEQ ID NO: 728852 - RNA, 20 nt, Human
aaaacagaggcgcuggaagc

SEQ ID NO: 728853 - RNA, 19 nt, Human
aaaaugaucccugaucuga

SEQ ID NO: 728854 - RNA, 23 nt, Human
aaacaaugacuaacucauccuga

SEQ ID NO: 728855 - RNA, 21 nt, Human
aaagagacuucaaagcaaccg

SEQ ID NO: 728856 - RNA, 23 nt, Human
aaaggagcagcaaccugcauuua

SEQ ID NO: 728857 - RNA, 21 nt, Human
aaagugugugcuccagccccc

SEQ ID NO: 728858 - RNA, 19 nt, Human
aacaaugacuaacucaucc

SEQ ID NO: 728859 - RNA, 18 nt, Human
aacccacuuguaguuugg

SEQ ID NO: 728860 - RNA, 23 nt, Human
aaccguggagggaggaagaaggc

SEQ ID NO: 728861 - RNA, 23 nt, Human
aagaaggcaggguucagggccag

SEQ ID NO: 728862 - RNA, 20 nt, Human
aagcaguggaauaaacuagg

SEQ ID NO: 728863 - RNA, 26 nt, Human
aagggaaacagggagggaggggcggg

SEQ ID NO: 728864 - RNA, 18 nt, Human
aaggggagggccagggcc

SEQ ID NO: 728865 - RNA, 20 nt, Human
acaacacagcccccuccaca

SEQ ID NO: 728866 - RNA, 20 nt, Human
acaccccccacccucauccc

SEQ ID NO: 728867 - RNA, 22 nt, Human
acagcgaugagaucccucacac

SEQ ID NO: 728868 - RNA, 18 nt, Human
acaggcaaaggcuccaca

SEQ ID NO: 728869 - RNA, 19 nt, Human
acccagugaauucaccccu

SEQ ID NO: 728870 - RNA, 18 nt, Human
acccuucccacacccccc

SEQ ID NO: 728871 - RNA, 21 nt, Human
accgacggagggagggugguc

SEQ ID NO: 728872 - RNA, 19 nt, Human
accuuccucuccagccaac

SEQ ID NO: 728873 - RNA, 18 nt, Human
acucgggguuccucuggc

SEQ ID NO: 728874 - RNA, 26 nt, Human
acugaagcacagguggaggcugccug

SEQ ID NO: 728875 - RNA, 20 nt, Human
agaaaacagacugggacuug

SEQ ID NO: 728876 - RNA, 19 nt, Human
agaaacaugcuucccuuau

SEQ ID NO: 728877 - RNA, 20 nt, Human
agaaggcaggguucagggcc

SEQ ID NO: 728878 - RNA, 23 nt, Human
agacugagacaggaucaacauca

SEQ ID NO: 728879 - RNA, 19 nt, Human
agagagaauggggucugag

SEQ ID NO: 728880 - RNA, 22 nt, Human
agagagaauggggucugaggga

SEQ ID NO: 728881 - RNA, 20 nt, Human
agaggggagggagggaggga

SEQ ID NO: 728882 - RNA, 21 nt, Human
agccaaugguuucccaacaca

SEQ ID NO: 728883 - RNA, 18 nt, Human
agcccccuccacacagug

SEQ ID NO: 728884 - RNA, 19 nt, Human
agccuuagaaaugcaauau

SEQ ID NO: 728885 - RNA, 22 nt, Human
aggaagcggcuaggcucugaca

SEQ ID NO: 728886 - RNA, 24 nt, Human
aggaaggaaaaaaaaugaucccug

SEQ ID NO: 728887 - RNA, 18 nt, Human
aggacuuggaggugggag

SEQ ID NO: 728888 - RNA, 23 nt, Human
aggcccagccaaugguuucccaa

SEQ ID NO: 728889 - RNA, 22 nt, Human
aggcgcuggaagccaguggcga

SEQ ID NO: 728890 - RNA, 24 nt, Human
aggcgggagugaggaaggggaggg

SEQ ID NO: 728891 - RNA, 21 nt, Human
agggaagggaaacagggaggg

SEQ ID NO: 728892 - RNA, 23 nt, Human
agggaaggggaagggagggacga

SEQ ID NO: 728893 - RNA, 25 nt, Human
agggagggagggaagggaaacaggg

SEQ ID NO: 728894 - RNA, 21 nt, Human
agggagggaggggcggguagg

SEQ ID NO: 728895 - RNA, 19 nt, Human
aggggaaagcaaugcaacc

SEQ ID NO: 728896 - RNA, 19 nt, Human
aggggaagggagggacgag

SEQ ID NO: 728897 - RNA, 25 nt, Human
agugacccagggccugcccggccuc

SEQ ID NO: 728898 - RNA, 20 nt, Human
aguuuggguucagcuggaaa

SEQ ID NO: 728899 - RNA, 24 nt, Human
auuggccaaagagacuucaaagca

SEQ ID NO: 728900 - RNA, 22 nt, Human
caaaccccacaugcuucagggg

SEQ ID NO: 728901 - RNA, 25 nt, Human
caaaccccacaugcuucaggggggc

SEQ ID NO: 728902 - RNA, 24 nt, Human
cacaaggccccuggggccaggacc

SEQ ID NO: 728903 - RNA, 24 nt, Human
caccaggaaaaagaaacaugcuuc

SEQ ID NO: 728904 - RNA, 18 nt, Human
caccccccacccucaucc

SEQ ID NO: 728905 - RNA, 21 nt, Human
caccccccacccucaucccuc

SEQ ID NO: 728906 - RNA, 18 nt, Human
caccccuguccucccgcc

SEQ ID NO: 728907 - RNA, 18 nt, Human
caccugggaccagagggc

SEQ ID NO: 728908 - RNA, 20 nt, Human
caccuguuccaccccacacc

SEQ ID NO: 728909 - RNA, 21 nt, Human
caccuuccucuccagccaaca

SEQ ID NO: 728910 - RNA, 20 nt, Human
caccuugucgccaacaggcu

SEQ ID NO: 728911 - RNA, 19 nt, Human
cagaaucaaucaaucacga

SEQ ID NO: 728912 - RNA, 18 nt, Human
cagcagagaggggaggga

SEQ ID NO: 728913 - RNA, 19 nt, Human
cagcuggaaagcaggacau

SEQ ID NO: 728914 - RNA, 22 nt, Human
caggaaaaagaaacaugcuucc

SEQ ID NO: 728915 - RNA, 18 nt, Human
caggaccagggccugcca

SEQ ID NO: 728916 - RNA, 22 nt, Human
caggacgauccccaaacaguga

SEQ ID NO: 728917 - RNA, 23 nt, Human
caggaucaacaucagauggcugg

SEQ ID NO: 728918 - RNA, 21 nt, Human
caggcucuuuuuagagacagg

SEQ ID NO: 728919 - RNA, 24 nt, Human
cagggccagggaccagagguggcg

SEQ ID NO: 728920 - RNA, 18 nt, Human
cagugaggaggacuugga

SEQ ID NO: 728921 - RNA, 22 nt, Human
caguggugacaguaucagcccu

SEQ ID NO: 728922 - RNA, 21 nt, Human
caucaaggagcccguucggag

SEQ ID NO: 728923 - RNA, 22 nt, Human
ccaccgacucugccugcccucc

SEQ ID NO: 728924 - RNA, 18 nt, Human
ccacugaagcacaggugg

SEQ ID NO: 728925 - RNA, 30 nt, Human
ccagcagagaggggagggagggagggaagg

SEQ ID NO: 728926 - RNA, 18 nt, Human
ccagccaacaacagggcc

SEQ ID NO: 728927 - RNA, 26 nt, Human
ccagccggcucagggaggcggccagc

SEQ ID NO: 728928 - RNA, 24 nt, Human
ccagcgcacagacccagcagagag

SEQ ID NO: 728929 - RNA, 26 nt, Human
ccagcucugccucucaucacauacau

SEQ ID NO: 728930 - RNA, 20 nt, Human
ccaggccaucaaggagcccg

SEQ ID NO: 728931 - RNA, 21 nt, Human
ccagggccaccccuguccucc

SEQ ID NO: 728932 - RNA, 18 nt, Human
ccaguggugacaguauca

SEQ ID NO: 728933 - RNA, 24 nt, Human
cccaaggugcccacaacacagccc

SEQ ID NO: 728934 - RNA, 21 nt, Human
cccacaacacagcccccucca

SEQ ID NO: 728935 - RNA, 23 nt, Human
cccacaacacagcccccuccaca

SEQ ID NO: 728936 - RNA, 19 nt, Human
cccacaccccccacccuca

SEQ ID NO: 728937 - RNA, 23 nt, Human
cccacucccauccuuuuccccag

SEQ ID NO: 728938 - RNA, 23 nt, Human
cccacucgccacucucagacuca

SEQ ID NO: 728939 - RNA, 23 nt, Human
ccccacucccauccuuuucccca

SEQ ID NO: 728940 - RNA, 20 nt, Human
ccccacucgccacucucaga

SEQ ID NO: 728941 - RNA, 20 nt, Human
cccccuccacacaguguuuc

SEQ ID NO: 728942 - RNA, 19 nt, Human
ccccgcugcgccugacccc

SEQ ID NO: 728943 - RNA, 22 nt, Human
cccgccccuacagcugccccgg

SEQ ID NO: 728944 - RNA, 26 nt, Human
cccgcgucuggggcaccccauggggc

SEQ ID NO: 728945 - RNA, 24 nt, Human
cccggcuccucccucgaggccucc

SEQ ID NO: 728946 - RNA, 24 nt, Human
cccgugggccgccugccaggcccc

SEQ ID NO: 728947 - RNA, 24 nt, Human
cccugagcagccccgcaucagccc

SEQ ID NO: 728948 - RNA, 23 nt, Human
ccgccccuacagcugccccggcc

SEQ ID NO: 728949 - RNA, 19 nt, Human
ccguggagggaggaagaag

SEQ ID NO: 728950 - RNA, 19 nt, Human
ccuacaccuugucgccaac

SEQ ID NO: 728951 - RNA, 23 nt, Human
ccuccaaagugacccagggccuu

SEQ ID NO: 728952 - RNA, 18 nt, Human
ccuccucccugaccugag

SEQ ID NO: 728953 - RNA, 20 nt, Human
ccuguccaucuggcccugug

SEQ ID NO: 728954 - RNA, 18 nt, Human
ccugucguccacucccag

SEQ ID NO: 728955 - RNA, 24 nt, Human
ccuguggccaggccaucaaggagc

SEQ ID NO: 728956 - RNA, 24 nt, Human
ccuguuugccacaaggccccuggg

SEQ ID NO: 728957 - RNA, 22 nt, Human
ccuugcucuggggagguagguc

SEQ ID NO: 728958 - RNA, 20 nt, Human
cgacucugccugcccuccuc

SEQ ID NO: 728959 - RNA, 23 nt, Human
cgccugcugccaguuggcgacug

SEQ ID NO: 728960 - RNA, 20 nt, Human
cggcuccucccucgaggccu

SEQ ID NO: 728961 - RNA, 22 nt, Human
cggcuccucccucgaggccucc

SEQ ID NO: 728962 - RNA, 18 nt, Human
cgggggcacuccucucag

SEQ ID NO: 728963 - RNA, 18 nt, Human
cgggggugggggaagggg

SEQ ID NO: 728964 - RNA, 19 nt, Human
cuccagacuggccaccgac

SEQ ID NO: 728965 - RNA, 22 nt, Human
cuccagcucaggggccugggcc

SEQ ID NO: 728966 - RNA, 18 nt, Human
cuccaucucccccgcugc

SEQ ID NO: 728967 - RNA, 18 nt, Human
cucccugaccugagcucc

SEQ ID NO: 728968 - RNA, 22 nt, Human
cucuccucucuucgggggccuu

SEQ ID NO: 728969 - RNA, 21 nt, Human
cucugccugcccuccucccca

SEQ ID NO: 728970 - RNA, 22 nt, Human
cucuucgggggccuugccuccu

SEQ ID NO: 728971 - RNA, 18 nt, Human
cugaagcacagguggagg

SEQ ID NO: 728972 - RNA, 18 nt, Human
cugagcucccacucccag

SEQ ID NO: 728973 - RNA, 20 nt, Human
cugcagcugagggacacgac

SEQ ID NO: 728974 - RNA, 19 nt, Human
cugccaggcccccuggcug

SEQ ID NO: 728975 - RNA, 21 nt, Human
cugcccuccuccccauuucuu

SEQ ID NO: 728976 - RNA, 23 nt, Human
cugcccuccuccccauuucuuuc

SEQ ID NO: 728977 - RNA, 19 nt, Human
cuggaccgccucuuccaug

SEQ ID NO: 728978 - RNA, 26 nt, Human
cugucugggcccccgccccuacagcu

SEQ ID NO: 728979 - RNA, 18 nt, Human
cuguguucccaggcuggg

SEQ ID NO: 728980 - RNA, 21 nt, Human
cuguguucccaggcugggcug

SEQ ID NO: 728981 - RNA, 22 nt, Human
cuguguucccaggcugggcugg

SEQ ID NO: 728982 - RNA, 21 nt, Human
cuugcaugcucgggcuggggg

SEQ ID NO: 728983 - RNA, 19 nt, Human
cuugcucugagcucaccgu

SEQ ID NO: 728984 - RNA, 22 nt, Human
cuuucaagcaguggaauaaacu

SEQ ID NO: 728985 - RNA, 21 nt, Human
gaacugcaaacuccaucuccc

SEQ ID NO: 728986 - RNA, 19 nt, Human
gaagggagggacgaggcuc

SEQ ID NO: 728987 - RNA, 18 nt, Human
gaaggggagggccagggc

SEQ ID NO: 728988 - RNA, 19 nt, Human
gacccagcagagaggggag

SEQ ID NO: 728989 - RNA, 23 nt, Human
gacucggccaacauuuacauuua

SEQ ID NO: 728990 - RNA, 19 nt, Human
gagacaggcaaaggcucca

SEQ ID NO: 728991 - RNA, 20 nt, Human
gagcagcaaccugcauuuag

SEQ ID NO: 728992 - RNA, 20 nt, Human
gaggaagaaggcaggguuca

SEQ ID NO: 728993 - RNA, 21 nt, Human
gaucuguguccucaaaggccc

SEQ ID NO: 728994 - RNA, 25 nt, Human
gauggggaggggagaggcgggagug

SEQ ID NO: 728995 - RNA, 19 nt, Human
gccaagaaaccccgucuug

SEQ ID NO: 728996 - RNA, 23 nt, Human
gcccacaacacagcccccuccac

SEQ ID NO: 728997 - RNA, 23 nt, Human
gccccaaggugcccacaacacag

SEQ ID NO: 728998 - RNA, 22 nt, Human
gcggaggggaucgggcgcccca

SEQ ID NO: 728999 - RNA, 22 nt, Human
gcgggagugaggaaggggaggg

SEQ ID NO: 729000 - RNA, 18 nt, Human
gcuacacgucgccugcug

SEQ ID NO: 729001 - RNA, 22 nt, Human
gcugcggucccagagcuucggc

SEQ ID NO: 729002 - RNA, 18 nt, Human
gcuggggaggaagggcag

SEQ ID NO: 729003 - RNA, 18 nt, Human
ggaaacagggagggaggg

SEQ ID NO: 729004 - RNA, 19 nt, Human
ggaaacagggagggagggg

SEQ ID NO: 729005 - RNA, 22 nt, Human
ggaaacagggagggaggggccg

SEQ ID NO: 729006 - RNA, 19 nt, Human
ggaaggacgaacagagaga

SEQ ID NO: 729007 - RNA, 21 nt, Human
ggacaaaccccacaugcuuca

SEQ ID NO: 729008 - RNA, 20 nt, Human
ggacuuggaggugggaggug

SEQ ID NO: 729009 - RNA, 21 nt, Human
ggagaccccacuccccugccu

SEQ ID NO: 729010 - RNA, 19 nt, Human
ggagcagggcuguggcaag

SEQ ID NO: 729011 - RNA, 18 nt, Human
ggaggacuuggagguggg

SEQ ID NO: 729012 - RNA, 23 nt, Human
ggaggacuuggaggugggaggug

SEQ ID NO: 729013 - RNA, 18 nt, Human
ggaggagcuugagaaagu

SEQ ID NO: 729014 - RNA, 19 nt, Human
ggagggaggaagaaggcag

SEQ ID NO: 729015 - RNA, 23 nt, Human
ggaggggcggguaggggggaggg

SEQ ID NO: 729016 - RNA, 18 nt, Human
ggagguggagcgucagcu

SEQ ID NO: 729017 - RNA, 18 nt, Human
ggagugaggaaggggagg

SEQ ID NO: 729018 - RNA, 21 nt, Human
ggccacgauggcaagcucgcc

SEQ ID NO: 729019 - RNA, 18 nt, Human
ggccagggucuguggggc

SEQ ID NO: 729020 - RNA, 19 nt, Human
ggccggugucugaugccag

SEQ ID NO: 729021 - RNA, 20 nt, Human
ggcggguaggggggagggag

SEQ ID NO: 729022 - RNA, 21 nt, Human
ggcugcagugaggaggacuug

SEQ ID NO: 729023 - RNA, 18 nt, Human
ggcuggggaggaagggca

SEQ ID NO: 729024 - RNA, 19 nt, Human
ggcuggggaggaagggcag

SEQ ID NO: 729025 - RNA, 20 nt, Human
gggaagggagggacgaggcu

SEQ ID NO: 729026 - RNA, 20 nt, Human
gggagacugagacaggauca

SEQ ID NO: 729027 - RNA, 19 nt, Human
gggagaggcgggagugagg

SEQ ID NO: 729028 - RNA, 24 nt, Human
gggaggaagaaggcaggguucagg

SEQ ID NO: 729029 - RNA, 24 nt, Human
gggccucgcuggggcugcgguccc

SEQ ID NO: 729030 - RNA, 19 nt, Human
gggcggcugguggggaccg

SEQ ID NO: 729031 - RNA, 21 nt, Human
gggcuggggggcuugugcggg

SEQ ID NO: 729032 - RNA, 18 nt, Human
ggggauggacuuggggag

SEQ ID NO: 729033 - RNA, 20 nt, Human
ggggaugggucugaugggga

SEQ ID NO: 729034 - RNA, 18 nt, Human
gggggccucgcuggggcu

SEQ ID NO: 729035 - RNA, 25 nt, Human
gguacccuucccacaccccccaccc

SEQ ID NO: 729036 - RNA, 19 nt, Human
ggucuguggggcauccacu

SEQ ID NO: 729037 - RNA, 20 nt, Human
gguggcggggcuccuggccu

SEQ ID NO: 729038 - RNA, 25 nt, Human
gugcuccagcccccagagauggagc

SEQ ID NO: 729039 - RNA, 22 nt, Human
guggagcgcaagacaccaucua

SEQ ID NO: 729040 - RNA, 23 nt, Human
gugggggaagggggcagggaagg

SEQ ID NO: 729041 - RNA, 22 nt, Human
guucagcuggaaagcaggacau

SEQ ID NO: 729042 - RNA, 18 nt, Human
guuucuuuaaaaaaaaaa

SEQ ID NO: 729043 - RNA, 19 nt, Human
guuuggguucagcuggaaa

SEQ ID NO: 729044 - RNA, 22 nt, Human
uaaaacacaauaaacaaaagag

SEQ ID NO: 729045 - RNA, 20 nt, Human
uaacagccaauggggagcug

SEQ ID NO: 729046 - RNA, 21 nt, Human
uaauuugccagucucguucug

SEQ ID NO: 729047 - RNA, 23 nt, Human
uaggccugaggcugugggggcug

SEQ ID NO: 729048 - RNA, 23 nt, Human
uaggggggagggaguagaggaag

SEQ ID NO: 729049 - RNA, 21 nt, Human
uagguccugucguccacuccc

SEQ ID NO: 729050 - RNA, 18 nt, Human
ucaagcaguggaauaaac

SEQ ID NO: 729051 - RNA, 19 nt, Human
ucaaucagaauaaauaccg

SEQ ID NO: 729052 - RNA, 27 nt, Human
ucacauacauucagaggucaacucgga

SEQ ID NO: 729053 - RNA, 24 nt, Human
ucaccugacugucccuuccaugac

SEQ ID NO: 729054 - RNA, 23 nt, Human
ucacuucuucuucacacucuggu

SEQ ID NO: 729055 - RNA, 20 nt, Human
ucagaggucaacucggacgc

SEQ ID NO: 729056 - RNA, 21 nt, Human
ucagcccuuugagaaaacaga

SEQ ID NO: 729057 - RNA, 23 nt, Human
ucagggaggcggccagcccuucc

SEQ ID NO: 729058 - RNA, 20 nt, Human
uccacacaguguuucggagc

SEQ ID NO: 729059 - RNA, 22 nt, Human
uccacaccugggaccagagggc

SEQ ID NO: 729060 - RNA, 20 nt, Human
uccaugcgccaagaaccgcg

SEQ ID NO: 729061 - RNA, 24 nt, Human
ucccacaccccccacccucauccc

SEQ ID NO: 729062 - RNA, 20 nt, Human
ucccagccggcucagggagg

SEQ ID NO: 729063 - RNA, 22 nt, Human
ucccagcugcggaggggaucgg

SEQ ID NO: 729064 - RNA, 18 nt, Human
ucccaggucucuccucuc

SEQ ID NO: 729065 - RNA, 23 nt, Human
uccccaggcaggccugagagucu

SEQ ID NO: 729066 - RNA, 19 nt, Human
uccccauuucuuucucccg

SEQ ID NO: 729067 - RNA, 19 nt, Human
uccccugccuccucccuga

SEQ ID NO: 729068 - RNA, 19 nt, Human
uccgagcuggggcagugac

SEQ ID NO: 729069 - RNA, 21 nt, Human
uccgagcuggggcagugacac

SEQ ID NO: 729070 - RNA, 21 nt, Human
ucgggggugggggaagggggc

SEQ ID NO: 729071 - RNA, 23 nt, Human
ucugacccaagcggugccccggc

SEQ ID NO: 729072 - RNA, 18 nt, Human
ucugccugcccuccuccc

SEQ ID NO: 729073 - RNA, 20 nt, Human
ucugggagaccccacucccc

SEQ ID NO: 729074 - RNA, 20 nt, Human
ucuguccugcaguuccuguc

SEQ ID NO: 729075 - RNA, 18 nt, Human
ucuguguucccaggcugg

SEQ ID NO: 729076 - RNA, 19 nt, Human
ucuguguucccaggcuggg

SEQ ID NO: 729077 - RNA, 19 nt, Human
ucuguguucccaggcuggg

SEQ ID NO: 729078 - RNA, 19 nt, Human
ucuugggagagaccacuga

SEQ ID NO: 729079 - RNA, 23 nt, Human
ugaaaaauaaaacacaauaaaca

SEQ ID NO: 729080 - RNA, 24 nt, Human
ugaaaaauaaaacacaauaaacaa

SEQ ID NO: 729081 - RNA, 22 nt, Human
ugacaguaucagcccuuugaga

SEQ ID NO: 729082 - RNA, 20 nt, Human
ugacccaagcggugccccgg

SEQ ID NO: 729083 - RNA, 19 nt, Human
ugacccagggccugcccgg

SEQ ID NO: 729084 - RNA, 20 nt, Human
ugaccugagcucccacuccc

SEQ ID NO: 729085 - RNA, 20 nt, Human
ugacugucccuuccaugacc

SEQ ID NO: 729086 - RNA, 23 nt, Human
ugagaaagucugggaagaaaccg

SEQ ID NO: 729087 - RNA, 21 nt, Human
ugagcagccccgcaucagccc

SEQ ID NO: 729088 - RNA, 22 nt, Human
ugcagugaggaggacuuggagg

SEQ ID NO: 729089 - RNA, 20 nt, Human
ugccaagaaaccccgucuug

SEQ ID NO: 729090 - RNA, 21 nt, Human
ugccaagaaaccccgucuugu

SEQ ID NO: 729091 - RNA, 19 nt, Human
ugccacaaggccccugggg

SEQ ID NO: 729092 - RNA, 18 nt, Human
ugccccggccugaucugu

SEQ ID NO: 729093 - RNA, 22 nt, Human
ugccuggccacgauggcaagcu

SEQ ID NO: 729094 - RNA, 24 nt, Human
ugcuccagcccccagagauggagc

SEQ ID NO: 729095 - RNA, 22 nt, Human
ugcucgggcuggggggcuugug

SEQ ID NO: 729096 - RNA, 23 nt, Human
ugcucuggggagguagguccugu

SEQ ID NO: 729097 - RNA, 20 nt, Human
ugcucugguggcggccuggc

SEQ ID NO: 729098 - RNA, 23 nt, Human
uggaauaaacuaggcaaacagua

SEQ ID NO: 729099 - RNA, 22 nt, Human
uggacaccuguuccaccccaca

SEQ ID NO: 729100 - RNA, 24 nt, Human
uggagggaggaagaaggcaggguu

SEQ ID NO: 729101 - RNA, 22 nt, Human
uggaggguggcggggcuccugg

SEQ ID NO: 729102 - RNA, 26 nt, Human
uggauggacaggacgauccccaaaca

SEQ ID NO: 729103 - RNA, 20 nt, Human
uggcaagcaggccgccucgg

SEQ ID NO: 729104 - RNA, 18 nt, Human
uggcaagcucgcccuggg

SEQ ID NO: 729105 - RNA, 23 nt, Human
uggcaagcucgcccuggggccug

SEQ ID NO: 729106 - RNA, 18 nt, Human
uggccaaagagacuucaa

SEQ ID NO: 729107 - RNA, 21 nt, Human
uggccaggccaucaaggagcc

SEQ ID NO: 729108 - RNA, 24 nt, Human
uggcgaggaacacaggauuccagc

SEQ ID NO: 729109 - RNA, 21 nt, Human
uggggagcugccccuguggcc

SEQ ID NO: 729110 - RNA, 20 nt, Human
uggggaggaagggcagugag

SEQ ID NO: 729111 - RNA, 18 nt, Human
uggggaggggagaggcgg

SEQ ID NO: 729112 - RNA, 22 nt, Human
ugggucugauggggaggggaga

SEQ ID NO: 729113 - RNA, 19 nt, Human
ugucugagcagucucccuc

SEQ ID NO: 729114 - RNA, 21 nt, Human
ugugaguguuccgcgcagagg

SEQ ID NO: 729115 - RNA, 20 nt, Human
ugugcuccagcccccagaga

SEQ ID NO: 729116 - RNA, 23 nt, Human
uguuccaccccacaccuuccucu

SEQ ID NO: 729117 - RNA, 23 nt, Human
uuccccgcccaucaccucccggc

SEQ ID NO: 729118 - RNA, 18 nt, Human
uuccgcgcagaggaaagu

SEQ ID NO: 729119 - RNA, 20 nt, Human
uugcagcugcagggaaagcu

SEQ ID NO: 729120 - RNA, 18 nt, Human
uugcucccuuccccgucu

SEQ ID NO: 729121 - RNA, 22 nt, Human
uuggaggcccgcgucuggggca

SEQ ID NO: 729122 - RNA, 19 nt, Human
uuucagccuuccgaggucc

SEQ ID NO: 729123 - RNA, 24 nt, Human
aaaaacacaagcagaacuggagac

SEQ ID NO: 729124 - RNA, 23 nt, Human
aaaaugcucucagccuuguccca

SEQ ID NO: 729125 - RNA, 24 nt, Human
aaacaagcccccagauugguaaac

SEQ ID NO: 729126 - RNA, 21 nt, Human
aaaccaucucaagcaucauau

SEQ ID NO: 729127 - RNA, 22 nt, Human
aaacuaaaaagcggaaaagcac

SEQ ID NO: 729128 - RNA, 21 nt, Human
aaagagacagacauauacaca

SEQ ID NO: 729129 - RNA, 23 nt, Human
aaagagacagacauauacacaga

SEQ ID NO: 729130 - RNA, 18 nt, Human
aaaggaauggggauggga

SEQ ID NO: 729131 - RNA, 22 nt, Human
aacacuauugucuucaaaugug

SEQ ID NO: 729132 - RNA, 19 nt, Human
aagaagaaaagaaaaacaa

SEQ ID NO: 729133 - RNA, 23 nt, Human
aagcaugccuggcaccgaaauau

SEQ ID NO: 729134 - RNA, 20 nt, Human
aagggacuugcuugcuuucu

SEQ ID NO: 729135 - RNA, 24 nt, Human
aaguaaaaggcauuuacuauaauc

SEQ ID NO: 729136 - RNA, 20 nt, Human
aagucaaguccuuaaacacc

SEQ ID NO: 729137 - RNA, 21 nt, Human
acaaaaaaaggacaguauagg

SEQ ID NO: 729138 - RNA, 20 nt, Human
acaaaagaaaggucccuaca

SEQ ID NO: 729139 - RNA, 20 nt, Human
acaacuggaaacaaacaaaa

SEQ ID NO: 729140 - RNA, 19 nt, Human
acaagcagaacuacccaag

SEQ ID NO: 729141 - RNA, 22 nt, Human
acaccuccaaauuccccauacc

SEQ ID NO: 729142 - RNA, 24 nt, Human
acccaccaaacuccuccucugccu

SEQ ID NO: 729143 - RNA, 23 nt, Human
accccucccauggcccucccccc

SEQ ID NO: 729144 - RNA, 23 nt, Human
accccucccauggcccucccccc

SEQ ID NO: 729145 - RNA, 25 nt, Human
accccucccauggcccuccccccaa

SEQ ID NO: 729146 - RNA, 24 nt, Human
acuacuacaaugcaucuacaaaag

SEQ ID NO: 729147 - RNA, 19 nt, Human
acuacuucgugguuccccu

SEQ ID NO: 729148 - RNA, 21 nt, Human
acugcaaucucuggcuuaacc

SEQ ID NO: 729149 - RNA, 22 nt, Human
acugcuuugcauccauccaggu

SEQ ID NO: 729150 - RNA, 18 nt, Human
agaaaaacaagcccccag

SEQ ID NO: 729151 - RNA, 19 nt, Human
agaaaaacaagcccccaga

SEQ ID NO: 729152 - RNA, 21 nt, Human
agaaaagaaaaacaagccccc

SEQ ID NO: 729153 - RNA, 23 nt, Human
agaaaagacaaaucuuuuccaaa

SEQ ID NO: 729154 - RNA, 24 nt, Human
agaaaagacaaaucuuuuccaaaa

SEQ ID NO: 729155 - RNA, 26 nt, Human
agaaagagacagacauauacacagaa

SEQ ID NO: 729156 - RNA, 22 nt, Human
agaacaaaaaacugcacaggga

SEQ ID NO: 729157 - RNA, 23 nt, Human
agaagaaaagaaaaacaagcccc

SEQ ID NO: 729158 - RNA, 18 nt, Human
agaagcagaggguuaggg

SEQ ID NO: 729159 - RNA, 18 nt, Human
agaauacaaaaaaaggac

SEQ ID NO: 729160 - RNA, 23 nt, Human
agaguggggccgcuguggcugcc

SEQ ID NO: 729161 - RNA, 20 nt, Human
agcaggcagggggaccaggg

SEQ ID NO: 729162 - RNA, 20 nt, Human
agccguaacauaaaaugucc

SEQ ID NO: 729163 - RNA, 21 nt, Human
agccugcugggcacaguuaag

SEQ ID NO: 729164 - RNA, 22 nt, Human
agcgugcgacccggccagcccu

SEQ ID NO: 729165 - RNA, 21 nt, Human
agcuaugaagccucaucaaga

SEQ ID NO: 729166 - RNA, 22 nt, Human
aggcgggaggcaggcaggcaau

SEQ ID NO: 729167 - RNA, 21 nt, Human
aggcuucggaggaggccgagc

SEQ ID NO: 729168 - RNA, 19 nt, Human
agggagggaggaggaugga

SEQ ID NO: 729169 - RNA, 21 nt, Human
agggcaggggggugggggugc

SEQ ID NO: 729170 - RNA, 25 nt, Human
aggggggugggggugcaaacuaaaa

SEQ ID NO: 729171 - RNA, 18 nt, Human
aguucugcagcaggggag

SEQ ID NO: 729172 - RNA, 21 nt, Human
aguugccuacaaaaucuuuug

SEQ ID NO: 729173 - RNA, 18 nt, Human
auacacagaagaggggag

SEQ ID NO: 729174 - RNA, 23 nt, Human
auaccacuuuuaucuauugugau

SEQ ID NO: 729175 - RNA, 18 nt, Human
aucaagggcaggggggug

SEQ ID NO: 729176 - RNA, 23 nt, Human
caaaaacacaagcagaacuaccc

SEQ ID NO: 729177 - RNA, 21 nt, Human
caaacacugcaauccaguaug

SEQ ID NO: 729178 - RNA, 22 nt, Human
caaacuaaaaagcggaaaagca

SEQ ID NO: 729179 - RNA, 23 nt, Human
caaacuaaaaagcggaaaagcac

SEQ ID NO: 729180 - RNA, 24 nt, Human
caacuggaaacaaacaaaaaaagg

SEQ ID NO: 729181 - RNA, 24 nt, Human
caagcccccagauugguaaacaca

SEQ ID NO: 729182 - RNA, 22 nt, Human
caaggagagacuccacggugga

SEQ ID NO: 729183 - RNA, 26 nt, Human
caagggcaggggggugggggggaagc

SEQ ID NO: 729184 - RNA, 21 nt, Human
caagguacaguuacauccauu

SEQ ID NO: 729185 - RNA, 22 nt, Human
caauaaacaaauccuccucucu

SEQ ID NO: 729186 - RNA, 20 nt, Human
caauaugcaaaaacacaagc

SEQ ID NO: 729187 - RNA, 26 nt, Human
cacaccaccaaaauauaauaaauaaa

SEQ ID NO: 729188 - RNA, 33 nt, Human
caccaccaaaauauaauaaauaaaaaaaggagg

SEQ ID NO: 729189 - RNA, 24 nt, Human
cacccaggcacccaugguggagcc

SEQ ID NO: 729190 - RNA, 24 nt, Human
caccuccaaauuccccauaccccu

SEQ ID NO: 729191 - RNA, 24 nt, Human
cacucgcucacugacuggcagguu

SEQ ID NO: 729192 - RNA, 24 nt, Human
cacugcuuugcauccauccaggua

SEQ ID NO: 729193 - RNA, 24 nt, Human
cacuuagaaaagacaaaucuuuuc

SEQ ID NO: 729194 - RNA, 18 nt, Human
cagaauacaaaaaaagga

SEQ ID NO: 729195 - RNA, 21 nt, Human
cagcagcaugcauggggcugg

SEQ ID NO: 729196 - RNA, 24 nt, Human
caggcacuacuguuguuuauauuc

SEQ ID NO: 729197 - RNA, 19 nt, Human
caguccagaggaaucaugg

SEQ ID NO: 729198 - RNA, 18 nt, Human
cauaugcacaaugcauca

SEQ ID NO: 729199 - RNA, 24 nt, Human
caucaagauagacuuuuagguuuc

SEQ ID NO: 729200 - RNA, 25 nt, Human
cauuacccagaauacaaaaaaagga

SEQ ID NO: 729201 - RNA, 24 nt, Human
cauugaauuuggcaacauuuuauu

SEQ ID NO: 729202 - RNA, 21 nt, Human
cauuggggcucugcugcucac

SEQ ID NO: 729203 - RNA, 24 nt, Human
ccaacccccuuuaugcauuuaaaa

SEQ ID NO: 729204 - RNA, 24 nt, Human
ccaaucccaacacagucuaccauu

SEQ ID NO: 729205 - RNA, 21 nt, Human
ccaccaaacuccuccucugcc

SEQ ID NO: 729206 - RNA, 22 nt, Human
ccacccgggcggucaccuucuc

SEQ ID NO: 729207 - RNA, 21 nt, Human
ccaccggcgcauuucuuguga

SEQ ID NO: 729208 - RNA, 20 nt, Human
ccagaauacaaaaaaaggac

SEQ ID NO: 729209 - RNA, 23 nt, Human
ccauggcccuccccccaauccca

SEQ ID NO: 729210 - RNA, 22 nt, Human
cccaacacagucuaccauuucc

SEQ ID NO: 729211 - RNA, 18 nt, Human
cccaccaaacuccuccuc

SEQ ID NO: 729212 - RNA, 21 nt, Human
cccaccaaacuccuccucugc

SEQ ID NO: 729213 - RNA, 22 nt, Human
cccaccggcgcauuucuuguga

SEQ ID NO: 729214 - RNA, 21 nt, Human
cccagaauacaaaaaaaggac

SEQ ID NO: 729215 - RNA, 18 nt, Human
cccaugguggagcccgag

SEQ ID NO: 729216 - RNA, 20 nt, Human
ccccagggaugcccugccug

SEQ ID NO: 729217 - RNA, 22 nt, Human
cccccaaucccaacacagucua

SEQ ID NO: 729218 - RNA, 22 nt, Human
cccccaaucccaacacagucua

SEQ ID NO: 729219 - RNA, 23 nt, Human
cccccaaucccaacacagucuac

SEQ ID NO: 729220 - RNA, 23 nt, Human
cccccagauugguaaacacauug

SEQ ID NO: 729221 - RNA, 19 nt, Human
ccccugccccaacccccuu

SEQ ID NO: 729222 - RNA, 24 nt, Human
ccccugccccaacccccuuuaugc

SEQ ID NO: 729223 - RNA, 19 nt, Human
cccgugggccccacguggg

SEQ ID NO: 729224 - RNA, 19 nt, Human
cccuacaaaggaacagaga

SEQ ID NO: 729225 - RNA, 22 nt, Human
cccucccauggcccucccccca

SEQ ID NO: 729226 - RNA, 25 nt, Human
cccuccccccaaucccaacacaguc

SEQ ID NO: 729227 - RNA, 22 nt, Human
cccucuguccccaagaggagcc

SEQ ID NO: 729228 - RNA, 21 nt, Human
ccgagccacacaccaccaaaa

SEQ ID NO: 729229 - RNA, 19 nt, Human
ccgcggcugugagggcugu

SEQ ID NO: 729230 - RNA, 23 nt, Human
ccggccagcccuaggucacuaga

SEQ ID NO: 729231 - RNA, 22 nt, Human
ccgugggccccacgugggacuc

SEQ ID NO: 729232 - RNA, 20 nt, Human
ccuaugaucucaccuacacc

SEQ ID NO: 729233 - RNA, 23 nt, Human
ccugcuggaguccuagucagcca

SEQ ID NO: 729234 - RNA, 20 nt, Human
ccuggagugugauuuugggg

SEQ ID NO: 729235 - RNA, 28 nt, Human
cgaggggaccaacagaaacuggagaccc

SEQ ID NO: 729236 - RNA, 23 nt, Human
cggcuauguugacgauguacccc

SEQ ID NO: 729237 - RNA, 18 nt, Human
cggucaccuucucugugg

SEQ ID NO: 729238 - RNA, 19 nt, Human
cuacaugucugccuggaau

SEQ ID NO: 729239 - RNA, 23 nt, Human
cuagacuguggguccccaaggac

SEQ ID NO: 729240 - RNA, 19 nt, Human
cucccagucuggcuuccug

SEQ ID NO: 729241 - RNA, 20 nt, Human
cucucagccuugucccaccc

SEQ ID NO: 729242 - RNA, 19 nt, Human
cugcacccgugggccccac

SEQ ID NO: 729243 - RNA, 19 nt, Human
cuggaaacaaacaaaaaaa

SEQ ID NO: 729244 - RNA, 19 nt, Human
cuguggcugccacccgggc

SEQ ID NO: 729245 - RNA, 23 nt, Human
cuuaaacacccuacagaaacaaa

SEQ ID NO: 729246 - RNA, 26 nt, Human
cuuagaaaagacaaaucuuuuccaaa

SEQ ID NO: 729247 - RNA, 21 nt, Human
gaaaaacaagcccccagauug

SEQ ID NO: 729248 - RNA, 22 nt, Human
gaaaccgagccacacaccacca

SEQ ID NO: 729249 - RNA, 25 nt, Human
gaagggagggaggaggauggacagg

SEQ ID NO: 729250 - RNA, 23 nt, Human
gaauggcucgacuuccuggaguc

SEQ ID NO: 729251 - RNA, 33 nt, Human
gaccuggcacauggcuggugcucaaaacauaau

SEQ ID NO: 729252 - RNA, 22 nt, Human
gagaaaacccguuagacaacug

SEQ ID NO: 729253 - RNA, 24 nt, Human
gagccacacaccaccaaaauauaa

SEQ ID NO: 729254 - RNA, 22 nt, Human
gagcccgagcugacagaggugg

SEQ ID NO: 729255 - RNA, 19 nt, Human
gaggaugagagaagcagag

SEQ ID NO: 729256 - RNA, 20 nt, Human
gaguccuagucagccacggc

SEQ ID NO: 729257 - RNA, 19 nt, Human
gcaaaaaccaucucaagca

SEQ ID NO: 729258 - RNA, 19 nt, Human
gcacagguguuauuuauug

SEQ ID NO: 729259 - RNA, 21 nt, Human
gcaccuucagaaaaaucaaaa

SEQ ID NO: 729260 - RNA, 24 nt, Human
gcaggggaggggccacacgagggg

SEQ ID NO: 729261 - RNA, 23 nt, Human
gcagguuuccgaggcuucggagg

SEQ ID NO: 729262 - RNA, 20 nt, Human
gcagugaagcccucugguca

SEQ ID NO: 729263 - RNA, 22 nt, Human
gcaugagggcggaccccagcuc

SEQ ID NO: 729264 - RNA, 21 nt, Human
gcccagguccccagggaugcc

SEQ ID NO: 729265 - RNA, 25 nt, Human
gccuucacaccuccaaauuccccau

SEQ ID NO: 729266 - RNA, 21 nt, Human
gcuagacuccaagcuggcuac

SEQ ID NO: 729267 - RNA, 22 nt, Human
gcucucuuggguguuucuucac

SEQ ID NO: 729268 - RNA, 19 nt, Human
gcuggggcagggacuguuc

SEQ ID NO: 729269 - RNA, 20 nt, Human
ggaacagagauuucgcuuuc

SEQ ID NO: 729270 - RNA, 18 nt, Human
ggaagggagggaggagga

SEQ ID NO: 729271 - RNA, 22 nt, Human
ggaccagggagaguggggccgc

SEQ ID NO: 729272 - RNA, 22 nt, Human
ggacccagaagcaugccuggca

SEQ ID NO: 729273 - RNA, 18 nt, Human
ggaccuggcacauggcug

SEQ ID NO: 729274 - RNA, 21 nt, Human
ggaccuggcacauggcuggug

SEQ ID NO: 729275 - RNA, 22 nt, Human
ggacgaguucugcagcagggga

SEQ ID NO: 729276 - RNA, 18 nt, Human
ggauuccauaaaggugag

SEQ ID NO: 729277 - RNA, 21 nt, Human
ggccacacgaggggaccaaca

SEQ ID NO: 729278 - RNA, 18 nt, Human
ggcuaaaccacaggcacu

SEQ ID NO: 729279 - RNA, 18 nt, Human
gggcaggggggugggggu

SEQ ID NO: 729280 - RNA, 18 nt, Human
ggggaugggaguggggaa

SEQ ID NO: 729281 - RNA, 19 nt, Human
ggguggcucgggaagggag

SEQ ID NO: 729282 - RNA, 19 nt, Human
guaaguugggucuccuggg

SEQ ID NO: 729283 - RNA, 23 nt, Human
gucuccuuucaucaaaugcagcc

SEQ ID NO: 729284 - RNA, 18 nt, Human
guggaaugaaccaucucu

SEQ ID NO: 729285 - RNA, 18 nt, Human
guucagcuggggcaggga

SEQ ID NO: 729286 - RNA, 22 nt, Human
uaaaaagcggaaaagcacacag

SEQ ID NO: 729287 - RNA, 25 nt, Human
uaaaaauuccaaagcaucuucaaau

SEQ ID NO: 729288 - RNA, 20 nt, Human
uacaaaaaaaggacaguaua

SEQ ID NO: 729289 - RNA, 22 nt, Human
uacaaacuagcaacuaaagcac

SEQ ID NO: 729290 - RNA, 24 nt, Human
uacaaaucucuguuggcuuuagga

SEQ ID NO: 729291 - RNA, 24 nt, Human
uacaaaucucuguuggcuuuaggg

SEQ ID NO: 729292 - RNA, 23 nt, Human
uauagaacaaugaccauacggua

SEQ ID NO: 729293 - RNA, 22 nt, Human
uauaguggucagauucccagug

SEQ ID NO: 729294 - RNA, 22 nt, Human
uauauuuaaaugaagauuuuac

SEQ ID NO: 729295 - RNA, 18 nt, Human
uaucuauugugauuaccu

SEQ ID NO: 729296 - RNA, 26 nt, Human
uaugcaaaaacacaagcagaacuacc

SEQ ID NO: 729297 - RNA, 21 nt, Human
uauucaccaucaaggaggcca

SEQ ID NO: 729298 - RNA, 22 nt, Human
uauucuguaaaagaagcuuguu

SEQ ID NO: 729299 - RNA, 22 nt, Human
ucaaaagagcuauauuccgagu

SEQ ID NO: 729300 - RNA, 25 nt, Human
ucaacgagaaacugaagugggagau

SEQ ID NO: 729301 - RNA, 18 nt, Human
ucaagauagacuuuuagg

SEQ ID NO: 729302 - RNA, 23 nt, Human
ucacguaaguugggucuccuggg

SEQ ID NO: 729303 - RNA, 19 nt, Human
ucagcacaauguuucuggu

SEQ ID NO: 729304 - RNA, 23 nt, Human
ucaguacaaacuagcaacuaaag

SEQ ID NO: 729305 - RNA, 23 nt, Human
uccaaaaaacauuacccagaaua

SEQ ID NO: 729306 - RNA, 24 nt, Human
uccaaaaaacauuacccagaauac

SEQ ID NO: 729307 - RNA, 19 nt, Human
uccaaauuccccauacccc

SEQ ID NO: 729308 - RNA, 18 nt, Human
ucccacccucugucccca

SEQ ID NO: 729309 - RNA, 26 nt, Human
ucccagugacaauaaacaagguaccc

SEQ ID NO: 729310 - RNA, 24 nt, Human
ucccauggcccuccccccaauccc

SEQ ID NO: 729311 - RNA, 19 nt, Human
uccccagggaugcccugcc

SEQ ID NO: 729312 - RNA, 24 nt, Human
uccccauaccccuuccucucccuu

SEQ ID NO: 729313 - RNA, 23 nt, Human
ucggucagaaaugugcccuguua

SEQ ID NO: 729314 - RNA, 23 nt, Human
ucuggaagguggacagaggugac

SEQ ID NO: 729315 - RNA, 25 nt, Human
ucuggcuuccugauguucagcuggu

SEQ ID NO: 729316 - RNA, 23 nt, Human
ucugugaugcaagagaaaagagc

SEQ ID NO: 729317 - RNA, 26 nt, Human
ucuguucauucuagguuuccaaaauc

SEQ ID NO: 729318 - RNA, 21 nt, Human
ucuucaaaugaaucuguucau

SEQ ID NO: 729319 - RNA, 23 nt, Human
ucuuucuuuuuagcugugacacu

SEQ ID NO: 729320 - RNA, 19 nt, Human
ugaaacccaccaaacuccu

SEQ ID NO: 729321 - RNA, 20 nt, Human
ugaagccucaucaagauaga

SEQ ID NO: 729322 - RNA, 24 nt, Human
ugacaauaaacaaauccuccucuc

SEQ ID NO: 729323 - RNA, 20 nt, Human
ugacauggcucauccaacgg

SEQ ID NO: 729324 - RNA, 22 nt, Human
ugacauggcucauccaacgguc

SEQ ID NO: 729325 - RNA, 25 nt, Human
ugacauggcucauccaacggucugg

SEQ ID NO: 729326 - RNA, 20 nt, Human
ugacccgagggagcaggcgg

SEQ ID NO: 729327 - RNA, 23 nt, Human
ugagaaaacccguuagacaacug

SEQ ID NO: 729328 - RNA, 23 nt, Human
ugagggcggaccccagcucgggc

SEQ ID NO: 729329 - RNA, 18 nt, Human
ugaucucaccuacaccca

SEQ ID NO: 729330 - RNA, 20 nt, Human
ugauggaaccccaggucccu

SEQ ID NO: 729331 - RNA, 18 nt, Human
ugccuggaauggcucgac

SEQ ID NO: 729332 - RNA, 23 nt, Human
ugccuggaauggcucgacuuccu

SEQ ID NO: 729333 - RNA, 18 nt, Human
ugcucaggagcacauucu

SEQ ID NO: 729334 - RNA, 22 nt, Human
ugcuggaguccuagucagccac

SEQ ID NO: 729335 - RNA, 24 nt, Human
uggaaacaaacaaaaaaagggggg

SEQ ID NO: 729336 - RNA, 21 nt, Human
uggaaauugaucagugcccuc

SEQ ID NO: 729337 - RNA, 22 nt, Human
uggaauggcucgacuuccugga

SEQ ID NO: 729338 - RNA, 27 nt, Human
uggaauggcucgacuuccuggagucuc

SEQ ID NO: 729339 - RNA, 20 nt, Human
uggacaggcacgcaacaccu

SEQ ID NO: 729340 - RNA, 18 nt, Human
uggcacauggcuggugcu

SEQ ID NO: 729341 - RNA, 20 nt, Human
uggcccuccccccaaucccu

SEQ ID NO: 729342 - RNA, 23 nt, Human
uggcucauccaacggucuggugg

SEQ ID NO: 729343 - RNA, 19 nt, Human
ugggagaaaggaagucaag

SEQ ID NO: 729344 - RNA, 18 nt, Human
ugggaguggggaagggca

SEQ ID NO: 729345 - RNA, 20 nt, Human
ugggcacaguuaaguaaaag

SEQ ID NO: 729346 - RNA, 25 nt, Human
ugggcaguauaacaaauuuaacuuc

SEQ ID NO: 729347 - RNA, 18 nt, Human
uggggaugggagugggga

SEQ ID NO: 729348 - RNA, 22 nt, Human
ugguggguggcucgggaaggga

SEQ ID NO: 729349 - RNA, 22 nt, Human
uguaccccucccauggcccucc

SEQ ID NO: 729350 - RNA, 19 nt, Human
ugucccacccucugucccc

SEQ ID NO: 729351 - RNA, 23 nt, Human
uguuaauauauagaacaaugacc

SEQ ID NO: 729352 - RNA, 21 nt, Human
uguucagcuggggcagggacu

SEQ ID NO: 729353 - RNA, 21 nt, Human
uuaaaauuuuacaaagacuug

SEQ ID NO: 729354 - RNA, 23 nt, Human
uuaaagcauaagauuagguaauu

SEQ ID NO: 729355 - RNA, 21 nt, Human
uucacauuuuuaaaacugccu

SEQ ID NO: 729356 - RNA, 18 nt, Human
uuccccugccccaacccc

SEQ ID NO: 729357 - RNA, 20 nt, Human
uugcuuuaaauuuuuucacu

SEQ ID NO: 729358 - RNA, 24 nt, Human
uuuaaaauaccacuuuuaucuauu

SEQ ID NO: 729359 - RNA, 26 nt, Human
uuuagcugugacacugcuuuuacaau

SEQ ID NO: 729360 - RNA, 18 nt, Human
uuuuaaaacugccuuacc

SEQ ID NO: 729361 - RNA, 18 nt, Human
uuuucaaaauacuugggc

SEQ ID NO: 729362 - RNA, 20 nt, Human
uuuuuagcugugacacugcu

SEQ ID NO: 729363 - RNA, 24 nt, Human
aaaaaucugacuuguaaaaaucuc

SEQ ID NO: 729364 - RNA, 21 nt, Human
aaacagauaaauuuaauccgg

SEQ ID NO: 729365 - RNA, 23 nt, Human
aaagaaaccaucuaacuagugga

SEQ ID NO: 729366 - RNA, 22 nt, Human
aaagaaagaaaaaggaagaaga

SEQ ID NO: 729367 - RNA, 24 nt, Human
aagaaagaaaaaggaagaagaaaa

SEQ ID NO: 729368 - RNA, 20 nt, Human
aagaagaaaagaaagacuuc

SEQ ID NO: 729369 - RNA, 21 nt, Human
aagaagaaaagaaagacuuca

SEQ ID NO: 729370 - RNA, 20 nt, Human
aagcuccuaaauggaacccc

SEQ ID NO: 729371 - RNA, 21 nt, Human
aagcuccuaaauggaaccccu

SEQ ID NO: 729372 - RNA, 22 nt, Human
acaaaacagcacuugaaccaca

SEQ ID NO: 729373 - RNA, 23 nt, Human
acaagaaacccagagaugcuucc

SEQ ID NO: 729374 - RNA, 24 nt, Human
acacacacgucccagaccuaagca

SEQ ID NO: 729375 - RNA, 24 nt, Human
acacacucacgggacagcacagaa

SEQ ID NO: 729376 - RNA, 19 nt, Human
acaggcuagcgggacaggc

SEQ ID NO: 729377 - RNA, 20 nt, Human
acgggacagcacagaacuug

SEQ ID NO: 729378 - RNA, 25 nt, Human
acuaagaaaaacaucucuuuccccc

SEQ ID NO: 729379 - RNA, 23 nt, Human
agaaagcuccuaaauggaacccc

SEQ ID NO: 729380 - RNA, 20 nt, Human
aggauucuuuaacaaaugcc

SEQ ID NO: 729381 - RNA, 20 nt, Human
aguaagcaaaggcugagaga

SEQ ID NO: 729382 - RNA, 20 nt, Human
auaauugaaaaaagaaagaa

SEQ ID NO: 729383 - RNA, 21 nt, Human
aucucuuucccccaaacccaa

SEQ ID NO: 729384 - RNA, 24 nt, Human
augccuucaggaggauucggagag

SEQ ID NO: 729385 - RNA, 21 nt, Human
caaaacaaacagugcaagaug

SEQ ID NO: 729386 - RNA, 21 nt, Human
caaaguagacaacuaagaaaa

SEQ ID NO: 729387 - RNA, 23 nt, Human
caaaugccacaaguucuucaaau

SEQ ID NO: 729388 - RNA, 19 nt, Human
caagaaacccagagaugcu

SEQ ID NO: 729389 - RNA, 22 nt, Human
caagucacauggaagccaggaa

SEQ ID NO: 729390 - RNA, 21 nt, Human
caauuguuaagagucacacac

SEQ ID NO: 729391 - RNA, 18 nt, Human
cacagaagggaagcuuca

SEQ ID NO: 729392 - RNA, 23 nt, Human
cacauuugcauuucacuuccugu

SEQ ID NO: 729393 - RNA, 20 nt, Human
caccaguaagcaaaggcuga

SEQ ID NO: 729394 - RNA, 24 nt, Human
caccuagagaggaaggccauucca

SEQ ID NO: 729395 - RNA, 24 nt, Human
caccuccccacucagcucugauuu

SEQ ID NO: 729396 - RNA, 25 nt, Human
cacgauuaaaagaugcugagcugac

SEQ ID NO: 729397 - RNA, 23 nt, Human
cagcaacuccagugaaugguacu

SEQ ID NO: 729398 - RNA, 18 nt, Human
cagcucaaagcuguguuc

SEQ ID NO: 729399 - RNA, 23 nt, Human
caggcuagcgggacaggcuuugc

SEQ ID NO: 729400 - RNA, 19 nt, Human
caugguguucugucuugac

SEQ ID NO: 729401 - RNA, 20 nt, Human
cauuucacuuccuguaacac

SEQ ID NO: 729402 - RNA, 21 nt, Human
ccaauccaaaacaaacagugc

SEQ ID NO: 729403 - RNA, 21 nt, Human
ccacaagaaacccagagaugc

SEQ ID NO: 729404 - RNA, 21 nt, Human
ccacccgucagcggacaccuc

SEQ ID NO: 729405 - RNA, 20 nt, Human
ccacuuuugugugcagaauc

SEQ ID NO: 729406 - RNA, 21 nt, Human
ccagacgccacaagaaaccca

SEQ ID NO: 729407 - RNA, 26 nt, Human
ccauuccacaccagacgccacaagaa

SEQ ID NO: 729408 - RNA, 21 nt, Human
cccagaccuaagcagcaacug

SEQ ID NO: 729409 - RNA, 21 nt, Human
ccucgccuacccuucuccuuu

SEQ ID NO: 729410 - RNA, 19 nt, Human
ccugaaaauacacuccgaa

SEQ ID NO: 729411 - RNA, 23 nt, Human
cggaaacaccaguaagcaaaggc

SEQ ID NO: 729412 - RNA, 22 nt, Human
cgugcaaacucagccuuaugaa

SEQ ID NO: 729413 - RNA, 21 nt, Human
cuaagcagcaacuccagugaa

SEQ ID NO: 729414 - RNA, 24 nt, Human
cuccgaaccccucgccuacccuuc

SEQ ID NO: 729415 - RNA, 23 nt, Human
cucucauuuucagacagcaauug

SEQ ID NO: 729416 - RNA, 22 nt, Human
cuucaaagacaugccacgcacu

SEQ ID NO: 729417 - RNA, 20 nt, Human
gaaaaaagaaagaaaaagga

SEQ ID NO: 729418 - RNA, 21 nt, Human
gaaaagaaaaacaugauagaa

SEQ ID NO: 729419 - RNA, 27 nt, Human
gaaaagaaaaacaugauagaacacagg

SEQ ID NO: 729420 - RNA, 19 nt, Human
gcaccuagagaggaaggcc

SEQ ID NO: 729421 - RNA, 22 nt, Human
gggaagcuucaaacauccucaa

SEQ ID NO: 729422 - RNA, 20 nt, Human
ggguuuuuuccaugguguuc

SEQ ID NO: 729423 - RNA, 19 nt, Human
guaaaaucagacacgauua

SEQ ID NO: 729424 - RNA, 21 nt, Human
gucccaacacacaaaacagca

SEQ ID NO: 729425 - RNA, 22 nt, Human
gugcaagaugggaaaggggguu

SEQ ID NO: 729426 - RNA, 22 nt, Human
uaaaaaacaaggcacacuuaca

SEQ ID NO: 729427 - RNA, 23 nt, Human
uaaaaaacaaggcacacuuacaa

SEQ ID NO: 729428 - RNA, 21 nt, Human
uaaaagaugcugagcugacau

SEQ ID NO: 729429 - RNA, 22 nt, Human
uaaaagcuccuuuaaaaaaaau

SEQ ID NO: 729430 - RNA, 25 nt, Human
uaaaguccaccacucuuuacaugcu

SEQ ID NO: 729431 - RNA, 21 nt, Human
uaacuaguggaagaccuuacg

SEQ ID NO: 729432 - RNA, 19 nt, Human
uaaguggaucaaccuuggc

SEQ ID NO: 729433 - RNA, 23 nt, Human
uaaguggaucaaccuuggccuuc

SEQ ID NO: 729434 - RNA, 24 nt, Human
uaccaaauauaaacauuuccccaa

SEQ ID NO: 729435 - RNA, 19 nt, Human
uagaaagcuccuaaaugga

SEQ ID NO: 729436 - RNA, 22 nt, Human
uagcagaacugaaguccaagcg

SEQ ID NO: 729437 - RNA, 21 nt, Human
uagguagaauuccugucucuu

SEQ ID NO: 729438 - RNA, 22 nt, Human
uaugaacacaaugugcuuccga

SEQ ID NO: 729439 - RNA, 25 nt, Human
uauugacaacuguuuggucccaaca

SEQ ID NO: 729440 - RNA, 19 nt, Human
ucaaacaaaguagacaacu

SEQ ID NO: 729441 - RNA, 21 nt, Human
ucaacaccaauuauuauuacu

SEQ ID NO: 729442 - RNA, 21 nt, Human
ucacauggaagccaggaaccu

SEQ ID NO: 729443 - RNA, 18 nt, Human
ucagacagcaauuguuaa

SEQ ID NO: 729444 - RNA, 25 nt, Human
ucagcggacaccucaggcaccuaga

SEQ ID NO: 729445 - RNA, 22 nt, Human
uccacaccagacgccacaagaa

SEQ ID NO: 729446 - RNA, 18 nt, Human
uccaugacaucgagacca

SEQ ID NO: 729447 - RNA, 18 nt, Human
uccccaaaagaaaccauc

SEQ ID NO: 729448 - RNA, 24 nt, Human
ucccccaaacccaauccaaaacaa

SEQ ID NO: 729449 - RNA, 18 nt, Human
ucccgcugcugcugaagc

SEQ ID NO: 729450 - RNA, 21 nt, Human
uccgaaccccucgccuacccu

SEQ ID NO: 729451 - RNA, 20 nt, Human
ugaaaucagaguccauuuuc

SEQ ID NO: 729452 - RNA, 22 nt, Human
ugaaaucuuagaauaaggcaac

SEQ ID NO: 729453 - RNA, 23 nt, Human
ugaacacacaggcuagcgggaca

SEQ ID NO: 729454 - RNA, 20 nt, Human
ugacuuguaaaaaucucucu

SEQ ID NO: 729455 - RNA, 20 nt, Human
ugacuuguaaugauaccucu

SEQ ID NO: 729456 - RNA, 23 nt, Human
ugagcugacauacacacacauag

SEQ ID NO: 729457 - RNA, 21 nt, Human
ugcugcugaagcaccucccca

SEQ ID NO: 729458 - RNA, 23 nt, Human
ugcuuccgaagucuucucucuca

SEQ ID NO: 729459 - RNA, 20 nt, Human
uggaaccccaaaguagaaac

SEQ ID NO: 729460 - RNA, 19 nt, Human
uggaagcaaaaccgcuucc

SEQ ID NO: 729461 - RNA, 22 nt, Human
uggggccauguguugagaacug

SEQ ID NO: 729462 - RNA, 24 nt, Human
uggguuaauacugucggaaacacc

SEQ ID NO: 729463 - RNA, 21 nt, Human
uggugugugaacacacaggcu

SEQ ID NO: 729464 - RNA, 20 nt, Human
uuacaggguuuuuuccaugg

SEQ ID NO: 729465 - RNA, 21 nt, Human
uuaugaaaucuuagaauaagg

SEQ ID NO: 729466 - RNA, 22 nt, Human
uuccaacagcgagaaguaacga

SEQ ID NO: 729467 - RNA, 20 nt, Human
uuccccaaaagaaaccaucu

SEQ ID NO: 729468 - RNA, 28 nt, Human
uuuaaaagcuccuuuaaaaaaaauugcc

SEQ ID NO: 729469 - RNA, 23 nt, Human
aaaaaaacaacacaacaggcugg

SEQ ID NO: 729470 - RNA, 22 nt, Human
aaaaaaccaaaaugcagaauac

SEQ ID NO: 729471 - RNA, 24 nt, Human
aaaaaccaaaaugcagaauaccau

SEQ ID NO: 729472 - RNA, 19 nt, Human
aaacagcuccagagccccc

SEQ ID NO: 729473 - RNA, 20 nt, Human
aaaccaaaaugcagaauacc

SEQ ID NO: 729474 - RNA, 18 nt, Human
aaagaaacacaaagaagc

SEQ ID NO: 729475 - RNA, 21 nt, Human
aaagaaacacaaagaagcuaa

SEQ ID NO: 729476 - RNA, 19 nt, Human
aaagugcugggauuacagg

SEQ ID NO: 729477 - RNA, 19 nt, Human
aaagugcugggauuacagg

SEQ ID NO: 729478 - RNA, 20 nt, Human
aacaauuuagaucaacaucu

SEQ ID NO: 729479 - RNA, 19 nt, Human
aacagcuccagagccccca

SEQ ID NO: 729480 - RNA, 18 nt, Human
aaccucccucaugcuccc

SEQ ID NO: 729481 - RNA, 18 nt, Human
aacucuggccuacugugg

SEQ ID NO: 729482 - RNA, 23 nt, Human
aagaaacacaaagaagcuaagca

SEQ ID NO: 729483 - RNA, 25 nt, Human
aagagaaaaagaguaugaguagacu

SEQ ID NO: 729484 - RNA, 20 nt, Human
aaguagcugggaucacaggc

SEQ ID NO: 729485 - RNA, 26 nt, Human
aaguagcugggaucacaggcgcaugc

SEQ ID NO: 729486 - RNA, 24 nt, Human
aagugaucguccugcuuuggccuc

SEQ ID NO: 729487 - RNA, 18 nt, Human
aagugcugggauuacagg

SEQ ID NO: 729488 - RNA, 21 nt, Human
aagugcugggauuacaggggu

SEQ ID NO: 729489 - RNA, 26 nt, Human
aagugcugggauuacagggguaagcc

SEQ ID NO: 729490 - RNA, 18 nt, Human
aauacuguuguccccagu

SEQ ID NO: 729491 - RNA, 22 nt, Human
aauuaaaaaaaaaaaaaauucc

SEQ ID NO: 729492 - RNA, 21 nt, Human
accaaaaugcagaauaccaua

SEQ ID NO: 729493 - RNA, 19 nt, Human
acccagguuggaguacagu

SEQ ID NO: 729494 - RNA, 21 nt, Human
accccaagaugaagucauagg

SEQ ID NO: 729495 - RNA, 20 nt, Human
accucaaaacacacaaagca

SEQ ID NO: 729496 - RNA, 23 nt, Human
accucagccuuccaaguagcugg

SEQ ID NO: 729497 - RNA, 19 nt, Human
accuggcccgcugcugcuu

SEQ ID NO: 729498 - RNA, 21 nt, Human
acuucauuacaccgaagagaa

SEQ ID NO: 729499 - RNA, 23 nt, Human
agaaaaaaaaccaaaaugcagaa

SEQ ID NO: 729500 - RNA, 20 nt, Human
agaugccauuucacacaugg

SEQ ID NO: 729501 - RNA, 30 nt, Human
agcaugucgugugugugugugugugugugg

SEQ ID NO: 729502 - RNA, 19 nt, Human
agccaccacaccuggcccg

SEQ ID NO: 729503 - RNA, 20 nt, Human
aggcaaagaaacacaaagaa

SEQ ID NO: 729504 - RNA, 18 nt, Human
aggcaauacaauaaguca

SEQ ID NO: 729505 - RNA, 21 nt, Human
aggcagugaugauucuaaaac

SEQ ID NO: 729506 - RNA, 20 nt, Human
aguaauacaggcaugugcca

SEQ ID NO: 729507 - RNA, 22 nt, Human
agugaucguccugcuuuggccu

SEQ ID NO: 729508 - RNA, 18 nt, Human
auauguuauuuauccauu

SEQ ID NO: 729509 - RNA, 19 nt, Human
auguuucuuuugaaaccca

SEQ ID NO: 729510 - RNA, 24 nt, Human
auuaggaucacuacaagauuccug

SEQ ID NO: 729511 - RNA, 19 nt, Human
caaaaugcagaauaccaua

SEQ ID NO: 729512 - RNA, 22 nt, Human
caaacauugucacagaaacaaa

SEQ ID NO: 729513 - RNA, 26 nt, Human
caaaccaaacucuuaccuacuagguu

SEQ ID NO: 729514 - RNA, 22 nt, Human
caaagaaacacaaagaagcuaa

SEQ ID NO: 729515 - RNA, 24 nt, Human
caaagugcugggauuacaggggua

SEQ ID NO: 729516 - RNA, 24 nt, Human
caaguacaaaaggcaaagaaacac

SEQ ID NO: 729517 - RNA, 22 nt, Human
caagugaucguccugcuuuggc

SEQ ID NO: 729518 - RNA, 18 nt, Human
caauaguaguucauguag

SEQ ID NO: 729519 - RNA, 24 nt, Human
cacaccccaagaugaagucauagg

SEQ ID NO: 729520 - RNA, 21 nt, Human
caccuggcccgcugcugcuuc

SEQ ID NO: 729521 - RNA, 23 nt, Human
cacuuaagaaaaaaaaccaaaau

SEQ ID NO: 729522 - RNA, 23 nt, Human
cagaaaaccacggauuaggauca

SEQ ID NO: 729523 - RNA, 25 nt, Human
cagaaaauccccaaagcauacuuga

SEQ ID NO: 729524 - RNA, 23 nt, Human
cagaauaccauauuuuagaugaa

SEQ ID NO: 729525 - RNA, 20 nt, Human
cagcauccgguuucuuuagu

SEQ ID NO: 729526 - RNA, 21 nt, Human
cagccccaaucuccucgagug

SEQ ID NO: 729527 - RNA, 22 nt, Human
cagcuccagagcccccaacucu

SEQ ID NO: 729528 - RNA, 22 nt, Human
cauaggcacguuuccauaacuc

SEQ ID NO: 729529 - RNA, 18 nt, Human
caugucgugugugugugu

SEQ ID NO: 729530 - RNA, 18 nt, Human
caugucgugugugugugu

SEQ ID NO: 729531 - RNA, 19 nt, Human
ccaaagugcugggauuaca

SEQ ID NO: 729532 - RNA, 21 nt, Human
ccaaagugcugggauuacagg

SEQ ID NO: 729533 - RNA, 24 nt, Human
ccaaagugcugggauuacaggggu

SEQ ID NO: 729534 - RNA, 19 nt, Human
ccagagcccccaacucugg

SEQ ID NO: 729535 - RNA, 19 nt, Human
cccacacucauaggcaacu

SEQ ID NO: 729536 - RNA, 23 nt, Human
ccucaaucuaauuucuagaccuu

SEQ ID NO: 729537 - RNA, 26 nt, Human
ccucucaccucagccuuccaaguagc

SEQ ID NO: 729538 - RNA, 25 nt, Human
ccugcccuaucaagcuuaguagaag

SEQ ID NO: 729539 - RNA, 21 nt, Human
ccugggcucaagugaucgucc

SEQ ID NO: 729540 - RNA, 22 nt, Human
ccugggcucaagugaucguccu

SEQ ID NO: 729541 - RNA, 23 nt, Human
ccugggcucaagugaucguccug

SEQ ID NO: 729542 - RNA, 24 nt, Human
ccuguuacccagguuggaguacag

SEQ ID NO: 729543 - RNA, 22 nt, Human
ccuugcuagauacuuuuucuua

SEQ ID NO: 729544 - RNA, 20 nt, Human
cgagugauccucucaccuca

SEQ ID NO: 729545 - RNA, 22 nt, Human
cguccugcuuuggccucccaaa

SEQ ID NO: 729546 - RNA, 21 nt, Human
cgugugugugugugugugugu

SEQ ID NO: 729547 - RNA, 21 nt, Human
cguucaaguccuccuauuuau

SEQ ID NO: 729548 - RNA, 21 nt, Human
cuaagcaacugcaucaucagc

SEQ ID NO: 729549 - RNA, 22 nt, Human
cuacuagguugagcucaucugc

SEQ ID NO: 729550 - RNA, 21 nt, Human
cuagugucagcaguaagagaa

SEQ ID NO: 729551 - RNA, 20 nt, Human
cucaaacguuuucagcagca

SEQ ID NO: 729552 - RNA, 18 nt, Human
cucaaagucccuuacucc

SEQ ID NO: 729553 - RNA, 18 nt, Human
cucaagugaucguccugc

SEQ ID NO: 729554 - RNA, 23 nt, Human
cucaccucagccuuccaaguagc

SEQ ID NO: 729555 - RNA, 23 nt, Human
cucagccuuccaaguagcuggga

SEQ ID NO: 729556 - RNA, 21 nt, Human
cucagggccucuggggcagcc

SEQ ID NO: 729557 - RNA, 18 nt, Human
cucccucaugcuccccug

SEQ ID NO: 729558 - RNA, 20 nt, Human
cucccucaugcuccccugua

SEQ ID NO: 729559 - RNA, 23 nt, Human
cugcuuuggccucccaaagugcu

SEQ ID NO: 729560 - RNA, 18 nt, Human
cuggcuucucuuuaauca

SEQ ID NO: 729561 - RNA, 19 nt, Human
cugguauuauucacuuaag

SEQ ID NO: 729562 - RNA, 26 nt, Human
cuuuuuuuuuuuuuuuugagauaggg

SEQ ID NO: 729563 - RNA, 23 nt, Human
gaacgccuucuaaugccccccac

SEQ ID NO: 729564 - RNA, 21 nt, Human
gaucacaggcgcaugccacug

SEQ ID NO: 729565 - RNA, 24 nt, Human
gaucacaggcgcaugccacugugc

SEQ ID NO: 729566 - RNA, 18 nt, Human
gaucacuacaagauuccu

SEQ ID NO: 729567 - RNA, 18 nt, Human
gauuacagggguaagcca

SEQ ID NO: 729568 - RNA, 20 nt, Human
gcaaagaaacacaaagaagc

SEQ ID NO: 729569 - RNA, 19 nt, Human
gcccuguuacccagguugg

SEQ ID NO: 729570 - RNA, 18 nt, Human
gcccuuuucccacuuuuu

SEQ ID NO: 729571 - RNA, 19 nt, Human
gcucaagugaucguccugc

SEQ ID NO: 729572 - RNA, 21 nt, Human
gcucauggcagccccaaucuc

SEQ ID NO: 729573 - RNA, 22 nt, Human
gcuuuggccucccaaagugcug

SEQ ID NO: 729574 - RNA, 21 nt, Human
ggaaugacugaaaacgagcac

SEQ ID NO: 729575 - RNA, 19 nt, Human
ggauuacagggguaagcca

SEQ ID NO: 729576 - RNA, 21 nt, Human
ggcuaauuaaaaaaaaaaaaa

SEQ ID NO: 729577 - RNA, 19 nt, Human
gggcucaagugaucguccu

SEQ ID NO: 729578 - RNA, 23 nt, Human
guaauccuuucauuaucuuuucc

SEQ ID NO: 729579 - RNA, 18 nt, Human
guccugcuuuggccuccc

SEQ ID NO: 729580 - RNA, 24 nt, Human
gugauccucucaccucagccuucc

SEQ ID NO: 729581 - RNA, 21 nt, Human
gugugugugugugugucaaug

SEQ ID NO: 729582 - RNA, 18 nt, Human
gugugugugugugugugu

SEQ ID NO: 729583 - RNA, 21 nt, Human
gugugugugugugugugugug

SEQ ID NO: 729584 - RNA, 21 nt, Human
gugugugugugugugugugug

SEQ ID NO: 729585 - RNA, 20 nt, Human
guuuugaagauuugagaagu

SEQ ID NO: 729586 - RNA, 23 nt, Human
uaaaaaaaaaaaaaauuccagag

SEQ ID NO: 729587 - RNA, 20 nt, Human
uaaaacauaaugaaauucua

SEQ ID NO: 729588 - RNA, 18 nt, Human
uaaauuucaguuuuuaca

SEQ ID NO: 729589 - RNA, 21 nt, Human
uaaauuucaguuuuuacaaau

SEQ ID NO: 729590 - RNA, 19 nt, Human
uaacaugaaaagacuagcu

SEQ ID NO: 729591 - RNA, 21 nt, Human
uaagaaaaaaaaccaaaaugc

SEQ ID NO: 729592 - RNA, 24 nt, Human
uaagaaaaaaaaccaaaaugcaga

SEQ ID NO: 729593 - RNA, 23 nt, Human
uaagagaaaaagaguaugaguag

SEQ ID NO: 729594 - RNA, 20 nt, Human
uaaggcaauacaauaaguca

SEQ ID NO: 729595 - RNA, 23 nt, Human
uacaaaaggcaaagaaacacaaa

SEQ ID NO: 729596 - RNA, 19 nt, Human
uacaaguacaaaaggcaaa

SEQ ID NO: 729597 - RNA, 22 nt, Human
uacaaguacaaaaggcaaagaa

SEQ ID NO: 729598 - RNA, 22 nt, Human
uacagggguaagccaccacacc

SEQ ID NO: 729599 - RNA, 22 nt, Human
uacagggguaagccaccacacc

SEQ ID NO: 729600 - RNA, 23 nt, Human
uacagggguaagccaccacaccu

SEQ ID NO: 729601 - RNA, 23 nt, Human
uacaugaaaacugcuucaaagcu

SEQ ID NO: 729602 - RNA, 21 nt, Human
uacccagguuggaguacagug

SEQ ID NO: 729603 - RNA, 18 nt, Human
uagagugacaaaacucag

SEQ ID NO: 729604 - RNA, 23 nt, Human
uagauugcacuccugcccuauca

SEQ ID NO: 729605 - RNA, 25 nt, Human
uagcaggaacacuacacuacgugcc

SEQ ID NO: 729606 - RNA, 21 nt, Human
uaggacacaccccaagaugaa

SEQ ID NO: 729607 - RNA, 18 nt, Human
uauguugcccaagcuggu

SEQ ID NO: 729608 - RNA, 23 nt, Human
uauguugcccaagcugguguuga

SEQ ID NO: 729609 - RNA, 24 nt, Human
uauguugcccaagcugguguugaa

SEQ ID NO: 729610 - RNA, 21 nt, Human
uauguuucuuuugaaacccac

SEQ ID NO: 729611 - RNA, 22 nt, Human
ucaaaacacacaaagcauucuu

SEQ ID NO: 729612 - RNA, 21 nt, Human
ucaaacuacuuuuucuucucu

SEQ ID NO: 729613 - RNA, 24 nt, Human
ucagauccagcuuguggaugcacu

SEQ ID NO: 729614 - RNA, 25 nt, Human
ucauaggcacguuuccauaacuccc

SEQ ID NO: 729615 - RNA, 23 nt, Human
ucauugguccccuuacuagguuu

SEQ ID NO: 729616 - RNA, 19 nt, Human
uccaaguagcugggaucac

SEQ ID NO: 729617 - RNA, 23 nt, Human
uccaaguagcugggaucacaggc

SEQ ID NO: 729618 - RNA, 24 nt, Human
uccaaguagcugggaucacaggcg

SEQ ID NO: 729619 - RNA, 22 nt, Human
uccagagcccccaacucuggcc

SEQ ID NO: 729620 - RNA, 23 nt, Human
uccaggcagcaggagucuuaaga

SEQ ID NO: 729621 - RNA, 23 nt, Human
ucccaaagugcugggauuacagg

SEQ ID NO: 729622 - RNA, 22 nt, Human
uccccaaagcauacuugaucau

SEQ ID NO: 729623 - RNA, 19 nt, Human
ucccucaaacguuuucagc

SEQ ID NO: 729624 - RNA, 21 nt, Human
uccguaguuuuaauccagagg

SEQ ID NO: 729625 - RNA, 18 nt, Human
uccugggcucaagugauc

SEQ ID NO: 729626 - RNA, 24 nt, Human
uccugggcucaagugaucguccug

SEQ ID NO: 729627 - RNA, 28 nt, Human
ucgagugauccucucaccucagccuucc

SEQ ID NO: 729628 - RNA, 19 nt, Human
ucucagggccucuggggca

SEQ ID NO: 729629 - RNA, 18 nt, Human
ucuccuguccucuucuaa

SEQ ID NO: 729630 - RNA, 24 nt, Human
ucuuagucaauuuacauuccaggg

SEQ ID NO: 729631 - RNA, 21 nt, Human
ucuuauguugcccaagcuggu

SEQ ID NO: 729632 - RNA, 19 nt, Human
ucuucuguaaaugacucua

SEQ ID NO: 729633 - RNA, 23 nt, Human
ucuucuuauguugcccaagcugg

SEQ ID NO: 729634 - RNA, 24 nt, Human
ucuucuuauguugcccaagcuggu

SEQ ID NO: 729635 - RNA, 24 nt, Human
ucuugcccuguuacccagguugga

SEQ ID NO: 729636 - RNA, 23 nt, Human
ucuuuucuuauuguuggauugac

SEQ ID NO: 729637 - RNA, 21 nt, Human
ugaaaacugcuucaaagcuaa

SEQ ID NO: 729638 - RNA, 18 nt, Human
ugaaaagacuagcuguga

SEQ ID NO: 729639 - RNA, 19 nt, Human
ugaaaaggcaaauguaggc

SEQ ID NO: 729640 - RNA, 23 nt, Human
ugaaaugcuccagaaaaccacgg

SEQ ID NO: 729641 - RNA, 20 nt, Human
ugacaaaacucagauccagc

SEQ ID NO: 729642 - RNA, 19 nt, Human
ugaccaaaccaaacucuua

SEQ ID NO: 729643 - RNA, 18 nt, Human
ugacuaugccauccugca

SEQ ID NO: 729644 - RNA, 22 nt, Human
ugagauagggucuugcccuguu

SEQ ID NO: 729645 - RNA, 18 nt, Human
ugauuaguaacaggaauc

SEQ ID NO: 729646 - RNA, 20 nt, Human
ugcaaaaggaaaauuacuuu

SEQ ID NO: 729647 - RNA, 19 nt, Human
ugcuucaaagcuaaagaca

SEQ ID NO: 729648 - RNA, 21 nt, Human
uggaguacagugccaagacca

SEQ ID NO: 729649 - RNA, 23 nt, Human
uggcagcauccgguuucuuuagu

SEQ ID NO: 729650 - RNA, 20 nt, Human
uggcucauggcagccccaau

SEQ ID NO: 729651 - RNA, 23 nt, Human
uggcucauggcagccccaaucuc

SEQ ID NO: 729652 - RNA, 21 nt, Human
ugggaauguuuugaacagaau

SEQ ID NO: 729653 - RNA, 21 nt, Human
ugggaucacaggcgcaugcca

SEQ ID NO: 729654 - RNA, 22 nt, Human
ugggaucacaggcgcaugccac

SEQ ID NO: 729655 - RNA, 22 nt, Human
ugggaucacaggcgcaugccac

SEQ ID NO: 729656 - RNA, 22 nt, Human
ugggaucacaggcgcaugccac

SEQ ID NO: 729657 - RNA, 24 nt, Human
ugggaucacaggcgcaugccacug

SEQ ID NO: 729658 - RNA, 22 nt, Human
ugggauuacagggguaagccac

SEQ ID NO: 729659 - RNA, 24 nt, Human
ugggauuacagggguaagccacca

SEQ ID NO: 729660 - RNA, 20 nt, Human
ugggcucaagugaucguccu

SEQ ID NO: 729661 - RNA, 24 nt, Human
ugggcucaagugaucguccugcuu

SEQ ID NO: 729662 - RNA, 21 nt, Human
uggggaaacagcuccagagcc

SEQ ID NO: 729663 - RNA, 19 nt, Human
ugguaagcugggcuucagc

SEQ ID NO: 729664 - RNA, 27 nt, Human
ugguaagcugggcuucaggacagagag

SEQ ID NO: 729665 - RNA, 22 nt, Human
ugguccccuuacuagguuuuga

SEQ ID NO: 729666 - RNA, 19 nt, Human
uguaaagugcuauacacuu

SEQ ID NO: 729667 - RNA, 18 nt, Human
uguaugggauaggaauua

SEQ ID NO: 729668 - RNA, 22 nt, Human
ugucagcaguaagagaaaaaga

SEQ ID NO: 729669 - RNA, 20 nt, Human
uguggagaacuuacaggcug

SEQ ID NO: 729670 - RNA, 19 nt, Human
uguguaaagugcuauacac

SEQ ID NO: 729671 - RNA, 19 nt, Human
ugugugucaauguggagaa

SEQ ID NO: 729672 - RNA, 18 nt, Human
ugugugugugugugugug

SEQ ID NO: 729673 - RNA, 18 nt, Human
ugugugugugugugugug

SEQ ID NO: 729674 - RNA, 18 nt, Human
ugugugugugugugugug

SEQ ID NO: 729675 - RNA, 18 nt, Human
ugugugugugugugugug

SEQ ID NO: 729676 - RNA, 18 nt, Human
ugugugugugugugugug

SEQ ID NO: 729677 - RNA, 18 nt, Human
ugugugugugugugugug

SEQ ID NO: 729678 - RNA, 18 nt, Human
ugugugugugugugugug

SEQ ID NO: 729679 - RNA, 18 nt, Human
ugugugugugugugugug

SEQ ID NO: 729680 - RNA, 18 nt, Human
ugugugugugugugugug

SEQ ID NO: 729681 - RNA, 21 nt, Human
ugugugugugugugugugugu

SEQ ID NO: 729682 - RNA, 21 nt, Human
ugugugugugugugugugugu

SEQ ID NO: 729683 - RNA, 21 nt, Human
ugugugugugugugugugugu

SEQ ID NO: 729684 - RNA, 21 nt, Human
ugugugugugugugugugugu

SEQ ID NO: 729685 - RNA, 21 nt, Human
ugugugugugugugugugugu

SEQ ID NO: 729686 - RNA, 21 nt, Human
ugugugugugugugugugugu

SEQ ID NO: 729687 - RNA, 21 nt, Human
ugugugugugugugugugugu

SEQ ID NO: 729688 - RNA, 21 nt, Human
ugugugugugugugugugugu

SEQ ID NO: 729689 - RNA, 21 nt, Human
ugugugugugugugugugugu

SEQ ID NO: 729690 - RNA, 21 nt, Human
ugugugugugugugugugugu

SEQ ID NO: 729691 - RNA, 21 nt, Human
ugugugugugugugugugugu

SEQ ID NO: 729692 - RNA, 21 nt, Human
ugugugugugugugugugugu

SEQ ID NO: 729693 - RNA, 21 nt, Human
ugugugugugugugugugugu

SEQ ID NO: 729694 - RNA, 21 nt, Human
ugugugugugugugugugugu

SEQ ID NO: 729695 - RNA, 21 nt, Human
ugugugugugugugugugugu

SEQ ID NO: 729696 - RNA, 21 nt, Human
ugugugugugugugugugugu

SEQ ID NO: 729697 - RNA, 22 nt, Human
ugugugugugugugugugugug

SEQ ID NO: 729698 - RNA, 22 nt, Human
ugugugugugugugugugugug

SEQ ID NO: 729699 - RNA, 22 nt, Human
ugugugugugugugugugugug

SEQ ID NO: 729700 - RNA, 22 nt, Human
ugugugugugugugugugugug

SEQ ID NO: 729701 - RNA, 22 nt, Human
ugugugugugugugugugugug

SEQ ID NO: 729702 - RNA, 21 nt, Human
uguugaacuccugggcucaag

SEQ ID NO: 729703 - RNA, 26 nt, Human
uuaaauuauuauuucaaaaaaacaac

SEQ ID NO: 729704 - RNA, 24 nt, Human
uuaauacuguuguccccaguccgu

SEQ ID NO: 729705 - RNA, 24 nt, Human
uuauccauuaccaacacuucuuuu

SEQ ID NO: 729706 - RNA, 21 nt, Human
uucaaacacaucgucagugaa

SEQ ID NO: 729707 - RNA, 18 nt, Human
uucacaaaaaaggguaca

SEQ ID NO: 729708 - RNA, 23 nt, Human
uucagcuaaauggcuauauaggu

SEQ ID NO: 729709 - RNA, 19 nt, Human
uuccuaggcugugaaaugc

SEQ ID NO: 729710 - RNA, 23 nt, Human
uucuuauguugcccaagcuggug

SEQ ID NO: 729711 - RNA, 19 nt, Human
uucuuuugaaacccacacu

SEQ ID NO: 729712 - RNA, 21 nt, Human
uugaaacccacacucauaggc

SEQ ID NO: 729713 - RNA, 24 nt, Human
uugaaaccuaaugggggaugcccc

SEQ ID NO: 729714 - RNA, 25 nt, Human
uugaaaccuaaugggggaugccccc

SEQ ID NO: 729715 - RNA, 24 nt, Human
uuuauaauacacucacauuuauac

SEQ ID NO: 729716 - RNA, 22 nt, Human
uuuauguuucuuuugaaaccca

SEQ ID NO: 729717 - RNA, 18 nt, Human
uuucaaaaaaacaacacu

SEQ ID NO: 729718 - RNA, 22 nt, Human
uuuccaaccucccucaugcucc

SEQ ID NO: 729719 - RNA, 19 nt, Human
uuugaagauuugagaaguu

SEQ ID NO: 729720 - RNA, 19 nt, Human
uuuggccucccaaagugcu

SEQ ID NO: 729721 - RNA, 19 nt, Human
uuuuacaucaauaaaccuc

SEQ ID NO: 729722 - RNA, 25 nt, Human
uuuuugagccugggauacucaaagu

SEQ ID NO: 729723 - RNA, 24 nt, Human
uuuuuuuuuugagauagggucuug

SEQ ID NO: 729724 - RNA, 23 nt, Human
uuuuuuuuuuuugagauaggguc

SEQ ID NO: 729725 - RNA, 20 nt, Human
aaaaaaauucaaaacacaga

SEQ ID NO: 729726 - RNA, 24 nt, Human
aaaaagaaacucugaaggugccuc

SEQ ID NO: 729727 - RNA, 23 nt, Human
aaaaaucuaaucauuuauaaaga

SEQ ID NO: 729728 - RNA, 22 nt, Human
aaaacagaugcuauacauaaua

SEQ ID NO: 729729 - RNA, 24 nt, Human
aaacacagauugaaaaaauaaccc

SEQ ID NO: 729730 - RNA, 18 nt, Human
aaacagaaaacuuacaua

SEQ ID NO: 729731 - RNA, 23 nt, Human
aaagaaacucugaaggugccuuu

SEQ ID NO: 729732 - RNA, 22 nt, Human
aaaggccagcucaucagacucc

SEQ ID NO: 729733 - RNA, 22 nt, Human
aaaguccccaauauguaacccu

SEQ ID NO: 729734 - RNA, 21 nt, Human
aaauaguaucagaagaaagca

SEQ ID NO: 729735 - RNA, 26 nt, Human
aagaaagcauucuccauauauuagcu

SEQ ID NO: 729736 - RNA, 19 nt, Human
aaggagaaacauaagaaca

SEQ ID NO: 729737 - RNA, 20 nt, Human
aaucacagcgcaaugauuuc

SEQ ID NO: 729738 - RNA, 22 nt, Human
acaacaguuccuuaccugaaca

SEQ ID NO: 729739 - RNA, 20 nt, Human
acuacauuuucacaaacaga

SEQ ID NO: 729740 - RNA, 18 nt, Human
agcuaacauauaguaugc

SEQ ID NO: 729741 - RNA, 20 nt, Human
agggaaccucaggcuacuac

SEQ ID NO: 729742 - RNA, 20 nt, Human
aguacauagcauuacugcug

SEQ ID NO: 729743 - RNA, 18 nt, Human
agugaguacauuaacuac

SEQ ID NO: 729744 - RNA, 24 nt, Human
caaaacaaaaguuuuccugaugaa

SEQ ID NO: 729745 - RNA, 26 nt, Human
caacuauacuuaaaaagaaacucuga

SEQ ID NO: 729746 - RNA, 18 nt, Human
caacugauacacuaggga

SEQ ID NO: 729747 - RNA, 22 nt, Human
cacaaacagaaaacuuacauac

SEQ ID NO: 729748 - RNA, 19 nt, Human
cacaaaggccagcucauca

SEQ ID NO: 729749 - RNA, 23 nt, Human
cacaauaaaaaaauucaaaacac

SEQ ID NO: 729750 - RNA, 22 nt, Human
cagaagaaagcauucuccauau

SEQ ID NO: 729751 - RNA, 18 nt, Human
cagauugaaaaaauaacc

SEQ ID NO: 729752 - RNA, 25 nt, Human
cagcgcaaugauuucaauaucccuu

SEQ ID NO: 729753 - RNA, 25 nt, Human
cauauaacacauuuacauucgugug

SEQ ID NO: 729754 - RNA, 18 nt, Human
cauuggugggggggaaag

SEQ ID NO: 729755 - RNA, 22 nt, Human
ccccuuucaucccggaggcagg

SEQ ID NO: 729756 - RNA, 18 nt, Human
ccucaggcuacuacaccu

SEQ ID NO: 729757 - RNA, 21 nt, Human
ccugaacauaaacaaagaaaa

SEQ ID NO: 729758 - RNA, 26 nt, Human
ccuuucaucccggaggcagggguugg

SEQ ID NO: 729759 - RNA, 18 nt, Human
cucaggcuacuacaccuc

SEQ ID NO: 729760 - RNA, 18 nt, Human
cucuuacaucugguaccu

SEQ ID NO: 729761 - RNA, 20 nt, Human
gaggcaggggugagguguuu

SEQ ID NO: 729762 - RNA, 22 nt, Human
gcacaaagguguaguucuccca

SEQ ID NO: 729763 - RNA, 20 nt, Human
ggaggcaggggugagguguu

SEQ ID NO: 729764 - RNA, 18 nt, Human
ggauuacaguuuaaguca

SEQ ID NO: 729765 - RNA, 18 nt, Human
uaaaaagaaacucugaag

SEQ ID NO: 729766 - RNA, 21 nt, Human
uaaaacagcuaacauauagua

SEQ ID NO: 729767 - RNA, 18 nt, Human
uaacuuaacagaauucag

SEQ ID NO: 729768 - RNA, 20 nt, Human
uaagaacacacuauuuuuau

SEQ ID NO: 729769 - RNA, 24 nt, Human
uaccugaacauaaacaaagaaaac

SEQ ID NO: 729770 - RNA, 18 nt, Human
uagauauaauugaaauga

SEQ ID NO: 729771 - RNA, 22 nt, Human
uaugaugacuguuggcaaauac

SEQ ID NO: 729772 - RNA, 19 nt, Human
ucaaaguuguuguugcaau

SEQ ID NO: 729773 - RNA, 21 nt, Human
ucacuauaaguuuugcugcuc

SEQ ID NO: 729774 - RNA, 19 nt, Human
ucucccagcugcauaugua

SEQ ID NO: 729775 - RNA, 24 nt, Human
ugaaaaaauaacccauguggcuaa

SEQ ID NO: 729776 - RNA, 19 nt, Human
ugcacaaaggccagcucau

SEQ ID NO: 729777 - RNA, 22 nt, Human
ugcacaaaggccagcucaucag

SEQ ID NO: 729778 - RNA, 18 nt, Human
uggaaagacacuuuaaaa

SEQ ID NO: 729779 - RNA, 21 nt, Human
uggcaaauacucuuuuguucu

SEQ ID NO: 729780 - RNA, 20 nt, Human
ugucaaaauacaaaacaaaa

SEQ ID NO: 729781 - RNA, 19 nt, Human
ugucaagagacuucaguug

SEQ ID NO: 729782 - RNA, 22 nt, Human
ugugcacaugguaaacaucaua

SEQ ID NO: 729783 - RNA, 26 nt, Human
uguuguugcaauucaaaauacaaaga

SEQ ID NO: 729784 - RNA, 23 nt, Human
uguuuacaagacaugucuccaua

SEQ ID NO: 729785 - RNA, 23 nt, Human
uuaacuacauuuucacaaacaga

SEQ ID NO: 729786 - RNA, 24 nt, Human
uuaugacucuuacaucugguaccu

SEQ ID NO: 729787 - RNA, 24 nt, Human
uucaaaaaucuaaucauuuauaaa

SEQ ID NO: 729788 - RNA, 19 nt, Human
uucacaaacagaaaacuua

SEQ ID NO: 729789 - RNA, 21 nt, Human
uucauuguugauaucaaaguu

SEQ ID NO: 729790 - RNA, 27 nt, Human
uucauuguugauaucaaaguuguuguu

SEQ ID NO: 729791 - RNA, 26 nt, Human
uucuuuaauugcauauauuuaugacu

SEQ ID NO: 729792 - RNA, 24 nt, Human
uugcuucauuguugauaucaaagu

SEQ ID NO: 729793 - RNA, 26 nt, Human
aaaaacacaaaaagauuagccaugcg

SEQ ID NO: 729794 - RNA, 22 nt, Human
aaacagugugaaacuccaucuc

SEQ ID NO: 729795 - RNA, 20 nt, Human
aacagugugaaacuccaucu

SEQ ID NO: 729796 - RNA, 24 nt, Human
aacuccacacauccccaaaacccu

SEQ ID NO: 729797 - RNA, 20 nt, Human
aacuggcaucacccccaucc

SEQ ID NO: 729798 - RNA, 23 nt, Human
aagacucaaaaaaaaaaaagcaa

SEQ ID NO: 729799 - RNA, 25 nt, Human
aagcaugagccaugguaaggaaaac

SEQ ID NO: 729800 - RNA, 22 nt, Human
aaguguuuaaacugccaaugua

SEQ ID NO: 729801 - RNA, 29 nt, Human
acagagcaagacucaaaaaaaaaaaagcc

SEQ ID NO: 729802 - RNA, 25 nt, Human
accacugcacuccaaacugggugac

SEQ ID NO: 729803 - RNA, 24 nt, Human
acccauguaugccuccaaaaccuc

SEQ ID NO: 729804 - RNA, 19 nt, Human
acccauuuuugccuugaca

SEQ ID NO: 729805 - RNA, 22 nt, Human
acccauuuuugccuugacacca

SEQ ID NO: 729806 - RNA, 26 nt, Human
acucaaaaaaaaaaaagcaaguguuu

SEQ ID NO: 729807 - RNA, 19 nt, Human
acugcacuccaaacugggu

SEQ ID NO: 729808 - RNA, 24 nt, Human
acugcacuccaaacugggugacag

SEQ ID NO: 729809 - RNA, 23 nt, Human
agaaauguucaggugcagccccc

SEQ ID NO: 729810 - RNA, 22 nt, Human
agaaccagaggccaagccacug

SEQ ID NO: 729811 - RNA, 20 nt, Human
agaaucccagaacuacaccc

SEQ ID NO: 729812 - RNA, 21 nt, Human
agacuugaggggcaacugaug

SEQ ID NO: 729813 - RNA, 18 nt, Human
agagcaaugcagguggga

SEQ ID NO: 729814 - RNA, 25 nt, Human
agccagccuccccgcccggccgcac

SEQ ID NO: 729815 - RNA, 22 nt, Human
agccaguccaugacaacccccu

SEQ ID NO: 729816 - RNA, 19 nt, Human
agccaugguaacaaguggc

SEQ ID NO: 729817 - RNA, 20 nt, Human
agccaugguaaggaaaaccc

SEQ ID NO: 729818 - RNA, 22 nt, Human
agcggcccuggggggaaggggc

SEQ ID NO: 729819 - RNA, 23 nt, Human
agcggcccuggggggaaggggca

SEQ ID NO: 729820 - RNA, 19 nt, Human
aggaaaaccugaacacuca

SEQ ID NO: 729821 - RNA, 23 nt, Human
aggaaaugguggugaguagucaa

SEQ ID NO: 729822 - RNA, 24 nt, Human
aggaaaugguggugaguagucaac

SEQ ID NO: 729823 - RNA, 22 nt, Human
aggagagggagggugacacuag

SEQ ID NO: 729824 - RNA, 25 nt, Human
aggagcacugcuggguauuuauuua

SEQ ID NO: 729825 - RNA, 24 nt, Human
aggaggagucccucauggaucgcg

SEQ ID NO: 729826 - RNA, 26 nt, Human
aggcaggcagagcauuugaagucagg

SEQ ID NO: 729827 - RNA, 22 nt, Human
aggccagaaucaugugagaaga

SEQ ID NO: 729828 - RNA, 21 nt, Human
aggccgaggcaggcagagcau

SEQ ID NO: 729829 - RNA, 24 nt, Human
aggccgaggucgcagugagccgag

SEQ ID NO: 729830 - RNA, 18 nt, Human
agguguccuuuccucucc

SEQ ID NO: 729831 - RNA, 24 nt, Human
aguacaagaaacacauggaaggga

SEQ ID NO: 729832 - RNA, 20 nt, Human
augccuccaaaaccucacca

SEQ ID NO: 729833 - RNA, 21 nt, Human
auguaugccuccaaaaccuca

SEQ ID NO: 729834 - RNA, 24 nt, Human
auugaggaaauaaagaaaagggag

SEQ ID NO: 729835 - RNA, 21 nt, Human
caaaaacacaaaaagauuagc

SEQ ID NO: 729836 - RNA, 21 nt, Human
caaagagaagagagaaacagu

SEQ ID NO: 729837 - RNA, 21 nt, Human
caaauugauuucaggaaaugg

SEQ ID NO: 729838 - RNA, 24 nt, Human
caacaccuagggaggccgaggcag

SEQ ID NO: 729839 - RNA, 24 nt, Human
caacugaagcagcaucugagacac

SEQ ID NO: 729840 - RNA, 20 nt, Human
caagccacugcaacucuggu

SEQ ID NO: 729841 - RNA, 20 nt, Human
caaguaaccaccuauacaga

SEQ ID NO: 729842 - RNA, 25 nt, Human
caaguaaccaccuauacagaugcca

SEQ ID NO: 729843 - RNA, 19 nt, Human
cacacuuagccccugucau

SEQ ID NO: 729844 - RNA, 20 nt, Human
caccagaucugcaaaaucaa

SEQ ID NO: 729845 - RNA, 22 nt, Human
cacccccauccgugcuguggga

SEQ ID NO: 729846 - RNA, 19 nt, Human
cacgccuguaaucccaaca

SEQ ID NO: 729847 - RNA, 22 nt, Human
cacuagaaauguucaggugcag

SEQ ID NO: 729848 - RNA, 23 nt, Human
cacugcacuccaaacugggugac

SEQ ID NO: 729849 - RNA, 24 nt, Human
cacugcacuccaaacugggugaca

SEQ ID NO: 729850 - RNA, 25 nt, Human
cacugcacuccaaacugggugacag

SEQ ID NO: 729851 - RNA, 22 nt, Human
cagaaccucuguauccggugac

SEQ ID NO: 729852 - RNA, 26 nt, Human
cagacaaccccgagaguguccgccac

SEQ ID NO: 729853 - RNA, 24 nt, Human
cagagcauuugaagucaggaacuu

SEQ ID NO: 729854 - RNA, 20 nt, Human
caggaagagaggagucucau

SEQ ID NO: 729855 - RNA, 24 nt, Human
caggcagagcauuugaagucagga

SEQ ID NO: 729856 - RNA, 20 nt, Human
caguacaagaaacacaugga

SEQ ID NO: 729857 - RNA, 21 nt, Human
cagugcacagcuuuuguaagg

SEQ ID NO: 729858 - RNA, 19 nt, Human
cagugccugccugggcauu

SEQ ID NO: 729859 - RNA, 22 nt, Human
caguggccucugaggacaggac

SEQ ID NO: 729860 - RNA, 24 nt, Human
cauccgugcugugggagcuaaagg

SEQ ID NO: 729861 - RNA, 24 nt, Human
caucugagacacaggggcucugca

SEQ ID NO: 729862 - RNA, 19 nt, Human
caugauaagagauagaggg

SEQ ID NO: 729863 - RNA, 21 nt, Human
caugccccgguguagggcaga

SEQ ID NO: 729864 - RNA, 18 nt, Human
cauucuccgucaugcccc

SEQ ID NO: 729865 - RNA, 21 nt, Human
ccaccaaaaacacaaaaagau

SEQ ID NO: 729866 - RNA, 18 nt, Human
ccacccgggaggcugaac

SEQ ID NO: 729867 - RNA, 21 nt, Human
ccaccugcuuucaagaguggg

SEQ ID NO: 729868 - RNA, 18 nt, Human
ccacugcaacucuggugc

SEQ ID NO: 729869 - RNA, 24 nt, Human
ccacugcaacucuggugcuugauc

SEQ ID NO: 729870 - RNA, 24 nt, Human
ccacugcacuccaaacugggugac

SEQ ID NO: 729871 - RNA, 20 nt, Human
ccagccuaccuuuguccuuu

SEQ ID NO: 729872 - RNA, 19 nt, Human
ccaggcccauguccuccug

SEQ ID NO: 729873 - RNA, 22 nt, Human
ccaguccaugacaaccccuggc

SEQ ID NO: 729874 - RNA, 21 nt, Human
ccauguaugccuccaaaaccu

SEQ ID NO: 729875 - RNA, 23 nt, Human
cccaaaacccuuuguaagugcag

SEQ ID NO: 729876 - RNA, 23 nt, Human
cccaagcagaagaguugguuuau

SEQ ID NO: 729877 - RNA, 26 nt, Human
cccacuucuaacuggcaucaccccca

SEQ ID NO: 729878 - RNA, 22 nt, Human
cccagccuuggcuuccccuggc

SEQ ID NO: 729879 - RNA, 19 nt, Human
cccauaaaucuccccuucc

SEQ ID NO: 729880 - RNA, 21 nt, Human
cccccaagcagaagaguuggu

SEQ ID NO: 729881 - RNA, 25 nt, Human
ccccccgucuccaccugcaaauaac

SEQ ID NO: 729882 - RNA, 21 nt, Human
ccccgcccggccgcacgcccg

SEQ ID NO: 729883 - RNA, 23 nt, Human
ccuacaaucccagccacccggga

SEQ ID NO: 729884 - RNA, 20 nt, Human
ccuccaaaaccucaccaguc

SEQ ID NO: 729885 - RNA, 19 nt, Human
ccugcaaauaaccucaccc

SEQ ID NO: 729886 - RNA, 22 nt, Human
ccugcugugugaauggguggag

SEQ ID NO: 729887 - RNA, 21 nt, Human
ccuguaaucccaacaccuagg

SEQ ID NO: 729888 - RNA, 23 nt, Human
cgaucugcucucuuggagaggcu

SEQ ID NO: 729889 - RNA, 21 nt, Human
cgcccggccgcacgcccguca

SEQ ID NO: 729890 - RNA, 23 nt, Human
cggccggcccagccuuggcuucc

SEQ ID NO: 729891 - RNA, 30 nt, Human
cucaccaguccuugaacuccacacaucccc

SEQ ID NO: 729892 - RNA, 19 nt, Human
cucacgccuguaaucccaa

SEQ ID NO: 729893 - RNA, 23 nt, Human
cucacgccuguaaucccaacacc

SEQ ID NO: 729894 - RNA, 22 nt, Human
cuccaccaaaaacacaaaaaga

SEQ ID NO: 729895 - RNA, 22 nt, Human
cuccaucuccaccaaaaacaca

SEQ ID NO: 729896 - RNA, 19 nt, Human
cucugcacgugggccuuuc

SEQ ID NO: 729897 - RNA, 19 nt, Human
cugcaccacugcacuccaa

SEQ ID NO: 729898 - RNA, 19 nt, Human
cugccauauccuugagguc

SEQ ID NO: 729899 - RNA, 21 nt, Human
cugggugacagagcaagacuc

SEQ ID NO: 729900 - RNA, 21 nt, Human
cuuggagaggcuaugccagcc

SEQ ID NO: 729901 - RNA, 27 nt, Human
cuuguagggcggccggcccagccuugg

SEQ ID NO: 729902 - RNA, 20 nt, Human
cuuucaagagcagcuaagcc

SEQ ID NO: 729903 - RNA, 25 nt, Human
cuuucuagcuguagucagugucacu

SEQ ID NO: 729904 - RNA, 21 nt, Human
gaagagaggagucucaugaua

SEQ ID NO: 729905 - RNA, 18 nt, Human
gaagguacuucccuggag

SEQ ID NO: 729906 - RNA, 20 nt, Human
gacaaccccuggcuucugag

SEQ ID NO: 729907 - RNA, 20 nt, Human
gacacacuuugcugcgaggc

SEQ ID NO: 729908 - RNA, 18 nt, Human
gacacuagaaauguucag

SEQ ID NO: 729909 - RNA, 22 nt, Human
gagaucaguucuguguucugga

SEQ ID NO: 729910 - RNA, 23 nt, Human
gagaucaguucuguguucuggaa

SEQ ID NO: 729911 - RNA, 24 nt, Human
gagcacgguggcucacgccuguaa

SEQ ID NO: 729912 - RNA, 19 nt, Human
gagcauuugaagucaggaa

SEQ ID NO: 729913 - RNA, 24 nt, Human
gagcggcccuggggggaaggggca

SEQ ID NO: 729914 - RNA, 27 nt, Human
gagcggcccuggggggaaggggcauuc

SEQ ID NO: 729915 - RNA, 25 nt, Human
gaggcaggcagagcauuugaaguca

SEQ ID NO: 729916 - RNA, 18 nt, Human
gaguucuagcaggcuuga

SEQ ID NO: 729917 - RNA, 18 nt, Human
gaucaucugcagccaugg

SEQ ID NO: 729918 - RNA, 21 nt, Human
gauucuggacaaguaacagcu

SEQ ID NO: 729919 - RNA, 19 nt, Human
gcagccccccgucuccacc

SEQ ID NO: 729920 - RNA, 21 nt, Human
gcaguacaagaaacacaugga

SEQ ID NO: 729921 - RNA, 23 nt, Human
gccuccaaaaccucaccaguccu

SEQ ID NO: 729922 - RNA, 20 nt, Human
gcgguauugguugguugugg

SEQ ID NO: 729923 - RNA, 23 nt, Human
ggaacucuccaaaccugacccau

SEQ ID NO: 729924 - RNA, 20 nt, Human
ggaggggaaauguauucuuu

SEQ ID NO: 729925 - RNA, 24 nt, Human
ggaggugugggggagccagccucc

SEQ ID NO: 729926 - RNA, 23 nt, Human
ggcaacugaagcagcaucugaga

SEQ ID NO: 729927 - RNA, 21 nt, Human
ggccagcacaguggccucuga

SEQ ID NO: 729928 - RNA, 24 nt, Human
ggcggccggcccagccuuggcuuc

SEQ ID NO: 729929 - RNA, 21 nt, Human
ggcuucugagaguuagccgac

SEQ ID NO: 729930 - RNA, 26 nt, Human
ggugacagagcaagacucaaaaaaaa

SEQ ID NO: 729931 - RNA, 20 nt, Human
ggugcuugauggaaagcaug

SEQ ID NO: 729932 - RNA, 23 nt, Human
gguggcucacgccuguaauccca

SEQ ID NO: 729933 - RNA, 21 nt, Human
guaaccaccuauacagaugcc

SEQ ID NO: 729934 - RNA, 19 nt, Human
guccgcaaacagugugaaa

SEQ ID NO: 729935 - RNA, 19 nt, Human
guccuuuccucucccucag

SEQ ID NO: 729936 - RNA, 21 nt, Human
gucgcagugagccgagacugc

SEQ ID NO: 729937 - RNA, 22 nt, Human
gugcagccccccgucuccaccu

SEQ ID NO: 729938 - RNA, 21 nt, Human
uaacacagauuggggcaugga

SEQ ID NO: 729939 - RNA, 18 nt, Human
uaacuggcaucaccccca

SEQ ID NO: 729940 - RNA, 18 nt, Human
uacaggauaucugcucug

SEQ ID NO: 729941 - RNA, 19 nt, Human
uacauuuuuauugaggaaa

SEQ ID NO: 729942 - RNA, 23 nt, Human
uaccacacugcaggaagagagga

SEQ ID NO: 729943 - RNA, 20 nt, Human
ucaaaaaaaaaaaagcaagu

SEQ ID NO: 729944 - RNA, 18 nt, Human
ucaaaaggagugggggaa

SEQ ID NO: 729945 - RNA, 21 nt, Human
ucaaacuccugaaguaaccac

SEQ ID NO: 729946 - RNA, 23 nt, Human
ucaacccauguaugccuccaaaa

SEQ ID NO: 729947 - RNA, 19 nt, Human
ucacauaggagcacugcug

SEQ ID NO: 729948 - RNA, 24 nt, Human
ucacccagaaccagaggccaagcc

SEQ ID NO: 729949 - RNA, 19 nt, Human
ucagccagacaucggucau

SEQ ID NO: 729950 - RNA, 19 nt, Human
uccaaaaccucaccagucc

SEQ ID NO: 729951 - RNA, 19 nt, Human
uccaaaaccucaccagucc

SEQ ID NO: 729952 - RNA, 21 nt, Human
uccagcauugacagguguccu

SEQ ID NO: 729953 - RNA, 21 nt, Human
uccaucuccaccaaaaacaca

SEQ ID NO: 729954 - RNA, 20 nt, Human
uccccaaaacccuuuguaag

SEQ ID NO: 729955 - RNA, 19 nt, Human
uccccccaagcagaagagu

SEQ ID NO: 729956 - RNA, 19 nt, Human
uccugcugugugaaugggu

SEQ ID NO: 729957 - RNA, 22 nt, Human
ucgcagugagccgagacugcac

SEQ ID NO: 729958 - RNA, 22 nt, Human
ucgcgguauugguugguugugg

SEQ ID NO: 729959 - RNA, 22 nt, Human
ucuccaccaccugcuuucaaga

SEQ ID NO: 729960 - RNA, 22 nt, Human
ucugcagaaccucuguauccgg

SEQ ID NO: 729961 - RNA, 22 nt, Human
ucuggaacagcucuccuuuucc

SEQ ID NO: 729962 - RNA, 24 nt, Human
ucuuggccaggacagccugggggu

SEQ ID NO: 729963 - RNA, 22 nt, Human
ugaaacuccaucuccaccaaaa

SEQ ID NO: 729964 - RNA, 20 nt, Human
ugaaauugacaucaggccua

SEQ ID NO: 729965 - RNA, 23 nt, Human
ugaacuugaauccaggaggccga

SEQ ID NO: 729966 - RNA, 22 nt, Human
ugaagcagcaucugagacacag

SEQ ID NO: 729967 - RNA, 20 nt, Human
ugaagucaggaacuugguac

SEQ ID NO: 729968 - RNA, 26 nt, Human
ugacagagcaagacucaaaaaaaaaa

SEQ ID NO: 729969 - RNA, 18 nt, Human
ugaccccaguagaacaca

SEQ ID NO: 729970 - RNA, 23 nt, Human
ugagaacaguguccacaaaggua

SEQ ID NO: 729971 - RNA, 20 nt, Human
ugagaagaguccugcugugu

SEQ ID NO: 729972 - RNA, 22 nt, Human
ugagaucaguucuguguucugg

SEQ ID NO: 729973 - RNA, 21 nt, Human
ugaggaaauaaagaaaaggga

SEQ ID NO: 729974 - RNA, 22 nt, Human
ugaggaaauaaagaaaagggag

SEQ ID NO: 729975 - RNA, 22 nt, Human
ugaggaaauaaagaaaagggag

SEQ ID NO: 729976 - RNA, 21 nt, Human
ugcaaauaaccucacccagaa

SEQ ID NO: 729977 - RNA, 23 nt, Human
ugcagccccccgucuccaccugc

SEQ ID NO: 729978 - RNA, 21 nt, Human
ugcgccuggcuuucuagcugu

SEQ ID NO: 729979 - RNA, 21 nt, Human
ugcuugauggaaagcaugagc

SEQ ID NO: 729980 - RNA, 18 nt, Human
uggaaagagcggcccugg

SEQ ID NO: 729981 - RNA, 18 nt, Human
uggaaagcaugagccaug

SEQ ID NO: 729982 - RNA, 19 nt, Human
uggccacaguucugcagaa

SEQ ID NO: 729983 - RNA, 24 nt, Human
uggcucacgccuguaaucccaaca

SEQ ID NO: 729984 - RNA, 20 nt, Human
ugggaggugugggggagcca

SEQ ID NO: 729985 - RNA, 19 nt, Human
uggguggagggcauucucc

SEQ ID NO: 729986 - RNA, 24 nt, Human
ugguugguuguggugauuugggga

SEQ ID NO: 729987 - RNA, 21 nt, Human
ugguuugggauucuggacaag

SEQ ID NO: 729988 - RNA, 21 nt, Human
uguagggcagauggccacagu

SEQ ID NO: 729989 - RNA, 24 nt, Human
uuaggcugagcacgguggcucacg

SEQ ID NO: 729990 - RNA, 23 nt, Human
uucaaauugauuucaggaaaugg

SEQ ID NO: 729991 - RNA, 18 nt, Human
uucugggggcaugugguc

SEQ ID NO: 729992 - RNA, 23 nt, Human
uugacaccaucgauuuucccugu

SEQ ID NO: 729993 - RNA, 20 nt, Human
uugguuguggugauuugggg

SEQ ID NO: 729994 - RNA, 20 nt, Human
uugugcgccuggcuuucuag

SEQ ID NO: 729995 - RNA, 23 nt, Human
uuuuugccuugacaccaucgauu

SEQ ID NO: 729996 - RNA, 23 nt, Human
aaaaagacuucaacauacuuuua

SEQ ID NO: 729997 - RNA, 18 nt, Human
aaacacuaucgucaaaau

SEQ ID NO: 729998 - RNA, 19 nt, Human
aaacagaauaaacaucuuu

SEQ ID NO: 729999 - RNA, 19 nt, Human
aaagaacaauaacaaccac

SEQ ID NO: 730000 - RNA, 21 nt, Human
aaagacucagcccagaucggc

SEQ ID NO: 730001 - RNA, 24 nt, Human
aacaauaacaaccacaauaacaac

SEQ ID NO: 730002 - RNA, 21 nt, Human
aacagcaaccuacacauuagu

SEQ ID NO: 730003 - RNA, 22 nt, Human
aaccacaauaacaacuaucacc

SEQ ID NO: 730004 - RNA, 22 nt, Human
aaguagacaauaauagcuaaca

SEQ ID NO: 730005 - RNA, 25 nt, Human
aauccuucccuucccucuacuccac

SEQ ID NO: 730006 - RNA, 20 nt, Human
acaauaacaaccacaauaac

SEQ ID NO: 730007 - RNA, 22 nt, Human
acaauaacaacuaucaccccaa

SEQ ID NO: 730008 - RNA, 22 nt, Human
acagaaaaugcuugaaagguua

SEQ ID NO: 730009 - RNA, 20 nt, Human
accagaacacauuaggaccc

SEQ ID NO: 730010 - RNA, 26 nt, Human
acucaaaugcaaaaucaacaaaucug

SEQ ID NO: 730011 - RNA, 18 nt, Human
agacaagucauacaugua

SEQ ID NO: 730012 - RNA, 18 nt, Human
agcagagcacugugcgua

SEQ ID NO: 730013 - RNA, 23 nt, Human
aggcaggccggagaaccugaagc

SEQ ID NO: 730014 - RNA, 23 nt, Human
agucaauaacagaaaaugcuuga

SEQ ID NO: 730015 - RNA, 22 nt, Human
auaucuuuguaccugacaaaca

SEQ ID NO: 730016 - RNA, 22 nt, Human
augguacaaccguucaacagaa

SEQ ID NO: 730017 - RNA, 25 nt, Human
caaaaugaaagggcauggcugagua

SEQ ID NO: 730018 - RNA, 24 nt, Human
caaacccaaauuccucagaagucu

SEQ ID NO: 730019 - RNA, 25 nt, Human
caaccacaauaacaacuaucacccc

SEQ ID NO: 730020 - RNA, 21 nt, Human
cacaauaacaacuaucacccc

SEQ ID NO: 730021 - RNA, 23 nt, Human
cacauauugggaaccuaccccua

SEQ ID NO: 730022 - RNA, 19 nt, Human
caccgcaggcaaguccagc

SEQ ID NO: 730023 - RNA, 18 nt, Human
cacgaucuucgcacaaca

SEQ ID NO: 730024 - RNA, 22 nt, Human
caggcaaguccagccgaagucu

SEQ ID NO: 730025 - RNA, 21 nt, Human
caguguacugaacauacugua

SEQ ID NO: 730026 - RNA, 21 nt, Human
ccaccaaaaaucaugacuacg

SEQ ID NO: 730027 - RNA, 22 nt, Human
ccccuaaagaacaauaacaacc

SEQ ID NO: 730028 - RNA, 20 nt, Human
ccuaaagaacaauaacaacc

SEQ ID NO: 730029 - RNA, 22 nt, Human
cgaagaaucuccuucaucgcca

SEQ ID NO: 730030 - RNA, 23 nt, Human
cgacaacuuacccagagccgccu

SEQ ID NO: 730031 - RNA, 18 nt, Human
cucccagacaagccgaaa

SEQ ID NO: 730032 - RNA, 21 nt, Human
cucccagacaagccgaaaccc

SEQ ID NO: 730033 - RNA, 20 nt, Human
cuccuucaucgccaaacagc

SEQ ID NO: 730034 - RNA, 23 nt, Human
cugcaauuacagaaaaagacuuc

SEQ ID NO: 730035 - RNA, 21 nt, Human
cuggaagggaggccuggagcu

SEQ ID NO: 730036 - RNA, 20 nt, Human
cuguugccuucuuucuggcc

SEQ ID NO: 730037 - RNA, 24 nt, Human
cuucaugccaaugagcuacuccuc

SEQ ID NO: 730038 - RNA, 18 nt, Human
cuucgcacaacagcaacc

SEQ ID NO: 730039 - RNA, 26 nt, Human
gaaaagcauuauaugagacaaaggca

SEQ ID NO: 730040 - RNA, 22 nt, Human
gaaaauguuaauaacuuagaca

SEQ ID NO: 730041 - RNA, 18 nt, Human
gaacaauaacaaccacaa

SEQ ID NO: 730042 - RNA, 19 nt, Human
gcagcccacagaacgacaa

SEQ ID NO: 730043 - RNA, 20 nt, Human
ggaaguaagacuaugaaaua

SEQ ID NO: 730044 - RNA, 22 nt, Human
ggagcucugcuaucaccaaucc

SEQ ID NO: 730045 - RNA, 18 nt, Human
gggcauggcugaguaugg

SEQ ID NO: 730046 - RNA, 19 nt, Human
ggggagcaggugucaccgc

SEQ ID NO: 730047 - RNA, 18 nt, Human
ggguuuuucguuuucuug

SEQ ID NO: 730048 - RNA, 19 nt, Human
gguaaauaacuccuuacaa

SEQ ID NO: 730049 - RNA, 22 nt, Human
guggcauuuuucuggacaaggg

SEQ ID NO: 730050 - RNA, 24 nt, Human
uaaaaaaaagucuacaauuucuaa

SEQ ID NO: 730051 - RNA, 23 nt, Human
uaagcaaaauuuagauggagaag

SEQ ID NO: 730052 - RNA, 21 nt, Human
uaauuuguaaacugcucaacu

SEQ ID NO: 730053 - RNA, 24 nt, Human
uacaaaauauuagaaacacuaucg

SEQ ID NO: 730054 - RNA, 23 nt, Human
uacaauuaaaugaacauuaucac

SEQ ID NO: 730055 - RNA, 22 nt, Human
uacucaaaugcaaaaucaacaa

SEQ ID NO: 730056 - RNA, 21 nt, Human
uagaaaguaguaacucaagua

SEQ ID NO: 730057 - RNA, 18 nt, Human
uagaggaugacucacugc

SEQ ID NO: 730058 - RNA, 22 nt, Human
uagcagacaaaauauaguucaa

SEQ ID NO: 730059 - RNA, 22 nt, Human
uagcaucaaucagggaugacca

SEQ ID NO: 730060 - RNA, 20 nt, Human
uagcuaacacuuaccgggca

SEQ ID NO: 730061 - RNA, 25 nt, Human
uaucaagugcccauacucuuugaca

SEQ ID NO: 730062 - RNA, 21 nt, Human
uaugaaaagcauuauaugaga

SEQ ID NO: 730063 - RNA, 20 nt, Human
uaugguacaaccguucaaca

SEQ ID NO: 730064 - RNA, 28 nt, Human
uauuaaaaauacuuacaaacaauucuua

SEQ ID NO: 730065 - RNA, 22 nt, Human
ucaaaugcaaaaucaacaaauc

SEQ ID NO: 730066 - RNA, 18 nt, Human
ucccagacaagccgaaac

SEQ ID NO: 730067 - RNA, 21 nt, Human
uccucagaagucugaguccac

SEQ ID NO: 730068 - RNA, 22 nt, Human
ucgcacaacagcaaccuacaca

SEQ ID NO: 730069 - RNA, 22 nt, Human
ucuauuagcugugcaagaaaua

SEQ ID NO: 730070 - RNA, 21 nt, Human
ucugcaauuacagaaaaagac

SEQ ID NO: 730071 - RNA, 24 nt, Human
ucugcaauuacagaaaaagacuuc

SEQ ID NO: 730072 - RNA, 18 nt, Human
ucuggacaagggagaggg

SEQ ID NO: 730073 - RNA, 22 nt, Human
ugaagacacuggcauuucagug

SEQ ID NO: 730074 - RNA, 18 nt, Human
ugaccagaacacauuagg

SEQ ID NO: 730075 - RNA, 28 nt, Human
ugacucccagacaagccgaaaccccuuu

SEQ ID NO: 730076 - RNA, 21 nt, Human
ugauaaaacauuccaccaaaa

SEQ ID NO: 730077 - RNA, 19 nt, Human
ugccacagugucuaaaagc

SEQ ID NO: 730078 - RNA, 19 nt, Human
uggaagggaggccuggagc

SEQ ID NO: 730079 - RNA, 20 nt, Human
uggcauuauguaucaagugc

SEQ ID NO: 730080 - RNA, 24 nt, Human
uggguaaauaacuccuuacaauau

SEQ ID NO: 730081 - RNA, 25 nt, Human
ugguaaaaaaaagucuacaauuucu

SEQ ID NO: 730082 - RNA, 19 nt, Human
uguaccugacaaacagaau

SEQ ID NO: 730083 - RNA, 23 nt, Human
uguguacacaagagagcuggaug

SEQ ID NO: 730084 - RNA, 21 nt, Human
uuaaaugaacauuaucacuga

SEQ ID NO: 730085 - RNA, 19 nt, Human
uuaggaccccagauuauuc

SEQ ID NO: 730086 - RNA, 25 nt, Human
uuagucuacaaaggggaacaaaccc

SEQ ID NO: 730087 - RNA, 21 nt, Human
uuccuagguuaaugggcaugu

SEQ ID NO: 730088 - RNA, 18 nt, Human
uuuaacaggcugaagauc

SEQ ID NO: 730089 - RNA, 23 nt, Human
uuugaaaaaaauaaaauguuuaa

SEQ ID NO: 730090 - RNA, 22 nt, Human
uuuggcaauuauaaggggcaaa

SEQ ID NO: 730091 - RNA, 21 nt, Human
uuuguaccugacaaacagaau

SEQ ID NO: 730092 - RNA, 20 nt, Human
aaaaggagacgggauauaaa

SEQ ID NO: 730093 - RNA, 19 nt, Human
aaaauacuguagaagcaaa

SEQ ID NO: 730094 - RNA, 22 nt, Human
aaaauacuguagaagcaaaauu

SEQ ID NO: 730095 - RNA, 22 nt, Human
aaacaaacaaaaaucacacuag

SEQ ID NO: 730096 - RNA, 26 nt, Human
aaacaaacaaaaaucacacuagccac

SEQ ID NO: 730097 - RNA, 26 nt, Human
aaaccaaauuuuacuacgguugugaa

SEQ ID NO: 730098 - RNA, 18 nt, Human
aacauucagcuuaaaaau

SEQ ID NO: 730099 - RNA, 23 nt, Human
aaccuuacguuaagcacauccac

SEQ ID NO: 730100 - RNA, 19 nt, Human
aacuaacuauaagcaauau

SEQ ID NO: 730101 - RNA, 19 nt, Human
aagcaaaaaguacaacagc

SEQ ID NO: 730102 - RNA, 22 nt, Human
aagcaaaaaguacaacagcuau

SEQ ID NO: 730103 - RNA, 23 nt, Human
aagcauuucccaagucacagaag

SEQ ID NO: 730104 - RNA, 20 nt, Human
aagccgcagaagauuccgaa

SEQ ID NO: 730105 - RNA, 19 nt, Human
aaggaaacaaacaaaaauc

SEQ ID NO: 730106 - RNA, 26 nt, Human
aaggaaacaaacaaaaaucacacuag

SEQ ID NO: 730107 - RNA, 23 nt, Human
aagucacagaagccccaaagaac

SEQ ID NO: 730108 - RNA, 21 nt, Human
acaaagccaauaacguaugcc

SEQ ID NO: 730109 - RNA, 24 nt, Human
acacugaucucauuucaacuguca

SEQ ID NO: 730110 - RNA, 20 nt, Human
acagaagccccaaagaacuc

SEQ ID NO: 730111 - RNA, 21 nt, Human
acagaagccccaaagaacucc

SEQ ID NO: 730112 - RNA, 19 nt, Human
acagacaaagccaauaacg

SEQ ID NO: 730113 - RNA, 19 nt, Human
accaagcccugagcacacu

SEQ ID NO: 730114 - RNA, 19 nt, Human
accugggcuuuugaaaaac

SEQ ID NO: 730115 - RNA, 18 nt, Human
agaagaaaaccaaggucc

SEQ ID NO: 730116 - RNA, 21 nt, Human
agucacagaagccccaaagaa

SEQ ID NO: 730117 - RNA, 25 nt, Human
auauggcagcgucuguaugaccagu

SEQ ID NO: 730118 - RNA, 20 nt, Human
augacccugugcaaguuuuc

SEQ ID NO: 730119 - RNA, 26 nt, Human
caaacaaaaaucacacuaaucaacgg

SEQ ID NO: 730120 - RNA, 22 nt, Human
caaacaaaaaucacacuagcca

SEQ ID NO: 730121 - RNA, 22 nt, Human
caaagaacuccuaaauuacaaa

SEQ ID NO: 730122 - RNA, 26 nt, Human
caaagaacuccuaaauuacaaauuca

SEQ ID NO: 730123 - RNA, 23 nt, Human
caacaguacuuaaaaggaaacaa

SEQ ID NO: 730124 - RNA, 18 nt, Human
caacuaaagaaaauggau

SEQ ID NO: 730125 - RNA, 24 nt, Human
caacugauaagcuuggcuuuacaa

SEQ ID NO: 730126 - RNA, 19 nt, Human
caagccgcagaagauuccg

SEQ ID NO: 730127 - RNA, 20 nt, Human
caagccgcagaagauuccga

SEQ ID NO: 730128 - RNA, 19 nt, Human
caagucacagaagccccaa

SEQ ID NO: 730129 - RNA, 22 nt, Human
caaguguuauguuccuuauauu

SEQ ID NO: 730130 - RNA, 23 nt, Human
cacauacucguccacugugugug

SEQ ID NO: 730131 - RNA, 24 nt, Human
caccgaguauauucuguuuauugu

SEQ ID NO: 730132 - RNA, 19 nt, Human
cacuagauucuuuguaugc

SEQ ID NO: 730133 - RNA, 20 nt, Human
cauugcugguugaguuugga

SEQ ID NO: 730134 - RNA, 21 nt, Human
ccugaauguaagcauuuccca

SEQ ID NO: 730135 - RNA, 24 nt, Human
cuuaacuuuuucaaaaggauccaa

SEQ ID NO: 730136 - RNA, 18 nt, Human
gcccaaacuaaauuauca

SEQ ID NO: 730137 - RNA, 25 nt, Human
ggaaccaaaaccucuuaacaacugg

SEQ ID NO: 730138 - RNA, 18 nt, Human
gugaacuauuauguccau

SEQ ID NO: 730139 - RNA, 23 nt, Human
gugcaaguuuucagaccuuccaa

SEQ ID NO: 730140 - RNA, 22 nt, Human
guuauauaauuacaaagaugac

SEQ ID NO: 730141 - RNA, 24 nt, Human
uaaaauagagaaauaagauaaaug

SEQ ID NO: 730142 - RNA, 22 nt, Human
uaagaaacacaaagaauaccac

SEQ ID NO: 730143 - RNA, 24 nt, Human
uaagaaauaagaaaauguuaaaaa

SEQ ID NO: 730144 - RNA, 24 nt, Human
uaagugaacuauuauguccauguu

SEQ ID NO: 730145 - RNA, 20 nt, Human
uacacaguauuuugcuguaa

SEQ ID NO: 730146 - RNA, 23 nt, Human
uacacaugaaauuaauuuuaauc

SEQ ID NO: 730147 - RNA, 21 nt, Human
uacacgaauaagauguaacuc

SEQ ID NO: 730148 - RNA, 22 nt, Human
uaccaagcccugagcacacuag

SEQ ID NO: 730149 - RNA, 19 nt, Human
uaccaguuagacggacaua

SEQ ID NO: 730150 - RNA, 25 nt, Human
uagaaaacaagcaaagauuaguuua

SEQ ID NO: 730151 - RNA, 21 nt, Human
uagaauuauagaugugauuua

SEQ ID NO: 730152 - RNA, 20 nt, Human
uagcaacguaaguuuaacca

SEQ ID NO: 730153 - RNA, 24 nt, Human
uaucuagaagaaaaccaagguccc

SEQ ID NO: 730154 - RNA, 20 nt, Human
uauguccauguuugcacaua

SEQ ID NO: 730155 - RNA, 21 nt, Human
uauuuucuuugggacagcugc

SEQ ID NO: 730156 - RNA, 18 nt, Human
uauuuugcuguaaauacc

SEQ ID NO: 730157 - RNA, 23 nt, Human
ucaauguaccaguuagacggaca

SEQ ID NO: 730158 - RNA, 23 nt, Human
ucacaacauaaaauagagaaaua

SEQ ID NO: 730159 - RNA, 18 nt, Human
ucacagaagccccaaaga

SEQ ID NO: 730160 - RNA, 22 nt, Human
ucacagaagccccaaagaacuc

SEQ ID NO: 730161 - RNA, 21 nt, Human
ucagcucauuguaccaagccc

SEQ ID NO: 730162 - RNA, 27 nt, Human
uccagaucacaaauaaucuuaagaguu

SEQ ID NO: 730163 - RNA, 20 nt, Human
ucccaagucacagaagcccc

SEQ ID NO: 730164 - RNA, 19 nt, Human
uccuaaaaccucaauuuuc

SEQ ID NO: 730165 - RNA, 23 nt, Human
ucuaacaaauacauaaauccaga

SEQ ID NO: 730166 - RNA, 27 nt, Human
ucucuaguguuaacaucaaaucacauu

SEQ ID NO: 730167 - RNA, 20 nt, Human
ugaaaauccuaaaaccucag

SEQ ID NO: 730168 - RNA, 21 nt, Human
ugagcacacuagauucuuugu

SEQ ID NO: 730169 - RNA, 21 nt, Human
ugauauagcaaaaucaaaggg

SEQ ID NO: 730170 - RNA, 22 nt, Human
ugaucaaauaauauuuuaguau

SEQ ID NO: 730171 - RNA, 20 nt, Human
ugcaucuuaguuugggguua

SEQ ID NO: 730172 - RNA, 19 nt, Human
ugccacacagaugauuauu

SEQ ID NO: 730173 - RNA, 22 nt, Human
uggaaagcaaaaaguacaacag

SEQ ID NO: 730174 - RNA, 22 nt, Human
uggccaaaauuuuagccuucau

SEQ ID NO: 730175 - RNA, 24 nt, Human
uguuuauuguuuaugauuuacaca

SEQ ID NO: 730176 - RNA, 21 nt, Human
uuaagcacauccacugguuuc

SEQ ID NO: 730177 - RNA, 21 nt, Human
uuauucacacuauggacaagc

SEQ ID NO: 730178 - RNA, 23 nt, Human
uucuuucuaaacuauggcauaua

SEQ ID NO: 730179 - RNA, 24 nt, Human
uugcauuccauuuuaacaauucgu

SEQ ID NO: 730180 - RNA, 20 nt, Human
uugccagccuuagcuuauac

SEQ ID NO: 730181 - RNA, 27 nt, Human
uuuaauacuuucugcaaaccuaaauuu

SEQ ID NO: 730182 - RNA, 20 nt, Human
uuucucagcauaugaaccaa

SEQ ID NO: 730183 - RNA, 21 nt, Human
aagcacugaaaaauuggaacu

SEQ ID NO: 730184 - RNA, 22 nt, Human
accgaaauuuagacaacgucca

SEQ ID NO: 730185 - RNA, 23 nt, Human
aggaugcuuucuauggagggaau

SEQ ID NO: 730186 - RNA, 19 nt, Human
agggaaggugcucugagga

SEQ ID NO: 730187 - RNA, 22 nt, Human
caacaguugcaugagaucuuaa

SEQ ID NO: 730188 - RNA, 23 nt, Human
cacucacuggagggagugucugg

SEQ ID NO: 730189 - RNA, 22 nt, Human
cagaaaaaacugaauggaacuu

SEQ ID NO: 730190 - RNA, 21 nt, Human
cagaaaauacaacaguugcau

SEQ ID NO: 730191 - RNA, 19 nt, Human
ccauggcuaccgaaauuua

SEQ ID NO: 730192 - RNA, 22 nt, Human
cuaaacguuauaauccacaaca

SEQ ID NO: 730193 - RNA, 19 nt, Human
cuccccgaaagggggcaga

SEQ ID NO: 730194 - RNA, 23 nt, Human
cugaauggaacuuguacuacuga

SEQ ID NO: 730195 - RNA, 21 nt, Human
cuguguuuuaaaugugcacuu

SEQ ID NO: 730196 - RNA, 19 nt, Human
gugcacuccccgaaagggg

SEQ ID NO: 730197 - RNA, 19 nt, Human
uacuacugagauucugugg

SEQ ID NO: 730198 - RNA, 31 nt, Human
uacuuuuuuuguuuuucuuuucuacaaaaag

SEQ ID NO: 730199 - RNA, 18 nt, Human
uaggaagccagggaaggu

SEQ ID NO: 730200 - RNA, 19 nt, Human
ucagaaaaaacugaaugga

SEQ ID NO: 730201 - RNA, 22 nt, Human
ucuguguuuuaaaugugcacuu

SEQ ID NO: 730202 - RNA, 18 nt, Human
ugcuuucuuauauucuug

SEQ ID NO: 730203 - RNA, 18 nt, Human
uggagaauggcuuccaga

SEQ ID NO: 730204 - RNA, 18 nt, Human
uggagggaauaagggcug

SEQ ID NO: 730205 - RNA, 24 nt, Human
uguaaagcacugaaaaauuggaac

SEQ ID NO: 730206 - RNA, 21 nt, Human
uucauuuaaaagguuaaauga

SEQ ID NO: 730207 - RNA, 24 nt, Human
uucuuugcuucacuuuaacagagg

SEQ ID NO: 730208 - RNA, 26 nt, Human
aaacugauacuuauuucaauucuuga

SEQ ID NO: 730209 - RNA, 24 nt, Human
aaagugcugggauuacaggcauga

SEQ ID NO: 730210 - RNA, 23 nt, Human
aaauagcuauguaaccguauuuu

SEQ ID NO: 730211 - RNA, 23 nt, Human
aaaucaguaccuuagacaagaca

SEQ ID NO: 730212 - RNA, 23 nt, Human
aagaauucucuauuacucuaacc

SEQ ID NO: 730213 - RNA, 19 nt, Human
aagugcugggauuacaggc

SEQ ID NO: 730214 - RNA, 21 nt, Human
aagugcugggauuacaggcau

SEQ ID NO: 730215 - RNA, 18 nt, Human
aauaagcuuagcuugaaa

SEQ ID NO: 730216 - RNA, 22 nt, Human
aaugacucccuuuguccuagaa

SEQ ID NO: 730217 - RNA, 23 nt, Human
acaaaaaaacauaacuggggagg

SEQ ID NO: 730218 - RNA, 22 nt, Human
acaaagucucugaggcucaaag

SEQ ID NO: 730219 - RNA, 23 nt, Human
acaccaccacgcccagcuaauuu

SEQ ID NO: 730220 - RNA, 24 nt, Human
accucgugauccgcccaccuuggc

SEQ ID NO: 730221 - RNA, 18 nt, Human
acuacacucuggccuggg

SEQ ID NO: 730222 - RNA, 24 nt, Human
acuauguuggucaggcugcccucg

SEQ ID NO: 730223 - RNA, 20 nt, Human
acugaguuuaugaguuugaa

SEQ ID NO: 730224 - RNA, 19 nt, Human
acugcagccuccgccuccu

SEQ ID NO: 730225 - RNA, 25 nt, Human
agacuguuauagagccagugaaacu

SEQ ID NO: 730226 - RNA, 21 nt, Human
agaguagauuacccccuacuc

SEQ ID NO: 730227 - RNA, 20 nt, Human
agcaaauaugcaaccaaaau

SEQ ID NO: 730228 - RNA, 20 nt, Human
agcuggguguggugguacau

SEQ ID NO: 730229 - RNA, 24 nt, Human
aggcuaaggugggaggguugcuug

SEQ ID NO: 730230 - RNA, 18 nt, Human
agggcuuaacaguguuug

SEQ ID NO: 730231 - RNA, 23 nt, Human
aggugggaggguugcuugagccc

SEQ ID NO: 730232 - RNA, 19 nt, Human
agguguuucaggagcccca

SEQ ID NO: 730233 - RNA, 18 nt, Human
aguagcugggauuacagg

SEQ ID NO: 730234 - RNA, 24 nt, Human
agugauucuccugucucagccucc

SEQ ID NO: 730235 - RNA, 21 nt, Human
agugcaauggcgugaucucag

SEQ ID NO: 730236 - RNA, 24 nt, Human
agugcaauggcgugaucucagcuc

SEQ ID NO: 730237 - RNA, 18 nt, Human
agugcugggauuacaggc

SEQ ID NO: 730238 - RNA, 19 nt, Human
aguuagaaacagguggccc

SEQ ID NO: 730239 - RNA, 19 nt, Human
aguucucuuaguguagagg

SEQ ID NO: 730240 - RNA, 22 nt, Human
auagagccagugaaacuugacu

SEQ ID NO: 730241 - RNA, 21 nt, Human
augggguuucacuauguuggu

SEQ ID NO: 730242 - RNA, 23 nt, Human
augggguuucacuauguugguca

SEQ ID NO: 730243 - RNA, 24 nt, Human
augggguuucacuauguuggucag

SEQ ID NO: 730244 - RNA, 18 nt, Human
auucuauuuccuaagaaa

SEQ ID NO: 730245 - RNA, 25 nt, Human
auucugcccaguucaaccaaaauga

SEQ ID NO: 730246 - RNA, 24 nt, Human
auugugccacuacacucuggccug

SEQ ID NO: 730247 - RNA, 20 nt, Human
auuuaugaaaaccuagauaa

SEQ ID NO: 730248 - RNA, 19 nt, Human
auuuuggaaguuuugugaa

SEQ ID NO: 730249 - RNA, 22 nt, Human
caaaacgagguguuucaggagc

SEQ ID NO: 730250 - RNA, 21 nt, Human
caaagucucugaggcucaaag

SEQ ID NO: 730251 - RNA, 25 nt, Human
caaagucucugaggcucaaaguuuu

SEQ ID NO: 730252 - RNA, 24 nt, Human
caaagugcugggauuacaggcaug

SEQ ID NO: 730253 - RNA, 22 nt, Human
caagugauucuccugucucagc

SEQ ID NO: 730254 - RNA, 22 nt, Human
caaguuagaaacagguggccca

SEQ ID NO: 730255 - RNA, 21 nt, Human
caauauagcagccacuagcca

SEQ ID NO: 730256 - RNA, 19 nt, Human
cacagcucucacagaagca

SEQ ID NO: 730257 - RNA, 24 nt, Human
caccacgcccagcuaauuuuugua

SEQ ID NO: 730258 - RNA, 23 nt, Human
cacuagcaacaucauuucucaag

SEQ ID NO: 730259 - RNA, 21 nt, Human
cacuauguuggucaggcugcc

SEQ ID NO: 730260 - RNA, 24 nt, Human
cacuauguuggucaggcugcccuc

SEQ ID NO: 730261 - RNA, 23 nt, Human
cacugcagccuccgccuccuggg

SEQ ID NO: 730262 - RNA, 24 nt, Human
cagauuaaaaugaaaaccauucaa

SEQ ID NO: 730263 - RNA, 23 nt, Human
cagccacagccacagccaacccg

SEQ ID NO: 730264 - RNA, 19 nt, Human
cagccuccgccuccugggc

SEQ ID NO: 730265 - RNA, 23 nt, Human
cagccuccgccuccugggcucaa

SEQ ID NO: 730266 - RNA, 18 nt, Human
caggaauucgaggcuaca

SEQ ID NO: 730267 - RNA, 23 nt, Human
caggagccccaaagcauaacauu

SEQ ID NO: 730268 - RNA, 23 nt, Human
ccaaagugcugggauuacaggca

SEQ ID NO: 730269 - RNA, 24 nt, Human
ccaaagugcugggauuacaggcau

SEQ ID NO: 730270 - RNA, 25 nt, Human
ccacagccacagccaacccggaagc

SEQ ID NO: 730271 - RNA, 20 nt, Human
ccacuacacucuggccuggg

SEQ ID NO: 730272 - RNA, 20 nt, Human
ccacuacacucuggccuggg

SEQ ID NO: 730273 - RNA, 20 nt, Human
ccacuacacucuggccuggg

SEQ ID NO: 730274 - RNA, 21 nt, Human
ccacuacacucuggccugggu

SEQ ID NO: 730275 - RNA, 23 nt, Human
ccacuacacucuggccuggguga

SEQ ID NO: 730276 - RNA, 23 nt, Human
ccacuacacucuggccuggguga

SEQ ID NO: 730277 - RNA, 24 nt, Human
ccacuacacucuggccugggugau

SEQ ID NO: 730278 - RNA, 24 nt, Human
cccaaagugcugggauuacaggca

SEQ ID NO: 730279 - RNA, 20 nt, Human
ccccaaagaaaaacuacccg

SEQ ID NO: 730280 - RNA, 20 nt, Human
cccccaaagaaaaacuaccc

SEQ ID NO: 730281 - RNA, 23 nt, Human
cccgaguagcugggauuacaggg

SEQ ID NO: 730282 - RNA, 21 nt, Human
ccgcagccacagccacagcca

SEQ ID NO: 730283 - RNA, 21 nt, Human
ccgccgcagccacagccacag

SEQ ID NO: 730284 - RNA, 24 nt, Human
ccgccuccugggcucaagugauuc

SEQ ID NO: 730285 - RNA, 21 nt, Human
ccgcuccgccccgcccgccuc

SEQ ID NO: 730286 - RNA, 19 nt, Human
ccuaagaaaaauaagaaaa

SEQ ID NO: 730287 - RNA, 23 nt, Human
ccuccaaauaacuuauuugauuu

SEQ ID NO: 730288 - RNA, 22 nt, Human
ccuccgccuccugggcucaagu

SEQ ID NO: 730289 - RNA, 21 nt, Human
ccuccugggcucaagugauuc

SEQ ID NO: 730290 - RNA, 24 nt, Human
ccuccugggcucaagugauucucc

SEQ ID NO: 730291 - RNA, 23 nt, Human
ccugggcucaagugauucuccuc

SEQ ID NO: 730292 - RNA, 23 nt, Human
ccugggcucaagugauucuccug

SEQ ID NO: 730293 - RNA, 22 nt, Human
ccuguagucccagcuacuaggg

SEQ ID NO: 730294 - RNA, 23 nt, Human
cgcucugucgccaggcuugagug

SEQ ID NO: 730295 - RNA, 23 nt, Human
cuauggcugugaacauuuaaacc

SEQ ID NO: 730296 - RNA, 23 nt, Human
cucaagugauucuccugucucag

SEQ ID NO: 730297 - RNA, 23 nt, Human
cucaaguuagaaacagguggccc

SEQ ID NO: 730298 - RNA, 24 nt, Human
cucacugcagccuccgccuccugg

SEQ ID NO: 730299 - RNA, 24 nt, Human
cucagccucccgaguagcugggau

SEQ ID NO: 730300 - RNA, 22 nt, Human
cuccugaccucgugauccgccc

SEQ ID NO: 730301 - RNA, 24 nt, Human
cuccugcgccgccgccgcagccac

SEQ ID NO: 730302 - RNA, 25 nt, Human
cuccugcgccgccgccgcagccaca

SEQ ID NO: 730303 - RNA, 21 nt, Human
cuccugggcucaagugauucu

SEQ ID NO: 730304 - RNA, 23 nt, Human
cugcagccuccgccuccugggcu

SEQ ID NO: 730305 - RNA, 18 nt, Human
cugcuccugcgccgccgc

SEQ ID NO: 730306 - RNA, 22 nt, Human
cuggcccuccgcuccgccccgc

SEQ ID NO: 730307 - RNA, 23 nt, Human
cugucucagccucccgaguagcu

SEQ ID NO: 730308 - RNA, 21 nt, Human
gaaaaagagaauguaaaaugu

SEQ ID NO: 730309 - RNA, 26 nt, Human
gaaacagguggcccaugcuguaauga

SEQ ID NO: 730310 - RNA, 20 nt, Human
gacccacgccggggcccgcu

SEQ ID NO: 730311 - RNA, 21 nt, Human
gaccucgugauccgcccaccu

SEQ ID NO: 730312 - RNA, 24 nt, Human
gaccucgugauccgcccaccuugg

SEQ ID NO: 730313 - RNA, 25 nt, Human
gaccucgugauccgcccaccuuggc

SEQ ID NO: 730314 - RNA, 24 nt, Human
gacggagucucgcucugucgccag

SEQ ID NO: 730315 - RNA, 24 nt, Human
gagaugggguuucacuauguuggu

SEQ ID NO: 730316 - RNA, 25 nt, Human
gaguagcugggauuacagggguaca

SEQ ID NO: 730317 - RNA, 21 nt, Human
gauacagugagaccccgucuc

SEQ ID NO: 730318 - RNA, 18 nt, Human
gauuacaggcaugagccc

SEQ ID NO: 730319 - RNA, 18 nt, Human
gauuacagggguacacca

SEQ ID NO: 730320 - RNA, 23 nt, Human
gcaacaucauuucucaaggacac

SEQ ID NO: 730321 - RNA, 19 nt, Human
gcauagcuaggacugaugc

SEQ ID NO: 730322 - RNA, 21 nt, Human
gccacagccacagccaacccg

SEQ ID NO: 730323 - RNA, 24 nt, Human
gccacuacacucuggccuggguga

SEQ ID NO: 730324 - RNA, 22 nt, Human
gcccagcuaauuuuuguauuuu

SEQ ID NO: 730325 - RNA, 20 nt, Human
gcccucgaacuccugaccuc

SEQ ID NO: 730326 - RNA, 20 nt, Human
gccgcagccacagccacagc

SEQ ID NO: 730327 - RNA, 22 nt, Human
gccugggugauacagugagacc

SEQ ID NO: 730328 - RNA, 18 nt, Human
gcuccugcgccgccgccg

SEQ ID NO: 730329 - RNA, 20 nt, Human
ggaggcuaaggugggagggu

SEQ ID NO: 730330 - RNA, 19 nt, Human
ggauuacaggcaugagccu

SEQ ID NO: 730331 - RNA, 18 nt, Human
ggauuuaacuagucugca

SEQ ID NO: 730332 - RNA, 22 nt, Human
ggccugggugauacagugagac

SEQ ID NO: 730333 - RNA, 22 nt, Human
gggaggguugcuugagcccagg

SEQ ID NO: 730334 - RNA, 25 nt, Human
gggcauuauaaacaucaguuagcca

SEQ ID NO: 730335 - RNA, 19 nt, Human
gggcucaagugauucuccu

SEQ ID NO: 730336 - RNA, 23 nt, Human
gggguuucacuauguuggucagg

SEQ ID NO: 730337 - RNA, 20 nt, Human
gguguggagagccugauuuc

SEQ ID NO: 730338 - RNA, 18 nt, Human
guagcugggauuacaggg

SEQ ID NO: 730339 - RNA, 20 nt, Human
guagcugggauuacaggggu

SEQ ID NO: 730340 - RNA, 20 nt, Human
gugaagaaagcuuuaccuuc

SEQ ID NO: 730341 - RNA, 24 nt, Human
gugauucuccugucucagccuccc

SEQ ID NO: 730342 - RNA, 19 nt, Human
uaaaagggcaaauucccca

SEQ ID NO: 730343 - RNA, 21 nt, Human
uaaaccuuacagaaaaacuga

SEQ ID NO: 730344 - RNA, 20 nt, Human
uaacaguguuuguaaaaaaa

SEQ ID NO: 730345 - RNA, 18 nt, Human
uaagaaacacacucuaua

SEQ ID NO: 730346 - RNA, 19 nt, Human
uaagaagagcccaaucaag

SEQ ID NO: 730347 - RNA, 21 nt, Human
uaagauuagaugaagauuagc

SEQ ID NO: 730348 - RNA, 23 nt, Human
uaaggugggaggguugcuugagc

SEQ ID NO: 730349 - RNA, 24 nt, Human
uaaggugggaggguugcuugagcc

SEQ ID NO: 730350 - RNA, 24 nt, Human
uaauuuuuguauuuuuaguagaga

SEQ ID NO: 730351 - RNA, 23 nt, Human
uacaaagucucugaggcucaaag

SEQ ID NO: 730352 - RNA, 21 nt, Human
uacaauuacagacacaugcug

SEQ ID NO: 730353 - RNA, 23 nt, Human
uacagaguagaggugaguuucaa

SEQ ID NO: 730354 - RNA, 23 nt, Human
uacagaucaaguauguccaauga

SEQ ID NO: 730355 - RNA, 23 nt, Human
uacaggcaugagccuccacgccc

SEQ ID NO: 730356 - RNA, 24 nt, Human
uacagggguacaccaccacgccca

SEQ ID NO: 730357 - RNA, 24 nt, Human
uacagugagaccccgucucuaaaa

SEQ ID NO: 730358 - RNA, 21 nt, Human
uaccuggauggagggcauuau

SEQ ID NO: 730359 - RNA, 27 nt, Human
uacuagugcccaccuucuuuucucaaa

SEQ ID NO: 730360 - RNA, 23 nt, Human
uagaaaacaaaaaaacauaacug

SEQ ID NO: 730361 - RNA, 20 nt, Human
uagaacaaaccauucugccc

SEQ ID NO: 730362 - RNA, 22 nt, Human
uagagaugggguuucacuaugu

SEQ ID NO: 730363 - RNA, 23 nt, Human
uagcuuagcaaauaugcaaccaa

SEQ ID NO: 730364 - RNA, 23 nt, Human
uaguagagaugggguuucacuau

SEQ ID NO: 730365 - RNA, 24 nt, Human
uaguagagaugggguuucacuaug

SEQ ID NO: 730366 - RNA, 18 nt, Human
uauguuggucaggcugcc

SEQ ID NO: 730367 - RNA, 24 nt, Human
uauguuggucaggcugcccucgaa

SEQ ID NO: 730368 - RNA, 23 nt, Human
ucaaugcccccaaagaaaaacua

SEQ ID NO: 730369 - RNA, 23 nt, Human
ucacugcagccuccgccuccugg

SEQ ID NO: 730370 - RNA, 24 nt, Human
ucacugcagccuccgccuccuggg

SEQ ID NO: 730371 - RNA, 25 nt, Human
ucacugcagccuccgccuccugggc

SEQ ID NO: 730372 - RNA, 26 nt, Human
ucacugcagccuccgccuccugggcu

SEQ ID NO: 730373 - RNA, 24 nt, Human
ucagcaucauuuaaucuguugcuc

SEQ ID NO: 730374 - RNA, 20 nt, Human
ucagccucccgaguagcugg

SEQ ID NO: 730375 - RNA, 24 nt, Human
ucccaaagugcugggauuacaggc

SEQ ID NO: 730376 - RNA, 25 nt, Human
uccccauacauugugaucugucaua

SEQ ID NO: 730377 - RNA, 23 nt, Human
uccccuaccagcuuacaugaaag

SEQ ID NO: 730378 - RNA, 23 nt, Human
ucccgaguagcugggauuacagg

SEQ ID NO: 730379 - RNA, 25 nt, Human
ucccgaguagcugggauuacagggg

SEQ ID NO: 730380 - RNA, 18 nt, Human
ucccuguagucccagcua

SEQ ID NO: 730381 - RNA, 23 nt, Human
ucccuguagucccagcuacuagg

SEQ ID NO: 730382 - RNA, 24 nt, Human
ucccuguagucccagcuacuaggg

SEQ ID NO: 730383 - RNA, 18 nt, Human
uccuagaaaacaaaaaaa

SEQ ID NO: 730384 - RNA, 22 nt, Human
uccugcgccgccgccgcagcca

SEQ ID NO: 730385 - RNA, 24 nt, Human
uccugcgccgccgccgcagccaca

SEQ ID NO: 730386 - RNA, 21 nt, Human
uccugggcucaagugauucuc

SEQ ID NO: 730387 - RNA, 22 nt, Human
uccugggcucaagugauucucc

SEQ ID NO: 730388 - RNA, 24 nt, Human
uccugggcucaagugauucuccug

SEQ ID NO: 730389 - RNA, 21 nt, Human
ucgcucugucgccaggcuuga

SEQ ID NO: 730390 - RNA, 20 nt, Human
ucucaaaaauccccuaccag

SEQ ID NO: 730391 - RNA, 24 nt, Human
ucuccugucucagccucccgagua

SEQ ID NO: 730392 - RNA, 23 nt, Human
ucucgcucugucgccaggcuuga

SEQ ID NO: 730393 - RNA, 24 nt, Human
ucucgcucugucgccaggcuugag

SEQ ID NO: 730394 - RNA, 19 nt, Human
ugaaaaguugguaaaaacu

SEQ ID NO: 730395 - RNA, 22 nt, Human
ugaaaaguugguaaaaacuuug

SEQ ID NO: 730396 - RNA, 22 nt, Human
ugaaaaguugguaaaaacuuug

SEQ ID NO: 730397 - RNA, 26 nt, Human
ugaaaaguugguaaaaacuuuguguu

SEQ ID NO: 730398 - RNA, 19 nt, Human
ugagaaguacuuucauguu

SEQ ID NO: 730399 - RNA, 19 nt, Human
ugagaccccgucucuaaaa

SEQ ID NO: 730400 - RNA, 19 nt, Human
ugaggguuacuuugucuua

SEQ ID NO: 730401 - RNA, 18 nt, Human
ugagugcaauggcgugau

SEQ ID NO: 730402 - RNA, 22 nt, Human
ugauacagugagaccccgucuc

SEQ ID NO: 730403 - RNA, 24 nt, Human
ugauacagugagaccccgucucua

SEQ ID NO: 730404 - RNA, 24 nt, Human
ugauccgcccaccuuggccuccca

SEQ ID NO: 730405 - RNA, 20 nt, Human
ugauucuccugucucagccu

SEQ ID NO: 730406 - RNA, 20 nt, Human
ugcugggauuacaggcauga

SEQ ID NO: 730407 - RNA, 19 nt, Human
ugcuucuuuuuauguuuuu

SEQ ID NO: 730408 - RNA, 19 nt, Human
uggcccuccgcuccgcccc

SEQ ID NO: 730409 - RNA, 27 nt, Human
uggcgggagacccacgccggggcccgc

SEQ ID NO: 730410 - RNA, 24 nt, Human
uggcgugaucucagcucacugcag

SEQ ID NO: 730411 - RNA, 20 nt, Human
uggcugugaacauuuaaacc

SEQ ID NO: 730412 - RNA, 18 nt, Human
ugggauuacaggcaugag

SEQ ID NO: 730413 - RNA, 19 nt, Human
ugggauuacaggcaugagc

SEQ ID NO: 730414 - RNA, 19 nt, Human
ugggauuacaggcaugagc

SEQ ID NO: 730415 - RNA, 24 nt, Human
ugggauuacaggcaugagccucca

SEQ ID NO: 730416 - RNA, 22 nt, Human
ugggauuacagggguacaccac

SEQ ID NO: 730417 - RNA, 24 nt, Human
ugggauuacagggguacaccacca

SEQ ID NO: 730418 - RNA, 18 nt, Human
ugggcucaagugauucuc

SEQ ID NO: 730419 - RNA, 24 nt, Human
ugggcucaagugauucuccugucu

SEQ ID NO: 730420 - RNA, 20 nt, Human
uggggagguuggcaagaccc

SEQ ID NO: 730421 - RNA, 24 nt, Human
ugggguuucacuauguuggucagg

SEQ ID NO: 730422 - RNA, 24 nt, Human
uggucaggcugcccucgaacuccu

SEQ ID NO: 730423 - RNA, 24 nt, Human
uggugguacaucccuguaguccca

SEQ ID NO: 730424 - RNA, 24 nt, Human
ugucucagccucccgaguagcugg

SEQ ID NO: 730425 - RNA, 21 nt, Human
ugucuugugguaacaacugug

SEQ ID NO: 730426 - RNA, 20 nt, Human
ugugaucugucauauuuagc

SEQ ID NO: 730427 - RNA, 23 nt, Human
uuaaaaugaaaaccauucaauaa

SEQ ID NO: 730428 - RNA, 24 nt, Human
uuaaaauuuugauagccuucuguu

SEQ ID NO: 730429 - RNA, 22 nt, Human
uuagcuacuugauaugagaauc

SEQ ID NO: 730430 - RNA, 18 nt, Human
uuagcugggugugguggu

SEQ ID NO: 730431 - RNA, 20 nt, Human
uuagcuggguguggugguac

SEQ ID NO: 730432 - RNA, 18 nt, Human
uuaguagagaugggguuu

SEQ ID NO: 730433 - RNA, 21 nt, Human
uuaguagagaugggguuucac

SEQ ID NO: 730434 - RNA, 21 nt, Human
uuaguagagaugggguuucac

SEQ ID NO: 730435 - RNA, 24 nt, Human
uuaguagagaugggguuucacuau

SEQ ID NO: 730436 - RNA, 19 nt, Human
uuaguguagagguagacug

SEQ ID NO: 730437 - RNA, 18 nt, Human
uugaaucuuucugaaguu

SEQ ID NO: 730438 - RNA, 23 nt, Human
uugagugcaauggcgugaucuca

SEQ ID NO: 730439 - RNA, 24 nt, Human
uugcuugagcccaggaauucgagg

SEQ ID NO: 730440 - RNA, 18 nt, Human
uuggccucccaaagugcu

SEQ ID NO: 730441 - RNA, 23 nt, Human
uuguauuuuuaguagagaugggg

SEQ ID NO: 730442 - RNA, 22 nt, Human
uuuucugacaaaaauucagaau

SEQ ID NO: 730443 - RNA, 20 nt, Human
uuuuguauuuuuaguagaga

SEQ ID NO: 730444 - RNA, 24 nt, Human
uuuuuaguagagaugggguuucac

SEQ ID NO: 730445 - RNA, 20 nt, Human
uuuuuguauuuuuaguagag

SEQ ID NO: 730446 - RNA, 22 nt, Human
aaaguccaguacuauacuccuc

SEQ ID NO: 730447 - RNA, 22 nt, Human
aaauacugaacaucacaaugug

SEQ ID NO: 730448 - RNA, 20 nt, Human
aaccccaccaccagcagagc

SEQ ID NO: 730449 - RNA, 21 nt, Human
aagacaaauaucaacaaaugu

SEQ ID NO: 730450 - RNA, 19 nt, Human
aagcaggccuccagaaauc

SEQ ID NO: 730451 - RNA, 20 nt, Human
acaguagaacgacaaucaga

SEQ ID NO: 730452 - RNA, 21 nt, Human
acgccagaccuucagaggccc

SEQ ID NO: 730453 - RNA, 22 nt, Human
acgccagaccuucagaggccca

SEQ ID NO: 730454 - RNA, 23 nt, Human
acugaacaucacaauguggacaa

SEQ ID NO: 730455 - RNA, 25 nt, Human
agaggcccagagcccaggucaucgg

SEQ ID NO: 730456 - RNA, 22 nt, Human
agcacuaaagauauauguugca

SEQ ID NO: 730457 - RNA, 23 nt, Human
agcagcaaccccaccaccagcag

SEQ ID NO: 730458 - RNA, 20 nt, Human
auguugcaacacagaaccaa

SEQ ID NO: 730459 - RNA, 25 nt, Human
caaccccaccaccagcagagcagcc

SEQ ID NO: 730460 - RNA, 22 nt, Human
caagccccacagcugacagaag

SEQ ID NO: 730461 - RNA, 18 nt, Human
caaguuacaaagaaaguc

SEQ ID NO: 730462 - RNA, 21 nt, Human
cacaaacaacacucaaauaua

SEQ ID NO: 730463 - RNA, 19 nt, Human
cacagguuuguuucuucac

SEQ ID NO: 730464 - RNA, 25 nt, Human
caccaccagcagagcagccacugga

SEQ ID NO: 730465 - RNA, 23 nt, Human
cacucagccuccuucccaaacac

SEQ ID NO: 730466 - RNA, 19 nt, Human
cacuguguccugucagaau

SEQ ID NO: 730467 - RNA, 20 nt, Human
cagaccuucagaggcccaga

SEQ ID NO: 730468 - RNA, 19 nt, Human
cagaugcucacuguguccu

SEQ ID NO: 730469 - RNA, 22 nt, Human
cagcagcaaccccaccaccagc

SEQ ID NO: 730470 - RNA, 21 nt, Human
cagccuccuucccaaacacag

SEQ ID NO: 730471 - RNA, 25 nt, Human
ccagccuuaaagcaggccuccagaa

SEQ ID NO: 730472 - RNA, 21 nt, Human
ccaguagucacucagccuccu

SEQ ID NO: 730473 - RNA, 24 nt, Human
cccaccaccagcagagcagccacu

SEQ ID NO: 730474 - RNA, 18 nt, Human
cccccuccucucuucagc

SEQ ID NO: 730475 - RNA, 19 nt, Human
cucaaauauauauauauau

SEQ ID NO: 730476 - RNA, 22 nt, Human
cucccccagucuaaaccucaac

SEQ ID NO: 730477 - RNA, 20 nt, Human
cucucuucagcucuccucug

SEQ ID NO: 730478 - RNA, 19 nt, Human
cuggcaucagaaaaaugcu

SEQ ID NO: 730479 - RNA, 22 nt, Human
cuugcagaacuggccagccuua

SEQ ID NO: 730480 - RNA, 23 nt, Human
gacaaucugaggccagcaauuaa

SEQ ID NO: 730481 - RNA, 21 nt, Human
gaguguagaacaggcacaacc

SEQ ID NO: 730482 - RNA, 23 nt, Human
gcccagagcccaggucaucggcc

SEQ ID NO: 730483 - RNA, 18 nt, Human
ggaauauucgugcuccuc

SEQ ID NO: 730484 - RNA, 22 nt, Human
gucaagccccacagcugacagg

SEQ ID NO: 730485 - RNA, 21 nt, Human
gugcagacccguugagggugg

SEQ ID NO: 730486 - RNA, 19 nt, Human
uaacauaggacuuuauuga

SEQ ID NO: 730487 - RNA, 22 nt, Human
uaacucaggaacauaaggacaa

SEQ ID NO: 730488 - RNA, 18 nt, Human
uagaguguagaacaggca

SEQ ID NO: 730489 - RNA, 22 nt, Human
uagugucaagccccacagcuga

SEQ ID NO: 730490 - RNA, 25 nt, Human
uagugucaagccccacagcugacag

SEQ ID NO: 730491 - RNA, 19 nt, Human
uauauauacaguagaacga

SEQ ID NO: 730492 - RNA, 19 nt, Human
ucacagguuuguuucuuca

SEQ ID NO: 730493 - RNA, 22 nt, Human
ucagcucuccucuggcugcucu

SEQ ID NO: 730494 - RNA, 22 nt, Human
ucuccuccuccuugccuuucuu

SEQ ID NO: 730495 - RNA, 22 nt, Human
ucucuucagcucuccucuggcu

SEQ ID NO: 730496 - RNA, 18 nt, Human
ugaaacacaaacaacacu

SEQ ID NO: 730497 - RNA, 23 nt, Human
ugaaacacaaacaacacucaaau

SEQ ID NO: 730498 - RNA, 23 nt, Human
ugaacaucacaauguggacaaga

SEQ ID NO: 730499 - RNA, 23 nt, Human
ugacagaaggggguccuccagag

SEQ ID NO: 730500 - RNA, 23 nt, Human
ugcaacacagaaccaacuauuaa

SEQ ID NO: 730501 - RNA, 23 nt, Human
uggccagccuuaaagcaggccuc

SEQ ID NO: 730502 - RNA, 24 nt, Human
uuacaaagaaaguccaguacuaua

SEQ ID NO: 730503 - RNA, 23 nt, Human
uuaggugauugaggauauaagcu

SEQ ID NO: 730504 - RNA, 22 nt, Human
uuauugaaacacaaacaacacu

SEQ ID NO: 730505 - RNA, 21 nt, Human
aaaaaaaaaacacaacgccag

SEQ ID NO: 730506 - RNA, 24 nt, Human
aaaaaaaaaacacaacgccaguga

SEQ ID NO: 730507 - RNA, 21 nt, Human
aaaaaccaaacccagcccaaa

SEQ ID NO: 730508 - RNA, 21 nt, Human
aaaagauguacaaauaaauga

SEQ ID NO: 730509 - RNA, 21 nt, Human
aaacauacacacagaguacaa

SEQ ID NO: 730510 - RNA, 18 nt, Human
aaacauggcucugcagaa

SEQ ID NO: 730511 - RNA, 18 nt, Human
aaacuggucagccccaaa

SEQ ID NO: 730512 - RNA, 18 nt, Human
aaacuuucagacacagaa

SEQ ID NO: 730513 - RNA, 23 nt, Human
aaacuuucagacacagaaaacag

SEQ ID NO: 730514 - RNA, 27 nt, Human
aaacuuucagacacagaaaacaggaca

SEQ ID NO: 730515 - RNA, 19 nt, Human
aaagaaaaaaaaaacacaa

SEQ ID NO: 730516 - RNA, 23 nt, Human
aaaguccagccugccccuggggg

SEQ ID NO: 730517 - RNA, 21 nt, Human
aaaugucagccagggucucac

SEQ ID NO: 730518 - RNA, 18 nt, Human
aacacagaaaaccaaaac

SEQ ID NO: 730519 - RNA, 20 nt, Human
aacacgcauguggaugaacc

SEQ ID NO: 730520 - RNA, 20 nt, Human
aacaugugagcccgcugaca

SEQ ID NO: 730521 - RNA, 22 nt, Human
aagaagucgucuggaaaaggug

SEQ ID NO: 730522 - RNA, 18 nt, Human
aagacgccaaacauacgg

SEQ ID NO: 730523 - RNA, 22 nt, Human
aagcuggugaauccugacccag

SEQ ID NO: 730524 - RNA, 19 nt, Human
aaggcgcacaggggagggg

SEQ ID NO: 730525 - RNA, 24 nt, Human
aaucgcugcuugaggaguucagga

SEQ ID NO: 730526 - RNA, 18 nt, Human
acacacaaacaggccuag

SEQ ID NO: 730527 - RNA, 18 nt, Human
acacagaaaaccaaaaca

SEQ ID NO: 730528 - RNA, 23 nt, Human
acacaggugcagacaggucaggu

SEQ ID NO: 730529 - RNA, 19 nt, Human
acccaacgcagcaguggcu

SEQ ID NO: 730530 - RNA, 18 nt, Human
accccgagucaccugagc

SEQ ID NO: 730531 - RNA, 20 nt, Human
accccgagucaccugagccc

SEQ ID NO: 730532 - RNA, 19 nt, Human
accccugaacucagacccc

SEQ ID NO: 730533 - RNA, 23 nt, Human
accuccaccccaggcccagcugg

SEQ ID NO: 730534 - RNA, 22 nt, Human
accuugggucuggaacccaucg

SEQ ID NO: 730535 - RNA, 23 nt, Human
acucuaguagcccaccccucccg

SEQ ID NO: 730536 - RNA, 20 nt, Human
acuuguaggucccgcccucc

SEQ ID NO: 730537 - RNA, 27 nt, Human
agaaaaaaaaaacacaacgccagugag

SEQ ID NO: 730538 - RNA, 19 nt, Human
agaagagacuugggggagg

SEQ ID NO: 730539 - RNA, 22 nt, Human
agaaggcaaacccaacgcagca

SEQ ID NO: 730540 - RNA, 21 nt, Human
agaugguuuugggaugucagg

SEQ ID NO: 730541 - RNA, 24 nt, Human
agcaaaaaccaaacccagcccaaa

SEQ ID NO: 730542 - RNA, 23 nt, Human
agccagggucucaccauagggcu

SEQ ID NO: 730543 - RNA, 21 nt, Human
agcccacucuccacuccaccu

SEQ ID NO: 730544 - RNA, 18 nt, Human
agcccuggccaggcuuuc

SEQ ID NO: 730545 - RNA, 18 nt, Human
agcucagggcccaugacc

SEQ ID NO: 730546 - RNA, 26 nt, Human
aggaaggcgcacaggggagggaccau

SEQ ID NO: 730547 - RNA, 20 nt, Human
aggacuucaaucauaggggg

SEQ ID NO: 730548 - RNA, 22 nt, Human
aggagcccuggccaggcuuucc

SEQ ID NO: 730549 - RNA, 22 nt, Human
aggaggggaaaugucagccagg

SEQ ID NO: 730550 - RNA, 20 nt, Human
aggcagaggagaagggagcc

SEQ ID NO: 730551 - RNA, 21 nt, Human
aggcagcccccaaaagcagga

SEQ ID NO: 730552 - RNA, 20 nt, Human
aggccccccacugguaacag

SEQ ID NO: 730553 - RNA, 23 nt, Human
aggccuuuccagggacaggggaa

SEQ ID NO: 730554 - RNA, 19 nt, Human
aggcuccaagugaccgaca

SEQ ID NO: 730555 - RNA, 19 nt, Human
agggccugaccugcucccc

SEQ ID NO: 730556 - RNA, 23 nt, Human
aggggagcacccgggggacucug

SEQ ID NO: 730557 - RNA, 22 nt, Human
aggggucugcagagggcacugg

SEQ ID NO: 730558 - RNA, 21 nt, Human
aggugggcgcccccccucccg

SEQ ID NO: 730559 - RNA, 25 nt, Human
caaaaagcccccgggaaggccuuuu

SEQ ID NO: 730560 - RNA, 22 nt, Human
caaacccagcccaaagacgcca

SEQ ID NO: 730561 - RNA, 24 nt, Human
caaagacgccaaacauacggacac

SEQ ID NO: 730562 - RNA, 21 nt, Human
caaagcuggacccgcccccgc

SEQ ID NO: 730563 - RNA, 23 nt, Human
caaaggauuuauuaaaacacaga

SEQ ID NO: 730564 - RNA, 24 nt, Human
caagacucagaaacgccuuccagg

SEQ ID NO: 730565 - RNA, 21 nt, Human
cacaccccugaacucagaccc

SEQ ID NO: 730566 - RNA, 18 nt, Human
caccccugaacucagacc

SEQ ID NO: 730567 - RNA, 23 nt, Human
cacccuggcugggacuccuggcg

SEQ ID NO: 730568 - RNA, 23 nt, Human
caccuccaccccaggcccagcug

SEQ ID NO: 730569 - RNA, 24 nt, Human
caccucuggcagaaggcaaaccca

SEQ ID NO: 730570 - RNA, 18 nt, Human
cacgggagugagcuucug

SEQ ID NO: 730571 - RNA, 20 nt, Human
cacucuccacuccaccuccu

SEQ ID NO: 730572 - RNA, 22 nt, Human
cacugguaacagaguccagggc

SEQ ID NO: 730573 - RNA, 19 nt, Human
cacuucugggcucuggccc

SEQ ID NO: 730574 - RNA, 21 nt, Human
cagaacucuccccacgccuuc

SEQ ID NO: 730575 - RNA, 22 nt, Human
cagaacucuccccacgccuucc

SEQ ID NO: 730576 - RNA, 19 nt, Human
cagaagcccuacucagcac

SEQ ID NO: 730577 - RNA, 20 nt, Human
cagcaagcccuuggugcugc

SEQ ID NO: 730578 - RNA, 21 nt, Human
cagcagcaaaaaccaaacccu

SEQ ID NO: 730579 - RNA, 18 nt, Human
cagcaguggcuccgaggc

SEQ ID NO: 730580 - RNA, 27 nt, Human
cagcccagggcccucccuuugccagcc

SEQ ID NO: 730581 - RNA, 22 nt, Human
cagcccuuuccuaacauuccca

SEQ ID NO: 730582 - RNA, 22 nt, Human
cagccucaggcaaaaagccccc

SEQ ID NO: 730583 - RNA, 20 nt, Human
cagcugccgaggccgaggcg

SEQ ID NO: 730584 - RNA, 22 nt, Human
cagcugccgaggccgaggcggg

SEQ ID NO: 730585 - RNA, 19 nt, Human
caggaaccagcugccgagg

SEQ ID NO: 730586 - RNA, 24 nt, Human
caggacacacacacacacccaacg

SEQ ID NO: 730587 - RNA, 20 nt, Human
caggaggcaccgcagagcac

SEQ ID NO: 730588 - RNA, 23 nt, Human
caggcccccaggggcagcccggu

SEQ ID NO: 730589 - RNA, 19 nt, Human
caggccuagggagggccug

SEQ ID NO: 730590 - RNA, 27 nt, Human
cagggcacagggcagggccagggucuc

SEQ ID NO: 730591 - RNA, 20 nt, Human
caucccagggcacagggcag

SEQ ID NO: 730592 - RNA, 20 nt, Human
ccacggacagcaccaccccu

SEQ ID NO: 730593 - RNA, 22 nt, Human
ccacucuccacuccaccuccuu

SEQ ID NO: 730594 - RNA, 21 nt, Human
ccagacaagccacggcucaca

SEQ ID NO: 730595 - RNA, 18 nt, Human
ccagcccagggcccuccc

SEQ ID NO: 730596 - RNA, 24 nt, Human
ccagcuggguuuuucacgcagccc

SEQ ID NO: 730597 - RNA, 23 nt, Human
ccaggcagugcagggggcccagg

SEQ ID NO: 730598 - RNA, 22 nt, Human
cccacagacccugacgcacacu

SEQ ID NO: 730599 - RNA, 24 nt, Human
cccacagacccugacgcacacugg

SEQ ID NO: 730600 - RNA, 20 nt, Human
cccacaugugggaagauggu

SEQ ID NO: 730601 - RNA, 22 nt, Human
cccaggcaggcccucuccaagg

SEQ ID NO: 730602 - RNA, 18 nt, Human
ccccaaaagcaggaggac

SEQ ID NO: 730603 - RNA, 23 nt, Human
ccccacuacgcccacgugcagug

SEQ ID NO: 730604 - RNA, 18 nt, Human
ccccaggcccagcugggu

SEQ ID NO: 730605 - RNA, 21 nt, Human
cccccaggggcagcccgguuc

SEQ ID NO: 730606 - RNA, 21 nt, Human
ccccccacugguaacagaguc

SEQ ID NO: 730607 - RNA, 19 nt, Human
cccccccagcccacccucc

SEQ ID NO: 730608 - RNA, 20 nt, Human
cccccccagcccacccuccc

SEQ ID NO: 730609 - RNA, 25 nt, Human
ccccccccagcccacccucccuggg

SEQ ID NO: 730610 - RNA, 18 nt, Human
cccccccucccgccgggc

SEQ ID NO: 730611 - RNA, 21 nt, Human
ccccgagucaccugagcccau

SEQ ID NO: 730612 - RNA, 18 nt, Human
ccccugaacucagacccc

SEQ ID NO: 730613 - RNA, 22 nt, Human
ccccugcccacagacccugacg

SEQ ID NO: 730614 - RNA, 21 nt, Human
cccucagucccaggcaggccc

SEQ ID NO: 730615 - RNA, 20 nt, Human
cccuggcccccucaguccca

SEQ ID NO: 730616 - RNA, 18 nt, Human
ccgcagagcacacaacac

SEQ ID NO: 730617 - RNA, 19 nt, Human
ccgcugacaaucaucucca

SEQ ID NO: 730618 - RNA, 19 nt, Human
ccuccaccccaggcccagc

SEQ ID NO: 730619 - RNA, 22 nt, Human
ccugacccagcccuggcccccu

SEQ ID NO: 730620 - RNA, 22 nt, Human
ccuggcggccuccagccuuggc

SEQ ID NO: 730621 - RNA, 25 nt, Human
ccuugcacccagcccagggcccucc

SEQ ID NO: 730622 - RNA, 24 nt, Human
ccuugggguggagacacagacccc

SEQ ID NO: 730623 - RNA, 20 nt, Human
cggcuccccaaaccugcccu

SEQ ID NO: 730624 - RNA, 23 nt, Human
cgggcagguggcccggcaggcgu

SEQ ID NO: 730625 - RNA, 23 nt, Human
cggggccacaggccccccacugg

SEQ ID NO: 730626 - RNA, 23 nt, Human
cgugccagccucggcccccaccc

SEQ ID NO: 730627 - RNA, 23 nt, Human
cucacuccaccccgagucaccgc

SEQ ID NO: 730628 - RNA, 18 nt, Human
cucagaucuuuucuccuc

SEQ ID NO: 730629 - RNA, 21 nt, Human
cuccacuccagggugcucccc

SEQ ID NO: 730630 - RNA, 21 nt, Human
cuccaggggugcuugggcucc

SEQ ID NO: 730631 - RNA, 21 nt, Human
cuccugggccagcucagggcc

SEQ ID NO: 730632 - RNA, 19 nt, Human
cucuaguagcccaccccuc

SEQ ID NO: 730633 - RNA, 18 nt, Human
cucuccacuccaccuccu

SEQ ID NO: 730634 - RNA, 24 nt, Human
cucucccaaacuggucagccccaa

SEQ ID NO: 730635 - RNA, 23 nt, Human
cugaguccacagggcagugccag

SEQ ID NO: 730636 - RNA, 25 nt, Human
cugcaccccaaggcaccuucccugg

SEQ ID NO: 730637 - RNA, 25 nt, Human
cugcagaagcccuacucagcacugg

SEQ ID NO: 730638 - RNA, 23 nt, Human
cuggcccagcugagcugggccuc

SEQ ID NO: 730639 - RNA, 20 nt, Human
cuggcccccucagucccagg

SEQ ID NO: 730640 - RNA, 24 nt, Human
cuggcgcgccuugcacccagccca

SEQ ID NO: 730641 - RNA, 19 nt, Human
cugugccuggggaaagggg

SEQ ID NO: 730642 - RNA, 23 nt, Human
cuuggucagcuccugaccucggc

SEQ ID NO: 730643 - RNA, 19 nt, Human
gacuugggggaggggccga

SEQ ID NO: 730644 - RNA, 23 nt, Human
gagcaaacaccuggcggccucca

SEQ ID NO: 730645 - RNA, 18 nt, Human
gagcccacucuccacucc

SEQ ID NO: 730646 - RNA, 22 nt, Human
gagcuucugacccgagccagga

SEQ ID NO: 730647 - RNA, 21 nt, Human
gaggccaggucaccaagacgg

SEQ ID NO: 730648 - RNA, 21 nt, Human
gaggccgaggcgggccuugcc

SEQ ID NO: 730649 - RNA, 21 nt, Human
gaggccugggagggaagcaga

SEQ ID NO: 730650 - RNA, 18 nt, Human
gagggccaaccccagugc

SEQ ID NO: 730651 - RNA, 22 nt, Human
gaggggccgaggccaggucacc

SEQ ID NO: 730652 - RNA, 22 nt, Human
gaggugggcaggguaggcaucc

SEQ ID NO: 730653 - RNA, 21 nt, Human
gcaaaaaccaaacccagccca

SEQ ID NO: 730654 - RNA, 23 nt, Human
gcaaaaaccaaacccagcccaaa

SEQ ID NO: 730655 - RNA, 26 nt, Human
gcaaaaaccaaacccagcccaaagac

SEQ ID NO: 730656 - RNA, 24 nt, Human
gcagaacucuccccacgccuucca

SEQ ID NO: 730657 - RNA, 25 nt, Human
gcagaacucuccccacgccuuccaa

SEQ ID NO: 730658 - RNA, 22 nt, Human
gcagaaggcaaacccaacgcaa

SEQ ID NO: 730659 - RNA, 18 nt, Human
gcagaccuggauccagac

SEQ ID NO: 730660 - RNA, 19 nt, Human
gcaggcccucuccaaggag

SEQ ID NO: 730661 - RNA, 20 nt, Human
gcaggcguggcucagcugga

SEQ ID NO: 730662 - RNA, 21 nt, Human
gcagggggcccaggcccaaag

SEQ ID NO: 730663 - RNA, 21 nt, Human
gccaaccccagugcuugccac

SEQ ID NO: 730664 - RNA, 19 nt, Human
gcccaaagacgccaaacau

SEQ ID NO: 730665 - RNA, 24 nt, Human
gcccaccccucccgggccccgggg

SEQ ID NO: 730666 - RNA, 19 nt, Human
gcccacucuccacuccacc

SEQ ID NO: 730667 - RNA, 21 nt, Human
gcccagcugagcugggccucg

SEQ ID NO: 730668 - RNA, 25 nt, Human
gcccagggcccucccuuugccagcc

SEQ ID NO: 730669 - RNA, 25 nt, Human
gccccagcccgugugcaccuccacc

SEQ ID NO: 730670 - RNA, 23 nt, Human
gccccccccccagcccacccucc

SEQ ID NO: 730671 - RNA, 22 nt, Human
gcccgcugacaaucaucuccac

SEQ ID NO: 730672 - RNA, 20 nt, Human
gcccuguccccugcccacag

SEQ ID NO: 730673 - RNA, 18 nt, Human
gcccuugggguggagaca

SEQ ID NO: 730674 - RNA, 21 nt, Human
gcgaagaccagacaagccacg

SEQ ID NO: 730675 - RNA, 21 nt, Human
gcgcugcaacacagggaaguc

SEQ ID NO: 730676 - RNA, 20 nt, Human
gcgcugggccggggacagac

SEQ ID NO: 730677 - RNA, 24 nt, Human
gcggggaggaggggaggugggcgc

SEQ ID NO: 730678 - RNA, 19 nt, Human
gcugccccccccccagccc

SEQ ID NO: 730679 - RNA, 18 nt, Human
ggaagaugguuuugggau

SEQ ID NO: 730680 - RNA, 19 nt, Human
ggacccucccuuccucucc

SEQ ID NO: 730681 - RNA, 20 nt, Human
ggagacacagaccccugccc

SEQ ID NO: 730682 - RNA, 19 nt, Human
ggagcccuggcgaggccug

SEQ ID NO: 730683 - RNA, 22 nt, Human
ggcaacgcuguguggaagaaca

SEQ ID NO: 730684 - RNA, 19 nt, Human
ggcagaggagaagggagcc

SEQ ID NO: 730685 - RNA, 20 nt, Human
ggcagcccgguuccaccucc

SEQ ID NO: 730686 - RNA, 18 nt, Human
ggcagggccagggucucc

SEQ ID NO: 730687 - RNA, 20 nt, Human
ggccaguggggacccucccu

SEQ ID NO: 730688 - RNA, 18 nt, Human
ggcugcaggugucaccgg

SEQ ID NO: 730689 - RNA, 20 nt, Human
gggaggggccgaggccaggu

SEQ ID NO: 730690 - RNA, 22 nt, Human
gggcagaggggcgugccagccu

SEQ ID NO: 730691 - RNA, 22 nt, Human
gggcagggaaaguccagccugc

SEQ ID NO: 730692 - RNA, 26 nt, Human
gggcagguggcccggcaggcguggcu

SEQ ID NO: 730693 - RNA, 24 nt, Human
gggcagugccaggacuaccuuggg

SEQ ID NO: 730694 - RNA, 22 nt, Human
ggggacucugggaaggcagccc

SEQ ID NO: 730695 - RNA, 19 nt, Human
ggggccacaggccccccac

SEQ ID NO: 730696 - RNA, 19 nt, Human
gggggcaacgcugugugga

SEQ ID NO: 730697 - RNA, 22 nt, Human
guagcccaccccucccgggccc

SEQ ID NO: 730698 - RNA, 23 nt, Human
guccagccugccccugggggaag

SEQ ID NO: 730699 - RNA, 20 nt, Human
guccugcugcucgggaccua

SEQ ID NO: 730700 - RNA, 19 nt, Human
gugaagagccggggccaca

SEQ ID NO: 730701 - RNA, 22 nt, Human
gugcagccucaggcaaaaagcc

SEQ ID NO: 730702 - RNA, 28 nt, Human
gugcagccucaggcaaaaagggaacgcc

SEQ ID NO: 730703 - RNA, 20 nt, Human
gugcuugccacugcuuguuu

SEQ ID NO: 730704 - RNA, 28 nt, Human
uaaaaaaaaaaucugaaaauuaaagaaa

SEQ ID NO: 730705 - RNA, 20 nt, Human
uaaaacacagaaaaccaaaa

SEQ ID NO: 730706 - RNA, 19 nt, Human
uaaaggugauuguguuggc

SEQ ID NO: 730707 - RNA, 23 nt, Human
uaccagcagcaaaaaccaaaccc

SEQ ID NO: 730708 - RNA, 24 nt, Human
uaccagcagcaaaaaccaaaccca

SEQ ID NO: 730709 - RNA, 22 nt, Human
uagcccaccccucccgggcccc

SEQ ID NO: 730710 - RNA, 24 nt, Human
uagggcuggacagcggcuccccaa

SEQ ID NO: 730711 - RNA, 24 nt, Human
ucacugcccuuaaccacaccucug

SEQ ID NO: 730712 - RNA, 18 nt, Human
ucagucccaggcaggccc

SEQ ID NO: 730713 - RNA, 21 nt, Human
uccacaccccugaacucagac

SEQ ID NO: 730714 - RNA, 24 nt, Human
uccaggucgaccuggggccaggag

SEQ ID NO: 730715 - RNA, 20 nt, Human
uccauacgucauccaacuuu

SEQ ID NO: 730716 - RNA, 23 nt, Human
ucccgggccccggggugcuggcc

SEQ ID NO: 730717 - RNA, 20 nt, Human
ucccuuugccagccuggggc

SEQ ID NO: 730718 - RNA, 21 nt, Human
uccugggccagcucagggccc

SEQ ID NO: 730719 - RNA, 22 nt, Human
uccugggccagcucagggccca

SEQ ID NO: 730720 - RNA, 19 nt, Human
ucgcagacuggcacuuugg

SEQ ID NO: 730721 - RNA, 25 nt, Human
ucuccaaggagcugagccccagccc

SEQ ID NO: 730722 - RNA, 20 nt, Human
ucuccaggggugcuugggcu

SEQ ID NO: 730723 - RNA, 21 nt, Human
ucuccaggggugcuugggcuc

SEQ ID NO: 730724 - RNA, 21 nt, Human
ucuuagcugggccugggccgg

SEQ ID NO: 730725 - RNA, 18 nt, Human
ugaauccugacccagccc

SEQ ID NO: 730726 - RNA, 18 nt, Human
ugacccgagccaggaccc

SEQ ID NO: 730727 - RNA, 21 nt, Human
ugacucuaguagcccaccccu

SEQ ID NO: 730728 - RNA, 26 nt, Human
ugagaggaaggcgcacaggggaggga

SEQ ID NO: 730729 - RNA, 21 nt, Human
ugagcccauggggcaaugccu

SEQ ID NO: 730730 - RNA, 18 nt, Human
ugagccccagcccgugug

SEQ ID NO: 730731 - RNA, 22 nt, Human
ugagggcagaggggcgugccag

SEQ ID NO: 730732 - RNA, 23 nt, Human
ugagggcagaggggcgugccagc

SEQ ID NO: 730733 - RNA, 18 nt, Human
ugaguuugggcugaugca

SEQ ID NO: 730734 - RNA, 20 nt, Human
ugaugagguggcacuucugg

SEQ ID NO: 730735 - RNA, 25 nt, Human
ugaugcaccacaaccuguaaacuuu

SEQ ID NO: 730736 - RNA, 21 nt, Human
ugcaaaagauguacaaauaaa

SEQ ID NO: 730737 - RNA, 19 nt, Human
ugcagagggcacugggucc

SEQ ID NO: 730738 - RNA, 19 nt, Human
ugcagggggcccaggccca

SEQ ID NO: 730739 - RNA, 19 nt, Human
ugccacugcuuguuugggg

SEQ ID NO: 730740 - RNA, 23 nt, Human
ugccagccuggggcugugccugg

SEQ ID NO: 730741 - RNA, 19 nt, Human
ugccggaccggcgcgcgcg

SEQ ID NO: 730742 - RNA, 22 nt, Human
uggaagaacacuugaauuauga

SEQ ID NO: 730743 - RNA, 24 nt, Human
uggaugaaccauaacaugugagcc

SEQ ID NO: 730744 - RNA, 20 nt, Human
uggcagaggauccaccuccc

SEQ ID NO: 730745 - RNA, 18 nt, Human
uggcaggaaggaggggaa

SEQ ID NO: 730746 - RNA, 18 nt, Human
uggcaggaaggaggggaa

SEQ ID NO: 730747 - RNA, 19 nt, Human
uggcaggaaggaggggaaa

SEQ ID NO: 730748 - RNA, 20 nt, Human
uggcuuccaaagcuggaccc

SEQ ID NO: 730749 - RNA, 23 nt, Human
uggcuucuggcucccauguaccc

SEQ ID NO: 730750 - RNA, 20 nt, Human
ugggagggaagcagagagga

SEQ ID NO: 730751 - RNA, 20 nt, Human
ugggcugaugcaccacaacc

SEQ ID NO: 730752 - RNA, 19 nt, Human
ugggggaagccaaguuugc

SEQ ID NO: 730753 - RNA, 19 nt, Human
uggguccagucccccucca

SEQ ID NO: 730754 - RNA, 19 nt, Human
uggguuaucgcaccuaaaa

SEQ ID NO: 730755 - RNA, 20 nt, Human
uguacccgagcccacucucc

SEQ ID NO: 730756 - RNA, 20 nt, Human
uguccccugcccacagaccc

SEQ ID NO: 730757 - RNA, 22 nt, Human
ugucuggugcugggaggcucca

SEQ ID NO: 730758 - RNA, 18 nt, Human
ugugccuggggaaagggg

SEQ ID NO: 730759 - RNA, 21 nt, Human
uucucagaucuuuucuccucu

SEQ ID NO: 730760 - RNA, 18 nt, Human
uugcacagaagagacuug

SEQ ID NO: 730761 - RNA, 19 nt, Human
uuucccuuuuugucccaag

SEQ ID NO: 730762 - RNA, 22 nt, Human
uuucccuuuuugucccaaggug

SEQ ID NO: 730763 - RNA, 21 nt, Human
uuucucucccaugugggucgg

SEQ ID NO: 730764 - RNA, 19 nt, Human
uuugggaugucagggcgcu

SEQ ID NO: 730765 - RNA, 24 nt, Human
aaagugcugggauuacaggcguga

SEQ ID NO: 730766 - RNA, 21 nt, Human
aacaagaauaacaugcuccac

SEQ ID NO: 730767 - RNA, 23 nt, Human
aaccaagcccacuaccgcuuagc

SEQ ID NO: 730768 - RNA, 18 nt, Human
aacugugugaccuggggc

SEQ ID NO: 730769 - RNA, 22 nt, Human
aaggaccuucagaaacaagaau

SEQ ID NO: 730770 - RNA, 19 nt, Human
aagugcugggauuacaggc

SEQ ID NO: 730771 - RNA, 19 nt, Human
aagugcugggauuacaggc

SEQ ID NO: 730772 - RNA, 26 nt, Human
aagugcugggauuacaggcgugagcc

SEQ ID NO: 730773 - RNA, 23 nt, Human
acaagacggccugugccaggucc

SEQ ID NO: 730774 - RNA, 25 nt, Human
acaggugcucaccaccacgccugac

SEQ ID NO: 730775 - RNA, 24 nt, Human
accacagucuacuaaacaucauca

SEQ ID NO: 730776 - RNA, 23 nt, Human
accagagacaagggcucucccca

SEQ ID NO: 730777 - RNA, 19 nt, Human
accugcagcuggcgcuugu

SEQ ID NO: 730778 - RNA, 22 nt, Human
acugcaaccucugccucccagg

SEQ ID NO: 730779 - RNA, 23 nt, Human
agagaaacagccugagccacagg

SEQ ID NO: 730780 - RNA, 19 nt, Human
agccggucccgcuggcgcc

SEQ ID NO: 730781 - RNA, 22 nt, Human
agccucuccaggccuggagcug

SEQ ID NO: 730782 - RNA, 20 nt, Human
agcgccuccucaucccaccc

SEQ ID NO: 730783 - RNA, 24 nt, Human
agcgccuccucaucccaccccagc

SEQ ID NO: 730784 - RNA, 21 nt, Human
agcuccaugacccugggccuc

SEQ ID NO: 730785 - RNA, 18 nt, Human
agcuccuccugggcagcc

SEQ ID NO: 730786 - RNA, 18 nt, Human
aggagcgccgcggugggg

SEQ ID NO: 730787 - RNA, 20 nt, Human
aggagcgccgcgguggggaa

SEQ ID NO: 730788 - RNA, 24 nt, Human
aggcgaucugccugccuuggccuc

SEQ ID NO: 730789 - RNA, 24 nt, Human
aguacaguggugcgauccuggcug

SEQ ID NO: 730790 - RNA, 18 nt, Human
aguagcugggauuacagg

SEQ ID NO: 730791 - RNA, 18 nt, Human
aucagggcgagcguggag

SEQ ID NO: 730792 - RNA, 21 nt, Human
aucugaaggguccuggcaggg

SEQ ID NO: 730793 - RNA, 22 nt, Human
augacccugggccuccguuuuc

SEQ ID NO: 730794 - RNA, 21 nt, Human
augcugggcuggggaccaggc

SEQ ID NO: 730795 - RNA, 18 nt, Human
augggucugguuagaaaa

SEQ ID NO: 730796 - RNA, 24 nt, Human
auuuuuguaguuuuaguagagacg

SEQ ID NO: 730797 - RNA, 21 nt, Human
caaagugcugggauuacaggc

SEQ ID NO: 730798 - RNA, 24 nt, Human
caaagugcugggauuacaggcgug

SEQ ID NO: 730799 - RNA, 25 nt, Human
caaccaagcccacuaccgcuuagcu

SEQ ID NO: 730800 - RNA, 24 nt, Human
caagacggccugugccaggucccu

SEQ ID NO: 730801 - RNA, 22 nt, Human
caagcaauucuccugccucagc

SEQ ID NO: 730802 - RNA, 22 nt, Human
cacaucuccccaaggaccuuca

SEQ ID NO: 730803 - RNA, 21 nt, Human
caccccagcuugaggccccca

SEQ ID NO: 730804 - RNA, 28 nt, Human
cagccucucaaggaggaacuuuaaugau

SEQ ID NO: 730805 - RNA, 22 nt, Human
cagcgagaugcugggcugggga

SEQ ID NO: 730806 - RNA, 18 nt, Human
cagcgccucccucaccuc

SEQ ID NO: 730807 - RNA, 18 nt, Human
cagcuccucggccugcug

SEQ ID NO: 730808 - RNA, 20 nt, Human
caggacccagugggugucac

SEQ ID NO: 730809 - RNA, 19 nt, Human
caggugcucaccaccacgc

SEQ ID NO: 730810 - RNA, 21 nt, Human
cauguccuggaccugcagcug

SEQ ID NO: 730811 - RNA, 19 nt, Human
ccaaaagaaggguccuccc

SEQ ID NO: 730812 - RNA, 19 nt, Human
ccacguuggucaggcuggu

SEQ ID NO: 730813 - RNA, 21 nt, Human
ccagcgagaugcugggcuggg

SEQ ID NO: 730814 - RNA, 23 nt, Human
cccagguucaagcaauucuccug

SEQ ID NO: 730815 - RNA, 21 nt, Human
ccccugucccaggcacagggg

SEQ ID NO: 730816 - RNA, 23 nt, Human
cccgaguagcugggauuacaggu

SEQ ID NO: 730817 - RNA, 24 nt, Human
cccgaguagcugggauuacaggug

SEQ ID NO: 730818 - RNA, 25 nt, Human
cccugcccugggccuggucccccuc

SEQ ID NO: 730819 - RNA, 21 nt, Human
ccgaguagcugggauuacagg

SEQ ID NO: 730820 - RNA, 20 nt, Human
ccgcagccgcugcaccucgc

SEQ ID NO: 730821 - RNA, 20 nt, Human
ccgcagcuccuccugggcag

SEQ ID NO: 730822 - RNA, 24 nt, Human
ccucccagguucaagcaauucucc

SEQ ID NO: 730823 - RNA, 19 nt, Human
ccucgcgcugggcguccuc

SEQ ID NO: 730824 - RNA, 22 nt, Human
ccucuagggcccgccgcucgcu

SEQ ID NO: 730825 - RNA, 21 nt, Human
ccugaccucaggcgaucugcc

SEQ ID NO: 730826 - RNA, 25 nt, Human
ccugcagcuggcgcuugugcagggc

SEQ ID NO: 730827 - RNA, 20 nt, Human
ccugcagcuucucccgcucc

SEQ ID NO: 730828 - RNA, 19 nt, Human
ccugccgcagcuccucggc

SEQ ID NO: 730829 - RNA, 23 nt, Human
ccugccucagccucccgaguagc

SEQ ID NO: 730830 - RNA, 24 nt, Human
ccugccucagccucccgaguagcu

SEQ ID NO: 730831 - RNA, 22 nt, Human
ccugccuuggccucucaaagug

SEQ ID NO: 730832 - RNA, 19 nt, Human
ccugggccuggucccccuc

SEQ ID NO: 730833 - RNA, 21 nt, Human
ccuggucccccuccucuuucc

SEQ ID NO: 730834 - RNA, 22 nt, Human
ccuggucccccuccucuuuccc

SEQ ID NO: 730835 - RNA, 21 nt, Human
ccuguagccagcgagaugcug

SEQ ID NO: 730836 - RNA, 25 nt, Human
ccuguagccgcagggauuccagggc

SEQ ID NO: 730837 - RNA, 20 nt, Human
ccuuagggucugcuguagcc

SEQ ID NO: 730838 - RNA, 19 nt, Human
cggccgggcgaggagcgcc

SEQ ID NO: 730839 - RNA, 18 nt, Human
cuaaggcggagagaucuc

SEQ ID NO: 730840 - RNA, 24 nt, Human
cucagccucccgaguagcugggau

SEQ ID NO: 730841 - RNA, 19 nt, Human
cuccagggccgccugcucc

SEQ ID NO: 730842 - RNA, 19 nt, Human
cuccaugacccugggccuc

SEQ ID NO: 730843 - RNA, 24 nt, Human
cuccccugucccaggcacaggggu

SEQ ID NO: 730844 - RNA, 18 nt, Human
cuccucuuucccacgauc

SEQ ID NO: 730845 - RNA, 26 nt, Human
cuccugaccucaggcgaucugccugc

SEQ ID NO: 730846 - RNA, 21 nt, Human
cucggccgggcgaggagcgcc

SEQ ID NO: 730847 - RNA, 23 nt, Human
cucuaguugucuauggcuguggg

SEQ ID NO: 730848 - RNA, 19 nt, Human
cucuucugcuaacugugug

SEQ ID NO: 730849 - RNA, 23 nt, Human
cugcaaccucugccucccagguu

SEQ ID NO: 730850 - RNA, 24 nt, Human
cugcaaccucugccucccagguuc

SEQ ID NO: 730851 - RNA, 24 nt, Human
cuggaccugcagcuggcgcuugug

SEQ ID NO: 730852 - RNA, 22 nt, Human
cuggacgccgcucucagagucu

SEQ ID NO: 730853 - RNA, 18 nt, Human
cuggcgccgcagcuccuc

SEQ ID NO: 730854 - RNA, 20 nt, Human
cugggccaccugcaggcugu

SEQ ID NO: 730855 - RNA, 22 nt, Human
cuguagccccucuccauccucu

SEQ ID NO: 730856 - RNA, 22 nt, Human
cugugccucaguuuaccaucca

SEQ ID NO: 730857 - RNA, 20 nt, Human
cuuaaaaugguaucuggcac

SEQ ID NO: 730858 - RNA, 21 nt, Human
cuugcucugucacacaggcug

SEQ ID NO: 730859 - RNA, 24 nt, Human
cuugcucugucacacaggcuggag

SEQ ID NO: 730860 - RNA, 24 nt, Human
cuuggccucucaaagugcugggau

SEQ ID NO: 730861 - RNA, 24 nt, Human
gaccucaggcgaucugccugccuu

SEQ ID NO: 730862 - RNA, 20 nt, Human
gagacgggauuucuccacgu

SEQ ID NO: 730863 - RNA, 22 nt, Human
gagcacucugaggaauuucccg

SEQ ID NO: 730864 - RNA, 21 nt, Human
gaggggggcuggacugcaggu

SEQ ID NO: 730865 - RNA, 18 nt, Human
gauuacaggcgugagcca

SEQ ID NO: 730866 - RNA, 22 nt, Human
gauuacaggcgugagccacugc

SEQ ID NO: 730867 - RNA, 22 nt, Human
gauuacaggcgugagccacugc

SEQ ID NO: 730868 - RNA, 22 nt, Human
gcaaccucugccucccagguuc

SEQ ID NO: 730869 - RNA, 19 nt, Human
gccccaguuuccugaaaug

SEQ ID NO: 730870 - RNA, 19 nt, Human
gccgcagcuccuccugggc

SEQ ID NO: 730871 - RNA, 22 nt, Human
gccgcugcaccucgcgcugggc

SEQ ID NO: 730872 - RNA, 18 nt, Human
gccucaguuuaccaucca

SEQ ID NO: 730873 - RNA, 18 nt, Human
gccucccucaccuccacc

SEQ ID NO: 730874 - RNA, 18 nt, Human
gccuccucaucccacccc

SEQ ID NO: 730875 - RNA, 21 nt, Human
gccuccucaucccaccccagc

SEQ ID NO: 730876 - RNA, 22 nt, Human
gccuuggccucucaaagugcug

SEQ ID NO: 730877 - RNA, 19 nt, Human
gcucaccaccacgccugac

SEQ ID NO: 730878 - RNA, 27 nt, Human
gcuccuuggccaggacugagcgcuucc

SEQ ID NO: 730879 - RNA, 21 nt, Human
gcugggaagccucuccaggcc

SEQ ID NO: 730880 - RNA, 23 nt, Human
gcuggucuggaacuccugaccuc

SEQ ID NO: 730881 - RNA, 20 nt, Human
ggaggcccaggacccagugg

SEQ ID NO: 730882 - RNA, 20 nt, Human
ggccugaggcaggaguuugg

SEQ ID NO: 730883 - RNA, 24 nt, Human
ggccugcugcugggccaccugcag

SEQ ID NO: 730884 - RNA, 18 nt, Human
ggcucugggggggggggc

SEQ ID NO: 730885 - RNA, 21 nt, Human
ggcucuucugcuaacugugug

SEQ ID NO: 730886 - RNA, 20 nt, Human
ggcugaccagagacaagggc

SEQ ID NO: 730887 - RNA, 24 nt, Human
ggcuggucuggaacuccugaccuc

SEQ ID NO: 730888 - RNA, 24 nt, Human
gggaagccgaagucagggccuggg

SEQ ID NO: 730889 - RNA, 19 nt, Human
ggggggcuggacugcaggu

SEQ ID NO: 730890 - RNA, 21 nt, Human
gguccagacgguaggaggccc

SEQ ID NO: 730891 - RNA, 18 nt, Human
guagcugggauuacaggu

SEQ ID NO: 730892 - RNA, 18 nt, Human
uaacaugcuccaccacag

SEQ ID NO: 730893 - RNA, 23 nt, Human
uaacugugugaccuggggcaagu

SEQ ID NO: 730894 - RNA, 25 nt, Human
uaagugacuauaccucccugagccc

SEQ ID NO: 730895 - RNA, 24 nt, Human
uaauuuuuguaguuuuaguagaga

SEQ ID NO: 730896 - RNA, 23 nt, Human
uacaaaaaacaguucugaacagu

SEQ ID NO: 730897 - RNA, 19 nt, Human
uacaggcgugagccacugc

SEQ ID NO: 730898 - RNA, 23 nt, Human
uacaggcgugagccacugcgccc

SEQ ID NO: 730899 - RNA, 22 nt, Human
uacaggugcucaccaccacgcc

SEQ ID NO: 730900 - RNA, 22 nt, Human
uagccagcgagaugcugggcug

SEQ ID NO: 730901 - RNA, 19 nt, Human
uaguagagacgggauuucu

SEQ ID NO: 730902 - RNA, 24 nt, Human
uaguagagacgggauuucuccacg

SEQ ID NO: 730903 - RNA, 20 nt, Human
uaucauggaguuaaaugaga

SEQ ID NO: 730904 - RNA, 24 nt, Human
uaucauggaguuaaaugagagaac

SEQ ID NO: 730905 - RNA, 22 nt, Human
ucaaagugcugggauuacaggc

SEQ ID NO: 730906 - RNA, 24 nt, Human
ucaaagugcugggauuacaggcgu

SEQ ID NO: 730907 - RNA, 20 nt, Human
ucacaucugcaaaaugaggu

SEQ ID NO: 730908 - RNA, 20 nt, Human
ucagccucccgaguagcugg

SEQ ID NO: 730909 - RNA, 22 nt, Human
uccacaaaauggagauaaccgc

SEQ ID NO: 730910 - RNA, 23 nt, Human
uccaccacagucuacuaaacauc

SEQ ID NO: 730911 - RNA, 22 nt, Human
uccagccggucccgcuggcgcc

SEQ ID NO: 730912 - RNA, 19 nt, Human
ucccaccccagcuugaggc

SEQ ID NO: 730913 - RNA, 22 nt, Human
ucccacgaucccaugcuccagg

SEQ ID NO: 730914 - RNA, 21 nt, Human
ucccagguucaagcaauucuc

SEQ ID NO: 730915 - RNA, 24 nt, Human
ucccagguucaagcaauucuccug

SEQ ID NO: 730916 - RNA, 18 nt, Human
ucccccuccucuuuccca

SEQ ID NO: 730917 - RNA, 19 nt, Human
ucccccuccucuuucccac

SEQ ID NO: 730918 - RNA, 23 nt, Human
ucccccuccucuuucccacgauc

SEQ ID NO: 730919 - RNA, 25 nt, Human
ucccccuccucuuucccacgauccc

SEQ ID NO: 730920 - RNA, 23 nt, Human
ucccgaguagcugggauuacagg

SEQ ID NO: 730921 - RNA, 24 nt, Human
ucccgaguagcugggauuacaggu

SEQ ID NO: 730922 - RNA, 21 nt, Human
ucccgcuggcgccgcagcucc

SEQ ID NO: 730923 - RNA, 24 nt, Human
uccuccugggcagccugcagcuuc

SEQ ID NO: 730924 - RNA, 26 nt, Human
uccugcacugcguccuccugcucuuc

SEQ ID NO: 730925 - RNA, 25 nt, Human
ucgcuaagcugcuuccgcagggugc

SEQ ID NO: 730926 - RNA, 20 nt, Human
ucggcggggugaacggccuc

SEQ ID NO: 730927 - RNA, 24 nt, Human
ucucaaagugcugggauuacaggc

SEQ ID NO: 730928 - RNA, 24 nt, Human
ucuccugccucagccucccgagua

SEQ ID NO: 730929 - RNA, 18 nt, Human
ucucugggaagccgaagu

SEQ ID NO: 730930 - RNA, 24 nt, Human
ucugacaagacggccugugccagg

SEQ ID NO: 730931 - RNA, 24 nt, Human
ucugagcacucugaggaauuuccc

SEQ ID NO: 730932 - RNA, 24 nt, Human
ucugcuaacugugugaccuggggc

SEQ ID NO: 730933 - RNA, 20 nt, Human
ucugcuguagccccucucca

SEQ ID NO: 730934 - RNA, 23 nt, Human
ucugcuguagccccucuccaucc

SEQ ID NO: 730935 - RNA, 19 nt, Human
ucugggggggggggcuguc

SEQ ID NO: 730936 - RNA, 19 nt, Human
ucuugcucugucacacagg

SEQ ID NO: 730937 - RNA, 23 nt, Human
ucuugcucugucacacaggcugg

SEQ ID NO: 730938 - RNA, 24 nt, Human
ucuugcucugucacacaggcugga

SEQ ID NO: 730939 - RNA, 18 nt, Human
ugacaagacggccugugc

SEQ ID NO: 730940 - RNA, 26 nt, Human
ugaccagagacaagggcucuccccaa

SEQ ID NO: 730941 - RNA, 18 nt, Human
ugaccucaggcgaucugc

SEQ ID NO: 730942 - RNA, 19 nt, Human
ugaccucaggcgaucugcc

SEQ ID NO: 730943 - RNA, 20 nt, Human
ugaccucaggcgaucugccu

SEQ ID NO: 730944 - RNA, 24 nt, Human
ugaccucaggcgaucugccugccu

SEQ ID NO: 730945 - RNA, 19 nt, Human
ugacugcaaccucugccuc

SEQ ID NO: 730946 - RNA, 24 nt, Human
ugacugcaaccucugccucccagg

SEQ ID NO: 730947 - RNA, 22 nt, Human
ugaggcaggaguuuggagagaa

SEQ ID NO: 730948 - RNA, 21 nt, Human
ugcacugcguccuccugcucu

SEQ ID NO: 730949 - RNA, 18 nt, Human
ugcagcuucucccgcucc

SEQ ID NO: 730950 - RNA, 20 nt, Human
ugccccgaaccuccuguagc

SEQ ID NO: 730951 - RNA, 23 nt, Human
ugccccgaaccuccuguagccag

SEQ ID NO: 730952 - RNA, 24 nt, Human
ugccucagccucccgaguagcugg

SEQ ID NO: 730953 - RNA, 24 nt, Human
ugccugacacaucuccccaaggac

SEQ ID NO: 730954 - RNA, 21 nt, Human
ugccuuggccucucaaagugc

SEQ ID NO: 730955 - RNA, 24 nt, Human
ugcugggauuacaggcgugagcca

SEQ ID NO: 730956 - RNA, 19 nt, Human
uggacugcagguguugcug

SEQ ID NO: 730957 - RNA, 24 nt, Human
uggaguacaguggugcgauccugg

SEQ ID NO: 730958 - RNA, 20 nt, Human
uggcccgagagcccccgcag

SEQ ID NO: 730959 - RNA, 18 nt, Human
ugggaagccucuccaggc

SEQ ID NO: 730960 - RNA, 21 nt, Human
ugggaagccucuccaggccug

SEQ ID NO: 730961 - RNA, 18 nt, Human
ugggauuacaggcgugag

SEQ ID NO: 730962 - RNA, 19 nt, Human
ugggauuacaggcgugagc

SEQ ID NO: 730963 - RNA, 21 nt, Human
ugggauuacaggcgugagcca

SEQ ID NO: 730964 - RNA, 22 nt, Human
ugggauuacaggcgugagccac

SEQ ID NO: 730965 - RNA, 22 nt, Human
ugggauuacaggcgugagccac

SEQ ID NO: 730966 - RNA, 24 nt, Human
ugggauuacaggcgugagccacug

SEQ ID NO: 730967 - RNA, 26 nt, Human
ugggauuacaggcgugagccacugcg

SEQ ID NO: 730968 - RNA, 19 nt, Human
ugggauuacaggugcucac

SEQ ID NO: 730969 - RNA, 21 nt, Human
ugggauuacaggugcucacca

SEQ ID NO: 730970 - RNA, 24 nt, Human
ugggauuacaggugcucaccacca

SEQ ID NO: 730971 - RNA, 22 nt, Human
ugggccucugaccccugcccug

SEQ ID NO: 730972 - RNA, 19 nt, Human
ugggccugcauggcgccgu

SEQ ID NO: 730973 - RNA, 21 nt, Human
uggguggguggcccaugucac

SEQ ID NO: 730974 - RNA, 26 nt, Human
uggguggguggcccauguuguaauga

SEQ ID NO: 730975 - RNA, 24 nt, Human
uggucaggcuggucuggaacuccu

SEQ ID NO: 730976 - RNA, 23 nt, Human
uggucuggaacuccugaccucag

SEQ ID NO: 730977 - RNA, 21 nt, Human
ugucacagaguuaucauggag

SEQ ID NO: 730978 - RNA, 18 nt, Human
uuaguagagacgggauuu

SEQ ID NO: 730979 - RNA, 21 nt, Human
uucaagcaauucuccugccuc

SEQ ID NO: 730980 - RNA, 24 nt, Human
uucaagcaauucuccugccucagc

SEQ ID NO: 730981 - RNA, 22 nt, Human
uuccagggccucaagcuucuca

SEQ ID NO: 730982 - RNA, 27 nt, Human
uuccugaaaugggucugguuagaaaaa

SEQ ID NO: 730983 - RNA, 19 nt, Human
uugcugggaagccucucca

SEQ ID NO: 730984 - RNA, 24 nt, Human
uuguuuguuuuuuugagacacagu

SEQ ID NO: 730985 - RNA, 18 nt, Human
uuuuguaguuuuaguaga

SEQ ID NO: 730986 - RNA, 20 nt, Human
uuuuuguaguuuuaguagag

SEQ ID NO: 730987 - RNA, 25 nt, Human
aaaaaaaaagauacagagggaagga

SEQ ID NO: 730988 - RNA, 24 nt, Human
aaaaaaaagauacagagggaagga

SEQ ID NO: 730989 - RNA, 21 nt, Human
aaaaacacaagaggggcugua

SEQ ID NO: 730990 - RNA, 19 nt, Human
aaaaacagaaaagaaccac

SEQ ID NO: 730991 - RNA, 18 nt, Human
aaaagacagagcaaccag

SEQ ID NO: 730992 - RNA, 22 nt, Human
aaaaggaguuagaaagucagga

SEQ ID NO: 730993 - RNA, 24 nt, Human
aaaaggggcaggcugcuccuaaaa

SEQ ID NO: 730994 - RNA, 23 nt, Human
aaaauacugcacaagacaacaaa

SEQ ID NO: 730995 - RNA, 24 nt, Human
aaaauuguauaaaaucaggagcuu

SEQ ID NO: 730996 - RNA, 21 nt, Human
aaacagaaaagaaccaccuga

SEQ ID NO: 730997 - RNA, 20 nt, Human
aaacagaaggaaagucuuga

SEQ ID NO: 730998 - RNA, 22 nt, Human
aaagcccaagaggaagaaccag

SEQ ID NO: 730999 - RNA, 22 nt, Human
aaagcccaagaggaagaaccag

SEQ ID NO: 731000 - RNA, 22 nt, Human
aaagguaggaucucaaccugcu

SEQ ID NO: 731001 - RNA, 19 nt, Human
aaagugcuaggauuacagg

SEQ ID NO: 731002 - RNA, 24 nt, Human
aaagugcuaggauuacaggcauga

SEQ ID NO: 731003 - RNA, 23 nt, Human
aaauaaagaaaaacacaagaggg

SEQ ID NO: 731004 - RNA, 19 nt, Human
aaauggagggucagguagg

SEQ ID NO: 731005 - RNA, 21 nt, Human
aacaaaacagaaggaaagucu

SEQ ID NO: 731006 - RNA, 18 nt, Human
aacacaggcuuggggaga

SEQ ID NO: 731007 - RNA, 19 nt, Human
aacaccagugagaagugag

SEQ ID NO: 731008 - RNA, 24 nt, Human
aacacuuugggaggccaagguggg

SEQ ID NO: 731009 - RNA, 21 nt, Human
aacagaagagagggcacugca

SEQ ID NO: 731010 - RNA, 21 nt, Human
aacauagggagacuccgucuc

SEQ ID NO: 731011 - RNA, 22 nt, Human
aaccuaauaaccccuccaaaga

SEQ ID NO: 731012 - RNA, 21 nt, Human
aaccucaugccaagcaucuaa

SEQ ID NO: 731013 - RNA, 19 nt, Human
aacugccuuuugauuacca

SEQ ID NO: 731014 - RNA, 24 nt, Human
aagacagccugauccacuuagaac

SEQ ID NO: 731015 - RNA, 21 nt, Human
aagagaucaagaugggcagug

SEQ ID NO: 731016 - RNA, 23 nt, Human
aagauuucuccucuacuccacca

SEQ ID NO: 731017 - RNA, 22 nt, Human
aagcaagggcagcuuuucagga

SEQ ID NO: 731018 - RNA, 20 nt, Human
aagcaggggcuccccagacu

SEQ ID NO: 731019 - RNA, 23 nt, Human
aagcauauaaaccacaaccucag

SEQ ID NO: 731020 - RNA, 18 nt, Human
aagccacuacaacagaag

SEQ ID NO: 731021 - RNA, 19 nt, Human
aaggcuucagguagcuagc

SEQ ID NO: 731022 - RNA, 23 nt, Human
aagggcuggcaggguggggggug

SEQ ID NO: 731023 - RNA, 22 nt, Human
aaguaacaggcccaaggucaca

SEQ ID NO: 731024 - RNA, 19 nt, Human
aaguagcugggacuacagg

SEQ ID NO: 731025 - RNA, 20 nt, Human
aaguagcugggacuacaggc

SEQ ID NO: 731026 - RNA, 26 nt, Human
aagugcuaggauuacaggcaugagcc

SEQ ID NO: 731027 - RNA, 22 nt, Human
aaguggcuuguggaaaaagcua

SEQ ID NO: 731028 - RNA, 24 nt, Human
acaaaacagaaggaaagucuugag

SEQ ID NO: 731029 - RNA, 21 nt, Human
acacaaaacaaaaguaucaac

SEQ ID NO: 731030 - RNA, 20 nt, Human
acacacacacacacacaaaa

SEQ ID NO: 731031 - RNA, 23 nt, Human
acacacacacacacacacacaca

SEQ ID NO: 731032 - RNA, 23 nt, Human
acacacacacacacacacacaca

SEQ ID NO: 731033 - RNA, 23 nt, Human
acacacacacacacacacacaca

SEQ ID NO: 731034 - RNA, 23 nt, Human
acacacacacacacacacacaca

SEQ ID NO: 731035 - RNA, 23 nt, Human
acacacacacacacacacacaca

SEQ ID NO: 731036 - RNA, 23 nt, Human
acacacacacacacacacacaca

SEQ ID NO: 731037 - RNA, 23 nt, Human
acacacacacacacacacacaca

SEQ ID NO: 731038 - RNA, 24 nt, Human
acacagauggaaggggaagccaga

SEQ ID NO: 731039 - RNA, 18 nt, Human
acaccacugcacuccagc

SEQ ID NO: 731040 - RNA, 20 nt, Human
acaccacugcacuccagccu

SEQ ID NO: 731041 - RNA, 19 nt, Human
acagaaaagaaccaccuga

SEQ ID NO: 731042 - RNA, 19 nt, Human
acaggcgccugccaccacg

SEQ ID NO: 731043 - RNA, 23 nt, Human
acagggcaccccccucaaccucc

SEQ ID NO: 731044 - RNA, 24 nt, Human
acaucacuaagugacauuugggag

SEQ ID NO: 731045 - RNA, 22 nt, Human
acauucuacacuagcaguucca

SEQ ID NO: 731046 - RNA, 25 nt, Human
acccgccucggcuucccaaagugcu

SEQ ID NO: 731047 - RNA, 18 nt, Human
accuugucuccaucucuc

SEQ ID NO: 731048 - RNA, 18 nt, Human
acgggguuucaccauguu

SEQ ID NO: 731049 - RNA, 19 nt, Human
acgggguuucaccauguua

SEQ ID NO: 731050 - RNA, 20 nt, Human
acgggguuucaccauguuag

SEQ ID NO: 731051 - RNA, 24 nt, Human
acgggguuucaccauguuagccag

SEQ ID NO: 731052 - RNA, 19 nt, Human
acucaguuucccuccucca

SEQ ID NO: 731053 - RNA, 23 nt, Human
acucauuuuguuucugguuuccu

SEQ ID NO: 731054 - RNA, 21 nt, Human
acucccacaaggaagugggga

SEQ ID NO: 731055 - RNA, 18 nt, Human
acugcacuccagccuagg

SEQ ID NO: 731056 - RNA, 24 nt, Human
acugcacuccagccuaggagacag

SEQ ID NO: 731057 - RNA, 20 nt, Human
acugcuuccauuauauuugu

SEQ ID NO: 731058 - RNA, 21 nt, Human
agaaaagaaccaccugagagc

SEQ ID NO: 731059 - RNA, 23 nt, Human
agaaaagaaccaccugagagcua

SEQ ID NO: 731060 - RNA, 23 nt, Human
agaagugguuuucagaaccuguu

SEQ ID NO: 731061 - RNA, 23 nt, Human
agacaaauacagcagggcucaag

SEQ ID NO: 731062 - RNA, 20 nt, Human
agagacuucuugcagcucug

SEQ ID NO: 731063 - RNA, 22 nt, Human
agagagaacaauggcuuggaaa

SEQ ID NO: 731064 - RNA, 21 nt, Human
agagagucugccuuuucauuc

SEQ ID NO: 731065 - RNA, 21 nt, Human
agaggaaaaggcuggacacag

SEQ ID NO: 731066 - RNA, 18 nt, Human
agaggagagggcaagugg

SEQ ID NO: 731067 - RNA, 21 nt, Human
agauacuagaaauuuucagcc

SEQ ID NO: 731068 - RNA, 23 nt, Human
agcauauaaaccacaaccucagu

SEQ ID NO: 731069 - RNA, 18 nt, Human
agccagaaagggagacug

SEQ ID NO: 731070 - RNA, 24 nt, Human
agccuaggcaacauagggagacuc

SEQ ID NO: 731071 - RNA, 22 nt, Human
aggaaaccagaguauguugaug

SEQ ID NO: 731072 - RNA, 18 nt, Human
aggaaaguaugggccaag

SEQ ID NO: 731073 - RNA, 22 nt, Human
aggaaguggggacuuuccgagg

SEQ ID NO: 731074 - RNA, 21 nt, Human
aggagagggcaaguggggcuu

SEQ ID NO: 731075 - RNA, 24 nt, Human
aggaucaccugagcccaagagcuc

SEQ ID NO: 731076 - RNA, 21 nt, Human
aggcaaagguggcccuccucc

SEQ ID NO: 731077 - RNA, 25 nt, Human
aggcuggagugcaguggcgcgaucu

SEQ ID NO: 731078 - RNA, 18 nt, Human
agggcaaguggggcuuuc

SEQ ID NO: 731079 - RNA, 18 nt, Human
agguagcuagcaccuuuc

SEQ ID NO: 731080 - RNA, 23 nt, Human
agguggcccuccuccccagccuc

SEQ ID NO: 731081 - RNA, 18 nt, Human
aggugggaggaucaccug

SEQ ID NO: 731082 - RNA, 18 nt, Human
aggugggaggaucaccug

SEQ ID NO: 731083 - RNA, 20 nt, Human
aggugggaggaucaccugag

SEQ ID NO: 731084 - RNA, 22 nt, Human
aguagagacgggguuucaccau

SEQ ID NO: 731085 - RNA, 25 nt, Human
aguagcugggacuacaggcgccugc

SEQ ID NO: 731086 - RNA, 22 nt, Human
agugaaaugggaaaacccucaa

SEQ ID NO: 731087 - RNA, 26 nt, Human
agugagggagcccagcucagaagaga

SEQ ID NO: 731088 - RNA, 19 nt, Human
agugcaguggcgcgaucuc

SEQ ID NO: 731089 - RNA, 19 nt, Human
aguggcucacgccuauaau

SEQ ID NO: 731090 - RNA, 23 nt, Human
aguggcucacgccuauaauccca

SEQ ID NO: 731091 - RNA, 19 nt, Human
auacagagggaaggaaacc

SEQ ID NO: 731092 - RNA, 26 nt, Human
auacagcagggcucaagcaggagggc

SEQ ID NO: 731093 - RNA, 22 nt, Human
auacugcacaagacaacaaaac

SEQ ID NO: 731094 - RNA, 20 nt, Human
aucacaccacugcacuccag

SEQ ID NO: 731095 - RNA, 22 nt, Human
aucacuaagugacauuugggag

SEQ ID NO: 731096 - RNA, 22 nt, Human
aucccaacacuuugggaggcca

SEQ ID NO: 731097 - RNA, 20 nt, Human
augcucugcagggcagaggg

SEQ ID NO: 731098 - RNA, 33 nt, Human
auguuaaaacacacacacacacacacacacagu

SEQ ID NO: 731099 - RNA, 24 nt, Human
auuuuaguagagacgggguuucac

SEQ ID NO: 731100 - RNA, 23 nt, Human
caaaaguaucaacauuucuccca

SEQ ID NO: 731101 - RNA, 18 nt, Human
caaacaaaacuaacaagc

SEQ ID NO: 731102 - RNA, 21 nt, Human
caaacaaaacuaacaagcuua

SEQ ID NO: 731103 - RNA, 24 nt, Human
caaacccaaucccagucccuaaag

SEQ ID NO: 731104 - RNA, 24 nt, Human
caaagugcuaggauuacaggcaug

SEQ ID NO: 731105 - RNA, 18 nt, Human
caaauaaguaccuggcac

SEQ ID NO: 731106 - RNA, 26 nt, Human
caaauaaguaccuggcaccuuagccc

SEQ ID NO: 731107 - RNA, 24 nt, Human
caacacuuugggaggccaaggugg

SEQ ID NO: 731108 - RNA, 24 nt, Human
caacauagggagacuccgucucua

SEQ ID NO: 731109 - RNA, 18 nt, Human
caaccaccuuccccagcc

SEQ ID NO: 731110 - RNA, 23 nt, Human
caagacaacaaaacagaaggaaa

SEQ ID NO: 731111 - RNA, 23 nt, Human
caagauacagaggaaaaggcugg

SEQ ID NO: 731112 - RNA, 21 nt, Human
caagcugaaacaccaaguauc

SEQ ID NO: 731113 - RNA, 20 nt, Human
caaggaaguggggacuuucc

SEQ ID NO: 731114 - RNA, 19 nt, Human
caagguagugcuccaaguc

SEQ ID NO: 731115 - RNA, 20 nt, Human
caaggugggaggaucaccug

SEQ ID NO: 731116 - RNA, 20 nt, Human
caagugaaaugggaaaaccc

SEQ ID NO: 731117 - RNA, 24 nt, Human
cacacacacaaaacaaaaguauca

SEQ ID NO: 731118 - RNA, 20 nt, Human
cacacacacacaaaacaaaa

SEQ ID NO: 731119 - RNA, 23 nt, Human
cacacacacacaaaacaaaagua

SEQ ID NO: 731120 - RNA, 20 nt, Human
cacacacacacacacacaca

SEQ ID NO: 731121 - RNA, 20 nt, Human
cacacacacacacacacaca

SEQ ID NO: 731122 - RNA, 20 nt, Human
cacacacacacacacacaca

SEQ ID NO: 731123 - RNA, 20 nt, Human
cacacacacacacacacaca

SEQ ID NO: 731124 - RNA, 20 nt, Human
cacacacacacacacacaca

SEQ ID NO: 731125 - RNA, 20 nt, Human
cacacacacacacacacaca

SEQ ID NO: 731126 - RNA, 20 nt, Human
cacacacacacacacacaca

SEQ ID NO: 731127 - RNA, 20 nt, Human
cacacacacacacacacaca

SEQ ID NO: 731128 - RNA, 20 nt, Human
cacacacacacacacacaca

SEQ ID NO: 731129 - RNA, 20 nt, Human
cacacacacacacacacaca

SEQ ID NO: 731130 - RNA, 20 nt, Human
cacacacacacacacacaca

SEQ ID NO: 731131 - RNA, 20 nt, Human
cacacacacacacacacaca

SEQ ID NO: 731132 - RNA, 20 nt, Human
cacacacacacacacacaca

SEQ ID NO: 731133 - RNA, 22 nt, Human
cacacacacacacacacacaca

SEQ ID NO: 731134 - RNA, 22 nt, Human
cacacacacacacacacacaca

SEQ ID NO: 731135 - RNA, 22 nt, Human
cacacacacacacacacacaca

SEQ ID NO: 731136 - RNA, 22 nt, Human
cacacacacacacacacacaca

SEQ ID NO: 731137 - RNA, 22 nt, Human
cacacacacacacacacacaca

SEQ ID NO: 731138 - RNA, 22 nt, Human
cacacacacacacacacacaca

SEQ ID NO: 731139 - RNA, 27 nt, Human
cacacacacacacacacacacacaaaa

SEQ ID NO: 731140 - RNA, 26 nt, Human
cacacacacacacacacacacacaca

SEQ ID NO: 731141 - RNA, 26 nt, Human
cacacacacacacacacacacacaca

SEQ ID NO: 731142 - RNA, 26 nt, Human
cacacacacacacacacacacacaca

SEQ ID NO: 731143 - RNA, 26 nt, Human
cacacacacacacacacacacacaca

SEQ ID NO: 731144 - RNA, 26 nt, Human
cacacacacacacacacacacacaca

SEQ ID NO: 731145 - RNA, 26 nt, Human
cacacacacacacacacacacacaca

SEQ ID NO: 731146 - RNA, 26 nt, Human
cacacacacacacacacacacacaca

SEQ ID NO: 731147 - RNA, 26 nt, Human
cacacacacacacacacacacacaca

SEQ ID NO: 731148 - RNA, 21 nt, Human
cacaccacugcacuccagccu

SEQ ID NO: 731149 - RNA, 21 nt, Human
cacaguaucgcucuggggaau

SEQ ID NO: 731150 - RNA, 21 nt, Human
caccagugagaagugagaaga

SEQ ID NO: 731151 - RNA, 18 nt, Human
caccauguuagccaggau

SEQ ID NO: 731152 - RNA, 22 nt, Human
caccauguuagccaggaugguc

SEQ ID NO: 731153 - RNA, 24 nt, Human
caccauguuagccaggauggucuc

SEQ ID NO: 731154 - RNA, 19 nt, Human
cacccagccgggacaaagc

SEQ ID NO: 731155 - RNA, 18 nt, Human
caccccccucaaccuccc

SEQ ID NO: 731156 - RNA, 23 nt, Human
cacccgccucggcuucccaaagu

SEQ ID NO: 731157 - RNA, 20 nt, Human
caccgcacccagccgggaca

SEQ ID NO: 731158 - RNA, 20 nt, Human
caccuguggucccagcuacu

SEQ ID NO: 731159 - RNA, 24 nt, Human
caccuguggucccagcuacuuggg

SEQ ID NO: 731160 - RNA, 24 nt, Human
cacgccuauaaucccaacacuuug

SEQ ID NO: 731161 - RNA, 21 nt, Human
cacuaagugacauuugggagg

SEQ ID NO: 731162 - RNA, 18 nt, Human
cacugcacuccagccuag

SEQ ID NO: 731163 - RNA, 19 nt, Human
cacugcacuccagccuagg

SEQ ID NO: 731164 - RNA, 19 nt, Human
cacugcacuccagccuagg

SEQ ID NO: 731165 - RNA, 24 nt, Human
cacugcacuccagccuaggagaca

SEQ ID NO: 731166 - RNA, 25 nt, Human
cacuguuuaaagccaagucauuccc

SEQ ID NO: 731167 - RNA, 20 nt, Human
cacuuggcccagggcagggc

SEQ ID NO: 731168 - RNA, 25 nt, Human
cagaaaagaaccaccugagagcuaa

SEQ ID NO: 731169 - RNA, 21 nt, Human
cagaaugauccguggguccaa

SEQ ID NO: 731170 - RNA, 22 nt, Human
cagagaaaggagguagccacau

SEQ ID NO: 731171 - RNA, 22 nt, Human
cagagaacguccucaaccaccu

SEQ ID NO: 731172 - RNA, 24 nt, Human
cagagauuuuuugcugcuccugcu

SEQ ID NO: 731173 - RNA, 22 nt, Human
cagauggaaggggaagccagaa

SEQ ID NO: 731174 - RNA, 24 nt, Human
cagcucggucccaaaauaaaaaua

SEQ ID NO: 731175 - RNA, 26 nt, Human
cagcucuguuccagagaaaccaagag

SEQ ID NO: 731176 - RNA, 21 nt, Human
cagcuggucaauggaagaggc

SEQ ID NO: 731177 - RNA, 21 nt, Human
caggcgccugccaccacgccc

SEQ ID NO: 731178 - RNA, 23 nt, Human
caggcgccugccaccacgcccgg

SEQ ID NO: 731179 - RNA, 20 nt, Human
caggcuucucuccccaccac

SEQ ID NO: 731180 - RNA, 20 nt, Human
cagggcaccccccucaaccu

SEQ ID NO: 731181 - RNA, 24 nt, Human
cagggugggggguggggucuuuag

SEQ ID NO: 731182 - RNA, 23 nt, Human
cauagaucaggauacuguccccu

SEQ ID NO: 731183 - RNA, 22 nt, Human
caugccauucuccugccucagc

SEQ ID NO: 731184 - RNA, 21 nt, Human
caugcuuucaacucuaagcau

SEQ ID NO: 731185 - RNA, 21 nt, Human
ccaaaacauauuucagucaaa

SEQ ID NO: 731186 - RNA, 19 nt, Human
ccaaagugcuaggauuaca

SEQ ID NO: 731187 - RNA, 24 nt, Human
ccaaagugcuaggauuacaggcau

SEQ ID NO: 731188 - RNA, 18 nt, Human
ccaaguaucagcaucucc

SEQ ID NO: 731189 - RNA, 23 nt, Human
ccacagggcaccccccucaaccu

SEQ ID NO: 731190 - RNA, 20 nt, Human
ccaccacgcccggcuaauuu

SEQ ID NO: 731191 - RNA, 28 nt, Human
ccacccacugcaagcuccaccucccggg

SEQ ID NO: 731192 - RNA, 19 nt, Human
ccacgggaguccucugggc

SEQ ID NO: 731193 - RNA, 24 nt, Human
ccacugcaagcuccaccucccggg

SEQ ID NO: 731194 - RNA, 27 nt, Human
ccacugcaagcuccaccucccggguuc

SEQ ID NO: 731195 - RNA, 20 nt, Human
ccacugcacuccagccuagg

SEQ ID NO: 731196 - RNA, 22 nt, Human
ccacugcacuccagccuaggag

SEQ ID NO: 731197 - RNA, 23 nt, Human
ccacugcacuccagccuaggaga

SEQ ID NO: 731198 - RNA, 24 nt, Human
ccacugcacuccagccuaggagac

SEQ ID NO: 731199 - RNA, 25 nt, Human
ccacugcacuccagccuaggagaca

SEQ ID NO: 731200 - RNA, 19 nt, Human
ccaggaaaugagaagcagg

SEQ ID NO: 731201 - RNA, 23 nt, Human
cccaaguagcugggacuacaggc

SEQ ID NO: 731202 - RNA, 23 nt, Human
cccaaguagcugggacuacaggc

SEQ ID NO: 731203 - RNA, 23 nt, Human
cccacucccuuuaccccuucaaa

SEQ ID NO: 731204 - RNA, 24 nt, Human
cccacugcaagcuccaccucccgg

SEQ ID NO: 731205 - RNA, 22 nt, Human
cccagagaaaggagguagccac

SEQ ID NO: 731206 - RNA, 21 nt, Human
cccagauaggccacuuggccc

SEQ ID NO: 731207 - RNA, 19 nt, Human
cccagggcagggcugggug

SEQ ID NO: 731208 - RNA, 22 nt, Human
ccccagccucagccugggggac

SEQ ID NO: 731209 - RNA, 23 nt, Human
ccccaugcuuucaacucuaagca

SEQ ID NO: 731210 - RNA, 21 nt, Human
cccuccuccagaaauuguccc

SEQ ID NO: 731211 - RNA, 22 nt, Human
ccuauaaucccaacacuuuggg

SEQ ID NO: 731212 - RNA, 22 nt, Human
ccuauaaucccaacacuuuggg

SEQ ID NO: 731213 - RNA, 22 nt, Human
ccucaaccuccccuuccuccag

SEQ ID NO: 731214 - RNA, 26 nt, Human
ccucaaccuccccuuccuccagcaaa

SEQ ID NO: 731215 - RNA, 22 nt, Human
ccucacuucaaugauuccccug

SEQ ID NO: 731216 - RNA, 24 nt, Human
ccucccggguucaugccauucucc

SEQ ID NO: 731217 - RNA, 23 nt, Human
ccuccucggcucccuaccccagc

SEQ ID NO: 731218 - RNA, 20 nt, Human
ccugaccucgugauccaccc

SEQ ID NO: 731219 - RNA, 20 nt, Human
ccugcaacacaggcuugggg

SEQ ID NO: 731220 - RNA, 23 nt, Human
ccugccucagccucccaaguagc

SEQ ID NO: 731221 - RNA, 24 nt, Human
ccugccucagccucccaaguagcu

SEQ ID NO: 731222 - RNA, 19 nt, Human
ccuggcaggaugcagggcc

SEQ ID NO: 731223 - RNA, 24 nt, Human
ccuggccaugcagaugcccagaga

SEQ ID NO: 731224 - RNA, 18 nt, Human
ccugugcaaauaaguacc

SEQ ID NO: 731225 - RNA, 25 nt, Human
ccuguggucccagcuacuugggugg

SEQ ID NO: 731226 - RNA, 19 nt, Human
ccuuauggcugcaggucac

SEQ ID NO: 731227 - RNA, 19 nt, Human
ccuuggccaggccuuccuu

SEQ ID NO: 731228 - RNA, 20 nt, Human
cgaccaaaacuccaguuuag

SEQ ID NO: 731229 - RNA, 22 nt, Human
cgagaaauaaagaaaaacacaa

SEQ ID NO: 731230 - RNA, 21 nt, Human
cgcacaggauuccuacaggac

SEQ ID NO: 731231 - RNA, 24 nt, Human
cgcccaggcuggagugcaguggcg

SEQ ID NO: 731232 - RNA, 24 nt, Human
cgccucggcuucccaaagugcuag

SEQ ID NO: 731233 - RNA, 24 nt, Human
cgcucugucgcccaggcuggagug

SEQ ID NO: 731234 - RNA, 24 nt, Human
cgggguuucaccauguuagccagg

SEQ ID NO: 731235 - RNA, 19 nt, Human
cuaaaagacagagcaaccg

SEQ ID NO: 731236 - RNA, 21 nt, Human
cuaagcauauaaaccacaacc

SEQ ID NO: 731237 - RNA, 25 nt, Human
cuaauuuuuuuaauuuuaguagaga

SEQ ID NO: 731238 - RNA, 21 nt, Human
cuacgaacugacucauuuugu

SEQ ID NO: 731239 - RNA, 22 nt, Human
cucacgccuauaaucccaacac

SEQ ID NO: 731240 - RNA, 24 nt, Human
cucacgccuauaaucccaacacuu

SEQ ID NO: 731241 - RNA, 24 nt, Human
cucagccucccaaguagcugggac

SEQ ID NO: 731242 - RNA, 19 nt, Human
cuccaucucaaaaaaaaaa

SEQ ID NO: 731243 - RNA, 21 nt, Human
cuccauggccuccucggcucc

SEQ ID NO: 731244 - RNA, 21 nt, Human
cucccggguucaugccauucu

SEQ ID NO: 731245 - RNA, 24 nt, Human
cuccugaccucgugauccacccgc

SEQ ID NO: 731246 - RNA, 21 nt, Human
cuccugggccuacugaggagg

SEQ ID NO: 731247 - RNA, 24 nt, Human
cucgcucugucgcccaggcuggag

SEQ ID NO: 731248 - RNA, 23 nt, Human
cucugucgcccaggcuggagugc

SEQ ID NO: 731249 - RNA, 20 nt, Human
cugagaaaaacagaaaagaa

SEQ ID NO: 731250 - RNA, 19 nt, Human
cuggcaggguggggggugg

SEQ ID NO: 731251 - RNA, 19 nt, Human
cuggcucugucaaucccca

SEQ ID NO: 731252 - RNA, 20 nt, Human
cugguucacagauguuaaaa

SEQ ID NO: 731253 - RNA, 28 nt, Human
cuuagccccaaaugcagggaaaagcaga

SEQ ID NO: 731254 - RNA, 18 nt, Human
gaaggagcacuccucucc

SEQ ID NO: 731255 - RNA, 23 nt, Human
gacacaguggcucacgccuauaa

SEQ ID NO: 731256 - RNA, 18 nt, Human
gacacuucugauaaauga

SEQ ID NO: 731257 - RNA, 22 nt, Human
gaccucgugauccacccgccuc

SEQ ID NO: 731258 - RNA, 22 nt, Human
gaccucgugauccacccgccuc

SEQ ID NO: 731259 - RNA, 24 nt, Human
gaccucgugauccacccgccucgg

SEQ ID NO: 731260 - RNA, 20 nt, Human
gagaacguccucaaccaccu

SEQ ID NO: 731261 - RNA, 24 nt, Human
gagacgggguuucaccauguuagc

SEQ ID NO: 731262 - RNA, 22 nt, Human
gagcccugaagguuggggcugc

SEQ ID NO: 731263 - RNA, 22 nt, Human
gaggaaaaggcuggacacagug

SEQ ID NO: 731264 - RNA, 20 nt, Human
gagggaaggaaaccagagua

SEQ ID NO: 731265 - RNA, 20 nt, Human
gagggugcuguccucuccac

SEQ ID NO: 731266 - RNA, 18 nt, Human
gaguacagaacacguugg

SEQ ID NO: 731267 - RNA, 24 nt, Human
gaucaccugagcccaagagcucaa

SEQ ID NO: 731268 - RNA, 22 nt, Human
gaucuccacccacugcaagcuc

SEQ ID NO: 731269 - RNA, 18 nt, Human
gauuacaggcaugagcca

SEQ ID NO: 731270 - RNA, 22 nt, Human
gauuacaggcaugagccaccgc

SEQ ID NO: 731271 - RNA, 23 nt, Human
gauuacaggcaugagccaccgca

SEQ ID NO: 731272 - RNA, 20 nt, Human
gcaaaccucaugccaagcau

SEQ ID NO: 731273 - RNA, 18 nt, Human
gcaagcucuauguacagc

SEQ ID NO: 731274 - RNA, 23 nt, Human
gcagaguccucuucaguuauuag

SEQ ID NO: 731275 - RNA, 25 nt, Human
gcagcuaaaagacagagcaaccagg

SEQ ID NO: 731276 - RNA, 19 nt, Human
gccaugaucacaccacugc

SEQ ID NO: 731277 - RNA, 23 nt, Human
gccaugaucacaccacugcacuu

SEQ ID NO: 731278 - RNA, 20 nt, Human
gcccaggcuggagugcagug

SEQ ID NO: 731279 - RNA, 18 nt, Human
gcccagggcagggcuggg

SEQ ID NO: 731280 - RNA, 18 nt, Human
gcccuccuccccagccuc

SEQ ID NO: 731281 - RNA, 23 nt, Human
gcccugaagguuggggcugcagu

SEQ ID NO: 731282 - RNA, 24 nt, Human
gcccugaagguuggggcugcagug

SEQ ID NO: 731283 - RNA, 24 nt, Human
gccucggcuucccaaagugcuagg

SEQ ID NO: 731284 - RNA, 19 nt, Human
gccugguucacagauguua

SEQ ID NO: 731285 - RNA, 23 nt, Human
gcuccaaucagguuuccagucuc

SEQ ID NO: 731286 - RNA, 20 nt, Human
gcugcuccugcucccugugc

SEQ ID NO: 731287 - RNA, 18 nt, Human
gcuggacacaguggcuca

SEQ ID NO: 731288 - RNA, 19 nt, Human
gcuggacacaguggcucac

SEQ ID NO: 731289 - RNA, 25 nt, Human
gcuggagugcaguggcgcgaucucc

SEQ ID NO: 731290 - RNA, 20 nt, Human
gcuggguguguggugggagc

SEQ ID NO: 731291 - RNA, 20 nt, Human
ggaagcaagggcagcuuuuc

SEQ ID NO: 731292 - RNA, 18 nt, Human
ggacaucacuaagugaca

SEQ ID NO: 731293 - RNA, 19 nt, Human
ggagcaccuggagagggug

SEQ ID NO: 731294 - RNA, 22 nt, Human
ggauuacaggcaugagccaccg

SEQ ID NO: 731295 - RNA, 23 nt, Human
ggcaggaagauucagaaugaucc

SEQ ID NO: 731296 - RNA, 24 nt, Human
ggcaggaagauucagaaugauccg

SEQ ID NO: 731297 - RNA, 18 nt, Human
ggcagggcugggugugug

SEQ ID NO: 731298 - RNA, 18 nt, Human
ggcaguggugguggugaa

SEQ ID NO: 731299 - RNA, 20 nt, Human
ggcaguggugguggugaagg

SEQ ID NO: 731300 - RNA, 18 nt, Human
ggcuggcagggugggggg

SEQ ID NO: 731301 - RNA, 23 nt, Human
gggcaguggugguggugaaggua

SEQ ID NO: 731302 - RNA, 22 nt, Human
ggggcuuucacaccacagggca

SEQ ID NO: 731303 - RNA, 23 nt, Human
gggguuucaccauguuagccagg

SEQ ID NO: 731304 - RNA, 18 nt, Human
gggugggggguggggucu

SEQ ID NO: 731305 - RNA, 20 nt, Human
ggucucgaucuccugaccuc

SEQ ID NO: 731306 - RNA, 24 nt, Human
ggugggagcaccuggagagggugc

SEQ ID NO: 731307 - RNA, 24 nt, Human
gguuucaccauguuagccaggaug

SEQ ID NO: 731308 - RNA, 23 nt, Human
guagagacgggguuucaccaugu

SEQ ID NO: 731309 - RNA, 20 nt, Human
gucaaacccaaucccagucc

SEQ ID NO: 731310 - RNA, 24 nt, Human
gugauccacccgccucggcuuccc

SEQ ID NO: 731311 - RNA, 20 nt, Human
guggaaaaagcuacauuaca

SEQ ID NO: 731312 - RNA, 23 nt, Human
guggccuugcacccucagcaggg

SEQ ID NO: 731313 - RNA, 18 nt, Human
guggcgcgaucuccaccc

SEQ ID NO: 731314 - RNA, 22 nt, Human
guuaaguguauccaaugccuag

SEQ ID NO: 731315 - RNA, 24 nt, Human
guucaaagucucuaucccuauccc

SEQ ID NO: 731316 - RNA, 20 nt, Human
uaaaacacacacacacacac

SEQ ID NO: 731317 - RNA, 21 nt, Human
uaaaccacaaccucagucuua

SEQ ID NO: 731318 - RNA, 19 nt, Human
uaaagagauggggugaggg

SEQ ID NO: 731319 - RNA, 18 nt, Human
uaaagccaagucauuccc

SEQ ID NO: 731320 - RNA, 23 nt, Human
uaacaggcccaaggucacacagc

SEQ ID NO: 731321 - RNA, 23 nt, Human
uaagacaggauccgauuucccac

SEQ ID NO: 731322 - RNA, 20 nt, Human
uaagauacuagaaauuuuca

SEQ ID NO: 731323 - RNA, 22 nt, Human
uaagauacuagaaauuuucagc

SEQ ID NO: 731324 - RNA, 18 nt, Human
uaagccacuacaacagaa

SEQ ID NO: 731325 - RNA, 18 nt, Human
uaagcuccuggccaugca

SEQ ID NO: 731326 - RNA, 25 nt, Human
uaagcuccuggccaugcagaugccc

SEQ ID NO: 731327 - RNA, 19 nt, Human
uaauaugaugugcuccagu

SEQ ID NO: 731328 - RNA, 23 nt, Human
uaauuuuuuuaauuuuaguagag

SEQ ID NO: 731329 - RNA, 24 nt, Human
uaauuuuuuuaauuuuaguagaga

SEQ ID NO: 731330 - RNA, 26 nt, Human
uaauuuuuuuaauuuuaguagagacg

SEQ ID NO: 731331 - RNA, 25 nt, Human
uacaacagaagagagggcacugcac

SEQ ID NO: 731332 - RNA, 21 nt, Human
uacacuagcaguuccaguagc

SEQ ID NO: 731333 - RNA, 24 nt, Human
uacaggcaugagccaccgcaccca

SEQ ID NO: 731334 - RNA, 23 nt, Human
uacaggcgccugccaccacgccc

SEQ ID NO: 731335 - RNA, 18 nt, Human
uaccugucuuaggaaggg

SEQ ID NO: 731336 - RNA, 20 nt, Human
uagaauuucaaacaaaacua

SEQ ID NO: 731337 - RNA, 22 nt, Human
uagagacgggguuucaccaugu

SEQ ID NO: 731338 - RNA, 27 nt, Human
uagaggagagggcaaguggggcuucaa

SEQ ID NO: 731339 - RNA, 25 nt, Human
uagauagugaaagagagagaacaau

SEQ ID NO: 731340 - RNA, 20 nt, Human
uagcaaaccucaugccaagc

SEQ ID NO: 731341 - RNA, 21 nt, Human
uagccacaucacagggacaac

SEQ ID NO: 731342 - RNA, 18 nt, Human
uaggauuacaggcaugag

SEQ ID NO: 731343 - RNA, 21 nt, Human
uaggauuacaggcaugagcca

SEQ ID NO: 731344 - RNA, 22 nt, Human
uaggauuacaggcaugagccac

SEQ ID NO: 731345 - RNA, 23 nt, Human
uaggauuacaggcaugagccacc

SEQ ID NO: 731346 - RNA, 24 nt, Human
uaggauuacaggcaugagccaccg

SEQ ID NO: 731347 - RNA, 24 nt, Human
uaggauuacaggcaugagccaccg

SEQ ID NO: 731348 - RNA, 26 nt, Human
uaggauuacaggcaugagccaccgca

SEQ ID NO: 731349 - RNA, 24 nt, Human
uaggccacuuggcccaggggaggu

SEQ ID NO: 731350 - RNA, 23 nt, Human
uaguaagcaagcucuauguacag

SEQ ID NO: 731351 - RNA, 24 nt, Human
uaguagagacgggguuucaccaug

SEQ ID NO: 731352 - RNA, 26 nt, Human
uaguagagacgggguuucaccauguu

SEQ ID NO: 731353 - RNA, 25 nt, Human
uaucaagcugaaacaccaaguauca

SEQ ID NO: 731354 - RNA, 21 nt, Human
ucaaacaaaacuaacaagcuu

SEQ ID NO: 731355 - RNA, 22 nt, Human
ucaaccugcucuguuacauaac

SEQ ID NO: 731356 - RNA, 26 nt, Human
ucaagguaaggauugagggaggugca

SEQ ID NO: 731357 - RNA, 25 nt, Human
ucaauccccacuugagucuucuuuc

SEQ ID NO: 731358 - RNA, 21 nt, Human
ucaaugauuccccuggcucca

SEQ ID NO: 731359 - RNA, 24 nt, Human
ucaccauguuagccaggauggucu

SEQ ID NO: 731360 - RNA, 21 nt, Human
ucacugucucuucugccccag

SEQ ID NO: 731361 - RNA, 21 nt, Human
ucagaaccuguucuggccaag

SEQ ID NO: 731362 - RNA, 18 nt, Human
ucagccucccaaguagcu

SEQ ID NO: 731363 - RNA, 20 nt, Human
ucagccucccaaguagcugg

SEQ ID NO: 731364 - RNA, 22 nt, Human
uccaacaccagugagaagugag

SEQ ID NO: 731365 - RNA, 19 nt, Human
uccacucugccccugaccc

SEQ ID NO: 731366 - RNA, 22 nt, Human
uccauggccuccucggcucccu

SEQ ID NO: 731367 - RNA, 24 nt, Human
ucccaaagugcuaggauuacaggc

SEQ ID NO: 731368 - RNA, 24 nt, Human
ucccaaguagcugggacuacaggc

SEQ ID NO: 731369 - RNA, 19 nt, Human
uccccagacuuuaagagaa

SEQ ID NO: 731370 - RNA, 21 nt, Human
uccccagccucagccuggggg

SEQ ID NO: 731371 - RNA, 27 nt, Human
uccccagccucagccugggggacccac

SEQ ID NO: 731372 - RNA, 21 nt, Human
ucccggguucaugccauucuc

SEQ ID NO: 731373 - RNA, 24 nt, Human
ucccggguucaugccauucuccug

SEQ ID NO: 731374 - RNA, 19 nt, Human
ucccuaaagaauuaggaaa

SEQ ID NO: 731375 - RNA, 22 nt, Human
uccuccccagccucagccuggg

SEQ ID NO: 731376 - RNA, 22 nt, Human
uccucuacuccaccaugccuuc

SEQ ID NO: 731377 - RNA, 22 nt, Human
ucgccaccuacgaacugacuca

SEQ ID NO: 731378 - RNA, 24 nt, Human
ucgcccaggcuggagugcaguggc

SEQ ID NO: 731379 - RNA, 24 nt, Human
ucgcucugucgcccaggcuggagu

SEQ ID NO: 731380 - RNA, 27 nt, Human
ucggucccaaaauaaaaauaagcaagg

SEQ ID NO: 731381 - RNA, 25 nt, Human
ucuaaucagagaacguccucaacca

SEQ ID NO: 731382 - RNA, 21 nt, Human
ucuacccacugcccucuccua

SEQ ID NO: 731383 - RNA, 21 nt, Human
ucucagggacacagauggaag

SEQ ID NO: 731384 - RNA, 21 nt, Human
ucucagggacacagauggaag

SEQ ID NO: 731385 - RNA, 21 nt, Human
ucuccacucugccccugaccc

SEQ ID NO: 731386 - RNA, 26 nt, Human
ucuccuagguuuggcucugcuggggu

SEQ ID NO: 731387 - RNA, 26 nt, Human
ucuccugccucagccucccaaguagc

SEQ ID NO: 731388 - RNA, 19 nt, Human
ucucgcucugucgcccagg

SEQ ID NO: 731389 - RNA, 23 nt, Human
ucucgcucugucgcccaggcugg

SEQ ID NO: 731390 - RNA, 24 nt, Human
ucucgcucugucgcccaggcugga

SEQ ID NO: 731391 - RNA, 26 nt, Human
ucucgcucugucgcccaggcuggagu

SEQ ID NO: 731392 - RNA, 27 nt, Human
ucucgcucugucgcccaggcuggagug

SEQ ID NO: 731393 - RNA, 26 nt, Human
ucugaacugcucuuuaaguggucuca

SEQ ID NO: 731394 - RNA, 19 nt, Human
ucugagaaaaacagaaaag

SEQ ID NO: 731395 - RNA, 18 nt, Human
ucugcagggcagaggguc

SEQ ID NO: 731396 - RNA, 21 nt, Human
ucuggcucugucaauccccac

SEQ ID NO: 731397 - RNA, 21 nt, Human
ucugggcugaaagcccaagag

SEQ ID NO: 731398 - RNA, 24 nt, Human
ucugucgcccaggcuggagugcag

SEQ ID NO: 731399 - RNA, 18 nt, Human
ugaaagagagagaacaau

SEQ ID NO: 731400 - RNA, 23 nt, Human
ugaaagcccaagaggaagaacca

SEQ ID NO: 731401 - RNA, 19 nt, Human
ugaaaugggaaaacccuca

SEQ ID NO: 731402 - RNA, 21 nt, Human
ugaaaugggaaaacccucaaa

SEQ ID NO: 731403 - RNA, 22 nt, Human
ugaagaauucucacacaaauca

SEQ ID NO: 731404 - RNA, 23 nt, Human
ugaagagucuggggaacuacaga

SEQ ID NO: 731405 - RNA, 20 nt, Human
ugaagggacagggaaguggc

SEQ ID NO: 731406 - RNA, 19 nt, Human
ugacaaagugcaggaaggg

SEQ ID NO: 731407 - RNA, 23 nt, Human
ugacaccuuccccacugugccau

SEQ ID NO: 731408 - RNA, 22 nt, Human
ugagaagacagaagucaacugg

SEQ ID NO: 731409 - RNA, 22 nt, Human
ugagaagacagaagucaacugg

SEQ ID NO: 731410 - RNA, 24 nt, Human
ugagaagauacagagaaacaccag

SEQ ID NO: 731411 - RNA, 21 nt, Human
ugagaagugagaagauacaga

SEQ ID NO: 731412 - RNA, 24 nt, Human
ugagagcugaggggaaaccuuagc

SEQ ID NO: 731413 - RNA, 20 nt, Human
ugaggaaauggagggucagg

SEQ ID NO: 731414 - RNA, 19 nt, Human
ugaggugggaggaucaccu

SEQ ID NO: 731415 - RNA, 20 nt, Human
ugaggugggaggaucaccug

SEQ ID NO: 731416 - RNA, 21 nt, Human
ugaggugggaggaucaccuga

SEQ ID NO: 731417 - RNA, 23 nt, Human
ugaggugggaggaucaccugagc

SEQ ID NO: 731418 - RNA, 24 nt, Human
ugaggugggaggaucaccugagcc

SEQ ID NO: 731419 - RNA, 21 nt, Human
ugaugagaaauccuaagacag

SEQ ID NO: 731420 - RNA, 25 nt, Human
ugcacaagacaacaaaacagaagga

SEQ ID NO: 731421 - RNA, 23 nt, Human
ugcagggcagagggucagagcag

SEQ ID NO: 731422 - RNA, 22 nt, Human
ugcagugagccaugaucacacc

SEQ ID NO: 731423 - RNA, 28 nt, Human
ugccaagcaucuaaucagagaacguccu

SEQ ID NO: 731424 - RNA, 21 nt, Human
ugcccagagacuucuugcagc

SEQ ID NO: 731425 - RNA, 26 nt, Human
ugcccagagacuucuugcagcucugu

SEQ ID NO: 731426 - RNA, 20 nt, Human
ugccuagaauuucaaacaaa

SEQ ID NO: 731427 - RNA, 22 nt, Human
ugccuagaauuucaaacaaaac

SEQ ID NO: 731428 - RNA, 24 nt, Human
ugccucagccucccaaguagcugg

SEQ ID NO: 731429 - RNA, 18 nt, Human
ugcuauggacaaaccaac

SEQ ID NO: 731430 - RNA, 20 nt, Human
uggaaggcagaauuaaugcc

SEQ ID NO: 731431 - RNA, 19 nt, Human
uggacacucaccugcccaa

SEQ ID NO: 731432 - RNA, 24 nt, Human
uggaggacucucuugacaaagugc

SEQ ID NO: 731433 - RNA, 23 nt, Human
uggagugcaguggcgcgaucucc

SEQ ID NO: 731434 - RNA, 25 nt, Human
uggcagggugggggguggggucuuu

SEQ ID NO: 731435 - RNA, 21 nt, Human
uggcaugcaccugugguccca

SEQ ID NO: 731436 - RNA, 24 nt, Human
uggcaugcaccuguggucccagcu

SEQ ID NO: 731437 - RNA, 24 nt, Human
uggccaugcagaugcccagagacu

SEQ ID NO: 731438 - RNA, 19 nt, Human
uggccucucagagcucccu

SEQ ID NO: 731439 - RNA, 19 nt, Human
uggcgcgaucuccacccac

SEQ ID NO: 731440 - RNA, 21 nt, Human
uggcucacccaagcagagcuc

SEQ ID NO: 731441 - RNA, 21 nt, Human
uggcucacgccuauaauccca

SEQ ID NO: 731442 - RNA, 24 nt, Human
uggcugaggugggaggaucaccug

SEQ ID NO: 731443 - RNA, 20 nt, Human
ugggaagauaaauuccagga

SEQ ID NO: 731444 - RNA, 18 nt, Human
ugggacaucacuaaguga

SEQ ID NO: 731445 - RNA, 21 nt, Human
ugggacuacaggcgccugcca

SEQ ID NO: 731446 - RNA, 22 nt, Human
ugggacuacaggcgccugccac

SEQ ID NO: 731447 - RNA, 24 nt, Human
ugggacuacaggcgccugccacca

SEQ ID NO: 731448 - RNA, 22 nt, Human
ugggaggaucaccugagcccug

SEQ ID NO: 731449 - RNA, 19 nt, Human
ugggaggccaaggugggag

SEQ ID NO: 731450 - RNA, 24 nt, Human
ugggaggccaaggugggaggauca

SEQ ID NO: 731451 - RNA, 18 nt, Human
uggggcagagaaucuacc

SEQ ID NO: 731452 - RNA, 19 nt, Human
uggggcuuucacaccacag

SEQ ID NO: 731453 - RNA, 20 nt, Human
ugggguauuuauguguaugu

SEQ ID NO: 731454 - RNA, 18 nt, Human
uggggugagggugggggg

SEQ ID NO: 731455 - RNA, 22 nt, Human
uggggugaggguggggggaacu

SEQ ID NO: 731456 - RNA, 18 nt, Human
uggguggcugagguggga

SEQ ID NO: 731457 - RNA, 24 nt, Human
uggguggcugaggugggaggauca

SEQ ID NO: 731458 - RNA, 21 nt, Human
ugguauugggugacuuucuga

SEQ ID NO: 731459 - RNA, 24 nt, Human
uggucaauggaagaggcagauaug

SEQ ID NO: 731460 - RNA, 21 nt, Human
uggugggagcaccuggagagg

SEQ ID NO: 731461 - RNA, 22 nt, Human
uggugggagcaccuggagaggg

SEQ ID NO: 731462 - RNA, 19 nt, Human
uguacgagaaauaaagaaa

SEQ ID NO: 731463 - RNA, 23 nt, Human
ugucuggcucacccaagcagagc

SEQ ID NO: 731464 - RNA, 23 nt, Human
ugucugggcccugguaucacuac

SEQ ID NO: 731465 - RNA, 19 nt, Human
ugucuuaggaaggggguga

SEQ ID NO: 731466 - RNA, 20 nt, Human
ugugcuggggaacacaugcc

SEQ ID NO: 731467 - RNA, 19 nt, Human
uguggaaaaagcuacauua

SEQ ID NO: 731468 - RNA, 23 nt, Human
uguggugggagcaccuggagagg

SEQ ID NO: 731469 - RNA, 26 nt, Human
uguguggugggagcaccuggagaggg

SEQ ID NO: 731470 - RNA, 28 nt, Human
uguuaaaacacacacacacacacacaca

SEQ ID NO: 731471 - RNA, 27 nt, Human
uguuaaaacacacacacacacacacag

SEQ ID NO: 731472 - RNA, 21 nt, Human
uguuccagagaaaccaagagc

SEQ ID NO: 731473 - RNA, 31 nt, Human
uuaaaacacacacacacacacacacacacag

SEQ ID NO: 731474 - RNA, 18 nt, Human
uuaguagagacgggguuu

SEQ ID NO: 731475 - RNA, 22 nt, Human
uuaguagagacgggguuucacc

SEQ ID NO: 731476 - RNA, 24 nt, Human
uuaguagagacgggguuucaccau

SEQ ID NO: 731477 - RNA, 23 nt, Human
uucaaaagguggucacugucucu

SEQ ID NO: 731478 - RNA, 24 nt, Human
uucacaagaguccauuucaucaaa

SEQ ID NO: 731479 - RNA, 19 nt, Human
uucagccagaaagggagac

SEQ ID NO: 731480 - RNA, 19 nt, Human
uucaugccauucuccugcc

SEQ ID NO: 731481 - RNA, 21 nt, Human
uuccaguagcaaaccucaugc

SEQ ID NO: 731482 - RNA, 21 nt, Human
uugagagcugaggggaaaccu

SEQ ID NO: 731483 - RNA, 24 nt, Human
uuggcccagggcagggcugggugu

SEQ ID NO: 731484 - RNA, 25 nt, Human
uuggguggcugaggugggaggauca

SEQ ID NO: 731485 - RNA, 24 nt, Human
uugucuggcucacccaagcagagc

SEQ ID NO: 731486 - RNA, 22 nt, Human
uuuaagagaaaucccagagaaa

SEQ ID NO: 731487 - RNA, 24 nt, Human
uuucacaccacagggcaccccccc

SEQ ID NO: 731488 - RNA, 19 nt, Human
uuucaccauguuagccagg

SEQ ID NO: 731489 - RNA, 20 nt, Human
uuucaccauguuagccagga

SEQ ID NO: 731490 - RNA, 19 nt, Human
uuuccagucucccagaggu

SEQ ID NO: 731491 - RNA, 24 nt, Human
uuucccuccuccagaaauuguccc

SEQ ID NO: 731492 - RNA, 19 nt, Human
uuucugaacugcucuuuau

SEQ ID NO: 731493 - RNA, 23 nt, Human
uuugagcucuucaaaaggugguc

SEQ ID NO: 731494 - RNA, 18 nt, Human
uuugcugcaccucucuac

SEQ ID NO: 731495 - RNA, 22 nt, Human
uuuuuuuuuucagacggagucu

SEQ ID NO: 731496 - RNA, 22 nt, Human
aaaaaagaaauggaaauccggg

SEQ ID NO: 731497 - RNA, 19 nt, Human
aaaaaggacugccaggcgg

SEQ ID NO: 731498 - RNA, 26 nt, Human
aaacagaaaauccaaacaggauggca

SEQ ID NO: 731499 - RNA, 18 nt, Human
aaacagaagcgacugaac

SEQ ID NO: 731500 - RNA, 24 nt, Human
aaagugcugcgauuagaggcguga

SEQ ID NO: 731501 - RNA, 20 nt, Human
aacacggccaagccaggccu

SEQ ID NO: 731502 - RNA, 21 nt, Human
aagcagacgcgagagccugau

SEQ ID NO: 731503 - RNA, 20 nt, Human
aagcagguguaguagcccac

SEQ ID NO: 731504 - RNA, 20 nt, Human
aagcugaagguuucugugcu

SEQ ID NO: 731505 - RNA, 24 nt, Human
aagucgaggcugcagugagccaag

SEQ ID NO: 731506 - RNA, 22 nt, Human
aaugacugucugacucaccaug

SEQ ID NO: 731507 - RNA, 19 nt, Human
aaugcuguuauacagggaa

SEQ ID NO: 731508 - RNA, 23 nt, Human
aauggccaacuuagcuccccaug

SEQ ID NO: 731509 - RNA, 25 nt, Human
acaaaaauaacgaggaggcauccac

SEQ ID NO: 731510 - RNA, 23 nt, Human
acaaaucaacaacuccccgccac

SEQ ID NO: 731511 - RNA, 20 nt, Human
acacaccacgcgccccagaa

SEQ ID NO: 731512 - RNA, 26 nt, Human
acacacccaguggaaguaaccacacc

SEQ ID NO: 731513 - RNA, 22 nt, Human
acaccacgcgccccagaaacau

SEQ ID NO: 731514 - RNA, 25 nt, Human
acaccacgcgccccagaaacauuca

SEQ ID NO: 731515 - RNA, 18 nt, Human
acaggguuucaucauguu

SEQ ID NO: 731516 - RNA, 21 nt, Human
acaggguuucaucauguuggc

SEQ ID NO: 731517 - RNA, 24 nt, Human
acaggguuucaucauguuggccag

SEQ ID NO: 731518 - RNA, 18 nt, Human
accacagcagaaucaaca

SEQ ID NO: 731519 - RNA, 27 nt, Human
accagaugcugugcggcuggaaauucc

SEQ ID NO: 731520 - RNA, 24 nt, Human
accgacaaaccgagaaagccgcag

SEQ ID NO: 731521 - RNA, 22 nt, Human
accggauuugggacaaggauuu

SEQ ID NO: 731522 - RNA, 23 nt, Human
acgcagcccaggguguggaaggg

SEQ ID NO: 731523 - RNA, 20 nt, Human
acucagaguccaaaaaagaa

SEQ ID NO: 731524 - RNA, 24 nt, Human
acuguacuccagccugggugacag

SEQ ID NO: 731525 - RNA, 19 nt, Human
agaaaaaaagaaauggaaa

SEQ ID NO: 731526 - RNA, 23 nt, Human
agaaguucugagugcccaccgug

SEQ ID NO: 731527 - RNA, 22 nt, Human
agaggaagugggcacccccagc

SEQ ID NO: 731528 - RNA, 23 nt, Human
agcaagacugucucaaaaaaaua

SEQ ID NO: 731529 - RNA, 22 nt, Human
agcaagggcacagugcuggcug

SEQ ID NO: 731530 - RNA, 19 nt, Human
agcaggagacccuuccuuc

SEQ ID NO: 731531 - RNA, 24 nt, Human
agccacaugggaggcugagguggg

SEQ ID NO: 731532 - RNA, 23 nt, Human
agccaggcaugguggcacgugcc

SEQ ID NO: 731533 - RNA, 24 nt, Human
agccugccucauacucagagucca

SEQ ID NO: 731534 - RNA, 19 nt, Human
aggaacggugggcucugag

SEQ ID NO: 731535 - RNA, 23 nt, Human
aggaguucaagaccagccugggc

SEQ ID NO: 731536 - RNA, 21 nt, Human
aggaugaggaagaggccccag

SEQ ID NO: 731537 - RNA, 20 nt, Human
aggaugcccacagcccuggg

SEQ ID NO: 731538 - RNA, 24 nt, Human
aggauugcuugagccgaggaguuc

SEQ ID NO: 731539 - RNA, 18 nt, Human
aggcagauuauuuuaaug

SEQ ID NO: 731540 - RNA, 21 nt, Human
aggcgugagccaccacaccca

SEQ ID NO: 731541 - RNA, 24 nt, Human
aggcugaggugggaggaucauuug

SEQ ID NO: 731542 - RNA, 24 nt, Human
aggcugaguaggaaggauugcuug

SEQ ID NO: 731543 - RNA, 23 nt, Human
aggcugcagugagccaagaucau

SEQ ID NO: 731544 - RNA, 19 nt, Human
agggagagggaggggacag

SEQ ID NO: 731545 - RNA, 24 nt, Human
agggggccuuccucuaaacagaag

SEQ ID NO: 731546 - RNA, 18 nt, Human
aguaucugggauuacagg

SEQ ID NO: 731547 - RNA, 24 nt, Human
agugcaauggcacgaucuuggcuc

SEQ ID NO: 731548 - RNA, 24 nt, Human
aucaugccacuguacuccagccug

SEQ ID NO: 731549 - RNA, 24 nt, Human
aucauguuggccaggcuggucucg

SEQ ID NO: 731550 - RNA, 18 nt, Human
auccuuuggacacaugua

SEQ ID NO: 731551 - RNA, 24 nt, Human
aucuugcccuguugcccaggcugg

SEQ ID NO: 731552 - RNA, 22 nt, Human
augccacuguacuccagccugg

SEQ ID NO: 731553 - RNA, 22 nt, Human
auggaaaacaacaaaaaaggac

SEQ ID NO: 731554 - RNA, 23 nt, Human
auggaaagccagugaagugacca

SEQ ID NO: 731555 - RNA, 18 nt, Human
auggucagaagccucugc

SEQ ID NO: 731556 - RNA, 24 nt, Human
auuuuuguauuuuugguagagaca

SEQ ID NO: 731557 - RNA, 27 nt, Human
caaaagcacagaccacgaccauggaca

SEQ ID NO: 731558 - RNA, 22 nt, Human
caaacaauucuccugccucagc

SEQ ID NO: 731559 - RNA, 22 nt, Human
caacaaaaaaauagccaggcau

SEQ ID NO: 731560 - RNA, 20 nt, Human
caacacugcagcguccugcc

SEQ ID NO: 731561 - RNA, 25 nt, Human
caagcagagcucaccggauuuggga

SEQ ID NO: 731562 - RNA, 20 nt, Human
cacaaacagaaaauccaaac

SEQ ID NO: 731563 - RNA, 22 nt, Human
cacacaccacgcgccccagaaa

SEQ ID NO: 731564 - RNA, 22 nt, Human
cacacaccacgcgcccccccug

SEQ ID NO: 731565 - RNA, 21 nt, Human
cacacaccuggccuguccucc

SEQ ID NO: 731566 - RNA, 20 nt, Human
cacacaggucagcgguuuua

SEQ ID NO: 731567 - RNA, 23 nt, Human
cacaccacgcgccccagaaacau

SEQ ID NO: 731568 - RNA, 18 nt, Human
cacacggcuccaguagcc

SEQ ID NO: 731569 - RNA, 26 nt, Human
cacagaacuagccagauucauuaggg

SEQ ID NO: 731570 - RNA, 21 nt, Human
cacagcagaaucaacagugac

SEQ ID NO: 731571 - RNA, 18 nt, Human
cacagguaggagggcagg

SEQ ID NO: 731572 - RNA, 21 nt, Human
cacauuuuggguugugcaaca

SEQ ID NO: 731573 - RNA, 19 nt, Human
caccacgcgccccagaaac

SEQ ID NO: 731574 - RNA, 24 nt, Human
caccacguuggcagauucagacuc

SEQ ID NO: 731575 - RNA, 19 nt, Human
caccagggccucucccagg

SEQ ID NO: 731576 - RNA, 19 nt, Human
caccagggccucucccagg

SEQ ID NO: 731577 - RNA, 21 nt, Human
caccaugguaauuuuucacaa

SEQ ID NO: 731578 - RNA, 18 nt, Human
cacguaacccaaaccauc

SEQ ID NO: 731579 - RNA, 22 nt, Human
cacugcaaccuccaucuccggg

SEQ ID NO: 731580 - RNA, 18 nt, Human
cacuggacccaccucugg

SEQ ID NO: 731581 - RNA, 19 nt, Human
cacuguacuccagccuggg

SEQ ID NO: 731582 - RNA, 19 nt, Human
cacuguacuccagccuggg

SEQ ID NO: 731583 - RNA, 19 nt, Human
cacuguacuccagccuggg

SEQ ID NO: 731584 - RNA, 21 nt, Human
cacuguacuccagccugggug

SEQ ID NO: 731585 - RNA, 22 nt, Human
cacuguacuccagccuggguga

SEQ ID NO: 731586 - RNA, 24 nt, Human
cacuguacuccagccugggugaca

SEQ ID NO: 731587 - RNA, 25 nt, Human
cacuguacuccagccugggugacag

SEQ ID NO: 731588 - RNA, 24 nt, Human
cagaacccugcaucgggcuccccu

SEQ ID NO: 731589 - RNA, 23 nt, Human
cagaacccugcaucgggcuccuc

SEQ ID NO: 731590 - RNA, 22 nt, Human
cagaagccucugccuaacacac

SEQ ID NO: 731591 - RNA, 21 nt, Human
cagcacgacugagcaagggca

SEQ ID NO: 731592 - RNA, 24 nt, Human
cagccacaugggaggcugaggugg

SEQ ID NO: 731593 - RNA, 22 nt, Human
cagccagacacagaacuagcca

SEQ ID NO: 731594 - RNA, 20 nt, Human
cagccuccugaguaucuggg

SEQ ID NO: 731595 - RNA, 23 nt, Human
cagcucaacaaaaaaauagccag

SEQ ID NO: 731596 - RNA, 19 nt, Human
caggaccacuggcgcccca

SEQ ID NO: 731597 - RNA, 18 nt, Human
caggcacccaccaucgca

SEQ ID NO: 731598 - RNA, 22 nt, Human
caggcucaccccacggggaccu

SEQ ID NO: 731599 - RNA, 18 nt, Human
cagggcccucuguccccu

SEQ ID NO: 731600 - RNA, 24 nt, Human
caggguuucaucauguuggccagg

SEQ ID NO: 731601 - RNA, 27 nt, Human
caucaaacucaaacauaggggcccgca

SEQ ID NO: 731602 - RNA, 24 nt, Human
caucauguuggccaggcuggucuc

SEQ ID NO: 731603 - RNA, 27 nt, Human
caucauguuggccaggcuggucucgaa

SEQ ID NO: 731604 - RNA, 20 nt, Human
caugggcuccaggcuccuuc

SEQ ID NO: 731605 - RNA, 21 nt, Human
cauguccugcaccccagcagg

SEQ ID NO: 731606 - RNA, 18 nt, Human
cauguuggccaggcuggu

SEQ ID NO: 731607 - RNA, 24 nt, Human
cauguuggccaggcuggucucgaa

SEQ ID NO: 731608 - RNA, 22 nt, Human
ccaaagugcugcgauuagaggc

SEQ ID NO: 731609 - RNA, 24 nt, Human
ccaaagugcugcgauuagaggcgu

SEQ ID NO: 731610 - RNA, 19 nt, Human
ccaaauggaaagccaguga

SEQ ID NO: 731611 - RNA, 20 nt, Human
ccacuguacuccagccuggg

SEQ ID NO: 731612 - RNA, 20 nt, Human
ccacuguacuccagccuggg

SEQ ID NO: 731613 - RNA, 21 nt, Human
ccacuguacuccagccugggu

SEQ ID NO: 731614 - RNA, 21 nt, Human
ccacuguacuccagccugggu

SEQ ID NO: 731615 - RNA, 24 nt, Human
ccacuguacuccagccugggugac

SEQ ID NO: 731616 - RNA, 27 nt, Human
ccagaccacaaucuucaaagaggccuc

SEQ ID NO: 731617 - RNA, 19 nt, Human
ccaggcuccuucugccagg

SEQ ID NO: 731618 - RNA, 19 nt, Human
cccacagguaggagggcag

SEQ ID NO: 731619 - RNA, 24 nt, Human
cccaggcaaagcguagaagcagac

SEQ ID NO: 731620 - RNA, 19 nt, Human
cccaggcuggagugcaaug

SEQ ID NO: 731621 - RNA, 19 nt, Human
ccccagcaugggagccuca

SEQ ID NO: 731622 - RNA, 26 nt, Human
ccccgccaccuccagggcauuuucua

SEQ ID NO: 731623 - RNA, 20 nt, Human
ccccgcgggcgccgcuccuc

SEQ ID NO: 731624 - RNA, 19 nt, Human
ccccggcgccuucacaaca

SEQ ID NO: 731625 - RNA, 21 nt, Human
cccugggguugcggggagcuc

SEQ ID NO: 731626 - RNA, 18 nt, Human
cccuugagugccgugcaa

SEQ ID NO: 731627 - RNA, 18 nt, Human
ccgccgguccagggccuc

SEQ ID NO: 731628 - RNA, 18 nt, Human
ccggcagccacauuacca

SEQ ID NO: 731629 - RNA, 22 nt, Human
ccucagaggcuguuuucacacu

SEQ ID NO: 731630 - RNA, 27 nt, Human
ccucaggccuccugcgcccucgggggu

SEQ ID NO: 731631 - RNA, 25 nt, Human
ccucucccaggcaaagcguagaagc

SEQ ID NO: 731632 - RNA, 19 nt, Human
ccugaguaucugggauuac

SEQ ID NO: 731633 - RNA, 23 nt, Human
ccugaguaucugggauuacaggc

SEQ ID NO: 731634 - RNA, 24 nt, Human
ccugaguaucugggauuacaggca

SEQ ID NO: 731635 - RNA, 23 nt, Human
ccuuaugccagaccacaaucuuc

SEQ ID NO: 731636 - RNA, 24 nt, Human
ccuuggguuuugccucuuggugcc

SEQ ID NO: 731637 - RNA, 18 nt, Human
cgacaaaccgagaaagcc

SEQ ID NO: 731638 - RNA, 21 nt, Human
cgagagccugaugcagucucc

SEQ ID NO: 731639 - RNA, 21 nt, Human
cgccacguaacccaaaccauc

SEQ ID NO: 731640 - RNA, 21 nt, Human
cgccaggaacgaggccaccag

SEQ ID NO: 731641 - RNA, 27 nt, Human
cgccaggaacgaggccaccagggccuc

SEQ ID NO: 731642 - RNA, 18 nt, Human
cgccgcaggcauagcgcu

SEQ ID NO: 731643 - RNA, 19 nt, Human
cggaacaguuuccaaccga

SEQ ID NO: 731644 - RNA, 24 nt, Human
cggaaucuugcccuguugcccagg

SEQ ID NO: 731645 - RNA, 20 nt, Human
cggcggcagcaagcagagcu

SEQ ID NO: 731646 - RNA, 25 nt, Human
cgguaucaacuuaccaccacagcag

SEQ ID NO: 731647 - RNA, 20 nt, Human
cggugggcucugagggagga

SEQ ID NO: 731648 - RNA, 23 nt, Human
cucacaaaucaacaacuccccgc

SEQ ID NO: 731649 - RNA, 23 nt, Human
cucacugcaaccuccaucuccgg

SEQ ID NO: 731650 - RNA, 25 nt, Human
cucagaguccaaaaaagaaaaggaa

SEQ ID NO: 731651 - RNA, 23 nt, Human
cuccgggguucaaacaauucucc

SEQ ID NO: 731652 - RNA, 24 nt, Human
cuccuggccuugugauccgccagc

SEQ ID NO: 731653 - RNA, 19 nt, Human
cucuuggugcccggcugug

SEQ ID NO: 731654 - RNA, 23 nt, Human
cugaguaucugggauuacaggca

SEQ ID NO: 731655 - RNA, 24 nt, Human
cugcaaccuccaucuccgggguuc

SEQ ID NO: 731656 - RNA, 23 nt, Human
cugccucagccuccugaguaucu

SEQ ID NO: 731657 - RNA, 20 nt, Human
cugcugccucccaaagugcu

SEQ ID NO: 731658 - RNA, 18 nt, Human
cuguggccucaugcccag

SEQ ID NO: 731659 - RNA, 24 nt, Human
cuugcccuguugcccaggcuggag

SEQ ID NO: 731660 - RNA, 20 nt, Human
cuuguuuacuucuuccaaca

SEQ ID NO: 731661 - RNA, 22 nt, Human
gaaaccgacuugggcauggaga

SEQ ID NO: 731662 - RNA, 19 nt, Human
gaaacuggaggaaauacuu

SEQ ID NO: 731663 - RNA, 19 nt, Human
gacacacaccacgcgcccc

SEQ ID NO: 731664 - RNA, 23 nt, Human
gacagagcaagacugucucaaaa

SEQ ID NO: 731665 - RNA, 21 nt, Human
gaccucagaacagccugccuc

SEQ ID NO: 731666 - RNA, 18 nt, Human
gacucaggaccacuggcg

SEQ ID NO: 731667 - RNA, 22 nt, Human
gacuguggcccuuuucaaggug

SEQ ID NO: 731668 - RNA, 18 nt, Human
gagacucaggaccacugg

SEQ ID NO: 731669 - RNA, 20 nt, Human
gagagugggacagggugggc

SEQ ID NO: 731670 - RNA, 21 nt, Human
gagagugggacagggugggcg

SEQ ID NO: 731671 - RNA, 23 nt, Human
gagccaccacacccagucuucua

SEQ ID NO: 731672 - RNA, 20 nt, Human
gagcucaccggauuugggac

SEQ ID NO: 731673 - RNA, 18 nt, Human
gaggcugcagugagccaa

SEQ ID NO: 731674 - RNA, 18 nt, Human
gagggauccgagagugga

SEQ ID NO: 731675 - RNA, 21 nt, Human
gaggugggaggaucauuugag

SEQ ID NO: 731676 - RNA, 18 nt, Human
gagugaggauccagcagc

SEQ ID NO: 731677 - RNA, 24 nt, Human
gaucauuugagcccaggaagucga

SEQ ID NO: 731678 - RNA, 18 nt, Human
gauuagaggcgugagcca

SEQ ID NO: 731679 - RNA, 24 nt, Human
gauugcuugagccgaggaguucaa

SEQ ID NO: 731680 - RNA, 18 nt, Human
gcaacaguguucucaucu

SEQ ID NO: 731681 - RNA, 22 nt, Human
gcaaccuccaucuccgggguuc

SEQ ID NO: 731682 - RNA, 20 nt, Human
gcacagcgcuggcggaucca

SEQ ID NO: 731683 - RNA, 23 nt, Human
gcacagcgcuggcggauccaggu

SEQ ID NO: 731684 - RNA, 22 nt, Human
gcacuggacccaccucuggcuc

SEQ ID NO: 731685 - RNA, 20 nt, Human
gccacauuaccacccuggga

SEQ ID NO: 731686 - RNA, 19 nt, Human
gccacuguacuccagccug

SEQ ID NO: 731687 - RNA, 24 nt, Human
gccacuguacuccagccuggguga

SEQ ID NO: 731688 - RNA, 24 nt, Human
gcccaggaagucgaggcugcagug

SEQ ID NO: 731689 - RNA, 19 nt, Human
gcccaggcuggagugcaau

SEQ ID NO: 731690 - RNA, 19 nt, Human
gcccuggagcucugggucc

SEQ ID NO: 731691 - RNA, 27 nt, Human
gcccuguugcccaggcuggagugcaau

SEQ ID NO: 731692 - RNA, 22 nt, Human
gccgcagcagggacuccgggcg

SEQ ID NO: 731693 - RNA, 18 nt, Human
gccgcggagacagcucgg

SEQ ID NO: 731694 - RNA, 27 nt, Human
gccuauauucucgacacuacaggaggc

SEQ ID NO: 731695 - RNA, 20 nt, Human
gccugccucauacucagagu

SEQ ID NO: 731696 - RNA, 22 nt, Human
gcggcggcagcaagcagagcuc

SEQ ID NO: 731697 - RNA, 18 nt, Human
gcuccaggcuccuucugc

SEQ ID NO: 731698 - RNA, 19 nt, Human
gcuggagugcaauggcacg

SEQ ID NO: 731699 - RNA, 22 nt, Human
gcuggugugggaagccgagggc

SEQ ID NO: 731700 - RNA, 19 nt, Human
ggaagggauaggagggcag

SEQ ID NO: 731701 - RNA, 23 nt, Human
ggauugcuugagccgaggaguuc

SEQ ID NO: 731702 - RNA, 21 nt, Human
ggccuccguggucauagcccu

SEQ ID NO: 731703 - RNA, 19 nt, Human
ggcgcgcgguggaggggcc

SEQ ID NO: 731704 - RNA, 18 nt, Human
ggcggcagcaagcagagc

SEQ ID NO: 731705 - RNA, 23 nt, Human
ggcuggucucgaacuccuggccu

SEQ ID NO: 731706 - RNA, 21 nt, Human
gggcagcaugggucaccguga

SEQ ID NO: 731707 - RNA, 20 nt, Human
gggcccucuguccccucccu

SEQ ID NO: 731708 - RNA, 19 nt, Human
gggccugagaggcgcgcgg

SEQ ID NO: 731709 - RNA, 23 nt, Human
gggcgcccgcgggaccggaaaug

SEQ ID NO: 731710 - RNA, 21 nt, Human
gggcuccaggcuccuucugcc

SEQ ID NO: 731711 - RNA, 23 nt, Human
gggguucaaacaauucuccugcc

SEQ ID NO: 731712 - RNA, 22 nt, Human
ggguuucaucauguuggccagg

SEQ ID NO: 731713 - RNA, 23 nt, Human
ggucucgaacuccuggccuugug

SEQ ID NO: 731714 - RNA, 22 nt, Human
guacuccagccugggugacaga

SEQ ID NO: 731715 - RNA, 26 nt, Human
guacuccagccugggugacagacaga

SEQ ID NO: 731716 - RNA, 21 nt, Human
guagagacaggguuucaucau

SEQ ID NO: 731717 - RNA, 22 nt, Human
guagagacaggguuucaucaug

SEQ ID NO: 731718 - RNA, 21 nt, Human
gugacacacaccacgcgcccc

SEQ ID NO: 731719 - RNA, 22 nt, Human
guggacccuggggugucgccca

SEQ ID NO: 731720 - RNA, 23 nt, Human
uaaaaagcugucuuguuggccug

SEQ ID NO: 731721 - RNA, 20 nt, Human
uaaaaugacugucugacuca

SEQ ID NO: 731722 - RNA, 21 nt, Human
uaaaggcagcuacaaagcuga

SEQ ID NO: 731723 - RNA, 23 nt, Human
uaauuuggcugugacguagacug

SEQ ID NO: 731724 - RNA, 24 nt, Human
uaauuuuuguauuuuugguagaga

SEQ ID NO: 731725 - RNA, 24 nt, Human
uacagggaauugggacucucggau

SEQ ID NO: 731726 - RNA, 21 nt, Human
uacuccagccugggugacaga

SEQ ID NO: 731727 - RNA, 26 nt, Human
uacugaaauaggucacaugcaaaaca

SEQ ID NO: 731728 - RNA, 25 nt, Human
uacuuuuaguucuccauaguuuugu

SEQ ID NO: 731729 - RNA, 22 nt, Human
uagaagcagacgcgagagccug

SEQ ID NO: 731730 - RNA, 22 nt, Human
uagacuguugauguaauuuuca

SEQ ID NO: 731731 - RNA, 22 nt, Human
uagagacaggguuucaucaugu

SEQ ID NO: 731732 - RNA, 18 nt, Human
uaggagggcagggugugg

SEQ ID NO: 731733 - RNA, 23 nt, Human
uaguagcccacgccuauauucuc

SEQ ID NO: 731734 - RNA, 24 nt, Human
ucaacacugcagcguccugcccaa

SEQ ID NO: 731735 - RNA, 24 nt, Human
ucaacguaaagaagccgaugaccc

SEQ ID NO: 731736 - RNA, 19 nt, Human
ucacccaggagcgcggcgg

SEQ ID NO: 731737 - RNA, 20 nt, Human
ucacugcaaccuccaucucc

SEQ ID NO: 731738 - RNA, 23 nt, Human
ucacugcaaccuccaucuccggg

SEQ ID NO: 731739 - RNA, 23 nt, Human
ucacugcaaccuccaucuccggg

SEQ ID NO: 731740 - RNA, 26 nt, Human
ucacugcaaccuccaucuccgggguu

SEQ ID NO: 731741 - RNA, 21 nt, Human
ucagaaccaggcgccugcacc

SEQ ID NO: 731742 - RNA, 22 nt, Human
ucagaagccucugccuaacaca

SEQ ID NO: 731743 - RNA, 22 nt, Human
ucagcaaggacggcgcccaggu

SEQ ID NO: 731744 - RNA, 23 nt, Human
ucaugccacuguacuccagccug

SEQ ID NO: 731745 - RNA, 19 nt, Human
uccaaaaaagaaaaggaac

SEQ ID NO: 731746 - RNA, 24 nt, Human
uccacaaacagaaaauccaaacag

SEQ ID NO: 731747 - RNA, 18 nt, Human
uccagccugggugacaga

SEQ ID NO: 731748 - RNA, 20 nt, Human
uccaggcuccuucugccagg

SEQ ID NO: 731749 - RNA, 19 nt, Human
uccauaguuuuguuuggua

SEQ ID NO: 731750 - RNA, 24 nt, Human
uccaucaucauggcagacuuuuuu

SEQ ID NO: 731751 - RNA, 24 nt, Human
ucccaaagugcugcgauuagaggc

SEQ ID NO: 731752 - RNA, 19 nt, Human
ucccaggugagaagccaaa

SEQ ID NO: 731753 - RNA, 21 nt, Human
uccgggguucaaacaauucuc

SEQ ID NO: 731754 - RNA, 24 nt, Human
uccgggguucaaacaauucuccug

SEQ ID NO: 731755 - RNA, 19 nt, Human
uccuccacacacaggucag

SEQ ID NO: 731756 - RNA, 23 nt, Human
uccucccaaguuaaacacgagag

SEQ ID NO: 731757 - RNA, 24 nt, Human
uccugaguaucugggauuacaggc

SEQ ID NO: 731758 - RNA, 19 nt, Human
ucgcagcgcagugagcaca

SEQ ID NO: 731759 - RNA, 24 nt, Human
ucgcugccccgcgggcgccgcucc

SEQ ID NO: 731760 - RNA, 18 nt, Human
ucucaaaaaaauaaaaag

SEQ ID NO: 731761 - RNA, 24 nt, Human
ucuccgccgcaggcauagcgcuag

SEQ ID NO: 731762 - RNA, 18 nt, Human
ucuccugccucagccucc

SEQ ID NO: 731763 - RNA, 19 nt, Human
ucugagugaucacccagga

SEQ ID NO: 731764 - RNA, 20 nt, Human
ucugccgccgguccagggcc

SEQ ID NO: 731765 - RNA, 23 nt, Human
ucuugcccuguugcccaggcugg

SEQ ID NO: 731766 - RNA, 24 nt, Human
ucuugcccuguugcccaggcugga

SEQ ID NO: 731767 - RNA, 23 nt, Human
ugaagcagguguaguagcccacg

SEQ ID NO: 731768 - RNA, 24 nt, Human
ugaagugaccaugggugccaaagg

SEQ ID NO: 731769 - RNA, 20 nt, Human
ugacccaauucgggaggugg

SEQ ID NO: 731770 - RNA, 24 nt, Human
ugaggaaagcagaaaaaaagaaau

SEQ ID NO: 731771 - RNA, 19 nt, Human
ugagggagagggaggggac

SEQ ID NO: 731772 - RNA, 22 nt, Human
ugaggguggaggggagggcacc

SEQ ID NO: 731773 - RNA, 23 nt, Human
ugaggugggaggaucauuugagc

SEQ ID NO: 731774 - RNA, 24 nt, Human
ugaggugggaggaucauuugagcc

SEQ ID NO: 731775 - RNA, 20 nt, Human
ugaguaggaaggauugcuuc

SEQ ID NO: 731776 - RNA, 21 nt, Human
ugcaaugcugcagcuugaggc

SEQ ID NO: 731777 - RNA, 18 nt, Human
ugcccaggcuggagugca

SEQ ID NO: 731778 - RNA, 21 nt, Human
ugcccaggcuggagugcaaug

SEQ ID NO: 731779 - RNA, 24 nt, Human
ugcccaggcuggagugcaauggca

SEQ ID NO: 731780 - RNA, 24 nt, Human
ugcccuguugcccaggcuggagug

SEQ ID NO: 731781 - RNA, 25 nt, Human
ugcccuguugcccaggcuggagugc

SEQ ID NO: 731782 - RNA, 24 nt, Human
ugccucagccuccugaguaucugg

SEQ ID NO: 731783 - RNA, 18 nt, Human
ugccucauacucagaguc

SEQ ID NO: 731784 - RNA, 23 nt, Human
ugccugugguuccagccacaugg

SEQ ID NO: 731785 - RNA, 24 nt, Human
ugccugugguuccagccacauggg

SEQ ID NO: 731786 - RNA, 24 nt, Human
ugcgauuagaggcgugagccacca

SEQ ID NO: 731787 - RNA, 21 nt, Human
ugcucagaaccaggcgccugc

SEQ ID NO: 731788 - RNA, 22 nt, Human
ugcucuguggccucaugcccag

SEQ ID NO: 731789 - RNA, 26 nt, Human
uggaaaacaacaaaaaaggacugcca

SEQ ID NO: 731790 - RNA, 19 nt, Human
uggaggaaauacuucagag

SEQ ID NO: 731791 - RNA, 23 nt, Human
uggagugcaauggcacgaucuug

SEQ ID NO: 731792 - RNA, 24 nt, Human
uggagugcaauggcacgaucuugg

SEQ ID NO: 731793 - RNA, 20 nt, Human
uggcagcuccuugugagggu

SEQ ID NO: 731794 - RNA, 24 nt, Human
uggccaggcuggucucgaacuccu

SEQ ID NO: 731795 - RNA, 21 nt, Human
ugggacaaggauuuuaaaggc

SEQ ID NO: 731796 - RNA, 18 nt, Human
ugggaggcugagguggga

SEQ ID NO: 731797 - RNA, 19 nt, Human
ugggaggcugaggugggag

SEQ ID NO: 731798 - RNA, 24 nt, Human
ugggaggcugaggugggaggauca

SEQ ID NO: 731799 - RNA, 19 nt, Human
ugggauuacaggcacccac

SEQ ID NO: 731800 - RNA, 21 nt, Human
ugggauuacaggcacccacca

SEQ ID NO: 731801 - RNA, 21 nt, Human
ugggauuacaggcacccacca

SEQ ID NO: 731802 - RNA, 22 nt, Human
ugggauuacaggcacccaccau

SEQ ID NO: 731803 - RNA, 18 nt, Human
ugggcgcgugacacacac

SEQ ID NO: 731804 - RNA, 18 nt, Human
uggggaaccggacaggug

SEQ ID NO: 731805 - RNA, 25 nt, Human
uggggagaaguucugagugcccacc

SEQ ID NO: 731806 - RNA, 19 nt, Human
ugggucagguggggagaag

SEQ ID NO: 731807 - RNA, 24 nt, Human
ugguagagacaggguuucaucaug

SEQ ID NO: 731808 - RNA, 19 nt, Human
uggucuggucucuacucca

SEQ ID NO: 731809 - RNA, 24 nt, Human
ugguggcacgugccugugguucca

SEQ ID NO: 731810 - RNA, 18 nt, Human
uggugugggaagccgagg

SEQ ID NO: 731811 - RNA, 21 nt, Human
ugucccacuccuguauccuca

SEQ ID NO: 731812 - RNA, 21 nt, Human
uguccucacaaaucaacaacu

SEQ ID NO: 731813 - RNA, 20 nt, Human
ugugcggcuggaaauuccaa

SEQ ID NO: 731814 - RNA, 19 nt, Human
ugugcugggaaugccauga

SEQ ID NO: 731815 - RNA, 20 nt, Human
uguugcccaggcuggagugc

SEQ ID NO: 731816 - RNA, 22 nt, Human
uguugcccaggcuggagugcaa

SEQ ID NO: 731817 - RNA, 26 nt, Human
uguuugguauaaaggaaauauaauuu

SEQ ID NO: 731818 - RNA, 24 nt, Human
uucaaacaauucuccugccucagc

SEQ ID NO: 731819 - RNA, 21 nt, Human
uucaaucuguccucacaaauc

SEQ ID NO: 731820 - RNA, 21 nt, Human
uuccuagaagcucaccuguga

SEQ ID NO: 731821 - RNA, 22 nt, Human
uugagccgaggaguucaagacc

SEQ ID NO: 731822 - RNA, 18 nt, Human
uugcccaggcuggagugc

SEQ ID NO: 731823 - RNA, 24 nt, Human
uugcccuguugcccaggcuggagu

SEQ ID NO: 731824 - RNA, 23 nt, Human
uugcucuguuucugaaugauuuu

SEQ ID NO: 731825 - RNA, 23 nt, Human
uugcuugagccgaggaguucaag

SEQ ID NO: 731826 - RNA, 24 nt, Human
uugguagagacaggguuucaucau

SEQ ID NO: 731827 - RNA, 19 nt, Human
uuggugcccggcugugcug

SEQ ID NO: 731828 - RNA, 23 nt, Human
uuggugcccggcugugcugggaa

SEQ ID NO: 731829 - RNA, 23 nt, Human
uugugcaacaguguucucaucuu

SEQ ID NO: 731830 - RNA, 24 nt, Human
uuucaucauguuggccaggcuggu

SEQ ID NO: 731831 - RNA, 24 nt, Human
uuugccucuuggugcccggcugug

SEQ ID NO: 731832 - RNA, 18 nt, Human
uuuguauuucccagguga

SEQ ID NO: 731833 - RNA, 22 nt, Human
uuuuugguagagacaggguuuc

SEQ ID NO: 731834 - RNA, 23 nt, Human
uuuuugguagagacaggguuuca

SEQ ID NO: 731835 - RNA, 20 nt, Human
uuuuuguauuuuugguagag

SEQ ID NO: 731836 - RNA, 21 nt, Human
aaacacgauggugaacagacc

SEQ ID NO: 731837 - RNA, 24 nt, Human
aaacacgauggugaacagaccagg

SEQ ID NO: 731838 - RNA, 23 nt, Human
aaagcaaacagaggaggcggccc

SEQ ID NO: 731839 - RNA, 21 nt, Human
aacagaaauguacaacauggg

SEQ ID NO: 731840 - RNA, 21 nt, Human
aacccgcucauaagcuucgaa

SEQ ID NO: 731841 - RNA, 22 nt, Human
aaccuuguguuuuccccaugug

SEQ ID NO: 731842 - RNA, 23 nt, Human
aagacuccuucuauccagggcac

SEQ ID NO: 731843 - RNA, 20 nt, Human
aagcaguugccuguuuggga

SEQ ID NO: 731844 - RNA, 23 nt, Human
aagucugccugcaggacccugcc

SEQ ID NO: 731845 - RNA, 18 nt, Human
aaucuuucuagcagcucc

SEQ ID NO: 731846 - RNA, 19 nt, Human
acaagccaugagccaaggc

SEQ ID NO: 731847 - RNA, 21 nt, Human
acagaggaggcggcccuggag

SEQ ID NO: 731848 - RNA, 25 nt, Human
acagcaaaaaauaaaaauaacaaaa

SEQ ID NO: 731849 - RNA, 23 nt, Human
acaggcaacaaccaggggauaug

SEQ ID NO: 731850 - RNA, 21 nt, Human
acauggaccuuggacaucccu

SEQ ID NO: 731851 - RNA, 19 nt, Human
accaggcacaggcaacaac

SEQ ID NO: 731852 - RNA, 19 nt, Human
accugcuggugucucccuc

SEQ ID NO: 731853 - RNA, 22 nt, Human
accuugugcuagucacaucaug

SEQ ID NO: 731854 - RNA, 18 nt, Human
accuuguguuuuccccau

SEQ ID NO: 731855 - RNA, 22 nt, Human
accuuguguuuuccccaugugg

SEQ ID NO: 731856 - RNA, 25 nt, Human
acuaugcugaagaggcccaagggca

SEQ ID NO: 731857 - RNA, 20 nt, Human
acuguuggggccaguugggg

SEQ ID NO: 731858 - RNA, 21 nt, Human
agaaaagaguuggugggcagg

SEQ ID NO: 731859 - RNA, 21 nt, Human
agacacaggcacccccaaucu

SEQ ID NO: 731860 - RNA, 18 nt, Human
agagagagagaagcugga

SEQ ID NO: 731861 - RNA, 21 nt, Human
agagggcagggaaggaucugg

SEQ ID NO: 731862 - RNA, 21 nt, Human
agcaaaaaauaaaaauaacaa

SEQ ID NO: 731863 - RNA, 27 nt, Human
agcaaggagagcagcaaaaccacucgg

SEQ ID NO: 731864 - RNA, 21 nt, Human
agccuaaugaagccugcagcc

SEQ ID NO: 731865 - RNA, 18 nt, Human
agcugcagagucgaagga

SEQ ID NO: 731866 - RNA, 21 nt, Human
aggcaacuccaugcgcugccu

SEQ ID NO: 731867 - RNA, 19 nt, Human
agggaacuguuggggccag

SEQ ID NO: 731868 - RNA, 21 nt, Human
agguggggcauccccggcccg

SEQ ID NO: 731869 - RNA, 24 nt, Human
aguggagcugggggccugcccccu

SEQ ID NO: 731870 - RNA, 22 nt, Human
auggggcuuaaauaacuuucau

SEQ ID NO: 731871 - RNA, 23 nt, Human
caaaauaauaaauaacugaagua

SEQ ID NO: 731872 - RNA, 19 nt, Human
caaagcaaacagaggaggc

SEQ ID NO: 731873 - RNA, 24 nt, Human
caaaggcuugggugugccaggcuc

SEQ ID NO: 731874 - RNA, 21 nt, Human
caagaucaugagugcugggga

SEQ ID NO: 731875 - RNA, 19 nt, Human
cacauaccacagguccggg

SEQ ID NO: 731876 - RNA, 21 nt, Human
caccucccagcagacacagcc

SEQ ID NO: 731877 - RNA, 21 nt, Human
cacucugaccaccucaaaggc

SEQ ID NO: 731878 - RNA, 20 nt, Human
cacugaccaggaggcuaugc

SEQ ID NO: 731879 - RNA, 26 nt, Human
cagaaaaugggcaugaugaugagcac

SEQ ID NO: 731880 - RNA, 21 nt, Human
cagaccaggcacaggcaacaa

SEQ ID NO: 731881 - RNA, 29 nt, Human
cagcagacacagcccccacgcugcuuccu

SEQ ID NO: 731882 - RNA, 20 nt, Human
cagcccccacgcugcuuccu

SEQ ID NO: 731883 - RNA, 22 nt, Human
cagcggacucccuuugggauuu

SEQ ID NO: 731884 - RNA, 19 nt, Human
caggacagcagagcuggcc

SEQ ID NO: 731885 - RNA, 18 nt, Human
caggcacaugagaaaguc

SEQ ID NO: 731886 - RNA, 24 nt, Human
caggcacccccaaucucacuuugg

SEQ ID NO: 731887 - RNA, 22 nt, Human
caggccccggaacggaggaagg

SEQ ID NO: 731888 - RNA, 20 nt, Human
cagggcccuggcacaggacu

SEQ ID NO: 731889 - RNA, 25 nt, Human
caggggauaugccugcucccagccc

SEQ ID NO: 731890 - RNA, 27 nt, Human
cagggugaggccacucccagacccacc

SEQ ID NO: 731891 - RNA, 22 nt, Human
cagugcagucaccccagguggg

SEQ ID NO: 731892 - RNA, 19 nt, Human
cauacacuauguacagcca

SEQ ID NO: 731893 - RNA, 21 nt, Human
ccacacaaacacgauggugaa

SEQ ID NO: 731894 - RNA, 22 nt, Human
ccaccacaucaggcacaugaga

SEQ ID NO: 731895 - RNA, 23 nt, Human
ccaccucccagcagacacagccc

SEQ ID NO: 731896 - RNA, 24 nt, Human
ccacgcugcuuccuacguggccca

SEQ ID NO: 731897 - RNA, 24 nt, Human
ccagacccaccgcugucccuuccc

SEQ ID NO: 731898 - RNA, 18 nt, Human
ccaggcacaggcaacaac

SEQ ID NO: 731899 - RNA, 23 nt, Human
ccagucuuaagaugggcacagaa

SEQ ID NO: 731900 - RNA, 20 nt, Human
cccaccgcugucccuuccca

SEQ ID NO: 731901 - RNA, 25 nt, Human
cccagaauuaggacaagccaugagc

SEQ ID NO: 731902 - RNA, 19 nt, Human
cccagacaggcagcagggc

SEQ ID NO: 731903 - RNA, 22 nt, Human
cccagacccaccgcugucccuu

SEQ ID NO: 731904 - RNA, 24 nt, Human
cccagagcugagagcuagcagggc

SEQ ID NO: 731905 - RNA, 18 nt, Human
cccagccgcccacaccug

SEQ ID NO: 731906 - RNA, 18 nt, Human
ccccagggaacuguuggg

SEQ ID NO: 731907 - RNA, 23 nt, Human
ccccagggaacuguuggggccag

SEQ ID NO: 731908 - RNA, 24 nt, Human
ccccagguggggcauccccggccc

SEQ ID NO: 731909 - RNA, 20 nt, Human
ccccauccaagccaccuccc

SEQ ID NO: 731910 - RNA, 25 nt, Human
cccccuaacauggaccuuggacauc

SEQ ID NO: 731911 - RNA, 21 nt, Human
cccccugucccagacacaggc

SEQ ID NO: 731912 - RNA, 18 nt, Human
ccccggggccugggcugu

SEQ ID NO: 731913 - RNA, 22 nt, Human
ccccggggccugggcugugggg

SEQ ID NO: 731914 - RNA, 19 nt, Human
cccugaaagagugggcaga

SEQ ID NO: 731915 - RNA, 21 nt, Human
cccuggcacaggacuaugcug

SEQ ID NO: 731916 - RNA, 20 nt, Human
ccuagaggccagggguagcu

SEQ ID NO: 731917 - RNA, 19 nt, Human
ccuccagucuuaagauggg

SEQ ID NO: 731918 - RNA, 20 nt, Human
ccucccagcagacacagccc

SEQ ID NO: 731919 - RNA, 19 nt, Human
ccugcaaggcccucaggac

SEQ ID NO: 731920 - RNA, 23 nt, Human
ccugcagggcaggcuccugucgg

SEQ ID NO: 731921 - RNA, 20 nt, Human
ccugcuggugucucccucca

SEQ ID NO: 731922 - RNA, 18 nt, Human
cgggggcgcugggcacaa

SEQ ID NO: 731923 - RNA, 21 nt, Human
cucgcagggccauaagaucac

SEQ ID NO: 731924 - RNA, 20 nt, Human
cugaccaucuccccaaagga

SEQ ID NO: 731925 - RNA, 25 nt, Human
cuggcacaggacuaugcugaagagg

SEQ ID NO: 731926 - RNA, 21 nt, Human
cuggcccccaagagcugaggg

SEQ ID NO: 731927 - RNA, 18 nt, Human
cuguccuccccauccaag

SEQ ID NO: 731928 - RNA, 21 nt, Human
gacaagccaugagccaaggcc

SEQ ID NO: 731929 - RNA, 18 nt, Human
gacacauaccacaggucc

SEQ ID NO: 731930 - RNA, 18 nt, Human
gagcgcccccgccuuccc

SEQ ID NO: 731931 - RNA, 19 nt, Human
gaggccacucccagaccca

SEQ ID NO: 731932 - RNA, 18 nt, Human
gagugagaagacacaugu

SEQ ID NO: 731933 - RNA, 26 nt, Human
gcaaagcaaacagaggaggcggcccu

SEQ ID NO: 731934 - RNA, 22 nt, Human
gcagagcuggccccgccgugag

SEQ ID NO: 731935 - RNA, 21 nt, Human
gcagggcaggcucugcccaca

SEQ ID NO: 731936 - RNA, 20 nt, Human
gcaggggacagaacaaaggu

SEQ ID NO: 731937 - RNA, 18 nt, Human
gccaggacagcagagcug

SEQ ID NO: 731938 - RNA, 20 nt, Human
gccuguuugggauggcaaag

SEQ ID NO: 731939 - RNA, 18 nt, Human
gcucacuagggcuaggac

SEQ ID NO: 731940 - RNA, 18 nt, Human
gcucccagcccagaccac

SEQ ID NO: 731941 - RNA, 19 nt, Human
gcugccuuugagaguucug

SEQ ID NO: 731942 - RNA, 20 nt, Human
gcugccuuugagaguucugg

SEQ ID NO: 731943 - RNA, 24 nt, Human
ggaaucuuucuagcagcuccaccu

SEQ ID NO: 731944 - RNA, 22 nt, Human
ggacagagccaacgugggggga

SEQ ID NO: 731945 - RNA, 18 nt, Human
ggacagggcccuggcaca

SEQ ID NO: 731946 - RNA, 22 nt, Human
ggacuguggggcagaaccccgg

SEQ ID NO: 731947 - RNA, 20 nt, Human
ggagaggagggccaggccca

SEQ ID NO: 731948 - RNA, 25 nt, Human
ggaggacagcaggagccuaaugaag

SEQ ID NO: 731949 - RNA, 24 nt, Human
ggcaacaaccaggggauaugccug

SEQ ID NO: 731950 - RNA, 19 nt, Human
ggcccgggggugggagcuc

SEQ ID NO: 731951 - RNA, 21 nt, Human
ggccggggcagcggacucccu

SEQ ID NO: 731952 - RNA, 23 nt, Human
ggccuagaggccagggguagcua

SEQ ID NO: 731953 - RNA, 22 nt, Human
ggccugggcuguggggugagcg

SEQ ID NO: 731954 - RNA, 19 nt, Human
ggcugaagguggcacucug

SEQ ID NO: 731955 - RNA, 19 nt, Human
gggaagaaacuucaagucc

SEQ ID NO: 731956 - RNA, 18 nt, Human
gggaaucaguccaagcuc

SEQ ID NO: 731957 - RNA, 18 nt, Human
gggauaugccugcuccca

SEQ ID NO: 731958 - RNA, 18 nt, Human
gggcagggaaggaucugg

SEQ ID NO: 731959 - RNA, 20 nt, Human
gggcauggcugguguaaggc

SEQ ID NO: 731960 - RNA, 20 nt, Human
gggcugaagguggcacucug

SEQ ID NO: 731961 - RNA, 20 nt, Human
gggcuggggaggggcggggg

SEQ ID NO: 731962 - RNA, 21 nt, Human
gggcuggggaggggcgggggu

SEQ ID NO: 731963 - RNA, 18 nt, Human
ggggcuuaaauaacuuuc

SEQ ID NO: 731964 - RNA, 19 nt, Human
gucaagucugccugcagga

SEQ ID NO: 731965 - RNA, 24 nt, Human
gucaggagaggagggccaggccca

SEQ ID NO: 731966 - RNA, 20 nt, Human
gugagaagacacauguggug

SEQ ID NO: 731967 - RNA, 22 nt, Human
gugcagucaccccagguggggc

SEQ ID NO: 731968 - RNA, 19 nt, Human
guggggggauccucccggg

SEQ ID NO: 731969 - RNA, 18 nt, Human
gugucucccuccaccaca

SEQ ID NO: 731970 - RNA, 22 nt, Human
uaaauaacuuucauacacuaug

SEQ ID NO: 731971 - RNA, 22 nt, Human
uaacaaaauaauaaauaacuga

SEQ ID NO: 731972 - RNA, 22 nt, Human
uaggaacagaaauguacaacau

SEQ ID NO: 731973 - RNA, 18 nt, Human
uaucaaagaagaaacaga

SEQ ID NO: 731974 - RNA, 20 nt, Human
uaucaaagaagaaacagaac

SEQ ID NO: 731975 - RNA, 18 nt, Human
ucaggggucuucucugau

SEQ ID NO: 731976 - RNA, 21 nt, Human
ucaggggucuucucugauccu

SEQ ID NO: 731977 - RNA, 23 nt, Human
ucaugagugcuggggauggggca

SEQ ID NO: 731978 - RNA, 22 nt, Human
uccaacucucaugaagcacaac

SEQ ID NO: 731979 - RNA, 19 nt, Human
uccaagccaccucccagca

SEQ ID NO: 731980 - RNA, 24 nt, Human
uccccgcaaccuuguguuuucccc

SEQ ID NO: 731981 - RNA, 21 nt, Human
ucccuaacgucacugcagcca

SEQ ID NO: 731982 - RNA, 22 nt, Human
ucccuccaccacaucaggcaca

SEQ ID NO: 731983 - RNA, 21 nt, Human
ucccugaaagagugggcagag

SEQ ID NO: 731984 - RNA, 18 nt, Human
ucccugggggcugugucg

SEQ ID NO: 731985 - RNA, 19 nt, Human
ucccugggggcugugucgg

SEQ ID NO: 731986 - RNA, 19 nt, Human
ucucaggggucuucucuga

SEQ ID NO: 731987 - RNA, 20 nt, Human
ucucgcagggccauaagauc

SEQ ID NO: 731988 - RNA, 21 nt, Human
ucucgcagggccauaagauca

SEQ ID NO: 731989 - RNA, 21 nt, Human
ugaagagauuccuaggcugaa

SEQ ID NO: 731990 - RNA, 26 nt, Human
ugaauaaccagagagagagaagcugg

SEQ ID NO: 731991 - RNA, 20 nt, Human
ugacccaucagaaacagcag

SEQ ID NO: 731992 - RNA, 23 nt, Human
ugacccaucagaaacagcagaaa

SEQ ID NO: 731993 - RNA, 23 nt, Human
ugagcaccucucgcagggccaac

SEQ ID NO: 731994 - RNA, 23 nt, Human
ugagugcuggggauggggcaggg

SEQ ID NO: 731995 - RNA, 18 nt, Human
ugaguggagcugggggcc

SEQ ID NO: 731996 - RNA, 20 nt, Human
ugaguggagcugggggccug

SEQ ID NO: 731997 - RNA, 22 nt, Human
ugauaggggcuucaagaucaug

SEQ ID NO: 731998 - RNA, 25 nt, Human
ugcaaaaucuguccuugcacacaag

SEQ ID NO: 731999 - RNA, 22 nt, Human
ugcaaagcaaacagaggaggcg

SEQ ID NO: 732000 - RNA, 21 nt, Human
ugcaggacccugccauugugc

SEQ ID NO: 732001 - RNA, 22 nt, Human
ugccagaggguuaaggguuagc

SEQ ID NO: 732002 - RNA, 20 nt, Human
ugccaggacagcagagcugg

SEQ ID NO: 732003 - RNA, 27 nt, Human
ugcccucugcccaggccacacaucccc

SEQ ID NO: 732004 - RNA, 21 nt, Human
ugccuuugagaguucuggcug

SEQ ID NO: 732005 - RNA, 18 nt, Human
ugggaagaaagucacugc

SEQ ID NO: 732006 - RNA, 20 nt, Human
ugggcagagaauccaacucc

SEQ ID NO: 732007 - RNA, 21 nt, Human
uggggaggggcgggggucagg

SEQ ID NO: 732008 - RNA, 22 nt, Human
uggggaggggcgggggucaggg

SEQ ID NO: 732009 - RNA, 23 nt, Human
uggggaggggcgggggucagggu

SEQ ID NO: 732010 - RNA, 18 nt, Human
uggggauggggcagggga

SEQ ID NO: 732011 - RNA, 24 nt, Human
uggggcaggggacagaacaaaggu

SEQ ID NO: 732012 - RNA, 18 nt, Human
uggggcauccccggcccg

SEQ ID NO: 732013 - RNA, 20 nt, Human
uggggcuuaaauaacuuuca

SEQ ID NO: 732014 - RNA, 20 nt, Human
ugggggacugcagggcuggg

SEQ ID NO: 732015 - RNA, 19 nt, Human
ugggggcugugucggggac

SEQ ID NO: 732016 - RNA, 20 nt, Human
uggugccgcgggcauggcug

SEQ ID NO: 732017 - RNA, 18 nt, Human
uggugggcagggcagggc

SEQ ID NO: 732018 - RNA, 24 nt, Human
uggugggcagggcagggcccugau

SEQ ID NO: 732019 - RNA, 18 nt, Human
ugucaagucugccugcag

SEQ ID NO: 732020 - RNA, 19 nt, Human
ugucaagucugccugcagg

SEQ ID NO: 732021 - RNA, 25 nt, Human
ugucccagacacaggcacccccaau

SEQ ID NO: 732022 - RNA, 27 nt, Human
uguccuccccauccaagccaccuccca

SEQ ID NO: 732023 - RNA, 21 nt, Human
uguggggcagaaccccggggc

SEQ ID NO: 732024 - RNA, 23 nt, Human
uguggggcagaaccccggggccu

SEQ ID NO: 732025 - RNA, 24 nt, Human
uguggggcagaaccccggggccug

SEQ ID NO: 732026 - RNA, 23 nt, Human
uguggggugagcgcccccgccuu

SEQ ID NO: 732027 - RNA, 20 nt, Human
uguuggggccaguuggggcu

SEQ ID NO: 732028 - RNA, 20 nt, Human
uuaaggguuagcugcaaggg

SEQ ID NO: 732029 - RNA, 24 nt, Human
uucaagaucaugagugcuggggau

SEQ ID NO: 732030 - RNA, 20 nt, Human
uuccccaugugguuuugugc

SEQ ID NO: 732031 - RNA, 19 nt, Human
uucccugcaaggcccucag

SEQ ID NO: 732032 - RNA, 21 nt, Human
uucgugcaagaacacgccuug

SEQ ID NO: 732033 - RNA, 23 nt, Human
uucuagcagcuccaccuuggccc

SEQ ID NO: 732034 - RNA, 23 nt, Human
uuucccugcaaaaucuguccuug

SEQ ID NO: 732035 - RNA, 24 nt, Human
aaagagacagggggagcaggugag

SEQ ID NO: 732036 - RNA, 22 nt, Human
aacgccgggaaaacugccuggc

SEQ ID NO: 732037 - RNA, 23 nt, Human
aacugccuggcagggccagccuc

SEQ ID NO: 732038 - RNA, 22 nt, Human
aagaccacuuccugcggaagcc

SEQ ID NO: 732039 - RNA, 21 nt, Human
aagagacagggggagcaggug

SEQ ID NO: 732040 - RNA, 24 nt, Human
aagagucugagacaggcaugggug

SEQ ID NO: 732041 - RNA, 18 nt, Human
aagcagaagagagagagg

SEQ ID NO: 732042 - RNA, 19 nt, Human
aagcagcgaagcccugggg

SEQ ID NO: 732043 - RNA, 18 nt, Human
aagccagcccugagauca

SEQ ID NO: 732044 - RNA, 21 nt, Human
aagccccuccugugggccccg

SEQ ID NO: 732045 - RNA, 19 nt, Human
aaggagggggauaggaggg

SEQ ID NO: 732046 - RNA, 19 nt, Human
aaguagagggguggggggu

SEQ ID NO: 732047 - RNA, 19 nt, Human
accacagccugcaccugcu

SEQ ID NO: 732048 - RNA, 25 nt, Human
acccaagucccagggccucaagcuc

SEQ ID NO: 732049 - RNA, 24 nt, Human
acccuaggccucacugccugaguu

SEQ ID NO: 732050 - RNA, 21 nt, Human
accugccccucacucuucacc

SEQ ID NO: 732051 - RNA, 20 nt, Human
accugggcugcaguucguca

SEQ ID NO: 732052 - RNA, 23 nt, Human
accugggcugcaguucgucaggg

SEQ ID NO: 732053 - RNA, 19 nt, Human
acgcagcacucagcaggcc

SEQ ID NO: 732054 - RNA, 22 nt, Human
acgcuagcaaggaggguucccc

SEQ ID NO: 732055 - RNA, 19 nt, Human
acggaggcagcgugggugg

SEQ ID NO: 732056 - RNA, 21 nt, Human
agacaaaacagaggugucuga

SEQ ID NO: 732057 - RNA, 21 nt, Human
agacagcacccaccgcgcccc

SEQ ID NO: 732058 - RNA, 22 nt, Human
agacagcacccaccgcgccccc

SEQ ID NO: 732059 - RNA, 23 nt, Human
agacagcacccaccgcgccccca

SEQ ID NO: 732060 - RNA, 24 nt, Human
agacuggagccggugccaggggga

SEQ ID NO: 732061 - RNA, 25 nt, Human
agagagaaggagggggauaggaggg

SEQ ID NO: 732062 - RNA, 18 nt, Human
agaggagcagaggcccgg

SEQ ID NO: 732063 - RNA, 18 nt, Human
agagggaggcagggagag

SEQ ID NO: 732064 - RNA, 21 nt, Human
agauagaggagcagaggcccg

SEQ ID NO: 732065 - RNA, 21 nt, Human
agauggccagcacuugaauca

SEQ ID NO: 732066 - RNA, 23 nt, Human
agcaccuggccacagccaaucuu

SEQ ID NO: 732067 - RNA, 21 nt, Human
agccaggcccccacagcagcc

SEQ ID NO: 732068 - RNA, 24 nt, Human
agccccuguccugcccucucccau

SEQ ID NO: 732069 - RNA, 21 nt, Human
agcccgaagguugggguugga

SEQ ID NO: 732070 - RNA, 21 nt, Human
agccuggucuagugggaggcc

SEQ ID NO: 732071 - RNA, 21 nt, Human
agcgaagcccuggggcccagg

SEQ ID NO: 732072 - RNA, 19 nt, Human
agcugcagccagcaggacc

SEQ ID NO: 732073 - RNA, 25 nt, Human
aggaaagcuuggucaggggggucug

SEQ ID NO: 732074 - RNA, 20 nt, Human
aggacccagcacuggggaca

SEQ ID NO: 732075 - RNA, 22 nt, Human
aggagcgccgcacaaaaccagg

SEQ ID NO: 732076 - RNA, 19 nt, Human
aggaggggcacaguggggg

SEQ ID NO: 732077 - RNA, 22 nt, Human
aggaggugaguuuggggaagcg

SEQ ID NO: 732078 - RNA, 27 nt, Human
aggagucggaucagggugguguccccc

SEQ ID NO: 732079 - RNA, 26 nt, Human
aggcagccccagggaggccggaaggg

SEQ ID NO: 732080 - RNA, 19 nt, Human
aggcaggaguagcuggucc

SEQ ID NO: 732081 - RNA, 18 nt, Human
aggccucacugccugagu

SEQ ID NO: 732082 - RNA, 19 nt, Human
aggcggccacagcaguggc

SEQ ID NO: 732083 - RNA, 21 nt, Human
aggcggccacccagcugaacc

SEQ ID NO: 732084 - RNA, 22 nt, Human
aggcuguggcucagucugcggg

SEQ ID NO: 732085 - RNA, 24 nt, Human
agggagcccaaugaucuccaccuc

SEQ ID NO: 732086 - RNA, 23 nt, Human
agggagggaggcagugguccagg

SEQ ID NO: 732087 - RNA, 24 nt, Human
agggaggggaggggaggagaggcc

SEQ ID NO: 732088 - RNA, 19 nt, Human
agggaggugggaaugggaa

SEQ ID NO: 732089 - RNA, 25 nt, Human
aggggcaggagggaggcaggggcgg

SEQ ID NO: 732090 - RNA, 21 nt, Human
aggggcccagcaugucaggcc

SEQ ID NO: 732091 - RNA, 18 nt, Human
agggggagggagggaggc

SEQ ID NO: 732092 - RNA, 21 nt, Human
agggggauaggaggggcacag

SEQ ID NO: 732093 - RNA, 18 nt, Human
agggguggaggcugcaag

SEQ ID NO: 732094 - RNA, 22 nt, Human
agguggcaggucugggcgggca

SEQ ID NO: 732095 - RNA, 21 nt, Human
agguggcccaggguccggggc

SEQ ID NO: 732096 - RNA, 20 nt, Human
augauggcugguggcagggg

SEQ ID NO: 732097 - RNA, 22 nt, Human
augguuggcaaggacagggagg

SEQ ID NO: 732098 - RNA, 20 nt, Human
caaaacagaggugucugaga

SEQ ID NO: 732099 - RNA, 19 nt, Human
caaaaccagggcccccugc

SEQ ID NO: 732100 - RNA, 22 nt, Human
caaacacccagcccagacccag

SEQ ID NO: 732101 - RNA, 24 nt, Human
caagaccaaagagacagggggagc

SEQ ID NO: 732102 - RNA, 22 nt, Human
caagcucagacaggagggcugg

SEQ ID NO: 732103 - RNA, 21 nt, Human
caagucccagggccucaagcu

SEQ ID NO: 732104 - RNA, 24 nt, Human
cacagcagccccucuugagauaga

SEQ ID NO: 732105 - RNA, 20 nt, Human
cacagucccggccccagacc

SEQ ID NO: 732106 - RNA, 22 nt, Human
caccaggaaguagagggguggg

SEQ ID NO: 732107 - RNA, 21 nt, Human
caccagggaaaggcagcccca

SEQ ID NO: 732108 - RNA, 21 nt, Human
caccccccugcaggggcgccu

SEQ ID NO: 732109 - RNA, 23 nt, Human
cacccccuccccagccgggccca

SEQ ID NO: 732110 - RNA, 20 nt, Human
cacggccgaggccugcuguc

SEQ ID NO: 732111 - RNA, 27 nt, Human
cacuggcguggcacucccugguugugu

SEQ ID NO: 732112 - RNA, 25 nt, Human
cagaaccaacagccugaggguccga

SEQ ID NO: 732113 - RNA, 24 nt, Human
cagaggcccgcagcccccggcgcu

SEQ ID NO: 732114 - RNA, 23 nt, Human
cagaggcccggggaggggacccu

SEQ ID NO: 732115 - RNA, 21 nt, Human
cagagggcacugggccccagc

SEQ ID NO: 732116 - RNA, 21 nt, Human
cagauccuaaaacgccgggaa

SEQ ID NO: 732117 - RNA, 23 nt, Human
cagaugcccccgagacagcaccc

SEQ ID NO: 732118 - RNA, 18 nt, Human
cagcacccaccgcgcccc

SEQ ID NO: 732119 - RNA, 24 nt, Human
cagcaggaguagccaggugcagcg

SEQ ID NO: 732120 - RNA, 18 nt, Human
cagcccccuccccagccc

SEQ ID NO: 732121 - RNA, 23 nt, Human
cagcccccuccccagcccccaca

SEQ ID NO: 732122 - RNA, 23 nt, Human
cagccugucgggccucaaaccag

SEQ ID NO: 732123 - RNA, 20 nt, Human
cagcucaaagccagggcagc

SEQ ID NO: 732124 - RNA, 22 nt, Human
cagcugaacccuggaucugccu

SEQ ID NO: 732125 - RNA, 23 nt, Human
cagcugagccgaggaggucacau

SEQ ID NO: 732126 - RNA, 22 nt, Human
cagcuuccugauucaagauccc

SEQ ID NO: 732127 - RNA, 23 nt, Human
caggagacgcccagcagcugcac

SEQ ID NO: 732128 - RNA, 20 nt, Human
caggcccccacagcagcccc

SEQ ID NO: 732129 - RNA, 22 nt, Human
cagggcccccugccacccccuc

SEQ ID NO: 732130 - RNA, 20 nt, Human
caggguccggggcuggcucc

SEQ ID NO: 732131 - RNA, 26 nt, Human
cagguccugagacccacagaggggcc

SEQ ID NO: 732132 - RNA, 18 nt, Human
cagucucugcugccgcuc

SEQ ID NO: 732133 - RNA, 21 nt, Human
cagucucugcugccgcuccug

SEQ ID NO: 732134 - RNA, 24 nt, Human
caguguccccagggcccacucagg

SEQ ID NO: 732135 - RNA, 27 nt, Human
caugccagaugcccccgagacagcacc

SEQ ID NO: 732136 - RNA, 20 nt, Human
ccaaagagacagggggagca

SEQ ID NO: 732137 - RNA, 24 nt, Human
ccaacagcccccuccccagccccc

SEQ ID NO: 732138 - RNA, 21 nt, Human
ccacagcaguggcguggggag

SEQ ID NO: 732139 - RNA, 19 nt, Human
ccaccacugacggucagag

SEQ ID NO: 732140 - RNA, 18 nt, Human
ccacuugcccggcccgug

SEQ ID NO: 732141 - RNA, 20 nt, Human
ccagacccucagcaagagca

SEQ ID NO: 732142 - RNA, 20 nt, Human
ccagcaccuggccacagcca

SEQ ID NO: 732143 - RNA, 21 nt, Human
ccagccccuguccugcccucu

SEQ ID NO: 732144 - RNA, 23 nt, Human
ccaggcuccccaguucuccaucc

SEQ ID NO: 732145 - RNA, 22 nt, Human
ccagggcccccugccacccccu

SEQ ID NO: 732146 - RNA, 21 nt, Human
ccaggugggguugaacccguu

SEQ ID NO: 732147 - RNA, 19 nt, Human
ccaguccacgcccugugcc

SEQ ID NO: 732148 - RNA, 24 nt, Human
ccaucccuggggccagggaccugg

SEQ ID NO: 732149 - RNA, 21 nt, Human
cccaagagucugagacaggca

SEQ ID NO: 732150 - RNA, 23 nt, Human
cccaaugaucuccaccuccacaa

SEQ ID NO: 732151 - RNA, 20 nt, Human
cccaaugaucuccaccuccc

SEQ ID NO: 732152 - RNA, 20 nt, Human
cccacauaggagacuggagc

SEQ ID NO: 732153 - RNA, 23 nt, Human
cccaccccugcccugggccucca

SEQ ID NO: 732154 - RNA, 21 nt, Human
cccaccgcgcccccaugacga

SEQ ID NO: 732155 - RNA, 27 nt, Human
cccagacccagguccugagacccacca

SEQ ID NO: 732156 - RNA, 21 nt, Human
cccagccuggcccaccacagc

SEQ ID NO: 732157 - RNA, 20 nt, Human
cccaggaggugaguuugggg

SEQ ID NO: 732158 - RNA, 24 nt, Human
cccaguccacgcccugugccgcac

SEQ ID NO: 732159 - RNA, 20 nt, Human
ccccagcccccacauaggag

SEQ ID NO: 732160 - RNA, 18 nt, Human
ccccagggcccacucagg

SEQ ID NO: 732161 - RNA, 24 nt, Human
cccccacagcagccccucuugaga

SEQ ID NO: 732162 - RNA, 24 nt, Human
cccccaggcagccuuuucuggucu

SEQ ID NO: 732163 - RNA, 23 nt, Human
cccccagucccaggaaaggcauc

SEQ ID NO: 732164 - RNA, 19 nt, Human
cccccuccccagcccccac

SEQ ID NO: 732165 - RNA, 18 nt, Human
cccccuccccagccgggc

SEQ ID NO: 732166 - RNA, 24 nt, Human
cccccuccccagccgggcccaggc

SEQ ID NO: 732167 - RNA, 18 nt, Human
cccccugcaggggcgccu

SEQ ID NO: 732168 - RNA, 21 nt, Human
cccccugccacccccucccca

SEQ ID NO: 732169 - RNA, 24 nt, Human
cccccugccacccccuccccagcc

SEQ ID NO: 732170 - RNA, 26 nt, Human
cccccugccacccccuccccagccgg

SEQ ID NO: 732171 - RNA, 24 nt, Human
ccccgggccagcagcuuuagccuu

SEQ ID NO: 732172 - RNA, 22 nt, Human
ccccguuaccugucacucgccg

SEQ ID NO: 732173 - RNA, 23 nt, Human
ccccucacucuucacccuucuaa

SEQ ID NO: 732174 - RNA, 19 nt, Human
ccccugccacccccucccc

SEQ ID NO: 732175 - RNA, 18 nt, Human
ccccugcccugggccucc

SEQ ID NO: 732176 - RNA, 18 nt, Human
ccccuggccccgacaccc

SEQ ID NO: 732177 - RNA, 22 nt, Human
ccccuguccugcccucucccau

SEQ ID NO: 732178 - RNA, 18 nt, Human
cccgagaugcccaaagcc

SEQ ID NO: 732179 - RNA, 18 nt, Human
cccgcagcccccggcgcu

SEQ ID NO: 732180 - RNA, 20 nt, Human
cccgucucaccccuggcccc

SEQ ID NO: 732181 - RNA, 23 nt, Human
cccgucucaccccuggccccgac

SEQ ID NO: 732182 - RNA, 24 nt, Human
cccucgggggugccccgcuccucu

SEQ ID NO: 732183 - RNA, 18 nt, Human
cccugcugcugcuggggc

SEQ ID NO: 732184 - RNA, 20 nt, Human
cccuggccccgacacccgcc

SEQ ID NO: 732185 - RNA, 22 nt, Human
cccugggccuccagagccgccc

SEQ ID NO: 732186 - RNA, 25 nt, Human
cccugugccgcacacggggcccucc

SEQ ID NO: 732187 - RNA, 18 nt, Human
ccgccggcgcccucgccg

SEQ ID NO: 732188 - RNA, 20 nt, Human
ccgccggcgcccucgccguu

SEQ ID NO: 732189 - RNA, 21 nt, Human
ccggcccaggcccugcagucu

SEQ ID NO: 732190 - RNA, 21 nt, Human
ccgggccagcagcuuuagccu

SEQ ID NO: 732191 - RNA, 23 nt, Human
ccggggagguggucaguggccca

SEQ ID NO: 732192 - RNA, 23 nt, Human
ccggguccugugggguauggggg

SEQ ID NO: 732193 - RNA, 19 nt, Human
ccggugccccgugccgagg

SEQ ID NO: 732194 - RNA, 21 nt, Human
ccucacucuucacccuucuaa

SEQ ID NO: 732195 - RNA, 21 nt, Human
ccuccaaacacccagcccaga

SEQ ID NO: 732196 - RNA, 18 nt, Human
ccuccagagccgcccagg

SEQ ID NO: 732197 - RNA, 24 nt, Human
ccuccagagccgcccagguuccca

SEQ ID NO: 732198 - RNA, 20 nt, Human
ccucccgggaggcccaggcu

SEQ ID NO: 732199 - RNA, 21 nt, Human
ccucgagccccagccuggccc

SEQ ID NO: 732200 - RNA, 19 nt, Human
ccugaccuggggcagggga

SEQ ID NO: 732201 - RNA, 26 nt, Human
ccugagacccacagaggggccagggg

SEQ ID NO: 732202 - RNA, 18 nt, Human
ccugcagucucugcugcc

SEQ ID NO: 732203 - RNA, 21 nt, Human
ccugcccgagaugcccaaagc

SEQ ID NO: 732204 - RNA, 20 nt, Human
ccugcggaagccgaggcccc

SEQ ID NO: 732205 - RNA, 21 nt, Human
ccuggacagcugggcccagga

SEQ ID NO: 732206 - RNA, 19 nt, Human
ccuggcccaccacagccug

SEQ ID NO: 732207 - RNA, 19 nt, Human
ccuggcgggcccggcuggc

SEQ ID NO: 732208 - RNA, 18 nt, Human
ccugggccuggcgggccc

SEQ ID NO: 732209 - RNA, 19 nt, Human
ccugggggacgaggaacag

SEQ ID NO: 732210 - RNA, 20 nt, Human
ccugugccgcacacggggcc

SEQ ID NO: 732211 - RNA, 21 nt, Human
ccuucuaguggggugcuucag

SEQ ID NO: 732212 - RNA, 18 nt, Human
cgaacucagaaccaacag

SEQ ID NO: 732213 - RNA, 18 nt, Human
cgaggaacagaugggugg

SEQ ID NO: 732214 - RNA, 22 nt, Human
cgcagcuggcuugcugcccccu

SEQ ID NO: 732215 - RNA, 22 nt, Human
cgcccagccccuguccugcccu

SEQ ID NO: 732216 - RNA, 18 nt, Human
cggaggcagcgugggugg

SEQ ID NO: 732217 - RNA, 20 nt, Human
cggcaggugggucacccccc

SEQ ID NO: 732218 - RNA, 20 nt, Human
cgggcccaggcuggugggug

SEQ ID NO: 732219 - RNA, 18 nt, Human
cguaugccccgccggcgc

SEQ ID NO: 732220 - RNA, 19 nt, Human
cguguaugucccucccucc

SEQ ID NO: 732221 - RNA, 20 nt, Human
cguugcacggccgaggccug

SEQ ID NO: 732222 - RNA, 23 nt, Human
cuauggcuggggauggccagggc

SEQ ID NO: 732223 - RNA, 19 nt, Human
cucacaugccagaugcccc

SEQ ID NO: 732224 - RNA, 20 nt, Human
cucaccccuggccccgacac

SEQ ID NO: 732225 - RNA, 19 nt, Human
cucacggcugcggcccagg

SEQ ID NO: 732226 - RNA, 18 nt, Human
cucacucuucacccuucu

SEQ ID NO: 732227 - RNA, 24 nt, Human
cucacucuucacccuucuaaucac

SEQ ID NO: 732228 - RNA, 21 nt, Human
cucagaggcccgcagcccccg

SEQ ID NO: 732229 - RNA, 18 nt, Human
cuccaaacacccagccca

SEQ ID NO: 732230 - RNA, 20 nt, Human
cucccaccccgaggcauccc

SEQ ID NO: 732231 - RNA, 19 nt, Human
cucccagcccaccagcacc

SEQ ID NO: 732232 - RNA, 20 nt, Human
cuccguguaugucccucccu

SEQ ID NO: 732233 - RNA, 18 nt, Human
cucgagccccagccuggc

SEQ ID NO: 732234 - RNA, 18 nt, Human
cugaaggccagcguccuc

SEQ ID NO: 732235 - RNA, 18 nt, Human
cugcagccagcaggaccc

SEQ ID NO: 732236 - RNA, 22 nt, Human
cugccaacagcccccuccccag

SEQ ID NO: 732237 - RNA, 18 nt, Human
cugcugccgcuccugggc

SEQ ID NO: 732238 - RNA, 22 nt, Human
cuggaggggcaggguggugugg

SEQ ID NO: 732239 - RNA, 19 nt, Human
cuggcaauggcacgcacgc

SEQ ID NO: 732240 - RNA, 20 nt, Human
cuggccacagccaaucuucc

SEQ ID NO: 732241 - RNA, 22 nt, Human
cuggcccaguauggaucaccuu

SEQ ID NO: 732242 - RNA, 19 nt, Human
cuggcugccgggggcccuc

SEQ ID NO: 732243 - RNA, 24 nt, Human
cugggcccaggaggucccugccug

SEQ ID NO: 732244 - RNA, 19 nt, Human
cugggccccagcucaaagc

SEQ ID NO: 732245 - RNA, 24 nt, Human
cugggcccuucuuugcaacgcuag

SEQ ID NO: 732246 - RNA, 21 nt, Human
cugggccuccagagccgccca

SEQ ID NO: 732247 - RNA, 21 nt, Human
cuguagccuggcaucaugcug

SEQ ID NO: 732248 - RNA, 19 nt, Human
cuguggggaggugggggag

SEQ ID NO: 732249 - RNA, 22 nt, Human
cuuccugcggaagccgaggccc

SEQ ID NO: 732250 - RNA, 23 nt, Human
cuugcccggcccguguccugccc

SEQ ID NO: 732251 - RNA, 20 nt, Human
gaacucagaaccaacagccu

SEQ ID NO: 732252 - RNA, 22 nt, Human
gaagccccuccugugggcccuu

SEQ ID NO: 732253 - RNA, 18 nt, Human
gacacagggcggggcaag

SEQ ID NO: 732254 - RNA, 23 nt, Human
gacacuggcguggcacucccugg

SEQ ID NO: 732255 - RNA, 20 nt, Human
gacccagcacuggggacaca

SEQ ID NO: 732256 - RNA, 21 nt, Human
gacugcaagaccaaagagaca

SEQ ID NO: 732257 - RNA, 18 nt, Human
gagaagcagaagagagag

SEQ ID NO: 732258 - RNA, 24 nt, Human
gagaagcagaagagagagagggag

SEQ ID NO: 732259 - RNA, 18 nt, Human
gagagagaaggaggggga

SEQ ID NO: 732260 - RNA, 21 nt, Human
gagaugggggcaggagagaga

SEQ ID NO: 732261 - RNA, 18 nt, Human
gagccagcgcagcugcuc

SEQ ID NO: 732262 - RNA, 19 nt, Human
gaggagcagaggcccgggg

SEQ ID NO: 732263 - RNA, 26 nt, Human
gaggaggucacauggcuucugggggu

SEQ ID NO: 732264 - RNA, 19 nt, Human
gaggcagccgcaucuccag

SEQ ID NO: 732265 - RNA, 23 nt, Human
gaggccucuuccaucccuucuag

SEQ ID NO: 732266 - RNA, 18 nt, Human
gagggaggggagggagga

SEQ ID NO: 732267 - RNA, 19 nt, Human
gagggcaagccaagggcag

SEQ ID NO: 732268 - RNA, 21 nt, Human
gaggggaggggaggagaggcc

SEQ ID NO: 732269 - RNA, 24 nt, Human
gcaaacccgggcagcugccuucca

SEQ ID NO: 732270 - RNA, 20 nt, Human
gcaagccaagggcagaggug

SEQ ID NO: 732271 - RNA, 21 nt, Human
gcacagugggggcuccagcgg

SEQ ID NO: 732272 - RNA, 20 nt, Human
gcacuggggccccucagaca

SEQ ID NO: 732273 - RNA, 19 nt, Human
gccagccucgaagccccuc

SEQ ID NO: 732274 - RNA, 18 nt, Human
gccagggccacaggggga

SEQ ID NO: 732275 - RNA, 23 nt, Human
gccagggggagggagggaggcag

SEQ ID NO: 732276 - RNA, 22 nt, Human
gcccccuccccagcccccacau

SEQ ID NO: 732277 - RNA, 19 nt, Human
gccccgggccagcagcuuu

SEQ ID NO: 732278 - RNA, 19 nt, Human
gcccgagagcauggcagga

SEQ ID NO: 732279 - RNA, 19 nt, Human
gcccugggccuccagagcc

SEQ ID NO: 732280 - RNA, 20 nt, Human
gcccuggggcccagggaauc

SEQ ID NO: 732281 - RNA, 26 nt, Human
gccucgaagccccuccugugggcccc

SEQ ID NO: 732282 - RNA, 22 nt, Human
gccugcuggaagacagugagcc

SEQ ID NO: 732283 - RNA, 18 nt, Human
gccugggcaugcaggggc

SEQ ID NO: 732284 - RNA, 23 nt, Human
gccugggggacgaggaacagaug

SEQ ID NO: 732285 - RNA, 19 nt, Human
gccuggucuagugggaggc

SEQ ID NO: 732286 - RNA, 25 nt, Human
gcgcggcuugggaagcugccgccuc

SEQ ID NO: 732287 - RNA, 22 nt, Human
gcgcuagcaggggacacuggcg

SEQ ID NO: 732288 - RNA, 20 nt, Human
gcgggugucuguggggaggu

SEQ ID NO: 732289 - RNA, 22 nt, Human
gcuccgugggcaccugccccuc

SEQ ID NO: 732290 - RNA, 22 nt, Human
gcugccaacagcccccucccca

SEQ ID NO: 732291 - RNA, 20 nt, Human
gcuggcaccaagaccacuuc

SEQ ID NO: 732292 - RNA, 20 nt, Human
gcuggggauggccagggccc

SEQ ID NO: 732293 - RNA, 21 nt, Human
gcugguggcagggggugacac

SEQ ID NO: 732294 - RNA, 23 nt, Human
ggaaggggcugagggaggggagg

SEQ ID NO: 732295 - RNA, 24 nt, Human
ggaaggggcugagggaggggaggg

SEQ ID NO: 732296 - RNA, 21 nt, Human
ggacuuggcagccacggggca

SEQ ID NO: 732297 - RNA, 18 nt, Human
ggagagagaaggaggggg

SEQ ID NO: 732298 - RNA, 20 nt, Human
ggagcaggggcaggagggag

SEQ ID NO: 732299 - RNA, 18 nt, Human
ggagcuggaaagggagcg

SEQ ID NO: 732300 - RNA, 24 nt, Human
ggaggaggagcgccgcacaaaacc

SEQ ID NO: 732301 - RNA, 19 nt, Human
ggaggaggaggaaacgcug

SEQ ID NO: 732302 - RNA, 21 nt, Human
ggaggcagcgugggugggggc

SEQ ID NO: 732303 - RNA, 21 nt, Human
ggagggaggacugagggaggg

SEQ ID NO: 732304 - RNA, 28 nt, Human
ggagggaggacugagggaggggaggggg

SEQ ID NO: 732305 - RNA, 28 nt, Human
ggagggaggacugagggaggggaggggg

SEQ ID NO: 732306 - RNA, 19 nt, Human
ggaggggaggagaggccag

SEQ ID NO: 732307 - RNA, 19 nt, Human
ggaggggaggggaggagag

SEQ ID NO: 732308 - RNA, 22 nt, Human
ggauggccagggcccccggagc

SEQ ID NO: 732309 - RNA, 21 nt, Human
ggcagagguggaaguagcugg

SEQ ID NO: 732310 - RNA, 20 nt, Human
ggcaggagggaggcaggggc

SEQ ID NO: 732311 - RNA, 19 nt, Human
ggcagggagagaggcggag

SEQ ID NO: 732312 - RNA, 21 nt, Human
ggccacagcaguggcgugggg

SEQ ID NO: 732313 - RNA, 20 nt, Human
ggcccagggaaucuacucca

SEQ ID NO: 732314 - RNA, 18 nt, Human
ggccccuccccaugaugg

SEQ ID NO: 732315 - RNA, 20 nt, Human
ggccggaaggggaggccagc

SEQ ID NO: 732316 - RNA, 21 nt, Human
ggccugggcaugcaggggcga

SEQ ID NO: 732317 - RNA, 22 nt, Human
ggcuucugggggugggucuggg

SEQ ID NO: 732318 - RNA, 19 nt, Human
gggaagcugcuggccacug

SEQ ID NO: 732319 - RNA, 20 nt, Human
gggacacaguuuugggggcc

SEQ ID NO: 732320 - RNA, 22 nt, Human
gggacacaugggggggcauggg

SEQ ID NO: 732321 - RNA, 19 nt, Human
gggaccagggccuggggcg

SEQ ID NO: 732322 - RNA, 20 nt, Human
gggaggcagggagagaggcg

SEQ ID NO: 732323 - RNA, 23 nt, Human
gggaggccgcuggccuguagccc

SEQ ID NO: 732324 - RNA, 18 nt, Human
gggcaaagucaucagcag

SEQ ID NO: 732325 - RNA, 20 nt, Human
gggcacagugggggcuccag

SEQ ID NO: 732326 - RNA, 21 nt, Human
gggcacagugggggcuccagc

SEQ ID NO: 732327 - RNA, 25 nt, Human
gggcaggcgucccaugugggcucca

SEQ ID NO: 732328 - RNA, 21 nt, Human
gggcaugggacaaggggcugg

SEQ ID NO: 732329 - RNA, 18 nt, Human
gggcccccugccaccccc

SEQ ID NO: 732330 - RNA, 19 nt, Human
gggcccgagagcauggcag

SEQ ID NO: 732331 - RNA, 24 nt, Human
gggccucaaaccagcuccacccaa

SEQ ID NO: 732332 - RNA, 18 nt, Human
gggccuggggcgggcucc

SEQ ID NO: 732333 - RNA, 25 nt, Human
ggggacagacaugcuggguguggag

SEQ ID NO: 732334 - RNA, 24 nt, Human
ggggagggaggacugagggagggg

SEQ ID NO: 732335 - RNA, 29 nt, Human
ggggagggaggacugagggaggggagggg

SEQ ID NO: 732336 - RNA, 29 nt, Human
ggggagggaggacugagggaggggagggg

SEQ ID NO: 732337 - RNA, 20 nt, Human
ggggagugagagagagccag

SEQ ID NO: 732338 - RNA, 21 nt, Human
ggggcaggagagagaaggagg

SEQ ID NO: 732339 - RNA, 22 nt, Human
ggggcaggcgucccaugugggc

SEQ ID NO: 732340 - RNA, 20 nt, Human
ggggcagggugguguggggc

SEQ ID NO: 732341 - RNA, 22 nt, Human
ggggccaggcacagggggcugg

SEQ ID NO: 732342 - RNA, 22 nt, Human
ggggccuggcugcccuguuucc

SEQ ID NO: 732343 - RNA, 20 nt, Human
ggggcuggauggcaccucug

SEQ ID NO: 732344 - RNA, 21 nt, Human
gggggauaggaggggcacagu

SEQ ID NO: 732345 - RNA, 26 nt, Human
gggggggcaugggacaaggggcuggu

SEQ ID NO: 732346 - RNA, 23 nt, Human
gggggguaguagaggggagaggg

SEQ ID NO: 732347 - RNA, 19 nt, Human
ggggugcccucaucccagg

SEQ ID NO: 732348 - RNA, 21 nt, Human
ggggugggucugggucccugg

SEQ ID NO: 732349 - RNA, 20 nt, Human
gggguuggauuugcucuugg

SEQ ID NO: 732350 - RNA, 20 nt, Human
gggucgcuggcacuggggcc

SEQ ID NO: 732351 - RNA, 18 nt, Human
gggugcagaggccagagg

SEQ ID NO: 732352 - RNA, 20 nt, Human
gggugggggguaguagaggg

SEQ ID NO: 732353 - RNA, 19 nt, Human
ggucagaggcggagcagga

SEQ ID NO: 732354 - RNA, 19 nt, Human
ggucaggggggucuggagg

SEQ ID NO: 732355 - RNA, 21 nt, Human
ggucaggggggucuggagggg

SEQ ID NO: 732356 - RNA, 21 nt, Human
ggugccagggggagggaggga

SEQ ID NO: 732357 - RNA, 24 nt, Human
gguggaggcugcaaggcccccaag

SEQ ID NO: 732358 - RNA, 19 nt, Human
ggugggucugggucccugg

SEQ ID NO: 732359 - RNA, 18 nt, Human
ggugucccgucucacccc

SEQ ID NO: 732360 - RNA, 19 nt, Human
guccacagggagcccaaug

SEQ ID NO: 732361 - RNA, 24 nt, Human
guccggggcuggcuccugccgucc

SEQ ID NO: 732362 - RNA, 21 nt, Human
gugccgcacacggggcccucc

SEQ ID NO: 732363 - RNA, 22 nt, Human
guggaaguagcugguccacagc

SEQ ID NO: 732364 - RNA, 24 nt, Human
guggaggcugcaaggcccccaaga

SEQ ID NO: 732365 - RNA, 21 nt, Human
gugggucugggucccuggggg

SEQ ID NO: 732366 - RNA, 21 nt, Human
gugggugacgugaugucuccu

SEQ ID NO: 732367 - RNA, 18 nt, Human
uaaaugccacuauggcug

SEQ ID NO: 732368 - RNA, 26 nt, Human
uaccugcccacaucagacuucccagu

SEQ ID NO: 732369 - RNA, 19 nt, Human
uagcaaggaggguuccccc

SEQ ID NO: 732370 - RNA, 24 nt, Human
uauguacagauccuaaaacgccgg

SEQ ID NO: 732371 - RNA, 25 nt, Human
uaugucccucccuccaggcuaagga

SEQ ID NO: 732372 - RNA, 24 nt, Human
ucacaggcaaacccgggcagcugc

SEQ ID NO: 732373 - RNA, 19 nt, Human
ucacaguggcugggaagcc

SEQ ID NO: 732374 - RNA, 20 nt, Human
ucacgggcagguggcccagg

SEQ ID NO: 732375 - RNA, 19 nt, Human
ucagacaaguccugccaug

SEQ ID NO: 732376 - RNA, 22 nt, Human
ucagaggcggagcaggaccagg

SEQ ID NO: 732377 - RNA, 22 nt, Human
ucagaggcggagcaggaccagg

SEQ ID NO: 732378 - RNA, 23 nt, Human
ucagaggcggagcaggaccaggu

SEQ ID NO: 732379 - RNA, 22 nt, Human
ucagcccaaagcagcgaagccc

SEQ ID NO: 732380 - RNA, 20 nt, Human
ucaggggccaugcaggucgc

SEQ ID NO: 732381 - RNA, 22 nt, Human
uccaaacacccagcccagaccc

SEQ ID NO: 732382 - RNA, 18 nt, Human
uccacacugcccucgugg

SEQ ID NO: 732383 - RNA, 22 nt, Human
uccacagcagacaaaacagagg

SEQ ID NO: 732384 - RNA, 20 nt, Human
uccacgucacaugagcgaca

SEQ ID NO: 732385 - RNA, 21 nt, Human
ucccagacgaggaagcggacc

SEQ ID NO: 732386 - RNA, 28 nt, Human
ucccccaggcagccuuuucuggucuugc

SEQ ID NO: 732387 - RNA, 22 nt, Human
ucccgggaggcccaggcugugg

SEQ ID NO: 732388 - RNA, 18 nt, Human
ucccucccgggaggccca

SEQ ID NO: 732389 - RNA, 18 nt, Human
ucccugagaagagcuggu

SEQ ID NO: 732390 - RNA, 24 nt, Human
ucccugccggcccaggcccugcag

SEQ ID NO: 732391 - RNA, 18 nt, Human
ucccugcugcaguccaca

SEQ ID NO: 732392 - RNA, 22 nt, Human
ucccugcugcaguccacaggga

SEQ ID NO: 732393 - RNA, 21 nt, Human
ucccuggggguaugaggggug

SEQ ID NO: 732394 - RNA, 21 nt, Human
ucccuggggguaugaggggug

SEQ ID NO: 732395 - RNA, 21 nt, Human
uccgugggcaccugccccuca

SEQ ID NO: 732396 - RNA, 22 nt, Human
uccuccccgggagcaggggcag

SEQ ID NO: 732397 - RNA, 25 nt, Human
uccucuggccaaugaagucacgccc

SEQ ID NO: 732398 - RNA, 18 nt, Human
uccuggacagcugggccc

SEQ ID NO: 732399 - RNA, 26 nt, Human
uccuugggcugggacagcacgggaca

SEQ ID NO: 732400 - RNA, 19 nt, Human
ucgaagccccuccuguggg

SEQ ID NO: 732401 - RNA, 24 nt, Human
ucgaugaucuccccacgguccccc

SEQ ID NO: 732402 - RNA, 22 nt, Human
ucgcccagccccuguccugccc

SEQ ID NO: 732403 - RNA, 22 nt, Human
ucgcccaggcucuuggacuugg

SEQ ID NO: 732404 - RNA, 23 nt, Human
ucgguggccacauggcuccagcc

SEQ ID NO: 732405 - RNA, 24 nt, Human
ucucgguggccacauggcuccagc

SEQ ID NO: 732406 - RNA, 20 nt, Human
ucucugcugccgcuccuggg

SEQ ID NO: 732407 - RNA, 24 nt, Human
ucucugcugccgcuccugggccug

SEQ ID NO: 732408 - RNA, 18 nt, Human
ucugagagccgggaggag

SEQ ID NO: 732409 - RNA, 18 nt, Human
ucugucagggugucccgu

SEQ ID NO: 732410 - RNA, 24 nt, Human
ucuugagcugcccgggcagggggu

SEQ ID NO: 732411 - RNA, 23 nt, Human
ugagaaggcggccacccagcuga

SEQ ID NO: 732412 - RNA, 30 nt, Human
ugagaaggcggccacccagcugaacccugg

SEQ ID NO: 732413 - RNA, 18 nt, Human
ugagagagagccagaggg

SEQ ID NO: 732414 - RNA, 22 nt, Human
ugagcaaacaacacgcccaccc

SEQ ID NO: 732415 - RNA, 19 nt, Human
ugagggguggggucucugg

SEQ ID NO: 732416 - RNA, 21 nt, Human
ugagggguggggucucuggug

SEQ ID NO: 732417 - RNA, 19 nt, Human
ugaugucuccugccugcug

SEQ ID NO: 732418 - RNA, 18 nt, Human
ugcaagaccaaagagaca

SEQ ID NO: 732419 - RNA, 21 nt, Human
ugcacggccgaggccugcugu

SEQ ID NO: 732420 - RNA, 22 nt, Human
ugccaagaugggcucagacucc

SEQ ID NO: 732421 - RNA, 19 nt, Human
ugccagaugcccccgagac

SEQ ID NO: 732422 - RNA, 21 nt, Human
ugccagaugcccccgagacag

SEQ ID NO: 732423 - RNA, 21 nt, Human
ugccaugaaucucaugugggg

SEQ ID NO: 732424 - RNA, 18 nt, Human
ugcccccugagcccugcc

SEQ ID NO: 732425 - RNA, 19 nt, Human
ugcccggcccguguccugc

SEQ ID NO: 732426 - RNA, 23 nt, Human
ugcccuagagggaggugggaaug

SEQ ID NO: 732427 - RNA, 19 nt, Human
ugcccugggccuccagagc

SEQ ID NO: 732428 - RNA, 18 nt, Human
ugccggcccaggcccugc

SEQ ID NO: 732429 - RNA, 24 nt, Human
ugcggcccaggcccaggcugggca

SEQ ID NO: 732430 - RNA, 21 nt, Human
ugcuaccaggaaucauggagg

SEQ ID NO: 732431 - RNA, 22 nt, Human
ugcugccgcuccugggccuggc

SEQ ID NO: 732432 - RNA, 24 nt, Human
ugcuggaggaggaggaaacgcugu

SEQ ID NO: 732433 - RNA, 25 nt, Human
ugcuggaggaggaggaaacgcuguc

SEQ ID NO: 732434 - RNA, 19 nt, Human
uggagagggggcggguguc

SEQ ID NO: 732435 - RNA, 22 nt, Human
uggaggaggaggaaacgcuguc

SEQ ID NO: 732436 - RNA, 24 nt, Human
uggcaaggacagggagggaguggc

SEQ ID NO: 732437 - RNA, 19 nt, Human
uggcaccaagaccacuucc

SEQ ID NO: 732438 - RNA, 21 nt, Human
uggccauagagaagccgacug

SEQ ID NO: 732439 - RNA, 21 nt, Human
uggcccaccacagccugcacc

SEQ ID NO: 732440 - RNA, 18 nt, Human
uggcccagcccucagcaa

SEQ ID NO: 732441 - RNA, 21 nt, Human
uggcccagcccucagcaagcc

SEQ ID NO: 732442 - RNA, 22 nt, Human
ugggaggccgcuggccuguagc

SEQ ID NO: 732443 - RNA, 21 nt, Human
ugggaggcgaacucagaacca

SEQ ID NO: 732444 - RNA, 18 nt, Human
ugggcagaacagcugcug

SEQ ID NO: 732445 - RNA, 21 nt, Human
ugggcaugcaggggcggcggg

SEQ ID NO: 732446 - RNA, 24 nt, Human
ugggcccaggaggucccugccugg

SEQ ID NO: 732447 - RNA, 27 nt, Human
ugggccccguuaccugucccgucaacg

SEQ ID NO: 732448 - RNA, 21 nt, Human
ugggccuccagagccgcccag

SEQ ID NO: 732449 - RNA, 18 nt, Human
uggggccagggaccuggg

SEQ ID NO: 732450 - RNA, 22 nt, Human
uggggccccucagacaaguccu

SEQ ID NO: 732451 - RNA, 19 nt, Human
uggggccuggggggcaggc

SEQ ID NO: 732452 - RNA, 23 nt, Human
uggggccuggggggcaggcgucc

SEQ ID NO: 732453 - RNA, 19 nt, Human
ugggggccuggcugcccug

SEQ ID NO: 732454 - RNA, 20 nt, Human
ugggggguaguagaggggag

SEQ ID NO: 732455 - RNA, 20 nt, Human
ugggggugggucuggguccc

SEQ ID NO: 732456 - RNA, 20 nt, Human
ugggggugggucuggguccc

SEQ ID NO: 732457 - RNA, 19 nt, Human
uggggugcggccugggcau

SEQ ID NO: 732458 - RNA, 23 nt, Human
ugggugacacagggcggggcaag

SEQ ID NO: 732459 - RNA, 18 nt, Human
ugggugggggcagaaagg

SEQ ID NO: 732460 - RNA, 21 nt, Human
ugucacugacagccacaugca

SEQ ID NO: 732461 - RNA, 22 nt, Human
ugucacugacagccacaugcac

SEQ ID NO: 732462 - RNA, 24 nt, Human
ugucccgcgcaccggguaccuuca

SEQ ID NO: 732463 - RNA, 23 nt, Human
uguggggaggugggggagugaga

SEQ ID NO: 732464 - RNA, 21 nt, Human
uuccaggcugcacaguggggg

SEQ ID NO: 732465 - RNA, 20 nt, Human
uuccugagcaaacaacacgc

SEQ ID NO: 732466 - RNA, 21 nt, Human
uuccuggacagcugggcccag

SEQ ID NO: 732467 - RNA, 22 nt, Human
uuccuggacagcugggcccagg

SEQ ID NO: 732468 - RNA, 23 nt, Human
uuccuggacagcugggcccagga

SEQ ID NO: 732469 - RNA, 19 nt, Human
uucucuauguacagauccu

SEQ ID NO: 732470 - RNA, 18 nt, Human
uuggucacagguggcagg

SEQ ID NO: 732471 - RNA, 24 nt, Human
uuuccaggcugcacagugggggga

SEQ ID NO: 732472 - RNA, 19 nt, Human
uuucccuccggaggagaga

SEQ ID NO: 732473 - RNA, 24 nt, Human
uuuccuccccgggagcaggggcag

SEQ ID NO: 732474 - RNA, 20 nt, Human
uuucuggucuugcccugccc

SEQ ID NO: 732475 - RNA, 24 nt, Human
aaaaaugaucacaccaggccaugc

SEQ ID NO: 732476 - RNA, 23 nt, Human
aaaagaauccacaucauuguuug

SEQ ID NO: 732477 - RNA, 24 nt, Human
aaaagaauccacaucauuguuugg

SEQ ID NO: 732478 - RNA, 26 nt, Human
aaacaaaggugauaauuagcagaaau

SEQ ID NO: 732479 - RNA, 18 nt, Human
aaacccaguaggaugacc

SEQ ID NO: 732480 - RNA, 19 nt, Human
aaagagcugggauuacagg

SEQ ID NO: 732481 - RNA, 25 nt, Human
aaagcacaaacaugauuagucagaa

SEQ ID NO: 732482 - RNA, 24 nt, Human
aaaguaaacauagcuugcaaaauc

SEQ ID NO: 732483 - RNA, 19 nt, Human
aacacaacaaaugguguca

SEQ ID NO: 732484 - RNA, 21 nt, Human
aacacagaaaaagaaaggacc

SEQ ID NO: 732485 - RNA, 21 nt, Human
aacaggaggaauccagcugga

SEQ ID NO: 732486 - RNA, 19 nt, Human
aaccccacaauccagcacc

SEQ ID NO: 732487 - RNA, 19 nt, Human
aagaaaaagacaacuacau

SEQ ID NO: 732488 - RNA, 22 nt, Human
aagaagcccacgcccacucuca

SEQ ID NO: 732489 - RNA, 24 nt, Human
aagaagcccacgcccacucucaac

SEQ ID NO: 732490 - RNA, 18 nt, Human
aagagcuacuacuguuac

SEQ ID NO: 732491 - RNA, 23 nt, Human
aagagcugggauuacaggcacau

SEQ ID NO: 732492 - RNA, 21 nt, Human
aagagugaggaggagaggagg

SEQ ID NO: 732493 - RNA, 19 nt, Human
aagcaaaacacagaaaaag

SEQ ID NO: 732494 - RNA, 26 nt, Human
aagcaaaacacagaaaaagaaaggac

SEQ ID NO: 732495 - RNA, 27 nt, Human
aagcaaaacacagaaaaagagggaccc

SEQ ID NO: 732496 - RNA, 27 nt, Human
aagcaaaacacagaaaaagccuuucgg

SEQ ID NO: 732497 - RNA, 21 nt, Human
aagcaguaucuuccccuccau

SEQ ID NO: 732498 - RNA, 21 nt, Human
aagcuacaacacuccuuguac

SEQ ID NO: 732499 - RNA, 23 nt, Human
aagggaagaggaggauggggagg

SEQ ID NO: 732500 - RNA, 20 nt, Human
aaggggaaagggaagaggag

SEQ ID NO: 732501 - RNA, 24 nt, Human
aagugauccuccugucuuggccuc

SEQ ID NO: 732502 - RNA, 21 nt, Human
aaugcaacaugauccucgugg

SEQ ID NO: 732503 - RNA, 21 nt, Human
acaaaacugucugccagggac

SEQ ID NO: 732504 - RNA, 22 nt, Human
acacagcagcaucaccuggaaa

SEQ ID NO: 732505 - RNA, 25 nt, Human
acacugcaacucagguuagcaacug

SEQ ID NO: 732506 - RNA, 19 nt, Human
acagaaggggugcgagcug

SEQ ID NO: 732507 - RNA, 20 nt, Human
acagaauuuuugaagugaau

SEQ ID NO: 732508 - RNA, 20 nt, Human
accugcugggagacugcagu

SEQ ID NO: 732509 - RNA, 19 nt, Human
acggauucucccuucugga

SEQ ID NO: 732510 - RNA, 22 nt, Human
acuacauuaaaauuuugucagg

SEQ ID NO: 732511 - RNA, 22 nt, Human
acucuacugugaaagcaaaauc

SEQ ID NO: 732512 - RNA, 19 nt, Human
acugcagccucgaccuccu

SEQ ID NO: 732513 - RNA, 19 nt, Human
acugcagugguugugaucc

SEQ ID NO: 732514 - RNA, 23 nt, Human
acugcaguugccuugguguucug

SEQ ID NO: 732515 - RNA, 19 nt, Human
agaaaugauggagaaagca

SEQ ID NO: 732516 - RNA, 21 nt, Human
agaagcuucuggagguaacag

SEQ ID NO: 732517 - RNA, 21 nt, Human
agaauccugucucuauuucuc

SEQ ID NO: 732518 - RNA, 18 nt, Human
agagcugggauuacaggc

SEQ ID NO: 732519 - RNA, 28 nt, Human
agaggagagaaggguggacagaaggggu

SEQ ID NO: 732520 - RNA, 18 nt, Human
agaggaggauggggaggg

SEQ ID NO: 732521 - RNA, 21 nt, Human
agaggaggggaggguggggag

SEQ ID NO: 732522 - RNA, 21 nt, Human
agauagcaccaaauacuaaca

SEQ ID NO: 732523 - RNA, 18 nt, Human
agccuagaguagaaagau

SEQ ID NO: 732524 - RNA, 19 nt, Human
agccuggcaaccuagacaa

SEQ ID NO: 732525 - RNA, 18 nt, Human
agccuuaaagcugugcuc

SEQ ID NO: 732526 - RNA, 19 nt, Human
agcgccgugcugggcucac

SEQ ID NO: 732527 - RNA, 24 nt, Human
agcuacuacuguuacccugaacag

SEQ ID NO: 732528 - RNA, 21 nt, Human
aggaauccagcuggaaaugcc

SEQ ID NO: 732529 - RNA, 18 nt, Human
aggagaggaggggagggu

SEQ ID NO: 732530 - RNA, 18 nt, Human
aggaggauggggagggug

SEQ ID NO: 732531 - RNA, 19 nt, Human
aggaggauggggagggugg

SEQ ID NO: 732532 - RNA, 20 nt, Human
aggaggauggggaggguggg

SEQ ID NO: 732533 - RNA, 24 nt, Human
aggaggguggggagaguggggagg

SEQ ID NO: 732534 - RNA, 21 nt, Human
aggaggugagaagaagccaaa

SEQ ID NO: 732535 - RNA, 18 nt, Human
aggcagggucuugcucug

SEQ ID NO: 732536 - RNA, 21 nt, Human
agggaagaggaggauggggag

SEQ ID NO: 732537 - RNA, 26 nt, Human
aggguggggagagugaggaggguggg

SEQ ID NO: 732538 - RNA, 20 nt, Human
aggguggggagaguggggag

SEQ ID NO: 732539 - RNA, 19 nt, Human
aggguguuguuaaagagcu

SEQ ID NO: 732540 - RNA, 21 nt, Human
aggugacuagagccuaugacc

SEQ ID NO: 732541 - RNA, 21 nt, Human
aguaggaugaccguuauuuug

SEQ ID NO: 732542 - RNA, 26 nt, Human
agugcccaauucauucccuguugugc

SEQ ID NO: 732543 - RNA, 24 nt, Human
aguggagugcccaauucauucccu

SEQ ID NO: 732544 - RNA, 23 nt, Human
auaaaaccaaacaaaauaaaaua

SEQ ID NO: 732545 - RNA, 18 nt, Human
auaaacacaguaggacau

SEQ ID NO: 732546 - RNA, 24 nt, Human
auagcucacugcagccucgaccuc

SEQ ID NO: 732547 - RNA, 23 nt, Human
auaucuagaaguaaacaaaacug

SEQ ID NO: 732548 - RNA, 27 nt, Human
aucagccaccccaccccaguaucucaa

SEQ ID NO: 732549 - RNA, 18 nt, Human
aucucggcuugggauggc

SEQ ID NO: 732550 - RNA, 20 nt, Human
augauaccugagaugccaca

SEQ ID NO: 732551 - RNA, 22 nt, Human
augauuagucagaauuugaggg

SEQ ID NO: 732552 - RNA, 22 nt, Human
augccacauaaauguaaccagu

SEQ ID NO: 732553 - RNA, 19 nt, Human
auggagaaagcaaaacaca

SEQ ID NO: 732554 - RNA, 23 nt, Human
auggggaggguggggauggggag

SEQ ID NO: 732555 - RNA, 22 nt, Human
auuacacccauccaaaauaaaa

SEQ ID NO: 732556 - RNA, 21 nt, Human
caaaaaaugaucacaccaggc

SEQ ID NO: 732557 - RNA, 25 nt, Human
caaaaagaauauauauguauguaau

SEQ ID NO: 732558 - RNA, 23 nt, Human
caaagagcugggauuacaggcac

SEQ ID NO: 732559 - RNA, 24 nt, Human
caaagagcugggauuacaggcaca

SEQ ID NO: 732560 - RNA, 19 nt, Human
caacaaaacagacuccucc

SEQ ID NO: 732561 - RNA, 19 nt, Human
caacaaaacagacuccucc

SEQ ID NO: 732562 - RNA, 20 nt, Human
caacacccaaaaagcugaag

SEQ ID NO: 732563 - RNA, 22 nt, Human
caagugauccuccugucuuggc

SEQ ID NO: 732564 - RNA, 27 nt, Human
caagugauccuccugucuuggccuccc

SEQ ID NO: 732565 - RNA, 22 nt, Human
caaugggagauuuuggacaggc

SEQ ID NO: 732566 - RNA, 21 nt, Human
cacagaaaaagaaaggaccuc

SEQ ID NO: 732567 - RNA, 23 nt, Human
caccaugauagcucacugcagcc

SEQ ID NO: 732568 - RNA, 23 nt, Human
cacgagcaccaagcagggggccg

SEQ ID NO: 732569 - RNA, 19 nt, Human
cacgcaggucaccucagug

SEQ ID NO: 732570 - RNA, 24 nt, Human
cacuaaucagccaccccaccccag

SEQ ID NO: 732571 - RNA, 19 nt, Human
cacugcagccucgaccucc

SEQ ID NO: 732572 - RNA, 20 nt, Human
cagauaauaugcugaaagua

SEQ ID NO: 732573 - RNA, 23 nt, Human
cagcagcagugaaaugauggccu

SEQ ID NO: 732574 - RNA, 24 nt, Human
cagccaccccaccccaguaucuca

SEQ ID NO: 732575 - RNA, 23 nt, Human
cagccucgaccuccugggcucaa

SEQ ID NO: 732576 - RNA, 24 nt, Human
cagccucgaccuccugggcucaag

SEQ ID NO: 732577 - RNA, 18 nt, Human
cagcucccugcacaugcc

SEQ ID NO: 732578 - RNA, 24 nt, Human
cagggucuugcucuguugcccagg

SEQ ID NO: 732579 - RNA, 21 nt, Human
cauauaacacaacaaauggug

SEQ ID NO: 732580 - RNA, 20 nt, Human
cauuuuguuuucaugagauu

SEQ ID NO: 732581 - RNA, 19 nt, Human
ccaaagagcugggauuaca

SEQ ID NO: 732582 - RNA, 23 nt, Human
ccaaagagcugggauuacaggca

SEQ ID NO: 732583 - RNA, 25 nt, Human
ccaaagagcugggauuacaggcaca

SEQ ID NO: 732584 - RNA, 23 nt, Human
ccaaagcacaaacaugauuaguc

SEQ ID NO: 732585 - RNA, 22 nt, Human
ccaacuaaagggccaacccuug

SEQ ID NO: 732586 - RNA, 18 nt, Human
ccaagcagggggccggcu

SEQ ID NO: 732587 - RNA, 19 nt, Human
ccacuccagggacggauuc

SEQ ID NO: 732588 - RNA, 23 nt, Human
ccagcgugcugccagugcugggg

SEQ ID NO: 732589 - RNA, 25 nt, Human
ccaguaucucaauacuauauuuucu

SEQ ID NO: 732590 - RNA, 18 nt, Human
cccaaaaagcugaaguga

SEQ ID NO: 732591 - RNA, 20 nt, Human
cccaaaaagcugaagugaga

SEQ ID NO: 732592 - RNA, 24 nt, Human
cccaaagagcugggauuacaggca

SEQ ID NO: 732593 - RNA, 19 nt, Human
cccagaaaugccucugaau

SEQ ID NO: 732594 - RNA, 18 nt, Human
ccccaaaacuauuccccc

SEQ ID NO: 732595 - RNA, 19 nt, Human
ccccaaaacuauucccccu

SEQ ID NO: 732596 - RNA, 18 nt, Human
ccccaaaccagcaaaacc

SEQ ID NO: 732597 - RNA, 20 nt, Human
ccccagcaggauccuuucuu

SEQ ID NO: 732598 - RNA, 21 nt, Human
cccuccauccacauuugucag

SEQ ID NO: 732599 - RNA, 22 nt, Human
ccuaggaaauaacagaaaucac

SEQ ID NO: 732600 - RNA, 26 nt, Human
ccuccugucuuggccucccaaagagc

SEQ ID NO: 732601 - RNA, 21 nt, Human
ccucgaccuccugggcucaag

SEQ ID NO: 732602 - RNA, 18 nt, Human
ccucgcugcgacuuaggg

SEQ ID NO: 732603 - RNA, 22 nt, Human
ccucuaaauggucauuauguuu

SEQ ID NO: 732604 - RNA, 22 nt, Human
ccugggcucaagugauccuccu

SEQ ID NO: 732605 - RNA, 23 nt, Human
ccugggcucaagugauccuccug

SEQ ID NO: 732606 - RNA, 25 nt, Human
cgaccuccugggcucaagugauccu

SEQ ID NO: 732607 - RNA, 22 nt, Human
cgagcaccaagcagggggccgg

SEQ ID NO: 732608 - RNA, 20 nt, Human
cgcccacucucaacaaaaca

SEQ ID NO: 732609 - RNA, 19 nt, Human
cgccgugcugggcucacuc

SEQ ID NO: 732610 - RNA, 18 nt, Human
cggcauaaaugguaagcc

SEQ ID NO: 732611 - RNA, 18 nt, Human
cgucagaacuccugaagc

SEQ ID NO: 732612 - RNA, 22 nt, Human
cguggccacuaaguaacaaaau

SEQ ID NO: 732613 - RNA, 21 nt, Human
cucacugcagccucgaccucc

SEQ ID NO: 732614 - RNA, 24 nt, Human
cucacugcagccucgaccuccugg

SEQ ID NO: 732615 - RNA, 22 nt, Human
cuccaagaucuaccucuacucu

SEQ ID NO: 732616 - RNA, 20 nt, Human
cuccacacagcagcaucacc

SEQ ID NO: 732617 - RNA, 20 nt, Human
cuccagcccugggacagaca

SEQ ID NO: 732618 - RNA, 19 nt, Human
cuccagggacggauucucc

SEQ ID NO: 732619 - RNA, 21 nt, Human
cuccagggacggauucucccu

SEQ ID NO: 732620 - RNA, 20 nt, Human
cuccucccugccugagaaga

SEQ ID NO: 732621 - RNA, 18 nt, Human
cucucucucuacaaaugu

SEQ ID NO: 732622 - RNA, 24 nt, Human
cugagggcauaaaaccaaacaaaa

SEQ ID NO: 732623 - RNA, 22 nt, Human
cugcagccucgaccuccugggc

SEQ ID NO: 732624 - RNA, 23 nt, Human
cugcagccucgaccuccugggcu

SEQ ID NO: 732625 - RNA, 22 nt, Human
cugcagugguugugaucccggc

SEQ ID NO: 732626 - RNA, 23 nt, Human
cugucuuggccucccaaagagcu

SEQ ID NO: 732627 - RNA, 21 nt, Human
cuucagaagcuacaacacucc

SEQ ID NO: 732628 - RNA, 24 nt, Human
cuuggccucccaaagagcugggau

SEQ ID NO: 732629 - RNA, 23 nt, Human
gaaaugccucugaauguauuuuu

SEQ ID NO: 732630 - RNA, 22 nt, Human
gaagaagccaaacgagccuaga

SEQ ID NO: 732631 - RNA, 24 nt, Human
gacagcagcagugaaaugauggcc

SEQ ID NO: 732632 - RNA, 21 nt, Human
gacaggcagagggcugcagga

SEQ ID NO: 732633 - RNA, 24 nt, Human
gacugcuuuccuaacaguaaauau

SEQ ID NO: 732634 - RNA, 19 nt, Human
gagaaagcaaaacacagaa

SEQ ID NO: 732635 - RNA, 21 nt, Human
gagaagaagccaaacgagccu

SEQ ID NO: 732636 - RNA, 21 nt, Human
gagaaggaggaggugagaaga

SEQ ID NO: 732637 - RNA, 18 nt, Human
gagagagaggcugagagc

SEQ ID NO: 732638 - RNA, 18 nt, Human
gagcuggucacgagcacc

SEQ ID NO: 732639 - RNA, 24 nt, Human
gaggagaaggcaaggggaaaggga

SEQ ID NO: 732640 - RNA, 18 nt, Human
gaggagaggaggggaggg

SEQ ID NO: 732641 - RNA, 18 nt, Human
gaggauggggaggguggg

SEQ ID NO: 732642 - RNA, 21 nt, Human
gaggauggggaggguggggau

SEQ ID NO: 732643 - RNA, 21 nt, Human
gauaguacaaguacaugcaau

SEQ ID NO: 732644 - RNA, 22 nt, Human
gaucuacuuuagcaaucauuug

SEQ ID NO: 732645 - RNA, 22 nt, Human
gaugaaaaagcaugggaaaaga

SEQ ID NO: 732646 - RNA, 24 nt, Human
gaugaguucgccuuuugcugcugc

SEQ ID NO: 732647 - RNA, 21 nt, Human
gauggagaaagcaaaacacag

SEQ ID NO: 732648 - RNA, 24 nt, Human
gcaccaugauagcucacugcagcc

SEQ ID NO: 732649 - RNA, 21 nt, Human
gcaucucagaaccuucuccac

SEQ ID NO: 732650 - RNA, 20 nt, Human
gcaugaaaacaaaagaaaac

SEQ ID NO: 732651 - RNA, 18 nt, Human
gccacuaaccccacaauc

SEQ ID NO: 732652 - RNA, 18 nt, Human
gcccagccaaagaacaga

SEQ ID NO: 732653 - RNA, 23 nt, Human
gccuagaacccacucccugucuu

SEQ ID NO: 732654 - RNA, 19 nt, Human
gccucgaccuccugggcuc

SEQ ID NO: 732655 - RNA, 18 nt, Human
gcucaccagacaugggcu

SEQ ID NO: 732656 - RNA, 25 nt, Human
gcucuguugcccaggcugaagugua

SEQ ID NO: 732657 - RNA, 20 nt, Human
ggagaaagcaaaacacagaa

SEQ ID NO: 732658 - RNA, 20 nt, Human
ggagagaaggguggacagaa

SEQ ID NO: 732659 - RNA, 23 nt, Human
ggagaggaggggaggguggggag

SEQ ID NO: 732660 - RNA, 19 nt, Human
ggaggguggggauggggag

SEQ ID NO: 732661 - RNA, 18 nt, Human
ggcagggcuuacacuccu

SEQ ID NO: 732662 - RNA, 18 nt, Human
ggcagggucuugcucugu

SEQ ID NO: 732663 - RNA, 24 nt, Human
ggcugugugaaaauaagaaaaaaa

SEQ ID NO: 732664 - RNA, 19 nt, Human
gggaaaagacaagucagaa

SEQ ID NO: 732665 - RNA, 18 nt, Human
gggaagcaucuccagccc

SEQ ID NO: 732666 - RNA, 22 nt, Human
gggcaauaaagggaacucugau

SEQ ID NO: 732667 - RNA, 19 nt, Human
gggcucaagugauccuccu

SEQ ID NO: 732668 - RNA, 18 nt, Human
ggggagagugaggagggu

SEQ ID NO: 732669 - RNA, 18 nt, Human
ggggagccuuaggcuugg

SEQ ID NO: 732670 - RNA, 18 nt, Human
ggggauggggaggguggg

SEQ ID NO: 732671 - RNA, 22 nt, Human
gggggaguggagugcccaauuc

SEQ ID NO: 732672 - RNA, 19 nt, Human
gggggccggcuggcugacu

SEQ ID NO: 732673 - RNA, 25 nt, Human
ggguggggauggggagggugggaag

SEQ ID NO: 732674 - RNA, 19 nt, Human
ggugcugaggacaaggauc

SEQ ID NO: 732675 - RNA, 21 nt, Human
gguggagggaagagaugaaag

SEQ ID NO: 732676 - RNA, 24 nt, Human
gguggggagagugaggaggguggg

SEQ ID NO: 732677 - RNA, 19 nt, Human
guagagaugaguucgccuu

SEQ ID NO: 732678 - RNA, 20 nt, Human
guccuguguggggagggccc

SEQ ID NO: 732679 - RNA, 21 nt, Human
gucugcucugagcgccccucu

SEQ ID NO: 732680 - RNA, 23 nt, Human
gugaggaggagaggaggggaggg

SEQ ID NO: 732681 - RNA, 20 nt, Human
gugcaaaagaauccacauca

SEQ ID NO: 732682 - RNA, 21 nt, Human
gugcccagggcaugccccaaa

SEQ ID NO: 732683 - RNA, 25 nt, Human
gugcugccagugcuggggggcaggg

SEQ ID NO: 732684 - RNA, 21 nt, Human
guggccacuaaguaacaaaau

SEQ ID NO: 732685 - RNA, 23 nt, Human
guucgccuuuugcugcugcugcc

SEQ ID NO: 732686 - RNA, 19 nt, Human
uaaaaagcagaaagauuug

SEQ ID NO: 732687 - RNA, 18 nt, Human
uaaaagcauccuuugcaa

SEQ ID NO: 732688 - RNA, 21 nt, Human
uaaaagcauuuuuagaaauug

SEQ ID NO: 732689 - RNA, 26 nt, Human
uaaaagcauuuuuagaaauuguuuuc

SEQ ID NO: 732690 - RNA, 19 nt, Human
uaaaauguccugcaugaaa

SEQ ID NO: 732691 - RNA, 22 nt, Human
uaaacagauaauaugcugaaag

SEQ ID NO: 732692 - RNA, 19 nt, Human
uaaagcaguaucuuccccu

SEQ ID NO: 732693 - RNA, 24 nt, Human
uaaccaaaaaaugaucacaccagg

SEQ ID NO: 732694 - RNA, 19 nt, Human
uaacuggugaaaugauucu

SEQ ID NO: 732695 - RNA, 24 nt, Human
uaagacacugagggcauaaaacca

SEQ ID NO: 732696 - RNA, 21 nt, Human
uaagauaaggaaaaagagcaa

SEQ ID NO: 732697 - RNA, 21 nt, Human
uacaacacuccuuguacccuu

SEQ ID NO: 732698 - RNA, 19 nt, Human
uacaacaggaggaauccag

SEQ ID NO: 732699 - RNA, 18 nt, Human
uacaaguacaugcaauuc

SEQ ID NO: 732700 - RNA, 21 nt, Human
uacauaauaacaaaaaaugua

SEQ ID NO: 732701 - RNA, 20 nt, Human
uaccauaagugguaaauaac

SEQ ID NO: 732702 - RNA, 24 nt, Human
uacccuuccuuuauaaaagguaag

SEQ ID NO: 732703 - RNA, 21 nt, Human
uagaagaaaacaaaggugaua

SEQ ID NO: 732704 - RNA, 23 nt, Human
uagaagaaaacugcaguugccuc

SEQ ID NO: 732705 - RNA, 24 nt, Human
uagaagaaaacugcaguugccuug

SEQ ID NO: 732706 - RNA, 24 nt, Human
uagcagaaaugcaacaugauccuc

SEQ ID NO: 732707 - RNA, 24 nt, Human
uagcucacugcagccucgaccucc

SEQ ID NO: 732708 - RNA, 26 nt, Human
uaggaaaagaaacaucuuggguagag

SEQ ID NO: 732709 - RNA, 24 nt, Human
uauaaucaaaucugagcuggcacc

SEQ ID NO: 732710 - RNA, 22 nt, Human
uaugaccaguuugaggacaggg

SEQ ID NO: 732711 - RNA, 21 nt, Human
uauggaaggagagagaggcug

SEQ ID NO: 732712 - RNA, 24 nt, Human
uauuucuccucuucugaucuuggg

SEQ ID NO: 732713 - RNA, 22 nt, Human
ucaacacccaaaaagcugaagu

SEQ ID NO: 732714 - RNA, 22 nt, Human
ucacauccauuuuccacuggcu

SEQ ID NO: 732715 - RNA, 23 nt, Human
ucacugcagccucgaccuccugg

SEQ ID NO: 732716 - RNA, 24 nt, Human
ucacugcagccucgaccuccuggg

SEQ ID NO: 732717 - RNA, 18 nt, Human
ucaggucccucuucucca

SEQ ID NO: 732718 - RNA, 24 nt, Human
ucauaugacaaugauccaacuaaa

SEQ ID NO: 732719 - RNA, 19 nt, Human
ucccaaagagcugggauua

SEQ ID NO: 732720 - RNA, 23 nt, Human
ucccaaagagcugggauuacagg

SEQ ID NO: 732721 - RNA, 24 nt, Human
ucccaaagagcugggauuacaggc

SEQ ID NO: 732722 - RNA, 21 nt, Human
uccugggcucaagugauccuc

SEQ ID NO: 732723 - RNA, 22 nt, Human
uccugggcucaagugauccucc

SEQ ID NO: 732724 - RNA, 22 nt, Human
uccugggcucaagugauccucc

SEQ ID NO: 732725 - RNA, 24 nt, Human
uccugggcucaagugauccuccug

SEQ ID NO: 732726 - RNA, 19 nt, Human
ucuaaaaagcagaaagauu

SEQ ID NO: 732727 - RNA, 25 nt, Human
ucucaauacuauauuuucucucccu

SEQ ID NO: 732728 - RNA, 22 nt, Human
ucucucgcucucucucuacaaa

SEQ ID NO: 732729 - RNA, 24 nt, Human
ucucugcccuguugggaggcugaa

SEQ ID NO: 732730 - RNA, 19 nt, Human
ucucuuucucuacucaugu

SEQ ID NO: 732731 - RNA, 20 nt, Human
ucugcaaguguuuucuacag

SEQ ID NO: 732732 - RNA, 24 nt, Human
ucuguugcccaggcugaaguguag

SEQ ID NO: 732733 - RNA, 19 nt, Human
ucuugcucuguugcccagg

SEQ ID NO: 732734 - RNA, 22 nt, Human
ucuugcucuguugcccaggcug

SEQ ID NO: 732735 - RNA, 23 nt, Human
ucuugcucuguugcccaggcuga

SEQ ID NO: 732736 - RNA, 24 nt, Human
ucuugcucuguugcccaggcugaa

SEQ ID NO: 732737 - RNA, 21 nt, Human
ugaaaaguaaaagagaggcaa

SEQ ID NO: 732738 - RNA, 22 nt, Human
ugaaagcaaaaucugucuaauc

SEQ ID NO: 732739 - RNA, 18 nt, Human
ugaaguggcuucaaaugu

SEQ ID NO: 732740 - RNA, 22 nt, Human
ugacaggaauuucagauucucc

SEQ ID NO: 732741 - RNA, 18 nt, Human
ugaccucugcucaccccu

SEQ ID NO: 732742 - RNA, 22 nt, Human
ugagaagaagccaaacgagccu

SEQ ID NO: 732743 - RNA, 23 nt, Human
ugagaagaagccaaacgagccua

SEQ ID NO: 732744 - RNA, 20 nt, Human
ugagaagagaagggagagag

SEQ ID NO: 732745 - RNA, 20 nt, Human
ugagacucuacugugaaagc

SEQ ID NO: 732746 - RNA, 21 nt, Human
ugagauacggaguaaaaagaa

SEQ ID NO: 732747 - RNA, 21 nt, Human
ugaggaggagaggaggggagg

SEQ ID NO: 732748 - RNA, 21 nt, Human
ugaggaggagaggaggggagg

SEQ ID NO: 732749 - RNA, 22 nt, Human
ugaggaggagaggaggggaggg

SEQ ID NO: 732750 - RNA, 24 nt, Human
ugaggaggagaggaggggagggug

SEQ ID NO: 732751 - RNA, 25 nt, Human
ugaggaggagaggaggggagggugg

SEQ ID NO: 732752 - RNA, 19 nt, Human
ugaggaggguggggagagu

SEQ ID NO: 732753 - RNA, 20 nt, Human
ugaggaggguggggagagug

SEQ ID NO: 732754 - RNA, 20 nt, Human
ugaggaggguggggagagug

SEQ ID NO: 732755 - RNA, 22 nt, Human
ugaggaggguggggagaguggg

SEQ ID NO: 732756 - RNA, 22 nt, Human
ugaggcagggucuugcucuguu

SEQ ID NO: 732757 - RNA, 21 nt, Human
ugagggcauaaaaccaaacaa

SEQ ID NO: 732758 - RNA, 22 nt, Human
ugaggguaaagcaggucuugga

SEQ ID NO: 732759 - RNA, 19 nt, Human
ugaguaacaaagucauaag

SEQ ID NO: 732760 - RNA, 20 nt, Human
ugauauuacacuaucaaaua

SEQ ID NO: 732761 - RNA, 21 nt, Human
ugauuugagucagcuuccccc

SEQ ID NO: 732762 - RNA, 23 nt, Human
ugcaucucagaaccuucuccaca

SEQ ID NO: 732763 - RNA, 24 nt, Human
ugcccagccaaagaacagaauuuu

SEQ ID NO: 732764 - RNA, 23 nt, Human
ugcccaggcugaaguguaguggc

SEQ ID NO: 732765 - RNA, 24 nt, Human
ugcccaggcugaaguguaguggca

SEQ ID NO: 732766 - RNA, 18 nt, Human
ugccuugguguucuguca

SEQ ID NO: 732767 - RNA, 24 nt, Human
ugcucuguugcccaggcugaagug

SEQ ID NO: 732768 - RNA, 20 nt, Human
ugcugccagugcuggggggc

SEQ ID NO: 732769 - RNA, 25 nt, Human
ugcugggcucacucacucuggccug

SEQ ID NO: 732770 - RNA, 21 nt, Human
uggaaaugccacuaaccccac

SEQ ID NO: 732771 - RNA, 19 nt, Human
uggcaccaugauagcucac

SEQ ID NO: 732772 - RNA, 23 nt, Human
uggcaccaugauagcucacugca

SEQ ID NO: 732773 - RNA, 19 nt, Human
uggcagggagcggagagcg

SEQ ID NO: 732774 - RNA, 18 nt, Human
uggccaccucagugacac

SEQ ID NO: 732775 - RNA, 20 nt, Human
uggccucccaaagagcuggg

SEQ ID NO: 732776 - RNA, 21 nt, Human
uggccucccaaagagcuggga

SEQ ID NO: 732777 - RNA, 18 nt, Human
ugggaaaagacaagucag

SEQ ID NO: 732778 - RNA, 18 nt, Human
ugggaagagugaggagga

SEQ ID NO: 732779 - RNA, 24 nt, Human
ugggaagagugaggaggagaggag

SEQ ID NO: 732780 - RNA, 23 nt, Human
ugggauuacaggcacaugcgcca

SEQ ID NO: 732781 - RNA, 24 nt, Human
ugggauuacaggcacaugcgccac

SEQ ID NO: 732782 - RNA, 26 nt, Human
ugggauuacaggcacaugcgccacca

SEQ ID NO: 732783 - RNA, 24 nt, Human
ugggcucaagugauccuccugucu

SEQ ID NO: 732784 - RNA, 19 nt, Human
uggggagagugaggagggu

SEQ ID NO: 732785 - RNA, 23 nt, Human
uggggagggugggaagagugagg

SEQ ID NO: 732786 - RNA, 18 nt, Human
uggggaggguggggaugg

SEQ ID NO: 732787 - RNA, 24 nt, Human
uggggaggguggggauggggaggg

SEQ ID NO: 732788 - RNA, 23 nt, Human
uggguaugaacacauuuaugacc

SEQ ID NO: 732789 - RNA, 19 nt, Human
ugguagcagaggaucucuu

SEQ ID NO: 732790 - RNA, 21 nt, Human
uguagaaauagauccuucuga

SEQ ID NO: 732791 - RNA, 18 nt, Human
uguauaaauauauacaua

SEQ ID NO: 732792 - RNA, 22 nt, Human
uguauccauauaacacaacaaa

SEQ ID NO: 732793 - RNA, 21 nt, Human
ugucaaagaaaaagacaacua

SEQ ID NO: 732794 - RNA, 22 nt, Human
ugucugccagggacucccaaaa

SEQ ID NO: 732795 - RNA, 20 nt, Human
ugugaagaagcccacgccca

SEQ ID NO: 732796 - RNA, 20 nt, Human
uguguauaaauauauacaua

SEQ ID NO: 732797 - RNA, 23 nt, Human
uguuuucuuugccuagaacccac

SEQ ID NO: 732798 - RNA, 18 nt, Human
uuaaagagagaauccugu

SEQ ID NO: 732799 - RNA, 24 nt, Human
uuaaucauauacaccuagcaaccc

SEQ ID NO: 732800 - RNA, 19 nt, Human
uuacaggcacaugcgccac

SEQ ID NO: 732801 - RNA, 19 nt, Human
uuacaggcacaugcgccac

SEQ ID NO: 732802 - RNA, 21 nt, Human
uuagaaauuuucaacacccaa

SEQ ID NO: 732803 - RNA, 22 nt, Human
uuaggacuauaaugagacucua

SEQ ID NO: 732804 - RNA, 23 nt, Human
uugaucuuaaaagcauccuuugc

SEQ ID NO: 732805 - RNA, 24 nt, Human
uugaucuuaaaagcauccuuugca

SEQ ID NO: 732806 - RNA, 24 nt, Human
uugcccaggcugaaguguaguggc

SEQ ID NO: 732807 - RNA, 20 nt, Human
uuggacaggcagagggcugc

SEQ ID NO: 732808 - RNA, 19 nt, Human
uugguuaaggcuguugaag

SEQ ID NO: 732809 - RNA, 24 nt, Human
uuucacuuuuacuugauuauaaac

SEQ ID NO: 732810 - RNA, 19 nt, Human
uuugcugcugcugcugaag

SEQ ID NO: 732811 - RNA, 24 nt, Human
uuuugaucuuaaaagcauccuuug

SEQ ID NO: 732812 - RNA, 25 nt, Human
aaaaaccacaagccaaaccuguggg

SEQ ID NO: 732813 - RNA, 22 nt, Human
aaaacuaagacguaacauucuu

SEQ ID NO: 732814 - RNA, 19 nt, Human
aaaagaaaacagucccggg

SEQ ID NO: 732815 - RNA, 23 nt, Human
aaagagacggggcauuuaaggag

SEQ ID NO: 732816 - RNA, 20 nt, Human
aaagcugauccuugaacacu

SEQ ID NO: 732817 - RNA, 19 nt, Human
aaagugggcucccaagccc

SEQ ID NO: 732818 - RNA, 19 nt, Human
aagcgaaacaccaaaaaca

SEQ ID NO: 732819 - RNA, 18 nt, Human
aaggagcccaaggggggc

SEQ ID NO: 732820 - RNA, 24 nt, Human
aaggcaaccaagccucggaguuca

SEQ ID NO: 732821 - RNA, 21 nt, Human
aaggugcaaaugucaaagugc

SEQ ID NO: 732822 - RNA, 22 nt, Human
acaaacaaaguggcccuggagc

SEQ ID NO: 732823 - RNA, 23 nt, Human
acacacacacacacacacacaca

SEQ ID NO: 732824 - RNA, 23 nt, Human
acacacacacacacacacacaca

SEQ ID NO: 732825 - RNA, 22 nt, Human
acagaaaagcgaaacaccaaaa

SEQ ID NO: 732826 - RNA, 23 nt, Human
acagggcagcccgcagcuaacuu

SEQ ID NO: 732827 - RNA, 22 nt, Human
accacagcccucaccucaaccc

SEQ ID NO: 732828 - RNA, 24 nt, Human
accaccccccagcaagacacacac

SEQ ID NO: 732829 - RNA, 20 nt, Human
accaggccuugcucccagca

SEQ ID NO: 732830 - RNA, 19 nt, Human
acccagugccgcaaaagcc

SEQ ID NO: 732831 - RNA, 20 nt, Human
accucaacccacuuuacugg

SEQ ID NO: 732832 - RNA, 21 nt, Human
acuugugcuaaagcucccuuc

SEQ ID NO: 732833 - RNA, 19 nt, Human
acuuuccucagagacgaac

SEQ ID NO: 732834 - RNA, 18 nt, Human
agaaaacuuacaaugcug

SEQ ID NO: 732835 - RNA, 19 nt, Human
agaaagaaaagcaguagaa

SEQ ID NO: 732836 - RNA, 18 nt, Human
agaagcagcgacagccag

SEQ ID NO: 732837 - RNA, 24 nt, Human
agcagcuacuaugguauuuugagg

SEQ ID NO: 732838 - RNA, 22 nt, Human
agccacgaugucaaaggcgucc

SEQ ID NO: 732839 - RNA, 18 nt, Human
agcuauuuaaagagcuga

SEQ ID NO: 732840 - RNA, 21 nt, Human
aggaaagggaggggaagaaga

SEQ ID NO: 732841 - RNA, 18 nt, Human
aggcucacugacgcauac

SEQ ID NO: 732842 - RNA, 23 nt, Human
agggaggggaagaagauuagcuu

SEQ ID NO: 732843 - RNA, 24 nt, Human
auccuucugaagggccagcgccag

SEQ ID NO: 732844 - RNA, 20 nt, Human
augucaaaugccccugaaac

SEQ ID NO: 732845 - RNA, 19 nt, Human
cacacaaacuaaaacucac

SEQ ID NO: 732846 - RNA, 20 nt, Human
cacacacacacacacacaca

SEQ ID NO: 732847 - RNA, 20 nt, Human
cacacacacacacacacaca

SEQ ID NO: 732848 - RNA, 20 nt, Human
cacacacacacacacacaca

SEQ ID NO: 732849 - RNA, 20 nt, Human
cacacacacacacacacaca

SEQ ID NO: 732850 - RNA, 20 nt, Human
cacacacacacacacacaca

SEQ ID NO: 732851 - RNA, 22 nt, Human
cacacacacacacacacacaca

SEQ ID NO: 732852 - RNA, 21 nt, Human
cacacacuggugacuguaaua

SEQ ID NO: 732853 - RNA, 23 nt, Human
caccccccagcaagacacacaca

SEQ ID NO: 732854 - RNA, 24 nt, Human
cacugauccacugagucaucccag

SEQ ID NO: 732855 - RNA, 21 nt, Human
cagacacagaggggaaguggg

SEQ ID NO: 732856 - RNA, 21 nt, Human
cagcaaaggcaaccaagccuc

SEQ ID NO: 732857 - RNA, 22 nt, Human
cagcaagacacacacaaacuaa

SEQ ID NO: 732858 - RNA, 19 nt, Human
caggggcagggccuguuuc

SEQ ID NO: 732859 - RNA, 24 nt, Human
cauccuguguccccucgggcugug

SEQ ID NO: 732860 - RNA, 18 nt, Human
caucugccucuccuaagg

SEQ ID NO: 732861 - RNA, 18 nt, Human
ccaaaaacaagacccagg

SEQ ID NO: 732862 - RNA, 19 nt, Human
ccacagggcagcccgcagc

SEQ ID NO: 732863 - RNA, 22 nt, Human
ccaccaagcagcaagacacucu

SEQ ID NO: 732864 - RNA, 18 nt, Human
ccacccagccccgcccua

SEQ ID NO: 732865 - RNA, 19 nt, Human
ccagugccgcaaaagccaa

SEQ ID NO: 732866 - RNA, 22 nt, Human
cccaagccccucuccuagaucc

SEQ ID NO: 732867 - RNA, 20 nt, Human
cccagccccgcccuaggugg

SEQ ID NO: 732868 - RNA, 23 nt, Human
ccccccagcaagacacacacaaa

SEQ ID NO: 732869 - RNA, 26 nt, Human
cccucauuccuugacaacuuccccaa

SEQ ID NO: 732870 - RNA, 21 nt, Human
ccucccaucucccacccagcc

SEQ ID NO: 732871 - RNA, 18 nt, Human
ccugggguuuccauccug

SEQ ID NO: 732872 - RNA, 21 nt, Human
cgaaacaccaaaaacaagacc

SEQ ID NO: 732873 - RNA, 20 nt, Human
cgcacacacacacacacaca

SEQ ID NO: 732874 - RNA, 21 nt, Human
cuaaaacucacccagugccgc

SEQ ID NO: 732875 - RNA, 22 nt, Human
cucacagcccaacuggacagcc

SEQ ID NO: 732876 - RNA, 24 nt, Human
cuccuggugggucugcgcuguguc

SEQ ID NO: 732877 - RNA, 21 nt, Human
cucuaauaauaauaaccugag

SEQ ID NO: 732878 - RNA, 27 nt, Human
cugggguuuccauccugugacgucucg

SEQ ID NO: 732879 - RNA, 19 nt, Human
cuuuauauuacuuuacagu

SEQ ID NO: 732880 - RNA, 26 nt, Human
gagcugggccucuuuccuccuggucg

SEQ ID NO: 732881 - RNA, 18 nt, Human
gagggaggcugaggagga

SEQ ID NO: 732882 - RNA, 24 nt, Human
gcagcccgcagcuaacuuccucag

SEQ ID NO: 732883 - RNA, 18 nt, Human
gccacagcucacagccca

SEQ ID NO: 732884 - RNA, 19 nt, Human
gccagcgccaguccugggu

SEQ ID NO: 732885 - RNA, 21 nt, Human
gccaguccugggugccacagc

SEQ ID NO: 732886 - RNA, 26 nt, Human
gcccaggggcuggggaagcacuggcc

SEQ ID NO: 732887 - RNA, 18 nt, Human
gcccucaccucaacccac

SEQ ID NO: 732888 - RNA, 22 nt, Human
gcgaaacaccaaaaacaagacc

SEQ ID NO: 732889 - RNA, 20 nt, Human
gcggcccaaagcagauuuuc

SEQ ID NO: 732890 - RNA, 21 nt, Human
gcucauaccaggccuugcucc

SEQ ID NO: 732891 - RNA, 18 nt, Human
gcugcggcccaaagcaga

SEQ ID NO: 732892 - RNA, 18 nt, Human
gcuugucuguuuuccacu

SEQ ID NO: 732893 - RNA, 19 nt, Human
ggaagcacuggccuggcuc

SEQ ID NO: 732894 - RNA, 20 nt, Human
ggauuccuccugaagcacca

SEQ ID NO: 732895 - RNA, 27 nt, Human
ggccuguuuccuccaaaggaaaccuuu

SEQ ID NO: 732896 - RNA, 20 nt, Human
ggcucccaagccccucuccu

SEQ ID NO: 732897 - RNA, 21 nt, Human
ggcugcagggcaggggagagc

SEQ ID NO: 732898 - RNA, 21 nt, Human
gggaagcacuggccuggcuca

SEQ ID NO: 732899 - RNA, 20 nt, Human
gggaagugggagaggaaagg

SEQ ID NO: 732900 - RNA, 22 nt, Human
gggagaggaaagggaggggaag

SEQ ID NO: 732901 - RNA, 22 nt, Human
gggaugucaaaugccccugaaa

SEQ ID NO: 732902 - RNA, 21 nt, Human
gggcugcagggcaggggagag

SEQ ID NO: 732903 - RNA, 19 nt, Human
ggggagagcugagaagugg

SEQ ID NO: 732904 - RNA, 21 nt, Human
guacauauauacauguuaaca

SEQ ID NO: 732905 - RNA, 18 nt, Human
gucaagggacuggguagc

SEQ ID NO: 732906 - RNA, 20 nt, Human
guugugcaaucacaggagau

SEQ ID NO: 732907 - RNA, 23 nt, Human
uaaacaccaaaaccuuccacgca

SEQ ID NO: 732908 - RNA, 21 nt, Human
uaaagugaggccccuuuuccc

SEQ ID NO: 732909 - RNA, 20 nt, Human
uaaccugagaaaacuuacaa

SEQ ID NO: 732910 - RNA, 22 nt, Human
uacagaaaagcgaaacaccaaa

SEQ ID NO: 732911 - RNA, 23 nt, Human
uacagaaaagcgaaacaccaaaa

SEQ ID NO: 732912 - RNA, 24 nt, Human
uacagaaaagcgaaacaccaaaaa

SEQ ID NO: 732913 - RNA, 20 nt, Human
uacauaauagagaaccagau

SEQ ID NO: 732914 - RNA, 25 nt, Human
uagaaaggagcccaaggggggcauc

SEQ ID NO: 732915 - RNA, 23 nt, Human
uagguggucuuuggauuccauuu

SEQ ID NO: 732916 - RNA, 21 nt, Human
uauaaacaccaaaaccuucca

SEQ ID NO: 732917 - RNA, 18 nt, Human
uaugguauuuugaggccc

SEQ ID NO: 732918 - RNA, 21 nt, Human
uauuaaaaagaaaacaguccc

SEQ ID NO: 732919 - RNA, 23 nt, Human
ucacaggagaugggcagcuauuu

SEQ ID NO: 732920 - RNA, 19 nt, Human
uccacaggaagaaaaauga

SEQ ID NO: 732921 - RNA, 22 nt, Human
uccagaaggugauagaaggcuc

SEQ ID NO: 732922 - RNA, 21 nt, Human
uccaucgucagcugagagcug

SEQ ID NO: 732923 - RNA, 22 nt, Human
ucccaagccccucuccuagauc

SEQ ID NO: 732924 - RNA, 21 nt, Human
ucccagcaggaauuuaaaacc

SEQ ID NO: 732925 - RNA, 24 nt, Human
uccccaaacccgacuccgguucug

SEQ ID NO: 732926 - RNA, 23 nt, Human
ucccuaucugcuuaauccuuaca

SEQ ID NO: 732927 - RNA, 21 nt, Human
ucccuuucaggaccacagccc

SEQ ID NO: 732928 - RNA, 18 nt, Human
uccugggugccacagcuc

SEQ ID NO: 732929 - RNA, 23 nt, Human
uccuucugaagggccagcgccag

SEQ ID NO: 732930 - RNA, 19 nt, Human
uccuugaacacuauguagc

SEQ ID NO: 732931 - RNA, 21 nt, Human
ugacaacuuccccaaacccga

SEQ ID NO: 732932 - RNA, 29 nt, Human
ugacaacuuccccaaacccgacuccgguu

SEQ ID NO: 732933 - RNA, 18 nt, Human
ugaccaggcccaggggcu

SEQ ID NO: 732934 - RNA, 19 nt, Human
ugacuuuguuccagaaggu

SEQ ID NO: 732935 - RNA, 18 nt, Human
ugaggaggaagcugcaga

SEQ ID NO: 732936 - RNA, 19 nt, Human
ugaggaggaagcugcagag

SEQ ID NO: 732937 - RNA, 19 nt, Human
ugcaaggagggaggcugag

SEQ ID NO: 732938 - RNA, 23 nt, Human
ugcagggcaggggagagcugaga

SEQ ID NO: 732939 - RNA, 23 nt, Human
ugcagugcuguauccugcugcca

SEQ ID NO: 732940 - RNA, 21 nt, Human
ugcgaugagcacccaccaagc

SEQ ID NO: 732941 - RNA, 21 nt, Human
uggcccagggcugcagggcag

SEQ ID NO: 732942 - RNA, 23 nt, Human
uggccuggcucacccuucaguga

SEQ ID NO: 732943 - RNA, 18 nt, Human
ugggaauacuuuagucuc

SEQ ID NO: 732944 - RNA, 18 nt, Human
ugggagaggaaagggagg

SEQ ID NO: 732945 - RNA, 21 nt, Human
ugggagaggaaagggagggga

SEQ ID NO: 732946 - RNA, 22 nt, Human
uggggaagcacuggccuggcuc

SEQ ID NO: 732947 - RNA, 18 nt, Human
ugggguuuccauccugug

SEQ ID NO: 732948 - RNA, 23 nt, Human
ugguauuuugaggcccagaucau

SEQ ID NO: 732949 - RNA, 19 nt, Human
ugucaaagugcuugguugu

SEQ ID NO: 732950 - RNA, 21 nt, Human
uguguagugaccaggcccagg

SEQ ID NO: 732951 - RNA, 22 nt, Human
uguguuugaagcagaaagaaaa

SEQ ID NO: 732952 - RNA, 19 nt, Human
uguugcugcccaggcagga

SEQ ID NO: 732953 - RNA, 21 nt, Human
uucaucucaguacauguuuuu

SEQ ID NO: 732954 - RNA, 21 nt, Human
uuccaaccucucuaauaauaa

SEQ ID NO: 732955 - RNA, 20 nt, Human
uuccagaaggugauagaagg

SEQ ID NO: 732956 - RNA, 20 nt, Human
uuccuugacaacuuccccaa

SEQ ID NO: 732957 - RNA, 20 nt, Human
uucucuggauuccuccugaa

SEQ ID NO: 732958 - RNA, 18 nt, Human
uuuauagccacacaaaac

SEQ ID NO: 732959 - RNA, 20 nt, Human
uuuuaaacguuauuuaacca

SEQ ID NO: 732960 - RNA, 26 nt, Human
aaaaaaaacuucaaugacuagagaag

SEQ ID NO: 732961 - RNA, 23 nt, Human
aaaaauccccaaaguuggcacau

SEQ ID NO: 732962 - RNA, 22 nt, Human
aaaagacauguuaucaaauaua

SEQ ID NO: 732963 - RNA, 20 nt, Human
aaacaggcaaaagccaguau

SEQ ID NO: 732964 - RNA, 22 nt, Human
aacccagcuauucccugagcgg

SEQ ID NO: 732965 - RNA, 18 nt, Human
aagcagaagaaaaacuau

SEQ ID NO: 732966 - RNA, 22 nt, Human
aagcagaagaaaaacuaugcag

SEQ ID NO: 732967 - RNA, 24 nt, Human
aagcagaagaaaaacuaugcagaa

SEQ ID NO: 732968 - RNA, 22 nt, Human
aauaaaaaguaagcagaagaaa

SEQ ID NO: 732969 - RNA, 23 nt, Human
aauugccagaagggauaugguua

SEQ ID NO: 732970 - RNA, 21 nt, Human
accuuuuccucuacaaacagg

SEQ ID NO: 732971 - RNA, 18 nt, Human
acuugguuuuaucaguaa

SEQ ID NO: 732972 - RNA, 21 nt, Human
agaaaacucuucauaucauca

SEQ ID NO: 732973 - RNA, 19 nt, Human
agaaagcaaaauaugauca

SEQ ID NO: 732974 - RNA, 19 nt, Human
agaacacagguagaaucaa

SEQ ID NO: 732975 - RNA, 22 nt, Human
agaacacagguagaaucaacau

SEQ ID NO: 732976 - RNA, 22 nt, Human
agauuaggaaauaucauacugc

SEQ ID NO: 732977 - RNA, 18 nt, Human
aggaagaagugcucccau

SEQ ID NO: 732978 - RNA, 23 nt, Human
agggaaaacguguguguucuggg

SEQ ID NO: 732979 - RNA, 18 nt, Human
agguagaaucaacauaug

SEQ ID NO: 732980 - RNA, 19 nt, Human
agucauuaaaaacuguagc

SEQ ID NO: 732981 - RNA, 22 nt, Human
agucauuaaaaacuguagccuu

SEQ ID NO: 732982 - RNA, 24 nt, Human
auagaacacuaagaagagauacca

SEQ ID NO: 732983 - RNA, 18 nt, Human
aucaaguauauaucggaa

SEQ ID NO: 732984 - RNA, 18 nt, Human
aucuguaaacaacuccuu

SEQ ID NO: 732985 - RNA, 23 nt, Human
auugugcuuuucccucuccuuga

SEQ ID NO: 732986 - RNA, 20 nt, Human
auuuacucacuaagaaaaca

SEQ ID NO: 732987 - RNA, 21 nt, Human
caaacaggcaaaagccaguau

SEQ ID NO: 732988 - RNA, 18 nt, Human
cacagccuaacaaaggaa

SEQ ID NO: 732989 - RNA, 19 nt, Human
cacauucaggaaguaaaau

SEQ ID NO: 732990 - RNA, 21 nt, Human
cagaacacagguagaaucaac

SEQ ID NO: 732991 - RNA, 21 nt, Human
cagaguacuaaaaccagccca

SEQ ID NO: 732992 - RNA, 18 nt, Human
cagcagggguuuuuguuu

SEQ ID NO: 732993 - RNA, 21 nt, Human
caguccucuuccuccccuagu

SEQ ID NO: 732994 - RNA, 20 nt, Human
caguucugaaaaguuacaga

SEQ ID NO: 732995 - RNA, 18 nt, Human
caugauggcggugguggu

SEQ ID NO: 732996 - RNA, 22 nt, Human
cauuuuauucccacuccccucu

SEQ ID NO: 732997 - RNA, 18 nt, Human
ccaccuuuuagucugauu

SEQ ID NO: 732998 - RNA, 20 nt, Human
cccacagcucacuauaaaga

SEQ ID NO: 732999 - RNA, 18 nt, Human
cccccgccuucuccccgc

SEQ ID NO: 733000 - RNA, 21 nt, Human
cccucugcaaaaccuuuuaag

SEQ ID NO: 733001 - RNA, 21 nt, Human
cgggguguccuauucuaacac

SEQ ID NO: 733002 - RNA, 22 nt, Human
cucaaggcuugauucaggauag

SEQ ID NO: 733003 - RNA, 23 nt, Human
cucacuauaaagaaaaaucccca

SEQ ID NO: 733004 - RNA, 18 nt, Human
cuccccuagucuggcucc

SEQ ID NO: 733005 - RNA, 22 nt, Human
cucuacaaacaggcaaaagcca

SEQ ID NO: 733006 - RNA, 20 nt, Human
cuugaugugagaucugcaag

SEQ ID NO: 733007 - RNA, 19 nt, Human
cuuugauuuaggcucaagg

SEQ ID NO: 733008 - RNA, 23 nt, Human
gaaauaucauacugcaccugaaa

SEQ ID NO: 733009 - RNA, 25 nt, Human
gagcgucaugauggcggugguggug

SEQ ID NO: 733010 - RNA, 24 nt, Human
gauaaauagaacacuaagaagaga

SEQ ID NO: 733011 - RNA, 21 nt, Human
gauuaggaaauaucauacugc

SEQ ID NO: 733012 - RNA, 25 nt, Human
gcacagccuaacaaagggggaacgc

SEQ ID NO: 733013 - RNA, 26 nt, Human
ggaaugucaauuguuauuuuugcuuu

SEQ ID NO: 733014 - RNA, 21 nt, Human
guaaagcacagccuaacaaag

SEQ ID NO: 733015 - RNA, 21 nt, Human
guuaagauggcaaccuaugcc

SEQ ID NO: 733016 - RNA, 23 nt, Human
guuuuuguuugcuuguuuuuguc

SEQ ID NO: 733017 - RNA, 18 nt, Human
uaaaaaguaagcagaaga

SEQ ID NO: 733018 - RNA, 18 nt, Human
uaagaaaacagauucauu

SEQ ID NO: 733019 - RNA, 19 nt, Human
uaagaaaacagauucauua

SEQ ID NO: 733020 - RNA, 23 nt, Human
uaagaaaacagauucauuagcag

SEQ ID NO: 733021 - RNA, 19 nt, Human
uaagaaaacucuucauauc

SEQ ID NO: 733022 - RNA, 23 nt, Human
uaagaaauaggaaagauuaggaa

SEQ ID NO: 733023 - RNA, 19 nt, Human
uaagauaaauagaacacua

SEQ ID NO: 733024 - RNA, 24 nt, Human
uaagcagaagaaaaacuaugcaga

SEQ ID NO: 733025 - RNA, 18 nt, Human
uaaggagaagccauagaa

SEQ ID NO: 733026 - RNA, 19 nt, Human
uaaguuggaaaacacucca

SEQ ID NO: 733027 - RNA, 22 nt, Human
uagaaaaagaauauaucaauau

SEQ ID NO: 733028 - RNA, 24 nt, Human
uagaacacuaagaagagauaccac

SEQ ID NO: 733029 - RNA, 20 nt, Human
uaggaaauaucauacugcac

SEQ ID NO: 733030 - RNA, 21 nt, Human
uaguuguagacaucuaagggc

SEQ ID NO: 733031 - RNA, 21 nt, Human
uauacauuugaagaaaaccac

SEQ ID NO: 733032 - RNA, 21 nt, Human
uauguaaagaaaaaaaaacuu

SEQ ID NO: 733033 - RNA, 26 nt, Human
uauguccuuaacaaugugguacaauu

SEQ ID NO: 733034 - RNA, 21 nt, Human
ucacugaaaauauuucuacac

SEQ ID NO: 733035 - RNA, 20 nt, Human
ucagaguacuaaaaccagcc

SEQ ID NO: 733036 - RNA, 21 nt, Human
uccaccuuuuucauguggaaa

SEQ ID NO: 733037 - RNA, 24 nt, Human
uccaccuuuuucauguggaaauug

SEQ ID NO: 733038 - RNA, 19 nt, Human
ucuaagggcaaacuugacc

SEQ ID NO: 733039 - RNA, 22 nt, Human
ucuaucauuauauguccuuaac

SEQ ID NO: 733040 - RNA, 19 nt, Human
ucucugagaaggaaauugc

SEQ ID NO: 733041 - RNA, 18 nt, Human
ucuuuugcgaguagcccu

SEQ ID NO: 733042 - RNA, 20 nt, Human
ugaaaaguuacagaguucug

SEQ ID NO: 733043 - RNA, 18 nt, Human
ugaagaaagcagaauuuu

SEQ ID NO: 733044 - RNA, 18 nt, Human
ugagaaguggggaaggca

SEQ ID NO: 733045 - RNA, 25 nt, Human
ugagcgucaugauggcggugguggu

SEQ ID NO: 733046 - RNA, 18 nt, Human
ugaguccauguuuuauug

SEQ ID NO: 733047 - RNA, 24 nt, Human
ugauacugcccucugcaaaaccuu

SEQ ID NO: 733048 - RNA, 23 nt, Human
ugauucaggauagguagcaacaa

SEQ ID NO: 733049 - RNA, 24 nt, Human
uggaacagaacacagguagaaucu

SEQ ID NO: 733050 - RNA, 23 nt, Human
uggguucccacagcucacuauaa

SEQ ID NO: 733051 - RNA, 20 nt, Human
uguaaagaaaaaaaaacuuc

SEQ ID NO: 733052 - RNA, 21 nt, Human
ugugacagagccacuacagag

SEQ ID NO: 733053 - RNA, 21 nt, Human
uuaauacuaaguuccaagaac

SEQ ID NO: 733054 - RNA, 21 nt, Human
uuagcaaauaagauaaauaga

SEQ ID NO: 733055 - RNA, 22 nt, Human
uuauguaaagaaaaaaaaacuu

SEQ ID NO: 733056 - RNA, 20 nt, Human
uucaauacuugguuuuauca

SEQ ID NO: 733057 - RNA, 24 nt, Human
uucacugaaaauauuucuacacaa

SEQ ID NO: 733058 - RNA, 26 nt, Human
uucauuagcaguaccuauacuuaaau

SEQ ID NO: 733059 - RNA, 19 nt, Human
uucccuuucacugaaaaua

SEQ ID NO: 733060 - RNA, 21 nt, Human
uugaagaaacgcacaaaaacc

SEQ ID NO: 733061 - RNA, 21 nt, Human
uugcuuguuuuuguccuucag

SEQ ID NO: 733062 - RNA, 20 nt, Human
uuggaaaacacuccaaaaua

SEQ ID NO: 733063 - RNA, 18 nt, Human
uuugcaaauucacagcag

SEQ ID NO: 733064 - RNA, 23 nt, Human
aaaaacaaaaccaaaagauacca

SEQ ID NO: 733065 - RNA, 18 nt, Human
aaaaaugaacuguaagag

SEQ ID NO: 733066 - RNA, 18 nt, Human
aaaacuucgaacaaaaaa

SEQ ID NO: 733067 - RNA, 20 nt, Human
aaaagccaccaaagucaaaa

SEQ ID NO: 733068 - RNA, 20 nt, Human
aaaaugcuguguacuuuuuu

SEQ ID NO: 733069 - RNA, 18 nt, Human
aaacaaauaccaaaaacc

SEQ ID NO: 733070 - RNA, 21 nt, Human
aaacaaauaccaaaaacccaa

SEQ ID NO: 733071 - RNA, 22 nt, Human
aaagauaccagugaaacugaag

SEQ ID NO: 733072 - RNA, 20 nt, Human
aaaugcgaacaugaaaaacc

SEQ ID NO: 733073 - RNA, 24 nt, Human
aacaaagcaagacucugucucaaa

SEQ ID NO: 733074 - RNA, 19 nt, Human
aacauggugaaaccccguc

SEQ ID NO: 733075 - RNA, 20 nt, Human
aacauggugaaaccccgucu

SEQ ID NO: 733076 - RNA, 21 nt, Human
aacauggugaaaccccgucuc

SEQ ID NO: 733077 - RNA, 19 nt, Human
aacuaagcauguugauucc

SEQ ID NO: 733078 - RNA, 20 nt, Human
aagaaacaaucuagggggaa

SEQ ID NO: 733079 - RNA, 18 nt, Human
aagaaaccuaaaccacaa

SEQ ID NO: 733080 - RNA, 19 nt, Human
aagcagcucccugggggaa

SEQ ID NO: 733081 - RNA, 24 nt, Human
aagcaugguggcacacaccuguaa

SEQ ID NO: 733082 - RNA, 21 nt, Human
aaggagacugacgcaugccaa

SEQ ID NO: 733083 - RNA, 18 nt, Human
aaggaugagagccaggcc

SEQ ID NO: 733084 - RNA, 22 nt, Human
aagguggcccuccucccacccc

SEQ ID NO: 733085 - RNA, 24 nt, Human
aaucgcuugaacccgggaggugga

SEQ ID NO: 733086 - RNA, 24 nt, Human
acaaagcaagacucugucucaaaa

SEQ ID NO: 733087 - RNA, 22 nt, Human
acaaauaccaaaaacccaacac

SEQ ID NO: 733088 - RNA, 20 nt, Human
acacugguaccagccccuuc

SEQ ID NO: 733089 - RNA, 22 nt, Human
accaaagucaaaaacaaaacca

SEQ ID NO: 733090 - RNA, 18 nt, Human
accacacuccagccuggg

SEQ ID NO: 733091 - RNA, 25 nt, Human
acccaguaaaacccaggcagagucu

SEQ ID NO: 733092 - RNA, 24 nt, Human
accccgucucuacuaaaaauacaa

SEQ ID NO: 733093 - RNA, 23 nt, Human
acugcuccauccccuuucuccug

SEQ ID NO: 733094 - RNA, 18 nt, Human
agacaaagaugauccaag

SEQ ID NO: 733095 - RNA, 21 nt, Human
agagccaggaaaacauaacuu

SEQ ID NO: 733096 - RNA, 24 nt, Human
agagugggaaaaugugugaagccu

SEQ ID NO: 733097 - RNA, 24 nt, Human
agcacuuugggaggcugaggcggg

SEQ ID NO: 733098 - RNA, 22 nt, Human
agccuggcuaacauggugaaac

SEQ ID NO: 733099 - RNA, 24 nt, Human
agccuggcuaacauggugaaaccc

SEQ ID NO: 733100 - RNA, 24 nt, Human
agccugggcaacaaagcaagacuc

SEQ ID NO: 733101 - RNA, 22 nt, Human
agccuugagguaagaaagugaa

SEQ ID NO: 733102 - RNA, 18 nt, Human
agcuccauagauaaggca

SEQ ID NO: 733103 - RNA, 18 nt, Human
agcugaggucuguggcug

SEQ ID NO: 733104 - RNA, 21 nt, Human
aggaaaacaucuucauucaga

SEQ ID NO: 733105 - RNA, 22 nt, Human
aggagcaauuccaagagacuac

SEQ ID NO: 733106 - RNA, 20 nt, Human
aggaguuugagaccagccug

SEQ ID NO: 733107 - RNA, 19 nt, Human
aggcacuggggaggccaag

SEQ ID NO: 733108 - RNA, 21 nt, Human
aggcacuggggaggccaaggg

SEQ ID NO: 733109 - RNA, 24 nt, Human
aggcaggagaaucgcuugaacccg

SEQ ID NO: 733110 - RNA, 24 nt, Human
aggcgggcagaucacaaggucagg

SEQ ID NO: 733111 - RNA, 20 nt, Human
aggcugaggcaggagaaucg

SEQ ID NO: 733112 - RNA, 24 nt, Human
aggcugaggcaggagaaucgcuug

SEQ ID NO: 733113 - RNA, 25 nt, Human
agguggagguugcagugacaacggu

SEQ ID NO: 733114 - RNA, 24 nt, Human
agguggagguugcagugagccgag

SEQ ID NO: 733115 - RNA, 21 nt, Human
aucacaaggucaggaguuuga

SEQ ID NO: 733116 - RNA, 24 nt, Human
auugccccaccacacuccagccug

SEQ ID NO: 733117 - RNA, 19 nt, Human
caaaacagaaaaacggcau

SEQ ID NO: 733118 - RNA, 23 nt, Human
caaaagacaaagaugauccaaga

SEQ ID NO: 733119 - RNA, 21 nt, Human
caaagcagcugcuucaaagac

SEQ ID NO: 733120 - RNA, 23 nt, Human
caaagucaaaaacaaaaccaaaa

SEQ ID NO: 733121 - RNA, 21 nt, Human
caaaugaacuaacagcaccug

SEQ ID NO: 733122 - RNA, 23 nt, Human
caacuacaaaaagccaccaaagu

SEQ ID NO: 733123 - RNA, 20 nt, Human
caagugcccacugaggcaac

SEQ ID NO: 733124 - RNA, 23 nt, Human
caauuacagcaaaacucacccca

SEQ ID NO: 733125 - RNA, 21 nt, Human
caauuagaaagagagaaggcc

SEQ ID NO: 733126 - RNA, 24 nt, Human
cacaaggucaggaguuugagacca

SEQ ID NO: 733127 - RNA, 24 nt, Human
cacacccguaauccuagcacuuug

SEQ ID NO: 733128 - RNA, 19 nt, Human
cacaccuguaaucccagcu

SEQ ID NO: 733129 - RNA, 23 nt, Human
cacacuacaagcuaccaagacaa

SEQ ID NO: 733130 - RNA, 18 nt, Human
caccaaagucaaaaacaa

SEQ ID NO: 733131 - RNA, 27 nt, Human
caccacacuccagccugggcaacaaag

SEQ ID NO: 733132 - RNA, 19 nt, Human
caccacugcuccauccccu

SEQ ID NO: 733133 - RNA, 21 nt, Human
caccccacccccgacaaucac

SEQ ID NO: 733134 - RNA, 19 nt, Human
cacccguaauccuagcacu

SEQ ID NO: 733135 - RNA, 24 nt, Human
cacccguaauccuagcacuuuggg

SEQ ID NO: 733136 - RNA, 21 nt, Human
caccuguaaucccagcuacuc

SEQ ID NO: 733137 - RNA, 24 nt, Human
caccuguaaucccagcuacucagg

SEQ ID NO: 733138 - RNA, 21 nt, Human
cacuggggaggccaagggccc

SEQ ID NO: 733139 - RNA, 23 nt, Human
cagccagucaggaaucugcccag

SEQ ID NO: 733140 - RNA, 24 nt, Human
cagcuacucaggaggcugaggcag

SEQ ID NO: 733141 - RNA, 19 nt, Human
caggccaaccacaaggcac

SEQ ID NO: 733142 - RNA, 20 nt, Human
caggccaaccacaaggcacc

SEQ ID NO: 733143 - RNA, 24 nt, Human
caggccaaccacaaggcaccgcuc

SEQ ID NO: 733144 - RNA, 21 nt, Human
cagggccuaccaaacauuuua

SEQ ID NO: 733145 - RNA, 20 nt, Human
caugccaacacuucuacaug

SEQ ID NO: 733146 - RNA, 23 nt, Human
ccaaaagauaccagugaaacuga

SEQ ID NO: 733147 - RNA, 19 nt, Human
ccaaaguauguucucuucu

SEQ ID NO: 733148 - RNA, 18 nt, Human
ccaaagucaaaaacaaaa

SEQ ID NO: 733149 - RNA, 19 nt, Human
ccaaagucaaaaacaaaac

SEQ ID NO: 733150 - RNA, 23 nt, Human
ccacaagggagaucccacuuccc

SEQ ID NO: 733151 - RNA, 23 nt, Human
ccacacuacaagcuaccaagaca

SEQ ID NO: 733152 - RNA, 22 nt, Human
ccaccccacccccgacaaucac

SEQ ID NO: 733153 - RNA, 25 nt, Human
ccacugcuccauccccuuucuccug

SEQ ID NO: 733154 - RNA, 18 nt, Human
ccauccugacugcaggcc

SEQ ID NO: 733155 - RNA, 18 nt, Human
ccaucuccccacugucag

SEQ ID NO: 733156 - RNA, 21 nt, Human
ccccaccacacuccagccugg

SEQ ID NO: 733157 - RNA, 26 nt, Human
ccccaccacacuccagccugggcaac

SEQ ID NO: 733158 - RNA, 18 nt, Human
ccccaggaguucgucucc

SEQ ID NO: 733159 - RNA, 21 nt, Human
ccccggaguuuuagcaacacu

SEQ ID NO: 733160 - RNA, 21 nt, Human
cccgggagguggagguugcag

SEQ ID NO: 733161 - RNA, 22 nt, Human
cccuuuucuucuuuccucugag

SEQ ID NO: 733162 - RNA, 19 nt, Human
ccuaaaccacaauguccua

SEQ ID NO: 733163 - RNA, 24 nt, Human
ccucccaccccacccccgacaauc

SEQ ID NO: 733164 - RNA, 23 nt, Human
ccucuuaccaguacugcucgagg

SEQ ID NO: 733165 - RNA, 23 nt, Human
ccuggcuaacauggugaaacccc

SEQ ID NO: 733166 - RNA, 24 nt, Human
ccuggcuaacauggugaaaccccg

SEQ ID NO: 733167 - RNA, 21 nt, Human
ccuguaaucccagcuacucag

SEQ ID NO: 733168 - RNA, 20 nt, Human
cgaggacaguaaagagaggg

SEQ ID NO: 733169 - RNA, 23 nt, Human
cgcagagauccuuuuggucaggg

SEQ ID NO: 733170 - RNA, 24 nt, Human
cgccgccagccgcaaggacuggca

SEQ ID NO: 733171 - RNA, 24 nt, Human
cgggagguggagguugcagugagc

SEQ ID NO: 733172 - RNA, 19 nt, Human
cuaaaacccaauagggccc

SEQ ID NO: 733173 - RNA, 23 nt, Human
cuaaacagaccaacuguaacuga

SEQ ID NO: 733174 - RNA, 24 nt, Human
cuaaaccacaauguccuaggagca

SEQ ID NO: 733175 - RNA, 20 nt, Human
cuagaguaacagcugcugac

SEQ ID NO: 733176 - RNA, 23 nt, Human
cuauagacccugcucuacacacu

SEQ ID NO: 733177 - RNA, 22 nt, Human
cuaugcaccacugcuccauccc

SEQ ID NO: 733178 - RNA, 24 nt, Human
cucacacccguaauccuagcacuu

SEQ ID NO: 733179 - RNA, 21 nt, Human
cuccaacuacaaaaagccacc

SEQ ID NO: 733180 - RNA, 22 nt, Human
cuccagggccuaccaaacauuu

SEQ ID NO: 733181 - RNA, 24 nt, Human
cuccugaccacacuacaagcuacc

SEQ ID NO: 733182 - RNA, 19 nt, Human
cuccuggcccuuuucuucu

SEQ ID NO: 733183 - RNA, 19 nt, Human
cucugucucaaaaaaaaaa

SEQ ID NO: 733184 - RNA, 20 nt, Human
cugaagcagcucccuggggg

SEQ ID NO: 733185 - RNA, 23 nt, Human
cugacaacagucaucccaggacu

SEQ ID NO: 733186 - RNA, 21 nt, Human
cuguaaucccagcuacucagg

SEQ ID NO: 733187 - RNA, 18 nt, Human
cuguacccaggaagaaac

SEQ ID NO: 733188 - RNA, 21 nt, Human
cuuagaguaaggcaacagaga

SEQ ID NO: 733189 - RNA, 23 nt, Human
cuuuacacugguaccagccccuu

SEQ ID NO: 733190 - RNA, 24 nt, Human
gaaucugcccagaguugaaaacca

SEQ ID NO: 733191 - RNA, 23 nt, Human
gagaaucgcuugaacccgggagg

SEQ ID NO: 733192 - RNA, 18 nt, Human
gagagaaggccccuccuc

SEQ ID NO: 733193 - RNA, 18 nt, Human
gagcagcagcagcucugg

SEQ ID NO: 733194 - RNA, 19 nt, Human
gagcuccauagauaaggca

SEQ ID NO: 733195 - RNA, 23 nt, Human
gagguugcagugagccgagauug

SEQ ID NO: 733196 - RNA, 23 nt, Human
gagugggaaaaugugugaagccu

SEQ ID NO: 733197 - RNA, 22 nt, Human
gaguucgucuccuguuacaacu

SEQ ID NO: 733198 - RNA, 21 nt, Human
gaucacaaggucaggaguuug

SEQ ID NO: 733199 - RNA, 22 nt, Human
gaucacaaggucaggaguuuga

SEQ ID NO: 733200 - RNA, 24 nt, Human
gaucacaaggucaggaguuugaga

SEQ ID NO: 733201 - RNA, 19 nt, Human
gcagacgucguaauuuaug

SEQ ID NO: 733202 - RNA, 19 nt, Human
gccaccaaagucaaaaaca

SEQ ID NO: 733203 - RNA, 25 nt, Human
gccagcuccagcugcuccacaaggg

SEQ ID NO: 733204 - RNA, 22 nt, Human
gccagcugaggucuguggcuga

SEQ ID NO: 733205 - RNA, 20 nt, Human
gccagggaucaaaccgccag

SEQ ID NO: 733206 - RNA, 24 nt, Human
gcccaaggccaccuucauuaacca

SEQ ID NO: 733207 - RNA, 24 nt, Human
gcuaacauggugaaaccccgucuc

SEQ ID NO: 733208 - RNA, 22 nt, Human
ggaaacaaauaccaaaaaccca

SEQ ID NO: 733209 - RNA, 20 nt, Human
ggacaguaaagagagggacu

SEQ ID NO: 733210 - RNA, 22 nt, Human
ggagguugcagugagccgagau

SEQ ID NO: 733211 - RNA, 24 nt, Human
ggagguugcagugagccgagauug

SEQ ID NO: 733212 - RNA, 22 nt, Human
ggaguuuucccaacuuugaaau

SEQ ID NO: 733213 - RNA, 21 nt, Human
ggcacacaccuguaaucccag

SEQ ID NO: 733214 - RNA, 23 nt, Human
ggcagaucacaaggucaggaguu

SEQ ID NO: 733215 - RNA, 24 nt, Human
gguugcucacacccguaauccuag

SEQ ID NO: 733216 - RNA, 18 nt, Human
gugcugguggaggcucug

SEQ ID NO: 733217 - RNA, 18 nt, Human
guggcccuccucccaccc

SEQ ID NO: 733218 - RNA, 21 nt, Human
guugcagugagccgagauugc

SEQ ID NO: 733219 - RNA, 23 nt, Human
uaaaaagaaauaaauguagcauu

SEQ ID NO: 733220 - RNA, 21 nt, Human
uaaaaauacaaaaauuagcca

SEQ ID NO: 733221 - RNA, 21 nt, Human
uaaaauuacuaaagccguuug

SEQ ID NO: 733222 - RNA, 22 nt, Human
uaacauggugaaaccccgucuc

SEQ ID NO: 733223 - RNA, 24 nt, Human
uaacauggugaaaccccgucucua

SEQ ID NO: 733224 - RNA, 21 nt, Human
uaagaaagugaagagcuacgc

SEQ ID NO: 733225 - RNA, 18 nt, Human
uaauuuucagcuuccagg

SEQ ID NO: 733226 - RNA, 18 nt, Human
uacaaaaagccaccaaag

SEQ ID NO: 733227 - RNA, 23 nt, Human
uacaaaaagccaccaaagucaaa

SEQ ID NO: 733228 - RNA, 20 nt, Human
uacaaauaugacuguccccu

SEQ ID NO: 733229 - RNA, 22 nt, Human
uacacacauacauucuaacuuu

SEQ ID NO: 733230 - RNA, 18 nt, Human
uacagaguuucucagaau

SEQ ID NO: 733231 - RNA, 20 nt, Human
uaccaaaaacccaacaccac

SEQ ID NO: 733232 - RNA, 21 nt, Human
uaccaaaaacccaacaccacu

SEQ ID NO: 733233 - RNA, 26 nt, Human
uaccaaaaacccaacaccacuaucaa

SEQ ID NO: 733234 - RNA, 24 nt, Human
uacccuauauaucuguuugagaau

SEQ ID NO: 733235 - RNA, 22 nt, Human
uagaauaaauucccuaugcaaa

SEQ ID NO: 733236 - RNA, 20 nt, Human
uagacccugcucuacacacu

SEQ ID NO: 733237 - RNA, 23 nt, Human
uagaguaaggcaacagagaucuu

SEQ ID NO: 733238 - RNA, 24 nt, Human
uagcacuuugggaggcugaggcgg

SEQ ID NO: 733239 - RNA, 19 nt, Human
uaggucagagccugagguu

SEQ ID NO: 733240 - RNA, 19 nt, Human
uauaucuguuugagaauga

SEQ ID NO: 733241 - RNA, 18 nt, Human
uaugcaaaaguucguagu

SEQ ID NO: 733242 - RNA, 21 nt, Human
uauuugcccaaguauuagguc

SEQ ID NO: 733243 - RNA, 24 nt, Human
ucacaaggucaggaguuugagacc

SEQ ID NO: 733244 - RNA, 22 nt, Human
ucagagccugagguuuuaaagg

SEQ ID NO: 733245 - RNA, 20 nt, Human
ucagcaucaauuauuugccc

SEQ ID NO: 733246 - RNA, 22 nt, Human
ucagggcaaauaaagccaccac

SEQ ID NO: 733247 - RNA, 19 nt, Human
uccaaccuaagucaaccaa

SEQ ID NO: 733248 - RNA, 20 nt, Human
uccaacuacaaaaagccacc

SEQ ID NO: 733249 - RNA, 20 nt, Human
uccagcagaugcuggaguuu

SEQ ID NO: 733250 - RNA, 25 nt, Human
ucccagccagcuccagcugcuccac

SEQ ID NO: 733251 - RNA, 20 nt, Human
ucccucccagccagcuccag

SEQ ID NO: 733252 - RNA, 18 nt, Human
ucccugggggaagcaggg

SEQ ID NO: 733253 - RNA, 24 nt, Human
ucccugggggaagcagggcaggca

SEQ ID NO: 733254 - RNA, 24 nt, Human
ucgcuugaacccgggagguggagg

SEQ ID NO: 733255 - RNA, 18 nt, Human
ucuaaaacccaauagggc

SEQ ID NO: 733256 - RNA, 19 nt, Human
ucuaaaacuucuaaaaccc

SEQ ID NO: 733257 - RNA, 24 nt, Human
ucuaaaacuucuaaaacccaauag

SEQ ID NO: 733258 - RNA, 22 nt, Human
ucuacacacuaucaaauuucca

SEQ ID NO: 733259 - RNA, 19 nt, Human
ucuagaaguuaugguucua

SEQ ID NO: 733260 - RNA, 20 nt, Human
ucucaaguaauucugcaagg

SEQ ID NO: 733261 - RNA, 21 nt, Human
ucucuacuaaaaauacaaaaa

SEQ ID NO: 733262 - RNA, 22 nt, Human
ucugaaaugcgagggguggggg

SEQ ID NO: 733263 - RNA, 18 nt, Human
ucuggcgacuccagggcc

SEQ ID NO: 733264 - RNA, 20 nt, Human
ucuggcgacuccagggccua

SEQ ID NO: 733265 - RNA, 23 nt, Human
ucugucucaaaaaaaaaaaaaaa

SEQ ID NO: 733266 - RNA, 23 nt, Human
ucuuaaguucacauccaccuaac

SEQ ID NO: 733267 - RNA, 20 nt, Human
ugaaaaacuaaauacacaca

SEQ ID NO: 733268 - RNA, 19 nt, Human
ugaaaaccaagacaaccau

SEQ ID NO: 733269 - RNA, 21 nt, Human
ugaaaccaguaguaaaauuac

SEQ ID NO: 733270 - RNA, 22 nt, Human
ugaaagagaaacuaaggaaacu

SEQ ID NO: 733271 - RNA, 21 nt, Human
ugaacaauuacagcaaaacuc

SEQ ID NO: 733272 - RNA, 21 nt, Human
ugaacgaaacuaacucagugu

SEQ ID NO: 733273 - RNA, 23 nt, Human
ugaagagcuacgcaucuacccaa

SEQ ID NO: 733274 - RNA, 22 nt, Human
ugacccaguaaaacccaggcag

SEQ ID NO: 733275 - RNA, 23 nt, Human
ugagaauggcaaaacagaaaaac

SEQ ID NO: 733276 - RNA, 23 nt, Human
ugagaccagccuggcuaacaugg

SEQ ID NO: 733277 - RNA, 19 nt, Human
ugagagccaggccacagag

SEQ ID NO: 733278 - RNA, 18 nt, Human
ugagaggaucuggccucu

SEQ ID NO: 733279 - RNA, 20 nt, Human
ugaggcaggagaaucgcuug

SEQ ID NO: 733280 - RNA, 24 nt, Human
ugaggcaggagaaucgcuugaacc

SEQ ID NO: 733281 - RNA, 25 nt, Human
ugaggcaggagaaucgcuugaaccc

SEQ ID NO: 733282 - RNA, 27 nt, Human
ugagguuuuaaaggaauuucaccuugg

SEQ ID NO: 733283 - RNA, 19 nt, Human
ugccagugaaggaauuuuc

SEQ ID NO: 733284 - RNA, 26 nt, Human
ugccccaccacacuccagccugggca

SEQ ID NO: 733285 - RNA, 22 nt, Human
uggaaagucuagcacacagcaa

SEQ ID NO: 733286 - RNA, 19 nt, Human
uggaaccacaaaacagucc

SEQ ID NO: 733287 - RNA, 23 nt, Human
uggaaccacaaaacaguccuaac

SEQ ID NO: 733288 - RNA, 20 nt, Human
uggaggcucuggaagaggca

SEQ ID NO: 733289 - RNA, 18 nt, Human
uggaucacggcuaugacc

SEQ ID NO: 733290 - RNA, 24 nt, Human
uggcaacuacauuaucuagaaguu

SEQ ID NO: 733291 - RNA, 22 nt, Human
uggcacacaccuguaaucccag

SEQ ID NO: 733292 - RNA, 24 nt, Human
uggcccuccucccaccccaccccc

SEQ ID NO: 733293 - RNA, 18 nt, Human
uggcuagacagagccuug

SEQ ID NO: 733294 - RNA, 20 nt, Human
uggcuagacagagccuugag

SEQ ID NO: 733295 - RNA, 19 nt, Human
ugggaaaaugugugaagcc

SEQ ID NO: 733296 - RNA, 20 nt, Human
ugggaggcugaggcgggcag

SEQ ID NO: 733297 - RNA, 24 nt, Human
ugggaggcugaggcgggcagauca

SEQ ID NO: 733298 - RNA, 23 nt, Human
ugggccuccacucgggcugccag

SEQ ID NO: 733299 - RNA, 19 nt, Human
ugguaccagccccuucuca

SEQ ID NO: 733300 - RNA, 18 nt, Human
uggugauaaagacaaucu

SEQ ID NO: 733301 - RNA, 24 nt, Human
ugguggaggcucuggaagaggcac

SEQ ID NO: 733302 - RNA, 23 nt, Human
ugguggcacacaccuguaauccc

SEQ ID NO: 733303 - RNA, 24 nt, Human
ugguggcacacaccuguaauccca

SEQ ID NO: 733304 - RNA, 21 nt, Human
ugugugagcucaugugugggc

SEQ ID NO: 733305 - RNA, 21 nt, Human
uuaaguucacauccaccuaac

SEQ ID NO: 733306 - RNA, 21 nt, Human
uuagaaagagagaaggccccu

SEQ ID NO: 733307 - RNA, 18 nt, Human
uucacauccaccuaacuc

SEQ ID NO: 733308 - RNA, 21 nt, Human
uucagggcaaauaaagccacc

SEQ ID NO: 733309 - RNA, 21 nt, Human
uuccaggccaaccacaaggca

SEQ ID NO: 733310 - RNA, 25 nt, Human
uuccaggccaaccacaaggcaccgc

SEQ ID NO: 733311 - RNA, 19 nt, Human
uuccagguucuggacuauu

SEQ ID NO: 733312 - RNA, 23 nt, Human
uucugagaggaucuggccucugc

SEQ ID NO: 733313 - RNA, 24 nt, Human
uugaacccgggagguggagguugc

SEQ ID NO: 733314 - RNA, 19 nt, Human
uugcagugagccgagauug

SEQ ID NO: 733315 - RNA, 20 nt, Human
uugcagugagccgagauugc

SEQ ID NO: 733316 - RNA, 21 nt, Human
uugcagugagccgagauugcc

SEQ ID NO: 733317 - RNA, 22 nt, Human
uugcagugagccgagauugccc

SEQ ID NO: 733318 - RNA, 23 nt, Human
uugcccaaguauuaggucccaaa

SEQ ID NO: 733319 - RNA, 24 nt, Human
uugcucacacccguaauccuagca

SEQ ID NO: 733320 - RNA, 25 nt, Human
uugggaggcugaggcgggcagauca

SEQ ID NO: 733321 - RNA, 23 nt, Human
uugucauggauggcuggcagccu

SEQ ID NO: 733322 - RNA, 20 nt, Human
uuucacacugaagcagcucc

SEQ ID NO: 733323 - RNA, 18 nt, Human
uuugagaaugaaagagaa

SEQ ID NO: 733324 - RNA, 19 nt, Human
aaaaacaaaauccgacccc

SEQ ID NO: 733325 - RNA, 20 nt, Human
aacaaaauccgaccccaucc

SEQ ID NO: 733326 - RNA, 18 nt, Human
aaccauuugaaacacuca

SEQ ID NO: 733327 - RNA, 23 nt, Human
acgcaaaugcaggaaaauaacca

SEQ ID NO: 733328 - RNA, 23 nt, Human
agucacuaaaaaacaaaauccga

SEQ ID NO: 733329 - RNA, 22 nt, Human
caaaugcaggaaaauaaccaga

SEQ ID NO: 733330 - RNA, 22 nt, Human
caacaguaagggcacagggcag

SEQ ID NO: 733331 - RNA, 20 nt, Human
cacaagcgcugcugcuccuc

SEQ ID NO: 733332 - RNA, 18 nt, Human
cagcuuaguaagaacuga

SEQ ID NO: 733333 - RNA, 20 nt, Human
cagggcaguauuuauuaaca

SEQ ID NO: 733334 - RNA, 23 nt, Human
ccacuuaacaugcuugacuuuug

SEQ ID NO: 733335 - RNA, 19 nt, Human
ccgaccccaucccuaaaac

SEQ ID NO: 733336 - RNA, 22 nt, Human
ccgaccccaucccuaaaaccaa

SEQ ID NO: 733337 - RNA, 19 nt, Human
gaccccaucccuaaaacca

SEQ ID NO: 733338 - RNA, 20 nt, Human
ggcggcggcggcggcggcgg

SEQ ID NO: 733339 - RNA, 21 nt, Human
gggcacagggcaguauuuauu

SEQ ID NO: 733340 - RNA, 20 nt, Human
guagucacuaaaaaacaaaa

SEQ ID NO: 733341 - RNA, 18 nt, Human
uauuauacaacaugacca

SEQ ID NO: 733342 - RNA, 22 nt, Human
ucaaaacuuaauuuuucacuau

SEQ ID NO: 733343 - RNA, 21 nt, Human
ucuggcggcggcggcggcggc

SEQ ID NO: 733344 - RNA, 26 nt, Human
ugaaccauuugaaacacucaacgcaa

SEQ ID NO: 733345 - RNA, 24 nt, Human
ugcaggaaaauaaccagauggcua

SEQ ID NO: 733346 - RNA, 18 nt, Human
uggcggcggcggcggcgg

SEQ ID NO: 733347 - RNA, 21 nt, Human
uguaauuguaaagacugacuc

SEQ ID NO: 733348 - RNA, 18 nt, Human
uuaacacaaacaaugaac

SEQ ID NO: 733349 - RNA, 19 nt, Human
uuuguagucacuaaaaaac

SEQ ID NO: 733350 - RNA, 21 nt, Human
aaaaaaaauuacccaucaaga

SEQ ID NO: 733351 - RNA, 23 nt, Human
aaaaaaacccaguacuaugauac

SEQ ID NO: 733352 - RNA, 21 nt, Human
aaaaaacaaaaccaaaaaaaa

SEQ ID NO: 733353 - RNA, 24 nt, Human
aaaaaacaaacaaacaaaaaagca

SEQ ID NO: 733354 - RNA, 22 nt, Human
aaaaaauagaaaccaaauaccc

SEQ ID NO: 733355 - RNA, 19 nt, Human
aaaaaauuuucuuuccuug

SEQ ID NO: 733356 - RNA, 21 nt, Human
aaaacuguuugaucgcuucag

SEQ ID NO: 733357 - RNA, 19 nt, Human
aaaagucacaaaaaccugu

SEQ ID NO: 733358 - RNA, 24 nt, Human
aaaauauuguuuaugucauguuuu

SEQ ID NO: 733359 - RNA, 18 nt, Human
aaacaaacaaaaaaaccc

SEQ ID NO: 733360 - RNA, 24 nt, Human
aaacaaacaaacaaaaaagcaggg

SEQ ID NO: 733361 - RNA, 23 nt, Human
aaacagggucaccuagaaaaaaa

SEQ ID NO: 733362 - RNA, 21 nt, Human
aaaccaaauaccccaccuggu

SEQ ID NO: 733363 - RNA, 19 nt, Human
aaagacaacuuccuggcca

SEQ ID NO: 733364 - RNA, 18 nt, Human
aaagcagggacugccccu

SEQ ID NO: 733365 - RNA, 20 nt, Human
aaauuuucuuuccuugaagc

SEQ ID NO: 733366 - RNA, 19 nt, Human
aacaaaaccaaaaaaaaau

SEQ ID NO: 733367 - RNA, 25 nt, Human
aaccaaaaaaaaauuuccuucuacu

SEQ ID NO: 733368 - RNA, 21 nt, Human
aaccaaauaccccaccuggua

SEQ ID NO: 733369 - RNA, 22 nt, Human
aaggggccaaggaucacaagug

SEQ ID NO: 733370 - RNA, 25 nt, Human
aaggggccaaggaucacaagugcaa

SEQ ID NO: 733371 - RNA, 20 nt, Human
acacaauaaaacaaacaaaa

SEQ ID NO: 733372 - RNA, 26 nt, Human
accaaauaccccaccugguaugcccc

SEQ ID NO: 733373 - RNA, 22 nt, Human
acuuucucaaaggcaaaggcug

SEQ ID NO: 733374 - RNA, 21 nt, Human
agaaaaauaccaaacacagug

SEQ ID NO: 733375 - RNA, 23 nt, Human
agaauggggaaaggggccaagga

SEQ ID NO: 733376 - RNA, 20 nt, Human
agagggaaggaaagaaaagg

SEQ ID NO: 733377 - RNA, 23 nt, Human
agaugucaaagguucacaaagcu

SEQ ID NO: 733378 - RNA, 21 nt, Human
aggaaaagacaaaucuauuca

SEQ ID NO: 733379 - RNA, 18 nt, Human
aggaaagaaaaggagaag

SEQ ID NO: 733380 - RNA, 21 nt, Human
agggacugccccugggggcuu

SEQ ID NO: 733381 - RNA, 22 nt, Human
auagcaucaugcccaaagacau

SEQ ID NO: 733382 - RNA, 22 nt, Human
augaaaaaacaaacaaacaaaa

SEQ ID NO: 733383 - RNA, 22 nt, Human
augaagacucaaacugggaaug

SEQ ID NO: 733384 - RNA, 21 nt, Human
augggccagcuccuuggcuca

SEQ ID NO: 733385 - RNA, 22 nt, Human
auuacuauugguuuuccuaauu

SEQ ID NO: 733386 - RNA, 22 nt, Human
auuguuuaugucauguuuugga

SEQ ID NO: 733387 - RNA, 22 nt, Human
caaaacccagcugauccacugu

SEQ ID NO: 733388 - RNA, 20 nt, Human
caaacaaaaaaacccaguac

SEQ ID NO: 733389 - RNA, 22 nt, Human
caaacaaacaaaaaagcagggu

SEQ ID NO: 733390 - RNA, 23 nt, Human
caaagacaacuuccuggccaaaa

SEQ ID NO: 733391 - RNA, 20 nt, Human
caacuuccuggccaaaaccc

SEQ ID NO: 733392 - RNA, 23 nt, Human
cacaaagacaacuuccuggccaa

SEQ ID NO: 733393 - RNA, 24 nt, Human
caguaaucccuuaaacaggcaugc

SEQ ID NO: 733394 - RNA, 23 nt, Human
caguuugccuccuuggcucacag

SEQ ID NO: 733395 - RNA, 19 nt, Human
ccaaaacccagcugaucca

SEQ ID NO: 733396 - RNA, 21 nt, Human
ccaaugggccagcuccuuggc

SEQ ID NO: 733397 - RNA, 23 nt, Human
ccacccuaaaacuguuugaucgc

SEQ ID NO: 733398 - RNA, 31 nt, Human
ccaguaaucccuuaaacaggcaugcucuccu

SEQ ID NO: 733399 - RNA, 18 nt, Human
cccuaagccccuuuaccc

SEQ ID NO: 733400 - RNA, 20 nt, Human
cccucccucacauguuccca

SEQ ID NO: 733401 - RNA, 21 nt, Human
ccuaagccccuuuacccuccc

SEQ ID NO: 733402 - RNA, 23 nt, Human
ccuagaaaaaaaacaaguuuaua

SEQ ID NO: 733403 - RNA, 18 nt, Human
cuaaggcuguggcugcug

SEQ ID NO: 733404 - RNA, 23 nt, Human
cugaauuauaaaaaacaaaacca

SEQ ID NO: 733405 - RNA, 19 nt, Human
cuuccuggccaaaacccag

SEQ ID NO: 733406 - RNA, 20 nt, Human
cuucuacuacuaagccaugc

SEQ ID NO: 733407 - RNA, 23 nt, Human
cuucuugaacaauuagcuccugg

SEQ ID NO: 733408 - RNA, 18 nt, Human
cuuggcucacaggagggg

SEQ ID NO: 733409 - RNA, 27 nt, Human
gaaaaaacaaacaaacaaaaaagcagg

SEQ ID NO: 733410 - RNA, 22 nt, Human
gaugguguugagaauggggaaa

SEQ ID NO: 733411 - RNA, 19 nt, Human
gcagaagacaggaacccca

SEQ ID NO: 733412 - RNA, 21 nt, Human
ggcaaaaagcuggggaagaga

SEQ ID NO: 733413 - RNA, 19 nt, Human
ggcaucaggcaaaaagcug

SEQ ID NO: 733414 - RNA, 21 nt, Human
gggaaguguaagucaacuuca

SEQ ID NO: 733415 - RNA, 22 nt, Human
gguaaaaggggaaacaaaaaaa

SEQ ID NO: 733416 - RNA, 21 nt, Human
gguggggugggagaaaugggu

SEQ ID NO: 733417 - RNA, 23 nt, Human
gguggggugggagaaaugggugg

SEQ ID NO: 733418 - RNA, 18 nt, Human
guacaguacguuuugguu

SEQ ID NO: 733419 - RNA, 18 nt, Human
gugcacaccccugugcgc

SEQ ID NO: 733420 - RNA, 24 nt, Human
uaaaaaaaauuacccaucaagaaa

SEQ ID NO: 733421 - RNA, 18 nt, Human
uaaaaaaaucccucaugc

SEQ ID NO: 733422 - RNA, 28 nt, Human
uaaaaaaaucccucaugcaaauuguaga

SEQ ID NO: 733423 - RNA, 24 nt, Human
uaaaacaaacaaaaaaacccagua

SEQ ID NO: 733424 - RNA, 22 nt, Human
uaaacaggcaugcucuccaucu

SEQ ID NO: 733425 - RNA, 20 nt, Human
uaacaggaugaaguucagua

SEQ ID NO: 733426 - RNA, 24 nt, Human
uaagagaaauaggggaaagccaca

SEQ ID NO: 733427 - RNA, 21 nt, Human
uaaggcuguggcugcugcaga

SEQ ID NO: 733428 - RNA, 19 nt, Human
uacuacuaagccaugcagg

SEQ ID NO: 733429 - RNA, 22 nt, Human
uagaaaccaaauaccccaccug

SEQ ID NO: 733430 - RNA, 24 nt, Human
uagauagcaucaugcccaaagaca

SEQ ID NO: 733431 - RNA, 21 nt, Human
uagcaucaugcccaaagacau

SEQ ID NO: 733432 - RNA, 21 nt, Human
uaggaccaguaaucccuuaaa

SEQ ID NO: 733433 - RNA, 19 nt, Human
uagugugcugggggaugaa

SEQ ID NO: 733434 - RNA, 28 nt, Human
uauccauauauauaauaaaccaguuugu

SEQ ID NO: 733435 - RNA, 22 nt, Human
ucacaggaggggaacauugugg

SEQ ID NO: 733436 - RNA, 19 nt, Human
ucaugcauuuuuaaagcca

SEQ ID NO: 733437 - RNA, 23 nt, Human
uccacacccccucaugaccccaa

SEQ ID NO: 733438 - RNA, 18 nt, Human
uccagagggauggauggu

SEQ ID NO: 733439 - RNA, 22 nt, Human
uccccagucugugaaagccuau

SEQ ID NO: 733440 - RNA, 20 nt, Human
ucuaacaggaugaaguucag

SEQ ID NO: 733441 - RNA, 18 nt, Human
ucucuguacgguacagua

SEQ ID NO: 733442 - RNA, 19 nt, Human
ucuucagaaauguucucac

SEQ ID NO: 733443 - RNA, 19 nt, Human
ucuucccuaaguauuaaga

SEQ ID NO: 733444 - RNA, 19 nt, Human
ugaaaaaacaaacaaacaa

SEQ ID NO: 733445 - RNA, 24 nt, Human
ugaaaaaacaaacaaacaaaaaag

SEQ ID NO: 733446 - RNA, 19 nt, Human
ugaccaaugggccagcucc

SEQ ID NO: 733447 - RNA, 21 nt, Human
ugaggaaaagacaaaucuauu

SEQ ID NO: 733448 - RNA, 24 nt, Human
ugagguaaaaggggaaacaaaaaa

SEQ ID NO: 733449 - RNA, 19 nt, Human
uggagagggaaggaaagaa

SEQ ID NO: 733450 - RNA, 24 nt, Human
uggccaagcuguuucuggaaggga

SEQ ID NO: 733451 - RNA, 22 nt, Human
uggccacacaauaaaacaaaca

SEQ ID NO: 733452 - RNA, 24 nt, Human
uggccacacaauaaaacaaacaaa

SEQ ID NO: 733453 - RNA, 18 nt, Human
uggggugggagaaauggg

SEQ ID NO: 733454 - RNA, 20 nt, Human
uggggugggagaaaugggug

SEQ ID NO: 733455 - RNA, 21 nt, Human
uggggugggagaaaugggugg

SEQ ID NO: 733456 - RNA, 21 nt, Human
ugguaugcccccuuuucccua

SEQ ID NO: 733457 - RNA, 21 nt, Human
uguaugauccuuuguccagag

SEQ ID NO: 733458 - RNA, 22 nt, Human
ugugcaguuugccuccuuggcu

SEQ ID NO: 733459 - RNA, 23 nt, Human
ugugcaguuugccuccuuggcuc

SEQ ID NO: 733460 - RNA, 25 nt, Human
uguucccacccucacuccacacccc

SEQ ID NO: 733461 - RNA, 21 nt, Human
uuaacauuugcccacaaauaa

SEQ ID NO: 733462 - RNA, 23 nt, Human
uucagugggacuuuuuuuccauu

SEQ ID NO: 733463 - RNA, 21 nt, Human
uuccugucagauucuucccua

SEQ ID NO: 733464 - RNA, 20 nt, Human
uucuugaacaauuagcuccu

SEQ ID NO: 733465 - RNA, 20 nt, Human
uugugcacaccccugugcgc

SEQ ID NO: 733466 - RNA, 22 nt, Human
uuuacaagcuugugcaguuugc

SEQ ID NO: 733467 - RNA, 18 nt, Human
uuugcuccuuuucucugu

SEQ ID NO: 733468 - RNA, 21 nt, Human
uuuguccagagggauggaugg

SEQ ID NO: 733469 - RNA, 22 nt, Human
uuugucuuucccaucuucagaa

SEQ ID NO: 733470 - RNA, 20 nt, Human
uuugugagcuacauaauuug

SEQ ID NO: 733471 - RNA, 23 nt, Human
aaaaaaguauucccacacugacu

SEQ ID NO: 733472 - RNA, 25 nt, Human
aaaugccaggacauuaagcugugag

SEQ ID NO: 733473 - RNA, 20 nt, Human
aacaagcccagagagaaggg

SEQ ID NO: 733474 - RNA, 20 nt, Human
aacacagcaagacccugucu

SEQ ID NO: 733475 - RNA, 21 nt, Human
aacacagcaagacccugucuc

SEQ ID NO: 733476 - RNA, 19 nt, Human
aacacagugaaaucccguc

SEQ ID NO: 733477 - RNA, 20 nt, Human
aacacagugaaaucccgucu

SEQ ID NO: 733478 - RNA, 21 nt, Human
aacacagugaaaucccgucuc

SEQ ID NO: 733479 - RNA, 21 nt, Human
aaccacagcaaagccgcaaaa

SEQ ID NO: 733480 - RNA, 18 nt, Human
aagccaccuccugcccag

SEQ ID NO: 733481 - RNA, 24 nt, Human
aagcccacaccccugcucaugucc

SEQ ID NO: 733482 - RNA, 21 nt, Human
aaggagaagggcaggaaaagg

SEQ ID NO: 733483 - RNA, 20 nt, Human
aaggagguggaggcugcagu

SEQ ID NO: 733484 - RNA, 20 nt, Human
aagggcaggaaaagguccag

SEQ ID NO: 733485 - RNA, 25 nt, Human
aagguccagggcacagggcaagcaa

SEQ ID NO: 733486 - RNA, 20 nt, Human
acagagcaagacccugucuc

SEQ ID NO: 733487 - RNA, 24 nt, Human
acagagcaagacccugucucaaaa

SEQ ID NO: 733488 - RNA, 23 nt, Human
acagagcgagacuccguauaaaa

SEQ ID NO: 733489 - RNA, 24 nt, Human
acagcaggugcuggaagaugacca

SEQ ID NO: 733490 - RNA, 18 nt, Human
acagcccagaacccacag

SEQ ID NO: 733491 - RNA, 21 nt, Human
acaggaacccagaguuccaca

SEQ ID NO: 733492 - RNA, 19 nt, Human
accacugcacuccagccug

SEQ ID NO: 733493 - RNA, 23 nt, Human
acccuaaaaccuuaagcaggauu

SEQ ID NO: 733494 - RNA, 19 nt, Human
accgcccccuuaaccccuc

SEQ ID NO: 733495 - RNA, 23 nt, Human
accuguagucccagcuacucggg

SEQ ID NO: 733496 - RNA, 18 nt, Human
acggccucugauucaggc

SEQ ID NO: 733497 - RNA, 24 nt, Human
acugcacuccagccugggugacag

SEQ ID NO: 733498 - RNA, 24 nt, Human
acugcacuccagccugggugacag

SEQ ID NO: 733499 - RNA, 26 nt, Human
acugcacuccagccugggugacagag

SEQ ID NO: 733500 - RNA, 26 nt, Human
acugcacuccagccugggugacagag

SEQ ID NO: 733501 - RNA, 21 nt, Human
acugggugugguggcacacgc

SEQ ID NO: 733502 - RNA, 22 nt, Human
acugggugugguggcacacgcc

SEQ ID NO: 733503 - RNA, 18 nt, Human
acuuuuauugcaaaaagu

SEQ ID NO: 733504 - RNA, 19 nt, Human
agaacacgccagggugccc

SEQ ID NO: 733505 - RNA, 18 nt, Human
agacaggagggucacuug

SEQ ID NO: 733506 - RNA, 20 nt, Human
agagaaacccaggggcugcc

SEQ ID NO: 733507 - RNA, 19 nt, Human
agagcuacagggcaggggg

SEQ ID NO: 733508 - RNA, 18 nt, Human
agaggaaggagaagggca

SEQ ID NO: 733509 - RNA, 18 nt, Human
agaggcuggugccugguu

SEQ ID NO: 733510 - RNA, 24 nt, Human
agagggaaacuggggagaggaggg

SEQ ID NO: 733511 - RNA, 24 nt, Human
agauggagcuugcagugagccgag

SEQ ID NO: 733512 - RNA, 19 nt, Human
agcacuuugggaggcugag

SEQ ID NO: 733513 - RNA, 19 nt, Human
agcacuuugggaggcugag

SEQ ID NO: 733514 - RNA, 23 nt, Human
agcacuuugggaggcugagacag

SEQ ID NO: 733515 - RNA, 20 nt, Human
agcagccccuaggaaguuaa

SEQ ID NO: 733516 - RNA, 23 nt, Human
agccacgccaucuggccagcaca

SEQ ID NO: 733517 - RNA, 24 nt, Human
agccaggcagaucacaaggucagg

SEQ ID NO: 733518 - RNA, 24 nt, Human
agccuggguaacacagcaagaccc

SEQ ID NO: 733519 - RNA, 24 nt, Human
agccugggugacagagcgagacuc

SEQ ID NO: 733520 - RNA, 19 nt, Human
agcugcggcauucacccuc

SEQ ID NO: 733521 - RNA, 20 nt, Human
agcugggcgugguggugggu

SEQ ID NO: 733522 - RNA, 19 nt, Human
aggagaggguagggcaggg

SEQ ID NO: 733523 - RNA, 27 nt, Human
aggcaaggacaaaaacucaagccaagg

SEQ ID NO: 733524 - RNA, 24 nt, Human
aggcagaucacaaggucaggagau

SEQ ID NO: 733525 - RNA, 21 nt, Human
aggcgggagaauggcgugaac

SEQ ID NO: 733526 - RNA, 24 nt, Human
aggcgggagaauggcgugaaccug

SEQ ID NO: 733527 - RNA, 24 nt, Human
aggcugagacaggagggucacuug

SEQ ID NO: 733528 - RNA, 23 nt, Human
aggggccaggagcuagggaggca

SEQ ID NO: 733529 - RNA, 21 nt, Human
agggucacuugaggccaggag

SEQ ID NO: 733530 - RNA, 19 nt, Human
agguggaggcugcagugag

SEQ ID NO: 733531 - RNA, 22 nt, Human
agguggaggcugcagugagcca

SEQ ID NO: 733532 - RNA, 25 nt, Human
agucaaggagguggaggcugcagug

SEQ ID NO: 733533 - RNA, 18 nt, Human
aguucaaauguauugucg

SEQ ID NO: 733534 - RNA, 21 nt, Human
auccuuuuguaucuacauaug

SEQ ID NO: 733535 - RNA, 24 nt, Human
aucgugccacugcacuccagccug

SEQ ID NO: 733536 - RNA, 19 nt, Human
augccuguaaucccagcac

SEQ ID NO: 733537 - RNA, 24 nt, Human
auuguaccacugcacuccagccug

SEQ ID NO: 733538 - RNA, 24 nt, Human
caaaaaagacugagaaaacaggaa

SEQ ID NO: 733539 - RNA, 22 nt, Human
caaacccagcccuuacgccccu

SEQ ID NO: 733540 - RNA, 21 nt, Human
caaagccgcaaaaaagacuga

SEQ ID NO: 733541 - RNA, 24 nt, Human
caacaagcccagagagaaggggug

SEQ ID NO: 733542 - RNA, 23 nt, Human
caagagccugugcuccuccugug

SEQ ID NO: 733543 - RNA, 23 nt, Human
cacaccccugcucaugucccacu

SEQ ID NO: 733544 - RNA, 21 nt, Human
cacagcaaagccgcaaaaaag

SEQ ID NO: 733545 - RNA, 22 nt, Human
caccaaagccaccuccugccca

SEQ ID NO: 733546 - RNA, 23 nt, Human
caccccucuucucaacaagccca

SEQ ID NO: 733547 - RNA, 19 nt, Human
cacccuccaagcccacacc

SEQ ID NO: 733548 - RNA, 19 nt, Human
caccucccagggccucccg

SEQ ID NO: 733549 - RNA, 23 nt, Human
caccucccagggccucccgggaa

SEQ ID NO: 733550 - RNA, 24 nt, Human
cacgccuauaauccuagcacuuug

SEQ ID NO: 733551 - RNA, 18 nt, Human
cacgccuguagucucagc

SEQ ID NO: 733552 - RNA, 22 nt, Human
cacuccagccugggugacagag

SEQ ID NO: 733553 - RNA, 22 nt, Human
cacuccagccugggugacagag

SEQ ID NO: 733554 - RNA, 24 nt, Human
cacuccagccugggugacagagcg

SEQ ID NO: 733555 - RNA, 19 nt, Human
cacugcacuccagccuggg

SEQ ID NO: 733556 - RNA, 19 nt, Human
cacugcacuccagccuggg

SEQ ID NO: 733557 - RNA, 19 nt, Human
cacugcacuccagccuggg

SEQ ID NO: 733558 - RNA, 19 nt, Human
cacugcacuccagccuggg

SEQ ID NO: 733559 - RNA, 19 nt, Human
cacugcacuccagccuggg

SEQ ID NO: 733560 - RNA, 22 nt, Human
cacugcacuccagccuggguga

SEQ ID NO: 733561 - RNA, 22 nt, Human
cacugcacuccagccuggguga

SEQ ID NO: 733562 - RNA, 23 nt, Human
cacugcacuccagccugggugac

SEQ ID NO: 733563 - RNA, 24 nt, Human
cacugcacuccagccugggugaca

SEQ ID NO: 733564 - RNA, 24 nt, Human
cacugcacuccagccugggugaca

SEQ ID NO: 733565 - RNA, 25 nt, Human
cacugcacuccagccugggugacag

SEQ ID NO: 733566 - RNA, 25 nt, Human
cacugcacuccagccugggugacag

SEQ ID NO: 733567 - RNA, 21 nt, Human
cacugucaggcugggcacccc

SEQ ID NO: 733568 - RNA, 20 nt, Human
cagaacccacagcagaggga

SEQ ID NO: 733569 - RNA, 19 nt, Human
cagauacucaauaaacacu

SEQ ID NO: 733570 - RNA, 18 nt, Human
cagcacuuugggaggcug

SEQ ID NO: 733571 - RNA, 24 nt, Human
cagcacuuugggaggcugagccag

SEQ ID NO: 733572 - RNA, 22 nt, Human
cagccagggcguucuaggacaa

SEQ ID NO: 733573 - RNA, 20 nt, Human
cagcccagaacccacagcag

SEQ ID NO: 733574 - RNA, 22 nt, Human
cagcuacucgggagguugaggc

SEQ ID NO: 733575 - RNA, 24 nt, Human
cagcuacucgggagguugaggcgg

SEQ ID NO: 733576 - RNA, 20 nt, Human
cagcucagugccuggaacgg

SEQ ID NO: 733577 - RNA, 19 nt, Human
caggcccagcaagggcuug

SEQ ID NO: 733578 - RNA, 26 nt, Human
cagugcuaagacugucuuccugcuga

SEQ ID NO: 733579 - RNA, 19 nt, Human
cauugcugcagaggcuggu

SEQ ID NO: 733580 - RNA, 21 nt, Human
ccaaccacagcaaagccgcaa

SEQ ID NO: 733581 - RNA, 22 nt, Human
ccaagcgcagcucuccugcacu

SEQ ID NO: 733582 - RNA, 20 nt, Human
ccacugcacuccagccuggg

SEQ ID NO: 733583 - RNA, 20 nt, Human
ccacugcacuccagccuggg

SEQ ID NO: 733584 - RNA, 20 nt, Human
ccacugcacuccagccuggg

SEQ ID NO: 733585 - RNA, 20 nt, Human
ccacugcacuccagccuggg

SEQ ID NO: 733586 - RNA, 20 nt, Human
ccacugcacuccagccuggg

SEQ ID NO: 733587 - RNA, 20 nt, Human
ccacugcacuccagccuggg

SEQ ID NO: 733588 - RNA, 20 nt, Human
ccacugcacuccagccuggg

SEQ ID NO: 733589 - RNA, 21 nt, Human
ccacugcacuccagccugggu

SEQ ID NO: 733590 - RNA, 21 nt, Human
ccacugcacuccagccugggu

SEQ ID NO: 733591 - RNA, 21 nt, Human
ccacugcacuccagccugggu

SEQ ID NO: 733592 - RNA, 21 nt, Human
ccacugcacuccagccugggu

SEQ ID NO: 733593 - RNA, 23 nt, Human
ccacugcacuccagccuggguga

SEQ ID NO: 733594 - RNA, 23 nt, Human
ccacugcacuccagccuggguga

SEQ ID NO: 733595 - RNA, 24 nt, Human
ccacugcacuccagccugggugac

SEQ ID NO: 733596 - RNA, 24 nt, Human
ccacugcacuccagccugggugac

SEQ ID NO: 733597 - RNA, 24 nt, Human
ccagaccauccuggcuaacacagu

SEQ ID NO: 733598 - RNA, 23 nt, Human
ccagggcacagggcaagcaacag

SEQ ID NO: 733599 - RNA, 20 nt, Human
ccaugcugcccacaggacuc

SEQ ID NO: 733600 - RNA, 20 nt, Human
cccaagucaucguccucucc

SEQ ID NO: 733601 - RNA, 22 nt, Human
cccacccgagaaggucuggggc

SEQ ID NO: 733602 - RNA, 24 nt, Human
cccauccucggccuucccagcacc

SEQ ID NO: 733603 - RNA, 29 nt, Human
ccccaccacgcuccacgcgcgagucucug

SEQ ID NO: 733604 - RNA, 22 nt, Human
ccccagagggguggccuuggcu

SEQ ID NO: 733605 - RNA, 22 nt, Human
ccccagaugacuguaugccuug

SEQ ID NO: 733606 - RNA, 23 nt, Human
ccccuucucccuucacgcguccc

SEQ ID NO: 733607 - RNA, 19 nt, Human
cccgagaugcccugugcug

SEQ ID NO: 733608 - RNA, 21 nt, Human
cccgugccgggccagacuggg

SEQ ID NO: 733609 - RNA, 23 nt, Human
cccucacuuccuucugcucucug

SEQ ID NO: 733610 - RNA, 22 nt, Human
ccgacagcaaugacauccacag

SEQ ID NO: 733611 - RNA, 20 nt, Human
ccgcugaacuccaacaaccu

SEQ ID NO: 733612 - RNA, 29 nt, Human
ccgcugaacuccaacaaccucuggguggg

SEQ ID NO: 733613 - RNA, 19 nt, Human
ccgggcgccaccgcccccc

SEQ ID NO: 733614 - RNA, 22 nt, Human
ccuaacccgacagcaaugacau

SEQ ID NO: 733615 - RNA, 22 nt, Human
ccuauaauccuagcacuuuggg

SEQ ID NO: 733616 - RNA, 20 nt, Human
ccucacgcgcaggcccagcc

SEQ ID NO: 733617 - RNA, 20 nt, Human
ccucaugcugacucugcucc

SEQ ID NO: 733618 - RNA, 18 nt, Human
ccuccaagcccacacccc

SEQ ID NO: 733619 - RNA, 22 nt, Human
ccucuucacccuccaagcccac

SEQ ID NO: 733620 - RNA, 23 nt, Human
ccuggcaggggccaggagcuagg

SEQ ID NO: 733621 - RNA, 23 nt, Human
ccuggcuaacacagugaaauccc

SEQ ID NO: 733622 - RNA, 22 nt, Human
ccuggguaacacagcaagaccc

SEQ ID NO: 733623 - RNA, 20 nt, Human
ccugggugacagagcaagac

SEQ ID NO: 733624 - RNA, 22 nt, Human
ccugggugacagagcgagacuc

SEQ ID NO: 733625 - RNA, 20 nt, Human
ccuguaaucccagcacuuug

SEQ ID NO: 733626 - RNA, 22 nt, Human
ccuguaaucccagcacuuuggg

SEQ ID NO: 733627 - RNA, 21 nt, Human
ccuguagucccagcuacucgg

SEQ ID NO: 733628 - RNA, 22 nt, Human
cgaagccacgcccacccgagaa

SEQ ID NO: 733629 - RNA, 24 nt, Human
cgagaucgugccacugcacuccag

SEQ ID NO: 733630 - RNA, 20 nt, Human
cgccaccgccccccgcgagc

SEQ ID NO: 733631 - RNA, 24 nt, Human
cgccuguagucucagcuauucagg

SEQ ID NO: 733632 - RNA, 22 nt, Human
cgcggggugggggugaccucca

SEQ ID NO: 733633 - RNA, 21 nt, Human
cgcugcagcgccaggccuccc

SEQ ID NO: 733634 - RNA, 21 nt, Human
cggcagcugccaaccacagca

SEQ ID NO: 733635 - RNA, 20 nt, Human
cggccggggucggccugggu

SEQ ID NO: 733636 - RNA, 18 nt, Human
cgggaugggcggggagac

SEQ ID NO: 733637 - RNA, 24 nt, Human
cgggcgccaccgccccccgcgagc

SEQ ID NO: 733638 - RNA, 24 nt, Human
cucaugccuguaaucccagcacuu

SEQ ID NO: 733639 - RNA, 24 nt, Human
cuccggccacaugggcugcuggug

SEQ ID NO: 733640 - RNA, 21 nt, Human
cuccguauaaaaaaaaaaaaa

SEQ ID NO: 733641 - RNA, 20 nt, Human
cuccugcacuggcucgcacc

SEQ ID NO: 733642 - RNA, 18 nt, Human
cucugcaguggcccucug

SEQ ID NO: 733643 - RNA, 20 nt, Human
cucuggagggcagcccucug

SEQ ID NO: 733644 - RNA, 20 nt, Human
cucuguaccugcugucccuc

SEQ ID NO: 733645 - RNA, 23 nt, Human
cucugugccgggcgccaccgccc

SEQ ID NO: 733646 - RNA, 26 nt, Human
cucugugccgggcgccaccgcccccc

SEQ ID NO: 733647 - RNA, 22 nt, Human
cugaagucaguguaaagacauc

SEQ ID NO: 733648 - RNA, 21 nt, Human
cugacucugcuccggccacau

SEQ ID NO: 733649 - RNA, 24 nt, Human
cugcaccgcccccuuaaccccucu

SEQ ID NO: 733650 - RNA, 22 nt, Human
cugcagugagccaugauuguac

SEQ ID NO: 733651 - RNA, 19 nt, Human
cugcaguggcccucugggc

SEQ ID NO: 733652 - RNA, 23 nt, Human
cugggcaugguggcucaugccug

SEQ ID NO: 733653 - RNA, 19 nt, Human
cugggugugguggcacacg

SEQ ID NO: 733654 - RNA, 18 nt, Human
cuucccacuucuucuaag

SEQ ID NO: 733655 - RNA, 24 nt, Human
cuugcagugagccgagaucgugcc

SEQ ID NO: 733656 - RNA, 22 nt, Human
cuugcucccucacuuccuucug

SEQ ID NO: 733657 - RNA, 18 nt, Human
gaaacuggggagaggagg

SEQ ID NO: 733658 - RNA, 22 nt, Human
gaaagcagcagagaggggaggc

SEQ ID NO: 733659 - RNA, 24 nt, Human
gaaccagcugggcguggugguuca

SEQ ID NO: 733660 - RNA, 24 nt, Human
gaacccacagcagagggaaacugg

SEQ ID NO: 733661 - RNA, 24 nt, Human
gagaagggguggacccugguuguc

SEQ ID NO: 733662 - RNA, 18 nt, Human
gagccgccccaccacgcu

SEQ ID NO: 733663 - RNA, 18 nt, Human
gagcuugcagugagccga

SEQ ID NO: 733664 - RNA, 23 nt, Human
gagcuugcagugagccgagaucg

SEQ ID NO: 733665 - RNA, 24 nt, Human
gaggagggggccugacccuggauc

SEQ ID NO: 733666 - RNA, 23 nt, Human
gaggcugcagugagccaugauug

SEQ ID NO: 733667 - RNA, 18 nt, Human
gauucuggacauggaagc

SEQ ID NO: 733668 - RNA, 24 nt, Human
gcaaagccgcaaaaaagacugaga

SEQ ID NO: 733669 - RNA, 22 nt, Human
gcaccccucuucucaacaagcc

SEQ ID NO: 733670 - RNA, 22 nt, Human
gcacccgcagcugucugcuugg

SEQ ID NO: 733671 - RNA, 24 nt, Human
gcacuccagccugggugacagagc

SEQ ID NO: 733672 - RNA, 24 nt, Human
gcacuccagccugggugacagagc

SEQ ID NO: 733673 - RNA, 18 nt, Human
gcagaccagccaagcccg

SEQ ID NO: 733674 - RNA, 25 nt, Human
gcagagcugggcucugaaccgcgag

SEQ ID NO: 733675 - RNA, 19 nt, Human
gccacugcacuccagccug

SEQ ID NO: 733676 - RNA, 24 nt, Human
gccacugcacuccagccuggguga

SEQ ID NO: 733677 - RNA, 23 nt, Human
gcccacaccccugcucauguccc

SEQ ID NO: 733678 - RNA, 20 nt, Human
gccgagaucgugccacugca

SEQ ID NO: 733679 - RNA, 24 nt, Human
gcggcggccggggucggccugggu

SEQ ID NO: 733680 - RNA, 21 nt, Human
gcugccccccacauguaccug

SEQ ID NO: 733681 - RNA, 22 nt, Human
gcugggcaugguggcucaugcc

SEQ ID NO: 733682 - RNA, 20 nt, Human
gcugucccucucuggaacag

SEQ ID NO: 733683 - RNA, 24 nt, Human
ggaaaaugcagucuaaaugcccuc

SEQ ID NO: 733684 - RNA, 20 nt, Human
ggaaccagcugggcguggug

SEQ ID NO: 733685 - RNA, 19 nt, Human
ggagaggccaggcagcccu

SEQ ID NO: 733686 - RNA, 24 nt, Human
ggagcuugcagugagccgagaucg

SEQ ID NO: 733687 - RNA, 22 nt, Human
ggaggacagacacaggagaggg

SEQ ID NO: 733688 - RNA, 22 nt, Human
ggaggcugcagugagccaugau

SEQ ID NO: 733689 - RNA, 24 nt, Human
ggaggcugcagugagccaugauug

SEQ ID NO: 733690 - RNA, 20 nt, Human
ggauaggaaauacuuuuauu

SEQ ID NO: 733691 - RNA, 21 nt, Human
ggauguggacacuggagggag

SEQ ID NO: 733692 - RNA, 19 nt, Human
ggcagcugggccuucccua

SEQ ID NO: 733693 - RNA, 24 nt, Human
ggcaugguggcucaugccuguaaa

SEQ ID NO: 733694 - RNA, 23 nt, Human
ggcguggugguucacgccuauaa

SEQ ID NO: 733695 - RNA, 23 nt, Human
ggcugggcaugguggcucaugcc

SEQ ID NO: 733696 - RNA, 23 nt, Human
gggaaacuggggagaggaggggg

SEQ ID NO: 733697 - RNA, 21 nt, Human
gggaaggagagggugagaggu

SEQ ID NO: 733698 - RNA, 25 nt, Human
gggagaggagggggccugacccugg

SEQ ID NO: 733699 - RNA, 18 nt, Human
gggcagggccccaccugg

SEQ ID NO: 733700 - RNA, 19 nt, Human
ggggaaaacagaacgcugg

SEQ ID NO: 733701 - RNA, 22 nt, Human
ggggcgccgcggcucucgaggg

SEQ ID NO: 733702 - RNA, 22 nt, Human
ggggcucccugagggaguuugc

SEQ ID NO: 733703 - RNA, 18 nt, Human
ggguagccccaagggagc

SEQ ID NO: 733704 - RNA, 22 nt, Human
gggugggcucagcagccccuag

SEQ ID NO: 733705 - RNA, 24 nt, Human
gggugugguggcacacgccuguag

SEQ ID NO: 733706 - RNA, 22 nt, Human
gguccagggcacagggcaagca

SEQ ID NO: 733707 - RNA, 21 nt, Human
gguggagaccuggguaggucc

SEQ ID NO: 733708 - RNA, 24 nt, Human
gguggcucaugccuguaaucccag

SEQ ID NO: 733709 - RNA, 19 nt, Human
ggugggaacaaguaggugc

SEQ ID NO: 733710 - RNA, 24 nt, Human
ggugguucacgccuauaauccuag

SEQ ID NO: 733711 - RNA, 18 nt, Human
guccaugucaucgcugcc

SEQ ID NO: 733712 - RNA, 23 nt, Human
gucccaucacugucaggcugggc

SEQ ID NO: 733713 - RNA, 22 nt, Human
gugcccgcugcagcgccaggcc

SEQ ID NO: 733714 - RNA, 22 nt, Human
gugcugggcccccauccucggc

SEQ ID NO: 733715 - RNA, 23 nt, Human
guggcacacgccuguagucucag

SEQ ID NO: 733716 - RNA, 26 nt, Human
uaaaaaggaggcaaggacaaaaacuc

SEQ ID NO: 733717 - RNA, 22 nt, Human
uaacacagcaagacccugucuc

SEQ ID NO: 733718 - RNA, 24 nt, Human
uaacacagcaagacccugucucua

SEQ ID NO: 733719 - RNA, 24 nt, Human
uaacacagugaaaucccgucucua

SEQ ID NO: 733720 - RNA, 20 nt, Human
uaacacugcucacauggcca

SEQ ID NO: 733721 - RNA, 23 nt, Human
uaacaucugugucucagugagcc

SEQ ID NO: 733722 - RNA, 18 nt, Human
uaacuuaauuugugcugu

SEQ ID NO: 733723 - RNA, 21 nt, Human
uaagccccuggcaggggccag

SEQ ID NO: 733724 - RNA, 18 nt, Human
uaagugacagugcuaaga

SEQ ID NO: 733725 - RNA, 25 nt, Human
uacagggcaggggggcucccugagg

SEQ ID NO: 733726 - RNA, 22 nt, Human
uaccacugcacuccagccuggg

SEQ ID NO: 733727 - RNA, 23 nt, Human
uaccuguagucccagcuacucgg

SEQ ID NO: 733728 - RNA, 24 nt, Human
uaccuguagucccagcuacucggg

SEQ ID NO: 733729 - RNA, 21 nt, Human
uacugggugugguggcacacg

SEQ ID NO: 733730 - RNA, 18 nt, Human
uagcacuuugggaggcug

SEQ ID NO: 733731 - RNA, 24 nt, Human
uaggagcagggggcuauggcugaa

SEQ ID NO: 733732 - RNA, 18 nt, Human
uaggccucuaccacgucc

SEQ ID NO: 733733 - RNA, 18 nt, Human
uagggaggcaggcucccc

SEQ ID NO: 733734 - RNA, 22 nt, Human
uaggucacagaccucaugcuga

SEQ ID NO: 733735 - RNA, 26 nt, Human
uagguugucgaggacgccgcggccgg

SEQ ID NO: 733736 - RNA, 21 nt, Human
uaguagaucagcauuaaauac

SEQ ID NO: 733737 - RNA, 20 nt, Human
uauaaaaaaaaaaaaaguau

SEQ ID NO: 733738 - RNA, 21 nt, Human
ucaacacaaguauucccacag

SEQ ID NO: 733739 - RNA, 18 nt, Human
ucacaaggucaggagauc

SEQ ID NO: 733740 - RNA, 24 nt, Human
ucacaaggucaggagauccagacc

SEQ ID NO: 733741 - RNA, 19 nt, Human
ucacaggaagcccagcugc

SEQ ID NO: 733742 - RNA, 23 nt, Human
ucacgccuauaauccuagcacuu

SEQ ID NO: 733743 - RNA, 20 nt, Human
ucacuguguuuauauaacuu

SEQ ID NO: 733744 - RNA, 22 nt, Human
ucacuugaggccaggaguguga

SEQ ID NO: 733745 - RNA, 23 nt, Human
ucagaacacacagcaagugcuca

SEQ ID NO: 733746 - RNA, 22 nt, Human
ucaugccuguaaucccagcacu

SEQ ID NO: 733747 - RNA, 21 nt, Human
ucaugggaggaccccuucucc

SEQ ID NO: 733748 - RNA, 24 nt, Human
uccaagagaaacccaggggcugcc

SEQ ID NO: 733749 - RNA, 22 nt, Human
uccacaggcuagagggacccau

SEQ ID NO: 733750 - RNA, 24 nt, Human
uccagccugggugacagagcaaga

SEQ ID NO: 733751 - RNA, 23 nt, Human
uccagccugggugacagagcgag

SEQ ID NO: 733752 - RNA, 24 nt, Human
uccagccugggugacagagcgaga

SEQ ID NO: 733753 - RNA, 20 nt, Human
uccagguucaggccauccuc

SEQ ID NO: 733754 - RNA, 22 nt, Human
uccccggaggcagcugggccuu

SEQ ID NO: 733755 - RNA, 21 nt, Human
uccccgugugcaggucgugcc

SEQ ID NO: 733756 - RNA, 18 nt, Human
uccucaggaaccagcugg

SEQ ID NO: 733757 - RNA, 23 nt, Human
ucgaagccacgcccacccgagaa

SEQ ID NO: 733758 - RNA, 23 nt, Human
ucgugccacugcacuccagccug

SEQ ID NO: 733759 - RNA, 21 nt, Human
ucuaggacaagacuuccuaac

SEQ ID NO: 733760 - RNA, 21 nt, Human
ucucaagguacagaaaccuuc

SEQ ID NO: 733761 - RNA, 22 nt, Human
ucucuacuaaaaauacacaaac

SEQ ID NO: 733762 - RNA, 19 nt, Human
ucucucagaaucucugcag

SEQ ID NO: 733763 - RNA, 25 nt, Human
ucuucacccuccaagcccacacccc

SEQ ID NO: 733764 - RNA, 22 nt, Human
ugacagagcaagacccugucuc

SEQ ID NO: 733765 - RNA, 21 nt, Human
ugacauccacaguguauggac

SEQ ID NO: 733766 - RNA, 25 nt, Human
ugagaaaaaaaauuacugggugugg

SEQ ID NO: 733767 - RNA, 18 nt, Human
ugagaaaacaggaaccca

SEQ ID NO: 733768 - RNA, 22 nt, Human
ugagaaaacaggaacccagagu

SEQ ID NO: 733769 - RNA, 20 nt, Human
ugagacaggagggucacuug

SEQ ID NO: 733770 - RNA, 25 nt, Human
ugagacaggagggucacuugaggcc

SEQ ID NO: 733771 - RNA, 20 nt, Human
ugagaggugaggacgcaaga

SEQ ID NO: 733772 - RNA, 22 nt, Human
ugagccgagaucgugccacugc

SEQ ID NO: 733773 - RNA, 18 nt, Human
ugaugguggagaccuggg

SEQ ID NO: 733774 - RNA, 22 nt, Human
ugcagugagccaugauuguacc

SEQ ID NO: 733775 - RNA, 24 nt, Human
ugcaguggcccucugggcugagca

SEQ ID NO: 733776 - RNA, 22 nt, Human
ugccccgcugaacuccaacaac

SEQ ID NO: 733777 - RNA, 21 nt, Human
ugccuaggagaacgggccucc

SEQ ID NO: 733778 - RNA, 23 nt, Human
ugccuguaaucccagcacuuugg

SEQ ID NO: 733779 - RNA, 23 nt, Human
ugccuguaaucccagcacuuugg

SEQ ID NO: 733780 - RNA, 21 nt, Human
ugcggugggaggacugcgagu

SEQ ID NO: 733781 - RNA, 22 nt, Human
ugcugggcccccauccucggcc

SEQ ID NO: 733782 - RNA, 21 nt, Human
ugcugucccucucuggaacag

SEQ ID NO: 733783 - RNA, 21 nt, Human
uggaaccaaccaccaaagcca

SEQ ID NO: 733784 - RNA, 18 nt, Human
uggaauuugggaccccac

SEQ ID NO: 733785 - RNA, 19 nt, Human
uggacauggaagccuacag

SEQ ID NO: 733786 - RNA, 21 nt, Human
uggcacacgccuguagucuca

SEQ ID NO: 733787 - RNA, 22 nt, Human
uggcucaugccuguaaucccag

SEQ ID NO: 733788 - RNA, 24 nt, Human
uggcucaugccuguaaucccagca

SEQ ID NO: 733789 - RNA, 18 nt, Human
ugggaacaaguaggugca

SEQ ID NO: 733790 - RNA, 29 nt, Human
ugggagauggagcuugcagugacaacggu

SEQ ID NO: 733791 - RNA, 24 nt, Human
ugggagauggagcuugcagugagc

SEQ ID NO: 733792 - RNA, 24 nt, Human
ugggaggcugagacaggaggguca

SEQ ID NO: 733793 - RNA, 24 nt, Human
ugggaggcugagccaggcagauca

SEQ ID NO: 733794 - RNA, 18 nt, Human
ugggcugggcaugguggc

SEQ ID NO: 733795 - RNA, 21 nt, Human
uggugccugguuuuccccaua

SEQ ID NO: 733796 - RNA, 24 nt, Human
ugguggcacacgccuguagucuca

SEQ ID NO: 733797 - RNA, 24 nt, Human
ugguggcucaugccuguaauccca

SEQ ID NO: 733798 - RNA, 24 nt, Human
uggugguggguaccuguaguccca

SEQ ID NO: 733799 - RNA, 22 nt, Human
uggugguucacgccuauaaucc

SEQ ID NO: 733800 - RNA, 19 nt, Human
ugguucacgccuauaaucc

SEQ ID NO: 733801 - RNA, 21 nt, Human
ugguucacgccuauaauccua

SEQ ID NO: 733802 - RNA, 24 nt, Human
ugguucacgccuauaauccuagca

SEQ ID NO: 733803 - RNA, 20 nt, Human
ugucagggguccugggacau

SEQ ID NO: 733804 - RNA, 24 nt, Human
uguccuugugcacaaaggaguggg

SEQ ID NO: 733805 - RNA, 18 nt, Human
ugugccgggcgccaccgc

SEQ ID NO: 733806 - RNA, 25 nt, Human
uguguuuauauaacuuaauuugugc

SEQ ID NO: 733807 - RNA, 23 nt, Human
uguuccaugcugcccacaggacu

SEQ ID NO: 733808 - RNA, 21 nt, Human
uuaaccaggaaaaugcagucu

SEQ ID NO: 733809 - RNA, 18 nt, Human
uuagcugggcgugguggu

SEQ ID NO: 733810 - RNA, 22 nt, Human
uucaacuuuggaaccaaccacc

SEQ ID NO: 733811 - RNA, 21 nt, Human
uuccaugcugcccacaggacu

SEQ ID NO: 733812 - RNA, 19 nt, Human
uucucaacaagcccagaga

SEQ ID NO: 733813 - RNA, 18 nt, Human
uugcagugagccgagauc

SEQ ID NO: 733814 - RNA, 21 nt, Human
uugcagugagccgagaucgug

SEQ ID NO: 733815 - RNA, 22 nt, Human
uugcagugagccgagaucgugc

SEQ ID NO: 733816 - RNA, 25 nt, Human
uugggaggcugagacaggaggguca

SEQ ID NO: 733817 - RNA, 25 nt, Human
uugggaggcugagccaggcagauca

SEQ ID NO: 733818 - RNA, 23 nt, Human
uuguaccacugcacuccagccug

SEQ ID NO: 733819 - RNA, 27 nt, Human
uuuaaccaggaaaaugcagucuaaaug

SEQ ID NO: 733820 - RNA, 25 nt, Human
aaaaaagaaaaaagaucuaugaagg

SEQ ID NO: 733821 - RNA, 21 nt, Human
aaaaaugaaaaaaagugccca

SEQ ID NO: 733822 - RNA, 25 nt, Human
aaagagaaaaaacaaguuuaaagaa

SEQ ID NO: 733823 - RNA, 20 nt, Human
aaaucuuauucccauuaaaa

SEQ ID NO: 733824 - RNA, 19 nt, Human
aacuugguaacacaggacc

SEQ ID NO: 733825 - RNA, 21 nt, Human
aagaaaaaagaucuaugaagg

SEQ ID NO: 733826 - RNA, 22 nt, Human
aagaagaaauuuuucauaggcu

SEQ ID NO: 733827 - RNA, 26 nt, Human
aagagaaaaaacaaguuuaaagaaga

SEQ ID NO: 733828 - RNA, 21 nt, Human
acaaaaggcgacacugccaca

SEQ ID NO: 733829 - RNA, 23 nt, Human
acaggauuauuguggaaauauua

SEQ ID NO: 733830 - RNA, 18 nt, Human
acaggccaaaggccuuug

SEQ ID NO: 733831 - RNA, 22 nt, Human
acaucucuauaaaguuuuuuug

SEQ ID NO: 733832 - RNA, 18 nt, Human
acccuguuuuaacauuuc

SEQ ID NO: 733833 - RNA, 24 nt, Human
agaaaaaacaaguuuaaagaagaa

SEQ ID NO: 733834 - RNA, 25 nt, Human
agaaaaaacaaguuuaaagaagaaa

SEQ ID NO: 733835 - RNA, 20 nt, Human
agaagcaaauagaaugguuu

SEQ ID NO: 733836 - RNA, 25 nt, Human
agagaaaaaacaaguuuaaagaaga

SEQ ID NO: 733837 - RNA, 18 nt, Human
agagggagcaaugcugau

SEQ ID NO: 733838 - RNA, 19 nt, Human
agggagcagcuuggcacag

SEQ ID NO: 733839 - RNA, 23 nt, Human
auaaaaccacaaaaggcgacacu

SEQ ID NO: 733840 - RNA, 20 nt, Human
auuuuguccaacuuuuucuu

SEQ ID NO: 733841 - RNA, 22 nt, Human
caaaaauaaauaaggaggauaa

SEQ ID NO: 733842 - RNA, 20 nt, Human
caaguccccuaaugaagaaa

SEQ ID NO: 733843 - RNA, 22 nt, Human
caauauuccuagccauuccaca

SEQ ID NO: 733844 - RNA, 20 nt, Human
cacuaugcugcuuccaauau

SEQ ID NO: 733845 - RNA, 21 nt, Human
cacuuuauuuaaaaauggagu

SEQ ID NO: 733846 - RNA, 20 nt, Human
cagaugaagaaguccauuuc

SEQ ID NO: 733847 - RNA, 19 nt, Human
cauaaaaccacaaaaggcg

SEQ ID NO: 733848 - RNA, 27 nt, Human
cauaaaaccacaaaaggcgacacugcc

SEQ ID NO: 733849 - RNA, 24 nt, Human
cccagcaaaucuuagugcaaacau

SEQ ID NO: 733850 - RNA, 24 nt, Human
cccauuaaaaaaaaaugaaaaaaa

SEQ ID NO: 733851 - RNA, 22 nt, Human
cgacacugccacaaucugcuuu

SEQ ID NO: 733852 - RNA, 23 nt, Human
cugccacaaucugcuuuuuccua

SEQ ID NO: 733853 - RNA, 23 nt, Human
cugcuuccaauauuccuagccau

SEQ ID NO: 733854 - RNA, 19 nt, Human
cuuaaaaaaaagaaaaaag

SEQ ID NO: 733855 - RNA, 23 nt, Human
gaaaguggaguaaaaacacugug

SEQ ID NO: 733856 - RNA, 22 nt, Human
gacugauggggucaagggggaa

SEQ ID NO: 733857 - RNA, 27 nt, Human
gagaaaaaacaaguuuaaagaagaaau

SEQ ID NO: 733858 - RNA, 18 nt, Human
gagcagcuuggcacagga

SEQ ID NO: 733859 - RNA, 20 nt, Human
gagcagcuuggcacaggaga

SEQ ID NO: 733860 - RNA, 23 nt, Human
ggagacuuagggguucagaaaug

SEQ ID NO: 733861 - RNA, 18 nt, Human
ggagcagcuuggcacagg

SEQ ID NO: 733862 - RNA, 23 nt, Human
gggaauuucuuuuucaacuguca

SEQ ID NO: 733863 - RNA, 23 nt, Human
uaaaaccacaaaaggcgacacug

SEQ ID NO: 733864 - RNA, 19 nt, Human
uaaauccuauuauuaagaa

SEQ ID NO: 733865 - RNA, 22 nt, Human
uaacugaauuaagauacacccc

SEQ ID NO: 733866 - RNA, 24 nt, Human
uaagaagcaaauagaaugguuuaa

SEQ ID NO: 733867 - RNA, 19 nt, Human
uagcacaggccaaaggccu

SEQ ID NO: 733868 - RNA, 26 nt, Human
uaggucacagcauggcuuaaaaaaaa

SEQ ID NO: 733869 - RNA, 25 nt, Human
uagugcaaacauaauaguuaauuuc

SEQ ID NO: 733870 - RNA, 20 nt, Human
uaguuaucauuuaaccuaaa

SEQ ID NO: 733871 - RNA, 20 nt, Human
uauaauugaaccaaacugug

SEQ ID NO: 733872 - RNA, 20 nt, Human
uauuuuguccaacuuuuucu

SEQ ID NO: 733873 - RNA, 23 nt, Human
uauuuuguccaacuuuuucuuca

SEQ ID NO: 733874 - RNA, 19 nt, Human
ucaacuaaucuuacgacua

SEQ ID NO: 733875 - RNA, 19 nt, Human
ucaacugucacauauaaac

SEQ ID NO: 733876 - RNA, 20 nt, Human
ucagaaauguuggcuauuua

SEQ ID NO: 733877 - RNA, 21 nt, Human
uccguaaaccccaagacaauu

SEQ ID NO: 733878 - RNA, 18 nt, Human
ucuguacagaugaagaag

SEQ ID NO: 733879 - RNA, 22 nt, Human
ucuugcaggguccuuauaaaug

SEQ ID NO: 733880 - RNA, 21 nt, Human
ugaagaaaauuuuaaccucau

SEQ ID NO: 733881 - RNA, 23 nt, Human
ugaagaaguccauuucagggagc

SEQ ID NO: 733882 - RNA, 18 nt, Human
uggcacaggagacuuagg

SEQ ID NO: 733883 - RNA, 24 nt, Human
uggggucaagggggaaaauccagg

SEQ ID NO: 733884 - RNA, 18 nt, Human
uguacaaaaaagacgguu

SEQ ID NO: 733885 - RNA, 23 nt, Human
uguacaaaaaagacgguuagucc

SEQ ID NO: 733886 - RNA, 19 nt, Human
uguccaccuaccacuccca

SEQ ID NO: 733887 - RNA, 20 nt, Human
ugugaaaggucugcuuuacu

SEQ ID NO: 733888 - RNA, 20 nt, Human
uguggaaauauuaaagacca

SEQ ID NO: 733889 - RNA, 24 nt, Human
uuaaaaccuuuuuucagucuuccu

SEQ ID NO: 733890 - RNA, 22 nt, Human
uuaaccuaaaaugagagaccaa

SEQ ID NO: 733891 - RNA, 24 nt, Human
uucaagggaauuucuuuuucaacu

SEQ ID NO: 733892 - RNA, 23 nt, Human
uucccauuaaaaaaaaaugaaaa

SEQ ID NO: 733893 - RNA, 23 nt, Human
uuucuuaaaacaaauauagcaca

SEQ ID NO: 733894 - RNA, 22 nt, Human
uuuuucaacaaucaagagaaag

SEQ ID NO: 733895 - RNA, 21 nt, Human
aaugucuccacaagaaaaaca

SEQ ID NO: 733896 - RNA, 18 nt, Human
acaagccagucuguggug

SEQ ID NO: 733897 - RNA, 22 nt, Human
accccaaaguagacuggaaaau

SEQ ID NO: 733898 - RNA, 20 nt, Human
auccacugcgagaaccccaa

SEQ ID NO: 733899 - RNA, 23 nt, Human
cuagcaugugagaaugugugaga

SEQ ID NO: 733900 - RNA, 24 nt, Human
gaaaucaaguacugaucuaaauaa

SEQ ID NO: 733901 - RNA, 20 nt, Human
ggcaaaagcaaucgaaugcg

SEQ ID NO: 733902 - RNA, 30 nt, Human; identical to SEQ ID NO: 119266

SEQ ID NO: 733903 - RNA, 21 nt, Human
gugugugugugugugugugag

SEQ ID NO: 733904 - RNA, 20 nt, Human
gugugugugugugugugugu

SEQ ID NO: 733905 - RNA, 25 nt, Human
uaaaaaacggcaaaagcaaucgaau

SEQ ID NO: 733906 - RNA, 19 nt, Human
uaagaacugcggugggagg

SEQ ID NO: 733907 - RNA, 23 nt, Human
uagaagggucuagcaugugagaa

SEQ ID NO: 733908 - RNA, 19 nt, Human
uccagaaugagaaagaugg

SEQ ID NO: 733909 - RNA, 23 nt, Human
ucgaaugcgagaaaauggccaag

SEQ ID NO: 733910 - RNA, 21 nt, Human
ugaugcaggagaguucagaua

SEQ ID NO: 733911 - RNA, 22 nt, Human
ugggaauugucagcuaaugucu

SEQ ID NO: 733912 - RNA, 18 nt, Human
ugugcgagaaagggugug

SEQ ID NO: 733913 - RNA, 28 nt, Human
ugugugagaguguguguguguguguggu

SEQ ID NO: 733914 - RNA, 20 nt, Human
ugugugcgugucuaugugug

SEQ ID NO: 733915 - RNA, 21 nt, Human
ugugugugcgugucuaugugu

SEQ ID NO: 733916 - RNA, 27 nt, Human
ugugugugugugcgagaaagggugugu

SEQ ID NO: 733917 - RNA, 18 nt, Human
ugugugugugugugugcg

SEQ ID NO: 733918 - RNA, 18 nt, Human
ugugugugugugugugug

SEQ ID NO: 733919 - RNA, 18 nt, Human
ugugugugugugugugug

SEQ ID NO: 733920 - RNA, 18 nt, Human
ugugugugugugugugug

SEQ ID NO: 733921 - RNA, 21 nt, Human
ugugugugugugugugugugu

SEQ ID NO: 733922 - RNA, 21 nt, Human
ugugugugugugugugugugu

SEQ ID NO: 733923 - RNA, 21 nt, Human
ugugugugugugugugugugu

SEQ ID NO: 733924 - RNA, 22 nt, Human
ugugugugugugugugugugug

SEQ ID NO: 733925 - RNA, 22 nt, Human
ugugugugugugugugugugug

SEQ ID NO: 733926 - RNA, 22 nt, Human
uguguguguguguguguguguu

SEQ ID NO: 733927 - RNA, 25 nt, Human
aaaagaccacccacccgccucccac

SEQ ID NO: 733928 - RNA, 19 nt, Human
aaacaaaaugagagaccag

SEQ ID NO: 733929 - RNA, 21 nt, Human
aaagaccacccacccgccucc

SEQ ID NO: 733930 - RNA, 24 nt, Human
aaagugcugagauuacaggcguga

SEQ ID NO: 733931 - RNA, 18 nt, Human
aacccagaaggaggaggu

SEQ ID NO: 733932 - RNA, 19 nt, Human
aagaacacuuugugacccu

SEQ ID NO: 733933 - RNA, 18 nt, Human
aagaacagauucuguucu

SEQ ID NO: 733934 - RNA, 19 nt, Human
aagaaugcauuugagagcu

SEQ ID NO: 733935 - RNA, 19 nt, Human
aagacuuuuccuaaaauuu

SEQ ID NO: 733936 - RNA, 25 nt, Human
aagcugguuuucuuccaguauguuu

SEQ ID NO: 733937 - RNA, 18 nt, Human
aaggacagaccacaauaa

SEQ ID NO: 733938 - RNA, 19 nt, Human
aaguagcugggauuacugg

SEQ ID NO: 733939 - RNA, 21 nt, Human
aaucacuugaacccagaagga

SEQ ID NO: 733940 - RNA, 23 nt, Human
aaucacuugaacccagaaggagg

SEQ ID NO: 733941 - RNA, 20 nt, Human
aaucccagcagcagaugugc

SEQ ID NO: 733942 - RNA, 18 nt, Human
acagagugagacuccguc

SEQ ID NO: 733943 - RNA, 20 nt, Human
acagagugagacuccgucuc

SEQ ID NO: 733944 - RNA, 22 nt, Human
acaguccuccugaagcgcuugc

SEQ ID NO: 733945 - RNA, 24 nt, Human
acaguccuccugaagcgcuugcuc

SEQ ID NO: 733946 - RNA, 19 nt, Human
accacuugggaacacauac

SEQ ID NO: 733947 - RNA, 20 nt, Human
accagacuucaagcucuggc

SEQ ID NO: 733948 - RNA, 22 nt, Human
accaggcuggucucgaacuccu

SEQ ID NO: 733949 - RNA, 23 nt, Human
accauguuaccaggcuggucucg

SEQ ID NO: 733950 - RNA, 24 nt, Human
accauguuggccaggcugcucuug

SEQ ID NO: 733951 - RNA, 24 nt, Human
accccacccaaaugagccaugcca

SEQ ID NO: 733952 - RNA, 24 nt, Human
accccgucucuacugaaaauacaa

SEQ ID NO: 733953 - RNA, 19 nt, Human
accccuccuuucuugacac

SEQ ID NO: 733954 - RNA, 24 nt, Human
accuugugauccgcccgccucagc

SEQ ID NO: 733955 - RNA, 18 nt, Human
acgggguuucaccauguu

SEQ ID NO: 733956 - RNA, 18 nt, Human
acgggguuucaccauguu

SEQ ID NO: 733957 - RNA, 19 nt, Human
acgggguuucaccauguua

SEQ ID NO: 733958 - RNA, 23 nt, Human
acgggguuucaccauguuaccag

SEQ ID NO: 733959 - RNA, 23 nt, Human
acgggguuucaccauguuggcca

SEQ ID NO: 733960 - RNA, 24 nt, Human
acgggguuucaccauguuggccag

SEQ ID NO: 733961 - RNA, 24 nt, Human
acuuugggaggcuggggugggcag

SEQ ID NO: 733962 - RNA, 20 nt, Human
agaaguauauacagugaaaa

SEQ ID NO: 733963 - RNA, 21 nt, Human
agagugaaagagaaaggucuu

SEQ ID NO: 733964 - RNA, 23 nt, Human
agauaccuggcugcagacagcag

SEQ ID NO: 733965 - RNA, 23 nt, Human
agaucguuugaggucaggaguuc

SEQ ID NO: 733966 - RNA, 22 nt, Human
agauuacaggcgugagccacca

SEQ ID NO: 733967 - RNA, 24 nt, Human
agauuacaggcgugagccaccaug

SEQ ID NO: 733968 - RNA, 24 nt, Human
agcacuuugggaggcugggguggg

SEQ ID NO: 733969 - RNA, 20 nt, Human
agccagaacaccacauuccu

SEQ ID NO: 733970 - RNA, 18 nt, Human
agccaugccagacagccc

SEQ ID NO: 733971 - RNA, 24 nt, Human
agccuggccaauauggggagaccc

SEQ ID NO: 733972 - RNA, 24 nt, Human
agccuguagucccagcuacucagg

SEQ ID NO: 733973 - RNA, 24 nt, Human
agcgauucuccugccucagccucc

SEQ ID NO: 733974 - RNA, 23 nt, Human
agcugagugugguggcacaagcc

SEQ ID NO: 733975 - RNA, 19 nt, Human
aggaggagguugcagugag

SEQ ID NO: 733976 - RNA, 24 nt, Human
aggaggagguugcagugagcugag

SEQ ID NO: 733977 - RNA, 23 nt, Human
aggaggcugaggcagaagaauca

SEQ ID NO: 733978 - RNA, 18 nt, Human
aggcagaagaaucacuug

SEQ ID NO: 733979 - RNA, 23 nt, Human
aggcagaagaaucacuugaaccc

SEQ ID NO: 733980 - RNA, 24 nt, Human
aggcagaagaaucacuugaaccca

SEQ ID NO: 733981 - RNA, 22 nt, Human
aggcagcauuuaagaucuguuu

SEQ ID NO: 733982 - RNA, 20 nt, Human
aggcaugcaccaccacgccc

SEQ ID NO: 733983 - RNA, 24 nt, Human
aggcugaggcagaagaaucacuug

SEQ ID NO: 733984 - RNA, 25 nt, Human
aggcuggagugcaguggcgugaucu

SEQ ID NO: 733985 - RNA, 25 nt, Human
aggcuggagugcaguggugugaucu

SEQ ID NO: 733986 - RNA, 20 nt, Human
aggcuggggugggcagaucg

SEQ ID NO: 733987 - RNA, 20 nt, Human
aggcugggugugguggcuca

SEQ ID NO: 733988 - RNA, 21 nt, Human
agggagcuacuaugcucaaac

SEQ ID NO: 733989 - RNA, 21 nt, Human
aguacuuaccccuccuuucuu

SEQ ID NO: 733990 - RNA, 22 nt, Human
aguagagacgggguuucaccau

SEQ ID NO: 733991 - RNA, 18 nt, Human
aguagcugggacuauagg

SEQ ID NO: 733992 - RNA, 24 nt, Human
agugcaauggcaugaucucggcuc

SEQ ID NO: 733993 - RNA, 19 nt, Human
agugcaguggcgugaucuc

SEQ ID NO: 733994 - RNA, 20 nt, Human
agugcaguggcgugaucucg

SEQ ID NO: 733995 - RNA, 23 nt, Human
agugcaguggcgugaucucggcu

SEQ ID NO: 733996 - RNA, 24 nt, Human
agugcaguggcgugaucucggcuc

SEQ ID NO: 733997 - RNA, 23 nt, Human
agugcaguggugugaucuuggcu

SEQ ID NO: 733998 - RNA, 24 nt, Human
agugcaguggugugaucuuggcuc

SEQ ID NO: 733999 - RNA, 18 nt, Human
aguggguuacuugaucca

SEQ ID NO: 734000 - RNA, 20 nt, Human
agugugguggcacaagccug

SEQ ID NO: 734001 - RNA, 20 nt, Human
aguuauuggggauuaggcag

SEQ ID NO: 734002 - RNA, 25 nt, Human
auaaaacaaaagcaaaguauacaca

SEQ ID NO: 734003 - RNA, 24 nt, Human
auaaaugucaaauucuccccaugg

SEQ ID NO: 734004 - RNA, 19 nt, Human
auccagaaaauccaaaagc

SEQ ID NO: 734005 - RNA, 24 nt, Human
aucguuugaggucaggaguucaag

SEQ ID NO: 734006 - RNA, 21 nt, Human
augcagccucugucuccuggg

SEQ ID NO: 734007 - RNA, 18 nt, Human
augccauuguacuccaga

SEQ ID NO: 734008 - RNA, 20 nt, Human
auggggagaccccgucucua

SEQ ID NO: 734009 - RNA, 18 nt, Human
caaaagaaaagacucaaa

SEQ ID NO: 734010 - RNA, 23 nt, Human
caaaagcaaaguauacacacucu

SEQ ID NO: 734011 - RNA, 24 nt, Human
caaaagcaaaguauacacacucua

SEQ ID NO: 734012 - RNA, 22 nt, Human
caaacuaagccgugggguaaac

SEQ ID NO: 734013 - RNA, 21 nt, Human
caaagcaagcccaaagggggc

SEQ ID NO: 734014 - RNA, 23 nt, Human
caaauauccauauguggacuuug

SEQ ID NO: 734015 - RNA, 20 nt, Human
caaccugagauaccuggcug

SEQ ID NO: 734016 - RNA, 22 nt, Human
caagcaaagacacaagaaugca

SEQ ID NO: 734017 - RNA, 22 nt, Human
caagcacacuucaugaggaacc

SEQ ID NO: 734018 - RNA, 22 nt, Human
caagcgauucuccugccucagc

SEQ ID NO: 734019 - RNA, 23 nt, Human
caaguagagaguacuuaccccuc

SEQ ID NO: 734020 - RNA, 22 nt, Human
caagugauucuccugccucagc

SEQ ID NO: 734021 - RNA, 19 nt, Human
cacacacagaacuaccaga

SEQ ID NO: 734022 - RNA, 21 nt, Human
cacacagaacuaccagaggag

SEQ ID NO: 734023 - RNA, 24 nt, Human
cacacuuguaaucccagcacuuug

SEQ ID NO: 734024 - RNA, 22 nt, Human
caccaccacgcccggcuaauuu

SEQ ID NO: 734025 - RNA, 19 nt, Human
caccaugaccucugccucc

SEQ ID NO: 734026 - RNA, 21 nt, Human
caccaugaccucugccucccg

SEQ ID NO: 734027 - RNA, 23 nt, Human
caccaugaccucugccucccggg

SEQ ID NO: 734028 - RNA, 19 nt, Human
caccaugccuggccucuuu

SEQ ID NO: 734029 - RNA, 23 nt, Human
caccauguuaccaggcuggucuc

SEQ ID NO: 734030 - RNA, 26 nt, Human
caccauguuaccaggcuggucucgaa

SEQ ID NO: 734031 - RNA, 22 nt, Human
caccauguuggccaggcugcuc

SEQ ID NO: 734032 - RNA, 23 nt, Human
caccauguuggccaggcugcucu

SEQ ID NO: 734033 - RNA, 24 nt, Human
caccauguuggccaggcugcucuu

SEQ ID NO: 734034 - RNA, 31 nt, Human
caccauguuggccaggcugcucuugaacucc

SEQ ID NO: 734035 - RNA, 24 nt, Human
cacucugucgcccaggcuggagug

SEQ ID NO: 734036 - RNA, 21 nt, Human
cacugcaaccuccgccuccca

SEQ ID NO: 734037 - RNA, 20 nt, Human
cacugcagugucccgcuugc

SEQ ID NO: 734038 - RNA, 23 nt, Human
cacuuguaaucccagcacuuugg

SEQ ID NO: 734039 - RNA, 24 nt, Human
cacuuguaaucccagcacuuuggg

SEQ ID NO: 734040 - RNA, 22 nt, Human
cagaacaccacauuccucagcu

SEQ ID NO: 734041 - RNA, 22 nt, Human
cagagcccaaagacacugaguc

SEQ ID NO: 734042 - RNA, 19 nt, Human
cagagcccaggauagccaa

SEQ ID NO: 734043 - RNA, 24 nt, Human
cagaucguuugaggucaggaguuc

SEQ ID NO: 734044 - RNA, 24 nt, Human
cagcacuuugggaggcuggggugg

SEQ ID NO: 734045 - RNA, 18 nt, Human
cagcaggaaccagacauc

SEQ ID NO: 734046 - RNA, 20 nt, Human
cagccuccugaguagcuggg

SEQ ID NO: 734047 - RNA, 20 nt, Human
cagccuccugaguaucuugg

SEQ ID NO: 734048 - RNA, 24 nt, Human
cagccuggccaauauggggagacc

SEQ ID NO: 734049 - RNA, 24 nt, Human
cagcuacucaggaggcugaggcag

SEQ ID NO: 734050 - RNA, 18 nt, Human
cagcucaagcaaagacac

SEQ ID NO: 734051 - RNA, 22 nt, Human
caguaacucuaaauccaauaac

SEQ ID NO: 734052 - RNA, 22 nt, Human
cagucccucccuuccacccucc

SEQ ID NO: 734053 - RNA, 18 nt, Human
caugccaucaucucucca

SEQ ID NO: 734054 - RNA, 23 nt, Human
cauguuaccaggcuggucucgaa

SEQ ID NO: 734055 - RNA, 24 nt, Human
cauguuggccaggcugcucuugaa

SEQ ID NO: 734056 - RNA, 20 nt, Human
cauuauaaucacauauaaca

SEQ ID NO: 734057 - RNA, 23 nt, Human
cauuguacuccagaaugggugac

SEQ ID NO: 734058 - RNA, 22 nt, Human
ccaaaacaaggcuaaagccugc

SEQ ID NO: 734059 - RNA, 20 nt, Human
ccaaaagaccacccacccgc

SEQ ID NO: 734060 - RNA, 22 nt, Human
ccaaagugcugagauuacaggc

SEQ ID NO: 734061 - RNA, 22 nt, Human
ccaaagugcugagauuacaggc

SEQ ID NO: 734062 - RNA, 24 nt, Human
ccaaagugcugagauuacaggcgu

SEQ ID NO: 734063 - RNA, 19 nt, Human
ccacccacccgccucccac

SEQ ID NO: 734064 - RNA, 24 nt, Human
ccagaaaauccaaaagcuuuggaa

SEQ ID NO: 734065 - RNA, 23 nt, Human
ccauuguacuccagaauggguga

SEQ ID NO: 734066 - RNA, 24 nt, Human
ccauuguacuccagaaugggugac

SEQ ID NO: 734067 - RNA, 18 nt, Human
ccauuucuccugacugcc

SEQ ID NO: 734068 - RNA, 24 nt, Human
cccaaagugcuacuguaaucacca

SEQ ID NO: 734069 - RNA, 20 nt, Human
cccaaguagcugggauuacu

SEQ ID NO: 734070 - RNA, 23 nt, Human
cccacccaaaugagccaugccag

SEQ ID NO: 734071 - RNA, 22 nt, Human
cccaggcuggagugcaguggcg

SEQ ID NO: 734072 - RNA, 23 nt, Human
cccagguucaagcgauucuccug

SEQ ID NO: 734073 - RNA, 21 nt, Human
ccccauggccaaaaggugagg

SEQ ID NO: 734074 - RNA, 23 nt, Human
cccggguucaagugauucuccuc

SEQ ID NO: 734075 - RNA, 23 nt, Human
cccggguucaagugauucuccug

SEQ ID NO: 734076 - RNA, 23 nt, Human
cccuagaaaaucccagcagcaga

SEQ ID NO: 734077 - RNA, 25 nt, Human
cccuccaaaagaccacccacccgcc

SEQ ID NO: 734078 - RNA, 24 nt, Human
ccgccucagccucccaaagugcug

SEQ ID NO: 734079 - RNA, 18 nt, Human
ccuaguguccucccaagu

SEQ ID NO: 734080 - RNA, 18 nt, Human
ccuccaaaagaccaccca

SEQ ID NO: 734081 - RNA, 24 nt, Human
ccucccagguucaagcgauucucc

SEQ ID NO: 734082 - RNA, 21 nt, Human
ccucccggguucaagugauuc

SEQ ID NO: 734083 - RNA, 24 nt, Human
ccucccggguucaagugauucucc

SEQ ID NO: 734084 - RNA, 19 nt, Human
ccucuauaacccaagugcu

SEQ ID NO: 734085 - RNA, 25 nt, Human
ccucuuuucagggccucuuggugau

SEQ ID NO: 734086 - RNA, 19 nt, Human
ccugaguagcugggacuau

SEQ ID NO: 734087 - RNA, 22 nt, Human
ccugaguagcugggacuauagg

SEQ ID NO: 734088 - RNA, 23 nt, Human
ccugaguaucuuggauuacaggc

SEQ ID NO: 734089 - RNA, 24 nt, Human
ccugaguaucuuggauuacaggca

SEQ ID NO: 734090 - RNA, 23 nt, Human
ccugcagagcccaaagacacuga

SEQ ID NO: 734091 - RNA, 23 nt, Human
ccuggccaauauggggagacccc

SEQ ID NO: 734092 - RNA, 24 nt, Human
ccuggccaauauggggagaccccg

SEQ ID NO: 734093 - RNA, 21 nt, Human
ccuguagucccagcuacucag

SEQ ID NO: 734094 - RNA, 24 nt, Human
cgcucuguugcccaggcuggagug

SEQ ID NO: 734095 - RNA, 23 nt, Human
cgggguuucaccauguuaccagg

SEQ ID NO: 734096 - RNA, 23 nt, Human
cguuugaggucaggaguucaaga

SEQ ID NO: 734097 - RNA, 18 nt, Human
cuaaagccugcagagccc

SEQ ID NO: 734098 - RNA, 23 nt, Human
cuaccucagccuccugaguagcu

SEQ ID NO: 734099 - RNA, 22 nt, Human
cucacacuuguaaucccagcac

SEQ ID NO: 734100 - RNA, 24 nt, Human
cucacacuuguaaucccagcacuu

SEQ ID NO: 734101 - RNA, 24 nt, Human
cucaccaugaccucugccucccgg

SEQ ID NO: 734102 - RNA, 24 nt, Human
cucacucugucgcccaggcuggag

SEQ ID NO: 734103 - RNA, 24 nt, Human
cucacugcaaccuccgccucccag

SEQ ID NO: 734104 - RNA, 20 nt, Human
cucacugggacuucugacca

SEQ ID NO: 734105 - RNA, 24 nt, Human
cucagccucccaaguagcugggau

SEQ ID NO: 734106 - RNA, 24 nt, Human
cucagccuccugaguagcugggac

SEQ ID NO: 734107 - RNA, 21 nt, Human
cucccaaagugcugagauuac

SEQ ID NO: 734108 - RNA, 18 nt, Human
cucccuuccacccucccc

SEQ ID NO: 734109 - RNA, 18 nt, Human
cucccuuccacccucccc

SEQ ID NO: 734110 - RNA, 21 nt, Human
cuccuggguucaagcaauucu

SEQ ID NO: 734111 - RNA, 21 nt, Human
cucgcucuguugcccaggcug

SEQ ID NO: 734112 - RNA, 24 nt, Human
cucgcucuguugcccaggcuggag

SEQ ID NO: 734113 - RNA, 25 nt, Human
cucucaguucucacccaaauacuuc

SEQ ID NO: 734114 - RNA, 24 nt, Human
cucuggaccuugugauccgcccgc

SEQ ID NO: 734115 - RNA, 19 nt, Human
cucuugaacucuggaccuu

SEQ ID NO: 734116 - RNA, 23 nt, Human
cugaccucagguuuuaaaaagug

SEQ ID NO: 734117 - RNA, 24 nt, Human
cugaguaucuuggauuacaggcau

SEQ ID NO: 734118 - RNA, 23 nt, Human
cugcaaccuccgccucccagguu

SEQ ID NO: 734119 - RNA, 24 nt, Human
cugcaaccuccgccucccagguuc

SEQ ID NO: 734120 - RNA, 24 nt, Human
cugcccaggcuggagugcaguggu

SEQ ID NO: 734121 - RNA, 23 nt, Human
cugccucagccucccaaguagcu

SEQ ID NO: 734122 - RNA, 23 nt, Human
cugccucagccuccugaguaucu

SEQ ID NO: 734123 - RNA, 23 nt, Human
cugcugaauaugcucagucauuc

SEQ ID NO: 734124 - RNA, 24 nt, Human
cuggagugcaauggcaugaucucg

SEQ ID NO: 734125 - RNA, 18 nt, Human
cuguccccuugaaguuga

SEQ ID NO: 734126 - RNA, 19 nt, Human
cugucgcccaggcuggagu

SEQ ID NO: 734127 - RNA, 21 nt, Human
gacagagugagacuccgucuc

SEQ ID NO: 734128 - RNA, 21 nt, Human
gaccacaguuauuggggauua

SEQ ID NO: 734129 - RNA, 24 nt, Human
gaccuugugauccgcccgccucag

SEQ ID NO: 734130 - RNA, 22 nt, Human
gacuauaggugcccgccaccau

SEQ ID NO: 734131 - RNA, 20 nt, Human
gagacgggguuucaccaugu

SEQ ID NO: 734132 - RNA, 24 nt, Human
gagacgggguuucaccauguuggc

SEQ ID NO: 734133 - RNA, 19 nt, Human
gagauaaagacuaaaagga

SEQ ID NO: 734134 - RNA, 25 nt, Human
gagggggaaggaaauaacuagagag

SEQ ID NO: 734135 - RNA, 22 nt, Human
gagguugcagugagcugagauc

SEQ ID NO: 734136 - RNA, 22 nt, Human
gaguaucuuggauuacaggcau

SEQ ID NO: 734137 - RNA, 23 nt, Human
gaucguuugaggucaggaguuca

SEQ ID NO: 734138 - RNA, 24 nt, Human
gaucguuugaggucaggaguucaa

SEQ ID NO: 734139 - RNA, 18 nt, Human
gauuacaggcgugagcca

SEQ ID NO: 734140 - RNA, 24 nt, Human
gauuacaggcgugagccaccaugc

SEQ ID NO: 734141 - RNA, 21 nt, Human
gauucuccugccucagccucc

SEQ ID NO: 734142 - RNA, 22 nt, Human
gcaaccuccgccucccagguuc

SEQ ID NO: 734143 - RNA, 20 nt, Human
gcaccaccacgcccggcuaa

SEQ ID NO: 734144 - RNA, 22 nt, Human
gcagaagaaucacuugaaccca

SEQ ID NO: 734145 - RNA, 18 nt, Human
gcagacagcaggaaccag

SEQ ID NO: 734146 - RNA, 24 nt, Human
gccaauauggggagaccccgucuc

SEQ ID NO: 734147 - RNA, 24 nt, Human
gccauuguacuccagaauggguga

SEQ ID NO: 734148 - RNA, 19 nt, Human
gcccaggauagccaaagag

SEQ ID NO: 734149 - RNA, 23 nt, Human
gcccaggcuggagugcaauggca

SEQ ID NO: 734150 - RNA, 24 nt, Human
gcccaggcuggagugcaauggcau

SEQ ID NO: 734151 - RNA, 24 nt, Human
gcccaggcuggagugcaguggcgu

SEQ ID NO: 734152 - RNA, 24 nt, Human
gcccaggcuggagugcaguggugu

SEQ ID NO: 734153 - RNA, 25 nt, Human
gccccaggcuccaccauuucuccug

SEQ ID NO: 734154 - RNA, 23 nt, Human
gccucagccucccaaagugcuga

SEQ ID NO: 734155 - RNA, 23 nt, Human
gcgauucuccugccucagccucc

SEQ ID NO: 734156 - RNA, 18 nt, Human
gcuaaagccugcagagcc

SEQ ID NO: 734157 - RNA, 21 nt, Human
gcucaagcaaagacacaagaa

SEQ ID NO: 734158 - RNA, 21 nt, Human
gcucaaugcagccucugucuc

SEQ ID NO: 734159 - RNA, 22 nt, Human
gcugaacacaggggccagacca

SEQ ID NO: 734160 - RNA, 19 nt, Human
gcuggagugcaguggcgug

SEQ ID NO: 734161 - RNA, 21 nt, Human
ggaaccagacauccacaaguu

SEQ ID NO: 734162 - RNA, 19 nt, Human
ggagcuacuaugcucaaac

SEQ ID NO: 734163 - RNA, 18 nt, Human
ggagguugcagugagcug

SEQ ID NO: 734164 - RNA, 22 nt, Human
ggagguugcagugagcugagau

SEQ ID NO: 734165 - RNA, 23 nt, Human
ggagguugcagugagcugagauc

SEQ ID NO: 734166 - RNA, 24 nt, Human
ggagguugcagugagcugagauca

SEQ ID NO: 734167 - RNA, 23 nt, Human
ggagucuugcucugcugcccagg

SEQ ID NO: 734168 - RNA, 22 nt, Human
ggauuacaggcaugcaccacca

SEQ ID NO: 734169 - RNA, 25 nt, Human
ggcagaucguuugaggucaggaguu

SEQ ID NO: 734170 - RNA, 20 nt, Human
ggcuaaagccugcagagccc

SEQ ID NO: 734171 - RNA, 22 nt, Human
ggcuggagugcaguggcgugau

SEQ ID NO: 734172 - RNA, 22 nt, Human
ggcuggagugcaguggugugau

SEQ ID NO: 734173 - RNA, 22 nt, Human
ggcuggccuagagacuuucaag

SEQ ID NO: 734174 - RNA, 24 nt, Human
ggcuggucucgaacuccugaccuc

SEQ ID NO: 734175 - RNA, 22 nt, Human
ggggaaucugcuagagaacugg

SEQ ID NO: 734176 - RNA, 22 nt, Human
gggguuucaccauguuaccagg

SEQ ID NO: 734177 - RNA, 23 nt, Human
gggguuucaccauguuggccagg

SEQ ID NO: 734178 - RNA, 24 nt, Human
gggugugguggcucacacuuguaa

SEQ ID NO: 734179 - RNA, 22 nt, Human
ggguucaagugauucuccugcc

SEQ ID NO: 734180 - RNA, 23 nt, Human
ggguucaagugauucuccugccu

SEQ ID NO: 734181 - RNA, 22 nt, Human
ggguuucaccauguuggccagg

SEQ ID NO: 734182 - RNA, 19 nt, Human
ggucucgaacuccugaccu

SEQ ID NO: 734183 - RNA, 24 nt, Human
gguggcucacacuuguaaucccag

SEQ ID NO: 734184 - RNA, 21 nt, Human
ggugggcagaucguuugaggu

SEQ ID NO: 734185 - RNA, 25 nt, Human
ggugggcagaucguuugaggucagg

SEQ ID NO: 734186 - RNA, 22 nt, Human
guaacacaacuacucaucuccu

SEQ ID NO: 734187 - RNA, 24 nt, Human
guacuccagaaugggugacagagu

SEQ ID NO: 734188 - RNA, 23 nt, Human
guagagacgggguuucaccaugu

SEQ ID NO: 734189 - RNA, 20 nt, Human
guaucuuggauuacaggcau

SEQ ID NO: 734190 - RNA, 24 nt, Human
gucaaauucuccccauggccaaaa

SEQ ID NO: 734191 - RNA, 24 nt, Human
gugauccgcccgccucagccuccc

SEQ ID NO: 734192 - RNA, 24 nt, Human
gugauucuccugccucagccuccc

SEQ ID NO: 734193 - RNA, 21 nt, Human
gugugguggcacaagccugua

SEQ ID NO: 734194 - RNA, 24 nt, Human
guugcagugagcugagaucaugcc

SEQ ID NO: 734195 - RNA, 24 nt, Human
guuugaggucaggaguucaagacc

SEQ ID NO: 734196 - RNA, 20 nt, Human
uaaagccugcagagcccaaa

SEQ ID NO: 734197 - RNA, 20 nt, Human
uaaaugacaacauuauaauc

SEQ ID NO: 734198 - RNA, 21 nt, Human
uaaaugacaacauuauaauca

SEQ ID NO: 734199 - RNA, 23 nt, Human
uaagguaugccuggggaaacccc

SEQ ID NO: 734200 - RNA, 23 nt, Human
uaaguuagugcagagaauagagu

SEQ ID NO: 734201 - RNA, 24 nt, Human
uaauagagacgggguuucaccaug

SEQ ID NO: 734202 - RNA, 24 nt, Human
uaauuuuuucuauuuuuaauagag

SEQ ID NO: 734203 - RNA, 24 nt, Human
uaauuuuuuguaucuuuaguagag

SEQ ID NO: 734204 - RNA, 20 nt, Human
uacacaacagacuuacaaug

SEQ ID NO: 734205 - RNA, 22 nt, Human
uacacacaaauauaugcauaca

SEQ ID NO: 734206 - RNA, 23 nt, Human
uacacacaaauauaugcauacac

SEQ ID NO: 734207 - RNA, 20 nt, Human
uacacacucuauacacacgu

SEQ ID NO: 734208 - RNA, 23 nt, Human
uacaggcaugcaccaccacgccc

SEQ ID NO: 734209 - RNA, 22 nt, Human
uacaggcgugagccaccaugcc

SEQ ID NO: 734210 - RNA, 22 nt, Human
uacaggcgugagccaccaugcc

SEQ ID NO: 734211 - RNA, 23 nt, Human
uacaggcgugagccaccaugccu

SEQ ID NO: 734212 - RNA, 19 nt, Human
uacauggaauuucugaaag

SEQ ID NO: 734213 - RNA, 21 nt, Human
uaccagaggaggguuuuucuc

SEQ ID NO: 734214 - RNA, 24 nt, Human
uaccucagccuccugaguagcugg

SEQ ID NO: 734215 - RNA, 22 nt, Human
uacuccagaaugggugacagag

SEQ ID NO: 734216 - RNA, 24 nt, Human
uacuccagaaugggugacagagug

SEQ ID NO: 734217 - RNA, 23 nt, Human
uacugaaaauacaaaaauuagcu

SEQ ID NO: 734218 - RNA, 23 nt, Human
uacuguaaucaccaauuccccug

SEQ ID NO: 734219 - RNA, 21 nt, Human
uagagacgggguuucaccaug

SEQ ID NO: 734220 - RNA, 22 nt, Human
uagagacgggguuucaccaugu

SEQ ID NO: 734221 - RNA, 22 nt, Human
uagagacgggguuucaccaugu

SEQ ID NO: 734222 - RNA, 24 nt, Human
uagagucucgcucuguugcccagg

SEQ ID NO: 734223 - RNA, 22 nt, Human
uagcaguaacucuaaauccaau

SEQ ID NO: 734224 - RNA, 18 nt, Human
uagccaaagaguuaaaag

SEQ ID NO: 734225 - RNA, 22 nt, Human
uagcucccucacugggacuucu

SEQ ID NO: 734226 - RNA, 22 nt, Human
uagcugagugugguggcacaag

SEQ ID NO: 734227 - RNA, 19 nt, Human
uagcugggauuacuggugc

SEQ ID NO: 734228 - RNA, 19 nt, Human
uaggugcccgccaccaugc

SEQ ID NO: 734229 - RNA, 24 nt, Human
uaguagagacgggguuucaccaug

SEQ ID NO: 734230 - RNA, 26 nt, Human
uauauacauauacacacaaauauaug

SEQ ID NO: 734231 - RNA, 21 nt, Human
uauugccacugcagugucccg

SEQ ID NO: 734232 - RNA, 21 nt, Human
ucaaaagugacucucuuuggu

SEQ ID NO: 734233 - RNA, 25 nt, Human
ucaaagguaaaagaacagauucugu

SEQ ID NO: 734234 - RNA, 19 nt, Human
ucaagugauucuccugccu

SEQ ID NO: 734235 - RNA, 24 nt, Human
ucaaugcagccucugucuccuggg

SEQ ID NO: 734236 - RNA, 19 nt, Human
ucacauauaacaaugagau

SEQ ID NO: 734237 - RNA, 23 nt, Human
ucaccaugaccucugccucccgg

SEQ ID NO: 734238 - RNA, 24 nt, Human
ucaccaugaccucugccucccggg

SEQ ID NO: 734239 - RNA, 19 nt, Human
ucacugcaaccuccgccuc

SEQ ID NO: 734240 - RNA, 24 nt, Human
ucacugcaaccuccgccucccagg

SEQ ID NO: 734241 - RNA, 25 nt, Human
ucacugcaaccuccgccucccaggu

SEQ ID NO: 734242 - RNA, 27 nt, Human
ucacugcaaccuccgccucccagguuc

SEQ ID NO: 734243 - RNA, 18 nt, Human
ucagccucccaaguagcu

SEQ ID NO: 734244 - RNA, 20 nt, Human
ucagccucccaaguagcugg

SEQ ID NO: 734245 - RNA, 23 nt, Human
ucagccuccugaguagcugggac

SEQ ID NO: 734246 - RNA, 22 nt, Human
ucaugccauuguacuccagaau

SEQ ID NO: 734247 - RNA, 24 nt, Human
uccagaaugggugacagagugaga

SEQ ID NO: 734248 - RNA, 23 nt, Human
uccaugaggaagaacacuuugug

SEQ ID NO: 734249 - RNA, 18 nt, Human
ucccaaagugcuacugua

SEQ ID NO: 734250 - RNA, 24 nt, Human
ucccaaagugcugagauuacaggc

SEQ ID NO: 734251 - RNA, 23 nt, Human
ucccaaguagcugggauuacugg

SEQ ID NO: 734252 - RNA, 22 nt, Human
ucccacucugacacaauaugga

SEQ ID NO: 734253 - RNA, 21 nt, Human
ucccagguucaagcgauucuc

SEQ ID NO: 734254 - RNA, 24 nt, Human
ucccagguucaagcgauucuccug

SEQ ID NO: 734255 - RNA, 20 nt, Human
uccccuuccucugccuagaa

SEQ ID NO: 734256 - RNA, 21 nt, Human
ucccggguucaagugauucuc

SEQ ID NO: 734257 - RNA, 24 nt, Human
ucccggguucaagugauucuccug

SEQ ID NO: 734258 - RNA, 20 nt, Human
ucccuugggaguguguccua

SEQ ID NO: 734259 - RNA, 21 nt, Human
uccgcccgccucagccuccca

SEQ ID NO: 734260 - RNA, 22 nt, Human
uccuccagccacaaucucaccu

SEQ ID NO: 734261 - RNA, 24 nt, Human
uccugaguagcugggacuauaggu

SEQ ID NO: 734262 - RNA, 24 nt, Human
uccugaguaucuuggauuacaggc

SEQ ID NO: 734263 - RNA, 21 nt, Human
uccuggguucaagcaauucuc

SEQ ID NO: 734264 - RNA, 23 nt, Human
uccuggguucaagcaauucuccu

SEQ ID NO: 734265 - RNA, 18 nt, Human
ucgcccaggcuggagugc

SEQ ID NO: 734266 - RNA, 24 nt, Human
ucgcucuguugcccaggcuggagu

SEQ ID NO: 734267 - RNA, 23 nt, Human
ucucacucugucgcccaggcugg

SEQ ID NO: 734268 - RNA, 24 nt, Human
ucucacucugucgcccaggcugga

SEQ ID NO: 734269 - RNA, 26 nt, Human
ucucacucugucgcccaggcuggagu

SEQ ID NO: 734270 - RNA, 24 nt, Human
ucuccuggguucaagcaauucucc

SEQ ID NO: 734271 - RNA, 19 nt, Human
ucucgaacuccugaccuca

SEQ ID NO: 734272 - RNA, 19 nt, Human
ucucgcucuguugcccagg

SEQ ID NO: 734273 - RNA, 23 nt, Human
ucucgcucuguugcccaggcugg

SEQ ID NO: 734274 - RNA, 24 nt, Human
ucucgcucuguugcccaggcugga

SEQ ID NO: 734275 - RNA, 26 nt, Human
ucucgcucuguugcccaggcuggagu

SEQ ID NO: 734276 - RNA, 27 nt, Human
ucucgcucuguugcccaggcuggagug

SEQ ID NO: 734277 - RNA, 21 nt, Human
ucucuacugaaaauacaaaaa

SEQ ID NO: 734278 - RNA, 19 nt, Human
ucucuccaaagcaagccca

SEQ ID NO: 734279 - RNA, 24 nt, Human
ucugcugcccaggcuggagugcag

SEQ ID NO: 734280 - RNA, 24 nt, Human
ucugucgcccaggcuggagugcaa

SEQ ID NO: 734281 - RNA, 24 nt, Human
ucugucuccuggguucaagcaauu

SEQ ID NO: 734282 - RNA, 23 nt, Human
ucuugcucugcugcccaggcugg

SEQ ID NO: 734283 - RNA, 24 nt, Human
ucuugcucugcugcccaggcugga

SEQ ID NO: 734284 - RNA, 24 nt, Human
ucuuuaguagagacgggguuucac

SEQ ID NO: 734285 - RNA, 18 nt, Human
ugaaaaccuaguguccuc

SEQ ID NO: 734286 - RNA, 22 nt, Human
ugaaacaaaaugagagaccaga

SEQ ID NO: 734287 - RNA, 18 nt, Human
ugagauaaagacuaaaag

SEQ ID NO: 734288 - RNA, 23 nt, Human
ugagauaauuacuggugauguga

SEQ ID NO: 734289 - RNA, 18 nt, Human
ugagauuacaggcgugag

SEQ ID NO: 734290 - RNA, 22 nt, Human
ugagauuacaggcgugagccac

SEQ ID NO: 734291 - RNA, 23 nt, Human
ugagauuacaggcgugagccacc

SEQ ID NO: 734292 - RNA, 24 nt, Human
ugagauuacaggcgugagccacca

SEQ ID NO: 734293 - RNA, 25 nt, Human
ugagauuacaggcgugagccaccau

SEQ ID NO: 734294 - RNA, 21 nt, Human
ugagcccucuauaacccaagu

SEQ ID NO: 734295 - RNA, 20 nt, Human
ugaggcagaagaaucacuug

SEQ ID NO: 734296 - RNA, 24 nt, Human
ugaggcagaagaaucacuugaacc

SEQ ID NO: 734297 - RNA, 25 nt, Human
ugaggcagaagaaucacuugaaccc

SEQ ID NO: 734298 - RNA, 24 nt, Human
ugagggggaaggaaauaacuagag

SEQ ID NO: 734299 - RNA, 20 nt, Human
ugaguauuuaaauaacaucc

SEQ ID NO: 734300 - RNA, 22 nt, Human
ugauccagaaaauccaaaagcu

SEQ ID NO: 734301 - RNA, 20 nt, Human
ugauucuccugccucagccu

SEQ ID NO: 734302 - RNA, 19 nt, Human
ugcaaguaaaaagguuauu

SEQ ID NO: 734303 - RNA, 18 nt, Human
ugcagagcccaaagacac

SEQ ID NO: 734304 - RNA, 22 nt, Human
ugcaguggcgugaucucggcuc

SEQ ID NO: 734305 - RNA, 22 nt, Human
ugcaguggugugaucuuggcuc

SEQ ID NO: 734306 - RNA, 19 nt, Human
ugcaucugagaugcaccaa

SEQ ID NO: 734307 - RNA, 21 nt, Human
ugcauuugagagcugacaggu

SEQ ID NO: 734308 - RNA, 19 nt, Human
ugccaaagaacaaagccaa

SEQ ID NO: 734309 - RNA, 18 nt, Human
ugcccaggcuggagugca

SEQ ID NO: 734310 - RNA, 18 nt, Human
ugcccaggcuggagugca

SEQ ID NO: 734311 - RNA, 21 nt, Human
ugcccaggcuggagugcagug

SEQ ID NO: 734312 - RNA, 21 nt, Human
ugcccaggcuggagugcagug

SEQ ID NO: 734313 - RNA, 22 nt, Human
ugcccaggcuggagugcagugg

SEQ ID NO: 734314 - RNA, 24 nt, Human
ugcccaggcuggagugcaguggug

SEQ ID NO: 734315 - RNA, 24 nt, Human
ugccucagccucccaaguagcugg

SEQ ID NO: 734316 - RNA, 25 nt, Human
ugccucagccuccugaguaucuugg

SEQ ID NO: 734317 - RNA, 22 nt, Human
ugccucccggguucaagugauu

SEQ ID NO: 734318 - RNA, 23 nt, Human
ugccuccuuuucauuugugaagc

SEQ ID NO: 734319 - RNA, 19 nt, Human
ugcgacucaucuuuguuuu

SEQ ID NO: 734320 - RNA, 24 nt, Human
ugcucugcugcccaggcuggagug

SEQ ID NO: 734321 - RNA, 24 nt, Human
ugcugagauuacaggcgugagcca

SEQ ID NO: 734322 - RNA, 19 nt, Human
uggaauaccaagcaugcca

SEQ ID NO: 734323 - RNA, 22 nt, Human
uggaauaccaagcaugccauca

SEQ ID NO: 734324 - RNA, 24 nt, Human
uggagucuugcucugcugcccagg

SEQ ID NO: 734325 - RNA, 19 nt, Human
uggagugcaauggcaugau

SEQ ID NO: 734326 - RNA, 24 nt, Human
uggagugcaauggcaugaucucgg

SEQ ID NO: 734327 - RNA, 19 nt, Human
uggagugcaguggcgugau

SEQ ID NO: 734328 - RNA, 23 nt, Human
uggagugcaguggcgugaucucg

SEQ ID NO: 734329 - RNA, 24 nt, Human
uggagugcaguggcgugaucucgg

SEQ ID NO: 734330 - RNA, 19 nt, Human
uggagugcaguggugugau

SEQ ID NO: 734331 - RNA, 23 nt, Human
uggagugcaguggugugaucuug

SEQ ID NO: 734332 - RNA, 24 nt, Human
uggagugcaguggugugaucuugg

SEQ ID NO: 734333 - RNA, 23 nt, Human
uggauuacaggcaugcaccacca

SEQ ID NO: 734334 - RNA, 21 nt, Human
uggccaggcugcucuugaacu

SEQ ID NO: 734335 - RNA, 22 nt, Human
uggccaggucaucauuuucaug

SEQ ID NO: 734336 - RNA, 20 nt, Human
uggcgugaucucggcucacc

SEQ ID NO: 734337 - RNA, 24 nt, Human
uggcgugaucucggcucaccauga

SEQ ID NO: 734338 - RNA, 29 nt, Human
uggcucaaugcagccucugucuccugggg

SEQ ID NO: 734339 - RNA, 21 nt, Human
uggcucacacuuguaauccca

SEQ ID NO: 734340 - RNA, 22 nt, Human
uggcucacacuuguaaucccag

SEQ ID NO: 734341 - RNA, 24 nt, Human
uggcucacacuuguaaucccagca

SEQ ID NO: 734342 - RNA, 26 nt, Human
uggcugcagacagcaggaaccagaca

SEQ ID NO: 734343 - RNA, 18 nt, Human
ugggaacacauacaacca

SEQ ID NO: 734344 - RNA, 23 nt, Human
ugggaacacauacaaccaaagcu

SEQ ID NO: 734345 - RNA, 21 nt, Human
ugggacuauaggugcccgcca

SEQ ID NO: 734346 - RNA, 22 nt, Human
ugggacuauaggugcccgccac

SEQ ID NO: 734347 - RNA, 24 nt, Human
ugggacuauaggugcccgccacca

SEQ ID NO: 734348 - RNA, 25 nt, Human
ugggacuauaggugcccgccaccau

SEQ ID NO: 734349 - RNA, 20 nt, Human
ugggaggcuggggugggcag

SEQ ID NO: 734350 - RNA, 23 nt, Human
ugggaggcuggggugggcagauc

SEQ ID NO: 734351 - RNA, 24 nt, Human
ugggaggcuggggugggcagaucg

SEQ ID NO: 734352 - RNA, 21 nt, Human
ugggauuacuggugcgugcca

SEQ ID NO: 734353 - RNA, 24 nt, Human
ugggcagaucguuugaggucagga

SEQ ID NO: 734354 - RNA, 24 nt, Human
uggggugggcagaucguuugaggu

SEQ ID NO: 734355 - RNA, 26 nt, Human
uggggugggcagaucguuugagguca

SEQ ID NO: 734356 - RNA, 20 nt, Human
ugggugacagagugagacuc

SEQ ID NO: 734357 - RNA, 21 nt, Human
uggguucaagcaauucuccua

SEQ ID NO: 734358 - RNA, 23 nt, Human
uggguucaagcaauucuccuacc

SEQ ID NO: 734359 - RNA, 24 nt, Human
ugguggcacaagccuguaguccca

SEQ ID NO: 734360 - RNA, 24 nt, Human
ugguggcucacacuuguaauccca

SEQ ID NO: 734361 - RNA, 23 nt, Human
uguaacacaacuacucaucuccu

SEQ ID NO: 734362 - RNA, 20 nt, Human
ugucgcccaggcuggagugc

SEQ ID NO: 734363 - RNA, 24 nt, Human
ugugauccgcccgccucagccucc

SEQ ID NO: 734364 - RNA, 23 nt, Human
ugugcgacucaucuuuguuuuuu

SEQ ID NO: 734365 - RNA, 24 nt, Human
uguguguaugucuauauagauaga

SEQ ID NO: 734366 - RNA, 21 nt, Human
uguugcccaggcuggagugca

SEQ ID NO: 734367 - RNA, 24 nt, Human
uguuuuuuguuuuuuuuuuuguuu

SEQ ID NO: 734368 - RNA, 24 nt, Human
uuaauagagacgggguuucaccau

SEQ ID NO: 734369 - RNA, 23 nt, Human
uuaaucccacucugacacaauau

SEQ ID NO: 734370 - RNA, 24 nt, Human
uuacaaacucucgggcugaacaca

SEQ ID NO: 734371 - RNA, 24 nt, Human
uuagcugacaauguuauaaaacaa

SEQ ID NO: 734372 - RNA, 18 nt, Human
uuagcugagugugguggc

SEQ ID NO: 734373 - RNA, 24 nt, Human
uuaggcugggugugguggcucaca

SEQ ID NO: 734374 - RNA, 18 nt, Human
uuaguagagacgggguuu

SEQ ID NO: 734375 - RNA, 22 nt, Human
uuaguagagacgggguuucacc

SEQ ID NO: 734376 - RNA, 24 nt, Human
uuaguagagacgggguuucaccau

SEQ ID NO: 734377 - RNA, 18 nt, Human
uuaguguuaaaaauuagg

SEQ ID NO: 734378 - RNA, 26 nt, Human
uuauuguuuuuguccccauguuuuca

SEQ ID NO: 734379 - RNA, 24 nt, Human
uucaagcaauucuccuaccucagc

SEQ ID NO: 734380 - RNA, 21 nt, Human
uucaagcgauucuccugccuc

SEQ ID NO: 734381 - RNA, 23 nt, Human
uucaagcgauucuccugccucag

SEQ ID NO: 734382 - RNA, 24 nt, Human
uucaagcgauucuccugccucagc

SEQ ID NO: 734383 - RNA, 21 nt, Human
uucaagugauucuccugccuc

SEQ ID NO: 734384 - RNA, 23 nt, Human
uucaagugauucuccugccucag

SEQ ID NO: 734385 - RNA, 24 nt, Human
uucaagugauucuccugccucagc

SEQ ID NO: 734386 - RNA, 26 nt, Human
uucacuguccaggagucaucccugcc

SEQ ID NO: 734387 - RNA, 18 nt, Human
uucagugcaguugucacu

SEQ ID NO: 734388 - RNA, 19 nt, Human
uuccagcaaguagagagua

SEQ ID NO: 734389 - RNA, 21 nt, Human
uuccaggaaagcaacuacucu

SEQ ID NO: 734390 - RNA, 23 nt, Human
uuccaggguuguuaaucccacuc

SEQ ID NO: 734391 - RNA, 27 nt, Human
uucccaaagugcuacuguaaucaccaa

SEQ ID NO: 734392 - RNA, 19 nt, Human
uucucuuucgucugcugcu

SEQ ID NO: 734393 - RNA, 24 nt, Human
uucucuuucgucugcugcuuuuuu

SEQ ID NO: 734394 - RNA, 19 nt, Human
uugaacccagaaggaggag

SEQ ID NO: 734395 - RNA, 18 nt, Human
uugcagugagcugagauc

SEQ ID NO: 734396 - RNA, 20 nt, Human
uugcagugagcugagaucau

SEQ ID NO: 734397 - RNA, 21 nt, Human
uugcagugagcugagaucaug

SEQ ID NO: 734398 - RNA, 24 nt, Human
uugcccaggcuggagugcaguggc

SEQ ID NO: 734399 - RNA, 24 nt, Human
uugcucugcugcccaggcuggagu

SEQ ID NO: 734400 - RNA, 19 nt, Human
uuuacacaucugagacacu

SEQ ID NO: 734401 - RNA, 21 nt, Human
uuucaccauguuggccaggcu

SEQ ID NO: 734402 - RNA, 19 nt, Human
uuucuagcucccucacugg

SEQ ID NO: 734403 - RNA, 23 nt, Human
uuugaggucaggaguucaagacc

SEQ ID NO: 734404 - RNA, 20 nt, Human
uuuugcaccuuuucucaaaa

SEQ ID NO: 734405 - RNA, 24 nt, Human
uuuuuaauagagacgggguuucac

SEQ ID NO: 734406 - RNA, 21 nt, Human
uuuuuguaucuuuaguagaga

SEQ ID NO: 734407 - RNA, 24 nt, Human
uuuuuuguaucuuuaguagagacg

SEQ ID NO: 734408 - RNA, 25 nt, Human
aaaaaaaaaagaaaaaagcaaaaaa

SEQ ID NO: 734409 - RNA, 23 nt, Human
aaaaaaagaaaaaagcaaaaaag

SEQ ID NO: 734410 - RNA, 24 nt, Human
aaaaaaagacaaagagauugcaaa

SEQ ID NO: 734411 - RNA, 22 nt, Human
aaaacacaugcuccagagccaa

SEQ ID NO: 734412 - RNA, 23 nt, Human
aaaugcugggaugacaggcauga

SEQ ID NO: 734413 - RNA, 20 nt, Human
aacaagacugaaugauagaa

SEQ ID NO: 734414 - RNA, 24 nt, Human
aacagagugagacuuggucucaaa

SEQ ID NO: 734415 - RNA, 25 nt, Human
aacagcaccucaacaagaugcagga

SEQ ID NO: 734416 - RNA, 20 nt, Human
aacaguuuuauaacaaaacc

SEQ ID NO: 734417 - RNA, 22 nt, Human
aacauggugaaacccgaaaccc

SEQ ID NO: 734418 - RNA, 24 nt, Human
aacccugcaacgacuugauuguaa

SEQ ID NO: 734419 - RNA, 24 nt, Human
aaccuggccaacauggugaaaccc

SEQ ID NO: 734420 - RNA, 18 nt, Human
aaucgcuugaaccuggga

SEQ ID NO: 734421 - RNA, 27 nt, Human
acaaaacaaaaacuguguuuuacaaac

SEQ ID NO: 734422 - RNA, 24 nt, Human
acagagugagacuuggucucaaaa

SEQ ID NO: 734423 - RNA, 19 nt, Human
accacaaauccauaacuua

SEQ ID NO: 734424 - RNA, 24 nt, Human
acccccggcccggccauucccagg

SEQ ID NO: 734425 - RNA, 24 nt, Human
acccugucuccacuaaaaauauaa

SEQ ID NO: 734426 - RNA, 21 nt, Human
accuggggucaggaguccaag

SEQ ID NO: 734427 - RNA, 19 nt, Human
accuguaggagugucccuu

SEQ ID NO: 734428 - RNA, 19 nt, Human
accuuccacaguuccuguc

SEQ ID NO: 734429 - RNA, 21 nt, Human
acuacaggcgcaugccaccgu

SEQ ID NO: 734430 - RNA, 24 nt, Human
acuccagccugggcaacagaguga

SEQ ID NO: 734431 - RNA, 24 nt, Human
acugcacuccagccugggcaacag

SEQ ID NO: 734432 - RNA, 24 nt, Human
acugcacuccagccugggcaacag

SEQ ID NO: 734433 - RNA, 19 nt, Human
agaaaaaagcaaaaaagaa

SEQ ID NO: 734434 - RNA, 27 nt, Human
agaaaauaccaaagacauccaaggcca

SEQ ID NO: 734435 - RNA, 22 nt, Human
agaaucgcuugaaccugggaga

SEQ ID NO: 734436 - RNA, 24 nt, Human
agacggagguugcagugagccaag

SEQ ID NO: 734437 - RNA, 23 nt, Human
agcacaaucucagcucacugcaa

SEQ ID NO: 734438 - RNA, 20 nt, Human
agcacuuuggaaggcugagg

SEQ ID NO: 734439 - RNA, 22 nt, Human
agccugggcaacagagugagac

SEQ ID NO: 734440 - RNA, 24 nt, Human
agccugggcaacagagugagacuu

SEQ ID NO: 734441 - RNA, 24 nt, Human
aggagcaaagcacacagcucugag

SEQ ID NO: 734442 - RNA, 22 nt, Human
aggcaagagaaucgcuugaacc

SEQ ID NO: 734443 - RNA, 24 nt, Human
aggcaagagaaucgcuugaaccug

SEQ ID NO: 734444 - RNA, 20 nt, Human
aggcagagguggaaauucgg

SEQ ID NO: 734445 - RNA, 23 nt, Human
aggcagagguggaaauucgggac

SEQ ID NO: 734446 - RNA, 18 nt, Human
aggcagguggaucaccug

SEQ ID NO: 734447 - RNA, 22 nt, Human
aggcagguggaucaccuggggu

SEQ ID NO: 734448 - RNA, 26 nt, Human
aggcagguggaucaccuggggucagg

SEQ ID NO: 734449 - RNA, 24 nt, Human
aggcugaggcaagagaaucgcuug

SEQ ID NO: 734450 - RNA, 21 nt, Human
aggcugaggcagguggaucac

SEQ ID NO: 734451 - RNA, 24 nt, Human
aggcugaggcagguggaucaccug

SEQ ID NO: 734452 - RNA, 25 nt, Human
aggcuggagugcagcagcacaaucu

SEQ ID NO: 734453 - RNA, 21 nt, Human
agguauacacucucaccugua

SEQ ID NO: 734454 - RNA, 24 nt, Human
aggugaucugccugccucagccuc

SEQ ID NO: 734455 - RNA, 18 nt, Human
agguucaacucaaaacac

SEQ ID NO: 734456 - RNA, 18 nt, Human
aguagcugggacuacagg

SEQ ID NO: 734457 - RNA, 19 nt, Human
aguagcugggacuacaggc

SEQ ID NO: 734458 - RNA, 24 nt, Human
agugauucuccugccucagccucc

SEQ ID NO: 734459 - RNA, 24 nt, Human
agugcagcagcacaaucucagcuc

SEQ ID NO: 734460 - RNA, 23 nt, Human
aucacaagauaaguccagccacu

SEQ ID NO: 734461 - RNA, 24 nt, Human
aucgugccacugcacuccagccug

SEQ ID NO: 734462 - RNA, 19 nt, Human
augccuguaaucccagcac

SEQ ID NO: 734463 - RNA, 24 nt, Human
augcuagccagccaggcuggucuc

SEQ ID NO: 734464 - RNA, 23 nt, Human
auggcgggcgccuguaaucccag

SEQ ID NO: 734465 - RNA, 25 nt, Human
auuccaugauuauacacauuggucc

SEQ ID NO: 734466 - RNA, 22 nt, Human
auugugcuguuucucuaucuuu

SEQ ID NO: 734467 - RNA, 24 nt, Human
auuuuugcauuuuuaguagagacg

SEQ ID NO: 734468 - RNA, 24 nt, Human
caaaacaaaaacuguguuuuacaa

SEQ ID NO: 734469 - RNA, 23 nt, Human
caaaacacaugcuccagagccaa

SEQ ID NO: 734470 - RNA, 24 nt, Human
caacauggugaaacccgaaacccu

SEQ ID NO: 734471 - RNA, 21 nt, Human
caagauaaguccagccacuua

SEQ ID NO: 734472 - RNA, 24 nt, Human
caagaucaaccuggccaacauggu

SEQ ID NO: 734473 - RNA, 24 nt, Human
caagaucgugccacugcacuccag

SEQ ID NO: 734474 - RNA, 22 nt, Human
caagugauucuccugccucagc

SEQ ID NO: 734475 - RNA, 22 nt, Human
caauccugacuuacaacaaaaa

SEQ ID NO: 734476 - RNA, 23 nt, Human
cacaaugcagccuuacacuaaag

SEQ ID NO: 734477 - RNA, 21 nt, Human
cacacagcucugaguccauag

SEQ ID NO: 734478 - RNA, 20 nt, Human
cacccccggcccggccauuc

SEQ ID NO: 734479 - RNA, 21 nt, Human
caccucaacaagaugcaggag

SEQ ID NO: 734480 - RNA, 19 nt, Human
caccuguuuguccuuuggc

SEQ ID NO: 734481 - RNA, 19 nt, Human
cacgccgcgcucaccgccc

SEQ ID NO: 734482 - RNA, 22 nt, Human
cacuccagccugggcaacagag

SEQ ID NO: 734483 - RNA, 24 nt, Human
cacuccagccugggcaacagagug

SEQ ID NO: 734484 - RNA, 23 nt, Human
cacucuugcucauguauuaagga

SEQ ID NO: 734485 - RNA, 21 nt, Human
cacugcaaccuucgccuccug

SEQ ID NO: 734486 - RNA, 18 nt, Human
cacugcacuccagccugg

SEQ ID NO: 734487 - RNA, 19 nt, Human
cacugcacuccagccuggg

SEQ ID NO: 734488 - RNA, 21 nt, Human
cacugcacuccagccugggca

SEQ ID NO: 734489 - RNA, 23 nt, Human
cacugcacuccagccugggcaac

SEQ ID NO: 734490 - RNA, 24 nt, Human
cacugcacuccagccugggcaaca

SEQ ID NO: 734491 - RNA, 19 nt, Human
cagaaaauaccaaagacau

SEQ ID NO: 734492 - RNA, 24 nt, Human
cagaaaugcaaagcuggaacagca

SEQ ID NO: 734493 - RNA, 18 nt, Human
cagaacacaaaacaaaaa

SEQ ID NO: 734494 - RNA, 19 nt, Human
cagaacacaaaacaaaaac

SEQ ID NO: 734495 - RNA, 20 nt, Human
cagaacacaaaacaaaaacu

SEQ ID NO: 734496 - RNA, 24 nt, Human
cagcacuuuggaaggcugaggcag

SEQ ID NO: 734497 - RNA, 26 nt, Human
cagcacuuuggaaggcugaggcaggu

SEQ ID NO: 734498 - RNA, 18 nt, Human
cagcagcacaaucucagc

SEQ ID NO: 734499 - RNA, 22 nt, Human
caggugaucugccugccucagc

SEQ ID NO: 734500 - RNA, 18 nt, Human
cagguggaucaccugggg

SEQ ID NO: 734501 - RNA, 23 nt, Human
caguaguucagucaucucccuga

SEQ ID NO: 734502 - RNA, 20 nt, Human
caugccuguaaucccagcac

SEQ ID NO: 734503 - RNA, 18 nt, Human
caugcuagccagccaggc

SEQ ID NO: 734504 - RNA, 18 nt, Human
cauuacauauacuuuuac

SEQ ID NO: 734505 - RNA, 20 nt, Human
cauuuucuuuccugccugcu

SEQ ID NO: 734506 - RNA, 23 nt, Human
ccaaaugcugggaugacaggcau

SEQ ID NO: 734507 - RNA, 20 nt, Human
ccacugcacuccagccuggg

SEQ ID NO: 734508 - RNA, 21 nt, Human
ccacugcacuccagccugggc

SEQ ID NO: 734509 - RNA, 22 nt, Human
ccacugcacuccagccugggca

SEQ ID NO: 734510 - RNA, 23 nt, Human
ccacugcacuccagccugggcaa

SEQ ID NO: 734511 - RNA, 24 nt, Human
ccacugcacuccagccugggcaac

SEQ ID NO: 734512 - RNA, 18 nt, Human
ccauggccccaaaucaca

SEQ ID NO: 734513 - RNA, 21 nt, Human
cccacccccggcccggccauu

SEQ ID NO: 734514 - RNA, 21 nt, Human
cccauuguucuguucaucuca

SEQ ID NO: 734515 - RNA, 22 nt, Human
ccccacgccgcgcucaccgccc

SEQ ID NO: 734516 - RNA, 24 nt, Human
ccccacgccgcgcucaccgccccc

SEQ ID NO: 734517 - RNA, 21 nt, Human
cccccaaacccacaaugcagc

SEQ ID NO: 734518 - RNA, 21 nt, Human
cccccggcccggccauuccca

SEQ ID NO: 734519 - RNA, 24 nt, Human
cccccggcccggccauucccaggc

SEQ ID NO: 734520 - RNA, 23 nt, Human
cccgaguagcugggacuacaggc

SEQ ID NO: 734521 - RNA, 24 nt, Human
cccgaguagcugggacuacaggcg

SEQ ID NO: 734522 - RNA, 24 nt, Human
cccggccauucccaggccaccucu

SEQ ID NO: 734523 - RNA, 20 nt, Human
cccggcccggccauucccag

SEQ ID NO: 734524 - RNA, 23 nt, Human
cccggccgcccccgccgccuccg

SEQ ID NO: 734525 - RNA, 19 nt, Human
ccgcccccgccgccuccgg

SEQ ID NO: 734526 - RNA, 27 nt, Human
ccgccgccgccgccacagcggcuccgg

SEQ ID NO: 734527 - RNA, 21 nt, Human
ccgcgcggugcggugcggcgc

SEQ ID NO: 734528 - RNA, 19 nt, Human
ccggcccccaccucuucuu

SEQ ID NO: 734529 - RNA, 22 nt, Human
ccucaggugaucugccugccuc

SEQ ID NO: 734530 - RNA, 18 nt, Human
ccucccaaaugcugggau

SEQ ID NO: 734531 - RNA, 21 nt, Human
ccuccuggauucaagugauuc

SEQ ID NO: 734532 - RNA, 24 nt, Human
ccuccuggauucaagugauucucc

SEQ ID NO: 734533 - RNA, 18 nt, Human
ccugacuuacaacaaaaa

SEQ ID NO: 734534 - RNA, 23 nt, Human
ccugccucagccucccaaaugcu

SEQ ID NO: 734535 - RNA, 24 nt, Human
ccugccucagccucccgaguagcu

SEQ ID NO: 734536 - RNA, 22 nt, Human
ccugccugcuuuuuuccuuagc

SEQ ID NO: 734537 - RNA, 23 nt, Human
ccuggauucaagugauucuccuc

SEQ ID NO: 734538 - RNA, 23 nt, Human
ccuggauucaagugauucuccug

SEQ ID NO: 734539 - RNA, 22 nt, Human
ccuggccaacauggugaaaccc

SEQ ID NO: 734540 - RNA, 23 nt, Human
ccuggccaacauggugaaacccg

SEQ ID NO: 734541 - RNA, 21 nt, Human
ccuggccucaggugaucugcc

SEQ ID NO: 734542 - RNA, 21 nt, Human
ccugggagacggagguugcag

SEQ ID NO: 734543 - RNA, 21 nt, Human
ccugggcaacagagugagacu

SEQ ID NO: 734544 - RNA, 20 nt, Human
ccuguaaucccagcacuuug

SEQ ID NO: 734545 - RNA, 22 nt, Human
ccuguaaucccagcuacucugg

SEQ ID NO: 734546 - RNA, 23 nt, Human
ccuguaaucccagcuacucugga

SEQ ID NO: 734547 - RNA, 22 nt, Human
cgaaacccugucuccacuaaaa

SEQ ID NO: 734548 - RNA, 18 nt, Human
cgccacagcggcuccggc

SEQ ID NO: 734549 - RNA, 23 nt, Human
cgccgcgcagagcggcaguccca

SEQ ID NO: 734550 - RNA, 24 nt, Human
cgccuguaaucccagcuacucugg

SEQ ID NO: 734551 - RNA, 24 nt, Human
cgcucugucucccaggcuggagug

SEQ ID NO: 734552 - RNA, 19 nt, Human
cggccgcccccgccgccuc

SEQ ID NO: 734553 - RNA, 21 nt, Human
cucaaacucacaggaugaggc

SEQ ID NO: 734554 - RNA, 22 nt, Human
cucaauucuaacuuuauggauu

SEQ ID NO: 734555 - RNA, 24 nt, Human
cucacugcaaccuucgccuccugg

SEQ ID NO: 734556 - RNA, 24 nt, Human
cucagccucccgaguagcugggac

SEQ ID NO: 734557 - RNA, 23 nt, Human
cucaggugaucugccugccucag

SEQ ID NO: 734558 - RNA, 24 nt, Human
cucaugccuguaaucccagcacuu

SEQ ID NO: 734559 - RNA, 29 nt, Human
cuccaauucuaucuuaaacauguaucucc

SEQ ID NO: 734560 - RNA, 24 nt, Human
cucgcucugucucccaggcuggag

SEQ ID NO: 734561 - RNA, 19 nt, Human
cugaagcucaaacucacag

SEQ ID NO: 734562 - RNA, 18 nt, Human
cugacaucucuuccuauu

SEQ ID NO: 734563 - RNA, 23 nt, Human
cugcaaccuucgccuccuggauu

SEQ ID NO: 734564 - RNA, 19 nt, Human
cuugaggaauugaagggaa

SEQ ID NO: 734565 - RNA, 18 nt, Human
cuugcucauguauuaagg

SEQ ID NO: 734566 - RNA, 21 nt, Human
gaaacccgaaacccugucucc

SEQ ID NO: 734567 - RNA, 24 nt, Human
gacuacaggcgcaugccaccgugc

SEQ ID NO: 734568 - RNA, 19 nt, Human
gacuauauacauuacauau

SEQ ID NO: 734569 - RNA, 23 nt, Human
gagaaugcagaauuuacuuaggu

SEQ ID NO: 734570 - RNA, 18 nt, Human
gagguugcagugagccaa

SEQ ID NO: 734571 - RNA, 23 nt, Human
gagguugcagugagccaagaucg

SEQ ID NO: 734572 - RNA, 18 nt, Human
gaucaccuggggucagga

SEQ ID NO: 734573 - RNA, 24 nt, Human
gaucaccuggggucaggaguccaa

SEQ ID NO: 734574 - RNA, 21 nt, Human
gaucugccugccucagccucc

SEQ ID NO: 734575 - RNA, 18 nt, Human
gaugacaggcaugagcca

SEQ ID NO: 734576 - RNA, 24 nt, Human
gauggcgggcgccuguaaucccag

SEQ ID NO: 734577 - RNA, 23 nt, Human
gcaaaaaagaagaaggcuuaaaa

SEQ ID NO: 734578 - RNA, 24 nt, Human
gcacuccagccugggcaacagagu

SEQ ID NO: 734579 - RNA, 20 nt, Human
gcagagcggcagucccacac

SEQ ID NO: 734580 - RNA, 18 nt, Human
gccaacauggugaaaccc

SEQ ID NO: 734581 - RNA, 20 nt, Human
gccaagaucgugccacugca

SEQ ID NO: 734582 - RNA, 22 nt, Human
gccacugcacuccagccugggc

SEQ ID NO: 734583 - RNA, 24 nt, Human
gccacugcacuccagccugggcaa

SEQ ID NO: 734584 - RNA, 19 nt, Human
gccagccaggcuggucucg

SEQ ID NO: 734585 - RNA, 22 nt, Human
gcccuguuaauuuuugcauuuu

SEQ ID NO: 734586 - RNA, 18 nt, Human
gccgcgcucaccgccccc

SEQ ID NO: 734587 - RNA, 21 nt, Human
gccgcgcucaccgcccccagc

SEQ ID NO: 734588 - RNA, 19 nt, Human
gcuagccagccaggcuggu

SEQ ID NO: 734589 - RNA, 19 nt, Human
gcuggagugcagcagcaca

SEQ ID NO: 734590 - RNA, 20 nt, Human
ggagguugcagugagccaag

SEQ ID NO: 734591 - RNA, 24 nt, Human
ggagguugcagugagccaagaucg

SEQ ID NO: 734592 - RNA, 21 nt, Human
ggaugacaggcaugagccacg

SEQ ID NO: 734593 - RNA, 23 nt, Human
ggcacgauggcgggcgccuguaa

SEQ ID NO: 734594 - RNA, 24 nt, Human
ggccacgguggcucaugccuguaa

SEQ ID NO: 734595 - RNA, 25 nt, Human
ggcgccuguaaucccagcuacucug

SEQ ID NO: 734596 - RNA, 21 nt, Human
ggcucaugccuguaaucccag

SEQ ID NO: 734597 - RNA, 24 nt, Human
ggcuggucucgaacuccuggccuc

SEQ ID NO: 734598 - RNA, 19 nt, Human
gggcguagagaaaggacug

SEQ ID NO: 734599 - RNA, 23 nt, Human
gguggcucaugccuguaauccca

SEQ ID NO: 734600 - RNA, 24 nt, Human
gguggcucaugccuguaaucccag

SEQ ID NO: 734601 - RNA, 23 nt, Human
gguuaauugggacacaacuauga

SEQ ID NO: 734602 - RNA, 20 nt, Human
gucucucucucuucuuccca

SEQ ID NO: 734603 - RNA, 18 nt, Human
gugaucugccugccucag

SEQ ID NO: 734604 - RNA, 24 nt, Human
gugaucugccugccucagccuccc

SEQ ID NO: 734605 - RNA, 24 nt, Human
gugauucuccugccucagccuccc

SEQ ID NO: 734606 - RNA, 21 nt, Human
gugccuggcucacuaguaugu

SEQ ID NO: 734607 - RNA, 22 nt, Human
guggcucccacacuuuccauuu

SEQ ID NO: 734608 - RNA, 22 nt, Human
uaaaaagaaguuucacuuauuu

SEQ ID NO: 734609 - RNA, 19 nt, Human
uaacucagcccauuguucu

SEQ ID NO: 734610 - RNA, 19 nt, Human
uaacuuacagcugauccaa

SEQ ID NO: 734611 - RNA, 24 nt, Human
uaauuuuugcauuuuuaguagaga

SEQ ID NO: 734612 - RNA, 20 nt, Human
uaccacucuauuagcucaau

SEQ ID NO: 734613 - RNA, 28 nt, Human
uagccagccaggcuggucucgaacuccu

SEQ ID NO: 734614 - RNA, 22 nt, Human
uaguagagacggucucaccaug

SEQ ID NO: 734615 - RNA, 23 nt, Human
uauucaucuauccaaaugucaca

SEQ ID NO: 734616 - RNA, 24 nt, Human
ucaaaacacaugcuccagagccaa

SEQ ID NO: 734617 - RNA, 19 nt, Human
ucaagugauucuccugccu

SEQ ID NO: 734618 - RNA, 23 nt, Human
ucaaugcaagaaaacugggcaua

SEQ ID NO: 734619 - RNA, 20 nt, Human
ucaccacccagacuugagga

SEQ ID NO: 734620 - RNA, 25 nt, Human
ucaccgcccccagccgccgccgccg

SEQ ID NO: 734621 - RNA, 25 nt, Human
ucaccuccuuuuuuuuuuuuuaaga

SEQ ID NO: 734622 - RNA, 19 nt, Human
ucacugcaaccuucgccuc

SEQ ID NO: 734623 - RNA, 23 nt, Human
ucacugcaaccuucgccuccugg

SEQ ID NO: 734624 - RNA, 27 nt, Human
ucacugcaaccuucgccuccuggauuc

SEQ ID NO: 734625 - RNA, 20 nt, Human
ucagaagacuucuuauucau

SEQ ID NO: 734626 - RNA, 23 nt, Human
ucagccucccgaguagcugggac

SEQ ID NO: 734627 - RNA, 22 nt, Human
ucaggugaucugccugccucag

SEQ ID NO: 734628 - RNA, 18 nt, Human
ucagugacaaaaaugccu

SEQ ID NO: 734629 - RNA, 22 nt, Human
ucaugccuguaaucccagcacu

SEQ ID NO: 734630 - RNA, 23 nt, Human
ucauggguucagaacuccaaaca

SEQ ID NO: 734631 - RNA, 21 nt, Human
uccaaucuuccauggccccaa

SEQ ID NO: 734632 - RNA, 23 nt, Human
uccagccugggcaacagagugag

SEQ ID NO: 734633 - RNA, 24 nt, Human
uccagccugggcaacagagugaga

SEQ ID NO: 734634 - RNA, 23 nt, Human
ucccaaaugcugggaugacaggc

SEQ ID NO: 734635 - RNA, 19 nt, Human
ucccaggcuggagugcagc

SEQ ID NO: 734636 - RNA, 19 nt, Human
ucccaguauucaucuaucc

SEQ ID NO: 734637 - RNA, 24 nt, Human
ucccgaguagcugggacuacaggc

SEQ ID NO: 734638 - RNA, 24 nt, Human
uccugccugcuuuuuuccuuagca

SEQ ID NO: 734639 - RNA, 21 nt, Human
uccuggauucaagugauucuc

SEQ ID NO: 734640 - RNA, 24 nt, Human
uccuggauucaagugauucuccug

SEQ ID NO: 734641 - RNA, 24 nt, Human
ucgcuugaaccugggagacggagg

SEQ ID NO: 734642 - RNA, 25 nt, Human
ucgcuugaaccugggagacggaggu

SEQ ID NO: 734643 - RNA, 23 nt, Human
ucgugccacugcacuccagccug

SEQ ID NO: 734644 - RNA, 18 nt, Human
ucucccaggcuggagugc

SEQ ID NO: 734645 - RNA, 19 nt, Human
ucucgaacuccuggccuca

SEQ ID NO: 734646 - RNA, 23 nt, Human
ucucgcucugucucccaggcugg

SEQ ID NO: 734647 - RNA, 24 nt, Human
ucucgcucugucucccaggcugga

SEQ ID NO: 734648 - RNA, 20 nt, Human
ucucucucuucuucccuccu

SEQ ID NO: 734649 - RNA, 21 nt, Human
ucugaguaguuguucccaguu

SEQ ID NO: 734650 - RNA, 19 nt, Human
ucugucucccaggcuggag

SEQ ID NO: 734651 - RNA, 24 nt, Human
ucugucucccaggcuggagugcag

SEQ ID NO: 734652 - RNA, 22 nt, Human
ucuguguuuugugcuagucugu

SEQ ID NO: 734653 - RNA, 18 nt, Human
ucuguucaucucaaaaug

SEQ ID NO: 734654 - RNA, 21 nt, Human
ugaaacccgaaacccugucuc

SEQ ID NO: 734655 - RNA, 24 nt, Human
ugaaccugggagacggagguugca

SEQ ID NO: 734656 - RNA, 19 nt, Human
ugacagaaaugcaaagcug

SEQ ID NO: 734657 - RNA, 21 nt, Human
ugacagaaaugcaaagcugga

SEQ ID NO: 734658 - RNA, 24 nt, Human
ugaccucuuuuccuucuccccuga

SEQ ID NO: 734659 - RNA, 19 nt, Human
ugagcaaaucagauccuau

SEQ ID NO: 734660 - RNA, 22 nt, Human
ugagccaagaucgugccacugc

SEQ ID NO: 734661 - RNA, 20 nt, Human
ugaggcaagagaaucgcuug

SEQ ID NO: 734662 - RNA, 24 nt, Human
ugaggcaagagaaucgcuugaacc

SEQ ID NO: 734663 - RNA, 25 nt, Human
ugaggcaagagaaucgcuugaaccu

SEQ ID NO: 734664 - RNA, 20 nt, Human
ugaggcagguggaucaccug

SEQ ID NO: 734665 - RNA, 24 nt, Human
ugaggcagguggaucaccuggggu

SEQ ID NO: 734666 - RNA, 26 nt, Human
ugaggcagguggaucaccugggguca

SEQ ID NO: 734667 - RNA, 21 nt, Human
ugaguccauagaugagugggc

SEQ ID NO: 734668 - RNA, 21 nt, Human
ugagugggcacaucaggccug

SEQ ID NO: 734669 - RNA, 24 nt, Human
ugaguucugauuuuccuaguuuug

SEQ ID NO: 734670 - RNA, 20 nt, Human
ugauucuccugccucagccu

SEQ ID NO: 734671 - RNA, 19 nt, Human
ugcaagaaaacugggcaua

SEQ ID NO: 734672 - RNA, 21 nt, Human
ugccagaacacaaaacaaaaa

SEQ ID NO: 734673 - RNA, 24 nt, Human
ugccagaacacaaaacaaaaacug

SEQ ID NO: 734674 - RNA, 20 nt, Human
ugcccaacccuagaaugagc

SEQ ID NO: 734675 - RNA, 23 nt, Human
ugccucagccucccaaaugcugg

SEQ ID NO: 734676 - RNA, 24 nt, Human
ugccucagccucccgaguagcugg

SEQ ID NO: 734677 - RNA, 18 nt, Human
ugccuguaaucccagcac

SEQ ID NO: 734678 - RNA, 23 nt, Human
ugccuguaaucccagcacuuugg

SEQ ID NO: 734679 - RNA, 19 nt, Human
ugcggugcggcgcggcccc

SEQ ID NO: 734680 - RNA, 23 nt, Human
ugcuccagagccaaucccaguau

SEQ ID NO: 734681 - RNA, 18 nt, Human
uggaacagcaccucaaca

SEQ ID NO: 734682 - RNA, 18 nt, Human
uggaaggcugaggcaggu

SEQ ID NO: 734683 - RNA, 24 nt, Human
uggaaggcugaggcagguggauca

SEQ ID NO: 734684 - RNA, 23 nt, Human
uggaucaccuggggucaggaguc

SEQ ID NO: 734685 - RNA, 24 nt, Human
uggaucaccuggggucaggagucc

SEQ ID NO: 734686 - RNA, 23 nt, Human
uggauucaagugauucuccugcc

SEQ ID NO: 734687 - RNA, 19 nt, Human
uggcauuaaauguauucaa

SEQ ID NO: 734688 - RNA, 18 nt, Human
uggccaacauggugaaac

SEQ ID NO: 734689 - RNA, 24 nt, Human
uggccggccacgguggcucaugcc

SEQ ID NO: 734690 - RNA, 24 nt, Human
uggccucaggugaucugccugccu

SEQ ID NO: 734691 - RNA, 21 nt, Human
uggcgggcgccuguaauccca

SEQ ID NO: 734692 - RNA, 22 nt, Human
uggcucaugccuguaaucccag

SEQ ID NO: 734693 - RNA, 24 nt, Human
uggcucaugccuguaaucccagca

SEQ ID NO: 734694 - RNA, 26 nt, Human
ugggaacagcagcuucagugacaaaa

SEQ ID NO: 734695 - RNA, 20 nt, Human
ugggaaggacugcuuuuggc

SEQ ID NO: 734696 - RNA, 20 nt, Human
ugggaauaaaaugaaaugau

SEQ ID NO: 734697 - RNA, 22 nt, Human
ugggacuacaggcgcaugccac

SEQ ID NO: 734698 - RNA, 23 nt, Human
ugggacuacaggcgcaugccacc

SEQ ID NO: 734699 - RNA, 23 nt, Human
ugggacuacaggcgcaugccacc

SEQ ID NO: 734700 - RNA, 24 nt, Human
ugggacuacaggcgcaugccaccg

SEQ ID NO: 734701 - RNA, 24 nt, Human
ugggagacggagguugcagugagc

SEQ ID NO: 734702 - RNA, 22 nt, Human
ugggaugacaggcaugagccac

SEQ ID NO: 734703 - RNA, 23 nt, Human
ugggaugacaggcaugagccacg

SEQ ID NO: 734704 - RNA, 24 nt, Human
ugggaugacaggcaugagccacgg

SEQ ID NO: 734705 - RNA, 21 nt, Human
uggucaaagaauacacgggug

SEQ ID NO: 734706 - RNA, 19 nt, Human
uuacugcaacuacuuacau

SEQ ID NO: 734707 - RNA, 23 nt, Human
uuaguagagacggucucaccaug

SEQ ID NO: 734708 - RNA, 21 nt, Human
uuauacacauugguccauuuc

SEQ ID NO: 734709 - RNA, 18 nt, Human
uuauuugcugccacucug

SEQ ID NO: 734710 - RNA, 21 nt, Human
uucaagugauucuccugccuc

SEQ ID NO: 734711 - RNA, 23 nt, Human
uucaagugauucuccugccucag

SEQ ID NO: 734712 - RNA, 24 nt, Human
uucaagugauucuccugccucagc

SEQ ID NO: 734713 - RNA, 19 nt, Human
uucccaguuucacccaaca

SEQ ID NO: 734714 - RNA, 18 nt, Human
uucugguucuaccauugg

SEQ ID NO: 734715 - RNA, 18 nt, Human
uugaaacccauagaacac

SEQ ID NO: 734716 - RNA, 22 nt, Human
uugaaagaccacaaauccauaa

SEQ ID NO: 734717 - RNA, 24 nt, Human
uugaaccugggagacggagguugc

SEQ ID NO: 734718 - RNA, 22 nt, Human
uugcagugagccaagaucgugc

SEQ ID NO: 734719 - RNA, 21 nt, Human
uugcugcuggccacuuccaau

SEQ ID NO: 734720 - RNA, 22 nt, Human
uuggaagauaaugcuggcuuca

SEQ ID NO: 734721 - RNA, 25 nt, Human
uuggaaggcugaggcagguggauca

SEQ ID NO: 734722 - RNA, 18 nt, Human
uuggucucaaaaaaaaaa

SEQ ID NO: 734723 - RNA, 19 nt, Human
uugguuaacacgaauucug

SEQ ID NO: 734724 - RNA, 21 nt, Human
uuuacauuucccccaaaccca

SEQ ID NO: 734725 - RNA, 23 nt, Human
uuuaguagagacggucucaccau

SEQ ID NO: 734726 - RNA, 20 nt, Human
uuuguccuuuggcaugggaa

SEQ ID NO: 734727 - RNA, 18 nt, Human
uuugugcuagucugucuu

SEQ ID NO: 734728 - RNA, 20 nt, Human
uuugugcuagucugucuucu

SEQ ID NO: 734729 - RNA, 23 nt, Human
uuuucugcaaaugcuuucaagaa

SEQ ID NO: 734730 - RNA, 20 nt, Human
uuuuugcauuuuuaguagag

SEQ ID NO: 734731 - RNA, 18 nt, Human
aaaacaaaaacuucuaaa

SEQ ID NO: 734732 - RNA, 23 nt, Human
aacagagcuguaccaacuccccc

SEQ ID NO: 734733 - RNA, 22 nt, Human
aacuccccccagaucuccccca

SEQ ID NO: 734734 - RNA, 18 nt, Human
aaggcggggcaggcaaga

SEQ ID NO: 734735 - RNA, 25 nt, Human
aaucccuucuuccucacuuccccac

SEQ ID NO: 734736 - RNA, 22 nt, Human
acaggucaggaccugggugggu

SEQ ID NO: 734737 - RNA, 22 nt, Human
acaguggaucccucuuccuguu

SEQ ID NO: 734738 - RNA, 25 nt, Human
accaacuccccccagaucuccccca

SEQ ID NO: 734739 - RNA, 22 nt, Human
acuacaaaccaccggaccaugg

SEQ ID NO: 734740 - RNA, 26 nt, Human
acuacaaaccaccggaccauggugcc

SEQ ID NO: 734741 - RNA, 18 nt, Human
acugggcauccuucccag

SEQ ID NO: 734742 - RNA, 18 nt, Human
agagggaccauuauuggu

SEQ ID NO: 734743 - RNA, 19 nt, Human
agagggaccauuauuggug

SEQ ID NO: 734744 - RNA, 19 nt, Human
agccuugggcuccuucagc

SEQ ID NO: 734745 - RNA, 24 nt, Human
agcguuccuccgcgcgccccgcuu

SEQ ID NO: 734746 - RNA, 22 nt, Human
aggcggccgaggaccgcagagc

SEQ ID NO: 734747 - RNA, 18 nt, Human
caccccuccuccucggcc

SEQ ID NO: 734748 - RNA, 21 nt, Human
cacugcaucugccugucccgc

SEQ ID NO: 734749 - RNA, 23 nt, Human
cagaucucccccaacaucagcac

SEQ ID NO: 734750 - RNA, 20 nt, Human
cagcucccgcggcgccgggg

SEQ ID NO: 734751 - RNA, 21 nt, Human
cagcucccgcggcgccgggga

SEQ ID NO: 734752 - RNA, 25 nt, Human
caguggaucccucuuccuguugucc

SEQ ID NO: 734753 - RNA, 18 nt, Human
caguuuaacucuagaauc

SEQ ID NO: 734754 - RNA, 23 nt, Human
cauuccccaaggcggggcaggca

SEQ ID NO: 734755 - RNA, 20 nt, Human
ccaacaucagcacgaacaaa

SEQ ID NO: 734756 - RNA, 20 nt, Human
ccaacuccccccagaucucc

SEQ ID NO: 734757 - RNA, 23 nt, Human
ccaacuccccccagaucuccccc

SEQ ID NO: 734758 - RNA, 21 nt, Human
ccaaggcggggcaggcaagaa

SEQ ID NO: 734759 - RNA, 21 nt, Human
cccaaggcggggcaggcaaga

SEQ ID NO: 734760 - RNA, 19 nt, Human
cccagcuaccacgaaguaa

SEQ ID NO: 734761 - RNA, 19 nt, Human
ccccaacaucagcacgaac

SEQ ID NO: 734762 - RNA, 21 nt, Human
ccccaacccccgcuccgggcc

SEQ ID NO: 734763 - RNA, 24 nt, Human
ccccagacauggcgcacccgacuu

SEQ ID NO: 734764 - RNA, 23 nt, Human
cccccaccccuccuccucggccc

SEQ ID NO: 734765 - RNA, 18 nt, Human
cccccagaucucccccaa

SEQ ID NO: 734766 - RNA, 19 nt, Human
ccccccccucacucacugc

SEQ ID NO: 734767 - RNA, 19 nt, Human
ccccgcguccccgccgcgc

SEQ ID NO: 734768 - RNA, 18 nt, Human
cccgccgcgcugcgccac

SEQ ID NO: 734769 - RNA, 19 nt, Human
cccgccgcgcugcgccacg

SEQ ID NO: 734770 - RNA, 22 nt, Human
cccggccccagacauggcgcac

SEQ ID NO: 734771 - RNA, 21 nt, Human
ccgccgcuacccccaccccuc

SEQ ID NO: 734772 - RNA, 20 nt, Human
ccgcguccccgccgcgcugc

SEQ ID NO: 734773 - RNA, 25 nt, Human
ccgcuuucucuacucccccaacccc

SEQ ID NO: 734774 - RNA, 19 nt, Human
ccggccggccggcccgcug

SEQ ID NO: 734775 - RNA, 28 nt, Human
ccggcucgguccucccagcucccgcggc

SEQ ID NO: 734776 - RNA, 18 nt, Human
ccgggccgcgggcgccgc

SEQ ID NO: 734777 - RNA, 19 nt, Human
ccuaggcuggagagggaag

SEQ ID NO: 734778 - RNA, 25 nt, Human
ccucacuuccccacccuaggcugga

SEQ ID NO: 734779 - RNA, 24 nt, Human
ccucccagcucccgcggcgccggg

SEQ ID NO: 734780 - RNA, 21 nt, Human
ccucccauucagggcaaaggc

SEQ ID NO: 734781 - RNA, 24 nt, Human
ccucuagcucccagugccugacuu

SEQ ID NO: 734782 - RNA, 20 nt, Human
ccugcaagcccagcuaccac

SEQ ID NO: 734783 - RNA, 22 nt, Human
cgcuacccccaccccuccuccu

SEQ ID NO: 734784 - RNA, 22 nt, Human
cggcccgcuggcggguggcucg

SEQ ID NO: 734785 - RNA, 18 nt, Human
cgggccggcgggcggcgg

SEQ ID NO: 734786 - RNA, 23 nt, Human
cggggcaggcaagaaaaauuagg

SEQ ID NO: 734787 - RNA, 22 nt, Human
cucacuuccccacccuaggcug

SEQ ID NO: 734788 - RNA, 21 nt, Human
cuccagaauaaauaauuuaaa

SEQ ID NO: 734789 - RNA, 19 nt, Human
cucccccaacccccgcucc

SEQ ID NO: 734790 - RNA, 22 nt, Human
cuccgccauggccccccccuca

SEQ ID NO: 734791 - RNA, 24 nt, Human
cuccgccauggccccccccucacu

SEQ ID NO: 734792 - RNA, 18 nt, Human
cuccgggccgcgggcgcc

SEQ ID NO: 734793 - RNA, 18 nt, Human
cuccuccgccauggcccc

SEQ ID NO: 734794 - RNA, 18 nt, Human
cuguaccaacucccccca

SEQ ID NO: 734795 - RNA, 23 nt, Human
cuuccuguuguccucgcuuggag

SEQ ID NO: 734796 - RNA, 21 nt, Human
cuuucucacucuccauaagaa

SEQ ID NO: 734797 - RNA, 21 nt, Human
gaagagggaccauuauuggug

SEQ ID NO: 734798 - RNA, 21 nt, Human
gaaggaacuacaaaccaccgg

SEQ ID NO: 734799 - RNA, 23 nt, Human
gaaggaagaagaggcggccgagg

SEQ ID NO: 734800 - RNA, 20 nt, Human
gacauggcgcacccgacuug

SEQ ID NO: 734801 - RNA, 19 nt, Human
gacccagcguuccuccgcg

SEQ ID NO: 734802 - RNA, 23 nt, Human
gagcuggcgggccggcgggcggc

SEQ ID NO: 734803 - RNA, 23 nt, Human
gagggcgcaggggcccacugggu

SEQ ID NO: 734804 - RNA, 21 nt, Human
gcaaaggcucaguagcucugc

SEQ ID NO: 734805 - RNA, 20 nt, Human
gcagaucuguggguacccug

SEQ ID NO: 734806 - RNA, 23 nt, Human
gccccgcuuucucuacuccccca

SEQ ID NO: 734807 - RNA, 25 nt, Human
gccccgcuuucucuacucccccaac

SEQ ID NO: 734808 - RNA, 24 nt, Human
gccgcgcugcucgcucggccggcu

SEQ ID NO: 734809 - RNA, 21 nt, Human
gccuugggcuccuucagcaac

SEQ ID NO: 734810 - RNA, 21 nt, Human
gcgcaggggcccacuggguuc

SEQ ID NO: 734811 - RNA, 20 nt, Human
gcggggcaggcaagaaaaag

SEQ ID NO: 734812 - RNA, 21 nt, Human
ggcauggagagccuugggcuc

SEQ ID NO: 734813 - RNA, 22 nt, Human
ggccggggagggcgcaggggcc

SEQ ID NO: 734814 - RNA, 18 nt, Human
ggcgcaguggaaggagau

SEQ ID NO: 734815 - RNA, 18 nt, Human
gggcaaaggcucaguagc

SEQ ID NO: 734816 - RNA, 20 nt, Human
ggguagguuggugauggggg

SEQ ID NO: 734817 - RNA, 19 nt, Human
ggugaugggggaaucagga

SEQ ID NO: 734818 - RNA, 20 nt, Human
gugaugggcucagcuggccg

SEQ ID NO: 734819 - RNA, 26 nt, Human
uaaaauaaaauacaaacacuuaggua

SEQ ID NO: 734820 - RNA, 21 nt, Human
uacaaaccaccggaccauggu

SEQ ID NO: 734821 - RNA, 21 nt, Human
uacccuggaggggaguucccg

SEQ ID NO: 734822 - RNA, 22 nt, Human
uagaaaggcauggagagccuug

SEQ ID NO: 734823 - RNA, 19 nt, Human
ucagcuggccggggagggc

SEQ ID NO: 734824 - RNA, 21 nt, Human
ucaggaccugggugggugagg

SEQ ID NO: 734825 - RNA, 21 nt, Human
ucaguagcucugcaucuuucc

SEQ ID NO: 734826 - RNA, 22 nt, Human
ucauaagcaagggggcuguggc

SEQ ID NO: 734827 - RNA, 18 nt, Human
uccauaagaaccucauaa

SEQ ID NO: 734828 - RNA, 20 nt, Human
uccccacccuaggcuggaga

SEQ ID NO: 734829 - RNA, 22 nt, Human
uccccccagaucucccccaaca

SEQ ID NO: 734830 - RNA, 18 nt, Human
uccccgcguccccgccgc

SEQ ID NO: 734831 - RNA, 21 nt, Human
uccccgcguccccgccgcgcu

SEQ ID NO: 734832 - RNA, 24 nt, Human
ucccggccggccggcccgcuggcg

SEQ ID NO: 734833 - RNA, 21 nt, Human
ucccuaccucccauucagggc

SEQ ID NO: 734834 - RNA, 24 nt, Human
ucucacucuccauaagaaccucau

SEQ ID NO: 734835 - RNA, 18 nt, Human
ugaaggaagaagaggcgg

SEQ ID NO: 734836 - RNA, 22 nt, Human
ugaccagggcaaugcagaucug

SEQ ID NO: 734837 - RNA, 23 nt, Human
ugaccagggcaaugcagaucugu

SEQ ID NO: 734838 - RNA, 21 nt, Human
ugcaagcccagcuaccacgaa

SEQ ID NO: 734839 - RNA, 23 nt, Human
ugcccuauuucccuucccuuucu

SEQ ID NO: 734840 - RNA, 22 nt, Human
ugcuccguucccugcaagccca

SEQ ID NO: 734841 - RNA, 18 nt, Human
uggaaggagauccgggcg

SEQ ID NO: 734842 - RNA, 19 nt, Human
uggagagggaagcuuaagg

SEQ ID NO: 734843 - RNA, 18 nt, Human
uggagccuuugacugggc

SEQ ID NO: 734844 - RNA, 23 nt, Human
uggcucggagggcgagcuggcgg

SEQ ID NO: 734845 - RNA, 20 nt, Human
ugggcauccuucccagccug

SEQ ID NO: 734846 - RNA, 20 nt, Human
uucccugcaagcccagcuac

SEQ ID NO: 734847 - RNA, 20 nt, Human
uuggagccuuugacugggca

SEQ ID NO: 734848 - RNA, 24 nt, Human
aaaaaaaaaaaaaauacaaaaacu

SEQ ID NO: 734849 - RNA, 21 nt, Human
aaaauaaaugaguaaagaccc

SEQ ID NO: 734850 - RNA, 20 nt, Human
aaacacacacccgccacccc

SEQ ID NO: 734851 - RNA, 20 nt, Human
aaacacacacccgccacccc

SEQ ID NO: 734852 - RNA, 18 nt, Human
aaaggccccagaguucag

SEQ ID NO: 734853 - RNA, 21 nt, Human
aaaggccccagaguucagucc

SEQ ID NO: 734854 - RNA, 20 nt, Human
aacauggcgagacccugucu

SEQ ID NO: 734855 - RNA, 19 nt, Human
aaccaggcacuccccucca

SEQ ID NO: 734856 - RNA, 20 nt, Human
aaccuggccaggcguagugg

SEQ ID NO: 734857 - RNA, 26 nt, Human
aagaagcccacagacuccuucacacc

SEQ ID NO: 734858 - RNA, 19 nt, Human
aagagcugugggaaccagg

SEQ ID NO: 734859 - RNA, 20 nt, Human
aagcacaccagaggccagaa

SEQ ID NO: 734860 - RNA, 26 nt, Human
aagcacaccagaggccagaagagaug

SEQ ID NO: 734861 - RNA, 21 nt, Human
aagccacaugucacuugggga

SEQ ID NO: 734862 - RNA, 23 nt, Human
aagccacaugucacuuggggaug

SEQ ID NO: 734863 - RNA, 20 nt, Human
aaucacacuccagccuggaa

SEQ ID NO: 734864 - RNA, 22 nt, Human
aauggauuccacaaaccauuaa

SEQ ID NO: 734865 - RNA, 25 nt, Human
acaaaaaaaaaaaaaaauacaaaaa

SEQ ID NO: 734866 - RNA, 21 nt, Human
acaccaccccaaaggccccag

SEQ ID NO: 734867 - RNA, 22 nt, Human
acaccaccccaaaggccccaga

SEQ ID NO: 734868 - RNA, 23 nt, Human
acaccaccccaaaggccccagag

SEQ ID NO: 734869 - RNA, 20 nt, Human
acagagcaagacccugucuc

SEQ ID NO: 734870 - RNA, 26 nt, Human
acagagcaagacccugucucccccaa

SEQ ID NO: 734871 - RNA, 18 nt, Human
accacgucaccagccccc

SEQ ID NO: 734872 - RNA, 22 nt, Human
accaggcacuccccuccacagg

SEQ ID NO: 734873 - RNA, 23 nt, Human
accauaugacccagagggagcca

SEQ ID NO: 734874 - RNA, 23 nt, Human
acccagaacuagggaaacucaac

SEQ ID NO: 734875 - RNA, 19 nt, Human
acccagagggagccaggcu

SEQ ID NO: 734876 - RNA, 22 nt, Human
accccagcagaggguaggauga

SEQ ID NO: 734877 - RNA, 22 nt, Human
acccugccacccagaacuaggg

SEQ ID NO: 734878 - RNA, 21 nt, Human
acccugucucccccaaaaaaa

SEQ ID NO: 734879 - RNA, 24 nt, Human
acuccagagcuuuguuuugggaag

SEQ ID NO: 734880 - RNA, 23 nt, Human
acuguaaacaguaagagcuguaa

SEQ ID NO: 734881 - RNA, 24 nt, Human
agaaagaauuucucagugcuugaa

SEQ ID NO: 734882 - RNA, 18 nt, Human
agaacaacgaagcuucca

SEQ ID NO: 734883 - RNA, 18 nt, Human
agacagcuucucucuucc

SEQ ID NO: 734884 - RNA, 26 nt, Human
agagcacugucucagcccaggccucc

SEQ ID NO: 734885 - RNA, 19 nt, Human
agagcucucccagacugac

SEQ ID NO: 734886 - RNA, 24 nt, Human
agagguugcagugagccaagaucg

SEQ ID NO: 734887 - RNA, 23 nt, Human
agcacuucccucccuccuuuggu

SEQ ID NO: 734888 - RNA, 24 nt, Human
agcacuuugggaggcccagguggg

SEQ ID NO: 734889 - RNA, 24 nt, Human
agcagugguggcucacgccugugg

SEQ ID NO: 734890 - RNA, 21 nt, Human
agccaguccacucucggcaca

SEQ ID NO: 734891 - RNA, 18 nt, Human
agcccgcagagguugcag

SEQ ID NO: 734892 - RNA, 20 nt, Human
agccuggaaucugacugccu

SEQ ID NO: 734893 - RNA, 22 nt, Human
agccugggcaacauggcgagac

SEQ ID NO: 734894 - RNA, 24 nt, Human
agccugggcaacauggcgagaccc

SEQ ID NO: 734895 - RNA, 22 nt, Human
aggaagcacagcaugaagccca

SEQ ID NO: 734896 - RNA, 24 nt, Human
aggaagcacagcaugaagcccagg

SEQ ID NO: 734897 - RNA, 19 nt, Human
aggagaccacacaaacacu

SEQ ID NO: 734898 - RNA, 25 nt, Human
aggcaaaaacaacaccgggacccca

SEQ ID NO: 734899 - RNA, 24 nt, Human
aggcagggagugggcggcagcaga

SEQ ID NO: 734900 - RNA, 24 nt, Human
aggcguaguggcucaugucuguaa

SEQ ID NO: 734901 - RNA, 21 nt, Human
agggugcugcuuuaauagauu

SEQ ID NO: 734902 - RNA, 18 nt, Human
aguaggagucucaccuuc

SEQ ID NO: 734903 - RNA, 24 nt, Human
aguggcucaugucuguaauccuag

SEQ ID NO: 734904 - RNA, 23 nt, Human
aguggcugacuguccugaccaug

SEQ ID NO: 734905 - RNA, 22 nt, Human
agugugccaugggccagagggc

SEQ ID NO: 734906 - RNA, 25 nt, Human
auaacugaccccaguauucccacag

SEQ ID NO: 734907 - RNA, 28 nt, Human
augacaacaaaacaaggaucaacgugcc

SEQ ID NO: 734908 - RNA, 24 nt, Human
auggagccgguggaaaguaaugcu

SEQ ID NO: 734909 - RNA, 19 nt, Human
augucuguaauccuagcac

SEQ ID NO: 734910 - RNA, 19 nt, Human
auugccagggaaaccuggu

SEQ ID NO: 734911 - RNA, 22 nt, Human
caaagccggcagaugccaguca

SEQ ID NO: 734912 - RNA, 22 nt, Human
caacauggcgagacccugucuc

SEQ ID NO: 734913 - RNA, 24 nt, Human
caacauggcgagacccugucucua

SEQ ID NO: 734914 - RNA, 24 nt, Human
caacucccaagccccaucccacag

SEQ ID NO: 734915 - RNA, 21 nt, Human
caagagcacugucucagccca

SEQ ID NO: 734916 - RNA, 21 nt, Human
caagcacaccagaggccagaa

SEQ ID NO: 734917 - RNA, 26 nt, Human
cacacagccacgcugcucucuaccca

SEQ ID NO: 734918 - RNA, 18 nt, Human
caccaaugcccuguaagc

SEQ ID NO: 734919 - RNA, 23 nt, Human
caccauaugacccagagggagcc

SEQ ID NO: 734920 - RNA, 21 nt, Human
caccccauuagccugucuuca

SEQ ID NO: 734921 - RNA, 24 nt, Human
caccccauuagccugucuucagcu

SEQ ID NO: 734922 - RNA, 22 nt, Human
caccgcaccagcagacuccaac

SEQ ID NO: 734923 - RNA, 22 nt, Human
caccgggaccccauggaagcga

SEQ ID NO: 734924 - RNA, 21 nt, Human
cacgucaccagcccccaggug

SEQ ID NO: 734925 - RNA, 21 nt, Human
cacuccccuccacaggggguc

SEQ ID NO: 734926 - RNA, 21 nt, Human
cacugcaacucccaagcccca

SEQ ID NO: 734927 - RNA, 21 nt, Human
cacuggaauucaaaauuuaca

SEQ ID NO: 734928 - RNA, 21 nt, Human
cacugggauacaagcagaaca

SEQ ID NO: 734929 - RNA, 21 nt, Human
cacuggguuugugccuucugc

SEQ ID NO: 734930 - RNA, 22 nt, Human
cacuguguuccagucuggguga

SEQ ID NO: 734931 - RNA, 24 nt, Human
cagacacugucuagcagcugaugc

SEQ ID NO: 734932 - RNA, 20 nt, Human
cagacuccuucacaccaccc

SEQ ID NO: 734933 - RNA, 26 nt, Human
cagacucuacuucugaagccacaugu

SEQ ID NO: 734934 - RNA, 21 nt, Human
cagagcaagacccugucuccc

SEQ ID NO: 734935 - RNA, 23 nt, Human
cagagggagccaggcugccaggu

SEQ ID NO: 734936 - RNA, 22 nt, Human
cagaguucaguccagaggccau

SEQ ID NO: 734937 - RNA, 23 nt, Human
cagcaauguaguccccaaaguac

SEQ ID NO: 734938 - RNA, 21 nt, Human
cagcagcgggccuguggggag

SEQ ID NO: 734939 - RNA, 20 nt, Human
cagcauuugcagcccccacu

SEQ ID NO: 734940 - RNA, 24 nt, Human
cagcccccacugugggccaagucc

SEQ ID NO: 734941 - RNA, 22 nt, Human
cagccuauggggaacgaggcaa

SEQ ID NO: 734942 - RNA, 18 nt, Human
cagcucccaucccacugc

SEQ ID NO: 734943 - RNA, 20 nt, Human
caugucuguaauccuagcac

SEQ ID NO: 734944 - RNA, 24 nt, Human
caugucuguaauccuagcacuuug

SEQ ID NO: 734945 - RNA, 21 nt, Human
ccaaacggcaggaaccuacau

SEQ ID NO: 734946 - RNA, 21 nt, Human
ccaacagaaaccuggccaggc

SEQ ID NO: 734947 - RNA, 20 nt, Human
ccaaccaggcacuccccucc

SEQ ID NO: 734948 - RNA, 22 nt, Human
ccaacuggcauccccaaaguca

SEQ ID NO: 734949 - RNA, 21 nt, Human
ccacccagaacuagggaaacu

SEQ ID NO: 734950 - RNA, 21 nt, Human
ccacucacaaggcagggagug

SEQ ID NO: 734951 - RNA, 24 nt, Human
ccacuguguuccagucugggugac

SEQ ID NO: 734952 - RNA, 21 nt, Human
ccagaggccagaagagaugcu

SEQ ID NO: 734953 - RNA, 18 nt, Human
ccagcagugguggcucac

SEQ ID NO: 734954 - RNA, 23 nt, Human
ccagggauggagggcaaagggca

SEQ ID NO: 734955 - RNA, 22 nt, Human
cccacagacuccuucacaccac

SEQ ID NO: 734956 - RNA, 28 nt, Human
cccacagacuccuucacaccaccccaaa

SEQ ID NO: 734957 - RNA, 19 nt, Human
ccccaaaaaaagaaaccug

SEQ ID NO: 734958 - RNA, 22 nt, Human
ccccaaaggccccagaguucag

SEQ ID NO: 734959 - RNA, 23 nt, Human
ccccagaguucaguccagaggcc

SEQ ID NO: 734960 - RNA, 18 nt, Human
cccccaaaaaaagaaacc

SEQ ID NO: 734961 - RNA, 22 nt, Human
cccccaaaaaaagaaaccugag

SEQ ID NO: 734962 - RNA, 25 nt, Human
cccucagccccgauuaucagaacuc

SEQ ID NO: 734963 - RNA, 20 nt, Human
cccuccucaccaccugggcc

SEQ ID NO: 734964 - RNA, 20 nt, Human
ccgcaccagcagacuccaac

SEQ ID NO: 734965 - RNA, 18 nt, Human
ccgcaguaauccuugcuc

SEQ ID NO: 734966 - RNA, 24 nt, Human
ccuggccaggcguaguggcucaug

SEQ ID NO: 734967 - RNA, 22 nt, Human
ccugggcaacauggcgagaccc

SEQ ID NO: 734968 - RNA, 19 nt, Human
ccugucucccccaaaaaaa

SEQ ID NO: 734969 - RNA, 21 nt, Human
ccuguggucccagcuacuugg

SEQ ID NO: 734970 - RNA, 18 nt, Human
ccuuccccucuuucuuga

SEQ ID NO: 734971 - RNA, 24 nt, Human
cgaagcuuccaucuguuuucuagg

SEQ ID NO: 734972 - RNA, 23 nt, Human
cgccuguggucccagcuacuugg

SEQ ID NO: 734973 - RNA, 24 nt, Human
cgccuguggucccagcuacuuggg

SEQ ID NO: 734974 - RNA, 23 nt, Human
cuacccaccaacuggcaucccca

SEQ ID NO: 734975 - RNA, 20 nt, Human
cuagcacuuugggaggccca

SEQ ID NO: 734976 - RNA, 20 nt, Human
cuaggcccaauuuaauaaca

SEQ ID NO: 734977 - RNA, 26 nt, Human
cucaccaccugggccaugagcucugg

SEQ ID NO: 734978 - RNA, 24 nt, Human
cucacgccuguggucccagcuacu

SEQ ID NO: 734979 - RNA, 25 nt, Human
cucacgccuguggucccagcuacuu

SEQ ID NO: 734980 - RNA, 22 nt, Human
cucagcccaggccuccagagga

SEQ ID NO: 734981 - RNA, 24 nt, Human
cucaugucuguaauccuagcacuu

SEQ ID NO: 734982 - RNA, 21 nt, Human
cucccaagccccaucccacag

SEQ ID NO: 734983 - RNA, 22 nt, Human
cucccaagccccaucccacagc

SEQ ID NO: 734984 - RNA, 20 nt, Human
cuccugccucuguacauggc

SEQ ID NO: 734985 - RNA, 25 nt, Human
cuccuucacaccaccccaaaggccc

SEQ ID NO: 734986 - RNA, 19 nt, Human
cugaccauggguggaagca

SEQ ID NO: 734987 - RNA, 19 nt, Human
cugcgggaggugaggcagc

SEQ ID NO: 734988 - RNA, 18 nt, Human
cugcugcaaacgcaggaa

SEQ ID NO: 734989 - RNA, 23 nt, Human
cugcugccaaggggauauucagu

SEQ ID NO: 734990 - RNA, 19 nt, Human
cugggugacagagcaagac

SEQ ID NO: 734991 - RNA, 21 nt, Human
cuguaauccuagcacuuuggg

SEQ ID NO: 734992 - RNA, 21 nt, Human
cugucugucugacuggauuuc

SEQ ID NO: 734993 - RNA, 20 nt, Human
cuucccucccuccuuugguc

SEQ ID NO: 734994 - RNA, 23 nt, Human
cuuucagacucuacuucugaagc

SEQ ID NO: 734995 - RNA, 20 nt, Human
gacagcccugccuggugugu

SEQ ID NO: 734996 - RNA, 19 nt, Human
gacccugccacccagaacu

SEQ ID NO: 734997 - RNA, 24 nt, Human
gagcccgcagagguugcagugagc

SEQ ID NO: 734998 - RNA, 18 nt, Human
gagcugacaacugacaag

SEQ ID NO: 734999 - RNA, 26 nt, Human
gagggaggccugucugcuacagagga

SEQ ID NO: 735000 - RNA, 18 nt, Human
gagguugcagugagccaa

SEQ ID NO: 735001 - RNA, 22 nt, Human
gcagagguugcagugagccaag

SEQ ID NO: 735002 - RNA, 21 nt, Human
gcagcagcgggccugugggga

SEQ ID NO: 735003 - RNA, 19 nt, Human
gcaggaggauugcgugagc

SEQ ID NO: 735004 - RNA, 21 nt, Human
gccaaggggauauucagugcc

SEQ ID NO: 735005 - RNA, 26 nt, Human
gccacuggguggagggggaaccccag

SEQ ID NO: 735006 - RNA, 24 nt, Human
gccacuguguuccagucuggguga

SEQ ID NO: 735007 - RNA, 23 nt, Human
gcccuucucaccauucuccuucc

SEQ ID NO: 735008 - RNA, 19 nt, Human
gccuaagucccaccagccc

SEQ ID NO: 735009 - RNA, 22 nt, Human
gcgggccuguggggagggaggc

SEQ ID NO: 735010 - RNA, 19 nt, Human
ggacccugccacccagaac

SEQ ID NO: 735011 - RNA, 22 nt, Human
ggaggccugucugcuacagagg

SEQ ID NO: 735012 - RNA, 18 nt, Human
ggagggcaaagggcaagc

SEQ ID NO: 735013 - RNA, 23 nt, Human
ggcaggaggauugcgugagcccg

SEQ ID NO: 735014 - RNA, 22 nt, Human
ggcaguggcagcauuugcagcc

SEQ ID NO: 735015 - RNA, 18 nt, Human
ggccauaagggcagcagc

SEQ ID NO: 735016 - RNA, 22 nt, Human
ggccccaucucugccagugugg

SEQ ID NO: 735017 - RNA, 23 nt, Human
ggccuguggggagggaggccugu

SEQ ID NO: 735018 - RNA, 23 nt, Human
gggcggcagcagagccacgggca

SEQ ID NO: 735019 - RNA, 23 nt, Human
ggguggagggggaaccccagcag

SEQ ID NO: 735020 - RNA, 18 nt, Human
gguaaaggaaaugacaca

SEQ ID NO: 735021 - RNA, 24 nt, Human
ggugcugggcguggccacugggug

SEQ ID NO: 735022 - RNA, 24 nt, Human
gguggcucacgccuguggucccag

SEQ ID NO: 735023 - RNA, 19 nt, Human
guggcagacagcccugccu

SEQ ID NO: 735024 - RNA, 23 nt, Human
guggcucacgccuguggucccag

SEQ ID NO: 735025 - RNA, 24 nt, Human
guguuccagucugggugacagagc

SEQ ID NO: 735026 - RNA, 22 nt, Human
guuaccaagaaacaaguggcac

SEQ ID NO: 735027 - RNA, 23 nt, Human
guucccaggacggaaaagccuua

SEQ ID NO: 735028 - RNA, 22 nt, Human
uaaacacacacccgccacccca

SEQ ID NO: 735029 - RNA, 22 nt, Human
uaaacacuuccagcagaaacuc

SEQ ID NO: 735030 - RNA, 19 nt, Human
uaacaugcugcuugucucc

SEQ ID NO: 735031 - RNA, 21 nt, Human
uaagggcagcagccuaugggg

SEQ ID NO: 735032 - RNA, 18 nt, Human
uacuccuggauggagccg

SEQ ID NO: 735033 - RNA, 26 nt, Human
uagaggccgcagcagcgggccugugg

SEQ ID NO: 735034 - RNA, 22 nt, Human
uagcacaggauaccaagagcac

SEQ ID NO: 735035 - RNA, 18 nt, Human
uagcacuucccucccucc

SEQ ID NO: 735036 - RNA, 24 nt, Human
uagcacuuugggaggcccaggugg

SEQ ID NO: 735037 - RNA, 22 nt, Human
uaguggcucaugucuguaaucc

SEQ ID NO: 735038 - RNA, 23 nt, Human
uaucuaacugccauucugcccac

SEQ ID NO: 735039 - RNA, 23 nt, Human
ucacaccaccccaaaggccccag

SEQ ID NO: 735040 - RNA, 22 nt, Human
ucacuuggggauggacaguguc

SEQ ID NO: 735041 - RNA, 20 nt, Human
ucagaacucuagcccgaggc

SEQ ID NO: 735042 - RNA, 21 nt, Human
ucaggacagccagggauggag

SEQ ID NO: 735043 - RNA, 27 nt, Human
ucagugccauuuugccaccugcaacgu

SEQ ID NO: 735044 - RNA, 22 nt, Human
uccaacagaaaccuggccaggc

SEQ ID NO: 735045 - RNA, 24 nt, Human
uccaacagaaaccuggccaggcgu

SEQ ID NO: 735046 - RNA, 19 nt, Human
uccagagcuuuguuuuggg

SEQ ID NO: 735047 - RNA, 19 nt, Human
uccagucugggugacagag

SEQ ID NO: 735048 - RNA, 24 nt, Human
uccagucugggugacagagcaaga

SEQ ID NO: 735049 - RNA, 22 nt, Human
uccaugccugggcuucucuaga

SEQ ID NO: 735050 - RNA, 26 nt, Human
ucccaagccccaucccacagcuugug

SEQ ID NO: 735051 - RNA, 19 nt, Human
ucccagacugacaguuccc

SEQ ID NO: 735052 - RNA, 21 nt, Human
ucccagacugacaguucccag

SEQ ID NO: 735053 - RNA, 22 nt, Human
ucccuucucucucuuaaauagg

SEQ ID NO: 735054 - RNA, 24 nt, Human
ucuaggacaagggaaaccauucug

SEQ ID NO: 735055 - RNA, 22 nt, Human
ucucuacaaaaaaaaaaaaaaa

SEQ ID NO: 735056 - RNA, 25 nt, Human
ucucuacccaccaacuggcaucccc

SEQ ID NO: 735057 - RNA, 21 nt, Human
ucucugcugcaaacgcaggaa

SEQ ID NO: 735058 - RNA, 20 nt, Human
ucugaagccacaugucacuu

SEQ ID NO: 735059 - RNA, 22 nt, Human
ucugcaccauaugacccagagg

SEQ ID NO: 735060 - RNA, 21 nt, Human
ucuguacauggcaaugugagg

SEQ ID NO: 735061 - RNA, 22 nt, Human
ucuugggcagaaguaggagaaa

SEQ ID NO: 735062 - RNA, 21 nt, Human
ugaaauucaaacuccaaagga

SEQ ID NO: 735063 - RNA, 21 nt, Human
ugacaacaaaacaaggaucaa

SEQ ID NO: 735064 - RNA, 24 nt, Human
ugacacacauucccccaauuugga

SEQ ID NO: 735065 - RNA, 22 nt, Human
ugacagagcaagacccugucuc

SEQ ID NO: 735066 - RNA, 18 nt, Human
ugaccacgucaccagccc

SEQ ID NO: 735067 - RNA, 18 nt, Human
ugaccacgucaccagccc

SEQ ID NO: 735068 - RNA, 23 nt, Human
ugagaaagaauuucucagugcuu

SEQ ID NO: 735069 - RNA, 21 nt, Human
ugagaacaacgaagcuuccaa

SEQ ID NO: 735070 - RNA, 21 nt, Human
ugagaacaacgaagcuuccag

SEQ ID NO: 735071 - RNA, 20 nt, Human
ugagacagaagagagaggcu

SEQ ID NO: 735072 - RNA, 23 nt, Human
ugagccaagaucgugccacugug

SEQ ID NO: 735073 - RNA, 18 nt, Human
ugaugagaaccagcacug

SEQ ID NO: 735074 - RNA, 22 nt, Human
ugauuuuuuuccuucagcaaug

SEQ ID NO: 735075 - RNA, 18 nt, Human
ugcaauaaguguggcggc

SEQ ID NO: 735076 - RNA, 22 nt, Human
ugccuaggcccaauuuaauaac

SEQ ID NO: 735077 - RNA, 18 nt, Human
ugccuccugggguacccu

SEQ ID NO: 735078 - RNA, 19 nt, Human
ugccuggaaggaaggggug

SEQ ID NO: 735079 - RNA, 21 nt, Human
ugccuggugcuggucacaguc

SEQ ID NO: 735080 - RNA, 18 nt, Human
uggaaaggcagacacugu

SEQ ID NO: 735081 - RNA, 19 nt, Human
uggaaaggcagacacuguc

SEQ ID NO: 735082 - RNA, 22 nt, Human
uggaaaugagggcuaccugucc

SEQ ID NO: 735083 - RNA, 22 nt, Human
uggaaggaagggguggccccau

SEQ ID NO: 735084 - RNA, 20 nt, Human
uggagggcaaagggcaagcu

SEQ ID NO: 735085 - RNA, 25 nt, Human
uggagggcaaagggcaagcuguggg

SEQ ID NO: 735086 - RNA, 19 nt, Human
uggcagaacccuaauugac

SEQ ID NO: 735087 - RNA, 24 nt, Human
uggcaggaggauugcgugagcccg

SEQ ID NO: 735088 - RNA, 22 nt, Human
uggccaggcguaguggcucaug

SEQ ID NO: 735089 - RNA, 18 nt, Human
uggccggagcuggcgcuc

SEQ ID NO: 735090 - RNA, 19 nt, Human
uggccuaagucccaccagc

SEQ ID NO: 735091 - RNA, 21 nt, Human
uggcucacgccugugguccca

SEQ ID NO: 735092 - RNA, 22 nt, Human
uggcucacgccuguggucccag

SEQ ID NO: 735093 - RNA, 24 nt, Human
uggcucacgccuguggucccagcu

SEQ ID NO: 735094 - RNA, 24 nt, Human
uggcucaugucuguaauccuagca

SEQ ID NO: 735095 - RNA, 18 nt, Human
uggcuucugaggccgacu

SEQ ID NO: 735096 - RNA, 22 nt, Human
ugggaagcuguggcaggaggau

SEQ ID NO: 735097 - RNA, 18 nt, Human
ugggagaacugcuugagc

SEQ ID NO: 735098 - RNA, 19 nt, Human
ugggagcagaggucuggaa

SEQ ID NO: 735099 - RNA, 19 nt, Human
ugggauccaaccaggcacu

SEQ ID NO: 735100 - RNA, 24 nt, Human
ugggcagaaguaggagaaaaggau

SEQ ID NO: 735101 - RNA, 19 nt, Human
uggggauggacagugucau

SEQ ID NO: 735102 - RNA, 24 nt, Human
ugguggcucacgccugugguccca

SEQ ID NO: 735103 - RNA, 23 nt, Human
uguaaacaccgcaccagcagacu

SEQ ID NO: 735104 - RNA, 19 nt, Human
ugucccaggcuggccggag

SEQ ID NO: 735105 - RNA, 23 nt, Human
ugucccaggcuggccggagcugg

SEQ ID NO: 735106 - RNA, 23 nt, Human
ugucuguaauccuagcacuuugg

SEQ ID NO: 735107 - RNA, 23 nt, Human
ugucuguaauccuagcacuuugg

SEQ ID NO: 735108 - RNA, 19 nt, Human
ugugccuggaaggaagggg

SEQ ID NO: 735109 - RNA, 20 nt, Human
uguggaaaccgucggggcug

SEQ ID NO: 735110 - RNA, 24 nt, Human
uguggcaggaggauugcgugagcc

SEQ ID NO: 735111 - RNA, 20 nt, Human
uguuaccaagaaacaagugg

SEQ ID NO: 735112 - RNA, 23 nt, Human
uuaaaggaaggggaugaagauga

SEQ ID NO: 735113 - RNA, 21 nt, Human
uuaaauggccagaggcaguga

SEQ ID NO: 735114 - RNA, 21 nt, Human
uuaccaagaaacaaguggcac

SEQ ID NO: 735115 - RNA, 19 nt, Human
uuacuccuggauggagccg

SEQ ID NO: 735116 - RNA, 23 nt, Human
uuaucaggcauggaaaugagggc

SEQ ID NO: 735117 - RNA, 24 nt, Human
uucauaacaaugcaacagaguaag

SEQ ID NO: 735118 - RNA, 23 nt, Human
uuccaugacucuuguuuguuacc

SEQ ID NO: 735119 - RNA, 20 nt, Human
uucucauccacuggacuugg

SEQ ID NO: 735120 - RNA, 21 nt, Human
uucuggucaguuuuuggcuuc

SEQ ID NO: 735121 - RNA, 22 nt, Human
uugcagugagccaagaucgugc

SEQ ID NO: 735122 - RNA, 23 nt, Human
uugguuggugcuaagcuaagaug

SEQ ID NO: 735123 - RNA, 21 nt, Human
uuugauuaaaggaaggggaug

SEQ ID NO: 735124 - RNA, 25 nt, Human
aaaaaauaaagcaacaaccuccucc

SEQ ID NO: 735125 - RNA, 22 nt, Human
aaaauaaacagcuccaugugaa

SEQ ID NO: 735126 - RNA, 24 nt, Human
aaaccauacacaacacuccagagc

SEQ ID NO: 735127 - RNA, 22 nt, Human
aaagcaacaaccuccuccacac

SEQ ID NO: 735128 - RNA, 24 nt, Human
aaauaacugugaggcaucaauuuc

SEQ ID NO: 735129 - RNA, 20 nt, Human
aaauagaacccaacagcacu

SEQ ID NO: 735130 - RNA, 18 nt, Human
aaccccauguccaccucu

SEQ ID NO: 735131 - RNA, 23 nt, Human
aagacagcucgccaauugucucc

SEQ ID NO: 735132 - RNA, 21 nt, Human
aagcucccuucaggccaacag

SEQ ID NO: 735133 - RNA, 22 nt, Human
aagggaaaacacaggccacacc

SEQ ID NO: 735134 - RNA, 24 nt, Human
acacaacacuccagagccuuaaaa

SEQ ID NO: 735135 - RNA, 22 nt, Human
acacaggccacacccaccuggc

SEQ ID NO: 735136 - RNA, 21 nt, Human
accuucucuggagaaaauaac

SEQ ID NO: 735137 - RNA, 18 nt, Human
agaaagaacagaagggaa

SEQ ID NO: 735138 - RNA, 21 nt, Human
agaagggaaaacacaggccac

SEQ ID NO: 735139 - RNA, 19 nt, Human
agaagggggcaggagcugc

SEQ ID NO: 735140 - RNA, 19 nt, Human
agaagggggcaggagcugc

SEQ ID NO: 735141 - RNA, 21 nt, Human
agaaguguggccagcuggggg

SEQ ID NO: 735142 - RNA, 21 nt, Human
agacggauaaaagagaggcca

SEQ ID NO: 735143 - RNA, 19 nt, Human
agagagaggauggggcagg

SEQ ID NO: 735144 - RNA, 20 nt, Human
agaguccuuuccguuucccu

SEQ ID NO: 735145 - RNA, 21 nt, Human
agccuuaaaaaaauaaagcaa

SEQ ID NO: 735146 - RNA, 18 nt, Human
agcuggcuugagaagccu

SEQ ID NO: 735147 - RNA, 19 nt, Human
aggaaaguugaggcagagc

SEQ ID NO: 735148 - RNA, 23 nt, Human
aggaacaaauaaauaaauaaaua

SEQ ID NO: 735149 - RNA, 19 nt, Human
aggaaggugcacaacagcu

SEQ ID NO: 735150 - RNA, 19 nt, Human
aggcagaaagaacagaagg

SEQ ID NO: 735151 - RNA, 20 nt, Human
agggaggagggguggggugg

SEQ ID NO: 735152 - RNA, 22 nt, Human
agggggcaggagcugcuggaau

SEQ ID NO: 735153 - RNA, 22 nt, Human
aggugcccgaaggcuagggacc

SEQ ID NO: 735154 - RNA, 20 nt, Human
auaaagcaacaaccuccucc

SEQ ID NO: 735155 - RNA, 23 nt, Human
auaaagcaacaaccuccuccaca

SEQ ID NO: 735156 - RNA, 19 nt, Human
auacacaacacuccagagc

SEQ ID NO: 735157 - RNA, 20 nt, Human
auccaaccccauguccaccu

SEQ ID NO: 735158 - RNA, 20 nt, Human
auucuggugagcuccuuagu

SEQ ID NO: 735159 - RNA, 22 nt, Human
caaaacaauccaaccccauguc

SEQ ID NO: 735160 - RNA, 24 nt, Human
caacacuccagagccuuaaaaaaa

SEQ ID NO: 735161 - RNA, 19 nt, Human
cacucuccagccuucaucc

SEQ ID NO: 735162 - RNA, 24 nt, Human
cacucuccagccuucauccucacc

SEQ ID NO: 735163 - RNA, 18 nt, Human
cacuuggccacaggugcc

SEQ ID NO: 735164 - RNA, 24 nt, Human
cagagaagggggcaggagcugcug

SEQ ID NO: 735165 - RNA, 23 nt, Human
cagagcccagccccagaaggagg

SEQ ID NO: 735166 - RNA, 20 nt, Human
cagagccuuaaaaaaauaaa

SEQ ID NO: 735167 - RNA, 22 nt, Human
cagcacucucagaggccuaagg

SEQ ID NO: 735168 - RNA, 19 nt, Human
cagcagagccuccucccuc

SEQ ID NO: 735169 - RNA, 22 nt, Human
cagcucuacagggaggaggggu

SEQ ID NO: 735170 - RNA, 18 nt, Human
cccucuccuccuauucuu

SEQ ID NO: 735171 - RNA, 25 nt, Human
ccuagcccagacccugcaccgguuc

SEQ ID NO: 735172 - RNA, 23 nt, Human
ccucaccaucuccaccagaggaa

SEQ ID NO: 735173 - RNA, 22 nt, Human
ccucccaucccggcuguagggc

SEQ ID NO: 735174 - RNA, 22 nt, Human
ccugcaccuucucuggagaaaa

SEQ ID NO: 735175 - RNA, 18 nt, Human
cucaccaucuccaccaga

SEQ ID NO: 735176 - RNA, 20 nt, Human
cucacucuccagccuucauc

SEQ ID NO: 735177 - RNA, 18 nt, Human
cucaggggggcccugggg

SEQ ID NO: 735178 - RNA, 18 nt, Human
cucugcggccagcagagc

SEQ ID NO: 735179 - RNA, 21 nt, Human
cucugcuccacuuggccacag

SEQ ID NO: 735180 - RNA, 23 nt, Human
cugacagcugcuggauuuucugc

SEQ ID NO: 735181 - RNA, 22 nt, Human
cuggacacacaaagaaguccaa

SEQ ID NO: 735182 - RNA, 19 nt, Human
cuggcccuggaggugcccg

SEQ ID NO: 735183 - RNA, 22 nt, Human
cuggccugcagagcccagcccc

SEQ ID NO: 735184 - RNA, 23 nt, Human
cuggcuugagaagccugagccug

SEQ ID NO: 735185 - RNA, 20 nt, Human
cuucugguucuagcugcugg

SEQ ID NO: 735186 - RNA, 19 nt, Human
gacacugggggcacgggua

SEQ ID NO: 735187 - RNA, 22 nt, Human
gagaagccugagccugcagucc

SEQ ID NO: 735188 - RNA, 21 nt, Human
gagaggccacgugccucccau

SEQ ID NO: 735189 - RNA, 21 nt, Human
gagcacaggguugguguggcu

SEQ ID NO: 735190 - RNA, 21 nt, Human
gaggaggggugggguggggau

SEQ ID NO: 735191 - RNA, 21 nt, Human
gaggcaucaauuuccaaggca

SEQ ID NO: 735192 - RNA, 22 nt, Human
gaggugcccgaaggcuagggac

SEQ ID NO: 735193 - RNA, 26 nt, Human
gcccagccccagaaggaggggaacgc

SEQ ID NO: 735194 - RNA, 23 nt, Human
gccuucauccucaccaucuccac

SEQ ID NO: 735195 - RNA, 21 nt, Human
ggacacacaaagaaguccaag

SEQ ID NO: 735196 - RNA, 20 nt, Human
ggagaaggugucagacagaa

SEQ ID NO: 735197 - RNA, 22 nt, Human
ggaggggugggguggggaugcu

SEQ ID NO: 735198 - RNA, 22 nt, Human
ggauggggcaggaccucuccug

SEQ ID NO: 735199 - RNA, 18 nt, Human
ggccaaacuggacacaca

SEQ ID NO: 735200 - RNA, 18 nt, Human
ggccacacccaccuggcc

SEQ ID NO: 735201 - RNA, 21 nt, Human
ggcccuggaggugcccgaagg

SEQ ID NO: 735202 - RNA, 19 nt, Human
uaagggcuuagggugaggc

SEQ ID NO: 735203 - RNA, 22 nt, Human
uaaucaaaacaauccaacccca

SEQ ID NO: 735204 - RNA, 22 nt, Human
uacaaaauaaauagacggauaa

SEQ ID NO: 735205 - RNA, 23 nt, Human
uacaggcagaaagaacagaaggg

SEQ ID NO: 735206 - RNA, 21 nt, Human
uaggaaaguugaggcagagcc

SEQ ID NO: 735207 - RNA, 19 nt, Human
uccaaaggcuaaauggaau

SEQ ID NO: 735208 - RNA, 18 nt, Human
uccaaccccauguccacc

SEQ ID NO: 735209 - RNA, 22 nt, Human
uccaagaaauccccucucuucu

SEQ ID NO: 735210 - RNA, 18 nt, Human
ucccacuucucccagcca

SEQ ID NO: 735211 - RNA, 20 nt, Human
ucccuguguucucugcggcc

SEQ ID NO: 735212 - RNA, 22 nt, Human
uccuggagaaguguggccagcu

SEQ ID NO: 735213 - RNA, 26 nt, Human
ucuccagccuucauccucaccaucuc

SEQ ID NO: 735214 - RNA, 21 nt, Human
ucucugcggccagcagagccu

SEQ ID NO: 735215 - RNA, 22 nt, Human
ucuuucggcuucugguucuagc

SEQ ID NO: 735216 - RNA, 23 nt, Human
ugaaaagaaaccauacacaacac

SEQ ID NO: 735217 - RNA, 24 nt, Human
ugaaaagaaaccauacacaacacu

SEQ ID NO: 735218 - RNA, 25 nt, Human
ugaggcagagcccucuccuccuauu

SEQ ID NO: 735219 - RNA, 21 nt, Human
ugcaacagaguccuuuccguu

SEQ ID NO: 735220 - RNA, 19 nt, Human
uggaauggacaguuugggc

SEQ ID NO: 735221 - RNA, 24 nt, Human
uggaauggacaguuugggcaggag

SEQ ID NO: 735222 - RNA, 24 nt, Human
uggacacacaaagaaguccaaggg

SEQ ID NO: 735223 - RNA, 21 nt, Human
uggacaguuugggcaggaggc

SEQ ID NO: 735224 - RNA, 21 nt, Human
uggauuuucugcgcucugacu

SEQ ID NO: 735225 - RNA, 21 nt, Human
ugggaugugaaaagaaaccau

SEQ ID NO: 735226 - RNA, 22 nt, Human
ugggcaggaggccaaacuggac

SEQ ID NO: 735227 - RNA, 18 nt, Human
uggguggcucggucccac

SEQ ID NO: 735228 - RNA, 22 nt, Human
ugugaaaagaaaccauacacaa

SEQ ID NO: 735229 - RNA, 19 nt, Human
uguggcaguuccggcaaag

SEQ ID NO: 735230 - RNA, 21 nt, Human
uuccaaggcaucuaaguuccu

SEQ ID NO: 735231 - RNA, 23 nt, Human
uuccugacucugagcugcucagg

SEQ ID NO: 735232 - RNA, 20 nt, Human
uugggcaggaggccaaacug

SEQ ID NO: 735233 - RNA, 20 nt, Human
aaaaaaagaaccaagauagu

SEQ ID NO: 735234 - RNA, 20 nt, Human
aaaaaagaaccaagauagug

SEQ ID NO: 735235 - RNA, 18 nt, Human
aaaaagcuucccucaagg

SEQ ID NO: 735236 - RNA, 22 nt, Human
aaagaaccaagauaguguccau

SEQ ID NO: 735237 - RNA, 21 nt, Human
aaauaaacuaagacgccgcuc

SEQ ID NO: 735238 - RNA, 22 nt, Human
aagcaggaaaagaaugucccaa

SEQ ID NO: 735239 - RNA, 21 nt, Human
aaggaaacaguuguuuaaaag

SEQ ID NO: 735240 - RNA, 21 nt, Human
aauauugauagaaagagccuu

SEQ ID NO: 735241 - RNA, 23 nt, Human
acguauguaugugcauauaugca

SEQ ID NO: 735242 - RNA, 19 nt, Human
acucaggagguugaacagu

SEQ ID NO: 735243 - RNA, 26 nt, Human
agacaugcuuuuccaguuacaagcuc

SEQ ID NO: 735244 - RNA, 19 nt, Human
agagagcagauaaagcaau

SEQ ID NO: 735245 - RNA, 24 nt, Human
auagaacaggucugguuaguacaa

SEQ ID NO: 735246 - RNA, 18 nt, Human
auccaugcaaauguagga

SEQ ID NO: 735247 - RNA, 26 nt, Human
caaagagaacugaaaacauguauaac

SEQ ID NO: 735248 - RNA, 23 nt, Human
caaugcaugcauccauccaugca

SEQ ID NO: 735249 - RNA, 18 nt, Human
cagacauuccagacaaag

SEQ ID NO: 735250 - RNA, 25 nt, Human
caucccgcaagucgaguccccuacu

SEQ ID NO: 735251 - RNA, 25 nt, Human
caucugaucaaugaucacauggugg

SEQ ID NO: 735252 - RNA, 18 nt, Human
cauguauaacagcugggu

SEQ ID NO: 735253 - RNA, 19 nt, Human
cauguugcucacaguaucc

SEQ ID NO: 735254 - RNA, 20 nt, Human
cccccaaagagaacugaaaa

SEQ ID NO: 735255 - RNA, 21 nt, Human
cgccgcucuaaaaaguggaga

SEQ ID NO: 735256 - RNA, 23 nt, Human
cuaauauuaaaaagcuucccuca

SEQ ID NO: 735257 - RNA, 24 nt, Human
cucacaguauccugauaugcauaa

SEQ ID NO: 735258 - RNA, 19 nt, Human
cuccagaaaugaaauaauc

SEQ ID NO: 735259 - RNA, 23 nt, Human
cugcuuaagcuacuaagcugugu

SEQ ID NO: 735260 - RNA, 24 nt, Human
gaguccccuacucacucaccacau

SEQ ID NO: 735261 - RNA, 21 nt, Human
gcacagaaaaaaguuaacucc

SEQ ID NO: 735262 - RNA, 24 nt, Human
gcuacuaagcugugucuuccucug

SEQ ID NO: 735263 - RNA, 22 nt, Human
ggacaccauguugcucacagua

SEQ ID NO: 735264 - RNA, 18 nt, Human
ggacaguuuucuauauua

SEQ ID NO: 735265 - RNA, 20 nt, Human
guacaauuuuccucaaugaa

SEQ ID NO: 735266 - RNA, 18 nt, Human
guauguaugugcauauau

SEQ ID NO: 735267 - RNA, 19 nt, Human
guggugagcaaagaggagu

SEQ ID NO: 735268 - RNA, 18 nt, Human
guguaccugaacccuaca

SEQ ID NO: 735269 - RNA, 21 nt, Human
uaagggacaccauguugcuca

SEQ ID NO: 735270 - RNA, 20 nt, Human
uacaagcucaaaauaggagu

SEQ ID NO: 735271 - RNA, 21 nt, Human
uagaaaaagcuucauuuggug

SEQ ID NO: 735272 - RNA, 21 nt, Human
uagaggcaagcuguugcggug

SEQ ID NO: 735273 - RNA, 21 nt, Human
uaggguaaggaaagcuugaaa

SEQ ID NO: 735274 - RNA, 23 nt, Human
uauacaacuggggaaaauaacca

SEQ ID NO: 735275 - RNA, 22 nt, Human
uauuaaaaagcuucccucaagg

SEQ ID NO: 735276 - RNA, 25 nt, Human
ucacucaccacaucugaucaaugau

SEQ ID NO: 735277 - RNA, 23 nt, Human
ucccaacaaaccaugaaacacuu

SEQ ID NO: 735278 - RNA, 19 nt, Human
ucccgcaagucgagucccc

SEQ ID NO: 735279 - RNA, 23 nt, Human
uccuccagaaaugaaauaaucaa

SEQ ID NO: 735280 - RNA, 23 nt, Human
ugcaaaguaaaaagauucugugc

SEQ ID NO: 735281 - RNA, 21 nt, Human
ugcacagaaaaaaguuaacuc

SEQ ID NO: 735282 - RNA, 21 nt, Human
ugccuuagccaguguaccuga

SEQ ID NO: 735283 - RNA, 18 nt, Human
uggacggauaaaaaaggu

SEQ ID NO: 735284 - RNA, 20 nt, Human
uggauagaaaaagcuucauu

SEQ ID NO: 735285 - RNA, 19 nt, Human
ugguggugagcaaagagga

SEQ ID NO: 735286 - RNA, 22 nt, Human
ugguggugagcaaagaggagua

SEQ ID NO: 735287 - RNA, 23 nt, Human
ugucuuccucuggaacuagaacc

SEQ ID NO: 735288 - RNA, 22 nt, Human
uucaacauuaucugcacagaaa

SEQ ID NO: 735289 - RNA, 19 nt, Human
uugcucacaguauccugau

SEQ ID NO: 735290 - RNA, 19 nt, Human
uuuaauagucucuuguucc

SEQ ID NO: 735291 - RNA, 19 nt, Human
uuuucagacauuccagaca

SEQ ID NO: 735292 - RNA, 20 nt, Human
aaaaauaagugagugacuca

SEQ ID NO: 735293 - RNA, 22 nt, Human
aacaucaaagguaagaaacaaa

SEQ ID NO: 735294 - RNA, 19 nt, Human
aacaucugagccagaagcc

SEQ ID NO: 735295 - RNA, 19 nt, Human
aaccggaagaaccaucccg

SEQ ID NO: 735296 - RNA, 19 nt, Human
aagaaccaucccgggagcc

SEQ ID NO: 735297 - RNA, 21 nt, Human
aagaguggagucaaacaggaa

SEQ ID NO: 735298 - RNA, 20 nt, Human
aagauugcuugagcccagga

SEQ ID NO: 735299 - RNA, 24 nt, Human
aagcaagaauugcuccgcagcagc

SEQ ID NO: 735300 - RNA, 20 nt, Human
aagcauuuucagaggaagag

SEQ ID NO: 735301 - RNA, 23 nt, Human
aagcccaaagucagugacaacag

SEQ ID NO: 735302 - RNA, 22 nt, Human
aagugggucaguucuucagccu

SEQ ID NO: 735303 - RNA, 19 nt, Human
aauugcuccgcagcagcag

SEQ ID NO: 735304 - RNA, 24 nt, Human
acauaaccaugaugauuuacauac

SEQ ID NO: 735305 - RNA, 20 nt, Human
accggggcguuucugggguc

SEQ ID NO: 735306 - RNA, 20 nt, Human
acuacaguucauucaaacaa

SEQ ID NO: 735307 - RNA, 18 nt, Human
acugcacuccagcuuggg

SEQ ID NO: 735308 - RNA, 22 nt, Human
acugcacuccagcuuggguaag

SEQ ID NO: 735309 - RNA, 24 nt, Human
acugcacuccagcuuggguaagag

SEQ ID NO: 735310 - RNA, 25 nt, Human
acuguucauaauauucuccauaauc

SEQ ID NO: 735311 - RNA, 24 nt, Human
acuugcagagagaguuuucuacug

SEQ ID NO: 735312 - RNA, 22 nt, Human
agaaaacaugaauauguucccc

SEQ ID NO: 735313 - RNA, 18 nt, Human
agaaagaaaaaaggcaga

SEQ ID NO: 735314 - RNA, 22 nt, Human
agacauugguacauccagauaa

SEQ ID NO: 735315 - RNA, 19 nt, Human
agaguggagucaaacagga

SEQ ID NO: 735316 - RNA, 20 nt, Human
agccuuagacagucagcagc

SEQ ID NO: 735317 - RNA, 24 nt, Human
agcuacuugggaggcugagguggg

SEQ ID NO: 735318 - RNA, 24 nt, Human
agcuuggguaagagagcaagacuc

SEQ ID NO: 735319 - RNA, 20 nt, Human
aggacaaccugauuuucaua

SEQ ID NO: 735320 - RNA, 28 nt, Human
aggcauauauuuccagaaggaaaccuuu

SEQ ID NO: 735321 - RNA, 24 nt, Human
aggcugaggugggaagauugcuug

SEQ ID NO: 735322 - RNA, 22 nt, Human
agguaaaaaauacagugcugga

SEQ ID NO: 735323 - RNA, 24 nt, Human
agguuaaguuauacauaaccauga

SEQ ID NO: 735324 - RNA, 22 nt, Human
aguaccaagaagcauuuucaga

SEQ ID NO: 735325 - RNA, 23 nt, Human
auaaagccuauaaaguauauacu

SEQ ID NO: 735326 - RNA, 24 nt, Human
auagcuacaagaguggaaaauaaa

SEQ ID NO: 735327 - RNA, 23 nt, Human
auauccagccugcaccacccacc

SEQ ID NO: 735328 - RNA, 24 nt, Human
aucaugucacugcacuccagcuug

SEQ ID NO: 735329 - RNA, 22 nt, Human
aucucuucccuugaucccccaa

SEQ ID NO: 735330 - RNA, 20 nt, Human
augaaaaugguguuaugcuc

SEQ ID NO: 735331 - RNA, 22 nt, Human
auucaggcaagucgggggaguc

SEQ ID NO: 735332 - RNA, 24 nt, Human
auucuguagucccagcuacuuggg

SEQ ID NO: 735333 - RNA, 19 nt, Human
auugcuugagcccaggagg

SEQ ID NO: 735334 - RNA, 27 nt, Human
caaaaaauaacuacaguucauucaaac

SEQ ID NO: 735335 - RNA, 19 nt, Human
caaagguaagaaacaaaaa

SEQ ID NO: 735336 - RNA, 24 nt, Human
caaagucagugacaacagaagucc

SEQ ID NO: 735337 - RNA, 19 nt, Human
caaaugacucuguacuccc

SEQ ID NO: 735338 - RNA, 23 nt, Human
caacgugaccagcgcgauucacc

SEQ ID NO: 735339 - RNA, 24 nt, Human
caagaucaugucacugcacuccag

SEQ ID NO: 735340 - RNA, 23 nt, Human
cacacauaccuaauggcacuaag

SEQ ID NO: 735341 - RNA, 20 nt, Human
caccaugccucuauggcaau

SEQ ID NO: 735342 - RNA, 23 nt, Human
caccucucccuuccuguaucuuc

SEQ ID NO: 735343 - RNA, 23 nt, Human
cacuccagcuuggguaagagagc

SEQ ID NO: 735344 - RNA, 24 nt, Human
cacugacugugccacagauaacau

SEQ ID NO: 735345 - RNA, 21 nt, Human
cacugaguuuucuauuugcaa

SEQ ID NO: 735346 - RNA, 19 nt, Human
cacugcacuccagcuuggg

SEQ ID NO: 735347 - RNA, 20 nt, Human
cacugcacuccagcuugggu

SEQ ID NO: 735348 - RNA, 21 nt, Human
cacugcacuccagcuugggua

SEQ ID NO: 735349 - RNA, 22 nt, Human
cacugcacuccagcuuggguaa

SEQ ID NO: 735350 - RNA, 22 nt, Human
cacugcacuccagcuuggguaa

SEQ ID NO: 735351 - RNA, 23 nt, Human
cacugcacuccagcuuggguaag

SEQ ID NO: 735352 - RNA, 22 nt, Human
cagaaccucucuucaaaggacu

SEQ ID NO: 735353 - RNA, 19 nt, Human
cagaggaagaguuccaucu

SEQ ID NO: 735354 - RNA, 18 nt, Human
cagaggacugcccaggug

SEQ ID NO: 735355 - RNA, 24 nt, Human
cagcagcaggaugcuuuuuagugg

SEQ ID NO: 735356 - RNA, 26 nt, Human
cagcagcaguaaaauugugcccacua

SEQ ID NO: 735357 - RNA, 19 nt, Human
cagcagcccaacagcgacu

SEQ ID NO: 735358 - RNA, 22 nt, Human
cagcagcccaacagcgacuggg

SEQ ID NO: 735359 - RNA, 24 nt, Human
cagcuacuugggaggcugaggugg

SEQ ID NO: 735360 - RNA, 24 nt, Human
cagcugaaaaacuguaaaaguuac

SEQ ID NO: 735361 - RNA, 21 nt, Human
cagcuggaucuucuugacuau

SEQ ID NO: 735362 - RNA, 22 nt, Human
cagucagccaagaucaugucac

SEQ ID NO: 735363 - RNA, 20 nt, Human
caugguaguggauguguggu

SEQ ID NO: 735364 - RNA, 21 nt, Human
cauuacaaaaccuucaagggg

SEQ ID NO: 735365 - RNA, 20 nt, Human
cauuuaccucaaacacagca

SEQ ID NO: 735366 - RNA, 20 nt, Human
ccaaaaccagaggacugccc

SEQ ID NO: 735367 - RNA, 18 nt, Human
ccaagaagccuuagacag

SEQ ID NO: 735368 - RNA, 19 nt, Human
ccagacccugcucccugcc

SEQ ID NO: 735369 - RNA, 21 nt, Human
ccaugguaguggauguguggu

SEQ ID NO: 735370 - RNA, 18 nt, Human
cccacgagcgacccucac

SEQ ID NO: 735371 - RNA, 24 nt, Human
cccacgagcgacccucaccaccau

SEQ ID NO: 735372 - RNA, 27 nt, Human
cccaggcgucucgggcuggggccgaac

SEQ ID NO: 735373 - RNA, 18 nt, Human
cccuugggaccccaggcg

SEQ ID NO: 735374 - RNA, 22 nt, Human
cccuugggaccccaggcgucuc

SEQ ID NO: 735375 - RNA, 21 nt, Human
ccgcagcagcccaacagcgac

SEQ ID NO: 735376 - RNA, 19 nt, Human
ccuccuacuuuccccucca

SEQ ID NO: 735377 - RNA, 22 nt, Human
ccugagaaggcccucaaaagac

SEQ ID NO: 735378 - RNA, 19 nt, Human
ccuguaucuucuguuguaa

SEQ ID NO: 735379 - RNA, 19 nt, Human
cgagaggaacccaaucugc

SEQ ID NO: 735380 - RNA, 18 nt, Human
cgagcgacccucaccacc

SEQ ID NO: 735381 - RNA, 20 nt, Human
cggaauuccaaagcacagcu

SEQ ID NO: 735382 - RNA, 23 nt, Human
cgggagcccaccgggcguucagc

SEQ ID NO: 735383 - RNA, 21 nt, Human
cuaaagcauucugauccaaag

SEQ ID NO: 735384 - RNA, 23 nt, Human
cuaaccguuacugcauuuaccuc

SEQ ID NO: 735385 - RNA, 20 nt, Human
cucaucagaagcaucacuga

SEQ ID NO: 735386 - RNA, 19 nt, Human
cucccaauacuggauguuu

SEQ ID NO: 735387 - RNA, 21 nt, Human
cuccgcagcagcaggaugcuu

SEQ ID NO: 735388 - RNA, 18 nt, Human
cugccaugcugaagcuug

SEQ ID NO: 735389 - RNA, 21 nt, Human
cuggggucucucccucuggcu

SEQ ID NO: 735390 - RNA, 24 nt, Human
cugguaguaggcaaugucaguguu

SEQ ID NO: 735391 - RNA, 19 nt, Human
cugguggagccccgggcgg

SEQ ID NO: 735392 - RNA, 20 nt, Human
cuguagucccagcuacuugg

SEQ ID NO: 735393 - RNA, 21 nt, Human
cuguagucccagcuacuuggg

SEQ ID NO: 735394 - RNA, 21 nt, Human
cuuccuguaucuucuguugua

SEQ ID NO: 735395 - RNA, 21 nt, Human
cuuccuguauuuccuccuccu

SEQ ID NO: 735396 - RNA, 21 nt, Human
cuucuuguacaggccuccuac

SEQ ID NO: 735397 - RNA, 23 nt, Human
cuugggaccccaggcgucucggg

SEQ ID NO: 735398 - RNA, 25 nt, Human
cuuguacaggccuccuacuuucccc

SEQ ID NO: 735399 - RNA, 19 nt, Human
gacucuguggcaaguuuuc

SEQ ID NO: 735400 - RNA, 23 nt, Human
gagaacucuguuuucauuauaca

SEQ ID NO: 735401 - RNA, 18 nt, Human
gagcgacccucaccacca

SEQ ID NO: 735402 - RNA, 22 nt, Human
gagcgacccucaccaccauccc

SEQ ID NO: 735403 - RNA, 24 nt, Human
gaggugggaagauugcuugagccc

SEQ ID NO: 735404 - RNA, 19 nt, Human
gaucaccggcuguuuuccu

SEQ ID NO: 735405 - RNA, 19 nt, Human
gccccgggcggaacacagg

SEQ ID NO: 735406 - RNA, 23 nt, Human
gcccuugugagugccagacccug

SEQ ID NO: 735407 - RNA, 20 nt, Human
gccuccuacuuuccccucca

SEQ ID NO: 735408 - RNA, 19 nt, Human
gcggaacacaggauccgaa

SEQ ID NO: 735409 - RNA, 23 nt, Human
gcuccagaaucuccuaacgcgca

SEQ ID NO: 735410 - RNA, 21 nt, Human
gcucgagaggaacccaaucug

SEQ ID NO: 735411 - RNA, 19 nt, Human
ggaauacaaaaaauaacua

SEQ ID NO: 735412 - RNA, 20 nt, Human
ggcaaguuuucugacaagga

SEQ ID NO: 735413 - RNA, 20 nt, Human
ggcacaaagaaccggaagaa

SEQ ID NO: 735414 - RNA, 18 nt, Human
ggucucucccucuggcuc

SEQ ID NO: 735415 - RNA, 24 nt, Human
gucacugcacuccagcuuggguaa

SEQ ID NO: 735416 - RNA, 20 nt, Human
gucuuggaaguucuguuugc

SEQ ID NO: 735417 - RNA, 21 nt, Human
gugcauccugggagccagugg

SEQ ID NO: 735418 - RNA, 18 nt, Human
gugcuuccucagauguug

SEQ ID NO: 735419 - RNA, 18 nt, Human
uaaacauaacagucauca

SEQ ID NO: 735420 - RNA, 22 nt, Human
uaacaugguccaaaauauucaa

SEQ ID NO: 735421 - RNA, 24 nt, Human
uaaucaaaauaagcacucgauuca

SEQ ID NO: 735422 - RNA, 19 nt, Human
uacaggcuccuucacuggg

SEQ ID NO: 735423 - RNA, 19 nt, Human
uacaguucauucaaacaaa

SEQ ID NO: 735424 - RNA, 18 nt, Human
uacauacacacauaccua

SEQ ID NO: 735425 - RNA, 19 nt, Human
uagcacauuucucaggcca

SEQ ID NO: 735426 - RNA, 25 nt, Human
uagcagacaccucucccuuccugua

SEQ ID NO: 735427 - RNA, 22 nt, Human
uaguggaugugugguuaaguuu

SEQ ID NO: 735428 - RNA, 25 nt, Human
uauagacaaacauaacauacacaug

SEQ ID NO: 735429 - RNA, 19 nt, Human
uaugccaagaagccuuaga

SEQ ID NO: 735430 - RNA, 23 nt, Human
ucaaacacagcacugacugugcc

SEQ ID NO: 735431 - RNA, 21 nt, Human
ucaaaggacuaaaagcuaaag

SEQ ID NO: 735432 - RNA, 24 nt, Human
ucaaugaccauuucaaaugacucu

SEQ ID NO: 735433 - RNA, 21 nt, Human
ucaccggcuguuuuccuucug

SEQ ID NO: 735434 - RNA, 20 nt, Human
ucacugcacuccagcuuggg

SEQ ID NO: 735435 - RNA, 21 nt, Human
ucacugcacuccagcuugggu

SEQ ID NO: 735436 - RNA, 24 nt, Human
ucacugcacuccagcuuggguaag

SEQ ID NO: 735437 - RNA, 22 nt, Human
ucaggccaagugcauaucuuga

SEQ ID NO: 735438 - RNA, 23 nt, Human
ucaugucacugcacuccagcuug

SEQ ID NO: 735439 - RNA, 19 nt, Human
uccaccccaugacaagagc

SEQ ID NO: 735440 - RNA, 18 nt, Human
uccagcuuggguaagaga

SEQ ID NO: 735441 - RNA, 25 nt, Human
uccauuuuucuuuaucauuuucuaa

SEQ ID NO: 735442 - RNA, 24 nt, Human
ucggaacugaacagcggaauucca

SEQ ID NO: 735443 - RNA, 23 nt, Human
ucuauaaauaacaaaaaguuauc

SEQ ID NO: 735444 - RNA, 21 nt, Human
ucuaugauuugccuguagagg

SEQ ID NO: 735445 - RNA, 18 nt, Human
ucucaucagaagcaucac

SEQ ID NO: 735446 - RNA, 18 nt, Human
ucuccucugccacucuga

SEQ ID NO: 735447 - RNA, 18 nt, Human
ucucgggcugggucgccg

SEQ ID NO: 735448 - RNA, 19 nt, Human
ucucuacuccaaaaccaga

SEQ ID NO: 735449 - RNA, 27 nt, Human
ucucugguaguaggcaaugucaguguu

SEQ ID NO: 735450 - RNA, 18 nt, Human
ucugucagcuggcuuccu

SEQ ID NO: 735451 - RNA, 24 nt, Human
ucuuccuaugccaagaagccuuag

SEQ ID NO: 735452 - RNA, 27 nt, Human
ucuucucugagaacucuguuuucauua

SEQ ID NO: 735453 - RNA, 23 nt, Human
ugaaaaacugggcucugugugaa

SEQ ID NO: 735454 - RNA, 24 nt, Human
ugaaaauauaaagcccaaagucag

SEQ ID NO: 735455 - RNA, 21 nt, Human
ugaaacagcauucuuaaccag

SEQ ID NO: 735456 - RNA, 24 nt, Human
ugaacaaaguuaaggacuugcaga

SEQ ID NO: 735457 - RNA, 23 nt, Human
ugaaucauaagaucaauauacug

SEQ ID NO: 735458 - RNA, 25 nt, Human
ugacaacagaaguccacauauaaau

SEQ ID NO: 735459 - RNA, 20 nt, Human
ugacugugccacagauaaca

SEQ ID NO: 735460 - RNA, 27 nt, Human
ugagcccaggaggcacaggaccaaagu

SEQ ID NO: 735461 - RNA, 21 nt, Human
ugaggaaggugaccauccacu

SEQ ID NO: 735462 - RNA, 18 nt, Human
ugaggugggaagauugcu

SEQ ID NO: 735463 - RNA, 24 nt, Human
ugaggugggaagauugcuugagcc

SEQ ID NO: 735464 - RNA, 22 nt, Human
ugagugacucacagucauaaga

SEQ ID NO: 735465 - RNA, 20 nt, Human
ugauccagagaguugagggc

SEQ ID NO: 735466 - RNA, 18 nt, Human
ugcaccacccaccaugcc

SEQ ID NO: 735467 - RNA, 18 nt, Human
ugcagucagccaagauca

SEQ ID NO: 735468 - RNA, 21 nt, Human
ugcccuaucauaucaucuccc

SEQ ID NO: 735469 - RNA, 22 nt, Human
ugccuguagagguuagaggugc

SEQ ID NO: 735470 - RNA, 24 nt, Human
ugcuauacaacugucaucagacag

SEQ ID NO: 735471 - RNA, 21 nt, Human
ugcuuuuuaguggcugacacu

SEQ ID NO: 735472 - RNA, 22 nt, Human
uggaccaaaacaagugguggca

SEQ ID NO: 735473 - RNA, 20 nt, Human
uggcaauuuccacuggcuuu

SEQ ID NO: 735474 - RNA, 22 nt, Human
uggcugacacuauaaagcuaac

SEQ ID NO: 735475 - RNA, 22 nt, Human
ugggaggcugaggugggaagau

SEQ ID NO: 735476 - RNA, 24 nt, Human
ugggaggcugaggugggaagauug

SEQ ID NO: 735477 - RNA, 22 nt, Human
ugggguugauucuguaguccca

SEQ ID NO: 735478 - RNA, 20 nt, Human
uggguaagagagcaagacuc

SEQ ID NO: 735479 - RNA, 23 nt, Human
ugguaguggaugugugguuaagu

SEQ ID NO: 735480 - RNA, 26 nt, Human
ugguaguggaugugugguuaaguuuu

SEQ ID NO: 735481 - RNA, 18 nt, Human
uguacaggacaaccugau

SEQ ID NO: 735482 - RNA, 22 nt, Human
ugucaggaauuucucugugagg

SEQ ID NO: 735483 - RNA, 18 nt, Human
ugugcagcagcuauagcu

SEQ ID NO: 735484 - RNA, 19 nt, Human
uguggcaaguuuucugaca

SEQ ID NO: 735485 - RNA, 24 nt, Human
uuacauaccuucuacaauguccaa

SEQ ID NO: 735486 - RNA, 23 nt, Human
uuagaugguuaauauaggaauac

SEQ ID NO: 735487 - RNA, 23 nt, Human
uucaaaggacuaaaagcuaaagg

SEQ ID NO: 735488 - RNA, 21 nt, Human
uuccgguuuaauucggaacug

SEQ ID NO: 735489 - RNA, 21 nt, Human
uuccuggaaugagugaacaaa

SEQ ID NO: 735490 - RNA, 20 nt, Human
uucuaaagcuucucaugaga

SEQ ID NO: 735491 - RNA, 19 nt, Human
uucucugagaacucuguuu

SEQ ID NO: 735492 - RNA, 24 nt, Human
uucuggggucucucccucuggcuc

SEQ ID NO: 735493 - RNA, 25 nt, Human
uugcagagagaguuuucuacuggaa

SEQ ID NO: 735494 - RNA, 24 nt, Human
uugccugucuucauuuuucuuacc

SEQ ID NO: 735495 - RNA, 22 nt, Human
uugcugaaucuauaguugcuuc

SEQ ID NO: 735496 - RNA, 18 nt, Human
uugcuugagcccaggagg

SEQ ID NO: 735497 - RNA, 20 nt, Human
uugggaggcugaggugggaa

SEQ ID NO: 735498 - RNA, 21 nt, Human
uuuucauuauacagcuggaca

SEQ ID NO: 735499 - RNA, 24 nt, Human
aaaaaacaaaauggauuucuccau

SEQ ID NO: 735500 - RNA, 19 nt, Human
aaacagaaccaaaauugcu

SEQ ID NO: 735501 - RNA, 25 nt, Human
aaacagcccuuaaauguuuaagggu

SEQ ID NO: 735502 - RNA, 19 nt, Human
aaagaguuaaggugucuuc

SEQ ID NO: 735503 - RNA, 23 nt, Human
aaagcgcucccgcccggaguuug

SEQ ID NO: 735504 - RNA, 23 nt, Human
aacaaagaguuaaggugucuuca

SEQ ID NO: 735505 - RNA, 19 nt, Human
aacccauucuucagcucug

SEQ ID NO: 735506 - RNA, 18 nt, Human
aacccugaauucucccua

SEQ ID NO: 735507 - RNA, 23 nt, Human
aacccugaauucucccuaaacag

SEQ ID NO: 735508 - RNA, 18 nt, Human
aacucagaagaaaggagu

SEQ ID NO: 735509 - RNA, 22 nt, Human
aagaacagaagauaaaccaaaa

SEQ ID NO: 735510 - RNA, 22 nt, Human
aagagaaaaaaagagggcuuua

SEQ ID NO: 735511 - RNA, 19 nt, Human
aagagaguggggaggugca

SEQ ID NO: 735512 - RNA, 19 nt, Human
aagcucuggguggucagug

SEQ ID NO: 735513 - RNA, 24 nt, Human
aaggagcuggugaccccaaaggau

SEQ ID NO: 735514 - RNA, 21 nt, Human
aaggcaaaagaaaacaaggac

SEQ ID NO: 735515 - RNA, 24 nt, Human
aaguuugguuaauaccaagcugaa

SEQ ID NO: 735516 - RNA, 22 nt, Human
aauacacacaacaaagaguuag

SEQ ID NO: 735517 - RNA, 19 nt, Human
acaaggcaaaagaaaacaa

SEQ ID NO: 735518 - RNA, 19 nt, Human
acagacuuaaguggguggg

SEQ ID NO: 735519 - RNA, 19 nt, Human
acauuauacaagauaguac

SEQ ID NO: 735520 - RNA, 21 nt, Human
accaaaaccaaacucacuauc

SEQ ID NO: 735521 - RNA, 25 nt, Human
accacagucaucuagaagucagguu

SEQ ID NO: 735522 - RNA, 20 nt, Human
accugucacuaaaaacaacu

SEQ ID NO: 735523 - RNA, 26 nt, Human
acucacuauccagucuuccucucaga

SEQ ID NO: 735524 - RNA, 22 nt, Human
acuucuaagggugcuccaggag

SEQ ID NO: 735525 - RNA, 23 nt, Human
agaaaaaaaaaaacagcccuuaa

SEQ ID NO: 735526 - RNA, 23 nt, Human
agacaacauacaaauaaaagucc

SEQ ID NO: 735527 - RNA, 19 nt, Human
agaugggugggggaaauca

SEQ ID NO: 735528 - RNA, 23 nt, Human
agcaaacaaaaccugucacuaaa

SEQ ID NO: 735529 - RNA, 21 nt, Human
agcccagaggaaacuggaacu

SEQ ID NO: 735530 - RNA, 20 nt, Human
agcuggugaccccaaaggau

SEQ ID NO: 735531 - RNA, 22 nt, Human
aggaaagagaaaaaaagagggc

SEQ ID NO: 735532 - RNA, 25 nt, Human
aggaagaacagaagauaaaccaaaa

SEQ ID NO: 735533 - RNA, 20 nt, Human
aggacaaacccccuggcagc

SEQ ID NO: 735534 - RNA, 20 nt, Human
aggaccagcaagggggggug

SEQ ID NO: 735535 - RNA, 20 nt, Human
aggagcugccagacugaaaa

SEQ ID NO: 735536 - RNA, 25 nt, Human
aggcaaaagaaaacaaggaccaaga

SEQ ID NO: 735537 - RNA, 20 nt, Human
aggcccuagcuccaggccug

SEQ ID NO: 735538 - RNA, 18 nt, Human
agggcgaaaaaaaagcca

SEQ ID NO: 735539 - RNA, 19 nt, Human
aggggggguguugaagggg

SEQ ID NO: 735540 - RNA, 22 nt, Human
aggucuccggcacgggcaacuc

SEQ ID NO: 735541 - RNA, 18 nt, Human
aguauaaacaccucugcc

SEQ ID NO: 735542 - RNA, 18 nt, Human
agucagguuuucucuucu

SEQ ID NO: 735543 - RNA, 22 nt, Human
auaaggucuccuccccucaaaa

SEQ ID NO: 735544 - RNA, 21 nt, Human
auacauuaccaaaauagcuuc

SEQ ID NO: 735545 - RNA, 23 nt, Human
auauagcuucuucaaacaaguua

SEQ ID NO: 735546 - RNA, 20 nt, Human
aucacauagaaauggccaag

SEQ ID NO: 735547 - RNA, 18 nt, Human
auggagacauggauguag

SEQ ID NO: 735548 - RNA, 22 nt, Human
auggagaugguacugguggugg

SEQ ID NO: 735549 - RNA, 20 nt, Human
caaaauagcuucacuaaaac

SEQ ID NO: 735550 - RNA, 24 nt, Human
caaacaaaaccugucacuaaaaac

SEQ ID NO: 735551 - RNA, 28 nt, Human
caaagcucaaaucaagucauggaaaccc

SEQ ID NO: 735552 - RNA, 18 nt, Human
caacagaagggacaaugg

SEQ ID NO: 735553 - RNA, 22 nt, Human
caagccaaugaggugugcagca

SEQ ID NO: 735554 - RNA, 23 nt, Human
caaggcaaaagaaaacaaggacc

SEQ ID NO: 735555 - RNA, 23 nt, Human
caaguuaccuaaagugccaggcu

SEQ ID NO: 735556 - RNA, 24 nt, Human
cacagcucucuucuaaagcucugg

SEQ ID NO: 735557 - RNA, 26 nt, Human
cacguuguuguuggcguugguggcgg

SEQ ID NO: 735558 - RNA, 24 nt, Human
cacuaaagaagucuguggcaugac

SEQ ID NO: 735559 - RNA, 21 nt, Human
cagagcccccuggucacuccc

SEQ ID NO: 735560 - RNA, 21 nt, Human
cagcagcuacaaucccaacac

SEQ ID NO: 735561 - RNA, 18 nt, Human
cagcagggaaaauggagc

SEQ ID NO: 735562 - RNA, 20 nt, Human
cagcccggauaaguaggcaa

SEQ ID NO: 735563 - RNA, 22 nt, Human
caggccccacuccagccgcgac

SEQ ID NO: 735564 - RNA, 22 nt, Human
cagugugagauaauggcugggg

SEQ ID NO: 735565 - RNA, 20 nt, Human
caguucucaaaaaaauaccu

SEQ ID NO: 735566 - RNA, 24 nt, Human
cauggaaacccugaauucucccua

SEQ ID NO: 735567 - RNA, 19 nt, Human
ccaaaaccaaaaccaaacu

SEQ ID NO: 735568 - RNA, 24 nt, Human
ccaaaaccaaaaccaaacucacua

SEQ ID NO: 735569 - RNA, 21 nt, Human
ccaaagggcgaaaaaaaagcc

SEQ ID NO: 735570 - RNA, 23 nt, Human
ccacucacacgcgcaggccccac

SEQ ID NO: 735571 - RNA, 18 nt, Human
ccagcagcuacaauccca

SEQ ID NO: 735572 - RNA, 22 nt, Human
ccaggguugggaauccugggcc

SEQ ID NO: 735573 - RNA, 23 nt, Human
cccaaagggcgaaaaaaaagccc

SEQ ID NO: 735574 - RNA, 23 nt, Human
ccccacuccagccgcgacuccgg

SEQ ID NO: 735575 - RNA, 18 nt, Human
cccccuggcagcgccugg

SEQ ID NO: 735576 - RNA, 25 nt, Human
cccgaggccgaggaagauccggagc

SEQ ID NO: 735577 - RNA, 22 nt, Human
cccggaguuugaggucuccggc

SEQ ID NO: 735578 - RNA, 20 nt, Human
cccugaaauaguacuaaaaa

SEQ ID NO: 735579 - RNA, 23 nt, Human
ccgcccggaguuugaggucuccg

SEQ ID NO: 735580 - RNA, 19 nt, Human
ccgcgccugauagaccccc

SEQ ID NO: 735581 - RNA, 25 nt, Human
ccggcuucggccgcggcugcucccg

SEQ ID NO: 735582 - RNA, 24 nt, Human
ccuccagcuaccaggacaaacccc

SEQ ID NO: 735583 - RNA, 24 nt, Human
cgacuccggccccugcuccggcuu

SEQ ID NO: 735584 - RNA, 20 nt, Human
cgacuccugagcugccaggu

SEQ ID NO: 735585 - RNA, 22 nt, Human
cgccagggacuggagauuggag

SEQ ID NO: 735586 - RNA, 21 nt, Human
cgcugucugggccuuggggac

SEQ ID NO: 735587 - RNA, 21 nt, Human
cucauaaacccugaaauagua

SEQ ID NO: 735588 - RNA, 18 nt, Human
cucccaccuagggguggg

SEQ ID NO: 735589 - RNA, 27 nt, Human
cucucuauauacauuucccagcuuuaa

SEQ ID NO: 735590 - RNA, 21 nt, Human
cugaauucucccuaaacagaa

SEQ ID NO: 735591 - RNA, 18 nt, Human
cugaccagauccgccagg

SEQ ID NO: 735592 - RNA, 20 nt, Human
cugagggaauaggaacaaag

SEQ ID NO: 735593 - RNA, 21 nt, Human
cuggaaaaaaaauuuaaguuu

SEQ ID NO: 735594 - RNA, 21 nt, Human
cugggucaaaauuagaagcac

SEQ ID NO: 735595 - RNA, 18 nt, Human
cuuaagccagugagucug

SEQ ID NO: 735596 - RNA, 22 nt, Human
cuuggagcugccuuccaggguu

SEQ ID NO: 735597 - RNA, 18 nt, Human
gaaagcagcaguaggagc

SEQ ID NO: 735598 - RNA, 18 nt, Human
gaccuccggagcaggauu

SEQ ID NO: 735599 - RNA, 19 nt, Human
gagcccccuggucacuccc

SEQ ID NO: 735600 - RNA, 23 nt, Human
gagggaccacuucuagcuggugu

SEQ ID NO: 735601 - RNA, 20 nt, Human
gauaaguaggcaauacuucu

SEQ ID NO: 735602 - RNA, 24 nt, Human
gaugaucaccguucuccggccucc

SEQ ID NO: 735603 - RNA, 22 nt, Human
gcaagccaaugaggugugcagc

SEQ ID NO: 735604 - RNA, 24 nt, Human
gcagcaaacaaaaccugucacuaa

SEQ ID NO: 735605 - RNA, 23 nt, Human
gccagagcccccuggucacuccc

SEQ ID NO: 735606 - RNA, 20 nt, Human
gccaggaagccggcuggggu

SEQ ID NO: 735607 - RNA, 19 nt, Human
gcuaaauacaagucacagg

SEQ ID NO: 735608 - RNA, 20 nt, Human
ggacaagcuacauuacccuc

SEQ ID NO: 735609 - RNA, 22 nt, Human
ggagcuccccaauggauaacuu

SEQ ID NO: 735610 - RNA, 20 nt, Human
ggccgaggaagauccggagc

SEQ ID NO: 735611 - RNA, 22 nt, Human
gggcucccagcagcuacaaucc

SEQ ID NO: 735612 - RNA, 19 nt, Human
gguggugggagccagcuac

SEQ ID NO: 735613 - RNA, 20 nt, Human
gguggugggagccagcuacg

SEQ ID NO: 735614 - RNA, 19 nt, Human
guaggaaaucauagauuuc

SEQ ID NO: 735615 - RNA, 20 nt, Human
guggcggcggcugcggcggc

SEQ ID NO: 735616 - RNA, 23 nt, Human
uaaaaccaaaaccaaaaccaaac

SEQ ID NO: 735617 - RNA, 18 nt, Human
uaaauuaaaauggcugug

SEQ ID NO: 735618 - RNA, 19 nt, Human
uaacuuaggaaagcagcag

SEQ ID NO: 735619 - RNA, 18 nt, Human
uaaggguuguuuuguugu

SEQ ID NO: 735620 - RNA, 19 nt, Human
uaaguaaggguuguuuugu

SEQ ID NO: 735621 - RNA, 24 nt, Human
uaaguuaagacaacauacaaauaa

SEQ ID NO: 735622 - RNA, 19 nt, Human
uacaagauaguacaaggca

SEQ ID NO: 735623 - RNA, 22 nt, Human
uacccaaauguguucugguuug

SEQ ID NO: 735624 - RNA, 19 nt, Human
uagaaaaucuguaagggug

SEQ ID NO: 735625 - RNA, 20 nt, Human
uagaggguggagagggaccu

SEQ ID NO: 735626 - RNA, 23 nt, Human
uagcuaaauuaaaauggcugugu

SEQ ID NO: 735627 - RNA, 25 nt, Human
uaggaagaacagaagauaaaccaaa

SEQ ID NO: 735628 - RNA, 22 nt, Human
uaguuuuuuuuuccccuuucaa

SEQ ID NO: 735629 - RNA, 19 nt, Human
uaugcaaagcucaaaucaa

SEQ ID NO: 735630 - RNA, 24 nt, Human
uaugcucauaaacccugaaauagu

SEQ ID NO: 735631 - RNA, 25 nt, Human
uaugcucauaaacccugaaauagua

SEQ ID NO: 735632 - RNA, 20 nt, Human
uaugguacaguauauacaaa

SEQ ID NO: 735633 - RNA, 26 nt, Human
ucacuaaaaacaacucaacaggccau

SEQ ID NO: 735634 - RNA, 19 nt, Human
ucagaagggugagaguuau

SEQ ID NO: 735635 - RNA, 19 nt, Human
uccacagaagcauuuaaag

SEQ ID NO: 735636 - RNA, 19 nt, Human
uccccucaaaaaaaggaaa

SEQ ID NO: 735637 - RNA, 19 nt, Human
ucccgcgccugauagaccc

SEQ ID NO: 735638 - RNA, 22 nt, Human
ucccgcgccugauagacccccg

SEQ ID NO: 735639 - RNA, 22 nt, Human
ucucaagggguaugguuuucug

SEQ ID NO: 735640 - RNA, 19 nt, Human
ucucugauucccagguugg

SEQ ID NO: 735641 - RNA, 23 nt, Human
ugaaggcccuagcuccaggccug

SEQ ID NO: 735642 - RNA, 24 nt, Human
ugacaccacagucaucuagaaguc

SEQ ID NO: 735643 - RNA, 21 nt, Human
ugagaaugcaguauaaacacc

SEQ ID NO: 735644 - RNA, 20 nt, Human
ugagagaagccagucccgcg

SEQ ID NO: 735645 - RNA, 23 nt, Human
ugagaguggauggaaggcaguca

SEQ ID NO: 735646 - RNA, 22 nt, Human
ugaggcuugacuacagcuaaau

SEQ ID NO: 735647 - RNA, 19 nt, Human
ugccagguccacagaagca

SEQ ID NO: 735648 - RNA, 24 nt, Human
ugcuuucuuucauuuaaauauuua

SEQ ID NO: 735649 - RNA, 19 nt, Human
uggaccuccggagcaggau

SEQ ID NO: 735650 - RNA, 26 nt, Human
uggagaugguacugguggugggagcc

SEQ ID NO: 735651 - RNA, 23 nt, Human
uggccaggaagccggcuggggug

SEQ ID NO: 735652 - RNA, 19 nt, Human
uggcggcaggagggggcuc

SEQ ID NO: 735653 - RNA, 18 nt, Human
uggcggcggcugcggcgg

SEQ ID NO: 735654 - RNA, 19 nt, Human
uggcguugguggcggcggc

SEQ ID NO: 735655 - RNA, 22 nt, Human
uggcuguguuacuuauuugaaa

SEQ ID NO: 735656 - RNA, 19 nt, Human
ugggaagagaguggggagg

SEQ ID NO: 735657 - RNA, 23 nt, Human
ugggaauccugggccagagcccc

SEQ ID NO: 735658 - RNA, 21 nt, Human
uggggugagaguggauggaag

SEQ ID NO: 735659 - RNA, 22 nt, Human
uggggugagaguggauggaagg

SEQ ID NO: 735660 - RNA, 27 nt, Human
uggguaaguaaggguuguuuuguuguu

SEQ ID NO: 735661 - RNA, 18 nt, Human
uggguggguggggaaggc

SEQ ID NO: 735662 - RNA, 18 nt, Human
ugguggcggcggcugcgg

SEQ ID NO: 735663 - RNA, 19 nt, Human
uguaaggguguauauauau

SEQ ID NO: 735664 - RNA, 20 nt, Human
ugugaaggcccuagcuccag

SEQ ID NO: 735665 - RNA, 18 nt, Human
uuaggcucuugguuagcc

SEQ ID NO: 735666 - RNA, 21 nt, Human
uuauaugcuaccuuuuugccu

SEQ ID NO: 735667 - RNA, 19 nt, Human
uucaaacaaguuaaaaggu

SEQ ID NO: 735668 - RNA, 21 nt, Human
uucaucuugcuuuaacuaaau

SEQ ID NO: 735669 - RNA, 22 nt, Human
uucccugaaaucgguuccucca

SEQ ID NO: 735670 - RNA, 24 nt, Human
uucuagacucaacauacaggagac

SEQ ID NO: 735671 - RNA, 20 nt, Human
uucuccggccuccguccuga

SEQ ID NO: 735672 - RNA, 23 nt, Human
uugccuggaagauguacuuucuc

SEQ ID NO: 735673 - RNA, 25 nt, Human
uuggaggacuagaggacugaugggu

SEQ ID NO: 735674 - RNA, 20 nt, Human
uuggcuuuagucauccccca

SEQ ID NO: 735675 - RNA, 22 nt, Human
uuucucuucuuuugguucuucu

SEQ ID NO: 735676 - RNA, 24 nt, Human
uuuguucauauccuguucaaaacc

SEQ ID NO: 735677 - RNA, 20 nt, Human
uuuuagaugacaccacaguc

SEQ ID NO: 735678 - RNA, 18 nt, Human
uuuuuuuuccccuuucaa

SEQ ID NO: 735679 - RNA, 19 nt, Human
aaaacaccuaagcaagccc

SEQ ID NO: 735680 - RNA, 19 nt, Human
aaaaggucuccacgccccu

SEQ ID NO: 735681 - RNA, 21 nt, Human
aaaauggaaaggagaaagccc

SEQ ID NO: 735682 - RNA, 20 nt, Human
aaauuguuuuuuaggccgag

SEQ ID NO: 735683 - RNA, 20 nt, Human
aacacaaaacaccuaagcaa

SEQ ID NO: 735684 - RNA, 18 nt, Human
aacacaguguccggagug

SEQ ID NO: 735685 - RNA, 25 nt, Human
aacaguaacaagugaaacaggcaac

SEQ ID NO: 735686 - RNA, 20 nt, Human
aacaugguacacgcacagaa

SEQ ID NO: 735687 - RNA, 20 nt, Human
aacauggugaaaucccaucu

SEQ ID NO: 735688 - RNA, 21 nt, Human
aacauggugaaaucccaucuc

SEQ ID NO: 735689 - RNA, 22 nt, Human
aaccagaggccuccaaggcccu

SEQ ID NO: 735690 - RNA, 19 nt, Human
aacccgcagaaucaaccca

SEQ ID NO: 735691 - RNA, 20 nt, Human
aacccggcuuuucacagugg

SEQ ID NO: 735692 - RNA, 19 nt, Human
aaccugcagaaucaaccca

SEQ ID NO: 735693 - RNA, 23 nt, Human
aagaaucgcuugaaccugggaga

SEQ ID NO: 735694 - RNA, 22 nt, Human
aagacaugucccagagaaaaca

SEQ ID NO: 735695 - RNA, 21 nt, Human
aagggacagggacaugccccg

SEQ ID NO: 735696 - RNA, 18 nt, Human
aaucccugaccugcccuc

SEQ ID NO: 735697 - RNA, 18 nt, Human
aaucgcuugaaccuggga

SEQ ID NO: 735698 - RNA, 20 nt, Human
aauguuuuuaaauacugguu

SEQ ID NO: 735699 - RNA, 19 nt, Human
acaccuaagcaagcccaac

SEQ ID NO: 735700 - RNA, 20 nt, Human
acacugcggagccagacagu

SEQ ID NO: 735701 - RNA, 20 nt, Human
acagaauaugggcuuuucau

SEQ ID NO: 735702 - RNA, 24 nt, Human
acagggcaagacuccaucucaaaa

SEQ ID NO: 735703 - RNA, 19 nt, Human
accauugcacuccagccug

SEQ ID NO: 735704 - RNA, 24 nt, Human
accauugcacuccagccuggguga

SEQ ID NO: 735705 - RNA, 19 nt, Human
acccacauagucaacccag

SEQ ID NO: 735706 - RNA, 23 nt, Human
acgcacagaaccccaaaggagca

SEQ ID NO: 735707 - RNA, 18 nt, Human
acugcagccuggaaggca

SEQ ID NO: 735708 - RNA, 21 nt, Human
agaagggggagggaacggggc

SEQ ID NO: 735709 - RNA, 20 nt, Human
agaaucucccucaaguacac

SEQ ID NO: 735710 - RNA, 21 nt, Human
agacggagguugcagugagcc

SEQ ID NO: 735711 - RNA, 24 nt, Human
agacggagguugcagugagccgag

SEQ ID NO: 735712 - RNA, 20 nt, Human
agagaggcccaccugccccu

SEQ ID NO: 735713 - RNA, 19 nt, Human
agcagcguuguagaaaguc

SEQ ID NO: 735714 - RNA, 23 nt, Human
agcaugguggcucacgccuguaa

SEQ ID NO: 735715 - RNA, 24 nt, Human
agccuggccaacauggugaaaucc

SEQ ID NO: 735716 - RNA, 24 nt, Human
agccugggugacagggcaagacuc

SEQ ID NO: 735717 - RNA, 25 nt, Human
aggacaaaacccaacacugcggagc

SEQ ID NO: 735718 - RNA, 26 nt, Human
aggacaucccagguuccuccugaaaa

SEQ ID NO: 735719 - RNA, 22 nt, Human
aggcagaagaaucgcuugaacc

SEQ ID NO: 735720 - RNA, 24 nt, Human
aggcagaagaaucgcuugaaccug

SEQ ID NO: 735721 - RNA, 22 nt, Human
aggcaggaucuuggcuccagcc

SEQ ID NO: 735722 - RNA, 21 nt, Human
aggcagugacggcggugaucc

SEQ ID NO: 735723 - RNA, 23 nt, Human
aggcccugcaguaaagggucucc

SEQ ID NO: 735724 - RNA, 19 nt, Human
aggcggggaggaugagcgc

SEQ ID NO: 735725 - RNA, 24 nt, Human
aggcugaggcagaagaaucgcuug

SEQ ID NO: 735726 - RNA, 19 nt, Human
agggggagggaacggggca

SEQ ID NO: 735727 - RNA, 20 nt, Human
aucaggacaucccagguucc

SEQ ID NO: 735728 - RNA, 24 nt, Human
aucccacccggagaagccucgcgg

SEQ ID NO: 735729 - RNA, 22 nt, Human
aucccagcacuuugggaggcca

SEQ ID NO: 735730 - RNA, 24 nt, Human
aucgcaccauugcacuccagccug

SEQ ID NO: 735731 - RNA, 21 nt, Human
auugcacuccagccuggguga

SEQ ID NO: 735732 - RNA, 24 nt, Human
caaaaaaggccuaaggaggccugc

SEQ ID NO: 735733 - RNA, 23 nt, Human
caaaacaccuaagcaagcccaac

SEQ ID NO: 735734 - RNA, 23 nt, Human
caaaacccaacacugcggagcca

SEQ ID NO: 735735 - RNA, 24 nt, Human
caacauggugaaaucccaucucua

SEQ ID NO: 735736 - RNA, 18 nt, Human
caaccagaggccuccaag

SEQ ID NO: 735737 - RNA, 24 nt, Human
caacccagcugaugaccucuaucu

SEQ ID NO: 735738 - RNA, 24 nt, Human
caacccagcugaugaccucuaucu

SEQ ID NO: 735739 - RNA, 25 nt, Human
caacccagcugaugaccucuaucua

SEQ ID NO: 735740 - RNA, 25 nt, Human
caacccagcugaugaccucuaucua

SEQ ID NO: 735741 - RNA, 25 nt, Human
caacccagcugaugaccucuaucua

SEQ ID NO: 735742 - RNA, 25 nt, Human
caacccagcugaugaucucuaucua

SEQ ID NO: 735743 - RNA, 23 nt, Human
cacaaaacaccuaagcaagccca

SEQ ID NO: 735744 - RNA, 23 nt, Human
cacauccaaagaggaagccuaga

SEQ ID NO: 735745 - RNA, 19 nt, Human
caccaggcacccggcccau

SEQ ID NO: 735746 - RNA, 22 nt, Human
caccaggcacccggcccauccc

SEQ ID NO: 735747 - RNA, 26 nt, Human
caccauugcacuccagccugggugac

SEQ ID NO: 735748 - RNA, 18 nt, Human
cacgcacagaaccccaaa

SEQ ID NO: 735749 - RNA, 24 nt, Human
cacgccuguaaucccagcacuuug

SEQ ID NO: 735750 - RNA, 19 nt, Human
cacgcguguaaucccagcu

SEQ ID NO: 735751 - RNA, 18 nt, Human
cacgucgugcacagcagc

SEQ ID NO: 735752 - RNA, 21 nt, Human
cacgucgugcacagcagcguu

SEQ ID NO: 735753 - RNA, 20 nt, Human
cacuccagccugggugacag

SEQ ID NO: 735754 - RNA, 20 nt, Human
cacuccagccugggugacag

SEQ ID NO: 735755 - RNA, 22 nt, Human
cacuccagccugggugacaggg

SEQ ID NO: 735756 - RNA, 23 nt, Human
cacuccagccugggugacagggc

SEQ ID NO: 735757 - RNA, 19 nt, Human
cagaaccccaaaggagcau

SEQ ID NO: 735758 - RNA, 27 nt, Human
cagaaggcugaggcagaagaaucgcuu

SEQ ID NO: 735759 - RNA, 18 nt, Human
cagaggccuccaaggccc

SEQ ID NO: 735760 - RNA, 21 nt, Human
cagcaacaugcauacggcauc

SEQ ID NO: 735761 - RNA, 21 nt, Human
cagcacuuugggaggccaugg

SEQ ID NO: 735762 - RNA, 24 nt, Human
cagcacuuugggaggccauggcag

SEQ ID NO: 735763 - RNA, 20 nt, Human
cagccucgacccccgaccga

SEQ ID NO: 735764 - RNA, 20 nt, Human
cagcguuggcacugacauuu

SEQ ID NO: 735765 - RNA, 24 nt, Human
cagcuacucagaaggcugaggcag

SEQ ID NO: 735766 - RNA, 24 nt, Human
cagcuucaccagcccucggcccug

SEQ ID NO: 735767 - RNA, 19 nt, Human
caggacaaaacccaacacu

SEQ ID NO: 735768 - RNA, 20 nt, Human
cagggcagagaauccuaaaa

SEQ ID NO: 735769 - RNA, 20 nt, Human
cagggcagguccacagcuga

SEQ ID NO: 735770 - RNA, 22 nt, Human
cagguuccuccugaaaacguca

SEQ ID NO: 735771 - RNA, 21 nt, Human
caguaacaguaacaagugaaa

SEQ ID NO: 735772 - RNA, 19 nt, Human
caucccagguuccuccuga

SEQ ID NO: 735773 - RNA, 23 nt, Human
cauccccggcucccaucuaggga

SEQ ID NO: 735774 - RNA, 26 nt, Human
caugcauacggcauccacgucgugca

SEQ ID NO: 735775 - RNA, 24 nt, Human
cauggcagguggaucacgagguca

SEQ ID NO: 735776 - RNA, 23 nt, Human
caugguuucccaaugcuuccccu

SEQ ID NO: 735777 - RNA, 19 nt, Human
cauugcacuccagccuggg

SEQ ID NO: 735778 - RNA, 19 nt, Human
cauugcacuccagccuggg

SEQ ID NO: 735779 - RNA, 21 nt, Human
cauugcacuccagccugggug

SEQ ID NO: 735780 - RNA, 22 nt, Human
cauugcacuccagccuggguga

SEQ ID NO: 735781 - RNA, 21 nt, Human
ccacagaaaagcugaaaccgc

SEQ ID NO: 735782 - RNA, 18 nt, Human
ccacagacguguccccag

SEQ ID NO: 735783 - RNA, 27 nt, Human
ccacccaccaggcacccggcccauccc

SEQ ID NO: 735784 - RNA, 19 nt, Human
ccacccgcccccggcugca

SEQ ID NO: 735785 - RNA, 20 nt, Human
ccagcccucggcccuguuug

SEQ ID NO: 735786 - RNA, 21 nt, Human
ccaguggauccuccccagggc

SEQ ID NO: 735787 - RNA, 20 nt, Human
ccauugcacuccagccuggg

SEQ ID NO: 735788 - RNA, 21 nt, Human
ccauugcacuccagccugggu

SEQ ID NO: 735789 - RNA, 21 nt, Human
ccauugcacuccagccugggu

SEQ ID NO: 735790 - RNA, 22 nt, Human
ccauugcacuccagccugggug

SEQ ID NO: 735791 - RNA, 24 nt, Human
ccauugcacuccagccugggugac

SEQ ID NO: 735792 - RNA, 25 nt, Human
ccauugcacuccagccugggugaca

SEQ ID NO: 735793 - RNA, 26 nt, Human
ccauugcacuccagccugggugacag

SEQ ID NO: 735794 - RNA, 21 nt, Human
cccaaggaauucugauucucc

SEQ ID NO: 735795 - RNA, 23 nt, Human
cccacaccuggggagcggggagc

SEQ ID NO: 735796 - RNA, 22 nt, Human
cccaucucuacuaaaaauacaa

SEQ ID NO: 735797 - RNA, 21 nt, Human
cccccacaccuggggagcggg

SEQ ID NO: 735798 - RNA, 23 nt, Human
cccccaggacugacagaggguag

SEQ ID NO: 735799 - RNA, 19 nt, Human
cccccgaccgagggacccg

SEQ ID NO: 735800 - RNA, 23 nt, Human
ccccgcccggugaugcccaagga

SEQ ID NO: 735801 - RNA, 22 nt, Human
ccccggcucccaucuagggauc

SEQ ID NO: 735802 - RNA, 20 nt, Human
cccggcccauccccggcucc

SEQ ID NO: 735803 - RNA, 20 nt, Human
cccugccaagggaacucuga

SEQ ID NO: 735804 - RNA, 25 nt, Human
ccgcccugcgagcagaggcguucgu

SEQ ID NO: 735805 - RNA, 20 nt, Human
ccggagaagccucgcgggcg

SEQ ID NO: 735806 - RNA, 21 nt, Human
ccgggaggugaccgaggccag

SEQ ID NO: 735807 - RNA, 18 nt, Human
ccuaagcaagcccaacuu

SEQ ID NO: 735808 - RNA, 22 nt, Human
ccuccugaaaacgucacccacc

SEQ ID NO: 735809 - RNA, 22 nt, Human
ccucugggugggacacugaucc

SEQ ID NO: 735810 - RNA, 23 nt, Human
ccugaaaacgucacccaccuuua

SEQ ID NO: 735811 - RNA, 25 nt, Human
ccugaaaagccugguuaaaccagaa

SEQ ID NO: 735812 - RNA, 24 nt, Human
ccugaccugcccucuuccugagag

SEQ ID NO: 735813 - RNA, 24 nt, Human
ccugcacauuugcacagauucagg

SEQ ID NO: 735814 - RNA, 23 nt, Human
ccuggccaacauggugaaauccc

SEQ ID NO: 735815 - RNA, 24 nt, Human
ccuggccaacauggugaaauccca

SEQ ID NO: 735816 - RNA, 21 nt, Human
ccugggagacggagguugcag

SEQ ID NO: 735817 - RNA, 22 nt, Human
ccuggggagcggggagcugcgg

SEQ ID NO: 735818 - RNA, 22 nt, Human
ccugggugacagggcaagacuc

SEQ ID NO: 735819 - RNA, 21 nt, Human
ccuguccacguacuuuggaaa

SEQ ID NO: 735820 - RNA, 25 nt, Human
ccuuccugcgggggcagauggaggc

SEQ ID NO: 735821 - RNA, 24 nt, Human
cgagaccagccuggccaacauggu

SEQ ID NO: 735822 - RNA, 22 nt, Human
cgaggucaguaguucgagacca

SEQ ID NO: 735823 - RNA, 21 nt, Human
cgcaccauugcacuccagccu

SEQ ID NO: 735824 - RNA, 18 nt, Human
cgcccggugaugcccaag

SEQ ID NO: 735825 - RNA, 23 nt, Human
cgccuguaaucccagcacuuugg

SEQ ID NO: 735826 - RNA, 24 nt, Human
cgccuguaaucccagcacuuuggg

SEQ ID NO: 735827 - RNA, 18 nt, Human
cuaaaauagcccgcagcc

SEQ ID NO: 735828 - RNA, 21 nt, Human
cuagagaggcccaccugcccc

SEQ ID NO: 735829 - RNA, 19 nt, Human
cucaaucaggugcuucacc

SEQ ID NO: 735830 - RNA, 20 nt, Human
cucaaucaggugcuucaccc

SEQ ID NO: 735831 - RNA, 23 nt, Human
cucacagcacccaguccacaauc

SEQ ID NO: 735832 - RNA, 22 nt, Human
cucacgccuguaaucccagcac

SEQ ID NO: 735833 - RNA, 24 nt, Human
cucacgccuguaaucccagcacuu

SEQ ID NO: 735834 - RNA, 22 nt, Human
cugcccgaggacagguguucca

SEQ ID NO: 735835 - RNA, 21 nt, Human
cugcgcacaacacaaaacacc

SEQ ID NO: 735836 - RNA, 18 nt, Human
cuggcuugugauaaggca

SEQ ID NO: 735837 - RNA, 25 nt, Human
cuuccugcgggggcagauggaggcg

SEQ ID NO: 735838 - RNA, 22 nt, Human
cuuggacaagccccacccaggu

SEQ ID NO: 735839 - RNA, 19 nt, Human
cuuguuggggcaugugaag

SEQ ID NO: 735840 - RNA, 23 nt, Human
cuuuggguggaaaacagccacug

SEQ ID NO: 735841 - RNA, 21 nt, Human
gaaggcccugaggaacugcuc

SEQ ID NO: 735842 - RNA, 23 nt, Human
gagaucgcaccauugcacuccag

SEQ ID NO: 735843 - RNA, 19 nt, Human
gaggccuccaaggcccugc

SEQ ID NO: 735844 - RNA, 23 nt, Human
gagguugcagugagccgagaucg

SEQ ID NO: 735845 - RNA, 20 nt, Human
gcaccauugcacuccagccu

SEQ ID NO: 735846 - RNA, 24 nt, Human
gcacuccagccugggugacagggc

SEQ ID NO: 735847 - RNA, 21 nt, Human
gcagggcagagaauccuaaaa

SEQ ID NO: 735848 - RNA, 22 nt, Human
gcaguaaagggucuccaccaca

SEQ ID NO: 735849 - RNA, 19 nt, Human
gcagugacggcggugaucc

SEQ ID NO: 735850 - RNA, 21 nt, Human
gcagugcuggcugauguccac

SEQ ID NO: 735851 - RNA, 24 nt, Human
gccaacauggugaaaucccaucuc

SEQ ID NO: 735852 - RNA, 22 nt, Human
gccacuagcagaucccguaaac

SEQ ID NO: 735853 - RNA, 21 nt, Human
gccaugagguuuugucucccu

SEQ ID NO: 735854 - RNA, 20 nt, Human
ggaaacggaagcagccucga

SEQ ID NO: 735855 - RNA, 21 nt, Human
ggaacaggcagugacggcggu

SEQ ID NO: 735856 - RNA, 18 nt, Human
ggaagcagccucgacccc

SEQ ID NO: 735857 - RNA, 22 nt, Human
ggacaaaacccaacacugcgga

SEQ ID NO: 735858 - RNA, 19 nt, Human
ggagaagggggagggaacg

SEQ ID NO: 735859 - RNA, 20 nt, Human
ggagguugcagugagccgag

SEQ ID NO: 735860 - RNA, 22 nt, Human
ggagguugcagugagccgagau

SEQ ID NO: 735861 - RNA, 24 nt, Human
ggagguugcagugagccgagaucg

SEQ ID NO: 735862 - RNA, 23 nt, Human
ggaguggguccguccgagcugga

SEQ ID NO: 735863 - RNA, 23 nt, Human
ggcagguggaucacgaggucagu

SEQ ID NO: 735864 - RNA, 21 nt, Human
ggcucacgccuguaaucccag

SEQ ID NO: 735865 - RNA, 19 nt, Human
gggaacaggcagugacggc

SEQ ID NO: 735866 - RNA, 20 nt, Human
gggaagccggagaggccgcc

SEQ ID NO: 735867 - RNA, 23 nt, Human
gggagggaacggggcaggcgggg

SEQ ID NO: 735868 - RNA, 22 nt, Human
gggcagaagacaugucccagag

SEQ ID NO: 735869 - RNA, 19 nt, Human
gggcaggcggcggggugaa

SEQ ID NO: 735870 - RNA, 18 nt, Human
gggcagguccacagcuga

SEQ ID NO: 735871 - RNA, 18 nt, Human
ggggagggaacggggcag

SEQ ID NO: 735872 - RNA, 19 nt, Human
gggggagggaacggggcag

SEQ ID NO: 735873 - RNA, 23 nt, Human
ggugaagguguccagggccugag

SEQ ID NO: 735874 - RNA, 24 nt, Human
gguggcacacgcguguaaucccag

SEQ ID NO: 735875 - RNA, 24 nt, Human
gguggcucacgccuguaaucccag

SEQ ID NO: 735876 - RNA, 24 nt, Human
gugacaagaacagaauaugggcuu

SEQ ID NO: 735877 - RNA, 21 nt, Human
guggaaaacagccacuguuca

SEQ ID NO: 735878 - RNA, 19 nt, Human
guugcagugagccgagauc

SEQ ID NO: 735879 - RNA, 25 nt, Human
uaacccgcagaaucaacccagcuga

SEQ ID NO: 735880 - RNA, 19 nt, Human
uaaccugcagaaucaaccc

SEQ ID NO: 735881 - RNA, 25 nt, Human
uaaccugcagaaucaacccagcuga

SEQ ID NO: 735882 - RNA, 19 nt, Human
uaaccugcggaaucaaccc

SEQ ID NO: 735883 - RNA, 19 nt, Human
uaaggcagcauucaggugg

SEQ ID NO: 735884 - RNA, 20 nt, Human
uaaguaggcaagccacuagc

SEQ ID NO: 735885 - RNA, 23 nt, Human
uacacgcacagaaccccaaagga

SEQ ID NO: 735886 - RNA, 23 nt, Human
uacaugguuucccaaugcuuccc

SEQ ID NO: 735887 - RNA, 20 nt, Human
uagaaagucccaccugcucc

SEQ ID NO: 735888 - RNA, 22 nt, Human
uagcagaucccguaaacguagu

SEQ ID NO: 735889 - RNA, 24 nt, Human
uaucuaacccacacaaucaaccca

SEQ ID NO: 735890 - RNA, 24 nt, Human
uaucuaacccacacaaucaaccca

SEQ ID NO: 735891 - RNA, 24 nt, Human
uaucuaacccacacaaucaaccca

SEQ ID NO: 735892 - RNA, 24 nt, Human
uaucuaacccacacaaucaaccca

SEQ ID NO: 735893 - RNA, 24 nt, Human
uaucuaacccacacaaucaaccca

SEQ ID NO: 735894 - RNA, 24 nt, Human
uaucuaacccacauagucaaccca

SEQ ID NO: 735895 - RNA, 18 nt, Human
ucacaggguuuacucccu

SEQ ID NO: 735896 - RNA, 22 nt, Human
ucacccaccuuuaaggguucug

SEQ ID NO: 735897 - RNA, 24 nt, Human
ucacgaggucaguaguucgagacc

SEQ ID NO: 735898 - RNA, 19 nt, Human
ucagaaucucccucaagua

SEQ ID NO: 735899 - RNA, 22 nt, Human
ucagccccgacugccacccacc

SEQ ID NO: 735900 - RNA, 20 nt, Human
uccacacagaauuuuggaaa

SEQ ID NO: 735901 - RNA, 24 nt, Human
uccacggccacggucacccggaag

SEQ ID NO: 735902 - RNA, 24 nt, Human
uccagccugggugacagggcaaga

SEQ ID NO: 735903 - RNA, 23 nt, Human
uccaucugcagcacgccuuggga

SEQ ID NO: 735904 - RNA, 24 nt, Human
ucccacaggagaagggggagggaa

SEQ ID NO: 735905 - RNA, 23 nt, Human
uccccggcucccaucuagggauc

SEQ ID NO: 735906 - RNA, 26 nt, Human
uccccggcucccaucuagggauccac

SEQ ID NO: 735907 - RNA, 22 nt, Human
ucccuaaguaggcaagccacua

SEQ ID NO: 735908 - RNA, 19 nt, Human
ucccucaaguacacgcaac

SEQ ID NO: 735909 - RNA, 20 nt, Human
uccgagcuggaguggucucc

SEQ ID NO: 735910 - RNA, 21 nt, Human
uccgagcuggaguggucuccg

SEQ ID NO: 735911 - RNA, 21 nt, Human
uccggaguggcuucccccagc

SEQ ID NO: 735912 - RNA, 18 nt, Human
uccugaaaagccugguua

SEQ ID NO: 735913 - RNA, 23 nt, Human
ucgcaccauugcacuccagccug

SEQ ID NO: 735914 - RNA, 24 nt, Human
ucgcuugaaccugggagacggagg

SEQ ID NO: 735915 - RNA, 25 nt, Human
ucgcuugaaccugggagacggaggu

SEQ ID NO: 735916 - RNA, 22 nt, Human
ucggagcccccacaccugggga

SEQ ID NO: 735917 - RNA, 24 nt, Human
ucuccaccacagacguguccccag

SEQ ID NO: 735918 - RNA, 21 nt, Human
ucucuacuaaaaauacaaaaa

SEQ ID NO: 735919 - RNA, 23 nt, Human
ucucugguucccagucaccccca

SEQ ID NO: 735920 - RNA, 22 nt, Human
ucuuccaggauacaugguaucc

SEQ ID NO: 735921 - RNA, 22 nt, Human
ugaaacaccagcguuggcacug

SEQ ID NO: 735922 - RNA, 25 nt, Human
ugaaacaggcaacuggauaucaggc

SEQ ID NO: 735923 - RNA, 24 nt, Human
ugaaccugggagacggagguugca

SEQ ID NO: 735924 - RNA, 21 nt, Human
ugaauaucuuuguuuaaaagg

SEQ ID NO: 735925 - RNA, 22 nt, Human
ugagccgagaucgcaccauugc

SEQ ID NO: 735926 - RNA, 20 nt, Human
ugaggcagaagaaucgcuug

SEQ ID NO: 735927 - RNA, 24 nt, Human
ugaggcagaagaaucgcuugaacc

SEQ ID NO: 735928 - RNA, 25 nt, Human
ugaggcagaagaaucgcuugaaccu

SEQ ID NO: 735929 - RNA, 19 nt, Human
ugauaaggcagcauucagg

SEQ ID NO: 735930 - RNA, 22 nt, Human
ugauaaggcagcauucaggugg

SEQ ID NO: 735931 - RNA, 23 nt, Human
ugauaaggcagcauucagguggc

SEQ ID NO: 735932 - RNA, 22 nt, Human
ugcacuccagccugggugacag

SEQ ID NO: 735933 - RNA, 18 nt, Human
ugccacagaaaagcugaa

SEQ ID NO: 735934 - RNA, 23 nt, Human
ugcccgaggacagguguuccagg

SEQ ID NO: 735935 - RNA, 21 nt, Human
ugcgcacaacacaaaacaccu

SEQ ID NO: 735936 - RNA, 21 nt, Human
uggaaacggaagcagccucga

SEQ ID NO: 735937 - RNA, 21 nt, Human
uggaaagcuaagcuggacuca

SEQ ID NO: 735938 - RNA, 24 nt, Human
uggaaugcaauuuuccaccugaaa

SEQ ID NO: 735939 - RNA, 18 nt, Human
uggacaagccccacccag

SEQ ID NO: 735940 - RNA, 18 nt, Human
uggacaagccccacccag

SEQ ID NO: 735941 - RNA, 22 nt, Human
uggacaagccccacccaggucc

SEQ ID NO: 735942 - RNA, 22 nt, Human
uggcacacgcguguaaucccag

SEQ ID NO: 735943 - RNA, 24 nt, Human
uggccaacauggugaaaucccauc

SEQ ID NO: 735944 - RNA, 20 nt, Human
uggccacgcacacuuuaaca

SEQ ID NO: 735945 - RNA, 22 nt, Human
uggcucacgccuguaaucccag

SEQ ID NO: 735946 - RNA, 24 nt, Human
uggcucacgccuguaaucccagca

SEQ ID NO: 735947 - RNA, 26 nt, Human
uggcuugugauaaggcagcauucagg

SEQ ID NO: 735948 - RNA, 24 nt, Human
ugggagacggagguugcagugagc

SEQ ID NO: 735949 - RNA, 18 nt, Human
ugggaggccauggcaggu

SEQ ID NO: 735950 - RNA, 24 nt, Human
ugggaggccauggcagguggauca

SEQ ID NO: 735951 - RNA, 20 nt, Human
uggguccguccgagcuggag

SEQ ID NO: 735952 - RNA, 24 nt, Human
ugguggcacacgcguguaauccca

SEQ ID NO: 735953 - RNA, 24 nt, Human
ugguggcucacgccuguaauccca

SEQ ID NO: 735954 - RNA, 18 nt, Human
ugguucccagucaccccc

SEQ ID NO: 735955 - RNA, 19 nt, Human
ugucccagagaaaacacag

SEQ ID NO: 735956 - RNA, 23 nt, Human
ugucugaagagcucucgauagga

SEQ ID NO: 735957 - RNA, 22 nt, Human
ugugcaagaacuggaaaaccgg

SEQ ID NO: 735958 - RNA, 19 nt, Human
uguuggggcaugugaaggg

SEQ ID NO: 735959 - RNA, 22 nt, Human
uguuggggcaugugaaggggcc

SEQ ID NO: 735960 - RNA, 18 nt, Human
uuagccuuaacagcuuca

SEQ ID NO: 735961 - RNA, 24 nt, Human
uuaggccgagcaugguggcucacg

SEQ ID NO: 735962 - RNA, 21 nt, Human
uuccaaaaggucuccacgccc

SEQ ID NO: 735963 - RNA, 19 nt, Human
uuccugcgggggcagaugg

SEQ ID NO: 735964 - RNA, 24 nt, Human
uugaaccugggagacggagguugc

SEQ ID NO: 735965 - RNA, 18 nt, Human
uugcagugagccgagauc

SEQ ID NO: 735966 - RNA, 19 nt, Human
uugcagugagccgagaucg

SEQ ID NO: 735967 - RNA, 20 nt, Human
uugcagugagccgagaucgc

SEQ ID NO: 735968 - RNA, 22 nt, Human
uugcagugagccgagaucgcac

SEQ ID NO: 735969 - RNA, 19 nt, Human
uuucucaggaauggugcug

SEQ ID NO: 735970 - RNA, 21 nt, Human
uuuucauaccacacacauaua

SEQ ID NO: 735971 - RNA, 25 nt, Human
uuuucauaccacacacauauauuuc

SEQ ID NO: 735972 - RNA, 22 nt, Human
uuuuuuaggccgagcauggugg

SEQ ID NO: 735973 - RNA, 24 nt, Human
aaaaaaaaaaaaaaaaaugccaag

SEQ ID NO: 735974 - RNA, 23 nt, Human
aaaaaaaaaaaaaaugccaacag

SEQ ID NO: 735975 - RNA, 18 nt, Human
aaaaagccaacagaggca

SEQ ID NO: 735976 - RNA, 22 nt, Human
aaaaagccaacagaggcaggug

SEQ ID NO: 735977 - RNA, 19 nt, Human
aaacaaacaaagaaaaccc

SEQ ID NO: 735978 - RNA, 20 nt, Human
aaacaaacaaagaaaacccc

SEQ ID NO: 735979 - RNA, 21 nt, Human
aaacaaacaaagaaaacccca

SEQ ID NO: 735980 - RNA, 23 nt, Human
aaacaaagaaaaccccaacccuu

SEQ ID NO: 735981 - RNA, 22 nt, Human
aaacaagacgggacuuaucuga

SEQ ID NO: 735982 - RNA, 21 nt, Human
aaacagaaggcucuggacccg

SEQ ID NO: 735983 - RNA, 19 nt, Human
aaaccccacccccaccccc

SEQ ID NO: 735984 - RNA, 22 nt, Human
aaagucccuuauagcgcugcuc

SEQ ID NO: 735985 - RNA, 23 nt, Human
aaauacagcgagacuccaucaca

SEQ ID NO: 735986 - RNA, 24 nt, Human
aacaaacccagcccaucgucucuc

SEQ ID NO: 735987 - RNA, 20 nt, Human
aacaaagaaaaccccaaccc

SEQ ID NO: 735988 - RNA, 20 nt, Human
aacaguaacuaagaaacccc

SEQ ID NO: 735989 - RNA, 20 nt, Human
aacauggcgaaacccugucu

SEQ ID NO: 735990 - RNA, 21 nt, Human
aacauggcgaaacccugucuc

SEQ ID NO: 735991 - RNA, 22 nt, Human
aacccaaucccuugccagcacc

SEQ ID NO: 735992 - RNA, 19 nt, Human
aacuccccagcccugaccc

SEQ ID NO: 735993 - RNA, 23 nt, Human
aacugaacuccucagcauuacug

SEQ ID NO: 735994 - RNA, 19 nt, Human
aagcaacccuggccagagc

SEQ ID NO: 735995 - RNA, 20 nt, Human
aagcaacccuggccagagcc

SEQ ID NO: 735996 - RNA, 20 nt, Human
aaggaggagagcagugcccu

SEQ ID NO: 735997 - RNA, 22 nt, Human
aaugccccagacacacauucug

SEQ ID NO: 735998 - RNA, 19 nt, Human
aauggcacauggccucagu

SEQ ID NO: 735999 - RNA, 24 nt, Human
aauugcuugaacccgggaggugga

SEQ ID NO: 736000 - RNA, 20 nt, Human
acaaaacuuucauacaaaaa

SEQ ID NO: 736001 - RNA, 18 nt, Human
acaaacaaacaaacaaag

SEQ ID NO: 736002 - RNA, 19 nt, Human
acaaacaaacaaacaaaga

SEQ ID NO: 736003 - RNA, 19 nt, Human
acaaacccagcccaucguc

SEQ ID NO: 736004 - RNA, 19 nt, Human
acaaaggcuaaaaacauac

SEQ ID NO: 736005 - RNA, 19 nt, Human
acacacagcucccgggccg

SEQ ID NO: 736006 - RNA, 25 nt, Human
acacugagccuucuccaaccggagg

SEQ ID NO: 736007 - RNA, 22 nt, Human
acagcacaaggggcugucucuc

SEQ ID NO: 736008 - RNA, 24 nt, Human
acaggcagcgccgcgcuccgaggu

SEQ ID NO: 736009 - RNA, 23 nt, Human
acauucugugauccaaccaaucu

SEQ ID NO: 736010 - RNA, 22 nt, Human
acccacucucucccuaacacag

SEQ ID NO: 736011 - RNA, 21 nt, Human
acccagaagacccuaagcaac

SEQ ID NO: 736012 - RNA, 23 nt, Human
acccagcccaucgucucuccccu

SEQ ID NO: 736013 - RNA, 21 nt, Human
acccagcucauggcgagcaca

SEQ ID NO: 736014 - RNA, 24 nt, Human
accccaacccuuuccuccccugaa

SEQ ID NO: 736015 - RNA, 18 nt, Human
accccacccccaccccca

SEQ ID NO: 736016 - RNA, 22 nt, Human
accccacccccacccccagccc

SEQ ID NO: 736017 - RNA, 18 nt, Human
acccccacccccagcccc

SEQ ID NO: 736018 - RNA, 21 nt, Human
acccccacccccagccccugu

SEQ ID NO: 736019 - RNA, 24 nt, Human
acccugucucuacuaaaaacacaa

SEQ ID NO: 736020 - RNA, 24 nt, Human
accggggagguggaggcugcagug

SEQ ID NO: 736021 - RNA, 24 nt, Human
accugaggucaggaguucaagacc

SEQ ID NO: 736022 - RNA, 19 nt, Human
accuugagugagaaucugg

SEQ ID NO: 736023 - RNA, 22 nt, Human
acgaucguggcuauuucugauc

SEQ ID NO: 736024 - RNA, 20 nt, Human
acugagccuucuccaagcaa

SEQ ID NO: 736025 - RNA, 18 nt, Human
acugcacuccagccuggg

SEQ ID NO: 736026 - RNA, 21 nt, Human
acugcacuccagccugggcaa

SEQ ID NO: 736027 - RNA, 25 nt, Human
acugcacuccagccugggcaacaag

SEQ ID NO: 736028 - RNA, 26 nt, Human
acuguaacaaaggcuaaaaacauacc

SEQ ID NO: 736029 - RNA, 22 nt, Human
agaagacccuaagcaacagccc

SEQ ID NO: 736030 - RNA, 20 nt, Human
agaaggcggcaggucaaccg

SEQ ID NO: 736031 - RNA, 22 nt, Human
agaauugcuugaacccgggagg

SEQ ID NO: 736032 - RNA, 21 nt, Human
agagacacccacacaaaccca

SEQ ID NO: 736033 - RNA, 24 nt, Human
agagauugugucacugcacuccag

SEQ ID NO: 736034 - RNA, 21 nt, Human
agagcauccucuacaccgcac

SEQ ID NO: 736035 - RNA, 26 nt, Human
agagcucuccuacacccagguggccc

SEQ ID NO: 736036 - RNA, 28 nt, Human
agaggcaggugugaugccucccaagggg

SEQ ID NO: 736037 - RNA, 19 nt, Human
agagggcgugugcauggga

SEQ ID NO: 736038 - RNA, 24 nt, Human
agcacuuugggaggcugagguggg

SEQ ID NO: 736039 - RNA, 19 nt, Human
agcauggugaaaccccauc

SEQ ID NO: 736040 - RNA, 20 nt, Human
agcauggugaaaccccaucu

SEQ ID NO: 736041 - RNA, 18 nt, Human
agccaagccaagcugucu

SEQ ID NO: 736042 - RNA, 23 nt, Human
agccgggcgugguggcaggugcc

SEQ ID NO: 736043 - RNA, 23 nt, Human
agccgggcgugguggcgugcacc

SEQ ID NO: 736044 - RNA, 24 nt, Human
agccuggccaacauggcgaaaccc

SEQ ID NO: 736045 - RNA, 22 nt, Human
agccuggccagcauggugaaac

SEQ ID NO: 736046 - RNA, 24 nt, Human
agccuggccagcauggugaaaccc

SEQ ID NO: 736047 - RNA, 24 nt, Human
agccugggaaauacagcgagacuc

SEQ ID NO: 736048 - RNA, 19 nt, Human
agcggauucuucuaaccgc

SEQ ID NO: 736049 - RNA, 18 nt, Human
agcuggggcugggggcag

SEQ ID NO: 736050 - RNA, 23 nt, Human
agcuggggcugggggcaguggcu

SEQ ID NO: 736051 - RNA, 24 nt, Human
agcugugugacccaagggacacuu

SEQ ID NO: 736052 - RNA, 20 nt, Human
agcuguuuggcccccuuucu

SEQ ID NO: 736053 - RNA, 20 nt, Human
aggaaagagaaagcagaggg

SEQ ID NO: 736054 - RNA, 20 nt, Human
aggaggagggagagccccgc

SEQ ID NO: 736055 - RNA, 18 nt, Human
aggcaggagaaucacuug

SEQ ID NO: 736056 - RNA, 22 nt, Human
aggcaggagaaucacuugaacc

SEQ ID NO: 736057 - RNA, 24 nt, Human
aggcaggagaauugcuugaacccg

SEQ ID NO: 736058 - RNA, 22 nt, Human
aggcaggaggcaggggacccca

SEQ ID NO: 736059 - RNA, 23 nt, Human
aggcaggaggcaggggaccccag

SEQ ID NO: 736060 - RNA, 20 nt, Human
aggcaggcccccugagggcc

SEQ ID NO: 736061 - RNA, 21 nt, Human
aggccgaggcggguggcucac

SEQ ID NO: 736062 - RNA, 19 nt, Human
aggccuguuugguuucaac

SEQ ID NO: 736063 - RNA, 19 nt, Human
aggcggguggcucaccuga

SEQ ID NO: 736064 - RNA, 22 nt, Human
aggcggguggcucaccugaggu

SEQ ID NO: 736065 - RNA, 24 nt, Human
aggcugaggcaggagaaucacuug

SEQ ID NO: 736066 - RNA, 21 nt, Human
aggcugaggcaggagaauugc

SEQ ID NO: 736067 - RNA, 24 nt, Human
aggcugaggcaggagaauugcuug

SEQ ID NO: 736068 - RNA, 23 nt, Human
aggcugccuagaggggagcccag

SEQ ID NO: 736069 - RNA, 23 nt, Human
aggggagcccagcagccuggugu

SEQ ID NO: 736070 - RNA, 18 nt, Human
agguaguaaagggggaaa

SEQ ID NO: 736071 - RNA, 19 nt, Human
aggucaggaguucgagacc

SEQ ID NO: 736072 - RNA, 22 nt, Human
agguggaggcugcagugaacgg

SEQ ID NO: 736073 - RNA, 19 nt, Human
agguggagguugcagugag

SEQ ID NO: 736074 - RNA, 24 nt, Human
agguggagguugcagugaguagag

SEQ ID NO: 736075 - RNA, 23 nt, Human
aggugggggggaucaccugaggu

SEQ ID NO: 736076 - RNA, 24 nt, Human
aggugggggggaucaccugagguc

SEQ ID NO: 736077 - RNA, 24 nt, Human
aggugugaugccucacgccuguaa

SEQ ID NO: 736078 - RNA, 19 nt, Human
aguaacuaagaaaccccac

SEQ ID NO: 736079 - RNA, 19 nt, Human
aguggcagcgccggcccuc

SEQ ID NO: 736080 - RNA, 23 nt, Human
aguggcucacgccuguaauccca

SEQ ID NO: 736081 - RNA, 19 nt, Human
auaccaagugcuccagggu

SEQ ID NO: 736082 - RNA, 18 nt, Human
aucaggauuuuaauuugg

SEQ ID NO: 736083 - RNA, 24 nt, Human
aucuggccguuucgccuuguggga

SEQ ID NO: 736084 - RNA, 21 nt, Human
augcaggucaucggguggggu

SEQ ID NO: 736085 - RNA, 23 nt, Human
augccucacgccuguaaucccag

SEQ ID NO: 736086 - RNA, 22 nt, Human
auggagggcggcuuccgggcca

SEQ ID NO: 736087 - RNA, 23 nt, Human
caaacaaacaaagaaaaccccaa

SEQ ID NO: 736088 - RNA, 20 nt, Human
caaacccagcccaucgucuc

SEQ ID NO: 736089 - RNA, 21 nt, Human
caaacccagcccaucgucucu

SEQ ID NO: 736090 - RNA, 24 nt, Human
caacacuuugggaggccgaggcgg

SEQ ID NO: 736091 - RNA, 19 nt, Human
caacagccaaagccaagcc

SEQ ID NO: 736092 - RNA, 24 nt, Human
caacauggcgaaacccugucucua

SEQ ID NO: 736093 - RNA, 27 nt, Human
caaccuuaaaacagaguuuguagaaca

SEQ ID NO: 736094 - RNA, 20 nt, Human
caacuccccagcccugaccc

SEQ ID NO: 736095 - RNA, 18 nt, Human
caagaaugaguccuucac

SEQ ID NO: 736096 - RNA, 23 nt, Human
caagcaacccuggccagagccac

SEQ ID NO: 736097 - RNA, 22 nt, Human
caaggucgggcggcagggugcc

SEQ ID NO: 736098 - RNA, 25 nt, Human
caaucuauuaccacggccccucuua

SEQ ID NO: 736099 - RNA, 23 nt, Human
cacacaaacccaaucccuugcca

SEQ ID NO: 736100 - RNA, 20 nt, Human
cacacacaggagguucaaga

SEQ ID NO: 736101 - RNA, 19 nt, Human
cacagcccagcucaugccu

SEQ ID NO: 736102 - RNA, 21 nt, Human
cacagcccagcucaugccugc

SEQ ID NO: 736103 - RNA, 26 nt, Human
cacagcccucaaggucgggcggcagg

SEQ ID NO: 736104 - RNA, 20 nt, Human
cacagcuccagccuucuuuu

SEQ ID NO: 736105 - RNA, 18 nt, Human
caccagguucaagaaggc

SEQ ID NO: 736106 - RNA, 22 nt, Human
cacccagaagacccuaagcaac

SEQ ID NO: 736107 - RNA, 22 nt, Human
cacccccagccccugugggagc

SEQ ID NO: 736108 - RNA, 23 nt, Human
caccucauggcuguccugccugc

SEQ ID NO: 736109 - RNA, 20 nt, Human
caccuccccacgcagggacc

SEQ ID NO: 736110 - RNA, 23 nt, Human
caccugaggucaggaguucaaga

SEQ ID NO: 736111 - RNA, 23 nt, Human
caccugaggucaggaguucgaga

SEQ ID NO: 736112 - RNA, 20 nt, Human
caccugccugcugggcccag

SEQ ID NO: 736113 - RNA, 18 nt, Human
caccugucaucccagcua

SEQ ID NO: 736114 - RNA, 24 nt, Human
caccugucaucccagcuacucagg

SEQ ID NO: 736115 - RNA, 24 nt, Human
cacgccuguaaucccaacacuuug

SEQ ID NO: 736116 - RNA, 24 nt, Human
cacgccuguaaucccagcacuuug

SEQ ID NO: 736117 - RNA, 20 nt, Human
cacgcggaacagccuaggga

SEQ ID NO: 736118 - RNA, 18 nt, Human
cacuaggauuggcacagc

SEQ ID NO: 736119 - RNA, 24 nt, Human
cacuccagccugggcaacaagagc

SEQ ID NO: 736120 - RNA, 18 nt, Human
cacugaaaucccguggcc

SEQ ID NO: 736121 - RNA, 18 nt, Human
cacugcacgccacuuggg

SEQ ID NO: 736122 - RNA, 19 nt, Human
cacugcacuccagccuggg

SEQ ID NO: 736123 - RNA, 20 nt, Human
cacugcacuccagccugggc

SEQ ID NO: 736124 - RNA, 21 nt, Human
cacugcacuccagccugggca

SEQ ID NO: 736125 - RNA, 22 nt, Human
cacugcacuccagccugggcaa

SEQ ID NO: 736126 - RNA, 23 nt, Human
cacugcacuccagccugggcaac

SEQ ID NO: 736127 - RNA, 24 nt, Human
cacugcacuccagccugggcaaca

SEQ ID NO: 736128 - RNA, 18 nt, Human
cagagcucuccuacaccc

SEQ ID NO: 736129 - RNA, 24 nt, Human
cagcacuuugggaggcugaggugg

SEQ ID NO: 736130 - RNA, 24 nt, Human
cagcagcaaggguuccuggggugc

SEQ ID NO: 736131 - RNA, 22 nt, Human
cagccaaagccaagccaagcug

SEQ ID NO: 736132 - RNA, 18 nt, Human
cagccacagccccacgcu

SEQ ID NO: 736133 - RNA, 22 nt, Human
cagccgggcgugguggcaggug

SEQ ID NO: 736134 - RNA, 23 nt, Human
cagccuagggaaaagcgaaucuc

SEQ ID NO: 736135 - RNA, 21 nt, Human
cagccuccagagccacugccu

SEQ ID NO: 736136 - RNA, 22 nt, Human
cagcgcuuagaggcagaggcca

SEQ ID NO: 736137 - RNA, 24 nt, Human
cagcuacucaggaggcugaggcag

SEQ ID NO: 736138 - RNA, 24 nt, Human
cagcuacucggaaggcugaggcag

SEQ ID NO: 736139 - RNA, 26 nt, Human
cagcucauggcgagcacacuggcagg

SEQ ID NO: 736140 - RNA, 21 nt, Human
cagcucccgggccgucugcag

SEQ ID NO: 736141 - RNA, 22 nt, Human
caggcacacacacgucccucug

SEQ ID NO: 736142 - RNA, 19 nt, Human
cagggcagaugcaaucuau

SEQ ID NO: 736143 - RNA, 20 nt, Human
caggggcccugagccccggc

SEQ ID NO: 736144 - RNA, 21 nt, Human
cagucaggggcccugagcccc

SEQ ID NO: 736145 - RNA, 26 nt, Human
cagucuaccccauuucacuuacagag

SEQ ID NO: 736146 - RNA, 22 nt, Human
caucaccgagcgggacacaaga

SEQ ID NO: 736147 - RNA, 20 nt, Human
caugcacagggcagaugcag

SEQ ID NO: 736148 - RNA, 25 nt, Human
caugcgcaugcacagggcagaugca

SEQ ID NO: 736149 - RNA, 18 nt, Human
cauggugaaaccccaucu

SEQ ID NO: 736150 - RNA, 19 nt, Human
cauggugaaaccccaucuc

SEQ ID NO: 736151 - RNA, 21 nt, Human
cauggugaaaccccaucucua

SEQ ID NO: 736152 - RNA, 21 nt, Human
ccaaugcguguugcuuggauu

SEQ ID NO: 736153 - RNA, 20 nt, Human
ccacacaaacccaaucccuu

SEQ ID NO: 736154 - RNA, 23 nt, Human
ccaccagguucaagaaggcggca

SEQ ID NO: 736155 - RNA, 26 nt, Human
ccacccagaagacccuaagcaacagg

SEQ ID NO: 736156 - RNA, 22 nt, Human
ccacggcagcgacaggcaggag

SEQ ID NO: 736157 - RNA, 22 nt, Human
ccacugucacucccaacucaga

SEQ ID NO: 736158 - RNA, 19 nt, Human
ccagagcucuccuacaccc

SEQ ID NO: 736159 - RNA, 23 nt, Human
ccagcaugcagguguugggguca

SEQ ID NO: 736160 - RNA, 27 nt, Human
ccagcccuuggcccacgauggcccaug

SEQ ID NO: 736161 - RNA, 20 nt, Human
ccaggcggggugcagcuggc

SEQ ID NO: 736162 - RNA, 25 nt, Human
ccagguccugggggaagagaggaaa

SEQ ID NO: 736163 - RNA, 23 nt, Human
ccaucggucacacgauugauucc

SEQ ID NO: 736164 - RNA, 18 nt, Human
cccacagaagagaagggc

SEQ ID NO: 736165 - RNA, 23 nt, Human
cccaccucuauuucaugagcaaa

SEQ ID NO: 736166 - RNA, 24 nt, Human
cccagcccugacccagcucauggc

SEQ ID NO: 736167 - RNA, 22 nt, Human
cccagccugcacaacuccccag

SEQ ID NO: 736168 - RNA, 30 nt, Human
cccagccugcacaacuccccagcccugacc

SEQ ID NO: 736169 - RNA, 23 nt, Human
cccagcucauggcgagcacacug

SEQ ID NO: 736170 - RNA, 19 nt, Human
cccaggcaguaagugcgag

SEQ ID NO: 736171 - RNA, 21 nt, Human
cccaucgucucuccccuugga

SEQ ID NO: 736172 - RNA, 22 nt, Human
ccccaacagccaaagccaagcc

SEQ ID NO: 736173 - RNA, 24 nt, Human
ccccaacagccaaagccaagccaa

SEQ ID NO: 736174 - RNA, 19 nt, Human
ccccaacccuuuccucccc

SEQ ID NO: 736175 - RNA, 24 nt, Human
ccccagacacacauucugugaucc

SEQ ID NO: 736176 - RNA, 26 nt, Human
cccccacccucgccagcccuuggccc

SEQ ID NO: 736177 - RNA, 19 nt, Human
ccccuccucccucuugguc

SEQ ID NO: 736178 - RNA, 20 nt, Human
ccccuccucccucuuggucu

SEQ ID NO: 736179 - RNA, 21 nt, Human
cccgggagguggagguugcag

SEQ ID NO: 736180 - RNA, 22 nt, Human
cccguggccacgugcaucccca

SEQ ID NO: 736181 - RNA, 18 nt, Human
cccuccccgucccugagg

SEQ ID NO: 736182 - RNA, 21 nt, Human
cccuggcuuccagcuaaggaa

SEQ ID NO: 736183 - RNA, 20 nt, Human
cccuuggauauggugaauuu

SEQ ID NO: 736184 - RNA, 22 nt, Human
ccgcacccacucucucccuaac

SEQ ID NO: 736185 - RNA, 18 nt, Human
ccucauggcuguccugcc

SEQ ID NO: 736186 - RNA, 30 nt, Human
ccuccccugaaauggcuauuucaagagucc

SEQ ID NO: 736187 - RNA, 23 nt, Human
ccucgcucugacauuucucuaaa

SEQ ID NO: 736188 - RNA, 27 nt, Human
ccucuacaccgcacccacucucucccu

SEQ ID NO: 736189 - RNA, 20 nt, Human
ccucugcacuccagccuggg

SEQ ID NO: 736190 - RNA, 24 nt, Human
ccucugcacuccagccugggaaau

SEQ ID NO: 736191 - RNA, 20 nt, Human
ccugaaauggcuauuucaag

SEQ ID NO: 736192 - RNA, 18 nt, Human
ccugaggcuggggcuggg

SEQ ID NO: 736193 - RNA, 22 nt, Human
ccugaggucaggaguucgagac

SEQ ID NO: 736194 - RNA, 24 nt, Human
ccugccccacagcgggagacuggg

SEQ ID NO: 736195 - RNA, 19 nt, Human
ccugccugcaucccuugcc

SEQ ID NO: 736196 - RNA, 21 nt, Human
ccugccugcugggcccagagg

SEQ ID NO: 736197 - RNA, 22 nt, Human
ccugccugcugggcccagaggg

SEQ ID NO: 736198 - RNA, 21 nt, Human
ccugcggagugcgaccucugg

SEQ ID NO: 736199 - RNA, 22 nt, Human
ccuggccaacauggcgaaaccc

SEQ ID NO: 736200 - RNA, 24 nt, Human
ccuggccaacauggcgaaacccug

SEQ ID NO: 736201 - RNA, 19 nt, Human
ccuggccagagccacuguc

SEQ ID NO: 736202 - RNA, 23 nt, Human
ccuggccagcauggugaaacccc

SEQ ID NO: 736203 - RNA, 24 nt, Human
ccuggccagcauggugaaacccca

SEQ ID NO: 736204 - RNA, 22 nt, Human
ccuguaaucccaacacuuuggg

SEQ ID NO: 736205 - RNA, 22 nt, Human
ccuguaaucccagcacuuuggg

SEQ ID NO: 736206 - RNA, 21 nt, Human
ccuguaaucccagcuacucgg

SEQ ID NO: 736207 - RNA, 26 nt, Human
ccugugguuaaacaugcgcaugcaca

SEQ ID NO: 736208 - RNA, 19 nt, Human
ccuucugacaacucaaggu

SEQ ID NO: 736209 - RNA, 22 nt, Human
ccuucuuuccucacaacugaac

SEQ ID NO: 736210 - RNA, 23 nt, Human
cgacaggcaggaggcaggggacc

SEQ ID NO: 736211 - RNA, 18 nt, Human
cgaccuugagugagaauc

SEQ ID NO: 736212 - RNA, 24 nt, Human
cgagaccagccuggccagcauggu

SEQ ID NO: 736213 - RNA, 26 nt, Human
cgaggcggguggcucaccugagguca

SEQ ID NO: 736214 - RNA, 23 nt, Human
cgccuguaaucccaacacuuugg

SEQ ID NO: 736215 - RNA, 23 nt, Human
cgccuguaaucccagcacuuugg

SEQ ID NO: 736216 - RNA, 20 nt, Human
cggaaggcugaggcaggaga

SEQ ID NO: 736217 - RNA, 21 nt, Human
cggcacugcugugacucuggc

SEQ ID NO: 736218 - RNA, 19 nt, Human
cggcauaguucagagggaa

SEQ ID NO: 736219 - RNA, 29 nt, Human
cgggagguggagguugcagugacaacggu

SEQ ID NO: 736220 - RNA, 24 nt, Human
cgggagguggagguugcagugagu

SEQ ID NO: 736221 - RNA, 24 nt, Human
cggguggcucaccugaggucagga

SEQ ID NO: 736222 - RNA, 23 nt, Human
cggucgucccccaccucuauuuc

SEQ ID NO: 736223 - RNA, 20 nt, Human
cgucugcaggcacacacacg

SEQ ID NO: 736224 - RNA, 19 nt, Human
cguuugccuucucuuucuc

SEQ ID NO: 736225 - RNA, 27 nt, Human
cuaaaaaaaaaaaaaaaaaaugccaaa

SEQ ID NO: 736226 - RNA, 19 nt, Human
cuaaaaagccaacagaggc

SEQ ID NO: 736227 - RNA, 19 nt, Human
cuaaaacuguaacaaaggc

SEQ ID NO: 736228 - RNA, 21 nt, Human
cuaacuaaaaagccaacagag

SEQ ID NO: 736229 - RNA, 21 nt, Human
cuacuaaaaacacaaaaauca

SEQ ID NO: 736230 - RNA, 24 nt, Human
cucaccugaggucaggaguucaag

SEQ ID NO: 736231 - RNA, 22 nt, Human
cucacgccuguaaucccaacac

SEQ ID NO: 736232 - RNA, 24 nt, Human
cucacgccuguaaucccaacacuu

SEQ ID NO: 736233 - RNA, 22 nt, Human
cucacgccuguaaucccagcac

SEQ ID NO: 736234 - RNA, 24 nt, Human
cucacgccuguaaucccagcacuu

SEQ ID NO: 736235 - RNA, 18 nt, Human
cucagaaucaaacaaaac

SEQ ID NO: 736236 - RNA, 22 nt, Human
cucagaaucaaacaaaacuuuc

SEQ ID NO: 736237 - RNA, 19 nt, Human
cuccaccacugggugugcc

SEQ ID NO: 736238 - RNA, 22 nt, Human
cuccagagccacugccugcucu

SEQ ID NO: 736239 - RNA, 19 nt, Human
cuccucagcauuacugggc

SEQ ID NO: 736240 - RNA, 23 nt, Human
cucuacaccgcacccacucucuc

SEQ ID NO: 736241 - RNA, 21 nt, Human
cucugcaccacagcccagcuc

SEQ ID NO: 736242 - RNA, 26 nt, Human
cucugcacuccagccugggaaauaca

SEQ ID NO: 736243 - RNA, 19 nt, Human
cugaaaucccguggccacg

SEQ ID NO: 736244 - RNA, 23 nt, Human
cugagccuucuccaagcaacccu

SEQ ID NO: 736245 - RNA, 21 nt, Human
cugcaucccuugcccaccccc

SEQ ID NO: 736246 - RNA, 21 nt, Human
cugcuucucuccagccacugu

SEQ ID NO: 736247 - RNA, 22 nt, Human
cuggagccguggcuggacgcug

SEQ ID NO: 736248 - RNA, 24 nt, Human
cuggagccguggcuggacgcugca

SEQ ID NO: 736249 - RNA, 23 nt, Human
cuggccagcauggugaaacccca

SEQ ID NO: 736250 - RNA, 18 nt, Human
cuggccuggaguaccugg

SEQ ID NO: 736251 - RNA, 22 nt, Human
cugggccucggugcugguuuua

SEQ ID NO: 736252 - RNA, 19 nt, Human
cugggucugcuugcucugc

SEQ ID NO: 736253 - RNA, 21 nt, Human
cugucaucccagcuacucagg

SEQ ID NO: 736254 - RNA, 21 nt, Human
cuguccugccugcaucccuug

SEQ ID NO: 736255 - RNA, 18 nt, Human
cuguuccugccccacagc

SEQ ID NO: 736256 - RNA, 20 nt, Human
cuuccgggccaguguuggcc

SEQ ID NO: 736257 - RNA, 21 nt, Human
cuuugggaggcugaggugggg

SEQ ID NO: 736258 - RNA, 23 nt, Human
gaaaccuuucacaaacucuuuac

SEQ ID NO: 736259 - RNA, 24 nt, Human
gaaacuuucucaaccuuaaaacag

SEQ ID NO: 736260 - RNA, 18 nt, Human
gaacaaagucugaaugca

SEQ ID NO: 736261 - RNA, 23 nt, Human
gagaaucacuugaaccggggagg

SEQ ID NO: 736262 - RNA, 20 nt, Human
gagagccccgcgggccuauu

SEQ ID NO: 736263 - RNA, 24 nt, Human
gagcucuccuacacccagguggcc

SEQ ID NO: 736264 - RNA, 18 nt, Human
gaggagugagcgagaggc

SEQ ID NO: 736265 - RNA, 24 nt, Human
gaggauggcaggaggagggagagc

SEQ ID NO: 736266 - RNA, 18 nt, Human
gaggggaggauggcagga

SEQ ID NO: 736267 - RNA, 18 nt, Human
gaggggccaccagagcuc

SEQ ID NO: 736268 - RNA, 26 nt, Human
gaggugggggggaucaccugagguca

SEQ ID NO: 736269 - RNA, 23 nt, Human
gagguugcagugaguagagauug

SEQ ID NO: 736270 - RNA, 18 nt, Human
gaguccaccccuuagggc

SEQ ID NO: 736271 - RNA, 24 nt, Human
gaucaccugaggucaggaguucga

SEQ ID NO: 736272 - RNA, 21 nt, Human
gaucugcuucucuccagccac

SEQ ID NO: 736273 - RNA, 18 nt, Human
gaugacaggccuucgugc

SEQ ID NO: 736274 - RNA, 24 nt, Human
gaugccucacgccuguaaucccag

SEQ ID NO: 736275 - RNA, 20 nt, Human
gcagcaggaguggcucuggg

SEQ ID NO: 736276 - RNA, 22 nt, Human
gcagcuacaggcagcgccgcgc

SEQ ID NO: 736277 - RNA, 23 nt, Human
gcaggagaaucacuugaaccggg

SEQ ID NO: 736278 - RNA, 18 nt, Human
gcagugcacucaggcucu

SEQ ID NO: 736279 - RNA, 19 nt, Human
gcaguggccggguaaguga

SEQ ID NO: 736280 - RNA, 24 nt, Human
gccaacauggcgaaacccugucuc

SEQ ID NO: 736281 - RNA, 24 nt, Human
gccagcauggugaaaccccaucuc

SEQ ID NO: 736282 - RNA, 24 nt, Human
gccaugucucucugcccacacaca

SEQ ID NO: 736283 - RNA, 22 nt, Human
gcccaacgaagucagcgcugcc

SEQ ID NO: 736284 - RNA, 18 nt, Human
gcccuggagccguggcug

SEQ ID NO: 736285 - RNA, 20 nt, Human
gcccugggugugccccuggu

SEQ ID NO: 736286 - RNA, 19 nt, Human
gccucugcacuccagccug

SEQ ID NO: 736287 - RNA, 21 nt, Human
gcgaaacccugucucuacuaa

SEQ ID NO: 736288 - RNA, 20 nt, Human
gcgcaugcacagggcagaug

SEQ ID NO: 736289 - RNA, 22 nt, Human
gcgcucccaaggacucucacuc

SEQ ID NO: 736290 - RNA, 21 nt, Human
gcgggacacaagauugcaaaa

SEQ ID NO: 736291 - RNA, 22 nt, Human
gcgugcaccugucaucccagcu

SEQ ID NO: 736292 - RNA, 23 nt, Human
gcucaccugaggucaggaguuca

SEQ ID NO: 736293 - RNA, 24 nt, Human
gcucaccugaggucaggaguucaa

SEQ ID NO: 736294 - RNA, 21 nt, Human
gcucaggggagcugcugguga

SEQ ID NO: 736295 - RNA, 18 nt, Human
gcuccgggaagcccugcu

SEQ ID NO: 736296 - RNA, 24 nt, Human
gcucuggacccagcaugcaggugu

SEQ ID NO: 736297 - RNA, 22 nt, Human
gcuguuuggcccccuuucuuuc

SEQ ID NO: 736298 - RNA, 26 nt, Human
gcuguuuggcccccuuucuuucuuuu

SEQ ID NO: 736299 - RNA, 22 nt, Human
gcuuccagcuaaggaaccccag

SEQ ID NO: 736300 - RNA, 20 nt, Human
gcuucgugaccauggaggcu

SEQ ID NO: 736301 - RNA, 23 nt, Human
ggaaggcugaggcaggagaauca

SEQ ID NO: 736302 - RNA, 19 nt, Human
ggacuggaaacgggacagg

SEQ ID NO: 736303 - RNA, 22 nt, Human
ggagacacacagcucccgggcc

SEQ ID NO: 736304 - RNA, 19 nt, Human
ggagaccacaggcagccuc

SEQ ID NO: 736305 - RNA, 24 nt, Human
ggagaucgugccucugcacuccag

SEQ ID NO: 736306 - RNA, 20 nt, Human
ggagcugcuggugaggcugc

SEQ ID NO: 736307 - RNA, 24 nt, Human
ggaggcugcagugaacggagaucg

SEQ ID NO: 736308 - RNA, 24 nt, Human
ggagggguguagaagggaaguugg

SEQ ID NO: 736309 - RNA, 19 nt, Human
ggagguagccaggaagggc

SEQ ID NO: 736310 - RNA, 22 nt, Human
ggagguugcagugaguagagau

SEQ ID NO: 736311 - RNA, 24 nt, Human
ggagguugcagugaguagagauug

SEQ ID NO: 736312 - RNA, 23 nt, Human
ggaucaccugaggucaggaguuc

SEQ ID NO: 736313 - RNA, 20 nt, Human
ggcaggaggagggagagccc

SEQ ID NO: 736314 - RNA, 19 nt, Human
ggcagggugccugcaaugg

SEQ ID NO: 736315 - RNA, 23 nt, Human
ggccaugucucucugcccacaca

SEQ ID NO: 736316 - RNA, 23 nt, Human
ggcccugggugugccccuggugu

SEQ ID NO: 736317 - RNA, 18 nt, Human
ggcgcagcuacaggcagc

SEQ ID NO: 736318 - RNA, 23 nt, Human
ggcgugguggcaggugccuguaa

SEQ ID NO: 736319 - RNA, 22 nt, Human
ggcucaccugaggucaggaguu

SEQ ID NO: 736320 - RNA, 18 nt, Human
gggaaaagcgaaucucac

SEQ ID NO: 736321 - RNA, 22 nt, Human
gggagcugcuggugaggcugcc

SEQ ID NO: 736322 - RNA, 23 nt, Human
gggaggcugccuagaggggagcc

SEQ ID NO: 736323 - RNA, 23 nt, Human
gggaucaccugaggucaggaguu

SEQ ID NO: 736324 - RNA, 24 nt, Human
gggaucaccugaggucaggaguuc

SEQ ID NO: 736325 - RNA, 18 nt, Human
gggcuggccuggaguacc

SEQ ID NO: 736326 - RNA, 18 nt, Human
gggcugggccacugccac

SEQ ID NO: 736327 - RNA, 18 nt, Human
ggggaggcugccuagagg

SEQ ID NO: 736328 - RNA, 23 nt, Human
ggggcaguggcucacgccuguaa

SEQ ID NO: 736329 - RNA, 21 nt, Human
ggggcugggggcaguggcuca

SEQ ID NO: 736330 - RNA, 24 nt, Human
gggggggaucaccugaggucagga

SEQ ID NO: 736331 - RNA, 19 nt, Human
gguccugggggaagagagg

SEQ ID NO: 736332 - RNA, 24 nt, Human
gguggcaggugccuguaaucccag

SEQ ID NO: 736333 - RNA, 21 nt, Human
gguggcucaccugaggucagg

SEQ ID NO: 736334 - RNA, 19 nt, Human
guauggagggcggcuuccg

SEQ ID NO: 736335 - RNA, 24 nt, Human
gucacugcacuccagccugggcaa

SEQ ID NO: 736336 - RNA, 26 nt, Human
gugcacccauugcagggaagguggcc

SEQ ID NO: 736337 - RNA, 20 nt, Human
guggcaggugguaagcccug

SEQ ID NO: 736338 - RNA, 27 nt, Human
guguccacccagaagacccuaagcaac

SEQ ID NO: 736339 - RNA, 21 nt, Human
guguuggggucaggccccggg

SEQ ID NO: 736340 - RNA, 22 nt, Human
guguuggggucaggccccgggc

SEQ ID NO: 736341 - RNA, 23 nt, Human
guucccgucacuuccuguuccug

SEQ ID NO: 736342 - RNA, 19 nt, Human
guuugccuucucuuucucc

SEQ ID NO: 736343 - RNA, 18 nt, Human
uaaaaagccaacagaggc

SEQ ID NO: 736344 - RNA, 21 nt, Human
uaaaacuguaacaaaggcuaa

SEQ ID NO: 736345 - RNA, 18 nt, Human
uaacaaaggcuaaaaaca

SEQ ID NO: 736346 - RNA, 23 nt, Human
uaacacaggcguuuccuccucaa

SEQ ID NO: 736347 - RNA, 21 nt, Human
uaacuaagaaaccccaccccc

SEQ ID NO: 736348 - RNA, 22 nt, Human
uaacuaagaaaccccaccccca

SEQ ID NO: 736349 - RNA, 21 nt, Human
uaagaaaccccacccccaccc

SEQ ID NO: 736350 - RNA, 18 nt, Human
uaaugcaugacuaagaac

SEQ ID NO: 736351 - RNA, 23 nt, Human
uacaaaaauccuguacauacagg

SEQ ID NO: 736352 - RNA, 21 nt, Human
uaccaaaaauauaaaaauuag

SEQ ID NO: 736353 - RNA, 27 nt, Human
uaccaagugcuccagggugguaaagac

SEQ ID NO: 736354 - RNA, 19 nt, Human
uagcuuccagcccuggcuu

SEQ ID NO: 736355 - RNA, 21 nt, Human
uagcuuccagcccuggcuucc

SEQ ID NO: 736356 - RNA, 20 nt, Human
uaguucagagggaaaaagga

SEQ ID NO: 736357 - RNA, 26 nt, Human
ucaaccuuaaaacagaguuuguagaa

SEQ ID NO: 736358 - RNA, 22 nt, Human
ucacccuugaaacuuucucaac

SEQ ID NO: 736359 - RNA, 19 nt, Human
ucaccggugcaaggaggag

SEQ ID NO: 736360 - RNA, 20 nt, Human
ucaccugaggucaggaguuc

SEQ ID NO: 736361 - RNA, 22 nt, Human
ucaccugaggucaggaguucaa

SEQ ID NO: 736362 - RNA, 20 nt, Human
ucacggucuggccagcggca

SEQ ID NO: 736363 - RNA, 22 nt, Human
ucacugcacgccacuugggggc

SEQ ID NO: 736364 - RNA, 20 nt, Human
ucacugcacuccagccuggg

SEQ ID NO: 736365 - RNA, 21 nt, Human
ucacugcacuccagccugggc

SEQ ID NO: 736366 - RNA, 24 nt, Human
ucacugcacuccagccugggcaac

SEQ ID NO: 736367 - RNA, 18 nt, Human
ucacugcacucugcaggc

SEQ ID NO: 736368 - RNA, 23 nt, Human
ucacuuccuguuccugccccguc

SEQ ID NO: 736369 - RNA, 18 nt, Human
ucagaaacuggacucucc

SEQ ID NO: 736370 - RNA, 25 nt, Human
ucagaacaccugccugcugggccca

SEQ ID NO: 736371 - RNA, 20 nt, Human
ucagaggagguagccaggaa

SEQ ID NO: 736372 - RNA, 18 nt, Human
ucagcagaagugaauggc

SEQ ID NO: 736373 - RNA, 23 nt, Human
ucagccgggcgugguggcaggug

SEQ ID NO: 736374 - RNA, 19 nt, Human
ucagcgcugccuuuccuuc

SEQ ID NO: 736375 - RNA, 21 nt, Human
ucaggccccgggcccaugggc

SEQ ID NO: 736376 - RNA, 18 nt, Human
ucaggcugcagugcacuc

SEQ ID NO: 736377 - RNA, 19 nt, Human
ucaugcaggucaucgggug

SEQ ID NO: 736378 - RNA, 22 nt, Human
ucaugucaggggucuggaauac

SEQ ID NO: 736379 - RNA, 19 nt, Human
ucccaaggacucucacuca

SEQ ID NO: 736380 - RNA, 19 nt, Human
ucccaggcacacugagccu

SEQ ID NO: 736381 - RNA, 27 nt, Human
uccccaacagccaaagccaagccaagc

SEQ ID NO: 736382 - RNA, 21 nt, Human
uccccagcccugacccagcuc

SEQ ID NO: 736383 - RNA, 26 nt, Human
ucccccaccucuauuucaugagcaaa

SEQ ID NO: 736384 - RNA, 22 nt, Human
uccccuuggauauggugaauuu

SEQ ID NO: 736385 - RNA, 19 nt, Human
ucccucuggugggagccag

SEQ ID NO: 736386 - RNA, 26 nt, Human
ucccugaggcuggggcugggguaccc

SEQ ID NO: 736387 - RNA, 25 nt, Human
ucccuuuccuggagagcaugugaua

SEQ ID NO: 736388 - RNA, 22 nt, Human
uccgucuaaaaaaaaaaaaaaa

SEQ ID NO: 736389 - RNA, 25 nt, Human
uccgucuaaaaaaaaaaaaaaaaaa

SEQ ID NO: 736390 - RNA, 25 nt, Human
ucggaaggcugaggcaggagaauca

SEQ ID NO: 736391 - RNA, 18 nt, Human
ucggcuuuagcuguguga

SEQ ID NO: 736392 - RNA, 20 nt, Human
ucgucccccaccucuauuuc

SEQ ID NO: 736393 - RNA, 22 nt, Human
ucuaggaaagagaaagcagagg

SEQ ID NO: 736394 - RNA, 22 nt, Human
ucucacucacugcacucugcag

SEQ ID NO: 736395 - RNA, 28 nt, Human
ucucacucacugcacucugcaggcuaga

SEQ ID NO: 736396 - RNA, 19 nt, Human
ucuccaagcaacccuggcc

SEQ ID NO: 736397 - RNA, 21 nt, Human
ucuccagccacugucacuccc

SEQ ID NO: 736398 - RNA, 19 nt, Human
ucugaaugcauuucagcua

SEQ ID NO: 736399 - RNA, 26 nt, Human
ucugcacuccagccugggaaauacag

SEQ ID NO: 736400 - RNA, 23 nt, Human
ucugcagucuggcagcauauggu

SEQ ID NO: 736401 - RNA, 19 nt, Human
ucugcaguuggcaucagag

SEQ ID NO: 736402 - RNA, 20 nt, Human
ucugcuucagaagggagcug

SEQ ID NO: 736403 - RNA, 23 nt, Human
ucugugauucccccacugggccu

SEQ ID NO: 736404 - RNA, 23 nt, Human
ugaacaucaggauuuuaauuugg

SEQ ID NO: 736405 - RNA, 24 nt, Human
ugaacaucaggauuuuaauuugga

SEQ ID NO: 736406 - RNA, 20 nt, Human
ugacccaagggacacuuugg

SEQ ID NO: 736407 - RNA, 23 nt, Human
ugacccaagggacacuuuggcac

SEQ ID NO: 736408 - RNA, 18 nt, Human
ugacccagcucauggcga

SEQ ID NO: 736409 - RNA, 18 nt, Human
ugagagggcuggauggga

SEQ ID NO: 736410 - RNA, 19 nt, Human
ugagaucacucaugcacca

SEQ ID NO: 736411 - RNA, 25 nt, Human
ugagcaaaucaucuaggauuaagga

SEQ ID NO: 736412 - RNA, 20 nt, Human
ugaggagggaccagccucag

SEQ ID NO: 736413 - RNA, 20 nt, Human
ugaggcaggagaaucacuug

SEQ ID NO: 736414 - RNA, 24 nt, Human
ugaggcaggagaaucacuugaacc

SEQ ID NO: 736415 - RNA, 24 nt, Human
ugaggcaggagaauugcuugaacc

SEQ ID NO: 736416 - RNA, 25 nt, Human
ugaggcaggagaauugcuugaaccc

SEQ ID NO: 736417 - RNA, 20 nt, Human
ugaggcugccuggaggggag

SEQ ID NO: 736418 - RNA, 18 nt, Human
ugagggaggaacagcgga

SEQ ID NO: 736419 - RNA, 25 nt, Human
ugaggugggggggaucaccugaggu

SEQ ID NO: 736420 - RNA, 22 nt, Human
ugaguagagauugugucacugc

SEQ ID NO: 736421 - RNA, 18 nt, Human
ugaguccuucacagcagc

SEQ ID NO: 736422 - RNA, 19 nt, Human
ugaguuuacggaggggcca

SEQ ID NO: 736423 - RNA, 18 nt, Human
ugcaaaaaugcaacagag

SEQ ID NO: 736424 - RNA, 19 nt, Human
ugcaccugucaucccagcu

SEQ ID NO: 736425 - RNA, 20 nt, Human
ugcccacccccacccucgcc

SEQ ID NO: 736426 - RNA, 21 nt, Human
ugccucacgccuguaauccca

SEQ ID NO: 736427 - RNA, 24 nt, Human
ugccucacgccuguaaucccagca

SEQ ID NO: 736428 - RNA, 18 nt, Human
ugccuggaggggaggcug

SEQ ID NO: 736429 - RNA, 23 nt, Human
ugccuguaaucccagcuacucgg

SEQ ID NO: 736430 - RNA, 19 nt, Human
ugcgagcccaucggucaca

SEQ ID NO: 736431 - RNA, 19 nt, Human
ugcuccagccggccaagag

SEQ ID NO: 736432 - RNA, 20 nt, Human
ugcucugcccagguccuggg

SEQ ID NO: 736433 - RNA, 21 nt, Human
ugcucugcccagguccugggg

SEQ ID NO: 736434 - RNA, 21 nt, Human
ugcucugucuguggucuuagc

SEQ ID NO: 736435 - RNA, 22 nt, Human
ugcugccugucaacauguccug

SEQ ID NO: 736436 - RNA, 18 nt, Human
ugcugcuggcuucaugca

SEQ ID NO: 736437 - RNA, 22 nt, Human
uggaaaaaagcccaacgaaguc

SEQ ID NO: 736438 - RNA, 22 nt, Human
uggaguaaacaaacccagccca

SEQ ID NO: 736439 - RNA, 19 nt, Human
uggaguccaccccuuaggg

SEQ ID NO: 736440 - RNA, 20 nt, Human
uggcaggaggagggagagcc

SEQ ID NO: 736441 - RNA, 22 nt, Human
uggcaggugccuguaaucccag

SEQ ID NO: 736442 - RNA, 24 nt, Human
uggccaacauggcgaaacccuguc

SEQ ID NO: 736443 - RNA, 24 nt, Human
uggccagcauggugaaaccccauc

SEQ ID NO: 736444 - RNA, 21 nt, Human
uggcccauggaguccuucccc

SEQ ID NO: 736445 - RNA, 19 nt, Human
uggcccugggugugccccu

SEQ ID NO: 736446 - RNA, 21 nt, Human
uggccuguguggcuccgggaa

SEQ ID NO: 736447 - RNA, 24 nt, Human
uggcucaccugaggucaggaguuc

SEQ ID NO: 736448 - RNA, 21 nt, Human
uggcucacgccuguaauccca

SEQ ID NO: 736449 - RNA, 24 nt, Human
uggcucacgccuguaaucccaaca

SEQ ID NO: 736450 - RNA, 21 nt, Human
uggcuccgggaagcccugcuc

SEQ ID NO: 736451 - RNA, 21 nt, Human
uggcuggacgcugcaggaggu

SEQ ID NO: 736452 - RNA, 24 nt, Human
uggcuuccagcuaaggaaccccuu

SEQ ID NO: 736453 - RNA, 21 nt, Human
ugggaaaaagugaaaccuauc

SEQ ID NO: 736454 - RNA, 27 nt, Human
ugggaaaaagugaaaccuaucuccaag

SEQ ID NO: 736455 - RNA, 18 nt, Human
ugggacccaggaagguca

SEQ ID NO: 736456 - RNA, 19 nt, Human
ugggaggccgaggcgggug

SEQ ID NO: 736457 - RNA, 24 nt, Human
ugggaggccgaggcggguggcuca

SEQ ID NO: 736458 - RNA, 25 nt, Human
ugggaggcugaggugggggggauca

SEQ ID NO: 736459 - RNA, 21 nt, Human
ugggcugggaggagugagcga

SEQ ID NO: 736460 - RNA, 20 nt, Human
uggggaauagugaggaccag

SEQ ID NO: 736461 - RNA, 20 nt, Human
ugggggaagagaggaaaccu

SEQ ID NO: 736462 - RNA, 20 nt, Human
ugggggaagagaggaaaccu

SEQ ID NO: 736463 - RNA, 18 nt, Human
ugggggggaucaccugag

SEQ ID NO: 736464 - RNA, 24 nt, Human
uggggucaggccccgggcccaugg

SEQ ID NO: 736465 - RNA, 18 nt, Human
uggggugacggccgggcg

SEQ ID NO: 736466 - RNA, 24 nt, Human
ugguggcaggugccuguaauccca

SEQ ID NO: 736467 - RNA, 24 nt, Human
ugucacugcacuccagccugggca

SEQ ID NO: 736468 - RNA, 20 nt, Human
ugucccaggcacacugagcc

SEQ ID NO: 736469 - RNA, 21 nt, Human
ugugaguuguuugcauuuugg

SEQ ID NO: 736470 - RNA, 27 nt, Human
uguggagaaaaaagugucaagaccagu

SEQ ID NO: 736471 - RNA, 19 nt, Human
uguggcuccgggaagcccu

SEQ ID NO: 736472 - RNA, 21 nt, Human
uguuccuggcccgcagcagca

SEQ ID NO: 736473 - RNA, 24 nt, Human
uguuggggucaggccccgggccca

SEQ ID NO: 736474 - RNA, 26 nt, Human
uguuuggcccccuuucuuucuuuugg

SEQ ID NO: 736475 - RNA, 20 nt, Human
uuaccacggccccucuuaga

SEQ ID NO: 736476 - RNA, 19 nt, Human
uuagccgggcgugguggcg

SEQ ID NO: 736477 - RNA, 22 nt, Human
uuagccgggcgugguggcgugc

SEQ ID NO: 736478 - RNA, 18 nt, Human
uucacaaacucuuuacag

SEQ ID NO: 736479 - RNA, 23 nt, Human
uucuagucaaugcacaggggauu

SEQ ID NO: 736480 - RNA, 22 nt, Human
uucuuggaaacacuacugggcu

SEQ ID NO: 736481 - RNA, 24 nt, Human
uugaacccgggagguggagguugc

SEQ ID NO: 736482 - RNA, 22 nt, Human
uugcagugaguagagauugugu

SEQ ID NO: 736483 - RNA, 24 nt, Human
uugcuugaacccgggagguggagg

SEQ ID NO: 736484 - RNA, 22 nt, Human
uuggcaucagagcgaggggugu

SEQ ID NO: 736485 - RNA, 19 nt, Human
uuggcccccuuucuuucuu

SEQ ID NO: 736486 - RNA, 24 nt, Human
uuuacagugugaaccugcauuccu

SEQ ID NO: 736487 - RNA, 19 nt, Human
aaaacugauaaaggacuca

SEQ ID NO: 736488 - RNA, 20 nt, Human
aaacaaacacaucaacagug

SEQ ID NO: 736489 - RNA, 22 nt, Human
aaacaagaccagccaggaccga

SEQ ID NO: 736490 - RNA, 21 nt, Human
aaagagugagcaagccuaaag

SEQ ID NO: 736491 - RNA, 24 nt, Human
aaagugcugggauuacaggcauga

SEQ ID NO: 736492 - RNA, 20 nt, Human
aaccuccaccuccugggcuc

SEQ ID NO: 736493 - RNA, 21 nt, Human
aagaacacaagcccacuccca

SEQ ID NO: 736494 - RNA, 21 nt, Human
aagggagagagccaaaucugc

SEQ ID NO: 736495 - RNA, 19 nt, Human
aagggggguugggaggggu

SEQ ID NO: 736496 - RNA, 21 nt, Human
aaggguucaauagggaaggua

SEQ ID NO: 736497 - RNA, 19 nt, Human
aagugcugggauuacaggc

SEQ ID NO: 736498 - RNA, 21 nt, Human
aagugcugggauuacaggcau

SEQ ID NO: 736499 - RNA, 22 nt, Human
acaaagacccaggacaagaaca

SEQ ID NO: 736500 - RNA, 20 nt, Human
acaaagggacugacagcccc

SEQ ID NO: 736501 - RNA, 21 nt, Human
acaagacaggcaggcccagag

SEQ ID NO: 736502 - RNA, 18 nt, Human
acacccaucaaaaagagu

SEQ ID NO: 736503 - RNA, 20 nt, Human
acaccucccagagcagggcc

SEQ ID NO: 736504 - RNA, 22 nt, Human
acagaacuggccccaugucucu

SEQ ID NO: 736505 - RNA, 18 nt, Human
acagaugcacaccaccau

SEQ ID NO: 736506 - RNA, 25 nt, Human
acagcaacagaacuggccccauguc

SEQ ID NO: 736507 - RNA, 21 nt, Human
acaggccaauacugggcuacu

SEQ ID NO: 736508 - RNA, 21 nt, Human
acagugcuaaagcccugucuc

SEQ ID NO: 736509 - RNA, 21 nt, Human
acaucaacagugaacuccaac

SEQ ID NO: 736510 - RNA, 18 nt, Human
accacuguggggguccug

SEQ ID NO: 736511 - RNA, 18 nt, Human
accagcacugugaccuca

SEQ ID NO: 736512 - RNA, 19 nt, Human
acccugggcuuccacaacc

SEQ ID NO: 736513 - RNA, 21 nt, Human
acccugggcuuccacaaccac

SEQ ID NO: 736514 - RNA, 20 nt, Human
accucaacccccugaguagc

SEQ ID NO: 736515 - RNA, 23 nt, Human
accucaacccccugaguagcuga

SEQ ID NO: 736516 - RNA, 23 nt, Human
accuuucuguaccccuggggaug

SEQ ID NO: 736517 - RNA, 23 nt, Human
acuccuaccucuagcuccagggg

SEQ ID NO: 736518 - RNA, 19 nt, Human
agaaagggagggaguggag

SEQ ID NO: 736519 - RNA, 22 nt, Human
agaagaggcuccagaaacaggc

SEQ ID NO: 736520 - RNA, 21 nt, Human
agaagccccagccagagggcc

SEQ ID NO: 736521 - RNA, 21 nt, Human
agaauccacagaacccagcac

SEQ ID NO: 736522 - RNA, 22 nt, Human
agacacccaucaaaaagaguga

SEQ ID NO: 736523 - RNA, 20 nt, Human
agacccaggacaagaacaca

SEQ ID NO: 736524 - RNA, 21 nt, Human
agagagaaagggagggagugg

SEQ ID NO: 736525 - RNA, 20 nt, Human
agagcagggccugaaaggga

SEQ ID NO: 736526 - RNA, 23 nt, Human
agagggcacagcaagggggguug

SEQ ID NO: 736527 - RNA, 22 nt, Human
agagggccaagucccaggcagg

SEQ ID NO: 736528 - RNA, 26 nt, Human
agaggggacaagcuauaugaagagag

SEQ ID NO: 736529 - RNA, 19 nt, Human
agaguccaaggggaggaga

SEQ ID NO: 736530 - RNA, 19 nt, Human
agagugagcaagccuaaag

SEQ ID NO: 736531 - RNA, 24 nt, Human
agccaaacaaacacaucaacagug

SEQ ID NO: 736532 - RNA, 22 nt, Human
agccacagcaacagaacuggcc

SEQ ID NO: 736533 - RNA, 18 nt, Human
agccaggagaaucgucug

SEQ ID NO: 736534 - RNA, 19 nt, Human
agccaggagaaucgucugg

SEQ ID NO: 736535 - RNA, 25 nt, Human
agcccagcuguguggggccggggcc

SEQ ID NO: 736536 - RNA, 22 nt, Human
agccccacagccucacagcccc

SEQ ID NO: 736537 - RNA, 19 nt, Human
agccgauauucgggugaga

SEQ ID NO: 736538 - RNA, 20 nt, Human
agccuggaaggugcagagau

SEQ ID NO: 736539 - RNA, 24 nt, Human
agcugguuuugaacuccugagcuc

SEQ ID NO: 736540 - RNA, 21 nt, Human
aggaagugggaugugggcugu

SEQ ID NO: 736541 - RNA, 18 nt, Human
aggcaggcccagagggga

SEQ ID NO: 736542 - RNA, 23 nt, Human
aggcagggugcaaagcugugggg

SEQ ID NO: 736543 - RNA, 24 nt, Human
aggcagggugcaaagcuguggggc

SEQ ID NO: 736544 - RNA, 21 nt, Human
aggccagcuccaagggccaca

SEQ ID NO: 736545 - RNA, 22 nt, Human
aggccaggccagaaugaaaaag

SEQ ID NO: 736546 - RNA, 19 nt, Human
aggcugcaguccugugguc

SEQ ID NO: 736547 - RNA, 19 nt, Human
agggagacaaggaucgugg

SEQ ID NO: 736548 - RNA, 24 nt, Human
agggcaggggcagccucugucuca

SEQ ID NO: 736549 - RNA, 19 nt, Human
aggggguggggcuguggga

SEQ ID NO: 736550 - RNA, 21 nt, Human
agggugcaaagcuguggggcg

SEQ ID NO: 736551 - RNA, 22 nt, Human
agguaaaaguugagaaagggaa

SEQ ID NO: 736552 - RNA, 24 nt, Human
agguagaccugucagcagcagcug

SEQ ID NO: 736553 - RNA, 20 nt, Human
agucugacgaggcaacaugg

SEQ ID NO: 736554 - RNA, 18 nt, Human
agugcugggauuacaggc

SEQ ID NO: 736555 - RNA, 24 nt, Human
auccuccuuggccuagccuugcug

SEQ ID NO: 736556 - RNA, 22 nt, Human
augacccuggaagccuggcagc

SEQ ID NO: 736557 - RNA, 21 nt, Human
caaaauaaacaagaccagcca

SEQ ID NO: 736558 - RNA, 21 nt, Human
caaacuccugcccuguccccc

SEQ ID NO: 736559 - RNA, 20 nt, Human
caaagcucucaccuccaaau

SEQ ID NO: 736560 - RNA, 22 nt, Human
caaauaaagccaccaagagucu

SEQ ID NO: 736561 - RNA, 24 nt, Human
caaaugccaagcucugcauuuaac

SEQ ID NO: 736562 - RNA, 23 nt, Human
caaauggauauuucuaaacugaa

SEQ ID NO: 736563 - RNA, 24 nt, Human
caacagugaacuccaacaccuccc

SEQ ID NO: 736564 - RNA, 18 nt, Human
caaccuauuaaacagaag

SEQ ID NO: 736565 - RNA, 24 nt, Human
caaccuccaccuccugggcucaag

SEQ ID NO: 736566 - RNA, 19 nt, Human
caagaacacaagcccacuc

SEQ ID NO: 736567 - RNA, 25 nt, Human
caagacaaagacccaggacaagaac

SEQ ID NO: 736568 - RNA, 26 nt, Human
caagacaccagacacuucaaaucaag

SEQ ID NO: 736569 - RNA, 21 nt, Human
caagccagggcagcauggagg

SEQ ID NO: 736570 - RNA, 22 nt, Human
caaggcagugacaagacaccag

SEQ ID NO: 736571 - RNA, 20 nt, Human
caagggcaagaagguagagu

SEQ ID NO: 736572 - RNA, 18 nt, Human
caaucuccacaagggcaa

SEQ ID NO: 736573 - RNA, 22 nt, Human
cacacagaggagcccgggugug

SEQ ID NO: 736574 - RNA, 24 nt, Human
cacaccaccaugcccagcuaauuu

SEQ ID NO: 736575 - RNA, 18 nt, Human
cacagaacccagcacaga

SEQ ID NO: 736576 - RNA, 21 nt, Human
cacagaagaaagucucuucau

SEQ ID NO: 736577 - RNA, 24 nt, Human
cacagaauccacagaacccagcac

SEQ ID NO: 736578 - RNA, 18 nt, Human
cacagcaagggggguugg

SEQ ID NO: 736579 - RNA, 21 nt, Human
cacagcaucuccugagccccu

SEQ ID NO: 736580 - RNA, 18 nt, Human
cacagccucacagccccu

SEQ ID NO: 736581 - RNA, 21 nt, Human
cacaguuggacaggccaauac

SEQ ID NO: 736582 - RNA, 24 nt, Human
caccacagaauccacagaacccag

SEQ ID NO: 736583 - RNA, 24 nt, Human
caccaugcccagcuaauuuuugua

SEQ ID NO: 736584 - RNA, 24 nt, Human
caccccuggguaguccuuacucug

SEQ ID NO: 736585 - RNA, 20 nt, Human
cacccuccucuugcucaaag

SEQ ID NO: 736586 - RNA, 24 nt, Human
caccucagccucccaaagugcugg

SEQ ID NO: 736587 - RNA, 18 nt, Human
caccucuucaagcugucc

SEQ ID NO: 736588 - RNA, 25 nt, Human
cacucuaucagcucucaacucuuua

SEQ ID NO: 736589 - RNA, 21 nt, Human
cacugcaaccuccaccuccug

SEQ ID NO: 736590 - RNA, 23 nt, Human
cacugcaaccuccaccuccuggg

SEQ ID NO: 736591 - RNA, 18 nt, Human
cacugcaggcaucaggcc

SEQ ID NO: 736592 - RNA, 19 nt, Human
cacugcaggcaucaggccu

SEQ ID NO: 736593 - RNA, 20 nt, Human
cacuggggccucacauuuca

SEQ ID NO: 736594 - RNA, 18 nt, Human
cacuguggggguccuggg

SEQ ID NO: 736595 - RNA, 24 nt, Human
cagaagccccagccagagggccaa

SEQ ID NO: 736596 - RNA, 23 nt, Human
cagaaguagguaaaaguugagaa

SEQ ID NO: 736597 - RNA, 23 nt, Human
cagacacuucaaaucaaggucau

SEQ ID NO: 736598 - RNA, 21 nt, Human
cagagccuggaaggugcagag

SEQ ID NO: 736599 - RNA, 20 nt, Human
cagagugggagcucagagaa

SEQ ID NO: 736600 - RNA, 19 nt, Human
cagcaacagaacuggcccc

SEQ ID NO: 736601 - RNA, 25 nt, Human
cagcacggaagcacuauggccucuu

SEQ ID NO: 736602 - RNA, 29 nt, Human
cagcacggaagcacuauggccucuuaacg

SEQ ID NO: 736603 - RNA, 20 nt, Human
cagcauggagguagcacaga

SEQ ID NO: 736604 - RNA, 18 nt, Human
cagccagggcaggggcag

SEQ ID NO: 736605 - RNA, 21 nt, Human
cagcugcccacuccauugccc

SEQ ID NO: 736606 - RNA, 23 nt, Human
caggacaaaauaaacaagaccag

SEQ ID NO: 736607 - RNA, 26 nt, Human
caggaccgaugccccaucccugcugg

SEQ ID NO: 736608 - RNA, 19 nt, Human
caggacgagggagcaauga

SEQ ID NO: 736609 - RNA, 18 nt, Human
cagggugcaaagcugugg

SEQ ID NO: 736610 - RNA, 19 nt, Human
cagugagauaagaugccca

SEQ ID NO: 736611 - RNA, 19 nt, Human
caucuccugagccccuacu

SEQ ID NO: 736612 - RNA, 18 nt, Human
caugaccccacacuagcc

SEQ ID NO: 736613 - RNA, 24 nt, Human
caugcugcccaagcugguuuugaa

SEQ ID NO: 736614 - RNA, 18 nt, Human
caugggccaugaccccac

SEQ ID NO: 736615 - RNA, 24 nt, Human
ccaaacaaacacaucaacagugaa

SEQ ID NO: 736616 - RNA, 23 nt, Human
ccaaagugcugggauuacaggca

SEQ ID NO: 736617 - RNA, 24 nt, Human
ccaaagugcugggauuacaggcau

SEQ ID NO: 736618 - RNA, 21 nt, Human
ccaaaguguugggaccugcau

SEQ ID NO: 736619 - RNA, 23 nt, Human
ccaaauggauauuucuaaacuga

SEQ ID NO: 736620 - RNA, 24 nt, Human
ccaacccaacaaacgcuccaaaug

SEQ ID NO: 736621 - RNA, 20 nt, Human
ccaacccaacaaacgcuuug

SEQ ID NO: 736622 - RNA, 19 nt, Human
ccaaccccagcccaaagug

SEQ ID NO: 736623 - RNA, 21 nt, Human
ccacaaacugcaccagcuggg

SEQ ID NO: 736624 - RNA, 25 nt, Human
ccacaccaugagcucagccagggca

SEQ ID NO: 736625 - RNA, 23 nt, Human
ccacagcaacagaacuggcccca

SEQ ID NO: 736626 - RNA, 21 nt, Human
ccacugucccuggcccagguc

SEQ ID NO: 736627 - RNA, 22 nt, Human
ccagcccugcccugccugacaa

SEQ ID NO: 736628 - RNA, 20 nt, Human
ccagcucuacucuaugaguu

SEQ ID NO: 736629 - RNA, 22 nt, Human
ccagcugccgguggguccagga

SEQ ID NO: 736630 - RNA, 22 nt, Human
ccaggccaggccagaaugaaaa

SEQ ID NO: 736631 - RNA, 24 nt, Human
ccaucugccgggcagguccugccc

SEQ ID NO: 736632 - RNA, 19 nt, Human
ccaugcugcccaagcuggu

SEQ ID NO: 736633 - RNA, 24 nt, Human
cccaaagugcugggauuacaggca

SEQ ID NO: 736634 - RNA, 19 nt, Human
cccaacccacaccaugagc

SEQ ID NO: 736635 - RNA, 19 nt, Human
cccacaccaugagcucagc

SEQ ID NO: 736636 - RNA, 20 nt, Human
cccagcccccagcugcccac

SEQ ID NO: 736637 - RNA, 20 nt, Human
cccauguacccacagccauu

SEQ ID NO: 736638 - RNA, 25 nt, Human
ccccacacuagcccucuggucccuc

SEQ ID NO: 736639 - RNA, 19 nt, Human
ccccagccagagggccaag

SEQ ID NO: 736640 - RNA, 22 nt, Human
ccccagcugcccacuccauugc

SEQ ID NO: 736641 - RNA, 26 nt, Human
ccccuggagcagacagaggggggauu

SEQ ID NO: 736642 - RNA, 22 nt, Human
cccucggcucagccggcccugg

SEQ ID NO: 736643 - RNA, 24 nt, Human
cccugucauccccaacccacacca

SEQ ID NO: 736644 - RNA, 18 nt, Human
cccugugugaaagguccc

SEQ ID NO: 736645 - RNA, 18 nt, Human
ccguguggauuuggaggg

SEQ ID NO: 736646 - RNA, 27 nt, Human
ccucacccuccucuugcucaaacugga

SEQ ID NO: 736647 - RNA, 19 nt, Human
ccucagucacuucccagaa

SEQ ID NO: 736648 - RNA, 19 nt, Human
ccuccaccuccugggcuca

SEQ ID NO: 736649 - RNA, 18 nt, Human
ccucccuccuuccacaaa

SEQ ID NO: 736650 - RNA, 21 nt, Human
ccuccucuugcucaaacugga

SEQ ID NO: 736651 - RNA, 24 nt, Human
ccuccugggcucaagccaucuucc

SEQ ID NO: 736652 - RNA, 20 nt, Human
ccucuagcuccaggggcaag

SEQ ID NO: 736653 - RNA, 20 nt, Human
ccugaaaugccuccucccca

SEQ ID NO: 736654 - RNA, 18 nt, Human
ccugaaugccauggaagg

SEQ ID NO: 736655 - RNA, 18 nt, Human
ccugcccucccuccuucc

SEQ ID NO: 736656 - RNA, 19 nt, Human
ccugcccucucuccaccca

SEQ ID NO: 736657 - RNA, 20 nt, Human
ccugggcucaagccaucuuc

SEQ ID NO: 736658 - RNA, 19 nt, Human
ccuuccacaaacugcacca

SEQ ID NO: 736659 - RNA, 19 nt, Human
ccuucccuaaagaccuggg

SEQ ID NO: 736660 - RNA, 31 nt, Human
cgccaugcugcccaagcugguuuugaacucc

SEQ ID NO: 736661 - RNA, 19 nt, Human
cgcuccaaaugagccgcca

SEQ ID NO: 736662 - RNA, 19 nt, Human
cguaauggucagcauccuc

SEQ ID NO: 736663 - RNA, 21 nt, Human
cguguagccacagcaacagaa

SEQ ID NO: 736664 - RNA, 22 nt, Human
cguguaugaacccagcccccag

SEQ ID NO: 736665 - RNA, 24 nt, Human
cuaaggggacagagacccaaucca

SEQ ID NO: 736666 - RNA, 24 nt, Human
cucaagccaucuucccaccucaac

SEQ ID NO: 736667 - RNA, 24 nt, Human
cucacugcaaccuccaccuccugg

SEQ ID NO: 736668 - RNA, 26 nt, Human
cucacugcaaccuccaccuccugggc

SEQ ID NO: 736669 - RNA, 18 nt, Human
cucauacaugacugcacu

SEQ ID NO: 736670 - RNA, 23 nt, Human
cuccacaagggcaagaagguaga

SEQ ID NO: 736671 - RNA, 21 nt, Human
cucccagagcagggccugaaa

SEQ ID NO: 736672 - RNA, 19 nt, Human
cuccugagccccuacugcg

SEQ ID NO: 736673 - RNA, 20 nt, Human
cugagcacuaacucagugcc

SEQ ID NO: 736674 - RNA, 22 nt, Human
cugagccccuacugcgugccca

SEQ ID NO: 736675 - RNA, 18 nt, Human
cugcaaccuccaccuccu

SEQ ID NO: 736676 - RNA, 23 nt, Human
cugcaaccuccaccuccugggcu

SEQ ID NO: 736677 - RNA, 24 nt, Human
cugcaaccuccaccuccugggcuc

SEQ ID NO: 736678 - RNA, 19 nt, Human
cugcccuaggguggggucc

SEQ ID NO: 736679 - RNA, 22 nt, Human
cugcuggggucuggcaaagcuc

SEQ ID NO: 736680 - RNA, 22 nt, Human
cuggagcacaguggcacuaucu

SEQ ID NO: 736681 - RNA, 18 nt, Human
cuggcaagccagggcagc

SEQ ID NO: 736682 - RNA, 21 nt, Human
cuggggcccuaaaccacugca

SEQ ID NO: 736683 - RNA, 21 nt, Human
cugugugcugagcacuaacuc

SEQ ID NO: 736684 - RNA, 23 nt, Human
cuucauaccagcccugcccugcc

SEQ ID NO: 736685 - RNA, 22 nt, Human
cuuccacaaccacccccauccu

SEQ ID NO: 736686 - RNA, 23 nt, Human
cuugccguugcucucagacuugc

SEQ ID NO: 736687 - RNA, 25 nt, Human
cuuggccuagccuugcugagcuggc

SEQ ID NO: 736688 - RNA, 22 nt, Human
gacagccccagaaucccaaggg

SEQ ID NO: 736689 - RNA, 20 nt, Human
gagagggcacagcaaggggg

SEQ ID NO: 736690 - RNA, 21 nt, Human
gagcccagcccggccugccau

SEQ ID NO: 736691 - RNA, 19 nt, Human
gagggcacagcaagggggg

SEQ ID NO: 736692 - RNA, 25 nt, Human
gagggcuaggguagcccuccucagu

SEQ ID NO: 736693 - RNA, 21 nt, Human
gaggggugcccaacacuacca

SEQ ID NO: 736694 - RNA, 18 nt, Human
gauuacaggcaugagcca

SEQ ID NO: 736695 - RNA, 21 nt, Human
gauuacaggcaugagccacug

SEQ ID NO: 736696 - RNA, 24 nt, Human
gauuacaggcaugagccacuguac

SEQ ID NO: 736697 - RNA, 21 nt, Human
gcacauccaaguaucugacca

SEQ ID NO: 736698 - RNA, 20 nt, Human
gcagaagcagggagccccug

SEQ ID NO: 736699 - RNA, 18 nt, Human
gcaugacauggaugcaaa

SEQ ID NO: 736700 - RNA, 19 nt, Human
gccagacaagggaugcgug

SEQ ID NO: 736701 - RNA, 20 nt, Human
gccagcuccaagggccacag

SEQ ID NO: 736702 - RNA, 20 nt, Human
gccaugcugcccaagcuggu

SEQ ID NO: 736703 - RNA, 18 nt, Human
gcccaacacuaccagccu

SEQ ID NO: 736704 - RNA, 22 nt, Human
gcccagcuaauuuuuguauuuu

SEQ ID NO: 736705 - RNA, 20 nt, Human
gcccagcuguguggggccgg

SEQ ID NO: 736706 - RNA, 21 nt, Human
gcccagugugccugcauccuc

SEQ ID NO: 736707 - RNA, 21 nt, Human
gccgggcagguccugcccucu

SEQ ID NO: 736708 - RNA, 18 nt, Human
gccucacccuccucuugc

SEQ ID NO: 736709 - RNA, 18 nt, Human
gccuccuccccaaaucca

SEQ ID NO: 736710 - RNA, 25 nt, Human
gcugcagucacuucagguagaccug

SEQ ID NO: 736711 - RNA, 18 nt, Human
ggaaagacacccaucaaa

SEQ ID NO: 736712 - RNA, 21 nt, Human
ggaagccccaggcugcagucc

SEQ ID NO: 736713 - RNA, 21 nt, Human
ggaccccuggucaccucccaa

SEQ ID NO: 736714 - RNA, 19 nt, Human
ggagagcaggugggcagaa

SEQ ID NO: 736715 - RNA, 22 nt, Human
ggagaucuguaaacuaaaccgc

SEQ ID NO: 736716 - RNA, 24 nt, Human
ggaggagaucuguaaacuaaaccg

SEQ ID NO: 736717 - RNA, 23 nt, Human
ggaggcuacaucuucaccccugg

SEQ ID NO: 736718 - RNA, 22 nt, Human
ggauuacaggcaugagccacug

SEQ ID NO: 736719 - RNA, 23 nt, Human
ggauuccugcugagacaaggggc

SEQ ID NO: 736720 - RNA, 19 nt, Human
ggcagggugcaaagcugug

SEQ ID NO: 736721 - RNA, 23 nt, Human
ggcagugacaagacaccagacac

SEQ ID NO: 736722 - RNA, 21 nt, Human
ggccaugggaaaaaggggugu

SEQ ID NO: 736723 - RNA, 21 nt, Human
ggccucacccuccucuugcuc

SEQ ID NO: 736724 - RNA, 24 nt, Human
ggcugcuuggcgugaacaaaacug

SEQ ID NO: 736725 - RNA, 21 nt, Human
gggagcuuggcugagcccagc

SEQ ID NO: 736726 - RNA, 23 nt, Human
gggagggaguggaguugaguugg

SEQ ID NO: 736727 - RNA, 21 nt, Human
gggcaacacccucggcucagc

SEQ ID NO: 736728 - RNA, 22 nt, Human
gggcaagcgagccccacagccu

SEQ ID NO: 736729 - RNA, 24 nt, Human
gggcauuugugggcuacaaguuug

SEQ ID NO: 736730 - RNA, 25 nt, Human
gggcuuugggggugaaacugcagcc

SEQ ID NO: 736731 - RNA, 18 nt, Human
ggggaagggagagagcca

SEQ ID NO: 736732 - RNA, 18 nt, Human
ggggccggaagccccagg

SEQ ID NO: 736733 - RNA, 20 nt, Human
ggggcugugggauaacagcu

SEQ ID NO: 736734 - RNA, 18 nt, Human
ggggguggggcuguggga

SEQ ID NO: 736735 - RNA, 21 nt, Human
gggguugggaggggucuccag

SEQ ID NO: 736736 - RNA, 21 nt, Human
gggguugggaggggucuccag

SEQ ID NO: 736737 - RNA, 19 nt, Human
gguccugaaugccauggaa

SEQ ID NO: 736738 - RNA, 21 nt, Human
guagagaugggauuucgccau

SEQ ID NO: 736739 - RNA, 21 nt, Human
guaguggccucacccuccucu

SEQ ID NO: 736740 - RNA, 19 nt, Human
guauuuuuuguagagaugg

SEQ ID NO: 736741 - RNA, 18 nt, Human
gugagugggagcuuggcu

SEQ ID NO: 736742 - RNA, 23 nt, Human
guggagugaacaaaaggucauuu

SEQ ID NO: 736743 - RNA, 20 nt, Human
guggauuuggagggaccugg

SEQ ID NO: 736744 - RNA, 18 nt, Human
gugggguccuggaggccg

SEQ ID NO: 736745 - RNA, 19 nt, Human
guguagccacagcaacaga

SEQ ID NO: 736746 - RNA, 22 nt, Human
guugggaggggucuccaguucc

SEQ ID NO: 736747 - RNA, 22 nt, Human
guuuugaacuccugagcucaag

SEQ ID NO: 736748 - RNA, 18 nt, Human
uaaccaaggcugcuuggc

SEQ ID NO: 736749 - RNA, 24 nt, Human
uaauuuuuguauuuuuuguagaga

SEQ ID NO: 736750 - RNA, 22 nt, Human
uacaacuccaugcagaaaccua

SEQ ID NO: 736751 - RNA, 22 nt, Human
uacaggcaugagccacuguacc

SEQ ID NO: 736752 - RNA, 19 nt, Human
uaccagcccugcccugccu

SEQ ID NO: 736753 - RNA, 19 nt, Human
uaccccagggccagggcaa

SEQ ID NO: 736754 - RNA, 19 nt, Human
uaccucuagcuccaggggc

SEQ ID NO: 736755 - RNA, 22 nt, Human
uacucaucucagugaugaugag

SEQ ID NO: 736756 - RNA, 20 nt, Human
uagagaugggauuucgccau

SEQ ID NO: 736757 - RNA, 21 nt, Human
uagcccucuggucccucacaa

SEQ ID NO: 736758 - RNA, 19 nt, Human
uagccugccugccagagag

SEQ ID NO: 736759 - RNA, 20 nt, Human
uaggcccuacaacuccaugc

SEQ ID NO: 736760 - RNA, 18 nt, Human
uagggaagguaccagcgg

SEQ ID NO: 736761 - RNA, 24 nt, Human
uagggugggguccuggaggccgcc

SEQ ID NO: 736762 - RNA, 18 nt, Human
uagguaaaaguugagaaa

SEQ ID NO: 736763 - RNA, 23 nt, Human
uauaugaagagaggcuucagcug

SEQ ID NO: 736764 - RNA, 19 nt, Human
uauucgggugagacaugug

SEQ ID NO: 736765 - RNA, 26 nt, Human
uauucuauuuaaucuccacaccaagc

SEQ ID NO: 736766 - RNA, 23 nt, Human
ucaaucagaccuauccugccuga

SEQ ID NO: 736767 - RNA, 20 nt, Human
ucacaaggguggauuggggg

SEQ ID NO: 736768 - RNA, 19 nt, Human
ucaccagggagccaccuuc

SEQ ID NO: 736769 - RNA, 20 nt, Human
ucaccuugucccagguagug

SEQ ID NO: 736770 - RNA, 22 nt, Human
ucacgggaucuuaggaucuuca

SEQ ID NO: 736771 - RNA, 23 nt, Human
ucacugcaaccuccaccuccugg

SEQ ID NO: 736772 - RNA, 24 nt, Human
ucacugcaaccuccaccuccuggg

SEQ ID NO: 736773 - RNA, 25 nt, Human
ucacugcaaccuccaccuccugggc

SEQ ID NO: 736774 - RNA, 27 nt, Human
ucacugcaaccuccaccuccugggcuc

SEQ ID NO: 736775 - RNA, 18 nt, Human
ucagcagcagcugugcaa

SEQ ID NO: 736776 - RNA, 26 nt, Human
ucagccagggcaggggcagccucugu

SEQ ID NO: 736777 - RNA, 18 nt, Human
ucagccucccaaagugcu

SEQ ID NO: 736778 - RNA, 25 nt, Human
ucagucccaccucuucaagcugucc

SEQ ID NO: 736779 - RNA, 22 nt, Human
ucauaccagcccugcccugccu

SEQ ID NO: 736780 - RNA, 19 nt, Human
uccaaguaucugaccaggc

SEQ ID NO: 736781 - RNA, 20 nt, Human
uccacaaccacccccauccu

SEQ ID NO: 736782 - RNA, 24 nt, Human
uccaccaccaccagcacugugacc

SEQ ID NO: 736783 - RNA, 24 nt, Human
ucccaaagugcugggauuacaggc

SEQ ID NO: 736784 - RNA, 23 nt, Human
ucccaccucagaaccccuuccac

SEQ ID NO: 736785 - RNA, 22 nt, Human
ucccaccucuucaagcugucca

SEQ ID NO: 736786 - RNA, 18 nt, Human
ucccauucuucacaggcc

SEQ ID NO: 736787 - RNA, 21 nt, Human
ucccccaaaauaggcccuaca

SEQ ID NO: 736788 - RNA, 22 nt, Human
ucccccaaaauaggcccuacaa

SEQ ID NO: 736789 - RNA, 20 nt, Human
uccccuuccucagaccagcc

SEQ ID NO: 736790 - RNA, 21 nt, Human
ucccuggcccaggucuaggac

SEQ ID NO: 736791 - RNA, 23 nt, Human
uccugagccccuacugcgugccc

SEQ ID NO: 736792 - RNA, 21 nt, Human
uccugcccucccuccuuccac

SEQ ID NO: 736793 - RNA, 20 nt, Human
uccugggcucaagccaucuu

SEQ ID NO: 736794 - RNA, 24 nt, Human
uccugggcucaagccaucuuccca

SEQ ID NO: 736795 - RNA, 21 nt, Human
uccugggcuucauaccagccc

SEQ ID NO: 736796 - RNA, 21 nt, Human
ucucagcagaagcuucugggg

SEQ ID NO: 736797 - RNA, 22 nt, Human
ucuccacccaccugucuaaccc

SEQ ID NO: 736798 - RNA, 19 nt, Human
ucuccugagccccuacugc

SEQ ID NO: 736799 - RNA, 23 nt, Human
ucuccuugguacagagugggagc

SEQ ID NO: 736800 - RNA, 20 nt, Human
ucucugggguucccugacuc

SEQ ID NO: 736801 - RNA, 24 nt, Human
ucuggcuccgucauccaggcugga

SEQ ID NO: 736802 - RNA, 18 nt, Human
ugaaaugccacuccugcu

SEQ ID NO: 736803 - RNA, 24 nt, Human
ugaacaugccauucaccuuguccc

SEQ ID NO: 736804 - RNA, 23 nt, Human
ugaagucagacugugccaaaccc

SEQ ID NO: 736805 - RNA, 22 nt, Human
ugacaaguuggaugaaaacuga

SEQ ID NO: 736806 - RNA, 20 nt, Human
ugacacugcaaauuaucuca

SEQ ID NO: 736807 - RNA, 25 nt, Human
ugacauggaugcaaaugucaauggg

SEQ ID NO: 736808 - RNA, 19 nt, Human
ugacuccuaccucuagcuc

SEQ ID NO: 736809 - RNA, 24 nt, Human
ugagaggggugcccaacacuacca

SEQ ID NO: 736810 - RNA, 21 nt, Human
ugagauaagaugcccacccag

SEQ ID NO: 736811 - RNA, 19 nt, Human
ugagcaagccuaaagaagg

SEQ ID NO: 736812 - RNA, 22 nt, Human
ugagccccuacugcgugcccag

SEQ ID NO: 736813 - RNA, 19 nt, Human
ugaggcugcagucacuuca

SEQ ID NO: 736814 - RNA, 19 nt, Human
ugaggugagugggagcuug

SEQ ID NO: 736815 - RNA, 19 nt, Human
ugaguaccagguccuugag

SEQ ID NO: 736816 - RNA, 18 nt, Human
ugcaaggcagugacaaga

SEQ ID NO: 736817 - RNA, 19 nt, Human
ugcaccugcugaacaugcc

SEQ ID NO: 736818 - RNA, 25 nt, Human
ugcagcagugagauaagaugcccac

SEQ ID NO: 736819 - RNA, 19 nt, Human
ugcaugagaaucugcaugu

SEQ ID NO: 736820 - RNA, 18 nt, Human
ugccaaaugaaggcuugc

SEQ ID NO: 736821 - RNA, 19 nt, Human
ugccagagagcagaagugc

SEQ ID NO: 736822 - RNA, 23 nt, Human
ugccauggaaggagagcaggugg

SEQ ID NO: 736823 - RNA, 24 nt, Human
ugcccaagcugguuuugaacuccu

SEQ ID NO: 736824 - RNA, 18 nt, Human
ugcccagcugccgguggg

SEQ ID NO: 736825 - RNA, 25 nt, Human
ugcccuagggugggguccuggaggc

SEQ ID NO: 736826 - RNA, 21 nt, Human
ugccgguggguccagggggca

SEQ ID NO: 736827 - RNA, 18 nt, Human
ugccuagccuaggucagg

SEQ ID NO: 736828 - RNA, 18 nt, Human
ugcgugcccagcuguagg

SEQ ID NO: 736829 - RNA, 19 nt, Human
ugcuggggucuggcaaagc

SEQ ID NO: 736830 - RNA, 21 nt, Human
ugcuuuuccaccaccaccagc

SEQ ID NO: 736831 - RNA, 20 nt, Human
uggaaaccucagcauccuga

SEQ ID NO: 736832 - RNA, 20 nt, Human
uggaagccuggcagcccucc

SEQ ID NO: 736833 - RNA, 21 nt, Human
uggaagccuggcagcccuccg

SEQ ID NO: 736834 - RNA, 23 nt, Human
uggcaaaaccaggccaggccaga

SEQ ID NO: 736835 - RNA, 24 nt, Human
uggcaaagcucucaccuccaaauu

SEQ ID NO: 736836 - RNA, 23 nt, Human
uggcagaguucugaggguggagu

SEQ ID NO: 736837 - RNA, 18 nt, Human
uggcaugacauggaugca

SEQ ID NO: 736838 - RNA, 24 nt, Human
uggccagaaaucuagaguccaagg

SEQ ID NO: 736839 - RNA, 20 nt, Human
uggccucacccuccucuugc

SEQ ID NO: 736840 - RNA, 21 nt, Human
uggcugagcccagcccggccu

SEQ ID NO: 736841 - RNA, 21 nt, Human
uggcugguuugugugggaggg

SEQ ID NO: 736842 - RNA, 22 nt, Human
uggcuuggacugaaaucacacc

SEQ ID NO: 736843 - RNA, 19 nt, Human
ugggaugugggcugugauc

SEQ ID NO: 736844 - RNA, 22 nt, Human
ugggauuacaggcaugagccac

SEQ ID NO: 736845 - RNA, 22 nt, Human
ugggauuacaggcaugagccac

SEQ ID NO: 736846 - RNA, 22 nt, Human
ugggauuacaggcaugagccac

SEQ ID NO: 736847 - RNA, 24 nt, Human
ugggauuacaggcaugagccacug

SEQ ID NO: 736848 - RNA, 26 nt, Human
ugggauuacaggcaugagccacugua

SEQ ID NO: 736849 - RNA, 18 nt, Human
ugggauuucgccaugcug

SEQ ID NO: 736850 - RNA, 21 nt, Human
ugggcuuccacaaccaccccc

SEQ ID NO: 736851 - RNA, 18 nt, Human
uggugugagagaucugga

SEQ ID NO: 736852 - RNA, 21 nt, Human
uguggcacacaggaggccucu

SEQ ID NO: 736853 - RNA, 20 nt, Human
uguggcauguggcccuuucu

SEQ ID NO: 736854 - RNA, 21 nt, Human
uguggcccuuggaaaucaagc

SEQ ID NO: 736855 - RNA, 20 nt, Human
ugugggauaacagcucuugg

SEQ ID NO: 736856 - RNA, 18 nt, Human
uguggggcgaggaaccug

SEQ ID NO: 736857 - RNA, 24 nt, Human
uguguaugcgugugugugcacgug

SEQ ID NO: 736858 - RNA, 23 nt, Human
ugugugcuguuggugugagagau

SEQ ID NO: 736859 - RNA, 21 nt, Human
uuaaucuccacaccaagcaug

SEQ ID NO: 736860 - RNA, 20 nt, Human
uuagccaggagaaucgucug

SEQ ID NO: 736861 - RNA, 22 nt, Human
uucaaagccaaacaaacacauc

SEQ ID NO: 736862 - RNA, 23 nt, Human
uucaaagccaaacaaacacauca

SEQ ID NO: 736863 - RNA, 24 nt, Human
uuccaccucaaugaguaccagguc

SEQ ID NO: 736864 - RNA, 23 nt, Human
uucccaccucaacccccugagua

SEQ ID NO: 736865 - RNA, 20 nt, Human
uuccuuuccucauuuacauc

SEQ ID NO: 736866 - RNA, 19 nt, Human
uucuugugacagugauggc

SEQ ID NO: 736867 - RNA, 22 nt, Human
uugcacacaugugugccugugu

SEQ ID NO: 736868 - RNA, 19 nt, Human
uuggccuagccuugcugag

SEQ ID NO: 736869 - RNA, 19 nt, Human
uuggucaaccagcacggaa

SEQ ID NO: 736870 - RNA, 21 nt, Human
uuguaacuugcccaagaucac

SEQ ID NO: 736871 - RNA, 24 nt, Human
uuguagagaugggauuucgccaug

SEQ ID NO: 736872 - RNA, 23 nt, Human
uuuccucagguguucuucugcuu

SEQ ID NO: 736873 - RNA, 24 nt, Human
uuuguagagaugggauuucgccau

SEQ ID NO: 736874 - RNA, 24 nt, Human
uuuugaacuccugagcucaagcag

SEQ ID NO: 736875 - RNA, 20 nt, Human
uuuuuguauuuuuuguagag

SEQ ID NO: 736876 - RNA, 23 nt, Human
uuuuuguauuuuuuguagagaug

SEQ ID NO: 736877 - RNA, 23 nt, Human
uuuuuuguagagaugggauuucg

SEQ ID NO: 736878 - RNA, 24 nt, Human
uuuuuuguagagaugggauuucgc

SEQ ID NO: 736879 - RNA, 21 nt, Human
aaaaaaacaaaaaacgcugug

SEQ ID NO: 736880 - RNA, 24 nt, Human
aaaacacaacccucucaggaacca

SEQ ID NO: 736881 - RNA, 20 nt, Human
aaaaccaaaccaaaugcagc

SEQ ID NO: 736882 - RNA, 24 nt, Human
aaacacaacccucucaggaaccaa

SEQ ID NO: 736883 - RNA, 20 nt, Human
aaacucccaguggccucacu

SEQ ID NO: 736884 - RNA, 19 nt, Human
aaaggccauuuccagcaga

SEQ ID NO: 736885 - RNA, 20 nt, Human
aaaguaaaaugacccugcug

SEQ ID NO: 736886 - RNA, 19 nt, Human
aacuagcccccgacaggcc

SEQ ID NO: 736887 - RNA, 23 nt, Human
aagaaaaccaaaccaaaugcagc

SEQ ID NO: 736888 - RNA, 25 nt, Human
aagaaaaccaaaccaaaugcagcug

SEQ ID NO: 736889 - RNA, 20 nt, Human
aagaaacauauaaaaguuca

SEQ ID NO: 736890 - RNA, 19 nt, Human
aagaugcuccuuccccaug

SEQ ID NO: 736891 - RNA, 23 nt, Human
aaggaaacaaaaacaaaacacaa

SEQ ID NO: 736892 - RNA, 26 nt, Human
aaggaaacaaaaacaaaacacaaccc

SEQ ID NO: 736893 - RNA, 19 nt, Human
aagugcuggucuccaccug

SEQ ID NO: 736894 - RNA, 18 nt, Human
acacacagguggugacgc

SEQ ID NO: 736895 - RNA, 22 nt, Human
acagcauggcugugcaccugug

SEQ ID NO: 736896 - RNA, 19 nt, Human
acagguccagagaaagcag

SEQ ID NO: 736897 - RNA, 21 nt, Human
acccaacuaugaccccccccc

SEQ ID NO: 736898 - RNA, 20 nt, Human
acccagccucacccuggacc

SEQ ID NO: 736899 - RNA, 23 nt, Human
accccaucugggccaaccuggga

SEQ ID NO: 736900 - RNA, 24 nt, Human
acccucuaacccaggcuuguucug

SEQ ID NO: 736901 - RNA, 20 nt, Human
acucccgcucuugccggagg

SEQ ID NO: 736902 - RNA, 21 nt, Human
acucccgcucuugccggaggc

SEQ ID NO: 736903 - RNA, 18 nt, Human
acugcauuucauuagacc

SEQ ID NO: 736904 - RNA, 20 nt, Human
acuguccccuucccuuuccu

SEQ ID NO: 736905 - RNA, 23 nt, Human
acuguccccuucccuuuccuugg

SEQ ID NO: 736906 - RNA, 21 nt, Human
agaaagcagcaggcuccggaa

SEQ ID NO: 736907 - RNA, 22 nt, Human
agaaggcuccaccagagcugcc

SEQ ID NO: 736908 - RNA, 24 nt, Human
agaaugcucgcaaucggugcccuc

SEQ ID NO: 736909 - RNA, 21 nt, Human
agacaaagaggaaaggccaaa

SEQ ID NO: 736910 - RNA, 21 nt, Human
agacacagagcuuagagccca

SEQ ID NO: 736911 - RNA, 20 nt, Human
agacagguccagagaaagca

SEQ ID NO: 736912 - RNA, 21 nt, Human
agaccuccaggcaaggccucg

SEQ ID NO: 736913 - RNA, 21 nt, Human
agcacacgauggcucacacaa

SEQ ID NO: 736914 - RNA, 22 nt, Human
agcacuggcaugggcugcccgc

SEQ ID NO: 736915 - RNA, 18 nt, Human
agcagccaacuuggccuc

SEQ ID NO: 736916 - RNA, 19 nt, Human
agccaggcaccagaaugcu

SEQ ID NO: 736917 - RNA, 26 nt, Human
agcugcugaaagaugcaggugaacag

SEQ ID NO: 736918 - RNA, 18 nt, Human
aggagcccaggacaggga

SEQ ID NO: 736919 - RNA, 22 nt, Human
aggagggguuggggcgcuggga

SEQ ID NO: 736920 - RNA, 18 nt, Human
aggcagggagggcaaauc

SEQ ID NO: 736921 - RNA, 19 nt, Human
aggccagaccacagcaugg

SEQ ID NO: 736922 - RNA, 18 nt, Human
aggccgucucccacuccu

SEQ ID NO: 736923 - RNA, 22 nt, Human
aggcgccggaaucgagggggcu

SEQ ID NO: 736924 - RNA, 23 nt, Human
agggaggucucucagucugggcc

SEQ ID NO: 736925 - RNA, 21 nt, Human
agggaugggcggcugggccgg

SEQ ID NO: 736926 - RNA, 18 nt, Human
aggggagcugcugaaaga

SEQ ID NO: 736927 - RNA, 21 nt, Human
agugaaacauuuacuucuuuu

SEQ ID NO: 736928 - RNA, 18 nt, Human
aguuaagaaaaccaaacc

SEQ ID NO: 736929 - RNA, 23 nt, Human
auaaaggcuugggauaaagaggg

SEQ ID NO: 736930 - RNA, 24 nt, Human
aucaagccaggagcuggaacccaa

SEQ ID NO: 736931 - RNA, 21 nt, Human
aucccaggccccacaagcagc

SEQ ID NO: 736932 - RNA, 19 nt, Human
auccuggcagaagccucug

SEQ ID NO: 736933 - RNA, 20 nt, Human
auccuggcagaagccucugc

SEQ ID NO: 736934 - RNA, 18 nt, Human
aucuuuucacuuucaaag

SEQ ID NO: 736935 - RNA, 24 nt, Human
augaauguuuaaaaaaaaacaaaa

SEQ ID NO: 736936 - RNA, 19 nt, Human
augacccugcugccaaauc

SEQ ID NO: 736937 - RNA, 18 nt, Human
augcuaaaacugucauca

SEQ ID NO: 736938 - RNA, 22 nt, Human
auggagccccagaagcagagcc

SEQ ID NO: 736939 - RNA, 24 nt, Human
auuagaccaaggagggguuggggc

SEQ ID NO: 736940 - RNA, 18 nt, Human
caaaaacaaaacacaacc

SEQ ID NO: 736941 - RNA, 24 nt, Human
caaaaagccucaaaguaaaaugac

SEQ ID NO: 736942 - RNA, 24 nt, Human
caaaacauaaacaaaaggaaacaa

SEQ ID NO: 736943 - RNA, 25 nt, Human
caaaacccccaaauccuuuuuuacu

SEQ ID NO: 736944 - RNA, 23 nt, Human
caaaaggaaacaaaaacaaaaca

SEQ ID NO: 736945 - RNA, 19 nt, Human
caaacaaaacccccaaauc

SEQ ID NO: 736946 - RNA, 24 nt, Human
caaacuaaacaggacagaggcuag

SEQ ID NO: 736947 - RNA, 22 nt, Human
caaagcaagcgggucaaugcca

SEQ ID NO: 736948 - RNA, 20 nt, Human
caacccucucaggaaccaaa

SEQ ID NO: 736949 - RNA, 26 nt, Human
caacuaugacccccccccucccccaa

SEQ ID NO: 736950 - RNA, 18 nt, Human
caacuuuaacaggcaaaa

SEQ ID NO: 736951 - RNA, 19 nt, Human
caaggccacugguggcuga

SEQ ID NO: 736952 - RNA, 24 nt, Human
cacaaggcaugaggucaaaagcuu

SEQ ID NO: 736953 - RNA, 23 nt, Human
cacacgcaccaccgcaucaggug

SEQ ID NO: 736954 - RNA, 22 nt, Human
cacagcuuuggaacugaacuga

SEQ ID NO: 736955 - RNA, 24 nt, Human
caccaagugggguggaaacaguga

SEQ ID NO: 736956 - RNA, 21 nt, Human
cacccagccucacccuggacc

SEQ ID NO: 736957 - RNA, 20 nt, Human
cacccaggaauggcuuggca

SEQ ID NO: 736958 - RNA, 19 nt, Human
caccccaucgcuucccagg

SEQ ID NO: 736959 - RNA, 21 nt, Human
cacgaugagcugugugggagg

SEQ ID NO: 736960 - RNA, 20 nt, Human
cacggggccugggaugggcc

SEQ ID NO: 736961 - RNA, 22 nt, Human
cacucuuguccccagaacacag

SEQ ID NO: 736962 - RNA, 22 nt, Human
cacugagccacuccuguccugg

SEQ ID NO: 736963 - RNA, 20 nt, Human
cacugcugagaaggcgcccu

SEQ ID NO: 736964 - RNA, 20 nt, Human
cacugugccuagggaugggc

SEQ ID NO: 736965 - RNA, 18 nt, Human
cacuuucaaaggcguccc

SEQ ID NO: 736966 - RNA, 19 nt, Human
cagauccagaagauaggag

SEQ ID NO: 736967 - RNA, 23 nt, Human
cagcagcaggaaagggaagugcu

SEQ ID NO: 736968 - RNA, 20 nt, Human
cagcagguggggcuccuccu

SEQ ID NO: 736969 - RNA, 18 nt, Human
cagccccuggggaaggga

SEQ ID NO: 736970 - RNA, 19 nt, Human
cagcucaggucacacacag

SEQ ID NO: 736971 - RNA, 23 nt, Human
cagcucaggucacacacaggugg

SEQ ID NO: 736972 - RNA, 19 nt, Human
caggcccuuuggaccuugg

SEQ ID NO: 736973 - RNA, 22 nt, Human
caguaaaacugcccuuucccag

SEQ ID NO: 736974 - RNA, 19 nt, Human
cagugaccaaggcagagcu

SEQ ID NO: 736975 - RNA, 20 nt, Human
cagugaccccuaagaacagc

SEQ ID NO: 736976 - RNA, 20 nt, Human
cauauaaaaguucagcuaua

SEQ ID NO: 736977 - RNA, 18 nt, Human
cauuagaccaaggagggg

SEQ ID NO: 736978 - RNA, 22 nt, Human
ccaaacaaaacccccaaauccu

SEQ ID NO: 736979 - RNA, 24 nt, Human
ccaaaccaaaugcagcuggcauug

SEQ ID NO: 736980 - RNA, 19 nt, Human
ccacagugccacucuuguc

SEQ ID NO: 736981 - RNA, 20 nt, Human
ccacagugccacucuugucc

SEQ ID NO: 736982 - RNA, 18 nt, Human
ccacccagccucacccug

SEQ ID NO: 736983 - RNA, 21 nt, Human
ccacuaagaccuccaggcaag

SEQ ID NO: 736984 - RNA, 20 nt, Human
ccagaccacagcauggcugg

SEQ ID NO: 736985 - RNA, 21 nt, Human
ccagcagguggggcuccuccu

SEQ ID NO: 736986 - RNA, 24 nt, Human
ccaggacagggacccugugugauu

SEQ ID NO: 736987 - RNA, 19 nt, Human
ccaggcuuguucugcagga

SEQ ID NO: 736988 - RNA, 22 nt, Human
ccagggccuucccgccgcuccc

SEQ ID NO: 736989 - RNA, 23 nt, Human
ccaguggccucacuuggggacca

SEQ ID NO: 736990 - RNA, 20 nt, Human
cccaacuaugaccccccccc

SEQ ID NO: 736991 - RNA, 24 nt, Human
cccacaggcccagggacucccgcu

SEQ ID NO: 736992 - RNA, 21 nt, Human
cccagcacacgauggcucaca

SEQ ID NO: 736993 - RNA, 24 nt, Human
cccagcacauccacuggcuuuaga

SEQ ID NO: 736994 - RNA, 18 nt, Human
cccaggacagggacccug

SEQ ID NO: 736995 - RNA, 23 nt, Human
cccaggcuuguucugcaggaagu

SEQ ID NO: 736996 - RNA, 19 nt, Human
cccauucaucacagaacac

SEQ ID NO: 736997 - RNA, 23 nt, Human
ccccacaggcccagggacucccg

SEQ ID NO: 736998 - RNA, 19 nt, Human
ccccagaagcagagcccac

SEQ ID NO: 736999 - RNA, 25 nt, Human
ccccagaagcagagcccacggggcc

SEQ ID NO: 737000 - RNA, 19 nt, Human
cccccccccucccccaacc

SEQ ID NO: 737001 - RNA, 19 nt, Human
cccccccucccccaaccug

SEQ ID NO: 737002 - RNA, 18 nt, Human
cccccucccccaaccugc

SEQ ID NO: 737003 - RNA, 22 nt, Human
ccccgacaggccaccauccacc

SEQ ID NO: 737004 - RNA, 18 nt, Human
ccccucccccaaccugcc

SEQ ID NO: 737005 - RNA, 18 nt, Human
cccggaggcugcgcaggc

SEQ ID NO: 737006 - RNA, 23 nt, Human
cccggcccccuccucuagguguu

SEQ ID NO: 737007 - RNA, 24 nt, Human
cccuagaaguggcuggaaggaccc

SEQ ID NO: 737008 - RNA, 26 nt, Human
cccuuucccaggcagcucuggggugg

SEQ ID NO: 737009 - RNA, 18 nt, Human
ccgccgcucccgccgcuc

SEQ ID NO: 737010 - RNA, 18 nt, Human
ccggcccccuccucuagg

SEQ ID NO: 737011 - RNA, 19 nt, Human
ccuaacgggcuucucccca

SEQ ID NO: 737012 - RNA, 21 nt, Human
ccucaagggugaaccagcuga

SEQ ID NO: 737013 - RNA, 23 nt, Human
ccucacccuggaccugcccccgc

SEQ ID NO: 737014 - RNA, 22 nt, Human
ccucccggcuccagcuuucggc

SEQ ID NO: 737015 - RNA, 23 nt, Human
ccucccggcuccagcuuucggcu

SEQ ID NO: 737016 - RNA, 23 nt, Human
ccuccuucucugccuuuuuacug

SEQ ID NO: 737017 - RNA, 23 nt, Human
ccucggagcagccaacuuggccu

SEQ ID NO: 737018 - RNA, 20 nt, Human
ccucggguccccacaggccc

SEQ ID NO: 737019 - RNA, 25 nt, Human
ccucuaacccaggcuuguucugcag

SEQ ID NO: 737020 - RNA, 24 nt, Human
ccugaacuguccccuucccuuucc

SEQ ID NO: 737021 - RNA, 20 nt, Human
ccugcagggcaggguaugga

SEQ ID NO: 737022 - RNA, 20 nt, Human
ccuuagaauugugagagcag

SEQ ID NO: 737023 - RNA, 22 nt, Human
ccuucuucucacccaaacuagc

SEQ ID NO: 737024 - RNA, 22 nt, Human
ccuuucccaggcagcucugggg

SEQ ID NO: 737025 - RNA, 20 nt, Human
ccuuuccccuuuguaaaaac

SEQ ID NO: 737026 - RNA, 21 nt, Human
cgcugggaggccugaggccug

SEQ ID NO: 737027 - RNA, 19 nt, Human
cggcuccagcuuucggcuc

SEQ ID NO: 737028 - RNA, 18 nt, Human
cgggaguggagaggaggg

SEQ ID NO: 737029 - RNA, 25 nt, Human
cuaagaugcuccuuccccauguucu

SEQ ID NO: 737030 - RNA, 19 nt, Human
cucacccuggaccugcccc

SEQ ID NO: 737031 - RNA, 23 nt, Human
cuccgcgcggcuguccucaaagc

SEQ ID NO: 737032 - RNA, 18 nt, Human
cuccucuuggccagcucc

SEQ ID NO: 737033 - RNA, 18 nt, Human
cucugccuuuuuacugga

SEQ ID NO: 737034 - RNA, 19 nt, Human
cugagcaccccaucgcuuc

SEQ ID NO: 737035 - RNA, 26 nt, Human
cugcccccgccgucugaagacaaacg

SEQ ID NO: 737036 - RNA, 20 nt, Human
cugcugcagccacuaagacc

SEQ ID NO: 737037 - RNA, 25 nt, Human
cuggaacccaacuaugacccccccc

SEQ ID NO: 737038 - RNA, 24 nt, Human
cuggagaagcuccucuuggccagc

SEQ ID NO: 737039 - RNA, 18 nt, Human
cuguucccacuaaggccc

SEQ ID NO: 737040 - RNA, 19 nt, Human
cuguucccacuaaggcccc

SEQ ID NO: 737041 - RNA, 25 nt, Human
cuuccagaagcugucacugaccauc

SEQ ID NO: 737042 - RNA, 20 nt, Human
cuucccgccgcucccgccgc

SEQ ID NO: 737043 - RNA, 23 nt, Human
cuucucugccuuuuuacuggagg

SEQ ID NO: 737044 - RNA, 21 nt, Human
cuuggcaaggagggccggugg

SEQ ID NO: 737045 - RNA, 24 nt, Human
cuuguccccagaacacaguuuggg

SEQ ID NO: 737046 - RNA, 21 nt, Human
cuuguccuccgcgcggcuguc

SEQ ID NO: 737047 - RNA, 24 nt, Human
cuuguucugcaggaagugaaaagg

SEQ ID NO: 737048 - RNA, 23 nt, Human
gaaaaacacagcaccccugcagg

SEQ ID NO: 737049 - RNA, 18 nt, Human
gaaaagcagacaagaagc

SEQ ID NO: 737050 - RNA, 21 nt, Human
gaaaagcagacaagaagcuca

SEQ ID NO: 737051 - RNA, 19 nt, Human
gaaacaaaaacaaaacaca

SEQ ID NO: 737052 - RNA, 21 nt, Human
gaaacaaaaacaaaacacaac

SEQ ID NO: 737053 - RNA, 21 nt, Human
gaaccaaacaaaacccccaaa

SEQ ID NO: 737054 - RNA, 18 nt, Human
gaaggaaggaaaaugaca

SEQ ID NO: 737055 - RNA, 19 nt, Human
gagaagccaacaguuaaga

SEQ ID NO: 737056 - RNA, 20 nt, Human
gagcccaagccugagcgcug

SEQ ID NO: 737057 - RNA, 18 nt, Human
gaggagcccaggacaggg

SEQ ID NO: 737058 - RNA, 21 nt, Human
gaggaguucugguaggagagc

SEQ ID NO: 737059 - RNA, 22 nt, Human
gaggcuucgggaaggucagcac

SEQ ID NO: 737060 - RNA, 19 nt, Human
gagggguuggggcgcuggg

SEQ ID NO: 737061 - RNA, 22 nt, Human
gagugucggcugugucgaggcc

SEQ ID NO: 737062 - RNA, 23 nt, Human
gaugggccugugguaugucagcu

SEQ ID NO: 737063 - RNA, 19 nt, Human
gcagagcugccagcgucag

SEQ ID NO: 737064 - RNA, 22 nt, Human
gcagcaggaaagggaagugcug

SEQ ID NO: 737065 - RNA, 19 nt, Human
gcccugggcucaucaagcc

SEQ ID NO: 737066 - RNA, 18 nt, Human
gccugggaugggccugug

SEQ ID NO: 737067 - RNA, 18 nt, Human
gcgugaucggaggaguuc

SEQ ID NO: 737068 - RNA, 21 nt, Human
gcucgcugaagucgcugcuuu

SEQ ID NO: 737069 - RNA, 22 nt, Human
gcucuggggugggcgcuguugg

SEQ ID NO: 737070 - RNA, 22 nt, Human
gcugggaggccugaggccugcc

SEQ ID NO: 737071 - RNA, 20 nt, Human
gcuucuccccaaacccuccc

SEQ ID NO: 737072 - RNA, 22 nt, Human
ggaaaagcagacaagaagcuca

SEQ ID NO: 737073 - RNA, 23 nt, Human
ggaagggacucaagcauaaaggc

SEQ ID NO: 737074 - RNA, 19 nt, Human
ggaaggucagcacuggcau

SEQ ID NO: 737075 - RNA, 21 nt, Human
ggacaaacucccaguggccuc

SEQ ID NO: 737076 - RNA, 19 nt, Human
ggaggaggagguagacgcu

SEQ ID NO: 737077 - RNA, 21 nt, Human
ggcgccuucuccugaagggcc

SEQ ID NO: 737078 - RNA, 24 nt, Human
ggcuggagaacaggugaccuuuuu

SEQ ID NO: 737079 - RNA, 18 nt, Human
gggagaaaggcguccaca

SEQ ID NO: 737080 - RNA, 18 nt, Human
gggagugaagcaaaggag

SEQ ID NO: 737081 - RNA, 21 nt, Human
gggguuggggcgcugggaggc

SEQ ID NO: 737082 - RNA, 22 nt, Human
gggucucugacuggagaagcuc

SEQ ID NO: 737083 - RNA, 18 nt, Human
gggugcauccccggcccc

SEQ ID NO: 737084 - RNA, 20 nt, Human
ggguuggggcgcugggaggc

SEQ ID NO: 737085 - RNA, 19 nt, Human
gguuggggcgcugggaggc

SEQ ID NO: 737086 - RNA, 21 nt, Human
gucacauuucagaagagagcu

SEQ ID NO: 737087 - RNA, 26 nt, Human
gucagcccuccacccagccucacccu

SEQ ID NO: 737088 - RNA, 19 nt, Human
gugaagagcaggucucaca

SEQ ID NO: 737089 - RNA, 20 nt, Human
gugcauccccggcccccucc

SEQ ID NO: 737090 - RNA, 21 nt, Human
guuggcucucauagcgagggg

SEQ ID NO: 737091 - RNA, 19 nt, Human
uaaaacugcccuuucccag

SEQ ID NO: 737092 - RNA, 20 nt, Human
uaaaaugacccugcugccaa

SEQ ID NO: 737093 - RNA, 22 nt, Human
uaaaaugacccugcugccaaau

SEQ ID NO: 737094 - RNA, 27 nt, Human
uaaacaaaaggaaacaaaaacaaaaca

SEQ ID NO: 737095 - RNA, 21 nt, Human
uaagaacagcugagaaaccug

SEQ ID NO: 737096 - RNA, 25 nt, Human
uacuacacaaggcaugaggucaaaa

SEQ ID NO: 737097 - RNA, 21 nt, Human
uacugugggucugauaccagg

SEQ ID NO: 737098 - RNA, 22 nt, Human
uacugugggucugauaccaggu

SEQ ID NO: 737099 - RNA, 23 nt, Human
uagagauggaagggagcggaggg

SEQ ID NO: 737100 - RNA, 20 nt, Human
uagagcccaagccugagcgc

SEQ ID NO: 737101 - RNA, 22 nt, Human
uaugacccccccccucccccaa

SEQ ID NO: 737102 - RNA, 20 nt, Human
uauuugaaaggagaaacaau

SEQ ID NO: 737103 - RNA, 24 nt, Human
ucacacgcaccaccgcaucaggug

SEQ ID NO: 737104 - RNA, 20 nt, Human
ucacaugcccgaagaccacc

SEQ ID NO: 737105 - RNA, 26 nt, Human
ucacccaaacuagcccccgacaggcc

SEQ ID NO: 737106 - RNA, 26 nt, Human
ucagcucaccccaucugggccaaccu

SEQ ID NO: 737107 - RNA, 23 nt, Human
ucaggaaccaaacaaaaccccca

SEQ ID NO: 737108 - RNA, 19 nt, Human
ucagugaccccuaagaaca

SEQ ID NO: 737109 - RNA, 20 nt, Human
ucccaggcagcucuggggug

SEQ ID NO: 737110 - RNA, 21 nt, Human
ucccaggccccacaagcagcc

SEQ ID NO: 737111 - RNA, 19 nt, Human
ucccaggcggggagccagg

SEQ ID NO: 737112 - RNA, 20 nt, Human
ucccccuuaaggaaccuaga

SEQ ID NO: 737113 - RNA, 19 nt, Human
ucccgcaggccugaacuca

SEQ ID NO: 737114 - RNA, 25 nt, Human
ucccgcucuugccggaggcgccgga

SEQ ID NO: 737115 - RNA, 26 nt, Human
ucccuccaucaccaagugguguucac

SEQ ID NO: 737116 - RNA, 19 nt, Human
uccuccucggguccccaca

SEQ ID NO: 737117 - RNA, 25 nt, Human
uccuggaggccaccaaguggggugg

SEQ ID NO: 737118 - RNA, 23 nt, Human
ucgggaguggagaggagggaggu

SEQ ID NO: 737119 - RNA, 25 nt, Human
ucuacacuagacacagagcuuagag

SEQ ID NO: 737120 - RNA, 24 nt, Human
ucucacaugcccgaagaccaccag

SEQ ID NO: 737121 - RNA, 18 nt, Human
ucuccccaaacccucccg

SEQ ID NO: 737122 - RNA, 19 nt, Human
ucucugccuuuuuacugga

SEQ ID NO: 737123 - RNA, 20 nt, Human
ucuuacuuaaaaacaagccc

SEQ ID NO: 737124 - RNA, 23 nt, Human
ugaauguuuaaaaaaaaacaaaa

SEQ ID NO: 737125 - RNA, 20 nt, Human
ugaccccccaaucccuaccu

SEQ ID NO: 737126 - RNA, 23 nt, Human
ugaccccccaaucccuaccucag

SEQ ID NO: 737127 - RNA, 22 nt, Human
ugacccccccccucccccaacc

SEQ ID NO: 737128 - RNA, 23 nt, Human
ugagagcaguaagaaguuacuuc

SEQ ID NO: 737129 - RNA, 22 nt, Human
ugaggaaucaggaggggaugca

SEQ ID NO: 737130 - RNA, 18 nt, Human
ugagggcaggaggggagc

SEQ ID NO: 737131 - RNA, 18 nt, Human
ugagggcaggaggggagc

SEQ ID NO: 737132 - RNA, 19 nt, Human
ugagggcaggaggggagcu

SEQ ID NO: 737133 - RNA, 23 nt, Human
ugcagggcaggguauggagcccc

SEQ ID NO: 737134 - RNA, 20 nt, Human
ugcccucagccccccaaguc

SEQ ID NO: 737135 - RNA, 18 nt, Human
ugccuagggaugggcggc

SEQ ID NO: 737136 - RNA, 18 nt, Human
ugcucagcuuccagaagc

SEQ ID NO: 737137 - RNA, 21 nt, Human
ugcugagaaggcgcccuggcu

SEQ ID NO: 737138 - RNA, 22 nt, Human
ugcuggucuccaccuguuccca

SEQ ID NO: 737139 - RNA, 19 nt, Human
ugcuuagguccgucacauu

SEQ ID NO: 737140 - RNA, 26 nt, Human
uggaaagacaaagaggaaaggccaaa

SEQ ID NO: 737141 - RNA, 22 nt, Human
uggaaugacagaaucuggagug

SEQ ID NO: 737142 - RNA, 25 nt, Human
uggagaagcugcccucccggaggcu

SEQ ID NO: 737143 - RNA, 19 nt, Human
uggcagaagccucugcaug

SEQ ID NO: 737144 - RNA, 21 nt, Human
uggcaugggcugcccgcucca

SEQ ID NO: 737145 - RNA, 19 nt, Human
ugggaggccugaggccugc

SEQ ID NO: 737146 - RNA, 19 nt, Human
ugggaggggucuggccaug

SEQ ID NO: 737147 - RNA, 20 nt, Human
ugggagguggagacaggucc

SEQ ID NO: 737148 - RNA, 22 nt, Human
ugggagguggagacagguccag

SEQ ID NO: 737149 - RNA, 21 nt, Human
ugggagugaagcaaaggagga

SEQ ID NO: 737150 - RNA, 23 nt, Human
uggggacagagagggcucauccc

SEQ ID NO: 737151 - RNA, 24 nt, Human
uguaaaaaccuuggcuacauuuua

SEQ ID NO: 737152 - RNA, 20 nt, Human
ugugcucagcuuccagaagc

SEQ ID NO: 737153 - RNA, 22 nt, Human
uguggggagaagccaacaguua

SEQ ID NO: 737154 - RNA, 23 nt, Human
uuaaaacaucucugcacuaagaa

SEQ ID NO: 737155 - RNA, 20 nt, Human
uuacuacacaaggcaugagg

SEQ ID NO: 737156 - RNA, 24 nt, Human
uuagagcccaagccugagcgcugu

SEQ ID NO: 737157 - RNA, 25 nt, Human
uucagaagagagcuggcuuucugga

SEQ ID NO: 737158 - RNA, 19 nt, Human
uucccacuaaggccccgug

SEQ ID NO: 737159 - RNA, 21 nt, Human
uucccaggcagcucuggggug

SEQ ID NO: 737160 - RNA, 18 nt, Human
uucucaaacagcaaguac

SEQ ID NO: 737161 - RNA, 21 nt, Human
uugcagugggagaaggaaaag

SEQ ID NO: 737162 - RNA, 19 nt, Human
uuuuuuauuuaaauaagga

SEQ ID NO: 737163 - RNA, 21 nt, Human
aagaagaagacgggagaaaga

SEQ ID NO: 737164 - RNA, 21 nt, Human
aagaagaagacgggagaaaga

SEQ ID NO: 737165 - RNA, 19 nt, Human
aagaagaggagcuggggcu

SEQ ID NO: 737166 - RNA, 22 nt, Human
aagcaaagagggugcaaggucc

SEQ ID NO: 737167 - RNA, 18 nt, Human
acaaugccugaaccccag

SEQ ID NO: 737168 - RNA, 20 nt, Human
accccgacagcuccggacac

SEQ ID NO: 737169 - RNA, 21 nt, Human
agaagaagacgggagaaagag

SEQ ID NO: 737170 - RNA, 25 nt, Human
agacagcgcuggggccggcggcacg

SEQ ID NO: 737171 - RNA, 23 nt, Human
agaggggagagggaggcaggagc

SEQ ID NO: 737172 - RNA, 20 nt, Human
agcaggcaaaaagacacaug

SEQ ID NO: 737173 - RNA, 21 nt, Human
agccgaagaggucugggcugg

SEQ ID NO: 737174 - RNA, 21 nt, Human
agcgcucuccuagccccacac

SEQ ID NO: 737175 - RNA, 22 nt, Human
agcuagaccuccagggaaaagu

SEQ ID NO: 737176 - RNA, 20 nt, Human
agcuccggacaccugcccuu

SEQ ID NO: 737177 - RNA, 18 nt, Human
aggaagcaaagagggugc

SEQ ID NO: 737178 - RNA, 21 nt, Human
aggaagcaaagagggugcaag

SEQ ID NO: 737179 - RNA, 24 nt, Human
aggaggaaaaaagacaaugccuga

SEQ ID NO: 737180 - RNA, 18 nt, Human
aggcagggaggacauggg

SEQ ID NO: 737181 - RNA, 21 nt, Human
agggaggacauggggaggagg

SEQ ID NO: 737182 - RNA, 20 nt, Human
aggggaacgggcaggagagc

SEQ ID NO: 737183 - RNA, 18 nt, Human
agguguaagggaauggcg

SEQ ID NO: 737184 - RNA, 19 nt, Human
aucaaugguccguguccuc

SEQ ID NO: 737185 - RNA, 22 nt, Human
aucuugggcucaugguggcccu

SEQ ID NO: 737186 - RNA, 19 nt, Human
caaguuccugaagccgaag

SEQ ID NO: 737187 - RNA, 25 nt, Human
cacacaggcccagaggucugaggcc

SEQ ID NO: 737188 - RNA, 18 nt, Human
cacagagagcucacacag

SEQ ID NO: 737189 - RNA, 24 nt, Human
cacagagagcucacacaggcccag

SEQ ID NO: 737190 - RNA, 21 nt, Human
caccacuccccagcgcuggag

SEQ ID NO: 737191 - RNA, 21 nt, Human
caccccgacagcuccggacac

SEQ ID NO: 737192 - RNA, 19 nt, Human
cacugccacccucccccgc

SEQ ID NO: 737193 - RNA, 21 nt, Human
cagccagagcucacagagagc

SEQ ID NO: 737194 - RNA, 24 nt, Human
cagccccucccacugccacccucc

SEQ ID NO: 737195 - RNA, 18 nt, Human
cagcucugauggcuucaa

SEQ ID NO: 737196 - RNA, 19 nt, Human
cagcugaaguuuggccaca

SEQ ID NO: 737197 - RNA, 20 nt, Human
caggcccugaggucagagag

SEQ ID NO: 737198 - RNA, 26 nt, Human
caucccagaccugagccccccccaaa

SEQ ID NO: 737199 - RNA, 23 nt, Human
ccaacacaagcagggucccaccc

SEQ ID NO: 737200 - RNA, 21 nt, Human
ccacccucccccgcccccaag

SEQ ID NO: 737201 - RNA, 21 nt, Human
ccacugccacccucccccgcc

SEQ ID NO: 737202 - RNA, 26 nt, Human
ccagagcucacagagagcucacaccg

SEQ ID NO: 737203 - RNA, 24 nt, Human
ccauacagccccucccacugccac

SEQ ID NO: 737204 - RNA, 20 nt, Human
cccaaaaccugucuggacuu

SEQ ID NO: 737205 - RNA, 21 nt, Human
cccaaccccagcucugauggc

SEQ ID NO: 737206 - RNA, 22 nt, Human
cccaagccccaguggcccuggc

SEQ ID NO: 737207 - RNA, 19 nt, Human
cccacacggccagaggagc

SEQ ID NO: 737208 - RNA, 19 nt, Human
ccccaagccccaguggccc

SEQ ID NO: 737209 - RNA, 25 nt, Human
ccccaagccccaguggcccuggccc

SEQ ID NO: 737210 - RNA, 24 nt, Human
ccccagacuuuccuguuccccagc

SEQ ID NO: 737211 - RNA, 19 nt, Human
ccccagcucugauggcuuc

SEQ ID NO: 737212 - RNA, 22 nt, Human
cccccaagccccaguggcccug

SEQ ID NO: 737213 - RNA, 18 nt, Human
cccccgggcccagccggg

SEQ ID NO: 737214 - RNA, 24 nt, Human
ccgcccccaagccccaguggcccu

SEQ ID NO: 737215 - RNA, 31 nt, Human
ccuccagcaggcaaaaagacacauggaaguu

SEQ ID NO: 737216 - RNA, 18 nt, Human
ccuccagggaaaaguggg

SEQ ID NO: 737217 - RNA, 25 nt, Human
ccucccacugccacccucccccgcc

SEQ ID NO: 737218 - RNA, 21 nt, Human
ccugagccccccccaaaaccu

SEQ ID NO: 737219 - RNA, 22 nt, Human
cgaaucuggaaggaaaccccau

SEQ ID NO: 737220 - RNA, 22 nt, Human
cgaggcaaguuccugaagccga

SEQ ID NO: 737221 - RNA, 22 nt, Human
cgcccccaagccccaguggccc

SEQ ID NO: 737222 - RNA, 23 nt, Human
cggcccaggggcaggggaacggg

SEQ ID NO: 737223 - RNA, 22 nt, Human
cggcggcacggggagcaggagc

SEQ ID NO: 737224 - RNA, 19 nt, Human
cgggucccaaggcagggag

SEQ ID NO: 737225 - RNA, 19 nt, Human
cucccccgcccccaagccc

SEQ ID NO: 737226 - RNA, 20 nt, Human
cucccccgcccccaagcccc

SEQ ID NO: 737227 - RNA, 21 nt, Human
cucuccauacagccccuccca

SEQ ID NO: 737228 - RNA, 20 nt, Human
cucuccuguggcuccccaga

SEQ ID NO: 737229 - RNA, 21 nt, Human
cucuccuguggcuccccagac

SEQ ID NO: 737230 - RNA, 19 nt, Human
cugcagcccaugguggaga

SEQ ID NO: 737231 - RNA, 25 nt, Human
gaaaaaagacaaugccugaacccca

SEQ ID NO: 737232 - RNA, 18 nt, Human
gaagaagaagacgggaga

SEQ ID NO: 737233 - RNA, 24 nt, Human
gaagaagaagacgggagaaagagu

SEQ ID NO: 737234 - RNA, 23 nt, Human
gaagcaaagagggugcaaggucc

SEQ ID NO: 737235 - RNA, 24 nt, Human
gacaaugccugaaccccagcuccu

SEQ ID NO: 737236 - RNA, 24 nt, Human
gaggccacagagcuagaccuccag

SEQ ID NO: 737237 - RNA, 21 nt, Human
gcaagaagaggagcuggggcu

SEQ ID NO: 737238 - RNA, 22 nt, Human
gcccccaagccccaguggcccu

SEQ ID NO: 737239 - RNA, 24 nt, Human
gcccugaggucagagagagggcca

SEQ ID NO: 737240 - RNA, 20 nt, Human
gcuccggacaccugcccuuc

SEQ ID NO: 737241 - RNA, 21 nt, Human
ggaaguguguggccaggcccu

SEQ ID NO: 737242 - RNA, 19 nt, Human
ggacagaaggacucaggca

SEQ ID NO: 737243 - RNA, 19 nt, Human
ggcaagaagaggagcuggg

SEQ ID NO: 737244 - RNA, 18 nt, Human
ggcccagaggucugaggc

SEQ ID NO: 737245 - RNA, 23 nt, Human
ggcgggggggcaugcaauauggg

SEQ ID NO: 737246 - RNA, 24 nt, Human
gggaaaaguggggaagaagaagac

SEQ ID NO: 737247 - RNA, 21 nt, Human
gggaauggcgggggggcaugc

SEQ ID NO: 737248 - RNA, 18 nt, Human
gggagcaggagcugaggc

SEQ ID NO: 737249 - RNA, 20 nt, Human
gggcaagaagaggagcuggg

SEQ ID NO: 737250 - RNA, 24 nt, Human
gggcuggggccuacuggagaaagg

SEQ ID NO: 737251 - RNA, 21 nt, Human
gggcuugagggcccgggggcc

SEQ ID NO: 737252 - RNA, 18 nt, Human
ggggagagggaggcagga

SEQ ID NO: 737253 - RNA, 23 nt, Human
gggggcccgggagacagcgcugg

SEQ ID NO: 737254 - RNA, 26 nt, Human
ggguagguguaagggaauggcggggg

SEQ ID NO: 737255 - RNA, 21 nt, Human
gguggagaggggagagggagg

SEQ ID NO: 737256 - RNA, 24 nt, Human
ggugggguagguguaagggaaugg

SEQ ID NO: 737257 - RNA, 22 nt, Human
uacaaggaggaaaaaagacaau

SEQ ID NO: 737258 - RNA, 19 nt, Human
uacgaggaucucuggaagg

SEQ ID NO: 737259 - RNA, 18 nt, Human
uauguguauauauauuuc

SEQ ID NO: 737260 - RNA, 21 nt, Human
ucacagagagcucacacaggc

SEQ ID NO: 737261 - RNA, 26 nt, Human
ucacagagagcucacacaggcccaga

SEQ ID NO: 737262 - RNA, 23 nt, Human
ucccaaccccagcucugauggcu

SEQ ID NO: 737263 - RNA, 18 nt, Human
ucccaaggcagggaggac

SEQ ID NO: 737264 - RNA, 26 nt, Human
ucccaaggcagggaggacauggggag

SEQ ID NO: 737265 - RNA, 20 nt, Human
ucccacugccacccuccccc

SEQ ID NO: 737266 - RNA, 20 nt, Human
uccccagggcugaugcuggg

SEQ ID NO: 737267 - RNA, 22 nt, Human
ucccccgggcccagccggggga

SEQ ID NO: 737268 - RNA, 18 nt, Human
uccccgcucucucacggc

SEQ ID NO: 737269 - RNA, 19 nt, Human
uccuccagcaggcaaaaag

SEQ ID NO: 737270 - RNA, 27 nt, Human
uccucuccauacagccccucccacugg

SEQ ID NO: 737271 - RNA, 26 nt, Human
ucuauacugcagcccaugguggagag

SEQ ID NO: 737272 - RNA, 23 nt, Human
ucucuggaaggcccucaccacuc

SEQ ID NO: 737273 - RNA, 24 nt, Human
ucucuggaaggcccucaccacucc

SEQ ID NO: 737274 - RNA, 24 nt, Human
ucugaggccacagagcuagaccuc

SEQ ID NO: 737275 - RNA, 24 nt, Human
ucuggaaggcccucaccacucccc

SEQ ID NO: 737276 - RNA, 22 nt, Human
ugaaaaaaccgaggaagcaaag

SEQ ID NO: 737277 - RNA, 21 nt, Human
ugagaggacgggucccaaggc

SEQ ID NO: 737278 - RNA, 19 nt, Human
ugaggagcuggauaugcgg

SEQ ID NO: 737279 - RNA, 24 nt, Human
ugaggccacagagcuagaccucca

SEQ ID NO: 737280 - RNA, 19 nt, Human
ugaggucagagagagggcc

SEQ ID NO: 737281 - RNA, 24 nt, Human
ugcagggcgaggcaaguuccugaa

SEQ ID NO: 737282 - RNA, 19 nt, Human
ugccacccucccccgcccc

SEQ ID NO: 737283 - RNA, 22 nt, Human
ugccucaggaaggauaucuugg

SEQ ID NO: 737284 - RNA, 23 nt, Human
ugcugggggugagaggacggguc

SEQ ID NO: 737285 - RNA, 20 nt, Human
uggaaggaaaccccauggca

SEQ ID NO: 737286 - RNA, 21 nt, Human
uggagaggcagcggagauucu

SEQ ID NO: 737287 - RNA, 23 nt, Human
ugggagccucucuccccagggcu

SEQ ID NO: 737288 - RNA, 19 nt, Human
uggggccggcggcacgggg

SEQ ID NO: 737289 - RNA, 21 nt, Human
uggggcuuguaaaaaauauau

SEQ ID NO: 737290 - RNA, 18 nt, Human
ugguccguguccuccagc

SEQ ID NO: 737291 - RNA, 24 nt, Human
uguccccgcucucucacggcgcca

SEQ ID NO: 737292 - RNA, 19 nt, Human
ugucuggacuuugaucagg

SEQ ID NO: 737293 - RNA, 21 nt, Human
uuccccagcucacucucucca

SEQ ID NO: 737294 - RNA, 21 nt, Human
uucugacggacagaaggacuc

SEQ ID NO: 737295 - RNA, 18 nt, Human
uugcagggcgaggcaagu

SEQ ID NO: 737296 - RNA, 20 nt, Human
accaagagacggagcaaacc

SEQ ID NO: 737297 - RNA, 21 nt, Human
accaagagacggagcaaaccc

SEQ ID NO: 737298 - RNA, 24 nt, Human
cagccucugcccaggcgucaagga

SEQ ID NO: 737299 - RNA, 19 nt, Human
cagggcuccuggcuggagc

SEQ ID NO: 737300 - RNA, 22 nt, Human
cagggcuccuggcuggagcccc

SEQ ID NO: 737301 - RNA, 19 nt, Human
cagggcucuaccgccccuc

SEQ ID NO: 737302 - RNA, 19 nt, Human
ccaagagacggagcaaacc

SEQ ID NO: 737303 - RNA, 18 nt, Human
cccugggcagcagggcuc

SEQ ID NO: 737304 - RNA, 20 nt, Human
ccuccggaggcgucauccuu

SEQ ID NO: 737305 - RNA, 18 nt, Human
ccuggcaccugccugugc

SEQ ID NO: 737306 - RNA, 22 nt, Human
ccuggcaccugccugugcucgc

SEQ ID NO: 737307 - RNA, 22 nt, Human
cgccuggggucacucacuguuc

SEQ ID NO: 737308 - RNA, 22 nt, Human
cugcagcugcagccucugccca

SEQ ID NO: 737309 - RNA, 24 nt, Human
gauggcuccuagcgcccagguggg

SEQ ID NO: 737310 - RNA, 18 nt, Human
gccacaggguccugcagc

SEQ ID NO: 737311 - RNA, 23 nt, Human
gccccugggcagcagggcuccug

SEQ ID NO: 737312 - RNA, 26 nt, Human
ggccacaggguccugcagcugcagcc

SEQ ID NO: 737313 - RNA, 21 nt, Human
ggcuggagccccgggauggcu

SEQ ID NO: 737314 - RNA, 20 nt, Human
uccggaggcgucauccuugc

SEQ ID NO: 737315 - RNA, 19 nt, Human
uccuggcuccuggcaccuu

SEQ ID NO: 737316 - RNA, 18 nt, Human
ucuccaguggccacaggg

SEQ ID NO: 737317 - RNA, 21 nt, Human
ucuccaguggccacagggucc

SEQ ID NO: 737318 - RNA, 22 nt, Human
ucuccaguggccacaggguccu

SEQ ID NO: 737319 - RNA, 18 nt, Human
ugccccguuuccaguagg

SEQ ID NO: 737320 - RNA, 23 nt, Human
ugccucugccucuguucaaguuc

SEQ ID NO: 737321 - RNA, 18 nt, Human
uggccacaggguccugca

SEQ ID NO: 737322 - RNA, 19 nt, Human
uggcuccuagcgcccaggu

SEQ ID NO: 737323 - RNA, 19 nt, Human
uggcuccuggcaccugccu

SEQ ID NO: 737324 - RNA, 18 nt, Human
aaaacauguugcgaaugu

SEQ ID NO: 737325 - RNA, 18 nt, Human
aaacagggcccaagcaca

SEQ ID NO: 737326 - RNA, 22 nt, Human
aaacauucaccauucucaaaac

SEQ ID NO: 737327 - RNA, 23 nt, Human
aaacauucaccauucucaaaaca

SEQ ID NO: 737328 - RNA, 18 nt, Human
aaaggaaacaacccauua

SEQ ID NO: 737329 - RNA, 24 nt, Human
aacagcaugagacucugucucaaa

SEQ ID NO: 737330 - RNA, 19 nt, Human
aacauggugaaacuccauc

SEQ ID NO: 737331 - RNA, 20 nt, Human
aacauggugaaacuccaucu

SEQ ID NO: 737332 - RNA, 21 nt, Human
aacauggugaaacuccaucuc

SEQ ID NO: 737333 - RNA, 24 nt, Human
aacauuucuuuuuuuuuucucccg

SEQ ID NO: 737334 - RNA, 22 nt, Human
aagcacaggucugggauuagug

SEQ ID NO: 737335 - RNA, 20 nt, Human
aaggagcccccgcccgucug

SEQ ID NO: 737336 - RNA, 24 nt, Human
aauugcuugaacuugggaggcaga

SEQ ID NO: 737337 - RNA, 21 nt, Human
acacaaaaacacuuagacugc

SEQ ID NO: 737338 - RNA, 21 nt, Human
acacugcacuccagccugggc

SEQ ID NO: 737339 - RNA, 23 nt, Human
acacugcacuccagccugggcaa

SEQ ID NO: 737340 - RNA, 24 nt, Human
acagcaugagacucugucucaaaa

SEQ ID NO: 737341 - RNA, 18 nt, Human
acagccaugccugacuuc

SEQ ID NO: 737342 - RNA, 22 nt, Human
acaggagacuauugcagguggc

SEQ ID NO: 737343 - RNA, 21 nt, Human
accaaagccucccugcccucc

SEQ ID NO: 737344 - RNA, 18 nt, Human
acccaacagacaggaugg

SEQ ID NO: 737345 - RNA, 24 nt, Human
acuccaucucuacuaaaaauauaa

SEQ ID NO: 737346 - RNA, 24 nt, Human
acugcacuccagccugggcaacag

SEQ ID NO: 737347 - RNA, 18 nt, Human
acugcuucugagaggaaa

SEQ ID NO: 737348 - RNA, 19 nt, Human
acuucgccuauuacuuuuc

SEQ ID NO: 737349 - RNA, 22 nt, Human
agaauugcuugaacuugggagg

SEQ ID NO: 737350 - RNA, 19 nt, Human
agagguugcagugagcuca

SEQ ID NO: 737351 - RNA, 20 nt, Human
agagguugcagugagcucag

SEQ ID NO: 737352 - RNA, 24 nt, Human
agagguugcagugagcucagaucg

SEQ ID NO: 737353 - RNA, 23 nt, Human
agaucacuugaggucaggaguuc

SEQ ID NO: 737354 - RNA, 25 nt, Human
agaucacuugaggucaggaguucuu

SEQ ID NO: 737355 - RNA, 19 nt, Human
agcacuuugggaggcuaag

SEQ ID NO: 737356 - RNA, 20 nt, Human
agcacuuugggaggcuaagg

SEQ ID NO: 737357 - RNA, 18 nt, Human
agccggagcgccugggcc

SEQ ID NO: 737358 - RNA, 22 nt, Human
agccuggccaacauggugaaac

SEQ ID NO: 737359 - RNA, 24 nt, Human
agccuggccaacauggugaaacuc

SEQ ID NO: 737360 - RNA, 24 nt, Human
agccugggcaacagcaugagacuc

SEQ ID NO: 737361 - RNA, 23 nt, Human
agcugggcaugguggugcaugcc

SEQ ID NO: 737362 - RNA, 26 nt, Human
aggagggcagaucacuugaggucagg

SEQ ID NO: 737363 - RNA, 23 nt, Human
aggcagagguugcagugagcuca

SEQ ID NO: 737364 - RNA, 21 nt, Human
aggcaggagaauugcuugaac

SEQ ID NO: 737365 - RNA, 24 nt, Human
aggcaggagaauugcuugaacuug

SEQ ID NO: 737366 - RNA, 21 nt, Human
aggcugaggcaggagaauugc

SEQ ID NO: 737367 - RNA, 24 nt, Human
aggcugaggcaggagaauugcuug

SEQ ID NO: 737368 - RNA, 22 nt, Human
agggcagaugguggaggagaca

SEQ ID NO: 737369 - RNA, 24 nt, Human
aucgggacacugcacuccagccug

SEQ ID NO: 737370 - RNA, 21 nt, Human
augcugccucucuuuacagcu

SEQ ID NO: 737371 - RNA, 18 nt, Human
auuguucuugacuucguc

SEQ ID NO: 737372 - RNA, 19 nt, Human
caaagccucccugcccucc

SEQ ID NO: 737373 - RNA, 23 nt, Human
caaagccucccugcccucccagg

SEQ ID NO: 737374 - RNA, 19 nt, Human
caacacacaccacauacuc

SEQ ID NO: 737375 - RNA, 20 nt, Human
caacagacaggauggauucu

SEQ ID NO: 737376 - RNA, 24 nt, Human
caacauggugaaacuccaucucua

SEQ ID NO: 737377 - RNA, 22 nt, Human
caaguggcuuugggagaaccca

SEQ ID NO: 737378 - RNA, 25 nt, Human
cacaauaauaguugcuaacacaguc

SEQ ID NO: 737379 - RNA, 23 nt, Human
cacacaccacauacucaucugug

SEQ ID NO: 737380 - RNA, 24 nt, Human
cacaccuggaauccuagcacuuug

SEQ ID NO: 737381 - RNA, 23 nt, Human
cacagucccaaugcugagacaga

SEQ ID NO: 737382 - RNA, 24 nt, Human
caccuacuugggaggcugaggcag

SEQ ID NO: 737383 - RNA, 23 nt, Human
caccuggaaaccucggugccaaa

SEQ ID NO: 737384 - RNA, 24 nt, Human
caccuggaauccuagcacuuuggg

SEQ ID NO: 737385 - RNA, 21 nt, Human
cacuccagccugggcaacagc

SEQ ID NO: 737386 - RNA, 18 nt, Human
cacugcacuccagccugg

SEQ ID NO: 737387 - RNA, 19 nt, Human
cacugcacuccagccuggg

SEQ ID NO: 737388 - RNA, 19 nt, Human
cacugcacuccagccuggg

SEQ ID NO: 737389 - RNA, 20 nt, Human
cacugcacuccagccugggc

SEQ ID NO: 737390 - RNA, 21 nt, Human
cacugcacuccagccugggca

SEQ ID NO: 737391 - RNA, 23 nt, Human
cacugcacuccagccugggcaac

SEQ ID NO: 737392 - RNA, 24 nt, Human
cacugcacuccagccugggcaaca

SEQ ID NO: 737393 - RNA, 26 nt, Human
cacugcacuccagccugggcaacagc

SEQ ID NO: 737394 - RNA, 24 nt, Human
cagaucacuugaggucaggaguuc

SEQ ID NO: 737395 - RNA, 18 nt, Human
cagcaacaucacaacauu

SEQ ID NO: 737396 - RNA, 21 nt, Human
caggagacuauugcagguggc

SEQ ID NO: 737397 - RNA, 19 nt, Human
cagggcccaagcacagguc

SEQ ID NO: 737398 - RNA, 25 nt, Human
caguuauuuuccucccaaguggcuu

SEQ ID NO: 737399 - RNA, 24 nt, Human
cauuaaacauucaccauucucaaa

SEQ ID NO: 737400 - RNA, 23 nt, Human
ccaaagcuugcugaaaagaggug

SEQ ID NO: 737401 - RNA, 23 nt, Human
ccacaauaauaguugcuaacaca

SEQ ID NO: 737402 - RNA, 19 nt, Human
ccacauacucaucugugcc

SEQ ID NO: 737403 - RNA, 21 nt, Human
ccacucggcucugcgcucugc

SEQ ID NO: 737404 - RNA, 25 nt, Human
ccacugccauaaaccauccucgccg

SEQ ID NO: 737405 - RNA, 18 nt, Human
ccacugcccagcgugcgc

SEQ ID NO: 737406 - RNA, 22 nt, Human
ccacugcccagcgugcgccacu

SEQ ID NO: 737407 - RNA, 24 nt, Human
ccacugcccagcgugcgccacucg

SEQ ID NO: 737408 - RNA, 24 nt, Human
ccaggccacugcccagcgugcgcc

SEQ ID NO: 737409 - RNA, 19 nt, Human
cccaggugcuccagagaca

SEQ ID NO: 737410 - RNA, 21 nt, Human
ccgcaaggagcccccgcccgu

SEQ ID NO: 737411 - RNA, 20 nt, Human
ccucacacuggaaacagggc

SEQ ID NO: 737412 - RNA, 19 nt, Human
ccugagagaggaaaccaag

SEQ ID NO: 737413 - RNA, 23 nt, Human
ccuggccaacauggugaaacucc

SEQ ID NO: 737414 - RNA, 24 nt, Human
ccuggccaacauggugaaacucca

SEQ ID NO: 737415 - RNA, 20 nt, Human
ccugggccgccgaacucccg

SEQ ID NO: 737416 - RNA, 19 nt, Human
ccuguaaucccaccuacuu

SEQ ID NO: 737417 - RNA, 23 nt, Human
ccuuuagggcuucagcuggccuc

SEQ ID NO: 737418 - RNA, 23 nt, Human
cgaggaggcggcuguaacccggc

SEQ ID NO: 737419 - RNA, 18 nt, Human
cgcagggaggcggggaga

SEQ ID NO: 737420 - RNA, 27 nt, Human
cucaaaaaaaaaaagauaauacugugg

SEQ ID NO: 737421 - RNA, 18 nt, Human
cucaacucccccaacaaa

SEQ ID NO: 737422 - RNA, 24 nt, Human
cucaacucccccaacaaaauguca

SEQ ID NO: 737423 - RNA, 24 nt, Human
cucacaccuggaauccuagcacuu

SEQ ID NO: 737424 - RNA, 19 nt, Human
cucugucucaaaaaaaaaa

SEQ ID NO: 737425 - RNA, 19 nt, Human
cucuugguucaucugcccu

SEQ ID NO: 737426 - RNA, 22 nt, Human
cugacuuccacacaacacacac

SEQ ID NO: 737427 - RNA, 23 nt, Human
cugcacacagccaugccugacuu

SEQ ID NO: 737428 - RNA, 22 nt, Human
cuggaaacagggcccaagcaca

SEQ ID NO: 737429 - RNA, 23 nt, Human
cuggccaacauggugaaacucca

SEQ ID NO: 737430 - RNA, 20 nt, Human
cuuccacacaacacacacca

SEQ ID NO: 737431 - RNA, 18 nt, Human
cuucgcgccgggcgcgcc

SEQ ID NO: 737432 - RNA, 26 nt, Human
cuucgcgcugggcaccuggaaaccuc

SEQ ID NO: 737433 - RNA, 24 nt, Human
cuuucacagauucuucugcuucuc

SEQ ID NO: 737434 - RNA, 21 nt, Human
gaaaccucaaagcuucuagac

SEQ ID NO: 737435 - RNA, 21 nt, Human
gaccagccuggccaacauggu

SEQ ID NO: 737436 - RNA, 18 nt, Human
gaggagacauugacauga

SEQ ID NO: 737437 - RNA, 20 nt, Human
gagggcucuggcugcguuug

SEQ ID NO: 737438 - RNA, 18 nt, Human
gaucacuugaggucagga

SEQ ID NO: 737439 - RNA, 22 nt, Human
gaucacuugaggucaggaguuc

SEQ ID NO: 737440 - RNA, 24 nt, Human
gaucacuugaggucaggaguucuu

SEQ ID NO: 737441 - RNA, 25 nt, Human
gaucacuugaggucaggaguucuug

SEQ ID NO: 737442 - RNA, 19 nt, Human
gauucuguuuccacagagc

SEQ ID NO: 737443 - RNA, 18 nt, Human
gcaaauccuuaaccauga

SEQ ID NO: 737444 - RNA, 18 nt, Human
gcaaggagcccccgcccg

SEQ ID NO: 737445 - RNA, 19 nt, Human
gcaccuggaaaccucggug

SEQ ID NO: 737446 - RNA, 24 nt, Human
gccaacauggugaaacuccaucuc

SEQ ID NO: 737447 - RNA, 20 nt, Human
gccuguaaucccaccuacuu

SEQ ID NO: 737448 - RNA, 19 nt, Human
gcgagggcgcagggaggcg

SEQ ID NO: 737449 - RNA, 19 nt, Human
gcgccgaggaggcggcugu

SEQ ID NO: 737450 - RNA, 19 nt, Human
gcgccugggccgccgaacu

SEQ ID NO: 737451 - RNA, 20 nt, Human
gcgcucugcgcucggcucac

SEQ ID NO: 737452 - RNA, 22 nt, Human
ggagagccgggggaggcucggg

SEQ ID NO: 737453 - RNA, 21 nt, Human
ggagggcagaucacuugaggu

SEQ ID NO: 737454 - RNA, 21 nt, Human
ggcacagacuggucaaggaca

SEQ ID NO: 737455 - RNA, 25 nt, Human
ggcagaucacuugaggucaggaguu

SEQ ID NO: 737456 - RNA, 23 nt, Human
ggcaugguggugcaugccuguaa

SEQ ID NO: 737457 - RNA, 18 nt, Human
gggcccaagcacaggucu

SEQ ID NO: 737458 - RNA, 20 nt, Human
ggggucuucucuguggcgcc

SEQ ID NO: 737459 - RNA, 20 nt, Human
gguagaaaacauguugcgaa

SEQ ID NO: 737460 - RNA, 18 nt, Human
guaaaacaccaccaacaa

SEQ ID NO: 737461 - RNA, 19 nt, Human
gucucaaaauaaauguguu

SEQ ID NO: 737462 - RNA, 18 nt, Human
guggugcaugccuguaau

SEQ ID NO: 737463 - RNA, 24 nt, Human
guuucauuucugugccaacauaca

SEQ ID NO: 737464 - RNA, 20 nt, Human
uaaaauaaaugacagacugu

SEQ ID NO: 737465 - RNA, 21 nt, Human
uaaaauuucagggcaugaagc

SEQ ID NO: 737466 - RNA, 21 nt, Human
uaacauuaauuuagaggauac

SEQ ID NO: 737467 - RNA, 18 nt, Human
uaagaacuuaaaaacuga

SEQ ID NO: 737468 - RNA, 24 nt, Human
uaaggagggcagaucacuugaggu

SEQ ID NO: 737469 - RNA, 26 nt, Human
uaaggagggcagaucacuugagguca

SEQ ID NO: 737470 - RNA, 19 nt, Human
uaccuguauuaauaauuug

SEQ ID NO: 737471 - RNA, 20 nt, Human
uacuggucugaggaccacac

SEQ ID NO: 737472 - RNA, 19 nt, Human
uacugugaugaaggaagag

SEQ ID NO: 737473 - RNA, 23 nt, Human
uagauaauacugcucucauacac

SEQ ID NO: 737474 - RNA, 24 nt, Human
uagcacuuugggaggcuaaggagg

SEQ ID NO: 737475 - RNA, 18 nt, Human
uauaaaauuucagggcau

SEQ ID NO: 737476 - RNA, 23 nt, Human
uauucuuccauauuccucuccca

SEQ ID NO: 737477 - RNA, 18 nt, Human
ucaaguaugugcccauac

SEQ ID NO: 737478 - RNA, 19 nt, Human
ucaccaaagccucccugcc

SEQ ID NO: 737479 - RNA, 21 nt, Human
ucacuccucaacucccccaac

SEQ ID NO: 737480 - RNA, 25 nt, Human
ucaggauuucccucuaccacacaaa

SEQ ID NO: 737481 - RNA, 22 nt, Human
uccacacaacacacaccacaua

SEQ ID NO: 737482 - RNA, 23 nt, Human
uccacacaacacacaccacauac

SEQ ID NO: 737483 - RNA, 24 nt, Human
ucccaaguggcuuugggagaaccc

SEQ ID NO: 737484 - RNA, 19 nt, Human
ucccaaugcugagacaggg

SEQ ID NO: 737485 - RNA, 21 nt, Human
ucccgggggucuucucugugg

SEQ ID NO: 737486 - RNA, 25 nt, Human
uccuguuuccugaguccaggguggg

SEQ ID NO: 737487 - RNA, 20 nt, Human
ucgcugagccacccuaagau

SEQ ID NO: 737488 - RNA, 19 nt, Human
ucucaaacuugagugcaua

SEQ ID NO: 737489 - RNA, 25 nt, Human
ucucuacuaaaaauauaaaaaaauu

SEQ ID NO: 737490 - RNA, 21 nt, Human
ucugucucaaaaaaaaaaaga

SEQ ID NO: 737491 - RNA, 24 nt, Human
ugaaaaaagaaaccucaaagcuuc

SEQ ID NO: 737492 - RNA, 21 nt, Human
ugaauuaucgugugauguguc

SEQ ID NO: 737493 - RNA, 18 nt, Human
ugacuuccacacaacaca

SEQ ID NO: 737494 - RNA, 19 nt, Human
ugagagaggaaaccaagga

SEQ ID NO: 737495 - RNA, 21 nt, Human
ugagagaggaaaccaaggacu

SEQ ID NO: 737496 - RNA, 23 nt, Human
ugaggaaaaaaugaugagccuca

SEQ ID NO: 737497 - RNA, 23 nt, Human
ugaggcaggagaauugcuugaac

SEQ ID NO: 737498 - RNA, 25 nt, Human
ugaggcaggagaauugcuugaacuu

SEQ ID NO: 737499 - RNA, 25 nt, Human
ugccauaaaccauccucgcugagcc

SEQ ID NO: 737500 - RNA, 19 nt, Human
ugcccaggccacugcccag

SEQ ID NO: 737501 - RNA, 20 nt, Human
ugcccaggccacugcccagc

SEQ ID NO: 737502 - RNA, 18 nt, Human
ugcccauacuugauaacc

SEQ ID NO: 737503 - RNA, 23 nt, Human
ugccuguaaucccaccuacuugg

SEQ ID NO: 737504 - RNA, 24 nt, Human
ugccuguaaucccaccuacuuggg

SEQ ID NO: 737505 - RNA, 18 nt, Human
ugcuauggugucucaaaa

SEQ ID NO: 737506 - RNA, 21 nt, Human
uggagggaacagagggggaug

SEQ ID NO: 737507 - RNA, 18 nt, Human
uggaguucagagaaaugg

SEQ ID NO: 737508 - RNA, 24 nt, Human
uggccaacauggugaaacuccauc

SEQ ID NO: 737509 - RNA, 19 nt, Human
uggcucacaccuggaaucc

SEQ ID NO: 737510 - RNA, 24 nt, Human
uggcucacaccuggaauccuagca

SEQ ID NO: 737511 - RNA, 22 nt, Human
ugggaggcagagguugcaguga

SEQ ID NO: 737512 - RNA, 24 nt, Human
ugggaggcagagguugcagugagc

SEQ ID NO: 737513 - RNA, 24 nt, Human
ugggaggcuaaggagggcagauca

SEQ ID NO: 737514 - RNA, 19 nt, Human
ugggaggcugaggcaggag

SEQ ID NO: 737515 - RNA, 22 nt, Human
ugggaggcugaggcaggagaau

SEQ ID NO: 737516 - RNA, 21 nt, Human
uggugcaugccuguaauccca

SEQ ID NO: 737517 - RNA, 24 nt, Human
ugguggugcaugccuguaauccca

SEQ ID NO: 737518 - RNA, 18 nt, Human
uguaaucccaccuacuug

SEQ ID NO: 737519 - RNA, 19 nt, Human
uguggcgccgaggaggcgg

SEQ ID NO: 737520 - RNA, 21 nt, Human
uguuggguuuauuucacaguc

SEQ ID NO: 737521 - RNA, 21 nt, Human
uguuuuaaucauucccuuuca

SEQ ID NO: 737522 - RNA, 21 nt, Human
uguuuuuaaaaaauaauggca

SEQ ID NO: 737523 - RNA, 24 nt, Human
uuagcugggcaugguggugcaugc

SEQ ID NO: 737524 - RNA, 23 nt, Human
uuauaaaauuucagggcaugaag

SEQ ID NO: 737525 - RNA, 18 nt, Human
uuccacacaacacacacc

SEQ ID NO: 737526 - RNA, 19 nt, Human
uucuuccauauuccucucc

SEQ ID NO: 737527 - RNA, 24 nt, Human
uugaacuugggaggcagagguugc

SEQ ID NO: 737528 - RNA, 25 nt, Human
uugcagugagcucagaucgggacac

SEQ ID NO: 737529 - RNA, 24 nt, Human
uugcuugaacuugggaggcagagg

SEQ ID NO: 737530 - RNA, 21 nt, Human
uugggaggcagagguugcagu

SEQ ID NO: 737531 - RNA, 23 nt, Human
uugggaggcugaggcaggagaau

SEQ ID NO: 737532 - RNA, 18 nt, Human
uuuaaauaucucagaagc

SEQ ID NO: 737533 - RNA, 23 nt, Human
uuucuaagaaggugauucauauu

SEQ ID NO: 737534 - RNA, 21 nt, Human
aaaauaacagagauugaugaa

SEQ ID NO: 737535 - RNA, 24 nt, Human
aagggcaguuuguuguccuggggg

SEQ ID NO: 737536 - RNA, 22 nt, Human
aauacagucuaacucaccauca

SEQ ID NO: 737537 - RNA, 21 nt, Human
aaucuacucaauucuuccuua

SEQ ID NO: 737538 - RNA, 21 nt, Human
aaugacaaaauaacagagauu

SEQ ID NO: 737539 - RNA, 18 nt, Human
aaugacucuuaagggcag

SEQ ID NO: 737540 - RNA, 24 nt, Human
acucaccaucaacaaucccucaga

SEQ ID NO: 737541 - RNA, 22 nt, Human
agccucugccgccccugcuugu

SEQ ID NO: 737542 - RNA, 19 nt, Human
aggaagggugcugucccgc

SEQ ID NO: 737543 - RNA, 19 nt, Human
agugcuuacucacuagcaa

SEQ ID NO: 737544 - RNA, 23 nt, Human
aucuucccauuucauuuuuuaaa

SEQ ID NO: 737545 - RNA, 22 nt, Human
auggguucuuccgucccggccc

SEQ ID NO: 737546 - RNA, 22 nt, Human
caaacaaaaugucaagauuaga

SEQ ID NO: 737547 - RNA, 22 nt, Human
caacuuucaaugaaaggacacc

SEQ ID NO: 737548 - RNA, 22 nt, Human
caaggcugggacgaaaagcaaa

SEQ ID NO: 737549 - RNA, 24 nt, Human
cacagggccugucuagaacaggca

SEQ ID NO: 737550 - RNA, 23 nt, Human
cauuuccaaauucuaugccaaau

SEQ ID NO: 737551 - RNA, 20 nt, Human
cauuuugcagcauauuuaca

SEQ ID NO: 737552 - RNA, 24 nt, Human
ccaaaagacuccaggcaaaucaaa

SEQ ID NO: 737553 - RNA, 22 nt, Human
ccauuguccccacacauuucuc

SEQ ID NO: 737554 - RNA, 20 nt, Human
cccacacauuucucaaauca

SEQ ID NO: 737555 - RNA, 28 nt, Human
ccgaauuccucagcaaaauacaacacau

SEQ ID NO: 737556 - RNA, 21 nt, Human
ccucuuuuagacaaagucaau

SEQ ID NO: 737557 - RNA, 23 nt, Human
cuacuaagucaacugcauuuuua

SEQ ID NO: 737558 - RNA, 21 nt, Human
cuccaggcaaaucaaaucuac

SEQ ID NO: 737559 - RNA, 19 nt, Human
cugaaaacuuuucuccauu

SEQ ID NO: 737560 - RNA, 24 nt, Human
ggccucuucuugggcucugucgca

SEQ ID NO: 737561 - RNA, 20 nt, Human
ggcgggaggaagggcuuuga

SEQ ID NO: 737562 - RNA, 22 nt, Human
gggcauuuggcgucgacagaaa

SEQ ID NO: 737563 - RNA, 18 nt, Human
gggugcugucccgcgcgg

SEQ ID NO: 737564 - RNA, 19 nt, Human
uaacaaaauucacugacau

SEQ ID NO: 737565 - RNA, 22 nt, Human
uaacucaccaucaacaaucccu

SEQ ID NO: 737566 - RNA, 25 nt, Human
uaagggcaguuuguuguccuggggg

SEQ ID NO: 737567 - RNA, 20 nt, Human
uacaacacauucagaaaucu

SEQ ID NO: 737568 - RNA, 20 nt, Human
uagaaaauucucaugccucc

SEQ ID NO: 737569 - RNA, 22 nt, Human
uagaaaauucucaugccuccaa

SEQ ID NO: 737570 - RNA, 25 nt, Human
uaguugagcucuuuuuuccuaauuu

SEQ ID NO: 737571 - RNA, 20 nt, Human
uaucuuauuaggaaauaauu

SEQ ID NO: 737572 - RNA, 21 nt, Human
uccaaaagacuccaggcaaau

SEQ ID NO: 737573 - RNA, 20 nt, Human
uccaaaagacuccaggcaag

SEQ ID NO: 737574 - RNA, 19 nt, Human
uccaucuuugcuacgguuc

SEQ ID NO: 737575 - RNA, 18 nt, Human
ucccuuucaguuguuacc

SEQ ID NO: 737576 - RNA, 24 nt, Human
ucuaugccaaauacagucuaaggg

SEQ ID NO: 737577 - RNA, 23 nt, Human
ucuccauuguccccacacauuuc

SEQ ID NO: 737578 - RNA, 21 nt, Human
ucugaaaacuuuucuccauug

SEQ ID NO: 737579 - RNA, 22 nt, Human
ugaaaggacaccagcuaugaua

SEQ ID NO: 737580 - RNA, 23 nt, Human
ugaagggucaagaccccacaggg

SEQ ID NO: 737581 - RNA, 21 nt, Human
ugacaaaauaacagagauuga

SEQ ID NO: 737582 - RNA, 20 nt, Human
ugagaccucauuccggagag

SEQ ID NO: 737583 - RNA, 20 nt, Human
ugcaaaggaggaauguaaua

SEQ ID NO: 737584 - RNA, 18 nt, Human
ugggacgaaaagcaaaac

SEQ ID NO: 737585 - RNA, 19 nt, Human
uguaauauuuaagguucau

SEQ ID NO: 737586 - RNA, 22 nt, Human
uuacauuuccaaauucuaugcc

SEQ ID NO: 737587 - RNA, 19 nt, Human
uuaguugagcucuuuuuuc

SEQ ID NO: 737588 - RNA, 18 nt, Human
uucuuccgucccggcccc

SEQ ID NO: 737589 - RNA, 22 nt, Human
uuuucuaaauuauacuagagua

SEQ ID NO: 737590 - RNA, 24 nt, Human
aaaaaaaaaacuguagcuauagga

SEQ ID NO: 737591 - RNA, 23 nt, Human
aaaaagaaauuuccaaaagaaaa

SEQ ID NO: 737592 - RNA, 23 nt, Human
aaaacaaaacaaaacaaaaaauc

SEQ ID NO: 737593 - RNA, 19 nt, Human
aaacaaaacaaaacaaaaa

SEQ ID NO: 737594 - RNA, 18 nt, Human
aaacaaaaguaaauauug

SEQ ID NO: 737595 - RNA, 20 nt, Human
aaacaagaaaugaaauguga

SEQ ID NO: 737596 - RNA, 27 nt, Human
aaacaagaaaugaaaugugagggaccc

SEQ ID NO: 737597 - RNA, 23 nt, Human
aaacacaaaauaaaaaaaaacaa

SEQ ID NO: 737598 - RNA, 24 nt, Human
aaacaguaaaaucaaaacauccaa

SEQ ID NO: 737599 - RNA, 25 nt, Human
aacaaaaaaauauaaugaaaguuuc

SEQ ID NO: 737600 - RNA, 21 nt, Human
aacuauauccaauuagaagca

SEQ ID NO: 737601 - RNA, 22 nt, Human
aacuauggcagaguuucugguu

SEQ ID NO: 737602 - RNA, 23 nt, Human
aauggaaaacaaaacaaaacaaa

SEQ ID NO: 737603 - RNA, 23 nt, Human
acaaaacaaaacaaaaaaucuuu

SEQ ID NO: 737604 - RNA, 24 nt, Human
acaaaacaaaacaaaaaaucuuua

SEQ ID NO: 737605 - RNA, 23 nt, Human
acagaaacaaaaguaaauauugc

SEQ ID NO: 737606 - RNA, 21 nt, Human
agacaaaucuguacaaucuaa

SEQ ID NO: 737607 - RNA, 19 nt, Human
aguucaugaaaagggcaac

SEQ ID NO: 737608 - RNA, 27 nt, Human
auaaaucucagaaaauggaaaacaaaa

SEQ ID NO: 737609 - RNA, 19 nt, Human
augaauaccaccccaaaau

SEQ ID NO: 737610 - RNA, 30 nt, Human
auguuuuuuuuuucuuuuuuguuuuuggcc

SEQ ID NO: 737611 - RNA, 19 nt, Human
caaaacaaaacaaaaaauc

SEQ ID NO: 737612 - RNA, 21 nt, Human
caacugggccgaacaagcagg

SEQ ID NO: 737613 - RNA, 20 nt, Human
caauuuaaaaaacuugaucg

SEQ ID NO: 737614 - RNA, 24 nt, Human
cacaauaucaucaauaucucaggg

SEQ ID NO: 737615 - RNA, 24 nt, Human
cacacuugcuaaaugagcuggaaa

SEQ ID NO: 737616 - RNA, 18 nt, Human
caccucaaauauuuacac

SEQ ID NO: 737617 - RNA, 23 nt, Human
cagaaaauggaaaacaaaacaaa

SEQ ID NO: 737618 - RNA, 27 nt, Human
cauaguaacuauauccaauuagaagcc

SEQ ID NO: 737619 - RNA, 20 nt, Human
cauccaacuuccuuauagaa

SEQ ID NO: 737620 - RNA, 21 nt, Human
caucuauaaacaguaaaauca

SEQ ID NO: 737621 - RNA, 27 nt, Human
cauguaaaaaucaaugaacuauggcag

SEQ ID NO: 737622 - RNA, 27 nt, Human
caugucaacaacaaaaaaauauaauga

SEQ ID NO: 737623 - RNA, 22 nt, Human
ccaccccaaaauccuggauggc

SEQ ID NO: 737624 - RNA, 19 nt, Human
ccugcaaaucugauguugc

SEQ ID NO: 737625 - RNA, 21 nt, Human
cucagaaaauggaaaacaaaa

SEQ ID NO: 737626 - RNA, 19 nt, Human
cuccacacuacuaguuuuc

SEQ ID NO: 737627 - RNA, 18 nt, Human
cuggaaaaauggguggcg

SEQ ID NO: 737628 - RNA, 18 nt, Human
cugguggcagcacaugau

SEQ ID NO: 737629 - RNA, 23 nt, Human
gaaacaaaaguaaauauugcaaa

SEQ ID NO: 737630 - RNA, 21 nt, Human
gaagcaaugaaaaaaaaaaac

SEQ ID NO: 737631 - RNA, 20 nt, Human
ggaaaacaaaacaaaacaaa

SEQ ID NO: 737632 - RNA, 24 nt, Human
uaaaaagaaauuuccaaaagaaaa

SEQ ID NO: 737633 - RNA, 21 nt, Human
uaaaagaacaauuuaaaaaac

SEQ ID NO: 737634 - RNA, 24 nt, Human
uaaaauuccaaauauaaauguguc

SEQ ID NO: 737635 - RNA, 23 nt, Human
uaaagcuaaacuguaagagcuaa

SEQ ID NO: 737636 - RNA, 21 nt, Human
uaagaucacauguauaaaaca

SEQ ID NO: 737637 - RNA, 23 nt, Human
uaagaucacauguauaaaacaag

SEQ ID NO: 737638 - RNA, 23 nt, Human
uacaccaaucuauaaaucucaga

SEQ ID NO: 737639 - RNA, 24 nt, Human
uauaacaaacacaaaauaaaaaaa

SEQ ID NO: 737640 - RNA, 21 nt, Human
ucacaugaauaccaccccaaa

SEQ ID NO: 737641 - RNA, 20 nt, Human
ucagguuuuaugcuuauugg

SEQ ID NO: 737642 - RNA, 19 nt, Human
uccacaaaacuuuauacag

SEQ ID NO: 737643 - RNA, 25 nt, Human
ucuauaaacaguaaaaucaaaacau

SEQ ID NO: 737644 - RNA, 20 nt, Human
ugaaaaaaaaaaacuguagc

SEQ ID NO: 737645 - RNA, 19 nt, Human
ugaauaaagcuaaacugua

SEQ ID NO: 737646 - RNA, 23 nt, Human
ugaauaaccaaaauaauuauaac

SEQ ID NO: 737647 - RNA, 24 nt, Human
ugaauaccaccccaaaauccugga

SEQ ID NO: 737648 - RNA, 19 nt, Human
ugacacacuugcuaaauga

SEQ ID NO: 737649 - RNA, 18 nt, Human
ugaccaugcuuauuuauu

SEQ ID NO: 737650 - RNA, 22 nt, Human
ugagaaauacagacaaaucugu

SEQ ID NO: 737651 - RNA, 23 nt, Human
ugagcagugaccuggugaaacau

SEQ ID NO: 737652 - RNA, 18 nt, Human
ugcuagagaaucugcuuu

SEQ ID NO: 737653 - RNA, 20 nt, Human
ugcuagagaaucugcuuuaa

SEQ ID NO: 737654 - RNA, 19 nt, Human
uggcaaauuuacaaagcag

SEQ ID NO: 737655 - RNA, 18 nt, Human
uguaaauaaauguuucau

SEQ ID NO: 737656 - RNA, 23 nt, Human
uguuuaaaaucuucaauguagua

SEQ ID NO: 737657 - RNA, 21 nt, Human
uuaaaaaacuugaucgcuuag

SEQ ID NO: 737658 - RNA, 19 nt, Human
uuaaagcuauacaccaauc

SEQ ID NO: 737659 - RNA, 22 nt, Human
uuaguuaaaaauuaaaauucca

SEQ ID NO: 737660 - RNA, 21 nt, Human
uuggccagguuaauucauguc

SEQ ID NO: 737661 - RNA, 20 nt, Human
uuguuuaguucaugaaaagg

SEQ ID NO: 737662 - RNA, 24 nt, Human
uuuacaauaauaaauauauacaaa

SEQ ID NO: 737663 - RNA, 19 nt, Human
uuuaguucaugaaaagggc

SEQ ID NO: 737664 - RNA, 24 nt, Human
uuuuauuuuaauaaauaacagugg

SEQ ID NO: 737665 - RNA, 20 nt, Human
uuuuuuguuuuuggccaggu

SEQ ID NO: 737666 - RNA, 18 nt, Human
uuuuuuuuuucuuuuuug

SEQ ID NO: 737667 - RNA, 18 nt, Human
aaaaacagaugcaacuug

SEQ ID NO: 737668 - RNA, 21 nt, Human
aaacccauucuuagaugcaaa

SEQ ID NO: 737669 - RNA, 24 nt, Human
aaaggagcaugaggcaaagguggu

SEQ ID NO: 737670 - RNA, 18 nt, Human
aacaguagacaucuaugg

SEQ ID NO: 737671 - RNA, 20 nt, Human
aacauagugagaccucaucu

SEQ ID NO: 737672 - RNA, 20 nt, Human
aagaaacccaaaaacuaaau

SEQ ID NO: 737673 - RNA, 23 nt, Human
aagaaacccaaaaacuaaaucac

SEQ ID NO: 737674 - RNA, 26 nt, Human
aagcauuucauuuaaagaaagaaucc

SEQ ID NO: 737675 - RNA, 19 nt, Human
aagccacaaaguccuaagc

SEQ ID NO: 737676 - RNA, 23 nt, Human
aagcugcagugagccaugacugu

SEQ ID NO: 737677 - RNA, 29 nt, Human
aauauaggacaaaggauuuacucaaaguu

SEQ ID NO: 737678 - RNA, 19 nt, Human
aauaugcaaaauuaccaua

SEQ ID NO: 737679 - RNA, 23 nt, Human
acaaacuggaagaagaacacuuu

SEQ ID NO: 737680 - RNA, 19 nt, Human
acucuagccugggugacag

SEQ ID NO: 737681 - RNA, 24 nt, Human
acuguacucuagccugggugacag

SEQ ID NO: 737682 - RNA, 25 nt, Human
agaaagaauccuaggccuuugcaga

SEQ ID NO: 737683 - RNA, 24 nt, Human
agacccucucuccaaaacaaauaa

SEQ ID NO: 737684 - RNA, 24 nt, Human
agcaguuugggagguggagguggg

SEQ ID NO: 737685 - RNA, 18 nt, Human
agccagguaugguggugc

SEQ ID NO: 737686 - RNA, 23 nt, Human
agcuacuuguggguugagguggg

SEQ ID NO: 737687 - RNA, 23 nt, Human
agcugggcaacauagugagaccu

SEQ ID NO: 737688 - RNA, 23 nt, Human
agcugggcaacauagugagaccu

SEQ ID NO: 737689 - RNA, 23 nt, Human
aggugggaggauugcuugaaccc

SEQ ID NO: 737690 - RNA, 23 nt, Human
agguggugacucagcccaaaaac

SEQ ID NO: 737691 - RNA, 19 nt, Human
agugggcauuuaaaauugc

SEQ ID NO: 737692 - RNA, 21 nt, Human
aguuugggagguggagguggg

SEQ ID NO: 737693 - RNA, 24 nt, Human
auaggacaaaggauuuacucaaag

SEQ ID NO: 737694 - RNA, 24 nt, Human
augcagugagacccugucucaaag

SEQ ID NO: 737695 - RNA, 22 nt, Human
augcuuugucaagucaauucca

SEQ ID NO: 737696 - RNA, 22 nt, Human
auuuaagacaucuugguaaccc

SEQ ID NO: 737697 - RNA, 26 nt, Human
caaaaacuaaaucacacaaccuucag

SEQ ID NO: 737698 - RNA, 22 nt, Human
caaaacaaauaaaaccaguggg

SEQ ID NO: 737699 - RNA, 19 nt, Human
caaacuggaagaagaacaa

SEQ ID NO: 737700 - RNA, 22 nt, Human
caaagaaacccaaaaacuaaau

SEQ ID NO: 737701 - RNA, 22 nt, Human
caaugcagugagacccugucuc

SEQ ID NO: 737702 - RNA, 18 nt, Human
cacacaagcaggaauaaa

SEQ ID NO: 737703 - RNA, 24 nt, Human
cacaccuguaaucccagcaguuug

SEQ ID NO: 737704 - RNA, 23 nt, Human
caccuguaaucccagcaguuugg

SEQ ID NO: 737705 - RNA, 24 nt, Human
caccuguaaucccagcaguuuggg

SEQ ID NO: 737706 - RNA, 19 nt, Human
cacuguacucuagccuggg

SEQ ID NO: 737707 - RNA, 19 nt, Human
cacuguacucuagccuggg

SEQ ID NO: 737708 - RNA, 19 nt, Human
cacuguacucuagccuggg

SEQ ID NO: 737709 - RNA, 22 nt, Human
cacuguacucuagccuggguga

SEQ ID NO: 737710 - RNA, 23 nt, Human
cacuguacucuagccugggugac

SEQ ID NO: 737711 - RNA, 21 nt, Human
cagaaugagacccucucucca

SEQ ID NO: 737712 - RNA, 19 nt, Human
cagcaagggcaaugcagug

SEQ ID NO: 737713 - RNA, 19 nt, Human
cauagagcaaaaauaaaug

SEQ ID NO: 737714 - RNA, 24 nt, Human
cauagugagaccucaucucuagaa

SEQ ID NO: 737715 - RNA, 25 nt, Human
ccaaaacaaauaaaaccagugggca

SEQ ID NO: 737716 - RNA, 22 nt, Human
ccaacaugugagaguuaaagau

SEQ ID NO: 737717 - RNA, 20 nt, Human
ccacuguacucuagccuggg

SEQ ID NO: 737718 - RNA, 20 nt, Human
ccacuguacucuagccuggg

SEQ ID NO: 737719 - RNA, 21 nt, Human
ccacuguacucuagccugggu

SEQ ID NO: 737720 - RNA, 24 nt, Human
ccacuguacucuagccugggugac

SEQ ID NO: 737721 - RNA, 19 nt, Human
ccaggcagugagcuuaagc

SEQ ID NO: 737722 - RNA, 25 nt, Human
cccaaaaacuaaaucacacaagcag

SEQ ID NO: 737723 - RNA, 18 nt, Human
cccaagaucuugagucaa

SEQ ID NO: 737724 - RNA, 24 nt, Human
cccacuguacucuagccuggguga

SEQ ID NO: 737725 - RNA, 21 nt, Human
ccccagaauuugaggucagca

SEQ ID NO: 737726 - RNA, 20 nt, Human
ccugaacacuuugggacugg

SEQ ID NO: 737727 - RNA, 21 nt, Human
cucacaccuguaaucccagca

SEQ ID NO: 737728 - RNA, 21 nt, Human
cucacaccuguaaucccagca

SEQ ID NO: 737729 - RNA, 20 nt, Human
cugcagugagccaugacugu

SEQ ID NO: 737730 - RNA, 24 nt, Human
cuuuauuauaacaaaaccuguaua

SEQ ID NO: 737731 - RNA, 23 nt, Human
gacagaaugagacccucucucca

SEQ ID NO: 737732 - RNA, 22 nt, Human
gagaccagcugggcaacauagu

SEQ ID NO: 737733 - RNA, 24 nt, Human
gaggugggaggauugcuugaaccc

SEQ ID NO: 737734 - RNA, 30 nt, Human
gaucacuugagcccaggcagugagcuuaaa

SEQ ID NO: 737735 - RNA, 20 nt, Human
ggacaccuuuuauuuuaaac

SEQ ID NO: 737736 - RNA, 21 nt, Human
ggcucacaccuguaaucccag

SEQ ID NO: 737737 - RNA, 24 nt, Human
gggcaugguggcucacaccuguaa

SEQ ID NO: 737738 - RNA, 19 nt, Human
guacucuagccugggugac

SEQ ID NO: 737739 - RNA, 23 nt, Human
guggcucacaccuguaaucccag

SEQ ID NO: 737740 - RNA, 24 nt, Human
guggguguugggcaugguggcuca

SEQ ID NO: 737741 - RNA, 21 nt, Human
guggugcauaccugugguggu

SEQ ID NO: 737742 - RNA, 19 nt, Human
gugguguagucccagcugc

SEQ ID NO: 737743 - RNA, 24 nt, Human
gugguguagucccagcugcuuggg

SEQ ID NO: 737744 - RNA, 22 nt, Human
guguugggcaugguggcucaca

SEQ ID NO: 737745 - RNA, 24 nt, Human
uaaaacaaacuggaagaagaacac

SEQ ID NO: 737746 - RNA, 20 nt, Human
uaaaaccugguaacaguaga

SEQ ID NO: 737747 - RNA, 22 nt, Human
uaaaucacacaagcaggaauaa

SEQ ID NO: 737748 - RNA, 25 nt, Human
uaacauucagugaugugagcuguau

SEQ ID NO: 737749 - RNA, 20 nt, Human
uaagcugcagugagccauga

SEQ ID NO: 737750 - RNA, 20 nt, Human
uaccauaaaagauacaagga

SEQ ID NO: 737751 - RNA, 22 nt, Human
uaccauaaaagauacaaggauu

SEQ ID NO: 737752 - RNA, 18 nt, Human
uacucuagccugggugac

SEQ ID NO: 737753 - RNA, 22 nt, Human
uacucuagccugggugacagaa

SEQ ID NO: 737754 - RNA, 24 nt, Human
uacucuagccugggugacagaaug

SEQ ID NO: 737755 - RNA, 22 nt, Human
uagaaaaaauuuuaaaaaucag

SEQ ID NO: 737756 - RNA, 19 nt, Human
uagguaacaagcuguagcc

SEQ ID NO: 737757 - RNA, 23 nt, Human
uaguaaaacaaacuggaagaaga

SEQ ID NO: 737758 - RNA, 20 nt, Human
uaucagacagacacugggaa

SEQ ID NO: 737759 - RNA, 27 nt, Human
ucaaagaauagcacugcaguuaaauga

SEQ ID NO: 737760 - RNA, 22 nt, Human
ucacacaagcaggaauaaacac

SEQ ID NO: 737761 - RNA, 20 nt, Human
ucagcaaacaugcucuaagc

SEQ ID NO: 737762 - RNA, 23 nt, Human
ucagccagguaugguggugcaua

SEQ ID NO: 737763 - RNA, 19 nt, Human
ucagcccaaaaacagaugc

SEQ ID NO: 737764 - RNA, 19 nt, Human
ucaguggguguugggcaug

SEQ ID NO: 737765 - RNA, 19 nt, Human
uccacagaauaaacaaaau

SEQ ID NO: 737766 - RNA, 23 nt, Human
ucccacuguacucuagccugggu

SEQ ID NO: 737767 - RNA, 24 nt, Human
ucuagccugggugacagaaugaga

SEQ ID NO: 737768 - RNA, 24 nt, Human
ucuccaaaacaaauaaaaccagug

SEQ ID NO: 737769 - RNA, 20 nt, Human
ugaacacuuugggacuggau

SEQ ID NO: 737770 - RNA, 18 nt, Human
ugacaaauguaacaagcc

SEQ ID NO: 737771 - RNA, 18 nt, Human
ugacaaauguaacaagcc

SEQ ID NO: 737772 - RNA, 18 nt, Human
ugacucagcccaaaaaca

SEQ ID NO: 737773 - RNA, 24 nt, Human
ugagcccaggcagugagcuuaagc

SEQ ID NO: 737774 - RNA, 18 nt, Human
ugaggucagcaagggcaa

SEQ ID NO: 737775 - RNA, 20 nt, Human
ugaggugggaggauugcuug

SEQ ID NO: 737776 - RNA, 23 nt, Human
ugaggugggaggauugcuugaac

SEQ ID NO: 737777 - RNA, 22 nt, Human
ugcagugagccaugacuguucc

SEQ ID NO: 737778 - RNA, 24 nt, Human
ugcgugaacugaggaguaugagac

SEQ ID NO: 737779 - RNA, 21 nt, Human
uggcucacaccuguaauccca

SEQ ID NO: 737780 - RNA, 22 nt, Human
uggcucacaccuguaaucccag

SEQ ID NO: 737781 - RNA, 24 nt, Human
uggcucacaccuguaaucccagca

SEQ ID NO: 737782 - RNA, 21 nt, Human
ugggaggcuggaguaagauca

SEQ ID NO: 737783 - RNA, 20 nt, Human
ugggcaaucuucaguuucau

SEQ ID NO: 737784 - RNA, 20 nt, Human
ugguggcaaaaugcagcccu

SEQ ID NO: 737785 - RNA, 24 nt, Human
ugguggcucacaccuguaauccca

SEQ ID NO: 737786 - RNA, 21 nt, Human
ugguggugcauaccuguggug

SEQ ID NO: 737787 - RNA, 24 nt, Human
ugguggugcauaccugugguggug

SEQ ID NO: 737788 - RNA, 21 nt, Human
ugguguagucccagcugcuug

SEQ ID NO: 737789 - RNA, 20 nt, Human
uguagucccagcugcuuggg

SEQ ID NO: 737790 - RNA, 22 nt, Human
uguauauuacccauuuaaacuc

SEQ ID NO: 737791 - RNA, 25 nt, Human
ugugagcuguauuaaacccagguau

SEQ ID NO: 737792 - RNA, 20 nt, Human
uguucccacuguacucuagc

SEQ ID NO: 737793 - RNA, 23 nt, Human
uuaaaugacaaauguaacaagcc

SEQ ID NO: 737794 - RNA, 19 nt, Human
uuaagacaucuugguaacc

SEQ ID NO: 737795 - RNA, 22 nt, Human
uuacagaacaaacugaaagaga

SEQ ID NO: 737796 - RNA, 24 nt, Human
uuaucagacagacacugggaauau

SEQ ID NO: 737797 - RNA, 20 nt, Human
uucaguuucauuauaaaaua

SEQ ID NO: 737798 - RNA, 20 nt, Human
uuucaaagaauagcacugca

SEQ ID NO: 737799 - RNA, 18 nt, Human
uuugaaguaucuuuuaga

SEQ ID NO: 737800 - RNA, 19 nt, Human
aaaaaaaccccacagauua

SEQ ID NO: 737801 - RNA, 20 nt, Human
aaaacauccuaaaaaucuaa

SEQ ID NO: 737802 - RNA, 24 nt, Human
aaacaucacauugugucucauaau

SEQ ID NO: 737803 - RNA, 19 nt, Human
aaaugaccuuauaccauga

SEQ ID NO: 737804 - RNA, 23 nt, Human
aaccuguguaaggaaggaauggc

SEQ ID NO: 737805 - RNA, 18 nt, Human
aagcccgaaguaaaacag

SEQ ID NO: 737806 - RNA, 27 nt, Human
aagugggaaucugccugaacccaagca

SEQ ID NO: 737807 - RNA, 25 nt, Human
aaugccuaauuaucaaaauaaugac

SEQ ID NO: 737808 - RNA, 21 nt, Human
acagaguuagcaauauguggc

SEQ ID NO: 737809 - RNA, 19 nt, Human
accccgcgcgcggccccgc

SEQ ID NO: 737810 - RNA, 20 nt, Human
acugcgcccggcgcuccuga

SEQ ID NO: 737811 - RNA, 23 nt, Human
acugcgcccggcgcuccugaggg

SEQ ID NO: 737812 - RNA, 20 nt, Human
agaaaaacucuccuaaaacu

SEQ ID NO: 737813 - RNA, 25 nt, Human
agaaaaacucuccuaaaacuauaga

SEQ ID NO: 737814 - RNA, 19 nt, Human
agaaacaaccaguggccuc

SEQ ID NO: 737815 - RNA, 18 nt, Human
agcaauuccuguaaucag

SEQ ID NO: 737816 - RNA, 20 nt, Human
agcagcuaggagaggaaggg

SEQ ID NO: 737817 - RNA, 25 nt, Human
agccaaguacauuuaguuuuauauu

SEQ ID NO: 737818 - RNA, 19 nt, Human
agcuuguuaagaguacugc

SEQ ID NO: 737819 - RNA, 21 nt, Human
aggaaacuguacucaggcucu

SEQ ID NO: 737820 - RNA, 21 nt, Human
aggaauggcuuguuauucuga

SEQ ID NO: 737821 - RNA, 18 nt, Human
aggagaggaagggcaaag

SEQ ID NO: 737822 - RNA, 18 nt, Human
aggagggacagaucccaa

SEQ ID NO: 737823 - RNA, 25 nt, Human
agggaaguagaaacaaccaguggcc

SEQ ID NO: 737824 - RNA, 23 nt, Human
agguugugguauuggaggcuguu

SEQ ID NO: 737825 - RNA, 24 nt, Human
aguuugcuuaugaggcaaaaacug

SEQ ID NO: 737826 - RNA, 21 nt, Human
auaaaacaacugguagaaaaa

SEQ ID NO: 737827 - RNA, 24 nt, Human
auaaauggcauuaugaaauaaaca

SEQ ID NO: 737828 - RNA, 20 nt, Human
auaaccuuccagaaauccaa

SEQ ID NO: 737829 - RNA, 20 nt, Human
aucacaauagggucauaguc

SEQ ID NO: 737830 - RNA, 22 nt, Human
aucgccacccagucucccgacc

SEQ ID NO: 737831 - RNA, 22 nt, Human
aucuuaaucuuaacacugcauu

SEQ ID NO: 737832 - RNA, 20 nt, Human
augcaguguuucccuaauuu

SEQ ID NO: 737833 - RNA, 21 nt, Human
auggucgauuaaaggcagcac

SEQ ID NO: 737834 - RNA, 18 nt, Human
auuaacagcauauuauaa

SEQ ID NO: 737835 - RNA, 19 nt, Human
auugcauaauuagccacag

SEQ ID NO: 737836 - RNA, 24 nt, Human
caaaaaaaccccacagauuauaga

SEQ ID NO: 737837 - RNA, 20 nt, Human
caaacuuagcucauuccuuu

SEQ ID NO: 737838 - RNA, 19 nt, Human
caaguaacuaugcauuagc

SEQ ID NO: 737839 - RNA, 25 nt, Human
caauuccaaacuauaucuguuaaug

SEQ ID NO: 737840 - RNA, 19 nt, Human
cacaaaauguaagcacuga

SEQ ID NO: 737841 - RNA, 18 nt, Human
caccacacaccugaaagc

SEQ ID NO: 737842 - RNA, 19 nt, Human
cacccugaagugaggaaac

SEQ ID NO: 737843 - RNA, 23 nt, Human
cacucuaaugaaaucacugcuau

SEQ ID NO: 737844 - RNA, 24 nt, Human
cacugagcauucuaauaaaccccc

SEQ ID NO: 737845 - RNA, 21 nt, Human
cagcuuuaacagaagcccgaa

SEQ ID NO: 737846 - RNA, 21 nt, Human
cauagaacagcuuuaacagaa

SEQ ID NO: 737847 - RNA, 19 nt, Human
cauuucggcucuuuucagg

SEQ ID NO: 737848 - RNA, 18 nt, Human
ccaaaaaaaccccacaga

SEQ ID NO: 737849 - RNA, 22 nt, Human
ccagcaccacacaccugaaagc

SEQ ID NO: 737850 - RNA, 24 nt, Human
ccagcaccacacaccugaaagcug

SEQ ID NO: 737851 - RNA, 19 nt, Human
ccagccugugugccagugu

SEQ ID NO: 737852 - RNA, 18 nt, Human
ccauaaaauccaaggcca

SEQ ID NO: 737853 - RNA, 21 nt, Human
cccacgguuguuaauaccagc

SEQ ID NO: 737854 - RNA, 25 nt, Human
ccccggucaggagggacagauccca

SEQ ID NO: 737855 - RNA, 23 nt, Human
cccgaccuuguccuuagcgggcc

SEQ ID NO: 737856 - RNA, 23 nt, Human
ccgccgucgccuccgcucggcug

SEQ ID NO: 737857 - RNA, 22 nt, Human
ccgcucggcugccuccagucgc

SEQ ID NO: 737858 - RNA, 24 nt, Human
ccgcucggcugccuccagucgcac

SEQ ID NO: 737859 - RNA, 24 nt, Human
ccgucgccuccgcucggcugccuc

SEQ ID NO: 737860 - RNA, 21 nt, Human
ccucaagaaacauuugaagaa

SEQ ID NO: 737861 - RNA, 18 nt, Human
ccuccaaaaaaaccccac

SEQ ID NO: 737862 - RNA, 21 nt, Human
ccucccccuccaaaaaaaccc

SEQ ID NO: 737863 - RNA, 25 nt, Human
cgagauaaaagagcauuuaaagcca

SEQ ID NO: 737864 - RNA, 23 nt, Human
cgcucggcugccuccagucgcac

SEQ ID NO: 737865 - RNA, 22 nt, Human
cgggccgaccccacagccgcgg

SEQ ID NO: 737866 - RNA, 22 nt, Human
cgucccggacccggccggaggc

SEQ ID NO: 737867 - RNA, 19 nt, Human
cuacuacaucaaaaucuug

SEQ ID NO: 737868 - RNA, 18 nt, Human
cuccaaaaaaaccccaca

SEQ ID NO: 737869 - RNA, 21 nt, Human
cugcaauuccaaacuauaucu

SEQ ID NO: 737870 - RNA, 19 nt, Human
cuggacagacuuuuccaug

SEQ ID NO: 737871 - RNA, 18 nt, Human
cuuaacacugcauuugga

SEQ ID NO: 737872 - RNA, 20 nt, Human
gaaaagcuuugauacguuga

SEQ ID NO: 737873 - RNA, 23 nt, Human
gaaaauagcaaaauuaucaugcc

SEQ ID NO: 737874 - RNA, 22 nt, Human
gaaagcuggguccagugcccgu

SEQ ID NO: 737875 - RNA, 22 nt, Human
gaaucaaugcuaagagaacuga

SEQ ID NO: 737876 - RNA, 21 nt, Human
gacauagucaugguuagaugc

SEQ ID NO: 737877 - RNA, 21 nt, Human
gagcauuuaaagccauugcaa

SEQ ID NO: 737878 - RNA, 21 nt, Human
gaucauuuaggucugauccaa

SEQ ID NO: 737879 - RNA, 18 nt, Human
gcagauggaucauuuagg

SEQ ID NO: 737880 - RNA, 25 nt, Human
gccucccccuccaaaaaaaccccac

SEQ ID NO: 737881 - RNA, 19 nt, Human
gcgcucguguugggaagaa

SEQ ID NO: 737882 - RNA, 23 nt, Human
gcucuuuucagguugugguauug

SEQ ID NO: 737883 - RNA, 24 nt, Human
ggaaaauagcaaaauuaucaugcc

SEQ ID NO: 737884 - RNA, 24 nt, Human
ggccucccccuccaaaaaaacccc

SEQ ID NO: 737885 - RNA, 28 nt, Human
gggaaguagaaacaaccaguggccuccc

SEQ ID NO: 737886 - RNA, 23 nt, Human
gggaccugaccgggaggaggagg

SEQ ID NO: 737887 - RNA, 18 nt, Human
gguagaaaaagaguggcc

SEQ ID NO: 737888 - RNA, 22 nt, Human
gguuaauuuuuaaaacuccauu

SEQ ID NO: 737889 - RNA, 22 nt, Human
gugguaaaaacugacuuuauca

SEQ ID NO: 737890 - RNA, 18 nt, Human
guuuuauuuuuccuuucu

SEQ ID NO: 737891 - RNA, 23 nt, Human
uaaaaaaaaugaaagcauccaaa

SEQ ID NO: 737892 - RNA, 26 nt, Human
uaaaagaagaugagauguugggaagu

SEQ ID NO: 737893 - RNA, 18 nt, Human
uaaacccccugugaaguu

SEQ ID NO: 737894 - RNA, 22 nt, Human
uaaaggaccuucauauuuaaca

SEQ ID NO: 737895 - RNA, 22 nt, Human
uaaaugccuaauuaucaaaaua

SEQ ID NO: 737896 - RNA, 23 nt, Human
uaaauggcauuaugaaauaaaca

SEQ ID NO: 737897 - RNA, 20 nt, Human
uaacacuauaguauacggca

SEQ ID NO: 737898 - RNA, 22 nt, Human
uaacuaacaccaaccagauggc

SEQ ID NO: 737899 - RNA, 21 nt, Human
uaagaaaaacucuccuaaaac

SEQ ID NO: 737900 - RNA, 22 nt, Human
uaagauagugguaaaaacugac

SEQ ID NO: 737901 - RNA, 19 nt, Human
uacgaccaaaagauggaug

SEQ ID NO: 737902 - RNA, 20 nt, Human
uacuacaucaaaaucuugcc

SEQ ID NO: 737903 - RNA, 22 nt, Human
uacuguacaaccauggcaugca

SEQ ID NO: 737904 - RNA, 18 nt, Human
uaggagaggaagggcaaa

SEQ ID NO: 737905 - RNA, 21 nt, Human
uauucccuggcgaaaucccgg

SEQ ID NO: 737906 - RNA, 22 nt, Human
uauuggaggcuguuuuuggaag

SEQ ID NO: 737907 - RNA, 20 nt, Human
ucaggcauuaaaaaaugucu

SEQ ID NO: 737908 - RNA, 21 nt, Human
ucauaguuuuauguucacuga

SEQ ID NO: 737909 - RNA, 19 nt, Human
uccaaaaaaaccccacaga

SEQ ID NO: 737910 - RNA, 21 nt, Human
uccaaagaaugugaaaaguac

SEQ ID NO: 737911 - RNA, 20 nt, Human
uccagugcccguuuuccagc

SEQ ID NO: 737912 - RNA, 23 nt, Human
uccauuguauuuaaccauuuuuu

SEQ ID NO: 737913 - RNA, 22 nt, Human
ucccaaccgccgucgccuccgc

SEQ ID NO: 737914 - RNA, 19 nt, Human
ucgcuggacagacuuuucc

SEQ ID NO: 737915 - RNA, 24 nt, Human
ucguguugggaagaagacuccugu

SEQ ID NO: 737916 - RNA, 19 nt, Human
ucuguguucuaaugugaag

SEQ ID NO: 737917 - RNA, 18 nt, Human
ucuuccacaguaauacua

SEQ ID NO: 737918 - RNA, 26 nt, Human
ugaaaacagaagacuggaaucaaugc

SEQ ID NO: 737919 - RNA, 20 nt, Human
ugaaaggugaucauugaugc

SEQ ID NO: 737920 - RNA, 19 nt, Human
ugaaguauguuuuauuuuu

SEQ ID NO: 737921 - RNA, 19 nt, Human
ugaagugaggaaacugcaa

SEQ ID NO: 737922 - RNA, 21 nt, Human
ugagagaagucaauauuuaga

SEQ ID NO: 737923 - RNA, 18 nt, Human
ugaggaaacugcaauucc

SEQ ID NO: 737924 - RNA, 20 nt, Human
ugauuuaaaaaaaaugaaag

SEQ ID NO: 737925 - RNA, 26 nt, Human
ugccuaauuaucaaaauaaugacaua

SEQ ID NO: 737926 - RNA, 18 nt, Human
uggaaaauagcaaaauua

SEQ ID NO: 737927 - RNA, 24 nt, Human
uggaauguagggggaaaaaccaac

SEQ ID NO: 737928 - RNA, 20 nt, Human
uggaugacaggaauguccuc

SEQ ID NO: 737929 - RNA, 22 nt, Human
ugguaagaagcacugaggagcu

SEQ ID NO: 737930 - RNA, 23 nt, Human
ugguuagaugcaaccuagaaauc

SEQ ID NO: 737931 - RNA, 20 nt, Human
ugucauaaccuuccagaaau

SEQ ID NO: 737932 - RNA, 23 nt, Human
uguguuaccaucuagccucgcaa

SEQ ID NO: 737933 - RNA, 19 nt, Human
uuaacugcgaaauucuggg

SEQ ID NO: 737934 - RNA, 24 nt, Human
uuagcgggccgaccccacagccgc

SEQ ID NO: 737935 - RNA, 18 nt, Human
uuagcucauuccuuuaau

SEQ ID NO: 737936 - RNA, 21 nt, Human
uuauugacuaaaugucaaagu

SEQ ID NO: 737937 - RNA, 19 nt, Human
uucaaaggugaaacuuacc

SEQ ID NO: 737938 - RNA, 18 nt, Human
uucggcucuuuucagguu

SEQ ID NO: 737939 - RNA, 21 nt, Human
uugaacacuggcaugcacacc

SEQ ID NO: 737940 - RNA, 18 nt, Human
uugaugucuuuucaaucc

SEQ ID NO: 737941 - RNA, 24 nt, Human
uuuacaucuaaaucuguauguuuu

SEQ ID NO: 737942 - RNA, 23 nt, Human
aaaaacagaaacaaaaaccaaaa

SEQ ID NO: 737943 - RNA, 19 nt, Human
aaaaauaaaaacagaaaca

SEQ ID NO: 737944 - RNA, 19 nt, Human
aaaacaccagagccggugg

SEQ ID NO: 737945 - RNA, 28 nt, Human
aaaacagaaacaaaaaccaaaaugaaac

SEQ ID NO: 737946 - RNA, 23 nt, Human
aaaaccaauuuugacaggagcca

SEQ ID NO: 737947 - RNA, 21 nt, Human
aaacagaaacaaaaaccaaaa

SEQ ID NO: 737948 - RNA, 27 nt, Human
aaacuacuaaacagacucaaucacuug

SEQ ID NO: 737949 - RNA, 22 nt, Human
aaagaaguguaauucuaccccu

SEQ ID NO: 737950 - RNA, 25 nt, Human
aaauaaaaacagaaacaaaaaccaa

SEQ ID NO: 737951 - RNA, 19 nt, Human
aacucaagcucaaguugcu

SEQ ID NO: 737952 - RNA, 22 nt, Human
aacuuuuuauuaccaaaaaaaa

SEQ ID NO: 737953 - RNA, 20 nt, Human
aagacagcaggccugggcaa

SEQ ID NO: 737954 - RNA, 21 nt, Human
aagaggaggugaacagcaagg

SEQ ID NO: 737955 - RNA, 21 nt, Human
aagggaguagacugacuuucc

SEQ ID NO: 737956 - RNA, 22 nt, Human
aauaccaccuccccuggacagc

SEQ ID NO: 737957 - RNA, 25 nt, Human
acagcccaagugucuccugccccuc

SEQ ID NO: 737958 - RNA, 23 nt, Human
accaggaccccgggccugcugag

SEQ ID NO: 737959 - RNA, 20 nt, Human
accaucaucuuucucccugg

SEQ ID NO: 737960 - RNA, 24 nt, Human
acccacacccccacccccccccac

SEQ ID NO: 737961 - RNA, 22 nt, Human
accucuuuucugucucccccag

SEQ ID NO: 737962 - RNA, 18 nt, Human
accuugcccgcccgaggc

SEQ ID NO: 737963 - RNA, 18 nt, Human
acggggcgggggcggcgc

SEQ ID NO: 737964 - RNA, 21 nt, Human
acucagucucugccucugagu

SEQ ID NO: 737965 - RNA, 21 nt, Human
acuggaaggaaaacuuaaccc

SEQ ID NO: 737966 - RNA, 22 nt, Human
agaccaggaaguacaaaccuag

SEQ ID NO: 737967 - RNA, 21 nt, Human
agaccgggcacagcgcuggga

SEQ ID NO: 737968 - RNA, 22 nt, Human
agaggaggugaacagcaaggag

SEQ ID NO: 737969 - RNA, 18 nt, Human
agaguccugccgcaccuc

SEQ ID NO: 737970 - RNA, 20 nt, Human
agcaggaggcgauuugcagg

SEQ ID NO: 737971 - RNA, 19 nt, Human
agcaucagggaggcggccc

SEQ ID NO: 737972 - RNA, 18 nt, Human
agcaucuggaugaaugaa

SEQ ID NO: 737973 - RNA, 18 nt, Human
agccaaugguucagccag

SEQ ID NO: 737974 - RNA, 27 nt, Human
aggaaggagguggaauugaagggaccc

SEQ ID NO: 737975 - RNA, 24 nt, Human
aggcauggccauucagaggguacu

SEQ ID NO: 737976 - RNA, 21 nt, Human
aggccaccuaugacuuaacuc

SEQ ID NO: 737977 - RNA, 27 nt, Human
aggccacggcggcggcggcggcggcgg

SEQ ID NO: 737978 - RNA, 18 nt, Human
aggccagggacguggaag

SEQ ID NO: 737979 - RNA, 23 nt, Human
aggccgccaucggaggugggcaa

SEQ ID NO: 737980 - RNA, 19 nt, Human
aggggagagcccaaacugu

SEQ ID NO: 737981 - RNA, 19 nt, Human
aggggagggggagcgaggg

SEQ ID NO: 737982 - RNA, 18 nt, Human
agguggcggcgguggcag

SEQ ID NO: 737983 - RNA, 23 nt, Human
agucaacaccacaccuagaauca

SEQ ID NO: 737984 - RNA, 23 nt, Human
auacggccggggccgccgcgggc

SEQ ID NO: 737985 - RNA, 18 nt, Human
aucuggaccccggcgggg

SEQ ID NO: 737986 - RNA, 19 nt, Human
augacuaaacccgauuccc

SEQ ID NO: 737987 - RNA, 27 nt, Human
augcacccacacccccaccccccccca

SEQ ID NO: 737988 - RNA, 24 nt, Human
augccaguaaaucccuacagaaca

SEQ ID NO: 737989 - RNA, 19 nt, Human
auguggggcgccgcgcccc

SEQ ID NO: 737990 - RNA, 26 nt, Human
caaaaaccaaaaugaaacaaaaauca

SEQ ID NO: 737991 - RNA, 19 nt, Human
caaaacaccagagccggug

SEQ ID NO: 737992 - RNA, 21 nt, Human
caacucaaagcauccaugcag

SEQ ID NO: 737993 - RNA, 21 nt, Human
caagaccgggcacagcgcugg

SEQ ID NO: 737994 - RNA, 22 nt, Human
caaggcaaacagcccaaguguc

SEQ ID NO: 737995 - RNA, 22 nt, Human
caauaucccaucuacaugcuaa

SEQ ID NO: 737996 - RNA, 19 nt, Human
cacaaggggccagcagggc

SEQ ID NO: 737997 - RNA, 19 nt, Human
cacacccccaccccccccc

SEQ ID NO: 737998 - RNA, 18 nt, Human
cacccacacccccacccc

SEQ ID NO: 737999 - RNA, 20 nt, Human
cacccacacccccacccccc

SEQ ID NO: 738000 - RNA, 26 nt, Human
cacccccacccccccccacacacaca

SEQ ID NO: 738001 - RNA, 19 nt, Human
cacccccccccacacacac

SEQ ID NO: 738002 - RNA, 21 nt, Human
cacccccccccacacacacaa

SEQ ID NO: 738003 - RNA, 24 nt, Human
cacccccccccacacacacaauuu

SEQ ID NO: 738004 - RNA, 18 nt, Human
caccccgcggggcagagc

SEQ ID NO: 738005 - RNA, 18 nt, Human
cacccggggccggggccg

SEQ ID NO: 738006 - RNA, 24 nt, Human
cacccggggccggggccgccguga

SEQ ID NO: 738007 - RNA, 25 nt, Human
cacccugaaaagugcuccccaucau

SEQ ID NO: 738008 - RNA, 22 nt, Human
cacgguccgcgcaccgcccccc

SEQ ID NO: 738009 - RNA, 22 nt, Human
cagaaacaaaaaccaaaaugaa

SEQ ID NO: 738010 - RNA, 24 nt, Human
cagccagggcuucccccaccuccc

SEQ ID NO: 738011 - RNA, 24 nt, Human
cagcccaagugucuccugccccuc

SEQ ID NO: 738012 - RNA, 20 nt, Human
cagcgcugggaugucggggu

SEQ ID NO: 738013 - RNA, 20 nt, Human
cagcuaccgcgggcccuccg

SEQ ID NO: 738014 - RNA, 19 nt, Human
caggaccccgggccugcug

SEQ ID NO: 738015 - RNA, 22 nt, Human
caggagaaccccaagagcggcg

SEQ ID NO: 738016 - RNA, 24 nt, Human
caggaguucauggcaaaguuuaaa

SEQ ID NO: 738017 - RNA, 19 nt, Human
caucaacuuccauucaucu

SEQ ID NO: 738018 - RNA, 22 nt, Human
caugcacccacacccccacccc

SEQ ID NO: 738019 - RNA, 24 nt, Human
caugcacccacacccccacccccc

SEQ ID NO: 738020 - RNA, 22 nt, Human
ccaaacagggcccaaauucuga

SEQ ID NO: 738021 - RNA, 20 nt, Human
ccacaggaugacuaaacccg

SEQ ID NO: 738022 - RNA, 20 nt, Human
ccacccccccccacacacac

SEQ ID NO: 738023 - RNA, 23 nt, Human
ccacccccccccacacacacaau

SEQ ID NO: 738024 - RNA, 19 nt, Human
ccagaucaaagaugacaac

SEQ ID NO: 738025 - RNA, 20 nt, Human
ccagcuaauucaucccucca

SEQ ID NO: 738026 - RNA, 21 nt, Human
ccaggggagggggagcgaggg

SEQ ID NO: 738027 - RNA, 18 nt, Human
ccauaaagcaaaugccaa

SEQ ID NO: 738028 - RNA, 19 nt, Human
ccaugcacccacaccccca

SEQ ID NO: 738029 - RNA, 21 nt, Human
ccaugcacccacacccccacc

SEQ ID NO: 738030 - RNA, 23 nt, Human
ccaugcacccacacccccacccc

SEQ ID NO: 738031 - RNA, 19 nt, Human
ccaugccaguaaaucccua

SEQ ID NO: 738032 - RNA, 18 nt, Human
cccaaccccuccccggga

SEQ ID NO: 738033 - RNA, 18 nt, Human
cccacacacacaauuugc

SEQ ID NO: 738034 - RNA, 20 nt, Human
cccacacccccacccccccc

SEQ ID NO: 738035 - RNA, 22 nt, Human
cccacacccccaccccccccca

SEQ ID NO: 738036 - RNA, 24 nt, Human
cccacacccccacccccccccaca

SEQ ID NO: 738037 - RNA, 23 nt, Human
cccagaggcgcccacccugccag

SEQ ID NO: 738038 - RNA, 21 nt, Human
cccauaacacacugcucagcu

SEQ ID NO: 738039 - RNA, 23 nt, Human
ccccacccccccccacacacaca

SEQ ID NO: 738040 - RNA, 23 nt, Human
ccccaccucccugcagccacccg

SEQ ID NO: 738041 - RNA, 22 nt, Human
ccccagaaccaucuggguaaca

SEQ ID NO: 738042 - RNA, 18 nt, Human
ccccagaggcgcccaccc

SEQ ID NO: 738043 - RNA, 22 nt, Human
ccccagaggcgcccacccugcc

SEQ ID NO: 738044 - RNA, 21 nt, Human
cccccacccccccccacacac

SEQ ID NO: 738045 - RNA, 20 nt, Human
cccccaccucccugcagcca

SEQ ID NO: 738046 - RNA, 19 nt, Human
cccccccccacacacacaa

SEQ ID NO: 738047 - RNA, 20 nt, Human
ccccuuccucccucguaccc

SEQ ID NO: 738048 - RNA, 21 nt, Human
cccgccccugggcgcccugga

SEQ ID NO: 738049 - RNA, 22 nt, Human
cccgccccugggcgcccuggaa

SEQ ID NO: 738050 - RNA, 19 nt, Human
cccggcccccgcgcccucu

SEQ ID NO: 738051 - RNA, 21 nt, Human
cccguuugcugagcaggaggc

SEQ ID NO: 738052 - RNA, 19 nt, Human
cccuccgacaccaucugga

SEQ ID NO: 738053 - RNA, 20 nt, Human
cccucguacccccgcccgcc

SEQ ID NO: 738054 - RNA, 19 nt, Human
ccgccccccggccgcggcg

SEQ ID NO: 738055 - RNA, 21 nt, Human
ccgcccgaggcuggcaccccg

SEQ ID NO: 738056 - RNA, 20 nt, Human
ccgcccgccccugggcgccc

SEQ ID NO: 738057 - RNA, 21 nt, Human
ccgcccgccccugggcgcccu

SEQ ID NO: 738058 - RNA, 24 nt, Human
ccgccgcgggccugggcgccccuu

SEQ ID NO: 738059 - RNA, 20 nt, Human
ccgccgggaccugcucgcga

SEQ ID NO: 738060 - RNA, 18 nt, Human
ccgccuggaaggggagga

SEQ ID NO: 738061 - RNA, 20 nt, Human
ccggcccccgcgcccucucc

SEQ ID NO: 738062 - RNA, 24 nt, Human
ccgguggcaaggggagagcccaaa

SEQ ID NO: 738063 - RNA, 24 nt, Human
ccucccugcagccacccggggccg

SEQ ID NO: 738064 - RNA, 19 nt, Human
ccuccuuaggccuugggag

SEQ ID NO: 738065 - RNA, 18 nt, Human
ccuggggucuugaagcac

SEQ ID NO: 738066 - RNA, 22 nt, Human
ccugugagcccaagucuugcuc

SEQ ID NO: 738067 - RNA, 21 nt, Human
cgacaccaucuggaccccggc

SEQ ID NO: 738068 - RNA, 24 nt, Human
cgccgcgccccccaaccccucccc

SEQ ID NO: 738069 - RNA, 21 nt, Human
cggcgcucgcgcggccccagg

SEQ ID NO: 738070 - RNA, 21 nt, Human
cggcucggucacuggcggcgg

SEQ ID NO: 738071 - RNA, 22 nt, Human
cgggacggagcuggcuccccag

SEQ ID NO: 738072 - RNA, 21 nt, Human
cggggcagagcugcgcccgcc

SEQ ID NO: 738073 - RNA, 21 nt, Human
cuacuaaacagacucaaucac

SEQ ID NO: 738074 - RNA, 18 nt, Human
cuauguccuuagcagagu

SEQ ID NO: 738075 - RNA, 22 nt, Human
cucaaagcauccaugcagguga

SEQ ID NO: 738076 - RNA, 23 nt, Human
cucaagcucaaguugcugaaauc

SEQ ID NO: 738077 - RNA, 19 nt, Human
cuccagcccucacuggaag

SEQ ID NO: 738078 - RNA, 22 nt, Human
cucccaacccccugcacucuuu

SEQ ID NO: 738079 - RNA, 21 nt, Human
cuccccagaggcgcccacccu

SEQ ID NO: 738080 - RNA, 23 nt, Human
cuccggggccggucgcucggccu

SEQ ID NO: 738081 - RNA, 18 nt, Human
cucgccagucgcagcuac

SEQ ID NO: 738082 - RNA, 20 nt, Human
cugcugagcaacccguuugc

SEQ ID NO: 738083 - RNA, 18 nt, Human
cugcuggcgccggggcgg

SEQ ID NO: 738084 - RNA, 20 nt, Human
cuggaaggggaggaaggcca

SEQ ID NO: 738085 - RNA, 18 nt, Human
cuggcggccggagcuggg

SEQ ID NO: 738086 - RNA, 20 nt, Human
cuuugggcucgcccaaggca

SEQ ID NO: 738087 - RNA, 23 nt, Human
gaagcaucuggaugaaugaagca

SEQ ID NO: 738088 - RNA, 20 nt, Human
gacaaguugccucuuguugg

SEQ ID NO: 738089 - RNA, 20 nt, Human
gacagcaggccugggcaaaa

SEQ ID NO: 738090 - RNA, 20 nt, Human
gaccaggaaguacaaaccua

SEQ ID NO: 738091 - RNA, 20 nt, Human
gagcccaagucuugcucccc

SEQ ID NO: 738092 - RNA, 23 nt, Human
gagcuaagcggggcuucagguac

SEQ ID NO: 738093 - RNA, 20 nt, Human
gagugcuuuguccucgcugg

SEQ ID NO: 738094 - RNA, 22 nt, Human
gauuugcaggccucuugccucc

SEQ ID NO: 738095 - RNA, 22 nt, Human
gcaccaauuaaauuacaccaau

SEQ ID NO: 738096 - RNA, 22 nt, Human
gcacccacacccccaccccccc

SEQ ID NO: 738097 - RNA, 19 nt, Human
gcaccgccccccggccgcg

SEQ ID NO: 738098 - RNA, 21 nt, Human
gcaggagggaggggagagggu

SEQ ID NO: 738099 - RNA, 22 nt, Human
gccacagcccacuggcugaguu

SEQ ID NO: 738100 - RNA, 23 nt, Human
gccacggcggcggcggcggcggc

SEQ ID NO: 738101 - RNA, 18 nt, Human
gccaucuugaacugaguu

SEQ ID NO: 738102 - RNA, 19 nt, Human
gccccaggggagggggagc

SEQ ID NO: 738103 - RNA, 20 nt, Human
gcgcagacggggcgggggcg

SEQ ID NO: 738104 - RNA, 28 nt, Human
gcgcggccccaggggaggggggaacgcc

SEQ ID NO: 738105 - RNA, 18 nt, Human
gcgcggcguaggccacgg

SEQ ID NO: 738106 - RNA, 20 nt, Human
gcgcugggaugucggggucc

SEQ ID NO: 738107 - RNA, 20 nt, Human
gcggcggcggcggccaggag

SEQ ID NO: 738108 - RNA, 21 nt, Human
gcggcggcggcggccaggagu

SEQ ID NO: 738109 - RNA, 20 nt, Human
gcggcuggccgagccccggg

SEQ ID NO: 738110 - RNA, 21 nt, Human
gcgguggcaggggaggcggug

SEQ ID NO: 738111 - RNA, 24 nt, Human
ggaagggaccgggaaauuccaagc

SEQ ID NO: 738112 - RNA, 18 nt, Human
ggaccaggaaagcugaca

SEQ ID NO: 738113 - RNA, 20 nt, Human
ggagaggguggcucgcagcg

SEQ ID NO: 738114 - RNA, 18 nt, Human
ggagcugggggagggggc

SEQ ID NO: 738115 - RNA, 20 nt, Human
ggccugggcgccccuucauu

SEQ ID NO: 738116 - RNA, 20 nt, Human
gggcgagguggcggcggugg

SEQ ID NO: 738117 - RNA, 22 nt, Human
gggcgagguggcggcgguggca

SEQ ID NO: 738118 - RNA, 25 nt, Human
gggcggugcagccagggccgggccc

SEQ ID NO: 738119 - RNA, 26 nt, Human
gggcggugcagccagggccgggcccc

SEQ ID NO: 738120 - RNA, 20 nt, Human
ggggagggggagcgaggggc

SEQ ID NO: 738121 - RNA, 24 nt, Human
ggggcgagccgggcuacagagggc

SEQ ID NO: 738122 - RNA, 18 nt, Human
gggggaggaagaagggag

SEQ ID NO: 738123 - RNA, 18 nt, Human
ggggggaggaagaaggga

SEQ ID NO: 738124 - RNA, 20 nt, Human
ggguggcucgcagcgcagga

SEQ ID NO: 738125 - RNA, 20 nt, Human
gguggcaggggaggcggugg

SEQ ID NO: 738126 - RNA, 22 nt, Human
gguugcggcuggccgagccccg

SEQ ID NO: 738127 - RNA, 19 nt, Human
gucauuuuuacuuaaagac

SEQ ID NO: 738128 - RNA, 25 nt, Human
guccucuaggaggugccauaaagca

SEQ ID NO: 738129 - RNA, 23 nt, Human
guggcggcgguggcaggggaggc

SEQ ID NO: 738130 - RNA, 18 nt, Human
gugguuauccagcuuguu

SEQ ID NO: 738131 - RNA, 21 nt, Human
guguuggcucaaggcugcaaa

SEQ ID NO: 738132 - RNA, 21 nt, Human
guugcugaaaucuacuugcca

SEQ ID NO: 738133 - RNA, 21 nt, Human
uaaaaacagaaacaaaaacca

SEQ ID NO: 738134 - RNA, 20 nt, Human
uaaaaagaaguguaauucuu

SEQ ID NO: 738135 - RNA, 25 nt, Human
uaaaaauaaaaacagaaacaaaaac

SEQ ID NO: 738136 - RNA, 22 nt, Human
uaaagcaaaugccaaacagggc

SEQ ID NO: 738137 - RNA, 21 nt, Human
uaacaaaugccucaccagugg

SEQ ID NO: 738138 - RNA, 19 nt, Human
uaacucccuagaagcaaac

SEQ ID NO: 738139 - RNA, 22 nt, Human
uaagccaaaacaccagagccgg

SEQ ID NO: 738140 - RNA, 24 nt, Human
uaauuccacagaagugaauaaagc

SEQ ID NO: 738141 - RNA, 19 nt, Human
uaccaaaaaaaauagaaau

SEQ ID NO: 738142 - RNA, 19 nt, Human
uacucaagacagcaggccu

SEQ ID NO: 738143 - RNA, 20 nt, Human
uacugacagcuacggacacg

SEQ ID NO: 738144 - RNA, 22 nt, Human
uaggaggugccauaaagcaaau

SEQ ID NO: 738145 - RNA, 18 nt, Human
uaucacauccaacucaaa

SEQ ID NO: 738146 - RNA, 21 nt, Human
ucaagacagcaggccugggca

SEQ ID NO: 738147 - RNA, 21 nt, Human
ucaagacagcaggccugggca

SEQ ID NO: 738148 - RNA, 18 nt, Human
ucagagcuaagcggggcu

SEQ ID NO: 738149 - RNA, 23 nt, Human
ucagcucaaccugaaggaacgca

SEQ ID NO: 738150 - RNA, 22 nt, Human
ucagguaccagcuaauucaucc

SEQ ID NO: 738151 - RNA, 21 nt, Human
uccaaagauguucccaagacc

SEQ ID NO: 738152 - RNA, 18 nt, Human
uccaggagaaccccaaga

SEQ ID NO: 738153 - RNA, 24 nt, Human
uccaugcacccacacccccacccc

SEQ ID NO: 738154 - RNA, 20 nt, Human
ucccaacccccugcacucuc

SEQ ID NO: 738155 - RNA, 24 nt, Human
ucccaacccccugcacucuuucaa

SEQ ID NO: 738156 - RNA, 22 nt, Human
uccccuuccucccucguacccc

SEQ ID NO: 738157 - RNA, 19 nt, Human
ucccuagaagcaaacuugc

SEQ ID NO: 738158 - RNA, 25 nt, Human
ucccucguacccccgcccgccccug

SEQ ID NO: 738159 - RNA, 22 nt, Human
uccgcgcaccgccccccggccg

SEQ ID NO: 738160 - RNA, 23 nt, Human
uccgcgcaccgccccccggccgc

SEQ ID NO: 738161 - RNA, 24 nt, Human
uccgcgcaccgccccccggccgcg

SEQ ID NO: 738162 - RNA, 21 nt, Human
ucgcccaaggcaaacagccca

SEQ ID NO: 738163 - RNA, 21 nt, Human
ucuccugccccuccuccagaa

SEQ ID NO: 738164 - RNA, 18 nt, Human
ugaaaagugcuccccauc

SEQ ID NO: 738165 - RNA, 22 nt, Human
ugaaggaacgcauaagccaaaa

SEQ ID NO: 738166 - RNA, 20 nt, Human
ugaaugaaaggaaauugagc

SEQ ID NO: 738167 - RNA, 24 nt, Human
ugacaaaagagaacacguguuugg

SEQ ID NO: 738168 - RNA, 20 nt, Human
ugacagugaaucuccugcuu

SEQ ID NO: 738169 - RNA, 19 nt, Human
ugacucacggaccuugccc

SEQ ID NO: 738170 - RNA, 23 nt, Human
ugagaaagaaagugacaaguugc

SEQ ID NO: 738171 - RNA, 24 nt, Human
ugagaaagaaagugacaaguugcc

SEQ ID NO: 738172 - RNA, 22 nt, Human
ugagcugggagggggaugggag

SEQ ID NO: 738173 - RNA, 24 nt, Human
ugaggcaggaaguagggagcuccc

SEQ ID NO: 738174 - RNA, 18 nt, Human
ugcaaagaucacagacca

SEQ ID NO: 738175 - RNA, 21 nt, Human
ugcacccacacccccaccccc

SEQ ID NO: 738176 - RNA, 22 nt, Human
ugcagccagggcuucccccacc

SEQ ID NO: 738177 - RNA, 22 nt, Human
ugcaggagggaggggagagggu

SEQ ID NO: 738178 - RNA, 24 nt, Human
ugccaaacagggcccaaauucuga

SEQ ID NO: 738179 - RNA, 18 nt, Human
ugccccuccuccagaagc

SEQ ID NO: 738180 - RNA, 24 nt, Human
ugcuccuuccacauaugcuuccuc

SEQ ID NO: 738181 - RNA, 24 nt, Human
ugcugagcaacccguuugcugagc

SEQ ID NO: 738182 - RNA, 20 nt, Human
ugcuggcgccggggcggcgg

SEQ ID NO: 738183 - RNA, 21 nt, Human
uggaaacuacuaaacagacuc

SEQ ID NO: 738184 - RNA, 25 nt, Human
uggaaggaaaacuuaaccccugcaa

SEQ ID NO: 738185 - RNA, 19 nt, Human
uggaaggggaggaaggcca

SEQ ID NO: 738186 - RNA, 18 nt, Human
uggacagcugguccucua

SEQ ID NO: 738187 - RNA, 28 nt, Human
uggacaguaucacauccaacucaaagca

SEQ ID NO: 738188 - RNA, 23 nt, Human
uggaccaggaccccgggccugcu

SEQ ID NO: 738189 - RNA, 20 nt, Human
uggaguggcaucuugucauu

SEQ ID NO: 738190 - RNA, 22 nt, Human
uggcagaagagcccaccucucc

SEQ ID NO: 738191 - RNA, 22 nt, Human
uggcaucuugucauugugaucu

SEQ ID NO: 738192 - RNA, 20 nt, Human
uggccaagugagacagugcc

SEQ ID NO: 738193 - RNA, 23 nt, Human
uggcgccggggcggcgguugcgg

SEQ ID NO: 738194 - RNA, 18 nt, Human
uggcggccggagcugggg

SEQ ID NO: 738195 - RNA, 29 nt, Human
uggcggcgguggcaggggaggggugcucc

SEQ ID NO: 738196 - RNA, 19 nt, Human
uggcucaaggcugcaaacu

SEQ ID NO: 738197 - RNA, 21 nt, Human
ugggauuggcugguagggaug

SEQ ID NO: 738198 - RNA, 25 nt, Human
ugggcaaaacucgccugaauuucac

SEQ ID NO: 738199 - RNA, 18 nt, Human
ugggcaaaccagggaccu

SEQ ID NO: 738200 - RNA, 21 nt, Human
ugggcgccccuucauuuucuu

SEQ ID NO: 738201 - RNA, 24 nt, Human
uggggcgccgcgccccccaacccc

SEQ ID NO: 738202 - RNA, 22 nt, Human
ugggggagggggcagggaggcc

SEQ ID NO: 738203 - RNA, 22 nt, Human
ugugcaaagaucacagaccauc

SEQ ID NO: 738204 - RNA, 23 nt, Human
uguuuuguuuuguuuacuuuuua

SEQ ID NO: 738205 - RNA, 21 nt, Human
uguuuuguuuuguuuuguuua

SEQ ID NO: 738206 - RNA, 25 nt, Human
uguuuuguuuuguuuuguuuugauu

SEQ ID NO: 738207 - RNA, 23 nt, Human
uuaacacagaucccacaggauga

SEQ ID NO: 738208 - RNA, 18 nt, Human
uuacuagucaaucacagc

SEQ ID NO: 738209 - RNA, 20 nt, Human
uuccccuucccuuucccgug

SEQ ID NO: 738210 - RNA, 20 nt, Human
uucccuuucccgugguagcc

SEQ ID NO: 738211 - RNA, 19 nt, Human
uuccucccaacccccugca

SEQ ID NO: 738212 - RNA, 24 nt, Human
uuccucccucguacccccgcccgc

SEQ ID NO: 738213 - RNA, 20 nt, Human
uugaaaggacagucaacacc

SEQ ID NO: 738214 - RNA, 20 nt, Human
uuggggggaggaagaaggga

SEQ ID NO: 738215 - RNA, 24 nt, Human
uuguccaucagguccuaaaagugu

SEQ ID NO: 738216 - RNA, 23 nt, Human
uuuccugacaaaagagaacacgu

SEQ ID NO: 738217 - RNA, 23 nt, Human
uuugaaaugccuuucagaccaau

SEQ ID NO: 738218 - RNA, 21 nt, Human
uuuggggggaggaagaaggga

SEQ ID NO: 738219 - RNA, 21 nt, Human
uuuguccucgcugggccggaa

SEQ ID NO: 738220 - RNA, 18 nt, Human
uuuguuuuguuuuguuua

SEQ ID NO: 738221 - RNA, 19 nt, Human
uuuguuuuguuuuguuuug

SEQ ID NO: 738222 - RNA, 19 nt, Human
uuuguuuuguuuuguuuug

SEQ ID NO: 738223 - RNA, 24 nt, Human
uuuuccccuguaggcuguucuggg

SEQ ID NO: 738224 - RNA, 23 nt, Human
uuuuucagucuguugucacagcc

SEQ ID NO: 738225 - RNA, 24 nt, Human
uuuuuuuucccuuuuaaccucuau

SEQ ID NO: 738226 - RNA, 18 nt, Human
caccccccugggcugccc

SEQ ID NO: 738227 - RNA, 24 nt, Human
cagggugggccccgcucacccccc

SEQ ID NO: 738228 - RNA, 21 nt, Human
ccccgcucaccccccugggcu

SEQ ID NO: 738229 - RNA, 24 nt, Human
cccgcucaccccccugggcugccc

SEQ ID NO: 738230 - RNA, 22 nt, Human
cgacuucugggcggggccuccc

SEQ ID NO: 738231 - RNA, 18 nt, Human
cgagcagccggacuggcc

SEQ ID NO: 738232 - RNA, 26 nt, Human
cgccagugcuggcccucagggcggcc

SEQ ID NO: 738233 - RNA, 20 nt, Human
cuuccgcccgccaaucccug

SEQ ID NO: 738234 - RNA, 20 nt, Human
gacuuccgcccgccaauccc

SEQ ID NO: 738235 - RNA, 18 nt, Human
gggccaggccugccgggg

SEQ ID NO: 738236 - RNA, 18 nt, Human
gggcggccccucagccgg

SEQ ID NO: 738237 - RNA, 21 nt, Human
ggggccucccgggccaggccu

SEQ ID NO: 738238 - RNA, 24 nt, Human
ggguguucccgccgacuucugggc

SEQ ID NO: 738239 - RNA, 21 nt, Human
gugggccccgcucaccccccu

SEQ ID NO: 738240 - RNA, 19 nt, Human
ucccugagcugggcagggu

SEQ ID NO: 738241 - RNA, 21 nt, Human
ugccgggggcggggcccgagc

SEQ ID NO: 738242 - RNA, 20 nt, Human
aaggaggaaagaggcagcag

SEQ ID NO: 738243 - RNA, 24 nt, Human
aauaaaaaaaaucaaacuuaaaac

SEQ ID NO: 738244 - RNA, 23 nt, Human
acaaaggccagccacguggccca

SEQ ID NO: 738245 - RNA, 23 nt, Human
accccgcccagaccccggggcuu

SEQ ID NO: 738246 - RNA, 21 nt, Human
agaaccacagggcccgcacug

SEQ ID NO: 738247 - RNA, 19 nt, Human
agcacagggccugccgcag

SEQ ID NO: 738248 - RNA, 21 nt, Human
agcagccaggcggcccagagc

SEQ ID NO: 738249 - RNA, 21 nt, Human
agccaucgggccugacguugg

SEQ ID NO: 738250 - RNA, 18 nt, Human
agccccuguccagcaccu

SEQ ID NO: 738251 - RNA, 20 nt, Human
agccgccuggaccugcugcu

SEQ ID NO: 738252 - RNA, 22 nt, Human
agccgccuggaccugcugcugg

SEQ ID NO: 738253 - RNA, 19 nt, Human
agccgcgccuucuuucucc

SEQ ID NO: 738254 - RNA, 21 nt, Human
agcguggcacagcggcggacg

SEQ ID NO: 738255 - RNA, 22 nt, Human
agcugcagucucugcugggcug

SEQ ID NO: 738256 - RNA, 23 nt, Human
aggaaggaguagaugggggucag

SEQ ID NO: 738257 - RNA, 23 nt, Human
aggaggaaagaggcagcagcagc

SEQ ID NO: 738258 - RNA, 23 nt, Human
aggcagggggcugugugggaagg

SEQ ID NO: 738259 - RNA, 18 nt, Human
aggccauguuccuguggc

SEQ ID NO: 738260 - RNA, 21 nt, Human
agggagggggcugcuggcuga

SEQ ID NO: 738261 - RNA, 23 nt, Human
agggaugaggggaccgggggcuu

SEQ ID NO: 738262 - RNA, 22 nt, Human
agggugccauccccagccccag

SEQ ID NO: 738263 - RNA, 18 nt, Human
aguccccaggaaggagua

SEQ ID NO: 738264 - RNA, 21 nt, Human
aucugcauuuccaccuguucc

SEQ ID NO: 738265 - RNA, 20 nt, Human
caaagcgcaggagccgcgug

SEQ ID NO: 738266 - RNA, 24 nt, Human
caccagcgcugaaaccagguccgc

SEQ ID NO: 738267 - RNA, 23 nt, Human
cagcaaugcgguugagaagggga

SEQ ID NO: 738268 - RNA, 19 nt, Human
cagcaccugcguuccuggu

SEQ ID NO: 738269 - RNA, 23 nt, Human
cagcagcaaugagaaucgguuuc

SEQ ID NO: 738270 - RNA, 24 nt, Human
cagcagcagcaaugagaaucgguu

SEQ ID NO: 738271 - RNA, 18 nt, Human
cagcagcagcagcuccgg

SEQ ID NO: 738272 - RNA, 23 nt, Human
cagcagcagcagcuccgggccuu

SEQ ID NO: 738273 - RNA, 20 nt, Human
cagcagcagcuccgggccug

SEQ ID NO: 738274 - RNA, 24 nt, Human
cagccgcgccuucuuucuccuccu

SEQ ID NO: 738275 - RNA, 21 nt, Human
cagcgcugaaaccagguccgc

SEQ ID NO: 738276 - RNA, 18 nt, Human
cagcuucccgccacugga

SEQ ID NO: 738277 - RNA, 25 nt, Human
caggcccagcccugguggcugagaa

SEQ ID NO: 738278 - RNA, 18 nt, Human
cagggagggggcugcugg

SEQ ID NO: 738279 - RNA, 18 nt, Human
cagggccugccgcagggc

SEQ ID NO: 738280 - RNA, 21 nt, Human
caugcacccucugggcauccc

SEQ ID NO: 738281 - RNA, 23 nt, Human
ccaccgggccagccccuccagcu

SEQ ID NO: 738282 - RNA, 20 nt, Human
ccacgcccgccucagcgcuu

SEQ ID NO: 738283 - RNA, 24 nt, Human
ccagcaguugggugcucugccugu

SEQ ID NO: 738284 - RNA, 26 nt, Human
ccccaccgaggguucuuuaucuccuu

SEQ ID NO: 738285 - RNA, 18 nt, Human
ccccaggcagggggcugu

SEQ ID NO: 738286 - RNA, 20 nt, Human
ccccuucuaacuggggaagc

SEQ ID NO: 738287 - RNA, 21 nt, Human
cccgcugcuccugccuccugg

SEQ ID NO: 738288 - RNA, 25 nt, Human
cccucuccagcugcagucucugcug

SEQ ID NO: 738289 - RNA, 19 nt, Human
ccgcacugucgcccgcugc

SEQ ID NO: 738290 - RNA, 21 nt, Human
ccgcacugucgcccgcugcuc

SEQ ID NO: 738291 - RNA, 19 nt, Human
ccgcgcgguccacgcccgc

SEQ ID NO: 738292 - RNA, 22 nt, Human
ccgcugcuccugccuccuggcu

SEQ ID NO: 738293 - RNA, 20 nt, Human
ccucccagauggcacagucc

SEQ ID NO: 738294 - RNA, 22 nt, Human
ccuccccgacagcccagcaccu

SEQ ID NO: 738295 - RNA, 22 nt, Human
ccuccccgacagcccagcaccu

SEQ ID NO: 738296 - RNA, 26 nt, Human
ccuccccgacagcccagcaccugcgu

SEQ ID NO: 738297 - RNA, 21 nt, Human
ccugacguugggagaaaaccc

SEQ ID NO: 738298 - RNA, 22 nt, Human
ccugcagcgagaaggcccagaa

SEQ ID NO: 738299 - RNA, 23 nt, Human
ccugcagcgagaaggcccagaac

SEQ ID NO: 738300 - RNA, 21 nt, Human
ccugguccucaggccccggcc

SEQ ID NO: 738301 - RNA, 23 nt, Human
cggcacgauggagacugugagcc

SEQ ID NO: 738302 - RNA, 21 nt, Human
cggcccagagcucccagaggc

SEQ ID NO: 738303 - RNA, 24 nt, Human
cggcccagagcucccagaggccga

SEQ ID NO: 738304 - RNA, 20 nt, Human
cggcggacggcacgauggag

SEQ ID NO: 738305 - RNA, 25 nt, Human
cggcgguauacggcgauccgggacc

SEQ ID NO: 738306 - RNA, 21 nt, Human
cgucagggagggggcugcugg

SEQ ID NO: 738307 - RNA, 19 nt, Human
cucagcgcuucgcgcgccu

SEQ ID NO: 738308 - RNA, 19 nt, Human
cuccucaaguucagccuca

SEQ ID NO: 738309 - RNA, 20 nt, Human
cuccucagcagccaggcggc

SEQ ID NO: 738310 - RNA, 21 nt, Human
cuccucucuguucagcuccag

SEQ ID NO: 738311 - RNA, 20 nt, Human
cucgucuccacggcgacgcg

SEQ ID NO: 738312 - RNA, 18 nt, Human
cucuacuuccugguccuc

SEQ ID NO: 738313 - RNA, 18 nt, Human
cucugcugggcugaccuc

SEQ ID NO: 738314 - RNA, 27 nt, Human
cucuuggucucaagggugccaucuuac

SEQ ID NO: 738315 - RNA, 21 nt, Human
cucuuucugcaccugcugcuc

SEQ ID NO: 738316 - RNA, 19 nt, Human
cugaggccucuggcucugc

SEQ ID NO: 738317 - RNA, 23 nt, Human
cugcagcugcugccgggaggccu

SEQ ID NO: 738318 - RNA, 23 nt, Human
cugcagucccaccagcgcugaaa

SEQ ID NO: 738319 - RNA, 23 nt, Human
cugccugcaguugaaaguccagg

SEQ ID NO: 738320 - RNA, 19 nt, Human
cugcugcugggccugcagc

SEQ ID NO: 738321 - RNA, 18 nt, Human
cugcugggccugcagcug

SEQ ID NO: 738322 - RNA, 24 nt, Human
cugcugggccugcagcugcugccg

SEQ ID NO: 738323 - RNA, 23 nt, Human
cugcugggcugaccuccggcugc

SEQ ID NO: 738324 - RNA, 25 nt, Human
cuggagcuccucugccagcagcugg

SEQ ID NO: 738325 - RNA, 21 nt, Human
cuggaggagcugccccuggua

SEQ ID NO: 738326 - RNA, 25 nt, Human
cuggcgcugagccuggagcuccucu

SEQ ID NO: 738327 - RNA, 20 nt, Human
cugucggggccucugccagg

SEQ ID NO: 738328 - RNA, 18 nt, Human
cuguggccucuuggucuc

SEQ ID NO: 738329 - RNA, 22 nt, Human
cuuaacucccgcgcgguccacg

SEQ ID NO: 738330 - RNA, 24 nt, Human
gaccugcugcugggccugcagcug

SEQ ID NO: 738331 - RNA, 20 nt, Human
gaccugcuucuuaacucccg

SEQ ID NO: 738332 - RNA, 23 nt, Human
gagaaucgguuucgaggggcgug

SEQ ID NO: 738333 - RNA, 25 nt, Human
gagcaugcacccucugggcaucccc

SEQ ID NO: 738334 - RNA, 19 nt, Human
gaggaaagaggcagcagca

SEQ ID NO: 738335 - RNA, 22 nt, Human
gaggcuucccgccccggcccag

SEQ ID NO: 738336 - RNA, 23 nt, Human
gagugggcaguguugagcuccag

SEQ ID NO: 738337 - RNA, 18 nt, Human
gcaaagcgcaggagccgc

SEQ ID NO: 738338 - RNA, 19 nt, Human
gcaaagcgcaggagccgcg

SEQ ID NO: 738339 - RNA, 20 nt, Human
gcacgaggaccaccccgccc

SEQ ID NO: 738340 - RNA, 24 nt, Human
gcagcagcagcuccgggccugugc

SEQ ID NO: 738341 - RNA, 23 nt, Human
gcagcgagaaggcccagaaccac

SEQ ID NO: 738342 - RNA, 24 nt, Human
gcagcugcugccgggaggccuuca

SEQ ID NO: 738343 - RNA, 20 nt, Human
gcaguugggugcucugccuc

SEQ ID NO: 738344 - RNA, 19 nt, Human
gcccagagcucccagaggc

SEQ ID NO: 738345 - RNA, 19 nt, Human
gccuggagcgcccacugca

SEQ ID NO: 738346 - RNA, 24 nt, Human
gcggcccagagcucccagaggccg

SEQ ID NO: 738347 - RNA, 25 nt, Human
gcggcgcgcacgaggaccaccccgc

SEQ ID NO: 738348 - RNA, 21 nt, Human
gcgucagggagggggcugcug

SEQ ID NO: 738349 - RNA, 23 nt, Human
gcucccagaggccgagaagccug

SEQ ID NO: 738350 - RNA, 23 nt, Human
gcugagucucugugccagcaguu

SEQ ID NO: 738351 - RNA, 19 nt, Human
gcugccagcuguugucucc

SEQ ID NO: 738352 - RNA, 19 nt, Human
gcugccaggggcugaggcu

SEQ ID NO: 738353 - RNA, 26 nt, Human
ggagcaugcacccucugggcaucccc

SEQ ID NO: 738354 - RNA, 24 nt, Human
ggaguagaugggggucagggacac

SEQ ID NO: 738355 - RNA, 22 nt, Human
ggcagcagcagcagcuccgggc

SEQ ID NO: 738356 - RNA, 19 nt, Human
ggcaugaaggaggaaagag

SEQ ID NO: 738357 - RNA, 23 nt, Human
ggccucuggcucugcgcaggcuc

SEQ ID NO: 738358 - RNA, 21 nt, Human
ggccugccgcagggccuggau

SEQ ID NO: 738359 - RNA, 23 nt, Human
ggcgccaaugggcuggcgcugag

SEQ ID NO: 738360 - RNA, 21 nt, Human
ggcugagucucugugccagca

SEQ ID NO: 738361 - RNA, 25 nt, Human
ggcugcuggcugagccaugccuagg

SEQ ID NO: 738362 - RNA, 19 nt, Human
gggaccagugcugucgggg

SEQ ID NO: 738363 - RNA, 20 nt, Human
gggagggggcugcuggcuga

SEQ ID NO: 738364 - RNA, 22 nt, Human
gggagggggcugcuggcugagc

SEQ ID NO: 738365 - RNA, 21 nt, Human
gggcaugaaggaggaaagagg

SEQ ID NO: 738366 - RNA, 24 nt, Human
gggcugaggcuucccgccccggcc

SEQ ID NO: 738367 - RNA, 23 nt, Human
gggcugugugggaccagugcugu

SEQ ID NO: 738368 - RNA, 20 nt, Human
gguggugguguugcacugcc

SEQ ID NO: 738369 - RNA, 20 nt, Human
guccgcagacagccccuguc

SEQ ID NO: 738370 - RNA, 20 nt, Human
gugagccgccuggaccugcu

SEQ ID NO: 738371 - RNA, 20 nt, Human
gugcgucuuccaccgggcca

SEQ ID NO: 738372 - RNA, 21 nt, Human
gugcucugccugugcaggagc

SEQ ID NO: 738373 - RNA, 20 nt, Human
guuccagcucuuucugcacc

SEQ ID NO: 738374 - RNA, 21 nt, Human
uacaaaggccagccacguggc

SEQ ID NO: 738375 - RNA, 23 nt, Human
ucagcagccaggcggcccagagc

SEQ ID NO: 738376 - RNA, 22 nt, Human
ucagggagggggcugcuggcug

SEQ ID NO: 738377 - RNA, 21 nt, Human
uccaccgggccagccccucca

SEQ ID NO: 738378 - RNA, 21 nt, Human
ucccagaggccgagaagccuc

SEQ ID NO: 738379 - RNA, 21 nt, Human
ucccgccccggcccagcacuu

SEQ ID NO: 738380 - RNA, 22 nt, Human
uccgcagacagccccuguccag

SEQ ID NO: 738381 - RNA, 24 nt, Human
uccucaaguucagccucaaggucc

SEQ ID NO: 738382 - RNA, 18 nt, Human
uccucucuguucagcucc

SEQ ID NO: 738383 - RNA, 25 nt, Human
uccugccuccuggcugccagcuguu

SEQ ID NO: 738384 - RNA, 19 nt, Human
uccuggaggagcugccccu

SEQ ID NO: 738385 - RNA, 20 nt, Human
uccuggcugccagcuguugu

SEQ ID NO: 738386 - RNA, 23 nt, Human
uccugguccucaggccccggcuc

SEQ ID NO: 738387 - RNA, 24 nt, Human
ucuccagcugcagucucugcuggg

SEQ ID NO: 738388 - RNA, 21 nt, Human
ucuccuccuuuccaguacaaa

SEQ ID NO: 738389 - RNA, 22 nt, Human
ucuccuccuuuccaguacaaag

SEQ ID NO: 738390 - RNA, 24 nt, Human
ucucugugccagcaguugggugcu

SEQ ID NO: 738391 - RNA, 19 nt, Human
ucugcugggcugaccuccg

SEQ ID NO: 738392 - RNA, 20 nt, Human
ugaccuccggcugcaguccc

SEQ ID NO: 738393 - RNA, 22 nt, Human
ugagugggcaguguugagcucc

SEQ ID NO: 738394 - RNA, 19 nt, Human
ugcacccucugggcauccc

SEQ ID NO: 738395 - RNA, 21 nt, Human
ugcagcugcugccgggaggcc

SEQ ID NO: 738396 - RNA, 20 nt, Human
ugccaggggcugaggcuucc

SEQ ID NO: 738397 - RNA, 22 nt, Human
ugccauccccagccccagcagc

SEQ ID NO: 738398 - RNA, 19 nt, Human
ugccccugguaggccugga

SEQ ID NO: 738399 - RNA, 20 nt, Human
ugccugcagcgagaaggccc

SEQ ID NO: 738400 - RNA, 20 nt, Human
ugcgauggcugccaggggcu

SEQ ID NO: 738401 - RNA, 19 nt, Human
ugcgcaggcugcucgcuug

SEQ ID NO: 738402 - RNA, 22 nt, Human
ugcucgcuugccgccgacagga

SEQ ID NO: 738403 - RNA, 21 nt, Human
ugcugcugggccugcagcugc

SEQ ID NO: 738404 - RNA, 19 nt, Human
uggcacagcggcggacggc

SEQ ID NO: 738405 - RNA, 20 nt, Human
uggccugaggccuccccgac

SEQ ID NO: 738406 - RNA, 18 nt, Human
uggcucugcgcaggcucc

SEQ ID NO: 738407 - RNA, 20 nt, Human
ugggagaaaacccggcggua

SEQ ID NO: 738408 - RNA, 23 nt, Human
ugggcauccccaccgaggguucu

SEQ ID NO: 738409 - RNA, 19 nt, Human
ugggccugcagcugcugcc

SEQ ID NO: 738410 - RNA, 21 nt, Human
ugggugcgauggcugccaggg

SEQ ID NO: 738411 - RNA, 18 nt, Human
uguaaugaguacuugcuu

SEQ ID NO: 738412 - RNA, 23 nt, Human
ugucggggccucugccaggaagg

SEQ ID NO: 738413 - RNA, 18 nt, Human
uucagcuccagccaccug

SEQ ID NO: 738414 - RNA, 18 nt, Human
uuccaccgggccagcccc

SEQ ID NO: 738415 - RNA, 20 nt, Human
uuccaccgggccagccccuc

SEQ ID NO: 738416 - RNA, 22 nt, Human
uuccuguggcuucugaggccuc

SEQ ID NO: 738417 - RNA, 23 nt, Human
uuccuguggcuucugaggccucu

SEQ ID NO: 738418 - RNA, 24 nt, Human
uugcacugcccucuccagcugcag

SEQ ID NO: 738419 - RNA, 21 nt, Human
uugcagcagcagcaaugagaa

SEQ ID NO: 738420 - RNA, 26 nt, Human
aaagcccuugucacugagcgcccuuc

SEQ ID NO: 738421 - RNA, 21 nt, Human
aaagggcccacccacaggggc

SEQ ID NO: 738422 - RNA, 22 nt, Human
aacuucgucccauccucuccug

SEQ ID NO: 738423 - RNA, 21 nt, Human
aagcggccuccugagccugcc

SEQ ID NO: 738424 - RNA, 23 nt, Human
aagcggccuccugagccugccaa

SEQ ID NO: 738425 - RNA, 22 nt, Human
aaggaaggcagaaccuagacaa

SEQ ID NO: 738426 - RNA, 24 nt, Human
aaggaaggcagaaccuagacaaaa

SEQ ID NO: 738427 - RNA, 23 nt, Human
aaggcagaaccuagacaaaauca

SEQ ID NO: 738428 - RNA, 20 nt, Human
accacugccugcagcagagc

SEQ ID NO: 738429 - RNA, 26 nt, Human
accagacccccugccagaagagccca

SEQ ID NO: 738430 - RNA, 24 nt, Human
acuucgucccauccucuccugggu

SEQ ID NO: 738431 - RNA, 24 nt, Human
agacccccugccagaagagcccag

SEQ ID NO: 738432 - RNA, 20 nt, Human
agagaccaucgccaccagca

SEQ ID NO: 738433 - RNA, 19 nt, Human
agaggucuuugagggagcu

SEQ ID NO: 738434 - RNA, 22 nt, Human
auggagaaagggcccacccaca

SEQ ID NO: 738435 - RNA, 19 nt, Human
auggcucuggcccucgucc

SEQ ID NO: 738436 - RNA, 22 nt, Human
augggaaggguacucagacagc

SEQ ID NO: 738437 - RNA, 20 nt, Human
caaaaucauccuccuccuga

SEQ ID NO: 738438 - RNA, 18 nt, Human
caaccucccccucuaaca

SEQ ID NO: 738439 - RNA, 20 nt, Human
caaccucccccucuaacaag

SEQ ID NO: 738440 - RNA, 22 nt, Human
cacagaggcgucuccaaggcag

SEQ ID NO: 738441 - RNA, 21 nt, Human
cacagcacaggaccugccuga

SEQ ID NO: 738442 - RNA, 18 nt, Human
cacaggaccugccugagc

SEQ ID NO: 738443 - RNA, 19 nt, Human
cacaggaccugccugagcc

SEQ ID NO: 738444 - RNA, 27 nt, Human
caccagacccccugccagaagagcccc

SEQ ID NO: 738445 - RNA, 21 nt, Human
cagacccccugccagaagagc

SEQ ID NO: 738446 - RNA, 23 nt, Human
cagacccccugccagaagagccc

SEQ ID NO: 738447 - RNA, 20 nt, Human
cagagaaacccugccugcug

SEQ ID NO: 738448 - RNA, 19 nt, Human
cagcagagcuggggcugca

SEQ ID NO: 738449 - RNA, 21 nt, Human
caggcccaaagucccuggagg

SEQ ID NO: 738450 - RNA, 19 nt, Human
cagggcagcucagagaaga

SEQ ID NO: 738451 - RNA, 23 nt, Human
caggggccugcagcacagcacag

SEQ ID NO: 738452 - RNA, 20 nt, Human
ccacacugcagccagagguc

SEQ ID NO: 738453 - RNA, 27 nt, Human
ccacaggggccugcagcacagcacagg

SEQ ID NO: 738454 - RNA, 23 nt, Human
ccagaagagcccagcuccaccau

SEQ ID NO: 738455 - RNA, 22 nt, Human
ccagaagccccucugugccucu

SEQ ID NO: 738456 - RNA, 24 nt, Human
ccagaagccccucugugccucuag

SEQ ID NO: 738457 - RNA, 18 nt, Human
cccagcuccaccaucugg

SEQ ID NO: 738458 - RNA, 23 nt, Human
cccaugguuaaggaaggcagaac

SEQ ID NO: 738459 - RNA, 22 nt, Human
cccuaccaggacacuccucuug

SEQ ID NO: 738460 - RNA, 19 nt, Human
cccuagagcaggggcaacc

SEQ ID NO: 738461 - RNA, 19 nt, Human
ccgggccgggcaugccacg

SEQ ID NO: 738462 - RNA, 22 nt, Human
ccuacaacaaggacuuuggaga

SEQ ID NO: 738463 - RNA, 24 nt, Human
ccuaccaggacacuccucuugcca

SEQ ID NO: 738464 - RNA, 22 nt, Human
ccuccugauaccccugcugcuc

SEQ ID NO: 738465 - RNA, 25 nt, Human
ccugcugacuugccucauuuccugc

SEQ ID NO: 738466 - RNA, 19 nt, Human
ccugcugcucugggaugcc

SEQ ID NO: 738467 - RNA, 20 nt, Human
ccugggugaugcuccagaag

SEQ ID NO: 738468 - RNA, 24 nt, Human
ccugggugaugcuccagaaggcuc

SEQ ID NO: 738469 - RNA, 22 nt, Human
cucagugggcccuggagauccu

SEQ ID NO: 738470 - RNA, 22 nt, Human
cucccaacuccaacuucguccc

SEQ ID NO: 738471 - RNA, 24 nt, Human
cuccugagccugccaagacggagc

SEQ ID NO: 738472 - RNA, 23 nt, Human
cuccugauaagcggccuccugag

SEQ ID NO: 738473 - RNA, 23 nt, Human
cugcagcaccuuaaaaaugaacu

SEQ ID NO: 738474 - RNA, 18 nt, Human
cugugggagccaggguag

SEQ ID NO: 738475 - RNA, 18 nt, Human
cuuagacugugggcagcc

SEQ ID NO: 738476 - RNA, 21 nt, Human
gaccacggccucacugcuucu

SEQ ID NO: 738477 - RNA, 19 nt, Human
gagcaggggcaaccucccc

SEQ ID NO: 738478 - RNA, 19 nt, Human
gaggauggggcagauggca

SEQ ID NO: 738479 - RNA, 20 nt, Human
gcaccagacccccugccaga

SEQ ID NO: 738480 - RNA, 19 nt, Human
gcagauggcagcuaagucc

SEQ ID NO: 738481 - RNA, 24 nt, Human
gcagcaccuuaaaaaugaacuuga

SEQ ID NO: 738482 - RNA, 19 nt, Human
gcaggggcaaccucccccu

SEQ ID NO: 738483 - RNA, 18 nt, Human
gccaggguaggaaguccc

SEQ ID NO: 738484 - RNA, 19 nt, Human
ggaaggguacucagacagc

SEQ ID NO: 738485 - RNA, 18 nt, Human
ggccugcagcacagcaca

SEQ ID NO: 738486 - RNA, 18 nt, Human
gggaaacugaggcacaaa

SEQ ID NO: 738487 - RNA, 19 nt, Human
gggaugccacugcccacuu

SEQ ID NO: 738488 - RNA, 20 nt, Human
gggauggauggcgcccacuu

SEQ ID NO: 738489 - RNA, 20 nt, Human
gggcagcucagagaagagug

SEQ ID NO: 738490 - RNA, 22 nt, Human
gggcccuggagauccuggugca

SEQ ID NO: 738491 - RNA, 18 nt, Human
gggcggugguucuguggu

SEQ ID NO: 738492 - RNA, 24 nt, Human
gugcagaguccccagggcagcuca

SEQ ID NO: 738493 - RNA, 24 nt, Human
uaaaaaugaacuugagauauagaa

SEQ ID NO: 738494 - RNA, 24 nt, Human
uaaggaaggcagaaccuagacaaa

SEQ ID NO: 738495 - RNA, 23 nt, Human
uaaguccacacugcagccagagg

SEQ ID NO: 738496 - RNA, 19 nt, Human
uaggaaggguacucaggug

SEQ ID NO: 738497 - RNA, 20 nt, Human
uauagaaccuucuggcacau

SEQ ID NO: 738498 - RNA, 21 nt, Human
uccaacuucgucccauccucu

SEQ ID NO: 738499 - RNA, 21 nt, Human
uccgggaagcaccagaccccc

SEQ ID NO: 738500 - RNA, 22 nt, Human
uccucuggcccuggacgcugcc

SEQ ID NO: 738501 - RNA, 30 nt, Human
uccugagccugccaagacggagcugcccuu

SEQ ID NO: 738502 - RNA, 21 nt, Human
ucucugcugccacuucaugga

SEQ ID NO: 738503 - RNA, 25 nt, Human
ucugaagcuagagcaggccgggguc

SEQ ID NO: 738504 - RNA, 20 nt, Human
ugaaccuagcagugccagaa

SEQ ID NO: 738505 - RNA, 18 nt, Human
ugccagaagagcccagcu

SEQ ID NO: 738506 - RNA, 21 nt, Human
ugccugagccaggcagcaagc

SEQ ID NO: 738507 - RNA, 20 nt, Human
uggaaggaaaagugcuucac

SEQ ID NO: 738508 - RNA, 20 nt, Human
ugggauggauggcgcccacu

SEQ ID NO: 738509 - RNA, 18 nt, Human
ugggcccuggagauccug

SEQ ID NO: 738510 - RNA, 21 nt, Human
ugguuaaggaaggcagaaccu

SEQ ID NO: 738511 - RNA, 19 nt, Human
ugucucagugggcccugga

SEQ ID NO: 738512 - RNA, 24 nt, Human
uguuucgcccuaaaggaagcccug

SEQ ID NO: 738513 - RNA, 23 nt, Human
uuaaaacaaguaucaggcagggc

SEQ ID NO: 738514 - RNA, 22 nt, Human
uucccacuuagacugugggcag

SEQ ID NO: 738515 - RNA, 24 nt, Human
uuccgcacgagaccacggccucac

SEQ ID NO: 738516 - RNA, 20 nt, Human
uuccugcccaugguuaagga

SEQ ID NO: 738517 - RNA, 23 nt, Human
aaaaaaaaaaaaaaagagaagag

SEQ ID NO: 738518 - RNA, 24 nt, Human
aaaaccagaaggaacccccgccag

SEQ ID NO: 738519 - RNA, 22 nt, Human
aaacaaacaaaaaaaacaggac

SEQ ID NO: 738520 - RNA, 23 nt, Human
aaagagaaugaggaggccaccag

SEQ ID NO: 738521 - RNA, 25 nt, Human
aacaaacaaacaaacaaaaaaaaca

SEQ ID NO: 738522 - RNA, 20 nt, Human
aacauggugaaaucccuucu

SEQ ID NO: 738523 - RNA, 20 nt, Human
aaccaacgaugagcccaucu

SEQ ID NO: 738524 - RNA, 23 nt, Human
aacucggucaacccagggugcag

SEQ ID NO: 738525 - RNA, 23 nt, Human
aagauacucuccccugggcacca

SEQ ID NO: 738526 - RNA, 23 nt, Human
aagcagcugugccuccgccccuc

SEQ ID NO: 738527 - RNA, 19 nt, Human
aaggcuggaagaagagccu

SEQ ID NO: 738528 - RNA, 21 nt, Human
aaggggaaagggccucuuaga

SEQ ID NO: 738529 - RNA, 21 nt, Human
acacgcaggguggguggacag

SEQ ID NO: 738530 - RNA, 21 nt, Human
acagagccccaaugcccagac

SEQ ID NO: 738531 - RNA, 21 nt, Human
acagcggcgggguccucacgc

SEQ ID NO: 738532 - RNA, 19 nt, Human
accacgcccaagccaauuu

SEQ ID NO: 738533 - RNA, 18 nt, Human
accagagcugcacgcagc

SEQ ID NO: 738534 - RNA, 27 nt, Human
acccaugcaccccaaggccccgagcaa

SEQ ID NO: 738535 - RNA, 18 nt, Human
accccaaggccccgagca

SEQ ID NO: 738536 - RNA, 23 nt, Human
accggaacacgggaguggaccug

SEQ ID NO: 738537 - RNA, 23 nt, Human
accucagcaccccugaguagcug

SEQ ID NO: 738538 - RNA, 20 nt, Human
accuuaggaguuugagacca

SEQ ID NO: 738539 - RNA, 25 nt, Human
acuccagccugggcagcaagaguga

SEQ ID NO: 738540 - RNA, 22 nt, Human
acucgcugggcucaagaagaca

SEQ ID NO: 738541 - RNA, 18 nt, Human
acugcacuccagccuggg

SEQ ID NO: 738542 - RNA, 21 nt, Human
acugcacuccagccugggcag

SEQ ID NO: 738543 - RNA, 24 nt, Human
acugcacuccagccugggcagcaa

SEQ ID NO: 738544 - RNA, 27 nt, Human
acugcacuccagccugggcagcaagag

SEQ ID NO: 738545 - RNA, 27 nt, Human
agaagagccugaccggccgccuagucc

SEQ ID NO: 738546 - RNA, 25 nt, Human
agacacggcccaggccccacucucc

SEQ ID NO: 738547 - RNA, 22 nt, Human
agacaggaggccggcucacaac

SEQ ID NO: 738548 - RNA, 20 nt, Human
agagcgcagucaaaagaagc

SEQ ID NO: 738549 - RNA, 24 nt, Human
agaggcuggggccuuggugggggc

SEQ ID NO: 738550 - RNA, 21 nt, Human
agcaggagucgggccccaggg

SEQ ID NO: 738551 - RNA, 24 nt, Human
agccacugcacuccagccugggca

SEQ ID NO: 738552 - RNA, 24 nt, Human
agcccggccaacauggugaaaucc

SEQ ID NO: 738553 - RNA, 21 nt, Human
agcgggggagcagguggcugu

SEQ ID NO: 738554 - RNA, 21 nt, Human
agcuuggugacaaggccacug

SEQ ID NO: 738555 - RNA, 18 nt, Human
aggagggagcgggggagc

SEQ ID NO: 738556 - RNA, 20 nt, Human
aggaguuugagaccagcccg

SEQ ID NO: 738557 - RNA, 18 nt, Human
aggcaggacgaucacuug

SEQ ID NO: 738558 - RNA, 24 nt, Human
aggcaggacgaucacuugaacccg

SEQ ID NO: 738559 - RNA, 22 nt, Human
aggcagguggaugaccuuaggg

SEQ ID NO: 738560 - RNA, 18 nt, Human
aggccgaggcagguggau

SEQ ID NO: 738561 - RNA, 24 nt, Human
aggcggagguugcagugacccgag

SEQ ID NO: 738562 - RNA, 24 nt, Human
aggcucacgccuguaaucucagca

SEQ ID NO: 738563 - RNA, 25 nt, Human
agggagcgggggagcagguggcugu

SEQ ID NO: 738564 - RNA, 21 nt, Human
agggagcugggugugaggacc

SEQ ID NO: 738565 - RNA, 23 nt, Human
aggggagggcuccucucuccaag

SEQ ID NO: 738566 - RNA, 23 nt, Human
aggggccgaggggauggccgggg

SEQ ID NO: 738567 - RNA, 22 nt, Human
agggggcaugcagacaggaggc

SEQ ID NO: 738568 - RNA, 21 nt, Human
agggguggggagcggcccugg

SEQ ID NO: 738569 - RNA, 21 nt, Human
aggugcauggggggagagagg

SEQ ID NO: 738570 - RNA, 23 nt, Human
aggugggagcagagggaggaggg

SEQ ID NO: 738571 - RNA, 23 nt, Human
aggugggccucggccacagugcu

SEQ ID NO: 738572 - RNA, 20 nt, Human
aguggaccugcugagcgucc

SEQ ID NO: 738573 - RNA, 23 nt, Human
aguggaggccagguggggcuggu

SEQ ID NO: 738574 - RNA, 18 nt, Human
aguggcucuggcgcaccu

SEQ ID NO: 738575 - RNA, 23 nt, Human
auauacaguaaaaacgaaccaac

SEQ ID NO: 738576 - RNA, 24 nt, Human
auccagcacccccacucccgccgc

SEQ ID NO: 738577 - RNA, 22 nt, Human
caaacaaacaaacaaaaaaaac

SEQ ID NO: 738578 - RNA, 26 nt, Human
caaaucagagagaacugcaagggggc

SEQ ID NO: 738579 - RNA, 24 nt, Human
caacauggugaaaucccuucucua

SEQ ID NO: 738580 - RNA, 20 nt, Human
caagcuccugccucccgcag

SEQ ID NO: 738581 - RNA, 18 nt, Human
caaggcaaagagaggagc

SEQ ID NO: 738582 - RNA, 21 nt, Human
caaggccacugaaugcuggcu

SEQ ID NO: 738583 - RNA, 22 nt, Human
caaggccacugaaugcuggcug

SEQ ID NO: 738584 - RNA, 18 nt, Human
cacaggacccuggggaac

SEQ ID NO: 738585 - RNA, 24 nt, Human
cacaggcacaagcuaccacgccca

SEQ ID NO: 738586 - RNA, 19 nt, Human
caccaggacugauggccag

SEQ ID NO: 738587 - RNA, 18 nt, Human
cacccagccaccagcccu

SEQ ID NO: 738588 - RNA, 18 nt, Human
cacccccacucccgccgc

SEQ ID NO: 738589 - RNA, 21 nt, Human
cacccugguagagggcgccuc

SEQ ID NO: 738590 - RNA, 22 nt, Human
caccucagcaccccugaguagc

SEQ ID NO: 738591 - RNA, 25 nt, Human
caccucagcaccccugaguagcugg

SEQ ID NO: 738592 - RNA, 19 nt, Human
caccuguaauccccagcua

SEQ ID NO: 738593 - RNA, 25 nt, Human
caccuguaauccccagcuacucagg

SEQ ID NO: 738594 - RNA, 24 nt, Human
cacgccuguaaucucagcacucug

SEQ ID NO: 738595 - RNA, 23 nt, Human
cacuccagccugggcagcaagag

SEQ ID NO: 738596 - RNA, 24 nt, Human
cacuccagccugggcagcaagagu

SEQ ID NO: 738597 - RNA, 25 nt, Human
cacuccagccugggcagcaagagug

SEQ ID NO: 738598 - RNA, 23 nt, Human
cacucccuuugccaucugcggcc

SEQ ID NO: 738599 - RNA, 18 nt, Human
cacugcacuccagccugg

SEQ ID NO: 738600 - RNA, 19 nt, Human
cacugcacuccagccuggg

SEQ ID NO: 738601 - RNA, 23 nt, Human
cacugcacuccagccugggcagc

SEQ ID NO: 738602 - RNA, 24 nt, Human
cacugcacuccagccugggcagca

SEQ ID NO: 738603 - RNA, 25 nt, Human
cagaagccugagacagaacaaacca

SEQ ID NO: 738604 - RNA, 21 nt, Human
cagagagcaggggagggcucc

SEQ ID NO: 738605 - RNA, 24 nt, Human
cagcacucugggaggccgaggcag

SEQ ID NO: 738606 - RNA, 26 nt, Human
cagcacucugggaggccgaggcaggu

SEQ ID NO: 738607 - RNA, 30 nt, Human
cagcagacacggcccaggccccacucuccu

SEQ ID NO: 738608 - RNA, 19 nt, Human
cagcaggcugcaugggccu

SEQ ID NO: 738609 - RNA, 22 nt, Human
cagcaggcugcaugggccucgg

SEQ ID NO: 738610 - RNA, 18 nt, Human
cagcagugggcucauggc

SEQ ID NO: 738611 - RNA, 25 nt, Human
cagcccacgagggacugugugccag

SEQ ID NO: 738612 - RNA, 18 nt, Human
cagccccucggcaaaguc

SEQ ID NO: 738613 - RNA, 20 nt, Human
cagcugugccuccgccccuc

SEQ ID NO: 738614 - RNA, 20 nt, Human
caggacccuggggaacgggg

SEQ ID NO: 738615 - RNA, 24 nt, Human
caggagccuaaggcaggacgauca

SEQ ID NO: 738616 - RNA, 21 nt, Human
caggcagagccagcggaggcc

SEQ ID NO: 738617 - RNA, 25 nt, Human
caggcagagccagcggaggccacac

SEQ ID NO: 738618 - RNA, 23 nt, Human
cagggccagcucugcgccacccc

SEQ ID NO: 738619 - RNA, 20 nt, Human
caguucucuucugcaggccu

SEQ ID NO: 738620 - RNA, 22 nt, Human
cauccagcacccccacucccgc

SEQ ID NO: 738621 - RNA, 20 nt, Human
cauccggaacaaggccaggc

SEQ ID NO: 738622 - RNA, 21 nt, Human
caugugcaggaguaugugcgu

SEQ ID NO: 738623 - RNA, 22 nt, Human
ccacagagccccaaugcccaga

SEQ ID NO: 738624 - RNA, 20 nt, Human
ccaccagguccucccuggca

SEQ ID NO: 738625 - RNA, 23 nt, Human
ccacccgcuccuaccgaucugga

SEQ ID NO: 738626 - RNA, 20 nt, Human
ccacugcacuccagccuggg

SEQ ID NO: 738627 - RNA, 21 nt, Human
ccacugcacuccagccugggc

SEQ ID NO: 738628 - RNA, 22 nt, Human
ccacugcacuccagccugggca

SEQ ID NO: 738629 - RNA, 22 nt, Human
ccacugcacuccagccugggca

SEQ ID NO: 738630 - RNA, 23 nt, Human
ccacugcacuccagccugggcag

SEQ ID NO: 738631 - RNA, 24 nt, Human
ccacugcacuccagccugggcagc

SEQ ID NO: 738632 - RNA, 20 nt, Human
ccagagccaggugagcagca

SEQ ID NO: 738633 - RNA, 21 nt, Human
ccagagccaggugagcagcag

SEQ ID NO: 738634 - RNA, 26 nt, Human
ccagaggcuggggccuuggugggggc

SEQ ID NO: 738635 - RNA, 21 nt, Human
ccaggcccacgguggccaugc

SEQ ID NO: 738636 - RNA, 22 nt, Human
ccaugcuguccacugcuggguc

SEQ ID NO: 738637 - RNA, 27 nt, Human
cccaaggccccgagcacugagggcccc

SEQ ID NO: 738638 - RNA, 19 nt, Human
cccagcaccgggcugagac

SEQ ID NO: 738639 - RNA, 23 nt, Human
cccagcagacacggcccaggccc

SEQ ID NO: 738640 - RNA, 24 nt, Human
cccagccccagccgcucagcccac

SEQ ID NO: 738641 - RNA, 22 nt, Human
cccaggagguuuaccuuuaaaa

SEQ ID NO: 738642 - RNA, 18 nt, Human
cccagggcuccgcagggg

SEQ ID NO: 738643 - RNA, 18 nt, Human
cccaggugugcugcuggc

SEQ ID NO: 738644 - RNA, 18 nt, Human
cccaugcaccccaaggcc

SEQ ID NO: 738645 - RNA, 19 nt, Human
cccaugcaccccaaggccc

SEQ ID NO: 738646 - RNA, 21 nt, Human
cccauggugaugccaggccuu

SEQ ID NO: 738647 - RNA, 22 nt, Human
ccccacugccccugaacaucug

SEQ ID NO: 738648 - RNA, 19 nt, Human
ccccagccccagccgcuca

SEQ ID NO: 738649 - RNA, 22 nt, Human
ccccagccccagccgcucagcc

SEQ ID NO: 738650 - RNA, 21 nt, Human
cccccggccaggcaccuccca

SEQ ID NO: 738651 - RNA, 24 nt, Human
cccccggccaggcaccucccagca

SEQ ID NO: 738652 - RNA, 20 nt, Human
ccccggauggcuacugcaag

SEQ ID NO: 738653 - RNA, 24 nt, Human
ccccugaguagcugggaccacagg

SEQ ID NO: 738654 - RNA, 21 nt, Human
ccccugggcaccagagggccc

SEQ ID NO: 738655 - RNA, 23 nt, Human
cccggccaacauggugaaauccc

SEQ ID NO: 738656 - RNA, 18 nt, Human
cccugggucaccaggccc

SEQ ID NO: 738657 - RNA, 22 nt, Human
cccuucucuacuaaaaauacaa

SEQ ID NO: 738658 - RNA, 22 nt, Human
ccgugccuggagccccccacug

SEQ ID NO: 738659 - RNA, 21 nt, Human
ccucaagcuccugccucccgc

SEQ ID NO: 738660 - RNA, 20 nt, Human
ccucggccaggcccagcacc

SEQ ID NO: 738661 - RNA, 24 nt, Human
ccugacacauggcucccagcagac

SEQ ID NO: 738662 - RNA, 23 nt, Human
ccugcccuugcccugguuccggu

SEQ ID NO: 738663 - RNA, 24 nt, Human
ccugggcucaagugaucuaucccc

SEQ ID NO: 738664 - RNA, 21 nt, Human
ccugugcacgagcgggagggg

SEQ ID NO: 738665 - RNA, 24 nt, Human
ccuguggccacaacagcauucacu

SEQ ID NO: 738666 - RNA, 21 nt, Human
ccuugugaugucaccaaagcc

SEQ ID NO: 738667 - RNA, 21 nt, Human
ccuuuaaaaaaacaaacaaac

SEQ ID NO: 738668 - RNA, 22 nt, Human
cgaagacccaaaaaccagaagg

SEQ ID NO: 738669 - RNA, 20 nt, Human
cgacgccgccgggcgcuguc

SEQ ID NO: 738670 - RNA, 22 nt, Human
cgagggacugugugccaggccc

SEQ ID NO: 738671 - RNA, 21 nt, Human
cgcaguggacaguggcucugg

SEQ ID NO: 738672 - RNA, 22 nt, Human
cgcccaggaggcggaccucaug

SEQ ID NO: 738673 - RNA, 23 nt, Human
cgccuguaaucucagcacucugg

SEQ ID NO: 738674 - RNA, 24 nt, Human
cgccuguaaucucagcacucuggg

SEQ ID NO: 738675 - RNA, 20 nt, Human
cgcugccgggcagaggggcc

SEQ ID NO: 738676 - RNA, 21 nt, Human
cggagcagccccucggcaaag

SEQ ID NO: 738677 - RNA, 21 nt, Human
cggcaauccucccaccucagc

SEQ ID NO: 738678 - RNA, 19 nt, Human
cggcccgaacuucacgcaa

SEQ ID NO: 738679 - RNA, 19 nt, Human
cgggccccagggcuggcag

SEQ ID NO: 738680 - RNA, 21 nt, Human
cgggguccggagcagccccuc

SEQ ID NO: 738681 - RNA, 19 nt, Human
cgucuauaccaacagagca

SEQ ID NO: 738682 - RNA, 22 nt, Human
cuaguccagauggagagaccuc

SEQ ID NO: 738683 - RNA, 23 nt, Human
cucacgccuguaaucucagcacu

SEQ ID NO: 738684 - RNA, 24 nt, Human
cucacgccuguaaucucagcacuc

SEQ ID NO: 738685 - RNA, 19 nt, Human
cuccaucucaaaaaaaaaa

SEQ ID NO: 738686 - RNA, 20 nt, Human
cuccccagcuccggcaaucc

SEQ ID NO: 738687 - RNA, 24 nt, Human
cucccccgugugugugugugugug

SEQ ID NO: 738688 - RNA, 19 nt, Human
cucccugggguucccucca

SEQ ID NO: 738689 - RNA, 23 nt, Human
cucuagcugcccagggcggcacc

SEQ ID NO: 738690 - RNA, 20 nt, Human
cucucagaguggggucagcu

SEQ ID NO: 738691 - RNA, 24 nt, Human
cucugcggcccgaacuucacgcaa

SEQ ID NO: 738692 - RNA, 19 nt, Human
cugaucuugaauuccuggg

SEQ ID NO: 738693 - RNA, 20 nt, Human
cuggcuuccuccucccuggg

SEQ ID NO: 738694 - RNA, 18 nt, Human
cuggggagccgagggcuc

SEQ ID NO: 738695 - RNA, 18 nt, Human
cugucucccugccugggc

SEQ ID NO: 738696 - RNA, 18 nt, Human
cugucucccugccugggc

SEQ ID NO: 738697 - RNA, 23 nt, Human
cuguuccagggccccucaaggcu

SEQ ID NO: 738698 - RNA, 20 nt, Human
cuugaauuccugggcucaag

SEQ ID NO: 738699 - RNA, 22 nt, Human
cuugcucugcggccugcccuuc

SEQ ID NO: 738700 - RNA, 20 nt, Human
cuugcuggccagggaggcgg

SEQ ID NO: 738701 - RNA, 18 nt, Human
gacacccagccaccagcc

SEQ ID NO: 738702 - RNA, 23 nt, Human
gacacgcaggguggguggacagg

SEQ ID NO: 738703 - RNA, 23 nt, Human
gagauugagccacugcacuccag

SEQ ID NO: 738704 - RNA, 21 nt, Human
gagcaggagucgggccccagg

SEQ ID NO: 738705 - RNA, 21 nt, Human
gagcaugugcaagugggcgug

SEQ ID NO: 738706 - RNA, 21 nt, Human
gagguugcagugacccgagau

SEQ ID NO: 738707 - RNA, 23 nt, Human
gagguugcagugacccgagauug

SEQ ID NO: 738708 - RNA, 20 nt, Human
gaguuuguuucccuuuuagg

SEQ ID NO: 738709 - RNA, 22 nt, Human
gcaaagcucuggcaccaggacu

SEQ ID NO: 738710 - RNA, 20 nt, Human
gcaagagugaaacuccaucu

SEQ ID NO: 738711 - RNA, 23 nt, Human
gcaaggcaaagagaggagccucc

SEQ ID NO: 738712 - RNA, 21 nt, Human
gcagaggacaaaaagcagcga

SEQ ID NO: 738713 - RNA, 18 nt, Human
gcaggagucgggccccag

SEQ ID NO: 738714 - RNA, 19 nt, Human
gccaaauacgcuguguccc

SEQ ID NO: 738715 - RNA, 24 nt, Human
gccaacauggugaaaucccuucuc

SEQ ID NO: 738716 - RNA, 19 nt, Human
gccaagguucuuacggcug

SEQ ID NO: 738717 - RNA, 19 nt, Human
gccacagaagccugagaca

SEQ ID NO: 738718 - RNA, 19 nt, Human
gccacugcacuccagccug

SEQ ID NO: 738719 - RNA, 22 nt, Human
gccacugcacuccagccugggc

SEQ ID NO: 738720 - RNA, 23 nt, Human
gccacugcacuccagccugggca

SEQ ID NO: 738721 - RNA, 25 nt, Human
gccagggccggaacgggagcggcga

SEQ ID NO: 738722 - RNA, 20 nt, Human
gcccggaggccguugagcgc

SEQ ID NO: 738723 - RNA, 19 nt, Human
gccgggaccccauucccca

SEQ ID NO: 738724 - RNA, 24 nt, Human
gccugacacccagccaccagcccu

SEQ ID NO: 738725 - RNA, 20 nt, Human
gccugcccuucuggcggcug

SEQ ID NO: 738726 - RNA, 21 nt, Human
gcggcacccaugcaccccaag

SEQ ID NO: 738727 - RNA, 21 nt, Human
gcgguggaugcccucugggcc

SEQ ID NO: 738728 - RNA, 19 nt, Human
gcucuggcgcaccugggcu

SEQ ID NO: 738729 - RNA, 24 nt, Human
gcugacaagggaaggagggagcgg

SEQ ID NO: 738730 - RNA, 20 nt, Human
gcuggggccuuggugggggc

SEQ ID NO: 738731 - RNA, 25 nt, Human
ggaacaugugcaggaguaugugcgu

SEQ ID NO: 738732 - RNA, 21 nt, Human
ggaaggagggagcgggggagc

SEQ ID NO: 738733 - RNA, 21 nt, Human
ggacauggcccggaccaggcc

SEQ ID NO: 738734 - RNA, 20 nt, Human
ggagccccagaggggcuggg

SEQ ID NO: 738735 - RNA, 18 nt, Human
ggagcggcgacagcggcg

SEQ ID NO: 738736 - RNA, 24 nt, Human
ggaggcucacgccuguaaucucag

SEQ ID NO: 738737 - RNA, 18 nt, Human
ggagggcacugaggccgc

SEQ ID NO: 738738 - RNA, 22 nt, Human
ggagguugcagugacccgagau

SEQ ID NO: 738739 - RNA, 24 nt, Human
ggagguugcagugacccgagauug

SEQ ID NO: 738740 - RNA, 19 nt, Human
ggaugccaaccucacaggg

SEQ ID NO: 738741 - RNA, 21 nt, Human
ggccagaggcuggggccuugg

SEQ ID NO: 738742 - RNA, 20 nt, Human
ggccucggccacagugcucg

SEQ ID NO: 738743 - RNA, 24 nt, Human
ggccugggugugcagggagcuggg

SEQ ID NO: 738744 - RNA, 25 nt, Human
ggccuugugaugucaccaaagccag

SEQ ID NO: 738745 - RNA, 21 nt, Human
ggcgacagcggcgggguccuc

SEQ ID NO: 738746 - RNA, 23 nt, Human
ggcgcggaggcucacgccuguaa

SEQ ID NO: 738747 - RNA, 18 nt, Human
ggcggcugcuguccagga

SEQ ID NO: 738748 - RNA, 23 nt, Human
ggcgucccuggggcuugggcaau

SEQ ID NO: 738749 - RNA, 20 nt, Human
ggcucacgccuguaaucuca

SEQ ID NO: 738750 - RNA, 21 nt, Human
ggcucacgccuguaaucucag

SEQ ID NO: 738751 - RNA, 21 nt, Human
ggcuggagugggccuugaccu

SEQ ID NO: 738752 - RNA, 23 nt, Human
ggcuggggccuuggugggggcgg

SEQ ID NO: 738753 - RNA, 19 nt, Human
gggaagacggggaccguag

SEQ ID NO: 738754 - RNA, 18 nt, Human
gggaaggcagaggguccc

SEQ ID NO: 738755 - RNA, 26 nt, Human
gggacgcugucagaguuuguuucccu

SEQ ID NO: 738756 - RNA, 18 nt, Human
gggccgaggggauggccg

SEQ ID NO: 738757 - RNA, 20 nt, Human
gggcggcacccaugcacccc

SEQ ID NO: 738758 - RNA, 25 nt, Human
ggggagagaggugcuuggggugggg

SEQ ID NO: 738759 - RNA, 19 nt, Human
ggggcaugcagacaggagg

SEQ ID NO: 738760 - RNA, 18 nt, Human
ggggcggggggcgggcgg

SEQ ID NO: 738761 - RNA, 18 nt, Human
ggggcggggggcgggcgg

SEQ ID NO: 738762 - RNA, 25 nt, Human
ggggcuggggccaccaaguggaggc

SEQ ID NO: 738763 - RNA, 20 nt, Human
gggucuggcgucccuggggc

SEQ ID NO: 738764 - RNA, 22 nt, Human
ggugcugucgggggccuugcuc

SEQ ID NO: 738765 - RNA, 18 nt, Human
ggugugaggaccaugcug

SEQ ID NO: 738766 - RNA, 18 nt, Human
ggugugcagggagcuggg

SEQ ID NO: 738767 - RNA, 18 nt, Human
guggagcuuggugacaag

SEQ ID NO: 738768 - RNA, 18 nt, Human
guggaggccagguggggc

SEQ ID NO: 738769 - RNA, 20 nt, Human
guggccacagggggcaugca

SEQ ID NO: 738770 - RNA, 21 nt, Human
gugugugugugugugugugug

SEQ ID NO: 738771 - RNA, 21 nt, Human
gugugugugugugugugugug

SEQ ID NO: 738772 - RNA, 18 nt, Human
guuuguuucccuuuuagg

SEQ ID NO: 738773 - RNA, 19 nt, Human
uaaggcaggacgaucacuu

SEQ ID NO: 738774 - RNA, 20 nt, Human
uaaggcaggacgaucacuug

SEQ ID NO: 738775 - RNA, 24 nt, Human
uaaggcaggacgaucacuugaacc

SEQ ID NO: 738776 - RNA, 18 nt, Human
uagcugcccagggcggca

SEQ ID NO: 738777 - RNA, 24 nt, Human
uaggguggaacucggucaacccag

SEQ ID NO: 738778 - RNA, 18 nt, Human
uaggugcgaaccacugcc

SEQ ID NO: 738779 - RNA, 22 nt, Human
uauuuuuuuuuauugagacagc

SEQ ID NO: 738780 - RNA, 19 nt, Human
ucaaaaaaaaaaaaaaaga

SEQ ID NO: 738781 - RNA, 24 nt, Human
ucacuugaacccgggaggcggagg

SEQ ID NO: 738782 - RNA, 19 nt, Human
ucagaguuuguuucccuuu

SEQ ID NO: 738783 - RNA, 21 nt, Human
ucagggcugccugacacccag

SEQ ID NO: 738784 - RNA, 23 nt, Human
uccaucucaaaaaaaaaaaaaaa

SEQ ID NO: 738785 - RNA, 25 nt, Human
ucccacagagccccaaugcccagag

SEQ ID NO: 738786 - RNA, 20 nt, Human
ucccagauccccggacaccc

SEQ ID NO: 738787 - RNA, 18 nt, Human
uccccagaugggucuggc

SEQ ID NO: 738788 - RNA, 25 nt, Human
uccccagaugggucuggcgucccug

SEQ ID NO: 738789 - RNA, 24 nt, Human
uccccagcuccggcaauccuccca

SEQ ID NO: 738790 - RNA, 19 nt, Human
uccccaggugugcugcugg

SEQ ID NO: 738791 - RNA, 27 nt, Human
ucccccgugugugugugugugugugug

SEQ ID NO: 738792 - RNA, 19 nt, Human
ucccuggggcuugggcaau

SEQ ID NO: 738793 - RNA, 21 nt, Human
ucccugggguucccuccacgg

SEQ ID NO: 738794 - RNA, 18 nt, Human
uccucccaccucagcacc

SEQ ID NO: 738795 - RNA, 18 nt, Human
uccugggcucaagugauc

SEQ ID NO: 738796 - RNA, 21 nt, Human
ucggagccugguggccacagg

SEQ ID NO: 738797 - RNA, 19 nt, Human
ucggcaaagucuggggagc

SEQ ID NO: 738798 - RNA, 18 nt, Human
ucucaggcuggagugggc

SEQ ID NO: 738799 - RNA, 22 nt, Human
ucucaggcuggagugggugggu

SEQ ID NO: 738800 - RNA, 22 nt, Human
ucucaggggagcugcuuucccg

SEQ ID NO: 738801 - RNA, 22 nt, Human
ucucccugccugggcugggacu

SEQ ID NO: 738802 - RNA, 22 nt, Human
ucucuacuaaaaauacaaaaaa

SEQ ID NO: 738803 - RNA, 22 nt, Human
ucugccuacauuuugguggcac

SEQ ID NO: 738804 - RNA, 22 nt, Human
ucugcggcccaggagguuuacc

SEQ ID NO: 738805 - RNA, 23 nt, Human
ucugggggaaggugcagcagcca

SEQ ID NO: 738806 - RNA, 23 nt, Human
ucuugggggggaugggggaugcc

SEQ ID NO: 738807 - RNA, 18 nt, Human
ugaaaggugcugacuguu

SEQ ID NO: 738808 - RNA, 20 nt, Human
ugaacaucugugaagauggu

SEQ ID NO: 738809 - RNA, 19 nt, Human
ugacacccagccaccagcc

SEQ ID NO: 738810 - RNA, 23 nt, Human
ugacccggcucaaguccacccaa

SEQ ID NO: 738811 - RNA, 19 nt, Human
ugagacagggucucaggcu

SEQ ID NO: 738812 - RNA, 24 nt, Human
ugagaccagcccggccaacauggu

SEQ ID NO: 738813 - RNA, 23 nt, Human
ugagcccuguucuagaucacacc

SEQ ID NO: 738814 - RNA, 19 nt, Human
ugagcugccccacagccga

SEQ ID NO: 738815 - RNA, 19 nt, Human
ugaggaggccaccaggucc

SEQ ID NO: 738816 - RNA, 20 nt, Human
ugagggccccagcgcagacg

SEQ ID NO: 738817 - RNA, 19 nt, Human
ugagucggcagcagugggc

SEQ ID NO: 738818 - RNA, 26 nt, Human
ugauggccagaggcuggggccuuuuc

SEQ ID NO: 738819 - RNA, 24 nt, Human
ugcacgagcgggagggguggcugg

SEQ ID NO: 738820 - RNA, 18 nt, Human
ugcagccccgagucagag

SEQ ID NO: 738821 - RNA, 21 nt, Human
ugcagggagcugggugugagg

SEQ ID NO: 738822 - RNA, 19 nt, Human
ugcagggcagcccuccaga

SEQ ID NO: 738823 - RNA, 18 nt, Human
ugcagggguggggagcgg

SEQ ID NO: 738824 - RNA, 21 nt, Human
ugcccagacuguggccugcaa

SEQ ID NO: 738825 - RNA, 18 nt, Human
ugccuccgccccucggcc

SEQ ID NO: 738826 - RNA, 24 nt, Human
ugcgaaccacugccuggacagagc

SEQ ID NO: 738827 - RNA, 21 nt, Human
ugcggacgaagacccaaaaac

SEQ ID NO: 738828 - RNA, 21 nt, Human
ugcgugagcaugugcaagugg

SEQ ID NO: 738829 - RNA, 25 nt, Human
ugcucugcggccugcccuucuggcg

SEQ ID NO: 738830 - RNA, 21 nt, Human
uggaagaagagccugaccggc

SEQ ID NO: 738831 - RNA, 20 nt, Human
uggagccccagaggggcugg

SEQ ID NO: 738832 - RNA, 19 nt, Human
uggagccccccacugcccc

SEQ ID NO: 738833 - RNA, 20 nt, Human
uggaggccagguggggcugg

SEQ ID NO: 738834 - RNA, 18 nt, Human
uggaugaccuuaggaguu

SEQ ID NO: 738835 - RNA, 21 nt, Human
uggcaggggccugccaaacag

SEQ ID NO: 738836 - RNA, 20 nt, Human
uggccacagggggcaugcag

SEQ ID NO: 738837 - RNA, 19 nt, Human
uggccagggaggcggggug

SEQ ID NO: 738838 - RNA, 18 nt, Human
uggcccagggcuccgcag

SEQ ID NO: 738839 - RNA, 19 nt, Human
uggccugggugugcaggga

SEQ ID NO: 738840 - RNA, 23 nt, Human
uggcucaggacaggggucaacag

SEQ ID NO: 738841 - RNA, 19 nt, Human
uggcugcuggaagcagcug

SEQ ID NO: 738842 - RNA, 22 nt, Human
ugggacagacgaucccagaucc

SEQ ID NO: 738843 - RNA, 24 nt, Human
ugggaccacaggcacaagcuacca

SEQ ID NO: 738844 - RNA, 18 nt, Human
ugggagcagagggaggag

SEQ ID NO: 738845 - RNA, 19 nt, Human
ugggauguggccagccacu

SEQ ID NO: 738846 - RNA, 18 nt, Human
ugggccucggcagaccag

SEQ ID NO: 738847 - RNA, 22 nt, Human
ugggccucggccacaggacccu

SEQ ID NO: 738848 - RNA, 22 nt, Human
ugggcgugcauuugugugugug

SEQ ID NO: 738849 - RNA, 19 nt, Human
ugggcucaagugaucuauc

SEQ ID NO: 738850 - RNA, 18 nt, Human
ugggcucguagccaggug

SEQ ID NO: 738851 - RNA, 22 nt, Human
ugggcugggacuguuccagggc

SEQ ID NO: 738852 - RNA, 18 nt, Human
uggggcuggugguggcga

SEQ ID NO: 738853 - RNA, 28 nt, Human
ugggucuggcgucccuggggcuugggca

SEQ ID NO: 738854 - RNA, 22 nt, Human
uggguggacaggcacuguuucc

SEQ ID NO: 738855 - RNA, 20 nt, Human
ugggugggugggugugugug

SEQ ID NO: 738856 - RNA, 24 nt, Human
uggugcagagccugggacggggcc

SEQ ID NO: 738857 - RNA, 18 nt, Human
ugguggcgaggccguggg

SEQ ID NO: 738858 - RNA, 19 nt, Human
uguaaaacacucaccuggg

SEQ ID NO: 738859 - RNA, 21 nt, Human
uguaauccccagcuacucagg

SEQ ID NO: 738860 - RNA, 21 nt, Human
ugugagcacaccaagggcccg

SEQ ID NO: 738861 - RNA, 18 nt, Human
ugugcacgagcgggaggg

SEQ ID NO: 738862 - RNA, 18 nt, Human
uguggugacgacgacuca

SEQ ID NO: 738863 - RNA, 20 nt, Human
uguguguacgugugagcgca

SEQ ID NO: 738864 - RNA, 19 nt, Human
uguguguguguacguguga

SEQ ID NO: 738865 - RNA, 18 nt, Human
ugugugugugugugugug

SEQ ID NO: 738866 - RNA, 18 nt, Human
ugugugugugugugugug

SEQ ID NO: 738867 - RNA, 18 nt, Human
ugugugugugugugugug

SEQ ID NO: 738868 - RNA, 18 nt, Human
ugugugugugugugugug

SEQ ID NO: 738869 - RNA, 18 nt, Human
ugugugugugugugugug

SEQ ID NO: 738870 - RNA, 18 nt, Human
ugugugugugugugugug

SEQ ID NO: 738871 - RNA, 21 nt, Human
ugugugugugugugugugugu

SEQ ID NO: 738872 - RNA, 21 nt, Human
ugugugugugugugugugugu

SEQ ID NO: 738873 - RNA, 21 nt, Human
ugugugugugugugugugugu

SEQ ID NO: 738874 - RNA, 21 nt, Human
ugugugugugugugugugugu

SEQ ID NO: 738875 - RNA, 21 nt, Human
ugugugugugugugugugugu

SEQ ID NO: 738876 - RNA, 22 nt, Human
ugugugugugugugugugugug

SEQ ID NO: 738877 - RNA, 22 nt, Human
ugugugugugugugugugugug

SEQ ID NO: 738878 - RNA, 25 nt, Human
uguuucccuuuuagguuucuugcuu

SEQ ID NO: 738879 - RNA, 22 nt, Human
uguuuucuacacugaucuugaa

SEQ ID NO: 738880 - RNA, 18 nt, Human
uucggaauccagggcccc

SEQ ID NO: 738881 - RNA, 24 nt, Human
uugaacccgggaggcggagguugc

SEQ ID NO: 738882 - RNA, 25 nt, Human
uugcagugacccgagauugagccac

SEQ ID NO: 738883 - RNA, 19 nt, Human
uuuguguguguguacgugu

SEQ ID NO: 738884 - RNA, 26 nt, Human
aaaaaaaaaagacaauaaagaauaau

SEQ ID NO: 738885 - RNA, 27 nt, Human
aaaaaaaaaagacaauaaagaauaaua

SEQ ID NO: 738886 - RNA, 21 nt, Human
aaaaaaccagaggaggagaug

SEQ ID NO: 738887 - RNA, 22 nt, Human
aaaaaagacaauaaagaauaau

SEQ ID NO: 738888 - RNA, 23 nt, Human
aaaaaagacaauaaagaauaaua

SEQ ID NO: 738889 - RNA, 25 nt, Human
aaaaagaaacgguuuccuggaggaa

SEQ ID NO: 738890 - RNA, 26 nt, Human
aaaaauaacagaaaacaaaaccaaaa

SEQ ID NO: 738891 - RNA, 24 nt, Human
aaaccaaaaaucauaauuuacacu

SEQ ID NO: 738892 - RNA, 23 nt, Human
aaaccuccagaaacaugccagaa

SEQ ID NO: 738893 - RNA, 19 nt, Human
aaaccugcugcuaucuucg

SEQ ID NO: 738894 - RNA, 19 nt, Human
aaaggaaaaaaaaaccaga

SEQ ID NO: 738895 - RNA, 20 nt, Human
aacaugccagaaaaucucaa

SEQ ID NO: 738896 - RNA, 24 nt, Human
aaccagcguccagugggguucgcg

SEQ ID NO: 738897 - RNA, 21 nt, Human
aacccagaagaggccgaggcu

SEQ ID NO: 738898 - RNA, 22 nt, Human
aacccucuucucucacccccac

SEQ ID NO: 738899 - RNA, 23 nt, Human
aaccuuuauuuccuuugaaaccu

SEQ ID NO: 738900 - RNA, 24 nt, Human
aaccuuuauuuccuuugaaaccuc

SEQ ID NO: 738901 - RNA, 24 nt, Human
aacuccuccccgccuggugccucc

SEQ ID NO: 738902 - RNA, 19 nt, Human
aagaacccucuucucucac

SEQ ID NO: 738903 - RNA, 21 nt, Human
aagaucguauaaaccguccug

SEQ ID NO: 738904 - RNA, 18 nt, Human
aaggaaaaaaagaaacgg

SEQ ID NO: 738905 - RNA, 26 nt, Human
aauaaagaauaauaaaaaaaaaaucc

SEQ ID NO: 738906 - RNA, 19 nt, Human
aauaacagaaaacaaaacc

SEQ ID NO: 738907 - RNA, 24 nt, Human
aauaacagaaaacaaaaccaaaaa

SEQ ID NO: 738908 - RNA, 21 nt, Human
acccucuucucucacccccac

SEQ ID NO: 738909 - RNA, 23 nt, Human
acgcugccuggggcacgcccacc

SEQ ID NO: 738910 - RNA, 18 nt, Human
agaaaaucucaagacagg

SEQ ID NO: 738911 - RNA, 22 nt, Human
agaaaccugcugugugaccucc

SEQ ID NO: 738912 - RNA, 24 nt, Human
agaaauccuuaaaaaauaacagaa

SEQ ID NO: 738913 - RNA, 26 nt, Human
agaacccucuucucucacccccaccc

SEQ ID NO: 738914 - RNA, 18 nt, Human
agaggaggagaugaaggc

SEQ ID NO: 738915 - RNA, 20 nt, Human
agaggaggagaugaaggcug

SEQ ID NO: 738916 - RNA, 19 nt, Human
agaggcagcagggccacgg

SEQ ID NO: 738917 - RNA, 19 nt, Human
aggaaaaaaaaaccagagg

SEQ ID NO: 738918 - RNA, 24 nt, Human
aggaaaaaaagaaacgguuuccug

SEQ ID NO: 738919 - RNA, 25 nt, Human
aggaaaaaaagaaacgguuuccugg

SEQ ID NO: 738920 - RNA, 20 nt, Human
aggcagcagaggucccugga

SEQ ID NO: 738921 - RNA, 18 nt, Human
aggcgcccuggucugugu

SEQ ID NO: 738922 - RNA, 24 nt, Human
agggggccagaggcugaucacagg

SEQ ID NO: 738923 - RNA, 23 nt, Human
auaaaaaaaaaauccaaaugaaa

SEQ ID NO: 738924 - RNA, 22 nt, Human
auaaauauauauauauauauau

SEQ ID NO: 738925 - RNA, 22 nt, Human
auaacagaaaacaaaaccaaaa

SEQ ID NO: 738926 - RNA, 19 nt, Human
auauauauauauauauaua

SEQ ID NO: 738927 - RNA, 19 nt, Human
auauauauauauauauaua

SEQ ID NO: 738928 - RNA, 19 nt, Human
auauauauauauauauaua

SEQ ID NO: 738929 - RNA, 19 nt, Human
auauauauauauauauaua

SEQ ID NO: 738930 - RNA, 22 nt, Human
aucuuuuucuguuugcuuuuaa

SEQ ID NO: 738931 - RNA, 21 nt, Human
caaauagaguuucucucucaa

SEQ ID NO: 738932 - RNA, 22 nt, Human
caacauaugaaaaaaaaaaccu

SEQ ID NO: 738933 - RNA, 22 nt, Human
caacucuacaugaaaaaauaaa

SEQ ID NO: 738934 - RNA, 19 nt, Human
cacaccggcaccuccgagu

SEQ ID NO: 738935 - RNA, 21 nt, Human
cacagacuguggccauacagg

SEQ ID NO: 738936 - RNA, 21 nt, Human
cacagccagaccugcuccgcc

SEQ ID NO: 738937 - RNA, 19 nt, Human
cacaguagcuggccagggc

SEQ ID NO: 738938 - RNA, 27 nt, Human
cacccauccacaccggcaccuccgagu

SEQ ID NO: 738939 - RNA, 20 nt, Human
cacccccacccauccacacc

SEQ ID NO: 738940 - RNA, 22 nt, Human
caccgggaccacagcugggcag

SEQ ID NO: 738941 - RNA, 22 nt, Human
cagagaaggggaugggggagaa

SEQ ID NO: 738942 - RNA, 20 nt, Human
cagccagaccugcuccgcca

SEQ ID NO: 738943 - RNA, 22 nt, Human
cagccagaccugcuccgccaac

SEQ ID NO: 738944 - RNA, 24 nt, Human
cagcccacaggggacacgccuugg

SEQ ID NO: 738945 - RNA, 19 nt, Human
cagcguccagugggguucg

SEQ ID NO: 738946 - RNA, 19 nt, Human
cagcucaccgggaccacag

SEQ ID NO: 738947 - RNA, 20 nt, Human
cagcuuggagggaggccuga

SEQ ID NO: 738948 - RNA, 19 nt, Human
caggagacgcgauaagaac

SEQ ID NO: 738949 - RNA, 22 nt, Human
cauaugaaaaaaaaaaccugcu

SEQ ID NO: 738950 - RNA, 24 nt, Human
caugccagaaaaucucaagacagg

SEQ ID NO: 738951 - RNA, 21 nt, Human
ccaccgccccggccuggccug

SEQ ID NO: 738952 - RNA, 24 nt, Human
ccacgcgggccucaccucucuggg

SEQ ID NO: 738953 - RNA, 21 nt, Human
ccagcccacaggggacacgcc

SEQ ID NO: 738954 - RNA, 23 nt, Human
ccagcccuguccugagggcuucg

SEQ ID NO: 738955 - RNA, 18 nt, Human
cccauccacaccggcacc

SEQ ID NO: 738956 - RNA, 18 nt, Human
ccccagagcccccuccuc

SEQ ID NO: 738957 - RNA, 19 nt, Human
cccucuggggcaugagggc

SEQ ID NO: 738958 - RNA, 24 nt, Human
cccuggucuguguccacgcgggcc

SEQ ID NO: 738959 - RNA, 23 nt, Human
ccuccagggggccagaggcugau

SEQ ID NO: 738960 - RNA, 19 nt, Human
ccucugguccucccacuga

SEQ ID NO: 738961 - RNA, 25 nt, Human
ccuggaacccagaagaggccgaggg

SEQ ID NO: 738962 - RNA, 23 nt, Human
ccuggagccgaggcgucuggaga

SEQ ID NO: 738963 - RNA, 19 nt, Human
ccuuuauuuccuuugaaac

SEQ ID NO: 738964 - RNA, 23 nt, Human
ccuuuauuuccuuugaaaccucc

SEQ ID NO: 738965 - RNA, 24 nt, Human
cggcagcugggagcugaguggagg

SEQ ID NO: 738966 - RNA, 23 nt, Human
cgggaggaggaggagagagucgg

SEQ ID NO: 738967 - RNA, 18 nt, Human
cguggugcagaaaccugc

SEQ ID NO: 738968 - RNA, 22 nt, Human
cuagcccaggugcaguggccuc

SEQ ID NO: 738969 - RNA, 23 nt, Human
cucacagccagaccugcuccgcc

SEQ ID NO: 738970 - RNA, 23 nt, Human
cucacccccacccauccacaccg

SEQ ID NO: 738971 - RNA, 23 nt, Human
cucagcuugagguuggggggaug

SEQ ID NO: 738972 - RNA, 25 nt, Human
cuccagcccuguccugagggcuucg

SEQ ID NO: 738973 - RNA, 21 nt, Human
cugacccugacucacagcccu

SEQ ID NO: 738974 - RNA, 18 nt, Human
cugauagaaaaagaucgu

SEQ ID NO: 738975 - RNA, 21 nt, Human
cuggcuccucucuccgucccc

SEQ ID NO: 738976 - RNA, 20 nt, Human
cuggugccucccaaaaaggg

SEQ ID NO: 738977 - RNA, 20 nt, Human
cuugguguugggggugaggg

SEQ ID NO: 738978 - RNA, 23 nt, Human
gaaaaaaaaaagacaauaaagaa

SEQ ID NO: 738979 - RNA, 19 nt, Human
gaagaugggaggagacaac

SEQ ID NO: 738980 - RNA, 21 nt, Human
gaaggcgggcggcggccuccc

SEQ ID NO: 738981 - RNA, 24 nt, Human
gagacaacugaaaaaaaaaaaaaa

SEQ ID NO: 738982 - RNA, 21 nt, Human
gagcauggugagggggucugg

SEQ ID NO: 738983 - RNA, 20 nt, Human
gaggaggaggagagagucgg

SEQ ID NO: 738984 - RNA, 22 nt, Human
gagggagagaggcagcagggcc

SEQ ID NO: 738985 - RNA, 20 nt, Human
gagggcccuggaugggucau

SEQ ID NO: 738986 - RNA, 21 nt, Human
gagggcccuggaugggucauc

SEQ ID NO: 738987 - RNA, 21 nt, Human
gagggcccuggaugggucauc

SEQ ID NO: 738988 - RNA, 20 nt, Human
gcagugcuccccggggagca

SEQ ID NO: 738989 - RNA, 18 nt, Human
gccccccagagaagggga

SEQ ID NO: 738990 - RNA, 19 nt, Human
gccugagaccacuucgccc

SEQ ID NO: 738991 - RNA, 25 nt, Human
gccugguuagcuggaagguggaggg

SEQ ID NO: 738992 - RNA, 18 nt, Human
gcuucgggagccccuccu

SEQ ID NO: 738993 - RNA, 21 nt, Human
ggagacgcgauaagaacccuc

SEQ ID NO: 738994 - RNA, 19 nt, Human
ggagccccuccuggaaccc

SEQ ID NO: 738995 - RNA, 23 nt, Human
ggagcgaaggcgggcggcggccu

SEQ ID NO: 738996 - RNA, 23 nt, Human
ggaggagagagucggcuccgucg

SEQ ID NO: 738997 - RNA, 21 nt, Human
ggaggaggggguuagggaggg

SEQ ID NO: 738998 - RNA, 24 nt, Human
ggaggaggggguuagggaggggau

SEQ ID NO: 738999 - RNA, 22 nt, Human
ggagggagagaggcagcagggc

SEQ ID NO: 739000 - RNA, 21 nt, Human
ggcagcgcugagguuuccucc

SEQ ID NO: 739001 - RNA, 22 nt, Human
ggccggguugccuggugcuggc

SEQ ID NO: 739002 - RNA, 18 nt, Human
ggcuccaccgccccggcc

SEQ ID NO: 739003 - RNA, 23 nt, Human
gggaaaaaaaaaagacaauaaag

SEQ ID NO: 739004 - RNA, 18 nt, Human
gggagcugaguggaggga

SEQ ID NO: 739005 - RNA, 19 nt, Human
gggauggggaaaaaaaaaa

SEQ ID NO: 739006 - RNA, 24 nt, Human
gggcaggggcagcgcugagguuuc

SEQ ID NO: 739007 - RNA, 19 nt, Human
gggcaugagggcugugcgc

SEQ ID NO: 739008 - RNA, 24 nt, Human
gggcugugcgcgcugacccugacu

SEQ ID NO: 739009 - RNA, 19 nt, Human
ggggaugggggagaagaug

SEQ ID NO: 739010 - RNA, 19 nt, Human
gggggugagggugggggca

SEQ ID NO: 739011 - RNA, 23 nt, Human
ggggugagggugggggcaggggc

SEQ ID NO: 739012 - RNA, 24 nt, Human
gggugggccccccagagaagggga

SEQ ID NO: 739013 - RNA, 18 nt, Human
ggugggggugggggacgg

SEQ ID NO: 739014 - RNA, 19 nt, Human
ggugguguuccgccgcugc

SEQ ID NO: 739015 - RNA, 21 nt, Human
guccccagagcccccuccucu

SEQ ID NO: 739016 - RNA, 21 nt, Human
guggaggggccuguggacccc

SEQ ID NO: 739017 - RNA, 23 nt, Human
guggaggggccuguggaccccua

SEQ ID NO: 739018 - RNA, 22 nt, Human
uaaaaaaaaaauccaaaugaaa

SEQ ID NO: 739019 - RNA, 24 nt, Human
uaaaaaauaacagaaaacaaaacc

SEQ ID NO: 739020 - RNA, 21 nt, Human
uaaagaaggaaaaaaagaaac

SEQ ID NO: 739021 - RNA, 18 nt, Human
uaacagaaaacaaaacca

SEQ ID NO: 739022 - RNA, 22 nt, Human
uaacagaaaacaaaaccaaaaa

SEQ ID NO: 739023 - RNA, 22 nt, Human
uaaguccccaaaaugauucgaa

SEQ ID NO: 739024 - RNA, 20 nt, Human
uagauggggacagcggggca

SEQ ID NO: 739025 - RNA, 19 nt, Human
uauauauauauauauauau

SEQ ID NO: 739026 - RNA, 19 nt, Human
uauauauauauauauauau

SEQ ID NO: 739027 - RNA, 22 nt, Human
uauugccuuuagagaaccagcg

SEQ ID NO: 739028 - RNA, 19 nt, Human
ucaagacagggauggggaa

SEQ ID NO: 739029 - RNA, 25 nt, Human
ucagggccaggucgugccgggagga

SEQ ID NO: 739030 - RNA, 23 nt, Human
uccacagacuguggccauacagg

SEQ ID NO: 739031 - RNA, 19 nt, Human
uccauggggagggcccugg

SEQ ID NO: 739032 - RNA, 21 nt, Human
uccauggggagggcccuggau

SEQ ID NO: 739033 - RNA, 19 nt, Human
ucccacugacccccagccc

SEQ ID NO: 739034 - RNA, 21 nt, Human
uccccggggagcauggugagg

SEQ ID NO: 739035 - RNA, 21 nt, Human
uccgccaacuccuccccgccu

SEQ ID NO: 739036 - RNA, 19 nt, Human
uccguccccaucagcuucg

SEQ ID NO: 739037 - RNA, 23 nt, Human
uccguguccauggggagggcccu

SEQ ID NO: 739038 - RNA, 19 nt, Human
uccuccagcccuguccuga

SEQ ID NO: 739039 - RNA, 21 nt, Human
uccuggaacccagaagaggcc

SEQ ID NO: 739040 - RNA, 21 nt, Human
ucggccccacaagccgcaacu

SEQ ID NO: 739041 - RNA, 24 nt, Human
ucggccccacaagccgcaacuuug

SEQ ID NO: 739042 - RNA, 21 nt, Human
ucggcugugugguggcuccac

SEQ ID NO: 739043 - RNA, 18 nt, Human
ucuaaggggugggggugg

SEQ ID NO: 739044 - RNA, 18 nt, Human
ucucaaauaaaucggcuc

SEQ ID NO: 739045 - RNA, 23 nt, Human
ugaaaaaaaaaaaaaaaaaggga

SEQ ID NO: 739046 - RNA, 21 nt, Human
ugagaccacuucgcccucugg

SEQ ID NO: 739047 - RNA, 19 nt, Human
ugaggccaucggaguuucc

SEQ ID NO: 739048 - RNA, 24 nt, Human
ugaggccaucggaguuuccguguc

SEQ ID NO: 739049 - RNA, 25 nt, Human
ugagggugggggcaggggcagcgcu

SEQ ID NO: 739050 - RNA, 19 nt, Human
ugcaaaggaaaaaaaaacc

SEQ ID NO: 739051 - RNA, 20 nt, Human
ugcaaaggaaaaaaaaacca

SEQ ID NO: 739052 - RNA, 23 nt, Human
ugcagaaaccugcugugugaccu

SEQ ID NO: 739053 - RNA, 23 nt, Human
ugccagaaaaucucaagacaggg

SEQ ID NO: 739054 - RNA, 21 nt, Human
ugccuggugcuggcucacagc

SEQ ID NO: 739055 - RNA, 20 nt, Human
ugcuccgccaacuccucccc

SEQ ID NO: 739056 - RNA, 24 nt, Human
ugcuuuuaaagaaggaaaaaaaga

SEQ ID NO: 739057 - RNA, 19 nt, Human
uggaacccagaagaggccg

SEQ ID NO: 739058 - RNA, 22 nt, Human
uggaccccuagcccaggugcag

SEQ ID NO: 739059 - RNA, 20 nt, Human
uggagccgaggcgucuggag

SEQ ID NO: 739060 - RNA, 23 nt, Human
uggaggaacagcgugguaccaca

SEQ ID NO: 739061 - RNA, 22 nt, Human
uggauagaacaucaaccucaaa

SEQ ID NO: 739062 - RNA, 21 nt, Human
uggcaucacaguagcuggcca

SEQ ID NO: 739063 - RNA, 20 nt, Human
uggccagggcugaggacgcu

SEQ ID NO: 739064 - RNA, 20 nt, Human
uggccugguuagcuggaagg

SEQ ID NO: 739065 - RNA, 21 nt, Human
uggccugguuagcuggaaggu

SEQ ID NO: 739066 - RNA, 19 nt, Human
uggcgccaacucuacauga

SEQ ID NO: 739067 - RNA, 22 nt, Human
ugggaggaggggguuagggagg

SEQ ID NO: 739068 - RNA, 21 nt, Human
ugggguucgcggggugcagug

SEQ ID NO: 739069 - RNA, 22 nt, Human
ugugugaccuccuggagccgag

SEQ ID NO: 739070 - RNA, 23 nt, Human
uguuccgccgcugcgacaccgac

SEQ ID NO: 739071 - RNA, 21 nt, Human
uuaaaaaauaacagaaaacaa

SEQ ID NO: 739072 - RNA, 21 nt, Human
uuccugaccccagagagaagg

SEQ ID NO: 739073 - RNA, 22 nt, Human
uugcaaaggaaaaaaaaaccag

SEQ ID NO: 739074 - RNA, 21 nt, Human
uugccucucucuauccucagg

SEQ ID NO: 739075 - RNA, 21 nt, Human
uugggggugagggugggggca

SEQ ID NO: 739076 - RNA, 26 nt, Human
aaaaaaaaaagaaauauagaaaaagg

SEQ ID NO: 739077 - RNA, 23 nt, Human
aaaaaacaacaacaacaacaaaa

SEQ ID NO: 739078 - RNA, 20 nt, Human
aaaaagcagaccaguguuuu

SEQ ID NO: 739079 - RNA, 19 nt, Human
aaaacaaagcaaaauuaaa

SEQ ID NO: 739080 - RNA, 21 nt, Human
aaaagaacagggaugaccaga

SEQ ID NO: 739081 - RNA, 24 nt, Human
aaaauaccuagcacuaacaccuuu

SEQ ID NO: 739082 - RNA, 19 nt, Human
aaacaacaacaacaacaaa

SEQ ID NO: 739083 - RNA, 21 nt, Human
aaagagccuauuccauuaggc

SEQ ID NO: 739084 - RNA, 22 nt, Human
aaccauggcuuaccucucuuug

SEQ ID NO: 739085 - RNA, 24 nt, Human
aaccucaguaaaugcuaaaaacaa

SEQ ID NO: 739086 - RNA, 19 nt, Human
aagcagaccaguguuuuga

SEQ ID NO: 739087 - RNA, 22 nt, Human
aagcagaccaguguuuugaaca

SEQ ID NO: 739088 - RNA, 21 nt, Human
aagcaguauauauucaugagg

SEQ ID NO: 739089 - RNA, 25 nt, Human
aagcauucccgccaaauaacagucc

SEQ ID NO: 739090 - RNA, 25 nt, Human
aagcauugcaaguguaacgaacccc

SEQ ID NO: 739091 - RNA, 22 nt, Human
acaaaauaaacaaguaaacuag

SEQ ID NO: 739092 - RNA, 20 nt, Human
acaacaaaaaaaaaacaccc

SEQ ID NO: 739093 - RNA, 20 nt, Human
acaacaacaacaacaaaaaa

SEQ ID NO: 739094 - RNA, 21 nt, Human
acaagaaaaaagcagaccagu

SEQ ID NO: 739095 - RNA, 24 nt, Human
accuauagugaaaagaaaaauuca

SEQ ID NO: 739096 - RNA, 22 nt, Human
agaaaaaaaaaacaacaacaac

SEQ ID NO: 739097 - RNA, 28 nt, Human
agaaaaaaaaaacaacaacaacaacaaa

SEQ ID NO: 739098 - RNA, 18 nt, Human
agaaaacuguaaaauacu

SEQ ID NO: 739099 - RNA, 22 nt, Human
agagaaaaaaaaaaaaaaagaa

SEQ ID NO: 739100 - RNA, 21 nt, Human
agaggucaagucaagaucuau

SEQ ID NO: 739101 - RNA, 22 nt, Human
agagguggucuuaaaaugucug

SEQ ID NO: 739102 - RNA, 23 nt, Human
agagguggucuuaaaaugucugu

SEQ ID NO: 739103 - RNA, 22 nt, Human
agaguugcuguaaaagacaggg

SEQ ID NO: 739104 - RNA, 23 nt, Human
agcaaucuguccaggaaaaaaaa

SEQ ID NO: 739105 - RNA, 19 nt, Human
agccuaaucuugaagaauc

SEQ ID NO: 739106 - RNA, 21 nt, Human
agccuaaucuugaagaaucau

SEQ ID NO: 739107 - RNA, 22 nt, Human
aggaaaaccuauagugaaaaga

SEQ ID NO: 739108 - RNA, 25 nt, Human
aggagaaaaaaaaaacaacaacaac

SEQ ID NO: 739109 - RNA, 23 nt, Human
agggaagcauagaaguaagacuu

SEQ ID NO: 739110 - RNA, 18 nt, Human
agggcucaaggucaggaa

SEQ ID NO: 739111 - RNA, 22 nt, Human
aggguaccuuuuugaauuaaaa

SEQ ID NO: 739112 - RNA, 19 nt, Human
auauauauauauauauaua

SEQ ID NO: 739113 - RNA, 19 nt, Human
auauauauauauauauaua

SEQ ID NO: 739114 - RNA, 19 nt, Human
auauauauauauauauaua

SEQ ID NO: 739115 - RNA, 19 nt, Human
auauauauauauauauaua

SEQ ID NO: 739116 - RNA, 19 nt, Human
auauauauauauauauaua

SEQ ID NO: 739117 - RNA, 26 nt, Human
aucagagagugucaagugagucagga

SEQ ID NO: 739118 - RNA, 24 nt, Human
aucuuaugauccauaaaacauuaa

SEQ ID NO: 739119 - RNA, 24 nt, Human
augcaauuuccugguauuuuucuu

SEQ ID NO: 739120 - RNA, 18 nt, Human
augccuaucacaauagaa

SEQ ID NO: 739121 - RNA, 19 nt, Human
auucaaugaguacucacuc

SEQ ID NO: 739122 - RNA, 21 nt, Human
caaaaaaaaaacaccucauaa

SEQ ID NO: 739123 - RNA, 25 nt, Human
caaaagagacagaaaaacuuuuuaa

SEQ ID NO: 739124 - RNA, 26 nt, Human
caaaauaaacaaguaaacuaccuaua

SEQ ID NO: 739125 - RNA, 20 nt, Human
caacaaaaaaaaaacaccuc

SEQ ID NO: 739126 - RNA, 21 nt, Human
caacaacaaaaaaaaaacacc

SEQ ID NO: 739127 - RNA, 18 nt, Human
caacucugaaauuaagca

SEQ ID NO: 739128 - RNA, 20 nt, Human
caagaguugcuguaaaagac

SEQ ID NO: 739129 - RNA, 21 nt, Human
cacaauaacaucugagacaaa

SEQ ID NO: 739130 - RNA, 19 nt, Human
caccuaaauguuguccuuc

SEQ ID NO: 739131 - RNA, 18 nt, Human
cacuggcagaauacugac

SEQ ID NO: 739132 - RNA, 23 nt, Human
cagaccaguguuuugaacauaaa

SEQ ID NO: 739133 - RNA, 22 nt, Human
cagagaaacuacaaagaaaggc

SEQ ID NO: 739134 - RNA, 27 nt, Human
cauaaauaacguucacaggagaaaaaa

SEQ ID NO: 739135 - RNA, 22 nt, Human
ccaggaaaaaaaaaaaaaaaaa

SEQ ID NO: 739136 - RNA, 23 nt, Human
cccacauacaugcuaaaugaaau

SEQ ID NO: 739137 - RNA, 22 nt, Human
ccuagcacuaacaccuuuaaaa

SEQ ID NO: 739138 - RNA, 19 nt, Human
ccuuacacagaccuuagcc

SEQ ID NO: 739139 - RNA, 19 nt, Human
cucacucucauuaaaccuc

SEQ ID NO: 739140 - RNA, 19 nt, Human
cuguaaacacagcccugga

SEQ ID NO: 739141 - RNA, 24 nt, Human
cuuaccucucuuugucccuuuaga

SEQ ID NO: 739142 - RNA, 23 nt, Human
cuuggcacuuggaaacuaguuuu

SEQ ID NO: 739143 - RNA, 21 nt, Human
cuuugugcugugacaaaaucc

SEQ ID NO: 739144 - RNA, 26 nt, Human
gagaaaaaaaaaacaacaacaacaac

SEQ ID NO: 739145 - RNA, 23 nt, Human
gagaaacuacaaagaaaggcuga

SEQ ID NO: 739146 - RNA, 19 nt, Human
gcaugaaauguuaacuucu

SEQ ID NO: 739147 - RNA, 19 nt, Human
guagggauuuaccaacaaa

SEQ ID NO: 739148 - RNA, 24 nt, Human
gugagggcucaaggucaggaaucu

SEQ ID NO: 739149 - RNA, 23 nt, Human
guggaaaacaagcuuacugcuua

SEQ ID NO: 739150 - RNA, 22 nt, Human
guguguguuuagggaacacaga

SEQ ID NO: 739151 - RNA, 26 nt, Human
guucacaggagaaaaaaaaaacaaca

SEQ ID NO: 739152 - RNA, 18 nt, Human
guuucagaaucugaacau

SEQ ID NO: 739153 - RNA, 21 nt, Human
guuugauaacaguacugucac

SEQ ID NO: 739154 - RNA, 21 nt, Human
guuuuggaguuuccgaauauu

SEQ ID NO: 739155 - RNA, 25 nt, Human
uaaaaagcauaauucuugcggauga

SEQ ID NO: 739156 - RNA, 23 nt, Human
uaaaagggacugccugcuuuuuu

SEQ ID NO: 739157 - RNA, 23 nt, Human
uaaaauaaaagauaaaaagcauu

SEQ ID NO: 739158 - RNA, 25 nt, Human
uaaauaacguucacaggagaaaaaa

SEQ ID NO: 739159 - RNA, 18 nt, Human
uaaaucccaaacaggaag

SEQ ID NO: 739160 - RNA, 22 nt, Human
uaaaucccaaacaggaaucucu

SEQ ID NO: 739161 - RNA, 28 nt, Human
uaaauccugaaaugaagaaucucaaaaa

SEQ ID NO: 739162 - RNA, 19 nt, Human
uaacgaaccccaaaugugc

SEQ ID NO: 739163 - RNA, 21 nt, Human
uaacgaaccccaaaugugcuc

SEQ ID NO: 739164 - RNA, 21 nt, Human
uaagaaaacuguaaaauacua

SEQ ID NO: 739165 - RNA, 23 nt, Human
uaauaaacaacccugauagagca

SEQ ID NO: 739166 - RNA, 23 nt, Human
uacaggaaaacaucgagauaaaa

SEQ ID NO: 739167 - RNA, 19 nt, Human
uacuuugugcugugacaaa

SEQ ID NO: 739168 - RNA, 22 nt, Human
uagaagcaggccaaacaggaag

SEQ ID NO: 739169 - RNA, 20 nt, Human
uagauauacacacaauucca

SEQ ID NO: 739170 - RNA, 23 nt, Human
uagugaaaagaaaaauucaacaa

SEQ ID NO: 739171 - RNA, 19 nt, Human
uauauauauauauauauau

SEQ ID NO: 739172 - RNA, 19 nt, Human
uauauauauauauauauau

SEQ ID NO: 739173 - RNA, 18 nt, Human
uaugcugaguuuuggagu

SEQ ID NO: 739174 - RNA, 19 nt, Human
ucaagucaagaucuaugcu

SEQ ID NO: 739175 - RNA, 20 nt, Human
ucaggaaaaugaacaaagca

SEQ ID NO: 739176 - RNA, 24 nt, Human
ucagugauucuugcuuucuguuuu

SEQ ID NO: 739177 - RNA, 20 nt, Human
uccacagugaugcacaaaga

SEQ ID NO: 739178 - RNA, 23 nt, Human
uccaggaaaaaaaaaaaaaaaaa

SEQ ID NO: 739179 - RNA, 22 nt, Human
uccaucaagacuacccagcaaa

SEQ ID NO: 739180 - RNA, 19 nt, Human
ucccuguuucccaccccaa

SEQ ID NO: 739181 - RNA, 20 nt, Human
ucuacagaaaucuccugacc

SEQ ID NO: 739182 - RNA, 21 nt, Human
ucuacagaaaucuccugacca

SEQ ID NO: 739183 - RNA, 23 nt, Human
ucuacauuuuaaaugagcauccc

SEQ ID NO: 739184 - RNA, 21 nt, Human
ucucuuggcacuuggaaacua

SEQ ID NO: 739185 - RNA, 21 nt, Human
ucugaacauugcuuucuuccc

SEQ ID NO: 739186 - RNA, 22 nt, Human
ucugaguacaaaacuuccugaa

SEQ ID NO: 739187 - RNA, 19 nt, Human
ucuguuuuguuacuguuua

SEQ ID NO: 739188 - RNA, 20 nt, Human
ucuugcuuucuguuuuguua

SEQ ID NO: 739189 - RNA, 18 nt, Human
ugaaacaccaccacuggc

SEQ ID NO: 739190 - RNA, 23 nt, Human
ugaaacaccaccacuggcagaau

SEQ ID NO: 739191 - RNA, 22 nt, Human
ugaaaugaagaaucucaaaaaa

SEQ ID NO: 739192 - RNA, 21 nt, Human
ugaacaaaaugaaacaccacc

SEQ ID NO: 739193 - RNA, 21 nt, Human
ugaacaaagcauugcaagugu

SEQ ID NO: 739194 - RNA, 19 nt, Human
ugaccagaggaaauaagua

SEQ ID NO: 739195 - RNA, 19 nt, Human
ugacuccaaucucuuggca

SEQ ID NO: 739196 - RNA, 20 nt, Human
ugacuccaaucucuuggcac

SEQ ID NO: 739197 - RNA, 22 nt, Human
ugacugugggaaucugaguaca

SEQ ID NO: 739198 - RNA, 23 nt, Human
ugagaagucaacaaaagagacag

SEQ ID NO: 739199 - RNA, 23 nt, Human
ugagaagucaacaaaagagacag

SEQ ID NO: 739200 - RNA, 19 nt, Human
ugagaaucuggcagggccu

SEQ ID NO: 739201 - RNA, 18 nt, Human
ugagagcaacugaccuag

SEQ ID NO: 739202 - RNA, 18 nt, Human
ugagggcucaaggucagg

SEQ ID NO: 739203 - RNA, 24 nt, Human
ugaucagucuugaauguuucuuga

SEQ ID NO: 739204 - RNA, 19 nt, Human
ugcugaguuuuggaguuuc

SEQ ID NO: 739205 - RNA, 22 nt, Human
uggcacaugcagaaaauuuaca

SEQ ID NO: 739206 - RNA, 22 nt, Human
uggcaggcuugcuaagaaaacu

SEQ ID NO: 739207 - RNA, 20 nt, Human
uggcauuugcaauaguuucc

SEQ ID NO: 739208 - RNA, 18 nt, Human
ugguaauucacaauaaca

SEQ ID NO: 739209 - RNA, 23 nt, Human
uguagugugagggcucaagguca

SEQ ID NO: 739210 - RNA, 21 nt, Human
uguauaguaacuauuaaaguu

SEQ ID NO: 739211 - RNA, 22 nt, Human
ugugcaaacuacgaagagguca

SEQ ID NO: 739212 - RNA, 18 nt, Human
uguuaugagaaucuggca

SEQ ID NO: 739213 - RNA, 19 nt, Human
uguucagugauucuugcuu

SEQ ID NO: 739214 - RNA, 23 nt, Human
uguucagugauucuugcuuucug

SEQ ID NO: 739215 - RNA, 20 nt, Human
uguuuuaggcugucagcuuu

SEQ ID NO: 739216 - RNA, 21 nt, Human
uuaaaccucaguaaaugcuaa

SEQ ID NO: 739217 - RNA, 18 nt, Human
uuaaauuuaagagcucau

SEQ ID NO: 739218 - RNA, 24 nt, Human
uuagaacaaucucagcagcaaugg

SEQ ID NO: 739219 - RNA, 20 nt, Human
uuccugaaaguuaacagggg

SEQ ID NO: 739220 - RNA, 19 nt, Human
uuuccacagugaugcacaa

SEQ ID NO: 739221 - RNA, 19 nt, Human
uuucucagguuaucaguuu

SEQ ID NO: 739222 - RNA, 26 nt, Human
aaaaugcuggcauuacacaggcggga

SEQ ID NO: 739223 - RNA, 19 nt, Human
aaagugcuggaauuauagg

SEQ ID NO: 739224 - RNA, 24 nt, Human
aaagugcuggaauuauaggcguga

SEQ ID NO: 739225 - RNA, 22 nt, Human
aaagugcugggaucaaggcaug

SEQ ID NO: 739226 - RNA, 21 nt, Human
aaccuugugaucugcccaccu

SEQ ID NO: 739227 - RNA, 24 nt, Human
aaccuugugaucugcccaccuugg

SEQ ID NO: 739228 - RNA, 20 nt, Human
aagacuacaagcacacacca

SEQ ID NO: 739229 - RNA, 23 nt, Human
aagacuacaagcacacaccaccg

SEQ ID NO: 739230 - RNA, 20 nt, Human
aagcacacaccaccacaccc

SEQ ID NO: 739231 - RNA, 21 nt, Human
aagcugaaguuggacaacaac

SEQ ID NO: 739232 - RNA, 21 nt, Human
aagugauccuucugucuuggc

SEQ ID NO: 739233 - RNA, 24 nt, Human
aagugauccuucugucuuggccuc

SEQ ID NO: 739234 - RNA, 24 nt, Human
aagugaucugccagccuuggccuc

SEQ ID NO: 739235 - RNA, 18 nt, Human
aauuauaggcgugagcca

SEQ ID NO: 739236 - RNA, 21 nt, Human
aauuauaggcgugagccacca

SEQ ID NO: 739237 - RNA, 22 nt, Human
aauuauaggcgugagccaccau

SEQ ID NO: 739238 - RNA, 22 nt, Human
acacggcaggagcuguagccuu

SEQ ID NO: 739239 - RNA, 24 nt, Human
accuugugaucugcccaccuuggc

SEQ ID NO: 739240 - RNA, 20 nt, Human
acggaguuucaccauauugg

SEQ ID NO: 739241 - RNA, 24 nt, Human
acggaguuucaccauauuggccag

SEQ ID NO: 739242 - RNA, 18 nt, Human
agacuacaagcacacacc

SEQ ID NO: 739243 - RNA, 22 nt, Human
agacuacaagcacacaccaccg

SEQ ID NO: 739244 - RNA, 20 nt, Human
agagcuccuugaugcagccc

SEQ ID NO: 739245 - RNA, 21 nt, Human
agcacacaccaccacacccag

SEQ ID NO: 739246 - RNA, 21 nt, Human
agccaagacuguccucuccau

SEQ ID NO: 739247 - RNA, 18 nt, Human
agccaccgcaccuggccc

SEQ ID NO: 739248 - RNA, 21 nt, Human
agcugggauuacaagcacaca

SEQ ID NO: 739249 - RNA, 19 nt, Human
aggaaggagaauggcccug

SEQ ID NO: 739250 - RNA, 20 nt, Human
aggauggggaaaggaggagu

SEQ ID NO: 739251 - RNA, 19 nt, Human
aggcacuuguagaaugaaa

SEQ ID NO: 739252 - RNA, 19 nt, Human
aggcaggagugcaguggca

SEQ ID NO: 739253 - RNA, 21 nt, Human
aggcgugagccaccaugccca

SEQ ID NO: 739254 - RNA, 25 nt, Human
aggcuggagugcagugguguaaucu

SEQ ID NO: 739255 - RNA, 19 nt, Human
aggugaaguaaaggaacaa

SEQ ID NO: 739256 - RNA, 19 nt, Human
aguagcugggauuacaagc

SEQ ID NO: 739257 - RNA, 23 nt, Human
aguauccaagacuacaagcacac

SEQ ID NO: 739258 - RNA, 24 nt, Human
agugauucucuugccucagccucc

SEQ ID NO: 739259 - RNA, 21 nt, Human
agugcaguggcacaaucacag

SEQ ID NO: 739260 - RNA, 20 nt, Human
agugcagugguguaaucucg

SEQ ID NO: 739261 - RNA, 23 nt, Human
agugcagugguguaaucucggcu

SEQ ID NO: 739262 - RNA, 24 nt, Human
agugcagugguguaaucucggcuc

SEQ ID NO: 739263 - RNA, 21 nt, Human
auaaaggucagccucuuggag

SEQ ID NO: 739264 - RNA, 18 nt, Human
auaagcagaacuguauuu

SEQ ID NO: 739265 - RNA, 24 nt, Human
aucugacuuuguugccugggcugg

SEQ ID NO: 739266 - RNA, 22 nt, Human
augcugaggaaggagaauggcc

SEQ ID NO: 739267 - RNA, 18 nt, Human
caaaaaguaaagagagcu

SEQ ID NO: 739268 - RNA, 20 nt, Human
caaaaugcuggcauuacaca

SEQ ID NO: 739269 - RNA, 27 nt, Human
caaagucacucaaguccuuaaaagccu

SEQ ID NO: 739270 - RNA, 24 nt, Human
caaagugcuggaauuauaggcgug

SEQ ID NO: 739271 - RNA, 23 nt, Human
caaagugcugggaucaaggcaug

SEQ ID NO: 739272 - RNA, 23 nt, Human
caacauaaugacagacauaggcu

SEQ ID NO: 739273 - RNA, 23 nt, Human
caaccuuuuucacuuuuugcacu

SEQ ID NO: 739274 - RNA, 23 nt, Human
caagacuguccucuccauacacu

SEQ ID NO: 739275 - RNA, 21 nt, Human
caagcacacaccaccacaccc

SEQ ID NO: 739276 - RNA, 20 nt, Human
caagugauucucuugccuca

SEQ ID NO: 739277 - RNA, 22 nt, Human
caagugauucucuugccucagc

SEQ ID NO: 739278 - RNA, 20 nt, Human
caauaauacacccacacaac

SEQ ID NO: 739279 - RNA, 23 nt, Human
cacacaccaccacacccagcuaa

SEQ ID NO: 739280 - RNA, 21 nt, Human
cacacaccaccgugccuacuu

SEQ ID NO: 739281 - RNA, 22 nt, Human
cacaggcgggagccaccgcacc

SEQ ID NO: 739282 - RNA, 24 nt, Human
caccacacccagcuaauuuuugua

SEQ ID NO: 739283 - RNA, 21 nt, Human
caccauauuggccaggcuggu

SEQ ID NO: 739284 - RNA, 24 nt, Human
caccauauuggccaggcuggucuc

SEQ ID NO: 739285 - RNA, 27 nt, Human
caccauauuggccaggcuggucuccaa

SEQ ID NO: 739286 - RNA, 18 nt, Human
caccauguugaccaggau

SEQ ID NO: 739287 - RNA, 22 nt, Human
caccauguugaccaggaugguc

SEQ ID NO: 739288 - RNA, 24 nt, Human
caccauguugaccaggauggucuc

SEQ ID NO: 739289 - RNA, 23 nt, Human
cacccacacaacuacacauccaa

SEQ ID NO: 739290 - RNA, 24 nt, Human
caccucagccuccagaguauccaa

SEQ ID NO: 739291 - RNA, 23 nt, Human
cacugccaacuugcaaaccaaca

SEQ ID NO: 739292 - RNA, 18 nt, Human
cagaacaaugucuaccga

SEQ ID NO: 739293 - RNA, 23 nt, Human
cagaacagccauuuucuccugcu

SEQ ID NO: 739294 - RNA, 22 nt, Human
cagaagagacucaggaauggca

SEQ ID NO: 739295 - RNA, 23 nt, Human
cagaauagcagagggucuggaug

SEQ ID NO: 739296 - RNA, 20 nt, Human
cagagccaagacuguccucu

SEQ ID NO: 739297 - RNA, 19 nt, Human
cagcccauaaaggucagcc

SEQ ID NO: 739298 - RNA, 20 nt, Human
cagccuccagaguauccaag

SEQ ID NO: 739299 - RNA, 20 nt, Human
cagccuccugaguagcuggg

SEQ ID NO: 739300 - RNA, 20 nt, Human
caggacucagucauagccau

SEQ ID NO: 739301 - RNA, 19 nt, Human
caguaucuauagcuagagg

SEQ ID NO: 739302 - RNA, 21 nt, Human
cagucauagccauaaccaaug

SEQ ID NO: 739303 - RNA, 23 nt, Human
cauaaccaaugcuuucccuagaa

SEQ ID NO: 739304 - RNA, 24 nt, Human
cauauuggccaggcuggucuccaa

SEQ ID NO: 739305 - RNA, 21 nt, Human
caucucaaaucacaaggccug

SEQ ID NO: 739306 - RNA, 22 nt, Human
ccaaagugcuggaauuauaggc

SEQ ID NO: 739307 - RNA, 24 nt, Human
ccaaagugcuggaauuauaggcgu

SEQ ID NO: 739308 - RNA, 23 nt, Human
ccaaagugcugggaucaaggcau

SEQ ID NO: 739309 - RNA, 23 nt, Human
ccaaagugcugggaucaaggcau

SEQ ID NO: 739310 - RNA, 21 nt, Human
ccaagacuacaagcacacacc

SEQ ID NO: 739311 - RNA, 20 nt, Human
ccaggcuggucuccaacucc

SEQ ID NO: 739312 - RNA, 21 nt, Human
cccugguucaagugauucucu

SEQ ID NO: 739313 - RNA, 19 nt, Human
ccucaaaauuacucaguua

SEQ ID NO: 739314 - RNA, 19 nt, Human
ccugaguagcugggauuac

SEQ ID NO: 739315 - RNA, 26 nt, Human
ccugaguucaagugaucugccagccu

SEQ ID NO: 739316 - RNA, 19 nt, Human
ccuggcccacugaucgccu

SEQ ID NO: 739317 - RNA, 18 nt, Human
ccuggcuuuaagugaucc

SEQ ID NO: 739318 - RNA, 18 nt, Human
ccuggcuuuaagugaucc

SEQ ID NO: 739319 - RNA, 24 nt, Human
ccuuccacagaacaaugucuaccg

SEQ ID NO: 739320 - RNA, 24 nt, Human
cggaguuucaccauauuggccagg

SEQ ID NO: 739321 - RNA, 20 nt, Human
cgggagccaccgcaccuggc

SEQ ID NO: 739322 - RNA, 24 nt, Human
cgugagccaccaugcccagccuau

SEQ ID NO: 739323 - RNA, 19 nt, Human
cuaauacaguagccaaagc

SEQ ID NO: 739324 - RNA, 23 nt, Human
cuaauuuuuguauuuuuaguaga

SEQ ID NO: 739325 - RNA, 22 nt, Human
cucacucuucuuuuugccccca

SEQ ID NO: 739326 - RNA, 25 nt, Human
cucacugcaaccucugacucccugg

SEQ ID NO: 739327 - RNA, 23 nt, Human
cucagccuccugaguagcuggga

SEQ ID NO: 739328 - RNA, 19 nt, Human
cucccugguucaagugauu

SEQ ID NO: 739329 - RNA, 20 nt, Human
cuccuaaccuugugaucugc

SEQ ID NO: 739330 - RNA, 20 nt, Human
cucucacucuucuuuuugcc

SEQ ID NO: 739331 - RNA, 19 nt, Human
cugaggaaggagaauggcc

SEQ ID NO: 739332 - RNA, 24 nt, Human
cugcaaccucugacucccugguuc

SEQ ID NO: 739333 - RNA, 19 nt, Human
cugcgccuggccucaucac

SEQ ID NO: 739334 - RNA, 19 nt, Human
cugggaucaaggcaugugc

SEQ ID NO: 739335 - RNA, 24 nt, Human
cugguucaagugauucucuugccu

SEQ ID NO: 739336 - RNA, 23 nt, Human
cugucuuggccucccaaagugcu

SEQ ID NO: 739337 - RNA, 22 nt, Human
cuuaaaagccuacugucuuuca

SEQ ID NO: 739338 - RNA, 18 nt, Human
cuuagguuuguguuugcu

SEQ ID NO: 739339 - RNA, 26 nt, Human
cuucccagcuguaauaagcccuguuu

SEQ ID NO: 739340 - RNA, 18 nt, Human
cuugaguuccuuuuaugg

SEQ ID NO: 739341 - RNA, 24 nt, Human
cuugccucagccuccugaguagcu

SEQ ID NO: 739342 - RNA, 21 nt, Human
cuuuguugccugggcuggucu

SEQ ID NO: 739343 - RNA, 18 nt, Human
gaauagcagagggucugg

SEQ ID NO: 739344 - RNA, 24 nt, Human
gaauuauaggcgugagccaccaug

SEQ ID NO: 739345 - RNA, 19 nt, Human
gacuuuguugccugggcug

SEQ ID NO: 739346 - RNA, 24 nt, Human
gaguagcugggauuacaagcacac

SEQ ID NO: 739347 - RNA, 24 nt, Human
gagugcaguggcacaaucacagcu

SEQ ID NO: 739348 - RNA, 20 nt, Human
gcaaaauuaauagaaauaaa

SEQ ID NO: 739349 - RNA, 19 nt, Human
gcacacaccaccacaccca

SEQ ID NO: 739350 - RNA, 20 nt, Human
gccacacauaguuauuaagc

SEQ ID NO: 739351 - RNA, 20 nt, Human
gccucagccuccugaguagc

SEQ ID NO: 739352 - RNA, 22 nt, Human
gccuuggccucccaaagugcug

SEQ ID NO: 739353 - RNA, 24 nt, Human
gcuuaguaacagcuggcuuaucac

SEQ ID NO: 739354 - RNA, 21 nt, Human
ggacaaugcacaauaacuccc

SEQ ID NO: 739355 - RNA, 18 nt, Human
ggagugcaguggcacaau

SEQ ID NO: 739356 - RNA, 19 nt, Human
ggcuggucuuaaacuccug

SEQ ID NO: 739357 - RNA, 19 nt, Human
ggcuuuaagugauccuucu

SEQ ID NO: 739358 - RNA, 20 nt, Human
gggcuggucuuaaacuccug

SEQ ID NO: 739359 - RNA, 20 nt, Human
ggggaaaggaggaguggcag

SEQ ID NO: 739360 - RNA, 21 nt, Human
gguucaagugauucucuugcc

SEQ ID NO: 739361 - RNA, 18 nt, Human
guagagacggaguuucac

SEQ ID NO: 739362 - RNA, 21 nt, Human
guagagauggggaucugacuu

SEQ ID NO: 739363 - RNA, 24 nt, Human
gucuugcucuguugccaggcugga

SEQ ID NO: 739364 - RNA, 19 nt, Human
gucuuggccucccaaagug

SEQ ID NO: 739365 - RNA, 24 nt, Human
gugauucucuugccucagccuccu

SEQ ID NO: 739366 - RNA, 25 nt, Human
uaaagagagcuccuugaugcagaac

SEQ ID NO: 739367 - RNA, 25 nt, Human
uaagggaaaaaaaggauggggaaag

SEQ ID NO: 739368 - RNA, 21 nt, Human
uaagguaaggccucaaaguca

SEQ ID NO: 739369 - RNA, 21 nt, Human
uaagugauccuucugucuugg

SEQ ID NO: 739370 - RNA, 20 nt, Human
uaauacacuuauuaccacca

SEQ ID NO: 739371 - RNA, 24 nt, Human
uaauuuuuguauuuuuaguagaga

SEQ ID NO: 739372 - RNA, 19 nt, Human
uaggacuaagaagaaauac

SEQ ID NO: 739373 - RNA, 24 nt, Human
uaguagagacuggcuuucaccaug

SEQ ID NO: 739374 - RNA, 21 nt, Human
uauggaaccaauagcaaaaca

SEQ ID NO: 739375 - RNA, 19 nt, Human
ucaagugauucucuugccu

SEQ ID NO: 739376 - RNA, 19 nt, Human
ucacugcaaccucugacuc

SEQ ID NO: 739377 - RNA, 24 nt, Human
ucacugcaaccucugacucccugg

SEQ ID NO: 739378 - RNA, 20 nt, Human
ucagccuccugaguagcugg

SEQ ID NO: 739379 - RNA, 18 nt, Human
ucaggaaagcugaaguug

SEQ ID NO: 739380 - RNA, 22 nt, Human
ucauuaacuuccuuuuuuuuuu

SEQ ID NO: 739381 - RNA, 23 nt, Human
uccaguagaaauuucuguaacga

SEQ ID NO: 739382 - RNA, 26 nt, Human
ucccaaaaugcuggcauuacacaggc

SEQ ID NO: 739383 - RNA, 24 nt, Human
ucccaaagugcuggaauuauaggc

SEQ ID NO: 739384 - RNA, 23 nt, Human
ucccaaagugcugggaucaaggc

SEQ ID NO: 739385 - RNA, 19 nt, Human
ucccagcuguaauaagccc

SEQ ID NO: 739386 - RNA, 21 nt, Human
ucccugguucaagugauucuc

SEQ ID NO: 739387 - RNA, 21 nt, Human
ucccugguucaagugauucuc

SEQ ID NO: 739388 - RNA, 18 nt, Human
uccugaguagcugggauu

SEQ ID NO: 739389 - RNA, 18 nt, Human
uccugaguucaagugauc

SEQ ID NO: 739390 - RNA, 18 nt, Human
ucuacaucuacauugucu

SEQ ID NO: 739391 - RNA, 21 nt, Human
ucuacauugucuaauacagua

SEQ ID NO: 739392 - RNA, 25 nt, Human
ucuacauugucuaauacaguagcca

SEQ ID NO: 739393 - RNA, 24 nt, Human
ucucacucugucaaccaggcagga

SEQ ID NO: 739394 - RNA, 18 nt, Human
ucucaggaaagcugaagu

SEQ ID NO: 739395 - RNA, 23 nt, Human
ucuccaacuccugaguucaagug

SEQ ID NO: 739396 - RNA, 18 nt, Human
ucugacuuuguugccugg

SEQ ID NO: 739397 - RNA, 24 nt, Human
ucugcccaccuuggccucccaaaa

SEQ ID NO: 739398 - RNA, 21 nt, Human
ucugucuuggccucccaaagu

SEQ ID NO: 739399 - RNA, 18 nt, Human
ucuguugccaggcuggag

SEQ ID NO: 739400 - RNA, 23 nt, Human
ucuguugccaggcuggagugcag

SEQ ID NO: 739401 - RNA, 20 nt, Human
ucuugaguuccuuuuaugga

SEQ ID NO: 739402 - RNA, 21 nt, Human
ucuugcucuguugccaggcug

SEQ ID NO: 739403 - RNA, 22 nt, Human
ucuugcucuguugccaggcugg

SEQ ID NO: 739404 - RNA, 23 nt, Human
ucuugcucuguugccaggcugga

SEQ ID NO: 739405 - RNA, 20 nt, Human
ucuuggccucccaaagugcu

SEQ ID NO: 739406 - RNA, 23 nt, Human
ugaaaacuacuaagguuucuagg

SEQ ID NO: 739407 - RNA, 21 nt, Human
ugaaauugucccccauugaga

SEQ ID NO: 739408 - RNA, 19 nt, Human
ugaacauggaucuucuuuc

SEQ ID NO: 739409 - RNA, 23 nt, Human
ugacagacauaggcugaagcagg

SEQ ID NO: 739410 - RNA, 19 nt, Human
ugacuccuaacauuaguag

SEQ ID NO: 739411 - RNA, 27 nt, Human
ugacuccuaacauuaguagcaccccuu

SEQ ID NO: 739412 - RNA, 19 nt, Human
ugaggaaggagaauggccc

SEQ ID NO: 739413 - RNA, 21 nt, Human
ugaggaaggagaauggcccug

SEQ ID NO: 739414 - RNA, 22 nt, Human
ugaggaaggagaauggcccugg

SEQ ID NO: 739415 - RNA, 18 nt, Human
ugaguucaagugaucugc

SEQ ID NO: 739416 - RNA, 22 nt, Human
ugaucugccagccuuggccucc

SEQ ID NO: 739417 - RNA, 24 nt, Human
ugaucugcccaccuuggccuccca

SEQ ID NO: 739418 - RNA, 23 nt, Human
ugcagugguguaaucucggcuca

SEQ ID NO: 739419 - RNA, 21 nt, Human
ugcauuggaggauauuuagug

SEQ ID NO: 739420 - RNA, 23 nt, Human
ugccaggcuggagugcaguggug

SEQ ID NO: 739421 - RNA, 24 nt, Human
ugccaggcuggagugcaguggugu

SEQ ID NO: 739422 - RNA, 24 nt, Human
ugccucagccuccugaguagcugg

SEQ ID NO: 739423 - RNA, 24 nt, Human
ugccugggcuggucuuaaacuccu

SEQ ID NO: 739424 - RNA, 23 nt, Human
ugcgccuggccucaucacagugu

SEQ ID NO: 739425 - RNA, 19 nt, Human
ugcugggaucaaggcaugu

SEQ ID NO: 739426 - RNA, 18 nt, Human
uggaaccaauagcaaaac

SEQ ID NO: 739427 - RNA, 19 nt, Human
uggaaccaauagcaaaaca

SEQ ID NO: 739428 - RNA, 18 nt, Human
uggaauuauaggcgugag

SEQ ID NO: 739429 - RNA, 22 nt, Human
uggaauuauaggcgugagccac

SEQ ID NO: 739430 - RNA, 24 nt, Human
uggaauuauaggcgugagccacca

SEQ ID NO: 739431 - RNA, 25 nt, Human
uggaauuauaggcgugagccaccau

SEQ ID NO: 739432 - RNA, 23 nt, Human
uggagugcagugguguaaucucg

SEQ ID NO: 739433 - RNA, 24 nt, Human
uggagugcagugguguaaucucgg

SEQ ID NO: 739434 - RNA, 18 nt, Human
uggcaacagaauagcaga

SEQ ID NO: 739435 - RNA, 20 nt, Human
uggcacaaucacagcucacu

SEQ ID NO: 739436 - RNA, 24 nt, Human
uggcacaaucacagcucacuauca

SEQ ID NO: 739437 - RNA, 24 nt, Human
uggccaggcuggucuccaacuccu

SEQ ID NO: 739438 - RNA, 18 nt, Human
uggccucccaaagugcug

SEQ ID NO: 739439 - RNA, 24 nt, Human
uggcuuuaagugauccuucugucu

SEQ ID NO: 739440 - RNA, 20 nt, Human
ugggaucaaggcaugugcca

SEQ ID NO: 739441 - RNA, 21 nt, Human
ugggauuacaagcacacacca

SEQ ID NO: 739442 - RNA, 24 nt, Human
ugggauuacaagcacacaccacca

SEQ ID NO: 739443 - RNA, 23 nt, Human
ugggcuggucuuaaacuccuggc

SEQ ID NO: 739444 - RNA, 22 nt, Human
uggggaaaggaggaguggcagu

SEQ ID NO: 739445 - RNA, 24 nt, Human
uggguagagacggaguuucaccau

SEQ ID NO: 739446 - RNA, 18 nt, Human
ugguucaagugauucucu

SEQ ID NO: 739447 - RNA, 24 nt, Human
uguucauuucagguuuccuacaug

SEQ ID NO: 739448 - RNA, 23 nt, Human
uguucuacaucuacauugucuaa

SEQ ID NO: 739449 - RNA, 24 nt, Human
uuaguagagacuggcuuucaccau

SEQ ID NO: 739450 - RNA, 20 nt, Human
uucaagugaucugccagccu

SEQ ID NO: 739451 - RNA, 23 nt, Human
uucaagugauucucuugccucag

SEQ ID NO: 739452 - RNA, 19 nt, Human
uucauccuacaucuuucua

SEQ ID NO: 739453 - RNA, 21 nt, Human
uucaucuaacagagccaagac

SEQ ID NO: 739454 - RNA, 18 nt, Human
uucccuagaaauggcucu

SEQ ID NO: 739455 - RNA, 19 nt, Human
uucucugugguagguucua

SEQ ID NO: 739456 - RNA, 22 nt, Human
uucuugaguuccuuuuauggga

SEQ ID NO: 739457 - RNA, 21 nt, Human
uugccaggcuggagugcagug

SEQ ID NO: 739458 - RNA, 24 nt, Human
uugccaggcuggagugcaguggug

SEQ ID NO: 739459 - RNA, 18 nt, Human
uuggccucccaaagugcu

SEQ ID NO: 739460 - RNA, 24 nt, Human
uuucaccauauuggccaggcuggu

SEQ ID NO: 739461 - RNA, 19 nt, Human
uuucaccauguugaccagg

SEQ ID NO: 739462 - RNA, 23 nt, Human
uuugacagaagaaugcugccacu

SEQ ID NO: 739463 - RNA, 20 nt, Human
uuuguagagauggggaucug

SEQ ID NO: 739464 - RNA, 24 nt, Human
uuuguugccugggcuggucuuaaa

SEQ ID NO: 739465 - RNA, 24 nt, Human
uuuuuaguagagacuggcuuucac

SEQ ID NO: 739466 - RNA, 18 nt, Human
uuuuuggguagagacgga

SEQ ID NO: 739467 - RNA, 20 nt, Human
uuuuuguauuuuuaguagag

SEQ ID NO: 739468 - RNA, 20 nt, Human
uuuuuuguagagauggggau

SEQ ID NO: 739469 - RNA, 26 nt, Human
aaagccuugcuuucaaguucucuaaa

SEQ ID NO: 739470 - RNA, 20 nt, Human
aaagggguaaagaaaaaagg

SEQ ID NO: 739471 - RNA, 25 nt, Human
aaagguaaaaaccugaaaacccacc

SEQ ID NO: 739472 - RNA, 21 nt, Human
aacacaggcagcucagaaaca

SEQ ID NO: 739473 - RNA, 26 nt, Human
aagcaaccuuuuggguuggugaaggc

SEQ ID NO: 739474 - RNA, 18 nt, Human
aagugccaagugcucuuc

SEQ ID NO: 739475 - RNA, 21 nt, Human
acacagggagaacacaggcag

SEQ ID NO: 739476 - RNA, 23 nt, Human
accucuuagcugggaggcuuugu

SEQ ID NO: 739477 - RNA, 20 nt, Human
acucaacaaagucucagucc

SEQ ID NO: 739478 - RNA, 21 nt, Human
agaaaaaagguaaaaaccuga

SEQ ID NO: 739479 - RNA, 24 nt, Human
agaaaaaagguaaaaaccugaaaa

SEQ ID NO: 739480 - RNA, 19 nt, Human
agaacacaggcagcucaga

SEQ ID NO: 739481 - RNA, 20 nt, Human
agaggaaaaagggaaagcga

SEQ ID NO: 739482 - RNA, 20 nt, Human
aggcaggcuuaggagucuag

SEQ ID NO: 739483 - RNA, 19 nt, Human
aguaaagggguaaagaaaa

SEQ ID NO: 739484 - RNA, 22 nt, Human
aguccuaaugaagcccaaacca

SEQ ID NO: 739485 - RNA, 19 nt, Human
auggacuguacugggaggg

SEQ ID NO: 739486 - RNA, 22 nt, Human
caaaucauuugaguaagaguuu

SEQ ID NO: 739487 - RNA, 19 nt, Human
caagucccagaaagaacuc

SEQ ID NO: 739488 - RNA, 23 nt, Human
cagaaagaacucaacaaagucuc

SEQ ID NO: 739489 - RNA, 24 nt, Human
cagaaagaacucaacaaagucuca

SEQ ID NO: 739490 - RNA, 21 nt, Human
cagacagaauuuaaaagacuc

SEQ ID NO: 739491 - RNA, 24 nt, Human
caguccuaaugaagcccaaaccaa

SEQ ID NO: 739492 - RNA, 18 nt, Human
cauaacacagcuuaaucg

SEQ ID NO: 739493 - RNA, 27 nt, Human
caugaagauaagugccaagugcucuuc

SEQ ID NO: 739494 - RNA, 24 nt, Human
ccagaaagaacucaacaaagucuc

SEQ ID NO: 739495 - RNA, 25 nt, Human
ccagaaagaacucaacaaagucuca

SEQ ID NO: 739496 - RNA, 21 nt, Human
ccagaagcucuuucugucuga

SEQ ID NO: 739497 - RNA, 19 nt, Human
ccaugaagauaagugccaa

SEQ ID NO: 739498 - RNA, 23 nt, Human
cccagaaagaacucaacaaaguc

SEQ ID NO: 739499 - RNA, 21 nt, Human
ccuggaaauuccugccaccuu

SEQ ID NO: 739500 - RNA, 24 nt, Human
cuaaaauuggagccaaugaugccu

SEQ ID NO: 739501 - RNA, 25 nt, Human
cuagucccuucucucacccacacag

SEQ ID NO: 739502 - RNA, 22 nt, Human
cuccaagucccagaaagaacuc

SEQ ID NO: 739503 - RNA, 28 nt, Human
cugccaccuuuuucucuccuucucaacc

SEQ ID NO: 739504 - RNA, 18 nt, Human
gaaaaagggaaagcgaua

SEQ ID NO: 739505 - RNA, 22 nt, Human
gaagcucuuucugucugacccu

SEQ ID NO: 739506 - RNA, 22 nt, Human
gacaaggcagcauucuugggga

SEQ ID NO: 739507 - RNA, 24 nt, Human
gagaacacaggcagcucagaaaca

SEQ ID NO: 739508 - RNA, 22 nt, Human
gagcgcugggaauguucagagc

SEQ ID NO: 739509 - RNA, 24 nt, Human
gauuuuauuagacuaguaguuuua

SEQ ID NO: 739510 - RNA, 18 nt, Human
gggaauguucagagccug

SEQ ID NO: 739511 - RNA, 21 nt, Human
guaaaaaccugaaaacccacc

SEQ ID NO: 739512 - RNA, 18 nt, Human
gugcauuuuaaaaaagac

SEQ ID NO: 739513 - RNA, 21 nt, Human
guucaaccaagccuucugauu

SEQ ID NO: 739514 - RNA, 25 nt, Human
uaaaaaccugaaaacccaccauaac

SEQ ID NO: 739515 - RNA, 24 nt, Human
uaaauacauacauacuucugcaca

SEQ ID NO: 739516 - RNA, 23 nt, Human
uaaugaagcccaaaccaagugac

SEQ ID NO: 739517 - RNA, 24 nt, Human
uaguaggcagacagaauuuaaaag

SEQ ID NO: 739518 - RNA, 19 nt, Human
uauaaggacacaagucaac

SEQ ID NO: 739519 - RNA, 26 nt, Human
ucaguccuaaugaagcccaaaccaag

SEQ ID NO: 739520 - RNA, 25 nt, Human
uccacagacaaggcagcauucuugg

SEQ ID NO: 739521 - RNA, 21 nt, Human
uccacucuccaagucccagaa

SEQ ID NO: 739522 - RNA, 19 nt, Human
ucccagaagcucuuucugu

SEQ ID NO: 739523 - RNA, 22 nt, Human
uccuaaugaagcccaaaccaag

SEQ ID NO: 739524 - RNA, 19 nt, Human
ucgcuaggccagcucaacu

SEQ ID NO: 739525 - RNA, 26 nt, Human
ugaauaucauccacucuccaaguccc

SEQ ID NO: 739526 - RNA, 22 nt, Human
uggaaauuuuacaacauaccau

SEQ ID NO: 739527 - RNA, 21 nt, Human
ugggaggggcggagggagagg

SEQ ID NO: 739528 - RNA, 26 nt, Human
uggguuggugaaggcaagagaguucu

SEQ ID NO: 739529 - RNA, 18 nt, Human
uuaaaacuaguaggcaga

SEQ ID NO: 739530 - RNA, 20 nt, Human
uucugauucugccucuagac

SEQ ID NO: 739531 - RNA, 18 nt, Human
uucuguaaagggccauau

SEQ ID NO: 739532 - RNA, 19 nt, Human
uuggaggaagguaaaguga

SEQ ID NO: 739533 - RNA, 21 nt, Human
aaagcccaacccccagggcuc

SEQ ID NO: 739534 - RNA, 18 nt, Human
aaagucuuuccaucacau

SEQ ID NO: 739535 - RNA, 24 nt, Human
aacaagggggugccgagaaaggga

SEQ ID NO: 739536 - RNA, 22 nt, Human
aacacacacacagggacacaca

SEQ ID NO: 739537 - RNA, 23 nt, Human
aaccccgcaaagaauucacugcc

SEQ ID NO: 739538 - RNA, 22 nt, Human
aagacccuacuccuauucccac

SEQ ID NO: 739539 - RNA, 18 nt, Human
aagcagaaagaggcuggg

SEQ ID NO: 739540 - RNA, 20 nt, Human
acacacucacaaccaggcca

SEQ ID NO: 739541 - RNA, 20 nt, Human
acaccccuauccaaaaauug

SEQ ID NO: 739542 - RNA, 22 nt, Human
acccggugcaggcccccucagg

SEQ ID NO: 739543 - RNA, 25 nt, Human
acccuacuccuauucccaccacccc

SEQ ID NO: 739544 - RNA, 20 nt, Human
acccucucaacucuuugcug

SEQ ID NO: 739545 - RNA, 25 nt, Human
accgcucugccccucaguguccccu

SEQ ID NO: 739546 - RNA, 22 nt, Human
accgugaagcccucugaguccu

SEQ ID NO: 739547 - RNA, 20 nt, Human
accuuauggcacugcacguc

SEQ ID NO: 739548 - RNA, 27 nt, Human
acucacccugcccuccuccuauucccu

SEQ ID NO: 739549 - RNA, 20 nt, Human
acuugggaaugggggcugcc

SEQ ID NO: 739550 - RNA, 20 nt, Human
agagaaauacaccccuaucc

SEQ ID NO: 739551 - RNA, 24 nt, Human
agagaaauacaccccuauccaaaa

SEQ ID NO: 739552 - RNA, 26 nt, Human
agagaccuggugaggaccacccagaa

SEQ ID NO: 739553 - RNA, 21 nt, Human
agagagaacuugggaaugggg

SEQ ID NO: 739554 - RNA, 19 nt, Human
agagagauggaggggaggg

SEQ ID NO: 739555 - RNA, 19 nt, Human
agagaggucuggagcccag

SEQ ID NO: 739556 - RNA, 18 nt, Human
agauggaggggaggggac

SEQ ID NO: 739557 - RNA, 23 nt, Human
agcacagagagcaucacuagaca

SEQ ID NO: 739558 - RNA, 20 nt, Human
agcccaacccccagggcucc

SEQ ID NO: 739559 - RNA, 19 nt, Human
aggaaacgggggucugggg

SEQ ID NO: 739560 - RNA, 19 nt, Human
aggaaacgggggucugggg

SEQ ID NO: 739561 - RNA, 18 nt, Human
aggaccacccagaagggc

SEQ ID NO: 739562 - RNA, 22 nt, Human
aggagggagagaggucuggagc

SEQ ID NO: 739563 - RNA, 26 nt, Human
aggccugaguccaagagaucuuguug

SEQ ID NO: 739564 - RNA, 20 nt, Human
aggcugggauaaaagagaga

SEQ ID NO: 739565 - RNA, 21 nt, Human
agggaggaaccuggucacagc

SEQ ID NO: 739566 - RNA, 21 nt, Human
agggagggagagcacuguagg

SEQ ID NO: 739567 - RNA, 19 nt, Human
agggccccaagagaagcag

SEQ ID NO: 739568 - RNA, 24 nt, Human
auccaacucuccccccgcccccaa

SEQ ID NO: 739569 - RNA, 18 nt, Human
aucccaaccucaugggcu

SEQ ID NO: 739570 - RNA, 18 nt, Human
caacagggaaccaaccuc

SEQ ID NO: 739571 - RNA, 24 nt, Human
caacaguagcagcccaggccucca

SEQ ID NO: 739572 - RNA, 25 nt, Human
caacaguagcagcccaggccuccag

SEQ ID NO: 739573 - RNA, 18 nt, Human
caacccccagggcuccau

SEQ ID NO: 739574 - RNA, 26 nt, Human
caaggauccugcgccugccgaacccc

SEQ ID NO: 739575 - RNA, 18 nt, Human
cacacacucacaaccagg

SEQ ID NO: 739576 - RNA, 18 nt, Human
caccaccccagccaaguc

SEQ ID NO: 739577 - RNA, 19 nt, Human
caccaccuaggauugcccc

SEQ ID NO: 739578 - RNA, 21 nt, Human
caccaccuaggauugccccca

SEQ ID NO: 739579 - RNA, 18 nt, Human
cacccagcucagagaccu

SEQ ID NO: 739580 - RNA, 19 nt, Human
caccgcucugccccucagu

SEQ ID NO: 739581 - RNA, 20 nt, Human
caccuugccccccaaaaccg

SEQ ID NO: 739582 - RNA, 20 nt, Human
cacucacaaccaggccaggc

SEQ ID NO: 739583 - RNA, 21 nt, Human
cacucacccugcccuccuccu

SEQ ID NO: 739584 - RNA, 20 nt, Human
cacucauguuuuuguggggg

SEQ ID NO: 739585 - RNA, 23 nt, Human
caggaaccucucaggucagccuu

SEQ ID NO: 739586 - RNA, 22 nt, Human
caggccuccagaaggacugggg

SEQ ID NO: 739587 - RNA, 21 nt, Human
caggcuccauggccuaggagg

SEQ ID NO: 739588 - RNA, 22 nt, Human
caguagguggcaggccugcccu

SEQ ID NO: 739589 - RNA, 19 nt, Human
cagugcaccaaaggucaag

SEQ ID NO: 739590 - RNA, 22 nt, Human
caguuucagcaaacccggugca

SEQ ID NO: 739591 - RNA, 18 nt, Human
caugugccucacucucgc

SEQ ID NO: 739592 - RNA, 18 nt, Human
ccaacaagggggugccga

SEQ ID NO: 739593 - RNA, 24 nt, Human
ccaacucuccccccgcccccaaaa

SEQ ID NO: 739594 - RNA, 23 nt, Human
ccacaggugggaggggggagggg

SEQ ID NO: 739595 - RNA, 20 nt, Human
ccacucacccugcccuccuc

SEQ ID NO: 739596 - RNA, 20 nt, Human
ccacucacccugcccuccuc

SEQ ID NO: 739597 - RNA, 19 nt, Human
ccagcucucuccaccuugc

SEQ ID NO: 739598 - RNA, 24 nt, Human
cccaccaccccagccaagucaacc

SEQ ID NO: 739599 - RNA, 20 nt, Human
cccagcucagagaccuggug

SEQ ID NO: 739600 - RNA, 19 nt, Human
ccccaaaacaagggccucc

SEQ ID NO: 739601 - RNA, 20 nt, Human
ccccaaaacaagggccuccg

SEQ ID NO: 739602 - RNA, 21 nt, Human
ccccaaaacucagucuugggg

SEQ ID NO: 739603 - RNA, 21 nt, Human
ccccacucacccugcccuccu

SEQ ID NO: 739604 - RNA, 18 nt, Human
ccccagggcuccaugcac

SEQ ID NO: 739605 - RNA, 21 nt, Human
cccccacucacccugcccucc

SEQ ID NO: 739606 - RNA, 19 nt, Human
cccccagcguugcucagcu

SEQ ID NO: 739607 - RNA, 20 nt, Human
ccccgaggcggcgagcgccu

SEQ ID NO: 739608 - RNA, 19 nt, Human
ccccucccgcaacacacac

SEQ ID NO: 739609 - RNA, 21 nt, Human
cccggcaccgcucugccccuc

SEQ ID NO: 739610 - RNA, 21 nt, Human
cccucaggcuccauggccuag

SEQ ID NO: 739611 - RNA, 20 nt, Human
cccucaguguccccuucccu

SEQ ID NO: 739612 - RNA, 18 nt, Human
ccgcagaggucccagggc

SEQ ID NO: 739613 - RNA, 18 nt, Human
ccgcgugccaggcgcccc

SEQ ID NO: 739614 - RNA, 23 nt, Human
ccgcucccuguggaccuugaccc

SEQ ID NO: 739615 - RNA, 24 nt, Human
ccgcugcagggugcgcggccccaa

SEQ ID NO: 739616 - RNA, 21 nt, Human
ccucagggcgccaggaaccuc

SEQ ID NO: 739617 - RNA, 23 nt, Human
ccucaugccaggccuacccuggg

SEQ ID NO: 739618 - RNA, 22 nt, Human
ccuccgaggcccggucugcagg

SEQ ID NO: 739619 - RNA, 19 nt, Human
ccuccuauucccuccuuuu

SEQ ID NO: 739620 - RNA, 24 nt, Human
ccuccuauucccuccuuuuagggg

SEQ ID NO: 739621 - RNA, 20 nt, Human
ccucugaguccuucuguggg

SEQ ID NO: 739622 - RNA, 21 nt, Human
ccucugaguccuucugugggu

SEQ ID NO: 739623 - RNA, 21 nt, Human
ccucugcgaaaugggaggaau

SEQ ID NO: 739624 - RNA, 18 nt, Human
ccugcgggauccuggcca

SEQ ID NO: 739625 - RNA, 24 nt, Human
ccugggaagacagggcccccuucc

SEQ ID NO: 739626 - RNA, 22 nt, Human
ccuggugaggaccacccagaag

SEQ ID NO: 739627 - RNA, 22 nt, Human
cggucugcaggggccaugugcc

SEQ ID NO: 739628 - RNA, 26 nt, Human
cgucccccucccccaaggccggccca

SEQ ID NO: 739629 - RNA, 23 nt, Human
cuacaauggguacaaaaaguucc

SEQ ID NO: 739630 - RNA, 21 nt, Human
cuauccaaaaauugagggugg

SEQ ID NO: 739631 - RNA, 19 nt, Human
cucacaaccaggccaggcu

SEQ ID NO: 739632 - RNA, 23 nt, Human
cuccagaaggacuggggcaccuu

SEQ ID NO: 739633 - RNA, 19 nt, Human
cucccccaaggccggccca

SEQ ID NO: 739634 - RNA, 23 nt, Human
cucccugccccuguggccuaggc

SEQ ID NO: 739635 - RNA, 19 nt, Human
cuccgccaugagcuuccca

SEQ ID NO: 739636 - RNA, 21 nt, Human
cucuccccccgcccccaaaaa

SEQ ID NO: 739637 - RNA, 24 nt, Human
cucucuccaccuugccccccaaaa

SEQ ID NO: 739638 - RNA, 18 nt, Human
cugaccucagaaacuggg

SEQ ID NO: 739639 - RNA, 21 nt, Human
cugcaaccccagaauuuuggg

SEQ ID NO: 739640 - RNA, 25 nt, Human
cugcaaccccagaauuuugggguuc

SEQ ID NO: 739641 - RNA, 22 nt, Human
cugcaguagguggcaggccugc

SEQ ID NO: 739642 - RNA, 22 nt, Human
cugcccuccuccuauucccucc

SEQ ID NO: 739643 - RNA, 18 nt, Human
cugcgccugccgaacccc

SEQ ID NO: 739644 - RNA, 21 nt, Human
cugggacccuccgaggcccgg

SEQ ID NO: 739645 - RNA, 22 nt, Human
cuguugcccugcgggauccugg

SEQ ID NO: 739646 - RNA, 22 nt, Human
cuuccagccccaguccuccccu

SEQ ID NO: 739647 - RNA, 19 nt, Human
cuucccagcccccuaaccu

SEQ ID NO: 739648 - RNA, 23 nt, Human
cuucccggauuacuacccucucc

SEQ ID NO: 739649 - RNA, 21 nt, Human
cuugggggugggaggaagaga

SEQ ID NO: 739650 - RNA, 24 nt, Human
gaaauacaccccuauccaaaaauu

SEQ ID NO: 739651 - RNA, 23 nt, Human
gaauccaacagggaaccaaccuc

SEQ ID NO: 739652 - RNA, 19 nt, Human
gacccuacuccuauuccca

SEQ ID NO: 739653 - RNA, 20 nt, Human
gacccuacuccuauucccac

SEQ ID NO: 739654 - RNA, 18 nt, Human
gacgcaguggcgccagcu

SEQ ID NO: 739655 - RNA, 21 nt, Human
gagcaugaaagcagaaagagg

SEQ ID NO: 739656 - RNA, 21 nt, Human
gaggaagagagugaaaaagag

SEQ ID NO: 739657 - RNA, 18 nt, Human
gaggcugggggaauagag

SEQ ID NO: 739658 - RNA, 22 nt, Human
gcaggugcugagccaccucagg

SEQ ID NO: 739659 - RNA, 20 nt, Human
gcaguggucgccaggauggc

SEQ ID NO: 739660 - RNA, 25 nt, Human
gccagcucucuccaccuugcccccc

SEQ ID NO: 739661 - RNA, 22 nt, Human
gcccccaaaacaagggccuccg

SEQ ID NO: 739662 - RNA, 19 nt, Human
gccgcaccggggcccuggg

SEQ ID NO: 739663 - RNA, 21 nt, Human
gcgcggccccaaggauccugc

SEQ ID NO: 739664 - RNA, 21 nt, Human
gcggccccaaggauccugcgc

SEQ ID NO: 739665 - RNA, 20 nt, Human
ggaaaugggguuggaagggg

SEQ ID NO: 739666 - RNA, 22 nt, Human
ggaagagagauggaggggaggg

SEQ ID NO: 739667 - RNA, 25 nt, Human
ggaagugggcagugcaccaaagguc

SEQ ID NO: 739668 - RNA, 20 nt, Human
ggacacacacucacaaccag

SEQ ID NO: 739669 - RNA, 20 nt, Human
ggacgggggccgcggcugca

SEQ ID NO: 739670 - RNA, 22 nt, Human
ggagagaggucuggagcccagg

SEQ ID NO: 739671 - RNA, 20 nt, Human
ggagagugccugagaggcag

SEQ ID NO: 739672 - RNA, 21 nt, Human
ggaggaggcuggucaggggcu

SEQ ID NO: 739673 - RNA, 22 nt, Human
ggaggggacacuggggacucug

SEQ ID NO: 739674 - RNA, 21 nt, Human
ggaggggaggggacacugggg

SEQ ID NO: 739675 - RNA, 23 nt, Human
ggaggggggaggggaggggaggg

SEQ ID NO: 739676 - RNA, 26 nt, Human
ggaggggggaggggaggggaggggcc

SEQ ID NO: 739677 - RNA, 24 nt, Human
ggaggugagcacagagagcaucac

SEQ ID NO: 739678 - RNA, 20 nt, Human
ggcaacgcuucccaagaaca

SEQ ID NO: 739679 - RNA, 18 nt, Human
ggcccgaaccagcugcgc

SEQ ID NO: 739680 - RNA, 23 nt, Human
ggcucugucaguuucagcaaacc

SEQ ID NO: 739681 - RNA, 18 nt, Human
gggaaaugggguuggaag

SEQ ID NO: 739682 - RNA, 18 nt, Human
gggaggggccgcugcagg

SEQ ID NO: 739683 - RNA, 20 nt, Human
gggcgaggagagugccugag

SEQ ID NO: 739684 - RNA, 19 nt, Human
ggggaauagagugcgggaa

SEQ ID NO: 739685 - RNA, 19 nt, Human
ggggaggggacacugggga

SEQ ID NO: 739686 - RNA, 20 nt, Human
ggggaggggaggggaggggc

SEQ ID NO: 739687 - RNA, 22 nt, Human
ggggaggggccgcugcagggug

SEQ ID NO: 739688 - RNA, 21 nt, Human
gggggugggaggaagagagug

SEQ ID NO: 739689 - RNA, 21 nt, Human
ggggucugggggagggugggu

SEQ ID NO: 739690 - RNA, 19 nt, Human
ggguagagccgagaagccg

SEQ ID NO: 739691 - RNA, 20 nt, Human
ggugaggguagagccgagaa

SEQ ID NO: 739692 - RNA, 23 nt, Human
guccaagugggcugccacggggg

SEQ ID NO: 739693 - RNA, 22 nt, Human
gucugggggaggguggguaggc

SEQ ID NO: 739694 - RNA, 24 nt, Human
guuucagcaaacccggugcaggcc

SEQ ID NO: 739695 - RNA, 23 nt, Human
uaaacuucugccuuagccccacc

SEQ ID NO: 739696 - RNA, 21 nt, Human
uacagugaggggugaauggaa

SEQ ID NO: 739697 - RNA, 21 nt, Human
uaccugaauccaacagggaac

SEQ ID NO: 739698 - RNA, 18 nt, Human
uaggaagaugaugugcug

SEQ ID NO: 739699 - RNA, 24 nt, Human
uaggagggagagaggucuggagcc

SEQ ID NO: 739700 - RNA, 22 nt, Human
uagguaagacccuacuccuauu

SEQ ID NO: 739701 - RNA, 22 nt, Human
uaguugccagcucucuccaccu

SEQ ID NO: 739702 - RNA, 18 nt, Human
uauggggucuauggggaa

SEQ ID NO: 739703 - RNA, 18 nt, Human
ucacuagacacagggugg

SEQ ID NO: 739704 - RNA, 19 nt, Human
ucacugccaccaggaagac

SEQ ID NO: 739705 - RNA, 27 nt, Human
ucacugccaccaggaagacuucccgga

SEQ ID NO: 739706 - RNA, 21 nt, Human
ucagcaaacccggugcaggcc

SEQ ID NO: 739707 - RNA, 22 nt, Human
ucagucuugggggugggaggaa

SEQ ID NO: 739708 - RNA, 25 nt, Human
ucagugacccucucaacucuuugcu

SEQ ID NO: 739709 - RNA, 22 nt, Human
uccaaaaauugagggugggggu

SEQ ID NO: 739710 - RNA, 22 nt, Human
uccaacucuccccccgccccca

SEQ ID NO: 739711 - RNA, 21 nt, Human
uccaaggugaaggaauaaggc

SEQ ID NO: 739712 - RNA, 21 nt, Human
uccaugcacauagcccccagc

SEQ ID NO: 739713 - RNA, 22 nt, Human
uccaugcacauagcccccagcg

SEQ ID NO: 739714 - RNA, 20 nt, Human
ucccaggcucagugacccuc

SEQ ID NO: 739715 - RNA, 22 nt, Human
ucccucgcggauggacgggggc

SEQ ID NO: 739716 - RNA, 23 nt, Human
ucccugccccuguggccuaggcc

SEQ ID NO: 739717 - RNA, 24 nt, Human
ucccugggugcuggacuuccagcc

SEQ ID NO: 739718 - RNA, 22 nt, Human
uccgccaugagcuucccaggcu

SEQ ID NO: 739719 - RNA, 23 nt, Human
uccuaaacuucugccuuagcccc

SEQ ID NO: 739720 - RNA, 21 nt, Human
uccugccaaucugcccaggga

SEQ ID NO: 739721 - RNA, 24 nt, Human
uccugcgccugccgaaccccgcaa

SEQ ID NO: 739722 - RNA, 20 nt, Human
ucuagggcagguacagugag

SEQ ID NO: 739723 - RNA, 23 nt, Human
ucuagggcagguacagugagggg

SEQ ID NO: 739724 - RNA, 21 nt, Human
ucucagggccugcguuuccca

SEQ ID NO: 739725 - RNA, 19 nt, Human
ucucaggucagccuuguuc

SEQ ID NO: 739726 - RNA, 19 nt, Human
ucugggggaggguggguag

SEQ ID NO: 739727 - RNA, 21 nt, Human
ucugggggaggguggguaggc

SEQ ID NO: 739728 - RNA, 18 nt, Human
ugaaaaagagagagauau

SEQ ID NO: 739729 - RNA, 19 nt, Human
ugaaagcagaaagaggcug

SEQ ID NO: 739730 - RNA, 18 nt, Human
ugaauccaacagggaacc

SEQ ID NO: 739731 - RNA, 19 nt, Human
ugaauggaaugggcagugg

SEQ ID NO: 739732 - RNA, 21 nt, Human
ugaggaaacgggggucugggg

SEQ ID NO: 739733 - RNA, 22 nt, Human
ugaggaaacgggggucuggggg

SEQ ID NO: 739734 - RNA, 20 nt, Human
ugcaguagguggcaggccug

SEQ ID NO: 739735 - RNA, 19 nt, Human
ugcagucagggcagaagug

SEQ ID NO: 739736 - RNA, 24 nt, Human
ugcagucagggcagaaguggaagc

SEQ ID NO: 739737 - RNA, 23 nt, Human
ugccaccaggaagacuucccgga

SEQ ID NO: 739738 - RNA, 22 nt, Human
ugccacgggggcagugcuggag

SEQ ID NO: 739739 - RNA, 20 nt, Human
ugcccccacucacccugccc

SEQ ID NO: 739740 - RNA, 20 nt, Human
ugcccccacucacccugccc

SEQ ID NO: 739741 - RNA, 24 nt, Human
ugccgagaaagggagcaugacucc

SEQ ID NO: 739742 - RNA, 20 nt, Human
ugcgcgacuuuggaggggcc

SEQ ID NO: 739743 - RNA, 23 nt, Human
ugcuggacuuccagccccagucc

SEQ ID NO: 739744 - RNA, 23 nt, Human
ugcuuuucccuuccugucuuggg

SEQ ID NO: 739745 - RNA, 18 nt, Human
uggaagaaaaggugagac

SEQ ID NO: 739746 - RNA, 20 nt, Human
uggaagaaaaggugagacuu

SEQ ID NO: 739747 - RNA, 25 nt, Human
uggaagaaaaggugagacuuugggg

SEQ ID NO: 739748 - RNA, 18 nt, Human
uggaaggggagagcagua

SEQ ID NO: 739749 - RNA, 20 nt, Human
uggaccuugacccugcucag

SEQ ID NO: 739750 - RNA, 18 nt, Human
uggcugaggccggggcag

SEQ ID NO: 739751 - RNA, 19 nt, Human
ugggaaaggaaaacaaaaa

SEQ ID NO: 739752 - RNA, 21 nt, Human
ugggaagugggcagugcaccc

SEQ ID NO: 739753 - RNA, 21 nt, Human
ugggaaugggggcugccuguu

SEQ ID NO: 739754 - RNA, 21 nt, Human
ugggacccuaauaucccaacc

SEQ ID NO: 739755 - RNA, 19 nt, Human
ugggacccuccgaggcccg

SEQ ID NO: 739756 - RNA, 23 nt, Human
ugggcaguggucgccaggauggc

SEQ ID NO: 739757 - RNA, 19 nt, Human
ugggcuggggaaauggggu

SEQ ID NO: 739758 - RNA, 20 nt, Human
uggggaaaugggguuggaaa

SEQ ID NO: 739759 - RNA, 23 nt, Human
ugggggaggggcugggcagguag

SEQ ID NO: 739760 - RNA, 19 nt, Human
ugggggaggguggguaggc

SEQ ID NO: 739761 - RNA, 24 nt, Human
ugguagagauauauauuuauauau

SEQ ID NO: 739762 - RNA, 18 nt, Human
ugguuggacgucccaaag

SEQ ID NO: 739763 - RNA, 18 nt, Human
uguccugccaaucugccc

SEQ ID NO: 739764 - RNA, 21 nt, Human
ugugcagaggguuagaggcca

SEQ ID NO: 739765 - RNA, 21 nt, Human
ugugguuggacgucccaaagc

SEQ ID NO: 739766 - RNA, 22 nt, Human
uguugggggaggggcugggcag

SEQ ID NO: 739767 - RNA, 20 nt, Human
uguugggggaggggcugggg

SEQ ID NO: 739768 - RNA, 20 nt, Human
uuagggggguccaagugggc

SEQ ID NO: 739769 - RNA, 27 nt, Human
uucccaccaccccagccaagucaaccc

SEQ ID NO: 739770 - RNA, 24 nt, Human
uucccaggcucagugacccucuca

SEQ ID NO: 739771 - RNA, 22 nt, Human
uucccugggugcuggacuucca

SEQ ID NO: 739772 - RNA, 21 nt, Human
uuccuaaacuucugccuuagc

SEQ ID NO: 739773 - RNA, 24 nt, Human
uucuucaagggcaaucacauccaa

SEQ ID NO: 739774 - RNA, 21 nt, Human
uugcccccacucacccugccc

SEQ ID NO: 739775 - RNA, 24 nt, Human
uugcugcaaccccagaauuuuggg

SEQ ID NO: 739776 - RNA, 23 nt, Human
uugcuggugaauuagaaauuugc

SEQ ID NO: 739777 - RNA, 21 nt, Human
uugggggaggggcugggcagg

SEQ ID NO: 739778 - RNA, 21 nt, Human
aaaaaaaaaauugucagaggg

SEQ ID NO: 739779 - RNA, 22 nt, Human
aaaaagcagagggaggagggga

SEQ ID NO: 739780 - RNA, 21 nt, Human
aaaaguacaugagggagacug

SEQ ID NO: 739781 - RNA, 21 nt, Human
aaacaucaacacaacagaaga

SEQ ID NO: 739782 - RNA, 27 nt, Human
aaagaugagcaucccucagaagccccc

SEQ ID NO: 739783 - RNA, 22 nt, Human
aaagcagcauuuacguuuauag

SEQ ID NO: 739784 - RNA, 18 nt, Human
aacagguaggaggguggg

SEQ ID NO: 739785 - RNA, 26 nt, Human
aacccaccccugcaagccaaaacuca

SEQ ID NO: 739786 - RNA, 24 nt, Human
aacucauccuccagccuacuucua

SEQ ID NO: 739787 - RNA, 23 nt, Human
aacuucaaaucuaaacccacccc

SEQ ID NO: 739788 - RNA, 33 nt, Human
aagaaggaaacaucaacacaacagaagaaaaag

SEQ ID NO: 739789 - RNA, 25 nt, Human
aagcaaagaaaaaugagucccuuca

SEQ ID NO: 739790 - RNA, 20 nt, Human
acaagguacccagggaaacc

SEQ ID NO: 739791 - RNA, 22 nt, Human
acacaacagaagaaaauauacc

SEQ ID NO: 739792 - RNA, 24 nt, Human
acacugcccaucccagccgggugc

SEQ ID NO: 739793 - RNA, 22 nt, Human
acagaagaaaauauacccuuca

SEQ ID NO: 739794 - RNA, 25 nt, Human
accaaccaaccaauucuagccacac

SEQ ID NO: 739795 - RNA, 19 nt, Human
acccaccccugcaagccaa

SEQ ID NO: 739796 - RNA, 18 nt, Human
accuguuucucuguguaa

SEQ ID NO: 739797 - RNA, 21 nt, Human
agaggaaaaaagcagagggag

SEQ ID NO: 739798 - RNA, 23 nt, Human
agagggggcuaaguacuaggaag

SEQ ID NO: 739799 - RNA, 21 nt, Human
agcaagugcucuggugacaac

SEQ ID NO: 739800 - RNA, 29 nt, Human
aggaaaaaagcagagggaggagggacccc

SEQ ID NO: 739801 - RNA, 24 nt, Human
aggaaacaucaacacaacagaaga

SEQ ID NO: 739802 - RNA, 20 nt, Human
aggaacagagccuuggccca

SEQ ID NO: 739803 - RNA, 21 nt, Human
aggaauccccccagacaauca

SEQ ID NO: 739804 - RNA, 28 nt, Human
aggaauccccccagacaaucaccaaauc

SEQ ID NO: 739805 - RNA, 18 nt, Human
aggagggugggagggcag

SEQ ID NO: 739806 - RNA, 22 nt, Human
aggagggugggagggcagucaa

SEQ ID NO: 739807 - RNA, 19 nt, Human
aggcaaagaggcagccaga

SEQ ID NO: 739808 - RNA, 27 nt, Human
aggcaagaagaggggcaaaagggaccc

SEQ ID NO: 739809 - RNA, 21 nt, Human
aggcaagaccagaugggccca

SEQ ID NO: 739810 - RNA, 25 nt, Human
aggcaggaacagagccuuggcccag

SEQ ID NO: 739811 - RNA, 19 nt, Human
agggacaaauugagaggag

SEQ ID NO: 739812 - RNA, 21 nt, Human
agggagacuguuaaagaugag

SEQ ID NO: 739813 - RNA, 19 nt, Human
auccccuccuucuccucug

SEQ ID NO: 739814 - RNA, 25 nt, Human
augaagcaaaauaucuguaaaugug

SEQ ID NO: 739815 - RNA, 18 nt, Human
augcuuagucaguuuugc

SEQ ID NO: 739816 - RNA, 20 nt, Human
auucuggaaguuaaagaaaa

SEQ ID NO: 739817 - RNA, 19 nt, Human
auuuaugggucuccucccc

SEQ ID NO: 739818 - RNA, 22 nt, Human
caaaacucaauucuuuggcugu

SEQ ID NO: 739819 - RNA, 22 nt, Human
caaaaggaagacugucccaacu

SEQ ID NO: 739820 - RNA, 22 nt, Human
caaagaaaaaugagucccuuca

SEQ ID NO: 739821 - RNA, 18 nt, Human
caacacaacagaagaaaa

SEQ ID NO: 739822 - RNA, 26 nt, Human
caacacaacagaagaaaauauacccu

SEQ ID NO: 739823 - RNA, 23 nt, Human
caaccaaccaauucuagccacac

SEQ ID NO: 739824 - RNA, 19 nt, Human
caagcuaaugggaagcagc

SEQ ID NO: 739825 - RNA, 22 nt, Human
caagggaacauuuaugggucuc

SEQ ID NO: 739826 - RNA, 22 nt, Human
caaucuacaagcuaaugggaag

SEQ ID NO: 739827 - RNA, 21 nt, Human
caccccugcaagccaaaacuc

SEQ ID NO: 739828 - RNA, 23 nt, Human
caccccugcaagccaaaacucaa

SEQ ID NO: 739829 - RNA, 20 nt, Human
caggaacagagccuuggccc

SEQ ID NO: 739830 - RNA, 24 nt, Human
cagggaaacccaggaaucccccca

SEQ ID NO: 739831 - RNA, 19 nt, Human
ccaagauaacagugccaaa

SEQ ID NO: 739832 - RNA, 24 nt, Human
cccaccccugcaagccaaaacuca

SEQ ID NO: 739833 - RNA, 24 nt, Human
ccccaaaaugguggcacuuccacc

SEQ ID NO: 739834 - RNA, 19 nt, Human
cccccagcugacugcugcc

SEQ ID NO: 739835 - RNA, 21 nt, Human
ccccugcaagccaaaacucaa

SEQ ID NO: 739836 - RNA, 18 nt, Human
ccuucuccucuguggggu

SEQ ID NO: 739837 - RNA, 20 nt, Human
cuaaacccaccccugcaagc

SEQ ID NO: 739838 - RNA, 23 nt, Human
cucagaagcccccagcugacugc

SEQ ID NO: 739839 - RNA, 21 nt, Human
cugcaagccaaaacucaauuc

SEQ ID NO: 739840 - RNA, 20 nt, Human
cuguaaaugugcucaccucc

SEQ ID NO: 739841 - RNA, 21 nt, Human
cuguaaaugugcucaccuccc

SEQ ID NO: 739842 - RNA, 21 nt, Human
cuuaacauuuugucccagcaa

SEQ ID NO: 739843 - RNA, 20 nt, Human
gaagagcagaggaaaaaagc

SEQ ID NO: 739844 - RNA, 22 nt, Human
gacaggaaaaagaaaucccuga

SEQ ID NO: 739845 - RNA, 21 nt, Human
gagaaaagaaacaaggaacgu

SEQ ID NO: 739846 - RNA, 19 nt, Human
gagaauuugcgaaggcagg

SEQ ID NO: 739847 - RNA, 26 nt, Human
gagcagaggaaaaaagcagagggagg

SEQ ID NO: 739848 - RNA, 23 nt, Human
gagcuggauguaaaaaauauuau

SEQ ID NO: 739849 - RNA, 23 nt, Human
gauguugcugcagaggggugggu

SEQ ID NO: 739850 - RNA, 18 nt, Human
gcagaggaaaaaagcaga

SEQ ID NO: 739851 - RNA, 19 nt, Human
gcagaggaaaaaagcagag

SEQ ID NO: 739852 - RNA, 21 nt, Human
gccagaguauggcucaaucua

SEQ ID NO: 739853 - RNA, 21 nt, Human
gcuaaugggaagcagcacgaa

SEQ ID NO: 739854 - RNA, 23 nt, Human
ggaaggcaaagaggcagccagag

SEQ ID NO: 739855 - RNA, 21 nt, Human
ggaauccccccagacaaucac

SEQ ID NO: 739856 - RNA, 22 nt, Human
ggaauccccccagacaaucacu

SEQ ID NO: 739857 - RNA, 21 nt, Human
ggcaaagaggcagccagagua

SEQ ID NO: 739858 - RNA, 19 nt, Human
gggauaacguaacgucacc

SEQ ID NO: 739859 - RNA, 19 nt, Human
gggcugaaagcaaagaaaa

SEQ ID NO: 739860 - RNA, 25 nt, Human
guaaaacagcaaaaguacaugaggg

SEQ ID NO: 739861 - RNA, 18 nt, Human
guaaaugugcucaccucc

SEQ ID NO: 739862 - RNA, 18 nt, Human
gucccagcaaaaaauguu

SEQ ID NO: 739863 - RNA, 21 nt, Human
guguaaaacagcaaaaguaca

SEQ ID NO: 739864 - RNA, 21 nt, Human
uaaaaaaaaaauugucagagg

SEQ ID NO: 739865 - RNA, 22 nt, Human
uacacaaagccaccagaacgag

SEQ ID NO: 739866 - RNA, 21 nt, Human
uacaugggcugaaagcaaaga

SEQ ID NO: 739867 - RNA, 24 nt, Human
uacaugggcugaaagcaaagaaaa

SEQ ID NO: 739868 - RNA, 25 nt, Human
uagaaacacagaagagggagggaca

SEQ ID NO: 739869 - RNA, 19 nt, Human
uagcucaaaaaucccaaua

SEQ ID NO: 739870 - RNA, 19 nt, Human
uaggaaaaugccaaagugg

SEQ ID NO: 739871 - RNA, 24 nt, Human
uaggaaaaugccaaagugggaauu

SEQ ID NO: 739872 - RNA, 18 nt, Human
uaggaaggcaaagaggca

SEQ ID NO: 739873 - RNA, 24 nt, Human
uaugagcuacaaaaagcagcauuu

SEQ ID NO: 739874 - RNA, 22 nt, Human
ucaaaaaucccaauacuggggg

SEQ ID NO: 739875 - RNA, 23 nt, Human
ucagagggggcuaaguacuagga

SEQ ID NO: 739876 - RNA, 22 nt, Human
uccaccacuagaacagcuuggc

SEQ ID NO: 739877 - RNA, 18 nt, Human
ucccaacucauccuccag

SEQ ID NO: 739878 - RNA, 22 nt, Human
ucccucagaagcccccagcuga

SEQ ID NO: 739879 - RNA, 18 nt, Human
ucccuguggcgcugagaa

SEQ ID NO: 739880 - RNA, 23 nt, Human
ucuaaacuugacaguuuggagau

SEQ ID NO: 739881 - RNA, 18 nt, Human
ucuaucauaugugauaaa

SEQ ID NO: 739882 - RNA, 24 nt, Human
ugaaagcaaagaaaaaugaguccc

SEQ ID NO: 739883 - RNA, 20 nt, Human
ugaaaggcaagaagaggggc

SEQ ID NO: 739884 - RNA, 27 nt, Human
ugaccaaccaaccaauucuagccacac

SEQ ID NO: 739885 - RNA, 21 nt, Human
ugagcaucccucagaagcccc

SEQ ID NO: 739886 - RNA, 18 nt, Human
ugagcugggcagagggcc

SEQ ID NO: 739887 - RNA, 27 nt, Human
ugccuggaacaagguacccagggaaac

SEQ ID NO: 739888 - RNA, 22 nt, Human
ugcucuggugacaacccacugg

SEQ ID NO: 739889 - RNA, 20 nt, Human
ugcugcccauuagcucaaaa

SEQ ID NO: 739890 - RNA, 21 nt, Human
uggacugacugccuggaacaa

SEQ ID NO: 739891 - RNA, 18 nt, Human
uggagaugccucuucugg

SEQ ID NO: 739892 - RNA, 19 nt, Human
uggcucaacacccccaagg

SEQ ID NO: 739893 - RNA, 26 nt, Human
ugggugaaaggcaagaagaggggcaa

SEQ ID NO: 739894 - RNA, 19 nt, Human
ugucaagugaccaaccaac

SEQ ID NO: 739895 - RNA, 19 nt, Human
ugucaagugaccaaccaac

SEQ ID NO: 739896 - RNA, 20 nt, Human
ugucuaaacugagcugggca

SEQ ID NO: 739897 - RNA, 26 nt, Human
ugucuaaacugagcugggggaggagu

SEQ ID NO: 739898 - RNA, 21 nt, Human
uuacagcauauauaucucuau

SEQ ID NO: 739899 - RNA, 23 nt, Human
uucaaaucuaaacccaccccugc

SEQ ID NO: 739900 - RNA, 20 nt, Human
uucacuuuagacacaugagc

SEQ ID NO: 739901 - RNA, 23 nt, Human
uucuuuggcugucagacacugcc

SEQ ID NO: 739902 - RNA, 20 nt, Human
uuuacagaagggaagagcag

SEQ ID NO: 739903 - RNA, 18 nt, Human
uuuacagcauauauaucu

SEQ ID NO: 739904 - RNA, 24 nt, Human
uuuauuuuuauuuuuacuuuuaaa

SEQ ID NO: 739905 - RNA, 21 nt, Human
uuuguuuucauuuuauaaccu

SEQ ID NO: 739906 - RNA, 26 nt, Human
aaaaaaaaaagaauacagcaggauag

SEQ ID NO: 739907 - RNA, 19 nt, Human
aaaauuaagagaaggaagg

SEQ ID NO: 739908 - RNA, 25 nt, Human
aaacaagaagaggucagaagggacc

SEQ ID NO: 739909 - RNA, 21 nt, Human
aaacugaauccauuuuccuug

SEQ ID NO: 739910 - RNA, 23 nt, Human
aaauaauacagcacuuguaauaa

SEQ ID NO: 739911 - RNA, 22 nt, Human
aaaugccagugcuaaaacugaa

SEQ ID NO: 739912 - RNA, 24 nt, Human
aacagaaagugaagaaaagggacc

SEQ ID NO: 739913 - RNA, 20 nt, Human
aacagagcaagacuccaucu

SEQ ID NO: 739914 - RNA, 25 nt, Human
aacauuuuauuguaaauagcucuuc

SEQ ID NO: 739915 - RNA, 23 nt, Human
aacuugauaacaguuucuugcug

SEQ ID NO: 739916 - RNA, 24 nt, Human
aagaugauccuguccuuggcuuug

SEQ ID NO: 739917 - RNA, 26 nt, Human
aagcaaaaagaaaaaacaagcaaacc

SEQ ID NO: 739918 - RNA, 26 nt, Human
aagcaaaaagaaaaaacaaggggacc

SEQ ID NO: 739919 - RNA, 21 nt, Human
aagcagccauuugaaaaacag

SEQ ID NO: 739920 - RNA, 20 nt, Human
aagcugcuuuaugagaucag

SEQ ID NO: 739921 - RNA, 20 nt, Human
aagcuucagugcuauagugc

SEQ ID NO: 739922 - RNA, 18 nt, Human
aagucuuuuauuugucuu

SEQ ID NO: 739923 - RNA, 24 nt, Human
aaucacuugaauccaggaggcgga

SEQ ID NO: 739924 - RNA, 24 nt, Human
acacaacuuaggaaaaggggaacc

SEQ ID NO: 739925 - RNA, 22 nt, Human
acacaacuuaggaaaaguacca

SEQ ID NO: 739926 - RNA, 20 nt, Human
acacauauucucuaugcaug

SEQ ID NO: 739927 - RNA, 21 nt, Human
acaccuguaauccuagcacuu

SEQ ID NO: 739928 - RNA, 23 nt, Human
acaccuguaauccuagcacuuug

SEQ ID NO: 739929 - RNA, 24 nt, Human
acagagcaagacuccaucucaaaa

SEQ ID NO: 739930 - RNA, 24 nt, Human
accagcauagugaaacccugucuc

SEQ ID NO: 739931 - RNA, 24 nt, Human
acccggagaagcuguuuaaaggag

SEQ ID NO: 739932 - RNA, 24 nt, Human
acccugucucuacuaaaaauacaa

SEQ ID NO: 739933 - RNA, 18 nt, Human
acgaugcggaugucucug

SEQ ID NO: 739934 - RNA, 19 nt, Human
acucaguaauacacaacuu

SEQ ID NO: 739935 - RNA, 19 nt, Human
acuccagcagcucauucug

SEQ ID NO: 739936 - RNA, 21 nt, Human
acuccgaagguccccagccuu

SEQ ID NO: 739937 - RNA, 24 nt, Human
acuugaggucaggaguucgagacc

SEQ ID NO: 739938 - RNA, 20 nt, Human
acuuuuucuuuacacaauau

SEQ ID NO: 739939 - RNA, 18 nt, Human
agaaaugacacacucuuc

SEQ ID NO: 739940 - RNA, 20 nt, Human
agaacuguuccaugucacuu

SEQ ID NO: 739941 - RNA, 22 nt, Human
agaaucacuugaauccaggagg

SEQ ID NO: 739942 - RNA, 24 nt, Human
agaaugcucuaggcaugugaggau

SEQ ID NO: 739943 - RNA, 19 nt, Human
agaguuguucguccaaagc

SEQ ID NO: 739944 - RNA, 23 nt, Human
agaucacuugaggucaggaguuc

SEQ ID NO: 739945 - RNA, 25 nt, Human
agaucacuugaggucaggaguucga

SEQ ID NO: 739946 - RNA, 23 nt, Human
agcaaaaagaaaaaacaagcaaa

SEQ ID NO: 739947 - RNA, 19 nt, Human
agcaaaucccuguaguaag

SEQ ID NO: 739948 - RNA, 22 nt, Human
agcaccucugcuuggagcuguu

SEQ ID NO: 739949 - RNA, 24 nt, Human
agcacuuugggaggcugaggcagg

SEQ ID NO: 739950 - RNA, 21 nt, Human
agcauagugaaacccugucuc

SEQ ID NO: 739951 - RNA, 24 nt, Human
agcaugggcaacagagcaagacuc

SEQ ID NO: 739952 - RNA, 23 nt, Human
agccaggugugguggugugcacc

SEQ ID NO: 739953 - RNA, 26 nt, Human
aggcagaucacuugaggucaggaguu

SEQ ID NO: 739954 - RNA, 18 nt, Human
aggcaggagaaucacuug

SEQ ID NO: 739955 - RNA, 23 nt, Human
aggcaggagaaucacuugaaucc

SEQ ID NO: 739956 - RNA, 22 nt, Human
aggcaggcagaucacuugaggu

SEQ ID NO: 739957 - RNA, 26 nt, Human
aggcaggcagaucacuugaggucagg

SEQ ID NO: 739958 - RNA, 24 nt, Human
aggcggagcuugccaugagccgag

SEQ ID NO: 739959 - RNA, 24 nt, Human
aggcugaggcaggcagaucacuug

SEQ ID NO: 739960 - RNA, 24 nt, Human
agggagagaugcaaacugaaucca

SEQ ID NO: 739961 - RNA, 24 nt, Human
agggagagaugcaaacugaaucca

SEQ ID NO: 739962 - RNA, 24 nt, Human
aggugugguggugugcaccuguaa

SEQ ID NO: 739963 - RNA, 24 nt, Human
agguugaggcaggagaaucacuug

SEQ ID NO: 739964 - RNA, 22 nt, Human
aguccauuguugauagaggaau

SEQ ID NO: 739965 - RNA, 23 nt, Human
agugaagaaaaauggaaaagucu

SEQ ID NO: 739966 - RNA, 24 nt, Human
aguggcuuacaccuguaauccuag

SEQ ID NO: 739967 - RNA, 20 nt, Human
auaaauaaaacuucaaaaau

SEQ ID NO: 739968 - RNA, 24 nt, Human
auagaggcggcggcggcggcagca

SEQ ID NO: 739969 - RNA, 23 nt, Human
auaggaaccacccuuccagcccc

SEQ ID NO: 739970 - RNA, 21 nt, Human
auccagcaggaggccgggcac

SEQ ID NO: 739971 - RNA, 26 nt, Human
augcucuuuggagggccugauauucu

SEQ ID NO: 739972 - RNA, 22 nt, Human
caaacugaauccauuuuccuug

SEQ ID NO: 739973 - RNA, 21 nt, Human
caacaacacaagaaagucaaa

SEQ ID NO: 739974 - RNA, 21 nt, Human
caagacuccaucucaaaaaaa

SEQ ID NO: 739975 - RNA, 22 nt, Human
caaugcacuccagcaugggcaa

SEQ ID NO: 739976 - RNA, 23 nt, Human
caaugcacuccagcaugggcaac

SEQ ID NO: 739977 - RNA, 24 nt, Human
caaugcacuccagcaugggcaaca

SEQ ID NO: 739978 - RNA, 19 nt, Human
cacagccugcagcuccuuc

SEQ ID NO: 739979 - RNA, 21 nt, Human
cacauauccacaauuuugcug

SEQ ID NO: 739980 - RNA, 19 nt, Human
cacauccuuaacaccuucu

SEQ ID NO: 739981 - RNA, 22 nt, Human
caccaacacuguagaggcaccc

SEQ ID NO: 739982 - RNA, 24 nt, Human
caccaacacuguagaggcacccuc

SEQ ID NO: 739983 - RNA, 23 nt, Human
caccuguaaucccagcuacuagg

SEQ ID NO: 739984 - RNA, 24 nt, Human
caccuguaaucccagcuacuaggg

SEQ ID NO: 739985 - RNA, 19 nt, Human
caccuguaauccuagcacu

SEQ ID NO: 739986 - RNA, 24 nt, Human
caccuguaauccuagcacuuuggg

SEQ ID NO: 739987 - RNA, 23 nt, Human
cacuccagcaugggcaacagagc

SEQ ID NO: 739988 - RNA, 23 nt, Human
cacuugaggucaggaguucgaga

SEQ ID NO: 739989 - RNA, 19 nt, Human
cagagagguuaagugacug

SEQ ID NO: 739990 - RNA, 24 nt, Human
cagaucacuugaggucaggaguuc

SEQ ID NO: 739991 - RNA, 22 nt, Human
cagcaccgugugcuugcgcugc

SEQ ID NO: 739992 - RNA, 23 nt, Human
cagcagcagcagcagcagcauca

SEQ ID NO: 739993 - RNA, 24 nt, Human
cagcauagugaaacccugucucua

SEQ ID NO: 739994 - RNA, 20 nt, Human
cagccauuugaaaaacagua

SEQ ID NO: 739995 - RNA, 24 nt, Human
cagccccacuagaguaucagcaau

SEQ ID NO: 739996 - RNA, 20 nt, Human
caguuuccgggccuccuccc

SEQ ID NO: 739997 - RNA, 21 nt, Human
caguuugcuccaagccuuugu

SEQ ID NO: 739998 - RNA, 24 nt, Human
cauaaagacagaaaagcaaauccc

SEQ ID NO: 739999 - RNA, 22 nt, Human
cauaccacuuuuucaaaaauuu

SEQ ID NO: 740000 - RNA, 18 nt, Human
cauagugaaacccugucu

SEQ ID NO: 740001 - RNA, 19 nt, Human
cauagugaaacccugucuc

SEQ ID NO: 740002 - RNA, 19 nt, Human
caugugauuuacaguauca

SEQ ID NO: 740003 - RNA, 19 nt, Human
cauguucccuauagauguu

SEQ ID NO: 740004 - RNA, 20 nt, Human
ccaaugcacuccagcauggg

SEQ ID NO: 740005 - RNA, 21 nt, Human
ccaaugcacuccagcaugggc

SEQ ID NO: 740006 - RNA, 24 nt, Human
ccaaugcacuccagcaugggcaac

SEQ ID NO: 740007 - RNA, 18 nt, Human
ccacuagaguaucagcaa

SEQ ID NO: 740008 - RNA, 21 nt, Human
ccagaucuuaagcaaaaagaa

SEQ ID NO: 740009 - RNA, 20 nt, Human
ccaggucuucaauuuuggcu

SEQ ID NO: 740010 - RNA, 18 nt, Human
ccagugugaauccugccc

SEQ ID NO: 740011 - RNA, 19 nt, Human
ccaucugagaaugggugaa

SEQ ID NO: 740012 - RNA, 19 nt, Human
cccacuagaguaucagcaa

SEQ ID NO: 740013 - RNA, 19 nt, Human
cccaugcugagacccggag

SEQ ID NO: 740014 - RNA, 22 nt, Human
ccccauaaauaaaacuucaaaa

SEQ ID NO: 740015 - RNA, 24 nt, Human
ccuccgaauaucccgcuccgacuc

SEQ ID NO: 740016 - RNA, 18 nt, Human
ccucgugcuucacucccc

SEQ ID NO: 740017 - RNA, 21 nt, Human
ccucuugcuguuuuucacuua

SEQ ID NO: 740018 - RNA, 22 nt, Human
ccugaccagcauagugaaaccc

SEQ ID NO: 740019 - RNA, 20 nt, Human
ccugaguuuaaaacaaucau

SEQ ID NO: 740020 - RNA, 22 nt, Human
ccuguaaucccagcuacuaggg

SEQ ID NO: 740021 - RNA, 19 nt, Human
ccuguaguaagaaaccaga

SEQ ID NO: 740022 - RNA, 20 nt, Human
ccugugguaaaagugggguu

SEQ ID NO: 740023 - RNA, 24 nt, Human
cgagaccagccugaccagcauagu

SEQ ID NO: 740024 - RNA, 25 nt, Human
cgagucggaugcagccuccgaaccc

SEQ ID NO: 740025 - RNA, 23 nt, Human
cggcagcagcagcagcagcagca

SEQ ID NO: 740026 - RNA, 23 nt, Human
cggcggcagcagcagcagcagca

SEQ ID NO: 740027 - RNA, 23 nt, Human
cguccaaagccuccuucugaagu

SEQ ID NO: 740028 - RNA, 21 nt, Human
cuaauaaugucccaaguagcu

SEQ ID NO: 740029 - RNA, 23 nt, Human
cuagccccauaaauaaaacuuca

SEQ ID NO: 740030 - RNA, 20 nt, Human
cuaguuccuggauucucaua

SEQ ID NO: 740031 - RNA, 23 nt, Human
cuaguucuuccuccagauagccu

SEQ ID NO: 740032 - RNA, 24 nt, Human
cucacagccugcagcuccuucauc

SEQ ID NO: 740033 - RNA, 23 nt, Human
cuccagauagccuuuuauuuugc

SEQ ID NO: 740034 - RNA, 19 nt, Human
cuccaucucaaaaaaaaaa

SEQ ID NO: 740035 - RNA, 23 nt, Human
cucccagaucuuaagcaaaaaga

SEQ ID NO: 740036 - RNA, 21 nt, Human
cuccucuugcuguuuuucacu

SEQ ID NO: 740037 - RNA, 20 nt, Human
cucuguggcaaacccgacuc

SEQ ID NO: 740038 - RNA, 20 nt, Human
cucuucuagcucuagguuuc

SEQ ID NO: 740039 - RNA, 21 nt, Human
cugacagucauacucucugcu

SEQ ID NO: 740040 - RNA, 21 nt, Human
cugccagggacagcacagugc

SEQ ID NO: 740041 - RNA, 20 nt, Human
cugccgguuuuuuuuuuccc

SEQ ID NO: 740042 - RNA, 20 nt, Human
cuggaugucuguuuuaucuu

SEQ ID NO: 740043 - RNA, 21 nt, Human
cuggcccuaaacacaucuaaa

SEQ ID NO: 740044 - RNA, 24 nt, Human
cuggucucuggcguccuguaguuc

SEQ ID NO: 740045 - RNA, 24 nt, Human
cugucaccagcaccgugugcuugc

SEQ ID NO: 740046 - RNA, 20 nt, Human
cuguguuuuugcccaaauca

SEQ ID NO: 740047 - RNA, 22 nt, Human
cuguugguuuuuaauuucuuuc

SEQ ID NO: 740048 - RNA, 20 nt, Human
cuuccagccccacuagagua

SEQ ID NO: 740049 - RNA, 19 nt, Human
cuuccugggaucuuaucca

SEQ ID NO: 740050 - RNA, 20 nt, Human
cuuggacaaucauccuagcu

SEQ ID NO: 740051 - RNA, 21 nt, Human
cuuggagcuguucuugagccu

SEQ ID NO: 740052 - RNA, 25 nt, Human
cuuggcuucucguucagcgucgaug

SEQ ID NO: 740053 - RNA, 22 nt, Human
gaaaaaacaagcaaaccuuuug

SEQ ID NO: 740054 - RNA, 20 nt, Human
gaaaaacaguauuuuggaaa

SEQ ID NO: 740055 - RNA, 20 nt, Human
gaacaaaaagugggacccca

SEQ ID NO: 740056 - RNA, 18 nt, Human
gaauuuggagauuaaaug

SEQ ID NO: 740057 - RNA, 18 nt, Human
gacuggcucuccuguggu

SEQ ID NO: 740058 - RNA, 22 nt, Human
gagaagcuguuuaaaggaggga

SEQ ID NO: 740059 - RNA, 23 nt, Human
gagaagcuguuuaaaggagggag

SEQ ID NO: 740060 - RNA, 22 nt, Human
gagagaugcaaacugaauccau

SEQ ID NO: 740061 - RNA, 22 nt, Human
gagagaugcaaacugaauccau

SEQ ID NO: 740062 - RNA, 23 nt, Human
gagauugugccaaugcacuccag

SEQ ID NO: 740063 - RNA, 24 nt, Human
gagcacucacaccaucugagaaug

SEQ ID NO: 740064 - RNA, 18 nt, Human
gagcagacuugagccucu

SEQ ID NO: 740065 - RNA, 19 nt, Human
gaggaaacugaggcacaga

SEQ ID NO: 740066 - RNA, 24 nt, Human
gaucacuugaggucaggaguucga

SEQ ID NO: 740067 - RNA, 21 nt, Human
gcagaucacuugaggucagga

SEQ ID NO: 740068 - RNA, 22 nt, Human
gcaggagaaucacuugaaucca

SEQ ID NO: 740069 - RNA, 26 nt, Human
gccaaugcacuccagcaugggcaaca

SEQ ID NO: 740070 - RNA, 19 nt, Human
gcucagagccucguccacc

SEQ ID NO: 740071 - RNA, 18 nt, Human
gcucuccugugguaaaag

SEQ ID NO: 740072 - RNA, 19 nt, Human
gcugagacccggagaagcu

SEQ ID NO: 740073 - RNA, 21 nt, Human
gcugagacccggagaagcugu

SEQ ID NO: 740074 - RNA, 18 nt, Human
gcuucuaguuccuggauu

SEQ ID NO: 740075 - RNA, 20 nt, Human
ggagaagcuguuuaaaggag

SEQ ID NO: 740076 - RNA, 20 nt, Human
ggagaagcuguuuaaaggag

SEQ ID NO: 740077 - RNA, 24 nt, Human
ggagcuugccaugagccgagauug

SEQ ID NO: 740078 - RNA, 23 nt, Human
ggcacaguggcuuacaccuguaa

SEQ ID NO: 740079 - RNA, 24 nt, Human
gguggugugcaccuguaaucccag

SEQ ID NO: 740080 - RNA, 21 nt, Human
ggugugcaccuguaaucccag

SEQ ID NO: 740081 - RNA, 22 nt, Human
gguuuagaagcacuugucuucc

SEQ ID NO: 740082 - RNA, 18 nt, Human
gucgcggagagcacagag

SEQ ID NO: 740083 - RNA, 19 nt, Human
gucuccucaaucgcugccc

SEQ ID NO: 740084 - RNA, 19 nt, Human
gucucucucucucuucuag

SEQ ID NO: 740085 - RNA, 21 nt, Human
gugaaacccugucucuacuaa

SEQ ID NO: 740086 - RNA, 19 nt, Human
gugcugccauguuacuguu

SEQ ID NO: 740087 - RNA, 21 nt, Human
gugcuucacuccccacccacc

SEQ ID NO: 740088 - RNA, 21 nt, Human
guucggaaccaucaccugccc

SEQ ID NO: 740089 - RNA, 22 nt, Human
guugcacucagccuccuugacc

SEQ ID NO: 740090 - RNA, 21 nt, Human
uaaaaauacaaaaauuagcca

SEQ ID NO: 740091 - RNA, 22 nt, Human
uaaaaugaccccccugcacagc

SEQ ID NO: 740092 - RNA, 22 nt, Human
uaaauggaggggaucgucucuc

SEQ ID NO: 740093 - RNA, 23 nt, Human
uaaccggugauuuucugccuccu

SEQ ID NO: 740094 - RNA, 18 nt, Human
uaagagaaggaaggugug

SEQ ID NO: 740095 - RNA, 22 nt, Human
uaagcaaaaagaaaaaacaagc

SEQ ID NO: 740096 - RNA, 21 nt, Human
uaagcagauuagguauauaaa

SEQ ID NO: 740097 - RNA, 18 nt, Human
uacaaaguagcuucuagu

SEQ ID NO: 740098 - RNA, 24 nt, Human
uacacaauauauguuuauaguucu

SEQ ID NO: 740099 - RNA, 19 nt, Human
uacuguuucuuauccugga

SEQ ID NO: 740100 - RNA, 24 nt, Human
uagcacuuugggaggcugaggcag

SEQ ID NO: 740101 - RNA, 25 nt, Human
uagcacuuugggaggcugaggcagg

SEQ ID NO: 740102 - RNA, 23 nt, Human
uagcaugagaugaucuauuuccu

SEQ ID NO: 740103 - RNA, 23 nt, Human
uagcuguuguucucauaugacuu

SEQ ID NO: 740104 - RNA, 28 nt, Human
uagcuuggucgaggucauucagagauuc

SEQ ID NO: 740105 - RNA, 18 nt, Human
uaggaaccacccuuccag

SEQ ID NO: 740106 - RNA, 24 nt, Human
uagguuucgaaacuccagcagcuc

SEQ ID NO: 740107 - RNA, 22 nt, Human
uaucauagaaaugacacacucu

SEQ ID NO: 740108 - RNA, 22 nt, Human
ucaaaaaaaaaaaaaaaagaaa

SEQ ID NO: 740109 - RNA, 24 nt, Human
ucaaaugaaacauuuuauuguaaa

SEQ ID NO: 740110 - RNA, 21 nt, Human
ucacccaagauaucaagcugc

SEQ ID NO: 740111 - RNA, 20 nt, Human
ucacuugaggucaggaguuc

SEQ ID NO: 740112 - RNA, 18 nt, Human
ucacuuuccaauuccauc

SEQ ID NO: 740113 - RNA, 18 nt, Human
ucagggauguucacaucc

SEQ ID NO: 740114 - RNA, 23 nt, Human
ucaguuugcuccaagccuuuguu

SEQ ID NO: 740115 - RNA, 20 nt, Human
ucauugauucugcuguguuu

SEQ ID NO: 740116 - RNA, 23 nt, Human
uccaaucauuuagaaauaguuac

SEQ ID NO: 740117 - RNA, 24 nt, Human
uccaaucauuuagaaauaguuacu

SEQ ID NO: 740118 - RNA, 23 nt, Human
uccacaagcuccaccuuuugcag

SEQ ID NO: 740119 - RNA, 25 nt, Human
uccacuucucugccagggacagcac

SEQ ID NO: 740120 - RNA, 19 nt, Human
uccagcaggaggccgggca

SEQ ID NO: 740121 - RNA, 20 nt, Human
uccagcaugggcaacagagc

SEQ ID NO: 740122 - RNA, 20 nt, Human
uccaggaggcggagcuugcc

SEQ ID NO: 740123 - RNA, 24 nt, Human
uccaucagccuccgaauaucccgc

SEQ ID NO: 740124 - RNA, 23 nt, Human
uccaucucaaaaaaaaaaaaaaa

SEQ ID NO: 740125 - RNA, 20 nt, Human
ucccucugucucugguuggc

SEQ ID NO: 740126 - RNA, 19 nt, Human
uccuccagaauaaaagaag

SEQ ID NO: 740127 - RNA, 19 nt, Human
uccucgugcuucacucccc

SEQ ID NO: 740128 - RNA, 19 nt, Human
uccugguuuugaaucucuc

SEQ ID NO: 740129 - RNA, 20 nt, Human
uccugugguaaaaguggggu

SEQ ID NO: 740130 - RNA, 24 nt, Human
uccuuggcuuugauuucauccauc

SEQ ID NO: 740131 - RNA, 25 nt, Human
ucgaaucugcuuuuauuucacaugu

SEQ ID NO: 740132 - RNA, 18 nt, Human
ucgcucggguccuuugac

SEQ ID NO: 740133 - RNA, 19 nt, Human
ucgcugcccuggaagccca

SEQ ID NO: 740134 - RNA, 18 nt, Human
ucgcuuccaggucuucaa

SEQ ID NO: 740135 - RNA, 23 nt, Human
ucguccaccugcuucuuggccgu

SEQ ID NO: 740136 - RNA, 18 nt, Human
ucucaaaaaaaaaaaaaa

SEQ ID NO: 740137 - RNA, 21 nt, Human
ucuccaagcaagguauuccug

SEQ ID NO: 740138 - RNA, 23 nt, Human
ucucuacuaaaaauacaaaaauu

SEQ ID NO: 740139 - RNA, 21 nt, Human
ucucuguggcaaacccgacuc

SEQ ID NO: 740140 - RNA, 21 nt, Human
ucugagaaugggugaauuugg

SEQ ID NO: 740141 - RNA, 23 nt, Human
ucugcuguguuuuugcccaaauc

SEQ ID NO: 740142 - RNA, 18 nt, Human
ucuucauuagcuuggucg

SEQ ID NO: 740143 - RNA, 19 nt, Human
ucuuccaugcgcugcaagg

SEQ ID NO: 740144 - RNA, 18 nt, Human
ucuuccucagcauuugcc

SEQ ID NO: 740145 - RNA, 24 nt, Human
ugaccagcauagugaaacccuguc

SEQ ID NO: 740146 - RNA, 20 nt, Human
ugaccugaaguuuuagaaac

SEQ ID NO: 740147 - RNA, 21 nt, Human
ugacuggaacacauauccaca

SEQ ID NO: 740148 - RNA, 22 nt, Human
ugacuggaacacauauccacaa

SEQ ID NO: 740149 - RNA, 20 nt, Human
ugagaaugggugaauuugga

SEQ ID NO: 740150 - RNA, 22 nt, Human
ugagccgagauugugccaaugc

SEQ ID NO: 740151 - RNA, 20 nt, Human
ugaggcaggagaaucacuug

SEQ ID NO: 740152 - RNA, 24 nt, Human
ugaggcaggagaaucacuugaauc

SEQ ID NO: 740153 - RNA, 25 nt, Human
ugaggcaggagaaucacuugaaucc

SEQ ID NO: 740154 - RNA, 20 nt, Human
ugaggcaggcagaucacuug

SEQ ID NO: 740155 - RNA, 26 nt, Human
ugaggcaggcagaucacuugagguca

SEQ ID NO: 740156 - RNA, 19 nt, Human
ugaguuuaaaacaaucaua

SEQ ID NO: 740157 - RNA, 22 nt, Human
ugaugggcuugcuguaagagcu

SEQ ID NO: 740158 - RNA, 21 nt, Human
ugcaacagaaagugaagaaaa

SEQ ID NO: 740159 - RNA, 19 nt, Human
ugcaaucaagagagcuggg

SEQ ID NO: 740160 - RNA, 19 nt, Human
ugcaccuguaaucccagcu

SEQ ID NO: 740161 - RNA, 22 nt, Human
ugcacuccagcaugggcaacag

SEQ ID NO: 740162 - RNA, 26 nt, Human
ugccaaugcacuccagcaugggcaac

SEQ ID NO: 740163 - RNA, 21 nt, Human
ugccagggacagcacagugcu

SEQ ID NO: 740164 - RNA, 23 nt, Human
ugccaugagccgagauugugcca

SEQ ID NO: 740165 - RNA, 25 nt, Human
ugcccaagacacaucuuugcuugau

SEQ ID NO: 740166 - RNA, 24 nt, Human
uggaacacauauccacaauuuugc

SEQ ID NO: 740167 - RNA, 22 nt, Human
uggagcuuggcuuugaguucug

SEQ ID NO: 740168 - RNA, 25 nt, Human
uggcuaguguugggucaccaacacu

SEQ ID NO: 740169 - RNA, 19 nt, Human
uggcuuacaccuguaaucc

SEQ ID NO: 740170 - RNA, 24 nt, Human
uggcuuacaccuguaauccuagca

SEQ ID NO: 740171 - RNA, 20 nt, Human
ugggaccccagcauucuagu

SEQ ID NO: 740172 - RNA, 24 nt, Human
ugggaccccagcauucuaguuuuu

SEQ ID NO: 740173 - RNA, 24 nt, Human
ugggacugaugcucacuccgaagg

SEQ ID NO: 740174 - RNA, 20 nt, Human
ugggaggcugaggcaggcag

SEQ ID NO: 740175 - RNA, 24 nt, Human
ugggaggcugaggcaggcagauca

SEQ ID NO: 740176 - RNA, 21 nt, Human
ugguaaggucuccucaaucgc

SEQ ID NO: 740177 - RNA, 24 nt, Human
ugguggugugcaccuguaauccca

SEQ ID NO: 740178 - RNA, 18 nt, Human
uguaaucccagcuacuag

SEQ ID NO: 740179 - RNA, 20 nt, Human
uguaguucuuguuguaaccg

SEQ ID NO: 740180 - RNA, 22 nt, Human
ugucaaacaguuuccgggccuc

SEQ ID NO: 740181 - RNA, 18 nt, Human
ugucaccagcaccgugug

SEQ ID NO: 740182 - RNA, 18 nt, Human
ugucucuguuccugaguu

SEQ ID NO: 740183 - RNA, 18 nt, Human
uguguuuuugcccaaauc

SEQ ID NO: 740184 - RNA, 23 nt, Human
uguguuuuugcccaaaucauaua

SEQ ID NO: 740185 - RNA, 21 nt, Human
uguucuguugcucaaugaccu

SEQ ID NO: 740186 - RNA, 21 nt, Human
uguugcacucagccuccuuga

SEQ ID NO: 740187 - RNA, 25 nt, Human
uguuuugaucuuuuaaaaugauguu

SEQ ID NO: 740188 - RNA, 21 nt, Human
uuaagcagccauuugaaaaac

SEQ ID NO: 740189 - RNA, 23 nt, Human
uuagaagcacuugucuuccuggg

SEQ ID NO: 740190 - RNA, 20 nt, Human
uuagguauauaaaccauacc

SEQ ID NO: 740191 - RNA, 22 nt, Human
uuaucuucuuccauauuuucug

SEQ ID NO: 740192 - RNA, 21 nt, Human
uuauggucacugugauccacu

SEQ ID NO: 740193 - RNA, 18 nt, Human
uuauuuugcagaacuguu

SEQ ID NO: 740194 - RNA, 24 nt, Human
uuccaggucuucaauuuuggcuuu

SEQ ID NO: 740195 - RNA, 21 nt, Human
uuccauauaaaaaaguagagc

SEQ ID NO: 740196 - RNA, 21 nt, Human
uuccgggccuccucccgggcc

SEQ ID NO: 740197 - RNA, 21 nt, Human
uuccuggauucucauauaugc

SEQ ID NO: 740198 - RNA, 20 nt, Human
uuccugggaucuuauccaug

SEQ ID NO: 740199 - RNA, 20 nt, Human
uucuuggugggacugaugcu

SEQ ID NO: 740200 - RNA, 19 nt, Human
uugcacucagccuccuuga

SEQ ID NO: 740201 - RNA, 18 nt, Human
uuggacaaucauccuagc

SEQ ID NO: 740202 - RNA, 25 nt, Human
uugggaggcugaggcaggcagauca

SEQ ID NO: 740203 - RNA, 19 nt, Human
uugguagaaauuuacucau

SEQ ID NO: 740204 - RNA, 23 nt, Human
uuggugggugggaaagcaaaauu

SEQ ID NO: 740205 - RNA, 23 nt, Human
uuguugauagaggaaugcagaug

SEQ ID NO: 740206 - RNA, 24 nt, Human
uuguuuaaugacuggcucuccugu

SEQ ID NO: 740207 - RNA, 22 nt, Human
uuuacucauaugggcccugcaa

SEQ ID NO: 740208 - RNA, 22 nt, Human
uuucuuguucuucauuagcuug

SEQ ID NO: 740209 - RNA, 19 nt, Human
uuugcaaaugccagugcua

SEQ ID NO: 740210 - RNA, 26 nt, Human
uuuuuguuuguuuguuuugaucuuuu

SEQ ID NO: 740211 - RNA, 21 nt, Human
aacacugugguucgcuuccag

SEQ ID NO: 740212 - RNA, 19 nt, Human
aagaggaaaaaaauagaaa

SEQ ID NO: 740213 - RNA, 21 nt, Human
aaggagcaccucacugccugc

SEQ ID NO: 740214 - RNA, 20 nt, Human
acacugugguucgcuuccag

SEQ ID NO: 740215 - RNA, 25 nt, Human
acagaaagcagccacaucagugagc

SEQ ID NO: 740216 - RNA, 19 nt, Human
accucacugccugccucca

SEQ ID NO: 740217 - RNA, 18 nt, Human
agcagaggcaugaaggcg

SEQ ID NO: 740218 - RNA, 19 nt, Human
agcugccagccugcuggcc

SEQ ID NO: 740219 - RNA, 19 nt, Human
agcugguuugaucaacccc

SEQ ID NO: 740220 - RNA, 19 nt, Human
aggggaugggggguguugg

SEQ ID NO: 740221 - RNA, 22 nt, Human
agggggagaaggggugggggcc

SEQ ID NO: 740222 - RNA, 22 nt, Human
aggugccgggggcuuggaagcu

SEQ ID NO: 740223 - RNA, 22 nt, Human
augcguucugggcuucacucgg

SEQ ID NO: 740224 - RNA, 18 nt, Human
caaccccugacucccccu

SEQ ID NO: 740225 - RNA, 20 nt, Human
caagaggaaaaaaauagaaa

SEQ ID NO: 740226 - RNA, 20 nt, Human
caaggcacauuuccaacucg

SEQ ID NO: 740227 - RNA, 20 nt, Human
caagggcacaggggcagaga

SEQ ID NO: 740228 - RNA, 22 nt, Human
caagggugaggggagauggggg

SEQ ID NO: 740229 - RNA, 19 nt, Human
cacaucagugagcacagcc

SEQ ID NO: 740230 - RNA, 20 nt, Human
caccucacugccugccucca

SEQ ID NO: 740231 - RNA, 18 nt, Human
cacuggggugaguucuuc

SEQ ID NO: 740232 - RNA, 24 nt, Human
cacuggggugaguucuucuggccc

SEQ ID NO: 740233 - RNA, 26 nt, Human
cagaaagcagccacaucagugagcac

SEQ ID NO: 740234 - RNA, 20 nt, Human
cagagacagaaagcagccac

SEQ ID NO: 740235 - RNA, 21 nt, Human
cagagacagaaagcagccaca

SEQ ID NO: 740236 - RNA, 22 nt, Human
cagagugggcccagcucuugcc

SEQ ID NO: 740237 - RNA, 18 nt, Human
cagcggcacugguuuggg

SEQ ID NO: 740238 - RNA, 19 nt, Human
cccacaucucagcugggaa

SEQ ID NO: 740239 - RNA, 22 nt, Human
cccacuguccugcucagccauu

SEQ ID NO: 740240 - RNA, 23 nt, Human
ccccaacaccugcauccagaggg

SEQ ID NO: 740241 - RNA, 22 nt, Human
cccuguaaccaggaaacuaccc

SEQ ID NO: 740242 - RNA, 21 nt, Human
ccgcugaagcucagguuucug

SEQ ID NO: 740243 - RNA, 22 nt, Human
ccucacugccugccuccaaggg

SEQ ID NO: 740244 - RNA, 21 nt, Human
ccugcagccacagccaucugu

SEQ ID NO: 740245 - RNA, 22 nt, Human
ccugcagccacagccaucuguc

SEQ ID NO: 740246 - RNA, 22 nt, Human
ccugggacugagggugagggac

SEQ ID NO: 740247 - RNA, 25 nt, Human
ccuguaaccaggaaacuaccccaac

SEQ ID NO: 740248 - RNA, 18 nt, Human
ccuguggccaacccagaa

SEQ ID NO: 740249 - RNA, 21 nt, Human
cgcaggcacugaguggggcug

SEQ ID NO: 740250 - RNA, 24 nt, Human
cuaagcucaugaaguauuugccgg

SEQ ID NO: 740251 - RNA, 21 nt, Human
cugagucagggucagcccagg

SEQ ID NO: 740252 - RNA, 22 nt, Human
cuggccacccacccacccuucc

SEQ ID NO: 740253 - RNA, 18 nt, Human
cugggacugagggugagg

SEQ ID NO: 740254 - RNA, 21 nt, Human
cugugguucgcuuccagcucc

SEQ ID NO: 740255 - RNA, 23 nt, Human
cuuacuggaguugcgggguaggg

SEQ ID NO: 740256 - RNA, 18 nt, Human
cuucccagcgggcucccc

SEQ ID NO: 740257 - RNA, 19 nt, Human
cuuggaagcuggagaaaug

SEQ ID NO: 740258 - RNA, 22 nt, Human
gaaagcagccacaucagugagc

SEQ ID NO: 740259 - RNA, 21 nt, Human
gacaaggaugcgcaggggaug

SEQ ID NO: 740260 - RNA, 21 nt, Human
gagcugagcagaggugccggg

SEQ ID NO: 740261 - RNA, 25 nt, Human
gagcugccagccugcuggccaccca

SEQ ID NO: 740262 - RNA, 22 nt, Human
gcacuggggugaguucuucugg

SEQ ID NO: 740263 - RNA, 19 nt, Human
gcaggaugcacacagccuu

SEQ ID NO: 740264 - RNA, 22 nt, Human
gcccugcuuacuggaguugcgg

SEQ ID NO: 740265 - RNA, 21 nt, Human
gccgugaucagaccaggaggg

SEQ ID NO: 740266 - RNA, 19 nt, Human
gcugaagggggagaagggg

SEQ ID NO: 740267 - RNA, 20 nt, Human
ggaagcuggagaaaugaugg

SEQ ID NO: 740268 - RNA, 21 nt, Human
ggaccagcucucccuccuuca

SEQ ID NO: 740269 - RNA, 19 nt, Human
ggagcccaccauaguggga

SEQ ID NO: 740270 - RNA, 20 nt, Human
ggcacaggggcagagacaga

SEQ ID NO: 740271 - RNA, 21 nt, Human
ggcagugcccugcuuacugga

SEQ ID NO: 740272 - RNA, 18 nt, Human
gggaaaggagcaccucac

SEQ ID NO: 740273 - RNA, 19 nt, Human
gggaaaggagcaccucacu

SEQ ID NO: 740274 - RNA, 22 nt, Human
ggggagaaggggugggggccug

SEQ ID NO: 740275 - RNA, 21 nt, Human
ggggguguuggccgcugaagc

SEQ ID NO: 740276 - RNA, 25 nt, Human
gggguguuggccgcugaccacuggg

SEQ ID NO: 740277 - RNA, 22 nt, Human
ggugcaaggcacauuuccaacu

SEQ ID NO: 740278 - RNA, 22 nt, Human
gguuucugaaggcagucucccu

SEQ ID NO: 740279 - RNA, 19 nt, Human
gucauuguccuguucugag

SEQ ID NO: 740280 - RNA, 19 nt, Human
uaaagcuuguacagccuuu

SEQ ID NO: 740281 - RNA, 18 nt, Human
uaccccaaccucucagcc

SEQ ID NO: 740282 - RNA, 23 nt, Human
uaccccaaccucucagccagcuc

SEQ ID NO: 740283 - RNA, 24 nt, Human
uauccagggcuguccucccgaguc

SEQ ID NO: 740284 - RNA, 24 nt, Human
ucacaucagccccgugcuccaaau

SEQ ID NO: 740285 - RNA, 19 nt, Human
ucagccccgugcuccaaau

SEQ ID NO: 740286 - RNA, 20 nt, Human
uccaccaguccccaaaugag

SEQ ID NO: 740287 - RNA, 18 nt, Human
ucccagcgggcuccccuc

SEQ ID NO: 740288 - RNA, 23 nt, Human
uccccaacaccugcauccagagg

SEQ ID NO: 740289 - RNA, 23 nt, Human
ucccucugcaggaugcacacagc

SEQ ID NO: 740290 - RNA, 20 nt, Human
uccucaguguuccccaacac

SEQ ID NO: 740291 - RNA, 19 nt, Human
uccugggcucccuguggcc

SEQ ID NO: 740292 - RNA, 20 nt, Human
ucucccugacaaaucugacc

SEQ ID NO: 740293 - RNA, 24 nt, Human
ucugaggcuggaugggaugccucc

SEQ ID NO: 740294 - RNA, 19 nt, Human
ugaccuguacccacaucuc

SEQ ID NO: 740295 - RNA, 20 nt, Human
ugagaggagagaggccccua

SEQ ID NO: 740296 - RNA, 21 nt, Human
ugagaggagagaggccccuau

SEQ ID NO: 740297 - RNA, 24 nt, Human
ugagcagaggugccgggggcuugg

SEQ ID NO: 740298 - RNA, 20 nt, Human
ugagggacgcaggcacugag

SEQ ID NO: 740299 - RNA, 18 nt, Human
ugagggugagggacgcag

SEQ ID NO: 740300 - RNA, 21 nt, Human
ugagucagggucagcccaggc

SEQ ID NO: 740301 - RNA, 24 nt, Human
ugcaagaggaaaaaaauagaaauu

SEQ ID NO: 740302 - RNA, 22 nt, Human
ugcccugcagccacagccaucu

SEQ ID NO: 740303 - RNA, 19 nt, Human
ugccgggggcuuggaagcu

SEQ ID NO: 740304 - RNA, 22 nt, Human
ugcggcgggccgggcugggcgc

SEQ ID NO: 740305 - RNA, 19 nt, Human
uggcagagagugcagggag

SEQ ID NO: 740306 - RNA, 21 nt, Human
uggccaaucccuuaucaggcc

SEQ ID NO: 740307 - RNA, 21 nt, Human
uggcccggcagcagcacgcag

SEQ ID NO: 740308 - RNA, 22 nt, Human
ugggaaguggcugaagggggag

SEQ ID NO: 740309 - RNA, 18 nt, Human
ugggagcugagcagaggu

SEQ ID NO: 740310 - RNA, 21 nt, Human
uguacagccuuuuuuuccccu

SEQ ID NO: 740311 - RNA, 19 nt, Human
uguccuguucugagucagg

SEQ ID NO: 740312 - RNA, 19 nt, Human
uguuacaucgaugcauaua

SEQ ID NO: 740313 - RNA, 23 nt, Human
uugcgggguagggucuggucucc

SEQ ID NO: 740314 - RNA, 20 nt, Human
uuggaagcuggagaaaugau

SEQ ID NO: 740315 - RNA, 21 nt, Human
uugggucacaagagcugguuu

SEQ ID NO: 740316 - RNA, 22 nt, Human
aaagugcuaggauuauaggugg

SEQ ID NO: 740317 - RNA, 24 nt, Human
aaagugcuaggauuauagguggga

SEQ ID NO: 740318 - RNA, 18 nt, Human
aaagugcugggauuacaa

SEQ ID NO: 740319 - RNA, 24 nt, Human
aaagugcugggauuacaagcguga

SEQ ID NO: 740320 - RNA, 19 nt, Human
aacauggagaaaccccauc

SEQ ID NO: 740321 - RNA, 20 nt, Human
aacauggagaaaccccaucu

SEQ ID NO: 740322 - RNA, 21 nt, Human
aacauggagaaaccccaucuc

SEQ ID NO: 740323 - RNA, 20 nt, Human
aaccuccgccucccugguuc

SEQ ID NO: 740324 - RNA, 22 nt, Human
aaccugucucucucuauaccuc

SEQ ID NO: 740325 - RNA, 24 nt, Human
aaccugucucucucuauaccucug

SEQ ID NO: 740326 - RNA, 24 nt, Human
aagcaauccacccgcguuggccuc

SEQ ID NO: 740327 - RNA, 18 nt, Human
aagcagcagccaguggga

SEQ ID NO: 740328 - RNA, 22 nt, Human
aagcagcagccagugggaggcc

SEQ ID NO: 740329 - RNA, 19 nt, Human
aagggaaugagaaaaaggg

SEQ ID NO: 740330 - RNA, 19 nt, Human
aaggggccaggagcaaacg

SEQ ID NO: 740331 - RNA, 22 nt, Human
aaggggccaggagcaaacgcag

SEQ ID NO: 740332 - RNA, 19 nt, Human
aaguagcugggacuacagg

SEQ ID NO: 740333 - RNA, 20 nt, Human
aaguagcugggacuacaggc

SEQ ID NO: 740334 - RNA, 24 nt, Human
aaguagcugggacuacaggcacac

SEQ ID NO: 740335 - RNA, 19 nt, Human
aagugcugggauuacaagc

SEQ ID NO: 740336 - RNA, 19 nt, Human
aagugcugggauuacaagc

SEQ ID NO: 740337 - RNA, 24 nt, Human
aaucacuugaaccugggaggugga

SEQ ID NO: 740338 - RNA, 19 nt, Human
acaacggugcgaccucggc

SEQ ID NO: 740339 - RNA, 19 nt, Human
acacagcaaggccccgucu

SEQ ID NO: 740340 - RNA, 20 nt, Human
acacagcaaggccccgucuc

SEQ ID NO: 740341 - RNA, 24 nt, Human
acacagcaaggccccgucucaaaa

SEQ ID NO: 740342 - RNA, 19 nt, Human
acacucccccagaggccgc

SEQ ID NO: 740343 - RNA, 21 nt, Human
acagaccaguggcucccacgc

SEQ ID NO: 740344 - RNA, 22 nt, Human
acagagacccuccccugccccc

SEQ ID NO: 740345 - RNA, 22 nt, Human
acagagcacacaggggccagaa

SEQ ID NO: 740346 - RNA, 18 nt, Human
acagcucacugcagccuc

SEQ ID NO: 740347 - RNA, 25 nt, Human
acaguagggcgccgggccuuuggga

SEQ ID NO: 740348 - RNA, 24 nt, Human
acagugcugggauuauagcacugu

SEQ ID NO: 740349 - RNA, 19 nt, Human
accacguccugggaaggcu

SEQ ID NO: 740350 - RNA, 24 nt, Human
accauguuggccaggauggucucg

SEQ ID NO: 740351 - RNA, 18 nt, Human
acccagugagugguggcc

SEQ ID NO: 740352 - RNA, 24 nt, Human
accccaucucuacuaaaaauacaa

SEQ ID NO: 740353 - RNA, 21 nt, Human
acccuccccugcccccuccac

SEQ ID NO: 740354 - RNA, 19 nt, Human
accuacagagacccucccc

SEQ ID NO: 740355 - RNA, 18 nt, Human
accucuggccagacacag

SEQ ID NO: 740356 - RNA, 24 nt, Human
accuugugauccaccugccucggc

SEQ ID NO: 740357 - RNA, 22 nt, Human
acgcagcccugggccccggccc

SEQ ID NO: 740358 - RNA, 19 nt, Human
acugcagccucaacuuccu

SEQ ID NO: 740359 - RNA, 22 nt, Human
agaaaggcacacauagauucuc

SEQ ID NO: 740360 - RNA, 22 nt, Human
agaaucauggccgggcgcggug

SEQ ID NO: 740361 - RNA, 23 nt, Human
agacaaaagcuggaaggugaagg

SEQ ID NO: 740362 - RNA, 26 nt, Human
agacaggaucucacucugucuuccag

SEQ ID NO: 740363 - RNA, 21 nt, Human
agacccuccccugcccccucc

SEQ ID NO: 740364 - RNA, 24 nt, Human
agcacuuugggaggccgagguggg

SEQ ID NO: 740365 - RNA, 18 nt, Human
agccaggcguaguggugc

SEQ ID NO: 740366 - RNA, 19 nt, Human
agcccccaggcccucuccc

SEQ ID NO: 740367 - RNA, 23 nt, Human
agccucagccucucaaguagcug

SEQ ID NO: 740368 - RNA, 22 nt, Human
agccuggguaaugaagugagac

SEQ ID NO: 740369 - RNA, 23 nt, Human
agccuggguaaugaagugagacu

SEQ ID NO: 740370 - RNA, 22 nt, Human
agcugcccuacgacuuccgaga

SEQ ID NO: 740371 - RNA, 22 nt, Human
agcuggcaaugcuuucggacca

SEQ ID NO: 740372 - RNA, 24 nt, Human
aggaugaggcaggaggaacacuug

SEQ ID NO: 740373 - RNA, 18 nt, Human
aggcaaaagacaggcccu

SEQ ID NO: 740374 - RNA, 22 nt, Human
aggcaggagaaucacuugaacc

SEQ ID NO: 740375 - RNA, 24 nt, Human
aggcaggagaaucacuugaaccug

SEQ ID NO: 740376 - RNA, 18 nt, Human
aggcaggaggaacacuug

SEQ ID NO: 740377 - RNA, 21 nt, Human
aggccgagguggguggaucac

SEQ ID NO: 740378 - RNA, 24 nt, Human
aggcguaguggugcgcaccuguaa

SEQ ID NO: 740379 - RNA, 24 nt, Human
aggcugaggcaggagaaucacuug

SEQ ID NO: 740380 - RNA, 24 nt, Human
aggggccugggggcucaggcugcg

SEQ ID NO: 740381 - RNA, 20 nt, Human
agggggggggagcagguggg

SEQ ID NO: 740382 - RNA, 24 nt, Human
agggggggggagcagguggggggu

SEQ ID NO: 740383 - RNA, 18 nt, Human
aggucaaaugugcacgua

SEQ ID NO: 740384 - RNA, 24 nt, Human
agguggagguuguggugagccaag

SEQ ID NO: 740385 - RNA, 24 nt, Human
agguggguggaucacaaggucggg

SEQ ID NO: 740386 - RNA, 23 nt, Human
aguagcugggacuacaggcacgu

SEQ ID NO: 740387 - RNA, 21 nt, Human
agugcaguggcacaaucacag

SEQ ID NO: 740388 - RNA, 24 nt, Human
agugcugggauuacaagcgugagc

SEQ ID NO: 740389 - RNA, 19 nt, Human
agugcugggauuauagcac

SEQ ID NO: 740390 - RNA, 26 nt, Human
agugcugggauuauagcacugugagc

SEQ ID NO: 740391 - RNA, 20 nt, Human
agugggcagaccccaaccac

SEQ ID NO: 740392 - RNA, 24 nt, Human
aguggggcaaccguggaaggccac

SEQ ID NO: 740393 - RNA, 24 nt, Human
aguggugcgcaccuguaaucccag

SEQ ID NO: 740394 - RNA, 22 nt, Human
auaaagucccaggaggucccuc

SEQ ID NO: 740395 - RNA, 24 nt, Human
augaagugagacugugucucaaaa

SEQ ID NO: 740396 - RNA, 23 nt, Human
augaggcaggaggaacacuugag

SEQ ID NO: 740397 - RNA, 19 nt, Human
augcugcagagccccgggc

SEQ ID NO: 740398 - RNA, 18 nt, Human
augggguuucaccauguu

SEQ ID NO: 740399 - RNA, 22 nt, Human
augggguuucaccauguuggcc

SEQ ID NO: 740400 - RNA, 18 nt, Human
auuugcuuucucuuucuc

SEQ ID NO: 740401 - RNA, 24 nt, Human
auuuuuguguuuuuaguagagaug

SEQ ID NO: 740402 - RNA, 18 nt, Human
caaagcuggcucugccac

SEQ ID NO: 740403 - RNA, 26 nt, Human
caaaguggggcaaccguggaaggcca

SEQ ID NO: 740404 - RNA, 25 nt, Human
caaccacacucccccagaggccgcc

SEQ ID NO: 740405 - RNA, 25 nt, Human
caacuuccugggcucaagugauccu

SEQ ID NO: 740406 - RNA, 25 nt, Human
caagaucgugccuugcacuccagcc

SEQ ID NO: 740407 - RNA, 21 nt, Human
caagcagcaggcagcgaccau

SEQ ID NO: 740408 - RNA, 18 nt, Human
caaggcaaggggagugag

SEQ ID NO: 740409 - RNA, 21 nt, Human
caaguagcugggacuacaggc

SEQ ID NO: 740410 - RNA, 20 nt, Human
caagugauucucuugccuca

SEQ ID NO: 740411 - RNA, 22 nt, Human
caagugauucucuugccucagc

SEQ ID NO: 740412 - RNA, 23 nt, Human
cacaaggccaggcugccucccag

SEQ ID NO: 740413 - RNA, 19 nt, Human
cacaccuguaaccccagcu

SEQ ID NO: 740414 - RNA, 22 nt, Human
cacacucccccagaggccgcca

SEQ ID NO: 740415 - RNA, 26 nt, Human
cacagcaaggccccgucucaaaaaaa

SEQ ID NO: 740416 - RNA, 21 nt, Human
cacaggacaagccuggucuuc

SEQ ID NO: 740417 - RNA, 21 nt, Human
cacaggccagacaaaagcugg

SEQ ID NO: 740418 - RNA, 23 nt, Human
caccaugccuagcuaauuuuugu

SEQ ID NO: 740419 - RNA, 22 nt, Human
caccauguuggccaggaugguc

SEQ ID NO: 740420 - RNA, 24 nt, Human
caccauguuggccaggauggucuc

SEQ ID NO: 740421 - RNA, 18 nt, Human
cacccgaccccacuccca

SEQ ID NO: 740422 - RNA, 20 nt, Human
cacccgcguuggccucccaa

SEQ ID NO: 740423 - RNA, 23 nt, Human
caccugccucggccucccaaagu

SEQ ID NO: 740424 - RNA, 18 nt, Human
caccuguaaccccagcua

SEQ ID NO: 740425 - RNA, 24 nt, Human
caccuguaaccccagcuacucagg

SEQ ID NO: 740426 - RNA, 21 nt, Human
caccuguaaucccagcuacuc

SEQ ID NO: 740427 - RNA, 24 nt, Human
caccuguaaucccagcuacucagg

SEQ ID NO: 740428 - RNA, 19 nt, Human
caccuugagugucggcuuc

SEQ ID NO: 740429 - RNA, 20 nt, Human
caccuugggccccacggugc

SEQ ID NO: 740430 - RNA, 26 nt, Human
cacgcaggcaccugggacucacagcu

SEQ ID NO: 740431 - RNA, 24 nt, Human
cacgccuguaaucccagcacuuug

SEQ ID NO: 740432 - RNA, 22 nt, Human
cacuccagccuggguaaugaag

SEQ ID NO: 740433 - RNA, 23 nt, Human
cacuccagccuggguaaugaagu

SEQ ID NO: 740434 - RNA, 24 nt, Human
cacuccagccuggguaaugaagug

SEQ ID NO: 740435 - RNA, 23 nt, Human
cacucugucuuccaggaugagug

SEQ ID NO: 740436 - RNA, 19 nt, Human
cacugcagccucaacuucc

SEQ ID NO: 740437 - RNA, 23 nt, Human
cacugccuggcuggaacguucca

SEQ ID NO: 740438 - RNA, 21 nt, Human
cacuugaaccugggaggugga

SEQ ID NO: 740439 - RNA, 22 nt, Human
cagaaccgggcucugcccccau

SEQ ID NO: 740440 - RNA, 18 nt, Human
cagacacaggacagagca

SEQ ID NO: 740441 - RNA, 18 nt, Human
cagaccaguggcucccac

SEQ ID NO: 740442 - RNA, 20 nt, Human
cagaccccaaccacacuccc

SEQ ID NO: 740443 - RNA, 21 nt, Human
cagaccccaaccacacucccc

SEQ ID NO: 740444 - RNA, 21 nt, Human
cagaccucagaaugugaccuu

SEQ ID NO: 740445 - RNA, 22 nt, Human
cagagacccuccccugcccccu

SEQ ID NO: 740446 - RNA, 24 nt, Human
cagcacuuugggaggccgaggugg

SEQ ID NO: 740447 - RNA, 20 nt, Human
cagccccacgaacaccuuga

SEQ ID NO: 740448 - RNA, 20 nt, Human
cagcccugggccccggcccu

SEQ ID NO: 740449 - RNA, 24 nt, Human
cagccucaacuuccugggcucaag

SEQ ID NO: 740450 - RNA, 24 nt, Human
cagccugaccaacauggagaaacc

SEQ ID NO: 740451 - RNA, 24 nt, Human
cagcuacucaggaggcugaggcag

SEQ ID NO: 740452 - RNA, 18 nt, Human
caggaccggagcggcggg

SEQ ID NO: 740453 - RNA, 23 nt, Human
caggagccagccccacgaacacc

SEQ ID NO: 740454 - RNA, 24 nt, Human
caggaggcugaggcaggagaauca

SEQ ID NO: 740455 - RNA, 22 nt, Human
caguagggcgccgggccuuugg

SEQ ID NO: 740456 - RNA, 20 nt, Human
cagugcccagcuuccucugc

SEQ ID NO: 740457 - RNA, 19 nt, Human
cagugcccaguuccuccac

SEQ ID NO: 740458 - RNA, 20 nt, Human
cagugcugggauuauagcac

SEQ ID NO: 740459 - RNA, 22 nt, Human
caucacagcacacgcaggcacc

SEQ ID NO: 740460 - RNA, 24 nt, Human
cauggccgggcgcgguggcucacg

SEQ ID NO: 740461 - RNA, 20 nt, Human
caugugcacccagaccucag

SEQ ID NO: 740462 - RNA, 19 nt, Human
cauuuggaaacucuggcag

SEQ ID NO: 740463 - RNA, 22 nt, Human
ccaaagugcuaggauuauaggu

SEQ ID NO: 740464 - RNA, 22 nt, Human
ccaaagugcugggauuacaagc

SEQ ID NO: 740465 - RNA, 24 nt, Human
ccaaagugcugggauuacaagcgu

SEQ ID NO: 740466 - RNA, 18 nt, Human
ccacagugcugggauuau

SEQ ID NO: 740467 - RNA, 20 nt, Human
ccacagugcugggauuauag

SEQ ID NO: 740468 - RNA, 21 nt, Human
ccacagugcugggauuauagc

SEQ ID NO: 740469 - RNA, 20 nt, Human
ccacccgaccccacucccaa

SEQ ID NO: 740470 - RNA, 24 nt, Human
ccacuggggacccccacccgaccc

SEQ ID NO: 740471 - RNA, 19 nt, Human
ccaggauguguccugcugu

SEQ ID NO: 740472 - RNA, 22 nt, Human
ccaggcagccccauucugcaga

SEQ ID NO: 740473 - RNA, 19 nt, Human
ccaggccacugaggauggg

SEQ ID NO: 740474 - RNA, 22 nt, Human
ccagggauucgaggcugcagug

SEQ ID NO: 740475 - RNA, 22 nt, Human
cccaaccacacucccccagagg

SEQ ID NO: 740476 - RNA, 18 nt, Human
cccacccgaccccacucc

SEQ ID NO: 740477 - RNA, 19 nt, Human
cccacccgaccccacuccc

SEQ ID NO: 740478 - RNA, 21 nt, Human
cccacccgaccccacucccaa

SEQ ID NO: 740479 - RNA, 22 nt, Human
ccccacgaacaccuugaguguc

SEQ ID NO: 740480 - RNA, 23 nt, Human
ccccagaggccgccaccuccagc

SEQ ID NO: 740481 - RNA, 19 nt, Human
ccccaugagagaucccaga

SEQ ID NO: 740482 - RNA, 19 nt, Human
cccccaggcccucucccac

SEQ ID NO: 740483 - RNA, 20 nt, Human
cccccaggcccucucccacc

SEQ ID NO: 740484 - RNA, 19 nt, Human
ccccgucucaaaaaaaaaa

SEQ ID NO: 740485 - RNA, 26 nt, Human
ccccugcucugugucaccuguucugg

SEQ ID NO: 740486 - RNA, 23 nt, Human
cccgaguagcugggacuacaggc

SEQ ID NO: 740487 - RNA, 24 nt, Human
cccgaguagcugggacuacaggca

SEQ ID NO: 740488 - RNA, 19 nt, Human
cccggccccuccacaggac

SEQ ID NO: 740489 - RNA, 21 nt, Human
cccugguucaagugauucucu

SEQ ID NO: 740490 - RNA, 21 nt, Human
ccggugggccuuguuccuuuu

SEQ ID NO: 740491 - RNA, 19 nt, Human
ccuacagagacccuccccu

SEQ ID NO: 740492 - RNA, 21 nt, Human
ccucaacuuccugggcucaag

SEQ ID NO: 740493 - RNA, 26 nt, Human
ccuccagccucagccucucaaguagc

SEQ ID NO: 740494 - RNA, 24 nt, Human
ccugaccaacauggagaaacccca

SEQ ID NO: 740495 - RNA, 19 nt, Human
ccugaccuugugauccacc

SEQ ID NO: 740496 - RNA, 21 nt, Human
ccugaccuugugauccaccug

SEQ ID NO: 740497 - RNA, 23 nt, Human
ccugccaagacccggccccucca

SEQ ID NO: 740498 - RNA, 21 nt, Human
ccugcucugugucaccuguuc

SEQ ID NO: 740499 - RNA, 25 nt, Human
ccugcuggccucauacugggccaau

SEQ ID NO: 740500 - RNA, 18 nt, Human
ccugggagguggagguug

SEQ ID NO: 740501 - RNA, 22 nt, Human
ccugggcucaagcaauccaccc

SEQ ID NO: 740502 - RNA, 20 nt, Human
ccugggcucaagugauccuc

SEQ ID NO: 740503 - RNA, 19 nt, Human
ccugggcugugccaaaagg

SEQ ID NO: 740504 - RNA, 21 nt, Human
ccuguaaccccagcuacucag

SEQ ID NO: 740505 - RNA, 22 nt, Human
ccuguaaccccagcuacucagg

SEQ ID NO: 740506 - RNA, 21 nt, Human
ccuguaaucccagcuacucag

SEQ ID NO: 740507 - RNA, 20 nt, Human
ccuugcacuccagccugggu

SEQ ID NO: 740508 - RNA, 21 nt, Human
ccuugcacuccagccugggua

SEQ ID NO: 740509 - RNA, 22 nt, Human
ccuugcacuccagccuggguaa

SEQ ID NO: 740510 - RNA, 23 nt, Human
ccuugcacuccagccuggguaau

SEQ ID NO: 740511 - RNA, 24 nt, Human
ccuugcacuccagccuggguaaug

SEQ ID NO: 740512 - RNA, 20 nt, Human
cgagaugacuaaacccacca

SEQ ID NO: 740513 - RNA, 26 nt, Human
cgagguggguggaucacaaggucggg

SEQ ID NO: 740514 - RNA, 23 nt, Human
cgccuguaaucccagcacuuugg

SEQ ID NO: 740515 - RNA, 24 nt, Human
cgccuguaaucccagcacuuuggg

SEQ ID NO: 740516 - RNA, 18 nt, Human
cgcugccggccgugggca

SEQ ID NO: 740517 - RNA, 19 nt, Human
cggcacacaccuguaaccc

SEQ ID NO: 740518 - RNA, 23 nt, Human
cggcacacaccuguaaccccagc

SEQ ID NO: 740519 - RNA, 18 nt, Human
cgugccacgccaccaugc

SEQ ID NO: 740520 - RNA, 24 nt, Human
cuacagagacccuccccugccccc

SEQ ID NO: 740521 - RNA, 24 nt, Human
cucaaguagcugggacuacaggca

SEQ ID NO: 740522 - RNA, 22 nt, Human
cucacgccuguaaucccagcac

SEQ ID NO: 740523 - RNA, 24 nt, Human
cucacgccuguaaucccagcacuu

SEQ ID NO: 740524 - RNA, 24 nt, Human
cucacugcagccucaacuuccugg

SEQ ID NO: 740525 - RNA, 24 nt, Human
cucagccucucaaguagcugggac

SEQ ID NO: 740526 - RNA, 24 nt, Human
cucagcuucccgaguagcugggac

SEQ ID NO: 740527 - RNA, 24 nt, Human
cuccagccucagccucucaaguag

SEQ ID NO: 740528 - RNA, 24 nt, Human
cucccaggcccuucaggagccagc

SEQ ID NO: 740529 - RNA, 18 nt, Human
cuccccugcccccuccac

SEQ ID NO: 740530 - RNA, 21 nt, Human
cuccccugcccccuccacucc

SEQ ID NO: 740531 - RNA, 18 nt, Human
cucccugguucaagugau

SEQ ID NO: 740532 - RNA, 24 nt, Human
cuccugaccuugugauccaccugc

SEQ ID NO: 740533 - RNA, 21 nt, Human
cucucccaccuacagagaccc

SEQ ID NO: 740534 - RNA, 24 nt, Human
cugcaaccuccgccucccugguuc

SEQ ID NO: 740535 - RNA, 23 nt, Human
cugcagccucaacuuccugggcu

SEQ ID NO: 740536 - RNA, 19 nt, Human
cugcccccauacgcugccc

SEQ ID NO: 740537 - RNA, 19 nt, Human
cugcccccauacgcugccc

SEQ ID NO: 740538 - RNA, 23 nt, Human
cugccucggccucccaaagugcu

SEQ ID NO: 740539 - RNA, 18 nt, Human
cugcucuugaacuccugg

SEQ ID NO: 740540 - RNA, 19 nt, Human
cugcuugcccccugccaag

SEQ ID NO: 740541 - RNA, 19 nt, Human
cuggccucauacugggcca

SEQ ID NO: 740542 - RNA, 19 nt, Human
cugggccaugggaggaaac

SEQ ID NO: 740543 - RNA, 24 nt, Human
cugguucaagugauucucuugccu

SEQ ID NO: 740544 - RNA, 21 nt, Human
cuguaaucccagcuacucagg

SEQ ID NO: 740545 - RNA, 22 nt, Human
cuuccgagaugacuaaacccac

SEQ ID NO: 740546 - RNA, 21 nt, Human
cuugaaccugggagguggagg

SEQ ID NO: 740547 - RNA, 23 nt, Human
cuugcacuccagccuggguaaug

SEQ ID NO: 740548 - RNA, 24 nt, Human
cuugccucagcuucccgaguagcu

SEQ ID NO: 740549 - RNA, 18 nt, Human
gaaagggaguuucaggcc

SEQ ID NO: 740550 - RNA, 24 nt, Human
gaaugagaaaaagggcaggucacg

SEQ ID NO: 740551 - RNA, 19 nt, Human
gaccucggcucacugcaac

SEQ ID NO: 740552 - RNA, 22 nt, Human
gaccuugugauccaccugccuc

SEQ ID NO: 740553 - RNA, 22 nt, Human
gaccuugugauccaccugccuc

SEQ ID NO: 740554 - RNA, 24 nt, Human
gaccuugugauccaccugccucgg

SEQ ID NO: 740555 - RNA, 24 nt, Human
gacuacaggcacaccccaucaugc

SEQ ID NO: 740556 - RNA, 23 nt, Human
gagaaucacuugaaccugggagg

SEQ ID NO: 740557 - RNA, 18 nt, Human
gagaugggguuucaccau

SEQ ID NO: 740558 - RNA, 24 nt, Human
gagaugggguuucaccauguuggc

SEQ ID NO: 740559 - RNA, 23 nt, Human
gagccggggccgaagacccuaaa

SEQ ID NO: 740560 - RNA, 22 nt, Human
gagguggguggaucacaagguc

SEQ ID NO: 740561 - RNA, 23 nt, Human
gagguuguggugagccaagaucg

SEQ ID NO: 740562 - RNA, 20 nt, Human
gaguagcugggacuacaggc

SEQ ID NO: 740563 - RNA, 25 nt, Human
gaguagcugggacuacaggcacgug

SEQ ID NO: 740564 - RNA, 24 nt, Human
gagugcaguggcacaaucacagcu

SEQ ID NO: 740565 - RNA, 22 nt, Human
gaucacaaggucgggaguucaa

SEQ ID NO: 740566 - RNA, 24 nt, Human
gaucacaaggucgggaguucaaga

SEQ ID NO: 740567 - RNA, 19 nt, Human
gaucauggcacuguauucc

SEQ ID NO: 740568 - RNA, 24 nt, Human
gaucgugccuugcacuccagccug

SEQ ID NO: 740569 - RNA, 18 nt, Human
gauuacaagcgugagcca

SEQ ID NO: 740570 - RNA, 22 nt, Human
gauuacaagcgugagccacugc

SEQ ID NO: 740571 - RNA, 23 nt, Human
gauuacaagcgugagccacugca

SEQ ID NO: 740572 - RNA, 18 nt, Human
gauuauaggugggagcca

SEQ ID NO: 740573 - RNA, 21 nt, Human
gauuauaggugggagccacug

SEQ ID NO: 740574 - RNA, 21 nt, Human
gauucucuugccucagcuucc

SEQ ID NO: 740575 - RNA, 19 nt, Human
gcaaaagacaggcccugcu

SEQ ID NO: 740576 - RNA, 22 nt, Human
gcaaccuccgccucccugguuc

SEQ ID NO: 740577 - RNA, 23 nt, Human
gcaggagaaucacuugaaccugg

SEQ ID NO: 740578 - RNA, 21 nt, Human
gccacugugcucggccucuga

SEQ ID NO: 740579 - RNA, 20 nt, Human
gccagagccggggccgaaga

SEQ ID NO: 740580 - RNA, 21 nt, Human
gccagagccggggccgaagac

SEQ ID NO: 740581 - RNA, 18 nt, Human
gccucaacuuccugggcu

SEQ ID NO: 740582 - RNA, 24 nt, Human
gccucagcuucccgaguagcuggg

SEQ ID NO: 740583 - RNA, 19 nt, Human
gccugggggcucaggcugc

SEQ ID NO: 740584 - RNA, 20 nt, Human
gcgggccucaggcuuggcag

SEQ ID NO: 740585 - RNA, 22 nt, Human
gcguuggccucccaaagugcua

SEQ ID NO: 740586 - RNA, 20 nt, Human
gcuauggaucugcaaagggg

SEQ ID NO: 740587 - RNA, 20 nt, Human
gcuggcaaugcuuucggacc

SEQ ID NO: 740588 - RNA, 20 nt, Human
gcugugaucagcccugaccu

SEQ ID NO: 740589 - RNA, 23 nt, Human
ggaacaaccacugccuggcugga

SEQ ID NO: 740590 - RNA, 22 nt, Human
ggaagugggcagaccccaacca

SEQ ID NO: 740591 - RNA, 19 nt, Human
ggaccaggcugucuagcag

SEQ ID NO: 740592 - RNA, 24 nt, Human
ggacccccacccgaccccacuccc

SEQ ID NO: 740593 - RNA, 23 nt, Human
ggaccggagcggcgggucucggc

SEQ ID NO: 740594 - RNA, 24 nt, Human
ggacuacaggcacaccccaucaug

SEQ ID NO: 740595 - RNA, 20 nt, Human
ggagguuguggugagccaag

SEQ ID NO: 740596 - RNA, 24 nt, Human
ggagguuguggugagccaagaucg

SEQ ID NO: 740597 - RNA, 23 nt, Human
ggaugaggcuguaugccagcagc

SEQ ID NO: 740598 - RNA, 21 nt, Human
ggcagaccccaaccacacucc

SEQ ID NO: 740599 - RNA, 19 nt, Human
ggcagccagggacgccaga

SEQ ID NO: 740600 - RNA, 20 nt, Human
ggcaggaccggagcggcggg

SEQ ID NO: 740601 - RNA, 25 nt, Human
ggcauggcggcacacaccuguaacc

SEQ ID NO: 740602 - RNA, 18 nt, Human
ggccuggccacaucuagc

SEQ ID NO: 740603 - RNA, 24 nt, Human
ggccuuguuccuuuucaggccuua

SEQ ID NO: 740604 - RNA, 23 nt, Human
ggcgcgguggcucacgccuguaa

SEQ ID NO: 740605 - RNA, 24 nt, Human
gggcauggcggcacacaccuguaa

SEQ ID NO: 740606 - RNA, 22 nt, Human
gggcucaagugauccuccagcc

SEQ ID NO: 740607 - RNA, 18 nt, Human
ggggagugagguaggaag

SEQ ID NO: 740608 - RNA, 18 nt, Human
ggggggggagcagguggg

SEQ ID NO: 740609 - RNA, 22 nt, Human
gggguacagcagggcucccugc

SEQ ID NO: 740610 - RNA, 18 nt, Human
gggguugggacgugggga

SEQ ID NO: 740611 - RNA, 22 nt, Human
gggguuucaccauguuggccag

SEQ ID NO: 740612 - RNA, 22 nt, Human
gggucucacgguguugcccagg

SEQ ID NO: 740613 - RNA, 24 nt, Human
ggguggaucacaaggucgggaguu

SEQ ID NO: 740614 - RNA, 18 nt, Human
ggguuucaccauguuggc

SEQ ID NO: 740615 - RNA, 19 nt, Human
ggucucgaucuccugaccu

SEQ ID NO: 740616 - RNA, 20 nt, Human
ggucucgaucuccugaccuu

SEQ ID NO: 740617 - RNA, 19 nt, Human
ggugcuuugcuagcuccug

SEQ ID NO: 740618 - RNA, 23 nt, Human
gguggcucacgccuguaauccca

SEQ ID NO: 740619 - RNA, 24 nt, Human
gguggcucacgccuguaaucccag

SEQ ID NO: 740620 - RNA, 23 nt, Human
gguguugcccagguuggucugga

SEQ ID NO: 740621 - RNA, 21 nt, Human
gguucaagugauucucuugcc

SEQ ID NO: 740622 - RNA, 24 nt, Human
gguuucaccauguuggccaggaug

SEQ ID NO: 740623 - RNA, 23 nt, Human
guagagaugggguuucaccaugu

SEQ ID NO: 740624 - RNA, 24 nt, Human
gucucguucuaucaccaggcugga

SEQ ID NO: 740625 - RNA, 22 nt, Human
gugagguaggaagucagaccug

SEQ ID NO: 740626 - RNA, 24 nt, Human
gugauccaccugccucggccuccc

SEQ ID NO: 740627 - RNA, 22 nt, Human
gugauccuccagccucagccuc

SEQ ID NO: 740628 - RNA, 24 nt, Human
gugauucucuugccucagcuuccc

SEQ ID NO: 740629 - RNA, 23 nt, Human
guggcacaaucacagcucacugc

SEQ ID NO: 740630 - RNA, 23 nt, Human
guggcucacgccuguaaucccag

SEQ ID NO: 740631 - RNA, 23 nt, Human
gugggccuuguuccuuuucaggc

SEQ ID NO: 740632 - RNA, 23 nt, Human
guucugcacccagugcccagcuu

SEQ ID NO: 740633 - RNA, 21 nt, Human
guucuggcugccacuggacac

SEQ ID NO: 740634 - RNA, 21 nt, Human
uaaaaauacaaaaauuagcca

SEQ ID NO: 740635 - RNA, 22 nt, Human
uaagggaaugagaaaaagggca

SEQ ID NO: 740636 - RNA, 24 nt, Human
uaauuuuuguguuuuuaguagaga

SEQ ID NO: 740637 - RNA, 22 nt, Human
uacaagcgugagccacugcacc

SEQ ID NO: 740638 - RNA, 22 nt, Human
uaccucuggccagacacaggaa

SEQ ID NO: 740639 - RNA, 19 nt, Human
uagaagguaaaagccgucc

SEQ ID NO: 740640 - RNA, 22 nt, Human
uagagaugggguuucaccaugu

SEQ ID NO: 740641 - RNA, 22 nt, Human
uaggauuauaggugggagccac

SEQ ID NO: 740642 - RNA, 22 nt, Human
uaggauuauaggugggagccac

SEQ ID NO: 740643 - RNA, 22 nt, Human
uaggauuauaggugggagccac

SEQ ID NO: 740644 - RNA, 24 nt, Human
uaggauuauaggugggagccacug

SEQ ID NO: 740645 - RNA, 24 nt, Human
uaguagagaugggguuucaccaug

SEQ ID NO: 740646 - RNA, 22 nt, Human
uauauugcccaggcugcucuug

SEQ ID NO: 740647 - RNA, 24 nt, Human
uauauugcccaggcugcucuugaa

SEQ ID NO: 740648 - RNA, 19 nt, Human
ucaagagcaaaggcuuuuu

SEQ ID NO: 740649 - RNA, 19 nt, Human
ucaagugauucucuugccu

SEQ ID NO: 740650 - RNA, 21 nt, Human
ucacaaggucgggaguucaag

SEQ ID NO: 740651 - RNA, 24 nt, Human
ucacaaggucgggaguucaagacc

SEQ ID NO: 740652 - RNA, 21 nt, Human
ucacacugcuugucuuggcca

SEQ ID NO: 740653 - RNA, 22 nt, Human
ucacaucccaggcaacauguca

SEQ ID NO: 740654 - RNA, 24 nt, Human
ucaccauguuggccaggauggucu

SEQ ID NO: 740655 - RNA, 19 nt, Human
ucacugagaauguuuuaca

SEQ ID NO: 740656 - RNA, 19 nt, Human
ucacugcaaccuccgccuc

SEQ ID NO: 740657 - RNA, 24 nt, Human
ucacugcaaccuccgccucccugg

SEQ ID NO: 740658 - RNA, 24 nt, Human
ucacugcaaccuccgccucccugg

SEQ ID NO: 740659 - RNA, 25 nt, Human
ucacugcaaccuccgccucccuggu

SEQ ID NO: 740660 - RNA, 28 nt, Human
ucacugcaaccuccgccucccugguuca

SEQ ID NO: 740661 - RNA, 23 nt, Human
ucacugcagccucaacuuccugg

SEQ ID NO: 740662 - RNA, 24 nt, Human
ucacugcagccucaacuuccuggg

SEQ ID NO: 740663 - RNA, 24 nt, Human
ucacuggccgccaagaucagggcu

SEQ ID NO: 740664 - RNA, 19 nt, Human
ucacuugaaccugggaggu

SEQ ID NO: 740665 - RNA, 24 nt, Human
ucacuugaaccugggagguggagg

SEQ ID NO: 740666 - RNA, 23 nt, Human
ucagcuucccgaguagcugggac

SEQ ID NO: 740667 - RNA, 21 nt, Human
ucaggcuuggcagccagggac

SEQ ID NO: 740668 - RNA, 23 nt, Human
ucagggccuggaagcgcugccgg

SEQ ID NO: 740669 - RNA, 24 nt, Human
ucaucaccaccuugggccccacgg

SEQ ID NO: 740670 - RNA, 21 nt, Human
uccacagugcugggauuauag

SEQ ID NO: 740671 - RNA, 24 nt, Human
uccagccuggguaaugaagugaga

SEQ ID NO: 740672 - RNA, 18 nt, Human
uccauagcugcccuacga

SEQ ID NO: 740673 - RNA, 23 nt, Human
ucccaaagugcuaggauuauagg

SEQ ID NO: 740674 - RNA, 18 nt, Human
ucccaaagugcugggauu

SEQ ID NO: 740675 - RNA, 24 nt, Human
ucccaaagugcugggauuacaagc

SEQ ID NO: 740676 - RNA, 22 nt, Human
ucccagcccccaggcccucucc

SEQ ID NO: 740677 - RNA, 21 nt, Human
ucccccagaggccgccaccuc

SEQ ID NO: 740678 - RNA, 24 nt, Human
uccccccucacuggacugcaugag

SEQ ID NO: 740679 - RNA, 19 nt, Human
uccccugcccccuccacuc

SEQ ID NO: 740680 - RNA, 24 nt, Human
ucccgaguagcugggacuacaggc

SEQ ID NO: 740681 - RNA, 21 nt, Human
ucccugguucaagugauucuc

SEQ ID NO: 740682 - RNA, 21 nt, Human
ucccugguucaagugauucuc

SEQ ID NO: 740683 - RNA, 18 nt, Human
uccugggcucaagcaauc

SEQ ID NO: 740684 - RNA, 19 nt, Human
uccugggcucaagcaaucc

SEQ ID NO: 740685 - RNA, 21 nt, Human
uccugggcucaagugauccuc

SEQ ID NO: 740686 - RNA, 22 nt, Human
uccugggcucaagugauccucc

SEQ ID NO: 740687 - RNA, 22 nt, Human
uccugggcucaagugauccucc

SEQ ID NO: 740688 - RNA, 24 nt, Human
uccuguuccuuugccagcaccguc

SEQ ID NO: 740689 - RNA, 18 nt, Human
ucggcagggggagggaag

SEQ ID NO: 740690 - RNA, 21 nt, Human
ucucaaaaaaaaaaggggggg

SEQ ID NO: 740691 - RNA, 24 nt, Human
ucucaaguagcugggacuacaggc

SEQ ID NO: 740692 - RNA, 19 nt, Human
ucucacgguguugcccagg

SEQ ID NO: 740693 - RNA, 23 nt, Human
ucucacgguguugcccagguugg

SEQ ID NO: 740694 - RNA, 20 nt, Human
ucucacucugucuuccagga

SEQ ID NO: 740695 - RNA, 23 nt, Human
ucucccaccuuuuuaaugccagu

SEQ ID NO: 740696 - RNA, 22 nt, Human
ucucguucuaucaccaggcugg

SEQ ID NO: 740697 - RNA, 23 nt, Human
ucucguucuaucaccaggcugga

SEQ ID NO: 740698 - RNA, 21 nt, Human
ucucuacuaaaaauacaaaaa

SEQ ID NO: 740699 - RNA, 22 nt, Human
ucucuuucucuucuuuaccuaa

SEQ ID NO: 740700 - RNA, 22 nt, Human
ucugcggccugggcaucccaaa

SEQ ID NO: 740701 - RNA, 19 nt, Human
ucuugaacuccugggcuca

SEQ ID NO: 740702 - RNA, 23 nt, Human
ucuugaacuccugggcucaagca

SEQ ID NO: 740703 - RNA, 24 nt, Human
ugaaccugggagguggagguugug

SEQ ID NO: 740704 - RNA, 21 nt, Human
ugaaucuagacagaauacugg

SEQ ID NO: 740705 - RNA, 20 nt, Human
ugagacaggaucucacucug

SEQ ID NO: 740706 - RNA, 21 nt, Human
ugagacaggaucucacucugu

SEQ ID NO: 740707 - RNA, 21 nt, Human
ugagccaagaucgugccuugc

SEQ ID NO: 740708 - RNA, 20 nt, Human
ugaggcaggagaaucacuug

SEQ ID NO: 740709 - RNA, 24 nt, Human
ugaggcaggagaaucacuugaacc

SEQ ID NO: 740710 - RNA, 25 nt, Human
ugaggcaggagaaucacuugaaccu

SEQ ID NO: 740711 - RNA, 24 nt, Human
ugaggcaggaggaacacuugagcc

SEQ ID NO: 740712 - RNA, 25 nt, Human
ugaggcaggaggaacacuugagccc

SEQ ID NO: 740713 - RNA, 23 nt, Human
ugaggggcauuuucauugcaagu

SEQ ID NO: 740714 - RNA, 21 nt, Human
ugaggucacaguguauugggg

SEQ ID NO: 740715 - RNA, 22 nt, Human
ugaggucacaguguauuggggg

SEQ ID NO: 740716 - RNA, 23 nt, Human
ugaugaggggcauuuucauugca

SEQ ID NO: 740717 - RNA, 22 nt, Human
ugauggaaaauaaacucuguuc

SEQ ID NO: 740718 - RNA, 19 nt, Human
ugccaagacccggccccuc

SEQ ID NO: 740719 - RNA, 24 nt, Human
ugccacuggacacucagagccugu

SEQ ID NO: 740720 - RNA, 20 nt, Human
ugccagcaccgucuugcagc

SEQ ID NO: 740721 - RNA, 24 nt, Human
ugcccaggcugcucuugaacuccu

SEQ ID NO: 740722 - RNA, 24 nt, Human
ugcccagguuggucuggaacuccu

SEQ ID NO: 740723 - RNA, 24 nt, Human
ugccucagcuucccgaguagcugg

SEQ ID NO: 740724 - RNA, 21 nt, Human
ugccucggccucccaaagugc

SEQ ID NO: 740725 - RNA, 24 nt, Human
ugccucggccucccaaagugcugg

SEQ ID NO: 740726 - RNA, 19 nt, Human
ugccuugcacuccagccug

SEQ ID NO: 740727 - RNA, 27 nt, Human
ugcugggauuacaagcgugagccacug

SEQ ID NO: 740728 - RNA, 22 nt, Human
uggaaaugcuguccuguguagg

SEQ ID NO: 740729 - RNA, 18 nt, Human
uggaacguuccagaaccc

SEQ ID NO: 740730 - RNA, 19 nt, Human
uggaaugcugcagagcccc

SEQ ID NO: 740731 - RNA, 24 nt, Human
uggagaccacguccugggaaggcu

SEQ ID NO: 740732 - RNA, 22 nt, Human
uggaucacaaggucgggaguuc

SEQ ID NO: 740733 - RNA, 20 nt, Human
uggcacaaucacagcucacu

SEQ ID NO: 740734 - RNA, 24 nt, Human
uggcacaaucacagcucacugcag

SEQ ID NO: 740735 - RNA, 22 nt, Human
uggcaggaugaagaagcuggag

SEQ ID NO: 740736 - RNA, 24 nt, Human
uggccaggauggucucgaucuccu

SEQ ID NO: 740737 - RNA, 23 nt, Human
uggcggcacacaccuguaacccc

SEQ ID NO: 740738 - RNA, 22 nt, Human
uggcucacgccuguaaucccag

SEQ ID NO: 740739 - RNA, 24 nt, Human
uggcucacgccuguaaucccagca

SEQ ID NO: 740740 - RNA, 18 nt, Human
uggcugaagccccugcuc

SEQ ID NO: 740741 - RNA, 24 nt, Human
ugggaagagcagagaaaucaucac

SEQ ID NO: 740742 - RNA, 23 nt, Human
ugggaaggcugggguacagcagg

SEQ ID NO: 740743 - RNA, 18 nt, Human
ugggacuacaggcacacc

SEQ ID NO: 740744 - RNA, 19 nt, Human
ugggacuacaggcacaccc

SEQ ID NO: 740745 - RNA, 21 nt, Human
ugggacuacaggcacacccca

SEQ ID NO: 740746 - RNA, 21 nt, Human
ugggacuacaggcacacccca

SEQ ID NO: 740747 - RNA, 21 nt, Human
ugggacuacaggcacgugcca

SEQ ID NO: 740748 - RNA, 22 nt, Human
ugggacuacaggcacgugccac

SEQ ID NO: 740749 - RNA, 26 nt, Human
ugggacuacaggcacgugccacgcca

SEQ ID NO: 740750 - RNA, 27 nt, Human
ugggacuacaggcacgugccacgccac

SEQ ID NO: 740751 - RNA, 23 nt, Human
ugggaggccgagguggguggauc

SEQ ID NO: 740752 - RNA, 24 nt, Human
ugggaggccgagguggguggauca

SEQ ID NO: 740753 - RNA, 20 nt, Human
ugggagguggagguuguggu

SEQ ID NO: 740754 - RNA, 24 nt, Human
ugggagguggagguuguggugagc

SEQ ID NO: 740755 - RNA, 19 nt, Human
ugggauuacaagcgugagc

SEQ ID NO: 740756 - RNA, 21 nt, Human
ugggauuacaagcgugagcca

SEQ ID NO: 740757 - RNA, 22 nt, Human
ugggauuacaagcgugagccac

SEQ ID NO: 740758 - RNA, 22 nt, Human
ugggauuacaagcgugagccac

SEQ ID NO: 740759 - RNA, 24 nt, Human
ugggauuacaagcgugagccacug

SEQ ID NO: 740760 - RNA, 24 nt, Human
ugggauuacaagcgugagccacug

SEQ ID NO: 740761 - RNA, 24 nt, Human
ugggauuauagcacugugagcugc

SEQ ID NO: 740762 - RNA, 26 nt, Human
ugggauuauagcacugugagcugcca

SEQ ID NO: 740763 - RNA, 27 nt, Human
ugggauuauagcacugugagcugccaa

SEQ ID NO: 740764 - RNA, 24 nt, Human
ugggcucaagugauccuccagccu

SEQ ID NO: 740765 - RNA, 23 nt, Human
uggggagaugucaggcccgucac

SEQ ID NO: 740766 - RNA, 23 nt, Human
uggggcaaccguggaaggccaca

SEQ ID NO: 740767 - RNA, 23 nt, Human
uggggccaagcagcaggcagcga

SEQ ID NO: 740768 - RNA, 24 nt, Human
uggggucucacgguguugcccagg

SEQ ID NO: 740769 - RNA, 24 nt, Human
ugggguuucaccauguuggccagg

SEQ ID NO: 740770 - RNA, 21 nt, Human
uggugcgcaccuguaauccca

SEQ ID NO: 740771 - RNA, 18 nt, Human
ugguucaagugauucucu

SEQ ID NO: 740772 - RNA, 19 nt, Human
uguaaccccagcuacucag

SEQ ID NO: 740773 - RNA, 25 nt, Human
uguaaccccagcuacucaggaggau

SEQ ID NO: 740774 - RNA, 24 nt, Human
ugucucaaaacaaaacaaaaaaag

SEQ ID NO: 740775 - RNA, 20 nt, Human
ugucuccaggauguguccug

SEQ ID NO: 740776 - RNA, 25 nt, Human
uguguccugcugucugccccguggg

SEQ ID NO: 740777 - RNA, 21 nt, Human
uguguuuuuaguagagauggg

SEQ ID NO: 740778 - RNA, 21 nt, Human
uguucugcacccagugcccag

SEQ ID NO: 740779 - RNA, 19 nt, Human
uguugcccagguuggucug

SEQ ID NO: 740780 - RNA, 28 nt, Human
uuaagggaaugagaaaaagggcagguca

SEQ ID NO: 740781 - RNA, 23 nt, Human
uuaccuuagaaagacaaaguggg

SEQ ID NO: 740782 - RNA, 18 nt, Human
uuaguagagaugggguuu

SEQ ID NO: 740783 - RNA, 22 nt, Human
uuaguagagaugggguuucacc

SEQ ID NO: 740784 - RNA, 24 nt, Human
uuaguagagaugggguuucaccau

SEQ ID NO: 740785 - RNA, 23 nt, Human
uucaagugauucucuugccucag

SEQ ID NO: 740786 - RNA, 19 nt, Human
uuccauaaagucccaggag

SEQ ID NO: 740787 - RNA, 22 nt, Human
uuccuggguccuguuccuuugc

SEQ ID NO: 740788 - RNA, 24 nt, Human
uugaaccugggagguggagguugu

SEQ ID NO: 740789 - RNA, 21 nt, Human
uugcacuccagccuggguaau

SEQ ID NO: 740790 - RNA, 18 nt, Human
uugcccccugccaagacc

SEQ ID NO: 740791 - RNA, 25 nt, Human
uugggaggccgagguggguggauca

SEQ ID NO: 740792 - RNA, 22 nt, Human
uuguggugagccaagaucgugc

SEQ ID NO: 740793 - RNA, 19 nt, Human
uuucaccauguuggccagg

SEQ ID NO: 740794 - RNA, 20 nt, Human
uuucaccauguuggccagga

SEQ ID NO: 740795 - RNA, 23 nt, Human
uuuccugaauucugugcccaggg

SEQ ID NO: 740796 - RNA, 27 nt, Human
uuugcuuucucuuucucuucuuuaccu

SEQ ID NO: 740797 - RNA, 21 nt, Human
uuugucuccccaaccuugucu

SEQ ID NO: 740798 - RNA, 19 nt, Human
uuuguguggagucucguuc

SEQ ID NO: 740799 - RNA, 24 nt, Human
uuuguguuuuuaguagagaugggg

SEQ ID NO: 740800 - RNA, 24 nt, Human
uuuuuaguagagaugggguuucac

SEQ ID NO: 740801 - RNA, 20 nt, Human
uuuuuguguuuuuaguagag

SEQ ID NO: 740802 - RNA, 18 nt, Human
uuuuuugguagggaagag

SEQ ID NO: 740803 - RNA, 21 nt, Human
aaaaauaaggcagaaaacuca

SEQ ID NO: 740804 - RNA, 22 nt, Human
aaaaggaaacagaauuuaagca

SEQ ID NO: 740805 - RNA, 23 nt, Human
aaaauaaggcagaaaacucagaa

SEQ ID NO: 740806 - RNA, 21 nt, Human
aaacagcuuuacucagacuuu

SEQ ID NO: 740807 - RNA, 23 nt, Human
aacaaagguaagaaaaaaggaaa

SEQ ID NO: 740808 - RNA, 20 nt, Human
aagaaaccuguaucuuacug

SEQ ID NO: 740809 - RNA, 23 nt, Human
aagcaaauauaaaauacaaaaaa

SEQ ID NO: 740810 - RNA, 26 nt, Human
aagcaaauauaaaauacaaaaaacag

SEQ ID NO: 740811 - RNA, 23 nt, Human
aaggucccagguaccucugccuu

SEQ ID NO: 740812 - RNA, 20 nt, Human
acaaaaaacagcuuuacuca

SEQ ID NO: 740813 - RNA, 24 nt, Human
acaaauccuggcucagccuaacca

SEQ ID NO: 740814 - RNA, 29 nt, Human
agacagcaaacaaagguaagagggacccc

SEQ ID NO: 740815 - RNA, 19 nt, Human
aggaaaugcauguaaccac

SEQ ID NO: 740816 - RNA, 20 nt, Human
aggcagaaaacucagaauuu

SEQ ID NO: 740817 - RNA, 26 nt, Human
aggcguuggggcugagcuagcgagcc

SEQ ID NO: 740818 - RNA, 23 nt, Human
agguaugauuacagacacacuca

SEQ ID NO: 740819 - RNA, 26 nt, Human
agucacauucacugguaauucuacau

SEQ ID NO: 740820 - RNA, 22 nt, Human
agugaucaaaacaugaaaggaa

SEQ ID NO: 740821 - RNA, 18 nt, Human
auaacagaagaaacaagu

SEQ ID NO: 740822 - RNA, 21 nt, Human
caaauauaagaacuaaacauu

SEQ ID NO: 740823 - RNA, 25 nt, Human
caagaauaaacagacaucuuaggug

SEQ ID NO: 740824 - RNA, 19 nt, Human
cacauucacugguaauucu

SEQ ID NO: 740825 - RNA, 23 nt, Human
cagcuuuacucagacuuuuugac

SEQ ID NO: 740826 - RNA, 23 nt, Human
cccaaacauuagugguguggagg

SEQ ID NO: 740827 - RNA, 19 nt, Human
ccuaaaauauagauuccua

SEQ ID NO: 740828 - RNA, 26 nt, Human
ccuggcucagccuaaccagccuuggc

SEQ ID NO: 740829 - RNA, 24 nt, Human
cgaaaucaguuaacaaauauaaga

SEQ ID NO: 740830 - RNA, 19 nt, Human
cgcacaaacgcuccgggcc

SEQ ID NO: 740831 - RNA, 19 nt, Human
cgggccggauauccucagc

SEQ ID NO: 740832 - RNA, 20 nt, Human
cuaggcucuaauccugagau

SEQ ID NO: 740833 - RNA, 27 nt, Human
cucauugcccagacucaggauccugcu

SEQ ID NO: 740834 - RNA, 22 nt, Human
cuccgcgccgcacaaacgcucc

SEQ ID NO: 740835 - RNA, 25 nt, Human
cucugggcagcggcaacccuggucc

SEQ ID NO: 740836 - RNA, 22 nt, Human
cugaaggucuccuuguggcugg

SEQ ID NO: 740837 - RNA, 18 nt, Human
cugggcaccaugcccagg

SEQ ID NO: 740838 - RNA, 24 nt, Human
gaaaugcauguaaccacuuugaua

SEQ ID NO: 740839 - RNA, 27 nt, Human
gcacaaacgcuccgggccggauauccu

SEQ ID NO: 740840 - RNA, 22 nt, Human
ggagcagagcccaaacuucugc

SEQ ID NO: 740841 - RNA, 24 nt, Human
ggauccugcuucuugcccagauug

SEQ ID NO: 740842 - RNA, 18 nt, Human
ggccggauauccucagcc

SEQ ID NO: 740843 - RNA, 24 nt, Human
gggaacccguacaacagcccaagc

SEQ ID NO: 740844 - RNA, 27 nt, Human
gguuuggagcagagcccaaacuucugc

SEQ ID NO: 740845 - RNA, 23 nt, Human
guauaacagaagaaacaaguucc

SEQ ID NO: 740846 - RNA, 18 nt, Human
gucccuugucagaaaaca

SEQ ID NO: 740847 - RNA, 21 nt, Human
guguagccggaaguucaugca

SEQ ID NO: 740848 - RNA, 21 nt, Human
guugcaauguagauuuagauu

SEQ ID NO: 740849 - RNA, 28 nt, Human
uaaauaacaaacuucaauacgauguuga

SEQ ID NO: 740850 - RNA, 21 nt, Human
uaacaaacuucaauacgaugu

SEQ ID NO: 740851 - RNA, 24 nt, Human
uaccucugccuucccauauuugaa

SEQ ID NO: 740852 - RNA, 24 nt, Human
uagccucauucaugugaagacaac

SEQ ID NO: 740853 - RNA, 22 nt, Human
uagugacaguaaaauggcagaa

SEQ ID NO: 740854 - RNA, 21 nt, Human
uauucaagacaccgaaaucag

SEQ ID NO: 740855 - RNA, 18 nt, Human
uauucauagaaaaugauu

SEQ ID NO: 740856 - RNA, 24 nt, Human
ucacauucacugguaauucuacau

SEQ ID NO: 740857 - RNA, 21 nt, Human
uccacuccaguggaaacuaaa

SEQ ID NO: 740858 - RNA, 22 nt, Human
uccacuccaguggaaacuaaag

SEQ ID NO: 740859 - RNA, 18 nt, Human
ucccaagaaaaauaaggc

SEQ ID NO: 740860 - RNA, 18 nt, Human
uccucagccuucagaguc

SEQ ID NO: 740861 - RNA, 20 nt, Human
ucucaaacuacaaagugccu

SEQ ID NO: 740862 - RNA, 21 nt, Human
ucugggcaccaugcccaggga

SEQ ID NO: 740863 - RNA, 19 nt, Human
ugacugccauguccuccuu

SEQ ID NO: 740864 - RNA, 23 nt, Human
ugagauucugacucauucagucu

SEQ ID NO: 740865 - RNA, 28 nt, Human
ugauaguauaacagaagaaacaaguucc

SEQ ID NO: 740866 - RNA, 20 nt, Human
ugaucaaaacaugaaaggaa

SEQ ID NO: 740867 - RNA, 19 nt, Human
ugaugacaaauccuggcuc

SEQ ID NO: 740868 - RNA, 18 nt, Human
ugauuuggcagaguccuc

SEQ ID NO: 740869 - RNA, 21 nt, Human
ugccauguccuccuuuagaag

SEQ ID NO: 740870 - RNA, 22 nt, Human
ugggaaaauucuacccugcaca

SEQ ID NO: 740871 - RNA, 20 nt, Human
ugggcagcggcaacccuggu

SEQ ID NO: 740872 - RNA, 23 nt, Human
ugguuaucccaagaaaaauaagg

SEQ ID NO: 740873 - RNA, 23 nt, Human
uguagguaugauuacagacacac

SEQ ID NO: 740874 - RNA, 18 nt, Human
uuaucccaagaaaaauaa

SEQ ID NO: 740875 - RNA, 20 nt, Human
uuccuaggcucuaauccuga

SEQ ID NO: 740876 - RNA, 22 nt, Human
uucucaaacuacaaagugccug

SEQ ID NO: 740877 - RNA, 19 nt, Human
aaaaaaaaaaaaaagaaaa

SEQ ID NO: 740878 - RNA, 20 nt, Human
aaaagcgcuuggcacacagu

SEQ ID NO: 740879 - RNA, 21 nt, Human
aaacagucaaugggauuaguc

SEQ ID NO: 740880 - RNA, 24 nt, Human
aaagaaaaaaaaaguaauaaauua

SEQ ID NO: 740881 - RNA, 27 nt, Human
aaagcucccucaccagagugcccuucg

SEQ ID NO: 740882 - RNA, 18 nt, Human
aacacagaugacuugucc

SEQ ID NO: 740883 - RNA, 30 nt, Human
aacaccuauucauccaucaaagcuccagcc

SEQ ID NO: 740884 - RNA, 24 nt, Human
aacagagugagacucugucucaaa

SEQ ID NO: 740885 - RNA, 19 nt, Human
aacauggugaaaccccguc

SEQ ID NO: 740886 - RNA, 20 nt, Human
aacauggugaaaccccgucu

SEQ ID NO: 740887 - RNA, 23 nt, Human
aagccacccuugucccccauucu

SEQ ID NO: 740888 - RNA, 19 nt, Human
aagcgaugucuccaccuuc

SEQ ID NO: 740889 - RNA, 24 nt, Human
aagcugaggcaggacaaucgcuug

SEQ ID NO: 740890 - RNA, 22 nt, Human
aaucaugaggucaggaguucga

SEQ ID NO: 740891 - RNA, 24 nt, Human
aaucaugaggucaggaguucgaga

SEQ ID NO: 740892 - RNA, 18 nt, Human
aaucgcuugaacuuggga

SEQ ID NO: 740893 - RNA, 24 nt, Human
aaucgcuugaacuugggaggcgga

SEQ ID NO: 740894 - RNA, 22 nt, Human
acaaacacagaugacuugucca

SEQ ID NO: 740895 - RNA, 24 nt, Human
acaaacacagaugacuuguccaaa

SEQ ID NO: 740896 - RNA, 20 nt, Human
acaaggccaggccaaggcag

SEQ ID NO: 740897 - RNA, 21 nt, Human
acacggcaucuuguccagggu

SEQ ID NO: 740898 - RNA, 18 nt, Human
acacugaguguuucugga

SEQ ID NO: 740899 - RNA, 21 nt, Human
acagagugagacucugucuca

SEQ ID NO: 740900 - RNA, 24 nt, Human
acagagugagacucugucucaaaa

SEQ ID NO: 740901 - RNA, 22 nt, Human
accaacauggugaaaccccguc

SEQ ID NO: 740902 - RNA, 20 nt, Human
accagacccuccauucaagc

SEQ ID NO: 740903 - RNA, 24 nt, Human
accccgucuguacuaaaaauacaa

SEQ ID NO: 740904 - RNA, 20 nt, Human
accccucugcccagauccgg

SEQ ID NO: 740905 - RNA, 24 nt, Human
acgccgcugcacuccagcccgggc

SEQ ID NO: 740906 - RNA, 25 nt, Human
acgccgcugcacuccagcccgggca

SEQ ID NO: 740907 - RNA, 19 nt, Human
acuccauccccucaaaugg

SEQ ID NO: 740908 - RNA, 28 nt, Human
acucugucucaaaaaaaaaaaaaaaaaa

SEQ ID NO: 740909 - RNA, 24 nt, Human
acugaguguuucuggaaguagcug

SEQ ID NO: 740910 - RNA, 18 nt, Human
agaaaaacuggaaaacac

SEQ ID NO: 740911 - RNA, 24 nt, Human
agcaaggaccgagauggcuucucg

SEQ ID NO: 740912 - RNA, 24 nt, Human
agcccgggcaacagagugagacuc

SEQ ID NO: 740913 - RNA, 24 nt, Human
agccugaccaacauggugaaaccc

SEQ ID NO: 740914 - RNA, 23 nt, Human
agcugggcauaguggugggcgcc

SEQ ID NO: 740915 - RNA, 24 nt, Human
aggcaaaucaugaggucaggaguu

SEQ ID NO: 740916 - RNA, 18 nt, Human
aggcagacucuauauaua

SEQ ID NO: 740917 - RNA, 23 nt, Human
aggcagccgagaaauuccgagga

SEQ ID NO: 740918 - RNA, 21 nt, Human
aggcaggacaaucgcuugaac

SEQ ID NO: 740919 - RNA, 24 nt, Human
aggcaggacaaucgcuugaacuug

SEQ ID NO: 740920 - RNA, 24 nt, Human
aggcaggcaaaucaugaggucagg

SEQ ID NO: 740921 - RNA, 24 nt, Human
aggccaaggcagagccugagggga

SEQ ID NO: 740922 - RNA, 25 nt, Human
aggcggagguugcagugacaacggu

SEQ ID NO: 740923 - RNA, 20 nt, Human
aggcggagguugcagugagc

SEQ ID NO: 740924 - RNA, 24 nt, Human
aggcggagguugcagugagcugag

SEQ ID NO: 740925 - RNA, 19 nt, Human
aggcuggcugagggagaag

SEQ ID NO: 740926 - RNA, 20 nt, Human
agggcagaggcagccgagaa

SEQ ID NO: 740927 - RNA, 21 nt, Human
aggggccgggagagggucggg

SEQ ID NO: 740928 - RNA, 21 nt, Human
aggugccuggggcaagaccug

SEQ ID NO: 740929 - RNA, 18 nt, Human
agugcccaccuggggagc

SEQ ID NO: 740930 - RNA, 24 nt, Human
aguggcucacgccuguaaucccag

SEQ ID NO: 740931 - RNA, 24 nt, Human
aguggugggcgccuguaaucccag

SEQ ID NO: 740932 - RNA, 24 nt, Human
aucacgccgcugcacuccagcccg

SEQ ID NO: 740933 - RNA, 19 nt, Human
aucaugaggucaggaguuc

SEQ ID NO: 740934 - RNA, 19 nt, Human
auggagggaaccccuaaca

SEQ ID NO: 740935 - RNA, 18 nt, Human
caaacagagucccaggug

SEQ ID NO: 740936 - RNA, 25 nt, Human
caaaggcaggcaaaucaugagguca

SEQ ID NO: 740937 - RNA, 19 nt, Human
caaagugcauccuucucag

SEQ ID NO: 740938 - RNA, 21 nt, Human
caacauggugaaaccccgucu

SEQ ID NO: 740939 - RNA, 22 nt, Human
caacauggugaaaccccgucug

SEQ ID NO: 740940 - RNA, 18 nt, Human
caagcacauucucugagc

SEQ ID NO: 740941 - RNA, 21 nt, Human
caagcgaugucuccaccuucc

SEQ ID NO: 740942 - RNA, 20 nt, Human
caaggaaacugaggcacaga

SEQ ID NO: 740943 - RNA, 24 nt, Human
caaggaaacugaggcacagagugg

SEQ ID NO: 740944 - RNA, 26 nt, Human
caaggcagagccugaggggaggggac

SEQ ID NO: 740945 - RNA, 21 nt, Human
cacagcaucaugggggaugag

SEQ ID NO: 740946 - RNA, 23 nt, Human
cacagugaagcugaaauucaaac

SEQ ID NO: 740947 - RNA, 20 nt, Human
caccaccuccagccuucuca

SEQ ID NO: 740948 - RNA, 24 nt, Human
caccagacccuccauucaagcucc

SEQ ID NO: 740949 - RNA, 24 nt, Human
cacgccuguaaucccagcacuuug

SEQ ID NO: 740950 - RNA, 19 nt, Human
cacggccaagggcuuacuc

SEQ ID NO: 740951 - RNA, 20 nt, Human
cacuccagcccgggcaacag

SEQ ID NO: 740952 - RNA, 22 nt, Human
cacuccagcccgggcaacagag

SEQ ID NO: 740953 - RNA, 24 nt, Human
cacuccagcccgggcaacagagug

SEQ ID NO: 740954 - RNA, 21 nt, Human
cagcacuuugggaggcaaagg

SEQ ID NO: 740955 - RNA, 24 nt, Human
cagcacuuugggaggcaaaggcag

SEQ ID NO: 740956 - RNA, 19 nt, Human
cagcuccaggauggaagga

SEQ ID NO: 740957 - RNA, 20 nt, Human
caggauggaaggagggggug

SEQ ID NO: 740958 - RNA, 22 nt, Human
caggcaaaucaugaggucagga

SEQ ID NO: 740959 - RNA, 18 nt, Human
cagggccugcaaacagag

SEQ ID NO: 740960 - RNA, 23 nt, Human
ccaccaagcucuugcgguucccg

SEQ ID NO: 740961 - RNA, 19 nt, Human
ccaggguagacuggacaag

SEQ ID NO: 740962 - RNA, 24 nt, Human
ccccauccaggcaugacuuuacgg

SEQ ID NO: 740963 - RNA, 21 nt, Human
cccgcaggacuggcauacugg

SEQ ID NO: 740964 - RNA, 22 nt, Human
cccgggcugagacugcgagagc

SEQ ID NO: 740965 - RNA, 20 nt, Human
ccgcugcacuccagcccggg

SEQ ID NO: 740966 - RNA, 21 nt, Human
ccgcugcacuccagcccgggc

SEQ ID NO: 740967 - RNA, 22 nt, Human
ccgcugcacuccagcccgggca

SEQ ID NO: 740968 - RNA, 24 nt, Human
ccgcugcacuccagcccgggcaac

SEQ ID NO: 740969 - RNA, 20 nt, Human
ccgggcaaaggggaaauuua

SEQ ID NO: 740970 - RNA, 19 nt, Human
ccucaaacacacggcaucu

SEQ ID NO: 740971 - RNA, 24 nt, Human
ccucgcuggggucucagcugcuuu

SEQ ID NO: 740972 - RNA, 23 nt, Human
ccugaccaacauggugaaacccc

SEQ ID NO: 740973 - RNA, 24 nt, Human
ccugaccaacauggugaaaccccg

SEQ ID NO: 740974 - RNA, 18 nt, Human
ccuguaaucccagccacu

SEQ ID NO: 740975 - RNA, 24 nt, Human
cgagaccagccugaccaacauggu

SEQ ID NO: 740976 - RNA, 24 nt, Human
cgccuguaaucccagcacuuuggg

SEQ ID NO: 740977 - RNA, 24 nt, Human
cgccuguaaucccagccacuuggg

SEQ ID NO: 740978 - RNA, 23 nt, Human
cgcugcacuccagcccgggcaac

SEQ ID NO: 740979 - RNA, 24 nt, Human
cgcugcacuccagcccgggcaaca

SEQ ID NO: 740980 - RNA, 21 nt, Human
cgcuugaacuugggaggcgga

SEQ ID NO: 740981 - RNA, 21 nt, Human
cggaaaaaacauugcacaaga

SEQ ID NO: 740982 - RNA, 19 nt, Human
cggcagccacguccucggc

SEQ ID NO: 740983 - RNA, 21 nt, Human
cgggcaacagagugagacucu

SEQ ID NO: 740984 - RNA, 22 nt, Human
cguggcaggcucagcuccuucu

SEQ ID NO: 740985 - RNA, 19 nt, Human
cguugcacggcccgggcug

SEQ ID NO: 740986 - RNA, 22 nt, Human
cuauucauccaucaaagcucca

SEQ ID NO: 740987 - RNA, 18 nt, Human
cucaaaaaaaaaaaaaaa

SEQ ID NO: 740988 - RNA, 22 nt, Human
cucacgccuguaaucccagcac

SEQ ID NO: 740989 - RNA, 24 nt, Human
cucacgccuguaaucccagcacuu

SEQ ID NO: 740990 - RNA, 19 nt, Human
cucccauaucccuucucca

SEQ ID NO: 740991 - RNA, 19 nt, Human
cucugucucaaaaaaaaaa

SEQ ID NO: 740992 - RNA, 21 nt, Human
cucuugcgguucccgcugcgg

SEQ ID NO: 740993 - RNA, 19 nt, Human
cugcacuccagcccgggca

SEQ ID NO: 740994 - RNA, 22 nt, Human
cugcacuccagcccgggcaaca

SEQ ID NO: 740995 - RNA, 23 nt, Human
cugcacuccagcccgggcaacag

SEQ ID NO: 740996 - RNA, 23 nt, Human
cuuacucugcugggccucaaaca

SEQ ID NO: 740997 - RNA, 20 nt, Human
cuucuggagcccgcggcgcc

SEQ ID NO: 740998 - RNA, 21 nt, Human
cuuuuauucacugccagcucc

SEQ ID NO: 740999 - RNA, 20 nt, Human
gaaauucaaacuugagccuc

SEQ ID NO: 741000 - RNA, 18 nt, Human
gaagccagcaggauugga

SEQ ID NO: 741001 - RNA, 20 nt, Human
gacucagaaagggaagcaga

SEQ ID NO: 741002 - RNA, 23 nt, Human
gagagcggggucggaggcggggu

SEQ ID NO: 741003 - RNA, 23 nt, Human
gagaucacgccgcugcacuccag

SEQ ID NO: 741004 - RNA, 18 nt, Human
gagcgugccccgagacag

SEQ ID NO: 741005 - RNA, 22 nt, Human
gagguugcagugagcugagauc

SEQ ID NO: 741006 - RNA, 24 nt, Human
gcaacagagugagacucugucuca

SEQ ID NO: 741007 - RNA, 18 nt, Human
gcacagagugggaaagcc

SEQ ID NO: 741008 - RNA, 22 nt, Human
gcacagccuuggucuacccucc

SEQ ID NO: 741009 - RNA, 20 nt, Human
gcgagggaccaucuucugcc

SEQ ID NO: 741010 - RNA, 20 nt, Human
gcggggugaccggccgccuu

SEQ ID NO: 741011 - RNA, 19 nt, Human
gcuccagcucccauauccc

SEQ ID NO: 741012 - RNA, 24 nt, Human
gcugcacuccagcccgggcaacag

SEQ ID NO: 741013 - RNA, 22 nt, Human
ggacacugaguguuucuggaag

SEQ ID NO: 741014 - RNA, 26 nt, Human
ggagggcguuccuaccaccaagcucu

SEQ ID NO: 741015 - RNA, 20 nt, Human
ggaggggaaugagaccaggu

SEQ ID NO: 741016 - RNA, 22 nt, Human
ggagguugcagugagcugagau

SEQ ID NO: 741017 - RNA, 23 nt, Human
ggagguugcagugagcugagauc

SEQ ID NO: 741018 - RNA, 24 nt, Human
ggagguugcagugagcugagauca

SEQ ID NO: 741019 - RNA, 23 nt, Human
ggcaggcaaaucaugaggucagg

SEQ ID NO: 741020 - RNA, 23 nt, Human
ggcauaguggugggcgccuguaa

SEQ ID NO: 741021 - RNA, 24 nt, Human
ggcccgggcugagacugcgagagc

SEQ ID NO: 741022 - RNA, 24 nt, Human
ggcgccuguaaucccagccacuug

SEQ ID NO: 741023 - RNA, 24 nt, Human
gggcccaguggcucacgccuguaa

SEQ ID NO: 741024 - RNA, 20 nt, Human
ggguagacuggacaaggcca

SEQ ID NO: 741025 - RNA, 23 nt, Human
gguagguguggggaggggaauga

SEQ ID NO: 741026 - RNA, 20 nt, Human
ggugaucgugggacaggucu

SEQ ID NO: 741027 - RNA, 19 nt, Human
guugcagugagcugagauc

SEQ ID NO: 741028 - RNA, 25 nt, Human
uacagaaaaacuggaaaacacaaac

SEQ ID NO: 741029 - RNA, 18 nt, Human
uagcugggcauaguggug

SEQ ID NO: 741030 - RNA, 19 nt, Human
uaucagugcccaccugggg

SEQ ID NO: 741031 - RNA, 26 nt, Human
uauucauccaucaaagcuccagcucc

SEQ ID NO: 741032 - RNA, 24 nt, Human
ucaaaaaaaaaaaaaaaaaaagaa

SEQ ID NO: 741033 - RNA, 18 nt, Human
ucaaagcuccagcuccca

SEQ ID NO: 741034 - RNA, 24 nt, Human
ucaaagcuccagcucccauauccc

SEQ ID NO: 741035 - RNA, 21 nt, Human
ucaacuccauccccucaaaug

SEQ ID NO: 741036 - RNA, 19 nt, Human
ucagaauccaguccaucgc

SEQ ID NO: 741037 - RNA, 21 nt, Human
ucagcccagagggcagggccu

SEQ ID NO: 741038 - RNA, 20 nt, Human
ucagcuccuucuggagcccg

SEQ ID NO: 741039 - RNA, 24 nt, Human
ucaugaggucaggaguucgagacc

SEQ ID NO: 741040 - RNA, 23 nt, Human
ucaugggggaugagcuggggcug

SEQ ID NO: 741041 - RNA, 25 nt, Human
uccaaagugcauccuucucagccca

SEQ ID NO: 741042 - RNA, 20 nt, Human
uccaccuuccagcaaggacc

SEQ ID NO: 741043 - RNA, 21 nt, Human
uccauagccggaagaugggag

SEQ ID NO: 741044 - RNA, 18 nt, Human
ucccagagccacacagug

SEQ ID NO: 741045 - RNA, 18 nt, Human
uccccauccaggcaugac

SEQ ID NO: 741046 - RNA, 18 nt, Human
uccccauccaggcaugac

SEQ ID NO: 741047 - RNA, 18 nt, Human
ucccucaccagagugccc

SEQ ID NO: 741048 - RNA, 21 nt, Human
ucgaagguccccguugcacgg

SEQ ID NO: 741049 - RNA, 24 nt, Human
ucgcuugaacuugggaggcggagg

SEQ ID NO: 741050 - RNA, 21 nt, Human
ucugagcugcggaagugcuug

SEQ ID NO: 741051 - RNA, 23 nt, Human
ucuggaaguagcuggacguaauc

SEQ ID NO: 741052 - RNA, 24 nt, Human
ucuguacuaaaaauacaaaaaauu

SEQ ID NO: 741053 - RNA, 23 nt, Human
ucugucucaaaaaaaaaaaaaaa

SEQ ID NO: 741054 - RNA, 28 nt, Human
ugaacaccuauucauccaucaaagcucc

SEQ ID NO: 741055 - RNA, 20 nt, Human
ugacaccaccuccagccuuc

SEQ ID NO: 741056 - RNA, 18 nt, Human
ugacaccagaacacaagc

SEQ ID NO: 741057 - RNA, 24 nt, Human
ugacaccagacccuccauucaagc

SEQ ID NO: 741058 - RNA, 24 nt, Human
ugaccaacauggugaaaccccguc

SEQ ID NO: 741059 - RNA, 18 nt, Human
ugaccggccgccuuccuc

SEQ ID NO: 741060 - RNA, 20 nt, Human
ugacgagaggguggagcugg

SEQ ID NO: 741061 - RNA, 22 nt, Human
ugagaggaauuguuuacggaca

SEQ ID NO: 741062 - RNA, 22 nt, Human
ugagcugagaucacgccgcugc

SEQ ID NO: 741063 - RNA, 23 nt, Human
ugaggcaggacaaucgcuugaac

SEQ ID NO: 741064 - RNA, 20 nt, Human
ugaugacaccaccuccagcc

SEQ ID NO: 741065 - RNA, 21 nt, Human
ugccccauccagccccgauug

SEQ ID NO: 741066 - RNA, 20 nt, Human
ugccuggggcaagaccuggc

SEQ ID NO: 741067 - RNA, 24 nt, Human
uggaaagcucccucaccagagugc

SEQ ID NO: 741068 - RNA, 21 nt, Human
uggaaggagggggugaaucau

SEQ ID NO: 741069 - RNA, 18 nt, Human
uggaagggaagcuggugg

SEQ ID NO: 741070 - RNA, 21 nt, Human
uggaggcugccuuggcaguuc

SEQ ID NO: 741071 - RNA, 22 nt, Human
uggcucacgccuguaaucccag

SEQ ID NO: 741072 - RNA, 24 nt, Human
uggcucacgccuguaaucccagca

SEQ ID NO: 741073 - RNA, 19 nt, Human
ugggaggcaaaggcaggca

SEQ ID NO: 741074 - RNA, 24 nt, Human
ugggaggcaaaggcaggcaaauca

SEQ ID NO: 741075 - RNA, 24 nt, Human
ugggaggcggagguugcagugagc

SEQ ID NO: 741076 - RNA, 19 nt, Human
uggguagguguggggaggg

SEQ ID NO: 741077 - RNA, 21 nt, Human
uggugggaaguggccuucaga

SEQ ID NO: 741078 - RNA, 21 nt, Human
uggugggcgccuguaauccca

SEQ ID NO: 741079 - RNA, 18 nt, Human
uuagcugggcauaguggu

SEQ ID NO: 741080 - RNA, 24 nt, Human
uuagcugggcauaguggugggcgc

SEQ ID NO: 741081 - RNA, 18 nt, Human
uucugccgucugcccucc

SEQ ID NO: 741082 - RNA, 22 nt, Human
uucugggugucaggcugguggc

SEQ ID NO: 741083 - RNA, 24 nt, Human
uugaacuugggaggcggagguugc

SEQ ID NO: 741084 - RNA, 21 nt, Human
uugacaccagaacacaagcga

SEQ ID NO: 741085 - RNA, 18 nt, Human
uugcagugagcugagauc

SEQ ID NO: 741086 - RNA, 20 nt, Human
uugcagugagcugagaucac

SEQ ID NO: 741087 - RNA, 21 nt, Human
uugcagugagcugagaucacg

SEQ ID NO: 741088 - RNA, 24 nt, Human
uugggaagcugaggcaggacaauc

SEQ ID NO: 741089 - RNA, 20 nt, Human
uuuacaaagccacccuuguc

SEQ ID NO: 741090 - RNA, 28 nt, Human
uuuacggaaaaaacauugcacaagaaaa

SEQ ID NO: 741091 - RNA, 22 nt, Human
uuuagggcagaggcagccgaga

SEQ ID NO: 741092 - RNA, 20 nt, Human
uuucuggcuugaacuucauc

SEQ ID NO: 741093 - RNA, 21 nt, Human
aaaaacaaaaaaacaacaaaa

SEQ ID NO: 741094 - RNA, 30 nt, Human
aaaaacaaaaacaaaaaaacaacaaaaaag

SEQ ID NO: 741095 - RNA, 22 nt, Human
aaaaacaacaaaaaaacccccu

SEQ ID NO: 741096 - RNA, 19 nt, Human
aaaaacccccuguaacuaa

SEQ ID NO: 741097 - RNA, 26 nt, Human
aaaacaaaaaaacaacaaaaaaaccc

SEQ ID NO: 741098 - RNA, 27 nt, Human
aaaacaaaaacaaaaacaaaaaaacaa

SEQ ID NO: 741099 - RNA, 23 nt, Human
aaacaaaaacaaaaaaacaacaa

SEQ ID NO: 741100 - RNA, 22 nt, Human
aaacaagcagacaaacaacacc

SEQ ID NO: 741101 - RNA, 25 nt, Human
aaaccccaccacccccgcaaaacaa

SEQ ID NO: 741102 - RNA, 19 nt, Human
aaacccccagcucacuccc

SEQ ID NO: 741103 - RNA, 21 nt, Human
aaacccccagcucacucccac

SEQ ID NO: 741104 - RNA, 22 nt, Human
aaacguggagauuaauucaugc

SEQ ID NO: 741105 - RNA, 21 nt, Human
aaagauguucucuuuugccuu

SEQ ID NO: 741106 - RNA, 22 nt, Human
aaauauuaaaaaguugcaaaau

SEQ ID NO: 741107 - RNA, 25 nt, Human
aacaaaaaaacccccuguaacuaac

SEQ ID NO: 741108 - RNA, 21 nt, Human
aacagagcaagacuccgucuc

SEQ ID NO: 741109 - RNA, 24 nt, Human
aacagagcaagacuccgucucaaa

SEQ ID NO: 741110 - RNA, 24 nt, Human
aaccccaccacccccgcaaaacaa

SEQ ID NO: 741111 - RNA, 19 nt, Human
aacccccagcucacuccca

SEQ ID NO: 741112 - RNA, 27 nt, Human
aacuccaucaacccaaaccuuucuaac

SEQ ID NO: 741113 - RNA, 23 nt, Human
aagaucgcgccacugcacuccag

SEQ ID NO: 741114 - RNA, 20 nt, Human
aagcagacaaacaacaccga

SEQ ID NO: 741115 - RNA, 23 nt, Human
aagcagacaaacaacaccgagca

SEQ ID NO: 741116 - RNA, 25 nt, Human
aagcagacaaacaacaccgagcaga

SEQ ID NO: 741117 - RNA, 26 nt, Human
aagcagacaaacaacaccgagcagag

SEQ ID NO: 741118 - RNA, 20 nt, Human
aagcgccucugagcaaaggc

SEQ ID NO: 741119 - RNA, 20 nt, Human
aauauggugaaaccccgucu

SEQ ID NO: 741120 - RNA, 21 nt, Human
aauauggugaaaccccgucuc

SEQ ID NO: 741121 - RNA, 24 nt, Human
aauugcucgaacccgggaggcgga

SEQ ID NO: 741122 - RNA, 22 nt, Human
acaaaaacaaaaaaacaacaaa

SEQ ID NO: 741123 - RNA, 24 nt, Human
acaaaaacaaaaaaacaacaaaaa

SEQ ID NO: 741124 - RNA, 21 nt, Human
acaacaaaaaaacccccugua

SEQ ID NO: 741125 - RNA, 23 nt, Human
acagagcaagacuccgucucaaa

SEQ ID NO: 741126 - RNA, 23 nt, Human
accacccccgcaaaacaaaaaca

SEQ ID NO: 741127 - RNA, 23 nt, Human
accccaccacccccgcaaaacaa

SEQ ID NO: 741128 - RNA, 19 nt, Human
accccaggggcgugcggga

SEQ ID NO: 741129 - RNA, 26 nt, Human
acccccgcaaaacaaaaacaaaaacc

SEQ ID NO: 741130 - RNA, 24 nt, Human
accccgucucuacuaaaaauacaa

SEQ ID NO: 741131 - RNA, 22 nt, Human
accgaugugcaaaagguuucug

SEQ ID NO: 741132 - RNA, 25 nt, Human
acuccaucaacccaaaccuuucuaa

SEQ ID NO: 741133 - RNA, 21 nt, Human
acuccgucucaaaccccacca

SEQ ID NO: 741134 - RNA, 24 nt, Human
acugcacuccagccuaggcaacag

SEQ ID NO: 741135 - RNA, 24 nt, Human
acugcacuccagccuaggcaacag

SEQ ID NO: 741136 - RNA, 18 nt, Human
agacaaacaacaccgagc

SEQ ID NO: 741137 - RNA, 24 nt, Human
agacaaacaacaccgagcagagca

SEQ ID NO: 741138 - RNA, 20 nt, Human
agacagacccugacucccuc

SEQ ID NO: 741139 - RNA, 24 nt, Human
agagcaagacuccgucucaaaccc

SEQ ID NO: 741140 - RNA, 24 nt, Human
agcacuuugggaggcggagguggg

SEQ ID NO: 741141 - RNA, 19 nt, Human
agcagacaaacaacaccga

SEQ ID NO: 741142 - RNA, 23 nt, Human
agccaggcguggugacacacgcc

SEQ ID NO: 741143 - RNA, 18 nt, Human
agccccggccgcagccuc

SEQ ID NO: 741144 - RNA, 24 nt, Human
agccuaggcaacagagcaagacuc

SEQ ID NO: 741145 - RNA, 19 nt, Human
agccuggccaauaugguga

SEQ ID NO: 741146 - RNA, 22 nt, Human
agccuggccaauauggugaaac

SEQ ID NO: 741147 - RNA, 24 nt, Human
agccuggccaauauggugaaaccc

SEQ ID NO: 741148 - RNA, 23 nt, Human
agcgaggcaagcagaagcccugg

SEQ ID NO: 741149 - RNA, 20 nt, Human
aggaguuugagaccagccug

SEQ ID NO: 741150 - RNA, 18 nt, Human
aggcaggagaauugcucg

SEQ ID NO: 741151 - RNA, 24 nt, Human
aggcaggagaauugcucgaacccg

SEQ ID NO: 741152 - RNA, 23 nt, Human
aggcauguguauaugugugugua

SEQ ID NO: 741153 - RNA, 21 nt, Human
aggcggagguggguggaucac

SEQ ID NO: 741154 - RNA, 24 nt, Human
aggcggagguugcagggggccaag

SEQ ID NO: 741155 - RNA, 24 nt, Human
aggcguggugacacacgccuguaa

SEQ ID NO: 741156 - RNA, 18 nt, Human
aggcugaggcaggagaau

SEQ ID NO: 741157 - RNA, 21 nt, Human
aggcugaggcaggagaauugc

SEQ ID NO: 741158 - RNA, 19 nt, Human
aggcuggggcagcgagagg

SEQ ID NO: 741159 - RNA, 21 nt, Human
agggaagggccccgacuggcg

SEQ ID NO: 741160 - RNA, 22 nt, Human
agggagcugaugccugucacag

SEQ ID NO: 741161 - RNA, 18 nt, Human
aggggacugcccuucagu

SEQ ID NO: 741162 - RNA, 24 nt, Human
agguggguggaucacaaggucagg

SEQ ID NO: 741163 - RNA, 21 nt, Human
aucacaaggucaggaguuuga

SEQ ID NO: 741164 - RNA, 23 nt, Human
aucgcgccacugcacuccagccu

SEQ ID NO: 741165 - RNA, 20 nt, Human
auggugaaaccccgucucua

SEQ ID NO: 741166 - RNA, 23 nt, Human
caaaaaaacaacaaaaaaacccc

SEQ ID NO: 741167 - RNA, 19 nt, Human
caaaaaaacccccuguaac

SEQ ID NO: 741168 - RNA, 23 nt, Human
caaaacaaaaacaaaaacaaaaa

SEQ ID NO: 741169 - RNA, 19 nt, Human
caaaacccccagcucacuc

SEQ ID NO: 741170 - RNA, 18 nt, Human
caaacaggacgcuuccuu

SEQ ID NO: 741171 - RNA, 22 nt, Human
caaaccccaccacccccgcaaa

SEQ ID NO: 741172 - RNA, 21 nt, Human
caaagcuauggacaaaacccc

SEQ ID NO: 741173 - RNA, 23 nt, Human
caaauagaaaacuauguuaaaau

SEQ ID NO: 741174 - RNA, 24 nt, Human
caacaaaaaaacccccuguaacua

SEQ ID NO: 741175 - RNA, 27 nt, Human
caacaaaaaaacccccuguaacuaaca

SEQ ID NO: 741176 - RNA, 18 nt, Human
caagcagaagcccugggc

SEQ ID NO: 741177 - RNA, 24 nt, Human
caagcagacaaacaacaccgagca

SEQ ID NO: 741178 - RNA, 24 nt, Human
caauauggugaaaccccgucucua

SEQ ID NO: 741179 - RNA, 24 nt, Human
cacaaggucaggaguuugagacca

SEQ ID NO: 741180 - RNA, 20 nt, Human
cacaugucuuuaggaauucg

SEQ ID NO: 741181 - RNA, 20 nt, Human
caccacccccgcaaaacaaa

SEQ ID NO: 741182 - RNA, 18 nt, Human
caccaggugggaggggac

SEQ ID NO: 741183 - RNA, 19 nt, Human
caccaggugggaggggacu

SEQ ID NO: 741184 - RNA, 21 nt, Human
caccaggugggaggggacugc

SEQ ID NO: 741185 - RNA, 22 nt, Human
cacccccgcaaaacaaaaacaa

SEQ ID NO: 741186 - RNA, 23 nt, Human
cacccccgcaaaacaaaaacaaa

SEQ ID NO: 741187 - RNA, 18 nt, Human
cacgccuguaaucccagc

SEQ ID NO: 741188 - RNA, 19 nt, Human
cacgccuguaaucccagcu

SEQ ID NO: 741189 - RNA, 24 nt, Human
cacuaaaaaugaagucuuuuuaua

SEQ ID NO: 741190 - RNA, 23 nt, Human
cacuccagccuaggcaacagagc

SEQ ID NO: 741191 - RNA, 19 nt, Human
cacugcacuccagccuagg

SEQ ID NO: 741192 - RNA, 21 nt, Human
cacugcacuccagccuaggca

SEQ ID NO: 741193 - RNA, 22 nt, Human
cacugcacuccagccuaggcaa

SEQ ID NO: 741194 - RNA, 23 nt, Human
cacugcacuccagccuaggcaac

SEQ ID NO: 741195 - RNA, 27 nt, Human
cacugcacuccagccuaggcaacagag

SEQ ID NO: 741196 - RNA, 22 nt, Human
cagacaucuuggcaucuauacu

SEQ ID NO: 741197 - RNA, 21 nt, Human
cagagaccaaggagcccgagc

SEQ ID NO: 741198 - RNA, 24 nt, Human
cagagcaagacuccgucucaaacc

SEQ ID NO: 741199 - RNA, 26 nt, Human
cagagcaagacuccgucucaaacccc

SEQ ID NO: 741200 - RNA, 23 nt, Human
cagcaaggugcggcugagguggg

SEQ ID NO: 741201 - RNA, 21 nt, Human
cagcacuuugggaggcggagg

SEQ ID NO: 741202 - RNA, 24 nt, Human
cagcacuuugggaggcggaggugg

SEQ ID NO: 741203 - RNA, 18 nt, Human
cagcaggcccagcagacg

SEQ ID NO: 741204 - RNA, 22 nt, Human
cagcgaggcaagcagaagcccu

SEQ ID NO: 741205 - RNA, 24 nt, Human
cagcuacucgggaggcugaggcag

SEQ ID NO: 741206 - RNA, 20 nt, Human
caggcccagcagacggggcc

SEQ ID NO: 741207 - RNA, 23 nt, Human
cauaccagugggcuucugccugc

SEQ ID NO: 741208 - RNA, 19 nt, Human
cauguguauaugugugugu

SEQ ID NO: 741209 - RNA, 24 nt, Human
cauguguauauguguguguauaua

SEQ ID NO: 741210 - RNA, 24 nt, Human
ccaaagcuauggacaaaaccccca

SEQ ID NO: 741211 - RNA, 26 nt, Human
ccacuaaucacugguaggaucauuuc

SEQ ID NO: 741212 - RNA, 19 nt, Human
ccacugcacuccagccuag

SEQ ID NO: 741213 - RNA, 20 nt, Human
ccacugcacuccagccuagg

SEQ ID NO: 741214 - RNA, 21 nt, Human
ccacugcacuccagccuaggc

SEQ ID NO: 741215 - RNA, 24 nt, Human
ccacugcacuccagccuaggcaac

SEQ ID NO: 741216 - RNA, 20 nt, Human
ccaggccagggaguacauug

SEQ ID NO: 741217 - RNA, 19 nt, Human
cccacaccugugucuaccu

SEQ ID NO: 741218 - RNA, 22 nt, Human
cccaccacccccgcaaaacaaa

SEQ ID NO: 741219 - RNA, 26 nt, Human
cccaccacccccgcaaaacaaaaaca

SEQ ID NO: 741220 - RNA, 20 nt, Human
cccauaccagugggcuucug

SEQ ID NO: 741221 - RNA, 21 nt, Human
cccauagccccggccgcagcc

SEQ ID NO: 741222 - RNA, 19 nt, Human
ccccaccacccccgcaaaa

SEQ ID NO: 741223 - RNA, 20 nt, Human
ccccaccacccccgcaaaac

SEQ ID NO: 741224 - RNA, 21 nt, Human
ccccaccacccccgcaaaaca

SEQ ID NO: 741225 - RNA, 22 nt, Human
cccccgcaaaacaaaaacaaaa

SEQ ID NO: 741226 - RNA, 25 nt, Human
ccccgcaaaacaaaaacaaaaacaa

SEQ ID NO: 741227 - RNA, 19 nt, Human
ccccugggagcacaggcug

SEQ ID NO: 741228 - RNA, 23 nt, Human
cccgugcgcaccgccacucuccu

SEQ ID NO: 741229 - RNA, 24 nt, Human
cccgugcgcaccgccacucuccug

SEQ ID NO: 741230 - RNA, 18 nt, Human
cccugggagcacaggcug

SEQ ID NO: 741231 - RNA, 23 nt, Human
cccuuaagcccuaaaacgacaac

SEQ ID NO: 741232 - RNA, 22 nt, Human
cccuuccgccgccccaggccgc

SEQ ID NO: 741233 - RNA, 22 nt, Human
ccgcaaaacaaaaacaaaaaca

SEQ ID NO: 741234 - RNA, 18 nt, Human
ccgccgccccaggccgcc

SEQ ID NO: 741235 - RNA, 18 nt, Human
ccgccgccccaggccgcc

SEQ ID NO: 741236 - RNA, 19 nt, Human
ccgccgccccaggccgccu

SEQ ID NO: 741237 - RNA, 24 nt, Human
ccgcggccccgguggagagggcgg

SEQ ID NO: 741238 - RNA, 21 nt, Human
ccgcugcuggccgagccacag

SEQ ID NO: 741239 - RNA, 21 nt, Human
ccgugcgcaccgccacucucc

SEQ ID NO: 741240 - RNA, 23 nt, Human
ccucacagagaccaaggagcccg

SEQ ID NO: 741241 - RNA, 20 nt, Human
ccucugagcaaaggcacggg

SEQ ID NO: 741242 - RNA, 23 nt, Human
ccuggccaauauggugaaacccc

SEQ ID NO: 741243 - RNA, 24 nt, Human
ccuggccaauauggugaaaccccg

SEQ ID NO: 741244 - RNA, 20 nt, Human
ccuguaacuaacaaaagagg

SEQ ID NO: 741245 - RNA, 21 nt, Human
ccuguaaucccagcuacucgg

SEQ ID NO: 741246 - RNA, 20 nt, Human
ccuguaauuccagcacuuug

SEQ ID NO: 741247 - RNA, 22 nt, Human
ccuguaauuccagcacuuuggg

SEQ ID NO: 741248 - RNA, 19 nt, Human
ccuuaagcccuaaaacgac

SEQ ID NO: 741249 - RNA, 18 nt, Human
ccuuccgccgccccaggc

SEQ ID NO: 741250 - RNA, 22 nt, Human
cgagacggagucucgcucuguc

SEQ ID NO: 741251 - RNA, 20 nt, Human
cgcaaaacaaaaacaaaaac

SEQ ID NO: 741252 - RNA, 22 nt, Human
cgcaaaacaaaaacaaaaacaa

SEQ ID NO: 741253 - RNA, 18 nt, Human
cgcaaacaagcagacaaa

SEQ ID NO: 741254 - RNA, 24 nt, Human
cgccacugcacuccagccuaggca

SEQ ID NO: 741255 - RNA, 23 nt, Human
cgccuguaaucccagcuacucgg

SEQ ID NO: 741256 - RNA, 24 nt, Human
cgccuguaaucccagcuacucggg

SEQ ID NO: 741257 - RNA, 23 nt, Human
cggagguggguggaucacaaggu

SEQ ID NO: 741258 - RNA, 21 nt, Human
cggggggcgccccuuccgccg

SEQ ID NO: 741259 - RNA, 19 nt, Human
cgucucaaaccccaccacc

SEQ ID NO: 741260 - RNA, 19 nt, Human
cgucucaaaccccaccacc

SEQ ID NO: 741261 - RNA, 21 nt, Human
cucacucccacaggaggggau

SEQ ID NO: 741262 - RNA, 24 nt, Human
cucaugccuguaauuccagcacuu

SEQ ID NO: 741263 - RNA, 21 nt, Human
cuccuggaaccgcugcuggcc

SEQ ID NO: 741264 - RNA, 19 nt, Human
cucugagcaaaggcacggg

SEQ ID NO: 741265 - RNA, 20 nt, Human
cucugcccauagccccggcc

SEQ ID NO: 741266 - RNA, 19 nt, Human
cugacucccuccacauggc

SEQ ID NO: 741267 - RNA, 22 nt, Human
cugcccauagccccggccgcag

SEQ ID NO: 741268 - RNA, 21 nt, Human
cuuggucccuuaacaauguau

SEQ ID NO: 741269 - RNA, 23 nt, Human
gagacccgcuccaucccucacag

SEQ ID NO: 741270 - RNA, 19 nt, Human
gaggcccauaccagugggc

SEQ ID NO: 741271 - RNA, 20 nt, Human
gaggcccauaccagugggcu

SEQ ID NO: 741272 - RNA, 30 nt, Human
gaggcggagguggguggaucacaaggucaa

SEQ ID NO: 741273 - RNA, 22 nt, Human
gagguggguggaucacaagguc

SEQ ID NO: 741274 - RNA, 19 nt, Human
gagguugcagggggccaag

SEQ ID NO: 741275 - RNA, 21 nt, Human
gaucacaaggucaggaguuug

SEQ ID NO: 741276 - RNA, 22 nt, Human
gaucacaaggucaggaguuuga

SEQ ID NO: 741277 - RNA, 24 nt, Human
gaucacaaggucaggaguuugaga

SEQ ID NO: 741278 - RNA, 22 nt, Human
gauccaaucacaacauggaugu

SEQ ID NO: 741279 - RNA, 18 nt, Human
gauugggccgggcgcggu

SEQ ID NO: 741280 - RNA, 24 nt, Human
gcacuccagccuaggcaacagagc

SEQ ID NO: 741281 - RNA, 20 nt, Human
gcauguguauaugugugugu

SEQ ID NO: 741282 - RNA, 19 nt, Human
gccaagaucgcgccacugc

SEQ ID NO: 741283 - RNA, 24 nt, Human
gccaauauggugaaaccccgucuc

SEQ ID NO: 741284 - RNA, 22 nt, Human
gcccauagccccggccgcagcc

SEQ ID NO: 741285 - RNA, 22 nt, Human
gccccaggccgccuugcacccc

SEQ ID NO: 741286 - RNA, 18 nt, Human
gccuaggccccugggagc

SEQ ID NO: 741287 - RNA, 23 nt, Human
gccuguaaucccagcuacucggg

SEQ ID NO: 741288 - RNA, 21 nt, Human
gcgaggcaagcagaagcccug

SEQ ID NO: 741289 - RNA, 23 nt, Human
gcuuccagacagacccugacucc

SEQ ID NO: 741290 - RNA, 22 nt, Human
gcuuccucagacggaacucggg

SEQ ID NO: 741291 - RNA, 22 nt, Human
ggaggggacugcccuucagucc

SEQ ID NO: 741292 - RNA, 24 nt, Human
ggagguugcagggggccaagaucg

SEQ ID NO: 741293 - RNA, 26 nt, Human
ggaguacauuguucaaaucgggauua

SEQ ID NO: 741294 - RNA, 21 nt, Human
ggccgggcgcgguggcucaug

SEQ ID NO: 741295 - RNA, 23 nt, Human
ggccgggcgcgguggcucaugcc

SEQ ID NO: 741296 - RNA, 22 nt, Human
ggccugagacagcccugaaggc

SEQ ID NO: 741297 - RNA, 23 nt, Human
ggcgcgguggcucaugccuguaa

SEQ ID NO: 741298 - RNA, 18 nt, Human
ggggaggcggccaggcgg

SEQ ID NO: 741299 - RNA, 24 nt, Human
ggugacacacgccuguaaucccag

SEQ ID NO: 741300 - RNA, 23 nt, Human
gguggaucacaaggucaggaguu

SEQ ID NO: 741301 - RNA, 23 nt, Human
gguggcucaugccuguaauucca

SEQ ID NO: 741302 - RNA, 24 nt, Human
gguggcucaugccuguaauuccag

SEQ ID NO: 741303 - RNA, 24 nt, Human
guauauguguguguauauauauau

SEQ ID NO: 741304 - RNA, 23 nt, Human
gugacacacgccuguaaucccag

SEQ ID NO: 741305 - RNA, 19 nt, Human
gugcggcugaggugggacc

SEQ ID NO: 741306 - RNA, 23 nt, Human
guggaucacaaggucaggaguuu

SEQ ID NO: 741307 - RNA, 23 nt, Human
guggcucaugccuguaauuccag

SEQ ID NO: 741308 - RNA, 26 nt, Human
guguauauauauauauauuucuuaaa

SEQ ID NO: 741309 - RNA, 21 nt, Human
uaaaacucucaauagccacua

SEQ ID NO: 741310 - RNA, 19 nt, Human
uaacaaaagaggaaccugu

SEQ ID NO: 741311 - RNA, 22 nt, Human
uaagcccuaaaacgacaacaaa

SEQ ID NO: 741312 - RNA, 21 nt, Human
uaccagugggcuucugccugc

SEQ ID NO: 741313 - RNA, 21 nt, Human
uaccuggggcugagugcacug

SEQ ID NO: 741314 - RNA, 22 nt, Human
uaccuggggcugagugcacugg

SEQ ID NO: 741315 - RNA, 22 nt, Human
uaccuggggcugagugcacugg

SEQ ID NO: 741316 - RNA, 21 nt, Human
uagaaaauaauggccaacauc

SEQ ID NO: 741317 - RNA, 21 nt, Human
uagaaucaggagacccgcucc

SEQ ID NO: 741318 - RNA, 21 nt, Human
uaggucggagcggugccgcgg

SEQ ID NO: 741319 - RNA, 20 nt, Human
uauguguguguauauauaua

SEQ ID NO: 741320 - RNA, 23 nt, Human
ucaaaaaaacuacgauuaaaaaa

SEQ ID NO: 741321 - RNA, 24 nt, Human
ucaaaaaaacuacgauuaaaaaaa

SEQ ID NO: 741322 - RNA, 24 nt, Human
ucacaaggucaggaguuugagacc

SEQ ID NO: 741323 - RNA, 18 nt, Human
ucacagagaccaaggagc

SEQ ID NO: 741324 - RNA, 25 nt, Human
ucagcacccggaccccaggggcgug

SEQ ID NO: 741325 - RNA, 22 nt, Human
ucaugccuguaauuccagcacu

SEQ ID NO: 741326 - RNA, 24 nt, Human
uccacaugucuuuaggaauucgaa

SEQ ID NO: 741327 - RNA, 19 nt, Human
ucccuccacauggcugccu

SEQ ID NO: 741328 - RNA, 22 nt, Human
ucccuggcggugcucucuggcu

SEQ ID NO: 741329 - RNA, 21 nt, Human
ucccuuaacaauguauaaccc

SEQ ID NO: 741330 - RNA, 22 nt, Human
uccgccgccccaggccgccuug

SEQ ID NO: 741331 - RNA, 24 nt, Human
ucgaacccgggaggcggagguugc

SEQ ID NO: 741332 - RNA, 20 nt, Human
ucggcagccgccgcuuccuc

SEQ ID NO: 741333 - RNA, 23 nt, Human
ucgggaggcugaggcaggagaau

SEQ ID NO: 741334 - RNA, 19 nt, Human
ucucauucuuguucuguuu

SEQ ID NO: 741335 - RNA, 20 nt, Human
ucuccuggaaccgcugcugg

SEQ ID NO: 741336 - RNA, 25 nt, Human
ucucuacuaaaaauacaaaaaaauu

SEQ ID NO: 741337 - RNA, 19 nt, Human
ugaccaagggauuuuacag

SEQ ID NO: 741338 - RNA, 23 nt, Human
ugagaccagccuggccaauaugg

SEQ ID NO: 741339 - RNA, 24 nt, Human
ugagaccagccuggccaauauggu

SEQ ID NO: 741340 - RNA, 24 nt, Human
ugaggcaggagaauugcucgaacc

SEQ ID NO: 741341 - RNA, 25 nt, Human
ugaggcaggagaauugcucgaaccc

SEQ ID NO: 741342 - RNA, 21 nt, Human
ugcauccauaucguuugcacg

SEQ ID NO: 741343 - RNA, 24 nt, Human
ugcccauagccccggccgcagccu

SEQ ID NO: 741344 - RNA, 18 nt, Human
ugccuggaugugacacag

SEQ ID NO: 741345 - RNA, 23 nt, Human
ugccuguaauuccagcacuuugg

SEQ ID NO: 741346 - RNA, 23 nt, Human
ugccuguaauuccagcacuuugg

SEQ ID NO: 741347 - RNA, 19 nt, Human
ugcgcaccgccacucuccu

SEQ ID NO: 741348 - RNA, 20 nt, Human
ugcgcgagcgccucccuggc

SEQ ID NO: 741349 - RNA, 19 nt, Human
ugcugaccguggccuugcg

SEQ ID NO: 741350 - RNA, 22 nt, Human
uggaauaucuuaacauaugaaa

SEQ ID NO: 741351 - RNA, 21 nt, Human
uggaucacaaggucaggaguu

SEQ ID NO: 741352 - RNA, 19 nt, Human
uggccaacaucucuuuaaa

SEQ ID NO: 741353 - RNA, 24 nt, Human
uggccaauauggugaaaccccguc

SEQ ID NO: 741354 - RNA, 18 nt, Human
uggcgcugccgcggcccc

SEQ ID NO: 741355 - RNA, 22 nt, Human
uggcucaugccuguaauuccag

SEQ ID NO: 741356 - RNA, 24 nt, Human
uggcucaugccuguaauuccagca

SEQ ID NO: 741357 - RNA, 19 nt, Human
uggcugguuaggagacugu

SEQ ID NO: 741358 - RNA, 19 nt, Human
ugggaggcggaggugggug

SEQ ID NO: 741359 - RNA, 24 nt, Human
ugggaggcggagguggguggauca

SEQ ID NO: 741360 - RNA, 23 nt, Human
uggggacagcagccagagcaugg

SEQ ID NO: 741361 - RNA, 25 nt, Human
uggggacagcagccagagcaugggg

SEQ ID NO: 741362 - RNA, 24 nt, Human
uggugacacacgccuguaauccca

SEQ ID NO: 741363 - RNA, 23 nt, Human
uggugagaaaagaauaauuccuu

SEQ ID NO: 741364 - RNA, 24 nt, Human
uguagaaucaggagacccgcucca

SEQ ID NO: 741365 - RNA, 23 nt, Human
uguauauauauauauauuucuua

SEQ ID NO: 741366 - RNA, 18 nt, Human
uguguauauauauauaua

SEQ ID NO: 741367 - RNA, 18 nt, Human
uguguauaugugugugua

SEQ ID NO: 741368 - RNA, 24 nt, Human
ugugucuaccucaguuccagcagg

SEQ ID NO: 741369 - RNA, 18 nt, Human
uguguguguauauauaua

SEQ ID NO: 741370 - RNA, 18 nt, Human
uguguguguauauauaua

SEQ ID NO: 741371 - RNA, 22 nt, Human
uugcagggggccaagaucgcgc

SEQ ID NO: 741372 - RNA, 21 nt, Human
uugcgcgagcgccucccuggc

SEQ ID NO: 741373 - RNA, 24 nt, Human
uugcucgaacccgggaggcggagg

SEQ ID NO: 741374 - RNA, 24 nt, Human
aaagugcugggauuacaggcguga

SEQ ID NO: 741375 - RNA, 22 nt, Human
aacagccaacucuccuacauau

SEQ ID NO: 741376 - RNA, 20 nt, Human
aacauggcgaaacuccgccu

SEQ ID NO: 741377 - RNA, 21 nt, Human
aacauggcgaaacuccgccuc

SEQ ID NO: 741378 - RNA, 22 nt, Human
aacuagaacccagcugacuucc

SEQ ID NO: 741379 - RNA, 19 nt, Human
aagagaaugaggagaaggg

SEQ ID NO: 741380 - RNA, 19 nt, Human
aagcaaaggugaaagcaga

SEQ ID NO: 741381 - RNA, 21 nt, Human
aagcaaaggugaaagcagaaa

SEQ ID NO: 741382 - RNA, 18 nt, Human
aagcaggagaaucgcuug

SEQ ID NO: 741383 - RNA, 24 nt, Human
aagcaggagaaucgcuugaacccg

SEQ ID NO: 741384 - RNA, 25 nt, Human
aagcaggagaaucgcuugaacccgg

SEQ ID NO: 741385 - RNA, 21 nt, Human
aaggcccaggaaggccuccag

SEQ ID NO: 741386 - RNA, 19 nt, Human
aagugcugggauuacaggc

SEQ ID NO: 741387 - RNA, 19 nt, Human
aagugcugggauuacaggc

SEQ ID NO: 741388 - RNA, 26 nt, Human
aagugcugggauuacaggcgugagcc

SEQ ID NO: 741389 - RNA, 21 nt, Human
aauacuaaaggcaacugucac

SEQ ID NO: 741390 - RNA, 24 nt, Human
aaucgcuugaacccgggaggcaga

SEQ ID NO: 741391 - RNA, 21 nt, Human
acacugcacuucagccugggc

SEQ ID NO: 741392 - RNA, 23 nt, Human
acacugcacuucagccugggcaa

SEQ ID NO: 741393 - RNA, 24 nt, Human
acacugcacuucagccugggcaac

SEQ ID NO: 741394 - RNA, 21 nt, Human
acagcacuucuagggucaccu

SEQ ID NO: 741395 - RNA, 19 nt, Human
acauggcgaaacuccgccu

SEQ ID NO: 741396 - RNA, 23 nt, Human
accagaguaaaaggaaaagacug

SEQ ID NO: 741397 - RNA, 22 nt, Human
accccagcuacucaggaggcca

SEQ ID NO: 741398 - RNA, 24 nt, Human
acuagaacccagcugacuuccccc

SEQ ID NO: 741399 - RNA, 18 nt, Human
acucaacacagccauucc

SEQ ID NO: 741400 - RNA, 24 nt, Human
acuccgccucuacuaaaaauacaa

SEQ ID NO: 741401 - RNA, 20 nt, Human
acugcaagcucugccuccca

SEQ ID NO: 741402 - RNA, 18 nt, Human
acugcacuucagccuggg

SEQ ID NO: 741403 - RNA, 21 nt, Human
acugcacuucagccugggcaa

SEQ ID NO: 741404 - RNA, 25 nt, Human
acugcacuucagccugggcaacaag

SEQ ID NO: 741405 - RNA, 23 nt, Human
agaaacaaucccuauuuaagagc

SEQ ID NO: 741406 - RNA, 18 nt, Human
agaaacuccaucucaaaa

SEQ ID NO: 741407 - RNA, 21 nt, Human
agaacccagcugacuuccccc

SEQ ID NO: 741408 - RNA, 19 nt, Human
agaacugcuccaugucacc

SEQ ID NO: 741409 - RNA, 18 nt, Human
agacaguagcauacuugg

SEQ ID NO: 741410 - RNA, 18 nt, Human
agagguugcagugagccg

SEQ ID NO: 741411 - RNA, 23 nt, Human
agagguugcagugagccgagauc

SEQ ID NO: 741412 - RNA, 24 nt, Human
agagguugcagugagccgagauca

SEQ ID NO: 741413 - RNA, 19 nt, Human
agcacgccuucccauccug

SEQ ID NO: 741414 - RNA, 18 nt, Human
agccaggcgcgguggugc

SEQ ID NO: 741415 - RNA, 18 nt, Human
aggaaauugagucacagg

SEQ ID NO: 741416 - RNA, 20 nt, Human
aggaaggauuugggccucag

SEQ ID NO: 741417 - RNA, 25 nt, Human
aggaaggccuccaggaaaaggcugc

SEQ ID NO: 741418 - RNA, 22 nt, Human
aggagaagggagaguugacaag

SEQ ID NO: 741419 - RNA, 21 nt, Human
aggcagagguugcagugagcc

SEQ ID NO: 741420 - RNA, 24 nt, Human
aggcagagguugcagugagccgag

SEQ ID NO: 741421 - RNA, 18 nt, Human
aggcaggacacagaggac

SEQ ID NO: 741422 - RNA, 22 nt, Human
aggccgaggcggggggaucacu

SEQ ID NO: 741423 - RNA, 20 nt, Human
aggcggggggaucacugagg

SEQ ID NO: 741424 - RNA, 21 nt, Human
aggcggggggaucacugaggu

SEQ ID NO: 741425 - RNA, 25 nt, Human
aggcuggagugcaguggugcaaucu

SEQ ID NO: 741426 - RNA, 24 nt, Human
aggggggccgggugugguggcuca

SEQ ID NO: 741427 - RNA, 21 nt, Human
aggugguguagccaccauacc

SEQ ID NO: 741428 - RNA, 20 nt, Human
aguaaaaggaaaagacugga

SEQ ID NO: 741429 - RNA, 20 nt, Human
agugcaguggugcaaucucg

SEQ ID NO: 741430 - RNA, 24 nt, Human
agugcaguggugcaaucucggcuc

SEQ ID NO: 741431 - RNA, 18 nt, Human
agugcugggauuacaggc

SEQ ID NO: 741432 - RNA, 18 nt, Human
auaaaacacuguagcccc

SEQ ID NO: 741433 - RNA, 18 nt, Human
auaaaacacuguagcccc

SEQ ID NO: 741434 - RNA, 24 nt, Human
aucacaacacugcacuucagccug

SEQ ID NO: 741435 - RNA, 24 nt, Human
augauccgcccgccucggccuccc

SEQ ID NO: 741436 - RNA, 18 nt, Human
augggguuucaccauguu

SEQ ID NO: 741437 - RNA, 19 nt, Human
augggguuucaccauguua

SEQ ID NO: 741438 - RNA, 20 nt, Human
augggguuucaccauguuag

SEQ ID NO: 741439 - RNA, 24 nt, Human
augggguuucaccauguuagccag

SEQ ID NO: 741440 - RNA, 24 nt, Human
caaagcaggagaaucgcuugaacc

SEQ ID NO: 741441 - RNA, 24 nt, Human
caaagugcugggauuacaggcgug

SEQ ID NO: 741442 - RNA, 22 nt, Human
caacacagccauuccccuagaa

SEQ ID NO: 741443 - RNA, 19 nt, Human
caagaaggugcuucaucuu

SEQ ID NO: 741444 - RNA, 24 nt, Human
caagcacgccuucccauccugccc

SEQ ID NO: 741445 - RNA, 19 nt, Human
caccacacccagccucuuc

SEQ ID NO: 741446 - RNA, 18 nt, Human
caccauguuagccaggau

SEQ ID NO: 741447 - RNA, 22 nt, Human
caccauguuagccaggaugguc

SEQ ID NO: 741448 - RNA, 23 nt, Human
caccauguuagccaggauggucu

SEQ ID NO: 741449 - RNA, 24 nt, Human
caccauguuagccaggauggucuu

SEQ ID NO: 741450 - RNA, 18 nt, Human
cacccaccaccaugccug

SEQ ID NO: 741451 - RNA, 18 nt, Human
caccccucuccuccccuu

SEQ ID NO: 741452 - RNA, 19 nt, Human
cacugcacuucagccuggg

SEQ ID NO: 741453 - RNA, 20 nt, Human
cacugcacuucagccugggc

SEQ ID NO: 741454 - RNA, 21 nt, Human
cacugcacuucagccugggca

SEQ ID NO: 741455 - RNA, 22 nt, Human
cacugcacuucagccugggcaa

SEQ ID NO: 741456 - RNA, 23 nt, Human
cacugcacuucagccugggcaac

SEQ ID NO: 741457 - RNA, 24 nt, Human
cacugcacuucagccugggcaaca

SEQ ID NO: 741458 - RNA, 24 nt, Human
cagaacuuugggaggccgaggcgg

SEQ ID NO: 741459 - RNA, 18 nt, Human
cagagaucuacccugugu

SEQ ID NO: 741460 - RNA, 22 nt, Human
cagaguaaaaggaaaagacugg

SEQ ID NO: 741461 - RNA, 18 nt, Human
cagccugggcaacaagag

SEQ ID NO: 741462 - RNA, 20 nt, Human
caggacuccagcgccugcug

SEQ ID NO: 741463 - RNA, 19 nt, Human
caggauauucagaagugcu

SEQ ID NO: 741464 - RNA, 21 nt, Human
caguagcauacuuggcccugg

SEQ ID NO: 741465 - RNA, 22 nt, Human
caugccauucuccugccucagc

SEQ ID NO: 741466 - RNA, 18 nt, Human
cauguuaaaucauuuccu

SEQ ID NO: 741467 - RNA, 22 nt, Human
ccaaagugcugggauuacaggc

SEQ ID NO: 741468 - RNA, 22 nt, Human
ccaaagugcugggauuacaggc

SEQ ID NO: 741469 - RNA, 24 nt, Human
ccaaagugcugggauuacaggcgu

SEQ ID NO: 741470 - RNA, 18 nt, Human
ccaacucuccuacauaug

SEQ ID NO: 741471 - RNA, 19 nt, Human
ccaacucuccuacauaugc

SEQ ID NO: 741472 - RNA, 22 nt, Human
ccagcgccugcugugguggggu

SEQ ID NO: 741473 - RNA, 21 nt, Human
ccaggcacccaccaccaugcc

SEQ ID NO: 741474 - RNA, 20 nt, Human
cccagguucaugccauucuc

SEQ ID NO: 741475 - RNA, 19 nt, Human
cccauccugcccugccgga

SEQ ID NO: 741476 - RNA, 21 nt, Human
ccccacagccguucuuaccua

SEQ ID NO: 741477 - RNA, 21 nt, Human
cccccacagccguucuuaccu

SEQ ID NO: 741478 - RNA, 23 nt, Human
ccccuuguaagcaugagucccgc

SEQ ID NO: 741479 - RNA, 22 nt, Human
cccugccggagcaccccucucc

SEQ ID NO: 741480 - RNA, 18 nt, Human
ccucaggauauucagaag

SEQ ID NO: 741481 - RNA, 23 nt, Human
ccugaccaacauggcgaaacucc

SEQ ID NO: 741482 - RNA, 24 nt, Human
ccugaccaacauggcgaaacuccg

SEQ ID NO: 741483 - RNA, 21 nt, Human
ccugcaaccccagcuacucag

SEQ ID NO: 741484 - RNA, 22 nt, Human
ccugcaaccccagcuacucagg

SEQ ID NO: 741485 - RNA, 23 nt, Human
ccugccucagccucccgaguagc

SEQ ID NO: 741486 - RNA, 21 nt, Human
cgaggacuccaaauuuucugu

SEQ ID NO: 741487 - RNA, 25 nt, Human
cgaggcggggggaucacugagguca

SEQ ID NO: 741488 - RNA, 24 nt, Human
cgcccaggcuggagugcaguggug

SEQ ID NO: 741489 - RNA, 21 nt, Human
cgcccugucuuuaugacaccu

SEQ ID NO: 741490 - RNA, 24 nt, Human
cgccucggccucccaaagugcugg

SEQ ID NO: 741491 - RNA, 24 nt, Human
cgggaggcagagguugcagugagc

SEQ ID NO: 741492 - RNA, 25 nt, Human
cuagaacccagcugacuucccccac

SEQ ID NO: 741493 - RNA, 20 nt, Human
cuaggcuacaaaccuguacu

SEQ ID NO: 741494 - RNA, 22 nt, Human
cucacacccauaaucccagaac

SEQ ID NO: 741495 - RNA, 22 nt, Human
cucaccuaaauuucacaacaau

SEQ ID NO: 741496 - RNA, 24 nt, Human
cucagccucccgaguagcugggac

SEQ ID NO: 741497 - RNA, 18 nt, Human
cucaugauccgcccgccu

SEQ ID NO: 741498 - RNA, 24 nt, Human
cuccugaccucaugauccgcccgc

SEQ ID NO: 741499 - RNA, 23 nt, Human
cucuccuccccuuagugaggaag

SEQ ID NO: 741500 - RNA, 20 nt, Human
cucugucgcccaggcuggag

SEQ ID NO: 741501 - RNA, 24 nt, Human
cugcaagcucugccucccagguuc

SEQ ID NO: 741502 - RNA, 23 nt, Human
cugccucagccucccgaguagcu

SEQ ID NO: 741503 - RNA, 23 nt, Human
cuguauuuuuaguagagaugggg

SEQ ID NO: 741504 - RNA, 22 nt, Human
cuuaggacuccuaggcuacaaa

SEQ ID NO: 741505 - RNA, 18 nt, Human
cuucaucuuauuuuagug

SEQ ID NO: 741506 - RNA, 20 nt, Human
cuugaagucuccuugguggg

SEQ ID NO: 741507 - RNA, 20 nt, Human
cuuguaagcaugagucccgc

SEQ ID NO: 741508 - RNA, 24 nt, Human
gaaaaauuucaaaacacuuugcaa

SEQ ID NO: 741509 - RNA, 19 nt, Human
gaaacuccgccucuacuaa

SEQ ID NO: 741510 - RNA, 20 nt, Human
gaaauccgagaacacucuuc

SEQ ID NO: 741511 - RNA, 21 nt, Human
gaaggggggccggguguggug

SEQ ID NO: 741512 - RNA, 22 nt, Human
gaccucaugauccgcccgccuc

SEQ ID NO: 741513 - RNA, 26 nt, Human
gacuccagcgccugcugugguggggu

SEQ ID NO: 741514 - RNA, 22 nt, Human
gacuccaggcacccaccaccau

SEQ ID NO: 741515 - RNA, 23 nt, Human
gagaaucgcuugaacccgggagg

SEQ ID NO: 741516 - RNA, 23 nt, Human
gagaucacaacacugcacuucag

SEQ ID NO: 741517 - RNA, 21 nt, Human
gagauggagucuugcucuguc

SEQ ID NO: 741518 - RNA, 18 nt, Human
gagaugggguuucaccau

SEQ ID NO: 741519 - RNA, 24 nt, Human
gagaugggguuucaccauguuagc

SEQ ID NO: 741520 - RNA, 19 nt, Human
gaggacuccaaauuuucug

SEQ ID NO: 741521 - RNA, 24 nt, Human
gaggcggggggaucacugagguca

SEQ ID NO: 741522 - RNA, 20 nt, Human
gaguagcugggacuccaggc

SEQ ID NO: 741523 - RNA, 18 nt, Human
gagugcugacuuccucuc

SEQ ID NO: 741524 - RNA, 23 nt, Human
gaucacugaggucagaaguucga

SEQ ID NO: 741525 - RNA, 18 nt, Human
gauuacaggcgugagcca

SEQ ID NO: 741526 - RNA, 21 nt, Human
gauuacaggcgugagccacca

SEQ ID NO: 741527 - RNA, 22 nt, Human
gauuacaggcgugagccaccac

SEQ ID NO: 741528 - RNA, 20 nt, Human
gcaccccucuccuccccuua

SEQ ID NO: 741529 - RNA, 19 nt, Human
gcccaggcuggagugcagu

SEQ ID NO: 741530 - RNA, 20 nt, Human
gcccaggcuggagugcagug

SEQ ID NO: 741531 - RNA, 23 nt, Human
gcccaggcuggagugcaguggug

SEQ ID NO: 741532 - RNA, 22 nt, Human
gcccuggguuugacauaaaacu

SEQ ID NO: 741533 - RNA, 25 nt, Human
gccucccagguucaugccauucucc

SEQ ID NO: 741534 - RNA, 25 nt, Human
gcucugucgcccaggcuggagugca

SEQ ID NO: 741535 - RNA, 21 nt, Human
gcuuggggagauaaagaaggc

SEQ ID NO: 741536 - RNA, 27 nt, Human
ggacuccagcgccugcugugguggggu

SEQ ID NO: 741537 - RNA, 21 nt, Human
ggacuccuaggcuacaaaccu

SEQ ID NO: 741538 - RNA, 23 nt, Human
ggagucuugcucugucgcccagg

SEQ ID NO: 741539 - RNA, 19 nt, Human
ggauuacaggcgugagcca

SEQ ID NO: 741540 - RNA, 25 nt, Human
ggcgcgguggugcacaccugcaacc

SEQ ID NO: 741541 - RNA, 19 nt, Human
gggaggccgaggcgggggg

SEQ ID NO: 741542 - RNA, 22 nt, Human
gggggccgggugugguggcuca

SEQ ID NO: 741543 - RNA, 24 nt, Human
gggggccgggugugguggcucaca

SEQ ID NO: 741544 - RNA, 22 nt, Human
gggguuucaccauguuagccag

SEQ ID NO: 741545 - RNA, 20 nt, Human
ggucuugaucuccugaccuc

SEQ ID NO: 741546 - RNA, 24 nt, Human
gguggugcacaccugcaaccccag

SEQ ID NO: 741547 - RNA, 23 nt, Human
ggugugguggcucacacccauaa

SEQ ID NO: 741548 - RNA, 24 nt, Human
gguuucaccauguuagccaggaug

SEQ ID NO: 741549 - RNA, 23 nt, Human
guagagaugggguuucaccaugu

SEQ ID NO: 741550 - RNA, 20 nt, Human
gucaguuguccauauggcuc

SEQ ID NO: 741551 - RNA, 24 nt, Human
gucuugcucugucgcccaggcugg

SEQ ID NO: 741552 - RNA, 24 nt, Human
gugagccaccacacccagccucuu

SEQ ID NO: 741553 - RNA, 18 nt, Human
guggugggguaggguggg

SEQ ID NO: 741554 - RNA, 19 nt, Human
guugcagugagccgagauc

SEQ ID NO: 741555 - RNA, 20 nt, Human
uaaaaauacaaaauuagcca

SEQ ID NO: 741556 - RNA, 22 nt, Human
uaaaaauacaaaauuagccagg

SEQ ID NO: 741557 - RNA, 23 nt, Human
uaaaaauacaaaauuagccaggc

SEQ ID NO: 741558 - RNA, 21 nt, Human
uaaagaaggcccaggaaggcc

SEQ ID NO: 741559 - RNA, 22 nt, Human
uaaggugaaauccgagaacacu

SEQ ID NO: 741560 - RNA, 24 nt, Human
uaauuuagaaacaaucccuauuua

SEQ ID NO: 741561 - RNA, 28 nt, Human
uaauuuuuuucuguauuuuuaguagaga

SEQ ID NO: 741562 - RNA, 23 nt, Human
uacacaaaccuaggugguguagc

SEQ ID NO: 741563 - RNA, 24 nt, Human
uacaggcgugagccaccacaccca

SEQ ID NO: 741564 - RNA, 22 nt, Human
uagagaugggguuucaccaugu

SEQ ID NO: 741565 - RNA, 20 nt, Human
uagcaugauccccaguuuaa

SEQ ID NO: 741566 - RNA, 22 nt, Human
uagccccaaguuaaguucccuc

SEQ ID NO: 741567 - RNA, 24 nt, Human
uaguagagaugggguuucaccaug

SEQ ID NO: 741568 - RNA, 26 nt, Human
uaguagagaugggguuucaccauguu

SEQ ID NO: 741569 - RNA, 22 nt, Human
uauuauuauaaucagauuucug

SEQ ID NO: 741570 - RNA, 23 nt, Human
uauucacucaccuaaauuucaca

SEQ ID NO: 741571 - RNA, 23 nt, Human
ucacaacacugcacuucagccug

SEQ ID NO: 741572 - RNA, 24 nt, Human
ucaccauguuagccaggauggucu

SEQ ID NO: 741573 - RNA, 21 nt, Human
ucaccuguguucagagaucua

SEQ ID NO: 741574 - RNA, 25 nt, Human
ucacuagguuauuucaccauugugc

SEQ ID NO: 741575 - RNA, 18 nt, Human
ucacugcaagcucugccu

SEQ ID NO: 741576 - RNA, 18 nt, Human
ucacugcaagcucugccu

SEQ ID NO: 741577 - RNA, 19 nt, Human
ucacugcaagcucugccuc

SEQ ID NO: 741578 - RNA, 24 nt, Human
ucacugcaagcucugccucccagg

SEQ ID NO: 741579 - RNA, 23 nt, Human
ucagccucccgaguagcugggac

SEQ ID NO: 741580 - RNA, 21 nt, Human
ucaggcaggacacagaggaca

SEQ ID NO: 741581 - RNA, 23 nt, Human
ucauauauucacucaccuaaaag

SEQ ID NO: 741582 - RNA, 18 nt, Human
ucaugucacaaucccgcc

SEQ ID NO: 741583 - RNA, 24 nt, Human
ucccaaagugcugggauuacaggc

SEQ ID NO: 741584 - RNA, 21 nt, Human
ucccaaggaagucaccggacc

SEQ ID NO: 741585 - RNA, 22 nt, Human
ucccaaggaagucaccggaccu

SEQ ID NO: 741586 - RNA, 18 nt, Human
ucccaggacuccagcgcc

SEQ ID NO: 741587 - RNA, 20 nt, Human
ucccagguucaugccauucu

SEQ ID NO: 741588 - RNA, 21 nt, Human
ucccagguucaugccauucuc

SEQ ID NO: 741589 - RNA, 24 nt, Human
ucccagguucaugccauucuccug

SEQ ID NO: 741590 - RNA, 19 nt, Human
ucccauccugcccugccgg

SEQ ID NO: 741591 - RNA, 23 nt, Human
uccccaguuuaaaggugaggaaa

SEQ ID NO: 741592 - RNA, 19 nt, Human
uccccuagaaguuacagca

SEQ ID NO: 741593 - RNA, 24 nt, Human
ucccgaguagcugggacuccaggc

SEQ ID NO: 741594 - RNA, 22 nt, Human
ucgcccaggcuggagugcagug

SEQ ID NO: 741595 - RNA, 18 nt, Human
ucgcuugaacccgggagg

SEQ ID NO: 741596 - RNA, 18 nt, Human
ucggccucccaaagugcu

SEQ ID NO: 741597 - RNA, 23 nt, Human
ucuacauauagaaagcuagggac

SEQ ID NO: 741598 - RNA, 24 nt, Human
ucuccugccucagccucccgagua

SEQ ID NO: 741599 - RNA, 23 nt, Human
ucuugcucugucgcccaggcugg

SEQ ID NO: 741600 - RNA, 24 nt, Human
ucuugcucugucgcccaggcugga

SEQ ID NO: 741601 - RNA, 20 nt, Human
ugaaaugcuaacuagcauga

SEQ ID NO: 741602 - RNA, 19 nt, Human
ugacaccuuuauuuaugcc

SEQ ID NO: 741603 - RNA, 20 nt, Human
ugaggagaagggagaguuga

SEQ ID NO: 741604 - RNA, 19 nt, Human
ugcaaccccagcuacucag

SEQ ID NO: 741605 - RNA, 20 nt, Human
ugcacacauggagaagaggc

SEQ ID NO: 741606 - RNA, 22 nt, Human
ugcaguggugcaaucucggcuc

SEQ ID NO: 741607 - RNA, 24 nt, Human
ugccucagccucccgaguagcugg

SEQ ID NO: 741608 - RNA, 20 nt, Human
ugccuggcauagacauaggg

SEQ ID NO: 741609 - RNA, 24 nt, Human
ugcugggauuacaggcgugagcca

SEQ ID NO: 741610 - RNA, 23 nt, Human
uggagucuugcucugucgcccag

SEQ ID NO: 741611 - RNA, 24 nt, Human
uggagucuugcucugucgcccagg

SEQ ID NO: 741612 - RNA, 23 nt, Human
uggagugcaguggugcaaucucg

SEQ ID NO: 741613 - RNA, 24 nt, Human
uggagugcaguggugcaaucucgg

SEQ ID NO: 741614 - RNA, 22 nt, Human
uggcucacacccauaaucccag

SEQ ID NO: 741615 - RNA, 18 nt, Human
ugggaggaggcugaacug

SEQ ID NO: 741616 - RNA, 24 nt, Human
ugggaggccgaggcggggggauca

SEQ ID NO: 741617 - RNA, 18 nt, Human
ugggauuacaggcgugag

SEQ ID NO: 741618 - RNA, 19 nt, Human
ugggauuacaggcgugagc

SEQ ID NO: 741619 - RNA, 22 nt, Human
ugggauuacaggcgugagccac

SEQ ID NO: 741620 - RNA, 23 nt, Human
ugggauuacaggcgugagccacc

SEQ ID NO: 741621 - RNA, 24 nt, Human
ugggauuacaggcgugagccacca

SEQ ID NO: 741622 - RNA, 27 nt, Human
ugggccucagauccugguggucccagg

SEQ ID NO: 741623 - RNA, 24 nt, Human
ugggguuucaccauguuagccagg

SEQ ID NO: 741624 - RNA, 23 nt, Human
uggugcacaccugcaaccccagc

SEQ ID NO: 741625 - RNA, 21 nt, Human
uguaacuagaacccagcugac

SEQ ID NO: 741626 - RNA, 21 nt, Human
ugucgcccaggcuggagugca

SEQ ID NO: 741627 - RNA, 18 nt, Human
uuaguagagaugggguuu

SEQ ID NO: 741628 - RNA, 22 nt, Human
uuaguagagaugggguuucacc

SEQ ID NO: 741629 - RNA, 24 nt, Human
uuaguagagaugggguuucaccau

SEQ ID NO: 741630 - RNA, 23 nt, Human
uucaucuuauuuuagugccuggc

SEQ ID NO: 741631 - RNA, 19 nt, Human
uucaugccauucuccugcc

SEQ ID NO: 741632 - RNA, 22 nt, Human
uugagucacaggcagaauaacu

SEQ ID NO: 741633 - RNA, 18 nt, Human
uugcagugagccgagauc

SEQ ID NO: 741634 - RNA, 19 nt, Human
uugcagugagccgagauca

SEQ ID NO: 741635 - RNA, 20 nt, Human
uugcagugagccgagaucac

SEQ ID NO: 741636 - RNA, 24 nt, Human
uugcucugucgcccaggcuggagu

SEQ ID NO: 741637 - RNA, 25 nt, Human
uugggaggccgaggcggggggauca

SEQ ID NO: 741638 - RNA, 25 nt, Human
uugggguaaaaguuaaauaaaacac

SEQ ID NO: 741639 - RNA, 19 nt, Human
uuucaccauguuagccagg

SEQ ID NO: 741640 - RNA, 20 nt, Human
uuucaccauguuagccagga

SEQ ID NO: 741641 - RNA, 24 nt, Human
uuucauaugcagucaugcauugcu

SEQ ID NO: 741642 - RNA, 21 nt, Human
uuucuguauuuuuaguagaga

SEQ ID NO: 741643 - RNA, 21 nt, Human
uuuucuguauuuuuaguagag

SEQ ID NO: 741644 - RNA, 24 nt, Human
uuuucuguauuuuuaguagagaug

SEQ ID NO: 741645 - RNA, 24 nt, Human
uuuuuaguagagaugggguuucac

SEQ ID NO: 741646 - RNA, 23 nt, Human
aaaccaccuuccuuuaaccccaa

SEQ ID NO: 741647 - RNA, 24 nt, Human
aagcacuccaaggauuuuuugauu

SEQ ID NO: 741648 - RNA, 25 nt, Human
aagcacuccaaggauuuuuugauuc

SEQ ID NO: 741649 - RNA, 24 nt, Human
accaccuuccuuuaaccccaaccu

SEQ ID NO: 741650 - RNA, 18 nt, Human
accuuccuuuaaccccaa

SEQ ID NO: 741651 - RNA, 21 nt, Human
agaagaacagaagaaacagua

SEQ ID NO: 741652 - RNA, 18 nt, Human
agacccaggaaugccgga

SEQ ID NO: 741653 - RNA, 21 nt, Human
agcauuuugguggguuuugca

SEQ ID NO: 741654 - RNA, 21 nt, Human
agcccaagagugugugggaau

SEQ ID NO: 741655 - RNA, 26 nt, Human
agggagaaaauaaaaauaagggaccc

SEQ ID NO: 741656 - RNA, 18 nt, Human
aguagagagcuuccugaa

SEQ ID NO: 741657 - RNA, 23 nt, Human
agucacguggaaaggcaagcacu

SEQ ID NO: 741658 - RNA, 19 nt, Human
auaaaggucagcccaagag

SEQ ID NO: 741659 - RNA, 25 nt, Human
caaaagcaaaguauuuucucccccu

SEQ ID NO: 741660 - RNA, 24 nt, Human
caaacacauaguucucaaaaccac

SEQ ID NO: 741661 - RNA, 21 nt, Human
cacauaguucucaaaaccacc

SEQ ID NO: 741662 - RNA, 18 nt, Human
cacuucuaaacucaucag

SEQ ID NO: 741663 - RNA, 23 nt, Human
cagaaugugacaucaaaggcuca

SEQ ID NO: 741664 - RNA, 18 nt, Human
caucaaaggcucaguuug

SEQ ID NO: 741665 - RNA, 21 nt, Human
cauuugcucuuuaagagccuu

SEQ ID NO: 741666 - RNA, 20 nt, Human
ccccaaaauggaguacugug

SEQ ID NO: 741667 - RNA, 21 nt, Human
cucccacucuagcagcaagga

SEQ ID NO: 741668 - RNA, 20 nt, Human
cuguuggagggacuuuuugg

SEQ ID NO: 741669 - RNA, 21 nt, Human
cuucauccauaucuucuuuuu

SEQ ID NO: 741670 - RNA, 20 nt, Human
cuuccuuuaaccccaaccuu

SEQ ID NO: 741671 - RNA, 19 nt, Human
cuucuggcugcuucucuga

SEQ ID NO: 741672 - RNA, 19 nt, Human
gaggcuuuaaaaaaaguug

SEQ ID NO: 741673 - RNA, 25 nt, Human
gauaggagcauuuugguggguuuug

SEQ ID NO: 741674 - RNA, 21 nt, Human
gaugcuagaagaacagaagaa

SEQ ID NO: 741675 - RNA, 21 nt, Human
gcaagacaucuuucuccuccc

SEQ ID NO: 741676 - RNA, 19 nt, Human
ggagaagaggacauuugcu

SEQ ID NO: 741677 - RNA, 20 nt, Human
guuguuuucuuucuuuuugu

SEQ ID NO: 741678 - RNA, 21 nt, Human
uaaaaugaaauuauggaccug

SEQ ID NO: 741679 - RNA, 23 nt, Human
uacaguuuggaccccaaaaugga

SEQ ID NO: 741680 - RNA, 21 nt, Human
uagaagaacagaagaaacagu

SEQ ID NO: 741681 - RNA, 21 nt, Human
uagaagaacagaagaaacagu

SEQ ID NO: 741682 - RNA, 27 nt, Human
uagagagcuuccugaaucuugaaguuc

SEQ ID NO: 741683 - RNA, 19 nt, Human
uaggaagacccaggaaugg

SEQ ID NO: 741684 - RNA, 21 nt, Human
uauaaaaucauuguuuucugg

SEQ ID NO: 741685 - RNA, 19 nt, Human
uauugcuguuggagggacu

SEQ ID NO: 741686 - RNA, 23 nt, Human
ucaaauccuggugucaucagggu

SEQ ID NO: 741687 - RNA, 18 nt, Human
ucucaaaaccaccuuccu

SEQ ID NO: 741688 - RNA, 19 nt, Human
ucuuucuuuuuguuacagc

SEQ ID NO: 741689 - RNA, 21 nt, Human
ugaaauuauugagaacagcca

SEQ ID NO: 741690 - RNA, 23 nt, Human
ugagaacagccagacuuucauaa

SEQ ID NO: 741691 - RNA, 24 nt, Human
ugagcauuacaguuuggaccccaa

SEQ ID NO: 741692 - RNA, 23 nt, Human
ugcccuaacguuucugauuuugc

SEQ ID NO: 741693 - RNA, 20 nt, Human
ugcuguuggagggacuuuuu

SEQ ID NO: 741694 - RNA, 25 nt, Human
uggaccccaaaauggaguacuguga

SEQ ID NO: 741695 - RNA, 23 nt, Human
uggguauuaucuuuucuucuuuc

SEQ ID NO: 741696 - RNA, 21 nt, Human
uuuaaacaaaguaauauugag

SEQ ID NO: 741697 - RNA, 21 nt, Human
uuuccaaucaccauucacuuc

SEQ ID NO: 741698 - RNA, 18 nt, Human
uuuuaaauuauaugguua

SEQ ID NO: 741699 - RNA, 24 nt, Human
uuuuuucaacucacuggugcccua

SEQ ID NO: 741700 - RNA, 21 nt, Human
aaaaacaucaaaacuauaagc

SEQ ID NO: 741701 - RNA, 20 nt, Human
aaaauggacaaauguuagaa

SEQ ID NO: 741702 - RNA, 18 nt, Human
aaaccuaagcgaacaaua

SEQ ID NO: 741703 - RNA, 24 nt, Human
aaagugcugggauuauagguuuga

SEQ ID NO: 741704 - RNA, 19 nt, Human
aaccauuuacagacguauu

SEQ ID NO: 741705 - RNA, 23 nt, Human
aacuaaaaucaauuaguaagaca

SEQ ID NO: 741706 - RNA, 19 nt, Human
aacuguuaccccauccuuu

SEQ ID NO: 741707 - RNA, 25 nt, Human
aaguaacugggacugcaggcgcaca

SEQ ID NO: 741708 - RNA, 18 nt, Human
aagugcugggauuauagg

SEQ ID NO: 741709 - RNA, 26 nt, Human
aagugcugggauuauagguuugagcu

SEQ ID NO: 741710 - RNA, 20 nt, Human
aaucaaguguugcagguuua

SEQ ID NO: 741711 - RNA, 24 nt, Human
acaauauacacaaagaaaacuauu

SEQ ID NO: 741712 - RNA, 23 nt, Human
acagugcccggccuacaucugcu

SEQ ID NO: 741713 - RNA, 22 nt, Human
accauguuggagguuggucucg

SEQ ID NO: 741714 - RNA, 19 nt, Human
acccugguaaauauuaugg

SEQ ID NO: 741715 - RNA, 19 nt, Human
acgggguuucaccauguug

SEQ ID NO: 741716 - RNA, 20 nt, Human
acgggguuucaccauguugg

SEQ ID NO: 741717 - RNA, 24 nt, Human
acgggguuucaccauguuggaggu

SEQ ID NO: 741718 - RNA, 19 nt, Human
acuacaggugugugccacu

SEQ ID NO: 741719 - RNA, 24 nt, Human
acuugucucaaauuuuggggguuc

SEQ ID NO: 741720 - RNA, 19 nt, Human
agaaaacuauuuaucuauu

SEQ ID NO: 741721 - RNA, 18 nt, Human
agacagaaucuugcuaug

SEQ ID NO: 741722 - RNA, 19 nt, Human
agacuuaaaaauaacggua

SEQ ID NO: 741723 - RNA, 21 nt, Human
agagacagaaucuugcuaugu

SEQ ID NO: 741724 - RNA, 23 nt, Human
agcagcugggacuacaggugugu

SEQ ID NO: 741725 - RNA, 23 nt, Human
aggagaucauaaaaacaucaaaa

SEQ ID NO: 741726 - RNA, 19 nt, Human
agggacgggguuucaccau

SEQ ID NO: 741727 - RNA, 24 nt, Human
aggugauccacccaccuuggccuc

SEQ ID NO: 741728 - RNA, 25 nt, Human
agguuggagugcagcagcgcaaucu

SEQ ID NO: 741729 - RNA, 23 nt, Human
agguuugagcuacagugcccggc

SEQ ID NO: 741730 - RNA, 23 nt, Human
agugcaacuguuugucucucacc

SEQ ID NO: 741731 - RNA, 24 nt, Human
agugcagcagcgcaaucucagcuc

SEQ ID NO: 741732 - RNA, 24 nt, Human
agugcugggauuauagguuugagc

SEQ ID NO: 741733 - RNA, 23 nt, Human
augagagcuccagagacuuaaaa

SEQ ID NO: 741734 - RNA, 22 nt, Human
caaaaccacugugcuauugcau

SEQ ID NO: 741735 - RNA, 18 nt, Human
caaagugcugggauuaua

SEQ ID NO: 741736 - RNA, 22 nt, Human
caagcaauucuccugccucagc

SEQ ID NO: 741737 - RNA, 27 nt, Human
caagcaauucuccugccucagccuccc

SEQ ID NO: 741738 - RNA, 22 nt, Human
caagugaucuuccugccucagc

SEQ ID NO: 741739 - RNA, 24 nt, Human
cacaccaccaugcccagcuaauuu

SEQ ID NO: 741740 - RNA, 24 nt, Human
caccaugcccagcuaauuuuugua

SEQ ID NO: 741741 - RNA, 22 nt, Human
caccauguuggagguuggucuc

SEQ ID NO: 741742 - RNA, 22 nt, Human
cacccaccuuggccucccaaag

SEQ ID NO: 741743 - RNA, 23 nt, Human
cacccaccuuggccucccaaagu

SEQ ID NO: 741744 - RNA, 22 nt, Human
caccuaucugugaccuggaagc

SEQ ID NO: 741745 - RNA, 18 nt, Human
cacugcaaccuuugccuc

SEQ ID NO: 741746 - RNA, 21 nt, Human
cacugcaaccuuugccuccca

SEQ ID NO: 741747 - RNA, 23 nt, Human
cacugcagauuugaacuccuggg

SEQ ID NO: 741748 - RNA, 18 nt, Human
cagaaucuugcuauguug

SEQ ID NO: 741749 - RNA, 22 nt, Human
cagcacuaucuuguaaaaugau

SEQ ID NO: 741750 - RNA, 18 nt, Human
cagcagcgcaaucucagc

SEQ ID NO: 741751 - RNA, 23 nt, Human
cagccucccaaguaacugggacu

SEQ ID NO: 741752 - RNA, 24 nt, Human
cagcgcaaucucagcucacugcaa

SEQ ID NO: 741753 - RNA, 18 nt, Human
cagcugggacuacaggug

SEQ ID NO: 741754 - RNA, 26 nt, Human
caguguaagauaacaccuucagauua

SEQ ID NO: 741755 - RNA, 21 nt, Human
caucugcuuuuuauacucucu

SEQ ID NO: 741756 - RNA, 18 nt, Human
caugugcagcuuuacaug

SEQ ID NO: 741757 - RNA, 19 nt, Human
cauuccaugugggccugcg

SEQ ID NO: 741758 - RNA, 21 nt, Human
cauuccaugugggccugcgcu

SEQ ID NO: 741759 - RNA, 18 nt, Human
ccaaagugcugggauuau

SEQ ID NO: 741760 - RNA, 21 nt, Human
ccaaagugcugggauuauagg

SEQ ID NO: 741761 - RNA, 22 nt, Human
ccaaagugcugggauuauaggu

SEQ ID NO: 741762 - RNA, 24 nt, Human
cccaaagugcugggauuauagguu

SEQ ID NO: 741763 - RNA, 23 nt, Human
cccaaguaacugggacugcaggc

SEQ ID NO: 741764 - RNA, 23 nt, Human
cccagguucaagcaauucuccug

SEQ ID NO: 741765 - RNA, 24 nt, Human
cccauuaaaagugaaccccagaca

SEQ ID NO: 741766 - RNA, 21 nt, Human
ccccagaaauagacucuuacu

SEQ ID NO: 741767 - RNA, 22 nt, Human
ccccuaaaauguauaaaaccaa

SEQ ID NO: 741768 - RNA, 18 nt, Human
ccuaucugugaccuggaa

SEQ ID NO: 741769 - RNA, 24 nt, Human
ccucccagguucaagcaauucucc

SEQ ID NO: 741770 - RNA, 24 nt, Human
ccucccuuugcuucaaauuguccc

SEQ ID NO: 741771 - RNA, 24 nt, Human
ccugaccucaggugauccacccac

SEQ ID NO: 741772 - RNA, 18 nt, Human
ccugcgcuacuuuucugu

SEQ ID NO: 741773 - RNA, 18 nt, Human
ccuggaagcccccucccc

SEQ ID NO: 741774 - RNA, 22 nt, Human
ccuggguucaagugaucuuccu

SEQ ID NO: 741775 - RNA, 23 nt, Human
ccuggguucaagugaucuuccug

SEQ ID NO: 741776 - RNA, 22 nt, Human
ccugguaaauauuauggaaaag

SEQ ID NO: 741777 - RNA, 23 nt, Human
cgcacaccaccaugcccagcuaa

SEQ ID NO: 741778 - RNA, 19 nt, Human
cuaaacccauuaaaaguga

SEQ ID NO: 741779 - RNA, 18 nt, Human
cuaaaguuauggccaggu

SEQ ID NO: 741780 - RNA, 26 nt, Human
cuaagauaaaugcagaucugacuguc

SEQ ID NO: 741781 - RNA, 24 nt, Human
cucacugcaaccuuugccucccag

SEQ ID NO: 741782 - RNA, 24 nt, Human
cucacugcaaccuuugccucccag

SEQ ID NO: 741783 - RNA, 24 nt, Human
cucaggugauccacccaccuuggc

SEQ ID NO: 741784 - RNA, 23 nt, Human
cuccagagacuuaaaaauaacgg

SEQ ID NO: 741785 - RNA, 18 nt, Human
cucugucgcccagguugg

SEQ ID NO: 741786 - RNA, 23 nt, Human
cugcaaccuuugccucccagguu

SEQ ID NO: 741787 - RNA, 24 nt, Human
cugcaaccuuugccucccagguuc

SEQ ID NO: 741788 - RNA, 24 nt, Human
cugcuuagggcaaaccugccuccc

SEQ ID NO: 741789 - RNA, 19 nt, Human
cuggaagcccccuccccgc

SEQ ID NO: 741790 - RNA, 27 nt, Human
cuggcucuucccaugugggggacgauc

SEQ ID NO: 741791 - RNA, 18 nt, Human
cugguaaguacugugaaa

SEQ ID NO: 741792 - RNA, 21 nt, Human
cuuagggcaaaccugccuccc

SEQ ID NO: 741793 - RNA, 23 nt, Human
cuuccugccucagccucaggagc

SEQ ID NO: 741794 - RNA, 21 nt, Human
gaaacugcuuagggcaaaccu

SEQ ID NO: 741795 - RNA, 20 nt, Human
gaaccccagacaaacuaaaa

SEQ ID NO: 741796 - RNA, 24 nt, Human
gacacgaaauagccagguaaacac

SEQ ID NO: 741797 - RNA, 23 nt, Human
gaccucaggugauccacccaccu

SEQ ID NO: 741798 - RNA, 18 nt, Human
gacgggguuucaccaugu

SEQ ID NO: 741799 - RNA, 21 nt, Human
gacuacaggugugugccacug

SEQ ID NO: 741800 - RNA, 24 nt, Human
gacuacaggugugugccacugugc

SEQ ID NO: 741801 - RNA, 24 nt, Human
gacugcaggcgcacaccaccaugc

SEQ ID NO: 741802 - RNA, 21 nt, Human
gagagcuccagagacuuaaaa

SEQ ID NO: 741803 - RNA, 21 nt, Human
gagauggagucuugcucuguc

SEQ ID NO: 741804 - RNA, 20 nt, Human
gagcagcugggacuacaggu

SEQ ID NO: 741805 - RNA, 26 nt, Human
gagcagcugggacuacaggugugugc

SEQ ID NO: 741806 - RNA, 25 nt, Human
gaucauuuagaguuagcuaauuuaa

SEQ ID NO: 741807 - RNA, 24 nt, Human
gcacugcagauuugaacuccuggg

SEQ ID NO: 741808 - RNA, 22 nt, Human
gcccagcuaauuuuuguauuuu

SEQ ID NO: 741809 - RNA, 20 nt, Human
gcuauugaaggacucuagau

SEQ ID NO: 741810 - RNA, 24 nt, Human
ggaaaagcuaaucagaaacucaaa

SEQ ID NO: 741811 - RNA, 22 nt, Human
ggacgcugaucaucucauuuuu

SEQ ID NO: 741812 - RNA, 20 nt, Human
ggacuacaggugugugccac

SEQ ID NO: 741813 - RNA, 24 nt, Human
ggacuacaggugugugccacugug

SEQ ID NO: 741814 - RNA, 23 nt, Human
ggagucuugcucugucgcccagg

SEQ ID NO: 741815 - RNA, 19 nt, Human
gggacgggguuucaccaug

SEQ ID NO: 741816 - RNA, 18 nt, Human
gggcaaaccugccuccca

SEQ ID NO: 741817 - RNA, 23 nt, Human
gguagagagacaaaacuuaugug

SEQ ID NO: 741818 - RNA, 19 nt, Human
ggucucgaacuccugaccu

SEQ ID NO: 741819 - RNA, 24 nt, Human
gguuggucucgaacuccugaccuc

SEQ ID NO: 741820 - RNA, 22 nt, Human
guaauuuuuuaaagagacagaa

SEQ ID NO: 741821 - RNA, 22 nt, Human
guauaaaaccaagcugugcccc

SEQ ID NO: 741822 - RNA, 24 nt, Human
gugauccacccaccuuggccuccc

SEQ ID NO: 741823 - RNA, 21 nt, Human
gugaucuuccugccucagccu

SEQ ID NO: 741824 - RNA, 19 nt, Human
guuuggacaccaaucauuc

SEQ ID NO: 741825 - RNA, 23 nt, Human
uaaaaacaucaaaacuauaagcc

SEQ ID NO: 741826 - RNA, 18 nt, Human
uaaaagaaguuacuguuu

SEQ ID NO: 741827 - RNA, 23 nt, Human
uaacgguaaaauuucugucuccu

SEQ ID NO: 741828 - RNA, 19 nt, Human
uaacugggacugcaggcgc

SEQ ID NO: 741829 - RNA, 18 nt, Human
uaagauaaaugcagaucu

SEQ ID NO: 741830 - RNA, 24 nt, Human
uaauuuuuguauuuuuauuaggga

SEQ ID NO: 741831 - RNA, 21 nt, Human
uacccagugguacaauuucau

SEQ ID NO: 741832 - RNA, 23 nt, Human
uaccccauccuuuuuauguuucu

SEQ ID NO: 741833 - RNA, 21 nt, Human
uagcaauuacagauguacuca

SEQ ID NO: 741834 - RNA, 21 nt, Human
uagggacgggguuucaccaug

SEQ ID NO: 741835 - RNA, 22 nt, Human
uagggacgggguuucaccaugu

SEQ ID NO: 741836 - RNA, 23 nt, Human
uauaaaaccaagcugugccccaa

SEQ ID NO: 741837 - RNA, 19 nt, Human
uaucagcuagcugggcucu

SEQ ID NO: 741838 - RNA, 18 nt, Human
uauguugcccagauugga

SEQ ID NO: 741839 - RNA, 24 nt, Human
uauuagggacgggguuucaccaug

SEQ ID NO: 741840 - RNA, 19 nt, Human
ucaagugaucuuccugccu

SEQ ID NO: 741841 - RNA, 24 nt, Human
ucaauuaguaagacaaagcacauc

SEQ ID NO: 741842 - RNA, 22 nt, Human
ucacuagaaaugcauuuucauc

SEQ ID NO: 741843 - RNA, 19 nt, Human
ucacugcaaccuuugccuc

SEQ ID NO: 741844 - RNA, 24 nt, Human
ucacugcaaccuuugccucccagg

SEQ ID NO: 741845 - RNA, 25 nt, Human
ucacugcaaccuuugccucccaggu

SEQ ID NO: 741846 - RNA, 27 nt, Human
ucagcucacugcaaccuuugccuccca

SEQ ID NO: 741847 - RNA, 23 nt, Human
ucccaaagugcugggauuauagg

SEQ ID NO: 741848 - RNA, 24 nt, Human
ucccaaguaacugggacugcaggc

SEQ ID NO: 741849 - RNA, 21 nt, Human
ucccagguucaagcaauucuc

SEQ ID NO: 741850 - RNA, 24 nt, Human
ucccagguucaagcaauucuccug

SEQ ID NO: 741851 - RNA, 21 nt, Human
uccccgcuaccagucuuccuc

SEQ ID NO: 741852 - RNA, 20 nt, Human
uccuggguucaagugaucuu

SEQ ID NO: 741853 - RNA, 24 nt, Human
uccuggguucaagugaucuuccug

SEQ ID NO: 741854 - RNA, 18 nt, Human
ucgcccagguuggagugc

SEQ ID NO: 741855 - RNA, 20 nt, Human
ucucacuucgaucucuucca

SEQ ID NO: 741856 - RNA, 25 nt, Human
ucuccugccucagccucccaaguaa

SEQ ID NO: 741857 - RNA, 23 nt, Human
ucucgaacuccugaccucaggug

SEQ ID NO: 741858 - RNA, 19 nt, Human
ucugugaucuggcucuucc

SEQ ID NO: 741859 - RNA, 23 nt, Human
ucugugaucuggcucuucccaug

SEQ ID NO: 741860 - RNA, 23 nt, Human
ucuugcuauguugcccagauugg

SEQ ID NO: 741861 - RNA, 24 nt, Human
ucuugcuauguugcccagauugga

SEQ ID NO: 741862 - RNA, 23 nt, Human
ucuugcucugucgcccagguugg

SEQ ID NO: 741863 - RNA, 24 nt, Human
ucuugcucugucgcccagguugga

SEQ ID NO: 741864 - RNA, 21 nt, Human
ucuugggccuccaaaaucacu

SEQ ID NO: 741865 - RNA, 21 nt, Human
ugaccucaggugauccaccca

SEQ ID NO: 741866 - RNA, 24 nt, Human
ugaccucaggugauccacccaccu

SEQ ID NO: 741867 - RNA, 18 nt, Human
ugaccuggaagcccccuc

SEQ ID NO: 741868 - RNA, 19 nt, Human
ugagagcuccagagacuua

SEQ ID NO: 741869 - RNA, 24 nt, Human
ugauccacccaccuuggccuccca

SEQ ID NO: 741870 - RNA, 23 nt, Human
ugauuuacaguguaagauaacac

SEQ ID NO: 741871 - RNA, 23 nt, Human
ugcaaccuuugccucccagguuc

SEQ ID NO: 741872 - RNA, 21 nt, Human
ugccucagccucaggagcagc

SEQ ID NO: 741873 - RNA, 24 nt, Human
ugccucagccucaggagcagcugg

SEQ ID NO: 741874 - RNA, 24 nt, Human
ugccucagccucccaaguaacugg

SEQ ID NO: 741875 - RNA, 21 nt, Human
ugcuauugaaggacucuagau

SEQ ID NO: 741876 - RNA, 24 nt, Human
ugcucugucgcccagguuggagug

SEQ ID NO: 741877 - RNA, 25 nt, Human
ugcucuuguuuccuuucuaguucuc

SEQ ID NO: 741878 - RNA, 20 nt, Human
uggaauuugggguauuaaga

SEQ ID NO: 741879 - RNA, 22 nt, Human
uggagguuggucucgaacuccu

SEQ ID NO: 741880 - RNA, 23 nt, Human
uggagucuugcucugucgcccag

SEQ ID NO: 741881 - RNA, 24 nt, Human
uggagucuugcucugucgcccagg

SEQ ID NO: 741882 - RNA, 20 nt, Human
uggauguguguccucaaccu

SEQ ID NO: 741883 - RNA, 21 nt, Human
ugggacuacaggugugugcca

SEQ ID NO: 741884 - RNA, 22 nt, Human
ugggacuacaggugugugccac

SEQ ID NO: 741885 - RNA, 22 nt, Human
ugggacuacaggugugugccac

SEQ ID NO: 741886 - RNA, 22 nt, Human
ugggacuacaggugugugccac

SEQ ID NO: 741887 - RNA, 24 nt, Human
ugggacuacaggugugugccacug

SEQ ID NO: 741888 - RNA, 22 nt, Human
ugggacugcaggcgcacaccac

SEQ ID NO: 741889 - RNA, 18 nt, Human
ugggauuauagguuugag

SEQ ID NO: 741890 - RNA, 19 nt, Human
ugggauuauagguuugagc

SEQ ID NO: 741891 - RNA, 22 nt, Human
ugggauuauagguuugagcuac

SEQ ID NO: 741892 - RNA, 22 nt, Human
ugggauuauagguuugagcuac

SEQ ID NO: 741893 - RNA, 23 nt, Human
uggguucaagugaucuuccugcc

SEQ ID NO: 741894 - RNA, 24 nt, Human
uggguucaagugaucuuccugccu

SEQ ID NO: 741895 - RNA, 21 nt, Human
ugucgcccagguuggagugca

SEQ ID NO: 741896 - RNA, 21 nt, Human
uguuugucucucaccuaucug

SEQ ID NO: 741897 - RNA, 24 nt, Human
uuaaaaugugucaguuugguuaca

SEQ ID NO: 741898 - RNA, 18 nt, Human
uuaaagagacagaaucuu

SEQ ID NO: 741899 - RNA, 18 nt, Human
uuaacaaaggaguaaucu

SEQ ID NO: 741900 - RNA, 23 nt, Human
uuaaccauuuacagacguauuua

SEQ ID NO: 741901 - RNA, 21 nt, Human
uuaggacacgaaauagccagg

SEQ ID NO: 741902 - RNA, 21 nt, Human
uuagggacgggguuucaccau

SEQ ID NO: 741903 - RNA, 24 nt, Human
uuauuagggacgggguuucaccau

SEQ ID NO: 741904 - RNA, 21 nt, Human
uucaagcaauucuccugccuc

SEQ ID NO: 741905 - RNA, 24 nt, Human
uucaagcaauucuccugccucagc

SEQ ID NO: 741906 - RNA, 21 nt, Human
uucaagugaucuuccugccuc

SEQ ID NO: 741907 - RNA, 23 nt, Human
uucaagugaucuuccugccucag

SEQ ID NO: 741908 - RNA, 24 nt, Human
uucaagugaucuuccugccucagc

SEQ ID NO: 741909 - RNA, 22 nt, Human
uuccugccucagccucaggagc

SEQ ID NO: 741910 - RNA, 20 nt, Human
uugcccagauuggaaugcug

SEQ ID NO: 741911 - RNA, 18 nt, Human
uuggccucccaaagugcu

SEQ ID NO: 741912 - RNA, 20 nt, Human
uugggguauuaagaauagaa

SEQ ID NO: 741913 - RNA, 23 nt, Human
uuuaaaaacaacaauauacacaa

SEQ ID NO: 741914 - RNA, 21 nt, Human
uuuaacauucauuucccauua

SEQ ID NO: 741915 - RNA, 21 nt, Human
uuucagaaaaauaaaaccuaa

SEQ ID NO: 741916 - RNA, 24 nt, Human
uuugagagguagugaggaaagaaa

SEQ ID NO: 741917 - RNA, 20 nt, Human
uuuuauggauuuuguaauuu

SEQ ID NO: 741918 - RNA, 24 nt, Human
uuuuuauuagggacgggguuucac

SEQ ID NO: 741919 - RNA, 18 nt, Human
uuuuuguauuuuuauuag

SEQ ID NO: 741920 - RNA, 23 nt, Human
uuuuuguauuuuuauuagggacg

SEQ ID NO: 741921 - RNA, 24 nt, Human
aaauuuuuguauuuucuguaggga

SEQ ID NO: 741922 - RNA, 21 nt, Human
aagaacagcaaugagcccaac

SEQ ID NO: 741923 - RNA, 20 nt, Human
aagagccacauugaauaaug

SEQ ID NO: 741924 - RNA, 25 nt, Human
aagcaauccucccaccucagccucc

SEQ ID NO: 741925 - RNA, 18 nt, Human
aagcagcauagacauugc

SEQ ID NO: 741926 - RNA, 19 nt, Human
aaucuuguaaaugaucgcu

SEQ ID NO: 741927 - RNA, 23 nt, Human
aauuuuuguauuuucuguaggga

SEQ ID NO: 741928 - RNA, 24 nt, Human
accauguugccuuggcuggucucg

SEQ ID NO: 741929 - RNA, 20 nt, Human
accucagccucccgaguagc

SEQ ID NO: 741930 - RNA, 19 nt, Human
acuacaggugugugccacc

SEQ ID NO: 741931 - RNA, 23 nt, Human
acugcaugauucaugacaaacug

SEQ ID NO: 741932 - RNA, 21 nt, Human
agcaauccacccaccucagcc

SEQ ID NO: 741933 - RNA, 25 nt, Human
agcaauuuuuaugucuguauguuua

SEQ ID NO: 741934 - RNA, 23 nt, Human
agccucgaccuccugagcucaag

SEQ ID NO: 741935 - RNA, 23 nt, Human
aggacuauaggcacgagccaccg

SEQ ID NO: 741936 - RNA, 21 nt, Human
aggcacgagccaccgugccca

SEQ ID NO: 741937 - RNA, 23 nt, Human
aguagcugagacuacaggugugu

SEQ ID NO: 741938 - RNA, 20 nt, Human
agugcaguggugugaucaug

SEQ ID NO: 741939 - RNA, 23 nt, Human
agugcaguggugugaucauggcu

SEQ ID NO: 741940 - RNA, 24 nt, Human
agugcaguggugugaucauggcuc

SEQ ID NO: 741941 - RNA, 18 nt, Human
augagguuucaccauguu

SEQ ID NO: 741942 - RNA, 25 nt, Human
augagguuucaccauguugccuugg

SEQ ID NO: 741943 - RNA, 21 nt, Human
auuguugugggagggaccugg

SEQ ID NO: 741944 - RNA, 19 nt, Human
caaagugccaggacuauag

SEQ ID NO: 741945 - RNA, 23 nt, Human
caaagugccaggacuauaggcac

SEQ ID NO: 741946 - RNA, 24 nt, Human
caaagugccaggacuauaggcacg

SEQ ID NO: 741947 - RNA, 27 nt, Human
caagcaauccucccaccucagccuccc

SEQ ID NO: 741948 - RNA, 23 nt, Human
caauguaacaacaaaaaauuuca

SEQ ID NO: 741949 - RNA, 24 nt, Human
caccauguugccuuggcuggucuc

SEQ ID NO: 741950 - RNA, 18 nt, Human
cacccaaaucucaucuug

SEQ ID NO: 741951 - RNA, 23 nt, Human
cacccaccucagccacucaaagu

SEQ ID NO: 741952 - RNA, 24 nt, Human
caccucagccucccgaguagcuga

SEQ ID NO: 741953 - RNA, 24 nt, Human
cagccaauagcagaaaagaacgau

SEQ ID NO: 741954 - RNA, 18 nt, Human
cagcccugacagggauaa

SEQ ID NO: 741955 - RNA, 21 nt, Human
cagcccugacagggauaacuu

SEQ ID NO: 741956 - RNA, 21 nt, Human
caggacuauaggcacgagcca

SEQ ID NO: 741957 - RNA, 24 nt, Human
caucaggaagaaauuucaauaaug

SEQ ID NO: 741958 - RNA, 20 nt, Human
ccaccacacccagcaaauuu

SEQ ID NO: 741959 - RNA, 23 nt, Human
ccaccucagccucccgaguagcu

SEQ ID NO: 741960 - RNA, 21 nt, Human
cccauacuguucuugugauaa

SEQ ID NO: 741961 - RNA, 22 nt, Human
cccccauacuguucuugugaua

SEQ ID NO: 741962 - RNA, 24 nt, Human
cccgaguagcugagacuacaggug

SEQ ID NO: 741963 - RNA, 21 nt, Human
cccucccccgcuucggaucac

SEQ ID NO: 741964 - RNA, 19 nt, Human
ccgccgcccccccccuccc

SEQ ID NO: 741965 - RNA, 20 nt, Human
ccuaggcuacagugcagugg

SEQ ID NO: 741966 - RNA, 24 nt, Human
ccucccaccucagccucccgagua

SEQ ID NO: 741967 - RNA, 19 nt, Human
ccucgaccuccugagcuca

SEQ ID NO: 741968 - RNA, 20 nt, Human
ccugagcucaagcaauccuc

SEQ ID NO: 741969 - RNA, 24 nt, Human
ccugguuucaagcaauccacccac

SEQ ID NO: 741970 - RNA, 20 nt, Human
ccuguaagcccaucaucuuc

SEQ ID NO: 741971 - RNA, 22 nt, Human
ccuuuaugagcaguguaaaaac

SEQ ID NO: 741972 - RNA, 25 nt, Human
cgaccuccugagcucaagcaauccu

SEQ ID NO: 741973 - RNA, 23 nt, Human
cuaaagaacagcaaugagcccaa

SEQ ID NO: 741974 - RNA, 21 nt, Human
cucaagcaauccucccaccuc

SEQ ID NO: 741975 - RNA, 24 nt, Human
cucaagcaauccucccaccucagc

SEQ ID NO: 741976 - RNA, 24 nt, Human
cuccccagccacauggaacucuga

SEQ ID NO: 741977 - RNA, 23 nt, Human
cuccugguuucaagcaauccacc

SEQ ID NO: 741978 - RNA, 27 nt, Human
cuccugguuucaagcaauccacccacc

SEQ ID NO: 741979 - RNA, 24 nt, Human
cuccuucugucaccuaggcuacag

SEQ ID NO: 741980 - RNA, 20 nt, Human
cugaagccucgaccuccuga

SEQ ID NO: 741981 - RNA, 24 nt, Human
cuguagggaugagguuucaccaug

SEQ ID NO: 741982 - RNA, 22 nt, Human
cuuguagaguuugauuuuuuuu

SEQ ID NO: 741983 - RNA, 22 nt, Human
cuuugaagauuccuccucaguc

SEQ ID NO: 741984 - RNA, 23 nt, Human
gaacuccugguuucaagcaaucc

SEQ ID NO: 741985 - RNA, 23 nt, Human
gaccuccugagcucaagcaaucc

SEQ ID NO: 741986 - RNA, 19 nt, Human
gagguuucaccauguugcc

SEQ ID NO: 741987 - RNA, 26 nt, Human
gaguagcugagacuacaggugugugc

SEQ ID NO: 741988 - RNA, 19 nt, Human
gaucagaacucuuugaaga

SEQ ID NO: 741989 - RNA, 23 nt, Human
gccuuggcuggucucgaacuccu

SEQ ID NO: 741990 - RNA, 21 nt, Human
gcucacugaagccucgaccuc

SEQ ID NO: 741991 - RNA, 22 nt, Human
ggacuauaggcacgagccaccg

SEQ ID NO: 741992 - RNA, 22 nt, Human
ggcuacagugcaguggugugau

SEQ ID NO: 741993 - RNA, 19 nt, Human
ggcuggucucgaacuccug

SEQ ID NO: 741994 - RNA, 19 nt, Human
gggaugagguuucaccaug

SEQ ID NO: 741995 - RNA, 24 nt, Human
gguuucaagcaauccacccaccuc

SEQ ID NO: 741996 - RNA, 19 nt, Human
guagcugagacuacaggug

SEQ ID NO: 741997 - RNA, 23 nt, Human
uaaaaaucuccaaaugcuuauau

SEQ ID NO: 741998 - RNA, 18 nt, Human
uacaaugugauacaguuu

SEQ ID NO: 741999 - RNA, 24 nt, Human
uacaggugugugccaccacaccca

SEQ ID NO: 742000 - RNA, 18 nt, Human
uaggcacgagccaccgug

SEQ ID NO: 742001 - RNA, 23 nt, Human
uauguuccuuucugagcugcagu

SEQ ID NO: 742002 - RNA, 23 nt, Human
ucaaagugccaggacuauaggca

SEQ ID NO: 742003 - RNA, 21 nt, Human
ucacuaaagaacagcaaugag

SEQ ID NO: 742004 - RNA, 19 nt, Human
ucacuaaguuaauaagugc

SEQ ID NO: 742005 - RNA, 23 nt, Human
ucagcaaggcuagauuucacuaa

SEQ ID NO: 742006 - RNA, 18 nt, Human
ucagccaaaugucuugcc

SEQ ID NO: 742007 - RNA, 21 nt, Human
uccacauacaaugugauacag

SEQ ID NO: 742008 - RNA, 21 nt, Human
uccacccaccucagccacuca

SEQ ID NO: 742009 - RNA, 23 nt, Human
ucccgaguagcugagacuacagg

SEQ ID NO: 742010 - RNA, 24 nt, Human
ucccgaguagcugagacuacaggu

SEQ ID NO: 742011 - RNA, 20 nt, Human
ucccggagcacuugaacuug

SEQ ID NO: 742012 - RNA, 24 nt, Human
ucccggagcacuugaacuugggca

SEQ ID NO: 742013 - RNA, 20 nt, Human
uccuucugucaccuaggcua

SEQ ID NO: 742014 - RNA, 18 nt, Human
ucuccuucugucaccuag

SEQ ID NO: 742015 - RNA, 21 nt, Human
ucucgaacuccugguuucaag

SEQ ID NO: 742016 - RNA, 18 nt, Human
ugaaaauuuaaagggugg

SEQ ID NO: 742017 - RNA, 21 nt, Human
ugagacuacaggugugugcca

SEQ ID NO: 742018 - RNA, 24 nt, Human
ugagacuacaggugugugccacca

SEQ ID NO: 742019 - RNA, 18 nt, Human
ugagguuucaccauguug

SEQ ID NO: 742020 - RNA, 22 nt, Human
ugcaguggugugaucauggcuc

SEQ ID NO: 742021 - RNA, 23 nt, Human
ugcaguggugugaucauggcuca

SEQ ID NO: 742022 - RNA, 19 nt, Human
ugccaccacacccagcaaa

SEQ ID NO: 742023 - RNA, 22 nt, Human
ugcuugauuacucucaucuugc

SEQ ID NO: 742024 - RNA, 23 nt, Human
ugggagaugacugaaucauggcg

SEQ ID NO: 742025 - RNA, 22 nt, Human
uggugugaucauggcucacuga

SEQ ID NO: 742026 - RNA, 21 nt, Human
ugguuucaagcaauccaccca

SEQ ID NO: 742027 - RNA, 22 nt, Human
ugguuucaagcaauccacccac

SEQ ID NO: 742028 - RNA, 21 nt, Human
uguagaguuugauuuuuuuuc

SEQ ID NO: 742029 - RNA, 23 nt, Human
uguagggaugagguuucaccaug

SEQ ID NO: 742030 - RNA, 24 nt, Human
uguagggaugagguuucaccaugu

SEQ ID NO: 742031 - RNA, 18 nt, Human
ugucuccacccaaaucuc

SEQ ID NO: 742032 - RNA, 18 nt, Human
ugugggagggaccuggug

SEQ ID NO: 742033 - RNA, 19 nt, Human
ugugggagggaccuggugg

SEQ ID NO: 742034 - RNA, 24 nt, Human
ugugugccaccacacccagcaaau

SEQ ID NO: 742035 - RNA, 21 nt, Human
uuaaugguaguacaauguuuu

SEQ ID NO: 742036 - RNA, 26 nt, Human
uucaagcaauccacccaccucagcca

SEQ ID NO: 742037 - RNA, 20 nt, Human
uucccauuguugugggaggg

SEQ ID NO: 742038 - RNA, 22 nt, Human
uugagaucugaugguuuuauaa

SEQ ID NO: 742039 - RNA, 22 nt, Human
uugauguaaguaaauauuuuga

SEQ ID NO: 742040 - RNA, 23 nt, Human
uugugaggccuccccagccacau

SEQ ID NO: 742041 - RNA, 22 nt, Human
uugugauaagugaauaagucuc

SEQ ID NO: 742042 - RNA, 24 nt, Human
uuuggccgugucuccacccaaauc

SEQ ID NO: 742043 - RNA, 23 nt, Human
uuuuuguauuuucuguagggaug

SEQ ID NO: 742044 - RNA, 20 nt, Human
aacacugcucaguucaaggu

SEQ ID NO: 742045 - RNA, 19 nt, Human
aacagcagcgugagccccc

SEQ ID NO: 742046 - RNA, 18 nt, Human
aacaguucccugcccaca

SEQ ID NO: 742047 - RNA, 26 nt, Human
aaccucacccccuucccagcuuccag

SEQ ID NO: 742048 - RNA, 18 nt, Human
aagcaggugaaaccccug

SEQ ID NO: 742049 - RNA, 19 nt, Human
aagcaggugaaaccccugc

SEQ ID NO: 742050 - RNA, 18 nt, Human
aaggcccugauuuuggag

SEQ ID NO: 742051 - RNA, 19 nt, Human
aagggcucagcccagggac

SEQ ID NO: 742052 - RNA, 19 nt, Human
aagggggcccaagaggagg

SEQ ID NO: 742053 - RNA, 22 nt, Human
aauagcccuguggacagaaagu

SEQ ID NO: 742054 - RNA, 23 nt, Human
aaugcaauccccaaagagacacu

SEQ ID NO: 742055 - RNA, 22 nt, Human
acaagccccacaaagccgaggg

SEQ ID NO: 742056 - RNA, 26 nt, Human
acacccucuggucccccugcgccccc

SEQ ID NO: 742057 - RNA, 19 nt, Human
acaccgcagcccccagggc

SEQ ID NO: 742058 - RNA, 20 nt, Human
acagaaaguugggcccaggc

SEQ ID NO: 742059 - RNA, 19 nt, Human
acccccaaagcagccacag

SEQ ID NO: 742060 - RNA, 19 nt, Human
accuuguggcccccaggcu

SEQ ID NO: 742061 - RNA, 19 nt, Human
acgguggugucacagcagg

SEQ ID NO: 742062 - RNA, 21 nt, Human
acugaugccaccagaaaacaa

SEQ ID NO: 742063 - RNA, 30 nt, Human
agaaagggggcccaagaggagggggggaaa

SEQ ID NO: 742064 - RNA, 20 nt, Human
agaagcuccccagcacacug

SEQ ID NO: 742065 - RNA, 25 nt, Human
agaccgaguccacuggguggcuggu

SEQ ID NO: 742066 - RNA, 18 nt, Human
agaggagggggggaaggc

SEQ ID NO: 742067 - RNA, 20 nt, Human
agaggccagggcgucaggcg

SEQ ID NO: 742068 - RNA, 26 nt, Human
agaguccaugaguggcccugagcagc

SEQ ID NO: 742069 - RNA, 24 nt, Human
agcacauucccuagucuaccagca

SEQ ID NO: 742070 - RNA, 23 nt, Human
agcacguugggugucugcuuccc

SEQ ID NO: 742071 - RNA, 21 nt, Human
aggaugggagccuggagaaag

SEQ ID NO: 742072 - RNA, 24 nt, Human
aggcaggaaaugcaauccccaaag

SEQ ID NO: 742073 - RNA, 18 nt, Human
aggcaugauggcuucugc

SEQ ID NO: 742074 - RNA, 19 nt, Human
aggcugaggggguccagua

SEQ ID NO: 742075 - RNA, 19 nt, Human
aggggaugggggcuaagaa

SEQ ID NO: 742076 - RNA, 21 nt, Human
aggggaugggggcuaagaaag

SEQ ID NO: 742077 - RNA, 20 nt, Human
aggucucugguggcuugaaa

SEQ ID NO: 742078 - RNA, 18 nt, Human
auagaguugggguccaug

SEQ ID NO: 742079 - RNA, 24 nt, Human
caaaacagagcugccaccagcgca

SEQ ID NO: 742080 - RNA, 19 nt, Human
caaagcagccacaguuggc

SEQ ID NO: 742081 - RNA, 21 nt, Human
caagcccuaguguggaccccc

SEQ ID NO: 742082 - RNA, 18 nt, Human
caaggggaugggggcuaa

SEQ ID NO: 742083 - RNA, 19 nt, Human
caauccccaaagagacacu

SEQ ID NO: 742084 - RNA, 18 nt, Human
cacaaagccgagggaaca

SEQ ID NO: 742085 - RNA, 18 nt, Human
cacacaacugcuccaggg

SEQ ID NO: 742086 - RNA, 23 nt, Human
cacauuuauccuccgccaagcug

SEQ ID NO: 742087 - RNA, 21 nt, Human
cacccaacgcagcucaggggc

SEQ ID NO: 742088 - RNA, 21 nt, Human
cacccccuucccagcuuccag

SEQ ID NO: 742089 - RNA, 23 nt, Human
cacccccuucccagcuuccagcc

SEQ ID NO: 742090 - RNA, 22 nt, Human
caccgcagcccccagggcaggg

SEQ ID NO: 742091 - RNA, 21 nt, Human
cacgccagauaaaaccagaga

SEQ ID NO: 742092 - RNA, 18 nt, Human
cacugcucaguucaaggu

SEQ ID NO: 742093 - RNA, 19 nt, Human
cacugcuggggcagcagcc

SEQ ID NO: 742094 - RNA, 20 nt, Human
cacuguggacgugaaaguca

SEQ ID NO: 742095 - RNA, 21 nt, Human
cagaucauccugggugucccc

SEQ ID NO: 742096 - RNA, 27 nt, Human
cagaucccagauggaacaugauuggag

SEQ ID NO: 742097 - RNA, 22 nt, Human
cagccacacagaagcuccccag

SEQ ID NO: 742098 - RNA, 19 nt, Human
cagcugaaggagucccaca

SEQ ID NO: 742099 - RNA, 26 nt, Human
cagggacaggaugggagccuggagaa

SEQ ID NO: 742100 - RNA, 19 nt, Human
cagggauaaaggacuggag

SEQ ID NO: 742101 - RNA, 22 nt, Human
cagggcagggauaaaggacugg

SEQ ID NO: 742102 - RNA, 22 nt, Human
caggggaugcccggggcccagc

SEQ ID NO: 742103 - RNA, 23 nt, Human
cauucccuagucuaccagcaccu

SEQ ID NO: 742104 - RNA, 23 nt, Human
cauucugaaaauccaccaauuaa

SEQ ID NO: 742105 - RNA, 21 nt, Human
ccaacccccgcaacaccggcc

SEQ ID NO: 742106 - RNA, 19 nt, Human
ccaaggggaccacagcuuc

SEQ ID NO: 742107 - RNA, 21 nt, Human
ccacaaaacagagcugccacc

SEQ ID NO: 742108 - RNA, 22 nt, Human
ccacaccgcagcccccagggca

SEQ ID NO: 742109 - RNA, 18 nt, Human
ccacuggguggcuggugg

SEQ ID NO: 742110 - RNA, 21 nt, Human
ccacuggguggcugguggucu

SEQ ID NO: 742111 - RNA, 19 nt, Human
ccaggcugccaucugugcu

SEQ ID NO: 742112 - RNA, 20 nt, Human
ccauuggccauugggaccgg

SEQ ID NO: 742113 - RNA, 22 nt, Human
cccaacgcagcucaggggcugu

SEQ ID NO: 742114 - RNA, 28 nt, Human
cccaagcccuaguguggacccccccaag

SEQ ID NO: 742115 - RNA, 19 nt, Human
cccacaaagccgagggaac

SEQ ID NO: 742116 - RNA, 25 nt, Human
cccacaaagccgagggaacagcagc

SEQ ID NO: 742117 - RNA, 24 nt, Human
cccacaccgcagcccccagggcag

SEQ ID NO: 742118 - RNA, 23 nt, Human
cccagaaccuggacccuccuaga

SEQ ID NO: 742119 - RNA, 23 nt, Human
cccagauggaacaugauuggagc

SEQ ID NO: 742120 - RNA, 24 nt, Human
ccccaaagcagccacaguuggccc

SEQ ID NO: 742121 - RNA, 22 nt, Human
ccccaagcccuaguguggaccc

SEQ ID NO: 742122 - RNA, 23 nt, Human
ccccaagcccuaguguggacccc

SEQ ID NO: 742123 - RNA, 19 nt, Human
ccccagagaccgaguccac

SEQ ID NO: 742124 - RNA, 20 nt, Human
ccccagagaccgaguccacu

SEQ ID NO: 742125 - RNA, 24 nt, Human
ccccaggcuggggucaacgguggu

SEQ ID NO: 742126 - RNA, 23 nt, Human
ccccccaagcaggugaaaccccc

SEQ ID NO: 742127 - RNA, 22 nt, Human
ccccugcccuggcacccaggag

SEQ ID NO: 742128 - RNA, 21 nt, Human
ccccuuugggucucaggggag

SEQ ID NO: 742129 - RNA, 20 nt, Human
cccggggaaaggucagcucu

SEQ ID NO: 742130 - RNA, 21 nt, Human
cccugcccuggcacccaggag

SEQ ID NO: 742131 - RNA, 19 nt, Human
cccuggggggggccgggcu

SEQ ID NO: 742132 - RNA, 19 nt, Human
ccgagcucaaggcccagga

SEQ ID NO: 742133 - RNA, 19 nt, Human
ccuaguguggaccccccca

SEQ ID NO: 742134 - RNA, 21 nt, Human
ccucugccccggcugcaugag

SEQ ID NO: 742135 - RNA, 21 nt, Human
ccuuguggcccccaggcuggg

SEQ ID NO: 742136 - RNA, 23 nt, Human
ccuuguggcccccaggcuggggu

SEQ ID NO: 742137 - RNA, 18 nt, Human
cguauccacaaaacagag

SEQ ID NO: 742138 - RNA, 19 nt, Human
cgugcagcccggggccugg

SEQ ID NO: 742139 - RNA, 20 nt, Human
cuaggcaggaaaugcaaucc

SEQ ID NO: 742140 - RNA, 19 nt, Human
cuccaacccccgcaacacc

SEQ ID NO: 742141 - RNA, 22 nt, Human
cugccacugaugccaccagaaa

SEQ ID NO: 742142 - RNA, 18 nt, Human
cugcgcccccaugccagg

SEQ ID NO: 742143 - RNA, 18 nt, Human
cugggcaccuggauugga

SEQ ID NO: 742144 - RNA, 24 nt, Human
cuggguggcugguggucuuggccu

SEQ ID NO: 742145 - RNA, 19 nt, Human
cuguccccaagcugggcgu

SEQ ID NO: 742146 - RNA, 24 nt, Human
cuguggcgccaggcguuggugucc

SEQ ID NO: 742147 - RNA, 22 nt, Human
cuucccaggaagcccagaaccu

SEQ ID NO: 742148 - RNA, 18 nt, Human
cuucucagagaaaccggc

SEQ ID NO: 742149 - RNA, 18 nt, Human
gaaaguccaaggucccca

SEQ ID NO: 742150 - RNA, 22 nt, Human
gaacaugauuggagcgggggaa

SEQ ID NO: 742151 - RNA, 25 nt, Human
gaacaugauuggagcgggggaaaga

SEQ ID NO: 742152 - RNA, 19 nt, Human
gagacaguggagauucaga

SEQ ID NO: 742153 - RNA, 18 nt, Human
gagcagcaggcugagggg

SEQ ID NO: 742154 - RNA, 24 nt, Human
gaguggcccugagcagcggggcug

SEQ ID NO: 742155 - RNA, 22 nt, Human
gccgggcuauggcagaggcccg

SEQ ID NO: 742156 - RNA, 20 nt, Human
gccugggcucuugcugcugg

SEQ ID NO: 742157 - RNA, 19 nt, Human
ggacaggaugggagccugg

SEQ ID NO: 742158 - RNA, 23 nt, Human
ggaccgggcccugcugcagagaa

SEQ ID NO: 742159 - RNA, 19 nt, Human
ggagcucaaggacaagccc

SEQ ID NO: 742160 - RNA, 24 nt, Human
ggaugggggcuaagaaaguccaag

SEQ ID NO: 742161 - RNA, 18 nt, Human
ggcaccccacggagggag

SEQ ID NO: 742162 - RNA, 19 nt, Human
ggcaggggaugcccggggc

SEQ ID NO: 742163 - RNA, 24 nt, Human
ggccccagcgcaccucagagacag

SEQ ID NO: 742164 - RNA, 23 nt, Human
ggccugaaggccucuuugucagg

SEQ ID NO: 742165 - RNA, 20 nt, Human
ggcugguggucuuggccucg

SEQ ID NO: 742166 - RNA, 19 nt, Human
gggaccacagcuucugggu

SEQ ID NO: 742167 - RNA, 23 nt, Human
ggggagggcaggggaugcccggg

SEQ ID NO: 742168 - RNA, 22 nt, Human
guggauggcgcuguuccacggc

SEQ ID NO: 742169 - RNA, 21 nt, Human
guguguguagcgagcuuucug

SEQ ID NO: 742170 - RNA, 18 nt, Human
uagagccaucgagccaca

SEQ ID NO: 742171 - RNA, 22 nt, Human
ucagcaaccuuguggcccccag

SEQ ID NO: 742172 - RNA, 20 nt, Human
ucaggggagggcaggggaug

SEQ ID NO: 742173 - RNA, 22 nt, Human
ucaggggagggcaggggaugcc

SEQ ID NO: 742174 - RNA, 20 nt, Human
ucaggggcuguggcugcuag

SEQ ID NO: 742175 - RNA, 18 nt, Human
uccaacccccgcaacacc

SEQ ID NO: 742176 - RNA, 20 nt, Human
uccacaaaacagagcugcca

SEQ ID NO: 742177 - RNA, 22 nt, Human
uccacaaaacagagcugccacc

SEQ ID NO: 742178 - RNA, 23 nt, Human
uccacaaaacagagcugccacca

SEQ ID NO: 742179 - RNA, 18 nt, Human
ucccacaccgcagccccc

SEQ ID NO: 742180 - RNA, 19 nt, Human
ucccaggaagcccagaacc

SEQ ID NO: 742181 - RNA, 25 nt, Human
uccccaaagagacacugcucggcuc

SEQ ID NO: 742182 - RNA, 21 nt, Human
uccccagcacacuggccacag

SEQ ID NO: 742183 - RNA, 22 nt, Human
uccccaggcuguccccaagcug

SEQ ID NO: 742184 - RNA, 25 nt, Human
uccguauccacaaaacagagcugcc

SEQ ID NO: 742185 - RNA, 18 nt, Human
uccuagaguccaugagug

SEQ ID NO: 742186 - RNA, 20 nt, Human
uccugggcugugagcugacg

SEQ ID NO: 742187 - RNA, 23 nt, Human
uccugggcugugagcugacgugc

SEQ ID NO: 742188 - RNA, 21 nt, Human
ucgcuggaauugcagccaugu

SEQ ID NO: 742189 - RNA, 20 nt, Human
ucggcuccagggcggccauu

SEQ ID NO: 742190 - RNA, 22 nt, Human
ucucaggggagggcaggggaug

SEQ ID NO: 742191 - RNA, 20 nt, Human
ucucuggggagaccuuggcc

SEQ ID NO: 742192 - RNA, 18 nt, Human
ucugagagucagcauggg

SEQ ID NO: 742193 - RNA, 23 nt, Human
ugacgugcagcccggggccuggg

SEQ ID NO: 742194 - RNA, 24 nt, Human
ugagcccccugcccuggcacccag

SEQ ID NO: 742195 - RNA, 30 nt, Human
ugagcucaaucaagugagcucagacacaag

SEQ ID NO: 742196 - RNA, 24 nt, Human
ugagcucagacacaaaggagcugg

SEQ ID NO: 742197 - RNA, 19 nt, Human
ugaggagaacaccccagag

SEQ ID NO: 742198 - RNA, 20 nt, Human
ugaguuggagaaggagcgug

SEQ ID NO: 742199 - RNA, 20 nt, Human
ugaguuggagaaggagcgug

SEQ ID NO: 742200 - RNA, 20 nt, Human
ugcagcccggggccugggcu

SEQ ID NO: 742201 - RNA, 20 nt, Human
ugccauagaguuggggucca

SEQ ID NO: 742202 - RNA, 24 nt, Human
ugccauagaguugggguccauguu

SEQ ID NO: 742203 - RNA, 20 nt, Human
ugcccggggaaaggucagcu

SEQ ID NO: 742204 - RNA, 23 nt, Human
ugcccggggaaaggucagcucug

SEQ ID NO: 742205 - RNA, 18 nt, Human
ugcugagcagcaggcuga

SEQ ID NO: 742206 - RNA, 21 nt, Human
ugcugcagagaagggaaggau

SEQ ID NO: 742207 - RNA, 20 nt, Human
ugcugcugguacccggaugc

SEQ ID NO: 742208 - RNA, 23 nt, Human
uggaagacacccucugguccccc

SEQ ID NO: 742209 - RNA, 22 nt, Human
uggagaaagggggcccaagagg

SEQ ID NO: 742210 - RNA, 22 nt, Human
uggccacaguggcauuagggaa

SEQ ID NO: 742211 - RNA, 19 nt, Human
uggcuuauguguuuucagc

SEQ ID NO: 742212 - RNA, 20 nt, Human
ugggagcagcugccacugau

SEQ ID NO: 742213 - RNA, 21 nt, Human
ugggcccaggcugccaucugu

SEQ ID NO: 742214 - RNA, 24 nt, Human
ugggggcaccccaccccgucccug

SEQ ID NO: 742215 - RNA, 22 nt, Human
ugggugaagguggggugcaggu

SEQ ID NO: 742216 - RNA, 18 nt, Human
uggguuccuccaaccccc

SEQ ID NO: 742217 - RNA, 19 nt, Human
ugguggucuuggccucgcu

SEQ ID NO: 742218 - RNA, 21 nt, Human
uguguuuucagcucucuaaag

SEQ ID NO: 742219 - RNA, 21 nt, Human
uuggaaccucacccccuuccc

SEQ ID NO: 742220 - RNA, 18 nt, Human
uuggagaaggagcguguc

SEQ ID NO: 742221 - RNA, 21 nt, Human
uugggugucugcuucccuucu

SEQ ID NO: 742222 - RNA, 21 nt, Human
aaaaauaguaacucagcccuc

SEQ ID NO: 742223 - RNA, 20 nt, Human
accgcaccgcgaacgcuucg

SEQ ID NO: 742224 - RNA, 19 nt, Human
aggacuucuugaagguuuu

SEQ ID NO: 742225 - RNA, 28 nt, Human
cacguccggagcggucucagcagcccca

SEQ ID NO: 742226 - RNA, 22 nt, Human
cacuagccaguguuuggccgac

SEQ ID NO: 742227 - RNA, 20 nt, Human
cagcagccccaugcgcuggc

SEQ ID NO: 742228 - RNA, 18 nt, Human
cauuguaaauaaaaauag

SEQ ID NO: 742229 - RNA, 26 nt, Human
cccuugacuucaguguugaauggcuc

SEQ ID NO: 742230 - RNA, 24 nt, Human
ggagcggucucagcagccccaugc

SEQ ID NO: 742231 - RNA, 18 nt, Human
ugaauggcucuugcaagg

SEQ ID NO: 742232 - RNA, 22 nt, Human
uuuuuuuuuuuuuuaguuugga

SEQ ID NO: 742233 - RNA, 22 nt, Human
aaaaugacuuuaaaaccagugg

SEQ ID NO: 742234 - RNA, 21 nt, Human
aacauccaaccagaaagcuaa

SEQ ID NO: 742235 - RNA, 22 nt, Human
aaccagaaagcuaagcgcucuc

SEQ ID NO: 742236 - RNA, 21 nt, Human
aaugacuuuaaaaccaguggc

SEQ ID NO: 742237 - RNA, 18 nt, Human
agcugaccucagagccca

SEQ ID NO: 742238 - RNA, 22 nt, Human
agcugaccucagagcccaaaac

SEQ ID NO: 742239 - RNA, 19 nt, Human
caaccagaaagcuaagcgc

SEQ ID NO: 742240 - RNA, 22 nt, Human
caagcugaccucagagcccaaa

SEQ ID NO: 742241 - RNA, 26 nt, Human
cagagcccaaaacauccaaccagaaa

SEQ ID NO: 742242 - RNA, 21 nt, Human
cccaaaacauccaaccagaaa

SEQ ID NO: 742243 - RNA, 19 nt, Human
ccgcacaagaccgcucuac

SEQ ID NO: 742244 - RNA, 22 nt, Human
cucagagcccaaaacauccaac

SEQ ID NO: 742245 - RNA, 19 nt, Human
cugugcuggcugucucuuc

SEQ ID NO: 742246 - RNA, 22 nt, Human
gcacaagaccgcucuacagucu

SEQ ID NO: 742247 - RNA, 19 nt, Human
uccaaccagaaagcuaagc

SEQ ID NO: 742248 - RNA, 25 nt, Human
ucuccaagcugaccucagagcccuu

SEQ ID NO: 742249 - RNA, 19 nt, Human
ucucuggugcucuuccauu

SEQ ID NO: 742250 - RNA, 24 nt, Human
ucuggugcucuuccauuccucucc

SEQ ID NO: 742251 - RNA, 18 nt, Human
ugcucaaaaaccaaacag

SEQ ID NO: 742252 - RNA, 21 nt, Human
uggcauaaacacugugcuggc

SEQ ID NO: 742253 - RNA, 25 nt, Human
uuaaaaccaguggcauaaacacugu

SEQ ID NO: 742254 - RNA, 18 nt, Human
uuaaucuuuuuuuucuuc

SEQ ID NO: 742255 - RNA, 20 nt, Human
uuauuuauuuauuuauuuua

SEQ ID NO: 742256 - RNA, 22 nt, Human
aaaauuccagaagaugccuuuc

SEQ ID NO: 742257 - RNA, 21 nt, Human
agcagggggugcagccgccaa

SEQ ID NO: 742258 - RNA, 20 nt, Human
aggagccgugggcccugcag

SEQ ID NO: 742259 - RNA, 18 nt, Human
agguucuagaaguuucuc

SEQ ID NO: 742260 - RNA, 21 nt, Human
auguguggggagcaggggggc

SEQ ID NO: 742261 - RNA, 21 nt, Human
auuacaggaguguugguggcc

SEQ ID NO: 742262 - RNA, 18 nt, Human
cacacccuccgccggccc

SEQ ID NO: 742263 - RNA, 22 nt, Human
cagaagaugccuuucugcagca

SEQ ID NO: 742264 - RNA, 20 nt, Human
cagcacgcugguccuggggc

SEQ ID NO: 742265 - RNA, 18 nt, Human
cagcagcacgcugguccu

SEQ ID NO: 742266 - RNA, 22 nt, Human
cagcugcagcuuccugagguuc

SEQ ID NO: 742267 - RNA, 22 nt, Human
cagcuguugcucaggagccgug

SEQ ID NO: 742268 - RNA, 24 nt, Human
caggagccgugggcccugcaggag

SEQ ID NO: 742269 - RNA, 24 nt, Human
cccagcaaaaaugcuggcuuugcc

SEQ ID NO: 742270 - RNA, 23 nt, Human
ccuccagcugcagcuuccugagg

SEQ ID NO: 742271 - RNA, 19 nt, Human
cgggucacacccuccgccg

SEQ ID NO: 742272 - RNA, 25 nt, Human
cugccaggccgcugagccgccgcgc

SEQ ID NO: 742273 - RNA, 20 nt, Human
cugucgcguauuccaacaca

SEQ ID NO: 742274 - RNA, 25 nt, Human
gaaaaaauuccagaagaugccuuuu

SEQ ID NO: 742275 - RNA, 21 nt, Human
gcagcagcacgcugguccugg

SEQ ID NO: 742276 - RNA, 21 nt, Human
gcagccgccaaggcccgggug

SEQ ID NO: 742277 - RNA, 19 nt, Human
gccgcugcguucucgccca

SEQ ID NO: 742278 - RNA, 22 nt, Human
gccgugggcccugcaggaguau

SEQ ID NO: 742279 - RNA, 22 nt, Human
ggccggugggcagagccuagca

SEQ ID NO: 742280 - RNA, 24 nt, Human
ggggugcagccgccaaggcccggg

SEQ ID NO: 742281 - RNA, 24 nt, Human
guauuccaacacagacauguuuuu

SEQ ID NO: 742282 - RNA, 19 nt, Human
gugggcagagccuagcagg

SEQ ID NO: 742283 - RNA, 19 nt, Human
uaugauguguggggagcag

SEQ ID NO: 742284 - RNA, 19 nt, Human
ucacacccuccgccggccc

SEQ ID NO: 742285 - RNA, 19 nt, Human
ugacgaaaaaauuccagaa

SEQ ID NO: 742286 - RNA, 23 nt, Human
ugccacagcugacgaaaaaauuc

SEQ ID NO: 742287 - RNA, 19 nt, Human
ugccccagcccuccagcug

SEQ ID NO: 742288 - RNA, 19 nt, Human
uggaauuacaggaguguug

SEQ ID NO: 742289 - RNA, 21 nt, Human
ugggcagagccuagcaggggg

SEQ ID NO: 742290 - RNA, 21 nt, Human
uggggagcaggggggcaggug

SEQ ID NO: 742291 - RNA, 23 nt, Human
uggggaggauaugaugugugggg

SEQ ID NO: 742292 - RNA, 25 nt, Human
ugucccagcuguugcucaggagccg

SEQ ID NO: 742293 - RNA, 20 nt, Human
uguggggagcaggggggcag

SEQ ID NO: 742294 - RNA, 19 nt, Human
uguguggggagcagggggg

SEQ ID NO: 742295 - RNA, 20 nt, Human
uuacaggaguguugguggcc

SEQ ID NO: 742296 - RNA, 24 nt, Human
uuccugagguucuagaaguuucuc

SEQ ID NO: 742297 - RNA, 20 nt, Human
uuucccagcaaaaaugcugg

SEQ ID NO: 742298 - RNA, 24 nt, Human
aaaaaaagcaaccccugcccccac

SEQ ID NO: 742299 - RNA, 19 nt, Human
aaaaacccuugucaccuaa

SEQ ID NO: 742300 - RNA, 20 nt, Human
aaaaagcaaccccugccccc

SEQ ID NO: 742301 - RNA, 22 nt, Human
aaaaagcaaccccugcccccac

SEQ ID NO: 742302 - RNA, 22 nt, Human
aaaacaguuuaaacuagauuuu

SEQ ID NO: 742303 - RNA, 18 nt, Human
aaaauucaauguaaagcc

SEQ ID NO: 742304 - RNA, 22 nt, Human
aaacugaaagcaauucuucaau

SEQ ID NO: 742305 - RNA, 26 nt, Human
aaagaagaaaauaccuuuuuaaagag

SEQ ID NO: 742306 - RNA, 28 nt, Human
aaagaagaaaauaccuuuuuaaagagaa

SEQ ID NO: 742307 - RNA, 19 nt, Human
aaauaaaaaaaagcaaccc

SEQ ID NO: 742308 - RNA, 20 nt, Human
aaaucaacuuuuggccgggu

SEQ ID NO: 742309 - RNA, 26 nt, Human
aaauuguagaaaccaguauaugaaau

SEQ ID NO: 742310 - RNA, 20 nt, Human
aacagagugagacuccaucu

SEQ ID NO: 742311 - RNA, 24 nt, Human
aacagagugagacuccaucucaaa

SEQ ID NO: 742312 - RNA, 26 nt, Human
aagcacacacaauagcagaaugaaau

SEQ ID NO: 742313 - RNA, 18 nt, Human
aagcgcccauccacccag

SEQ ID NO: 742314 - RNA, 20 nt, Human
aauaaacaaacuacaccaag

SEQ ID NO: 742315 - RNA, 20 nt, Human
aauaugcugaaaccccaucu

SEQ ID NO: 742316 - RNA, 24 nt, Human
aaucgcuugaacccgggaggcgga

SEQ ID NO: 742317 - RNA, 20 nt, Human
aauuacauuuuucacaucua

SEQ ID NO: 742318 - RNA, 19 nt, Human
acaaaacccaaacugaaag

SEQ ID NO: 742319 - RNA, 21 nt, Human
acacacacacaagcacacaca

SEQ ID NO: 742320 - RNA, 24 nt, Human
acagagugagacuccaucucaaaa

SEQ ID NO: 742321 - RNA, 19 nt, Human
acccaaacugaaagcaauu

SEQ ID NO: 742322 - RNA, 18 nt, Human
accccaucucuacuaaaa

SEQ ID NO: 742323 - RNA, 18 nt, Human
accguccggcagcccagg

SEQ ID NO: 742324 - RNA, 24 nt, Human
acgccacugcacuccagccugggc

SEQ ID NO: 742325 - RNA, 24 nt, Human
acgccacugcacuccagccugggc

SEQ ID NO: 742326 - RNA, 24 nt, Human
acuccagccugggcaacagaguga

SEQ ID NO: 742327 - RNA, 25 nt, Human
acucugcaauuaaagcucagggcua

SEQ ID NO: 742328 - RNA, 24 nt, Human
acugcacuccagccugggcaacag

SEQ ID NO: 742329 - RNA, 24 nt, Human
acugcacuccagccugggcaacag

SEQ ID NO: 742330 - RNA, 22 nt, Human
agaaaggcccuauaggcuuaag

SEQ ID NO: 742331 - RNA, 24 nt, Human
agcacuuugggaggccgaggcggg

SEQ ID NO: 742332 - RNA, 21 nt, Human
agcauuucaaagcaguucugc

SEQ ID NO: 742333 - RNA, 24 nt, Human
agccuggccaauaugcugaaaccc

SEQ ID NO: 742334 - RNA, 24 nt, Human
agccugggcaacagagugagacuc

SEQ ID NO: 742335 - RNA, 19 nt, Human
agcgcccauccacccaggc

SEQ ID NO: 742336 - RNA, 21 nt, Human
agcgucccacagcgacuuccg

SEQ ID NO: 742337 - RNA, 23 nt, Human
agcuggguguggugggacgcgcc

SEQ ID NO: 742338 - RNA, 24 nt, Human
aggcaggagaaucgcuugaacccg

SEQ ID NO: 742339 - RNA, 21 nt, Human
aggccgaggcggguggaucac

SEQ ID NO: 742340 - RNA, 21 nt, Human
aggcggagguugcaguaagcc

SEQ ID NO: 742341 - RNA, 24 nt, Human
aggcggagguugcaguaagccgag

SEQ ID NO: 742342 - RNA, 24 nt, Human
aggcggguggaucacaaggucagg

SEQ ID NO: 742343 - RNA, 20 nt, Human
aggcugaggcaggagaaucg

SEQ ID NO: 742344 - RNA, 24 nt, Human
aggcugaggcaggagaaucgcuug

SEQ ID NO: 742345 - RNA, 24 nt, Human
aggggcucacgccuauaaucccag

SEQ ID NO: 742346 - RNA, 29 nt, Human
auaaaacuuucuuuuaaaggcccauaaaa

SEQ ID NO: 742347 - RNA, 24 nt, Human
auaacacugagaaauuucaaauau

SEQ ID NO: 742348 - RNA, 22 nt, Human
auagaaaaugcuugucaccuua

SEQ ID NO: 742349 - RNA, 19 nt, Human
aucacaaggucaggaguuc

SEQ ID NO: 742350 - RNA, 21 nt, Human
aucacaaggucaggaguucga

SEQ ID NO: 742351 - RNA, 24 nt, Human
aucacgccacugcacuccagccug

SEQ ID NO: 742352 - RNA, 25 nt, Human
aucucaaaaaaacaaacaaacaaac

SEQ ID NO: 742353 - RNA, 18 nt, Human
aucuuacuaaaaauaauu

SEQ ID NO: 742354 - RNA, 20 nt, Human
caaacaaaguauggaacagu

SEQ ID NO: 742355 - RNA, 26 nt, Human
caaacugaaagcaauucuucaauuua

SEQ ID NO: 742356 - RNA, 25 nt, Human
caagcacacacaauagcagaaugaa

SEQ ID NO: 742357 - RNA, 26 nt, Human
caagcgcccauccacccaggcgcccc

SEQ ID NO: 742358 - RNA, 21 nt, Human
caaguucaaccaagacugaag

SEQ ID NO: 742359 - RNA, 19 nt, Human
cacagauccaauccacugu

SEQ ID NO: 742360 - RNA, 24 nt, Human
cacgccuauaaucccagcacuuug

SEQ ID NO: 742361 - RNA, 22 nt, Human
cacuccagccugggcaacagag

SEQ ID NO: 742362 - RNA, 22 nt, Human
cacuccagccugggcaacagag

SEQ ID NO: 742363 - RNA, 24 nt, Human
cacuccagccugggcaacagagug

SEQ ID NO: 742364 - RNA, 19 nt, Human
cacugagaaauuucaaaua

SEQ ID NO: 742365 - RNA, 18 nt, Human
cacugcacuccagccugg

SEQ ID NO: 742366 - RNA, 19 nt, Human
cacugcacuccagccuggg

SEQ ID NO: 742367 - RNA, 21 nt, Human
cacugcacuccagccugggca

SEQ ID NO: 742368 - RNA, 23 nt, Human
cacugcacuccagccugggcaac

SEQ ID NO: 742369 - RNA, 24 nt, Human
cacugcacuccagccugggcaaca

SEQ ID NO: 742370 - RNA, 24 nt, Human
cagcacuuugggaggccgaggcgg

SEQ ID NO: 742371 - RNA, 24 nt, Human
caguuacuugggaggcugaggcag

SEQ ID NO: 742372 - RNA, 24 nt, Human
cauaaaacuuucuuuuaaaggccc

SEQ ID NO: 742373 - RNA, 26 nt, Human
caucucaaaaaaacaaacaaacaaac

SEQ ID NO: 742374 - RNA, 22 nt, Human
ccacccaggcgccccgcucccg

SEQ ID NO: 742375 - RNA, 20 nt, Human
ccacugcacuccagccuggg

SEQ ID NO: 742376 - RNA, 20 nt, Human
ccacugcacuccagccuggg

SEQ ID NO: 742377 - RNA, 21 nt, Human
ccacugcacuccagccugggc

SEQ ID NO: 742378 - RNA, 22 nt, Human
ccacugcacuccagccugggca

SEQ ID NO: 742379 - RNA, 23 nt, Human
ccacugcacuccagccugggcaa

SEQ ID NO: 742380 - RNA, 24 nt, Human
ccacugcacuccagccugggcaac

SEQ ID NO: 742381 - RNA, 19 nt, Human
cccaagcgcccauccaccc

SEQ ID NO: 742382 - RNA, 23 nt, Human
cccagugcuuuuuuccccuugaa

SEQ ID NO: 742383 - RNA, 22 nt, Human
ccccagugcuuuuuuccccuug

SEQ ID NO: 742384 - RNA, 22 nt, Human
ccuauaaucccagcacuuuggg

SEQ ID NO: 742385 - RNA, 21 nt, Human
ccugcccccacacuuuaaaag

SEQ ID NO: 742386 - RNA, 24 nt, Human
ccuggccaauaugcugaaacccca

SEQ ID NO: 742387 - RNA, 22 nt, Human
ccugggcaacagagugagacuc

SEQ ID NO: 742388 - RNA, 22 nt, Human
ccuguugucccaguuacuuggg

SEQ ID NO: 742389 - RNA, 19 nt, Human
cgagaccagccuggccaau

SEQ ID NO: 742390 - RNA, 24 nt, Human
cgagaucacgccacugcacuccag

SEQ ID NO: 742391 - RNA, 26 nt, Human
cgaggcggguggaucacaaggucagg

SEQ ID NO: 742392 - RNA, 23 nt, Human
cgcccauccacccaggcgccccg

SEQ ID NO: 742393 - RNA, 22 nt, Human
cucacgccuauaaucccagcac

SEQ ID NO: 742394 - RNA, 24 nt, Human
cucacgccuauaaucccagcacuu

SEQ ID NO: 742395 - RNA, 23 nt, Human
cuccaucucaaaaaaacaaacaa

SEQ ID NO: 742396 - RNA, 22 nt, Human
cuugcagcauuucaaagcaguu

SEQ ID NO: 742397 - RNA, 19 nt, Human
gacuugcucauauuaguaa

SEQ ID NO: 742398 - RNA, 23 nt, Human
gagaaucgcuugaacccgggagg

SEQ ID NO: 742399 - RNA, 22 nt, Human
gagguugcaguaagccgagauc

SEQ ID NO: 742400 - RNA, 22 nt, Human
gaucacaaggucaggaguucga

SEQ ID NO: 742401 - RNA, 24 nt, Human
gaucacaaggucaggaguucgaga

SEQ ID NO: 742402 - RNA, 24 nt, Human
gcacuccagccugggcaacagagu

SEQ ID NO: 742403 - RNA, 24 nt, Human
gccaauaugcugaaaccccaucuc

SEQ ID NO: 742404 - RNA, 22 nt, Human
gccacugcacuccagccugggc

SEQ ID NO: 742405 - RNA, 24 nt, Human
gccacugcacuccagccugggcaa

SEQ ID NO: 742406 - RNA, 20 nt, Human
gccgagaucacgccacugca

SEQ ID NO: 742407 - RNA, 24 nt, Human
gccgggugcaggggcucacgccua

SEQ ID NO: 742408 - RNA, 21 nt, Human
gcgcccauccacccaggcgcc

SEQ ID NO: 742409 - RNA, 27 nt, Human
ggacuuaggcucuagagucaucuuuag

SEQ ID NO: 742410 - RNA, 24 nt, Human
ggagaaacuaggacuuaggcucua

SEQ ID NO: 742411 - RNA, 18 nt, Human
ggagguugcaguaagccg

SEQ ID NO: 742412 - RNA, 24 nt, Human
ggagguugcaguaagccgagauca

SEQ ID NO: 742413 - RNA, 24 nt, Human
gggcucacgccuauaaucccagca

SEQ ID NO: 742414 - RNA, 23 nt, Human
ggugcaggggcucacgccuauaa

SEQ ID NO: 742415 - RNA, 23 nt, Human
gguggaucacaaggucaggaguu

SEQ ID NO: 742416 - RNA, 21 nt, Human
gguguggugggacgcgccugu

SEQ ID NO: 742417 - RNA, 22 nt, Human
gucaaucuuuugguuguauuuu

SEQ ID NO: 742418 - RNA, 23 nt, Human
guggaucacaaggucaggaguuc

SEQ ID NO: 742419 - RNA, 19 nt, Human
uaaaagcagguuuccaaaa

SEQ ID NO: 742420 - RNA, 18 nt, Human
uaaacaaacuacaccaag

SEQ ID NO: 742421 - RNA, 18 nt, Human
uaacuuuuacuaccagcu

SEQ ID NO: 742422 - RNA, 19 nt, Human
uaagaaaggcccuauaggc

SEQ ID NO: 742423 - RNA, 18 nt, Human
uaagaagggaaggcucuu

SEQ ID NO: 742424 - RNA, 24 nt, Human
uaauuuugucauuacuggcacagg

SEQ ID NO: 742425 - RNA, 21 nt, Human
uacaaacaaaguauggaacag

SEQ ID NO: 742426 - RNA, 21 nt, Human
uacacacacacaagcacacac

SEQ ID NO: 742427 - RNA, 22 nt, Human
uacacacacacaagcacacaca

SEQ ID NO: 742428 - RNA, 25 nt, Human
uacacacacacaagcacacacaaua

SEQ ID NO: 742429 - RNA, 18 nt, Human
uagaaaaugcuugucacc

SEQ ID NO: 742430 - RNA, 18 nt, Human
uagauuuucuaagauaau

SEQ ID NO: 742431 - RNA, 18 nt, Human
uagcagaaugaaauuaca

SEQ ID NO: 742432 - RNA, 24 nt, Human
uauacaaaacccaaacugaaagca

SEQ ID NO: 742433 - RNA, 22 nt, Human
uauuaauuuuguccaguagaga

SEQ ID NO: 742434 - RNA, 22 nt, Human
uauuaccaacaaagcaggauuu

SEQ ID NO: 742435 - RNA, 23 nt, Human
uauucaguugagccauacuuaua

SEQ ID NO: 742436 - RNA, 24 nt, Human
ucacaaggucaggaguucgagacc

SEQ ID NO: 742437 - RNA, 23 nt, Human
ucacgccacugcacuccagccug

SEQ ID NO: 742438 - RNA, 23 nt, Human
uccagccugggcaacagagugag

SEQ ID NO: 742439 - RNA, 24 nt, Human
uccagccugggcaacagagugaga

SEQ ID NO: 742440 - RNA, 18 nt, Human
uccaggcaaaccaaugaa

SEQ ID NO: 742441 - RNA, 21 nt, Human
uccaucucaaaaaaacaaaca

SEQ ID NO: 742442 - RNA, 18 nt, Human
uccucagcgucccacagc

SEQ ID NO: 742443 - RNA, 24 nt, Human
ucgcuugaacccgggaggcggagg

SEQ ID NO: 742444 - RNA, 22 nt, Human
ucuaagugagaggacauaaacu

SEQ ID NO: 742445 - RNA, 24 nt, Human
ucucaaaaaaacaaacaaacaaac

SEQ ID NO: 742446 - RNA, 22 nt, Human
ucucuacuaaaaguauaaaaaa

SEQ ID NO: 742447 - RNA, 19 nt, Human
ucugcaauuaaagcucagg

SEQ ID NO: 742448 - RNA, 21 nt, Human
ucugcaauuaaagcucagggc

SEQ ID NO: 742449 - RNA, 19 nt, Human
ugaaaccccaucucuacua

SEQ ID NO: 742450 - RNA, 22 nt, Human
ugaaauaccaauaaaauuauag

SEQ ID NO: 742451 - RNA, 20 nt, Human
ugaggcaggagaaucgcuug

SEQ ID NO: 742452 - RNA, 24 nt, Human
ugaggcaggagaaucgcuugaacc

SEQ ID NO: 742453 - RNA, 25 nt, Human
ugaggcaggagaaucgcuugaaccc

SEQ ID NO: 742454 - RNA, 18 nt, Human
ugcagaaauaagaugacu

SEQ ID NO: 742455 - RNA, 20 nt, Human
ugccaagaacucaaguucaa

SEQ ID NO: 742456 - RNA, 24 nt, Human
ugcuuuuccaucacucuuuacaua

SEQ ID NO: 742457 - RNA, 22 nt, Human
uggaucacaaggucaggaguuc

SEQ ID NO: 742458 - RNA, 23 nt, Human
ugggaggccgaggcggguggauc

SEQ ID NO: 742459 - RNA, 24 nt, Human
ugggaggccgaggcggguggauca

SEQ ID NO: 742460 - RNA, 19 nt, Human
ugggaggcugaggcaggag

SEQ ID NO: 742461 - RNA, 23 nt, Human
ugggaggcugaggcaggagaauc

SEQ ID NO: 742462 - RNA, 21 nt, Human
uggucagagugccaagaacuc

SEQ ID NO: 742463 - RNA, 18 nt, Human
uuaaaguuacucugcaau

SEQ ID NO: 742464 - RNA, 23 nt, Human
uuaacccuucuuccacuguaccu

SEQ ID NO: 742465 - RNA, 24 nt, Human
uuaagaagggaaggcucuuuuaaa

SEQ ID NO: 742466 - RNA, 23 nt, Human
uuagacaauaaacaaacuacacc

SEQ ID NO: 742467 - RNA, 22 nt, Human
uuagcuggguguggugggacgc

SEQ ID NO: 742468 - RNA, 24 nt, Human
uuagcuggguguggugggacgcgc

SEQ ID NO: 742469 - RNA, 19 nt, Human
uucccauuuaauucuuuug

SEQ ID NO: 742470 - RNA, 24 nt, Human
uugaacccgggaggcggagguugc

SEQ ID NO: 742471 - RNA, 24 nt, Human
uugaauauggaaaaucuuuuaaca

SEQ ID NO: 742472 - RNA, 18 nt, Human
uugaccauuuuauuuuca

SEQ ID NO: 742473 - RNA, 24 nt, Human
uugaccauuuuauuuucaaacaug

SEQ ID NO: 742474 - RNA, 20 nt, Human
uugcaguaagccgagaucac

SEQ ID NO: 742475 - RNA, 25 nt, Human
uugggaggccgaggcggguggauca

SEQ ID NO: 742476 - RNA, 24 nt, Human
uugggaggcugaggcaggagaauc

SEQ ID NO: 742477 - RNA, 23 nt, Human
aaggagaaaaaggauagcaggga

SEQ ID NO: 742478 - RNA, 21 nt, Human
acuggggauccccucagcccc

SEQ ID NO: 742479 - RNA, 21 nt, Human
aggagaaaaaggauagcaggg

SEQ ID NO: 742480 - RNA, 21 nt, Human
aucucacuagcagcucucucc

SEQ ID NO: 742481 - RNA, 25 nt, Human
cacuuuuuuccauuucuuuauaaaa

SEQ ID NO: 742482 - RNA, 22 nt, Human
cccugaacacccagcgcugcuc

SEQ ID NO: 742483 - RNA, 21 nt, Human
cuuggccccugaacacccagc

SEQ ID NO: 742484 - RNA, 18 nt, Human
cuuguuucaauaccuguu

SEQ ID NO: 742485 - RNA, 24 nt, Human
gcagcucucuccccuagaguaggg

SEQ ID NO: 742486 - RNA, 22 nt, Human
uagcagcucucuccccuagagu

SEQ ID NO: 742487 - RNA, 19 nt, Human
ugacuuauguuccaaacac

SEQ ID NO: 742488 - RNA, 20 nt, Human
ugggcaccuccaaaggagaa

SEQ ID NO: 742489 - RNA, 19 nt, Human
uugggcaccuccaaaggag

SEQ ID NO: 742490 - RNA, 20 nt, Human
uuuccauuucuuuauaaaac

SEQ ID NO: 742491 - RNA, 18 nt, Human
uuuucucucucuaguuga

SEQ ID NO: 742492 - RNA, 21 nt, Human
uuuuuuuuuuuuuuuucucuc

SEQ ID NO: 742493 - RNA, 22 nt, Human
aaacaaggcgggggcaaaucug

SEQ ID NO: 742494 - RNA, 19 nt, Human
aaacccuuugggacagucc

SEQ ID NO: 742495 - RNA, 24 nt, Human
aaagugcugggauuacaggcuuga

SEQ ID NO: 742496 - RNA, 24 nt, Human
aaccucaggugauccacccgccuc

SEQ ID NO: 742497 - RNA, 18 nt, Human
aaccuccaccuccaccuc

SEQ ID NO: 742498 - RNA, 20 nt, Human
aacuuauccccucaccucug

SEQ ID NO: 742499 - RNA, 21 nt, Human
aagaacaaggggcugaggaaa

SEQ ID NO: 742500 - RNA, 23 nt, Human
aaggggcucucguggccugaagc

SEQ ID NO: 742501 - RNA, 19 nt, Human
aagucggggcacagcaggc

SEQ ID NO: 742502 - RNA, 19 nt, Human
aagugcugggauuacaggc

SEQ ID NO: 742503 - RNA, 19 nt, Human
aagugcugggauuacaggc

SEQ ID NO: 742504 - RNA, 26 nt, Human
aagugcugggauuacaggcuugagcc

SEQ ID NO: 742505 - RNA, 21 nt, Human
acacugcucccugcuuuccac

SEQ ID NO: 742506 - RNA, 18 nt, Human
acaggguuucaccauguu

SEQ ID NO: 742507 - RNA, 21 nt, Human
acaggguuucaccauguuggc

SEQ ID NO: 742508 - RNA, 24 nt, Human
acaggguuucaccauguuggccag

SEQ ID NO: 742509 - RNA, 24 nt, Human
accauguuggccaggcugaucucg

SEQ ID NO: 742510 - RNA, 20 nt, Human
accccagaguacccugugua

SEQ ID NO: 742511 - RNA, 25 nt, Human
acccgccucggccucccaaagugcu

SEQ ID NO: 742512 - RNA, 22 nt, Human
accuccaccuccaccuccaggg

SEQ ID NO: 742513 - RNA, 23 nt, Human
accucccuccucucaaacuccag

SEQ ID NO: 742514 - RNA, 18 nt, Human
acugcaccccuuuucugc

SEQ ID NO: 742515 - RNA, 18 nt, Human
acugcaccccuuuucugc

SEQ ID NO: 742516 - RNA, 22 nt, Human
agaggaguggggaagggccagg

SEQ ID NO: 742517 - RNA, 23 nt, Human
agcaccaagaugacaaagaccca

SEQ ID NO: 742518 - RNA, 19 nt, Human
agccaccacaccuggccca

SEQ ID NO: 742519 - RNA, 21 nt, Human
agccaccacaccuggcccaga

SEQ ID NO: 742520 - RNA, 23 nt, Human
agccaggguggugaagcugaggc

SEQ ID NO: 742521 - RNA, 23 nt, Human
agcgcccccgccccaugcagccg

SEQ ID NO: 742522 - RNA, 24 nt, Human
aggaaaccaggcacacagcagcca

SEQ ID NO: 742523 - RNA, 21 nt, Human
aggagcggcugggaaggcugc

SEQ ID NO: 742524 - RNA, 18 nt, Human
aggagguaggccagcgcc

SEQ ID NO: 742525 - RNA, 23 nt, Human
aggcaggaugugaggaaaccagg

SEQ ID NO: 742526 - RNA, 28 nt, Human
aggccccccacgaggagcggcugggaag

SEQ ID NO: 742527 - RNA, 18 nt, Human
aggcgggggcaaaucugg

SEQ ID NO: 742528 - RNA, 24 nt, Human
aggguggaggacagggaagaacaa

SEQ ID NO: 742529 - RNA, 24 nt, Human
aggugauccacccgccucggccuc

SEQ ID NO: 742530 - RNA, 18 nt, Human
aguagcugggauuacagg

SEQ ID NO: 742531 - RNA, 20 nt, Human
agugcaauggcgcgaucucg

SEQ ID NO: 742532 - RNA, 24 nt, Human
agugcaauggcgcgaucucggcuc

SEQ ID NO: 742533 - RNA, 24 nt, Human
agugcugggauuacaggcuugagc

SEQ ID NO: 742534 - RNA, 18 nt, Human
augcagccgaggaugagg

SEQ ID NO: 742535 - RNA, 19 nt, Human
auuggggaaaaccacccug

SEQ ID NO: 742536 - RNA, 22 nt, Human
caaagacccaagaccugucccu

SEQ ID NO: 742537 - RNA, 24 nt, Human
caaagugcugggauuacaggcuug

SEQ ID NO: 742538 - RNA, 26 nt, Human
caacugccucacgacauggucccacu

SEQ ID NO: 742539 - RNA, 21 nt, Human
caagcgauucuccugccuaaa

SEQ ID NO: 742540 - RNA, 20 nt, Human
cacagcaccaagaugacaaa

SEQ ID NO: 742541 - RNA, 21 nt, Human
caccauguuggccaggcugau

SEQ ID NO: 742542 - RNA, 24 nt, Human
caccauguuggccaggcugaucuc

SEQ ID NO: 742543 - RNA, 27 nt, Human
caccauguuggccaggcugaucucgaa

SEQ ID NO: 742544 - RNA, 23 nt, Human
cacccgccucggccucccaaagu

SEQ ID NO: 742545 - RNA, 24 nt, Human
cagaacccauuucuuuauaagccu

SEQ ID NO: 742546 - RNA, 21 nt, Human
cagaaucuggguucacuuagu

SEQ ID NO: 742547 - RNA, 19 nt, Human
cagcaacaucccacagcug

SEQ ID NO: 742548 - RNA, 21 nt, Human
cagcaacaucccacagcuggc

SEQ ID NO: 742549 - RNA, 24 nt, Human
cagcacacccgugggugcccagca

SEQ ID NO: 742550 - RNA, 21 nt, Human
cagcagccggcugggguccag

SEQ ID NO: 742551 - RNA, 23 nt, Human
cagcagggcgggugaaggggcuc

SEQ ID NO: 742552 - RNA, 26 nt, Human
cagccagauacucuagcaaccaacac

SEQ ID NO: 742553 - RNA, 19 nt, Human
caggaaaagggcggccaca

SEQ ID NO: 742554 - RNA, 24 nt, Human
caggaugcagggagaagguggccc

SEQ ID NO: 742555 - RNA, 21 nt, Human
caggcacacagcagccagcca

SEQ ID NO: 742556 - RNA, 21 nt, Human
caggcgcccaccaccacgccc

SEQ ID NO: 742557 - RNA, 24 nt, Human
caggguuucaccauguuggccagg

SEQ ID NO: 742558 - RNA, 23 nt, Human
cagguccaaauaccaacucaagu

SEQ ID NO: 742559 - RNA, 19 nt, Human
caguccccggcccaguccu

SEQ ID NO: 742560 - RNA, 19 nt, Human
caucgcguucggcaauuuc

SEQ ID NO: 742561 - RNA, 21 nt, Human
cauggucccacucuaccuccu

SEQ ID NO: 742562 - RNA, 24 nt, Human
cauguuggccaggcugaucucgaa

SEQ ID NO: 742563 - RNA, 22 nt, Human
cauucuaacuuauccccucacc

SEQ ID NO: 742564 - RNA, 19 nt, Human
ccaaagugcugggauuaca

SEQ ID NO: 742565 - RNA, 22 nt, Human
ccaaagugcugggauuacaggc

SEQ ID NO: 742566 - RNA, 23 nt, Human
ccaaagugcugggauuacaggcu

SEQ ID NO: 742567 - RNA, 21 nt, Human
ccaagaugacaaagacccaag

SEQ ID NO: 742568 - RNA, 21 nt, Human
ccacaccuggcccagaaccca

SEQ ID NO: 742569 - RNA, 22 nt, Human
ccagccagauacucuagcaacc

SEQ ID NO: 742570 - RNA, 24 nt, Human
ccaggagaguaaggggucacaggg

SEQ ID NO: 742571 - RNA, 20 nt, Human
ccaggguucaagcgauucuc

SEQ ID NO: 742572 - RNA, 23 nt, Human
ccaggguucaagcgauucuccug

SEQ ID NO: 742573 - RNA, 24 nt, Human
cccaaagugcugggauuacaggcu

SEQ ID NO: 742574 - RNA, 19 nt, Human
cccacauggggcagagggc

SEQ ID NO: 742575 - RNA, 21 nt, Human
cccaccaccacgcccagcuaa

SEQ ID NO: 742576 - RNA, 24 nt, Human
cccacccacauggggcagagggca

SEQ ID NO: 742577 - RNA, 20 nt, Human
cccagcaccucccuccucuc

SEQ ID NO: 742578 - RNA, 22 nt, Human
cccagcaccucccuccucucaa

SEQ ID NO: 742579 - RNA, 23 nt, Human
cccagcaccucccuccucucaaa

SEQ ID NO: 742580 - RNA, 23 nt, Human
cccaugcagccgaggaugaggca

SEQ ID NO: 742581 - RNA, 23 nt, Human
ccccacgaggagcggcugggaag

SEQ ID NO: 742582 - RNA, 22 nt, Human
ccccccacccacauggggcaga

SEQ ID NO: 742583 - RNA, 20 nt, Human
ccccucaccucugccacuua

SEQ ID NO: 742584 - RNA, 23 nt, Human
cccgaguagcugggauuacaggc

SEQ ID NO: 742585 - RNA, 24 nt, Human
cccgaguagcugggauuacaggcg

SEQ ID NO: 742586 - RNA, 21 nt, Human
cccgccccaugcagccgagga

SEQ ID NO: 742587 - RNA, 21 nt, Human
cccgcccccgccgccgcggga

SEQ ID NO: 742588 - RNA, 21 nt, Human
cccuccuaccucucacagcac

SEQ ID NO: 742589 - RNA, 22 nt, Human
ccgaguagcugggauuacaggc

SEQ ID NO: 742590 - RNA, 22 nt, Human
ccuaaccucaggugauccaccc

SEQ ID NO: 742591 - RNA, 23 nt, Human
ccuaaccucaggugauccacccg

SEQ ID NO: 742592 - RNA, 24 nt, Human
ccuccaggguucaagcgauucucc

SEQ ID NO: 742593 - RNA, 21 nt, Human
ccucugccacuuaccuguccc

SEQ ID NO: 742594 - RNA, 19 nt, Human
ccucugggcuccagcagcc

SEQ ID NO: 742595 - RNA, 23 nt, Human
ccugccuaaaccucccgaguagc

SEQ ID NO: 742596 - RNA, 24 nt, Human
ccugccuaaaccucccgaguagcu

SEQ ID NO: 742597 - RNA, 19 nt, Human
ccugcucuggcagccacgg

SEQ ID NO: 742598 - RNA, 18 nt, Human
ccugucccugccacugga

SEQ ID NO: 742599 - RNA, 25 nt, Human
ccuguguaugcuccaccacagggag

SEQ ID NO: 742600 - RNA, 20 nt, Human
cgagcuaaggccaccccgcu

SEQ ID NO: 742601 - RNA, 20 nt, Human
cgccccaugcagccgaggau

SEQ ID NO: 742602 - RNA, 24 nt, Human
cgccucggccucccaaagugcugg

SEQ ID NO: 742603 - RNA, 19 nt, Human
cgcuggagcauucauucac

SEQ ID NO: 742604 - RNA, 21 nt, Human
cucacagcgcccucgggcauc

SEQ ID NO: 742605 - RNA, 24 nt, Human
cucacugcaaccuccaccuccacc

SEQ ID NO: 742606 - RNA, 26 nt, Human
cucacugcaaccuccaccuccaccuc

SEQ ID NO: 742607 - RNA, 18 nt, Human
cuccagagggcuucccag

SEQ ID NO: 742608 - RNA, 19 nt, Human
cuccaguauccagcacacc

SEQ ID NO: 742609 - RNA, 21 nt, Human
cuccugccuaaaccucccgag

SEQ ID NO: 742610 - RNA, 19 nt, Human
cucgugaaggaccuggccc

SEQ ID NO: 742611 - RNA, 22 nt, Human
cucucaaacuccaguauccagc

SEQ ID NO: 742612 - RNA, 23 nt, Human
cucucaccucgaccccagaguac

SEQ ID NO: 742613 - RNA, 18 nt, Human
cugaagcugugguaaagc

SEQ ID NO: 742614 - RNA, 22 nt, Human
cugcaaccuccaccuccaccuc

SEQ ID NO: 742615 - RNA, 22 nt, Human
cuggagggccagauggcucugc

SEQ ID NO: 742616 - RNA, 27 nt, Human
cuggcccagagggcgaaccugaguccc

SEQ ID NO: 742617 - RNA, 24 nt, Human
cugggcuccagcagccggcugggg

SEQ ID NO: 742618 - RNA, 20 nt, Human
cugucuucccacuccagagg

SEQ ID NO: 742619 - RNA, 19 nt, Human
gaagaacaaggggcugaga

SEQ ID NO: 742620 - RNA, 19 nt, Human
gaaggguagcucccuccuc

SEQ ID NO: 742621 - RNA, 19 nt, Human
gaccuggcccagagggcga

SEQ ID NO: 742622 - RNA, 24 nt, Human
gagccaccacaccuggcccagaac

SEQ ID NO: 742623 - RNA, 21 nt, Human
gagcggcugggaaggcugcuu

SEQ ID NO: 742624 - RNA, 23 nt, Human
gagcuucauguuugcccagguga

SEQ ID NO: 742625 - RNA, 19 nt, Human
gaggggcagaggggcugca

SEQ ID NO: 742626 - RNA, 25 nt, Human
gaguagcugggauuacaggcgccca

SEQ ID NO: 742627 - RNA, 23 nt, Human
gaguggggcggcgguugccgguu

SEQ ID NO: 742628 - RNA, 18 nt, Human
gauuacaggcuugagcca

SEQ ID NO: 742629 - RNA, 21 nt, Human
gauuacaggcuugagccacca

SEQ ID NO: 742630 - RNA, 21 nt, Human
gcagaggggcugcaguuugga

SEQ ID NO: 742631 - RNA, 21 nt, Human
gcaguagggcccagaaaaacc

SEQ ID NO: 742632 - RNA, 21 nt, Human
gcgggggcaaaucuggagugg

SEQ ID NO: 742633 - RNA, 21 nt, Human
gcucugccuuucugagcucca

SEQ ID NO: 742634 - RNA, 23 nt, Human
gcugaucucgaacuccuaaccuc

SEQ ID NO: 742635 - RNA, 20 nt, Human
gcugggguccaggguggagg

SEQ ID NO: 742636 - RNA, 23 nt, Human
ggaaaggaggccagagcuucaug

SEQ ID NO: 742637 - RNA, 20 nt, Human
ggaguggggaagggccaggu

SEQ ID NO: 742638 - RNA, 19 nt, Human
ggauuacaggcuugagcca

SEQ ID NO: 742639 - RNA, 20 nt, Human
ggcagagggcaggaaaaggg

SEQ ID NO: 742640 - RNA, 22 nt, Human
ggccucugggcuccagcagccg

SEQ ID NO: 742641 - RNA, 24 nt, Human
ggcgguugccgguggccucagaca

SEQ ID NO: 742642 - RNA, 25 nt, Human
gggagugcagcuggugucgggcccc

SEQ ID NO: 742643 - RNA, 18 nt, Human
gggcagaggggcugcagu

SEQ ID NO: 742644 - RNA, 20 nt, Human
ggggcggcgguugccggugg

SEQ ID NO: 742645 - RNA, 22 nt, Human
ggguuucaccauguuggccagg

SEQ ID NO: 742646 - RNA, 21 nt, Human
gguagcucccuccucgugaag

SEQ ID NO: 742647 - RNA, 18 nt, Human
ggugaagcugaggcagga

SEQ ID NO: 742648 - RNA, 18 nt, Human
guagcugggauuacaggc

SEQ ID NO: 742649 - RNA, 21 nt, Human
gugagggcuuacuguccugca

SEQ ID NO: 742650 - RNA, 24 nt, Human
gugauccacccgccucggccuccc

SEQ ID NO: 742651 - RNA, 21 nt, Human
guggggcggcgguugccggug

SEQ ID NO: 742652 - RNA, 20 nt, Human
guguguguguguacaugugu

SEQ ID NO: 742653 - RNA, 21 nt, Human
uaaaaacagcgcccccgcccc

SEQ ID NO: 742654 - RNA, 22 nt, Human
uaaaaacagcgcccccgcccca

SEQ ID NO: 742655 - RNA, 24 nt, Human
uaacccuuuuucuuuuuuuuuuuu

SEQ ID NO: 742656 - RNA, 24 nt, Human
uaaccucaggugauccacccgccu

SEQ ID NO: 742657 - RNA, 24 nt, Human
uaacuuauccccucaccucugcca

SEQ ID NO: 742658 - RNA, 21 nt, Human
uaauaaauacaggccccccuc

SEQ ID NO: 742659 - RNA, 21 nt, Human
uaauuuuuuuauuuuuaguag

SEQ ID NO: 742660 - RNA, 22 nt, Human
uaauuuuuuuauuuuuaguaga

SEQ ID NO: 742661 - RNA, 22 nt, Human
uacaggcuugagccaccacacc

SEQ ID NO: 742662 - RNA, 24 nt, Human
uagguguguguguguacaugugug

SEQ ID NO: 742663 - RNA, 22 nt, Human
uaguagacaggguuucaccaug

SEQ ID NO: 742664 - RNA, 22 nt, Human
uaugcccucucacugaccagcc

SEQ ID NO: 742665 - RNA, 19 nt, Human
ucaaaacaaggcgggggca

SEQ ID NO: 742666 - RNA, 23 nt, Human
ucaaaacaaggcgggggcaaauc

SEQ ID NO: 742667 - RNA, 22 nt, Human
ucaacagcggcacugucuuccc

SEQ ID NO: 742668 - RNA, 18 nt, Human
ucaacagcgugcugugca

SEQ ID NO: 742669 - RNA, 23 nt, Human
ucacagcgcccucgggcaucgcg

SEQ ID NO: 742670 - RNA, 18 nt, Human
ucaccuagguuggagugc

SEQ ID NO: 742671 - RNA, 18 nt, Human
ucacugcaaccuccaccu

SEQ ID NO: 742672 - RNA, 19 nt, Human
ucacugcaaccuccaccuc

SEQ ID NO: 742673 - RNA, 30 nt, Human
ucacugcaaccuccaccuccaccuccaggg

SEQ ID NO: 742674 - RNA, 18 nt, Human
uccagagggcuucccagu

SEQ ID NO: 742675 - RNA, 24 nt, Human
uccaggguucaagcgauucuccug

SEQ ID NO: 742676 - RNA, 24 nt, Human
ucccaaagugcugggauuacaggc

SEQ ID NO: 742677 - RNA, 18 nt, Human
ucccacagcuggcucaag

SEQ ID NO: 742678 - RNA, 18 nt, Human
ucccacagcuggcucaag

SEQ ID NO: 742679 - RNA, 26 nt, Human
ucccacucuaccuccuaggguccccu

SEQ ID NO: 742680 - RNA, 18 nt, Human
ucccaguaugcccucuca

SEQ ID NO: 742681 - RNA, 23 nt, Human
uccccggcccaguccugggucuu

SEQ ID NO: 742682 - RNA, 21 nt, Human
uccccuaucuccuuucccuca

SEQ ID NO: 742683 - RNA, 24 nt, Human
ucccgaguagcugggauuacaggc

SEQ ID NO: 742684 - RNA, 19 nt, Human
uccugggucuugucucaac

SEQ ID NO: 742685 - RNA, 20 nt, Human
ucgaccccagaguacccugu

SEQ ID NO: 742686 - RNA, 21 nt, Human
ucuaccuaaaccagguguccu

SEQ ID NO: 742687 - RNA, 21 nt, Human
ucuaccuccuaggguccccua

SEQ ID NO: 742688 - RNA, 21 nt, Human
ucugccuuucugagcuccagg

SEQ ID NO: 742689 - RNA, 20 nt, Human
ugaacacugcucccugcuuu

SEQ ID NO: 742690 - RNA, 20 nt, Human
ugagggcuuacuguccugca

SEQ ID NO: 742691 - RNA, 18 nt, Human
ugaggggcagaggggcug

SEQ ID NO: 742692 - RNA, 18 nt, Human
ugcagggagaagguggcc

SEQ ID NO: 742693 - RNA, 24 nt, Human
ugccuaaaccucccgaguagcugg

SEQ ID NO: 742694 - RNA, 24 nt, Human
ugccuuugaggaggcuccuucuac

SEQ ID NO: 742695 - RNA, 22 nt, Human
ugcucuggcagccacgggagug

SEQ ID NO: 742696 - RNA, 21 nt, Human
uggaaucgcuggagcauucau

SEQ ID NO: 742697 - RNA, 19 nt, Human
uggaggggcuguggaggca

SEQ ID NO: 742698 - RNA, 23 nt, Human
uggagugcaauggcgcgaucucg

SEQ ID NO: 742699 - RNA, 24 nt, Human
uggagugcaauggcgcgaucucgg

SEQ ID NO: 742700 - RNA, 24 nt, Human
uggccaggcugaucucgaacuccu

SEQ ID NO: 742701 - RNA, 24 nt, Human
uggcccagaacccauuucuuuaua

SEQ ID NO: 742702 - RNA, 22 nt, Human
uggccucugggcuccagcagcc

SEQ ID NO: 742703 - RNA, 22 nt, Human
ugggaagucggggcacagcagg

SEQ ID NO: 742704 - RNA, 20 nt, Human
ugggaguggaaugugcgggc

SEQ ID NO: 742705 - RNA, 21 nt, Human
ugggauuacaggcgcccacca

SEQ ID NO: 742706 - RNA, 24 nt, Human
ugggauuacaggcgcccaccacca

SEQ ID NO: 742707 - RNA, 18 nt, Human
ugggauuacaggcuugag

SEQ ID NO: 742708 - RNA, 19 nt, Human
ugggauuacaggcuugagc

SEQ ID NO: 742709 - RNA, 21 nt, Human
ugggauuacaggcuugagcca

SEQ ID NO: 742710 - RNA, 22 nt, Human
ugggauuacaggcuugagccac

SEQ ID NO: 742711 - RNA, 24 nt, Human
ugggauuacaggcuugagccacca

SEQ ID NO: 742712 - RNA, 19 nt, Human
uggugaagcugaggcagga

SEQ ID NO: 742713 - RNA, 24 nt, Human
uguagcuuugucaccuagguugga

SEQ ID NO: 742714 - RNA, 20 nt, Human
ugucaccuagguuggagugc

SEQ ID NO: 742715 - RNA, 23 nt, Human
ugugagaggggaagugcagguag

SEQ ID NO: 742716 - RNA, 25 nt, Human
ugugcacgugcaugcgugugaucuc

SEQ ID NO: 742717 - RNA, 24 nt, Human
ugugggaagucggggcacagcagg

SEQ ID NO: 742718 - RNA, 24 nt, Human
uguguacaugugugcacgugcaug

SEQ ID NO: 742719 - RNA, 18 nt, Human
uguguguacaugugugca

SEQ ID NO: 742720 - RNA, 18 nt, Human
uguguguguacaugugug

SEQ ID NO: 742721 - RNA, 22 nt, Human
uguguguguguacaugugugca

SEQ ID NO: 742722 - RNA, 22 nt, Human
uuaguagacaggguuucaccau

SEQ ID NO: 742723 - RNA, 23 nt, Human
uuaguagacaggguuucaccaug

SEQ ID NO: 742724 - RNA, 24 nt, Human
uucaagcgauucuccugccuaaac

SEQ ID NO: 742725 - RNA, 23 nt, Human
uuuaguagacaggguuucaccau

SEQ ID NO: 742726 - RNA, 24 nt, Human
uuuaguagacaggguuucaccaug

SEQ ID NO: 742727 - RNA, 22 nt, Human
uuuauaagccucugccuauggc

SEQ ID NO: 742728 - RNA, 19 nt, Human
uuucaaaacaaggcggggg

SEQ ID NO: 742729 - RNA, 21 nt, Human
uuucaccauguuggccaggcu

SEQ ID NO: 742730 - RNA, 23 nt, Human
uuucuuuuuuuuuuuugagaugg

SEQ ID NO: 742731 - RNA, 24 nt, Human
uuugucaccuagguuggagugcaa

SEQ ID NO: 742732 - RNA, 21 nt, Human
uuuuauuuuuaguagacaggg

SEQ ID NO: 742733 - RNA, 22 nt, Human
uuuuuaguagacaggguuucac

SEQ ID NO: 742734 - RNA, 20 nt, Human
uuuuucuuuuuuuuuuuugg

SEQ ID NO: 742735 - RNA, 24 nt, Human
uuuuuuuauuuuuaguagacaggg

SEQ ID NO: 742736 - RNA, 27 nt, Human
aaaaaauuagcugggugugguggcuca

SEQ ID NO: 742737 - RNA, 23 nt, Human
aaaagagcaaaaggcuggcaugc

SEQ ID NO: 742738 - RNA, 19 nt, Human
aaagaaaaagcccgcccuc

SEQ ID NO: 742739 - RNA, 23 nt, Human
aaagaaaaagcccgcccucacau

SEQ ID NO: 742740 - RNA, 18 nt, Human
aaagccucuccaggccac

SEQ ID NO: 742741 - RNA, 19 nt, Human
aacacggcgaaaccccguc

SEQ ID NO: 742742 - RNA, 20 nt, Human
aacacggcgaaaccccgucu

SEQ ID NO: 742743 - RNA, 21 nt, Human
aacacggcgaaaccccgucuc

SEQ ID NO: 742744 - RNA, 22 nt, Human
aacaugacuccucccuccccca

SEQ ID NO: 742745 - RNA, 19 nt, Human
aaccacagggucagcacaa

SEQ ID NO: 742746 - RNA, 18 nt, Human
aaccuccaacaugacucc

SEQ ID NO: 742747 - RNA, 20 nt, Human
aaccuccaugucuccaucuc

SEQ ID NO: 742748 - RNA, 22 nt, Human
aaccuccaugucuccaucuccc

SEQ ID NO: 742749 - RNA, 19 nt, Human
aaccuggccuccaccaaca

SEQ ID NO: 742750 - RNA, 23 nt, Human
aagaucacgccauugcacuccag

SEQ ID NO: 742751 - RNA, 26 nt, Human
aagcacccgguuccugggcuucauca

SEQ ID NO: 742752 - RNA, 24 nt, Human
aauugcuugaaccugggaggcgga

SEQ ID NO: 742753 - RNA, 25 nt, Human
acaaacuccaagaaaaggggaacgc

SEQ ID NO: 742754 - RNA, 19 nt, Human
acaaagccucuccaggcca

SEQ ID NO: 742755 - RNA, 23 nt, Human
acagaauaagacucugucucaaa

SEQ ID NO: 742756 - RNA, 24 nt, Human
acagaauaagacucugucucaaaa

SEQ ID NO: 742757 - RNA, 22 nt, Human
acagagcaagacuccguuucaa

SEQ ID NO: 742758 - RNA, 18 nt, Human
acagaucucagcacucac

SEQ ID NO: 742759 - RNA, 22 nt, Human
accacugcgcuccagccugggc

SEQ ID NO: 742760 - RNA, 24 nt, Human
accccgucucuacuaaaaauacaa

SEQ ID NO: 742761 - RNA, 24 nt, Human
accucaccaccucccuuuuucuug

SEQ ID NO: 742762 - RNA, 22 nt, Human
accucccuuuuucuugguccaa

SEQ ID NO: 742763 - RNA, 18 nt, Human
accugcuccgccaccgcc

SEQ ID NO: 742764 - RNA, 28 nt, Human
acucugucucaaaaaaaaaaaaaaaaaa

SEQ ID NO: 742765 - RNA, 24 nt, Human
acugcgcuccagccugggcgacag

SEQ ID NO: 742766 - RNA, 26 nt, Human
acugcgcuccagccugggcgacagag

SEQ ID NO: 742767 - RNA, 21 nt, Human
agaaguucgagaccagccugg

SEQ ID NO: 742768 - RNA, 26 nt, Human
agacccaucuucagguugggucagaa

SEQ ID NO: 742769 - RNA, 18 nt, Human
agagaacaacuauuuaca

SEQ ID NO: 742770 - RNA, 19 nt, Human
agagaacaacuauuuacaa

SEQ ID NO: 742771 - RNA, 24 nt, Human
agcacuuugggaggccgagguggg

SEQ ID NO: 742772 - RNA, 23 nt, Human
agccaacgcuggaggccugagca

SEQ ID NO: 742773 - RNA, 24 nt, Human
agccugggcgacagagcaagacuc

SEQ ID NO: 742774 - RNA, 24 nt, Human
agccugggugacagaauaagacuc

SEQ ID NO: 742775 - RNA, 24 nt, Human
agccuggucaacacggcgaaaccc

SEQ ID NO: 742776 - RNA, 19 nt, Human
agcugggugugguggcuca

SEQ ID NO: 742777 - RNA, 22 nt, Human
aggcaggagaccccugcacacg

SEQ ID NO: 742778 - RNA, 21 nt, Human
aggccgagguggguggaucac

SEQ ID NO: 742779 - RNA, 19 nt, Human
aggcggagguugcaguaag
